United States Patent 7,888,497 (BIOINFORMATICALLY DETECTABLE GROUP OF NOVEL REGULATORY OLIGONUCLEOTIDES AND USES THEREOF) - sequence listing, part 154

SEQ ID NO: 6531267 - DNA, 18 bp, Homo sapiens
tgggtgggcagggagggg

SEQ ID NO: 6531268 - DNA, 20 bp, Homo sapiens
tgggtgggccccacagtggt

SEQ ID NO: 6531269 - DNA, 16 bp, Homo sapiens
tgggtgggcctgactg

SEQ ID NO: 6531270 - DNA, 19 bp, Homo sapiens
tgggtgggcctggccctgc

SEQ ID NO: 6531271 - DNA, 16 bp, Homo sapiens
tgggtgggctctgtgc

SEQ ID NO: 6531272 - DNA, 20 bp, Homo sapiens
tgggtggggaggaaatagaa

SEQ ID NO: 6531273 - DNA, 22 bp, Homo sapiens
tgggtggggaggccctgcctga

SEQ ID NO: 6531274 - DNA, 14 bp, Homo sapiens
tgggtggggaggga

SEQ ID NO: 6531275 - DNA, 21 bp, Homo sapiens
tgggtggggcagggcctggcc

SEQ ID NO: 6531276 - DNA, 17 bp, Homo sapiens
tgggtggggctcctggg

SEQ ID NO: 6531277 - DNA, 12 bp, Homo sapiens
tgggtggggctg

SEQ ID NO: 6531278 - DNA, 13 bp, Homo sapiens
tgggtggggcttc

SEQ ID NO: 6531279 - DNA, 14 bp, Homo sapiens
tgggtggggcttct

SEQ ID NO: 6531280 - DNA, 12 bp, Homo sapiens
tgggtgggggct

SEQ ID NO: 6531281 - DNA, 13 bp, Homo sapiens
tgggtgggggctg

SEQ ID NO: 6531282 - DNA, 15 bp, Homo sapiens
tgggtggggtgagga

SEQ ID NO: 6531283 - DNA, 20 bp, Homo sapiens
tgggtggggtgaggaccact

SEQ ID NO: 6531284 - DNA, 15 bp, Homo sapiens
tgggtgggtggtggg

SEQ ID NO: 6531285 - DNA, 16 bp, Homo sapiens
tgggtggtaagaggga

SEQ ID NO: 6531286 - DNA, 15 bp, Homo sapiens
tgggtggtacccagg

SEQ ID NO: 6531287 - DNA, 22 bp, Homo sapiens
tgggtggtaccctctggagggg

SEQ ID NO: 6531288 - DNA, 17 bp, Homo sapiens
tgggtggtttggttttt

SEQ ID NO: 6531289 - DNA, 14 bp, Homo sapiens
tgggtggtttgtga

SEQ ID NO: 6531290 - DNA, 21 bp, Homo sapiens
tgggtggtttgtgagccttgc

SEQ ID NO: 6531291 - DNA, 24 bp, Homo sapiens
tgggtggtttgtgagccttgctgc

SEQ ID NO: 6531292 - DNA, 15 bp, Homo sapiens
tgggtggtttttatt

SEQ ID NO: 6531293 - DNA, 15 bp, Homo sapiens
tgggtgtaaacacat

SEQ ID NO: 6531294 - DNA, 23 bp, Homo sapiens
tgggtgtaacaggtctcctctta

SEQ ID NO: 6531295 - DNA, 19 bp, Homo sapiens
tgggtgtaccacccatccc

SEQ ID NO: 6531296 - DNA, 17 bp, Homo sapiens
tgggtgtagatttctga

SEQ ID NO: 6531297 - DNA, 17 bp, Homo sapiens
tgggtgtatataatttt

SEQ ID NO: 6531298 - DNA, 20 bp, Homo sapiens
tgggtgtattaggactggct

SEQ ID NO: 6531299 - DNA, 16 bp, Homo sapiens
tgggtgtattctctgt

SEQ ID NO: 6531300 - DNA, 17 bp, Homo sapiens
tgggtgtattctctgta

SEQ ID NO: 6531301 - DNA, 21 bp, Homo sapiens
tgggtgtcaagagggtctgag

SEQ ID NO: 6531302 - DNA, 21 bp, Homo sapiens
tgggtgtcaagtgcctgcacc

SEQ ID NO: 6531303 - DNA, 14 bp, Homo sapiens
tgggtgtccatgtg

SEQ ID NO: 6531304 - DNA, 15 bp, Homo sapiens
tgggtgtccatgtgc

SEQ ID NO: 6531305 - DNA, 20 bp, Homo sapiens
tgggtgtccatgtgcacccg

SEQ ID NO: 6531306 - DNA, 17 bp, Homo sapiens
tgggtgtcctgcctgtc

SEQ ID NO: 6531307 - DNA, 15 bp, Homo sapiens
tgggtgtctccctcg

SEQ ID NO: 6531308 - DNA, 18 bp, Homo sapiens
tgggtgtgaagggatgag

SEQ ID NO: 6531309 - DNA, 22 bp, Homo sapiens
tgggtgtgagaatgatcaagga

SEQ ID NO: 6531310 - DNA, 13 bp, Homo sapiens
tgggtgtgccctg

SEQ ID NO: 6531311 - DNA, 16 bp, Homo sapiens
tgggtgtgccctggct

SEQ ID NO: 6531312 - DNA, 11 bp, Homo sapiens
tgggtgtggat

SEQ ID NO: 6531313 - DNA, 15 bp, Homo sapiens
tgggtgtggatggca

SEQ ID NO: 6531314 - DNA, 13 bp, Homo sapiens
tgggtgtggccag

SEQ ID NO: 6531315 - DNA, 23 bp, Homo sapiens
tgggtgtggccagcacaccaagt

SEQ ID NO: 6531316 - DNA, 15 bp, Homo sapiens
tgggtgtgggtggaa

SEQ ID NO: 6531317 - DNA, 14 bp, Homo sapiens
tgggtgtgtccagg

SEQ ID NO: 6531318 - DNA, 14 bp, Homo sapiens
tgggtgtgtgactc

SEQ ID NO: 6531319 - DNA, 16 bp, Homo sapiens
tgggtgtgtggcctcc

SEQ ID NO: 6531320 - DNA, 20 bp, Homo sapiens
tgggtgtgtttcaggacagc

SEQ ID NO: 6531321 - DNA, 22 bp, Homo sapiens
tgggtgttgaccactccagaga

SEQ ID NO: 6531322 - DNA, 14 bp, Homo sapiens
tgggtgttgctgtt

SEQ ID NO: 6531323 - DNA, 18 bp, Homo sapiens
tgggtgtttgggaaaggc

SEQ ID NO: 6531324 - DNA, 23 bp, Homo sapiens
tgggttaaacaaaatgaaaatat

SEQ ID NO: 6531325 - DNA, 24 bp, Homo sapiens
tgggttaaatattttgctaactgg

SEQ ID NO: 6531326 - DNA, 23 bp, Homo sapiens
tgggttaacagtaaatatacact

SEQ ID NO: 6531327 - DNA, 14 bp, Homo sapiens
tgggttaagtatta

SEQ ID NO: 6531328 - DNA, 17 bp, Homo sapiens
tgggttaattcatttgg

SEQ ID NO: 6531329 - DNA, 20 bp, Homo sapiens
tgggttagactgccagctct

SEQ ID NO: 6531330 - DNA, 23 bp, Homo sapiens
tgggttaggtggccgctcctccc

SEQ ID NO: 6531331 - DNA, 24 bp, Homo sapiens
tgggttaggtggccgctcctccct

SEQ ID NO: 6531332 - DNA, 20 bp, Homo sapiens
tgggttatcatggaagaaaa

SEQ ID NO: 6531333 - DNA, 20 bp, Homo sapiens
tgggttatttttattaaatg

SEQ ID NO: 6531334 - DNA, 16 bp, Homo sapiens
tgggttcaagagactc

SEQ ID NO: 6531335 - DNA, 22 bp, Homo sapiens
tgggttcacgtaatcctcctga

SEQ ID NO: 6531336 - DNA, 21 bp, Homo sapiens
tgggttcagaaccaagatgcc

SEQ ID NO: 6531337 - DNA, 24 bp, Homo sapiens
tgggttcaggggactcagccctga

SEQ ID NO: 6531338 - DNA, 19 bp, Homo sapiens
tgggttcatgatgcagtct

SEQ ID NO: 6531339 - DNA, 11 bp, Homo sapiens
tgggttcatta

SEQ ID NO: 6531340 - DNA, 18 bp, Homo sapiens
tgggttcattattggaat

SEQ ID NO: 6531341 - DNA, 16 bp, Homo sapiens
tgggttccaaaatatt

SEQ ID NO: 6531342 - DNA, 13 bp, Homo sapiens
tgggttccacaga

SEQ ID NO: 6531343 - DNA, 19 bp, Homo sapiens
tgggttccagacagagtgg

SEQ ID NO: 6531344 - DNA, 16 bp, Homo sapiens
tgggttccatcttgct

SEQ ID NO: 6531345 - DNA, 21 bp, Homo sapiens
tgggttcccacgtagcaaatc

SEQ ID NO: 6531346 - DNA, 14 bp, Homo sapiens
tgggttcccactcc

SEQ ID NO: 6531347 - DNA, 20 bp, Homo sapiens
tgggttccgggaggcagaga

SEQ ID NO: 6531348 - DNA, 13 bp, Homo sapiens
tgggttcctcttc

SEQ ID NO: 6531349 - DNA, 23 bp, Homo sapiens
tgggttcctttttcaacttggaa

SEQ ID NO: 6531350 - DNA, 17 bp, Homo sapiens
tgggttcgttggggaca

SEQ ID NO: 6531351 - DNA, 15 bp, Homo sapiens
tgggttctacccagg

SEQ ID NO: 6531352 - DNA, 17 bp, Homo sapiens
tgggttctgatattgcc

SEQ ID NO: 6531353 - DNA, 16 bp, Homo sapiens
tgggttctgcctgcca

SEQ ID NO: 6531354 - DNA, 14 bp, Homo sapiens
tgggttctgggtgg

SEQ ID NO: 6531355 - DNA, 19 bp, Homo sapiens
tgggttgaatatagcctgc

SEQ ID NO: 6531356 - DNA, 21 bp, Homo sapiens
tgggttgaatatagcctgcct

SEQ ID NO: 6531357 - DNA, 23 bp, Homo sapiens
tgggttgaatatagcctgcctca

SEQ ID NO: 6531358 - DNA, 20 bp, Homo sapiens
ttcattacaatggaaacaat

SEQ ID NO: 6531359 - DNA, 13 bp, Homo sapiens
ttcattacagctt

SEQ ID NO: 6531360 - DNA, 21 bp, Homo sapiens
ttcattaccttttttgataaa

SEQ ID NO: 6531361 - DNA, 16 bp, Homo sapiens
ttcattactgcccaga

SEQ ID NO: 6531362 - DNA, 15 bp, Homo sapiens
ttcattacttgaatg

SEQ ID NO: 6531363 - DNA, 16 bp, Homo sapiens
ttcattacttgaatgt

SEQ ID NO: 6531364 - DNA, 21 bp, Homo sapiens
ttcattacttgattaagattt

SEQ ID NO: 6531365 - DNA, 13 bp, Homo sapiens
ttcattagataca

SEQ ID NO: 6531366 - DNA, 18 bp, Homo sapiens
ttcattagcagttgctca

SEQ ID NO: 6531367 - DNA, 14 bp, Homo sapiens
ttcattaggcaaag

SEQ ID NO: 6531368 - DNA, 16 bp, Homo sapiens
ttcattagtcatgttt

SEQ ID NO: 6531369 - DNA, 23 bp, Homo sapiens
ttcattataatttgggtgactag

SEQ ID NO: 6531370 - DNA, 22 bp, Homo sapiens
ttcattatagacaacgatgaat

SEQ ID NO: 6531371 - DNA, 19 bp, Homo sapiens
ttcattatgcaacgtttaa

SEQ ID NO: 6531372 - DNA, 23 bp, Homo sapiens
ttcattatgcaacgtttaacatt

SEQ ID NO: 6531373 - DNA, 13 bp, Homo sapiens
ttcattatgcttt

SEQ ID NO: 6531374 - DNA, 16 bp, Homo sapiens
ttcattatgctttgaa

SEQ ID NO: 6531375 - DNA, 14 bp, Homo sapiens
ttcattatgtaaaa

SEQ ID NO: 6531376 - DNA, 13 bp, Homo sapiens
ttcattatgttca

SEQ ID NO: 6531377 - DNA, 15 bp, Homo sapiens
ttcattattcctcag

SEQ ID NO: 6531378 - DNA, 13 bp, Homo sapiens
ttcattattctca

SEQ ID NO: 6531379 - DNA, 20 bp, Homo sapiens
ttcattattctccacttttt

SEQ ID NO: 6531380 - DNA, 15 bp, Homo sapiens
ttcattattctctgc

SEQ ID NO: 6531381 - DNA, 13 bp, Homo sapiens
ttcattattggaa

SEQ ID NO: 6531382 - DNA, 16 bp, Homo sapiens
ttcattatttcaagga

SEQ ID NO: 6531383 - DNA, 20 bp, Homo sapiens
ttcattatttggaaatttag

SEQ ID NO: 6531384 - DNA, 15 bp, Homo sapiens
ttcattatttgtcaa

SEQ ID NO: 6531385 - DNA, 21 bp, Homo sapiens
ttcattatttgtcaaattgtc

SEQ ID NO: 6531386 - DNA, 17 bp, Homo sapiens
ttcattcaaatcagtga

SEQ ID NO: 6531387 - DNA, 16 bp, Homo sapiens
ttcattcaatagatac

SEQ ID NO: 6531388 - DNA, 17 bp, Homo sapiens
ttcattcaatattgaca

SEQ ID NO: 6531389 - DNA, 18 bp, Homo sapiens
ttcattcaatattgacat

SEQ ID NO: 6531390 - DNA, 21 bp, Homo sapiens
ttcattcaatattgacatttg

SEQ ID NO: 6531391 - DNA, 15 bp, Homo sapiens
ttcattcacttctct

SEQ ID NO: 6531392 - DNA, 16 bp, Homo sapiens
ttcattcatacttaaa

SEQ ID NO: 6531393 - DNA, 16 bp, Homo sapiens
ttcattcatatcctcc

SEQ ID NO: 6531394 - DNA, 18 bp, Homo sapiens
ttcattcatattacaata

SEQ ID NO: 6531395 - DNA, 23 bp, Homo sapiens
ttcattcatattacaatatttgt

SEQ ID NO: 6531396 - DNA, 18 bp, Homo sapiens
ttcattcatggaccactg

SEQ ID NO: 6531397 - DNA, 23 bp, Homo sapiens
ttcattcatggaccactgtttct

SEQ ID NO: 6531398 - DNA, 13 bp, Homo sapiens
ttcattcattcag

SEQ ID NO: 6531399 - DNA, 15 bp, Homo sapiens
ttcattcattggtga

SEQ ID NO: 6531400 - DNA, 13 bp, Homo sapiens
ttcattccatttg

SEQ ID NO: 6531401 - DNA, 15 bp, Homo sapiens
ttcattcccactgca

SEQ ID NO: 6531402 - DNA, 12 bp, Homo sapiens
ttcattcccaga

SEQ ID NO: 6531403 - DNA, 12 bp, Homo sapiens
ttcattccccag

SEQ ID NO: 6531404 - DNA, 15 bp, Homo sapiens
ttcattcccccttcc

SEQ ID NO: 6531405 - DNA, 15 bp, Homo sapiens
ttcattccctgtagt

SEQ ID NO: 6531406 - DNA, 20 bp, Homo sapiens
ttcattccgaaaaaaaaatg

SEQ ID NO: 6531407 - DNA, 16 bp, Homo sapiens
ttcattcctaaagaaa

SEQ ID NO: 6531408 - DNA, 18 bp, Homo sapiens
ttcattcctaacacagca

SEQ ID NO: 6531409 - DNA, 21 bp, Homo sapiens
ttcattccttcagatttggct

SEQ ID NO: 6531410 - DNA, 19 bp, Homo sapiens
ttcattcggtgtgaacttt

SEQ ID NO: 6531411 - DNA, 23 bp, Homo sapiens
ttcattcgtcttgttgttattga

SEQ ID NO: 6531412 - DNA, 16 bp, Homo sapiens
ttcattctaaaccaaa

SEQ ID NO: 6531413 - DNA, 13 bp, Homo sapiens
ttcattctaccaa

SEQ ID NO: 6531414 - DNA, 17 bp, Homo sapiens
ttcattctaccaagctg

SEQ ID NO: 6531415 - DNA, 21 bp, Homo sapiens
ttcattctaccaagctgtcac

SEQ ID NO: 6531416 - DNA, 22 bp, Homo sapiens
ttcattctcccgcttcctggcc

SEQ ID NO: 6531417 - DNA, 17 bp, Homo sapiens
ttcattctcctcctcct

SEQ ID NO: 6531418 - DNA, 23 bp, Homo sapiens
ttcattctcctcctcctccctcc

SEQ ID NO: 6531419 - DNA, 17 bp, Homo sapiens
ttcattctccttgttgt

SEQ ID NO: 6531420 - DNA, 14 bp, Homo sapiens
ttcattctctttta

SEQ ID NO: 6531421 - DNA, 21 bp, Homo sapiens
ttcattctgaaccctccaaag

SEQ ID NO: 6531422 - DNA, 12 bp, Homo sapiens
ttcattctgcat

SEQ ID NO: 6531423 - DNA, 15 bp, Homo sapiens
ttcattctgccaaag

SEQ ID NO: 6531424 - DNA, 18 bp, Homo sapiens
ttcattctggaggggcag

SEQ ID NO: 6531425 - DNA, 15 bp, Homo sapiens
ttcattctggtcatt

SEQ ID NO: 6531426 - DNA, 23 bp, Homo sapiens
ttcattctggtccttagtaaatt

SEQ ID NO: 6531427 - DNA, 12 bp, Homo sapiens
ttcattctgtga

SEQ ID NO: 6531428 - DNA, 17 bp, Homo sapiens
ttcattcttaacaagat

SEQ ID NO: 6531429 - DNA, 23 bp, Homo sapiens
ttcattcttaatttatgtaaggt

SEQ ID NO: 6531430 - DNA, 13 bp, Homo sapiens
ttcattcttagct

SEQ ID NO: 6531431 - DNA, 18 bp, Homo sapiens
ttcattcttaggctttca

SEQ ID NO: 6531432 - DNA, 14 bp, Homo sapiens
ttcattcttctcac

SEQ ID NO: 6531433 - DNA, 18 bp, Homo sapiens
ttcattcttctctagctg

SEQ ID NO: 6531434 - DNA, 13 bp, Homo sapiens
ttcattcttgaaa

SEQ ID NO: 6531435 - DNA, 13 bp, Homo sapiens
ttcattcttgtat

SEQ ID NO: 6531436 - DNA, 16 bp, Homo sapiens
ttcattctttatatat

SEQ ID NO: 6531437 - DNA, 20 bp, Homo sapiens
ttcattgacctcatcattaa

SEQ ID NO: 6531438 - DNA, 22 bp, Homo sapiens
ttcattgacctcatcattaata

SEQ ID NO: 6531439 - DNA, 20 bp, Homo sapiens
ttcattgaggataaattgcc

SEQ ID NO: 6531440 - DNA, 18 bp, Homo sapiens
ttcattgatatgaaaaat

SEQ ID NO: 6531441 - DNA, 20 bp, Homo sapiens
ttcattgatggatgtcttct

SEQ ID NO: 6531442 - DNA, 21 bp, Homo sapiens
ttcattgatttagtaagtgtt

SEQ ID NO: 6531443 - DNA, 16 bp, Homo sapiens
ttcattgcacaatata

SEQ ID NO: 6531444 - DNA, 13 bp, Homo sapiens
ttcattgcactgc

SEQ ID NO: 6531445 - DNA, 12 bp, Homo sapiens
ttcattgcactt

SEQ ID NO: 6531446 - DNA, 19 bp, Homo sapiens
ttcattgccagtgtctttc

SEQ ID NO: 6531447 - DNA, 20 bp, Homo sapiens
ttcattgcccccagggcact

SEQ ID NO: 6531448 - DNA, 17 bp, Homo sapiens
ttcattgcctttccagg

SEQ ID NO: 6531449 - DNA, 18 bp, Homo sapiens
ttcattgctcaacaagaa

SEQ ID NO: 6531450 - DNA, 21 bp, Homo sapiens
ttcattggatttttgttaatt

SEQ ID NO: 6531451 - DNA, 23 bp, Homo sapiens
ttcattggatttttgttaatttt

SEQ ID NO: 6531452 - DNA, 17 bp, Homo sapiens
ttcattgggaaaggaca

SEQ ID NO: 6531453 - DNA, 20 bp, Homo sapiens
ttcattgggaagattctcta

SEQ ID NO: 6531454 - DNA, 18 bp, Homo sapiens
ttcattggtgaagtaaat

SEQ ID NO: 6531455 - DNA, 17 bp, Homo sapiens
ttcattggttaattttt

SEQ ID NO: 6531456 - DNA, 13 bp, Homo sapiens
ttcattgtataaa

SEQ ID NO: 6531457 - DNA, 14 bp, Homo sapiens
ttcattgtatgatg

SEQ ID NO: 6531458 - DNA, 16 bp, Homo sapiens
ttcattgtctcagtga

SEQ ID NO: 6531459 - DNA, 17 bp, Homo sapiens
ttcattgtctcagtgaa

SEQ ID NO: 6531460 - DNA, 12 bp, Homo sapiens
ttcattgtggtt

SEQ ID NO: 6531461 - DNA, 21 bp, Homo sapiens
ttcattgtggttatttttata

SEQ ID NO: 6531462 - DNA, 12 bp, Homo sapiens
ttcattgttaaa

SEQ ID NO: 6531463 - DNA, 16 bp, Homo sapiens
ttcattgttttgcaaa

SEQ ID NO: 6531464 - DNA, 17 bp, Homo sapiens
ttcattgttttgcaaaa

SEQ ID NO: 6531465 - DNA, 13 bp, Homo sapiens
ttcatttaaaatg

SEQ ID NO: 6531466 - DNA, 15 bp, Homo sapiens
ttcatttaaaatgat

SEQ ID NO: 6531467 - DNA, 16 bp, Homo sapiens
ttcatttaaactaaat

SEQ ID NO: 6531468 - DNA, 17 bp, Homo sapiens
ttcatttaactctttga

SEQ ID NO: 6531469 - DNA, 19 bp, Homo sapiens
ttcatttacaatttcaaaa

SEQ ID NO: 6531470 - DNA, 16 bp, Homo sapiens
ttcatttactcaccat

SEQ ID NO: 6531471 - DNA, 19 bp, Homo sapiens
ttcatttactgtggcttct

SEQ ID NO: 6531472 - DNA, 21 bp, Homo sapiens
ttcatttagataatttgaaaa

SEQ ID NO: 6531473 - DNA, 16 bp, Homo sapiens
ttcatttatcaagcag

SEQ ID NO: 6531474 - DNA, 18 bp, Homo sapiens
ttcatttatctataattt

SEQ ID NO: 6531475 - DNA, 15 bp, Homo sapiens
ttcatttcaactgtt

SEQ ID NO: 6531476 - DNA, 14 bp, Homo sapiens
ttcatttcaatcat

SEQ ID NO: 6531477 - DNA, 16 bp, Homo sapiens
ttcatttcaatcattg

SEQ ID NO: 6531478 - DNA, 21 bp, Homo sapiens
ttcatttcacacagtgaaacg

SEQ ID NO: 6531479 - DNA, 15 bp, Homo sapiens
ttcatttcacatttt

SEQ ID NO: 6531480 - DNA, 13 bp, Homo sapiens
ttcatttcatcta

SEQ ID NO: 6531481 - DNA, 12 bp, Homo sapiens
ttcatttcattg

SEQ ID NO: 6531482 - DNA, 19 bp, Homo sapiens
ttcatttccaactcaggtt

SEQ ID NO: 6531483 - DNA, 13 bp, Homo sapiens
ttcatttcctgcc

SEQ ID NO: 6531484 - DNA, 14 bp, Homo sapiens
ttcatttcctgccc

SEQ ID NO: 6531485 - DNA, 23 bp, Homo sapiens
ttcatttctaacataagtaagac

SEQ ID NO: 6531486 - DNA, 15 bp, Homo sapiens
ttcatttctagactc

SEQ ID NO: 6531487 - DNA, 18 bp, Homo sapiens
ttcatttctatagccaaa

SEQ ID NO: 6531488 - DNA, 14 bp, Homo sapiens
ttcatttctgcaga

SEQ ID NO: 6531489 - DNA, 19 bp, Homo sapiens
ttcatttcttatcacataa

SEQ ID NO: 6531490 - DNA, 19 bp, Homo sapiens
ttcatttcttcctcagctg

SEQ ID NO: 6531491 - DNA, 21 bp, Homo sapiens
ttcatttcttcctcagctggt

SEQ ID NO: 6531492 - DNA, 20 bp, Homo sapiens
ttcatttgagttattttaat

SEQ ID NO: 6531493 - DNA, 16 bp, Homo sapiens
ttcatttgatgctaaa

SEQ ID NO: 6531494 - DNA, 14 bp, Homo sapiens
ttcatttgcaattc

SEQ ID NO: 6531495 - DNA, 19 bp, Homo sapiens
ttcatttgcaattcatgta

SEQ ID NO: 6531496 - DNA, 13 bp, Homo sapiens
ttcatttgctatc

SEQ ID NO: 6531497 - DNA, 19 bp, Homo sapiens
ttcatttgctgttcatctt

SEQ ID NO: 6531498 - DNA, 20 bp, Homo sapiens
ttcatttggtgttcctggaa

SEQ ID NO: 6531499 - DNA, 21 bp, Homo sapiens
ttcatttggtgttcctggaag

SEQ ID NO: 6531500 - DNA, 14 bp, Homo sapiens
ttcatttgtacaag

SEQ ID NO: 6531501 - DNA, 16 bp, Homo sapiens
ttcatttgttattctt

SEQ ID NO: 6531502 - DNA, 15 bp, Homo sapiens
ttcattttaaaaagt

SEQ ID NO: 6531503 - DNA, 15 bp, Homo sapiens
ttcattttaatttat

SEQ ID NO: 6531504 - DNA, 19 bp, Homo sapiens
ttcattttacagttacttt

SEQ ID NO: 6531505 - DNA, 19 bp, Homo sapiens
ttcattttaggaataataa

SEQ ID NO: 6531506 - DNA, 20 bp, Homo sapiens
ttcattttaggaataataaa

SEQ ID NO: 6531507 - DNA, 21 bp, Homo sapiens
ttcattttagtgtatctttaa

SEQ ID NO: 6531508 - DNA, 17 bp, Homo sapiens
ttcattttatatttaaa

SEQ ID NO: 6531509 - DNA, 14 bp, Homo sapiens
ttcattttcagagt

SEQ ID NO: 6531510 - DNA, 16 bp, Homo sapiens
ttcattttcatcactg

SEQ ID NO: 6531511 - DNA, 17 bp, Homo sapiens
ttcattttcatcactgg

SEQ ID NO: 6531512 - DNA, 13 bp, Homo sapiens
ttcattttccaat

SEQ ID NO: 6531513 - DNA, 12 bp, Homo sapiens
ttcattttcctg

SEQ ID NO: 6531514 - DNA, 15 bp, Homo sapiens
ttcattttcctgtgc

SEQ ID NO: 6531515 - DNA, 14 bp, Homo sapiens
ttcattttcctgtt

SEQ ID NO: 6531516 - DNA, 20 bp, Homo sapiens
ttcattttcctgttcagtga

SEQ ID NO: 6531517 - DNA, 12 bp, Homo sapiens
ttcattttctct

SEQ ID NO: 6531518 - DNA, 13 bp, Homo sapiens
ttcattttctctc

SEQ ID NO: 6531519 - DNA, 21 bp, Homo sapiens
ttcattttctgacatgcattg

SEQ ID NO: 6531520 - DNA, 23 bp, Homo sapiens
ttcattttctgacatgcattgtt

SEQ ID NO: 6531521 - DNA, 14 bp, Homo sapiens
ttcattttctgcaa

SEQ ID NO: 6531522 - DNA, 18 bp, Homo sapiens
ttcattttctgcaagcct

SEQ ID NO: 6531523 - DNA, 17 bp, Homo sapiens
ttcattttgagctgaaa

SEQ ID NO: 6531524 - DNA, 21 bp, Homo sapiens
ttcattttgcacctgcagcca

SEQ ID NO: 6531525 - DNA, 15 bp, Homo sapiens
ttcattttgctttaa

SEQ ID NO: 6531526 - DNA, 16 bp, Homo sapiens
ttcattttggttttgt

SEQ ID NO: 6531527 - DNA, 19 bp, Homo sapiens
ttcattttgttttgctctg

SEQ ID NO: 6531528 - DNA, 20 bp, Homo sapiens
ttcatttttaaagcctggct

SEQ ID NO: 6531529 - DNA, 21 bp, Homo sapiens
ttcatttttaaagcctggctt

SEQ ID NO: 6531530 - DNA, 14 bp, Homo sapiens
ttcatttttaaatg

SEQ ID NO: 6531531 - DNA, 18 bp, Homo sapiens
ttcatttttaagactgta

SEQ ID NO: 6531532 - DNA, 17 bp, Homo sapiens
ttcatttttaatcatga

SEQ ID NO: 6531533 - DNA, 21 bp, Homo sapiens
ttcatttttccatgacatttt

SEQ ID NO: 6531534 - DNA, 17 bp, Homo sapiens
ttcatttttctctccct

SEQ ID NO: 6531535 - DNA, 23 bp, Homo sapiens
ttcatttttgatagctgtcccat

SEQ ID NO: 6531536 - DNA, 17 bp, Homo sapiens
ttcattttttaatgtgc

SEQ ID NO: 6531537 - DNA, 20 bp, Homo sapiens
ttcattttttatgtattgtt

SEQ ID NO: 6531538 - DNA, 12 bp, Homo sapiens
tgggttgacccc

SEQ ID NO: 6531539 - DNA, 22 bp, Homo sapiens
tgggttgattctcgactgcttt

SEQ ID NO: 6531540 - DNA, 15 bp, Homo sapiens
tgggttgcaaagcta

SEQ ID NO: 6531541 - DNA, 19 bp, Homo sapiens
tgggttgcgtcctgacggc

SEQ ID NO: 6531542 - DNA, 23 bp, Homo sapiens
tgggttgctgctgtccagtgcct

SEQ ID NO: 6531543 - DNA, 15 bp, Homo sapiens
tgggttggcgcaccc

SEQ ID NO: 6531544 - DNA, 23 bp, Homo sapiens
tgggttggcgcaccctcccctcc

SEQ ID NO: 6531545 - DNA, 23 bp, Homo sapiens
tgggttgttaatactatattgct

SEQ ID NO: 6531546 - DNA, 14 bp, Homo sapiens
tgggttgttgcaga

SEQ ID NO: 6531547 - DNA, 16 bp, Homo sapiens
tgggttgttggtctgt

SEQ ID NO: 6531548 - DNA, 19 bp, Homo sapiens
tgggttgttgtttttttct

SEQ ID NO: 6531549 - DNA, 17 bp, Homo sapiens
tgggttgtttccaggag

SEQ ID NO: 6531550 - DNA, 18 bp, Homo sapiens
tgggtttacaacaaacac

SEQ ID NO: 6531551 - DNA, 11 bp, Homo sapiens
tgggtttactc

SEQ ID NO: 6531552 - DNA, 20 bp, Homo sapiens
tgggtttactctcaatgcat

SEQ ID NO: 6531553 - DNA, 23 bp, Homo sapiens
tgggtttagcaggctgcagcagg

SEQ ID NO: 6531554 - DNA, 13 bp, Homo sapiens
tgggtttcaagaa

SEQ ID NO: 6531555 - DNA, 19 bp, Homo sapiens
tgggtttcaagaaaatctt

SEQ ID NO: 6531556 - DNA, 13 bp, Homo sapiens
tgggtttcaattt

SEQ ID NO: 6531557 - DNA, 14 bp, Homo sapiens
tgggtttcaattta

SEQ ID NO: 6531558 - DNA, 23 bp, Homo sapiens
tgggtttcccttgccctttccat

SEQ ID NO: 6531559 - DNA, 14 bp, Homo sapiens
tgggtttcctgcag

SEQ ID NO: 6531560 - DNA, 17 bp, Homo sapiens
tgggtttcctgcaggca

SEQ ID NO: 6531561 - DNA, 15 bp, Homo sapiens
tgggtttgaagctgc

SEQ ID NO: 6531562 - DNA, 17 bp, Homo sapiens
tgggtttgaagctgctg

SEQ ID NO: 6531563 - DNA, 14 bp, Homo sapiens
tgggtttgccaagc

SEQ ID NO: 6531564 - DNA, 21 bp, Homo sapiens
tgggtttgccaagccctttgc

SEQ ID NO: 6531565 - DNA, 22 bp, Homo sapiens
tgggtttgcccagtcctgggtt

SEQ ID NO: 6531566 - DNA, 15 bp, Homo sapiens
tgggtttgctcatgt

SEQ ID NO: 6531567 - DNA, 23 bp, Homo sapiens
tgggtttgctcatgtaatgtggt

SEQ ID NO: 6531568 - DNA, 16 bp, Homo sapiens
tgggtttgctccctga

SEQ ID NO: 6531569 - DNA, 18 bp, Homo sapiens
tgggtttggccagggagg

SEQ ID NO: 6531570 - DNA, 19 bp, Homo sapiens
tgggtttggccagggaggc

SEQ ID NO: 6531571 - DNA, 21 bp, Homo sapiens
tgggtttggccagggaggcgc

SEQ ID NO: 6531572 - DNA, 22 bp, Homo sapiens
tgggtttggccagggaggcgca

SEQ ID NO: 6531573 - DNA, 13 bp, Homo sapiens
tgggtttggccca

SEQ ID NO: 6531574 - DNA, 14 bp, Homo sapiens
tgggtttggcccct

SEQ ID NO: 6531575 - DNA, 14 bp, Homo sapiens
tgggtttgggagcc

SEQ ID NO: 6531576 - DNA, 22 bp, Homo sapiens
tgggtttgggagccaggactcc

SEQ ID NO: 6531577 - DNA, 15 bp, Homo sapiens
tgggtttgggcagtg

SEQ ID NO: 6531578 - DNA, 21 bp, Homo sapiens
tgggtttgggcagtggagagg

SEQ ID NO: 6531579 - DNA, 20 bp, Homo sapiens
tgggtttggggccatggtgg

SEQ ID NO: 6531580 - DNA, 17 bp, Homo sapiens
tgggtttgggtgcctcc

SEQ ID NO: 6531581 - DNA, 20 bp, Homo sapiens
tgggtttgggtgcctcctgc

SEQ ID NO: 6531582 - DNA, 16 bp, Homo sapiens
tgggtttggttagagg

SEQ ID NO: 6531583 - DNA, 19 bp, Homo sapiens
tgggtttggttagaggaag

SEQ ID NO: 6531584 - DNA, 14 bp, Homo sapiens
tgggttttatcagt

SEQ ID NO: 6531585 - DNA, 21 bp, Homo sapiens
tgggttttctaactgtaaatc

SEQ ID NO: 6531586 - DNA, 19 bp, Homo sapiens
tgggttttctatttgaaca

SEQ ID NO: 6531587 - DNA, 19 bp, Homo sapiens
tgggttttcttaaccatct

SEQ ID NO: 6531588 - DNA, 15 bp, Homo sapiens
tgggttttcttccct

SEQ ID NO: 6531589 - DNA, 19 bp, Homo sapiens
tgggttttgatctcagcat

SEQ ID NO: 6531590 - DNA, 15 bp, Homo sapiens
tgggttttgcctctg

SEQ ID NO: 6531591 - DNA, 19 bp, Homo sapiens
tgggttttgtccattatta

SEQ ID NO: 6531592 - DNA, 16 bp, Homo sapiens
tgggttttgttcttgt

SEQ ID NO: 6531593 - DNA, 15 bp, Homo sapiens
tgggtttttaactca

SEQ ID NO: 6531594 - DNA, 14 bp, Homo sapiens
tgggtttttccctg

SEQ ID NO: 6531595 - DNA, 18 bp, Homo sapiens
tggtaaaaaagaaatgaa

SEQ ID NO: 6531596 - DNA, 14 bp, Homo sapiens
tggtaaaaagaaaa

SEQ ID NO: 6531597 - DNA, 22 bp, Homo sapiens
tggtaaaaagatccagggatgg

SEQ ID NO: 6531598 - DNA, 18 bp, Homo sapiens
tggtaaaaagattatata

SEQ ID NO: 6531599 - DNA, 18 bp, Homo sapiens
tggtaaaaatgctgctct

SEQ ID NO: 6531600 - DNA, 15 bp, Homo sapiens
tggtaaaacattact

SEQ ID NO: 6531601 - DNA, 21 bp, Homo sapiens
tggtaaaagggatacacagga

SEQ ID NO: 6531602 - DNA, 22 bp, Homo sapiens
tggtaaaatagtggatctcagt

SEQ ID NO: 6531603 - DNA, 19 bp, Homo sapiens
tggtaaaatgaagaattta

SEQ ID NO: 6531604 - DNA, 18 bp, Homo sapiens
tggtaaacattcctccag

SEQ ID NO: 6531605 - DNA, 24 bp, Homo sapiens
tggtaaacattcctccagcctccc

SEQ ID NO: 6531606 - DNA, 22 bp, Homo sapiens
tggtaaacggtttttattaaag

SEQ ID NO: 6531607 - DNA, 13 bp, Homo sapiens
tggtaaactattt

SEQ ID NO: 6531608 - DNA, 13 bp, Homo sapiens
tggtaaagccatg

SEQ ID NO: 6531609 - DNA, 15 bp, Homo sapiens
tggtaaagccatgtt

SEQ ID NO: 6531610 - DNA, 16 bp, Homo sapiens
tggtaaagccatgtta

SEQ ID NO: 6531611 - DNA, 18 bp, Homo sapiens
tggtaaaggtatgtaaac

SEQ ID NO: 6531612 - DNA, 17 bp, Homo sapiens
tggtaaagtagttgatt

SEQ ID NO: 6531613 - DNA, 20 bp, Homo sapiens
tggtaaagtgttaaggaata

SEQ ID NO: 6531614 - DNA, 17 bp, Homo sapiens
tggtaaataactgtgac

SEQ ID NO: 6531615 - DNA, 11 bp, Homo sapiens
tggtaaatatg

SEQ ID NO: 6531616 - DNA, 13 bp, Homo sapiens
tggtaaatgtttc

SEQ ID NO: 6531617 - DNA, 15 bp, Homo sapiens
tggtaaatgtttctt

SEQ ID NO: 6531618 - DNA, 21 bp, Homo sapiens
tggtaaattagtatttattta

SEQ ID NO: 6531619 - DNA, 21 bp, Homo sapiens
tggtaaattcagacaacatta

SEQ ID NO: 6531620 - DNA, 23 bp, Homo sapiens
tggtaaattcagacaacattatg

SEQ ID NO: 6531621 - DNA, 16 bp, Homo sapiens
tggtaaattctggtat

SEQ ID NO: 6531622 - DNA, 22 bp, Homo sapiens
tggtaaattctggtatacattg

SEQ ID NO: 6531623 - DNA, 22 bp, Homo sapiens
tggtaaatttccccaacagtgt

SEQ ID NO: 6531624 - DNA, 23 bp, Homo sapiens
tggtaaatttccccaacagtgtg

SEQ ID NO: 6531625 - DNA, 19 bp, Homo sapiens
tggtaaatttttgaaaaat

SEQ ID NO: 6531626 - DNA, 22 bp, Homo sapiens
tggtaaatttttgaaaaatatt

SEQ ID NO: 6531627 - DNA, 22 bp, Homo sapiens
tggtaacaaataacctataaag

SEQ ID NO: 6531628 - DNA, 21 bp, Homo sapiens
tggtaacaagaggagcaggaa

SEQ ID NO: 6531629 - DNA, 14 bp, Homo sapiens
tggtaacagatttg

SEQ ID NO: 6531630 - DNA, 15 bp, Homo sapiens
tggtaacagctctct

SEQ ID NO: 6531631 - DNA, 17 bp, Homo sapiens
tggtaacagttcatgtt

SEQ ID NO: 6531632 - DNA, 21 bp, Homo sapiens
tggtaacatcctttctattga

SEQ ID NO: 6531633 - DNA, 15 bp, Homo sapiens
tggtaaccaaatatt

SEQ ID NO: 6531634 - DNA, 19 bp, Homo sapiens
tggtaacgtggctccacct

SEQ ID NO: 6531635 - DNA, 21 bp, Homo sapiens
tggtaactgattacctgccaa

SEQ ID NO: 6531636 - DNA, 14 bp, Homo sapiens
tggtaactgctttc

SEQ ID NO: 6531637 - DNA, 13 bp, Homo sapiens
tggtaactgttaa

SEQ ID NO: 6531638 - DNA, 13 bp, Homo sapiens
tggtaacttgaga

SEQ ID NO: 6531639 - DNA, 21 bp, Homo sapiens
tggtaacttgagattcaagac

SEQ ID NO: 6531640 - DNA, 20 bp, Homo sapiens
tggtaacttttgtagtctta

SEQ ID NO: 6531641 - DNA, 16 bp, Homo sapiens
tggtaacttttgtgaa

SEQ ID NO: 6531642 - DNA, 12 bp, Homo sapiens
tggtaagaaaaa

SEQ ID NO: 6531643 - DNA, 13 bp, Homo sapiens
tggtaagagaaaa

SEQ ID NO: 6531644 - DNA, 14 bp, Homo sapiens
tggtaagagaaaag

SEQ ID NO: 6531645 - DNA, 14 bp, Homo sapiens
tggtaagagaagtg

SEQ ID NO: 6531646 - DNA, 16 bp, Homo sapiens
tggtaagagaatgtta

SEQ ID NO: 6531647 - DNA, 15 bp, Homo sapiens
tggtaagagacagaa

SEQ ID NO: 6531648 - DNA, 20 bp, Homo sapiens
tggtaagagacagaatgtat

SEQ ID NO: 6531649 - DNA, 20 bp, Homo sapiens
tggtaagattgttattaaat

SEQ ID NO: 6531650 - DNA, 20 bp, Homo sapiens
tggtaagcaacatggctttg

SEQ ID NO: 6531651 - DNA, 18 bp, Homo sapiens
tggtaagcgatttgaaac

SEQ ID NO: 6531652 - DNA, 13 bp, Homo sapiens
tggtaagctctgg

SEQ ID NO: 6531653 - DNA, 14 bp, Homo sapiens
tggtaagctctggc

SEQ ID NO: 6531654 - DNA, 13 bp, Homo sapiens
tggtaagggaagt

SEQ ID NO: 6531655 - DNA, 18 bp, Homo sapiens
tggtaagggaccttcagg

SEQ ID NO: 6531656 - DNA, 16 bp, Homo sapiens
tggtaagggccaagtc

SEQ ID NO: 6531657 - DNA, 20 bp, Homo sapiens
tggtaaggggaattgaggac

SEQ ID NO: 6531658 - DNA, 17 bp, Homo sapiens
tggtaagggggtccctg

SEQ ID NO: 6531659 - DNA, 20 bp, Homo sapiens
tggtaagggggtccctgtgc

SEQ ID NO: 6531660 - DNA, 21 bp, Homo sapiens
tggtaagggggtccctgtgct

SEQ ID NO: 6531661 - DNA, 22 bp, Homo sapiens
tggtaaggtgtgtactcagggc

SEQ ID NO: 6531662 - DNA, 21 bp, Homo sapiens
tggtaagtaatgagggctgag

SEQ ID NO: 6531663 - DNA, 18 bp, Homo sapiens
tggtaagtgaatttatga

SEQ ID NO: 6531664 - DNA, 12 bp, Homo sapiens
tggtaagtggag

SEQ ID NO: 6531665 - DNA, 13 bp, Homo sapiens
tggtaatagaata

SEQ ID NO: 6531666 - DNA, 13 bp, Homo sapiens
tggtaatatacaa

SEQ ID NO: 6531667 - DNA, 16 bp, Homo sapiens
tggtaatcatattaga

SEQ ID NO: 6531668 - DNA, 16 bp, Homo sapiens
tggtaatcttttctga

SEQ ID NO: 6531669 - DNA, 14 bp, Homo sapiens
tggtaatgacagat

SEQ ID NO: 6531670 - DNA, 20 bp, Homo sapiens
tggtaatgatgttgataatt

SEQ ID NO: 6531671 - DNA, 13 bp, Homo sapiens
tggtaatgtgtca

SEQ ID NO: 6531672 - DNA, 18 bp, Homo sapiens
tggtaatgtgtcaaagag

SEQ ID NO: 6531673 - DNA, 12 bp, Homo sapiens
tggtaattcact

SEQ ID NO: 6531674 - DNA, 17 bp, Homo sapiens
tggtaattcttattctt

SEQ ID NO: 6531675 - DNA, 20 bp, Homo sapiens
tggtaatttagtgtatatgt

SEQ ID NO: 6531676 - DNA, 22 bp, Homo sapiens
tggtaatttagtgtatatgtga

SEQ ID NO: 6531677 - DNA, 19 bp, Homo sapiens
tggtaatttgtatctgaag

SEQ ID NO: 6531678 - DNA, 16 bp, Homo sapiens
tggtaattttgatttc

SEQ ID NO: 6531679 - DNA, 15 bp, Homo sapiens
tggtaatttttgtac

SEQ ID NO: 6531680 - DNA, 14 bp, Homo sapiens
tggtacaaaaataa

SEQ ID NO: 6531681 - DNA, 21 bp, Homo sapiens
tggtacaaaaataaatttata

SEQ ID NO: 6531682 - DNA, 15 bp, Homo sapiens
tggtacaacggaggc

SEQ ID NO: 6531683 - DNA, 16 bp, Homo sapiens
tggtacaaggtggaga

SEQ ID NO: 6531684 - DNA, 17 bp, Homo sapiens
tggtacaatctggctca

SEQ ID NO: 6531685 - DNA, 12 bp, Homo sapiens
tggtacacatgt

SEQ ID NO: 6531686 - DNA, 17 bp, Homo sapiens
tggtacactgcatctca

SEQ ID NO: 6531687 - DNA, 12 bp, Homo sapiens
tggtacagagaa

SEQ ID NO: 6531688 - DNA, 16 bp, Homo sapiens
tggtacagagaagcca

SEQ ID NO: 6531689 - DNA, 18 bp, Homo sapiens
tggtacagagaagccagc

SEQ ID NO: 6531690 - DNA, 19 bp, Homo sapiens
tggtacagagaagccagct

SEQ ID NO: 6531691 - DNA, 22 bp, Homo sapiens
tggtacagagaagccagcttgt

SEQ ID NO: 6531692 - DNA, 13 bp, Homo sapiens
tggtacaggaagg

SEQ ID NO: 6531693 - DNA, 15 bp, Homo sapiens
tggtacaggtatatt

SEQ ID NO: 6531694 - DNA, 22 bp, Homo sapiens
tggtacagtatgggggttgtaa

SEQ ID NO: 6531695 - DNA, 15 bp, Homo sapiens
tggtacatggccagt

SEQ ID NO: 6531696 - DNA, 21 bp, Homo sapiens
tggtaccaatcatgaatcttt

SEQ ID NO: 6531697 - DNA, 13 bp, Homo sapiens
tggtaccagataa

SEQ ID NO: 6531698 - DNA, 15 bp, Homo sapiens
tggtaccagataaaa

SEQ ID NO: 6531699 - DNA, 18 bp, Homo sapiens
tggtaccagataaaatta

SEQ ID NO: 6531700 - DNA, 13 bp, Homo sapiens
tggtaccagatgc

SEQ ID NO: 6531701 - DNA, 20 bp, Homo sapiens
tggtaccagccctggggctg

SEQ ID NO: 6531702 - DNA, 21 bp, Homo sapiens
tggtaccagccctggggctgg

SEQ ID NO: 6531703 - DNA, 14 bp, Homo sapiens
tggtaccaggcccg

SEQ ID NO: 6531704 - DNA, 16 bp, Homo sapiens
tggtaccccccctttt

SEQ ID NO: 6531705 - DNA, 21 bp, Homo sapiens
tggtaccctcctggctcttga

SEQ ID NO: 6531706 - DNA, 15 bp, Homo sapiens
tggtacctgccctct

SEQ ID NO: 6531707 - DNA, 18 bp, Homo sapiens
tggtaccttcagccctgg

SEQ ID NO: 6531708 - DNA, 21 bp, Homo sapiens
tggtaccttcccccagctttc

SEQ ID NO: 6531709 - DNA, 16 bp, Homo sapiens
tggtaccttgcacaca

SEQ ID NO: 6531710 - DNA, 18 bp, Homo sapiens
tggtacggagatgtttca

SEQ ID NO: 6531711 - DNA, 15 bp, Homo sapiens
tggtacgtgaccctc

SEQ ID NO: 6531712 - DNA, 15 bp, Homo sapiens
tggtacgtgggtacc

SEQ ID NO: 6531713 - DNA, 21 bp, Homo sapiens
tggtactaatgaaatttacag

SEQ ID NO: 6531714 - DNA, 17 bp, Homo sapiens
tggtactagtgtggtgt

SEQ ID NO: 6531715 - DNA, 21 bp, Homo sapiens
tggtactagtgtggtgtgttt

SEQ ID NO: 6531716 - DNA, 18 bp, Homo sapiens
tggtactcaagccagcct

SEQ ID NO: 6531717 - DNA, 14 bp, Homo sapiens
ttcatttttttcca

SEQ ID NO: 6531718 - DNA, 19 bp, Homo sapiens
ttcatttttttttcaatca

SEQ ID NO: 6531719 - DNA, 13 bp, Homo sapiens
ttccaaaaaaata

SEQ ID NO: 6531720 - DNA, 21 bp, Homo sapiens
ttccaaaaacaaagtgcaaag

SEQ ID NO: 6531721 - DNA, 23 bp, Homo sapiens
ttccaaaaacaaagtgcaaagct

SEQ ID NO: 6531722 - DNA, 21 bp, Homo sapiens
ttccaaaaagattttcagaaa

SEQ ID NO: 6531723 - DNA, 18 bp, Homo sapiens
ttccaaaaaggttgctgt

SEQ ID NO: 6531724 - DNA, 16 bp, Homo sapiens
ttccaaaacctaaaga

SEQ ID NO: 6531725 - DNA, 15 bp, Homo sapiens
ttccaaaacctgctt

SEQ ID NO: 6531726 - DNA, 23 bp, Homo sapiens
ttccaaaacctgcttccttcagt

SEQ ID NO: 6531727 - DNA, 15 bp, Homo sapiens
ttccaaaagccaatg

SEQ ID NO: 6531728 - DNA, 15 bp, Homo sapiens
ttccaaaaggaagca

SEQ ID NO: 6531729 - DNA, 21 bp, Homo sapiens
ttccaaaagtactagcaataa

SEQ ID NO: 6531730 - DNA, 17 bp, Homo sapiens
ttccaaaagtggcctct

SEQ ID NO: 6531731 - DNA, 17 bp, Homo sapiens
ttccaaaataaaatgaa

SEQ ID NO: 6531732 - DNA, 21 bp, Homo sapiens
ttccaaaataattttaagaaa

SEQ ID NO: 6531733 - DNA, 14 bp, Homo sapiens
ttccaaaatattat

SEQ ID NO: 6531734 - DNA, 16 bp, Homo sapiens
ttccaaaatccaaaaa

SEQ ID NO: 6531735 - DNA, 20 bp, Homo sapiens
ttccaaaatctaaaagctgt

SEQ ID NO: 6531736 - DNA, 13 bp, Homo sapiens
ttccaaaattcca

SEQ ID NO: 6531737 - DNA, 14 bp, Homo sapiens
ttccaaaattctta

SEQ ID NO: 6531738 - DNA, 20 bp, Homo sapiens
ttccaaaattcttatttttc

SEQ ID NO: 6531739 - DNA, 15 bp, Homo sapiens
ttccaaacagacaaa

SEQ ID NO: 6531740 - DNA, 15 bp, Homo sapiens
ttccaaacccaggct

SEQ ID NO: 6531741 - DNA, 15 bp, Homo sapiens
ttccaaacttttgca

SEQ ID NO: 6531742 - DNA, 14 bp, Homo sapiens
ttccaaagaaagtt

SEQ ID NO: 6531743 - DNA, 16 bp, Homo sapiens
ttccaaagaatatttt

SEQ ID NO: 6531744 - DNA, 11 bp, Homo sapiens
ttccaaagatc

SEQ ID NO: 6531745 - DNA, 20 bp, Homo sapiens
ttccaaagcacattgaaaga

SEQ ID NO: 6531746 - DNA, 20 bp, Homo sapiens
ttccaaagcattttcagcat

SEQ ID NO: 6531747 - DNA, 16 bp, Homo sapiens
ttccaaagctttatta

SEQ ID NO: 6531748 - DNA, 23 bp, Homo sapiens
ttccaaaggccatggagagctgg

SEQ ID NO: 6531749 - DNA, 16 bp, Homo sapiens
ttccaaagtcacagga

SEQ ID NO: 6531750 - DNA, 19 bp, Homo sapiens
ttccaaagtcacaggaaga

SEQ ID NO: 6531751 - DNA, 14 bp, Homo sapiens
ttccaaagttaaca

SEQ ID NO: 6531752 - DNA, 13 bp, Homo sapiens
ttccaaataaaac

SEQ ID NO: 6531753 - DNA, 15 bp, Homo sapiens
ttccaaataaaatgt

SEQ ID NO: 6531754 - DNA, 17 bp, Homo sapiens
ttccaaataaaatgttc

SEQ ID NO: 6531755 - DNA, 22 bp, Homo sapiens
ttccaaataaggatttgttcac

SEQ ID NO: 6531756 - DNA, 15 bp, Homo sapiens
ttccaaatattctaa

SEQ ID NO: 6531757 - DNA, 17 bp, Homo sapiens
ttccaaatcctggaagg

SEQ ID NO: 6531758 - DNA, 19 bp, Homo sapiens
ttccaaatgatcctagtaa

SEQ ID NO: 6531759 - DNA, 17 bp, Homo sapiens
ttccaaatgcaatttga

SEQ ID NO: 6531760 - DNA, 22 bp, Homo sapiens
ttccaaatgcagttcattgcag

SEQ ID NO: 6531761 - DNA, 12 bp, Homo sapiens
ttccaaatgctt

SEQ ID NO: 6531762 - DNA, 16 bp, Homo sapiens
ttccaaatgcttctat

SEQ ID NO: 6531763 - DNA, 13 bp, Homo sapiens
ttccaaatgcttt

SEQ ID NO: 6531764 - DNA, 19 bp, Homo sapiens
ttccaaattaaaacaaata

SEQ ID NO: 6531765 - DNA, 13 bp, Homo sapiens
ttccaaattatta

SEQ ID NO: 6531766 - DNA, 16 bp, Homo sapiens
ttccaaattatttctt

SEQ ID NO: 6531767 - DNA, 15 bp, Homo sapiens
ttccaaattcacaag

SEQ ID NO: 6531768 - DNA, 23 bp, Homo sapiens
ttccaaattcacaagttgtgttt

SEQ ID NO: 6531769 - DNA, 20 bp, Homo sapiens
ttccaaattcagtttcataa

SEQ ID NO: 6531770 - DNA, 23 bp, Homo sapiens
ttccaaattgccctatgctgtgc

SEQ ID NO: 6531771 - DNA, 19 bp, Homo sapiens
ttccaaatttgctttacat

SEQ ID NO: 6531772 - DNA, 18 bp, Homo sapiens
ttccaaatttttttctta

SEQ ID NO: 6531773 - DNA, 20 bp, Homo sapiens
ttccaacaaacttactgtca

SEQ ID NO: 6531774 - DNA, 16 bp, Homo sapiens
ttccaacaaagggttt

SEQ ID NO: 6531775 - DNA, 23 bp, Homo sapiens
ttccaacaaagggttttaatgta

SEQ ID NO: 6531776 - DNA, 17 bp, Homo sapiens
ttccaacaaggacagcc

SEQ ID NO: 6531777 - DNA, 16 bp, Homo sapiens
ttccaacacacaatta

SEQ ID NO: 6531778 - DNA, 16 bp, Homo sapiens
ttccaacacatttcac

SEQ ID NO: 6531779 - DNA, 12 bp, Homo sapiens
ttccaacaccac

SEQ ID NO: 6531780 - DNA, 18 bp, Homo sapiens
ttccaacaccacagacac

SEQ ID NO: 6531781 - DNA, 23 bp, Homo sapiens
ttccaacaccacagacacacaca

SEQ ID NO: 6531782 - DNA, 16 bp, Homo sapiens
ttccaacagacagggc

SEQ ID NO: 6531783 - DNA, 11 bp, Homo sapiens
ttccaacagca

SEQ ID NO: 6531784 - DNA, 17 bp, Homo sapiens
ttccaacaggcgtggga

SEQ ID NO: 6531785 - DNA, 14 bp, Homo sapiens
ttccaacagtgagt

SEQ ID NO: 6531786 - DNA, 13 bp, Homo sapiens
ttccaaccccagc

SEQ ID NO: 6531787 - DNA, 14 bp, Homo sapiens
ttccaaccccagct

SEQ ID NO: 6531788 - DNA, 16 bp, Homo sapiens
ttccaaccccagctgg

SEQ ID NO: 6531789 - DNA, 19 bp, Homo sapiens
ttccaaccctcatcaccaa

SEQ ID NO: 6531790 - DNA, 18 bp, Homo sapiens
ttccaacctcacttcccg

SEQ ID NO: 6531791 - DNA, 20 bp, Homo sapiens
ttccaacctcctgctctggg

SEQ ID NO: 6531792 - DNA, 21 bp, Homo sapiens
ttccaacctcctgctctggga

SEQ ID NO: 6531793 - DNA, 19 bp, Homo sapiens
ttccaacctgttcacgtga

SEQ ID NO: 6531794 - DNA, 16 bp, Homo sapiens
ttccaaccttcctttt

SEQ ID NO: 6531795 - DNA, 13 bp, Homo sapiens
ttccaacgtaaat

SEQ ID NO: 6531796 - DNA, 18 bp, Homo sapiens
ttccaactactaatagaa

SEQ ID NO: 6531797 - DNA, 15 bp, Homo sapiens
ttccaactcctgatg

SEQ ID NO: 6531798 - DNA, 19 bp, Homo sapiens
ttccaactcgtatagcatg

SEQ ID NO: 6531799 - DNA, 16 bp, Homo sapiens
ttccaactgctgcccc

SEQ ID NO: 6531800 - DNA, 17 bp, Homo sapiens
ttccaacttgaaggatt

SEQ ID NO: 6531801 - DNA, 17 bp, Homo sapiens
ttccaacttggctgcag

SEQ ID NO: 6531802 - DNA, 13 bp, Homo sapiens
ttccaagaaagat

SEQ ID NO: 6531803 - DNA, 23 bp, Homo sapiens
ttccaagaaagatgaatacattt

SEQ ID NO: 6531804 - DNA, 14 bp, Homo sapiens
ttccaagaacctat

SEQ ID NO: 6531805 - DNA, 23 bp, Homo sapiens
ttccaagaatagcatctgtacaa

SEQ ID NO: 6531806 - DNA, 22 bp, Homo sapiens
ttccaagacagtatacagtcct

SEQ ID NO: 6531807 - DNA, 16 bp, Homo sapiens
ttccaagacattgtca

SEQ ID NO: 6531808 - DNA, 16 bp, Homo sapiens
ttccaagacctgactc

SEQ ID NO: 6531809 - DNA, 17 bp, Homo sapiens
ttccaagactgaagact

SEQ ID NO: 6531810 - DNA, 22 bp, Homo sapiens
ttccaagagcctgagagtgagg

SEQ ID NO: 6531811 - DNA, 13 bp, Homo sapiens
ttccaagagctga

SEQ ID NO: 6531812 - DNA, 15 bp, Homo sapiens
ttccaagaggctgta

SEQ ID NO: 6531813 - DNA, 15 bp, Homo sapiens
ttccaagagtctaaa

SEQ ID NO: 6531814 - DNA, 19 bp, Homo sapiens
ttccaagcaaaatctaaaa

SEQ ID NO: 6531815 - DNA, 22 bp, Homo sapiens
ttccaagcctgggccactggca

SEQ ID NO: 6531816 - DNA, 15 bp, Homo sapiens
ttccaagctccaaat

SEQ ID NO: 6531817 - DNA, 19 bp, Homo sapiens
ttccaagctgttagttgct

SEQ ID NO: 6531818 - DNA, 23 bp, Homo sapiens
ttccaagcttccatagctgctgc

SEQ ID NO: 6531819 - DNA, 20 bp, Homo sapiens
ttccaaggaaaattgaaagt

SEQ ID NO: 6531820 - DNA, 21 bp, Homo sapiens
ttccaaggaaaattgaaagta

SEQ ID NO: 6531821 - DNA, 13 bp, Homo sapiens
ttccaaggaaata

SEQ ID NO: 6531822 - DNA, 13 bp, Homo sapiens
ttccaaggagacc

SEQ ID NO: 6531823 - DNA, 22 bp, Homo sapiens
ttccaaggagctgagaatagaa

SEQ ID NO: 6531824 - DNA, 23 bp, Homo sapiens
ttccaaggagctgagaatagaag

SEQ ID NO: 6531825 - DNA, 19 bp, Homo sapiens
ttccaaggctttaaagctg

SEQ ID NO: 6531826 - DNA, 18 bp, Homo sapiens
ttccaaggggcaaatttt

SEQ ID NO: 6531827 - DNA, 15 bp, Homo sapiens
ttccaagggtactaa

SEQ ID NO: 6531828 - DNA, 20 bp, Homo sapiens
ttccaaggtcactcttggtc

SEQ ID NO: 6531829 - DNA, 20 bp, Homo sapiens
ttccaaggtggtctgctcgg

SEQ ID NO: 6531830 - DNA, 17 bp, Homo sapiens
ttccaagtcatttttgt

SEQ ID NO: 6531831 - DNA, 20 bp, Homo sapiens
ttccaagtcatttttgtttt

SEQ ID NO: 6531832 - DNA, 19 bp, Homo sapiens
ttccaagtctctgtgtaac

SEQ ID NO: 6531833 - DNA, 16 bp, Homo sapiens
ttccaagtgcattttt

SEQ ID NO: 6531834 - DNA, 20 bp, Homo sapiens
ttccaagtgcatttttctta

SEQ ID NO: 6531835 - DNA, 18 bp, Homo sapiens
ttccaagtggacggcaga

SEQ ID NO: 6531836 - DNA, 14 bp, Homo sapiens
ttccaagtgtgcat

SEQ ID NO: 6531837 - DNA, 17 bp, Homo sapiens
ttccaagtgtgtgtgca

SEQ ID NO: 6531838 - DNA, 21 bp, Homo sapiens
ttccaataaaccaggtttaga

SEQ ID NO: 6531839 - DNA, 21 bp, Homo sapiens
ttccaatacttcattaatttc

SEQ ID NO: 6531840 - DNA, 17 bp, Homo sapiens
ttccaatagaaagaaac

SEQ ID NO: 6531841 - DNA, 20 bp, Homo sapiens
ttccaatagaaagaaactaa

SEQ ID NO: 6531842 - DNA, 13 bp, Homo sapiens
ttccaatatgtga

SEQ ID NO: 6531843 - DNA, 14 bp, Homo sapiens
ttccaatatgtgat

SEQ ID NO: 6531844 - DNA, 23 bp, Homo sapiens
ttccaatatttataattaaagaa

SEQ ID NO: 6531845 - DNA, 15 bp, Homo sapiens
ttccaatatttctgc

SEQ ID NO: 6531846 - DNA, 21 bp, Homo sapiens
ttccaatattttaataaagta

SEQ ID NO: 6531847 - DNA, 15 bp, Homo sapiens
ttccaatcacagtgt

SEQ ID NO: 6531848 - DNA, 15 bp, Homo sapiens
ttccaatcttgcttt

SEQ ID NO: 6531849 - DNA, 19 bp, Homo sapiens
ttccaatgccaattcatct

SEQ ID NO: 6531850 - DNA, 22 bp, Homo sapiens
ttccaatgccaattcatctcag

SEQ ID NO: 6531851 - DNA, 17 bp, Homo sapiens
ttccaatgccacagaca

SEQ ID NO: 6531852 - DNA, 17 bp, Homo sapiens
ttccaatgtgaaagatt

SEQ ID NO: 6531853 - DNA, 14 bp, Homo sapiens
ttccaatgtgccca

SEQ ID NO: 6531854 - DNA, 21 bp, Homo sapiens
ttccaatgtgcccagtcatga

SEQ ID NO: 6531855 - DNA, 22 bp, Homo sapiens
ttccaatttacatactctgctt

SEQ ID NO: 6531856 - DNA, 11 bp, Homo sapiens
ttccacaaaat

SEQ ID NO: 6531857 - DNA, 16 bp, Homo sapiens
ttccacaaaattagaa

SEQ ID NO: 6531858 - DNA, 22 bp, Homo sapiens
ttccacaaaattagaaaggaca

SEQ ID NO: 6531859 - DNA, 17 bp, Homo sapiens
ttccacaaagcagtggc

SEQ ID NO: 6531860 - DNA, 15 bp, Homo sapiens
ttccacaattcttct

SEQ ID NO: 6531861 - DNA, 15 bp, Homo sapiens
ttccacacaaaatgt

SEQ ID NO: 6531862 - DNA, 19 bp, Homo sapiens
ttccacacaaaatgtcaca

SEQ ID NO: 6531863 - DNA, 19 bp, Homo sapiens
ttccacacagaatgcaacc

SEQ ID NO: 6531864 - DNA, 13 bp, Homo sapiens
ttccacacagcct

SEQ ID NO: 6531865 - DNA, 18 bp, Homo sapiens
ttccacacatttaaaaca

SEQ ID NO: 6531866 - DNA, 15 bp, Homo sapiens
ttccacacccccacc

SEQ ID NO: 6531867 - DNA, 17 bp, Homo sapiens
ttccacacccccacccc

SEQ ID NO: 6531868 - DNA, 19 bp, Homo sapiens
ttccacacctagcatctca

SEQ ID NO: 6531869 - DNA, 21 bp, Homo sapiens
ttccacacctggcactgctgt

SEQ ID NO: 6531870 - DNA, 19 bp, Homo sapiens
ttccacactccttgtcaac

SEQ ID NO: 6531871 - DNA, 21 bp, Homo sapiens
ttccacacttccacccccagc

SEQ ID NO: 6531872 - DNA, 10 bp, Homo sapiens
ttccacagac

SEQ ID NO: 6531873 - DNA, 12 bp, Homo sapiens
ttccacagacgg

SEQ ID NO: 6531874 - DNA, 13 bp, Homo sapiens
ttccacagaggac

SEQ ID NO: 6531875 - DNA, 12 bp, Homo sapiens
ttccacagattg

SEQ ID NO: 6531876 - DNA, 19 bp, Homo sapiens
ttccacagattgtttctat

SEQ ID NO: 6531877 - DNA, 15 bp, Homo sapiens
ttccacagcagcaga

SEQ ID NO: 6531878 - DNA, 22 bp, Homo sapiens
ttccacagcagcagaacaagtg

SEQ ID NO: 6531879 - DNA, 15 bp, Homo sapiens
ttccacagcagtgtc

SEQ ID NO: 6531880 - DNA, 22 bp, Homo sapiens
ttccacagcagtgtcacagacg

SEQ ID NO: 6531881 - DNA, 16 bp, Homo sapiens
ttccacagctggcctg

SEQ ID NO: 6531882 - DNA, 21 bp, Homo sapiens
ttccacaggacgaatgcatat

SEQ ID NO: 6531883 - DNA, 11 bp, Homo sapiens
ttccacaggat

SEQ ID NO: 6531884 - DNA, 18 bp, Homo sapiens
ttccacaggatcatcatt

SEQ ID NO: 6531885 - DNA, 22 bp, Homo sapiens
ttccacagggtcccacagccac

SEQ ID NO: 6531886 - DNA, 18 bp, Homo sapiens
ttccacagtctctgggag

SEQ ID NO: 6531887 - DNA, 10 bp, Homo sapiens
ttccacagtg

SEQ ID NO: 6531888 - DNA, 13 bp, Homo sapiens
ttccacagttatc

SEQ ID NO: 6531889 - DNA, 16 bp, Homo sapiens
ttccacagttatctta

SEQ ID NO: 6531890 - DNA, 20 bp, Homo sapiens
ttccacagttatcttagctg

SEQ ID NO: 6531891 - DNA, 17 bp, Homo sapiens
ttccacagttgccacca

SEQ ID NO: 6531892 - DNA, 18 bp, Homo sapiens
ttccacagttgccaccac

SEQ ID NO: 6531893 - DNA, 13 bp, Homo sapiens
ttccacataaagg

SEQ ID NO: 6531894 - DNA, 15 bp, Homo sapiens
ttccacataaatttt

SEQ ID NO: 6531895 - DNA, 12 bp, Homo sapiens
ttccacatcatg

SEQ ID NO: 6531896 - DNA, 17 bp, Homo sapiens
tggtactcattaaaaaa

SEQ ID NO: 6531897 - DNA, 20 bp, Homo sapiens
tggtactcccaaactgacaa

SEQ ID NO: 6531898 - DNA, 17 bp, Homo sapiens
tggtactcccccagccc

SEQ ID NO: 6531899 - DNA, 22 bp, Homo sapiens
tggtactccctctcaggatcca

SEQ ID NO: 6531900 - DNA, 23 bp, Homo sapiens
tggtactctggcaaatgatgatg

SEQ ID NO: 6531901 - DNA, 16 bp, Homo sapiens
tggtactctgtgtctg

SEQ ID NO: 6531902 - DNA, 21 bp, Homo sapiens
tggtactgactttgcttgctt

SEQ ID NO: 6531903 - DNA, 18 bp, Homo sapiens
tggtactgcacattttgt

SEQ ID NO: 6531904 - DNA, 13 bp, Homo sapiens
tggtactgctgag

SEQ ID NO: 6531905 - DNA, 19 bp, Homo sapiens
tggtactgctgtcttccaa

SEQ ID NO: 6531906 - DNA, 21 bp, Homo sapiens
tggtactgtacagctggctct

SEQ ID NO: 6531907 - DNA, 14 bp, Homo sapiens
tggtacttcctctg

SEQ ID NO: 6531908 - DNA, 17 bp, Homo sapiens
tggtacttgctgctatt

SEQ ID NO: 6531909 - DNA, 18 bp, Homo sapiens
tggtacttgctgctattt

SEQ ID NO: 6531910 - DNA, 20 bp, Homo sapiens
tggtacttggcaccaataaa

SEQ ID NO: 6531911 - DNA, 16 bp, Homo sapiens
tggtactttctgtact

SEQ ID NO: 6531912 - DNA, 17 bp, Homo sapiens
tggtacttttgagtgtg

SEQ ID NO: 6531913 - DNA, 18 bp, Homo sapiens
tggtacttttgagtgtgt

SEQ ID NO: 6531914 - DNA, 21 bp, Homo sapiens
tggtagaaaaacatctgaaga

SEQ ID NO: 6531915 - DNA, 21 bp, Homo sapiens
tggtagaaaaaggggcctgag

SEQ ID NO: 6531916 - DNA, 19 bp, Homo sapiens
tggtagaaaatgcaccaaa

SEQ ID NO: 6531917 - DNA, 22 bp, Homo sapiens
tggtagaaaatgcaccaaatag

SEQ ID NO: 6531918 - DNA, 12 bp, Homo sapiens
tggtagaaattt

SEQ ID NO: 6531919 - DNA, 13 bp, Homo sapiens
tggtagaagccag

SEQ ID NO: 6531920 - DNA, 18 bp, Homo sapiens
tggtagaattgggaagct

SEQ ID NO: 6531921 - DNA, 17 bp, Homo sapiens
tggtagaccaaaataaa

SEQ ID NO: 6531922 - DNA, 16 bp, Homo sapiens
tggtagagacccccag

SEQ ID NO: 6531923 - DNA, 13 bp, Homo sapiens
tggtagagatgga

SEQ ID NO: 6531924 - DNA, 16 bp, Homo sapiens
tggtagagccctcaga

SEQ ID NO: 6531925 - DNA, 19 bp, Homo sapiens
tggtagagctggtgccaga

SEQ ID NO: 6531926 - DNA, 19 bp, Homo sapiens
tggtagaggcctggggccg

SEQ ID NO: 6531927 - DNA, 17 bp, Homo sapiens
tggtagaggtgtgtgcc

SEQ ID NO: 6531928 - DNA, 20 bp, Homo sapiens
tggtagagtgtgcctgaagt

SEQ ID NO: 6531929 - DNA, 16 bp, Homo sapiens
tggtagagttcctttc

SEQ ID NO: 6531930 - DNA, 19 bp, Homo sapiens
tggtagatattcaggaaat

SEQ ID NO: 6531931 - DNA, 21 bp, Homo sapiens
tggtagatcttcaatttggat

SEQ ID NO: 6531932 - DNA, 15 bp, Homo sapiens
tggtagatgctgagg

SEQ ID NO: 6531933 - DNA, 16 bp, Homo sapiens
tggtagatgctgaggc

SEQ ID NO: 6531934 - DNA, 18 bp, Homo sapiens
tggtagatgctgaggccc

SEQ ID NO: 6531935 - DNA, 19 bp, Homo sapiens
tggtagattcgctgtcccc

SEQ ID NO: 6531936 - DNA, 20 bp, Homo sapiens
tggtagattcgctgtcccct

SEQ ID NO: 6531937 - DNA, 17 bp, Homo sapiens
tggtagatttcctcctc

SEQ ID NO: 6531938 - DNA, 14 bp, Homo sapiens
tggtagcaaagtaa

SEQ ID NO: 6531939 - DNA, 15 bp, Homo sapiens
tggtagcagcaggct

SEQ ID NO: 6531940 - DNA, 15 bp, Homo sapiens
tggtagcagcctggg

SEQ ID NO: 6531941 - DNA, 18 bp, Homo sapiens
tggtagcagggtctttgt

SEQ ID NO: 6531942 - DNA, 17 bp, Homo sapiens
tggtagcatgacctttt

SEQ ID NO: 6531943 - DNA, 18 bp, Homo sapiens
tggtagcattttaaacaa

SEQ ID NO: 6531944 - DNA, 19 bp, Homo sapiens
tggtagccagttgaattta

SEQ ID NO: 6531945 - DNA, 18 bp, Homo sapiens
tggtagccatcaagcact

SEQ ID NO: 6531946 - DNA, 14 bp, Homo sapiens
tggtagctcaggtg

SEQ ID NO: 6531947 - DNA, 23 bp, Homo sapiens
tggtagctcatgcctgtaaccct

SEQ ID NO: 6531948 - DNA, 22 bp, Homo sapiens
tggtagctctgaagggagggga

SEQ ID NO: 6531949 - DNA, 16 bp, Homo sapiens
tggtagctctgagccc

SEQ ID NO: 6531950 - DNA, 20 bp, Homo sapiens
tggtaggaaaaagctttact

SEQ ID NO: 6531951 - DNA, 17 bp, Homo sapiens
tggtaggaatagcatgt

SEQ ID NO: 6531952 - DNA, 12 bp, Homo sapiens
tggtaggaccct

SEQ ID NO: 6531953 - DNA, 22 bp, Homo sapiens
tggtaggaccctcgagagcctt

SEQ ID NO: 6531954 - DNA, 14 bp, Homo sapiens
tggtaggaggaggc

SEQ ID NO: 6531955 - DNA, 18 bp, Homo sapiens
tggtaggaggaggcatgg

SEQ ID NO: 6531956 - DNA, 15 bp, Homo sapiens
tggtaggcttatcaa

SEQ ID NO: 6531957 - DNA, 17 bp, Homo sapiens
tggtagggacttaaaaa

SEQ ID NO: 6531958 - DNA, 15 bp, Homo sapiens
tggtaggggcaggga

SEQ ID NO: 6531959 - DNA, 17 bp, Homo sapiens
tggtaggggcagggagg

SEQ ID NO: 6531960 - DNA, 19 bp, Homo sapiens
tggtagggtataatgtgtc

SEQ ID NO: 6531961 - DNA, 20 bp, Homo sapiens
tggtaggtactttttgtgaa

SEQ ID NO: 6531962 - DNA, 16 bp, Homo sapiens
tggtaggtagcacagt

SEQ ID NO: 6531963 - DNA, 19 bp, Homo sapiens
tggtaggtctggattttca

SEQ ID NO: 6531964 - DNA, 21 bp, Homo sapiens
tggtaggttgggacaccaggg

SEQ ID NO: 6531965 - DNA, 14 bp, Homo sapiens
tggtagtaaaacac

SEQ ID NO: 6531966 - DNA, 22 bp, Homo sapiens
tggtagtaatcacagttggcct

SEQ ID NO: 6531967 - DNA, 22 bp, Homo sapiens
tggtagtaatttcctttattat

SEQ ID NO: 6531968 - DNA, 13 bp, Homo sapiens
tggtagtcacttg

SEQ ID NO: 6531969 - DNA, 17 bp, Homo sapiens
tggtagtcctcccaagc

SEQ ID NO: 6531970 - DNA, 19 bp, Homo sapiens
tggtagtcctcccaagctg

SEQ ID NO: 6531971 - DNA, 23 bp, Homo sapiens
tggtagtcctcccaagctgtgct

SEQ ID NO: 6531972 - DNA, 22 bp, Homo sapiens
tggtagtgtagctgtgtggctt

SEQ ID NO: 6531973 - DNA, 14 bp, Homo sapiens
tggtagttaacaca

SEQ ID NO: 6531974 - DNA, 17 bp, Homo sapiens
tggtagttagtagcatg

SEQ ID NO: 6531975 - DNA, 17 bp, Homo sapiens
tggtataaaaggttgcc

SEQ ID NO: 6531976 - DNA, 15 bp, Homo sapiens
tggtataagtaactt

SEQ ID NO: 6531977 - DNA, 16 bp, Homo sapiens
tggtataattgaaact

SEQ ID NO: 6531978 - DNA, 16 bp, Homo sapiens
tggtatacctatttca

SEQ ID NO: 6531979 - DNA, 14 bp, Homo sapiens
tggtatagaaatgc

SEQ ID NO: 6531980 - DNA, 20 bp, Homo sapiens
tggtatagatttctataaaa

SEQ ID NO: 6531981 - DNA, 14 bp, Homo sapiens
tggtatatatacat

SEQ ID NO: 6531982 - DNA, 19 bp, Homo sapiens
tggtatatccaaaagcttt

SEQ ID NO: 6531983 - DNA, 22 bp, Homo sapiens
tggtatatctggccacactggg

SEQ ID NO: 6531984 - DNA, 15 bp, Homo sapiens
tggtatatgtcatta

SEQ ID NO: 6531985 - DNA, 18 bp, Homo sapiens
tggtatattattgcttca

SEQ ID NO: 6531986 - DNA, 17 bp, Homo sapiens
tggtatattgtgtaaat

SEQ ID NO: 6531987 - DNA, 15 bp, Homo sapiens
tggtatatttgtaga

SEQ ID NO: 6531988 - DNA, 15 bp, Homo sapiens
tggtatcaagaaagt

SEQ ID NO: 6531989 - DNA, 14 bp, Homo sapiens
tggtatcatatatt

SEQ ID NO: 6531990 - DNA, 14 bp, Homo sapiens
tggtatcctactga

SEQ ID NO: 6531991 - DNA, 15 bp, Homo sapiens
tggtatctaattctt

SEQ ID NO: 6531992 - DNA, 21 bp, Homo sapiens
tggtatctaattctttaatga

SEQ ID NO: 6531993 - DNA, 16 bp, Homo sapiens
tggtatctcagaaagt

SEQ ID NO: 6531994 - DNA, 19 bp, Homo sapiens
tggtatctcaggtctgaat

SEQ ID NO: 6531995 - DNA, 22 bp, Homo sapiens
tggtatctgttctttaatttat

SEQ ID NO: 6531996 - DNA, 23 bp, Homo sapiens
tggtatctgttctttaatttatt

SEQ ID NO: 6531997 - DNA, 20 bp, Homo sapiens
tggtatcttgttagagagct

SEQ ID NO: 6531998 - DNA, 13 bp, Homo sapiens
tggtatgaaacaa

SEQ ID NO: 6531999 - DNA, 17 bp, Homo sapiens
tggtatgaaacaaatat

SEQ ID NO: 6532000 - DNA, 23 bp, Homo sapiens
tggtatgaacttgaggacacatg

SEQ ID NO: 6532001 - DNA, 12 bp, Homo sapiens
tggtatgagaca

SEQ ID NO: 6532002 - DNA, 15 bp, Homo sapiens
tggtatgagctgagg

SEQ ID NO: 6532003 - DNA, 14 bp, Homo sapiens
tggtatgagggggt

SEQ ID NO: 6532004 - DNA, 18 bp, Homo sapiens
tggtatgatgctgccggc

SEQ ID NO: 6532005 - DNA, 15 bp, Homo sapiens
tggtatgatgtatat

SEQ ID NO: 6532006 - DNA, 19 bp, Homo sapiens
tggtatgcagcatacaaaa

SEQ ID NO: 6532007 - DNA, 17 bp, Homo sapiens
tggtatgcattctttat

SEQ ID NO: 6532008 - DNA, 22 bp, Homo sapiens
tggtatgcattctttatagtga

SEQ ID NO: 6532009 - DNA, 15 bp, Homo sapiens
tggtatgctggccag

SEQ ID NO: 6532010 - DNA, 21 bp, Homo sapiens
tggtatggagctgtgccgagg

SEQ ID NO: 6532011 - DNA, 21 bp, Homo sapiens
tggtatggagttggcagacag

SEQ ID NO: 6532012 - DNA, 22 bp, Homo sapiens
tggtatgggggatttcaaactt

SEQ ID NO: 6532013 - DNA, 20 bp, Homo sapiens
tggtatgtaatttatgcaag

SEQ ID NO: 6532014 - DNA, 21 bp, Homo sapiens
tggtatgtagcccggccaggg

SEQ ID NO: 6532015 - DNA, 20 bp, Homo sapiens
tggtatgtgccaggcttgcc

SEQ ID NO: 6532016 - DNA, 12 bp, Homo sapiens
tggtatgtgtgt

SEQ ID NO: 6532017 - DNA, 17 bp, Homo sapiens
tggtatgtgtgtgtatg

SEQ ID NO: 6532018 - DNA, 21 bp, Homo sapiens
tggtatgtgtgtgtatgctac

SEQ ID NO: 6532019 - DNA, 13 bp, Homo sapiens
tggtatgttttca

SEQ ID NO: 6532020 - DNA, 16 bp, Homo sapiens
tggtattaataaaaag

SEQ ID NO: 6532021 - DNA, 20 bp, Homo sapiens
tggtattaatcttgtgtagt

SEQ ID NO: 6532022 - DNA, 15 bp, Homo sapiens
tggtattacacagtc

SEQ ID NO: 6532023 - DNA, 18 bp, Homo sapiens
tggtattacactgtattt

SEQ ID NO: 6532024 - DNA, 20 bp, Homo sapiens
tggtattacactgtatttgt

SEQ ID NO: 6532025 - DNA, 18 bp, Homo sapiens
tggtattatatctctgta

SEQ ID NO: 6532026 - DNA, 17 bp, Homo sapiens
tggtattatttacaatg

SEQ ID NO: 6532027 - DNA, 20 bp, Homo sapiens
tggtattcaactaatacatg

SEQ ID NO: 6532028 - DNA, 16 bp, Homo sapiens
tggtattcctgcctcc

SEQ ID NO: 6532029 - DNA, 12 bp, Homo sapiens
tggtattctgtc

SEQ ID NO: 6532030 - DNA, 14 bp, Homo sapiens
tggtattctgtcat

SEQ ID NO: 6532031 - DNA, 16 bp, Homo sapiens
tggtattgactcaaca

SEQ ID NO: 6532032 - DNA, 18 bp, Homo sapiens
tggtattggaatagcagc

SEQ ID NO: 6532033 - DNA, 23 bp, Homo sapiens
tggtattggccataagcaacaat

SEQ ID NO: 6532034 - DNA, 20 bp, Homo sapiens
tggtattgggcagttgggag

SEQ ID NO: 6532035 - DNA, 15 bp, Homo sapiens
tggtattggtgcttt

SEQ ID NO: 6532036 - DNA, 17 bp, Homo sapiens
tggtattgtaaaacatt

SEQ ID NO: 6532037 - DNA, 13 bp, Homo sapiens
tggtattgtaata

SEQ ID NO: 6532038 - DNA, 14 bp, Homo sapiens
tggtattgtattta

SEQ ID NO: 6532039 - DNA, 16 bp, Homo sapiens
tggtattgtcttaaat

SEQ ID NO: 6532040 - DNA, 17 bp, Homo sapiens
tggtattgtgagatgat

SEQ ID NO: 6532041 - DNA, 13 bp, Homo sapiens
tggtatttactgc

SEQ ID NO: 6532042 - DNA, 18 bp, Homo sapiens
tggtatttactgcaatgt

SEQ ID NO: 6532043 - DNA, 13 bp, Homo sapiens
tggtatttatatt

SEQ ID NO: 6532044 - DNA, 20 bp, Homo sapiens
tggtatttatctattgtaag

SEQ ID NO: 6532045 - DNA, 21 bp, Homo sapiens
tggtatttatgtaaaaggatt

SEQ ID NO: 6532046 - DNA, 13 bp, Homo sapiens
tggtatttctaat

SEQ ID NO: 6532047 - DNA, 14 bp, Homo sapiens
tggtatttctaatt

SEQ ID NO: 6532048 - DNA, 16 bp, Homo sapiens
tggtatttctttctcg

SEQ ID NO: 6532049 - DNA, 15 bp, Homo sapiens
tggtatttgctgtca

SEQ ID NO: 6532050 - DNA, 18 bp, Homo sapiens
tggtatttggatatctgt

SEQ ID NO: 6532051 - DNA, 15 bp, Homo sapiens
tggtatttgtttaat

SEQ ID NO: 6532052 - DNA, 16 bp, Homo sapiens
tggtatttgtttaata

SEQ ID NO: 6532053 - DNA, 22 bp, Homo sapiens
tggtatttgtttgtagctttcc

SEQ ID NO: 6532054 - DNA, 17 bp, Homo sapiens
tggtattttataagcac

SEQ ID NO: 6532055 - DNA, 13 bp, Homo sapiens
tggtattttcaat

SEQ ID NO: 6532056 - DNA, 17 bp, Homo sapiens
tggtattttcaatagcc

SEQ ID NO: 6532057 - DNA, 20 bp, Homo sapiens
tggtattttcaatagccact

SEQ ID NO: 6532058 - DNA, 18 bp, Homo sapiens
tggtattttccagcactt

SEQ ID NO: 6532059 - DNA, 18 bp, Homo sapiens
tggtattttggcattttg

SEQ ID NO: 6532060 - DNA, 17 bp, Homo sapiens
tggtattttttgtgaat

SEQ ID NO: 6532061 - DNA, 21 bp, Homo sapiens
tggtcaaaccgcactcaccca

SEQ ID NO: 6532062 - DNA, 18 bp, Homo sapiens
tggtcaaacttgttttct

SEQ ID NO: 6532063 - DNA, 20 bp, Homo sapiens
tggtcaaactttttccagca

SEQ ID NO: 6532064 - DNA, 21 bp, Homo sapiens
tggtcaaactttttccagcaa

SEQ ID NO: 6532065 - DNA, 22 bp, Homo sapiens
tggtcaacatagtgagacactg

SEQ ID NO: 6532066 - DNA, 14 bp, Homo sapiens
tggtcaacatttct

SEQ ID NO: 6532067 - DNA, 18 bp, Homo sapiens
tggtcaacctcctggaca

SEQ ID NO: 6532068 - DNA, 13 bp, Homo sapiens
tggtcaacttaag

SEQ ID NO: 6532069 - DNA, 14 bp, Homo sapiens
tggtcaacttaagg

SEQ ID NO: 6532070 - DNA, 21 bp, Homo sapiens
tggtcaagaaaggaggggaga

SEQ ID NO: 6532071 - DNA, 23 bp, Homo sapiens
tggtcaatacacataagaccgtg

SEQ ID NO: 6532072 - DNA, 15 bp, Homo sapiens
tggtcacaagcacaa

SEQ ID NO: 6532073 - DNA, 23 bp, Homo sapiens
tggtcacaagtaggagacacaga

SEQ ID NO: 6532074 - DNA, 17 bp, Homo sapiens
ttccacatcatgttact

SEQ ID NO: 6532075 - DNA, 16 bp, Homo sapiens
ttccacatgctctgag

SEQ ID NO: 6532076 - DNA, 18 bp, Homo sapiens
ttccacatggcagatgat

SEQ ID NO: 6532077 - DNA, 15 bp, Homo sapiens
ttccacatgtacata

SEQ ID NO: 6532078 - DNA, 13 bp, Homo sapiens
ttccacattaatt

SEQ ID NO: 6532079 - DNA, 19 bp, Homo sapiens
ttccacatttttgcacaga

SEQ ID NO: 6532080 - DNA, 12 bp, Homo sapiens
ttccaccagcct

SEQ ID NO: 6532081 - DNA, 19 bp, Homo sapiens
ttccaccatcaagccacca

SEQ ID NO: 6532082 - DNA, 19 bp, Homo sapiens
ttccacccacaaactccag

SEQ ID NO: 6532083 - DNA, 22 bp, Homo sapiens
ttccacccacaaactccaggct

SEQ ID NO: 6532084 - DNA, 22 bp, Homo sapiens
ttccacccacacgactgcaaca

SEQ ID NO: 6532085 - DNA, 19 bp, Homo sapiens
ttccacccacgagcacttt

SEQ ID NO: 6532086 - DNA, 15 bp, Homo sapiens
ttccacccagaccct

SEQ ID NO: 6532087 - DNA, 20 bp, Homo sapiens
ttccacccagaccctccttc

SEQ ID NO: 6532088 - DNA, 22 bp, Homo sapiens
ttccacccagaccctccttccc

SEQ ID NO: 6532089 - DNA, 19 bp, Homo sapiens
ttccacccaggggcagccc

SEQ ID NO: 6532090 - DNA, 23 bp, Homo sapiens
ttccacccagtgctgaatttccc

SEQ ID NO: 6532091 - DNA, 13 bp, Homo sapiens
ttccacccccagc

SEQ ID NO: 6532092 - DNA, 20 bp, Homo sapiens
ttccacccccgttagcttcc

SEQ ID NO: 6532093 - DNA, 14 bp, Homo sapiens
ttccacccctcctc

SEQ ID NO: 6532094 - DNA, 20 bp, Homo sapiens
ttccacccctccttccctgg

SEQ ID NO: 6532095 - DNA, 16 bp, Homo sapiens
ttccacccctctcctc

SEQ ID NO: 6532096 - DNA, 13 bp, Homo sapiens
ttccacccgtctc

SEQ ID NO: 6532097 - DNA, 11 bp, Homo sapiens
ttccaccctgg

SEQ ID NO: 6532098 - DNA, 14 bp, Homo sapiens
ttccaccctggaga

SEQ ID NO: 6532099 - DNA, 19 bp, Homo sapiens
ttccaccggcactcatgac

SEQ ID NO: 6532100 - DNA, 14 bp, Homo sapiens
ttccacctccagcc

SEQ ID NO: 6532101 - DNA, 13 bp, Homo sapiens
ttccacctccctc

SEQ ID NO: 6532102 - DNA, 18 bp, Homo sapiens
ttccacctggaaagccag

SEQ ID NO: 6532103 - DNA, 14 bp, Homo sapiens
ttccaccttaaatt

SEQ ID NO: 6532104 - DNA, 17 bp, Homo sapiens
ttccaccttaaattaaa

SEQ ID NO: 6532105 - DNA, 18 bp, Homo sapiens
ttccaccttaaattaaac

SEQ ID NO: 6532106 - DNA, 20 bp, Homo sapiens
ttccaccttaaattaaacaa

SEQ ID NO: 6532107 - DNA, 13 bp, Homo sapiens
ttccacctttctc

SEQ ID NO: 6532108 - DNA, 18 bp, Homo sapiens
ttccacgcagttctttcc

SEQ ID NO: 6532109 - DNA, 18 bp, Homo sapiens
ttccacgctgtctccaga

SEQ ID NO: 6532110 - DNA, 23 bp, Homo sapiens
ttccacggcatcgcatccgtcct

SEQ ID NO: 6532111 - DNA, 17 bp, Homo sapiens
ttccacgggggctgtgg

SEQ ID NO: 6532112 - DNA, 17 bp, Homo sapiens
ttccacgtcttcctcca

SEQ ID NO: 6532113 - DNA, 14 bp, Homo sapiens
ttccacgtgcccct

SEQ ID NO: 6532114 - DNA, 15 bp, Homo sapiens
ttccacgtgcccctt

SEQ ID NO: 6532115 - DNA, 16 bp, Homo sapiens
ttccactaccctccct

SEQ ID NO: 6532116 - DNA, 19 bp, Homo sapiens
ttccactatttgcagaggc

SEQ ID NO: 6532117 - DNA, 19 bp, Homo sapiens
ttccactattttcaaagaa

SEQ ID NO: 6532118 - DNA, 20 bp, Homo sapiens
ttccactcaaaatatgtcaa

SEQ ID NO: 6532119 - DNA, 12 bp, Homo sapiens
ttccactcagct

SEQ ID NO: 6532120 - DNA, 14 bp, Homo sapiens
ttccactcagcttg

SEQ ID NO: 6532121 - DNA, 14 bp, Homo sapiens
ttccactcatgccg

SEQ ID NO: 6532122 - DNA, 17 bp, Homo sapiens
ttccactccaagatgcc

SEQ ID NO: 6532123 - DNA, 19 bp, Homo sapiens
ttccactcccactgccagg

SEQ ID NO: 6532124 - DNA, 17 bp, Homo sapiens
ttccactccttccagaa

SEQ ID NO: 6532125 - DNA, 14 bp, Homo sapiens
ttccactgaaaatt

SEQ ID NO: 6532126 - DNA, 18 bp, Homo sapiens
ttccactgaaaatttaac

SEQ ID NO: 6532127 - DNA, 21 bp, Homo sapiens
ttccactgaaaatttaacagt

SEQ ID NO: 6532128 - DNA, 19 bp, Homo sapiens
ttccactgaaacctctgtt

SEQ ID NO: 6532129 - DNA, 22 bp, Homo sapiens
ttccactgaaacctctgttctc

SEQ ID NO: 6532130 - DNA, 17 bp, Homo sapiens
ttccactgacaacgaaa

SEQ ID NO: 6532131 - DNA, 13 bp, Homo sapiens
ttccactgagctc

SEQ ID NO: 6532132 - DNA, 14 bp, Homo sapiens
ttccactgagctcc

SEQ ID NO: 6532133 - DNA, 19 bp, Homo sapiens
ttccactgccaaaacaatg

SEQ ID NO: 6532134 - DNA, 23 bp, Homo sapiens
ttccactgcctgggatgatgcag

SEQ ID NO: 6532135 - DNA, 22 bp, Homo sapiens
ttccactggacttgagcttggc

SEQ ID NO: 6532136 - DNA, 23 bp, Homo sapiens
ttccactggcttttgcctgtaag

SEQ ID NO: 6532137 - DNA, 23 bp, Homo sapiens
ttccactgtatattttttaatgt

SEQ ID NO: 6532138 - DNA, 22 bp, Homo sapiens
ttccactgtgcaggttcccact

SEQ ID NO: 6532139 - DNA, 13 bp, Homo sapiens
ttccactgtgtgt

SEQ ID NO: 6532140 - DNA, 15 bp, Homo sapiens
ttccacttagagaac

SEQ ID NO: 6532141 - DNA, 19 bp, Homo sapiens
ttccacttataggaattga

SEQ ID NO: 6532142 - DNA, 17 bp, Homo sapiens
ttccacttccagagggg

SEQ ID NO: 6532143 - DNA, 14 bp, Homo sapiens
ttccacttcctgcc

SEQ ID NO: 6532144 - DNA, 17 bp, Homo sapiens
ttccacttcctgcccca

SEQ ID NO: 6532145 - DNA, 19 bp, Homo sapiens
ttccacttctaactccact

SEQ ID NO: 6532146 - DNA, 18 bp, Homo sapiens
ttccacttcttcctttct

SEQ ID NO: 6532147 - DNA, 21 bp, Homo sapiens
ttccacttcttcctttctctt

SEQ ID NO: 6532148 - DNA, 13 bp, Homo sapiens
ttccacttgccct

SEQ ID NO: 6532149 - DNA, 15 bp, Homo sapiens
ttccactttgttctt

SEQ ID NO: 6532150 - DNA, 22 bp, Homo sapiens
ttccagaaatgtttttggcaac

SEQ ID NO: 6532151 - DNA, 14 bp, Homo sapiens
ttccagaaattctt

SEQ ID NO: 6532152 - DNA, 16 bp, Homo sapiens
ttccagaacaaattgt

SEQ ID NO: 6532153 - DNA, 15 bp, Homo sapiens
ttccagaacagccct

SEQ ID NO: 6532154 - DNA, 19 bp, Homo sapiens
ttccagaacagccctcggc

SEQ ID NO: 6532155 - DNA, 17 bp, Homo sapiens
ttccagaacgccctgtg

SEQ ID NO: 6532156 - DNA, 19 bp, Homo sapiens
ttccagaacgccctgtgtc

SEQ ID NO: 6532157 - DNA, 21 bp, Homo sapiens
ttccagaacgccctgtgtcca

SEQ ID NO: 6532158 - DNA, 20 bp, Homo sapiens
ttccagaacgtctctcacct

SEQ ID NO: 6532159 - DNA, 22 bp, Homo sapiens
ttccagaagaaagatggaaatt

SEQ ID NO: 6532160 - DNA, 16 bp, Homo sapiens
ttccagaagaagagaa

SEQ ID NO: 6532161 - DNA, 21 bp, Homo sapiens
ttccagaagaagagaagctgc

SEQ ID NO: 6532162 - DNA, 21 bp, Homo sapiens
ttccagaaggatttcttgtat

SEQ ID NO: 6532163 - DNA, 21 bp, Homo sapiens
ttccagaagtgtgattgggaa

SEQ ID NO: 6532164 - DNA, 19 bp, Homo sapiens
ttccagaatatctgggatt

SEQ ID NO: 6532165 - DNA, 15 bp, Homo sapiens
ttccagaatcccaag

SEQ ID NO: 6532166 - DNA, 14 bp, Homo sapiens
ttccagaatgacct

SEQ ID NO: 6532167 - DNA, 15 bp, Homo sapiens
ttccagaatgctgta

SEQ ID NO: 6532168 - DNA, 22 bp, Homo sapiens
ttccagaatttggaagctagaa

SEQ ID NO: 6532169 - DNA, 15 bp, Homo sapiens
ttccagaccaaaata

SEQ ID NO: 6532170 - DNA, 14 bp, Homo sapiens
ttccagaccacctg

SEQ ID NO: 6532171 - DNA, 20 bp, Homo sapiens
ttccagaccacctgccagcc

SEQ ID NO: 6532172 - DNA, 16 bp, Homo sapiens
ttccagacctgaagaa

SEQ ID NO: 6532173 - DNA, 13 bp, Homo sapiens
ttccagacctgct

SEQ ID NO: 6532174 - DNA, 18 bp, Homo sapiens
ttccagactcaggttcca

SEQ ID NO: 6532175 - DNA, 19 bp, Homo sapiens
ttccagactcaggttccag

SEQ ID NO: 6532176 - DNA, 20 bp, Homo sapiens
ttccagactcaggttccaga

SEQ ID NO: 6532177 - DNA, 23 bp, Homo sapiens
ttccagactgcttccaattttct

SEQ ID NO: 6532178 - DNA, 14 bp, Homo sapiens
ttccagacttcaaa

SEQ ID NO: 6532179 - DNA, 19 bp, Homo sapiens
ttccagagaacctgtgggc

SEQ ID NO: 6532180 - DNA, 11 bp, Homo sapiens
ttccagagaag

SEQ ID NO: 6532181 - DNA, 17 bp, Homo sapiens
ttccagagagtggctcc

SEQ ID NO: 6532182 - DNA, 20 bp, Homo sapiens
ttccagagagtggctcctcc

SEQ ID NO: 6532183 - DNA, 10 bp, Homo sapiens
ttccagagca

SEQ ID NO: 6532184 - DNA, 15 bp, Homo sapiens
ttccagagctgcttc

SEQ ID NO: 6532185 - DNA, 21 bp, Homo sapiens
ttccagagctgcttctgtctg

SEQ ID NO: 6532186 - DNA, 11 bp, Homo sapiens
ttccagaggac

SEQ ID NO: 6532187 - DNA, 19 bp, Homo sapiens
ttccagaggacagctctgg

SEQ ID NO: 6532188 - DNA, 17 bp, Homo sapiens
ttccagaggactctgct

SEQ ID NO: 6532189 - DNA, 22 bp, Homo sapiens
ttccagagggggccagagggac

SEQ ID NO: 6532190 - DNA, 20 bp, Homo sapiens
ttccagagtccggaggcagc

SEQ ID NO: 6532191 - DNA, 21 bp, Homo sapiens
ttccagagtccggaggcagca

SEQ ID NO: 6532192 - DNA, 15 bp, Homo sapiens
ttccagagttgttgt

SEQ ID NO: 6532193 - DNA, 22 bp, Homo sapiens
ttccagatcccaggcccctgga

SEQ ID NO: 6532194 - DNA, 16 bp, Homo sapiens
ttccagatcctctctg

SEQ ID NO: 6532195 - DNA, 19 bp, Homo sapiens
ttccagatcctggaaatca

SEQ ID NO: 6532196 - DNA, 16 bp, Homo sapiens
ttccagatctttcaga

SEQ ID NO: 6532197 - DNA, 20 bp, Homo sapiens
ttccagatctttcagaaata

SEQ ID NO: 6532198 - DNA, 17 bp, Homo sapiens
ttccagatgcccgagca

SEQ ID NO: 6532199 - DNA, 18 bp, Homo sapiens
ttccagatgctatcacag

SEQ ID NO: 6532200 - DNA, 22 bp, Homo sapiens
ttccagatgtctaaaagattct

SEQ ID NO: 6532201 - DNA, 15 bp, Homo sapiens
ttccagattcccagc

SEQ ID NO: 6532202 - DNA, 14 bp, Homo sapiens
ttccagattcctat

SEQ ID NO: 6532203 - DNA, 16 bp, Homo sapiens
ttccagattcctatga

SEQ ID NO: 6532204 - DNA, 19 bp, Homo sapiens
ttccagattgggggccctg

SEQ ID NO: 6532205 - DNA, 14 bp, Homo sapiens
ttccagattgttct

SEQ ID NO: 6532206 - DNA, 22 bp, Homo sapiens
ttccagattttaaattttatgt

SEQ ID NO: 6532207 - DNA, 14 bp, Homo sapiens
ttccagcaaaatcc

SEQ ID NO: 6532208 - DNA, 15 bp, Homo sapiens
ttccagcaaaatcca

SEQ ID NO: 6532209 - DNA, 18 bp, Homo sapiens
ttccagcaaaatccaaac

SEQ ID NO: 6532210 - DNA, 16 bp, Homo sapiens
ttccagcaaaatggaa

SEQ ID NO: 6532211 - DNA, 17 bp, Homo sapiens
ttccagcaaaatggaag

SEQ ID NO: 6532212 - DNA, 15 bp, Homo sapiens
ttccagcaagcaaag

SEQ ID NO: 6532213 - DNA, 11 bp, Homo sapiens
ttccagcaata

SEQ ID NO: 6532214 - DNA, 13 bp, Homo sapiens
ttccagcaataag

SEQ ID NO: 6532215 - DNA, 16 bp, Homo sapiens
ttccagcaataagaaa

SEQ ID NO: 6532216 - DNA, 19 bp, Homo sapiens
ttccagcaataagaaatga

SEQ ID NO: 6532217 - DNA, 20 bp, Homo sapiens
ttccagcaataagaaatgaa

SEQ ID NO: 6532218 - DNA, 18 bp, Homo sapiens
ttccagcagctgcacccc

SEQ ID NO: 6532219 - DNA, 13 bp, Homo sapiens
ttccagcaggagg

SEQ ID NO: 6532220 - DNA, 23 bp, Homo sapiens
ttccagcaggagggacagtctca

SEQ ID NO: 6532221 - DNA, 21 bp, Homo sapiens
ttccagcagtgaaacttgtgc

SEQ ID NO: 6532222 - DNA, 21 bp, Homo sapiens
ttccagcatgtaaagagctgg

SEQ ID NO: 6532223 - DNA, 15 bp, Homo sapiens
ttccagccaaagcat

SEQ ID NO: 6532224 - DNA, 18 bp, Homo sapiens
ttccagccaggcccaggc

SEQ ID NO: 6532225 - DNA, 15 bp, Homo sapiens
ttccagccagggctg

SEQ ID NO: 6532226 - DNA, 16 bp, Homo sapiens
ttccagccagggctgc

SEQ ID NO: 6532227 - DNA, 12 bp, Homo sapiens
ttccagccatca

SEQ ID NO: 6532228 - DNA, 14 bp, Homo sapiens
ttccagccattctg

SEQ ID NO: 6532229 - DNA, 20 bp, Homo sapiens
ttccagcccagacatcctgt

SEQ ID NO: 6532230 - DNA, 14 bp, Homo sapiens
ttccagcccctctg

SEQ ID NO: 6532231 - DNA, 16 bp, Homo sapiens
ttccagcccctctggt

SEQ ID NO: 6532232 - DNA, 20 bp, Homo sapiens
ttccagcccctctggtcgct

SEQ ID NO: 6532233 - DNA, 19 bp, Homo sapiens
ttccagcctatagcagaag

SEQ ID NO: 6532234 - DNA, 12 bp, Homo sapiens
ttccagcctgcc

SEQ ID NO: 6532235 - DNA, 16 bp, Homo sapiens
ttccagcctgccactc

SEQ ID NO: 6532236 - DNA, 12 bp, Homo sapiens
ttccagcctggg

SEQ ID NO: 6532237 - DNA, 15 bp, Homo sapiens
ttccagcctgggaca

SEQ ID NO: 6532238 - DNA, 20 bp, Homo sapiens
ttccagcctgggacacacac

SEQ ID NO: 6532239 - DNA, 15 bp, Homo sapiens
ttccagcgggccctc

SEQ ID NO: 6532240 - DNA, 13 bp, Homo sapiens
ttccagctcagtc

SEQ ID NO: 6532241 - DNA, 15 bp, Homo sapiens
ttccagctcagtccc

SEQ ID NO: 6532242 - DNA, 19 bp, Homo sapiens
ttccagctcattcatttta

SEQ ID NO: 6532243 - DNA, 18 bp, Homo sapiens
ttccagctccctcccctg

SEQ ID NO: 6532244 - DNA, 16 bp, Homo sapiens
ttccagctccgtgttt

SEQ ID NO: 6532245 - DNA, 18 bp, Homo sapiens
ttccagctccgtgtttct

SEQ ID NO: 6532246 - DNA, 21 bp, Homo sapiens
ttccagctccgtgtttctcta

SEQ ID NO: 6532247 - DNA, 18 bp, Homo sapiens
ttccagctctcccatgga

SEQ ID NO: 6532248 - DNA, 13 bp, Homo sapiens
ttccagctctgcc

SEQ ID NO: 6532249 - DNA, 14 bp, Homo sapiens
ttccagctctgccc

SEQ ID NO: 6532250 - DNA, 16 bp, Homo sapiens
ttccagctctgccccc

SEQ ID NO: 6532251 - DNA, 21 bp, Homo sapiens
ttccagctctgcccccgcggg

SEQ ID NO: 6532252 - DNA, 15 bp, Homo sapiens
ttccagctgctgtct

SEQ ID NO: 6532253 - DNA, 22 bp, Homo sapiens
ttccagctgctgtcttctggac

SEQ ID NO: 6532254 - DNA, 14 bp, Homo sapiens
tggtcacacactga

SEQ ID NO: 6532255 - DNA, 13 bp, Homo sapiens
tggtcacagaccc

SEQ ID NO: 6532256 - DNA, 14 bp, Homo sapiens
tggtcacagacccc

SEQ ID NO: 6532257 - DNA, 21 bp, Homo sapiens
tggtcacagacccctggggga

SEQ ID NO: 6532258 - DNA, 14 bp, Homo sapiens
tggtcacagccagg

SEQ ID NO: 6532259 - DNA, 13 bp, Homo sapiens
tggtcacagcctc

SEQ ID NO: 6532260 - DNA, 16 bp, Homo sapiens
tggtcacagcctcctc

SEQ ID NO: 6532261 - DNA, 17 bp, Homo sapiens
tggtcacagcctcctct

SEQ ID NO: 6532262 - DNA, 18 bp, Homo sapiens
tggtcacagcctcctctg

SEQ ID NO: 6532263 - DNA, 15 bp, Homo sapiens
tggtcacagcggagg

SEQ ID NO: 6532264 - DNA, 21 bp, Homo sapiens
tggtcacagcggaggtgtgga

SEQ ID NO: 6532265 - DNA, 22 bp, Homo sapiens
tggtcacaggactctgcctcct

SEQ ID NO: 6532266 - DNA, 13 bp, Homo sapiens
tggtcacaggctg

SEQ ID NO: 6532267 - DNA, 20 bp, Homo sapiens
tggtcacagtaaagagtaca

SEQ ID NO: 6532268 - DNA, 20 bp, Homo sapiens
tggtcacagtcctatgtaca

SEQ ID NO: 6532269 - DNA, 22 bp, Homo sapiens
tggtcacagtcctatgtacaga

SEQ ID NO: 6532270 - DNA, 23 bp, Homo sapiens
tggtcaccaaatcagctgctact

SEQ ID NO: 6532271 - DNA, 17 bp, Homo sapiens
tggtcaccaaggcagtg

SEQ ID NO: 6532272 - DNA, 22 bp, Homo sapiens
tggtcaccaaggcagtgcatgc

SEQ ID NO: 6532273 - DNA, 15 bp, Homo sapiens
tggtcaccagctcct

SEQ ID NO: 6532274 - DNA, 14 bp, Homo sapiens
tggtcaccatgaaa

SEQ ID NO: 6532275 - DNA, 16 bp, Homo sapiens
tggtcaccatgaaact

SEQ ID NO: 6532276 - DNA, 13 bp, Homo sapiens
tggtcaccctcag

SEQ ID NO: 6532277 - DNA, 15 bp, Homo sapiens
tggtcaccctcagga

SEQ ID NO: 6532278 - DNA, 18 bp, Homo sapiens
tggtcaccctggggctgc

SEQ ID NO: 6532279 - DNA, 22 bp, Homo sapiens
tggtcaccctggggctgcttag

SEQ ID NO: 6532280 - DNA, 16 bp, Homo sapiens
tggtcacccttaatat

SEQ ID NO: 6532281 - DNA, 22 bp, Homo sapiens
tggtcaccgagactcagcctct

SEQ ID NO: 6532282 - DNA, 16 bp, Homo sapiens
tggtcacctaggaagc

SEQ ID NO: 6532283 - DNA, 21 bp, Homo sapiens
tggtcacctaggaagcctcag

SEQ ID NO: 6532284 - DNA, 22 bp, Homo sapiens
tggtcacctaggaagcctcaga

SEQ ID NO: 6532285 - DNA, 19 bp, Homo sapiens
tggtcaccttcctctgcct

SEQ ID NO: 6532286 - DNA, 19 bp, Homo sapiens
tggtcacggatttgtgtct

SEQ ID NO: 6532287 - DNA, 19 bp, Homo sapiens
tggtcacgtttggtgcttc

SEQ ID NO: 6532288 - DNA, 18 bp, Homo sapiens
tggtcactaaccaacaag

SEQ ID NO: 6532289 - DNA, 13 bp, Homo sapiens
tggtcactccagt

SEQ ID NO: 6532290 - DNA, 14 bp, Homo sapiens
tggtcactccagta

SEQ ID NO: 6532291 - DNA, 14 bp, Homo sapiens
tggtcactgctgtc

SEQ ID NO: 6532292 - DNA, 20 bp, Homo sapiens
tggtcactggtcagggcagt

SEQ ID NO: 6532293 - DNA, 19 bp, Homo sapiens
tggtcactgtgcactgccc

SEQ ID NO: 6532294 - DNA, 22 bp, Homo sapiens
tggtcacttaaaatgtgcagta

SEQ ID NO: 6532295 - DNA, 24 bp, Homo sapiens
tggtcacttcaaacatgccctcag

SEQ ID NO: 6532296 - DNA, 19 bp, Homo sapiens
tggtcagaactgcagggcc

SEQ ID NO: 6532297 - DNA, 22 bp, Homo sapiens
tggtcagacacaaacaaacaag

SEQ ID NO: 6532298 - DNA, 12 bp, Homo sapiens
tggtcagagcca

SEQ ID NO: 6532299 - DNA, 14 bp, Homo sapiens
tggtcagagcccag

SEQ ID NO: 6532300 - DNA, 10 bp, Homo sapiens
tggtcagagg

SEQ ID NO: 6532301 - DNA, 22 bp, Homo sapiens
tggtcagagggactgtcagctg

SEQ ID NO: 6532302 - DNA, 17 bp, Homo sapiens
tggtcagagtgaattga

SEQ ID NO: 6532303 - DNA, 15 bp, Homo sapiens
tggtcagagtgccac

SEQ ID NO: 6532304 - DNA, 17 bp, Homo sapiens
tggtcagagtgccactg

SEQ ID NO: 6532305 - DNA, 21 bp, Homo sapiens
tggtcagcagatgccagtgaa

SEQ ID NO: 6532306 - DNA, 19 bp, Homo sapiens
tggtcagccctagggtgga

SEQ ID NO: 6532307 - DNA, 20 bp, Homo sapiens
tggtcagcgattcctgccaa

SEQ ID NO: 6532308 - DNA, 18 bp, Homo sapiens
tggtcagcggcctgggga

SEQ ID NO: 6532309 - DNA, 14 bp, Homo sapiens
tggtcagctcacac

SEQ ID NO: 6532310 - DNA, 19 bp, Homo sapiens
tggtcagctcccttctctg

SEQ ID NO: 6532311 - DNA, 17 bp, Homo sapiens
tggtcagcttgctcaga

SEQ ID NO: 6532312 - DNA, 15 bp, Homo sapiens
tggtcagcttttgtt

SEQ ID NO: 6532313 - DNA, 20 bp, Homo sapiens
tggtcaggaagtttgcagat

SEQ ID NO: 6532314 - DNA, 23 bp, Homo sapiens
tggtcaggagggtcaccctggcc

SEQ ID NO: 6532315 - DNA, 19 bp, Homo sapiens
tggtcaggatctcatgaca

SEQ ID NO: 6532316 - DNA, 18 bp, Homo sapiens
tggtcaggcccactgcag

SEQ ID NO: 6532317 - DNA, 15 bp, Homo sapiens
tggtcaggcccagcc

SEQ ID NO: 6532318 - DNA, 17 bp, Homo sapiens
tggtcaggcccagcctc

SEQ ID NO: 6532319 - DNA, 15 bp, Homo sapiens
tggtcaggccctggt

SEQ ID NO: 6532320 - DNA, 13 bp, Homo sapiens
tggtcaggctggt

SEQ ID NO: 6532321 - DNA, 13 bp, Homo sapiens
tggtcagggcagt

SEQ ID NO: 6532322 - DNA, 15 bp, Homo sapiens
tggtcagggcagtgg

SEQ ID NO: 6532323 - DNA, 21 bp, Homo sapiens
tggtcaggtatttcagttctt

SEQ ID NO: 6532324 - DNA, 19 bp, Homo sapiens
tggtcaggtccccatggct

SEQ ID NO: 6532325 - DNA, 22 bp, Homo sapiens
tggtcagtagtttcatgtttta

SEQ ID NO: 6532326 - DNA, 15 bp, Homo sapiens
tggtcagtctttgct

SEQ ID NO: 6532327 - DNA, 21 bp, Homo sapiens
tggtcagtgtggagaggggtg

SEQ ID NO: 6532328 - DNA, 21 bp, Homo sapiens
tggtcatagcccagatcagct

SEQ ID NO: 6532329 - DNA, 19 bp, Homo sapiens
tggtcatcagtattgtgta

SEQ ID NO: 6532330 - DNA, 21 bp, Homo sapiens
tggtcatccttggtgctcttg

SEQ ID NO: 6532331 - DNA, 19 bp, Homo sapiens
tggtcatcgagatggagct

SEQ ID NO: 6532332 - DNA, 18 bp, Homo sapiens
tggtcatctctcctgtgt

SEQ ID NO: 6532333 - DNA, 15 bp, Homo sapiens
tggtcatgaatagaa

SEQ ID NO: 6532334 - DNA, 13 bp, Homo sapiens
tggtcatgctcag

SEQ ID NO: 6532335 - DNA, 14 bp, Homo sapiens
tggtcatgctcagc

SEQ ID NO: 6532336 - DNA, 21 bp, Homo sapiens
tggtcatgctcagccttgctg

SEQ ID NO: 6532337 - DNA, 13 bp, Homo sapiens
tggtcatggacag

SEQ ID NO: 6532338 - DNA, 18 bp, Homo sapiens
tggtcatgggtctgccct

SEQ ID NO: 6532339 - DNA, 20 bp, Homo sapiens
tggtcatgtgagtctgggat

SEQ ID NO: 6532340 - DNA, 21 bp, Homo sapiens
tggtcatgtgagtctgggata

SEQ ID NO: 6532341 - DNA, 23 bp, Homo sapiens
tggtcattcatatcactatgaac

SEQ ID NO: 6532342 - DNA, 16 bp, Homo sapiens
tggtcatttcccccaa

SEQ ID NO: 6532343 - DNA, 22 bp, Homo sapiens
tggtcatttggcagcccctgtt

SEQ ID NO: 6532344 - DNA, 18 bp, Homo sapiens
tggtcatttggtggctct

SEQ ID NO: 6532345 - DNA, 18 bp, Homo sapiens
tggtcattttatgttaag

SEQ ID NO: 6532346 - DNA, 23 bp, Homo sapiens
tggtccaaaagattgctgaaatt

SEQ ID NO: 6532347 - DNA, 21 bp, Homo sapiens
tggtccaaaataaaacctcag

SEQ ID NO: 6532348 - DNA, 14 bp, Homo sapiens
tggtccaacagttt

SEQ ID NO: 6532349 - DNA, 16 bp, Homo sapiens
tggtccaactgcaact

SEQ ID NO: 6532350 - DNA, 15 bp, Homo sapiens
tggtccaagattccg

SEQ ID NO: 6532351 - DNA, 18 bp, Homo sapiens
tggtccaattagtttcct

SEQ ID NO: 6532352 - DNA, 23 bp, Homo sapiens
tggtccaattagtttccttttta

SEQ ID NO: 6532353 - DNA, 23 bp, Homo sapiens
tggtccacactagaaagaagctc

SEQ ID NO: 6532354 - DNA, 13 bp, Homo sapiens
tggtccacagggc

SEQ ID NO: 6532355 - DNA, 15 bp, Homo sapiens
tggtccacagggcac

SEQ ID NO: 6532356 - DNA, 22 bp, Homo sapiens
tggtccacagggctcctgaagg

SEQ ID NO: 6532357 - DNA, 17 bp, Homo sapiens
tggtccacattctgctg

SEQ ID NO: 6532358 - DNA, 12 bp, Homo sapiens
tggtccactgtg

SEQ ID NO: 6532359 - DNA, 13 bp, Homo sapiens
tggtccactgtgt

SEQ ID NO: 6532360 - DNA, 17 bp, Homo sapiens
tggtccagaaacaaaaa

SEQ ID NO: 6532361 - DNA, 13 bp, Homo sapiens
tggtccagaaact

SEQ ID NO: 6532362 - DNA, 21 bp, Homo sapiens
tggtccagaaactcctgtttc

SEQ ID NO: 6532363 - DNA, 21 bp, Homo sapiens
tggtccagaagaaattattta

SEQ ID NO: 6532364 - DNA, 14 bp, Homo sapiens
tggtccagcctggt

SEQ ID NO: 6532365 - DNA, 15 bp, Homo sapiens
tggtccagctctgac

SEQ ID NO: 6532366 - DNA, 16 bp, Homo sapiens
tggtccagctctgaca

SEQ ID NO: 6532367 - DNA, 18 bp, Homo sapiens
tggtccagctctgacatc

SEQ ID NO: 6532368 - DNA, 20 bp, Homo sapiens
tggtccagctctgacatccc

SEQ ID NO: 6532369 - DNA, 15 bp, Homo sapiens
tggtccagctcttgg

SEQ ID NO: 6532370 - DNA, 13 bp, Homo sapiens
tggtccaggccag

SEQ ID NO: 6532371 - DNA, 19 bp, Homo sapiens
tggtccaggccctgtggca

SEQ ID NO: 6532372 - DNA, 16 bp, Homo sapiens
tggtccagggtccagc

SEQ ID NO: 6532373 - DNA, 21 bp, Homo sapiens
tggtccaggtcttcagtttcc

SEQ ID NO: 6532374 - DNA, 22 bp, Homo sapiens
tggtccagtcgggaggagcagc

SEQ ID NO: 6532375 - DNA, 23 bp, Homo sapiens
tggtccagtttctagagggcact

SEQ ID NO: 6532376 - DNA, 14 bp, Homo sapiens
tggtccatctcatt

SEQ ID NO: 6532377 - DNA, 15 bp, Homo sapiens
tggtccatgcagggg

SEQ ID NO: 6532378 - DNA, 12 bp, Homo sapiens
tggtccatgccc

SEQ ID NO: 6532379 - DNA, 13 bp, Homo sapiens
tggtccatgccca

SEQ ID NO: 6532380 - DNA, 18 bp, Homo sapiens
tggtccatgcccactgct

SEQ ID NO: 6532381 - DNA, 19 bp, Homo sapiens
tggtccatgcccactgctg

SEQ ID NO: 6532382 - DNA, 15 bp, Homo sapiens
tggtccatgctgatg

SEQ ID NO: 6532383 - DNA, 16 bp, Homo sapiens
tggtccatttgttcct

SEQ ID NO: 6532384 - DNA, 21 bp, Homo sapiens
tggtcccaacaggaggacaat

SEQ ID NO: 6532385 - DNA, 18 bp, Homo sapiens
tggtcccaagacagtgag

SEQ ID NO: 6532386 - DNA, 13 bp, Homo sapiens
tggtcccacccca

SEQ ID NO: 6532387 - DNA, 17 bp, Homo sapiens
tggtcccacttcacagc

SEQ ID NO: 6532388 - DNA, 20 bp, Homo sapiens
tggtcccacttccccatctg

SEQ ID NO: 6532389 - DNA, 17 bp, Homo sapiens
tggtcccaggaagcagg

SEQ ID NO: 6532390 - DNA, 13 bp, Homo sapiens
tggtcccatccag

SEQ ID NO: 6532391 - DNA, 15 bp, Homo sapiens
tggtcccatccaggc

SEQ ID NO: 6532392 - DNA, 17 bp, Homo sapiens
tggtcccatccaggcag

SEQ ID NO: 6532393 - DNA, 18 bp, Homo sapiens
tggtcccatccaggcagt

SEQ ID NO: 6532394 - DNA, 13 bp, Homo sapiens
tggtcccatggct

SEQ ID NO: 6532395 - DNA, 20 bp, Homo sapiens
tggtccccaaaacactgtct

SEQ ID NO: 6532396 - DNA, 19 bp, Homo sapiens
tggtccccaacaatgtgag

SEQ ID NO: 6532397 - DNA, 14 bp, Homo sapiens
tggtcccccttcca

SEQ ID NO: 6532398 - DNA, 13 bp, Homo sapiens
tggtcccctccct

SEQ ID NO: 6532399 - DNA, 18 bp, Homo sapiens
tggtcccctccctcgtgg

SEQ ID NO: 6532400 - DNA, 21 bp, Homo sapiens
tggtcccctccctcgtgggct

SEQ ID NO: 6532401 - DNA, 20 bp, Homo sapiens
tggtcccgtggatgctcttt

SEQ ID NO: 6532402 - DNA, 21 bp, Homo sapiens
tggtccctaaatttgcatgaa

SEQ ID NO: 6532403 - DNA, 14 bp, Homo sapiens
tggtccctgggagg

SEQ ID NO: 6532404 - DNA, 19 bp, Homo sapiens
tggtccctgggaggaaatt

SEQ ID NO: 6532405 - DNA, 21 bp, Homo sapiens
tggtccctgggccaccgggca

SEQ ID NO: 6532406 - DNA, 13 bp, Homo sapiens
tggtcccttcagt

SEQ ID NO: 6532407 - DNA, 18 bp, Homo sapiens
tggtcccttccaatgctg

SEQ ID NO: 6532408 - DNA, 23 bp, Homo sapiens
tggtcccttgtatcccctgcagg

SEQ ID NO: 6532409 - DNA, 22 bp, Homo sapiens
tggtccgtgcgggaaattcagt

SEQ ID NO: 6532410 - DNA, 18 bp, Homo sapiens
tggtccgtgctaaggact

SEQ ID NO: 6532411 - DNA, 17 bp, Homo sapiens
tggtcctaaaagcaaaa

SEQ ID NO: 6532412 - DNA, 12 bp, Homo sapiens
tggtcctaccca

SEQ ID NO: 6532413 - DNA, 17 bp, Homo sapiens
tggtcctagaggccctt

SEQ ID NO: 6532414 - DNA, 21 bp, Homo sapiens
tggtcctagaggccctttgct

SEQ ID NO: 6532415 - DNA, 23 bp, Homo sapiens
tggtcctaggctggaaggaggaa

SEQ ID NO: 6532416 - DNA, 21 bp, Homo sapiens
tggtcctatttttgtgaagag

SEQ ID NO: 6532417 - DNA, 23 bp, Homo sapiens
tggtcctcacaagcctcttctga

SEQ ID NO: 6532418 - DNA, 16 bp, Homo sapiens
tggtcctccctcccaa

SEQ ID NO: 6532419 - DNA, 17 bp, Homo sapiens
tggtcctccgcctactg

SEQ ID NO: 6532420 - DNA, 23 bp, Homo sapiens
tggtcctccgcctactgtccctc

SEQ ID NO: 6532421 - DNA, 23 bp, Homo sapiens
tggtcctctctctgtggggctga

SEQ ID NO: 6532422 - DNA, 19 bp, Homo sapiens
tggtcctctgatttcacat

SEQ ID NO: 6532423 - DNA, 19 bp, Homo sapiens
tggtcctgactcaacatgt

SEQ ID NO: 6532424 - DNA, 18 bp, Homo sapiens
tggtcctgacttccctgg

SEQ ID NO: 6532425 - DNA, 17 bp, Homo sapiens
tggtcctgcacatgagt

SEQ ID NO: 6532426 - DNA, 13 bp, Homo sapiens
tggtcctgctgca

SEQ ID NO: 6532427 - DNA, 15 bp, Homo sapiens
tggtcctgctgcagt

SEQ ID NO: 6532428 - DNA, 20 bp, Homo sapiens
tggtcctggacacctcccag

SEQ ID NO: 6532429 - DNA, 20 bp, Homo sapiens
tggtcctggaggctcaaatt

SEQ ID NO: 6532430 - DNA, 17 bp, Homo sapiens
tggtcctggctgcactc

SEQ ID NO: 6532431 - DNA, 20 bp, Homo sapiens
ttccagctgtcactctgtgc

SEQ ID NO: 6532432 - DNA, 18 bp, Homo sapiens
ttccagcttcaggcacca

SEQ ID NO: 6532433 - DNA, 22 bp, Homo sapiens
ttccagcttcaggcaccagcat

SEQ ID NO: 6532434 - DNA, 16 bp, Homo sapiens
ttccagcttccagaac

SEQ ID NO: 6532435 - DNA, 18 bp, Homo sapiens
ttccagcttccagaactg

SEQ ID NO: 6532436 - DNA, 19 bp, Homo sapiens
ttccagcttcctctgagcc

SEQ ID NO: 6532437 - DNA, 13 bp, Homo sapiens
ttccagcttttgt

SEQ ID NO: 6532438 - DNA, 21 bp, Homo sapiens
ttccaggaaactccacatctg

SEQ ID NO: 6532439 - DNA, 18 bp, Homo sapiens
ttccaggaagatccagga

SEQ ID NO: 6532440 - DNA, 17 bp, Homo sapiens
ttccaggaagcacaggc

SEQ ID NO: 6532441 - DNA, 16 bp, Homo sapiens
ttccaggaatgctggg

SEQ ID NO: 6532442 - DNA, 18 bp, Homo sapiens
ttccaggaatgctgggcc

SEQ ID NO: 6532443 - DNA, 14 bp, Homo sapiens
ttccaggaattcct

SEQ ID NO: 6532444 - DNA, 14 bp, Homo sapiens
ttccaggactcttt

SEQ ID NO: 6532445 - DNA, 16 bp, Homo sapiens
ttccaggactgtttca

SEQ ID NO: 6532446 - DNA, 18 bp, Homo sapiens
ttccaggagaaagccggg

SEQ ID NO: 6532447 - DNA, 18 bp, Homo sapiens
ttccaggagacatatata

SEQ ID NO: 6532448 - DNA, 21 bp, Homo sapiens
ttccaggagcacacggccctg

SEQ ID NO: 6532449 - DNA, 23 bp, Homo sapiens
ttccaggagcacacggccctgcc

SEQ ID NO: 6532450 - DNA, 23 bp, Homo sapiens
ttccaggaggagttagccaaaca

SEQ ID NO: 6532451 - DNA, 17 bp, Homo sapiens
ttccaggagttctgaag

SEQ ID NO: 6532452 - DNA, 14 bp, Homo sapiens
ttccaggatggtgt

SEQ ID NO: 6532453 - DNA, 11 bp, Homo sapiens
ttccaggcagc

SEQ ID NO: 6532454 - DNA, 11 bp, Homo sapiens
ttccaggcccc

SEQ ID NO: 6532455 - DNA, 17 bp, Homo sapiens
ttccaggccccaggctg

SEQ ID NO: 6532456 - DNA, 19 bp, Homo sapiens
ttccaggccccaggctgga

SEQ ID NO: 6532457 - DNA, 13 bp, Homo sapiens
ttccaggcccctg

SEQ ID NO: 6532458 - DNA, 16 bp, Homo sapiens
ttccaggccctccagt

SEQ ID NO: 6532459 - DNA, 19 bp, Homo sapiens
ttccaggcgtagggccagg

SEQ ID NO: 6532460 - DNA, 11 bp, Homo sapiens
ttccaggctga

SEQ ID NO: 6532461 - DNA, 15 bp, Homo sapiens
ttccaggctgagcca

SEQ ID NO: 6532462 - DNA, 20 bp, Homo sapiens
ttccaggctgcatagaagga

SEQ ID NO: 6532463 - DNA, 15 bp, Homo sapiens
ttccaggctgggaga

SEQ ID NO: 6532464 - DNA, 17 bp, Homo sapiens
ttccaggctgggagagc

SEQ ID NO: 6532465 - DNA, 12 bp, Homo sapiens
ttccaggctgtg

SEQ ID NO: 6532466 - DNA, 22 bp, Homo sapiens
ttccaggcttctgctggggcct

SEQ ID NO: 6532467 - DNA, 19 bp, Homo sapiens
ttccagggcataaaactca

SEQ ID NO: 6532468 - DNA, 14 bp, Homo sapiens
ttccagggctgggg

SEQ ID NO: 6532469 - DNA, 15 bp, Homo sapiens
ttccaggggaacctg

SEQ ID NO: 6532470 - DNA, 17 bp, Homo sapiens
ttccaggggaacctgcc

SEQ ID NO: 6532471 - DNA, 18 bp, Homo sapiens
ttccaggggaacctgcca

SEQ ID NO: 6532472 - DNA, 21 bp, Homo sapiens
ttccaggggtgggacaccctg

SEQ ID NO: 6532473 - DNA, 22 bp, Homo sapiens
ttccagggtcaaagtacagaat

SEQ ID NO: 6532474 - DNA, 22 bp, Homo sapiens
ttccagggtctttactgggaag

SEQ ID NO: 6532475 - DNA, 16 bp, Homo sapiens
ttccaggtaacaggtg

SEQ ID NO: 6532476 - DNA, 22 bp, Homo sapiens
ttccaggtagctgaaaggggaa

SEQ ID NO: 6532477 - DNA, 17 bp, Homo sapiens
ttccaggtatctccagg

SEQ ID NO: 6532478 - DNA, 15 bp, Homo sapiens
ttccaggtctgcctg

SEQ ID NO: 6532479 - DNA, 17 bp, Homo sapiens
ttccaggtctgcctggt

SEQ ID NO: 6532480 - DNA, 19 bp, Homo sapiens
ttccaggtgcctggccctt

SEQ ID NO: 6532481 - DNA, 17 bp, Homo sapiens
ttccaggtgtttatagt

SEQ ID NO: 6532482 - DNA, 13 bp, Homo sapiens
ttccagtaacttt

SEQ ID NO: 6532483 - DNA, 17 bp, Homo sapiens
ttccagtacctttgtca

SEQ ID NO: 6532484 - DNA, 18 bp, Homo sapiens
ttccagtacctttgtcac

SEQ ID NO: 6532485 - DNA, 14 bp, Homo sapiens
ttccagtattgaaa

SEQ ID NO: 6532486 - DNA, 15 bp, Homo sapiens
ttccagtattgaaaa

SEQ ID NO: 6532487 - DNA, 12 bp, Homo sapiens
ttccagtcacat

SEQ ID NO: 6532488 - DNA, 22 bp, Homo sapiens
ttccagtcaggctctctgggct

SEQ ID NO: 6532489 - DNA, 14 bp, Homo sapiens
ttccagtcctaaca

SEQ ID NO: 6532490 - DNA, 17 bp, Homo sapiens
ttccagtcctaacaaat

SEQ ID NO: 6532491 - DNA, 22 bp, Homo sapiens
ttccagtcgggggaactgaggc

SEQ ID NO: 6532492 - DNA, 18 bp, Homo sapiens
ttccagtctctgcatgta

SEQ ID NO: 6532493 - DNA, 22 bp, Homo sapiens
ttccagtgaaatcagttactct

SEQ ID NO: 6532494 - DNA, 17 bp, Homo sapiens
ttccagtgaacattccc

SEQ ID NO: 6532495 - DNA, 23 bp, Homo sapiens
ttccagtgaacattcccagccca

SEQ ID NO: 6532496 - DNA, 16 bp, Homo sapiens
ttccagtgaggctctg

SEQ ID NO: 6532497 - DNA, 22 bp, Homo sapiens
ttccagtgatgtgtgagctatg

SEQ ID NO: 6532498 - DNA, 22 bp, Homo sapiens
ttccagtgcagtagtgccaaaa

SEQ ID NO: 6532499 - DNA, 13 bp, Homo sapiens
ttccagtgcatgt

SEQ ID NO: 6532500 - DNA, 14 bp, Homo sapiens
ttccagtggatgag

SEQ ID NO: 6532501 - DNA, 17 bp, Homo sapiens
ttccagtggcctggctc

SEQ ID NO: 6532502 - DNA, 14 bp, Homo sapiens
ttccagtggcttct

SEQ ID NO: 6532503 - DNA, 17 bp, Homo sapiens
ttccagtgggttatctt

SEQ ID NO: 6532504 - DNA, 22 bp, Homo sapiens
ttccagtggtcatgctcagcct

SEQ ID NO: 6532505 - DNA, 18 bp, Homo sapiens
ttccagtgtccttagaac

SEQ ID NO: 6532506 - DNA, 11 bp, Homo sapiens
ttccagtgtgt

SEQ ID NO: 6532507 - DNA, 13 bp, Homo sapiens
ttccagtgttcta

SEQ ID NO: 6532508 - DNA, 20 bp, Homo sapiens
ttccagtgttggctgtgtga

SEQ ID NO: 6532509 - DNA, 16 bp, Homo sapiens
ttccagttaacctatt

SEQ ID NO: 6532510 - DNA, 22 bp, Homo sapiens
ttccagttcatctatggcagtc

SEQ ID NO: 6532511 - DNA, 18 bp, Homo sapiens
ttccagttgcgtgtctgt

SEQ ID NO: 6532512 - DNA, 17 bp, Homo sapiens
ttccagttgctgtggac

SEQ ID NO: 6532513 - DNA, 13 bp, Homo sapiens
ttccagtttctcc

SEQ ID NO: 6532514 - DNA, 17 bp, Homo sapiens
ttccagtttctccttga

SEQ ID NO: 6532515 - DNA, 20 bp, Homo sapiens
ttccagtttgtttattactt

SEQ ID NO: 6532516 - DNA, 15 bp, Homo sapiens
ttccataaacaccca

SEQ ID NO: 6532517 - DNA, 15 bp, Homo sapiens
ttccataagctattt

SEQ ID NO: 6532518 - DNA, 16 bp, Homo sapiens
ttccataagctatttt

SEQ ID NO: 6532519 - DNA, 17 bp, Homo sapiens
ttccataaggaatgtag

SEQ ID NO: 6532520 - DNA, 22 bp, Homo sapiens
ttccataatctggactcctctg

SEQ ID NO: 6532521 - DNA, 19 bp, Homo sapiens
ttccataatgtataaagaa

SEQ ID NO: 6532522 - DNA, 13 bp, Homo sapiens
ttccataattatg

SEQ ID NO: 6532523 - DNA, 14 bp, Homo sapiens
ttccataattatga

SEQ ID NO: 6532524 - DNA, 22 bp, Homo sapiens
ttccatacgtgcccatttcaca

SEQ ID NO: 6532525 - DNA, 17 bp, Homo sapiens
ttccatacttctctcag

SEQ ID NO: 6532526 - DNA, 18 bp, Homo sapiens
ttccataggaatcatgtt

SEQ ID NO: 6532527 - DNA, 23 bp, Homo sapiens
ttccatagtatattaaaaatggt

SEQ ID NO: 6532528 - DNA, 16 bp, Homo sapiens
ttccatagttaaagaa

SEQ ID NO: 6532529 - DNA, 23 bp, Homo sapiens
ttccatatccgggtgctcaataa

SEQ ID NO: 6532530 - DNA, 21 bp, Homo sapiens
ttccatatcttgcgaatccaa

SEQ ID NO: 6532531 - DNA, 14 bp, Homo sapiens
ttccatatgctcca

SEQ ID NO: 6532532 - DNA, 22 bp, Homo sapiens
ttccatatggatccactggctg

SEQ ID NO: 6532533 - DNA, 12 bp, Homo sapiens
ttccatattaaa

SEQ ID NO: 6532534 - DNA, 18 bp, Homo sapiens
ttccatattaaaatcaca

SEQ ID NO: 6532535 - DNA, 21 bp, Homo sapiens
ttccatattagaaaactttgt

SEQ ID NO: 6532536 - DNA, 14 bp, Homo sapiens
ttccatattcatgt

SEQ ID NO: 6532537 - DNA, 13 bp, Homo sapiens
ttccatatttgga

SEQ ID NO: 6532538 - DNA, 13 bp, Homo sapiens
ttccatatttttt

SEQ ID NO: 6532539 - DNA, 23 bp, Homo sapiens
ttccatatttttttccttacata

SEQ ID NO: 6532540 - DNA, 21 bp, Homo sapiens
ttccatcaaagccctccctgt

SEQ ID NO: 6532541 - DNA, 20 bp, Homo sapiens
ttccatcacagccagcccag

SEQ ID NO: 6532542 - DNA, 19 bp, Homo sapiens
ttccatcaccccaacctct

SEQ ID NO: 6532543 - DNA, 15 bp, Homo sapiens
ttccatcagcagtga

SEQ ID NO: 6532544 - DNA, 19 bp, Homo sapiens
ttccatcagcagtgattga

SEQ ID NO: 6532545 - DNA, 23 bp, Homo sapiens
ttccatcagcgggtctcctccca

SEQ ID NO: 6532546 - DNA, 15 bp, Homo sapiens
ttccatcagctttat

SEQ ID NO: 6532547 - DNA, 19 bp, Homo sapiens
ttccatcaggttccatccc

SEQ ID NO: 6532548 - DNA, 13 bp, Homo sapiens
ttccatcatcact

SEQ ID NO: 6532549 - DNA, 15 bp, Homo sapiens
ttccatcatcactgt

SEQ ID NO: 6532550 - DNA, 16 bp, Homo sapiens
ttccatcatcactgta

SEQ ID NO: 6532551 - DNA, 18 bp, Homo sapiens
ttccatcatcactgtaaa

SEQ ID NO: 6532552 - DNA, 19 bp, Homo sapiens
ttccatcatcactgtaaag

SEQ ID NO: 6532553 - DNA, 18 bp, Homo sapiens
ttccatcatcactttgga

SEQ ID NO: 6532554 - DNA, 23 bp, Homo sapiens
ttccatcatctcttttcccactc

SEQ ID NO: 6532555 - DNA, 16 bp, Homo sapiens
ttccatcatgtcccca

SEQ ID NO: 6532556 - DNA, 17 bp, Homo sapiens
ttccatcatgtccccaa

SEQ ID NO: 6532557 - DNA, 15 bp, Homo sapiens
ttccatcatgtctgt

SEQ ID NO: 6532558 - DNA, 13 bp, Homo sapiens
ttccatcatttta

SEQ ID NO: 6532559 - DNA, 19 bp, Homo sapiens
ttccatcattttacagtga

SEQ ID NO: 6532560 - DNA, 19 bp, Homo sapiens
ttccatccacctttcccaa

SEQ ID NO: 6532561 - DNA, 23 bp, Homo sapiens
ttccatccataaatccagttcta

SEQ ID NO: 6532562 - DNA, 22 bp, Homo sapiens
ttccatccatctttccatccat

SEQ ID NO: 6532563 - DNA, 15 bp, Homo sapiens
ttccatccatggcca

SEQ ID NO: 6532564 - DNA, 17 bp, Homo sapiens
ttccatccatggccagc

SEQ ID NO: 6532565 - DNA, 18 bp, Homo sapiens
ttccatccatggccagca

SEQ ID NO: 6532566 - DNA, 13 bp, Homo sapiens
ttccatcccactc

SEQ ID NO: 6532567 - DNA, 20 bp, Homo sapiens
ttccatcccctagaaatcct

SEQ ID NO: 6532568 - DNA, 12 bp, Homo sapiens
ttccatccctaa

SEQ ID NO: 6532569 - DNA, 20 bp, Homo sapiens
ttccatcctgaggtgcctcc

SEQ ID NO: 6532570 - DNA, 19 bp, Homo sapiens
ttccatcctgtacaagtgc

SEQ ID NO: 6532571 - DNA, 20 bp, Homo sapiens
ttccatcctgtacaagtgct

SEQ ID NO: 6532572 - DNA, 21 bp, Homo sapiens
ttccatcctgtacaagtgctc

SEQ ID NO: 6532573 - DNA, 22 bp, Homo sapiens
ttccatcctgtacaagtgctca

SEQ ID NO: 6532574 - DNA, 17 bp, Homo sapiens
ttccatccttgactgaa

SEQ ID NO: 6532575 - DNA, 19 bp, Homo sapiens
ttccatcctttgcatttct

SEQ ID NO: 6532576 - DNA, 21 bp, Homo sapiens
ttccatcctttgcatttctct

SEQ ID NO: 6532577 - DNA, 15 bp, Homo sapiens
ttccatctaaaatac

SEQ ID NO: 6532578 - DNA, 14 bp, Homo sapiens
ttccatctaggact

SEQ ID NO: 6532579 - DNA, 13 bp, Homo sapiens
ttccatctagttt

SEQ ID NO: 6532580 - DNA, 17 bp, Homo sapiens
ttccatctatcactgca

SEQ ID NO: 6532581 - DNA, 23 bp, Homo sapiens
ttccatctcgccacccctccttc

SEQ ID NO: 6532582 - DNA, 12 bp, Homo sapiens
ttccatctctgc

SEQ ID NO: 6532583 - DNA, 16 bp, Homo sapiens
ttccatctcttccttt

SEQ ID NO: 6532584 - DNA, 12 bp, Homo sapiens
ttccatctgatt

SEQ ID NO: 6532585 - DNA, 22 bp, Homo sapiens
ttccatctgcttgtattttcca

SEQ ID NO: 6532586 - DNA, 18 bp, Homo sapiens
ttccatcttacttgccct

SEQ ID NO: 6532587 - DNA, 23 bp, Homo sapiens
ttccatcttattcccaattaaaa

SEQ ID NO: 6532588 - DNA, 22 bp, Homo sapiens
ttccatcttctccccacagcct

SEQ ID NO: 6532589 - DNA, 12 bp, Homo sapiens
ttccatcttgct

SEQ ID NO: 6532590 - DNA, 16 bp, Homo sapiens
ttccatgaaggcagag

SEQ ID NO: 6532591 - DNA, 15 bp, Homo sapiens
ttccatgaatcgctt

SEQ ID NO: 6532592 - DNA, 20 bp, Homo sapiens
ttccatgaatgtatcaggaa

SEQ ID NO: 6532593 - DNA, 17 bp, Homo sapiens
ttccatgaatgttcctg

SEQ ID NO: 6532594 - DNA, 13 bp, Homo sapiens
ttccatgaatttt

SEQ ID NO: 6532595 - DNA, 13 bp, Homo sapiens
ttccatgacagta

SEQ ID NO: 6532596 - DNA, 14 bp, Homo sapiens
ttccatgacatttt

SEQ ID NO: 6532597 - DNA, 19 bp, Homo sapiens
ttccatgacctcccctccc

SEQ ID NO: 6532598 - DNA, 22 bp, Homo sapiens
ttccatgacctcccctccccag

SEQ ID NO: 6532599 - DNA, 18 bp, Homo sapiens
ttccatgagaacagcagg

SEQ ID NO: 6532600 - DNA, 15 bp, Homo sapiens
ttccatgatgcacag

SEQ ID NO: 6532601 - DNA, 20 bp, Homo sapiens
ttccatgatgcacagtatct

SEQ ID NO: 6532602 - DNA, 20 bp, Homo sapiens
ttccatgatggattcccccc

SEQ ID NO: 6532603 - DNA, 17 bp, Homo sapiens
ttccatgatgttacatt

SEQ ID NO: 6532604 - DNA, 17 bp, Homo sapiens
ttccatgattctattta

SEQ ID NO: 6532605 - DNA, 18 bp, Homo sapiens
ttccatgattctatttat

SEQ ID NO: 6532606 - DNA, 14 bp, Homo sapiens
ttccatgcaactgg

SEQ ID NO: 6532607 - DNA, 14 bp, Homo sapiens
ttccatgccccagg

SEQ ID NO: 6532608 - DNA, 15 bp, Homo sapiens
ttccatgccccagga

SEQ ID NO: 6532609 - DNA, 23 bp, Homo sapiens
ttccatgcccgagtccgcccatc

SEQ ID NO: 6532610 - DNA, 19 bp, Homo sapiens
tggtcctggctgcactctt

SEQ ID NO: 6532611 - DNA, 14 bp, Homo sapiens
tggtcctggtgctg

SEQ ID NO: 6532612 - DNA, 15 bp, Homo sapiens
tggtcctggtgctgc

SEQ ID NO: 6532613 - DNA, 21 bp, Homo sapiens
tggtcctgtcaccctggcccc

SEQ ID NO: 6532614 - DNA, 17 bp, Homo sapiens
tggtcctgtctgtcctt

SEQ ID NO: 6532615 - DNA, 18 bp, Homo sapiens
tggtcctgtctgtccttc

SEQ ID NO: 6532616 - DNA, 16 bp, Homo sapiens
tggtcctgtgccccga

SEQ ID NO: 6532617 - DNA, 20 bp, Homo sapiens
tggtcctgtgtgcagtgaag

SEQ ID NO: 6532618 - DNA, 16 bp, Homo sapiens
tggtccttaccagaga

SEQ ID NO: 6532619 - DNA, 22 bp, Homo sapiens
tggtccttaggagacgctgcac

SEQ ID NO: 6532620 - DNA, 15 bp, Homo sapiens
tggtccttagtaaat

SEQ ID NO: 6532621 - DNA, 17 bp, Homo sapiens
tggtccttagtaaattc

SEQ ID NO: 6532622 - DNA, 13 bp, Homo sapiens
tggtccttattta

SEQ ID NO: 6532623 - DNA, 22 bp, Homo sapiens
tggtccttcactggcgccttct

SEQ ID NO: 6532624 - DNA, 20 bp, Homo sapiens
tggtccttctcgtttgctct

SEQ ID NO: 6532625 - DNA, 14 bp, Homo sapiens
tggtcctttacact

SEQ ID NO: 6532626 - DNA, 15 bp, Homo sapiens
tggtcctttctggaa

SEQ ID NO: 6532627 - DNA, 18 bp, Homo sapiens
tggtcgccttccacctct

SEQ ID NO: 6532628 - DNA, 13 bp, Homo sapiens
tggtcgctcctgc

SEQ ID NO: 6532629 - DNA, 17 bp, Homo sapiens
tggtcggaaaacatgct

SEQ ID NO: 6532630 - DNA, 16 bp, Homo sapiens
tggtcggatctcacag

SEQ ID NO: 6532631 - DNA, 22 bp, Homo sapiens
tggtcgtcaactttcctcaaat

SEQ ID NO: 6532632 - DNA, 17 bp, Homo sapiens
tggtcgtcatgctgtcc

SEQ ID NO: 6532633 - DNA, 22 bp, Homo sapiens
tggtcgttttttttttgtttgt

SEQ ID NO: 6532634 - DNA, 12 bp, Homo sapiens
tggtctaaaact

SEQ ID NO: 6532635 - DNA, 22 bp, Homo sapiens
tggtctaatcctagtttgctgt

SEQ ID NO: 6532636 - DNA, 14 bp, Homo sapiens
tggtctaatgttta

SEQ ID NO: 6532637 - DNA, 15 bp, Homo sapiens
tggtctacactgtgc

SEQ ID NO: 6532638 - DNA, 19 bp, Homo sapiens
tggtctacactgtgctgag

SEQ ID NO: 6532639 - DNA, 17 bp, Homo sapiens
tggtctaccaagtaaga

SEQ ID NO: 6532640 - DNA, 21 bp, Homo sapiens
tggtctaccaatctgggaaga

SEQ ID NO: 6532641 - DNA, 15 bp, Homo sapiens
tggtctactctagaa

SEQ ID NO: 6532642 - DNA, 14 bp, Homo sapiens
tggtctagaccagg

SEQ ID NO: 6532643 - DNA, 22 bp, Homo sapiens
tggtctaggagctgtctccagg

SEQ ID NO: 6532644 - DNA, 16 bp, Homo sapiens
tggtctataaaataaa

SEQ ID NO: 6532645 - DNA, 22 bp, Homo sapiens
tggtctataaaataaacttctt

SEQ ID NO: 6532646 - DNA, 23 bp, Homo sapiens
tggtctataaaataaacttctta

SEQ ID NO: 6532647 - DNA, 23 bp, Homo sapiens
tggtctataagatgaaacatcat

SEQ ID NO: 6532648 - DNA, 13 bp, Homo sapiens
tggtctatttctc

SEQ ID NO: 6532649 - DNA, 17 bp, Homo sapiens
tggtctattttctgcag

SEQ ID NO: 6532650 - DNA, 18 bp, Homo sapiens
tggtctattttctgcaga

SEQ ID NO: 6532651 - DNA, 22 bp, Homo sapiens
tggtctcaaaatggtgtgctat

SEQ ID NO: 6532652 - DNA, 23 bp, Homo sapiens
tggtctcaaactcttgacctcag

SEQ ID NO: 6532653 - DNA, 23 bp, Homo sapiens
tggtctcaggatatccttatcag

SEQ ID NO: 6532654 - DNA, 15 bp, Homo sapiens
tggtctcatctcctt

SEQ ID NO: 6532655 - DNA, 19 bp, Homo sapiens
tggtctcatctcctttgct

SEQ ID NO: 6532656 - DNA, 14 bp, Homo sapiens
tggtctcatgcccc

SEQ ID NO: 6532657 - DNA, 21 bp, Homo sapiens
tggtctcatgtaacacataaa

SEQ ID NO: 6532658 - DNA, 18 bp, Homo sapiens
tggtctccacctgtgctt

SEQ ID NO: 6532659 - DNA, 13 bp, Homo sapiens
tggtctccagctc

SEQ ID NO: 6532660 - DNA, 20 bp, Homo sapiens
tggtctccagctcctctcca

SEQ ID NO: 6532661 - DNA, 18 bp, Homo sapiens
tggtctccatatcagctc

SEQ ID NO: 6532662 - DNA, 20 bp, Homo sapiens
tggtctccatttttcccagg

SEQ ID NO: 6532663 - DNA, 13 bp, Homo sapiens
tggtctcctccca

SEQ ID NO: 6532664 - DNA, 15 bp, Homo sapiens
tggtctcctctcagc

SEQ ID NO: 6532665 - DNA, 21 bp, Homo sapiens
tggtctcctctgattatcagg

SEQ ID NO: 6532666 - DNA, 16 bp, Homo sapiens
tggtctccttggaaat

SEQ ID NO: 6532667 - DNA, 18 bp, Homo sapiens
tggtctcgaactcctgac

SEQ ID NO: 6532668 - DNA, 17 bp, Homo sapiens
tggtctcgaactcctgg

SEQ ID NO: 6532669 - DNA, 18 bp, Homo sapiens
tggtctcgatgctgctgg

SEQ ID NO: 6532670 - DNA, 21 bp, Homo sapiens
tggtctcgatgctgctggcct

SEQ ID NO: 6532671 - DNA, 22 bp, Homo sapiens
tggtctcgtcttccgtctcccc

SEQ ID NO: 6532672 - DNA, 20 bp, Homo sapiens
tggtctcgtgttcgctggct

SEQ ID NO: 6532673 - DNA, 23 bp, Homo sapiens
tggtctcgtgttcgctggctgat

SEQ ID NO: 6532674 - DNA, 23 bp, Homo sapiens
tggtctctagagggttgctgcct

SEQ ID NO: 6532675 - DNA, 15 bp, Homo sapiens
tggtctctaggcctg

SEQ ID NO: 6532676 - DNA, 17 bp, Homo sapiens
tggtctctaggcctgaa

SEQ ID NO: 6532677 - DNA, 18 bp, Homo sapiens
tggtctctaggctgggga

SEQ ID NO: 6532678 - DNA, 21 bp, Homo sapiens
tggtctctctccctctgtctt

SEQ ID NO: 6532679 - DNA, 17 bp, Homo sapiens
tggtctctgcacccagt

SEQ ID NO: 6532680 - DNA, 15 bp, Homo sapiens
tggtctctgcatttt

SEQ ID NO: 6532681 - DNA, 13 bp, Homo sapiens
tggtctctgccat

SEQ ID NO: 6532682 - DNA, 17 bp, Homo sapiens
tggtctctggttcttga

SEQ ID NO: 6532683 - DNA, 13 bp, Homo sapiens
tggtctctttctt

SEQ ID NO: 6532684 - DNA, 18 bp, Homo sapiens
tggtctctttctttccaa

SEQ ID NO: 6532685 - DNA, 12 bp, Homo sapiens
tggtctgaatgt

SEQ ID NO: 6532686 - DNA, 22 bp, Homo sapiens
tggtctgaatgttctgacatta

SEQ ID NO: 6532687 - DNA, 20 bp, Homo sapiens
tggtctgagcaccccctcat

SEQ ID NO: 6532688 - DNA, 16 bp, Homo sapiens
tggtctgatttcagga

SEQ ID NO: 6532689 - DNA, 12 bp, Homo sapiens
tggtctgccaat

SEQ ID NO: 6532690 - DNA, 18 bp, Homo sapiens
tggtctgccaatctgtac

SEQ ID NO: 6532691 - DNA, 13 bp, Homo sapiens
tggtctgccagaa

SEQ ID NO: 6532692 - DNA, 17 bp, Homo sapiens
tggtctgccagaatact

SEQ ID NO: 6532693 - DNA, 13 bp, Homo sapiens
tggtctgcgcctt

SEQ ID NO: 6532694 - DNA, 19 bp, Homo sapiens
tggtctgctcaggaattga

SEQ ID NO: 6532695 - DNA, 18 bp, Homo sapiens
tggtctgctcgggcccag

SEQ ID NO: 6532696 - DNA, 21 bp, Homo sapiens
tggtctgctcgggcccaggcc

SEQ ID NO: 6532697 - DNA, 22 bp, Homo sapiens
tggtctgctggtgtcattgctg

SEQ ID NO: 6532698 - DNA, 19 bp, Homo sapiens
tggtctgcttaaagcttcc

SEQ ID NO: 6532699 - DNA, 21 bp, Homo sapiens
tggtctgcttaaagcttccct

SEQ ID NO: 6532700 - DNA, 22 bp, Homo sapiens
tggtctggaatggactgggtgc

SEQ ID NO: 6532701 - DNA, 18 bp, Homo sapiens
tggtctggagttgctgaa

SEQ ID NO: 6532702 - DNA, 16 bp, Homo sapiens
tggtctgggactctct

SEQ ID NO: 6532703 - DNA, 21 bp, Homo sapiens
tggtctgggacttccttgctc

SEQ ID NO: 6532704 - DNA, 18 bp, Homo sapiens
tggtctgggtggatgtga

SEQ ID NO: 6532705 - DNA, 23 bp, Homo sapiens
tggtctgggtggatgtgagcaga

SEQ ID NO: 6532706 - DNA, 13 bp, Homo sapiens
tggtctggtcagg

SEQ ID NO: 6532707 - DNA, 17 bp, Homo sapiens
tggtctggttcctgtgt

SEQ ID NO: 6532708 - DNA, 18 bp, Homo sapiens
tggtctggttcctgtgtg

SEQ ID NO: 6532709 - DNA, 15 bp, Homo sapiens
tggtctgtgaagagc

SEQ ID NO: 6532710 - DNA, 22 bp, Homo sapiens
tggtctgtgagatgctagaact

SEQ ID NO: 6532711 - DNA, 13 bp, Homo sapiens
tggtctgtgcatt

SEQ ID NO: 6532712 - DNA, 20 bp, Homo sapiens
tggtctgtggagatggactc

SEQ ID NO: 6532713 - DNA, 12 bp, Homo sapiens
tggtctgtgtgt

SEQ ID NO: 6532714 - DNA, 14 bp, Homo sapiens
tggtctgtgtgtgt

SEQ ID NO: 6532715 - DNA, 17 bp, Homo sapiens
tggtctgtgtgtgttct

SEQ ID NO: 6532716 - DNA, 18 bp, Homo sapiens
tggtctgttaatcttttt

SEQ ID NO: 6532717 - DNA, 14 bp, Homo sapiens
tggtctgttggcag

SEQ ID NO: 6532718 - DNA, 18 bp, Homo sapiens
tggtctgttggcaggctg

SEQ ID NO: 6532719 - DNA, 23 bp, Homo sapiens
tggtctgtttccaggtcagaaac

SEQ ID NO: 6532720 - DNA, 13 bp, Homo sapiens
tggtctgttttct

SEQ ID NO: 6532721 - DNA, 14 bp, Homo sapiens
tggtcttaaatgct

SEQ ID NO: 6532722 - DNA, 20 bp, Homo sapiens
tggtcttaaatgctcatttt

SEQ ID NO: 6532723 - DNA, 20 bp, Homo sapiens
tggtcttaactaatgtaaat

SEQ ID NO: 6532724 - DNA, 22 bp, Homo sapiens
tggtcttaactaatgtaaatat

SEQ ID NO: 6532725 - DNA, 20 bp, Homo sapiens
tggtcttacagcaggcagta

SEQ ID NO: 6532726 - DNA, 24 bp, Homo sapiens
tggtcttactttgttaatttatct

SEQ ID NO: 6532727 - DNA, 18 bp, Homo sapiens
tggtcttaggtcttcctg

SEQ ID NO: 6532728 - DNA, 19 bp, Homo sapiens
tggtcttaggtcttcctgt

SEQ ID NO: 6532729 - DNA, 13 bp, Homo sapiens
tggtcttatattt

SEQ ID NO: 6532730 - DNA, 13 bp, Homo sapiens
tggtcttatcctg

SEQ ID NO: 6532731 - DNA, 21 bp, Homo sapiens
tggtcttatgattttattaca

SEQ ID NO: 6532732 - DNA, 14 bp, Homo sapiens
tggtcttcagcctc

SEQ ID NO: 6532733 - DNA, 19 bp, Homo sapiens
tggtcttcagcctccctca

SEQ ID NO: 6532734 - DNA, 21 bp, Homo sapiens
tggtcttcagcctccctcagc

SEQ ID NO: 6532735 - DNA, 16 bp, Homo sapiens
tggtcttccatgggat

SEQ ID NO: 6532736 - DNA, 17 bp, Homo sapiens
tggtcttcccaggctgg

SEQ ID NO: 6532737 - DNA, 14 bp, Homo sapiens
tggtcttccttttt

SEQ ID NO: 6532738 - DNA, 11 bp, Homo sapiens
tggtcttctca

SEQ ID NO: 6532739 - DNA, 19 bp, Homo sapiens
tggtcttctctacagttca

SEQ ID NO: 6532740 - DNA, 20 bp, Homo sapiens
tggtcttgaactcttggcct

SEQ ID NO: 6532741 - DNA, 15 bp, Homo sapiens
tggtcttgaagtcct

SEQ ID NO: 6532742 - DNA, 20 bp, Homo sapiens
tggtcttgatcctccaatgt

SEQ ID NO: 6532743 - DNA, 18 bp, Homo sapiens
tggtcttgatctcctgag

SEQ ID NO: 6532744 - DNA, 22 bp, Homo sapiens
tggtcttgccctattataattg

SEQ ID NO: 6532745 - DNA, 20 bp, Homo sapiens
tggtcttggaattccatttg

SEQ ID NO: 6532746 - DNA, 12 bp, Homo sapiens
tggtcttggaga

SEQ ID NO: 6532747 - DNA, 16 bp, Homo sapiens
tggtcttgtggaattg

SEQ ID NO: 6532748 - DNA, 19 bp, Homo sapiens
tggtcttgtttccaggagc

SEQ ID NO: 6532749 - DNA, 14 bp, Homo sapiens
tggtctttccatct

SEQ ID NO: 6532750 - DNA, 14 bp, Homo sapiens
tggtctttctgtgc

SEQ ID NO: 6532751 - DNA, 20 bp, Homo sapiens
tggtctttcttacaaggaag

SEQ ID NO: 6532752 - DNA, 10 bp, Homo sapiens
tggtctttga

SEQ ID NO: 6532753 - DNA, 15 bp, Homo sapiens
tggtctttgaataaa

SEQ ID NO: 6532754 - DNA, 18 bp, Homo sapiens
tggtctttgaataaagtc

SEQ ID NO: 6532755 - DNA, 11 bp, Homo sapiens
tggtctttgag

SEQ ID NO: 6532756 - DNA, 14 bp, Homo sapiens
tggtctttgctcca

SEQ ID NO: 6532757 - DNA, 21 bp, Homo sapiens
tggtctttgtaagagtgtaga

SEQ ID NO: 6532758 - DNA, 23 bp, Homo sapiens
tggtctttgtaagagtgtagaag

SEQ ID NO: 6532759 - DNA, 12 bp, Homo sapiens
tggtcttttcct

SEQ ID NO: 6532760 - DNA, 23 bp, Homo sapiens
tggtgaaaccaaacaaatacaaa

SEQ ID NO: 6532761 - DNA, 19 bp, Homo sapiens
tggtgaaacccccatctct

SEQ ID NO: 6532762 - DNA, 13 bp, Homo sapiens
tggtgaaagagta

SEQ ID NO: 6532763 - DNA, 16 bp, Homo sapiens
tggtgaaataataaaa

SEQ ID NO: 6532764 - DNA, 11 bp, Homo sapiens
tggtgaaatct

SEQ ID NO: 6532765 - DNA, 20 bp, Homo sapiens
tggtgaaattataactatta

SEQ ID NO: 6532766 - DNA, 16 bp, Homo sapiens
tggtgaacactgtgac

SEQ ID NO: 6532767 - DNA, 20 bp, Homo sapiens
tggtgaacagaacctcccaa

SEQ ID NO: 6532768 - DNA, 14 bp, Homo sapiens
tggtgaacatttta

SEQ ID NO: 6532769 - DNA, 16 bp, Homo sapiens
tggtgaactgaagcag

SEQ ID NO: 6532770 - DNA, 13 bp, Homo sapiens
tggtgaagagtag

SEQ ID NO: 6532771 - DNA, 20 bp, Homo sapiens
tggtgaagggaagtggggag

SEQ ID NO: 6532772 - DNA, 12 bp, Homo sapiens
tggtgaaggggc

SEQ ID NO: 6532773 - DNA, 19 bp, Homo sapiens
tggtgaaggggctggtgga

SEQ ID NO: 6532774 - DNA, 23 bp, Homo sapiens
tggtgaagtaaattaggcagtgc

SEQ ID NO: 6532775 - DNA, 15 bp, Homo sapiens
tggtgaagtgcttgg

SEQ ID NO: 6532776 - DNA, 16 bp, Homo sapiens
tggtgaagtgtgactt

SEQ ID NO: 6532777 - DNA, 13 bp, Homo sapiens
tggtgaagtgtgg

SEQ ID NO: 6532778 - DNA, 17 bp, Homo sapiens
tggtgaagtgtggctgg

SEQ ID NO: 6532779 - DNA, 15 bp, Homo sapiens
tggtgaagtttgtca

SEQ ID NO: 6532780 - DNA, 15 bp, Homo sapiens
tggtgaataaaacct

SEQ ID NO: 6532781 - DNA, 18 bp, Homo sapiens
tggtgaataactatgcca

SEQ ID NO: 6532782 - DNA, 13 bp, Homo sapiens
tggtgaatattgt

SEQ ID NO: 6532783 - DNA, 14 bp, Homo sapiens
tggtgaatcacctg

SEQ ID NO: 6532784 - DNA, 14 bp, Homo sapiens
tggtgaatggattt

SEQ ID NO: 6532785 - DNA, 19 bp, Homo sapiens
tggtgaatggccttccttc

SEQ ID NO: 6532786 - DNA, 13 bp, Homo sapiens
tggtgaatttgaa

SEQ ID NO: 6532787 - DNA, 14 bp, Homo sapiens
tggtgacacacagc

SEQ ID NO: 6532788 - DNA, 15 bp, Homo sapiens
tggtgacagccttgg

SEQ ID NO: 6532789 - DNA, 13 bp, Homo sapiens
ttccatgcctgag

SEQ ID NO: 6532790 - DNA, 18 bp, Homo sapiens
ttccatgcctgagggtgg

SEQ ID NO: 6532791 - DNA, 23 bp, Homo sapiens
ttccatgcctgagggtggagact

SEQ ID NO: 6532792 - DNA, 18 bp, Homo sapiens
ttccatgcctgctctcga

SEQ ID NO: 6532793 - DNA, 15 bp, Homo sapiens
ttccatgcctggccc

SEQ ID NO: 6532794 - DNA, 18 bp, Homo sapiens
ttccatgcgtgtttctga

SEQ ID NO: 6532795 - DNA, 16 bp, Homo sapiens
ttccatgctaagcaag

SEQ ID NO: 6532796 - DNA, 23 bp, Homo sapiens
ttccatgctgtgcgcccagggct

SEQ ID NO: 6532797 - DNA, 17 bp, Homo sapiens
ttccatggcaggaaggc

SEQ ID NO: 6532798 - DNA, 16 bp, Homo sapiens
ttccatggcctcttca

SEQ ID NO: 6532799 - DNA, 23 bp, Homo sapiens
ttccatgggactttccttccctc

SEQ ID NO: 6532800 - DNA, 17 bp, Homo sapiens
ttccatgggcccgctgc

SEQ ID NO: 6532801 - DNA, 22 bp, Homo sapiens
ttccatgggcccgctgcctctt

SEQ ID NO: 6532802 - DNA, 17 bp, Homo sapiens
ttccatgggttgaacaa

SEQ ID NO: 6532803 - DNA, 17 bp, Homo sapiens
ttccatgtatcttttga

SEQ ID NO: 6532804 - DNA, 18 bp, Homo sapiens
ttccatgtcgcctctgca

SEQ ID NO: 6532805 - DNA, 20 bp, Homo sapiens
ttccatgtcgcctctgcatt

SEQ ID NO: 6532806 - DNA, 19 bp, Homo sapiens
ttccatgtctccattttct

SEQ ID NO: 6532807 - DNA, 16 bp, Homo sapiens
ttccatgtgaaaataa

SEQ ID NO: 6532808 - DNA, 23 bp, Homo sapiens
ttccatgtgagggttttcagcat

SEQ ID NO: 6532809 - DNA, 17 bp, Homo sapiens
ttccatgtgcccagtta

SEQ ID NO: 6532810 - DNA, 20 bp, Homo sapiens
ttccatgtgcctttctttgc

SEQ ID NO: 6532811 - DNA, 23 bp, Homo sapiens
ttccatgtgcctttctttgcctc

SEQ ID NO: 6532812 - DNA, 15 bp, Homo sapiens
ttccatgttgctgcc

SEQ ID NO: 6532813 - DNA, 20 bp, Homo sapiens
ttccatgttttgttttcttg

SEQ ID NO: 6532814 - DNA, 21 bp, Homo sapiens
ttccatgttttttcttcaaat

SEQ ID NO: 6532815 - DNA, 23 bp, Homo sapiens
ttccattaaacgatttttaaaat

SEQ ID NO: 6532816 - DNA, 17 bp, Homo sapiens
ttccattaacaaatgct

SEQ ID NO: 6532817 - DNA, 15 bp, Homo sapiens
ttccattaacagcaa

SEQ ID NO: 6532818 - DNA, 22 bp, Homo sapiens
ttccattaataactgaataaaa

SEQ ID NO: 6532819 - DNA, 23 bp, Homo sapiens
ttccattaataactgaataaaaa

SEQ ID NO: 6532820 - DNA, 19 bp, Homo sapiens
ttccattagtaaaacacaa

SEQ ID NO: 6532821 - DNA, 15 bp, Homo sapiens
ttccattatgaaaat

SEQ ID NO: 6532822 - DNA, 19 bp, Homo sapiens
ttccattatgaaaatctta

SEQ ID NO: 6532823 - DNA, 14 bp, Homo sapiens
ttccattatgattc

SEQ ID NO: 6532824 - DNA, 15 bp, Homo sapiens
ttccattatgattct

SEQ ID NO: 6532825 - DNA, 16 bp, Homo sapiens
ttccattatgttcatc

SEQ ID NO: 6532826 - DNA, 20 bp, Homo sapiens
ttccattattgagttcctcc

SEQ ID NO: 6532827 - DNA, 15 bp, Homo sapiens
ttccattcagacaat

SEQ ID NO: 6532828 - DNA, 15 bp, Homo sapiens
ttccattcatggata

SEQ ID NO: 6532829 - DNA, 16 bp, Homo sapiens
ttccattccagaatat

SEQ ID NO: 6532830 - DNA, 16 bp, Homo sapiens
ttccattccattgttt

SEQ ID NO: 6532831 - DNA, 13 bp, Homo sapiens
ttccattccttca

SEQ ID NO: 6532832 - DNA, 13 bp, Homo sapiens
ttccattcgcatg

SEQ ID NO: 6532833 - DNA, 15 bp, Homo sapiens
ttccattctatgact

SEQ ID NO: 6532834 - DNA, 14 bp, Homo sapiens
ttccattctttctt

SEQ ID NO: 6532835 - DNA, 16 bp, Homo sapiens
ttccattctttcttcc

SEQ ID NO: 6532836 - DNA, 18 bp, Homo sapiens
ttccattgacatttgaat

SEQ ID NO: 6532837 - DNA, 15 bp, Homo sapiens
ttccattgaccagct

SEQ ID NO: 6532838 - DNA, 23 bp, Homo sapiens
ttccattgccgccgcgggtgtgc

SEQ ID NO: 6532839 - DNA, 16 bp, Homo sapiens
ttccattgctcccagt

SEQ ID NO: 6532840 - DNA, 13 bp, Homo sapiens
ttccattgcttat

SEQ ID NO: 6532841 - DNA, 21 bp, Homo sapiens
ttccattgctttgaaaaagtt

SEQ ID NO: 6532842 - DNA, 14 bp, Homo sapiens
ttccattggaaata

SEQ ID NO: 6532843 - DNA, 17 bp, Homo sapiens
ttccattggtccaagat

SEQ ID NO: 6532844 - DNA, 19 bp, Homo sapiens
ttccattggtccaagattc

SEQ ID NO: 6532845 - DNA, 24 bp, Homo sapiens
ttccattggttcttcctttccctg

SEQ ID NO: 6532846 - DNA, 13 bp, Homo sapiens
ttccattgtgtga

SEQ ID NO: 6532847 - DNA, 13 bp, Homo sapiens
ttccattgtttaa

SEQ ID NO: 6532848 - DNA, 13 bp, Homo sapiens
ttccattgtttta

SEQ ID NO: 6532849 - DNA, 18 bp, Homo sapiens
ttccatttacttaagact

SEQ ID NO: 6532850 - DNA, 19 bp, Homo sapiens
ttccatttatctttctaca

SEQ ID NO: 6532851 - DNA, 16 bp, Homo sapiens
ttccatttctactgta

SEQ ID NO: 6532852 - DNA, 13 bp, Homo sapiens
ttccatttctcaa

SEQ ID NO: 6532853 - DNA, 11 bp, Homo sapiens
ttccatttctg

SEQ ID NO: 6532854 - DNA, 12 bp, Homo sapiens
ttccatttctga

SEQ ID NO: 6532855 - DNA, 16 bp, Homo sapiens
ttccatttcttcagag

SEQ ID NO: 6532856 - DNA, 18 bp, Homo sapiens
ttccatttcttcagaggg

SEQ ID NO: 6532857 - DNA, 13 bp, Homo sapiens
ttccatttcttct

SEQ ID NO: 6532858 - DNA, 17 bp, Homo sapiens
ttccatttgcaagggaa

SEQ ID NO: 6532859 - DNA, 19 bp, Homo sapiens
ttccatttggcactatggt

SEQ ID NO: 6532860 - DNA, 11 bp, Homo sapiens
ttccatttgtc

SEQ ID NO: 6532861 - DNA, 11 bp, Homo sapiens
ttccattttat

SEQ ID NO: 6532862 - DNA, 12 bp, Homo sapiens
ttccattttatg

SEQ ID NO: 6532863 - DNA, 16 bp, Homo sapiens
ttccattttatgcaga

SEQ ID NO: 6532864 - DNA, 16 bp, Homo sapiens
ttccattttcccccac

SEQ ID NO: 6532865 - DNA, 14 bp, Homo sapiens
ttccattttggaaa

SEQ ID NO: 6532866 - DNA, 23 bp, Homo sapiens
ttccattttggcgctattacaaa

SEQ ID NO: 6532867 - DNA, 22 bp, Homo sapiens
ttccatttttcctctgttcaca

SEQ ID NO: 6532868 - DNA, 23 bp, Homo sapiens
ttccatttttcctctgttcacaa

SEQ ID NO: 6532869 - DNA, 16 bp, Homo sapiens
ttccattttttgtatt

SEQ ID NO: 6532870 - DNA, 17 bp, Homo sapiens
ttcccaaaacaatctat

SEQ ID NO: 6532871 - DNA, 19 bp, Homo sapiens
ttcccaaaacaatctattt

SEQ ID NO: 6532872 - DNA, 17 bp, Homo sapiens
ttcccaaaacaatggtg

SEQ ID NO: 6532873 - DNA, 19 bp, Homo sapiens
ttcccaaaatgttgaaata

SEQ ID NO: 6532874 - DNA, 22 bp, Homo sapiens
ttcccaaaatgttgaaatatga

SEQ ID NO: 6532875 - DNA, 17 bp, Homo sapiens
ttcccaaaattagggag

SEQ ID NO: 6532876 - DNA, 23 bp, Homo sapiens
ttcccaaaattagggagctcttg

SEQ ID NO: 6532877 - DNA, 13 bp, Homo sapiens
ttcccaaagcact

SEQ ID NO: 6532878 - DNA, 23 bp, Homo sapiens
ttcccaaagcagtgcatgctgtc

SEQ ID NO: 6532879 - DNA, 23 bp, Homo sapiens
ttcccaaaggcattataaaaaga

SEQ ID NO: 6532880 - DNA, 15 bp, Homo sapiens
ttcccaaagggaggg

SEQ ID NO: 6532881 - DNA, 18 bp, Homo sapiens
ttcccaaagtgaactctc

SEQ ID NO: 6532882 - DNA, 18 bp, Homo sapiens
ttcccaacccccagcccc

SEQ ID NO: 6532883 - DNA, 21 bp, Homo sapiens
ttcccaaccccttaagccctg

SEQ ID NO: 6532884 - DNA, 17 bp, Homo sapiens
ttcccaacctcctgtgg

SEQ ID NO: 6532885 - DNA, 15 bp, Homo sapiens
ttcccaacgtgcaaa

SEQ ID NO: 6532886 - DNA, 15 bp, Homo sapiens
ttcccaactgcaagt

SEQ ID NO: 6532887 - DNA, 21 bp, Homo sapiens
ttcccaagaaaggaaaccttt

SEQ ID NO: 6532888 - DNA, 14 bp, Homo sapiens
ttcccaagaaatgc

SEQ ID NO: 6532889 - DNA, 20 bp, Homo sapiens
ttcccaagagcatcatgcct

SEQ ID NO: 6532890 - DNA, 16 bp, Homo sapiens
ttcccaagatgcctga

SEQ ID NO: 6532891 - DNA, 21 bp, Homo sapiens
ttcccaagctagactgtgtct

SEQ ID NO: 6532892 - DNA, 11 bp, Homo sapiens
ttcccaagctc

SEQ ID NO: 6532893 - DNA, 16 bp, Homo sapiens
ttcccaagctctgctc

SEQ ID NO: 6532894 - DNA, 19 bp, Homo sapiens
ttcccaaggcagctggatt

SEQ ID NO: 6532895 - DNA, 13 bp, Homo sapiens
ttcccaagggaga

SEQ ID NO: 6532896 - DNA, 16 bp, Homo sapiens
ttcccaagtatgcctt

SEQ ID NO: 6532897 - DNA, 21 bp, Homo sapiens
ttcccaagtatgccttaagca

SEQ ID NO: 6532898 - DNA, 16 bp, Homo sapiens
ttcccaagtattgcga

SEQ ID NO: 6532899 - DNA, 23 bp, Homo sapiens
ttcccaagtgagtctctctgggc

SEQ ID NO: 6532900 - DNA, 23 bp, Homo sapiens
ttcccaatagcaacgtagcttct

SEQ ID NO: 6532901 - DNA, 15 bp, Homo sapiens
ttcccaatatgtagc

SEQ ID NO: 6532902 - DNA, 18 bp, Homo sapiens
ttcccaatcagcactgaa

SEQ ID NO: 6532903 - DNA, 18 bp, Homo sapiens
ttcccaatctgaaattca

SEQ ID NO: 6532904 - DNA, 17 bp, Homo sapiens
ttcccaatgatcttgca

SEQ ID NO: 6532905 - DNA, 12 bp, Homo sapiens
ttcccaatggtg

SEQ ID NO: 6532906 - DNA, 21 bp, Homo sapiens
ttcccaatggtgtttttcttg

SEQ ID NO: 6532907 - DNA, 22 bp, Homo sapiens
ttcccaatggtgtttttcttgt

SEQ ID NO: 6532908 - DNA, 16 bp, Homo sapiens
ttcccaattgccacat

SEQ ID NO: 6532909 - DNA, 19 bp, Homo sapiens
ttcccacaaaagacagacc

SEQ ID NO: 6532910 - DNA, 20 bp, Homo sapiens
ttcccacaaaagacagaccc

SEQ ID NO: 6532911 - DNA, 21 bp, Homo sapiens
ttcccacaaaagacagaccca

SEQ ID NO: 6532912 - DNA, 19 bp, Homo sapiens
ttcccacacatattcaaat

SEQ ID NO: 6532913 - DNA, 16 bp, Homo sapiens
ttcccacacctccaca

SEQ ID NO: 6532914 - DNA, 21 bp, Homo sapiens
ttcccacacctccacagttca

SEQ ID NO: 6532915 - DNA, 16 bp, Homo sapiens
ttcccacacctgcctg

SEQ ID NO: 6532916 - DNA, 17 bp, Homo sapiens
ttcccacacctgcctgc

SEQ ID NO: 6532917 - DNA, 18 bp, Homo sapiens
ttcccacacctgcctgcg

SEQ ID NO: 6532918 - DNA, 15 bp, Homo sapiens
ttcccacacggcagc

SEQ ID NO: 6532919 - DNA, 17 bp, Homo sapiens
ttcccacacggcagccc

SEQ ID NO: 6532920 - DNA, 15 bp, Homo sapiens
ttcccacactgaaat

SEQ ID NO: 6532921 - DNA, 16 bp, Homo sapiens
ttcccacactgaaatt

SEQ ID NO: 6532922 - DNA, 13 bp, Homo sapiens
ttcccacagcatt

SEQ ID NO: 6532923 - DNA, 15 bp, Homo sapiens
ttcccacatctttcc

SEQ ID NO: 6532924 - DNA, 15 bp, Homo sapiens
ttcccacatgcctgc

SEQ ID NO: 6532925 - DNA, 16 bp, Homo sapiens
ttcccacatttgtctt

SEQ ID NO: 6532926 - DNA, 23 bp, Homo sapiens
ttcccaccaactctctctgcccc

SEQ ID NO: 6532927 - DNA, 16 bp, Homo sapiens
ttcccaccagctccca

SEQ ID NO: 6532928 - DNA, 19 bp, Homo sapiens
ttcccacccactagccctc

SEQ ID NO: 6532929 - DNA, 16 bp, Homo sapiens
ttcccacccagcctgg

SEQ ID NO: 6532930 - DNA, 17 bp, Homo sapiens
ttcccacccaggaaagg

SEQ ID NO: 6532931 - DNA, 14 bp, Homo sapiens
ttcccacccatctc

SEQ ID NO: 6532932 - DNA, 22 bp, Homo sapiens
ttcccacccccaggcaaggctg

SEQ ID NO: 6532933 - DNA, 22 bp, Homo sapiens
ttcccacccctacacacacact

SEQ ID NO: 6532934 - DNA, 23 bp, Homo sapiens
ttcccacccctcatacctacacc

SEQ ID NO: 6532935 - DNA, 12 bp, Homo sapiens
ttcccaccctcc

SEQ ID NO: 6532936 - DNA, 21 bp, Homo sapiens
ttcccaccctccacctctcac

SEQ ID NO: 6532937 - DNA, 16 bp, Homo sapiens
ttcccacctccctgcc

SEQ ID NO: 6532938 - DNA, 18 bp, Homo sapiens
ttcccacctctctcccca

SEQ ID NO: 6532939 - DNA, 17 bp, Homo sapiens
ttcccacctctgaggac

SEQ ID NO: 6532940 - DNA, 19 bp, Homo sapiens
ttcccacgtgggcctccca

SEQ ID NO: 6532941 - DNA, 22 bp, Homo sapiens
ttcccacgttgacaccaagaaa

SEQ ID NO: 6532942 - DNA, 19 bp, Homo sapiens
ttcccactaagctttctcc

SEQ ID NO: 6532943 - DNA, 21 bp, Homo sapiens
ttcccactaagctttctcctt

SEQ ID NO: 6532944 - DNA, 15 bp, Homo sapiens
ttcccactcaccccg

SEQ ID NO: 6532945 - DNA, 13 bp, Homo sapiens
ttcccactcacct

SEQ ID NO: 6532946 - DNA, 17 bp, Homo sapiens
ttcccactcagcagtga

SEQ ID NO: 6532947 - DNA, 11 bp, Homo sapiens
ttcccactccc

SEQ ID NO: 6532948 - DNA, 14 bp, Homo sapiens
ttcccactccttca

SEQ ID NO: 6532949 - DNA, 18 bp, Homo sapiens
ttcccactctagggcagt

SEQ ID NO: 6532950 - DNA, 15 bp, Homo sapiens
ttcccactgaaatgg

SEQ ID NO: 6532951 - DNA, 13 bp, Homo sapiens
ttcccactgcacc

SEQ ID NO: 6532952 - DNA, 19 bp, Homo sapiens
ttcccactgcaccccctcc

SEQ ID NO: 6532953 - DNA, 24 bp, Homo sapiens
ttcccactgcaccccctcctgctg

SEQ ID NO: 6532954 - DNA, 20 bp, Homo sapiens
ttcccactgcactccagcct

SEQ ID NO: 6532955 - DNA, 15 bp, Homo sapiens
ttcccactgcacttg

SEQ ID NO: 6532956 - DNA, 18 bp, Homo sapiens
ttcccactggcctcaagt

SEQ ID NO: 6532957 - DNA, 17 bp, Homo sapiens
ttcccactgtcctttct

SEQ ID NO: 6532958 - DNA, 13 bp, Homo sapiens
ttcccacttccac

SEQ ID NO: 6532959 - DNA, 16 bp, Homo sapiens
ttcccactttttggta

SEQ ID NO: 6532960 - DNA, 22 bp, Homo sapiens
ttcccagaaatacaacagaagt

SEQ ID NO: 6532961 - DNA, 23 bp, Homo sapiens
ttcccagaaccttgatggggtga

SEQ ID NO: 6532962 - DNA, 23 bp, Homo sapiens
ttcccagaatatatttaaatgca

SEQ ID NO: 6532963 - DNA, 18 bp, Homo sapiens
ttcccagagaacttcaca

SEQ ID NO: 6532964 - DNA, 20 bp, Homo sapiens
ttcccagagaagctcattta

SEQ ID NO: 6532965 - DNA, 17 bp, Homo sapiens
ttcccagagagacgctg

SEQ ID NO: 6532966 - DNA, 18 bp, Homo sapiens
ttcccagagcaaaataat

SEQ ID NO: 6532967 - DNA, 19 bp, Homo sapiens
tggtgacaggacgctgacc

SEQ ID NO: 6532968 - DNA, 15 bp, Homo sapiens
tggtgacaggcagac

SEQ ID NO: 6532969 - DNA, 16 bp, Homo sapiens
tggtgacaggcagaca

SEQ ID NO: 6532970 - DNA, 21 bp, Homo sapiens
tggtgacatttcccaagtcag

SEQ ID NO: 6532971 - DNA, 13 bp, Homo sapiens
tggtgaccagact

SEQ ID NO: 6532972 - DNA, 14 bp, Homo sapiens
tggtgaccagactt

SEQ ID NO: 6532973 - DNA, 15 bp, Homo sapiens
tggtgaccagtttct

SEQ ID NO: 6532974 - DNA, 14 bp, Homo sapiens
tggtgacctcacac

SEQ ID NO: 6532975 - DNA, 17 bp, Homo sapiens
tggtgacctctgcctga

SEQ ID NO: 6532976 - DNA, 19 bp, Homo sapiens
tggtgacctgatgtaaaca

SEQ ID NO: 6532977 - DNA, 22 bp, Homo sapiens
tggtgaccttccaagagcctga

SEQ ID NO: 6532978 - DNA, 15 bp, Homo sapiens
tggtgacctttttaa

SEQ ID NO: 6532979 - DNA, 21 bp, Homo sapiens
tggtgacgtggtagtcacttg

SEQ ID NO: 6532980 - DNA, 20 bp, Homo sapiens
tggtgactcctgaaacctct

SEQ ID NO: 6532981 - DNA, 22 bp, Homo sapiens
tggtgactcgggggctgtctca

SEQ ID NO: 6532982 - DNA, 16 bp, Homo sapiens
tggtgactgattcttc

SEQ ID NO: 6532983 - DNA, 15 bp, Homo sapiens
tggtgactgtcccac

SEQ ID NO: 6532984 - DNA, 16 bp, Homo sapiens
tggtgacttctgctgc

SEQ ID NO: 6532985 - DNA, 19 bp, Homo sapiens
tggtgacttgtctgcctcc

SEQ ID NO: 6532986 - DNA, 21 bp, Homo sapiens
tggtgacttgtctgcctcctg

SEQ ID NO: 6532987 - DNA, 18 bp, Homo sapiens
tggtgactttggataata

SEQ ID NO: 6532988 - DNA, 23 bp, Homo sapiens
tggtgactttggataataaggaa

SEQ ID NO: 6532989 - DNA, 20 bp, Homo sapiens
tggtgactttggggacaggg

SEQ ID NO: 6532990 - DNA, 14 bp, Homo sapiens
tggtgacttttgaa

SEQ ID NO: 6532991 - DNA, 14 bp, Homo sapiens
tggtgactttttaa

SEQ ID NO: 6532992 - DNA, 21 bp, Homo sapiens
tggtgagaaaatatatgcctg

SEQ ID NO: 6532993 - DNA, 20 bp, Homo sapiens
tggtgagaaacctgtatctt

SEQ ID NO: 6532994 - DNA, 23 bp, Homo sapiens
tggtgagaattaaaataaaacgt

SEQ ID NO: 6532995 - DNA, 14 bp, Homo sapiens
tggtgagaggcatc

SEQ ID NO: 6532996 - DNA, 17 bp, Homo sapiens
tggtgagatgcagctgg

SEQ ID NO: 6532997 - DNA, 19 bp, Homo sapiens
tggtgaggacctgcggcct

SEQ ID NO: 6532998 - DNA, 23 bp, Homo sapiens
tggtgaggacctgcggccttggg

SEQ ID NO: 6532999 - DNA, 18 bp, Homo sapiens
tggtgaggcccagcctgt

SEQ ID NO: 6533000 - DNA, 19 bp, Homo sapiens
tggtgaggcccagcctgtc

SEQ ID NO: 6533001 - DNA, 21 bp, Homo sapiens
tggtgaggcccagcctgtcct

SEQ ID NO: 6533002 - DNA, 17 bp, Homo sapiens
tggtgaggccggccctg

SEQ ID NO: 6533003 - DNA, 19 bp, Homo sapiens
tggtgaggccggccctgcc

SEQ ID NO: 6533004 - DNA, 20 bp, Homo sapiens
tggtgaggccggccctgccc

SEQ ID NO: 6533005 - DNA, 12 bp, Homo sapiens
tggtgaggggcc

SEQ ID NO: 6533006 - DNA, 23 bp, Homo sapiens
tggtgagggtgccccgcctgagt

SEQ ID NO: 6533007 - DNA, 19 bp, Homo sapiens
tggtgaggtggcccaggcc

SEQ ID NO: 6533008 - DNA, 20 bp, Homo sapiens
tggtgaggtggcccaggccc

SEQ ID NO: 6533009 - DNA, 17 bp, Homo sapiens
tggtgaggttgtggaga

SEQ ID NO: 6533010 - DNA, 19 bp, Homo sapiens
tggtgaggtttaaaggata

SEQ ID NO: 6533011 - DNA, 18 bp, Homo sapiens
tggtgagtcttggcggca

SEQ ID NO: 6533012 - DNA, 15 bp, Homo sapiens
tggtgataaggacat

SEQ ID NO: 6533013 - DNA, 12 bp, Homo sapiens
tggtgataagta

SEQ ID NO: 6533014 - DNA, 13 bp, Homo sapiens
tggtgataagtgg

SEQ ID NO: 6533015 - DNA, 18 bp, Homo sapiens
tggtgataagtggaaaaa

SEQ ID NO: 6533016 - DNA, 16 bp, Homo sapiens
tggtgatataaagaat

SEQ ID NO: 6533017 - DNA, 21 bp, Homo sapiens
tggtgatataaagaatgaaag

SEQ ID NO: 6533018 - DNA, 17 bp, Homo sapiens
tggtgatcaattaaatg

SEQ ID NO: 6533019 - DNA, 15 bp, Homo sapiens
tggtgatcctctatt

SEQ ID NO: 6533020 - DNA, 18 bp, Homo sapiens
tggtgatcctctattttg

SEQ ID NO: 6533021 - DNA, 21 bp, Homo sapiens
tggtgatctcccaagctatct

SEQ ID NO: 6533022 - DNA, 15 bp, Homo sapiens
tggtgatctgtagac

SEQ ID NO: 6533023 - DNA, 13 bp, Homo sapiens
tggtgatgcaagt

SEQ ID NO: 6533024 - DNA, 20 bp, Homo sapiens
tggtgatggaggtttcatac

SEQ ID NO: 6533025 - DNA, 14 bp, Homo sapiens
tggtgatgtaaaac

SEQ ID NO: 6533026 - DNA, 20 bp, Homo sapiens
tggtgatgtaaaacagaata

SEQ ID NO: 6533027 - DNA, 20 bp, Homo sapiens
tggtgatgtacgctgcgtgc

SEQ ID NO: 6533028 - DNA, 21 bp, Homo sapiens
tggtgatgtacgctgcgtgcc

SEQ ID NO: 6533029 - DNA, 20 bp, Homo sapiens
tggtgatgtcataataaagt

SEQ ID NO: 6533030 - DNA, 16 bp, Homo sapiens
tggtgatgtgcctgta

SEQ ID NO: 6533031 - DNA, 20 bp, Homo sapiens
tggtgattaaaatgagttta

SEQ ID NO: 6533032 - DNA, 20 bp, Homo sapiens
tggtgattaaggtcctgctt

SEQ ID NO: 6533033 - DNA, 22 bp, Homo sapiens
tggtgatttagcaggaagctgt

SEQ ID NO: 6533034 - DNA, 14 bp, Homo sapiens
tggtgatttgaaaa

SEQ ID NO: 6533035 - DNA, 21 bp, Homo sapiens
tggtgatttgaaaaatataaa

SEQ ID NO: 6533036 - DNA, 22 bp, Homo sapiens
tggtgatttgaaaaatataaaa

SEQ ID NO: 6533037 - DNA, 12 bp, Homo sapiens
tggtgcaaaaaa

SEQ ID NO: 6533038 - DNA, 11 bp, Homo sapiens
tggtgcaatat

SEQ ID NO: 6533039 - DNA, 16 bp, Homo sapiens
tggtgcaatttgtctt

SEQ ID NO: 6533040 - DNA, 20 bp, Homo sapiens
tggtgcacaagtaacacatt

SEQ ID NO: 6533041 - DNA, 17 bp, Homo sapiens
tggtgcacagattgctg

SEQ ID NO: 6533042 - DNA, 23 bp, Homo sapiens
tggtgcacagcacaaattagtta

SEQ ID NO: 6533043 - DNA, 23 bp, Homo sapiens
tggtgcacgctggggaagaattt

SEQ ID NO: 6533044 - DNA, 15 bp, Homo sapiens
tggtgcactttgtaa

SEQ ID NO: 6533045 - DNA, 20 bp, Homo sapiens
tggtgcagaaaaaaaaaaag

SEQ ID NO: 6533046 - DNA, 15 bp, Homo sapiens
tggtgcagacagaag

SEQ ID NO: 6533047 - DNA, 20 bp, Homo sapiens
tggtgcagagaagctggact

SEQ ID NO: 6533048 - DNA, 21 bp, Homo sapiens
tggtgcagagaagctggactt

SEQ ID NO: 6533049 - DNA, 19 bp, Homo sapiens
tggtgcagaggtttcttga

SEQ ID NO: 6533050 - DNA, 19 bp, Homo sapiens
tggtgcagggagacatctg

SEQ ID NO: 6533051 - DNA, 21 bp, Homo sapiens
tggtgcaggtctccacctgca

SEQ ID NO: 6533052 - DNA, 14 bp, Homo sapiens
tggtgcagtgaaga

SEQ ID NO: 6533053 - DNA, 14 bp, Homo sapiens
tggtgcagtgtgtg

SEQ ID NO: 6533054 - DNA, 15 bp, Homo sapiens
tggtgcatgttcttt

SEQ ID NO: 6533055 - DNA, 13 bp, Homo sapiens
tggtgcattacag

SEQ ID NO: 6533056 - DNA, 16 bp, Homo sapiens
tggtgcattacagaga

SEQ ID NO: 6533057 - DNA, 19 bp, Homo sapiens
tggtgccaaaaccaggcct

SEQ ID NO: 6533058 - DNA, 18 bp, Homo sapiens
tggtgccaaatagcccca

SEQ ID NO: 6533059 - DNA, 23 bp, Homo sapiens
tggtgccaaatagccccagactg

SEQ ID NO: 6533060 - DNA, 23 bp, Homo sapiens
tggtgccaccgtccctctgcaga

SEQ ID NO: 6533061 - DNA, 17 bp, Homo sapiens
tggtgccagagaggggc

SEQ ID NO: 6533062 - DNA, 20 bp, Homo sapiens
tggtgccagatcctcttctc

SEQ ID NO: 6533063 - DNA, 13 bp, Homo sapiens
tggtgccagggtg

SEQ ID NO: 6533064 - DNA, 18 bp, Homo sapiens
tggtgccatcattgctgt

SEQ ID NO: 6533065 - DNA, 22 bp, Homo sapiens
tggtgccatcattgctgtctgc

SEQ ID NO: 6533066 - DNA, 16 bp, Homo sapiens
tggtgccatccccagg

SEQ ID NO: 6533067 - DNA, 22 bp, Homo sapiens
tggtgcccaccagctggctctg

SEQ ID NO: 6533068 - DNA, 13 bp, Homo sapiens
tggtgccccacag

SEQ ID NO: 6533069 - DNA, 12 bp, Homo sapiens
tggtgccccacc

SEQ ID NO: 6533070 - DNA, 18 bp, Homo sapiens
tggtgccccacctgcctg

SEQ ID NO: 6533071 - DNA, 19 bp, Homo sapiens
tggtgccccacctgcctgg

SEQ ID NO: 6533072 - DNA, 23 bp, Homo sapiens
tggtgccccacctgcctggtgca

SEQ ID NO: 6533073 - DNA, 14 bp, Homo sapiens
tggtgccccctggg

SEQ ID NO: 6533074 - DNA, 15 bp, Homo sapiens
tggtgcccctgctca

SEQ ID NO: 6533075 - DNA, 22 bp, Homo sapiens
tggtgcccctgctcactgggcc

SEQ ID NO: 6533076 - DNA, 17 bp, Homo sapiens
tggtgcccgtgcccgca

SEQ ID NO: 6533077 - DNA, 24 bp, Homo sapiens
tggtgccctgaacctctgatgcct

SEQ ID NO: 6533078 - DNA, 15 bp, Homo sapiens
tggtgccctggccca

SEQ ID NO: 6533079 - DNA, 20 bp, Homo sapiens
tggtgccctgttctctacca

SEQ ID NO: 6533080 - DNA, 19 bp, Homo sapiens
tggtgccgatgttgaactt

SEQ ID NO: 6533081 - DNA, 22 bp, Homo sapiens
tggtgcctaaagtttaaccaaa

SEQ ID NO: 6533082 - DNA, 23 bp, Homo sapiens
tggtgcctatatctgagagacct

SEQ ID NO: 6533083 - DNA, 22 bp, Homo sapiens
tggtgcctatttattcattcag

SEQ ID NO: 6533084 - DNA, 23 bp, Homo sapiens
tggtgcctcactgggggctttgg

SEQ ID NO: 6533085 - DNA, 14 bp, Homo sapiens
tggtgcctcctcaa

SEQ ID NO: 6533086 - DNA, 18 bp, Homo sapiens
tggtgcctgagaggcagg

SEQ ID NO: 6533087 - DNA, 14 bp, Homo sapiens
tggtgcctgagccc

SEQ ID NO: 6533088 - DNA, 11 bp, Homo sapiens
tggtgcctgcc

SEQ ID NO: 6533089 - DNA, 13 bp, Homo sapiens
tggtgcctgcctc

SEQ ID NO: 6533090 - DNA, 14 bp, Homo sapiens
tggtgcctgctttg

SEQ ID NO: 6533091 - DNA, 12 bp, Homo sapiens
tggtgcctggcc

SEQ ID NO: 6533092 - DNA, 23 bp, Homo sapiens
tggtgcctggcctggcacacatc

SEQ ID NO: 6533093 - DNA, 13 bp, Homo sapiens
tggtgcctttcct

SEQ ID NO: 6533094 - DNA, 19 bp, Homo sapiens
tggtgcctttcctgttcag

SEQ ID NO: 6533095 - DNA, 20 bp, Homo sapiens
tggtgcctttcctgttcagc

SEQ ID NO: 6533096 - DNA, 14 bp, Homo sapiens
tggtgccttttgtg

SEQ ID NO: 6533097 - DNA, 20 bp, Homo sapiens
tggtgcgatcatggctcact

SEQ ID NO: 6533098 - DNA, 14 bp, Homo sapiens
tggtgcgctgtgct

SEQ ID NO: 6533099 - DNA, 14 bp, Homo sapiens
tggtgcggctggcc

SEQ ID NO: 6533100 - DNA, 17 bp, Homo sapiens
tggtgcggctggccatg

SEQ ID NO: 6533101 - DNA, 18 bp, Homo sapiens
tggtgcgggcacaataaa

SEQ ID NO: 6533102 - DNA, 14 bp, Homo sapiens
tggtgcgggccagg

SEQ ID NO: 6533103 - DNA, 18 bp, Homo sapiens
tggtgcgggccaggtctg

SEQ ID NO: 6533104 - DNA, 22 bp, Homo sapiens
tggtgcgggccaggtctggcgc

SEQ ID NO: 6533105 - DNA, 14 bp, Homo sapiens
tggtgcgggcctgg

SEQ ID NO: 6533106 - DNA, 15 bp, Homo sapiens
tggtgcgggcctggc

SEQ ID NO: 6533107 - DNA, 20 bp, Homo sapiens
tggtgcggtaggtgctggcc

SEQ ID NO: 6533108 - DNA, 22 bp, Homo sapiens
tggtgcggtaggtgctggcctc

SEQ ID NO: 6533109 - DNA, 14 bp, Homo sapiens
tggtgcgtgtggcc

SEQ ID NO: 6533110 - DNA, 19 bp, Homo sapiens
tggtgcgtgtggccctgtg

SEQ ID NO: 6533111 - DNA, 21 bp, Homo sapiens
tggtgcgtgtggccctgtggg

SEQ ID NO: 6533112 - DNA, 21 bp, Homo sapiens
tggtgctaaagattgttaaat

SEQ ID NO: 6533113 - DNA, 14 bp, Homo sapiens
tggtgctaatgtgt

SEQ ID NO: 6533114 - DNA, 14 bp, Homo sapiens
tggtgctataacat

SEQ ID NO: 6533115 - DNA, 18 bp, Homo sapiens
tggtgctatttgaagaaa

SEQ ID NO: 6533116 - DNA, 22 bp, Homo sapiens
tggtgctcacgactcttcctgc

SEQ ID NO: 6533117 - DNA, 18 bp, Homo sapiens
tggtgctcacgtgtcctt

SEQ ID NO: 6533118 - DNA, 20 bp, Homo sapiens
tggtgctccccttcctgcca

SEQ ID NO: 6533119 - DNA, 19 bp, Homo sapiens
tggtgctcctgcccagcca

SEQ ID NO: 6533120 - DNA, 22 bp, Homo sapiens
tggtgctcgccttcggcctctc

SEQ ID NO: 6533121 - DNA, 13 bp, Homo sapiens
tggtgctctgtgt

SEQ ID NO: 6533122 - DNA, 16 bp, Homo sapiens
tggtgctcttgctttt

SEQ ID NO: 6533123 - DNA, 15 bp, Homo sapiens
tggtgctgagtgcta

SEQ ID NO: 6533124 - DNA, 14 bp, Homo sapiens
tggtgctgatggag

SEQ ID NO: 6533125 - DNA, 21 bp, Homo sapiens
tggtgctgcattgagtccagc

SEQ ID NO: 6533126 - DNA, 18 bp, Homo sapiens
tggtgctgccacacttca

SEQ ID NO: 6533127 - DNA, 14 bp, Homo sapiens
tggtgctgccgagg

SEQ ID NO: 6533128 - DNA, 18 bp, Homo sapiens
tggtgctgccgagggctg

SEQ ID NO: 6533129 - DNA, 19 bp, Homo sapiens
tggtgctgccgagggctgg

SEQ ID NO: 6533130 - DNA, 18 bp, Homo sapiens
tggtgctgccttgcttct

SEQ ID NO: 6533131 - DNA, 19 bp, Homo sapiens
tggtgctgcgcccagggag

SEQ ID NO: 6533132 - DNA, 14 bp, Homo sapiens
tggtgctgctcagg

SEQ ID NO: 6533133 - DNA, 19 bp, Homo sapiens
tggtgctgctgctgctgtg

SEQ ID NO: 6533134 - DNA, 20 bp, Homo sapiens
tggtgctggaaccagctctc

SEQ ID NO: 6533135 - DNA, 17 bp, Homo sapiens
tggtgctggatattttc

SEQ ID NO: 6533136 - DNA, 11 bp, Homo sapiens
tggtgctggga

SEQ ID NO: 6533137 - DNA, 13 bp, Homo sapiens
tggtgctgggact

SEQ ID NO: 6533138 - DNA, 20 bp, Homo sapiens
tggtgctgggagaggcagcc

SEQ ID NO: 6533139 - DNA, 22 bp, Homo sapiens
tggtgctgggagatgctctctg

SEQ ID NO: 6533140 - DNA, 20 bp, Homo sapiens
tggtgctggggagccaaagg

SEQ ID NO: 6533141 - DNA, 12 bp, Homo sapiens
tggtgctggttt

SEQ ID NO: 6533142 - DNA, 13 bp, Homo sapiens
tggtgctggttta

SEQ ID NO: 6533143 - DNA, 17 bp, Homo sapiens
tggtgctgttgaaaata

SEQ ID NO: 6533144 - DNA, 11 bp, Homo sapiens
ttcccagaggc

SEQ ID NO: 6533145 - DNA, 15 bp, Homo sapiens
ttcccagagggagca

SEQ ID NO: 6533146 - DNA, 21 bp, Homo sapiens
ttcccagcaaagttttcagat

SEQ ID NO: 6533147 - DNA, 16 bp, Homo sapiens
ttcccagcacaggcag

SEQ ID NO: 6533148 - DNA, 17 bp, Homo sapiens
ttcccagcacaggcagg

SEQ ID NO: 6533149 - DNA, 21 bp, Homo sapiens
ttcccagcactatgctttcct

SEQ ID NO: 6533150 - DNA, 23 bp, Homo sapiens
ttcccagcactatgctttccttc

SEQ ID NO: 6533151 - DNA, 21 bp, Homo sapiens
ttcccagcagtgggggtcaga

SEQ ID NO: 6533152 - DNA, 21 bp, Homo sapiens
ttcccagcattcagtggtcct

SEQ ID NO: 6533153 - DNA, 18 bp, Homo sapiens
ttcccagccatgcccagg

SEQ ID NO: 6533154 - DNA, 16 bp, Homo sapiens
ttcccagcccatatct

SEQ ID NO: 6533155 - DNA, 14 bp, Homo sapiens
ttcccagcccctgc

SEQ ID NO: 6533156 - DNA, 15 bp, Homo sapiens
ttcccagcccctgca

SEQ ID NO: 6533157 - DNA, 18 bp, Homo sapiens
ttcccagcggttcctgtg

SEQ ID NO: 6533158 - DNA, 19 bp, Homo sapiens
ttcccagcggttcctgtgc

SEQ ID NO: 6533159 - DNA, 21 bp, Homo sapiens
ttcccagctacacctttctcc

SEQ ID NO: 6533160 - DNA, 14 bp, Homo sapiens
ttcccagctccccc

SEQ ID NO: 6533161 - DNA, 15 bp, Homo sapiens
ttcccagctcccccc

SEQ ID NO: 6533162 - DNA, 18 bp, Homo sapiens
ttcccagctccccccgcc

SEQ ID NO: 6533163 - DNA, 22 bp, Homo sapiens
ttcccagctccccccgcccacc

SEQ ID NO: 6533164 - DNA, 20 bp, Homo sapiens
ttcccagctctacattctgc

SEQ ID NO: 6533165 - DNA, 16 bp, Homo sapiens
ttcccagctctccctc

SEQ ID NO: 6533166 - DNA, 15 bp, Homo sapiens
ttcccagctgcccct

SEQ ID NO: 6533167 - DNA, 22 bp, Homo sapiens
ttcccagctggcagcgcctccc

SEQ ID NO: 6533168 - DNA, 12 bp, Homo sapiens
ttcccaggaccc

SEQ ID NO: 6533169 - DNA, 19 bp, Homo sapiens
ttcccaggagaaagatgaa

SEQ ID NO: 6533170 - DNA, 21 bp, Homo sapiens
ttcccaggagatgggtccagg

SEQ ID NO: 6533171 - DNA, 21 bp, Homo sapiens
ttcccaggaggtgcagacttc

SEQ ID NO: 6533172 - DNA, 20 bp, Homo sapiens
ttcccaggagttctgctcat

SEQ ID NO: 6533173 - DNA, 20 bp, Homo sapiens
ttcccaggcaaataaaattc

SEQ ID NO: 6533174 - DNA, 22 bp, Homo sapiens
ttcccaggcaaataaaattccc

SEQ ID NO: 6533175 - DNA, 12 bp, Homo sapiens
ttcccaggcagg

SEQ ID NO: 6533176 - DNA, 22 bp, Homo sapiens
ttcccaggcagggagggaaacc

SEQ ID NO: 6533177 - DNA, 13 bp, Homo sapiens
ttcccaggccagc

SEQ ID NO: 6533178 - DNA, 17 bp, Homo sapiens
ttcccaggccagcgagg

SEQ ID NO: 6533179 - DNA, 22 bp, Homo sapiens
ttcccaggcccactgtgcctca

SEQ ID NO: 6533180 - DNA, 17 bp, Homo sapiens
ttcccaggccctttggc

SEQ ID NO: 6533181 - DNA, 18 bp, Homo sapiens
ttcccaggccctttggct

SEQ ID NO: 6533182 - DNA, 20 bp, Homo sapiens
ttcccaggccctttggcttc

SEQ ID NO: 6533183 - DNA, 22 bp, Homo sapiens
ttcccaggccctttggcttctg

SEQ ID NO: 6533184 - DNA, 12 bp, Homo sapiens
ttcccaggcctt

SEQ ID NO: 6533185 - DNA, 22 bp, Homo sapiens
ttcccagggaagtgctctgata

SEQ ID NO: 6533186 - DNA, 12 bp, Homo sapiens
ttcccagggaga

SEQ ID NO: 6533187 - DNA, 22 bp, Homo sapiens
ttcccagggagaaacccacgac

SEQ ID NO: 6533188 - DNA, 11 bp, Homo sapiens
ttcccagggca

SEQ ID NO: 6533189 - DNA, 14 bp, Homo sapiens
ttcccagggccgct

SEQ ID NO: 6533190 - DNA, 20 bp, Homo sapiens
ttcccagggccgcttctcct

SEQ ID NO: 6533191 - DNA, 23 bp, Homo sapiens
ttcccagggtagcccgcctgcca

SEQ ID NO: 6533192 - DNA, 20 bp, Homo sapiens
ttcccaggtaatttaaattg

SEQ ID NO: 6533193 - DNA, 22 bp, Homo sapiens
ttcccaggtaatttaaattggt

SEQ ID NO: 6533194 - DNA, 12 bp, Homo sapiens
ttcccaggtgct

SEQ ID NO: 6533195 - DNA, 17 bp, Homo sapiens
ttcccaggttacaatgg

SEQ ID NO: 6533196 - DNA, 18 bp, Homo sapiens
ttcccaggttctgtttat

SEQ ID NO: 6533197 - DNA, 14 bp, Homo sapiens
ttcccagtataaga

SEQ ID NO: 6533198 - DNA, 20 bp, Homo sapiens
ttcccagtcttctgacaaac

SEQ ID NO: 6533199 - DNA, 14 bp, Homo sapiens
ttcccagtgagcct

SEQ ID NO: 6533200 - DNA, 15 bp, Homo sapiens
ttcccagtgagcctc

SEQ ID NO: 6533201 - DNA, 16 bp, Homo sapiens
ttcccagtgagcctct

SEQ ID NO: 6533202 - DNA, 19 bp, Homo sapiens
ttcccagtgagcctctgcg

SEQ ID NO: 6533203 - DNA, 21 bp, Homo sapiens
ttcccataccacccaatgctg

SEQ ID NO: 6533204 - DNA, 18 bp, Homo sapiens
ttcccatacttgcataca

SEQ ID NO: 6533205 - DNA, 13 bp, Homo sapiens
ttcccatagattt

SEQ ID NO: 6533206 - DNA, 14 bp, Homo sapiens
ttcccatcaccaga

SEQ ID NO: 6533207 - DNA, 14 bp, Homo sapiens
ttcccatcctaccc

SEQ ID NO: 6533208 - DNA, 17 bp, Homo sapiens
ttcccatctccagggaa

SEQ ID NO: 6533209 - DNA, 18 bp, Homo sapiens
ttcccatctccagggaag

SEQ ID NO: 6533210 - DNA, 13 bp, Homo sapiens
ttcccatctgtgg

SEQ ID NO: 6533211 - DNA, 16 bp, Homo sapiens
ttcccatctttactcc

SEQ ID NO: 6533212 - DNA, 21 bp, Homo sapiens
ttcccatgacctaaaacactg

SEQ ID NO: 6533213 - DNA, 18 bp, Homo sapiens
ttcccatgactcttggag

SEQ ID NO: 6533214 - DNA, 16 bp, Homo sapiens
ttcccatgactgcacc

SEQ ID NO: 6533215 - DNA, 19 bp, Homo sapiens
ttcccatgactgcacccag

SEQ ID NO: 6533216 - DNA, 15 bp, Homo sapiens
ttcccatgatccaga

SEQ ID NO: 6533217 - DNA, 16 bp, Homo sapiens
ttcccatgatccagaa

SEQ ID NO: 6533218 - DNA, 21 bp, Homo sapiens
ttcccatgatttcatgtactg

SEQ ID NO: 6533219 - DNA, 14 bp, Homo sapiens
ttcccatgctgaat

SEQ ID NO: 6533220 - DNA, 16 bp, Homo sapiens
ttcccatgctgaatta

SEQ ID NO: 6533221 - DNA, 18 bp, Homo sapiens
ttcccatgctgaattatt

SEQ ID NO: 6533222 - DNA, 15 bp, Homo sapiens
ttcccatggggaggg

SEQ ID NO: 6533223 - DNA, 17 bp, Homo sapiens
ttcccatgtagccccct

SEQ ID NO: 6533224 - DNA, 16 bp, Homo sapiens
ttcccatgtatttgtt

SEQ ID NO: 6533225 - DNA, 13 bp, Homo sapiens
ttcccatgtggaa

SEQ ID NO: 6533226 - DNA, 19 bp, Homo sapiens
ttcccattaaaaatgagat

SEQ ID NO: 6533227 - DNA, 11 bp, Homo sapiens
ttcccattcca

SEQ ID NO: 6533228 - DNA, 20 bp, Homo sapiens
ttcccattgcatcacctctg

SEQ ID NO: 6533229 - DNA, 15 bp, Homo sapiens
ttcccattggctttc

SEQ ID NO: 6533230 - DNA, 23 bp, Homo sapiens
ttcccattggttcacctgtgact

SEQ ID NO: 6533231 - DNA, 17 bp, Homo sapiens
ttcccattgtggctcct

SEQ ID NO: 6533232 - DNA, 17 bp, Homo sapiens
ttcccatttactcttga

SEQ ID NO: 6533233 - DNA, 13 bp, Homo sapiens
ttcccatttagaa

SEQ ID NO: 6533234 - DNA, 22 bp, Homo sapiens
ttcccatttagaatggtgattt

SEQ ID NO: 6533235 - DNA, 13 bp, Homo sapiens
ttcccatttcttc

SEQ ID NO: 6533236 - DNA, 16 bp, Homo sapiens
ttcccatttgctcctt

SEQ ID NO: 6533237 - DNA, 13 bp, Homo sapiens
ttcccatttgtaa

SEQ ID NO: 6533238 - DNA, 19 bp, Homo sapiens
ttcccatttgttgctgctg

SEQ ID NO: 6533239 - DNA, 12 bp, Homo sapiens
ttcccattttaa

SEQ ID NO: 6533240 - DNA, 13 bp, Homo sapiens
ttcccattttgga

SEQ ID NO: 6533241 - DNA, 14 bp, Homo sapiens
ttccccaaaggcat

SEQ ID NO: 6533242 - DNA, 14 bp, Homo sapiens
ttccccaaatacaa

SEQ ID NO: 6533243 - DNA, 16 bp, Homo sapiens
ttccccaacagtgtga

SEQ ID NO: 6533244 - DNA, 23 bp, Homo sapiens
ttccccaacagtgtgaagttaga

SEQ ID NO: 6533245 - DNA, 20 bp, Homo sapiens
ttccccaacggggtggggag

SEQ ID NO: 6533246 - DNA, 21 bp, Homo sapiens
ttccccaacggggtggggagg

SEQ ID NO: 6533247 - DNA, 21 bp, Homo sapiens
ttccccaagatctgccagacc

SEQ ID NO: 6533248 - DNA, 13 bp, Homo sapiens
ttccccaaggacc

SEQ ID NO: 6533249 - DNA, 19 bp, Homo sapiens
ttccccaataaagcctttt

SEQ ID NO: 6533250 - DNA, 16 bp, Homo sapiens
ttccccacacagggca

SEQ ID NO: 6533251 - DNA, 22 bp, Homo sapiens
ttccccacacagggcactgact

SEQ ID NO: 6533252 - DNA, 13 bp, Homo sapiens
ttccccacaggtc

SEQ ID NO: 6533253 - DNA, 22 bp, Homo sapiens
ttccccacagtgacagtcactt

SEQ ID NO: 6533254 - DNA, 20 bp, Homo sapiens
ttccccaccagatgctgaaa

SEQ ID NO: 6533255 - DNA, 12 bp, Homo sapiens
ttccccacccca

SEQ ID NO: 6533256 - DNA, 13 bp, Homo sapiens
ttccccaccccat

SEQ ID NO: 6533257 - DNA, 22 bp, Homo sapiens
ttccccaccctccccttcccag

SEQ ID NO: 6533258 - DNA, 13 bp, Homo sapiens
ttccccaccgcag

SEQ ID NO: 6533259 - DNA, 17 bp, Homo sapiens
ttccccaccgccctgcc

SEQ ID NO: 6533260 - DNA, 15 bp, Homo sapiens
ttccccacctcttcc

SEQ ID NO: 6533261 - DNA, 21 bp, Homo sapiens
ttccccacctcttccttccgc

SEQ ID NO: 6533262 - DNA, 17 bp, Homo sapiens
ttccccaccttccccca

SEQ ID NO: 6533263 - DNA, 19 bp, Homo sapiens
ttccccaccttcccccaac

SEQ ID NO: 6533264 - DNA, 12 bp, Homo sapiens
ttccccactccc

SEQ ID NO: 6533265 - DNA, 20 bp, Homo sapiens
ttccccactctgctcccagc

SEQ ID NO: 6533266 - DNA, 22 bp, Homo sapiens
ttccccactctgctcccagccc

SEQ ID NO: 6533267 - DNA, 17 bp, Homo sapiens
ttccccactgcacacac

SEQ ID NO: 6533268 - DNA, 14 bp, Homo sapiens
ttccccactggagc

SEQ ID NO: 6533269 - DNA, 14 bp, Homo sapiens
ttccccagacacat

SEQ ID NO: 6533270 - DNA, 21 bp, Homo sapiens
ttccccagaccgatccttccc

SEQ ID NO: 6533271 - DNA, 17 bp, Homo sapiens
ttccccagactcagctc

SEQ ID NO: 6533272 - DNA, 21 bp, Homo sapiens
ttccccagactcagctccaga

SEQ ID NO: 6533273 - DNA, 19 bp, Homo sapiens
ttccccagagagcaggcag

SEQ ID NO: 6533274 - DNA, 20 bp, Homo sapiens
ttccccagagagcaggcagg

SEQ ID NO: 6533275 - DNA, 18 bp, Homo sapiens
ttccccagaggctcccaa

SEQ ID NO: 6533276 - DNA, 18 bp, Homo sapiens
ttccccagccacaggcca

SEQ ID NO: 6533277 - DNA, 12 bp, Homo sapiens
ttccccagccct

SEQ ID NO: 6533278 - DNA, 13 bp, Homo sapiens
ttccccagcctct

SEQ ID NO: 6533279 - DNA, 14 bp, Homo sapiens
ttccccagcctctc

SEQ ID NO: 6533280 - DNA, 12 bp, Homo sapiens
ttccccagctca

SEQ ID NO: 6533281 - DNA, 20 bp, Homo sapiens
ttccccagctcagagccccg

SEQ ID NO: 6533282 - DNA, 21 bp, Homo sapiens
ttccccagctcagagccccgc

SEQ ID NO: 6533283 - DNA, 19 bp, Homo sapiens
ttccccagctcccccaggc

SEQ ID NO: 6533284 - DNA, 20 bp, Homo sapiens
ttccccagctcccccaggca

SEQ ID NO: 6533285 - DNA, 11 bp, Homo sapiens
ttccccaggag

SEQ ID NO: 6533286 - DNA, 20 bp, Homo sapiens
ttccccaggagctctctgct

SEQ ID NO: 6533287 - DNA, 17 bp, Homo sapiens
ttccccaggaggccagc

SEQ ID NO: 6533288 - DNA, 19 bp, Homo sapiens
ttccccaggaggccagcct

SEQ ID NO: 6533289 - DNA, 23 bp, Homo sapiens
ttccccaggctgcccactctggg

SEQ ID NO: 6533290 - DNA, 16 bp, Homo sapiens
ttccccagggaaggaa

SEQ ID NO: 6533291 - DNA, 19 bp, Homo sapiens
ttccccagggttctgtatt

SEQ ID NO: 6533292 - DNA, 16 bp, Homo sapiens
ttccccagtgactcca

SEQ ID NO: 6533293 - DNA, 18 bp, Homo sapiens
ttccccagtgactccagg

SEQ ID NO: 6533294 - DNA, 11 bp, Homo sapiens
ttccccagtgt

SEQ ID NO: 6533295 - DNA, 22 bp, Homo sapiens
ttccccagtgtggccccagccc

SEQ ID NO: 6533296 - DNA, 18 bp, Homo sapiens
ttccccatacaaataagc

SEQ ID NO: 6533297 - DNA, 19 bp, Homo sapiens
ttccccatcagctcccaac

SEQ ID NO: 6533298 - DNA, 22 bp, Homo sapiens
ttccccatcccaaggcaagcat

SEQ ID NO: 6533299 - DNA, 23 bp, Homo sapiens
ttccccatcgccttctggctgct

SEQ ID NO: 6533300 - DNA, 14 bp, Homo sapiens
ttccccatctctgt

SEQ ID NO: 6533301 - DNA, 15 bp, Homo sapiens
ttccccatctgggtc

SEQ ID NO: 6533302 - DNA, 12 bp, Homo sapiens
ttccccatctgt

SEQ ID NO: 6533303 - DNA, 18 bp, Homo sapiens
ttccccatcttctaaacc

SEQ ID NO: 6533304 - DNA, 19 bp, Homo sapiens
ttccccatgaaccctgccc

SEQ ID NO: 6533305 - DNA, 12 bp, Homo sapiens
ttccccatgaca

SEQ ID NO: 6533306 - DNA, 21 bp, Homo sapiens
ttccccatgcttccttgcctg

SEQ ID NO: 6533307 - DNA, 22 bp, Homo sapiens
ttccccatgttggtcaggctgg

SEQ ID NO: 6533308 - DNA, 18 bp, Homo sapiens
ttccccattcctacccac

SEQ ID NO: 6533309 - DNA, 18 bp, Homo sapiens
ttccccattgccttctgg

SEQ ID NO: 6533310 - DNA, 23 bp, Homo sapiens
ttcccccaaactttttgttcatg

SEQ ID NO: 6533311 - DNA, 20 bp, Homo sapiens
ttcccccaaatcttcctctg

SEQ ID NO: 6533312 - DNA, 23 bp, Homo sapiens
ttcccccaccaccaaaactgctc

SEQ ID NO: 6533313 - DNA, 18 bp, Homo sapiens
ttcccccaccagctgcag

SEQ ID NO: 6533314 - DNA, 17 bp, Homo sapiens
ttcccccaccccagagt

SEQ ID NO: 6533315 - DNA, 18 bp, Homo sapiens
ttcccccaccccagagtt

SEQ ID NO: 6533316 - DNA, 21 bp, Homo sapiens
ttcccccaccccatttctctc

SEQ ID NO: 6533317 - DNA, 13 bp, Homo sapiens
ttcccccaccctc

SEQ ID NO: 6533318 - DNA, 22 bp, Homo sapiens
ttcccccaccggtccagctggc

SEQ ID NO: 6533319 - DNA, 14 bp, Homo sapiens
ttcccccagcccaa

SEQ ID NO: 6533320 - DNA, 17 bp, Homo sapiens
ttcccccagcccaataa

SEQ ID NO: 6533321 - DNA, 21 bp, Homo sapiens
ttcccccagcccaataaaggt

SEQ ID NO: 6533322 - DNA, 17 bp, Homo sapiens
tggtgcttaagttccag

SEQ ID NO: 6533323 - DNA, 13 bp, Homo sapiens
tggtgcttagttt

SEQ ID NO: 6533324 - DNA, 18 bp, Homo sapiens
tggtgcttattcttaact

SEQ ID NO: 6533325 - DNA, 22 bp, Homo sapiens
tggtgcttcagccctggcccct

SEQ ID NO: 6533326 - DNA, 19 bp, Homo sapiens
tggtgcttccaaatattgt

SEQ ID NO: 6533327 - DNA, 14 bp, Homo sapiens
tggtgcttccccca

SEQ ID NO: 6533328 - DNA, 23 bp, Homo sapiens
tggtgcttctcagatttctgagg

SEQ ID NO: 6533329 - DNA, 16 bp, Homo sapiens
tggtgcttggaggggg

SEQ ID NO: 6533330 - DNA, 19 bp, Homo sapiens
tggtgcttggagggggaag

SEQ ID NO: 6533331 - DNA, 17 bp, Homo sapiens
tggtgctttcaggtctg

SEQ ID NO: 6533332 - DNA, 15 bp, Homo sapiens
tggtgctttccttca

SEQ ID NO: 6533333 - DNA, 17 bp, Homo sapiens
tggtgctttttataaaa

SEQ ID NO: 6533334 - DNA, 22 bp, Homo sapiens
tggtggaaaaaacattttaagt

SEQ ID NO: 6533335 - DNA, 18 bp, Homo sapiens
tggtggaaaacgaagctc

SEQ ID NO: 6533336 - DNA, 12 bp, Homo sapiens
tggtggaagagg

SEQ ID NO: 6533337 - DNA, 19 bp, Homo sapiens
tggtggaagaggggacagg

SEQ ID NO: 6533338 - DNA, 16 bp, Homo sapiens
tggtggacagtcctgg

SEQ ID NO: 6533339 - DNA, 18 bp, Homo sapiens
tggtggacagtcctggga

SEQ ID NO: 6533340 - DNA, 15 bp, Homo sapiens
tggtggactacaaaa

SEQ ID NO: 6533341 - DNA, 16 bp, Homo sapiens
tggtggagcagccaga

SEQ ID NO: 6533342 - DNA, 15 bp, Homo sapiens
tggtggagccagggc

SEQ ID NO: 6533343 - DNA, 23 bp, Homo sapiens
tggtggaggaaacttccaacttt

SEQ ID NO: 6533344 - DNA, 19 bp, Homo sapiens
tggtggaggaagggctggg

SEQ ID NO: 6533345 - DNA, 14 bp, Homo sapiens
tggtggaggattgc

SEQ ID NO: 6533346 - DNA, 21 bp, Homo sapiens
tggtggaggattgctgccaga

SEQ ID NO: 6533347 - DNA, 13 bp, Homo sapiens
tggtggagggcca

SEQ ID NO: 6533348 - DNA, 22 bp, Homo sapiens
tggtggaggggcgcccagggtc

SEQ ID NO: 6533349 - DNA, 15 bp, Homo sapiens
tggtggagggggctg

SEQ ID NO: 6533350 - DNA, 18 bp, Homo sapiens
tggtggagtcaggaaaga

SEQ ID NO: 6533351 - DNA, 16 bp, Homo sapiens
tggtggagtgagagcc

SEQ ID NO: 6533352 - DNA, 16 bp, Homo sapiens
tggtggatgaggcttc

SEQ ID NO: 6533353 - DNA, 16 bp, Homo sapiens
tggtggatgggccctg

SEQ ID NO: 6533354 - DNA, 19 bp, Homo sapiens
tggtggcaaccccagaccc

SEQ ID NO: 6533355 - DNA, 16 bp, Homo sapiens
tggtggcaagagcccc

SEQ ID NO: 6533356 - DNA, 15 bp, Homo sapiens
tggtggcacaggccc

SEQ ID NO: 6533357 - DNA, 11 bp, Homo sapiens
tggtggcacat

SEQ ID NO: 6533358 - DNA, 21 bp, Homo sapiens
tggtggcaccagatgcaacct

SEQ ID NO: 6533359 - DNA, 17 bp, Homo sapiens
tggtggcacgtgcctgt

SEQ ID NO: 6533360 - DNA, 18 bp, Homo sapiens
tggtggcagtgggagctg

SEQ ID NO: 6533361 - DNA, 20 bp, Homo sapiens
tggtggcagtgggagctgcc

SEQ ID NO: 6533362 - DNA, 15 bp, Homo sapiens
tggtggcatcacaga

SEQ ID NO: 6533363 - DNA, 16 bp, Homo sapiens
tggtggcatgtgcctg

SEQ ID NO: 6533364 - DNA, 21 bp, Homo sapiens
tggtggcatttttgcttccta

SEQ ID NO: 6533365 - DNA, 17 bp, Homo sapiens
tggtggccaagcctgcc

SEQ ID NO: 6533366 - DNA, 18 bp, Homo sapiens
tggtggccaagcctgccc

SEQ ID NO: 6533367 - DNA, 17 bp, Homo sapiens
tggtggccactgagctg

SEQ ID NO: 6533368 - DNA, 18 bp, Homo sapiens
tggtggccactgagctgg

SEQ ID NO: 6533369 - DNA, 15 bp, Homo sapiens
tggtggccaggctgg

SEQ ID NO: 6533370 - DNA, 17 bp, Homo sapiens
tggtggccaggctggta

SEQ ID NO: 6533371 - DNA, 14 bp, Homo sapiens
tggtggccatgctc

SEQ ID NO: 6533372 - DNA, 20 bp, Homo sapiens
tggtggccatgtcgcctgcc

SEQ ID NO: 6533373 - DNA, 13 bp, Homo sapiens
tggtggcccagct

SEQ ID NO: 6533374 - DNA, 11 bp, Homo sapiens
tggtggcccca

SEQ ID NO: 6533375 - DNA, 19 bp, Homo sapiens
tggtggccccgacaggtct

SEQ ID NO: 6533376 - DNA, 22 bp, Homo sapiens
tggtggccccgacaggtcttcc

SEQ ID NO: 6533377 - DNA, 19 bp, Homo sapiens
tggtggcccgacagcctgg

SEQ ID NO: 6533378 - DNA, 21 bp, Homo sapiens
tggtggcccgacagcctggca

SEQ ID NO: 6533379 - DNA, 22 bp, Homo sapiens
tggtggccctctcccctgcccc

SEQ ID NO: 6533380 - DNA, 13 bp, Homo sapiens
tggtggccctggg

SEQ ID NO: 6533381 - DNA, 21 bp, Homo sapiens
tggtggccctgtgcctgggcc

SEQ ID NO: 6533382 - DNA, 10 bp, Homo sapiens
tggtggcctc

SEQ ID NO: 6533383 - DNA, 13 bp, Homo sapiens
tggtggcctcagc

SEQ ID NO: 6533384 - DNA, 22 bp, Homo sapiens
tggtggcggcggcacttcaagc

SEQ ID NO: 6533385 - DNA, 19 bp, Homo sapiens
tggtggctcatgcctgtga

SEQ ID NO: 6533386 - DNA, 14 bp, Homo sapiens
tggtggctcatggc

SEQ ID NO: 6533387 - DNA, 20 bp, Homo sapiens
tggtggctccccctctgctt

SEQ ID NO: 6533388 - DNA, 21 bp, Homo sapiens
tggtggctcccggagggccct

SEQ ID NO: 6533389 - DNA, 13 bp, Homo sapiens
tggtggctggagg

SEQ ID NO: 6533390 - DNA, 16 bp, Homo sapiens
tggtggctgggctgct

SEQ ID NO: 6533391 - DNA, 20 bp, Homo sapiens
tggtggctgggctgctcctg

SEQ ID NO: 6533392 - DNA, 14 bp, Homo sapiens
tggtggctgtgtct

SEQ ID NO: 6533393 - DNA, 14 bp, Homo sapiens
tggtggcttcagct

SEQ ID NO: 6533394 - DNA, 16 bp, Homo sapiens
tggtggcttcagctcc

SEQ ID NO: 6533395 - DNA, 17 bp, Homo sapiens
tggtggcttcagctcca

SEQ ID NO: 6533396 - DNA, 14 bp, Homo sapiens
tggtggcttctcca

SEQ ID NO: 6533397 - DNA, 13 bp, Homo sapiens
tggtggctttcct

SEQ ID NO: 6533398 - DNA, 20 bp, Homo sapiens
tggtggctttttttaaaatt

SEQ ID NO: 6533399 - DNA, 14 bp, Homo sapiens
tggtgggaaaatgt

SEQ ID NO: 6533400 - DNA, 18 bp, Homo sapiens
tggtgggaaccctcccca

SEQ ID NO: 6533401 - DNA, 19 bp, Homo sapiens
tggtgggaagcaagcaggg

SEQ ID NO: 6533402 - DNA, 21 bp, Homo sapiens
tggtgggaagcgtctgtccgt

SEQ ID NO: 6533403 - DNA, 19 bp, Homo sapiens
tggtgggacactgggcagc

SEQ ID NO: 6533404 - DNA, 22 bp, Homo sapiens
tggtgggacactgggcagcaag

SEQ ID NO: 6533405 - DNA, 23 bp, Homo sapiens
tggtgggagacgaacggaagggt

SEQ ID NO: 6533406 - DNA, 12 bp, Homo sapiens
tggtgggagggg

SEQ ID NO: 6533407 - DNA, 22 bp, Homo sapiens
tggtgggaggggcgcccacctc

SEQ ID NO: 6533408 - DNA, 23 bp, Homo sapiens
tggtgggaggggcgcccacctcc

SEQ ID NO: 6533409 - DNA, 15 bp, Homo sapiens
tggtgggagggggag

SEQ ID NO: 6533410 - DNA, 15 bp, Homo sapiens
tggtgggaggggtgt

SEQ ID NO: 6533411 - DNA, 23 bp, Homo sapiens
tggtgggagggttggcacctgca

SEQ ID NO: 6533412 - DNA, 20 bp, Homo sapiens
tggtgggataggagggtgcc

SEQ ID NO: 6533413 - DNA, 14 bp, Homo sapiens
tggtgggatccacg

SEQ ID NO: 6533414 - DNA, 22 bp, Homo sapiens
tggtgggcaggatctcaagcca

SEQ ID NO: 6533415 - DNA, 23 bp, Homo sapiens
tggtgggccaacaaagaacacta

SEQ ID NO: 6533416 - DNA, 21 bp, Homo sapiens
tggtgggctgatttacatgta

SEQ ID NO: 6533417 - DNA, 18 bp, Homo sapiens
tggtgggctggcccagcc

SEQ ID NO: 6533418 - DNA, 16 bp, Homo sapiens
tggtggggatattttt

SEQ ID NO: 6533419 - DNA, 14 bp, Homo sapiens
tggtggggcagctc

SEQ ID NO: 6533420 - DNA, 24 bp, Homo sapiens
tggtggggccaggccaggaccaca

SEQ ID NO: 6533421 - DNA, 15 bp, Homo sapiens
tggtggggcccccag

SEQ ID NO: 6533422 - DNA, 20 bp, Homo sapiens
tggtggggcccccagcaccc

SEQ ID NO: 6533423 - DNA, 21 bp, Homo sapiens
tggtggggcccccagcaccct

SEQ ID NO: 6533424 - DNA, 19 bp, Homo sapiens
tggtgggggagcctctgga

SEQ ID NO: 6533425 - DNA, 13 bp, Homo sapiens
tggtggggggcag

SEQ ID NO: 6533426 - DNA, 13 bp, Homo sapiens
tggtggggtggca

SEQ ID NO: 6533427 - DNA, 23 bp, Homo sapiens
tggtggggtgtgttccaactgcc

SEQ ID NO: 6533428 - DNA, 12 bp, Homo sapiens
tggtgggtaatt

SEQ ID NO: 6533429 - DNA, 22 bp, Homo sapiens
tggtgggtaattgtacaataaa

SEQ ID NO: 6533430 - DNA, 21 bp, Homo sapiens
tggtgggttcaggggactcag

SEQ ID NO: 6533431 - DNA, 22 bp, Homo sapiens
tggtgggttgaatatagcctgc

SEQ ID NO: 6533432 - DNA, 16 bp, Homo sapiens
tggtggtaaccctggt

SEQ ID NO: 6533433 - DNA, 14 bp, Homo sapiens
tggtggtactttat

SEQ ID NO: 6533434 - DNA, 18 bp, Homo sapiens
tggtggtactttattctt

SEQ ID NO: 6533435 - DNA, 22 bp, Homo sapiens
tggtggtactttattcttgctg

SEQ ID NO: 6533436 - DNA, 13 bp, Homo sapiens
tggtggtagaaat

SEQ ID NO: 6533437 - DNA, 12 bp, Homo sapiens
tggtggtatctg

SEQ ID NO: 6533438 - DNA, 14 bp, Homo sapiens
tggtggtattctgt

SEQ ID NO: 6533439 - DNA, 17 bp, Homo sapiens
tggtggtattctgtcat

SEQ ID NO: 6533440 - DNA, 18 bp, Homo sapiens
tggtggtcacaggctgtg

SEQ ID NO: 6533441 - DNA, 14 bp, Homo sapiens
tggtggtccctggg

SEQ ID NO: 6533442 - DNA, 15 bp, Homo sapiens
tggtggtccctgggt

SEQ ID NO: 6533443 - DNA, 13 bp, Homo sapiens
tggtggtgaaggg

SEQ ID NO: 6533444 - DNA, 16 bp, Homo sapiens
tggtggtgaaggggct

SEQ ID NO: 6533445 - DNA, 12 bp, Homo sapiens
tggtggtgcagc

SEQ ID NO: 6533446 - DNA, 13 bp, Homo sapiens
tggtggtgctaaa

SEQ ID NO: 6533447 - DNA, 18 bp, Homo sapiens
tggtggttaaggccaggg

SEQ ID NO: 6533448 - DNA, 17 bp, Homo sapiens
tggtggttcattccaca

SEQ ID NO: 6533449 - DNA, 22 bp, Homo sapiens
tggtggttcctttgcaccctgt

SEQ ID NO: 6533450 - DNA, 14 bp, Homo sapiens
tggtggttgctgtt

SEQ ID NO: 6533451 - DNA, 15 bp, Homo sapiens
tggtggttgtgcctt

SEQ ID NO: 6533452 - DNA, 17 bp, Homo sapiens
tggtggtttcagaaatg

SEQ ID NO: 6533453 - DNA, 18 bp, Homo sapiens
tggtggtttcagaaatgt

SEQ ID NO: 6533454 - DNA, 18 bp, Homo sapiens
tggtggtttctatacatg

SEQ ID NO: 6533455 - DNA, 17 bp, Homo sapiens
tggtggtttgattgttt

SEQ ID NO: 6533456 - DNA, 22 bp, Homo sapiens
tggtggttttcagagcaggagg

SEQ ID NO: 6533457 - DNA, 19 bp, Homo sapiens
tggtggttttctgttcttt

SEQ ID NO: 6533458 - DNA, 16 bp, Homo sapiens
tggtggtttttcagct

SEQ ID NO: 6533459 - DNA, 18 bp, Homo sapiens
tggtgtaaagctggccct

SEQ ID NO: 6533460 - DNA, 19 bp, Homo sapiens
tggtgtaaagctggccctg

SEQ ID NO: 6533461 - DNA, 16 bp, Homo sapiens
tggtgtaataagacat

SEQ ID NO: 6533462 - DNA, 17 bp, Homo sapiens
tggtgtaataagacata

SEQ ID NO: 6533463 - DNA, 16 bp, Homo sapiens
tggtgtaatctcaatg

SEQ ID NO: 6533464 - DNA, 20 bp, Homo sapiens
tggtgtactctaggacttca

SEQ ID NO: 6533465 - DNA, 22 bp, Homo sapiens
tggtgtactctaggacttcaaa

SEQ ID NO: 6533466 - DNA, 15 bp, Homo sapiens
tggtgtagaacacta

SEQ ID NO: 6533467 - DNA, 21 bp, Homo sapiens
tggtgtagaacactaattcat

SEQ ID NO: 6533468 - DNA, 13 bp, Homo sapiens
tggtgtagtcttt

SEQ ID NO: 6533469 - DNA, 15 bp, Homo sapiens
tggtgtatgcacagg

SEQ ID NO: 6533470 - DNA, 15 bp, Homo sapiens
tggtgtcaccagcct

SEQ ID NO: 6533471 - DNA, 14 bp, Homo sapiens
tggtgtcaccccag

SEQ ID NO: 6533472 - DNA, 15 bp, Homo sapiens
tggtgtcaccccaga

SEQ ID NO: 6533473 - DNA, 16 bp, Homo sapiens
tggtgtcaccccagag

SEQ ID NO: 6533474 - DNA, 17 bp, Homo sapiens
tggtgtcaccccagagc

SEQ ID NO: 6533475 - DNA, 21 bp, Homo sapiens
tggtgtcaccccagagccaca

SEQ ID NO: 6533476 - DNA, 16 bp, Homo sapiens
tggtgtcacctgaaga

SEQ ID NO: 6533477 - DNA, 12 bp, Homo sapiens
tggtgtcactgt

SEQ ID NO: 6533478 - DNA, 21 bp, Homo sapiens
tggtgtcactgtccctcctgg

SEQ ID NO: 6533479 - DNA, 22 bp, Homo sapiens
tggtgtcactgtccctcctggt

SEQ ID NO: 6533480 - DNA, 16 bp, Homo sapiens
tggtgtcacttactgt

SEQ ID NO: 6533481 - DNA, 20 bp, Homo sapiens
tggtgtcacttactgtttct

SEQ ID NO: 6533482 - DNA, 18 bp, Homo sapiens
tggtgtcagaccctggag

SEQ ID NO: 6533483 - DNA, 19 bp, Homo sapiens
tggtgtcagaccctggagg

SEQ ID NO: 6533484 - DNA, 21 bp, Homo sapiens
tggtgtcagcccctcttccct

SEQ ID NO: 6533485 - DNA, 14 bp, Homo sapiens
tggtgtcaggcagg

SEQ ID NO: 6533486 - DNA, 15 bp, Homo sapiens
tggtgtcataactag

SEQ ID NO: 6533487 - DNA, 20 bp, Homo sapiens
tggtgtcatagaatagcatg

SEQ ID NO: 6533488 - DNA, 23 bp, Homo sapiens
tggtgtcatctgctccttcctgt

SEQ ID NO: 6533489 - DNA, 22 bp, Homo sapiens
tggtgtcatgaggaaaaaaaat

SEQ ID NO: 6533490 - DNA, 19 bp, Homo sapiens
tggtgtcattattccatct

SEQ ID NO: 6533491 - DNA, 16 bp, Homo sapiens
tggtgtcattctgcct

SEQ ID NO: 6533492 - DNA, 18 bp, Homo sapiens
tggtgtcattctgcctgc

SEQ ID NO: 6533493 - DNA, 17 bp, Homo sapiens
tggtgtcattttcttga

SEQ ID NO: 6533494 - DNA, 18 bp, Homo sapiens
tggtgtccagacagagcc

SEQ ID NO: 6533495 - DNA, 21 bp, Homo sapiens
tggtgtccagacagagccctg

SEQ ID NO: 6533496 - DNA, 20 bp, Homo sapiens
tggtgtccagcatggatgaa

SEQ ID NO: 6533497 - DNA, 13 bp, Homo sapiens
tggtgtccagctg

SEQ ID NO: 6533498 - DNA, 17 bp, Homo sapiens
tggtgtccagctgagtt

SEQ ID NO: 6533499 - DNA, 13 bp, Homo sapiens
tggtgtccccttc

SEQ ID NO: 6533500 - DNA, 18 bp, Homo sapiens
tggtgtccctgcctggcc

SEQ ID NO: 6533501 - DNA, 13 bp, Homo sapiens
ttcccccagccct

SEQ ID NO: 6533502 - DNA, 19 bp, Homo sapiens
ttcccccaggcgcctgcgc

SEQ ID NO: 6533503 - DNA, 18 bp, Homo sapiens
ttcccccagggtcccctg

SEQ ID NO: 6533504 - DNA, 13 bp, Homo sapiens
ttcccccatccct

SEQ ID NO: 6533505 - DNA, 16 bp, Homo sapiens
ttcccccatccctacc

SEQ ID NO: 6533506 - DNA, 18 bp, Homo sapiens
ttccccccaccccccagc

SEQ ID NO: 6533507 - DNA, 20 bp, Homo sapiens
ttccccccatctctgagtgg

SEQ ID NO: 6533508 - DNA, 17 bp, Homo sapiens
ttcccccccctttccta

SEQ ID NO: 6533509 - DNA, 20 bp, Homo sapiens
ttcccccctctcctcccagc

SEQ ID NO: 6533510 - DNA, 19 bp, Homo sapiens
ttcccccgctggcagccac

SEQ ID NO: 6533511 - DNA, 14 bp, Homo sapiens
ttccccctccccca

SEQ ID NO: 6533512 - DNA, 20 bp, Homo sapiens
ttccccctccccctcctgct

SEQ ID NO: 6533513 - DNA, 14 bp, Homo sapiens
ttccccctgccctg

SEQ ID NO: 6533514 - DNA, 22 bp, Homo sapiens
ttccccctgcttccacctcacc

SEQ ID NO: 6533515 - DNA, 10 bp, Homo sapiens
ttcccccttc

SEQ ID NO: 6533516 - DNA, 11 bp, Homo sapiens
ttcccccttcc

SEQ ID NO: 6533517 - DNA, 17 bp, Homo sapiens
ttcccccttccaaataa

SEQ ID NO: 6533518 - DNA, 21 bp, Homo sapiens
ttcccccttccaaataataaa

SEQ ID NO: 6533519 - DNA, 17 bp, Homo sapiens
ttccccctttctctgcc

SEQ ID NO: 6533520 - DNA, 23 bp, Homo sapiens
ttccccctttctctgcctggcaa

SEQ ID NO: 6533521 - DNA, 14 bp, Homo sapiens
ttccccctttcttc

SEQ ID NO: 6533522 - DNA, 15 bp, Homo sapiens
ttccccctttcttcc

SEQ ID NO: 6533523 - DNA, 20 bp, Homo sapiens
ttccccgaagagtcagcccc

SEQ ID NO: 6533524 - DNA, 16 bp, Homo sapiens
ttccccgagggatgat

SEQ ID NO: 6533525 - DNA, 22 bp, Homo sapiens
ttccccgagggatgatgccaca

SEQ ID NO: 6533526 - DNA, 23 bp, Homo sapiens
ttccccgagggatgatgccacac

SEQ ID NO: 6533527 - DNA, 18 bp, Homo sapiens
ttccccgagtgactctgg

SEQ ID NO: 6533528 - DNA, 21 bp, Homo sapiens
ttccccgatgtgagccgcctc

SEQ ID NO: 6533529 - DNA, 19 bp, Homo sapiens
ttccccgcaacccacagct

SEQ ID NO: 6533530 - DNA, 15 bp, Homo sapiens
ttccccgcctgcagt

SEQ ID NO: 6533531 - DNA, 17 bp, Homo sapiens
ttccccggtcccttgag

SEQ ID NO: 6533532 - DNA, 22 bp, Homo sapiens
ttccccgtgcatgatttactct

SEQ ID NO: 6533533 - DNA, 19 bp, Homo sapiens
ttcccctaacctcattccc

SEQ ID NO: 6533534 - DNA, 15 bp, Homo sapiens
ttcccctaagtggat

SEQ ID NO: 6533535 - DNA, 16 bp, Homo sapiens
ttcccctaattttcca

SEQ ID NO: 6533536 - DNA, 18 bp, Homo sapiens
ttcccctatcctgttctt

SEQ ID NO: 6533537 - DNA, 13 bp, Homo sapiens
ttcccctccacca

SEQ ID NO: 6533538 - DNA, 13 bp, Homo sapiens
ttcccctccagga

SEQ ID NO: 6533539 - DNA, 16 bp, Homo sapiens
ttcccctcccccactc

SEQ ID NO: 6533540 - DNA, 21 bp, Homo sapiens
ttcccctcccccactcctcta

SEQ ID NO: 6533541 - DNA, 13 bp, Homo sapiens
ttcccctccccct

SEQ ID NO: 6533542 - DNA, 21 bp, Homo sapiens
ttcccctcccgattgagcctt

SEQ ID NO: 6533543 - DNA, 22 bp, Homo sapiens
ttcccctcccgcttcctccggc

SEQ ID NO: 6533544 - DNA, 12 bp, Homo sapiens
ttcccctcccta

SEQ ID NO: 6533545 - DNA, 17 bp, Homo sapiens
ttcccctccctcccaca

SEQ ID NO: 6533546 - DNA, 13 bp, Homo sapiens
ttcccctccctgg

SEQ ID NO: 6533547 - DNA, 16 bp, Homo sapiens
ttcccctcctacccct

SEQ ID NO: 6533548 - DNA, 19 bp, Homo sapiens
ttcccctcctacccctccc

SEQ ID NO: 6533549 - DNA, 20 bp, Homo sapiens
ttcccctcctacccctccca

SEQ ID NO: 6533550 - DNA, 21 bp, Homo sapiens
ttcccctcctacccctcccag

SEQ ID NO: 6533551 - DNA, 18 bp, Homo sapiens
ttcccctcctttgtcttt

SEQ ID NO: 6533552 - DNA, 15 bp, Homo sapiens
ttcccctcgctgtcc

SEQ ID NO: 6533553 - DNA, 19 bp, Homo sapiens
ttcccctcgctgtcctgct

SEQ ID NO: 6533554 - DNA, 13 bp, Homo sapiens
ttcccctctcgcg

SEQ ID NO: 6533555 - DNA, 15 bp, Homo sapiens
ttcccctctgctgct

SEQ ID NO: 6533556 - DNA, 18 bp, Homo sapiens
ttcccctctgctgctgtc

SEQ ID NO: 6533557 - DNA, 14 bp, Homo sapiens
ttcccctctggctt

SEQ ID NO: 6533558 - DNA, 22 bp, Homo sapiens
ttcccctctgtgtcctctcccc

SEQ ID NO: 6533559 - DNA, 23 bp, Homo sapiens
ttcccctctgtgtcctctcccct

SEQ ID NO: 6533560 - DNA, 16 bp, Homo sapiens
ttcccctcttgtctcc

SEQ ID NO: 6533561 - DNA, 12 bp, Homo sapiens
ttcccctgaaga

SEQ ID NO: 6533562 - DNA, 13 bp, Homo sapiens
ttcccctgcaatg

SEQ ID NO: 6533563 - DNA, 22 bp, Homo sapiens
ttcccctgcaatgcgtcttgtg

SEQ ID NO: 6533564 - DNA, 23 bp, Homo sapiens
ttcccctgcaatgcgtcttgtga

SEQ ID NO: 6533565 - DNA, 13 bp, Homo sapiens
ttcccctgcacct

SEQ ID NO: 6533566 - DNA, 18 bp, Homo sapiens
ttcccctgcacctggcct

SEQ ID NO: 6533567 - DNA, 17 bp, Homo sapiens
ttcccctgcgccctccc

SEQ ID NO: 6533568 - DNA, 19 bp, Homo sapiens
ttcccctgctgaccttgga

SEQ ID NO: 6533569 - DNA, 12 bp, Homo sapiens
ttcccctggcct

SEQ ID NO: 6533570 - DNA, 13 bp, Homo sapiens
ttcccctggcctt

SEQ ID NO: 6533571 - DNA, 12 bp, Homo sapiens
ttcccctgggaa

SEQ ID NO: 6533572 - DNA, 21 bp, Homo sapiens
ttcccctgtcagtttcccctc

SEQ ID NO: 6533573 - DNA, 16 bp, Homo sapiens
ttcccctgtcctgtga

SEQ ID NO: 6533574 - DNA, 17 bp, Homo sapiens
ttcccctgtcctgtgaa

SEQ ID NO: 6533575 - DNA, 18 bp, Homo sapiens
ttcccctgtcctgtgaat

SEQ ID NO: 6533576 - DNA, 12 bp, Homo sapiens
ttcccctgtctt

SEQ ID NO: 6533577 - DNA, 22 bp, Homo sapiens
ttcccctgtcttcacctgccac

SEQ ID NO: 6533578 - DNA, 12 bp, Homo sapiens
ttcccctgtgtc

SEQ ID NO: 6533579 - DNA, 14 bp, Homo sapiens
ttcccctgttcact

SEQ ID NO: 6533580 - DNA, 19 bp, Homo sapiens
ttccccttagaaacactgc

SEQ ID NO: 6533581 - DNA, 20 bp, Homo sapiens
ttccccttagagtgctgtga

SEQ ID NO: 6533582 - DNA, 17 bp, Homo sapiens
ttccccttatcctccct

SEQ ID NO: 6533583 - DNA, 18 bp, Homo sapiens
ttccccttcagaccttgc

SEQ ID NO: 6533584 - DNA, 14 bp, Homo sapiens
ttccccttccctta

SEQ ID NO: 6533585 - DNA, 12 bp, Homo sapiens
ttccccttccta

SEQ ID NO: 6533586 - DNA, 13 bp, Homo sapiens
ttccccttccttc

SEQ ID NO: 6533587 - DNA, 19 bp, Homo sapiens
ttccccttctgtgtcacag

SEQ ID NO: 6533588 - DNA, 23 bp, Homo sapiens
ttccccttgccacggtttatcct

SEQ ID NO: 6533589 - DNA, 23 bp, Homo sapiens
ttccccttgcccagggctcagcc

SEQ ID NO: 6533590 - DNA, 17 bp, Homo sapiens
ttccccttgtccctggg

SEQ ID NO: 6533591 - DNA, 17 bp, Homo sapiens
ttcccctttactcagcc

SEQ ID NO: 6533592 - DNA, 14 bp, Homo sapiens
ttcccctttcccca

SEQ ID NO: 6533593 - DNA, 12 bp, Homo sapiens
ttcccctttcct

SEQ ID NO: 6533594 - DNA, 12 bp, Homo sapiens
ttcccctttctc

SEQ ID NO: 6533595 - DNA, 17 bp, Homo sapiens
ttcccctttctttcctt

SEQ ID NO: 6533596 - DNA, 20 bp, Homo sapiens
ttccccttttgcctggctgt

SEQ ID NO: 6533597 - DNA, 22 bp, Homo sapiens
ttccccttttgcctggctgtgg

SEQ ID NO: 6533598 - DNA, 23 bp, Homo sapiens
ttcccgaaccccaaggagggaga

SEQ ID NO: 6533599 - DNA, 16 bp, Homo sapiens
ttcccgaagtaaaata

SEQ ID NO: 6533600 - DNA, 21 bp, Homo sapiens
ttcccgacccagccagctgca

SEQ ID NO: 6533601 - DNA, 15 bp, Homo sapiens
ttcccgagggagctg

SEQ ID NO: 6533602 - DNA, 23 bp, Homo sapiens
ttcccgatggtctctctccctct

SEQ ID NO: 6533603 - DNA, 13 bp, Homo sapiens
ttcccgcacatgg

SEQ ID NO: 6533604 - DNA, 15 bp, Homo sapiens
ttcccgcagcaccag

SEQ ID NO: 6533605 - DNA, 19 bp, Homo sapiens
ttcccgcagcaccagcctg

SEQ ID NO: 6533606 - DNA, 16 bp, Homo sapiens
ttcccgcatggttttt

SEQ ID NO: 6533607 - DNA, 15 bp, Homo sapiens
ttcccgccccacctc

SEQ ID NO: 6533608 - DNA, 18 bp, Homo sapiens
ttcccgccccacctccca

SEQ ID NO: 6533609 - DNA, 16 bp, Homo sapiens
ttcccgccctccccct

SEQ ID NO: 6533610 - DNA, 19 bp, Homo sapiens
ttcccgccgcccagcccac

SEQ ID NO: 6533611 - DNA, 17 bp, Homo sapiens
ttcccgccggaggccag

SEQ ID NO: 6533612 - DNA, 16 bp, Homo sapiens
ttcccgcctcagcctc

SEQ ID NO: 6533613 - DNA, 14 bp, Homo sapiens
ttcccgcctcggct

SEQ ID NO: 6533614 - DNA, 18 bp, Homo sapiens
ttcccgccttcaggttcc

SEQ ID NO: 6533615 - DNA, 20 bp, Homo sapiens
ttcccgccttgggcttgcag

SEQ ID NO: 6533616 - DNA, 12 bp, Homo sapiens
ttcccgctcagc

SEQ ID NO: 6533617 - DNA, 15 bp, Homo sapiens
ttcccgctcagccct

SEQ ID NO: 6533618 - DNA, 14 bp, Homo sapiens
ttcccgctccccac

SEQ ID NO: 6533619 - DNA, 21 bp, Homo sapiens
ttcccgctgcacatggacaga

SEQ ID NO: 6533620 - DNA, 21 bp, Homo sapiens
ttcccggactgcaagcagggc

SEQ ID NO: 6533621 - DNA, 18 bp, Homo sapiens
ttcccggagcacagccct

SEQ ID NO: 6533622 - DNA, 23 bp, Homo sapiens
ttcccggagcacagccctgggag

SEQ ID NO: 6533623 - DNA, 22 bp, Homo sapiens
ttcccggcccccggccaaggac

SEQ ID NO: 6533624 - DNA, 14 bp, Homo sapiens
ttcccggctggact

SEQ ID NO: 6533625 - DNA, 22 bp, Homo sapiens
ttcccgggagctgggccctgcc

SEQ ID NO: 6533626 - DNA, 23 bp, Homo sapiens
ttcccgggagctgggccctgcct

SEQ ID NO: 6533627 - DNA, 18 bp, Homo sapiens
ttcccgggccctcagccc

SEQ ID NO: 6533628 - DNA, 17 bp, Homo sapiens
ttcccgtataataaaac

SEQ ID NO: 6533629 - DNA, 17 bp, Homo sapiens
ttcccgtgcctgggaga

SEQ ID NO: 6533630 - DNA, 15 bp, Homo sapiens
ttcccgtggccccag

SEQ ID NO: 6533631 - DNA, 17 bp, Homo sapiens
ttcccgtgtgcctgagc

SEQ ID NO: 6533632 - DNA, 23 bp, Homo sapiens
ttccctaaacaaaagcaaagatg

SEQ ID NO: 6533633 - DNA, 13 bp, Homo sapiens
ttccctaaactgc

SEQ ID NO: 6533634 - DNA, 14 bp, Homo sapiens
ttccctaaactgca

SEQ ID NO: 6533635 - DNA, 18 bp, Homo sapiens
ttccctaacttgtgaaga

SEQ ID NO: 6533636 - DNA, 12 bp, Homo sapiens
ttccctaagcca

SEQ ID NO: 6533637 - DNA, 15 bp, Homo sapiens
ttccctaagccaagg

SEQ ID NO: 6533638 - DNA, 20 bp, Homo sapiens
ttccctaattctgccttaaa

SEQ ID NO: 6533639 - DNA, 17 bp, Homo sapiens
ttccctacacagggcct

SEQ ID NO: 6533640 - DNA, 17 bp, Homo sapiens
ttccctacagaaaagaa

SEQ ID NO: 6533641 - DNA, 19 bp, Homo sapiens
ttccctacagcctagggca

SEQ ID NO: 6533642 - DNA, 15 bp, Homo sapiens
ttccctacccacagg

SEQ ID NO: 6533643 - DNA, 16 bp, Homo sapiens
ttccctaccctctaga

SEQ ID NO: 6533644 - DNA, 20 bp, Homo sapiens
ttccctaccctctagagaaa

SEQ ID NO: 6533645 - DNA, 17 bp, Homo sapiens
ttccctacccttcctgc

SEQ ID NO: 6533646 - DNA, 14 bp, Homo sapiens
ttccctacctcagg

SEQ ID NO: 6533647 - DNA, 19 bp, Homo sapiens
ttccctactaacatcccaa

SEQ ID NO: 6533648 - DNA, 16 bp, Homo sapiens
ttccctacttcctgtg

SEQ ID NO: 6533649 - DNA, 18 bp, Homo sapiens
ttccctagaaagccatat

SEQ ID NO: 6533650 - DNA, 15 bp, Homo sapiens
ttccctagactctgt

SEQ ID NO: 6533651 - DNA, 11 bp, Homo sapiens
ttccctagaga

SEQ ID NO: 6533652 - DNA, 13 bp, Homo sapiens
ttccctagcagga

SEQ ID NO: 6533653 - DNA, 18 bp, Homo sapiens
ttccctagcttattttgt

SEQ ID NO: 6533654 - DNA, 22 bp, Homo sapiens
ttccctaggatcccgtcttcca

SEQ ID NO: 6533655 - DNA, 14 bp, Homo sapiens
ttccctagttcttt

SEQ ID NO: 6533656 - DNA, 17 bp, Homo sapiens
ttccctagttctttgca

SEQ ID NO: 6533657 - DNA, 22 bp, Homo sapiens
ttccctataggaacagcccagc

SEQ ID NO: 6533658 - DNA, 23 bp, Homo sapiens
ttccctatcaaaacatatcaatt

SEQ ID NO: 6533659 - DNA, 14 bp, Homo sapiens
ttccctatctgcaa

SEQ ID NO: 6533660 - DNA, 16 bp, Homo sapiens
ttccctatctttgcca

SEQ ID NO: 6533661 - DNA, 13 bp, Homo sapiens
ttccctatctttt

SEQ ID NO: 6533662 - DNA, 16 bp, Homo sapiens
ttccctatggagaggc

SEQ ID NO: 6533663 - DNA, 21 bp, Homo sapiens
ttccctatggagaggcttccc

SEQ ID NO: 6533664 - DNA, 20 bp, Homo sapiens
ttccctatttgtgaattctg

SEQ ID NO: 6533665 - DNA, 23 bp, Homo sapiens
ttccctcaaagcttccattccac

SEQ ID NO: 6533666 - DNA, 20 bp, Homo sapiens
ttccctcacaccctgcctcg

SEQ ID NO: 6533667 - DNA, 12 bp, Homo sapiens
ttccctcacccc

SEQ ID NO: 6533668 - DNA, 13 bp, Homo sapiens
ttccctcaccccc

SEQ ID NO: 6533669 - DNA, 14 bp, Homo sapiens
ttccctcaccccca

SEQ ID NO: 6533670 - DNA, 13 bp, Homo sapiens
ttccctcactctt

SEQ ID NO: 6533671 - DNA, 17 bp, Homo sapiens
ttccctcactcttcctc

SEQ ID NO: 6533672 - DNA, 13 bp, Homo sapiens
ttccctcagccta

SEQ ID NO: 6533673 - DNA, 11 bp, Homo sapiens
ttccctcaggc

SEQ ID NO: 6533674 - DNA, 22 bp, Homo sapiens
ttccctcaggttctattttctt

SEQ ID NO: 6533675 - DNA, 15 bp, Homo sapiens
ttccctcatctctcc

SEQ ID NO: 6533676 - DNA, 17 bp, Homo sapiens
ttccctcatctctcctc

SEQ ID NO: 6533677 - DNA, 24 bp, Homo sapiens
ttccctccagagaaagcacaattt

SEQ ID NO: 6533678 - DNA, 12 bp, Homo sapiens
ttccctccattt

SEQ ID NO: 6533679 - DNA, 20 bp, Homo sapiens
ttccctccatttttctccca

SEQ ID NO: 6533680 - DNA, 23 bp, Homo sapiens
ttccctccatttttctcccaaga

SEQ ID NO: 6533681 - DNA, 19 bp, Homo sapiens
tggtgtccctgcctggccc

SEQ ID NO: 6533682 - DNA, 14 bp, Homo sapiens
tggtgtcctgacca

SEQ ID NO: 6533683 - DNA, 17 bp, Homo sapiens
tggtgtcctgaccaccc

SEQ ID NO: 6533684 - DNA, 19 bp, Homo sapiens
tggtgtcctgaccaccctc

SEQ ID NO: 6533685 - DNA, 21 bp, Homo sapiens
tggtgtcctgaccaccctccc

SEQ ID NO: 6533686 - DNA, 23 bp, Homo sapiens
tggtgtcctgaggcctccaagga

SEQ ID NO: 6533687 - DNA, 19 bp, Homo sapiens
tggtgtcctgcatgtatgc

SEQ ID NO: 6533688 - DNA, 14 bp, Homo sapiens
tggtgtccttccct

SEQ ID NO: 6533689 - DNA, 13 bp, Homo sapiens
tggtgtccttctc

SEQ ID NO: 6533690 - DNA, 15 bp, Homo sapiens
tggtgtccttcttcc

SEQ ID NO: 6533691 - DNA, 17 bp, Homo sapiens
tggtgtccttcttcctc

SEQ ID NO: 6533692 - DNA, 19 bp, Homo sapiens
tggtgtcgggcatgacacg

SEQ ID NO: 6533693 - DNA, 20 bp, Homo sapiens
tggtgtctattatagtgaaa

SEQ ID NO: 6533694 - DNA, 11 bp, Homo sapiens
tggtgtctcca

SEQ ID NO: 6533695 - DNA, 23 bp, Homo sapiens
tggtgtctcttctttagaacagg

SEQ ID NO: 6533696 - DNA, 13 bp, Homo sapiens
tggtgtctgcctg

SEQ ID NO: 6533697 - DNA, 22 bp, Homo sapiens
tggtgtcttcattttacattgt

SEQ ID NO: 6533698 - DNA, 14 bp, Homo sapiens
tggtgtcttgagac

SEQ ID NO: 6533699 - DNA, 13 bp, Homo sapiens
tggtgtgaaaatg

SEQ ID NO: 6533700 - DNA, 18 bp, Homo sapiens
tggtgtgaaacaaattaa

SEQ ID NO: 6533701 - DNA, 15 bp, Homo sapiens
tggtgtgaaagtcag

SEQ ID NO: 6533702 - DNA, 22 bp, Homo sapiens
tggtgtgaactaagttattgct

SEQ ID NO: 6533703 - DNA, 15 bp, Homo sapiens
tggtgtgaagaaagc

SEQ ID NO: 6533704 - DNA, 18 bp, Homo sapiens
tggtgtgagatcctcttt

SEQ ID NO: 6533705 - DNA, 13 bp, Homo sapiens
tggtgtgaggccc

SEQ ID NO: 6533706 - DNA, 17 bp, Homo sapiens
tggtgtgagtatcagaa

SEQ ID NO: 6533707 - DNA, 15 bp, Homo sapiens
tggtgtgatcccagc

SEQ ID NO: 6533708 - DNA, 17 bp, Homo sapiens
tggtgtgatcccagctc

SEQ ID NO: 6533709 - DNA, 18 bp, Homo sapiens
tggtgtgcatctgtgtgt

SEQ ID NO: 6533710 - DNA, 20 bp, Homo sapiens
tggtgtgccacaggctgcaa

SEQ ID NO: 6533711 - DNA, 15 bp, Homo sapiens
tggtgtgcttatgtt

SEQ ID NO: 6533712 - DNA, 19 bp, Homo sapiens
tggtgtggagttggggctg

SEQ ID NO: 6533713 - DNA, 16 bp, Homo sapiens
tggtgtggcaaagcct

SEQ ID NO: 6533714 - DNA, 15 bp, Homo sapiens
tggtgtggcctgtgg

SEQ ID NO: 6533715 - DNA, 20 bp, Homo sapiens
tggtgtgggtaaagggacag

SEQ ID NO: 6533716 - DNA, 15 bp, Homo sapiens
tggtgtgggtgtcct

SEQ ID NO: 6533717 - DNA, 16 bp, Homo sapiens
tggtgtggtacagaga

SEQ ID NO: 6533718 - DNA, 15 bp, Homo sapiens
tggtgtggtgaatgt

SEQ ID NO: 6533719 - DNA, 15 bp, Homo sapiens
tggtgtgtccctgga

SEQ ID NO: 6533720 - DNA, 16 bp, Homo sapiens
tggtgtgtccctggac

SEQ ID NO: 6533721 - DNA, 19 bp, Homo sapiens
tggtgtgtccctggacaca

SEQ ID NO: 6533722 - DNA, 22 bp, Homo sapiens
tggtgtgtccctggacacagct

SEQ ID NO: 6533723 - DNA, 16 bp, Homo sapiens
tggtgtgtgtctctga

SEQ ID NO: 6533724 - DNA, 20 bp, Homo sapiens
tggtgtgttcgtggagccac

SEQ ID NO: 6533725 - DNA, 11 bp, Homo sapiens
tggtgtgtttc

SEQ ID NO: 6533726 - DNA, 20 bp, Homo sapiens
tggtgttaaagctgtacacc

SEQ ID NO: 6533727 - DNA, 14 bp, Homo sapiens
tggtgttaacagaa

SEQ ID NO: 6533728 - DNA, 14 bp, Homo sapiens
tggtgttaatgagt

SEQ ID NO: 6533729 - DNA, 21 bp, Homo sapiens
tggtgttacacagcccaagag

SEQ ID NO: 6533730 - DNA, 23 bp, Homo sapiens
tggtgttacacagcccaagagga

SEQ ID NO: 6533731 - DNA, 14 bp, Homo sapiens
tggtgttatgttta

SEQ ID NO: 6533732 - DNA, 20 bp, Homo sapiens
tggtgttcaccaaaaccaaa

SEQ ID NO: 6533733 - DNA, 13 bp, Homo sapiens
tggtgttcctgaa

SEQ ID NO: 6533734 - DNA, 14 bp, Homo sapiens
tggtgttcctggaa

SEQ ID NO: 6533735 - DNA, 20 bp, Homo sapiens
tggtgttcgtttccatcatg

SEQ ID NO: 6533736 - DNA, 14 bp, Homo sapiens
tggtgttctcctgc

SEQ ID NO: 6533737 - DNA, 13 bp, Homo sapiens
tggtgttctgaag

SEQ ID NO: 6533738 - DNA, 15 bp, Homo sapiens
tggtgttctggcctc

SEQ ID NO: 6533739 - DNA, 16 bp, Homo sapiens
tggtgttgacatacat

SEQ ID NO: 6533740 - DNA, 16 bp, Homo sapiens
tggtgttgcagccgca

SEQ ID NO: 6533741 - DNA, 20 bp, Homo sapiens
tggtgttgcagccgcagaga

SEQ ID NO: 6533742 - DNA, 11 bp, Homo sapiens
tggtgttgccc

SEQ ID NO: 6533743 - DNA, 20 bp, Homo sapiens
tggtgttggacaagcttctg

SEQ ID NO: 6533744 - DNA, 17 bp, Homo sapiens
tggtgttggcagtgttt

SEQ ID NO: 6533745 - DNA, 22 bp, Homo sapiens
tggtgttgggaaggggtcctgc

SEQ ID NO: 6533746 - DNA, 13 bp, Homo sapiens
tggtgttggtgaa

SEQ ID NO: 6533747 - DNA, 16 bp, Homo sapiens
tggtgtttatgcacac

SEQ ID NO: 6533748 - DNA, 15 bp, Homo sapiens
tggtgtttcctggca

SEQ ID NO: 6533749 - DNA, 17 bp, Homo sapiens
tggtgtttcctggcact

SEQ ID NO: 6533750 - DNA, 18 bp, Homo sapiens
tggtgtttctagcactgg

SEQ ID NO: 6533751 - DNA, 16 bp, Homo sapiens
tggtgtttctccctct

SEQ ID NO: 6533752 - DNA, 14 bp, Homo sapiens
tggtgtttgggaat

SEQ ID NO: 6533753 - DNA, 21 bp, Homo sapiens
tggtgtttgtaggctgtgggg

SEQ ID NO: 6533754 - DNA, 22 bp, Homo sapiens
tggtgtttgtcatggtgaaatt

SEQ ID NO: 6533755 - DNA, 16 bp, Homo sapiens
tggtgtttgtctgtgt

SEQ ID NO: 6533756 - DNA, 17 bp, Homo sapiens
tggtgttttaaagagaa

SEQ ID NO: 6533757 - DNA, 20 bp, Homo sapiens
tggtgttttggggatgagag

SEQ ID NO: 6533758 - DNA, 15 bp, Homo sapiens
tggtgtttttctctc

SEQ ID NO: 6533759 - DNA, 20 bp, Homo sapiens
tggtgttttttgttactgtt

SEQ ID NO: 6533760 - DNA, 17 bp, Homo sapiens
tggttaaaaaaaagaat

SEQ ID NO: 6533761 - DNA, 13 bp, Homo sapiens
tggttaaaaaggc

SEQ ID NO: 6533762 - DNA, 14 bp, Homo sapiens
tggttaaaaaggcc

SEQ ID NO: 6533763 - DNA, 21 bp, Homo sapiens
tggttaaaaaggccaaagata

SEQ ID NO: 6533764 - DNA, 20 bp, Homo sapiens
tggttaaaataaagcctatt

SEQ ID NO: 6533765 - DNA, 12 bp, Homo sapiens
tggttaaataaa

SEQ ID NO: 6533766 - DNA, 14 bp, Homo sapiens
tggttaaattaaca

SEQ ID NO: 6533767 - DNA, 12 bp, Homo sapiens
tggttaaatttt

SEQ ID NO: 6533768 - DNA, 24 bp, Homo sapiens
tggttaacgaggaagacgatgtgt

SEQ ID NO: 6533769 - DNA, 16 bp, Homo sapiens
tggttaagaactgtga

SEQ ID NO: 6533770 - DNA, 16 bp, Homo sapiens
tggttaagctttgaca

SEQ ID NO: 6533771 - DNA, 18 bp, Homo sapiens
tggttaagtctgttttat

SEQ ID NO: 6533772 - DNA, 19 bp, Homo sapiens
tggttaataaaactgcaca

SEQ ID NO: 6533773 - DNA, 22 bp, Homo sapiens
tggttaataaaactgcacagtg

SEQ ID NO: 6533774 - DNA, 19 bp, Homo sapiens
tggttaatacatctttccc

SEQ ID NO: 6533775 - DNA, 13 bp, Homo sapiens
tggttaatcactt

SEQ ID NO: 6533776 - DNA, 18 bp, Homo sapiens
tggttaatcagtgttgat

SEQ ID NO: 6533777 - DNA, 20 bp, Homo sapiens
tggttaatccaatcaattta

SEQ ID NO: 6533778 - DNA, 23 bp, Homo sapiens
tggttaatccaatcaatttaaat

SEQ ID NO: 6533779 - DNA, 21 bp, Homo sapiens
tggttaatttttcctgcatgt

SEQ ID NO: 6533780 - DNA, 19 bp, Homo sapiens
tggttacagtgcagacagg

SEQ ID NO: 6533781 - DNA, 14 bp, Homo sapiens
tggttaccaggcac

SEQ ID NO: 6533782 - DNA, 18 bp, Homo sapiens
tggttaccatgggtgtgg

SEQ ID NO: 6533783 - DNA, 20 bp, Homo sapiens
tggttaccatgggtgtggat

SEQ ID NO: 6533784 - DNA, 18 bp, Homo sapiens
tggttaccccgggctggg

SEQ ID NO: 6533785 - DNA, 16 bp, Homo sapiens
tggttaccgagtatct

SEQ ID NO: 6533786 - DNA, 20 bp, Homo sapiens
tggttaccgagtatctgtaa

SEQ ID NO: 6533787 - DNA, 15 bp, Homo sapiens
tggttacctattgct

SEQ ID NO: 6533788 - DNA, 20 bp, Homo sapiens
tggttacctgttccattgtt

SEQ ID NO: 6533789 - DNA, 23 bp, Homo sapiens
tggttactcagggttcatctgtc

SEQ ID NO: 6533790 - DNA, 15 bp, Homo sapiens
tggttactctggtgc

SEQ ID NO: 6533791 - DNA, 16 bp, Homo sapiens
tggttactctggtgct

SEQ ID NO: 6533792 - DNA, 19 bp, Homo sapiens
tggttactggtgatgttga

SEQ ID NO: 6533793 - DNA, 15 bp, Homo sapiens
tggttacttcttctc

SEQ ID NO: 6533794 - DNA, 16 bp, Homo sapiens
tggttactttcaaaat

SEQ ID NO: 6533795 - DNA, 17 bp, Homo sapiens
tggttactttcaaaatg

SEQ ID NO: 6533796 - DNA, 20 bp, Homo sapiens
tggttagaagggttacatgg

SEQ ID NO: 6533797 - DNA, 23 bp, Homo sapiens
tggttagacgccttccaggtcag

SEQ ID NO: 6533798 - DNA, 15 bp, Homo sapiens
tggttagctcagccc

SEQ ID NO: 6533799 - DNA, 18 bp, Homo sapiens
tggttagctcagccccag

SEQ ID NO: 6533800 - DNA, 12 bp, Homo sapiens
tggttaggatgg

SEQ ID NO: 6533801 - DNA, 21 bp, Homo sapiens
tggttagtcacctgccccagc

SEQ ID NO: 6533802 - DNA, 15 bp, Homo sapiens
tggttagtgatgcag

SEQ ID NO: 6533803 - DNA, 16 bp, Homo sapiens
tggttagtgcatgtca

SEQ ID NO: 6533804 - DNA, 20 bp, Homo sapiens
tggttatagtgcaatatatt

SEQ ID NO: 6533805 - DNA, 13 bp, Homo sapiens
tggttatatttca

SEQ ID NO: 6533806 - DNA, 12 bp, Homo sapiens
tggttatgaaac

SEQ ID NO: 6533807 - DNA, 17 bp, Homo sapiens
tggttatgaaacatgtg

SEQ ID NO: 6533808 - DNA, 13 bp, Homo sapiens
tggttatgaaaga

SEQ ID NO: 6533809 - DNA, 15 bp, Homo sapiens
tggttatgaaagaat

SEQ ID NO: 6533810 - DNA, 17 bp, Homo sapiens
tggttatgcagaagcag

SEQ ID NO: 6533811 - DNA, 13 bp, Homo sapiens
tggttatgttttt

SEQ ID NO: 6533812 - DNA, 20 bp, Homo sapiens
tggttattcattattcctca

SEQ ID NO: 6533813 - DNA, 21 bp, Homo sapiens
tggttattcattattcctcag

SEQ ID NO: 6533814 - DNA, 19 bp, Homo sapiens
tggttattctaagcccttt

SEQ ID NO: 6533815 - DNA, 14 bp, Homo sapiens
tggttattggactc

SEQ ID NO: 6533816 - DNA, 17 bp, Homo sapiens
tggttatttcagccccc

SEQ ID NO: 6533817 - DNA, 15 bp, Homo sapiens
tggttatttctaaac

SEQ ID NO: 6533818 - DNA, 21 bp, Homo sapiens
tggttattttaaatataaata

SEQ ID NO: 6533819 - DNA, 16 bp, Homo sapiens
tggttattttctccat

SEQ ID NO: 6533820 - DNA, 20 bp, Homo sapiens
tggttattttctccatgtct

SEQ ID NO: 6533821 - DNA, 21 bp, Homo sapiens
tggttatttttctcttgtacc

SEQ ID NO: 6533822 - DNA, 23 bp, Homo sapiens
tggttatttttctcttgtaccat

SEQ ID NO: 6533823 - DNA, 21 bp, Homo sapiens
tggttcaaatgtgttttggtc

SEQ ID NO: 6533824 - DNA, 15 bp, Homo sapiens
tggttcaagtattaa

SEQ ID NO: 6533825 - DNA, 19 bp, Homo sapiens
tggttcaagtattaagcag

SEQ ID NO: 6533826 - DNA, 21 bp, Homo sapiens
tggttcaagtattaagcagtt

SEQ ID NO: 6533827 - DNA, 20 bp, Homo sapiens
tggttcactcttggagcctg

SEQ ID NO: 6533828 - DNA, 22 bp, Homo sapiens
tggttcactcttggagcctgca

SEQ ID NO: 6533829 - DNA, 20 bp, Homo sapiens
tggttcacttcaaagctaaa

SEQ ID NO: 6533830 - DNA, 21 bp, Homo sapiens
tggttcagaattaaactttta

SEQ ID NO: 6533831 - DNA, 20 bp, Homo sapiens
tggttcagagactggcagcc

SEQ ID NO: 6533832 - DNA, 23 bp, Homo sapiens
tggttcagagactggcagccagg

SEQ ID NO: 6533833 - DNA, 18 bp, Homo sapiens
tggttcagctactttcca

SEQ ID NO: 6533834 - DNA, 19 bp, Homo sapiens
tggttcagctactttccat

SEQ ID NO: 6533835 - DNA, 22 bp, Homo sapiens
tggttcagctactttccatttg

SEQ ID NO: 6533836 - DNA, 22 bp, Homo sapiens
tggttcagggttggcccctgcc

SEQ ID NO: 6533837 - DNA, 17 bp, Homo sapiens
tggttcaggtacacata

SEQ ID NO: 6533838 - DNA, 23 bp, Homo sapiens
tggttcagtttttttttttccag

SEQ ID NO: 6533839 - DNA, 16 bp, Homo sapiens
tggttcataaatgaat

SEQ ID NO: 6533840 - DNA, 15 bp, Homo sapiens
tggttcatattttat

SEQ ID NO: 6533841 - DNA, 16 bp, Homo sapiens
tggttcatcagtgtta

SEQ ID NO: 6533842 - DNA, 22 bp, Homo sapiens
tggttcatccatcatctgctgc

SEQ ID NO: 6533843 - DNA, 18 bp, Homo sapiens
tggttcatgcagacaaag

SEQ ID NO: 6533844 - DNA, 13 bp, Homo sapiens
tggttcatgcctg

SEQ ID NO: 6533845 - DNA, 15 bp, Homo sapiens
tggttcatgcctggg

SEQ ID NO: 6533846 - DNA, 16 bp, Homo sapiens
tggttcatgcctgggg

SEQ ID NO: 6533847 - DNA, 17 bp, Homo sapiens
tggttcatgcctggggt

SEQ ID NO: 6533848 - DNA, 18 bp, Homo sapiens
tggttcatgcctggggtg

SEQ ID NO: 6533849 - DNA, 19 bp, Homo sapiens
tggttcatgcctggggtgg

SEQ ID NO: 6533850 - DNA, 23 bp, Homo sapiens
tggttcatgcctggggtggaggc

SEQ ID NO: 6533851 - DNA, 13 bp, Homo sapiens
tggttcattccac

SEQ ID NO: 6533852 - DNA, 18 bp, Homo sapiens
tggttcattccacaggac

SEQ ID NO: 6533853 - DNA, 17 bp, Homo sapiens
tggttcattttcagatt

SEQ ID NO: 6533854 - DNA, 20 bp, Homo sapiens
tggttccaaaccagtttatt

SEQ ID NO: 6533855 - DNA, 17 bp, Homo sapiens
tggttccaagccctgga

SEQ ID NO: 6533856 - DNA, 20 bp, Homo sapiens
tggttccaagtctttgctat

SEQ ID NO: 6533857 - DNA, 23 bp, Homo sapiens
tggttccagaacgtctctcacct

SEQ ID NO: 6533858 - DNA, 19 bp, Homo sapiens
tggttccatgcctgctctc

SEQ ID NO: 6533859 - DNA, 13 bp, Homo sapiens
ttccctccccagc

SEQ ID NO: 6533860 - DNA, 22 bp, Homo sapiens
ttccctccccctccttgtgcct

SEQ ID NO: 6533861 - DNA, 13 bp, Homo sapiens
ttccctcccggga

SEQ ID NO: 6533862 - DNA, 13 bp, Homo sapiens
ttccctccctgct

SEQ ID NO: 6533863 - DNA, 16 bp, Homo sapiens
ttccctccctgctgtc

SEQ ID NO: 6533864 - DNA, 23 bp, Homo sapiens
ttccctccgggcaggggagccag

SEQ ID NO: 6533865 - DNA, 19 bp, Homo sapiens
ttccctcctagctctccca

SEQ ID NO: 6533866 - DNA, 21 bp, Homo sapiens
ttccctcctagctctcccagt

SEQ ID NO: 6533867 - DNA, 13 bp, Homo sapiens
ttccctcctgaca

SEQ ID NO: 6533868 - DNA, 14 bp, Homo sapiens
ttccctcctgcagc

SEQ ID NO: 6533869 - DNA, 17 bp, Homo sapiens
ttccctcctgcccagga

SEQ ID NO: 6533870 - DNA, 19 bp, Homo sapiens
ttccctcctggtcctggac

SEQ ID NO: 6533871 - DNA, 14 bp, Homo sapiens
ttccctccttccct

SEQ ID NO: 6533872 - DNA, 18 bp, Homo sapiens
ttccctccttcccttctc

SEQ ID NO: 6533873 - DNA, 13 bp, Homo sapiens
ttccctccttggt

SEQ ID NO: 6533874 - DNA, 13 bp, Homo sapiens
ttccctcctttta

SEQ ID NO: 6533875 - DNA, 14 bp, Homo sapiens
ttccctcgggaccc

SEQ ID NO: 6533876 - DNA, 16 bp, Homo sapiens
ttccctcgtccgtctg

SEQ ID NO: 6533877 - DNA, 17 bp, Homo sapiens
ttccctcgtctttccca

SEQ ID NO: 6533878 - DNA, 19 bp, Homo sapiens
ttccctctaaatgtatatg

SEQ ID NO: 6533879 - DNA, 16 bp, Homo sapiens
ttccctctcagctgct

SEQ ID NO: 6533880 - DNA, 14 bp, Homo sapiens
ttccctctcatctc

SEQ ID NO: 6533881 - DNA, 14 bp, Homo sapiens
ttccctctcccagg

SEQ ID NO: 6533882 - DNA, 13 bp, Homo sapiens
ttccctctccctc

SEQ ID NO: 6533883 - DNA, 16 bp, Homo sapiens
ttccctctcctgccca

SEQ ID NO: 6533884 - DNA, 14 bp, Homo sapiens
ttccctctcctgct

SEQ ID NO: 6533885 - DNA, 18 bp, Homo sapiens
ttccctctcctgcttcct

SEQ ID NO: 6533886 - DNA, 16 bp, Homo sapiens
ttccctctcctgtcct

SEQ ID NO: 6533887 - DNA, 19 bp, Homo sapiens
ttccctctctcagcacagc

SEQ ID NO: 6533888 - DNA, 18 bp, Homo sapiens
ttccctctctccctgcct

SEQ ID NO: 6533889 - DNA, 20 bp, Homo sapiens
ttccctctctccctgcctca

SEQ ID NO: 6533890 - DNA, 20 bp, Homo sapiens
ttccctctctgatgtcccag

SEQ ID NO: 6533891 - DNA, 15 bp, Homo sapiens
ttccctctctggaga

SEQ ID NO: 6533892 - DNA, 11 bp, Homo sapiens
ttccctctgag

SEQ ID NO: 6533893 - DNA, 13 bp, Homo sapiens
ttccctctgcatt

SEQ ID NO: 6533894 - DNA, 21 bp, Homo sapiens
ttccctctgcattgacctgga

SEQ ID NO: 6533895 - DNA, 11 bp, Homo sapiens
ttccctctgcc

SEQ ID NO: 6533896 - DNA, 19 bp, Homo sapiens
ttccctctgcctgggatgc

SEQ ID NO: 6533897 - DNA, 17 bp, Homo sapiens
ttccctctgcctgtccc

SEQ ID NO: 6533898 - DNA, 19 bp, Homo sapiens
ttccctctgctcctggagc

SEQ ID NO: 6533899 - DNA, 20 bp, Homo sapiens
ttccctctgggcacgcctgc

SEQ ID NO: 6533900 - DNA, 23 bp, Homo sapiens
ttccctctgggcctgttctcttg

SEQ ID NO: 6533901 - DNA, 15 bp, Homo sapiens
ttccctcttcccaga

SEQ ID NO: 6533902 - DNA, 16 bp, Homo sapiens
ttccctcttccctctc

SEQ ID NO: 6533903 - DNA, 19 bp, Homo sapiens
ttccctcttccctctccct

SEQ ID NO: 6533904 - DNA, 21 bp, Homo sapiens
ttccctcttgtccctttccct

SEQ ID NO: 6533905 - DNA, 16 bp, Homo sapiens
ttccctcttgtgctca

SEQ ID NO: 6533906 - DNA, 23 bp, Homo sapiens
ttccctcttgtgctcagtcgccc

SEQ ID NO: 6533907 - DNA, 19 bp, Homo sapiens
ttccctctttcctgtgcca

SEQ ID NO: 6533908 - DNA, 13 bp, Homo sapiens
ttccctcttttct

SEQ ID NO: 6533909 - DNA, 19 bp, Homo sapiens
ttccctgaaaacccagaga

SEQ ID NO: 6533910 - DNA, 16 bp, Homo sapiens
ttccctgaacatctgt

SEQ ID NO: 6533911 - DNA, 20 bp, Homo sapiens
ttccctgaacgttttcttct

SEQ ID NO: 6533912 - DNA, 13 bp, Homo sapiens
ttccctgaagctc

SEQ ID NO: 6533913 - DNA, 15 bp, Homo sapiens
ttccctgaatcctct

SEQ ID NO: 6533914 - DNA, 13 bp, Homo sapiens
ttccctgaatctg

SEQ ID NO: 6533915 - DNA, 17 bp, Homo sapiens
ttccctgacactgcggg

SEQ ID NO: 6533916 - DNA, 13 bp, Homo sapiens
ttccctgactcat

SEQ ID NO: 6533917 - DNA, 12 bp, Homo sapiens
ttccctgaggaa

SEQ ID NO: 6533918 - DNA, 15 bp, Homo sapiens
ttccctgaggaatga

SEQ ID NO: 6533919 - DNA, 20 bp, Homo sapiens
ttccctgatggcctttggac

SEQ ID NO: 6533920 - DNA, 11 bp, Homo sapiens
ttccctgcaca

SEQ ID NO: 6533921 - DNA, 15 bp, Homo sapiens
ttccctgcaccctgg

SEQ ID NO: 6533922 - DNA, 11 bp, Homo sapiens
ttccctgcaga

SEQ ID NO: 6533923 - DNA, 16 bp, Homo sapiens
ttccctgcagctgacc

SEQ ID NO: 6533924 - DNA, 14 bp, Homo sapiens
ttccctgcatccct

SEQ ID NO: 6533925 - DNA, 16 bp, Homo sapiens
ttccctgcatcccttg

SEQ ID NO: 6533926 - DNA, 20 bp, Homo sapiens
ttccctgccacatccagctt

SEQ ID NO: 6533927 - DNA, 23 bp, Homo sapiens
ttccctgcccaaacccttaactg

SEQ ID NO: 6533928 - DNA, 22 bp, Homo sapiens
ttccctgcccaatcctccctgg

SEQ ID NO: 6533929 - DNA, 20 bp, Homo sapiens
ttccctgcctaggagctggg

SEQ ID NO: 6533930 - DNA, 18 bp, Homo sapiens
ttccctgcctccagctgt

SEQ ID NO: 6533931 - DNA, 13 bp, Homo sapiens
ttccctgcctgtg

SEQ ID NO: 6533932 - DNA, 11 bp, Homo sapiens
ttccctgcctt

SEQ ID NO: 6533933 - DNA, 18 bp, Homo sapiens
ttccctgccttgctgaca

SEQ ID NO: 6533934 - DNA, 11 bp, Homo sapiens
ttccctgctga

SEQ ID NO: 6533935 - DNA, 12 bp, Homo sapiens
ttccctgctgaa

SEQ ID NO: 6533936 - DNA, 13 bp, Homo sapiens
ttccctgctgaat

SEQ ID NO: 6533937 - DNA, 22 bp, Homo sapiens
ttccctgctgtcgtcttagcaa

SEQ ID NO: 6533938 - DNA, 15 bp, Homo sapiens
ttccctgcttccagg

SEQ ID NO: 6533939 - DNA, 18 bp, Homo sapiens
ttccctgctttgcatctt

SEQ ID NO: 6533940 - DNA, 18 bp, Homo sapiens
ttccctgcttttctccca

SEQ ID NO: 6533941 - DNA, 22 bp, Homo sapiens
ttccctggaaaccttccaccca

SEQ ID NO: 6533942 - DNA, 23 bp, Homo sapiens
ttccctggaaaccttccacccag

SEQ ID NO: 6533943 - DNA, 12 bp, Homo sapiens
ttccctggcctt

SEQ ID NO: 6533944 - DNA, 17 bp, Homo sapiens
ttccctggcctttcata

SEQ ID NO: 6533945 - DNA, 24 bp, Homo sapiens
ttccctggctacttcccttcctcc

SEQ ID NO: 6533946 - DNA, 13 bp, Homo sapiens
ttccctggctcag

SEQ ID NO: 6533947 - DNA, 23 bp, Homo sapiens
ttccctggcttgtaactccacca

SEQ ID NO: 6533948 - DNA, 20 bp, Homo sapiens
ttccctgggatctggtggtc

SEQ ID NO: 6533949 - DNA, 13 bp, Homo sapiens
ttccctgggcctc

SEQ ID NO: 6533950 - DNA, 23 bp, Homo sapiens
ttccctgggctgccaccagcccc

SEQ ID NO: 6533951 - DNA, 17 bp, Homo sapiens
ttccctgggctgtgcta

SEQ ID NO: 6533952 - DNA, 10 bp, Homo sapiens
ttccctgggg

SEQ ID NO: 6533953 - DNA, 20 bp, Homo sapiens
ttccctggggaaaacttgca

SEQ ID NO: 6533954 - DNA, 17 bp, Homo sapiens
ttccctggggagccctc

SEQ ID NO: 6533955 - DNA, 19 bp, Homo sapiens
ttccctggggagccctcag

SEQ ID NO: 6533956 - DNA, 12 bp, Homo sapiens
ttccctggggcc

SEQ ID NO: 6533957 - DNA, 23 bp, Homo sapiens
ttccctgggggcagatatttccc

SEQ ID NO: 6533958 - DNA, 20 bp, Homo sapiens
ttccctgggtttgggagcca

SEQ ID NO: 6533959 - DNA, 17 bp, Homo sapiens
ttccctggtaagaaaaa

SEQ ID NO: 6533960 - DNA, 15 bp, Homo sapiens
ttccctggtcaccaa

SEQ ID NO: 6533961 - DNA, 22 bp, Homo sapiens
ttccctggtcaccaaggcagtg

SEQ ID NO: 6533962 - DNA, 14 bp, Homo sapiens
ttccctggtccaga

SEQ ID NO: 6533963 - DNA, 20 bp, Homo sapiens
ttccctgtattttctttctc

SEQ ID NO: 6533964 - DNA, 14 bp, Homo sapiens
ttccctgtcagagg

SEQ ID NO: 6533965 - DNA, 15 bp, Homo sapiens
ttccctgtgcctcct

SEQ ID NO: 6533966 - DNA, 11 bp, Homo sapiens
ttccctgtgct

SEQ ID NO: 6533967 - DNA, 18 bp, Homo sapiens
ttccctgtggccttatga

SEQ ID NO: 6533968 - DNA, 15 bp, Homo sapiens
ttccctgtgtctttt

SEQ ID NO: 6533969 - DNA, 13 bp, Homo sapiens
ttccctgtgtgga

SEQ ID NO: 6533970 - DNA, 12 bp, Homo sapiens
ttccctgttctt

SEQ ID NO: 6533971 - DNA, 15 bp, Homo sapiens
ttccctgttcttcct

SEQ ID NO: 6533972 - DNA, 20 bp, Homo sapiens
ttccctgttctttaagactt

SEQ ID NO: 6533973 - DNA, 18 bp, Homo sapiens
ttcccttatttttattta

SEQ ID NO: 6533974 - DNA, 18 bp, Homo sapiens
ttcccttcaaggtcattt

SEQ ID NO: 6533975 - DNA, 20 bp, Homo sapiens
ttcccttccagtttattcca

SEQ ID NO: 6533976 - DNA, 19 bp, Homo sapiens
ttcccttccatctcttcct

SEQ ID NO: 6533977 - DNA, 21 bp, Homo sapiens
ttcccttccatctcttccttt

SEQ ID NO: 6533978 - DNA, 18 bp, Homo sapiens
ttcccttcccagaccagg

SEQ ID NO: 6533979 - DNA, 16 bp, Homo sapiens
ttcccttccctcaccc

SEQ ID NO: 6533980 - DNA, 13 bp, Homo sapiens
ttcccttcctcca

SEQ ID NO: 6533981 - DNA, 20 bp, Homo sapiens
ttcccttcctcggtggctct

SEQ ID NO: 6533982 - DNA, 12 bp, Homo sapiens
ttcccttcctct

SEQ ID NO: 6533983 - DNA, 15 bp, Homo sapiens
ttcccttcctctgat

SEQ ID NO: 6533984 - DNA, 13 bp, Homo sapiens
ttcccttcctctt

SEQ ID NO: 6533985 - DNA, 15 bp, Homo sapiens
ttcccttcctcttcc

SEQ ID NO: 6533986 - DNA, 15 bp, Homo sapiens
ttcccttcctgccag

SEQ ID NO: 6533987 - DNA, 12 bp, Homo sapiens
ttcccttctccc

SEQ ID NO: 6533988 - DNA, 13 bp, Homo sapiens
ttcccttctcccc

SEQ ID NO: 6533989 - DNA, 18 bp, Homo sapiens
ttcccttctccccagcca

SEQ ID NO: 6533990 - DNA, 23 bp, Homo sapiens
ttcccttctcccccttgtcttcc

SEQ ID NO: 6533991 - DNA, 20 bp, Homo sapiens
ttcccttctccttccaactg

SEQ ID NO: 6533992 - DNA, 11 bp, Homo sapiens
ttcccttctct

SEQ ID NO: 6533993 - DNA, 13 bp, Homo sapiens
ttcccttctctca

SEQ ID NO: 6533994 - DNA, 19 bp, Homo sapiens
ttcccttctctggtctcct

SEQ ID NO: 6533995 - DNA, 14 bp, Homo sapiens
ttcccttctcttgg

SEQ ID NO: 6533996 - DNA, 22 bp, Homo sapiens
ttcccttctgatcttggaaaga

SEQ ID NO: 6533997 - DNA, 22 bp, Homo sapiens
ttcccttctgggcttcattctg

SEQ ID NO: 6533998 - DNA, 22 bp, Homo sapiens
ttcccttcttggtttccaaagg

SEQ ID NO: 6533999 - DNA, 17 bp, Homo sapiens
ttcccttcttttcctgg

SEQ ID NO: 6534000 - DNA, 21 bp, Homo sapiens
ttcccttcttttcctgggtgc

SEQ ID NO: 6534001 - DNA, 14 bp, Homo sapiens
ttcccttgaaactt

SEQ ID NO: 6534002 - DNA, 14 bp, Homo sapiens
ttcccttgaccatt

SEQ ID NO: 6534003 - DNA, 23 bp, Homo sapiens
ttcccttgagatgagtttctggg

SEQ ID NO: 6534004 - DNA, 18 bp, Homo sapiens
ttcccttgatgaagaagt

SEQ ID NO: 6534005 - DNA, 15 bp, Homo sapiens
ttcccttgccctggg

SEQ ID NO: 6534006 - DNA, 15 bp, Homo sapiens
ttcccttgctcatga

SEQ ID NO: 6534007 - DNA, 20 bp, Homo sapiens
ttcccttgctcatgagctcc

SEQ ID NO: 6534008 - DNA, 13 bp, Homo sapiens
ttcccttgctgta

SEQ ID NO: 6534009 - DNA, 19 bp, Homo sapiens
ttcccttgcttttccctct

SEQ ID NO: 6534010 - DNA, 17 bp, Homo sapiens
ttcccttggatgtagtc

SEQ ID NO: 6534011 - DNA, 14 bp, Homo sapiens
ttcccttggcctca

SEQ ID NO: 6534012 - DNA, 17 bp, Homo sapiens
ttcccttgggctggaga

SEQ ID NO: 6534013 - DNA, 20 bp, Homo sapiens
ttcccttgtagctcctcccc

SEQ ID NO: 6534014 - DNA, 15 bp, Homo sapiens
ttcccttgtgtctgt

SEQ ID NO: 6534015 - DNA, 23 bp, Homo sapiens
ttccctttaaccctcacactgct

SEQ ID NO: 6534016 - DNA, 21 bp, Homo sapiens
ttccctttagcacgtttaaag

SEQ ID NO: 6534017 - DNA, 17 bp, Homo sapiens
ttccctttatttctctt

SEQ ID NO: 6534018 - DNA, 12 bp, Homo sapiens
ttccctttcccc

SEQ ID NO: 6534019 - DNA, 23 bp, Homo sapiens
ttccctttctttaaaagaaactt

SEQ ID NO: 6534020 - DNA, 14 bp, Homo sapiens
ttccctttgacttc

SEQ ID NO: 6534021 - DNA, 11 bp, Homo sapiens
ttccctttgcc

SEQ ID NO: 6534022 - DNA, 14 bp, Homo sapiens
ttccctttgcctta

SEQ ID NO: 6534023 - DNA, 15 bp, Homo sapiens
ttccctttgccttaa

SEQ ID NO: 6534024 - DNA, 17 bp, Homo sapiens
ttccctttgctccaccc

SEQ ID NO: 6534025 - DNA, 17 bp, Homo sapiens
ttccctttggagatgct

SEQ ID NO: 6534026 - DNA, 22 bp, Homo sapiens
ttccctttggggatagtctgga

SEQ ID NO: 6534027 - DNA, 14 bp, Homo sapiens
ttccctttgttgct

SEQ ID NO: 6534028 - DNA, 18 bp, Homo sapiens
ttccctttgttgctgtct

SEQ ID NO: 6534029 - DNA, 14 bp, Homo sapiens
ttcccttttaaaga

SEQ ID NO: 6534030 - DNA, 23 bp, Homo sapiens
ttcccttttaaagaatttttgcc

SEQ ID NO: 6534031 - DNA, 21 bp, Homo sapiens
ttcccttttacatactgctgt

SEQ ID NO: 6534032 - DNA, 17 bp, Homo sapiens
ttcccttttccatcatc

SEQ ID NO: 6534033 - DNA, 14 bp, Homo sapiens
ttcccttttctgtt

SEQ ID NO: 6534034 - DNA, 16 bp, Homo sapiens
ttcccttttctgttta

SEQ ID NO: 6534035 - DNA, 16 bp, Homo sapiens
ttcccttttgactctt

SEQ ID NO: 6534036 - DNA, 15 bp, Homo sapiens
ttccctttttaaaaa

SEQ ID NO: 6534037 - DNA, 20 bp, Homo sapiens
ttccctttttaaaaaatacc

SEQ ID NO: 6534038 - DNA, 18 bp, Homo sapiens
ttcccttttttggctgct

SEQ ID NO: 6534039 - DNA, 19 bp, Homo sapiens
ttcccttttttggctgctg

SEQ ID NO: 6534040 - DNA, 15 bp, Homo sapiens
tggttccatgttgac

SEQ ID NO: 6534041 - DNA, 20 bp, Homo sapiens
tggttcccaatatcatgtga

SEQ ID NO: 6534042 - DNA, 15 bp, Homo sapiens
tggttcccagaaaac

SEQ ID NO: 6534043 - DNA, 15 bp, Homo sapiens
tggttccccaggagg

SEQ ID NO: 6534044 - DNA, 19 bp, Homo sapiens
tggttcccctgttcactct

SEQ ID NO: 6534045 - DNA, 20 bp, Homo sapiens
tggttcccctgttcactcta

SEQ ID NO: 6534046 - DNA, 12 bp, Homo sapiens
tggttccctctt

SEQ ID NO: 6534047 - DNA, 17 bp, Homo sapiens
tggttccctctttcctg

SEQ ID NO: 6534048 - DNA, 14 bp, Homo sapiens
tggttccctgctgc

SEQ ID NO: 6534049 - DNA, 14 bp, Homo sapiens
tggttcccttccta

SEQ ID NO: 6534050 - DNA, 23 bp, Homo sapiens
tggttccgacttgtccctctctc

SEQ ID NO: 6534051 - DNA, 16 bp, Homo sapiens
tggttcctaagcctgt

SEQ ID NO: 6534052 - DNA, 17 bp, Homo sapiens
tggttcctaagcctgtt

SEQ ID NO: 6534053 - DNA, 14 bp, Homo sapiens
tggttcctcatggc

SEQ ID NO: 6534054 - DNA, 18 bp, Homo sapiens
tggttcctccagccacct

SEQ ID NO: 6534055 - DNA, 12 bp, Homo sapiens
tggttcctcccc

SEQ ID NO: 6534056 - DNA, 18 bp, Homo sapiens
tggttcctcccctcctcc

SEQ ID NO: 6534057 - DNA, 14 bp, Homo sapiens
tggttcctctacta

SEQ ID NO: 6534058 - DNA, 19 bp, Homo sapiens
tggttcctgctagaaatgg

SEQ ID NO: 6534059 - DNA, 22 bp, Homo sapiens
tggttcctgctgtcctggtggc

SEQ ID NO: 6534060 - DNA, 12 bp, Homo sapiens
tggttcctggga

SEQ ID NO: 6534061 - DNA, 14 bp, Homo sapiens
tggttcctggggca

SEQ ID NO: 6534062 - DNA, 16 bp, Homo sapiens
tggttcctgtttgaaa

SEQ ID NO: 6534063 - DNA, 18 bp, Homo sapiens
tggttcctgtttgaaact

SEQ ID NO: 6534064 - DNA, 20 bp, Homo sapiens
tggttcctgtttgaaactaa

SEQ ID NO: 6534065 - DNA, 16 bp, Homo sapiens
tggttccttccctggg

SEQ ID NO: 6534066 - DNA, 23 bp, Homo sapiens
tggttccttctgatccacagcct

SEQ ID NO: 6534067 - DNA, 17 bp, Homo sapiens
tggttcctttctcagcc

SEQ ID NO: 6534068 - DNA, 17 bp, Homo sapiens
tggttctaactgctgtt

SEQ ID NO: 6534069 - DNA, 22 bp, Homo sapiens
tggttctaaggacctgaaattc

SEQ ID NO: 6534070 - DNA, 14 bp, Homo sapiens
tggttctataataa

SEQ ID NO: 6534071 - DNA, 14 bp, Homo sapiens
tggttctatgctaa

SEQ ID NO: 6534072 - DNA, 14 bp, Homo sapiens
tggttctatttaat

SEQ ID NO: 6534073 - DNA, 11 bp, Homo sapiens
tggttctcaat

SEQ ID NO: 6534074 - DNA, 14 bp, Homo sapiens
tggttctcaatgaa

SEQ ID NO: 6534075 - DNA, 18 bp, Homo sapiens
tggttctcaattccaaca

SEQ ID NO: 6534076 - DNA, 16 bp, Homo sapiens
tggttctcaattgtat

SEQ ID NO: 6534077 - DNA, 13 bp, Homo sapiens
tggttctcaattt

SEQ ID NO: 6534078 - DNA, 15 bp, Homo sapiens
tggttctcatctttc

SEQ ID NO: 6534079 - DNA, 13 bp, Homo sapiens
tggttctccatcc

SEQ ID NO: 6534080 - DNA, 22 bp, Homo sapiens
tggttctccttcctcagcctcc

SEQ ID NO: 6534081 - DNA, 14 bp, Homo sapiens
tggttctctgcctt

SEQ ID NO: 6534082 - DNA, 16 bp, Homo sapiens
tggttctctgggcctc

SEQ ID NO: 6534083 - DNA, 17 bp, Homo sapiens
tggttctgaaagtggct

SEQ ID NO: 6534084 - DNA, 19 bp, Homo sapiens
tggttctgaggccagaaag

SEQ ID NO: 6534085 - DNA, 20 bp, Homo sapiens
tggttctgatgatgtgcctg

SEQ ID NO: 6534086 - DNA, 15 bp, Homo sapiens
tggttctgcttcaat

SEQ ID NO: 6534087 - DNA, 12 bp, Homo sapiens
tggttctggcca

SEQ ID NO: 6534088 - DNA, 21 bp, Homo sapiens
tggttctgtgctaatcaaaac

SEQ ID NO: 6534089 - DNA, 19 bp, Homo sapiens
tggttcttagttctcactg

SEQ ID NO: 6534090 - DNA, 15 bp, Homo sapiens
tggttcttattcact

SEQ ID NO: 6534091 - DNA, 22 bp, Homo sapiens
tggttcttcaaatcttaagaga

SEQ ID NO: 6534092 - DNA, 22 bp, Homo sapiens
tggttcttcctttccctggagc

SEQ ID NO: 6534093 - DNA, 15 bp, Homo sapiens
tggttcttctctttt

SEQ ID NO: 6534094 - DNA, 23 bp, Homo sapiens
tggttcttctgacacttgtggta

SEQ ID NO: 6534095 - DNA, 14 bp, Homo sapiens
tggttcttgtatta

SEQ ID NO: 6534096 - DNA, 18 bp, Homo sapiens
tggttcttgtattaagaa

SEQ ID NO: 6534097 - DNA, 15 bp, Homo sapiens
tggttctttcagctg

SEQ ID NO: 6534098 - DNA, 22 bp, Homo sapiens
tggttcttttaccccacgaaga

SEQ ID NO: 6534099 - DNA, 18 bp, Homo sapiens
tggttgaaaagattccat

SEQ ID NO: 6534100 - DNA, 19 bp, Homo sapiens
tggttgaaggtcacagaag

SEQ ID NO: 6534101 - DNA, 20 bp, Homo sapiens
tggttgaaggtcacagaagt

SEQ ID NO: 6534102 - DNA, 12 bp, Homo sapiens
tggttgaataaa

SEQ ID NO: 6534103 - DNA, 23 bp, Homo sapiens
tggttgaatacagttacttaatg

SEQ ID NO: 6534104 - DNA, 12 bp, Homo sapiens
tggttgaatatg

SEQ ID NO: 6534105 - DNA, 14 bp, Homo sapiens
tggttgaatgaata

SEQ ID NO: 6534106 - DNA, 20 bp, Homo sapiens
tggttgaatgaataaaacaa

SEQ ID NO: 6534107 - DNA, 23 bp, Homo sapiens
tggttgacccaaaaatgttccct

SEQ ID NO: 6534108 - DNA, 17 bp, Homo sapiens
tggttgagaaatgaata

SEQ ID NO: 6534109 - DNA, 22 bp, Homo sapiens
tggttgaggtggaagccctcct

SEQ ID NO: 6534110 - DNA, 22 bp, Homo sapiens
tggttgagttcaggtagctgcc

SEQ ID NO: 6534111 - DNA, 18 bp, Homo sapiens
tggttgatgatctttgca

SEQ ID NO: 6534112 - DNA, 15 bp, Homo sapiens
tggttgatggaaaat

SEQ ID NO: 6534113 - DNA, 17 bp, Homo sapiens
tggttgatggaaaataa

SEQ ID NO: 6534114 - DNA, 16 bp, Homo sapiens
tggttgatggttttgc

SEQ ID NO: 6534115 - DNA, 15 bp, Homo sapiens
tggttgatgtttaaa

SEQ ID NO: 6534116 - DNA, 12 bp, Homo sapiens
tggttgatttca

SEQ ID NO: 6534117 - DNA, 20 bp, Homo sapiens
tggttgcaattgtttaagaa

SEQ ID NO: 6534118 - DNA, 20 bp, Homo sapiens
tggttgcacttatgatttca

SEQ ID NO: 6534119 - DNA, 16 bp, Homo sapiens
tggttgcactttgtag

SEQ ID NO: 6534120 - DNA, 14 bp, Homo sapiens
tggttgcagcctga

SEQ ID NO: 6534121 - DNA, 11 bp, Homo sapiens
tggttgcatgg

SEQ ID NO: 6534122 - DNA, 22 bp, Homo sapiens
tggttgccagtagtaccttgtt

SEQ ID NO: 6534123 - DNA, 19 bp, Homo sapiens
tggttgccgtctctggccc

SEQ ID NO: 6534124 - DNA, 15 bp, Homo sapiens
tggttgcctgccctc

SEQ ID NO: 6534125 - DNA, 17 bp, Homo sapiens
tggttgccttaaaagaa

SEQ ID NO: 6534126 - DNA, 18 bp, Homo sapiens
tggttgccttaaagaaag

SEQ ID NO: 6534127 - DNA, 13 bp, Homo sapiens
tggttgctgtgtg

SEQ ID NO: 6534128 - DNA, 19 bp, Homo sapiens
tggttgctgttttcctccc

SEQ ID NO: 6534129 - DNA, 14 bp, Homo sapiens
tggttgctttaata

SEQ ID NO: 6534130 - DNA, 17 bp, Homo sapiens
tggttggaagcctcccc

SEQ ID NO: 6534131 - DNA, 18 bp, Homo sapiens
tggttggacctattgcca

SEQ ID NO: 6534132 - DNA, 21 bp, Homo sapiens
tggttggccgtggtccagctc

SEQ ID NO: 6534133 - DNA, 23 bp, Homo sapiens
tggttggccgtggtccagctctt

SEQ ID NO: 6534134 - DNA, 18 bp, Homo sapiens
tggttggctgggaaatcg

SEQ ID NO: 6534135 - DNA, 17 bp, Homo sapiens
tggttggctggttgttt

SEQ ID NO: 6534136 - DNA, 18 bp, Homo sapiens
tggttgggctgtgcctgg

SEQ ID NO: 6534137 - DNA, 19 bp, Homo sapiens
tggttggggccctgccctg

SEQ ID NO: 6534138 - DNA, 18 bp, Homo sapiens
tggttggggtggggcagg

SEQ ID NO: 6534139 - DNA, 22 bp, Homo sapiens
tggttgggtcaaggacagggct

SEQ ID NO: 6534140 - DNA, 15 bp, Homo sapiens
tggttgggtcctcac

SEQ ID NO: 6534141 - DNA, 22 bp, Homo sapiens
tggttggtaacacaaattttca

SEQ ID NO: 6534142 - DNA, 19 bp, Homo sapiens
tggttggttagtgcatgtc

SEQ ID NO: 6534143 - DNA, 24 bp, Homo sapiens
tggttggttttgacttcagattga

SEQ ID NO: 6534144 - DNA, 17 bp, Homo sapiens
tggttgtaaatgctcgt

SEQ ID NO: 6534145 - DNA, 18 bp, Homo sapiens
tggttgtaattaaatttt

SEQ ID NO: 6534146 - DNA, 15 bp, Homo sapiens
tggttgtagaaggag

SEQ ID NO: 6534147 - DNA, 14 bp, Homo sapiens
tggttgtatctgtg

SEQ ID NO: 6534148 - DNA, 15 bp, Homo sapiens
tggttgtattctttg

SEQ ID NO: 6534149 - DNA, 12 bp, Homo sapiens
tggttgtatttc

SEQ ID NO: 6534150 - DNA, 14 bp, Homo sapiens
tggttgtatttcta

SEQ ID NO: 6534151 - DNA, 16 bp, Homo sapiens
tggttgtcactctaca

SEQ ID NO: 6534152 - DNA, 15 bp, Homo sapiens
tggttgtccaggtct

SEQ ID NO: 6534153 - DNA, 20 bp, Homo sapiens
tggttgtctagtcattgtca

SEQ ID NO: 6534154 - DNA, 22 bp, Homo sapiens
tggttgtctgaacccaggcagc

SEQ ID NO: 6534155 - DNA, 16 bp, Homo sapiens
tggttgtcttattgca

SEQ ID NO: 6534156 - DNA, 18 bp, Homo sapiens
tggttgtgaaatgtaaca

SEQ ID NO: 6534157 - DNA, 21 bp, Homo sapiens
tggttgtgaaccaactgcctt

SEQ ID NO: 6534158 - DNA, 15 bp, Homo sapiens
tggttgtgacttccc

SEQ ID NO: 6534159 - DNA, 15 bp, Homo sapiens
tggttgtgcacatgc

SEQ ID NO: 6534160 - DNA, 16 bp, Homo sapiens
tggttgtgccttttgt

SEQ ID NO: 6534161 - DNA, 16 bp, Homo sapiens
tggttgtgggcttgga

SEQ ID NO: 6534162 - DNA, 15 bp, Homo sapiens
tggttgtgtctgctt

SEQ ID NO: 6534163 - DNA, 17 bp, Homo sapiens
tggttgtgtgtgttctg

SEQ ID NO: 6534164 - DNA, 14 bp, Homo sapiens
tggttgttgcatat

SEQ ID NO: 6534165 - DNA, 16 bp, Homo sapiens
tggttgttgcatatag

SEQ ID NO: 6534166 - DNA, 16 bp, Homo sapiens
tggttgtttctctgag

SEQ ID NO: 6534167 - DNA, 17 bp, Homo sapiens
tggttgtttctgttcca

SEQ ID NO: 6534168 - DNA, 14 bp, Homo sapiens
tggttgtttcttcc

SEQ ID NO: 6534169 - DNA, 22 bp, Homo sapiens
tggtttaaaaagtttcacgtct

SEQ ID NO: 6534170 - DNA, 19 bp, Homo sapiens
tggtttaaatatgaatgaa

SEQ ID NO: 6534171 - DNA, 17 bp, Homo sapiens
tggtttaattcagcaga

SEQ ID NO: 6534172 - DNA, 17 bp, Homo sapiens
tggtttacatgaacaca

SEQ ID NO: 6534173 - DNA, 11 bp, Homo sapiens
tggtttactgc

SEQ ID NO: 6534174 - DNA, 15 bp, Homo sapiens
tggtttactgctgtc

SEQ ID NO: 6534175 - DNA, 21 bp, Homo sapiens
tggtttagaatgctgcgctta

SEQ ID NO: 6534176 - DNA, 16 bp, Homo sapiens
tggtttagctttggaa

SEQ ID NO: 6534177 - DNA, 20 bp, Homo sapiens
tggtttagtgtaaaaatgag

SEQ ID NO: 6534178 - DNA, 21 bp, Homo sapiens
tggtttagtgtaaaaatgaga

SEQ ID NO: 6534179 - DNA, 17 bp, Homo sapiens
tggtttagtgttctgta

SEQ ID NO: 6534180 - DNA, 11 bp, Homo sapiens
tggtttataga

SEQ ID NO: 6534181 - DNA, 17 bp, Homo sapiens
tggtttatataagacca

SEQ ID NO: 6534182 - DNA, 20 bp, Homo sapiens
tggtttatattcttatgtta

SEQ ID NO: 6534183 - DNA, 16 bp, Homo sapiens
tggtttatgactttgt

SEQ ID NO: 6534184 - DNA, 22 bp, Homo sapiens
tggtttatgagaactggttctt

SEQ ID NO: 6534185 - DNA, 12 bp, Homo sapiens
tggtttatgtca

SEQ ID NO: 6534186 - DNA, 15 bp, Homo sapiens
tggtttattcccaag

SEQ ID NO: 6534187 - DNA, 20 bp, Homo sapiens
tggtttattcccaagtatgc

SEQ ID NO: 6534188 - DNA, 23 bp, Homo sapiens
tggtttattccctccagggtcta

SEQ ID NO: 6534189 - DNA, 17 bp, Homo sapiens
tggtttattctttgcaa

SEQ ID NO: 6534190 - DNA, 22 bp, Homo sapiens
tggtttattggtgagttaggaa

SEQ ID NO: 6534191 - DNA, 20 bp, Homo sapiens
tggtttatttgttgttttct

SEQ ID NO: 6534192 - DNA, 11 bp, Homo sapiens
tggtttcaaag

SEQ ID NO: 6534193 - DNA, 23 bp, Homo sapiens
tggtttcaaagtaaaggcctcct

SEQ ID NO: 6534194 - DNA, 16 bp, Homo sapiens
tggtttcaattcagat

SEQ ID NO: 6534195 - DNA, 14 bp, Homo sapiens
tggtttcaccttcc

SEQ ID NO: 6534196 - DNA, 16 bp, Homo sapiens
tggtttcaccttccct

SEQ ID NO: 6534197 - DNA, 17 bp, Homo sapiens
tggtttcaccttccctc

SEQ ID NO: 6534198 - DNA, 20 bp, Homo sapiens
tggtttcagatgtgcaataa

SEQ ID NO: 6534199 - DNA, 22 bp, Homo sapiens
tggtttcataacttcctgtact

SEQ ID NO: 6534200 - DNA, 15 bp, Homo sapiens
tggtttcatgttagt

SEQ ID NO: 6534201 - DNA, 16 bp, Homo sapiens
tggtttcattgccttc

SEQ ID NO: 6534202 - DNA, 16 bp, Homo sapiens
tggtttccaaggagct

SEQ ID NO: 6534203 - DNA, 14 bp, Homo sapiens
tggtttccaatgtg

SEQ ID NO: 6534204 - DNA, 16 bp, Homo sapiens
tggtttccaatgtgtt

SEQ ID NO: 6534205 - DNA, 18 bp, Homo sapiens
tggtttccacatgctctg

SEQ ID NO: 6534206 - DNA, 18 bp, Homo sapiens
tggtttccagtcatgagc

SEQ ID NO: 6534207 - DNA, 17 bp, Homo sapiens
tggtttcccaagagcta

SEQ ID NO: 6534208 - DNA, 18 bp, Homo sapiens
tggtttcccattggttca

SEQ ID NO: 6534209 - DNA, 16 bp, Homo sapiens
tggtttccctgcccct

SEQ ID NO: 6534210 - DNA, 17 bp, Homo sapiens
tggtttccctgcccctg

SEQ ID NO: 6534211 - DNA, 19 bp, Homo sapiens
tggtttcctcattcctgaa

SEQ ID NO: 6534212 - DNA, 22 bp, Homo sapiens
tggtttcctccatttgagaaaa

SEQ ID NO: 6534213 - DNA, 14 bp, Homo sapiens
tggtttcctcgaga

SEQ ID NO: 6534214 - DNA, 12 bp, Homo sapiens
tggtttcctgcc

SEQ ID NO: 6534215 - DNA, 13 bp, Homo sapiens
tggtttcctgccc

SEQ ID NO: 6534216 - DNA, 15 bp, Homo sapiens
tggtttcctgcccag

SEQ ID NO: 6534217 - DNA, 21 bp, Homo sapiens
tggtttcctgcccagcctggg

SEQ ID NO: 6534218 - DNA, 14 bp, Homo sapiens
tggtttcctgccct

SEQ ID NO: 6534219 - DNA, 15 bp, Homo sapiens
tggtttcctgccctg

SEQ ID NO: 6534220 - DNA, 16 bp, Homo sapiens
ttcccttttttttctg

SEQ ID NO: 6534221 - DNA, 21 bp, Homo sapiens
ttccgaagaccttctgaagat

SEQ ID NO: 6534222 - DNA, 15 bp, Homo sapiens
ttccgacaccactgg

SEQ ID NO: 6534223 - DNA, 16 bp, Homo sapiens
ttccgacaccactggg

SEQ ID NO: 6534224 - DNA, 17 bp, Homo sapiens
ttccgaccctctgggaa

SEQ ID NO: 6534225 - DNA, 16 bp, Homo sapiens
ttccgactgcccagaa

SEQ ID NO: 6534226 - DNA, 19 bp, Homo sapiens
ttccgacttgtccctctct

SEQ ID NO: 6534227 - DNA, 16 bp, Homo sapiens
ttccgagtctttctca

SEQ ID NO: 6534228 - DNA, 16 bp, Homo sapiens
ttccgatcaacattta

SEQ ID NO: 6534229 - DNA, 18 bp, Homo sapiens
ttccgcaccctccctagc

SEQ ID NO: 6534230 - DNA, 14 bp, Homo sapiens
ttccgcaccctgcc

SEQ ID NO: 6534231 - DNA, 20 bp, Homo sapiens
ttccgcactacctgaacatt

SEQ ID NO: 6534232 - DNA, 17 bp, Homo sapiens
ttccgcagcccctttcc

SEQ ID NO: 6534233 - DNA, 18 bp, Homo sapiens
ttccgccaatctggccct

SEQ ID NO: 6534234 - DNA, 18 bp, Homo sapiens
ttccgccactggggctca

SEQ ID NO: 6534235 - DNA, 18 bp, Homo sapiens
ttccgcccactcctggga

SEQ ID NO: 6534236 - DNA, 15 bp, Homo sapiens
ttccgccccttccct

SEQ ID NO: 6534237 - DNA, 17 bp, Homo sapiens
ttccgccccttcccttc

SEQ ID NO: 6534238 - DNA, 13 bp, Homo sapiens
ttccgcctcctgt

SEQ ID NO: 6534239 - DNA, 13 bp, Homo sapiens
ttccgctctgagg

SEQ ID NO: 6534240 - DNA, 18 bp, Homo sapiens
ttccgctgtcacccagca

SEQ ID NO: 6534241 - DNA, 22 bp, Homo sapiens
ttccgctgtcgccccaggccct

SEQ ID NO: 6534242 - DNA, 22 bp, Homo sapiens
ttccggagctgggtatctcaaa

SEQ ID NO: 6534243 - DNA, 17 bp, Homo sapiens
ttccggcacactgccaa

SEQ ID NO: 6534244 - DNA, 18 bp, Homo sapiens
ttccggcacactgccaaa

SEQ ID NO: 6534245 - DNA, 22 bp, Homo sapiens
ttccggcatggacaatggaccg

SEQ ID NO: 6534246 - DNA, 13 bp, Homo sapiens
ttccggcccctcc

SEQ ID NO: 6534247 - DNA, 19 bp, Homo sapiens
ttccggctgagctgtgcca

SEQ ID NO: 6534248 - DNA, 18 bp, Homo sapiens
ttccgggaataacatgat

SEQ ID NO: 6534249 - DNA, 20 bp, Homo sapiens
ttccgggtctcgcagcctga

SEQ ID NO: 6534250 - DNA, 23 bp, Homo sapiens
ttccgggtctcgcagcctgaagc

SEQ ID NO: 6534251 - DNA, 15 bp, Homo sapiens
ttccgtatctccctg

SEQ ID NO: 6534252 - DNA, 17 bp, Homo sapiens
ttccgtatttaaagttg

SEQ ID NO: 6534253 - DNA, 15 bp, Homo sapiens
ttccgtcagaaagtg

SEQ ID NO: 6534254 - DNA, 13 bp, Homo sapiens
ttccgtcatgctc

SEQ ID NO: 6534255 - DNA, 14 bp, Homo sapiens
ttccgtccatcccc

SEQ ID NO: 6534256 - DNA, 17 bp, Homo sapiens
ttccgtccatccccctt

SEQ ID NO: 6534257 - DNA, 13 bp, Homo sapiens
ttccgtccccccc

SEQ ID NO: 6534258 - DNA, 19 bp, Homo sapiens
ttccgtccccccccaggcc

SEQ ID NO: 6534259 - DNA, 19 bp, Homo sapiens
ttccgtctccctaaaataa

SEQ ID NO: 6534260 - DNA, 13 bp, Homo sapiens
ttccgtctcctct

SEQ ID NO: 6534261 - DNA, 17 bp, Homo sapiens
ttccgtgaagggcaccg

SEQ ID NO: 6534262 - DNA, 13 bp, Homo sapiens
ttccgtgccaggc

SEQ ID NO: 6534263 - DNA, 17 bp, Homo sapiens
ttccgtgccgtgtattt

SEQ ID NO: 6534264 - DNA, 16 bp, Homo sapiens
ttccgtgcgtggcact

SEQ ID NO: 6534265 - DNA, 18 bp, Homo sapiens
ttccgtgggtcatcccag

SEQ ID NO: 6534266 - DNA, 19 bp, Homo sapiens
ttccgtggtcagagtgcca

SEQ ID NO: 6534267 - DNA, 12 bp, Homo sapiens
ttccgtgtcctc

SEQ ID NO: 6534268 - DNA, 14 bp, Homo sapiens
ttccgtgtcctctc

SEQ ID NO: 6534269 - DNA, 14 bp, Homo sapiens
ttccgttcattgct

SEQ ID NO: 6534270 - DNA, 13 bp, Homo sapiens
ttccgttccccgc

SEQ ID NO: 6534271 - DNA, 15 bp, Homo sapiens
ttccgttccccgcta

SEQ ID NO: 6534272 - DNA, 16 bp, Homo sapiens
ttccgttcctccccct

SEQ ID NO: 6534273 - DNA, 15 bp, Homo sapiens
ttccgttggaaagaa

SEQ ID NO: 6534274 - DNA, 14 bp, Homo sapiens
ttccgttgtctgtg

SEQ ID NO: 6534275 - DNA, 19 bp, Homo sapiens
ttcctaaaaataagcttta

SEQ ID NO: 6534276 - DNA, 20 bp, Homo sapiens
ttcctaaaaataagctttat

SEQ ID NO: 6534277 - DNA, 19 bp, Homo sapiens
ttcctaaaacacccttcag

SEQ ID NO: 6534278 - DNA, 13 bp, Homo sapiens
ttcctaaaattat

SEQ ID NO: 6534279 - DNA, 12 bp, Homo sapiens
ttcctaaacata

SEQ ID NO: 6534280 - DNA, 16 bp, Homo sapiens
ttcctaaactctgaaa

SEQ ID NO: 6534281 - DNA, 18 bp, Homo sapiens
ttcctaaagaaaaagata

SEQ ID NO: 6534282 - DNA, 15 bp, Homo sapiens
ttcctaaagccatca

SEQ ID NO: 6534283 - DNA, 20 bp, Homo sapiens
ttcctaaatcagcatttttc

SEQ ID NO: 6534284 - DNA, 13 bp, Homo sapiens
ttcctaaatgcag

SEQ ID NO: 6534285 - DNA, 14 bp, Homo sapiens
ttcctaaatgcagt

SEQ ID NO: 6534286 - DNA, 12 bp, Homo sapiens
ttcctaaatttt

SEQ ID NO: 6534287 - DNA, 14 bp, Homo sapiens
ttcctaacaaaatg

SEQ ID NO: 6534288 - DNA, 19 bp, Homo sapiens
ttcctaacacagcatgtgt

SEQ ID NO: 6534289 - DNA, 19 bp, Homo sapiens
ttcctaacaggattagaca

SEQ ID NO: 6534290 - DNA, 24 bp, Homo sapiens
ttcctaactagaattagtatgtct

SEQ ID NO: 6534291 - DNA, 11 bp, Homo sapiens
ttcctaactta

SEQ ID NO: 6534292 - DNA, 19 bp, Homo sapiens
ttcctaagaagtccccagg

SEQ ID NO: 6534293 - DNA, 18 bp, Homo sapiens
ttcctaagacatttttca

SEQ ID NO: 6534294 - DNA, 23 bp, Homo sapiens
ttcctaagacatttttcattcat

SEQ ID NO: 6534295 - DNA, 20 bp, Homo sapiens
ttcctaagactgctgctgaa

SEQ ID NO: 6534296 - DNA, 21 bp, Homo sapiens
ttcctaagagtggaggaggag

SEQ ID NO: 6534297 - DNA, 22 bp, Homo sapiens
ttcctaagccacttgaaatgtt

SEQ ID NO: 6534298 - DNA, 17 bp, Homo sapiens
ttcctaagcctgtggct

SEQ ID NO: 6534299 - DNA, 20 bp, Homo sapiens
ttcctaaggccactgtttta

SEQ ID NO: 6534300 - DNA, 14 bp, Homo sapiens
ttcctaaggcccag

SEQ ID NO: 6534301 - DNA, 17 bp, Homo sapiens
ttcctaaggcccagctg

SEQ ID NO: 6534302 - DNA, 22 bp, Homo sapiens
ttcctaaggcccagctgccagg

SEQ ID NO: 6534303 - DNA, 14 bp, Homo sapiens
ttcctaaggctgca

SEQ ID NO: 6534304 - DNA, 16 bp, Homo sapiens
ttcctaagttcccttc

SEQ ID NO: 6534305 - DNA, 17 bp, Homo sapiens
ttcctaagttcttagat

SEQ ID NO: 6534306 - DNA, 22 bp, Homo sapiens
ttcctaataaagttctgtactc

SEQ ID NO: 6534307 - DNA, 16 bp, Homo sapiens
ttcctaatatcaaatg

SEQ ID NO: 6534308 - DNA, 13 bp, Homo sapiens
ttcctaatcctct

SEQ ID NO: 6534309 - DNA, 14 bp, Homo sapiens
ttcctaattctatg

SEQ ID NO: 6534310 - DNA, 17 bp, Homo sapiens
ttcctaattgtgcccct

SEQ ID NO: 6534311 - DNA, 13 bp, Homo sapiens
ttcctaattttag

SEQ ID NO: 6534312 - DNA, 13 bp, Homo sapiens
ttcctacaaaatg

SEQ ID NO: 6534313 - DNA, 18 bp, Homo sapiens
ttcctacaaagaaaaaag

SEQ ID NO: 6534314 - DNA, 16 bp, Homo sapiens
ttcctacaaagatgtt

SEQ ID NO: 6534315 - DNA, 20 bp, Homo sapiens
ttcctacaagagcagcctgt

SEQ ID NO: 6534316 - DNA, 14 bp, Homo sapiens
ttcctacacaggac

SEQ ID NO: 6534317 - DNA, 23 bp, Homo sapiens
ttcctacagagccaaaatgccat

SEQ ID NO: 6534318 - DNA, 18 bp, Homo sapiens
ttcctacagatagtcaaa

SEQ ID NO: 6534319 - DNA, 15 bp, Homo sapiens
ttcctacagcactac

SEQ ID NO: 6534320 - DNA, 22 bp, Homo sapiens
ttcctacagcactactgggtgt

SEQ ID NO: 6534321 - DNA, 23 bp, Homo sapiens
ttcctacagcactactgggtgtc

SEQ ID NO: 6534322 - DNA, 20 bp, Homo sapiens
ttcctacatgccccctccct

SEQ ID NO: 6534323 - DNA, 20 bp, Homo sapiens
ttcctacccacacctctgcc

SEQ ID NO: 6534324 - DNA, 17 bp, Homo sapiens
ttcctacccctcttcca

SEQ ID NO: 6534325 - DNA, 22 bp, Homo sapiens
ttcctacccctcttccagcttc

SEQ ID NO: 6534326 - DNA, 23 bp, Homo sapiens
ttcctacccctcttccagcttct

SEQ ID NO: 6534327 - DNA, 16 bp, Homo sapiens
ttcctaccctgcctcc

SEQ ID NO: 6534328 - DNA, 23 bp, Homo sapiens
ttcctaccgtactccctgcaccg

SEQ ID NO: 6534329 - DNA, 16 bp, Homo sapiens
ttcctaccttggtcct

SEQ ID NO: 6534330 - DNA, 23 bp, Homo sapiens
ttcctacgtaggatgaaaagatt

SEQ ID NO: 6534331 - DNA, 16 bp, Homo sapiens
ttcctactcacacttc

SEQ ID NO: 6534332 - DNA, 19 bp, Homo sapiens
ttcctactccctcttccaa

SEQ ID NO: 6534333 - DNA, 20 bp, Homo sapiens
ttcctactccctcttccaaa

SEQ ID NO: 6534334 - DNA, 14 bp, Homo sapiens
ttcctactcctcat

SEQ ID NO: 6534335 - DNA, 12 bp, Homo sapiens
ttcctactcttc

SEQ ID NO: 6534336 - DNA, 18 bp, Homo sapiens
ttcctactcttctctctg

SEQ ID NO: 6534337 - DNA, 19 bp, Homo sapiens
ttcctactgacaacattat

SEQ ID NO: 6534338 - DNA, 17 bp, Homo sapiens
ttcctactgcgcctcgt

SEQ ID NO: 6534339 - DNA, 15 bp, Homo sapiens
ttcctactgtcctca

SEQ ID NO: 6534340 - DNA, 16 bp, Homo sapiens
ttcctacttaaacaaa

SEQ ID NO: 6534341 - DNA, 16 bp, Homo sapiens
ttcctagaaattgaac

SEQ ID NO: 6534342 - DNA, 15 bp, Homo sapiens
ttcctagaagtggtt

SEQ ID NO: 6534343 - DNA, 22 bp, Homo sapiens
ttcctagaagttactgaatgca

SEQ ID NO: 6534344 - DNA, 20 bp, Homo sapiens
ttcctagactaattaaaatc

SEQ ID NO: 6534345 - DNA, 23 bp, Homo sapiens
ttcctagagcatctgtcccactg

SEQ ID NO: 6534346 - DNA, 18 bp, Homo sapiens
ttcctagaggcagaggtt

SEQ ID NO: 6534347 - DNA, 18 bp, Homo sapiens
ttcctagataaaaagatg

SEQ ID NO: 6534348 - DNA, 19 bp, Homo sapiens
ttcctagattacatctgcc

SEQ ID NO: 6534349 - DNA, 20 bp, Homo sapiens
ttcctagattacatctgcct

SEQ ID NO: 6534350 - DNA, 22 bp, Homo sapiens
ttcctagattacatctgcctta

SEQ ID NO: 6534351 - DNA, 21 bp, Homo sapiens
ttcctagcaaatttctctctt

SEQ ID NO: 6534352 - DNA, 22 bp, Homo sapiens
ttcctagcaaatttctctcttt

SEQ ID NO: 6534353 - DNA, 19 bp, Homo sapiens
ttcctagcacacacttttg

SEQ ID NO: 6534354 - DNA, 21 bp, Homo sapiens
ttcctagcactgccccacatg

SEQ ID NO: 6534355 - DNA, 22 bp, Homo sapiens
ttcctagcactgccccacatgc

SEQ ID NO: 6534356 - DNA, 14 bp, Homo sapiens
ttcctagccaccgc

SEQ ID NO: 6534357 - DNA, 21 bp, Homo sapiens
ttcctagccaccgcctcctac

SEQ ID NO: 6534358 - DNA, 15 bp, Homo sapiens
ttcctagctgtaaat

SEQ ID NO: 6534359 - DNA, 17 bp, Homo sapiens
ttcctaggatgtcatgt

SEQ ID NO: 6534360 - DNA, 19 bp, Homo sapiens
ttcctaggcattgcaggac

SEQ ID NO: 6534361 - DNA, 18 bp, Homo sapiens
ttcctaggggaatgaggg

SEQ ID NO: 6534362 - DNA, 20 bp, Homo sapiens
ttcctaggtataattcacat

SEQ ID NO: 6534363 - DNA, 14 bp, Homo sapiens
ttcctagtatatta

SEQ ID NO: 6534364 - DNA, 19 bp, Homo sapiens
ttcctagtgaaccacaggt

SEQ ID NO: 6534365 - DNA, 24 bp, Homo sapiens
ttcctagtgaaccacaggttttag

SEQ ID NO: 6534366 - DNA, 20 bp, Homo sapiens
ttcctagtggatgactgttg

SEQ ID NO: 6534367 - DNA, 21 bp, Homo sapiens
ttcctagtggatgactgttga

SEQ ID NO: 6534368 - DNA, 17 bp, Homo sapiens
ttcctagttctgtagaa

SEQ ID NO: 6534369 - DNA, 21 bp, Homo sapiens
ttcctagttggtgagaaacct

SEQ ID NO: 6534370 - DNA, 15 bp, Homo sapiens
ttcctagttttctcc

SEQ ID NO: 6534371 - DNA, 20 bp, Homo sapiens
ttcctataacttcttcctgc

SEQ ID NO: 6534372 - DNA, 20 bp, Homo sapiens
ttcctataccggagctccag

SEQ ID NO: 6534373 - DNA, 20 bp, Homo sapiens
ttcctatatacctaataccc

SEQ ID NO: 6534374 - DNA, 12 bp, Homo sapiens
ttcctatatgca

SEQ ID NO: 6534375 - DNA, 18 bp, Homo sapiens
ttcctatcaaaaagatat

SEQ ID NO: 6534376 - DNA, 16 bp, Homo sapiens
ttcctatcataaaaat

SEQ ID NO: 6534377 - DNA, 15 bp, Homo sapiens
ttcctatcatgttaa

SEQ ID NO: 6534378 - DNA, 15 bp, Homo sapiens
ttcctatcccatccc

SEQ ID NO: 6534379 - DNA, 14 bp, Homo sapiens
ttcctatgacacag

SEQ ID NO: 6534380 - DNA, 15 bp, Homo sapiens
ttcctatgactaatt

SEQ ID NO: 6534381 - DNA, 13 bp, Homo sapiens
ttcctatgatgga

SEQ ID NO: 6534382 - DNA, 14 bp, Homo sapiens
ttcctatgatgtat

SEQ ID NO: 6534383 - DNA, 21 bp, Homo sapiens
ttcctatgatgtatactgcca

SEQ ID NO: 6534384 - DNA, 18 bp, Homo sapiens
ttcctatgctattgacaa

SEQ ID NO: 6534385 - DNA, 19 bp, Homo sapiens
ttcctattccaagcttcca

SEQ ID NO: 6534386 - DNA, 17 bp, Homo sapiens
ttcctattctgttgcca

SEQ ID NO: 6534387 - DNA, 12 bp, Homo sapiens
ttcctattgtga

SEQ ID NO: 6534388 - DNA, 22 bp, Homo sapiens
ttcctatttcagtgttacctgt

SEQ ID NO: 6534389 - DNA, 22 bp, Homo sapiens
ttcctatttgccatgggcttca

SEQ ID NO: 6534390 - DNA, 19 bp, Homo sapiens
ttcctatttgttttcatgg

SEQ ID NO: 6534391 - DNA, 21 bp, Homo sapiens
ttcctatttgttttcatggtg

SEQ ID NO: 6534392 - DNA, 21 bp, Homo sapiens
ttcctattttggagtggtcag

SEQ ID NO: 6534393 - DNA, 16 bp, Homo sapiens
ttcctatttttaaata

SEQ ID NO: 6534394 - DNA, 17 bp, Homo sapiens
ttcctatttttaaataa

SEQ ID NO: 6534395 - DNA, 19 bp, Homo sapiens
ttcctcaaaaagcagaagg

SEQ ID NO: 6534396 - DNA, 20 bp, Homo sapiens
ttcctcaaaataaagaagta

SEQ ID NO: 6534397 - DNA, 14 bp, Homo sapiens
ttcctcaaatcaaa

SEQ ID NO: 6534398 - DNA, 22 bp, Homo sapiens
tggtttcggaaaaaaaaaaaga

SEQ ID NO: 6534399 - DNA, 24 bp, Homo sapiens
tggtttctacttcccctgggatgc

SEQ ID NO: 6534400 - DNA, 16 bp, Homo sapiens
tggtttctagacttgt

SEQ ID NO: 6534401 - DNA, 15 bp, Homo sapiens
tggtttctatacatg

SEQ ID NO: 6534402 - DNA, 17 bp, Homo sapiens
tggtttctcatgagctg

SEQ ID NO: 6534403 - DNA, 15 bp, Homo sapiens
tggtttctcattctt

SEQ ID NO: 6534404 - DNA, 16 bp, Homo sapiens
tggtttctcattcttg

SEQ ID NO: 6534405 - DNA, 21 bp, Homo sapiens
tggtttctctctacagtgcca

SEQ ID NO: 6534406 - DNA, 15 bp, Homo sapiens
tggtttctcttctcc

SEQ ID NO: 6534407 - DNA, 17 bp, Homo sapiens
tggtttctgaaaatgtt

SEQ ID NO: 6534408 - DNA, 19 bp, Homo sapiens
tggtttctgcgtgtgtata

SEQ ID NO: 6534409 - DNA, 14 bp, Homo sapiens
tggtttctgcttct

SEQ ID NO: 6534410 - DNA, 23 bp, Homo sapiens
tggtttctgtttgaattttcaaa

SEQ ID NO: 6534411 - DNA, 11 bp, Homo sapiens
tggtttcttat

SEQ ID NO: 6534412 - DNA, 15 bp, Homo sapiens
tggtttcttcattct

SEQ ID NO: 6534413 - DNA, 16 bp, Homo sapiens
tggtttcttcattctt

SEQ ID NO: 6534414 - DNA, 22 bp, Homo sapiens
tggtttcttgtgcactggcacc

SEQ ID NO: 6534415 - DNA, 23 bp, Homo sapiens
tggtttgaaaatattttcattat

SEQ ID NO: 6534416 - DNA, 16 bp, Homo sapiens
tggtttgaaagattat

SEQ ID NO: 6534417 - DNA, 21 bp, Homo sapiens
tggtttgacaattttgtctta

SEQ ID NO: 6534418 - DNA, 21 bp, Homo sapiens
tggtttgagacactggtttac

SEQ ID NO: 6534419 - DNA, 23 bp, Homo sapiens
tggtttgagcttagtgaaattac

SEQ ID NO: 6534420 - DNA, 15 bp, Homo sapiens
tggtttgcaggtggc

SEQ ID NO: 6534421 - DNA, 16 bp, Homo sapiens
tggtttgcatgacttt

SEQ ID NO: 6534422 - DNA, 13 bp, Homo sapiens
tggtttgccatgt

SEQ ID NO: 6534423 - DNA, 15 bp, Homo sapiens
tggtttgcccagagc

SEQ ID NO: 6534424 - DNA, 16 bp, Homo sapiens
tggtttgccttccaga

SEQ ID NO: 6534425 - DNA, 12 bp, Homo sapiens
tggtttgctagt

SEQ ID NO: 6534426 - DNA, 13 bp, Homo sapiens
tggtttggaaaat

SEQ ID NO: 6534427 - DNA, 22 bp, Homo sapiens
tggtttggattactattgcaaa

SEQ ID NO: 6534428 - DNA, 20 bp, Homo sapiens
tggtttggccatctctggat

SEQ ID NO: 6534429 - DNA, 23 bp, Homo sapiens
tggtttggcccttctccttttga

SEQ ID NO: 6534430 - DNA, 17 bp, Homo sapiens
tggtttggcctccatcc

SEQ ID NO: 6534431 - DNA, 20 bp, Homo sapiens
tggtttgggcaagcagactg

SEQ ID NO: 6534432 - DNA, 21 bp, Homo sapiens
tggtttgggccccattcagaa

SEQ ID NO: 6534433 - DNA, 15 bp, Homo sapiens
tggtttggggagaaa

SEQ ID NO: 6534434 - DNA, 16 bp, Homo sapiens
tggtttggggagaaat

SEQ ID NO: 6534435 - DNA, 19 bp, Homo sapiens
tggtttggggcgaggcaga

SEQ ID NO: 6534436 - DNA, 23 bp, Homo sapiens
tggtttggtccctggttttcagt

SEQ ID NO: 6534437 - DNA, 19 bp, Homo sapiens
tggtttggttcatggtgaa

SEQ ID NO: 6534438 - DNA, 13 bp, Homo sapiens
tggtttggttttg

SEQ ID NO: 6534439 - DNA, 11 bp, Homo sapiens
tggtttgtaat

SEQ ID NO: 6534440 - DNA, 17 bp, Homo sapiens
tggtttgtacatatcaa

SEQ ID NO: 6534441 - DNA, 15 bp, Homo sapiens
tggtttgtactcaaa

SEQ ID NO: 6534442 - DNA, 13 bp, Homo sapiens
tggtttgtcctga

SEQ ID NO: 6534443 - DNA, 23 bp, Homo sapiens
tggtttgtgaatccatcttgctt

SEQ ID NO: 6534444 - DNA, 21 bp, Homo sapiens
tggtttgtgagccttgctgcc

SEQ ID NO: 6534445 - DNA, 22 bp, Homo sapiens
tggtttgtgtcaaaactggttt

SEQ ID NO: 6534446 - DNA, 13 bp, Homo sapiens
tggtttgttattc

SEQ ID NO: 6534447 - DNA, 13 bp, Homo sapiens
tggtttgtttgct

SEQ ID NO: 6534448 - DNA, 12 bp, Homo sapiens
tggttttaaaat

SEQ ID NO: 6534449 - DNA, 13 bp, Homo sapiens
tggttttaaaata

SEQ ID NO: 6534450 - DNA, 20 bp, Homo sapiens
tggttttaaacctttaatga

SEQ ID NO: 6534451 - DNA, 16 bp, Homo sapiens
tggttttaaagctaaa

SEQ ID NO: 6534452 - DNA, 12 bp, Homo sapiens
tggttttaacaa

SEQ ID NO: 6534453 - DNA, 20 bp, Homo sapiens
tggttttaacaactgtgctt

SEQ ID NO: 6534454 - DNA, 16 bp, Homo sapiens
tggttttacacagaga

SEQ ID NO: 6534455 - DNA, 18 bp, Homo sapiens
tggttttacacagagaaa

SEQ ID NO: 6534456 - DNA, 16 bp, Homo sapiens
tggttttacacaggaa

SEQ ID NO: 6534457 - DNA, 23 bp, Homo sapiens
tggttttacagtgaatttctgat

SEQ ID NO: 6534458 - DNA, 16 bp, Homo sapiens
tggttttacttacaaa

SEQ ID NO: 6534459 - DNA, 13 bp, Homo sapiens
tggttttagattt

SEQ ID NO: 6534460 - DNA, 20 bp, Homo sapiens
tggttttatactatattaac

SEQ ID NO: 6534461 - DNA, 21 bp, Homo sapiens
tggttttatactatattaact

SEQ ID NO: 6534462 - DNA, 23 bp, Homo sapiens
tggttttatactgaaggaaaaac

SEQ ID NO: 6534463 - DNA, 12 bp, Homo sapiens
tggttttatgca

SEQ ID NO: 6534464 - DNA, 14 bp, Homo sapiens
tggttttcaaaata

SEQ ID NO: 6534465 - DNA, 18 bp, Homo sapiens
tggttttcagagcaggag

SEQ ID NO: 6534466 - DNA, 20 bp, Homo sapiens
tggttttcagagcaggaggc

SEQ ID NO: 6534467 - DNA, 12 bp, Homo sapiens
tggttttcatta

SEQ ID NO: 6534468 - DNA, 13 bp, Homo sapiens
tggttttcattat

SEQ ID NO: 6534469 - DNA, 12 bp, Homo sapiens
tggttttccatg

SEQ ID NO: 6534470 - DNA, 14 bp, Homo sapiens
tggttttcccctcc

SEQ ID NO: 6534471 - DNA, 20 bp, Homo sapiens
tggttttcgtcatcttccct

SEQ ID NO: 6534472 - DNA, 19 bp, Homo sapiens
tggttttctccaagagcta

SEQ ID NO: 6534473 - DNA, 12 bp, Homo sapiens
tggttttctcct

SEQ ID NO: 6534474 - DNA, 15 bp, Homo sapiens
tggttttctctctgg

SEQ ID NO: 6534475 - DNA, 21 bp, Homo sapiens
tggttttctgccaatgaccaa

SEQ ID NO: 6534476 - DNA, 16 bp, Homo sapiens
tggttttctgttcttt

SEQ ID NO: 6534477 - DNA, 19 bp, Homo sapiens
tggttttcttgccaccctc

SEQ ID NO: 6534478 - DNA, 23 bp, Homo sapiens
tggttttcttgccaccctctggg

SEQ ID NO: 6534479 - DNA, 17 bp, Homo sapiens
tggttttctttttcctt

SEQ ID NO: 6534480 - DNA, 21 bp, Homo sapiens
tggttttgccctccctctctg

SEQ ID NO: 6534481 - DNA, 15 bp, Homo sapiens
tggttttgcctcttt

SEQ ID NO: 6534482 - DNA, 16 bp, Homo sapiens
tggttttggccacccc

SEQ ID NO: 6534483 - DNA, 20 bp, Homo sapiens
tggttttggctctcccaccc

SEQ ID NO: 6534484 - DNA, 21 bp, Homo sapiens
tggttttggggaaatgtggag

SEQ ID NO: 6534485 - DNA, 18 bp, Homo sapiens
tggttttgtaagatgctg

SEQ ID NO: 6534486 - DNA, 13 bp, Homo sapiens
tggttttgtaatt

SEQ ID NO: 6534487 - DNA, 15 bp, Homo sapiens
tggttttgtgcttta

SEQ ID NO: 6534488 - DNA, 17 bp, Homo sapiens
tggttttgttcccctcc

SEQ ID NO: 6534489 - DNA, 14 bp, Homo sapiens
tggttttgtttctg

SEQ ID NO: 6534490 - DNA, 20 bp, Homo sapiens
tggttttgttttcaatgaat

SEQ ID NO: 6534491 - DNA, 23 bp, Homo sapiens
tggttttgttttcaatgaattaa

SEQ ID NO: 6534492 - DNA, 21 bp, Homo sapiens
tggtttttaaaaaactgctga

SEQ ID NO: 6534493 - DNA, 23 bp, Homo sapiens
tggtttttaaaaaactgctgact

SEQ ID NO: 6534494 - DNA, 23 bp, Homo sapiens
tggtttttaaaaaatgttttctg

SEQ ID NO: 6534495 - DNA, 21 bp, Homo sapiens
tggtttttaaattttgtaatg

SEQ ID NO: 6534496 - DNA, 18 bp, Homo sapiens
tggtttttactgctctga

SEQ ID NO: 6534497 - DNA, 13 bp, Homo sapiens
tggtttttataat

SEQ ID NO: 6534498 - DNA, 16 bp, Homo sapiens
tggtttttcagttttc

SEQ ID NO: 6534499 - DNA, 16 bp, Homo sapiens
tggtttttcttttctt

SEQ ID NO: 6534500 - DNA, 19 bp, Homo sapiens
tggtttttcttttcttgga

SEQ ID NO: 6534501 - DNA, 24 bp, Homo sapiens
tggtttttgcaagatttaacacta

SEQ ID NO: 6534502 - DNA, 22 bp, Homo sapiens
tggtttttgtagccttcctcca

SEQ ID NO: 6534503 - DNA, 22 bp, Homo sapiens
tggttttttttttttttttggc

SEQ ID NO: 6534504 - DNA, 19 bp, Homo sapiens
tgtaaaaaaaaatgccttt

SEQ ID NO: 6534505 - DNA, 16 bp, Homo sapiens
tgtaaaaaaagcaaaa

SEQ ID NO: 6534506 - DNA, 13 bp, Homo sapiens
tgtaaaaaacaaa

SEQ ID NO: 6534507 - DNA, 17 bp, Homo sapiens
tgtaaaaaacaaaaaaa

SEQ ID NO: 6534508 - DNA, 21 bp, Homo sapiens
tgtaaaaaacaaaaaaaacaa

SEQ ID NO: 6534509 - DNA, 22 bp, Homo sapiens
tgtaaaaaacaaaaaaaacaac

SEQ ID NO: 6534510 - DNA, 12 bp, Homo sapiens
tgtaaaaaagaa

SEQ ID NO: 6534511 - DNA, 14 bp, Homo sapiens
tgtaaaaaatacaa

SEQ ID NO: 6534512 - DNA, 14 bp, Homo sapiens
tgtaaaaaatatta

SEQ ID NO: 6534513 - DNA, 16 bp, Homo sapiens
tgtaaaaaatattaaa

SEQ ID NO: 6534514 - DNA, 12 bp, Homo sapiens
tgtaaaaaatgg

SEQ ID NO: 6534515 - DNA, 15 bp, Homo sapiens
tgtaaaaaatggaaa

SEQ ID NO: 6534516 - DNA, 16 bp, Homo sapiens
tgtaaaaaatggaaaa

SEQ ID NO: 6534517 - DNA, 21 bp, Homo sapiens
tgtaaaaaatggaaaaaaaca

SEQ ID NO: 6534518 - DNA, 22 bp, Homo sapiens
tgtaaaaaatgtctcatgtcaa

SEQ ID NO: 6534519 - DNA, 16 bp, Homo sapiens
tgtaaaaaattcacat

SEQ ID NO: 6534520 - DNA, 19 bp, Homo sapiens
tgtaaaaaattcacataat

SEQ ID NO: 6534521 - DNA, 22 bp, Homo sapiens
tgtaaaaaattcacataataaa

SEQ ID NO: 6534522 - DNA, 14 bp, Homo sapiens
tgtaaaaacactga

SEQ ID NO: 6534523 - DNA, 22 bp, Homo sapiens
tgtaaaaacagcattgctttct

SEQ ID NO: 6534524 - DNA, 22 bp, Homo sapiens
tgtaaaaacccaagtccctgtc

SEQ ID NO: 6534525 - DNA, 13 bp, Homo sapiens
tgtaaaaactgaa

SEQ ID NO: 6534526 - DNA, 14 bp, Homo sapiens
tgtaaaaactgtgg

SEQ ID NO: 6534527 - DNA, 13 bp, Homo sapiens
tgtaaaaagaaaa

SEQ ID NO: 6534528 - DNA, 13 bp, Homo sapiens
tgtaaaaagaaat

SEQ ID NO: 6534529 - DNA, 18 bp, Homo sapiens
tgtaaaaagcctccttgt

SEQ ID NO: 6534530 - DNA, 16 bp, Homo sapiens
tgtaaaaagggaaaaa

SEQ ID NO: 6534531 - DNA, 19 bp, Homo sapiens
tgtaaaaagggaaaaagac

SEQ ID NO: 6534532 - DNA, 18 bp, Homo sapiens
tgtaaaaaggggaggaga

SEQ ID NO: 6534533 - DNA, 19 bp, Homo sapiens
tgtaaaaaggggaggagaa

SEQ ID NO: 6534534 - DNA, 22 bp, Homo sapiens
tgtaaaaagtagattaaaatat

SEQ ID NO: 6534535 - DNA, 17 bp, Homo sapiens
tgtaaaaatgaaggaat

SEQ ID NO: 6534536 - DNA, 11 bp, Homo sapiens
tgtaaaacaaa

SEQ ID NO: 6534537 - DNA, 23 bp, Homo sapiens
tgtaaaacaaaaatgtaatgatc

SEQ ID NO: 6534538 - DNA, 20 bp, Homo sapiens
tgtaaaacaatgccatgaac

SEQ ID NO: 6534539 - DNA, 14 bp, Homo sapiens
tgtaaaacaggtag

SEQ ID NO: 6534540 - DNA, 14 bp, Homo sapiens
tgtaaaacagtggt

SEQ ID NO: 6534541 - DNA, 21 bp, Homo sapiens
tgtaaaaccatcagatatttc

SEQ ID NO: 6534542 - DNA, 21 bp, Homo sapiens
tgtaaaaccatgtagttttaa

SEQ ID NO: 6534543 - DNA, 16 bp, Homo sapiens
tgtaaaacctgtcaat

SEQ ID NO: 6534544 - DNA, 16 bp, Homo sapiens
tgtaaaacgctgtcaa

SEQ ID NO: 6534545 - DNA, 17 bp, Homo sapiens
tgtaaaactcgctttta

SEQ ID NO: 6534546 - DNA, 22 bp, Homo sapiens
tgtaaaactgtgacattccaca

SEQ ID NO: 6534547 - DNA, 23 bp, Homo sapiens
tgtaaaactgtgacattccacag

SEQ ID NO: 6534548 - DNA, 12 bp, Homo sapiens
tgtaaaactgtt

SEQ ID NO: 6534549 - DNA, 14 bp, Homo sapiens
tgtaaaacttctgc

SEQ ID NO: 6534550 - DNA, 17 bp, Homo sapiens
tgtaaaacttctgctcg

SEQ ID NO: 6534551 - DNA, 12 bp, Homo sapiens
tgtaaaacttta

SEQ ID NO: 6534552 - DNA, 13 bp, Homo sapiens
tgtaaaactttat

SEQ ID NO: 6534553 - DNA, 17 bp, Homo sapiens
tgtaaaactttggtgca

SEQ ID NO: 6534554 - DNA, 23 bp, Homo sapiens
tgtaaaagaaaattttttttcaa

SEQ ID NO: 6534555 - DNA, 21 bp, Homo sapiens
tgtaaaagaaaggttgcgttt

SEQ ID NO: 6534556 - DNA, 12 bp, Homo sapiens
tgtaaaagacat

SEQ ID NO: 6534557 - DNA, 14 bp, Homo sapiens
tgtaaaagagaaac

SEQ ID NO: 6534558 - DNA, 18 bp, Homo sapiens
tgtaaaagcattttgtaa

SEQ ID NO: 6534559 - DNA, 15 bp, Homo sapiens
tgtaaaagttactaa

SEQ ID NO: 6534560 - DNA, 16 bp, Homo sapiens
tgtaaaagttataata

SEQ ID NO: 6534561 - DNA, 16 bp, Homo sapiens
tgtaaaataaaaccac

SEQ ID NO: 6534562 - DNA, 14 bp, Homo sapiens
tgtaaaataaaatt

SEQ ID NO: 6534563 - DNA, 18 bp, Homo sapiens
tgtaaaataagaatgatt

SEQ ID NO: 6534564 - DNA, 13 bp, Homo sapiens
tgtaaaatactat

SEQ ID NO: 6534565 - DNA, 16 bp, Homo sapiens
tgtaaaatagaaaaag

SEQ ID NO: 6534566 - DNA, 12 bp, Homo sapiens
tgtaaaatagct

SEQ ID NO: 6534567 - DNA, 17 bp, Homo sapiens
tgtaaaatagcttgtat

SEQ ID NO: 6534568 - DNA, 15 bp, Homo sapiens
tgtaaaatagtctca

SEQ ID NO: 6534569 - DNA, 12 bp, Homo sapiens
tgtaaaatagtt

SEQ ID NO: 6534570 - DNA, 19 bp, Homo sapiens
tgtaaaatatagctgtaca

SEQ ID NO: 6534571 - DNA, 17 bp, Homo sapiens
tgtaaaatatagtcgct

SEQ ID NO: 6534572 - DNA, 17 bp, Homo sapiens
tgtaaaatatctacctg

SEQ ID NO: 6534573 - DNA, 18 bp, Homo sapiens
tgtaaaatatctacctgc

SEQ ID NO: 6534574 - DNA, 19 bp, Homo sapiens
tgtaaaatattttgaatca

SEQ ID NO: 6534575 - DNA, 21 bp, Homo sapiens
tgtaaaatcctacagtgaaat

SEQ ID NO: 6534576 - DNA, 22 bp, Homo sapiens
tgtaaaatcctacagtgaaatg

SEQ ID NO: 6534577 - DNA, 20 bp, Homo sapiens
ttcctcaaatcagtgataat

SEQ ID NO: 6534578 - DNA, 15 bp, Homo sapiens
ttcctcaaatgttga

SEQ ID NO: 6534579 - DNA, 14 bp, Homo sapiens
ttcctcaaattttt

SEQ ID NO: 6534580 - DNA, 22 bp, Homo sapiens
ttcctcaacagtgttttcagaa

SEQ ID NO: 6534581 - DNA, 22 bp, Homo sapiens
ttcctcaagtatcttctatttt

SEQ ID NO: 6534582 - DNA, 18 bp, Homo sapiens
ttcctcaatcacactaca

SEQ ID NO: 6534583 - DNA, 21 bp, Homo sapiens
ttcctcacaccaggcttgcct

SEQ ID NO: 6534584 - DNA, 23 bp, Homo sapiens
ttcctcacacccctgtcccaccc

SEQ ID NO: 6534585 - DNA, 18 bp, Homo sapiens
ttcctcacagccttggct

SEQ ID NO: 6534586 - DNA, 21 bp, Homo sapiens
ttcctcacagccttggctcct

SEQ ID NO: 6534587 - DNA, 13 bp, Homo sapiens
ttcctcacatttg

SEQ ID NO: 6534588 - DNA, 10 bp, Homo sapiens
ttcctcacca

SEQ ID NO: 6534589 - DNA, 14 bp, Homo sapiens
ttcctcaccaataa

SEQ ID NO: 6534590 - DNA, 16 bp, Homo sapiens
ttcctcaccaataact

SEQ ID NO: 6534591 - DNA, 17 bp, Homo sapiens
ttcctcaccaataactt

SEQ ID NO: 6534592 - DNA, 22 bp, Homo sapiens
ttcctcaccaataacttcagag

SEQ ID NO: 6534593 - DNA, 23 bp, Homo sapiens
ttcctcaccaataacttcagaga

SEQ ID NO: 6534594 - DNA, 22 bp, Homo sapiens
ttcctcacctaccctcaaagta

SEQ ID NO: 6534595 - DNA, 15 bp, Homo sapiens
ttcctcactatgaca

SEQ ID NO: 6534596 - DNA, 13 bp, Homo sapiens
ttcctcagatgat

SEQ ID NO: 6534597 - DNA, 19 bp, Homo sapiens
ttcctcagatgatgtttgc

SEQ ID NO: 6534598 - DNA, 22 bp, Homo sapiens
ttcctcagattagatgtgccaa

SEQ ID NO: 6534599 - DNA, 15 bp, Homo sapiens
ttcctcagcaggcca

SEQ ID NO: 6534600 - DNA, 22 bp, Homo sapiens
ttcctcagcaggttggcttttt

SEQ ID NO: 6534601 - DNA, 13 bp, Homo sapiens
ttcctcagcctcc

SEQ ID NO: 6534602 - DNA, 14 bp, Homo sapiens
ttcctcagcctcca

SEQ ID NO: 6534603 - DNA, 13 bp, Homo sapiens
ttcctcagcctgg

SEQ ID NO: 6534604 - DNA, 11 bp, Homo sapiens
ttcctcagctc

SEQ ID NO: 6534605 - DNA, 13 bp, Homo sapiens
ttcctcagctcta

SEQ ID NO: 6534606 - DNA, 17 bp, Homo sapiens
ttcctcagctctaggct

SEQ ID NO: 6534607 - DNA, 15 bp, Homo sapiens
ttcctcagctgccaa

SEQ ID NO: 6534608 - DNA, 15 bp, Homo sapiens
ttcctcagctgcctc

SEQ ID NO: 6534609 - DNA, 16 bp, Homo sapiens
ttcctcagctgcctcc

SEQ ID NO: 6534610 - DNA, 17 bp, Homo sapiens
ttcctcaggaaggacat

SEQ ID NO: 6534611 - DNA, 15 bp, Homo sapiens
ttcctcagtcctgga

SEQ ID NO: 6534612 - DNA, 17 bp, Homo sapiens
ttcctcagtgatggaat

SEQ ID NO: 6534613 - DNA, 17 bp, Homo sapiens
ttcctcagttacacaaa

SEQ ID NO: 6534614 - DNA, 23 bp, Homo sapiens
ttcctcatcaccatcgtgtttgc

SEQ ID NO: 6534615 - DNA, 18 bp, Homo sapiens
ttcctcatccaccccatc

SEQ ID NO: 6534616 - DNA, 14 bp, Homo sapiens
ttcctcatcctgct

SEQ ID NO: 6534617 - DNA, 17 bp, Homo sapiens
ttcctcatcctgcttct

SEQ ID NO: 6534618 - DNA, 19 bp, Homo sapiens
ttcctcatcctttccctct

SEQ ID NO: 6534619 - DNA, 21 bp, Homo sapiens
ttcctcatctatggttctaaa

SEQ ID NO: 6534620 - DNA, 23 bp, Homo sapiens
ttcctcatctatggttctaaata

SEQ ID NO: 6534621 - DNA, 18 bp, Homo sapiens
ttcctcatctgggtctcc

SEQ ID NO: 6534622 - DNA, 13 bp, Homo sapiens
ttcctcatctgtg

SEQ ID NO: 6534623 - DNA, 17 bp, Homo sapiens
ttcctcatgaatgtaaa

SEQ ID NO: 6534624 - DNA, 21 bp, Homo sapiens
ttcctcatgaatgtaaatttg

SEQ ID NO: 6534625 - DNA, 18 bp, Homo sapiens
ttcctcattgatgttaag

SEQ ID NO: 6534626 - DNA, 17 bp, Homo sapiens
ttcctccaaactcctgc

SEQ ID NO: 6534627 - DNA, 12 bp, Homo sapiens
ttcctccacagt

SEQ ID NO: 6534628 - DNA, 15 bp, Homo sapiens
ttcctccacatcctt

SEQ ID NO: 6534629 - DNA, 13 bp, Homo sapiens
ttcctccacccat

SEQ ID NO: 6534630 - DNA, 14 bp, Homo sapiens
ttcctccagacaga

SEQ ID NO: 6534631 - DNA, 12 bp, Homo sapiens
ttcctccagcct

SEQ ID NO: 6534632 - DNA, 20 bp, Homo sapiens
ttcctccagcctcccctccc

SEQ ID NO: 6534633 - DNA, 22 bp, Homo sapiens
ttcctccagctgcaccagagca

SEQ ID NO: 6534634 - DNA, 22 bp, Homo sapiens
ttcctccaggagaaggggccca

SEQ ID NO: 6534635 - DNA, 14 bp, Homo sapiens
ttcctccagtctgt

SEQ ID NO: 6534636 - DNA, 20 bp, Homo sapiens
ttcctccagtgcatactgta

SEQ ID NO: 6534637 - DNA, 13 bp, Homo sapiens
ttcctccatccta

SEQ ID NO: 6534638 - DNA, 18 bp, Homo sapiens
ttcctccatcctcctcct

SEQ ID NO: 6534639 - DNA, 14 bp, Homo sapiens
ttcctccattttta

SEQ ID NO: 6534640 - DNA, 20 bp, Homo sapiens
ttcctcccaagtggtgccta

SEQ ID NO: 6534641 - DNA, 18 bp, Homo sapiens
ttcctcccattcaagatt

SEQ ID NO: 6534642 - DNA, 19 bp, Homo sapiens
ttcctccccacactccact

SEQ ID NO: 6534643 - DNA, 22 bp, Homo sapiens
ttcctccccacactccactctg

SEQ ID NO: 6534644 - DNA, 23 bp, Homo sapiens
ttcctccccacactccactctga

SEQ ID NO: 6534645 - DNA, 13 bp, Homo sapiens
ttcctccccaccc

SEQ ID NO: 6534646 - DNA, 23 bp, Homo sapiens
ttcctccccaccctgtcccaggc

SEQ ID NO: 6534647 - DNA, 23 bp, Homo sapiens
ttcctccccaccttccccagact

SEQ ID NO: 6534648 - DNA, 21 bp, Homo sapiens
ttcctccccaggacttggtct

SEQ ID NO: 6534649 - DNA, 22 bp, Homo sapiens
ttcctccccaggacttggtctt

SEQ ID NO: 6534650 - DNA, 14 bp, Homo sapiens
ttcctccccataca

SEQ ID NO: 6534651 - DNA, 19 bp, Homo sapiens
ttcctccccatacacacac

SEQ ID NO: 6534652 - DNA, 21 bp, Homo sapiens
ttcctccccattagagtcagc

SEQ ID NO: 6534653 - DNA, 23 bp, Homo sapiens
ttcctccccattagagtcagcct

SEQ ID NO: 6534654 - DNA, 16 bp, Homo sapiens
ttcctcccccagagcc

SEQ ID NO: 6534655 - DNA, 21 bp, Homo sapiens
ttcctcccctcaacagtgagt

SEQ ID NO: 6534656 - DNA, 13 bp, Homo sapiens
ttcctcccctctc

SEQ ID NO: 6534657 - DNA, 14 bp, Homo sapiens
ttcctcccctctca

SEQ ID NO: 6534658 - DNA, 12 bp, Homo sapiens
ttcctccctcca

SEQ ID NO: 6534659 - DNA, 17 bp, Homo sapiens
ttcctccctccctgcag

SEQ ID NO: 6534660 - DNA, 18 bp, Homo sapiens
ttcctccctccctgcagg

SEQ ID NO: 6534661 - DNA, 21 bp, Homo sapiens
ttcctccctgcttaaaaatgt

SEQ ID NO: 6534662 - DNA, 12 bp, Homo sapiens
ttcctccctgga

SEQ ID NO: 6534663 - DNA, 15 bp, Homo sapiens
ttcctccctgggggc

SEQ ID NO: 6534664 - DNA, 12 bp, Homo sapiens
ttcctccctgtc

SEQ ID NO: 6534665 - DNA, 15 bp, Homo sapiens
ttcctcccttacaga

SEQ ID NO: 6534666 - DNA, 11 bp, Homo sapiens
ttcctcccttc

SEQ ID NO: 6534667 - DNA, 18 bp, Homo sapiens
ttcctcccttctgctact

SEQ ID NO: 6534668 - DNA, 20 bp, Homo sapiens
ttcctcccttctttgcttct

SEQ ID NO: 6534669 - DNA, 23 bp, Homo sapiens
ttcctccgctcccctttcccatc

SEQ ID NO: 6534670 - DNA, 24 bp, Homo sapiens
ttcctccgctcccctttcccatca

SEQ ID NO: 6534671 - DNA, 17 bp, Homo sapiens
ttcctccggctggacct

SEQ ID NO: 6534672 - DNA, 18 bp, Homo sapiens
ttcctccgtccacccagg

SEQ ID NO: 6534673 - DNA, 21 bp, Homo sapiens
ttcctccgtccacccaggctg

SEQ ID NO: 6534674 - DNA, 12 bp, Homo sapiens
ttcctcctacct

SEQ ID NO: 6534675 - DNA, 22 bp, Homo sapiens
ttcctcctaccttttgtctctt

SEQ ID NO: 6534676 - DNA, 17 bp, Homo sapiens
ttcctcctaggcgctca

SEQ ID NO: 6534677 - DNA, 19 bp, Homo sapiens
ttcctcctcagtcttctca

SEQ ID NO: 6534678 - DNA, 14 bp, Homo sapiens
ttcctcctcatcct

SEQ ID NO: 6534679 - DNA, 12 bp, Homo sapiens
ttcctcctcatg

SEQ ID NO: 6534680 - DNA, 16 bp, Homo sapiens
ttcctcctccacagtg

SEQ ID NO: 6534681 - DNA, 13 bp, Homo sapiens
ttcctcctccacc

SEQ ID NO: 6534682 - DNA, 14 bp, Homo sapiens
ttcctcctccaccc

SEQ ID NO: 6534683 - DNA, 15 bp, Homo sapiens
ttcctcctccctcct

SEQ ID NO: 6534684 - DNA, 23 bp, Homo sapiens
ttcctcctcctcctcctgttcct

SEQ ID NO: 6534685 - DNA, 13 bp, Homo sapiens
ttcctcctctcaa

SEQ ID NO: 6534686 - DNA, 19 bp, Homo sapiens
ttcctcctctcctggaaac

SEQ ID NO: 6534687 - DNA, 20 bp, Homo sapiens
ttcctcctctgcctacagcc

SEQ ID NO: 6534688 - DNA, 18 bp, Homo sapiens
ttcctcctgaagcctctg

SEQ ID NO: 6534689 - DNA, 14 bp, Homo sapiens
ttcctcctgatgga

SEQ ID NO: 6534690 - DNA, 16 bp, Homo sapiens
ttcctcctgcctttct

SEQ ID NO: 6534691 - DNA, 17 bp, Homo sapiens
ttcctcctgcctttctc

SEQ ID NO: 6534692 - DNA, 12 bp, Homo sapiens
ttcctcctgctg

SEQ ID NO: 6534693 - DNA, 13 bp, Homo sapiens
ttcctcctgctgt

SEQ ID NO: 6534694 - DNA, 23 bp, Homo sapiens
ttcctcctgctgtagtcctttct

SEQ ID NO: 6534695 - DNA, 14 bp, Homo sapiens
ttcctcctggaaat

SEQ ID NO: 6534696 - DNA, 14 bp, Homo sapiens
ttcctcctgtctcc

SEQ ID NO: 6534697 - DNA, 21 bp, Homo sapiens
ttcctccttcactgtttcatc

SEQ ID NO: 6534698 - DNA, 15 bp, Homo sapiens
ttcctccttccatgg

SEQ ID NO: 6534699 - DNA, 12 bp, Homo sapiens
ttcctccttccc

SEQ ID NO: 6534700 - DNA, 14 bp, Homo sapiens
ttcctccttccccc

SEQ ID NO: 6534701 - DNA, 15 bp, Homo sapiens
ttcctccttcccccc

SEQ ID NO: 6534702 - DNA, 16 bp, Homo sapiens
ttcctccttcccccca

SEQ ID NO: 6534703 - DNA, 18 bp, Homo sapiens
ttcctcctttacctttca

SEQ ID NO: 6534704 - DNA, 18 bp, Homo sapiens
ttcctcgagaggcacctc

SEQ ID NO: 6534705 - DNA, 16 bp, Homo sapiens
ttcctcgcctaggcct

SEQ ID NO: 6534706 - DNA, 15 bp, Homo sapiens
ttcctcgctctggga

SEQ ID NO: 6534707 - DNA, 13 bp, Homo sapiens
ttcctcgcttctt

SEQ ID NO: 6534708 - DNA, 17 bp, Homo sapiens
ttcctcggtctcccttc

SEQ ID NO: 6534709 - DNA, 18 bp, Homo sapiens
ttcctcggtctcccttcc

SEQ ID NO: 6534710 - DNA, 16 bp, Homo sapiens
ttcctcggtggctctg

SEQ ID NO: 6534711 - DNA, 16 bp, Homo sapiens
ttcctcgtgcagagct

SEQ ID NO: 6534712 - DNA, 21 bp, Homo sapiens
ttcctcgtgcagagctggggc

SEQ ID NO: 6534713 - DNA, 17 bp, Homo sapiens
ttcctctaacatttttg

SEQ ID NO: 6534714 - DNA, 18 bp, Homo sapiens
ttcctctaagatcttgcc

SEQ ID NO: 6534715 - DNA, 18 bp, Homo sapiens
ttcctctaggaaatgtac

SEQ ID NO: 6534716 - DNA, 22 bp, Homo sapiens
ttcctctaggaaatgtacgata

SEQ ID NO: 6534717 - DNA, 22 bp, Homo sapiens
ttcctctaggcaagcaggacct

SEQ ID NO: 6534718 - DNA, 23 bp, Homo sapiens
ttcctctaggcaagcaggacctg

SEQ ID NO: 6534719 - DNA, 21 bp, Homo sapiens
ttcctctaggggctgtacagt

SEQ ID NO: 6534720 - DNA, 23 bp, Homo sapiens
ttcctctagtgccctccacagcc

SEQ ID NO: 6534721 - DNA, 17 bp, Homo sapiens
ttcctctatacatctct

SEQ ID NO: 6534722 - DNA, 22 bp, Homo sapiens
ttcctctatacatctctcccca

SEQ ID NO: 6534723 - DNA, 17 bp, Homo sapiens
ttcctctatactttgtt

SEQ ID NO: 6534724 - DNA, 23 bp, Homo sapiens
ttcctctatactttgttctgttg

SEQ ID NO: 6534725 - DNA, 23 bp, Homo sapiens
ttcctctattgatgtacagtctg

SEQ ID NO: 6534726 - DNA, 12 bp, Homo sapiens
ttcctctcaccc

SEQ ID NO: 6534727 - DNA, 18 bp, Homo sapiens
ttcctctcactaaacttt

SEQ ID NO: 6534728 - DNA, 13 bp, Homo sapiens
ttcctctcactcc

SEQ ID NO: 6534729 - DNA, 16 bp, Homo sapiens
ttcctctcactcctgc

SEQ ID NO: 6534730 - DNA, 17 bp, Homo sapiens
ttcctctcactcctgcc

SEQ ID NO: 6534731 - DNA, 19 bp, Homo sapiens
ttcctctcactcctgcctc

SEQ ID NO: 6534732 - DNA, 23 bp, Homo sapiens
ttcctctcatccttttctcctat

SEQ ID NO: 6534733 - DNA, 19 bp, Homo sapiens
ttcctctcatttccagctt

SEQ ID NO: 6534734 - DNA, 15 bp, Homo sapiens
ttcctctccaattgt

SEQ ID NO: 6534735 - DNA, 15 bp, Homo sapiens
ttcctctccacacag

SEQ ID NO: 6534736 - DNA, 19 bp, Homo sapiens
ttcctctccactgccttcg

SEQ ID NO: 6534737 - DNA, 18 bp, Homo sapiens
ttcctctccactgctgga

SEQ ID NO: 6534738 - DNA, 12 bp, Homo sapiens
ttcctctccagc

SEQ ID NO: 6534739 - DNA, 22 bp, Homo sapiens
ttcctctccagccttctctctc

SEQ ID NO: 6534740 - DNA, 15 bp, Homo sapiens
ttcctctccaggcca

SEQ ID NO: 6534741 - DNA, 14 bp, Homo sapiens
ttcctctccatacc

SEQ ID NO: 6534742 - DNA, 10 bp, Homo sapiens
ttcctctccc

SEQ ID NO: 6534743 - DNA, 12 bp, Homo sapiens
ttcctctcccag

SEQ ID NO: 6534744 - DNA, 17 bp, Homo sapiens
ttcctctccctctctct

SEQ ID NO: 6534745 - DNA, 17 bp, Homo sapiens
ttcctctcctgggtact

SEQ ID NO: 6534746 - DNA, 14 bp, Homo sapiens
ttcctctccttccc

SEQ ID NO: 6534747 - DNA, 22 bp, Homo sapiens
ttcctctccttcccacaaaaga

SEQ ID NO: 6534748 - DNA, 22 bp, Homo sapiens
ttcctctccttcgtatcccgag

SEQ ID NO: 6534749 - DNA, 19 bp, Homo sapiens
ttcctctcggctggaagaa

SEQ ID NO: 6534750 - DNA, 16 bp, Homo sapiens
ttcctctctatatttc

SEQ ID NO: 6534751 - DNA, 11 bp, Homo sapiens
ttcctctctct

SEQ ID NO: 6534752 - DNA, 15 bp, Homo sapiens
ttcctctctctccct

SEQ ID NO: 6534753 - DNA, 23 bp, Homo sapiens
ttcctctctctctctctctctgt

SEQ ID NO: 6534754 - DNA, 18 bp, Homo sapiens
ttcctctctggtggctct

SEQ ID NO: 6534755 - DNA, 12 bp, Homo sapiens
ttcctctctgtc

SEQ ID NO: 6534756 - DNA, 16 bp, Homo sapiens
tgtaaaatcttcagct

SEQ ID NO: 6534757 - DNA, 12 bp, Homo sapiens
tgtaaaatcttg

SEQ ID NO: 6534758 - DNA, 15 bp, Homo sapiens
tgtaaaatcttgata

SEQ ID NO: 6534759 - DNA, 22 bp, Homo sapiens
tgtaaaatcttgtcatgtgtat

SEQ ID NO: 6534760 - DNA, 13 bp, Homo sapiens
tgtaaaatctttc

SEQ ID NO: 6534761 - DNA, 23 bp, Homo sapiens
tgtaaaatctttctttcttagaa

SEQ ID NO: 6534762 - DNA, 15 bp, Homo sapiens
tgtaaaatgaaatta

SEQ ID NO: 6534763 - DNA, 22 bp, Homo sapiens
tgtaaaatgaattgaaaaacaa

SEQ ID NO: 6534764 - DNA, 16 bp, Homo sapiens
tgtaaaatgacaatca

SEQ ID NO: 6534765 - DNA, 23 bp, Homo sapiens
tgtaaaatgagtaggatgtctct

SEQ ID NO: 6534766 - DNA, 16 bp, Homo sapiens
tgtaaaatgatactgt

SEQ ID NO: 6534767 - DNA, 13 bp, Homo sapiens
tgtaaaatgcaaa

SEQ ID NO: 6534768 - DNA, 18 bp, Homo sapiens
tgtaaaatgcaaaaaatc

SEQ ID NO: 6534769 - DNA, 21 bp, Homo sapiens
tgtaaaatgcagtccagaata

SEQ ID NO: 6534770 - DNA, 22 bp, Homo sapiens
tgtaaaatgcttttcactttct

SEQ ID NO: 6534771 - DNA, 23 bp, Homo sapiens
tgtaaaatgcttttcactttctg

SEQ ID NO: 6534772 - DNA, 14 bp, Homo sapiens
tgtaaaatgtaatg

SEQ ID NO: 6534773 - DNA, 13 bp, Homo sapiens
tgtaaaattaatg

SEQ ID NO: 6534774 - DNA, 15 bp, Homo sapiens
tgtaaaattaatgta

SEQ ID NO: 6534775 - DNA, 20 bp, Homo sapiens
tgtaaaattaatgtaataaa

SEQ ID NO: 6534776 - DNA, 14 bp, Homo sapiens
tgtaaaattcatag

SEQ ID NO: 6534777 - DNA, 18 bp, Homo sapiens
tgtaaaattggattatta

SEQ ID NO: 6534778 - DNA, 14 bp, Homo sapiens
tgtaaaattgtata

SEQ ID NO: 6534779 - DNA, 22 bp, Homo sapiens
tgtaaaattgttaaccttgtaa

SEQ ID NO: 6534780 - DNA, 20 bp, Homo sapiens
tgtaaaattttgcctaatac

SEQ ID NO: 6534781 - DNA, 22 bp, Homo sapiens
tgtaaacaaaccacagcaggat

SEQ ID NO: 6534782 - DNA, 14 bp, Homo sapiens
tgtaaacaaactct

SEQ ID NO: 6534783 - DNA, 17 bp, Homo sapiens
tgtaaacaaatcctgtt

SEQ ID NO: 6534784 - DNA, 19 bp, Homo sapiens
tgtaaacaaatctttccat

SEQ ID NO: 6534785 - DNA, 15 bp, Homo sapiens
tgtaaacaacaaact

SEQ ID NO: 6534786 - DNA, 13 bp, Homo sapiens
tgtaaacacatct

SEQ ID NO: 6534787 - DNA, 15 bp, Homo sapiens
tgtaaacagaaggag

SEQ ID NO: 6534788 - DNA, 18 bp, Homo sapiens
tgtaaacagcctcttttt

SEQ ID NO: 6534789 - DNA, 20 bp, Homo sapiens
tgtaaacaggagacaggaag

SEQ ID NO: 6534790 - DNA, 17 bp, Homo sapiens
tgtaaacagtgcctgct

SEQ ID NO: 6534791 - DNA, 19 bp, Homo sapiens
tgtaaacagtgcctgctga

SEQ ID NO: 6534792 - DNA, 16 bp, Homo sapiens
tgtaaacatagatagt

SEQ ID NO: 6534793 - DNA, 20 bp, Homo sapiens
tgtaaacatcataaatagta

SEQ ID NO: 6534794 - DNA, 15 bp, Homo sapiens
tgtaaacatctgctt

SEQ ID NO: 6534795 - DNA, 20 bp, Homo sapiens
tgtaaacattcatatttgca

SEQ ID NO: 6534796 - DNA, 13 bp, Homo sapiens
tgtaaacatttat

SEQ ID NO: 6534797 - DNA, 19 bp, Homo sapiens
tgtaaaccaaacagacaag

SEQ ID NO: 6534798 - DNA, 13 bp, Homo sapiens
tgtaaaccaaagc

SEQ ID NO: 6534799 - DNA, 16 bp, Homo sapiens
tgtaaaccacttgtca

SEQ ID NO: 6534800 - DNA, 19 bp, Homo sapiens
tgtaaacctgagtcgtaca

SEQ ID NO: 6534801 - DNA, 19 bp, Homo sapiens
tgtaaacgacaagaataat

SEQ ID NO: 6534802 - DNA, 21 bp, Homo sapiens
tgtaaacggtgctatttctat

SEQ ID NO: 6534803 - DNA, 22 bp, Homo sapiens
tgtaaacgtctttttaagcctt

SEQ ID NO: 6534804 - DNA, 16 bp, Homo sapiens
tgtaaactcaaaactt

SEQ ID NO: 6534805 - DNA, 21 bp, Homo sapiens
tgtaaactcaaaacttaacat

SEQ ID NO: 6534806 - DNA, 15 bp, Homo sapiens
tgtaaactcaaaata

SEQ ID NO: 6534807 - DNA, 23 bp, Homo sapiens
tgtaaactcaaaatatttgtaca

SEQ ID NO: 6534808 - DNA, 22 bp, Homo sapiens
tgtaaactctcttctctttctc

SEQ ID NO: 6534809 - DNA, 17 bp, Homo sapiens
tgtaaactgatgtttgt

SEQ ID NO: 6534810 - DNA, 20 bp, Homo sapiens
tgtaaactggaattaaaagg

SEQ ID NO: 6534811 - DNA, 22 bp, Homo sapiens
tgtaaactgtactagtctgtgt

SEQ ID NO: 6534812 - DNA, 14 bp, Homo sapiens
tgtaaactgtgcac

SEQ ID NO: 6534813 - DNA, 13 bp, Homo sapiens
tgtaaactgtgta

SEQ ID NO: 6534814 - DNA, 19 bp, Homo sapiens
tgtaaactgtgtattccaa

SEQ ID NO: 6534815 - DNA, 22 bp, Homo sapiens
tgtaaacttccgttcattgctc

SEQ ID NO: 6534816 - DNA, 15 bp, Homo sapiens
tgtaaacttgtacat

SEQ ID NO: 6534817 - DNA, 16 bp, Homo sapiens
tgtaaacttgtacatg

SEQ ID NO: 6534818 - DNA, 18 bp, Homo sapiens
tgtaaactttatcactta

SEQ ID NO: 6534819 - DNA, 14 bp, Homo sapiens
tgtaaactttgaaa

SEQ ID NO: 6534820 - DNA, 12 bp, Homo sapiens
tgtaaactttgt

SEQ ID NO: 6534821 - DNA, 18 bp, Homo sapiens
tgtaaactttgtcatggt

SEQ ID NO: 6534822 - DNA, 19 bp, Homo sapiens
tgtaaactttttcaatggt

SEQ ID NO: 6534823 - DNA, 18 bp, Homo sapiens
tgtaaagaaaaatattta

SEQ ID NO: 6534824 - DNA, 15 bp, Homo sapiens
tgtaaagaaaactta

SEQ ID NO: 6534825 - DNA, 16 bp, Homo sapiens
tgtaaagaaagagaga

SEQ ID NO: 6534826 - DNA, 18 bp, Homo sapiens
tgtaaagaaagagagaaa

SEQ ID NO: 6534827 - DNA, 22 bp, Homo sapiens
tgtaaagaaagagagaaaataa

SEQ ID NO: 6534828 - DNA, 23 bp, Homo sapiens
tgtaaagaaagagagaaaataaa

SEQ ID NO: 6534829 - DNA, 12 bp, Homo sapiens
tgtaaagaattg

SEQ ID NO: 6534830 - DNA, 22 bp, Homo sapiens
tgtaaagactgagcagaactga

SEQ ID NO: 6534831 - DNA, 23 bp, Homo sapiens
tgtaaagactgagcagaactgaa

SEQ ID NO: 6534832 - DNA, 18 bp, Homo sapiens
tgtaaagatatttttatc

SEQ ID NO: 6534833 - DNA, 11 bp, Homo sapiens
tgtaaagatgt

SEQ ID NO: 6534834 - DNA, 19 bp, Homo sapiens
tgtaaagatttctgttcag

SEQ ID NO: 6534835 - DNA, 14 bp, Homo sapiens
tgtaaagcaaaata

SEQ ID NO: 6534836 - DNA, 23 bp, Homo sapiens
tgtaaagcaaaatatttgtgaaa

SEQ ID NO: 6534837 - DNA, 17 bp, Homo sapiens
tgtaaagcattccaaca

SEQ ID NO: 6534838 - DNA, 18 bp, Homo sapiens
tgtaaagcattccaacaa

SEQ ID NO: 6534839 - DNA, 13 bp, Homo sapiens
tgtaaagccatgc

SEQ ID NO: 6534840 - DNA, 17 bp, Homo sapiens
tgtaaagctaaaataaa

SEQ ID NO: 6534841 - DNA, 20 bp, Homo sapiens
tgtaaagctaaaataaagaa

SEQ ID NO: 6534842 - DNA, 12 bp, Homo sapiens
tgtaaagctggc

SEQ ID NO: 6534843 - DNA, 14 bp, Homo sapiens
tgtaaagctgttaa

SEQ ID NO: 6534844 - DNA, 22 bp, Homo sapiens
tgtaaagctgttaaaatacata

SEQ ID NO: 6534845 - DNA, 22 bp, Homo sapiens
tgtaaaggacctcctaaataaa

SEQ ID NO: 6534846 - DNA, 16 bp, Homo sapiens
tgtaaaggagggagat

SEQ ID NO: 6534847 - DNA, 16 bp, Homo sapiens
tgtaaaggagtcaaaa

SEQ ID NO: 6534848 - DNA, 17 bp, Homo sapiens
tgtaaaggggcagctga

SEQ ID NO: 6534849 - DNA, 15 bp, Homo sapiens
tgtaaaggtaggtgc

SEQ ID NO: 6534850 - DNA, 20 bp, Homo sapiens
tgtaaaggtaggtgcatgcc

SEQ ID NO: 6534851 - DNA, 17 bp, Homo sapiens
tgtaaaggtttcatgtt

SEQ ID NO: 6534852 - DNA, 14 bp, Homo sapiens
tgtaaagtaaaata

SEQ ID NO: 6534853 - DNA, 16 bp, Homo sapiens
tgtaaagtaaaatatg

SEQ ID NO: 6534854 - DNA, 22 bp, Homo sapiens
tgtaaagtagctgtaagaattt

SEQ ID NO: 6534855 - DNA, 15 bp, Homo sapiens
tgtaaagtccccaga

SEQ ID NO: 6534856 - DNA, 17 bp, Homo sapiens
tgtaaagtctagaaaat

SEQ ID NO: 6534857 - DNA, 13 bp, Homo sapiens
tgtaaagtgaaga

SEQ ID NO: 6534858 - DNA, 15 bp, Homo sapiens
tgtaaagtgaagaat

SEQ ID NO: 6534859 - DNA, 19 bp, Homo sapiens
tgtaaagtgaagaatcctt

SEQ ID NO: 6534860 - DNA, 19 bp, Homo sapiens
tgtaaagtgatttttggtc

SEQ ID NO: 6534861 - DNA, 16 bp, Homo sapiens
tgtaaagtgtaaatcc

SEQ ID NO: 6534862 - DNA, 20 bp, Homo sapiens
tgtaaagtgtgtgattgaag

SEQ ID NO: 6534863 - DNA, 16 bp, Homo sapiens
tgtaaagttacactgt

SEQ ID NO: 6534864 - DNA, 14 bp, Homo sapiens
tgtaaagttagtct

SEQ ID NO: 6534865 - DNA, 20 bp, Homo sapiens
tgtaaagttatgtatttaaa

SEQ ID NO: 6534866 - DNA, 20 bp, Homo sapiens
tgtaaagttgaggggagagg

SEQ ID NO: 6534867 - DNA, 15 bp, Homo sapiens
tgtaaataaaatgtg

SEQ ID NO: 6534868 - DNA, 20 bp, Homo sapiens
tgtaaataaaatgtgtacag

SEQ ID NO: 6534869 - DNA, 15 bp, Homo sapiens
tgtaaataaactatt

SEQ ID NO: 6534870 - DNA, 22 bp, Homo sapiens
tgtaaataaactatttatatca

SEQ ID NO: 6534871 - DNA, 19 bp, Homo sapiens
tgtaaataaagaactagca

SEQ ID NO: 6534872 - DNA, 13 bp, Homo sapiens
tgtaaataaagcc

SEQ ID NO: 6534873 - DNA, 14 bp, Homo sapiens
tgtaaataaagccc

SEQ ID NO: 6534874 - DNA, 17 bp, Homo sapiens
tgtaaataaaggaacca

SEQ ID NO: 6534875 - DNA, 13 bp, Homo sapiens
tgtaaataaagtc

SEQ ID NO: 6534876 - DNA, 23 bp, Homo sapiens
tgtaaataaatgtacaggttgga

SEQ ID NO: 6534877 - DNA, 21 bp, Homo sapiens
tgtaaataaccacaaggtcca

SEQ ID NO: 6534878 - DNA, 21 bp, Homo sapiens
tgtaaataaccacactgaaac

SEQ ID NO: 6534879 - DNA, 21 bp, Homo sapiens
tgtaaataaccccattctttg

SEQ ID NO: 6534880 - DNA, 23 bp, Homo sapiens
tgtaaataaccccattctttgct

SEQ ID NO: 6534881 - DNA, 13 bp, Homo sapiens
tgtaaataactct

SEQ ID NO: 6534882 - DNA, 22 bp, Homo sapiens
tgtaaataatacattatatttc

SEQ ID NO: 6534883 - DNA, 15 bp, Homo sapiens
tgtaaataatataaa

SEQ ID NO: 6534884 - DNA, 22 bp, Homo sapiens
tgtaaataatataaaatgtttc

SEQ ID NO: 6534885 - DNA, 22 bp, Homo sapiens
tgtaaataattcttttttatta

SEQ ID NO: 6534886 - DNA, 17 bp, Homo sapiens
tgtaaataatttgcact

SEQ ID NO: 6534887 - DNA, 18 bp, Homo sapiens
tgtaaataatttgcactg

SEQ ID NO: 6534888 - DNA, 22 bp, Homo sapiens
tgtaaataattttaaataacct

SEQ ID NO: 6534889 - DNA, 23 bp, Homo sapiens
tgtaaataattttctaagacagt

SEQ ID NO: 6534890 - DNA, 23 bp, Homo sapiens
tgtaaatacaaaataaaattatg

SEQ ID NO: 6534891 - DNA, 16 bp, Homo sapiens
tgtaaatacaattcaa

SEQ ID NO: 6534892 - DNA, 19 bp, Homo sapiens
tgtaaatacaatttgtact

SEQ ID NO: 6534893 - DNA, 12 bp, Homo sapiens
tgtaaatacata

SEQ ID NO: 6534894 - DNA, 21 bp, Homo sapiens
tgtaaatacatgtccccctgt

SEQ ID NO: 6534895 - DNA, 18 bp, Homo sapiens
tgtaaatacatgtgtgga

SEQ ID NO: 6534896 - DNA, 20 bp, Homo sapiens
tgtaaataccagactgcagg

SEQ ID NO: 6534897 - DNA, 20 bp, Homo sapiens
tgtaaataccattgacacat

SEQ ID NO: 6534898 - DNA, 21 bp, Homo sapiens
tgtaaatactcatgaatgaaa

SEQ ID NO: 6534899 - DNA, 17 bp, Homo sapiens
tgtaaatactggactca

SEQ ID NO: 6534900 - DNA, 20 bp, Homo sapiens
tgtaaatactggactcagga

SEQ ID NO: 6534901 - DNA, 22 bp, Homo sapiens
tgtaaatactggtgcacttctt

SEQ ID NO: 6534902 - DNA, 17 bp, Homo sapiens
tgtaaataggattttta

SEQ ID NO: 6534903 - DNA, 20 bp, Homo sapiens
tgtaaatagttttaaatatg

SEQ ID NO: 6534904 - DNA, 13 bp, Homo sapiens
tgtaaatataaag

SEQ ID NO: 6534905 - DNA, 22 bp, Homo sapiens
tgtaaatatacagcatgagatt

SEQ ID NO: 6534906 - DNA, 14 bp, Homo sapiens
tgtaaatatataaa

SEQ ID NO: 6534907 - DNA, 16 bp, Homo sapiens
tgtaaatatataaata

SEQ ID NO: 6534908 - DNA, 19 bp, Homo sapiens
tgtaaatatataaatatat

SEQ ID NO: 6534909 - DNA, 16 bp, Homo sapiens
tgtaaatatccctccc

SEQ ID NO: 6534910 - DNA, 19 bp, Homo sapiens
tgtaaatatccctcccctc

SEQ ID NO: 6534911 - DNA, 20 bp, Homo sapiens
tgtaaatatgtgacattcct

SEQ ID NO: 6534912 - DNA, 17 bp, Homo sapiens
tgtaaatatgtttgtgc

SEQ ID NO: 6534913 - DNA, 13 bp, Homo sapiens
tgtaaatattaaa

SEQ ID NO: 6534914 - DNA, 15 bp, Homo sapiens
tgtaaatattctata

SEQ ID NO: 6534915 - DNA, 14 bp, Homo sapiens
tgtaaatattcttg

SEQ ID NO: 6534916 - DNA, 17 bp, Homo sapiens
tgtaaatattcttgtcc

SEQ ID NO: 6534917 - DNA, 20 bp, Homo sapiens
tgtaaatattcttgtccaca

SEQ ID NO: 6534918 - DNA, 12 bp, Homo sapiens
tgtaaatattta

SEQ ID NO: 6534919 - DNA, 13 bp, Homo sapiens
tgtaaatatttat

SEQ ID NO: 6534920 - DNA, 18 bp, Homo sapiens
tgtaaatatttatttatg

SEQ ID NO: 6534921 - DNA, 15 bp, Homo sapiens
tgtaaatatttcata

SEQ ID NO: 6534922 - DNA, 21 bp, Homo sapiens
tgtaaatatttcataaattaa

SEQ ID NO: 6534923 - DNA, 19 bp, Homo sapiens
tgtaaatatttttccctcc

SEQ ID NO: 6534924 - DNA, 16 bp, Homo sapiens
tgtaaatcaaatttga

SEQ ID NO: 6534925 - DNA, 16 bp, Homo sapiens
tgtaaatcacatcctt

SEQ ID NO: 6534926 - DNA, 12 bp, Homo sapiens
tgtaaatcactt

SEQ ID NO: 6534927 - DNA, 15 bp, Homo sapiens
tgtaaatcacttgta

SEQ ID NO: 6534928 - DNA, 16 bp, Homo sapiens
tgtaaatcacttgtaa

SEQ ID NO: 6534929 - DNA, 19 bp, Homo sapiens
tgtaaatcacttgtaaata

SEQ ID NO: 6534930 - DNA, 21 bp, Homo sapiens
tgtaaatcacttgtaaataaa

SEQ ID NO: 6534931 - DNA, 16 bp, Homo sapiens
tgtaaatccaacacaa

SEQ ID NO: 6534932 - DNA, 19 bp, Homo sapiens
tgtaaatccagtgttacaa

SEQ ID NO: 6534933 - DNA, 10 bp, Homo sapiens
tgtaaatccc

SEQ ID NO: 6534934 - DNA, 14 bp, Homo sapiens
ttcctctctgtctg

SEQ ID NO: 6534935 - DNA, 21 bp, Homo sapiens
ttcctctctttgttctcagct

SEQ ID NO: 6534936 - DNA, 22 bp, Homo sapiens
ttcctctgaagactgctatcag

SEQ ID NO: 6534937 - DNA, 21 bp, Homo sapiens
ttcctctgaatattaagaaac

SEQ ID NO: 6534938 - DNA, 11 bp, Homo sapiens
ttcctctgagc

SEQ ID NO: 6534939 - DNA, 14 bp, Homo sapiens
ttcctctgagccca

SEQ ID NO: 6534940 - DNA, 23 bp, Homo sapiens
ttcctctgagcccagctgcctgg

SEQ ID NO: 6534941 - DNA, 17 bp, Homo sapiens
ttcctctgagctgttat

SEQ ID NO: 6534942 - DNA, 18 bp, Homo sapiens
ttcctctgaggaagaagg

SEQ ID NO: 6534943 - DNA, 23 bp, Homo sapiens
ttcctctgataatatattttcaa

SEQ ID NO: 6534944 - DNA, 16 bp, Homo sapiens
ttcctctgatttcaag

SEQ ID NO: 6534945 - DNA, 13 bp, Homo sapiens
ttcctctgcaagt

SEQ ID NO: 6534946 - DNA, 13 bp, Homo sapiens
ttcctctgcacgc

SEQ ID NO: 6534947 - DNA, 13 bp, Homo sapiens
ttcctctgcagct

SEQ ID NO: 6534948 - DNA, 22 bp, Homo sapiens
ttcctctgcaggacacagatct

SEQ ID NO: 6534949 - DNA, 17 bp, Homo sapiens
ttcctctgcagttttga

SEQ ID NO: 6534950 - DNA, 13 bp, Homo sapiens
ttcctctgcattt

SEQ ID NO: 6534951 - DNA, 11 bp, Homo sapiens
ttcctctgcca

SEQ ID NO: 6534952 - DNA, 11 bp, Homo sapiens
ttcctctgccc

SEQ ID NO: 6534953 - DNA, 15 bp, Homo sapiens
ttcctctgcctgccc

SEQ ID NO: 6534954 - DNA, 13 bp, Homo sapiens
ttcctctgctccc

SEQ ID NO: 6534955 - DNA, 14 bp, Homo sapiens
ttcctctgctcccc

SEQ ID NO: 6534956 - DNA, 21 bp, Homo sapiens
ttcctctgctcccccttttcc

SEQ ID NO: 6534957 - DNA, 11 bp, Homo sapiens
ttcctctgctg

SEQ ID NO: 6534958 - DNA, 14 bp, Homo sapiens
ttcctctgctgcat

SEQ ID NO: 6534959 - DNA, 23 bp, Homo sapiens
ttcctctgctgcatccccttcca

SEQ ID NO: 6534960 - DNA, 14 bp, Homo sapiens
ttcctctggccgca

SEQ ID NO: 6534961 - DNA, 20 bp, Homo sapiens
ttcctctggctccccaaggc

SEQ ID NO: 6534962 - DNA, 13 bp, Homo sapiens
ttcctctggttcc

SEQ ID NO: 6534963 - DNA, 17 bp, Homo sapiens
ttcctctggttcctttc

SEQ ID NO: 6534964 - DNA, 14 bp, Homo sapiens
ttcctctggtttct

SEQ ID NO: 6534965 - DNA, 18 bp, Homo sapiens
ttcctctggtttctgtgt

SEQ ID NO: 6534966 - DNA, 14 bp, Homo sapiens
ttcctctgtacagc

SEQ ID NO: 6534967 - DNA, 17 bp, Homo sapiens
ttcctctgtcctctcat

SEQ ID NO: 6534968 - DNA, 18 bp, Homo sapiens
ttcctctgtgccacgctc

SEQ ID NO: 6534969 - DNA, 14 bp, Homo sapiens
ttcctctgttcaca

SEQ ID NO: 6534970 - DNA, 13 bp, Homo sapiens
ttcctctgttcta

SEQ ID NO: 6534971 - DNA, 21 bp, Homo sapiens
ttcctctgtttctccttctga

SEQ ID NO: 6534972 - DNA, 20 bp, Homo sapiens
ttcctcttaatgtctcaaaa

SEQ ID NO: 6534973 - DNA, 18 bp, Homo sapiens
ttcctcttataacttctg

SEQ ID NO: 6534974 - DNA, 19 bp, Homo sapiens
ttcctcttccccttgccct

SEQ ID NO: 6534975 - DNA, 17 bp, Homo sapiens
ttcctcttcctgccctt

SEQ ID NO: 6534976 - DNA, 15 bp, Homo sapiens
ttcctcttccttctc

SEQ ID NO: 6534977 - DNA, 20 bp, Homo sapiens
ttcctcttccttctctactc

SEQ ID NO: 6534978 - DNA, 15 bp, Homo sapiens
ttcctcttgaaccag

SEQ ID NO: 6534979 - DNA, 15 bp, Homo sapiens
ttcctcttgaccctg

SEQ ID NO: 6534980 - DNA, 18 bp, Homo sapiens
ttcctcttgaccctgcac

SEQ ID NO: 6534981 - DNA, 19 bp, Homo sapiens
ttcctcttgaccctgcacc

SEQ ID NO: 6534982 - DNA, 23 bp, Homo sapiens
ttcctcttgaccctgcaccctcc

SEQ ID NO: 6534983 - DNA, 17 bp, Homo sapiens
ttcctcttgatctcaaa

SEQ ID NO: 6534984 - DNA, 17 bp, Homo sapiens
ttcctcttgcctctctc

SEQ ID NO: 6534985 - DNA, 18 bp, Homo sapiens
ttcctcttgcctctctca

SEQ ID NO: 6534986 - DNA, 18 bp, Homo sapiens
ttcctcttggcaagatgt

SEQ ID NO: 6534987 - DNA, 16 bp, Homo sapiens
ttcctcttgtcctggc

SEQ ID NO: 6534988 - DNA, 18 bp, Homo sapiens
ttcctcttgtcctggccc

SEQ ID NO: 6534989 - DNA, 19 bp, Homo sapiens
ttcctctttaactgaggag

SEQ ID NO: 6534990 - DNA, 11 bp, Homo sapiens
ttcctctttcc

SEQ ID NO: 6534991 - DNA, 17 bp, Homo sapiens
ttcctctttccatctac

SEQ ID NO: 6534992 - DNA, 13 bp, Homo sapiens
ttcctctttctgc

SEQ ID NO: 6534993 - DNA, 20 bp, Homo sapiens
ttcctctttctgctctgcca

SEQ ID NO: 6534994 - DNA, 22 bp, Homo sapiens
ttcctctttctgctctgccatc

SEQ ID NO: 6534995 - DNA, 15 bp, Homo sapiens
ttcctctttgcatgg

SEQ ID NO: 6534996 - DNA, 17 bp, Homo sapiens
ttcctctttgcatggaa

SEQ ID NO: 6534997 - DNA, 14 bp, Homo sapiens
ttcctctttgcttt

SEQ ID NO: 6534998 - DNA, 21 bp, Homo sapiens
ttcctcttttgtgctgcttct

SEQ ID NO: 6534999 - DNA, 22 bp, Homo sapiens
ttcctctttttatttagttcct

SEQ ID NO: 6535000 - DNA, 18 bp, Homo sapiens
ttcctgaaacaacttgga

SEQ ID NO: 6535001 - DNA, 17 bp, Homo sapiens
ttcctgaaagaaacagt

SEQ ID NO: 6535002 - DNA, 12 bp, Homo sapiens
ttcctgaaagct

SEQ ID NO: 6535003 - DNA, 11 bp, Homo sapiens
ttcctgaaata

SEQ ID NO: 6535004 - DNA, 14 bp, Homo sapiens
ttcctgaaataaac

SEQ ID NO: 6535005 - DNA, 15 bp, Homo sapiens
ttcctgaaataaaca

SEQ ID NO: 6535006 - DNA, 17 bp, Homo sapiens
ttcctgaaataaacact

SEQ ID NO: 6535007 - DNA, 17 bp, Homo sapiens
ttcctgaaataaatgtt

SEQ ID NO: 6535008 - DNA, 16 bp, Homo sapiens
ttcctgaacctggaaa

SEQ ID NO: 6535009 - DNA, 18 bp, Homo sapiens
ttcctgaagaattgaaaa

SEQ ID NO: 6535010 - DNA, 14 bp, Homo sapiens
ttcctgaagcattt

SEQ ID NO: 6535011 - DNA, 13 bp, Homo sapiens
ttcctgaagccag

SEQ ID NO: 6535012 - DNA, 14 bp, Homo sapiens
ttcctgaagccaga

SEQ ID NO: 6535013 - DNA, 23 bp, Homo sapiens
ttcctgaagccagatccacccta

SEQ ID NO: 6535014 - DNA, 14 bp, Homo sapiens
ttcctgaagctgag

SEQ ID NO: 6535015 - DNA, 13 bp, Homo sapiens
ttcctgaagctgc

SEQ ID NO: 6535016 - DNA, 16 bp, Homo sapiens
ttcctgaagctgctgt

SEQ ID NO: 6535017 - DNA, 21 bp, Homo sapiens
ttcctgaagctgcttaacagt

SEQ ID NO: 6535018 - DNA, 18 bp, Homo sapiens
ttcctgaatccaaactaa

SEQ ID NO: 6535019 - DNA, 13 bp, Homo sapiens
ttcctgacaaaag

SEQ ID NO: 6535020 - DNA, 19 bp, Homo sapiens
ttcctgacatcacagcagc

SEQ ID NO: 6535021 - DNA, 22 bp, Homo sapiens
ttcctgacccaggccgcagctc

SEQ ID NO: 6535022 - DNA, 23 bp, Homo sapiens
ttcctgacccggattggccctgc

SEQ ID NO: 6535023 - DNA, 14 bp, Homo sapiens
ttcctgaccctccc

SEQ ID NO: 6535024 - DNA, 16 bp, Homo sapiens
ttcctgaccctcccta

SEQ ID NO: 6535025 - DNA, 21 bp, Homo sapiens
ttcctgaccctccctacctga

SEQ ID NO: 6535026 - DNA, 19 bp, Homo sapiens
ttcctgacgagataagcag

SEQ ID NO: 6535027 - DNA, 17 bp, Homo sapiens
ttcctgactgacacagg

SEQ ID NO: 6535028 - DNA, 22 bp, Homo sapiens
ttcctgactgacacaggccagc

SEQ ID NO: 6535029 - DNA, 12 bp, Homo sapiens
ttcctgactgtt

SEQ ID NO: 6535030 - DNA, 15 bp, Homo sapiens
ttcctgactgttctc

SEQ ID NO: 6535031 - DNA, 18 bp, Homo sapiens
ttcctgacttgagtgttc

SEQ ID NO: 6535032 - DNA, 22 bp, Homo sapiens
ttcctgagaaacgtccatctct

SEQ ID NO: 6535033 - DNA, 22 bp, Homo sapiens
ttcctgagaaagcccacctggg

SEQ ID NO: 6535034 - DNA, 16 bp, Homo sapiens
ttcctgagattctggg

SEQ ID NO: 6535035 - DNA, 18 bp, Homo sapiens
ttcctgagattctgggaa

SEQ ID NO: 6535036 - DNA, 16 bp, Homo sapiens
ttcctgagcagtccct

SEQ ID NO: 6535037 - DNA, 17 bp, Homo sapiens
ttcctgagctgtcgctg

SEQ ID NO: 6535038 - DNA, 18 bp, Homo sapiens
ttcctgagctgtcgctgc

SEQ ID NO: 6535039 - DNA, 11 bp, Homo sapiens
ttcctgagctt

SEQ ID NO: 6535040 - DNA, 13 bp, Homo sapiens
ttcctgagcttgg

SEQ ID NO: 6535041 - DNA, 21 bp, Homo sapiens
ttcctgaggaagagggactgt

SEQ ID NO: 6535042 - DNA, 19 bp, Homo sapiens
ttcctgaggatctagcttc

SEQ ID NO: 6535043 - DNA, 15 bp, Homo sapiens
ttcctgaggctgggc

SEQ ID NO: 6535044 - DNA, 23 bp, Homo sapiens
ttcctgaggtcatctgtaaaata

SEQ ID NO: 6535045 - DNA, 20 bp, Homo sapiens
ttcctgagttaggctttctc

SEQ ID NO: 6535046 - DNA, 17 bp, Homo sapiens
ttcctgataattgtgca

SEQ ID NO: 6535047 - DNA, 18 bp, Homo sapiens
ttcctgataattgtgcac

SEQ ID NO: 6535048 - DNA, 19 bp, Homo sapiens
ttcctgatactgggtacaa

SEQ ID NO: 6535049 - DNA, 17 bp, Homo sapiens
ttcctgatgatgctggc

SEQ ID NO: 6535050 - DNA, 19 bp, Homo sapiens
ttcctgatgcttcttcaga

SEQ ID NO: 6535051 - DNA, 22 bp, Homo sapiens
ttcctgatggtacaggaaagct

SEQ ID NO: 6535052 - DNA, 17 bp, Homo sapiens
ttcctgatgtgccagaa

SEQ ID NO: 6535053 - DNA, 20 bp, Homo sapiens
ttcctgatgttgataatagt

SEQ ID NO: 6535054 - DNA, 22 bp, Homo sapiens
ttcctgattaccagtctgatta

SEQ ID NO: 6535055 - DNA, 16 bp, Homo sapiens
ttcctgattggtttct

SEQ ID NO: 6535056 - DNA, 19 bp, Homo sapiens
ttcctgattggtttctctt

SEQ ID NO: 6535057 - DNA, 20 bp, Homo sapiens
ttcctgattggtttctcttc

SEQ ID NO: 6535058 - DNA, 17 bp, Homo sapiens
ttcctgcaattttctaa

SEQ ID NO: 6535059 - DNA, 11 bp, Homo sapiens
ttcctgcaccc

SEQ ID NO: 6535060 - DNA, 16 bp, Homo sapiens
ttcctgcacctgctgt

SEQ ID NO: 6535061 - DNA, 17 bp, Homo sapiens
ttcctgcactccagaat

SEQ ID NO: 6535062 - DNA, 20 bp, Homo sapiens
ttcctgcagaggcccagcca

SEQ ID NO: 6535063 - DNA, 21 bp, Homo sapiens
ttcctgcagcagagcctggaa

SEQ ID NO: 6535064 - DNA, 20 bp, Homo sapiens
ttcctgcagccccagaagaa

SEQ ID NO: 6535065 - DNA, 14 bp, Homo sapiens
ttcctgcagcctgg

SEQ ID NO: 6535066 - DNA, 21 bp, Homo sapiens
ttcctgcatttgatagcaatg

SEQ ID NO: 6535067 - DNA, 18 bp, Homo sapiens
ttcctgcatttgtgaaat

SEQ ID NO: 6535068 - DNA, 12 bp, Homo sapiens
ttcctgccaagt

SEQ ID NO: 6535069 - DNA, 18 bp, Homo sapiens
ttcctgccaggctctccc

SEQ ID NO: 6535070 - DNA, 16 bp, Homo sapiens
ttcctgcccagcctgg

SEQ ID NO: 6535071 - DNA, 19 bp, Homo sapiens
ttcctgcccagcctggggc

SEQ ID NO: 6535072 - DNA, 23 bp, Homo sapiens
ttcctgccccaactccttccagc

SEQ ID NO: 6535073 - DNA, 13 bp, Homo sapiens
ttcctgccccacc

SEQ ID NO: 6535074 - DNA, 13 bp, Homo sapiens
ttcctgccccagg

SEQ ID NO: 6535075 - DNA, 17 bp, Homo sapiens
ttcctgcccctctttct

SEQ ID NO: 6535076 - DNA, 18 bp, Homo sapiens
ttcctgcccctctttctc

SEQ ID NO: 6535077 - DNA, 11 bp, Homo sapiens
ttcctgcccta

SEQ ID NO: 6535078 - DNA, 19 bp, Homo sapiens
ttcctgccctgctgtttat

SEQ ID NO: 6535079 - DNA, 23 bp, Homo sapiens
ttcctgccctgtacctctctctg

SEQ ID NO: 6535080 - DNA, 24 bp, Homo sapiens
ttcctgccctgtacctctctctgc

SEQ ID NO: 6535081 - DNA, 18 bp, Homo sapiens
ttcctgcccttccctctg

SEQ ID NO: 6535082 - DNA, 23 bp, Homo sapiens
ttcctgcccttccctctgggcac

SEQ ID NO: 6535083 - DNA, 21 bp, Homo sapiens
ttcctgcccttgaaccccctc

SEQ ID NO: 6535084 - DNA, 20 bp, Homo sapiens
ttcctgcctcccaagcagct

SEQ ID NO: 6535085 - DNA, 15 bp, Homo sapiens
ttcctgcctgtctcc

SEQ ID NO: 6535086 - DNA, 16 bp, Homo sapiens
ttcctgcctgtctcct

SEQ ID NO: 6535087 - DNA, 15 bp, Homo sapiens
ttcctgccttctctt

SEQ ID NO: 6535088 - DNA, 16 bp, Homo sapiens
ttcctgccttctcttc

SEQ ID NO: 6535089 - DNA, 11 bp, Homo sapiens
ttcctgccttt

SEQ ID NO: 6535090 - DNA, 15 bp, Homo sapiens
ttcctgcgtcctcct

SEQ ID NO: 6535091 - DNA, 17 bp, Homo sapiens
ttcctgcgtcctcctca

SEQ ID NO: 6535092 - DNA, 23 bp, Homo sapiens
ttcctgctaataatttgccatta

SEQ ID NO: 6535093 - DNA, 13 bp, Homo sapiens
ttcctgctagtgt

SEQ ID NO: 6535094 - DNA, 23 bp, Homo sapiens
ttcctgctatattaacatcatct

SEQ ID NO: 6535095 - DNA, 21 bp, Homo sapiens
ttcctgctccatgactggctg

SEQ ID NO: 6535096 - DNA, 11 bp, Homo sapiens
ttcctgctccg

SEQ ID NO: 6535097 - DNA, 16 bp, Homo sapiens
ttcctgctcctccagt

SEQ ID NO: 6535098 - DNA, 18 bp, Homo sapiens
ttcctgctctctgctcat

SEQ ID NO: 6535099 - DNA, 9 bp, Homo sapiens
ttcctgctg

SEQ ID NO: 6535100 - DNA, 11 bp, Homo sapiens
ttcctgctgca

SEQ ID NO: 6535101 - DNA, 22 bp, Homo sapiens
ttcctgctgcaccctgcgcctc

SEQ ID NO: 6535102 - DNA, 16 bp, Homo sapiens
ttcctgctgctgctac

SEQ ID NO: 6535103 - DNA, 18 bp, Homo sapiens
ttcctgctgctgctactg

SEQ ID NO: 6535104 - DNA, 17 bp, Homo sapiens
ttcctgctgctgtctgg

SEQ ID NO: 6535105 - DNA, 21 bp, Homo sapiens
ttcctgctgctgtctgggtgc

SEQ ID NO: 6535106 - DNA, 18 bp, Homo sapiens
ttcctgctgtatttcctg

SEQ ID NO: 6535107 - DNA, 19 bp, Homo sapiens
ttcctgctgtatttcctgc

SEQ ID NO: 6535108 - DNA, 20 bp, Homo sapiens
ttcctgctgtatttcctgct

SEQ ID NO: 6535109 - DNA, 15 bp, Homo sapiens
ttcctgctgtcttct

SEQ ID NO: 6535110 - DNA, 14 bp, Homo sapiens
ttcctgcttccctg

SEQ ID NO: 6535111 - DNA, 16 bp, Homo sapiens
ttcctgcttcctcaga

SEQ ID NO: 6535112 - DNA, 11 bp, Homo sapiens
ttcctgctttc

SEQ ID NO: 6535113 - DNA, 14 bp, Homo sapiens
ttcctgctttccat

SEQ ID NO: 6535114 - DNA, 13 bp, Homo sapiens
tgtaaatcccatt

SEQ ID NO: 6535115 - DNA, 19 bp, Homo sapiens
tgtaaatcctagacttgaa

SEQ ID NO: 6535116 - DNA, 16 bp, Homo sapiens
tgtaaatcctgccatt

SEQ ID NO: 6535117 - DNA, 14 bp, Homo sapiens
tgtaaatcctgtgt

SEQ ID NO: 6535118 - DNA, 17 bp, Homo sapiens
tgtaaatcctgtgtttc

SEQ ID NO: 6535119 - DNA, 19 bp, Homo sapiens
tgtaaatctaacattatta

SEQ ID NO: 6535120 - DNA, 15 bp, Homo sapiens
tgtaaatctacacac

SEQ ID NO: 6535121 - DNA, 16 bp, Homo sapiens
tgtaaatctgaagaaa

SEQ ID NO: 6535122 - DNA, 15 bp, Homo sapiens
tgtaaatctgccaca

SEQ ID NO: 6535123 - DNA, 16 bp, Homo sapiens
tgtaaatctgctcagg

SEQ ID NO: 6535124 - DNA, 13 bp, Homo sapiens
tgtaaatctgtac

SEQ ID NO: 6535125 - DNA, 15 bp, Homo sapiens
tgtaaatctgtactt

SEQ ID NO: 6535126 - DNA, 18 bp, Homo sapiens
tgtaaatctttgtgaaca

SEQ ID NO: 6535127 - DNA, 21 bp, Homo sapiens
tgtaaatctttgtgaacattc

SEQ ID NO: 6535128 - DNA, 19 bp, Homo sapiens
tgtaaatgaaacttaagaa

SEQ ID NO: 6535129 - DNA, 15 bp, Homo sapiens
tgtaaatgaacataa

SEQ ID NO: 6535130 - DNA, 17 bp, Homo sapiens
tgtaaatgaagatcttt

SEQ ID NO: 6535131 - DNA, 19 bp, Homo sapiens
tgtaaatgaagatctttat

SEQ ID NO: 6535132 - DNA, 22 bp, Homo sapiens
tgtaaatgaagatctttatatt

SEQ ID NO: 6535133 - DNA, 23 bp, Homo sapiens
tgtaaatgaccaagaaaaagaaa

SEQ ID NO: 6535134 - DNA, 14 bp, Homo sapiens
tgtaaatgactttc

SEQ ID NO: 6535135 - DNA, 21 bp, Homo sapiens
tgtaaatgactttcataataa

SEQ ID NO: 6535136 - DNA, 14 bp, Homo sapiens
tgtaaatgagaaga

SEQ ID NO: 6535137 - DNA, 20 bp, Homo sapiens
tgtaaatgatatgtctttaa

SEQ ID NO: 6535138 - DNA, 22 bp, Homo sapiens
tgtaaatgatatgtctttaaaa

SEQ ID NO: 6535139 - DNA, 18 bp, Homo sapiens
tgtaaatgcatctgtcct

SEQ ID NO: 6535140 - DNA, 18 bp, Homo sapiens
tgtaaatgcctcttaaat

SEQ ID NO: 6535141 - DNA, 20 bp, Homo sapiens
tgtaaatgctcctagagtat

SEQ ID NO: 6535142 - DNA, 13 bp, Homo sapiens
tgtaaatgctcgt

SEQ ID NO: 6535143 - DNA, 11 bp, Homo sapiens
tgtaaatgctg

SEQ ID NO: 6535144 - DNA, 13 bp, Homo sapiens
tgtaaatgctgta

SEQ ID NO: 6535145 - DNA, 22 bp, Homo sapiens
tgtaaatgctgtcaactatgat

SEQ ID NO: 6535146 - DNA, 20 bp, Homo sapiens
tgtaaatgcttaaatttcag

SEQ ID NO: 6535147 - DNA, 18 bp, Homo sapiens
tgtaaatggtgtacataa

SEQ ID NO: 6535148 - DNA, 12 bp, Homo sapiens
tgtaaatgtaag

SEQ ID NO: 6535149 - DNA, 16 bp, Homo sapiens
tgtaaatgtactggta

SEQ ID NO: 6535150 - DNA, 20 bp, Homo sapiens
tgtaaatgtactggtaattg

SEQ ID NO: 6535151 - DNA, 11 bp, Homo sapiens
tgtaaatgtat

SEQ ID NO: 6535152 - DNA, 15 bp, Homo sapiens
tgtaaatgtattcat

SEQ ID NO: 6535153 - DNA, 20 bp, Homo sapiens
tgtaaatgtattggcacagt

SEQ ID NO: 6535154 - DNA, 22 bp, Homo sapiens
tgtaaatgtctcactgagcact

SEQ ID NO: 6535155 - DNA, 18 bp, Homo sapiens
tgtaaatgtcttttcaaa

SEQ ID NO: 6535156 - DNA, 12 bp, Homo sapiens
tgtaaatgtgtt

SEQ ID NO: 6535157 - DNA, 12 bp, Homo sapiens
tgtaaatgttaa

SEQ ID NO: 6535158 - DNA, 16 bp, Homo sapiens
tgtaaatgttatgact

SEQ ID NO: 6535159 - DNA, 17 bp, Homo sapiens
tgtaaatgttatttctg

SEQ ID NO: 6535160 - DNA, 19 bp, Homo sapiens
tgtaaatgttatttctgca

SEQ ID NO: 6535161 - DNA, 21 bp, Homo sapiens
tgtaaatgttatttctgcaaa

SEQ ID NO: 6535162 - DNA, 19 bp, Homo sapiens
tgtaaatgttcttggtgtt

SEQ ID NO: 6535163 - DNA, 13 bp, Homo sapiens
tgtaaatgtttct

SEQ ID NO: 6535164 - DNA, 16 bp, Homo sapiens
tgtaaattaactcacc

SEQ ID NO: 6535165 - DNA, 13 bp, Homo sapiens
tgtaaattaactt

SEQ ID NO: 6535166 - DNA, 16 bp, Homo sapiens
tgtaaattaactttta

SEQ ID NO: 6535167 - DNA, 15 bp, Homo sapiens
tgtaaattaatactt

SEQ ID NO: 6535168 - DNA, 17 bp, Homo sapiens
tgtaaattagtttgaca

SEQ ID NO: 6535169 - DNA, 18 bp, Homo sapiens
tgtaaattagtttgacac

SEQ ID NO: 6535170 - DNA, 12 bp, Homo sapiens
tgtaaattatgt

SEQ ID NO: 6535171 - DNA, 23 bp, Homo sapiens
tgtaaattattgatgattttgta

SEQ ID NO: 6535172 - DNA, 15 bp, Homo sapiens
tgtaaattattgtaa

SEQ ID NO: 6535173 - DNA, 16 bp, Homo sapiens
tgtaaattatttgcta

SEQ ID NO: 6535174 - DNA, 15 bp, Homo sapiens
tgtaaattattttat

SEQ ID NO: 6535175 - DNA, 15 bp, Homo sapiens
tgtaaattccaaaga

SEQ ID NO: 6535176 - DNA, 16 bp, Homo sapiens
tgtaaattccaaagat

SEQ ID NO: 6535177 - DNA, 17 bp, Homo sapiens
tgtaaattccaaagatc

SEQ ID NO: 6535178 - DNA, 13 bp, Homo sapiens
tgtaaattctgat

SEQ ID NO: 6535179 - DNA, 14 bp, Homo sapiens
tgtaaattctgatt

SEQ ID NO: 6535180 - DNA, 12 bp, Homo sapiens
tgtaaattgaac

SEQ ID NO: 6535181 - DNA, 14 bp, Homo sapiens
tgtaaattgaactt

SEQ ID NO: 6535182 - DNA, 15 bp, Homo sapiens
tgtaaattgaagaag

SEQ ID NO: 6535183 - DNA, 22 bp, Homo sapiens
tgtaaattgaatcagtataaac

SEQ ID NO: 6535184 - DNA, 15 bp, Homo sapiens
tgtaaattgcacaga

SEQ ID NO: 6535185 - DNA, 19 bp, Homo sapiens
tgtaaattgcagaattcaa

SEQ ID NO: 6535186 - DNA, 20 bp, Homo sapiens
tgtaaattgcagaattcaaa

SEQ ID NO: 6535187 - DNA, 17 bp, Homo sapiens
tgtaaattgtattctca

SEQ ID NO: 6535188 - DNA, 19 bp, Homo sapiens
tgtaaattgtattctcata

SEQ ID NO: 6535189 - DNA, 20 bp, Homo sapiens
tgtaaattgtattctcataa

SEQ ID NO: 6535190 - DNA, 15 bp, Homo sapiens
tgtaaatttagtgtt

SEQ ID NO: 6535191 - DNA, 16 bp, Homo sapiens
tgtaaatttggcttct

SEQ ID NO: 6535192 - DNA, 13 bp, Homo sapiens
tgtaaatttgtac

SEQ ID NO: 6535193 - DNA, 12 bp, Homo sapiens
tgtaaattttag

SEQ ID NO: 6535194 - DNA, 20 bp, Homo sapiens
tgtaaattttataaggctga

SEQ ID NO: 6535195 - DNA, 23 bp, Homo sapiens
tgtaaattttttacgtagctatt

SEQ ID NO: 6535196 - DNA, 19 bp, Homo sapiens
tgtaacaaattgatctgtt

SEQ ID NO: 6535197 - DNA, 15 bp, Homo sapiens
tgtaacaagaaaaca

SEQ ID NO: 6535198 - DNA, 20 bp, Homo sapiens
tgtaacaattgtgtagcctt

SEQ ID NO: 6535199 - DNA, 20 bp, Homo sapiens
tgtaacacaagccacagaag

SEQ ID NO: 6535200 - DNA, 24 bp, Homo sapiens
tgtaacacaagccacagaagccag

SEQ ID NO: 6535201 - DNA, 20 bp, Homo sapiens
tgtaacacagctgagagact

SEQ ID NO: 6535202 - DNA, 23 bp, Homo sapiens
tgtaacacagctgagagactttt

SEQ ID NO: 6535203 - DNA, 20 bp, Homo sapiens
tgtaacactattacagtatt

SEQ ID NO: 6535204 - DNA, 16 bp, Homo sapiens
tgtaacactgatgata

SEQ ID NO: 6535205 - DNA, 13 bp, Homo sapiens
tgtaacactgtgt

SEQ ID NO: 6535206 - DNA, 16 bp, Homo sapiens
tgtaacactttacaat

SEQ ID NO: 6535207 - DNA, 20 bp, Homo sapiens
tgtaacactttacaatgttc

SEQ ID NO: 6535208 - DNA, 23 bp, Homo sapiens
tgtaacagaaagggcaacaataa

SEQ ID NO: 6535209 - DNA, 22 bp, Homo sapiens
tgtaacagcaattttcataata

SEQ ID NO: 6535210 - DNA, 16 bp, Homo sapiens
tgtaacagctccttgg

SEQ ID NO: 6535211 - DNA, 22 bp, Homo sapiens
tgtaacagctccttgggaggaa

SEQ ID NO: 6535212 - DNA, 22 bp, Homo sapiens
tgtaacaggtctcctcttaaaa

SEQ ID NO: 6535213 - DNA, 14 bp, Homo sapiens
tgtaacagtctgat

SEQ ID NO: 6535214 - DNA, 16 bp, Homo sapiens
tgtaacagtctgatcg

SEQ ID NO: 6535215 - DNA, 15 bp, Homo sapiens
tgtaacatatgcaaa

SEQ ID NO: 6535216 - DNA, 16 bp, Homo sapiens
tgtaacatatgcaaac

SEQ ID NO: 6535217 - DNA, 19 bp, Homo sapiens
tgtaacatcataattacat

SEQ ID NO: 6535218 - DNA, 20 bp, Homo sapiens
tgtaacatcataattacatt

SEQ ID NO: 6535219 - DNA, 17 bp, Homo sapiens
tgtaacatgatgttaac

SEQ ID NO: 6535220 - DNA, 11 bp, Homo sapiens
tgtaacatgta

SEQ ID NO: 6535221 - DNA, 21 bp, Homo sapiens
tgtaacattaattctactaaa

SEQ ID NO: 6535222 - DNA, 16 bp, Homo sapiens
tgtaacattggtgaag

SEQ ID NO: 6535223 - DNA, 13 bp, Homo sapiens
tgtaaccaagctg

SEQ ID NO: 6535224 - DNA, 13 bp, Homo sapiens
tgtaaccactgca

SEQ ID NO: 6535225 - DNA, 17 bp, Homo sapiens
tgtaaccagtgcagaaa

SEQ ID NO: 6535226 - DNA, 22 bp, Homo sapiens
tgtaaccagtgcagaaatgaaa

SEQ ID NO: 6535227 - DNA, 23 bp, Homo sapiens
tgtaaccagtgcagaaatgaaat

SEQ ID NO: 6535228 - DNA, 22 bp, Homo sapiens
tgtaaccatttctcactagtgt

SEQ ID NO: 6535229 - DNA, 12 bp, Homo sapiens
tgtaaccatttt

SEQ ID NO: 6535230 - DNA, 19 bp, Homo sapiens
tgtaaccattttataaagt

SEQ ID NO: 6535231 - DNA, 16 bp, Homo sapiens
tgtaacccttgaattt

SEQ ID NO: 6535232 - DNA, 20 bp, Homo sapiens
tgtaaccgattcatctctca

SEQ ID NO: 6535233 - DNA, 15 bp, Homo sapiens
tgtaacctcagctct

SEQ ID NO: 6535234 - DNA, 18 bp, Homo sapiens
tgtaacctcgtgtctagt

SEQ ID NO: 6535235 - DNA, 13 bp, Homo sapiens
tgtaacctgctgg

SEQ ID NO: 6535236 - DNA, 22 bp, Homo sapiens
tgtaacctgctggatgggactc

SEQ ID NO: 6535237 - DNA, 18 bp, Homo sapiens
tgtaacctgggaaagcca

SEQ ID NO: 6535238 - DNA, 23 bp, Homo sapiens
tgtaacctgttgctgtgtttaat

SEQ ID NO: 6535239 - DNA, 21 bp, Homo sapiens
tgtaaccttgggtggcccctg

SEQ ID NO: 6535240 - DNA, 14 bp, Homo sapiens
tgtaacgcctgctt

SEQ ID NO: 6535241 - DNA, 18 bp, Homo sapiens
tgtaacgtgtgctgtgtt

SEQ ID NO: 6535242 - DNA, 16 bp, Homo sapiens
tgtaacgttgctgtgg

SEQ ID NO: 6535243 - DNA, 20 bp, Homo sapiens
tgtaacgttgctgtgggaac

SEQ ID NO: 6535244 - DNA, 14 bp, Homo sapiens
tgtaactaaaataa

SEQ ID NO: 6535245 - DNA, 22 bp, Homo sapiens
tgtaactacaaagctttgctac

SEQ ID NO: 6535246 - DNA, 23 bp, Homo sapiens
tgtaactaccctctcaaatggac

SEQ ID NO: 6535247 - DNA, 16 bp, Homo sapiens
tgtaactactttataa

SEQ ID NO: 6535248 - DNA, 21 bp, Homo sapiens
tgtaactatagtccagctttg

SEQ ID NO: 6535249 - DNA, 16 bp, Homo sapiens
tgtaactatgctgtta

SEQ ID NO: 6535250 - DNA, 12 bp, Homo sapiens
tgtaactcaact

SEQ ID NO: 6535251 - DNA, 17 bp, Homo sapiens
tgtaactcacatgcctt

SEQ ID NO: 6535252 - DNA, 23 bp, Homo sapiens
tgtaactcacatgccttctaaac

SEQ ID NO: 6535253 - DNA, 13 bp, Homo sapiens
tgtaactcagaca

SEQ ID NO: 6535254 - DNA, 16 bp, Homo sapiens
tgtaactctaaaagat

SEQ ID NO: 6535255 - DNA, 17 bp, Homo sapiens
tgtaactctaaaagatc

SEQ ID NO: 6535256 - DNA, 18 bp, Homo sapiens
tgtaactctaaaagatcc

SEQ ID NO: 6535257 - DNA, 20 bp, Homo sapiens
tgtaactctaaaagatcctt

SEQ ID NO: 6535258 - DNA, 18 bp, Homo sapiens
tgtaactctccagccatt

SEQ ID NO: 6535259 - DNA, 13 bp, Homo sapiens
tgtaactctttgg

SEQ ID NO: 6535260 - DNA, 14 bp, Homo sapiens
tgtaactgaagcat

SEQ ID NO: 6535261 - DNA, 16 bp, Homo sapiens
tgtaactgaagcataa

SEQ ID NO: 6535262 - DNA, 16 bp, Homo sapiens
tgtaactgagagaaag

SEQ ID NO: 6535263 - DNA, 23 bp, Homo sapiens
tgtaactgcattgagaactgcat

SEQ ID NO: 6535264 - DNA, 15 bp, Homo sapiens
tgtaactgccaggct

SEQ ID NO: 6535265 - DNA, 18 bp, Homo sapiens
tgtaactgccaggctctc

SEQ ID NO: 6535266 - DNA, 13 bp, Homo sapiens
tgtaactgcccag

SEQ ID NO: 6535267 - DNA, 15 bp, Homo sapiens
tgtaactgcccagcc

SEQ ID NO: 6535268 - DNA, 19 bp, Homo sapiens
tgtaactgcccagcccctt

SEQ ID NO: 6535269 - DNA, 24 bp, Homo sapiens
tgtaactgcccttttaaatggcat

SEQ ID NO: 6535270 - DNA, 20 bp, Homo sapiens
tgtaactgctcagagcttta

SEQ ID NO: 6535271 - DNA, 12 bp, Homo sapiens
tgtaactgctga

SEQ ID NO: 6535272 - DNA, 16 bp, Homo sapiens
tgtaactgctgagcca

SEQ ID NO: 6535273 - DNA, 13 bp, Homo sapiens
tgtaactggctgc

SEQ ID NO: 6535274 - DNA, 18 bp, Homo sapiens
tgtaactggctgctccct

SEQ ID NO: 6535275 - DNA, 23 bp, Homo sapiens
tgtaactgtcagccgggccctga

SEQ ID NO: 6535276 - DNA, 17 bp, Homo sapiens
tgtaactgttaccattg

SEQ ID NO: 6535277 - DNA, 21 bp, Homo sapiens
tgtaactgtttagatgaatgt

SEQ ID NO: 6535278 - DNA, 14 bp, Homo sapiens
tgtaacttaattat

SEQ ID NO: 6535279 - DNA, 18 bp, Homo sapiens
tgtaacttagctttattt

SEQ ID NO: 6535280 - DNA, 16 bp, Homo sapiens
tgtaacttatattgaa

SEQ ID NO: 6535281 - DNA, 13 bp, Homo sapiens
tgtaacttatgta

SEQ ID NO: 6535282 - DNA, 15 bp, Homo sapiens
tgtaacttatgtaga

SEQ ID NO: 6535283 - DNA, 20 bp, Homo sapiens
tgtaacttatgtagatattt

SEQ ID NO: 6535284 - DNA, 22 bp, Homo sapiens
tgtaacttatgtagatatttgg

SEQ ID NO: 6535285 - DNA, 14 bp, Homo sapiens
tgtaacttattcca

SEQ ID NO: 6535286 - DNA, 22 bp, Homo sapiens
tgtaacttattccaagtgcatt

SEQ ID NO: 6535287 - DNA, 21 bp, Homo sapiens
tgtaacttccaaataaataat

SEQ ID NO: 6535288 - DNA, 16 bp, Homo sapiens
tgtaacttcctgctgc

SEQ ID NO: 6535289 - DNA, 22 bp, Homo sapiens
tgtaacttcctgctgcaccctg

SEQ ID NO: 6535290 - DNA, 14 bp, Homo sapiens
tgtaacttcctgtg

SEQ ID NO: 6535291 - DNA, 15 bp, Homo sapiens
tgtaacttcctgtgg

SEQ ID NO: 6535292 - DNA, 17 bp, Homo sapiens
tgtaacttcctgtggat

SEQ ID NO: 6535293 - DNA, 18 bp, Homo sapiens
ttcctgctttctctttca

SEQ ID NO: 6535294 - DNA, 13 bp, Homo sapiens
ttcctgcttttct

SEQ ID NO: 6535295 - DNA, 14 bp, Homo sapiens
ttcctggaaacagc

SEQ ID NO: 6535296 - DNA, 10 bp, Homo sapiens
ttcctggaac

SEQ ID NO: 6535297 - DNA, 13 bp, Homo sapiens
ttcctggaagcag

SEQ ID NO: 6535298 - DNA, 18 bp, Homo sapiens
ttcctggaattgccagct

SEQ ID NO: 6535299 - DNA, 16 bp, Homo sapiens
ttcctggacacactct

SEQ ID NO: 6535300 - DNA, 15 bp, Homo sapiens
ttcctggacagctgt

SEQ ID NO: 6535301 - DNA, 24 bp, Homo sapiens
ttcctggacagctgtgcctcgctc

SEQ ID NO: 6535302 - DNA, 17 bp, Homo sapiens
ttcctggacagtgagag

SEQ ID NO: 6535303 - DNA, 21 bp, Homo sapiens
ttcctggacatcaccagtcct

SEQ ID NO: 6535304 - DNA, 24 bp, Homo sapiens
ttcctggacatcctcttctgctta

SEQ ID NO: 6535305 - DNA, 17 bp, Homo sapiens
ttcctggacctgagtcg

SEQ ID NO: 6535306 - DNA, 18 bp, Homo sapiens
ttcctggactggcccttg

SEQ ID NO: 6535307 - DNA, 19 bp, Homo sapiens
ttcctggagagtctcactc

SEQ ID NO: 6535308 - DNA, 22 bp, Homo sapiens
ttcctggagcagaagcagcaac

SEQ ID NO: 6535309 - DNA, 16 bp, Homo sapiens
ttcctggagcccagag

SEQ ID NO: 6535310 - DNA, 14 bp, Homo sapiens
ttcctggagcccga

SEQ ID NO: 6535311 - DNA, 18 bp, Homo sapiens
ttcctggagtgaagaaaa

SEQ ID NO: 6535312 - DNA, 14 bp, Homo sapiens
ttcctggagtgcct

SEQ ID NO: 6535313 - DNA, 20 bp, Homo sapiens
ttcctggattttctttctat

SEQ ID NO: 6535314 - DNA, 15 bp, Homo sapiens
ttcctggcaatagtg

SEQ ID NO: 6535315 - DNA, 22 bp, Homo sapiens
ttcctggcacaatgttggagca

SEQ ID NO: 6535316 - DNA, 19 bp, Homo sapiens
ttcctggcacattgcccct

SEQ ID NO: 6535317 - DNA, 13 bp, Homo sapiens
ttcctggcagctg

SEQ ID NO: 6535318 - DNA, 15 bp, Homo sapiens
ttcctggcagctgct

SEQ ID NO: 6535319 - DNA, 16 bp, Homo sapiens
ttcctggcagctgctg

SEQ ID NO: 6535320 - DNA, 17 bp, Homo sapiens
ttcctggcagctgctgt

SEQ ID NO: 6535321 - DNA, 11 bp, Homo sapiens
ttcctggccca

SEQ ID NO: 6535322 - DNA, 14 bp, Homo sapiens
ttcctggccccctc

SEQ ID NO: 6535323 - DNA, 16 bp, Homo sapiens
ttcctggccccctcat

SEQ ID NO: 6535324 - DNA, 21 bp, Homo sapiens
ttcctggcccctcatggcggg

SEQ ID NO: 6535325 - DNA, 21 bp, Homo sapiens
ttcctggcctcactggctggg

SEQ ID NO: 6535326 - DNA, 14 bp, Homo sapiens
ttcctggcctcaga

SEQ ID NO: 6535327 - DNA, 15 bp, Homo sapiens
ttcctggcctcagag

SEQ ID NO: 6535328 - DNA, 16 bp, Homo sapiens
ttcctggcctcagagc

SEQ ID NO: 6535329 - DNA, 17 bp, Homo sapiens
ttcctggcctcagagct

SEQ ID NO: 6535330 - DNA, 18 bp, Homo sapiens
ttcctggcctcagagctt

SEQ ID NO: 6535331 - DNA, 24 bp, Homo sapiens
ttcctggcctcagagcttcctggg

SEQ ID NO: 6535332 - DNA, 19 bp, Homo sapiens
ttcctggcctcccttctcc

SEQ ID NO: 6535333 - DNA, 13 bp, Homo sapiens
ttcctggcctctt

SEQ ID NO: 6535334 - DNA, 23 bp, Homo sapiens
ttcctggctctaccctgtctgtc

SEQ ID NO: 6535335 - DNA, 21 bp, Homo sapiens
ttcctggctgatgatccagaa

SEQ ID NO: 6535336 - DNA, 16 bp, Homo sapiens
ttcctgggaatggaat

SEQ ID NO: 6535337 - DNA, 18 bp, Homo sapiens
ttcctgggagaaagacca

SEQ ID NO: 6535338 - DNA, 12 bp, Homo sapiens
ttcctgggagga

SEQ ID NO: 6535339 - DNA, 19 bp, Homo sapiens
ttcctgggatgatgtgtga

SEQ ID NO: 6535340 - DNA, 21 bp, Homo sapiens
ttcctgggatggcgatgggga

SEQ ID NO: 6535341 - DNA, 16 bp, Homo sapiens
ttcctgggcacacgct

SEQ ID NO: 6535342 - DNA, 15 bp, Homo sapiens
ttcctgggcagccca

SEQ ID NO: 6535343 - DNA, 20 bp, Homo sapiens
ttcctgggcagcccagagag

SEQ ID NO: 6535344 - DNA, 22 bp, Homo sapiens
ttcctgggcagcctttccagcc

SEQ ID NO: 6535345 - DNA, 14 bp, Homo sapiens
ttcctgggcctgtc

SEQ ID NO: 6535346 - DNA, 17 bp, Homo sapiens
ttcctggggaccaagat

SEQ ID NO: 6535347 - DNA, 17 bp, Homo sapiens
ttcctggggatgtcata

SEQ ID NO: 6535348 - DNA, 23 bp, Homo sapiens
ttcctggggatgtcatagccaaa

SEQ ID NO: 6535349 - DNA, 14 bp, Homo sapiens
ttcctggggccgcc

SEQ ID NO: 6535350 - DNA, 19 bp, Homo sapiens
ttcctggggccgcctgccc

SEQ ID NO: 6535351 - DNA, 20 bp, Homo sapiens
ttcctggggccgcctgccct

SEQ ID NO: 6535352 - DNA, 20 bp, Homo sapiens
ttcctggggtggattcctaa

SEQ ID NO: 6535353 - DNA, 16 bp, Homo sapiens
ttcctgggtcctgcct

SEQ ID NO: 6535354 - DNA, 16 bp, Homo sapiens
ttcctgggtggctact

SEQ ID NO: 6535355 - DNA, 22 bp, Homo sapiens
ttcctggtagaccactgccata

SEQ ID NO: 6535356 - DNA, 14 bp, Homo sapiens
ttcctggtccctca

SEQ ID NO: 6535357 - DNA, 12 bp, Homo sapiens
ttcctggtgagg

SEQ ID NO: 6535358 - DNA, 22 bp, Homo sapiens
ttcctggtgaggcccagcctgt

SEQ ID NO: 6535359 - DNA, 11 bp, Homo sapiens
ttcctggtgct

SEQ ID NO: 6535360 - DNA, 15 bp, Homo sapiens
ttcctggtgctcttt

SEQ ID NO: 6535361 - DNA, 14 bp, Homo sapiens
ttcctggtgctgga

SEQ ID NO: 6535362 - DNA, 15 bp, Homo sapiens
ttcctggtgctggag

SEQ ID NO: 6535363 - DNA, 16 bp, Homo sapiens
ttcctggttgttcctg

SEQ ID NO: 6535364 - DNA, 13 bp, Homo sapiens
ttcctggtttgta

SEQ ID NO: 6535365 - DNA, 20 bp, Homo sapiens
ttcctggttttgtacactgc

SEQ ID NO: 6535366 - DNA, 22 bp, Homo sapiens
ttcctggttttgtacactgctg

SEQ ID NO: 6535367 - DNA, 21 bp, Homo sapiens
ttcctgtaaaaaaaaaaaagt

SEQ ID NO: 6535368 - DNA, 14 bp, Homo sapiens
ttcctgtaaataag

SEQ ID NO: 6535369 - DNA, 14 bp, Homo sapiens
ttcctgtaacaggt

SEQ ID NO: 6535370 - DNA, 22 bp, Homo sapiens
ttcctgtaatatatttatatac

SEQ ID NO: 6535371 - DNA, 15 bp, Homo sapiens
ttcctgtagcatctt

SEQ ID NO: 6535372 - DNA, 18 bp, Homo sapiens
ttcctgtagcatcttctg

SEQ ID NO: 6535373 - DNA, 17 bp, Homo sapiens
ttcctgtagtgcccctc

SEQ ID NO: 6535374 - DNA, 14 bp, Homo sapiens
ttcctgtatgttgt

SEQ ID NO: 6535375 - DNA, 23 bp, Homo sapiens
ttcctgtatgttgtacaatcaaa

SEQ ID NO: 6535376 - DNA, 21 bp, Homo sapiens
ttcctgtatttgttcccaaga

SEQ ID NO: 6535377 - DNA, 22 bp, Homo sapiens
ttcctgtatttgttcccaagag

SEQ ID NO: 6535378 - DNA, 13 bp, Homo sapiens
ttcctgtcagtgt

SEQ ID NO: 6535379 - DNA, 17 bp, Homo sapiens
ttcctgtcattcctcta

SEQ ID NO: 6535380 - DNA, 15 bp, Homo sapiens
ttcctgtccagagag

SEQ ID NO: 6535381 - DNA, 15 bp, Homo sapiens
ttcctgtccagctcc

SEQ ID NO: 6535382 - DNA, 14 bp, Homo sapiens
ttcctgtcccacct

SEQ ID NO: 6535383 - DNA, 16 bp, Homo sapiens
ttcctgtccccagggg

SEQ ID NO: 6535384 - DNA, 14 bp, Homo sapiens
ttcctgtccctgcg

SEQ ID NO: 6535385 - DNA, 21 bp, Homo sapiens
ttcctgtccctgcgcctttcc

SEQ ID NO: 6535386 - DNA, 22 bp, Homo sapiens
ttcctgtccctgcgcctttcct

SEQ ID NO: 6535387 - DNA, 15 bp, Homo sapiens
ttcctgtccctttgt

SEQ ID NO: 6535388 - DNA, 20 bp, Homo sapiens
ttcctgtcctcccagctcct

SEQ ID NO: 6535389 - DNA, 20 bp, Homo sapiens
ttcctgtcctctttcagctc

SEQ ID NO: 6535390 - DNA, 14 bp, Homo sapiens
ttcctgtcctgcct

SEQ ID NO: 6535391 - DNA, 16 bp, Homo sapiens
ttcctgtcctgcctcc

SEQ ID NO: 6535392 - DNA, 18 bp, Homo sapiens
ttcctgtcctgcctcctc

SEQ ID NO: 6535393 - DNA, 24 bp, Homo sapiens
ttcctgtccttctctcacctccta

SEQ ID NO: 6535394 - DNA, 20 bp, Homo sapiens
ttcctgtccttgttcatgga

SEQ ID NO: 6535395 - DNA, 20 bp, Homo sapiens
ttcctgtctagtctctcctg

SEQ ID NO: 6535396 - DNA, 19 bp, Homo sapiens
ttcctgtctcaatagctcc

SEQ ID NO: 6535397 - DNA, 15 bp, Homo sapiens
ttcctgtctcactct

SEQ ID NO: 6535398 - DNA, 15 bp, Homo sapiens
ttcctgtctcagcct

SEQ ID NO: 6535399 - DNA, 11 bp, Homo sapiens
ttcctgtctga

SEQ ID NO: 6535400 - DNA, 17 bp, Homo sapiens
ttcctgtctgtttatat

SEQ ID NO: 6535401 - DNA, 21 bp, Homo sapiens
ttcctgtctttgttgtctccc

SEQ ID NO: 6535402 - DNA, 22 bp, Homo sapiens
ttcctgtctttgttgtctccct

SEQ ID NO: 6535403 - DNA, 12 bp, Homo sapiens
ttcctgtgacac

SEQ ID NO: 6535404 - DNA, 17 bp, Homo sapiens
ttcctgtgatacatttc

SEQ ID NO: 6535405 - DNA, 19 bp, Homo sapiens
ttcctgtgatacatttctg

SEQ ID NO: 6535406 - DNA, 21 bp, Homo sapiens
ttcctgtgatacatttctgaa

SEQ ID NO: 6535407 - DNA, 22 bp, Homo sapiens
ttcctgtgatacatttctgaat

SEQ ID NO: 6535408 - DNA, 23 bp, Homo sapiens
ttcctgtgcagatgctgctgaag

SEQ ID NO: 6535409 - DNA, 15 bp, Homo sapiens
ttcctgtgccaacct

SEQ ID NO: 6535410 - DNA, 14 bp, Homo sapiens
ttcctgtgccagga

SEQ ID NO: 6535411 - DNA, 13 bp, Homo sapiens
ttcctgtgcccat

SEQ ID NO: 6535412 - DNA, 15 bp, Homo sapiens
ttcctgtgccgtaag

SEQ ID NO: 6535413 - DNA, 21 bp, Homo sapiens
ttcctgtggctccctctctcc

SEQ ID NO: 6535414 - DNA, 13 bp, Homo sapiens
ttcctgtgggtgg

SEQ ID NO: 6535415 - DNA, 20 bp, Homo sapiens
ttcctgtgggtggggcttct

SEQ ID NO: 6535416 - DNA, 22 bp, Homo sapiens
ttcctgtgggtgttctttcctg

SEQ ID NO: 6535417 - DNA, 19 bp, Homo sapiens
ttcctgtgtaaaaacaaca

SEQ ID NO: 6535418 - DNA, 16 bp, Homo sapiens
ttcctgtgtaacatct

SEQ ID NO: 6535419 - DNA, 20 bp, Homo sapiens
ttcctgtgtaacatctgcca

SEQ ID NO: 6535420 - DNA, 23 bp, Homo sapiens
ttcctgtgtaacatctgccattt

SEQ ID NO: 6535421 - DNA, 19 bp, Homo sapiens
ttcctgtgtacctctagaa

SEQ ID NO: 6535422 - DNA, 18 bp, Homo sapiens
ttcctgtgtactctttat

SEQ ID NO: 6535423 - DNA, 16 bp, Homo sapiens
ttcctgtgtccatgtg

SEQ ID NO: 6535424 - DNA, 14 bp, Homo sapiens
ttcctgtgtcctga

SEQ ID NO: 6535425 - DNA, 11 bp, Homo sapiens
ttcctgtgtct

SEQ ID NO: 6535426 - DNA, 15 bp, Homo sapiens
ttcctgtgtctccaa

SEQ ID NO: 6535427 - DNA, 21 bp, Homo sapiens
ttcctgtgtgaccctgggcag

SEQ ID NO: 6535428 - DNA, 17 bp, Homo sapiens
ttcctgtgtttgtcctg

SEQ ID NO: 6535429 - DNA, 16 bp, Homo sapiens
ttcctgttaagtgaat

SEQ ID NO: 6535430 - DNA, 17 bp, Homo sapiens
ttcctgttacctgtctt

SEQ ID NO: 6535431 - DNA, 21 bp, Homo sapiens
ttcctgttactgagatgtctt

SEQ ID NO: 6535432 - DNA, 15 bp, Homo sapiens
ttcctgttcacctta

SEQ ID NO: 6535433 - DNA, 19 bp, Homo sapiens
ttcctgttcaccttatgta

SEQ ID NO: 6535434 - DNA, 23 bp, Homo sapiens
ttcctgttcaccttatgtattat

SEQ ID NO: 6535435 - DNA, 17 bp, Homo sapiens
ttcctgttcagcattct

SEQ ID NO: 6535436 - DNA, 17 bp, Homo sapiens
ttcctgttcccatgaga

SEQ ID NO: 6535437 - DNA, 18 bp, Homo sapiens
ttcctgttccctcctggt

SEQ ID NO: 6535438 - DNA, 15 bp, Homo sapiens
ttcctgttctgaact

SEQ ID NO: 6535439 - DNA, 13 bp, Homo sapiens
ttcctgttcttcc

SEQ ID NO: 6535440 - DNA, 14 bp, Homo sapiens
ttcctgttcttcct

SEQ ID NO: 6535441 - DNA, 17 bp, Homo sapiens
ttcctgttgtcaagaat

SEQ ID NO: 6535442 - DNA, 22 bp, Homo sapiens
ttcctgttgttatggaaactgt

SEQ ID NO: 6535443 - DNA, 21 bp, Homo sapiens
ttcctgtttcagaccccccca

SEQ ID NO: 6535444 - DNA, 15 bp, Homo sapiens
ttcctgtttccaggg

SEQ ID NO: 6535445 - DNA, 16 bp, Homo sapiens
ttcctgtttctgaaaa

SEQ ID NO: 6535446 - DNA, 21 bp, Homo sapiens
ttcctgtttgaaatatcatgt

SEQ ID NO: 6535447 - DNA, 20 bp, Homo sapiens
ttcctgtttgaacccaggag

SEQ ID NO: 6535448 - DNA, 17 bp, Homo sapiens
ttcctgtttgggaagag

SEQ ID NO: 6535449 - DNA, 17 bp, Homo sapiens
ttcctgtttgttgaagg

SEQ ID NO: 6535450 - DNA, 21 bp, Homo sapiens
ttccttaaaattaagttgaaa

SEQ ID NO: 6535451 - DNA, 13 bp, Homo sapiens
ttccttaaactgt

SEQ ID NO: 6535452 - DNA, 16 bp, Homo sapiens
ttccttaaactgtgtg

SEQ ID NO: 6535453 - DNA, 17 bp, Homo sapiens
ttccttaaactgtgtgg

SEQ ID NO: 6535454 - DNA, 22 bp, Homo sapiens
ttccttaagagctatttgtggt

SEQ ID NO: 6535455 - DNA, 19 bp, Homo sapiens
ttccttaagtcagaacagc

SEQ ID NO: 6535456 - DNA, 18 bp, Homo sapiens
ttccttacagaactactt

SEQ ID NO: 6535457 - DNA, 14 bp, Homo sapiens
ttccttacttgcac

SEQ ID NO: 6535458 - DNA, 17 bp, Homo sapiens
ttccttacttgcactgt

SEQ ID NO: 6535459 - DNA, 18 bp, Homo sapiens
ttccttagacccgccagg

SEQ ID NO: 6535460 - DNA, 15 bp, Homo sapiens
ttccttagcagctca

SEQ ID NO: 6535461 - DNA, 21 bp, Homo sapiens
ttccttagctatttatccctt

SEQ ID NO: 6535462 - DNA, 19 bp, Homo sapiens
ttccttagctgtaaaatgg

SEQ ID NO: 6535463 - DNA, 23 bp, Homo sapiens
ttccttagcttagacctcagcct

SEQ ID NO: 6535464 - DNA, 20 bp, Homo sapiens
ttccttagcttggtatgaga

SEQ ID NO: 6535465 - DNA, 22 bp, Homo sapiens
ttccttaggtttttttccttct

SEQ ID NO: 6535466 - DNA, 13 bp, Homo sapiens
ttccttagtttca

SEQ ID NO: 6535467 - DNA, 22 bp, Homo sapiens
ttccttatcacagaaataaaat

SEQ ID NO: 6535468 - DNA, 15 bp, Homo sapiens
ttccttatccctctc

SEQ ID NO: 6535469 - DNA, 17 bp, Homo sapiens
ttccttatccctctctt

SEQ ID NO: 6535470 - DNA, 21 bp, Homo sapiens
ttccttatccctctcttcccc

SEQ ID NO: 6535471 - DNA, 24 bp, Homo sapiens
tgtaacttgaacctatgaagcaat

SEQ ID NO: 6535472 - DNA, 23 bp, Homo sapiens
tgtaacttgatccatttctaatt

SEQ ID NO: 6535473 - DNA, 23 bp, Homo sapiens
tgtaacttgggctgtaaagcaaa

SEQ ID NO: 6535474 - DNA, 15 bp, Homo sapiens
tgtaactttaaacat

SEQ ID NO: 6535475 - DNA, 23 bp, Homo sapiens
tgtaactttccactcttcctgta

SEQ ID NO: 6535476 - DNA, 15 bp, Homo sapiens
tgtaactttgcatgt

SEQ ID NO: 6535477 - DNA, 15 bp, Homo sapiens
tgtaacttttaatcc

SEQ ID NO: 6535478 - DNA, 16 bp, Homo sapiens
tgtaacttttgtaaga

SEQ ID NO: 6535479 - DNA, 20 bp, Homo sapiens
tgtaacttttgtaagacaaa

SEQ ID NO: 6535480 - DNA, 11 bp, Homo sapiens
tgtaacttttt

SEQ ID NO: 6535481 - DNA, 15 bp, Homo sapiens
tgtaagaaaacaaaa

SEQ ID NO: 6535482 - DNA, 21 bp, Homo sapiens
tgtaagaaaacaaactaaatg

SEQ ID NO: 6535483 - DNA, 20 bp, Homo sapiens
tgtaagaaaaccaaaataaa

SEQ ID NO: 6535484 - DNA, 17 bp, Homo sapiens
tgtaagaaaagctgatg

SEQ ID NO: 6535485 - DNA, 20 bp, Homo sapiens
tgtaagaaaatgctgtcaca

SEQ ID NO: 6535486 - DNA, 18 bp, Homo sapiens
tgtaagaaaccaatcaag

SEQ ID NO: 6535487 - DNA, 18 bp, Homo sapiens
tgtaagaaatactgtaca

SEQ ID NO: 6535488 - DNA, 12 bp, Homo sapiens
tgtaagaaatga

SEQ ID NO: 6535489 - DNA, 20 bp, Homo sapiens
tgtaagaacaatgccagggc

SEQ ID NO: 6535490 - DNA, 22 bp, Homo sapiens
tgtaagaactaaagaagatctg

SEQ ID NO: 6535491 - DNA, 19 bp, Homo sapiens
tgtaagaactacaaacaaa

SEQ ID NO: 6535492 - DNA, 16 bp, Homo sapiens
tgtaagaagaaactgc

SEQ ID NO: 6535493 - DNA, 22 bp, Homo sapiens
tgtaagaagcggcatagcaccc

SEQ ID NO: 6535494 - DNA, 17 bp, Homo sapiens
tgtaagaaggcaatatt

SEQ ID NO: 6535495 - DNA, 12 bp, Homo sapiens
tgtaagaataat

SEQ ID NO: 6535496 - DNA, 22 bp, Homo sapiens
tgtaagaataggcattaacaca

SEQ ID NO: 6535497 - DNA, 17 bp, Homo sapiens
tgtaagaattctgattg

SEQ ID NO: 6535498 - DNA, 16 bp, Homo sapiens
tgtaagacacacagcc

SEQ ID NO: 6535499 - DNA, 19 bp, Homo sapiens
tgtaagacacacagccttt

SEQ ID NO: 6535500 - DNA, 22 bp, Homo sapiens
tgtaagacacacagcctttctg

SEQ ID NO: 6535501 - DNA, 23 bp, Homo sapiens
tgtaagacacacagcctttctgt

SEQ ID NO: 6535502 - DNA, 19 bp, Homo sapiens
tgtaagacacgtgcaacag

SEQ ID NO: 6535503 - DNA, 23 bp, Homo sapiens
tgtaagacacgtgcaacagactg

SEQ ID NO: 6535504 - DNA, 22 bp, Homo sapiens
tgtaagacattagtttgaggta

SEQ ID NO: 6535505 - DNA, 14 bp, Homo sapiens
tgtaagacatttgt

SEQ ID NO: 6535506 - DNA, 18 bp, Homo sapiens
tgtaagacccttattgct

SEQ ID NO: 6535507 - DNA, 16 bp, Homo sapiens
tgtaagacggccttgg

SEQ ID NO: 6535508 - DNA, 16 bp, Homo sapiens
tgtaagacttcagatt

SEQ ID NO: 6535509 - DNA, 14 bp, Homo sapiens
tgtaagagaaaata

SEQ ID NO: 6535510 - DNA, 17 bp, Homo sapiens
tgtaagagaatgttgaa

SEQ ID NO: 6535511 - DNA, 15 bp, Homo sapiens
tgtaagagacatgaa

SEQ ID NO: 6535512 - DNA, 23 bp, Homo sapiens
tgtaagagagatgagcacttcta

SEQ ID NO: 6535513 - DNA, 17 bp, Homo sapiens
tgtaagagctatacagt

SEQ ID NO: 6535514 - DNA, 21 bp, Homo sapiens
tgtaagaggctgacttttcca

SEQ ID NO: 6535515 - DNA, 15 bp, Homo sapiens
tgtaagagtgtagaa

SEQ ID NO: 6535516 - DNA, 20 bp, Homo sapiens
tgtaagatcgttctctgcct

SEQ ID NO: 6535517 - DNA, 15 bp, Homo sapiens
tgtaagatggcaact

SEQ ID NO: 6535518 - DNA, 19 bp, Homo sapiens
tgtaagattatagattcta

SEQ ID NO: 6535519 - DNA, 19 bp, Homo sapiens
tgtaagattttattttcaa

SEQ ID NO: 6535520 - DNA, 16 bp, Homo sapiens
tgtaagattttgaaaa

SEQ ID NO: 6535521 - DNA, 23 bp, Homo sapiens
tgtaagcaacgggaacacctgct

SEQ ID NO: 6535522 - DNA, 17 bp, Homo sapiens
tgtaagcaacttgcttc

SEQ ID NO: 6535523 - DNA, 20 bp, Homo sapiens
tgtaagcaagtcacttaatc

SEQ ID NO: 6535524 - DNA, 17 bp, Homo sapiens
tgtaagcaattctaagt

SEQ ID NO: 6535525 - DNA, 21 bp, Homo sapiens
tgtaagcaattctaagtgaga

SEQ ID NO: 6535526 - DNA, 18 bp, Homo sapiens
tgtaagcactctggatga

SEQ ID NO: 6535527 - DNA, 22 bp, Homo sapiens
tgtaagcattctgagctgggct

SEQ ID NO: 6535528 - DNA, 20 bp, Homo sapiens
tgtaagcatttgtacatctt

SEQ ID NO: 6535529 - DNA, 13 bp, Homo sapiens
tgtaagccaaaga

SEQ ID NO: 6535530 - DNA, 21 bp, Homo sapiens
tgtaagccaaagaaatgaaca

SEQ ID NO: 6535531 - DNA, 22 bp, Homo sapiens
tgtaagccaaagaaatgaacat

SEQ ID NO: 6535532 - DNA, 12 bp, Homo sapiens
tgtaagccagag

SEQ ID NO: 6535533 - DNA, 18 bp, Homo sapiens
tgtaagccagagtcaaca

SEQ ID NO: 6535534 - DNA, 16 bp, Homo sapiens
tgtaagcccagcattt

SEQ ID NO: 6535535 - DNA, 14 bp, Homo sapiens
tgtaagcctgcaag

SEQ ID NO: 6535536 - DNA, 15 bp, Homo sapiens
tgtaagctataacat

SEQ ID NO: 6535537 - DNA, 19 bp, Homo sapiens
tgtaagctataacatattt

SEQ ID NO: 6535538 - DNA, 19 bp, Homo sapiens
tgtaagctctttgaaacaa

SEQ ID NO: 6535539 - DNA, 16 bp, Homo sapiens
tgtaagctgaaaatat

SEQ ID NO: 6535540 - DNA, 16 bp, Homo sapiens
tgtaagctgtgtccta

SEQ ID NO: 6535541 - DNA, 14 bp, Homo sapiens
tgtaagctgtttat

SEQ ID NO: 6535542 - DNA, 21 bp, Homo sapiens
tgtaagcttagattttctgta

SEQ ID NO: 6535543 - DNA, 22 bp, Homo sapiens
tgtaagcttagattttctgtaa

SEQ ID NO: 6535544 - DNA, 14 bp, Homo sapiens
tgtaagctttgttc

SEQ ID NO: 6535545 - DNA, 20 bp, Homo sapiens
tgtaagctttgttctgggag

SEQ ID NO: 6535546 - DNA, 14 bp, Homo sapiens
tgtaaggaaatgtt

SEQ ID NO: 6535547 - DNA, 21 bp, Homo sapiens
tgtaaggaactggaacacaca

SEQ ID NO: 6535548 - DNA, 14 bp, Homo sapiens
tgtaaggaagaggg

SEQ ID NO: 6535549 - DNA, 15 bp, Homo sapiens
tgtaaggaatgatta

SEQ ID NO: 6535550 - DNA, 16 bp, Homo sapiens
tgtaaggactcagtgt

SEQ ID NO: 6535551 - DNA, 19 bp, Homo sapiens
tgtaaggatccggaaagaa

SEQ ID NO: 6535552 - DNA, 21 bp, Homo sapiens
tgtaaggatccggaaagaaga

SEQ ID NO: 6535553 - DNA, 23 bp, Homo sapiens
tgtaaggattgcctttgtagtta

SEQ ID NO: 6535554 - DNA, 14 bp, Homo sapiens
tgtaaggcatgaag

SEQ ID NO: 6535555 - DNA, 11 bp, Homo sapiens
tgtaaggcctt

SEQ ID NO: 6535556 - DNA, 14 bp, Homo sapiens
tgtaaggctctaga

SEQ ID NO: 6535557 - DNA, 21 bp, Homo sapiens
tgtaaggctgtgtaagatttg

SEQ ID NO: 6535558 - DNA, 13 bp, Homo sapiens
tgtaagggcagtg

SEQ ID NO: 6535559 - DNA, 18 bp, Homo sapiens
tgtaagggccagaaatat

SEQ ID NO: 6535560 - DNA, 21 bp, Homo sapiens
tgtaagggccagaaatatctt

SEQ ID NO: 6535561 - DNA, 15 bp, Homo sapiens
tgtaagggctttaaa

SEQ ID NO: 6535562 - DNA, 22 bp, Homo sapiens
tgtaaggggaagagggaaatgt

SEQ ID NO: 6535563 - DNA, 17 bp, Homo sapiens
tgtaagggtctgttgta

SEQ ID NO: 6535564 - DNA, 20 bp, Homo sapiens
tgtaagggtctgttgtaaat

SEQ ID NO: 6535565 - DNA, 12 bp, Homo sapiens
tgtaaggtatat

SEQ ID NO: 6535566 - DNA, 23 bp, Homo sapiens
tgtaaggtcttcttgtgtcctga

SEQ ID NO: 6535567 - DNA, 14 bp, Homo sapiens
tgtaaggtctttgt

SEQ ID NO: 6535568 - DNA, 17 bp, Homo sapiens
tgtaaggtgcttgctcc

SEQ ID NO: 6535569 - DNA, 20 bp, Homo sapiens
tgtaaggtgcttgctcccca

SEQ ID NO: 6535570 - DNA, 22 bp, Homo sapiens
tgtaaggtgttcagtagagcta

SEQ ID NO: 6535571 - DNA, 15 bp, Homo sapiens
tgtaagtaacacagt

SEQ ID NO: 6535572 - DNA, 23 bp, Homo sapiens
tgtaagtaacacagtattatgcc

SEQ ID NO: 6535573 - DNA, 21 bp, Homo sapiens
tgtaagtaattgcatttctgc

SEQ ID NO: 6535574 - DNA, 16 bp, Homo sapiens
tgtaagtagcaaacag

SEQ ID NO: 6535575 - DNA, 15 bp, Homo sapiens
tgtaagtatgtgaaa

SEQ ID NO: 6535576 - DNA, 22 bp, Homo sapiens
tgtaagtcatctacttaataaa

SEQ ID NO: 6535577 - DNA, 16 bp, Homo sapiens
tgtaagtgtagctcaa

SEQ ID NO: 6535578 - DNA, 21 bp, Homo sapiens
tgtaagtgtgagtaagagctg

SEQ ID NO: 6535579 - DNA, 15 bp, Homo sapiens
tgtaagttatgtttt

SEQ ID NO: 6535580 - DNA, 20 bp, Homo sapiens
tgtaagttatgttttacatg

SEQ ID NO: 6535581 - DNA, 16 bp, Homo sapiens
tgtaagttgaagcaaa

SEQ ID NO: 6535582 - DNA, 19 bp, Homo sapiens
tgtaagttgagtggaatgt

SEQ ID NO: 6535583 - DNA, 14 bp, Homo sapiens
tgtaagttgggctt

SEQ ID NO: 6535584 - DNA, 19 bp, Homo sapiens
tgtaagttgggcttgctat

SEQ ID NO: 6535585 - DNA, 20 bp, Homo sapiens
tgtaagttgtacaaatgtat

SEQ ID NO: 6535586 - DNA, 19 bp, Homo sapiens
tgtaagtttatgtctaaag

SEQ ID NO: 6535587 - DNA, 19 bp, Homo sapiens
tgtaagtttcaggtgacat

SEQ ID NO: 6535588 - DNA, 13 bp, Homo sapiens
tgtaagtttgaat

SEQ ID NO: 6535589 - DNA, 12 bp, Homo sapiens
tgtaagtttgtg

SEQ ID NO: 6535590 - DNA, 13 bp, Homo sapiens
tgtaagtttgtgt

SEQ ID NO: 6535591 - DNA, 16 bp, Homo sapiens
tgtaataaaaatagtt

SEQ ID NO: 6535592 - DNA, 15 bp, Homo sapiens
tgtaataaaactgtt

SEQ ID NO: 6535593 - DNA, 13 bp, Homo sapiens
tgtaataaacagg

SEQ ID NO: 6535594 - DNA, 14 bp, Homo sapiens
tgtaataaaccctt

SEQ ID NO: 6535595 - DNA, 22 bp, Homo sapiens
tgtaataaacccttaactggca

SEQ ID NO: 6535596 - DNA, 20 bp, Homo sapiens
tgtaataaactcatttctag

SEQ ID NO: 6535597 - DNA, 13 bp, Homo sapiens
tgtaataaactct

SEQ ID NO: 6535598 - DNA, 14 bp, Homo sapiens
tgtaataaactctc

SEQ ID NO: 6535599 - DNA, 11 bp, Homo sapiens
tgtaataaagt

SEQ ID NO: 6535600 - DNA, 13 bp, Homo sapiens
tgtaataaagtga

SEQ ID NO: 6535601 - DNA, 23 bp, Homo sapiens
tgtaataaatctaggatgtgatg

SEQ ID NO: 6535602 - DNA, 15 bp, Homo sapiens
tgtaataaattcaaa

SEQ ID NO: 6535603 - DNA, 12 bp, Homo sapiens
tgtaataacaga

SEQ ID NO: 6535604 - DNA, 16 bp, Homo sapiens
tgtaataacatttaat

SEQ ID NO: 6535605 - DNA, 23 bp, Homo sapiens
tgtaataacatttaatttagata

SEQ ID NO: 6535606 - DNA, 18 bp, Homo sapiens
tgtaataactttcttacc

SEQ ID NO: 6535607 - DNA, 19 bp, Homo sapiens
tgtaataactttcttacca

SEQ ID NO: 6535608 - DNA, 13 bp, Homo sapiens
tgtaataagaaag

SEQ ID NO: 6535609 - DNA, 14 bp, Homo sapiens
tgtaataagaaagt

SEQ ID NO: 6535610 - DNA, 21 bp, Homo sapiens
tgtaataagacttagattgtg

SEQ ID NO: 6535611 - DNA, 21 bp, Homo sapiens
tgtaataataaaaccaaagaa

SEQ ID NO: 6535612 - DNA, 13 bp, Homo sapiens
tgtaataatacct

SEQ ID NO: 6535613 - DNA, 17 bp, Homo sapiens
tgtaataatgtaacatg

SEQ ID NO: 6535614 - DNA, 14 bp, Homo sapiens
tgtaataattgctc

SEQ ID NO: 6535615 - DNA, 13 bp, Homo sapiens
tgtaatacacata

SEQ ID NO: 6535616 - DNA, 18 bp, Homo sapiens
tgtaatacagacaaactt

SEQ ID NO: 6535617 - DNA, 20 bp, Homo sapiens
tgtaatactggaataatttg

SEQ ID NO: 6535618 - DNA, 17 bp, Homo sapiens
tgtaatacttaaataaa

SEQ ID NO: 6535619 - DNA, 22 bp, Homo sapiens
tgtaatacttaaataaacatga

SEQ ID NO: 6535620 - DNA, 20 bp, Homo sapiens
tgtaatagaataaaggcctg

SEQ ID NO: 6535621 - DNA, 18 bp, Homo sapiens
tgtaatagatgtttgata

SEQ ID NO: 6535622 - DNA, 13 bp, Homo sapiens
tgtaatagtccat

SEQ ID NO: 6535623 - DNA, 18 bp, Homo sapiens
tgtaatagtggctttcat

SEQ ID NO: 6535624 - DNA, 14 bp, Homo sapiens
tgtaatagttcagt

SEQ ID NO: 6535625 - DNA, 17 bp, Homo sapiens
tgtaatataaagatgtt

SEQ ID NO: 6535626 - DNA, 17 bp, Homo sapiens
tgtaatataaagtattc

SEQ ID NO: 6535627 - DNA, 21 bp, Homo sapiens
tgtaatataaagtattcaaca

SEQ ID NO: 6535628 - DNA, 23 bp, Homo sapiens
tgtaatataaagtattcaacaat

SEQ ID NO: 6535629 - DNA, 20 bp, Homo sapiens
tgtaatataatgagtcacaa

SEQ ID NO: 6535630 - DNA, 21 bp, Homo sapiens
tgtaatataatgagtcacaaa

SEQ ID NO: 6535631 - DNA, 15 bp, Homo sapiens
tgtaatataatgtat

SEQ ID NO: 6535632 - DNA, 13 bp, Homo sapiens
tgtaatatattgc

SEQ ID NO: 6535633 - DNA, 19 bp, Homo sapiens
tgtaatatcagttacagtg

SEQ ID NO: 6535634 - DNA, 21 bp, Homo sapiens
tgtaatatcagttacagtggc

SEQ ID NO: 6535635 - DNA, 23 bp, Homo sapiens
tgtaatatcagttacagtggcag

SEQ ID NO: 6535636 - DNA, 14 bp, Homo sapiens
tgtaatatcatttc

SEQ ID NO: 6535637 - DNA, 13 bp, Homo sapiens
tgtaatatgaaat

SEQ ID NO: 6535638 - DNA, 12 bp, Homo sapiens
tgtaatatgaca

SEQ ID NO: 6535639 - DNA, 15 bp, Homo sapiens
tgtaatatgacagat

SEQ ID NO: 6535640 - DNA, 15 bp, Homo sapiens
tgtaatatgagaatg

SEQ ID NO: 6535641 - DNA, 19 bp, Homo sapiens
tgtaatattaaaaagaagt

SEQ ID NO: 6535642 - DNA, 14 bp, Homo sapiens
tgtaatattatata

SEQ ID NO: 6535643 - DNA, 19 bp, Homo sapiens
tgtaatattcattcaaaag

SEQ ID NO: 6535644 - DNA, 20 bp, Homo sapiens
tgtaatattctctgatgttt

SEQ ID NO: 6535645 - DNA, 17 bp, Homo sapiens
tgtaatattgagggata

SEQ ID NO: 6535646 - DNA, 14 bp, Homo sapiens
tgtaatattgtaaa

SEQ ID NO: 6535647 - DNA, 20 bp, Homo sapiens
tgtaatattgtaaatactgg

SEQ ID NO: 6535648 - DNA, 21 bp, Homo sapiens
tgtaatattgtaaatactgga

SEQ ID NO: 6535649 - DNA, 18 bp, Homo sapiens
ttccttatcctagccttt

SEQ ID NO: 6535650 - DNA, 21 bp, Homo sapiens
ttccttatgggatcatttttc

SEQ ID NO: 6535651 - DNA, 22 bp, Homo sapiens
ttccttatgggatcatttttcc

SEQ ID NO: 6535652 - DNA, 16 bp, Homo sapiens
ttccttattgtttgta

SEQ ID NO: 6535653 - DNA, 16 bp, Homo sapiens
ttccttatttctctct

SEQ ID NO: 6535654 - DNA, 22 bp, Homo sapiens
ttccttatttctctctcctggt

SEQ ID NO: 6535655 - DNA, 15 bp, Homo sapiens
ttccttattttcata

SEQ ID NO: 6535656 - DNA, 14 bp, Homo sapiens
ttccttcaaataaa

SEQ ID NO: 6535657 - DNA, 17 bp, Homo sapiens
ttccttcaaataaagaa

SEQ ID NO: 6535658 - DNA, 13 bp, Homo sapiens
ttccttcaaccac

SEQ ID NO: 6535659 - DNA, 23 bp, Homo sapiens
ttccttcaccacctcatgtcatt

SEQ ID NO: 6535660 - DNA, 21 bp, Homo sapiens
ttccttcacccaccaccccca

SEQ ID NO: 6535661 - DNA, 15 bp, Homo sapiens
ttccttcaggcagct

SEQ ID NO: 6535662 - DNA, 20 bp, Homo sapiens
ttccttcaggcagctgaaat

SEQ ID NO: 6535663 - DNA, 21 bp, Homo sapiens
ttccttcaggcagctgaaatt

SEQ ID NO: 6535664 - DNA, 13 bp, Homo sapiens
ttccttcagggtt

SEQ ID NO: 6535665 - DNA, 16 bp, Homo sapiens
ttccttcagggtttaa

SEQ ID NO: 6535666 - DNA, 22 bp, Homo sapiens
ttccttcagggtttaatagact

SEQ ID NO: 6535667 - DNA, 17 bp, Homo sapiens
ttccttcagtgaagaac

SEQ ID NO: 6535668 - DNA, 22 bp, Homo sapiens
ttccttcagtgcatctgggaag

SEQ ID NO: 6535669 - DNA, 21 bp, Homo sapiens
ttccttcatttccaccaggcc

SEQ ID NO: 6535670 - DNA, 21 bp, Homo sapiens
ttccttccaatgtctggagac

SEQ ID NO: 6535671 - DNA, 19 bp, Homo sapiens
ttccttccacagttatctt

SEQ ID NO: 6535672 - DNA, 21 bp, Homo sapiens
ttccttccactgtagctatta

SEQ ID NO: 6535673 - DNA, 15 bp, Homo sapiens
ttccttccagcccat

SEQ ID NO: 6535674 - DNA, 20 bp, Homo sapiens
ttccttccatccctaccccc

SEQ ID NO: 6535675 - DNA, 21 bp, Homo sapiens
ttccttccatgctcccaactc

SEQ ID NO: 6535676 - DNA, 12 bp, Homo sapiens
ttccttcccacc

SEQ ID NO: 6535677 - DNA, 21 bp, Homo sapiens
ttccttcccacccatcgctgt

SEQ ID NO: 6535678 - DNA, 13 bp, Homo sapiens
ttccttcccaggc

SEQ ID NO: 6535679 - DNA, 14 bp, Homo sapiens
ttccttcccaggcc

SEQ ID NO: 6535680 - DNA, 21 bp, Homo sapiens
ttccttcccaggccctttggc

SEQ ID NO: 6535681 - DNA, 22 bp, Homo sapiens
ttccttcccaggccctttggct

SEQ ID NO: 6535682 - DNA, 22 bp, Homo sapiens
ttccttcccgccagagggcttg

SEQ ID NO: 6535683 - DNA, 15 bp, Homo sapiens
ttccttccctctcct

SEQ ID NO: 6535684 - DNA, 19 bp, Homo sapiens
ttccttccctgctgtgaaa

SEQ ID NO: 6535685 - DNA, 21 bp, Homo sapiens
ttccttccctgctgtgaaaga

SEQ ID NO: 6535686 - DNA, 13 bp, Homo sapiens
ttccttccctggc

SEQ ID NO: 6535687 - DNA, 16 bp, Homo sapiens
ttccttccctgggctg

SEQ ID NO: 6535688 - DNA, 20 bp, Homo sapiens
ttccttccctgggctgtgct

SEQ ID NO: 6535689 - DNA, 19 bp, Homo sapiens
ttccttccgctcctttacc

SEQ ID NO: 6535690 - DNA, 20 bp, Homo sapiens
ttccttccgctcctttacct

SEQ ID NO: 6535691 - DNA, 12 bp, Homo sapiens
ttccttcctgag

SEQ ID NO: 6535692 - DNA, 20 bp, Homo sapiens
ttccttcctgccctgtacct

SEQ ID NO: 6535693 - DNA, 14 bp, Homo sapiens
ttccttccttccct

SEQ ID NO: 6535694 - DNA, 11 bp, Homo sapiens
ttccttccttt

SEQ ID NO: 6535695 - DNA, 19 bp, Homo sapiens
ttccttcgaaaggccttca

SEQ ID NO: 6535696 - DNA, 20 bp, Homo sapiens
ttccttcgaaaggccttcag

SEQ ID NO: 6535697 - DNA, 18 bp, Homo sapiens
ttccttcggtcttttgta

SEQ ID NO: 6535698 - DNA, 19 bp, Homo sapiens
ttccttcggtcttttgtat

SEQ ID NO: 6535699 - DNA, 17 bp, Homo sapiens
ttccttctcacttagaa

SEQ ID NO: 6535700 - DNA, 13 bp, Homo sapiens
ttccttctcagca

SEQ ID NO: 6535701 - DNA, 12 bp, Homo sapiens
ttccttctcgtc

SEQ ID NO: 6535702 - DNA, 11 bp, Homo sapiens
ttccttctctg

SEQ ID NO: 6535703 - DNA, 14 bp, Homo sapiens
ttccttctctgggt

SEQ ID NO: 6535704 - DNA, 21 bp, Homo sapiens
ttccttctgctcccaccccag

SEQ ID NO: 6535705 - DNA, 17 bp, Homo sapiens
ttccttctgtagcctga

SEQ ID NO: 6535706 - DNA, 18 bp, Homo sapiens
ttccttctgtgaagaagc

SEQ ID NO: 6535707 - DNA, 13 bp, Homo sapiens
ttccttctgttaa

SEQ ID NO: 6535708 - DNA, 21 bp, Homo sapiens
ttccttctgttaagaaaggat

SEQ ID NO: 6535709 - DNA, 17 bp, Homo sapiens
ttccttctgttgctggt

SEQ ID NO: 6535710 - DNA, 12 bp, Homo sapiens
ttccttcttccc

SEQ ID NO: 6535711 - DNA, 12 bp, Homo sapiens
ttccttctttga

SEQ ID NO: 6535712 - DNA, 13 bp, Homo sapiens
ttccttctttgat

SEQ ID NO: 6535713 - DNA, 19 bp, Homo sapiens
ttccttctttgataatgtt

SEQ ID NO: 6535714 - DNA, 19 bp, Homo sapiens
ttccttgaaatttctcagc

SEQ ID NO: 6535715 - DNA, 13 bp, Homo sapiens
ttccttgaagccg

SEQ ID NO: 6535716 - DNA, 15 bp, Homo sapiens
ttccttgaccttcct

SEQ ID NO: 6535717 - DNA, 24 bp, Homo sapiens
ttccttgagacacggagcccagcc

SEQ ID NO: 6535718 - DNA, 15 bp, Homo sapiens
ttccttgaggacaga

SEQ ID NO: 6535719 - DNA, 22 bp, Homo sapiens
ttccttgaggggagccaggagg

SEQ ID NO: 6535720 - DNA, 23 bp, Homo sapiens
ttccttgaggggagccaggaggg

SEQ ID NO: 6535721 - DNA, 18 bp, Homo sapiens
ttccttgaggggcagttt

SEQ ID NO: 6535722 - DNA, 16 bp, Homo sapiens
ttccttgatcattttg

SEQ ID NO: 6535723 - DNA, 16 bp, Homo sapiens
ttccttgccacaatca

SEQ ID NO: 6535724 - DNA, 12 bp, Homo sapiens
ttccttgccagt

SEQ ID NO: 6535725 - DNA, 15 bp, Homo sapiens
ttccttgccagtctt

SEQ ID NO: 6535726 - DNA, 16 bp, Homo sapiens
ttccttgccccacagt

SEQ ID NO: 6535727 - DNA, 14 bp, Homo sapiens
ttccttgcccctgc

SEQ ID NO: 6535728 - DNA, 13 bp, Homo sapiens
ttccttgcctgca

SEQ ID NO: 6535729 - DNA, 19 bp, Homo sapiens
ttccttgcctgcacaaact

SEQ ID NO: 6535730 - DNA, 15 bp, Homo sapiens
ttccttgcgcctcag

SEQ ID NO: 6535731 - DNA, 15 bp, Homo sapiens
ttccttgctcaacca

SEQ ID NO: 6535732 - DNA, 12 bp, Homo sapiens
ttccttgctttt

SEQ ID NO: 6535733 - DNA, 14 bp, Homo sapiens
ttccttgcttttat

SEQ ID NO: 6535734 - DNA, 23 bp, Homo sapiens
ttccttggaagggggctctttta

SEQ ID NO: 6535735 - DNA, 23 bp, Homo sapiens
ttccttggataggctttttagta

SEQ ID NO: 6535736 - DNA, 17 bp, Homo sapiens
ttccttggcccagcagc

SEQ ID NO: 6535737 - DNA, 15 bp, Homo sapiens
ttccttggctttatg

SEQ ID NO: 6535738 - DNA, 18 bp, Homo sapiens
ttccttgggcgtctcccc

SEQ ID NO: 6535739 - DNA, 12 bp, Homo sapiens
ttccttggggaa

SEQ ID NO: 6535740 - DNA, 13 bp, Homo sapiens
ttccttggggggc

SEQ ID NO: 6535741 - DNA, 23 bp, Homo sapiens
ttccttggtcctagtaagaagac

SEQ ID NO: 6535742 - DNA, 14 bp, Homo sapiens
ttccttggtttgga

SEQ ID NO: 6535743 - DNA, 18 bp, Homo sapiens
ttccttgtactcttagga

SEQ ID NO: 6535744 - DNA, 18 bp, Homo sapiens
ttccttgtagccttttga

SEQ ID NO: 6535745 - DNA, 19 bp, Homo sapiens
ttccttgtagccttttgac

SEQ ID NO: 6535746 - DNA, 20 bp, Homo sapiens
ttccttgtagcgactaaact

SEQ ID NO: 6535747 - DNA, 13 bp, Homo sapiens
ttccttgtcacca

SEQ ID NO: 6535748 - DNA, 21 bp, Homo sapiens
ttccttgtccccacactccta

SEQ ID NO: 6535749 - DNA, 13 bp, Homo sapiens
ttccttgtcccgt

SEQ ID NO: 6535750 - DNA, 12 bp, Homo sapiens
ttccttgtctct

SEQ ID NO: 6535751 - DNA, 14 bp, Homo sapiens
ttccttgtctctca

SEQ ID NO: 6535752 - DNA, 15 bp, Homo sapiens
ttccttgtctctcat

SEQ ID NO: 6535753 - DNA, 16 bp, Homo sapiens
ttccttgtcttgataa

SEQ ID NO: 6535754 - DNA, 13 bp, Homo sapiens
ttccttgtgcaaa

SEQ ID NO: 6535755 - DNA, 18 bp, Homo sapiens
ttccttgtgcctgctcct

SEQ ID NO: 6535756 - DNA, 19 bp, Homo sapiens
ttccttgttacccatgaaa

SEQ ID NO: 6535757 - DNA, 20 bp, Homo sapiens
ttccttgttacccatgaaaa

SEQ ID NO: 6535758 - DNA, 13 bp, Homo sapiens
ttccttgttcagc

SEQ ID NO: 6535759 - DNA, 18 bp, Homo sapiens
ttccttgttcttcccttc

SEQ ID NO: 6535760 - DNA, 19 bp, Homo sapiens
ttccttgttggtcagagga

SEQ ID NO: 6535761 - DNA, 19 bp, Homo sapiens
ttccttgttgtttgctttg

SEQ ID NO: 6535762 - DNA, 22 bp, Homo sapiens
ttccttgtttatggggctctca

SEQ ID NO: 6535763 - DNA, 12 bp, Homo sapiens
ttccttgttttc

SEQ ID NO: 6535764 - DNA, 12 bp, Homo sapiens
ttcctttaaaaa

SEQ ID NO: 6535765 - DNA, 17 bp, Homo sapiens
ttcctttaaaaatacat

SEQ ID NO: 6535766 - DNA, 16 bp, Homo sapiens
ttcctttaaaatatat

SEQ ID NO: 6535767 - DNA, 18 bp, Homo sapiens
ttcctttaacaacatgtt

SEQ ID NO: 6535768 - DNA, 19 bp, Homo sapiens
ttcctttaacctttgctgt

SEQ ID NO: 6535769 - DNA, 18 bp, Homo sapiens
ttcctttacaactaaata

SEQ ID NO: 6535770 - DNA, 20 bp, Homo sapiens
ttcctttacaactaaataac

SEQ ID NO: 6535771 - DNA, 14 bp, Homo sapiens
ttcctttacctttt

SEQ ID NO: 6535772 - DNA, 16 bp, Homo sapiens
ttcctttactcctggc

SEQ ID NO: 6535773 - DNA, 16 bp, Homo sapiens
ttcctttactttccct

SEQ ID NO: 6535774 - DNA, 15 bp, Homo sapiens
ttcctttatgattct

SEQ ID NO: 6535775 - DNA, 19 bp, Homo sapiens
ttcctttatgtgaattttt

SEQ ID NO: 6535776 - DNA, 14 bp, Homo sapiens
ttcctttatgtgat

SEQ ID NO: 6535777 - DNA, 16 bp, Homo sapiens
ttcctttatgttctca

SEQ ID NO: 6535778 - DNA, 20 bp, Homo sapiens
ttcctttatttaggaaacac

SEQ ID NO: 6535779 - DNA, 20 bp, Homo sapiens
ttcctttcaataaagttgtt

SEQ ID NO: 6535780 - DNA, 21 bp, Homo sapiens
ttcctttcaataaagttgttg

SEQ ID NO: 6535781 - DNA, 13 bp, Homo sapiens
ttcctttcagatt

SEQ ID NO: 6535782 - DNA, 15 bp, Homo sapiens
ttcctttcatacctt

SEQ ID NO: 6535783 - DNA, 18 bp, Homo sapiens
ttcctttcatcctcagca

SEQ ID NO: 6535784 - DNA, 20 bp, Homo sapiens
ttcctttcatctctctacct

SEQ ID NO: 6535785 - DNA, 16 bp, Homo sapiens
ttcctttcatttactg

SEQ ID NO: 6535786 - DNA, 21 bp, Homo sapiens
ttcctttcatttactgtggct

SEQ ID NO: 6535787 - DNA, 14 bp, Homo sapiens
ttcctttccccagc

SEQ ID NO: 6535788 - DNA, 17 bp, Homo sapiens
ttcctttccccagccca

SEQ ID NO: 6535789 - DNA, 14 bp, Homo sapiens
ttcctttccctgga

SEQ ID NO: 6535790 - DNA, 12 bp, Homo sapiens
ttcctttccctt

SEQ ID NO: 6535791 - DNA, 13 bp, Homo sapiens
ttcctttcccttc

SEQ ID NO: 6535792 - DNA, 14 bp, Homo sapiens
ttcctttcccttcc

SEQ ID NO: 6535793 - DNA, 18 bp, Homo sapiens
ttcctttcccttcctctt

SEQ ID NO: 6535794 - DNA, 19 bp, Homo sapiens
ttcctttcctactgtcctg

SEQ ID NO: 6535795 - DNA, 15 bp, Homo sapiens
ttcctttcctctgca

SEQ ID NO: 6535796 - DNA, 23 bp, Homo sapiens
ttcctttcctgtgtgtactctgt

SEQ ID NO: 6535797 - DNA, 14 bp, Homo sapiens
ttcctttcctttca

SEQ ID NO: 6535798 - DNA, 14 bp, Homo sapiens
ttcctttccttttc

SEQ ID NO: 6535799 - DNA, 16 bp, Homo sapiens
ttcctttctaaatctg

SEQ ID NO: 6535800 - DNA, 10 bp, Homo sapiens
ttcctttctc

SEQ ID NO: 6535801 - DNA, 17 bp, Homo sapiens
ttcctttctcctgcccc

SEQ ID NO: 6535802 - DNA, 14 bp, Homo sapiens
ttcctttctggccc

SEQ ID NO: 6535803 - DNA, 12 bp, Homo sapiens
ttcctttcttga

SEQ ID NO: 6535804 - DNA, 17 bp, Homo sapiens
ttcctttcttttccccc

SEQ ID NO: 6535805 - DNA, 22 bp, Homo sapiens
ttcctttgacctctcacttttt

SEQ ID NO: 6535806 - DNA, 14 bp, Homo sapiens
ttcctttgcaccct

SEQ ID NO: 6535807 - DNA, 16 bp, Homo sapiens
ttcctttgcaccctgt

SEQ ID NO: 6535808 - DNA, 18 bp, Homo sapiens
ttcctttgcaccctgtag

SEQ ID NO: 6535809 - DNA, 13 bp, Homo sapiens
ttcctttgcattc

SEQ ID NO: 6535810 - DNA, 14 bp, Homo sapiens
ttcctttgctagtt

SEQ ID NO: 6535811 - DNA, 17 bp, Homo sapiens
ttcctttgggcctctgc

SEQ ID NO: 6535812 - DNA, 23 bp, Homo sapiens
ttcctttgggtatgttaacctag

SEQ ID NO: 6535813 - DNA, 14 bp, Homo sapiens
ttcctttgtcattt

SEQ ID NO: 6535814 - DNA, 13 bp, Homo sapiens
ttcctttgtgtgt

SEQ ID NO: 6535815 - DNA, 17 bp, Homo sapiens
ttcctttgttgtctaca

SEQ ID NO: 6535816 - DNA, 20 bp, Homo sapiens
ttccttttaaaacacttcca

SEQ ID NO: 6535817 - DNA, 21 bp, Homo sapiens
ttccttttaaagaagctttat

SEQ ID NO: 6535818 - DNA, 22 bp, Homo sapiens
ttccttttacttttcttctatt

SEQ ID NO: 6535819 - DNA, 21 bp, Homo sapiens
ttccttttagagttaagaact

SEQ ID NO: 6535820 - DNA, 16 bp, Homo sapiens
ttccttttattcacat

SEQ ID NO: 6535821 - DNA, 20 bp, Homo sapiens
ttccttttattctgtacctt

SEQ ID NO: 6535822 - DNA, 13 bp, Homo sapiens
ttccttttcactg

SEQ ID NO: 6535823 - DNA, 16 bp, Homo sapiens
ttccttttcactgctg

SEQ ID NO: 6535824 - DNA, 15 bp, Homo sapiens
ttccttttcaggaga

SEQ ID NO: 6535825 - DNA, 16 bp, Homo sapiens
ttccttttcaggagat

SEQ ID NO: 6535826 - DNA, 15 bp, Homo sapiens
ttccttttccctgct

SEQ ID NO: 6535827 - DNA, 17 bp, Homo sapiens
ttccttttccctgcttc

SEQ ID NO: 6535828 - DNA, 16 bp, Homo sapiens
ttccttttcttccttc

SEQ ID NO: 6535829 - DNA, 17 bp, Homo sapiens
ttccttttcttccttct

SEQ ID NO: 6535830 - DNA, 17 bp, Homo sapiens
tgtaatatttacaatgt

SEQ ID NO: 6535831 - DNA, 21 bp, Homo sapiens
tgtaatatttacataaagact

SEQ ID NO: 6535832 - DNA, 16 bp, Homo sapiens
tgtaatatttagctgt

SEQ ID NO: 6535833 - DNA, 16 bp, Homo sapiens
tgtaatatttgaattt

SEQ ID NO: 6535834 - DNA, 17 bp, Homo sapiens
tgtaatatttgaatttt

SEQ ID NO: 6535835 - DNA, 17 bp, Homo sapiens
tgtaatattttgtatta

SEQ ID NO: 6535836 - DNA, 18 bp, Homo sapiens
tgtaatcacaactcagca

SEQ ID NO: 6535837 - DNA, 17 bp, Homo sapiens
tgtaatcacactctctt

SEQ ID NO: 6535838 - DNA, 20 bp, Homo sapiens
tgtaatcacactctcttctt

SEQ ID NO: 6535839 - DNA, 23 bp, Homo sapiens
tgtaatcacactctcttcttact

SEQ ID NO: 6535840 - DNA, 15 bp, Homo sapiens
tgtaatcactcccat

SEQ ID NO: 6535841 - DNA, 16 bp, Homo sapiens
tgtaatcagctctcct

SEQ ID NO: 6535842 - DNA, 18 bp, Homo sapiens
tgtaatcagctctcctgg

SEQ ID NO: 6535843 - DNA, 20 bp, Homo sapiens
tgtaatcagctctcctggct

SEQ ID NO: 6535844 - DNA, 22 bp, Homo sapiens
tgtaatcagctctcctggctcc

SEQ ID NO: 6535845 - DNA, 18 bp, Homo sapiens
tgtaatcaggcaaggagg

SEQ ID NO: 6535846 - DNA, 19 bp, Homo sapiens
tgtaatcaggcaaggagga

SEQ ID NO: 6535847 - DNA, 21 bp, Homo sapiens
tgtaatcaggcaaggaggagg

SEQ ID NO: 6535848 - DNA, 22 bp, Homo sapiens
tgtaatcaggcaaggaggagga

SEQ ID NO: 6535849 - DNA, 16 bp, Homo sapiens
tgtaatcataaatact

SEQ ID NO: 6535850 - DNA, 23 bp, Homo sapiens
tgtaatcattatctcactttgta

SEQ ID NO: 6535851 - DNA, 19 bp, Homo sapiens
tgtaatcatttgtttacat

SEQ ID NO: 6535852 - DNA, 20 bp, Homo sapiens
tgtaatcattttaaattcca

SEQ ID NO: 6535853 - DNA, 15 bp, Homo sapiens
tgtaatcccagaact

SEQ ID NO: 6535854 - DNA, 15 bp, Homo sapiens
tgtaatcccagcact

SEQ ID NO: 6535855 - DNA, 23 bp, Homo sapiens
tgtaatcccagcactttgggagg

SEQ ID NO: 6535856 - DNA, 16 bp, Homo sapiens
tgtaatcccagctact

SEQ ID NO: 6535857 - DNA, 21 bp, Homo sapiens
tgtaatcccagctactcagga

SEQ ID NO: 6535858 - DNA, 13 bp, Homo sapiens
tgtaatcccccag

SEQ ID NO: 6535859 - DNA, 19 bp, Homo sapiens
tgtaatcctgtatattatg

SEQ ID NO: 6535860 - DNA, 21 bp, Homo sapiens
tgtaatcgttatgtgtgtata

SEQ ID NO: 6535861 - DNA, 16 bp, Homo sapiens
tgtaatctatgtatat

SEQ ID NO: 6535862 - DNA, 13 bp, Homo sapiens
tgtaatctatgtt

SEQ ID NO: 6535863 - DNA, 13 bp, Homo sapiens
tgtaatctcaatg

SEQ ID NO: 6535864 - DNA, 19 bp, Homo sapiens
tgtaatctcaatgcaagcc

SEQ ID NO: 6535865 - DNA, 14 bp, Homo sapiens
tgtaatctctctgc

SEQ ID NO: 6535866 - DNA, 17 bp, Homo sapiens
tgtaatctctctgcagc

SEQ ID NO: 6535867 - DNA, 18 bp, Homo sapiens
tgtaatctctctgcagct

SEQ ID NO: 6535868 - DNA, 19 bp, Homo sapiens
tgtaatctctgattaaatt

SEQ ID NO: 6535869 - DNA, 14 bp, Homo sapiens
tgtaatctgaagta

SEQ ID NO: 6535870 - DNA, 12 bp, Homo sapiens
tgtaatcttaaa

SEQ ID NO: 6535871 - DNA, 20 bp, Homo sapiens
tgtaatcttatttaggaagt

SEQ ID NO: 6535872 - DNA, 21 bp, Homo sapiens
tgtaatcttgaattgtaactg

SEQ ID NO: 6535873 - DNA, 14 bp, Homo sapiens
tgtaatcttgttga

SEQ ID NO: 6535874 - DNA, 13 bp, Homo sapiens
tgtaatgaaaacc

SEQ ID NO: 6535875 - DNA, 23 bp, Homo sapiens
tgtaatgaaaatgatgtagacat

SEQ ID NO: 6535876 - DNA, 18 bp, Homo sapiens
tgtaatgaaattccagat

SEQ ID NO: 6535877 - DNA, 15 bp, Homo sapiens
tgtaatgaatacctt

SEQ ID NO: 6535878 - DNA, 20 bp, Homo sapiens
tgtaatgaatctaagcagca

SEQ ID NO: 6535879 - DNA, 22 bp, Homo sapiens
tgtaatgaatttgtcgcaaaga

SEQ ID NO: 6535880 - DNA, 15 bp, Homo sapiens
tgtaatgacaccaca

SEQ ID NO: 6535881 - DNA, 16 bp, Homo sapiens
tgtaatgacagagagt

SEQ ID NO: 6535882 - DNA, 21 bp, Homo sapiens
tgtaatgactgagatttgtaa

SEQ ID NO: 6535883 - DNA, 12 bp, Homo sapiens
tgtaatgcaaaa

SEQ ID NO: 6535884 - DNA, 13 bp, Homo sapiens
tgtaatgcacaat

SEQ ID NO: 6535885 - DNA, 20 bp, Homo sapiens
tgtaatgcacaatttagaaa

SEQ ID NO: 6535886 - DNA, 12 bp, Homo sapiens
tgtaatgcactg

SEQ ID NO: 6535887 - DNA, 22 bp, Homo sapiens
tgtaatgcattaataaaaatca

SEQ ID NO: 6535888 - DNA, 20 bp, Homo sapiens
tgtaatgccaatatgacaca

SEQ ID NO: 6535889 - DNA, 22 bp, Homo sapiens
tgtaatgcgattttattactgg

SEQ ID NO: 6535890 - DNA, 12 bp, Homo sapiens
tgtaatgctgca

SEQ ID NO: 6535891 - DNA, 14 bp, Homo sapiens
tgtaatgctgcact

SEQ ID NO: 6535892 - DNA, 20 bp, Homo sapiens
tgtaatgctgcacttcctgt

SEQ ID NO: 6535893 - DNA, 15 bp, Homo sapiens
tgtaatgcttatgtg

SEQ ID NO: 6535894 - DNA, 17 bp, Homo sapiens
tgtaatggaactgaccc

SEQ ID NO: 6535895 - DNA, 17 bp, Homo sapiens
tgtaatggactatgcac

SEQ ID NO: 6535896 - DNA, 22 bp, Homo sapiens
tgtaatgggatctatttttgca

SEQ ID NO: 6535897 - DNA, 21 bp, Homo sapiens
tgtaatggtactgactttgct

SEQ ID NO: 6535898 - DNA, 13 bp, Homo sapiens
tgtaatggtgctt

SEQ ID NO: 6535899 - DNA, 18 bp, Homo sapiens
tgtaatgtaaaccagaaa

SEQ ID NO: 6535900 - DNA, 15 bp, Homo sapiens
tgtaatgtaactgct

SEQ ID NO: 6535901 - DNA, 21 bp, Homo sapiens
tgtaatgtagcgtgtttacat

SEQ ID NO: 6535902 - DNA, 20 bp, Homo sapiens
tgtaatgtaggggaaagttt

SEQ ID NO: 6535903 - DNA, 18 bp, Homo sapiens
tgtaatgtatacttgaaa

SEQ ID NO: 6535904 - DNA, 21 bp, Homo sapiens
tgtaatgtatcttatttatat

SEQ ID NO: 6535905 - DNA, 20 bp, Homo sapiens
tgtaatgtcaccaccttccc

SEQ ID NO: 6535906 - DNA, 19 bp, Homo sapiens
tgtaatgtcttgagctcta

SEQ ID NO: 6535907 - DNA, 17 bp, Homo sapiens
tgtaatgtgaaaagtat

SEQ ID NO: 6535908 - DNA, 14 bp, Homo sapiens
tgtaatgtgaatct

SEQ ID NO: 6535909 - DNA, 13 bp, Homo sapiens
tgtaatgtgactt

SEQ ID NO: 6535910 - DNA, 16 bp, Homo sapiens
tgtaatgtgtatgtct

SEQ ID NO: 6535911 - DNA, 23 bp, Homo sapiens
tgtaatgtgtgaaaaagatgcca

SEQ ID NO: 6535912 - DNA, 18 bp, Homo sapiens
tgtaatgtgtggtggcct

SEQ ID NO: 6535913 - DNA, 21 bp, Homo sapiens
tgtaatgtgtggtggcctcag

SEQ ID NO: 6535914 - DNA, 22 bp, Homo sapiens
tgtaatgtgtggtggcctcagc

SEQ ID NO: 6535915 - DNA, 17 bp, Homo sapiens
tgtaatgttaatattga

SEQ ID NO: 6535916 - DNA, 18 bp, Homo sapiens
tgtaatgttaatattgat

SEQ ID NO: 6535917 - DNA, 14 bp, Homo sapiens
tgtaatgttactga

SEQ ID NO: 6535918 - DNA, 22 bp, Homo sapiens
tgtaatgttactgatcatgcat

SEQ ID NO: 6535919 - DNA, 14 bp, Homo sapiens
tgtaatgttgcttt

SEQ ID NO: 6535920 - DNA, 14 bp, Homo sapiens
tgtaatgttgtgaa

SEQ ID NO: 6535921 - DNA, 16 bp, Homo sapiens
tgtaatgtttgttacc

SEQ ID NO: 6535922 - DNA, 21 bp, Homo sapiens
tgtaatgttttctttgcaaag

SEQ ID NO: 6535923 - DNA, 23 bp, Homo sapiens
tgtaatgtttttatttcaattgt

SEQ ID NO: 6535924 - DNA, 22 bp, Homo sapiens
tgtaattaaactagtttaaggg

SEQ ID NO: 6535925 - DNA, 13 bp, Homo sapiens
tgtaattaaattt

SEQ ID NO: 6535926 - DNA, 14 bp, Homo sapiens
tgtaattaaatttt

SEQ ID NO: 6535927 - DNA, 16 bp, Homo sapiens
tgtaattaaattttta

SEQ ID NO: 6535928 - DNA, 14 bp, Homo sapiens
tgtaattaactgta

SEQ ID NO: 6535929 - DNA, 17 bp, Homo sapiens
tgtaattaactgtaaac

SEQ ID NO: 6535930 - DNA, 19 bp, Homo sapiens
tgtaattaactgtaaactt

SEQ ID NO: 6535931 - DNA, 20 bp, Homo sapiens
tgtaattaagtaaaccaaaa

SEQ ID NO: 6535932 - DNA, 21 bp, Homo sapiens
tgtaattaagtactatgtatc

SEQ ID NO: 6535933 - DNA, 22 bp, Homo sapiens
tgtaattaataactttctctgt

SEQ ID NO: 6535934 - DNA, 24 bp, Homo sapiens
tgtaattaataactttctctgtga

SEQ ID NO: 6535935 - DNA, 15 bp, Homo sapiens
tgtaattacaactaa

SEQ ID NO: 6535936 - DNA, 17 bp, Homo sapiens
tgtaattacaactaaat

SEQ ID NO: 6535937 - DNA, 20 bp, Homo sapiens
tgtaattacaggagggaaca

SEQ ID NO: 6535938 - DNA, 20 bp, Homo sapiens
tgtaattagagattgacttc

SEQ ID NO: 6535939 - DNA, 12 bp, Homo sapiens
tgtaattatata

SEQ ID NO: 6535940 - DNA, 13 bp, Homo sapiens
tgtaattatatct

SEQ ID NO: 6535941 - DNA, 12 bp, Homo sapiens
tgtaattatcta

SEQ ID NO: 6535942 - DNA, 15 bp, Homo sapiens
tgtaattatgatttg

SEQ ID NO: 6535943 - DNA, 16 bp, Homo sapiens
tgtaattatgtaaata

SEQ ID NO: 6535944 - DNA, 22 bp, Homo sapiens
tgtaattatgtaacctatttat

SEQ ID NO: 6535945 - DNA, 21 bp, Homo sapiens
tgtaattatgttctaagtgcc

SEQ ID NO: 6535946 - DNA, 20 bp, Homo sapiens
tgtaattatttatgtatggt

SEQ ID NO: 6535947 - DNA, 13 bp, Homo sapiens
tgtaattcagaaa

SEQ ID NO: 6535948 - DNA, 20 bp, Homo sapiens
tgtaattcagaaaacataat

SEQ ID NO: 6535949 - DNA, 19 bp, Homo sapiens
tgtaattcaggtttttcct

SEQ ID NO: 6535950 - DNA, 23 bp, Homo sapiens
tgtaattcattgagcagttagct

SEQ ID NO: 6535951 - DNA, 22 bp, Homo sapiens
tgtaattccacatcatgttact

SEQ ID NO: 6535952 - DNA, 14 bp, Homo sapiens
tgtaattctaaatg

SEQ ID NO: 6535953 - DNA, 23 bp, Homo sapiens
tgtaattcttctcctttgtcaaa

SEQ ID NO: 6535954 - DNA, 19 bp, Homo sapiens
tgtaattgaatattattcc

SEQ ID NO: 6535955 - DNA, 23 bp, Homo sapiens
tgtaattgcactttttaagtttg

SEQ ID NO: 6535956 - DNA, 15 bp, Homo sapiens
tgtaattgctgcctt

SEQ ID NO: 6535957 - DNA, 14 bp, Homo sapiens
tgtaattgcttaca

SEQ ID NO: 6535958 - DNA, 23 bp, Homo sapiens
tgtaattgcttacatttttacaa

SEQ ID NO: 6535959 - DNA, 19 bp, Homo sapiens
tgtaattggcttttgaatc

SEQ ID NO: 6535960 - DNA, 22 bp, Homo sapiens
tgtaattggcttttgaatcaaa

SEQ ID NO: 6535961 - DNA, 18 bp, Homo sapiens
tgtaattggtgacaatgt

SEQ ID NO: 6535962 - DNA, 14 bp, Homo sapiens
tgtaattgtggatt

SEQ ID NO: 6535963 - DNA, 14 bp, Homo sapiens
tgtaattgtgtaaa

SEQ ID NO: 6535964 - DNA, 16 bp, Homo sapiens
tgtaattgtgtggatt

SEQ ID NO: 6535965 - DNA, 21 bp, Homo sapiens
tgtaattgtgtggattcttta

SEQ ID NO: 6535966 - DNA, 17 bp, Homo sapiens
tgtaattgttgtttgta

SEQ ID NO: 6535967 - DNA, 23 bp, Homo sapiens
tgtaattgttgtttgtatgtata

SEQ ID NO: 6535968 - DNA, 20 bp, Homo sapiens
tgtaattgttttggaataaa

SEQ ID NO: 6535969 - DNA, 17 bp, Homo sapiens
tgtaatttaaaattgtg

SEQ ID NO: 6535970 - DNA, 20 bp, Homo sapiens
tgtaatttaaaattgtgatg

SEQ ID NO: 6535971 - DNA, 21 bp, Homo sapiens
tgtaatttaaaattgtgatgt

SEQ ID NO: 6535972 - DNA, 15 bp, Homo sapiens
tgtaatttaaacagg

SEQ ID NO: 6535973 - DNA, 16 bp, Homo sapiens
tgtaatttaaatgaaa

SEQ ID NO: 6535974 - DNA, 22 bp, Homo sapiens
tgtaatttaagtgacacagaca

SEQ ID NO: 6535975 - DNA, 23 bp, Homo sapiens
tgtaatttaagtgacacagacat

SEQ ID NO: 6535976 - DNA, 20 bp, Homo sapiens
tgtaatttaatgcctgccca

SEQ ID NO: 6535977 - DNA, 20 bp, Homo sapiens
tgtaatttagggtactaaat

SEQ ID NO: 6535978 - DNA, 21 bp, Homo sapiens
tgtaatttagggtactaaatt

SEQ ID NO: 6535979 - DNA, 19 bp, Homo sapiens
tgtaatttagtctaacaca

SEQ ID NO: 6535980 - DNA, 16 bp, Homo sapiens
tgtaatttataaaatt

SEQ ID NO: 6535981 - DNA, 23 bp, Homo sapiens
tgtaatttatattccatttacat

SEQ ID NO: 6535982 - DNA, 13 bp, Homo sapiens
tgtaatttatgca

SEQ ID NO: 6535983 - DNA, 16 bp, Homo sapiens
tgtaatttatgtgaaa

SEQ ID NO: 6535984 - DNA, 17 bp, Homo sapiens
tgtaatttcctgctcct

SEQ ID NO: 6535985 - DNA, 17 bp, Homo sapiens
tgtaatttcgccttaaa

SEQ ID NO: 6535986 - DNA, 18 bp, Homo sapiens
tgtaatttcgccttaaac

SEQ ID NO: 6535987 - DNA, 23 bp, Homo sapiens
tgtaatttctaactccttatgtt

SEQ ID NO: 6535988 - DNA, 18 bp, Homo sapiens
tgtaatttctttgcctgt

SEQ ID NO: 6535989 - DNA, 23 bp, Homo sapiens
tgtaatttctttgcctgttcagt

SEQ ID NO: 6535990 - DNA, 18 bp, Homo sapiens
tgtaatttgcattactct

SEQ ID NO: 6535991 - DNA, 20 bp, Homo sapiens
tgtaatttgtacaggggcca

SEQ ID NO: 6535992 - DNA, 21 bp, Homo sapiens
tgtaatttgtacaggggccat

SEQ ID NO: 6535993 - DNA, 17 bp, Homo sapiens
tgtaatttgtgatacaa

SEQ ID NO: 6535994 - DNA, 21 bp, Homo sapiens
tgtaatttgtgatacaatgct

SEQ ID NO: 6535995 - DNA, 15 bp, Homo sapiens
tgtaatttgtgtaat

SEQ ID NO: 6535996 - DNA, 21 bp, Homo sapiens
tgtaattttaaataaaagtga

SEQ ID NO: 6535997 - DNA, 15 bp, Homo sapiens
tgtaattttcttgat

SEQ ID NO: 6535998 - DNA, 15 bp, Homo sapiens
tgtaattttgtgtaa

SEQ ID NO: 6535999 - DNA, 19 bp, Homo sapiens
tgtaattttgttcctgttt

SEQ ID NO: 6536000 - DNA, 23 bp, Homo sapiens
tgtaattttgttctagttttcag

SEQ ID NO: 6536001 - DNA, 18 bp, Homo sapiens
tgtaatttttcaaaatcg

SEQ ID NO: 6536002 - DNA, 16 bp, Homo sapiens
tgtaatttttctgtat

SEQ ID NO: 6536003 - DNA, 17 bp, Homo sapiens
tgtaatttttctgtata

SEQ ID NO: 6536004 - DNA, 20 bp, Homo sapiens
tgtaatttttctgtatagac

SEQ ID NO: 6536005 - DNA, 13 bp, Homo sapiens
tgtaatttttgct

SEQ ID NO: 6536006 - DNA, 17 bp, Homo sapiens
ttccttttcttgtctct

SEQ ID NO: 6536007 - DNA, 18 bp, Homo sapiens
ttccttttcttgtctctg

SEQ ID NO: 6536008 - DNA, 21 bp, Homo sapiens
ttccttttcttgtctctgagg

SEQ ID NO: 6536009 - DNA, 15 bp, Homo sapiens
ttccttttgaaagaa

SEQ ID NO: 6536010 - DNA, 13 bp, Homo sapiens
ttccttttgaaat

SEQ ID NO: 6536011 - DNA, 14 bp, Homo sapiens
ttccttttgaaatt

SEQ ID NO: 6536012 - DNA, 21 bp, Homo sapiens
ttccttttgatggggagaaag

SEQ ID NO: 6536013 - DNA, 23 bp, Homo sapiens
ttccttttgtaaagtaaaatatg

SEQ ID NO: 6536014 - DNA, 23 bp, Homo sapiens
ttcctttttaaatgtgaattttt

SEQ ID NO: 6536015 - DNA, 16 bp, Homo sapiens
ttcctttttcttcgct

SEQ ID NO: 6536016 - DNA, 15 bp, Homo sapiens
ttcctttttgacact

SEQ ID NO: 6536017 - DNA, 17 bp, Homo sapiens
ttcctttttgacactga

SEQ ID NO: 6536018 - DNA, 23 bp, Homo sapiens
ttcctttttgtaaatatgtgaca

SEQ ID NO: 6536019 - DNA, 21 bp, Homo sapiens
ttccttttttaaaaatgcaaa

SEQ ID NO: 6536020 - DNA, 19 bp, Homo sapiens
ttccttttttaaaataaaa

SEQ ID NO: 6536021 - DNA, 19 bp, Homo sapiens
ttccttttttcaatatgca

SEQ ID NO: 6536022 - DNA, 13 bp, Homo sapiens
ttccttttttccc

SEQ ID NO: 6536023 - DNA, 15 bp, Homo sapiens
ttccttttttgagat

SEQ ID NO: 6536024 - DNA, 16 bp, Homo sapiens
ttccttttttgagatt

SEQ ID NO: 6536025 - DNA, 18 bp, Homo sapiens
ttcctttttttaaatttt

SEQ ID NO: 6536026 - DNA, 22 bp, Homo sapiens
ttcctttttttaaattttctcc

SEQ ID NO: 6536027 - DNA, 14 bp, Homo sapiens
ttcctttttttgat

SEQ ID NO: 6536028 - DNA, 16 bp, Homo sapiens
ttcctttttttgtacc

SEQ ID NO: 6536029 - DNA, 21 bp, Homo sapiens
ttcgaaacctgtccataaagt

SEQ ID NO: 6536030 - DNA, 12 bp, Homo sapiens
ttcgaaactgcc

SEQ ID NO: 6536031 - DNA, 17 bp, Homo sapiens
ttcgaaactgccaaggg

SEQ ID NO: 6536032 - DNA, 15 bp, Homo sapiens
ttcgaaaggccttca

SEQ ID NO: 6536033 - DNA, 23 bp, Homo sapiens
ttcgaagacccagcagatgttta

SEQ ID NO: 6536034 - DNA, 16 bp, Homo sapiens
ttcgaagctcagccca

SEQ ID NO: 6536035 - DNA, 19 bp, Homo sapiens
ttcgaaggagcagtgtgac

SEQ ID NO: 6536036 - DNA, 13 bp, Homo sapiens
ttcgaagtcatta

SEQ ID NO: 6536037 - DNA, 15 bp, Homo sapiens
ttcgaagttctagaa

SEQ ID NO: 6536038 - DNA, 17 bp, Homo sapiens
ttcgaataaagtgaata

SEQ ID NO: 6536039 - DNA, 18 bp, Homo sapiens
ttcgaatctctgcccctc

SEQ ID NO: 6536040 - DNA, 22 bp, Homo sapiens
ttcgaatcttaatttattattt

SEQ ID NO: 6536041 - DNA, 22 bp, Homo sapiens
ttcgaattcgggtggcatcctc

SEQ ID NO: 6536042 - DNA, 14 bp, Homo sapiens
ttcgacactgttct

SEQ ID NO: 6536043 - DNA, 15 bp, Homo sapiens
ttcgacactgttctt

SEQ ID NO: 6536044 - DNA, 23 bp, Homo sapiens
ttcgacagcattttcctctgctt

SEQ ID NO: 6536045 - DNA, 17 bp, Homo sapiens
ttcgaccctttctctga

SEQ ID NO: 6536046 - DNA, 13 bp, Homo sapiens
ttcgactggtcca

SEQ ID NO: 6536047 - DNA, 16 bp, Homo sapiens
ttcgactggtccagct

SEQ ID NO: 6536048 - DNA, 20 bp, Homo sapiens
ttcgactggtccagctctga

SEQ ID NO: 6536049 - DNA, 22 bp, Homo sapiens
ttcgactggtccagctctgaca

SEQ ID NO: 6536050 - DNA, 19 bp, Homo sapiens
ttcgactgtgacctgtggg

SEQ ID NO: 6536051 - DNA, 21 bp, Homo sapiens
ttcgactgttgttatctgttt

SEQ ID NO: 6536052 - DNA, 15 bp, Homo sapiens
ttcgagaagctgctc

SEQ ID NO: 6536053 - DNA, 16 bp, Homo sapiens
ttcgagaccagcctcg

SEQ ID NO: 6536054 - DNA, 15 bp, Homo sapiens
ttcgagaccagcctg

SEQ ID NO: 6536055 - DNA, 13 bp, Homo sapiens
ttcgagactccat

SEQ ID NO: 6536056 - DNA, 16 bp, Homo sapiens
ttcgagagcagcctgg

SEQ ID NO: 6536057 - DNA, 18 bp, Homo sapiens
ttcgagagcagcctggcc

SEQ ID NO: 6536058 - DNA, 22 bp, Homo sapiens
ttcgagatcatcacttccttgc

SEQ ID NO: 6536059 - DNA, 14 bp, Homo sapiens
ttcgagcaaacaac

SEQ ID NO: 6536060 - DNA, 16 bp, Homo sapiens
ttcgaggtcctcctgg

SEQ ID NO: 6536061 - DNA, 19 bp, Homo sapiens
ttcgaggtcctcctggcct

SEQ ID NO: 6536062 - DNA, 18 bp, Homo sapiens
ttcgatctcattcagtat

SEQ ID NO: 6536063 - DNA, 16 bp, Homo sapiens
ttcgatgaaggctgcc

SEQ ID NO: 6536064 - DNA, 15 bp, Homo sapiens
ttcgatgaagttctg

SEQ ID NO: 6536065 - DNA, 17 bp, Homo sapiens
ttcgatgcccccctaga

SEQ ID NO: 6536066 - DNA, 20 bp, Homo sapiens
ttcgatgggcccaattctta

SEQ ID NO: 6536067 - DNA, 15 bp, Homo sapiens
ttcgatttctgactc

SEQ ID NO: 6536068 - DNA, 12 bp, Homo sapiens
ttcgcacaatct

SEQ ID NO: 6536069 - DNA, 18 bp, Homo sapiens
ttcgcacattctcctgat

SEQ ID NO: 6536070 - DNA, 19 bp, Homo sapiens
ttcgcaccttgctgtgtga

SEQ ID NO: 6536071 - DNA, 11 bp, Homo sapiens
ttcgcagaggc

SEQ ID NO: 6536072 - DNA, 18 bp, Homo sapiens
ttcgcagccaccctgagg

SEQ ID NO: 6536073 - DNA, 22 bp, Homo sapiens
ttcgcagtccacttctgacagc

SEQ ID NO: 6536074 - DNA, 14 bp, Homo sapiens
ttcgcatcaaaaga

SEQ ID NO: 6536075 - DNA, 20 bp, Homo sapiens
ttcgcatccaccgccacccc

SEQ ID NO: 6536076 - DNA, 14 bp, Homo sapiens
ttcgcatggtcaca

SEQ ID NO: 6536077 - DNA, 19 bp, Homo sapiens
ttcgcccaaagccagacag

SEQ ID NO: 6536078 - DNA, 15 bp, Homo sapiens
ttcgccctctgaaat

SEQ ID NO: 6536079 - DNA, 22 bp, Homo sapiens
ttcgccgaatggggcagcacca

SEQ ID NO: 6536080 - DNA, 16 bp, Homo sapiens
ttcgcctcctccagct

SEQ ID NO: 6536081 - DNA, 21 bp, Homo sapiens
ttcgccttaatacttttttat

SEQ ID NO: 6536082 - DNA, 14 bp, Homo sapiens
ttcgcctttgtctt

SEQ ID NO: 6536083 - DNA, 20 bp, Homo sapiens
ttcgcctttgtcttgtactt

SEQ ID NO: 6536084 - DNA, 15 bp, Homo sapiens
ttcgctattcccagg

SEQ ID NO: 6536085 - DNA, 16 bp, Homo sapiens
ttcgctattcccaggc

SEQ ID NO: 6536086 - DNA, 18 bp, Homo sapiens
ttcgctattcccaggcag

SEQ ID NO: 6536087 - DNA, 13 bp, Homo sapiens
ttcgctcctgtgt

SEQ ID NO: 6536088 - DNA, 11 bp, Homo sapiens
ttcgctcttga

SEQ ID NO: 6536089 - DNA, 12 bp, Homo sapiens
ttcgctgcaacc

SEQ ID NO: 6536090 - DNA, 14 bp, Homo sapiens
ttcgctgccaggac

SEQ ID NO: 6536091 - DNA, 16 bp, Homo sapiens
ttcgctgccaggacac

SEQ ID NO: 6536092 - DNA, 22 bp, Homo sapiens
ttcgctgccaggacacctgccc

SEQ ID NO: 6536093 - DNA, 23 bp, Homo sapiens
ttcgctggactattgtgccaact

SEQ ID NO: 6536094 - DNA, 24 bp, Homo sapiens
ttcgctgtcccccaacactgagca

SEQ ID NO: 6536095 - DNA, 16 bp, Homo sapiens
ttcgcttgagaaaaaa

SEQ ID NO: 6536096 - DNA, 15 bp, Homo sapiens
ttcgcttgcttctgc

SEQ ID NO: 6536097 - DNA, 18 bp, Homo sapiens
ttcgcttgttttaaaagg

SEQ ID NO: 6536098 - DNA, 18 bp, Homo sapiens
ttcggaaaaaaaaaaaga

SEQ ID NO: 6536099 - DNA, 20 bp, Homo sapiens
ttcggaaaaaaaaaaagaaa

SEQ ID NO: 6536100 - DNA, 21 bp, Homo sapiens
ttcggaaaaaaaaaaagaaaa

SEQ ID NO: 6536101 - DNA, 13 bp, Homo sapiens
ttcggaaacactg

SEQ ID NO: 6536102 - DNA, 14 bp, Homo sapiens
ttcggaaacactga

SEQ ID NO: 6536103 - DNA, 17 bp, Homo sapiens
ttcggaagggaaaacag

SEQ ID NO: 6536104 - DNA, 19 bp, Homo sapiens
ttcggaccgaaggtgacag

SEQ ID NO: 6536105 - DNA, 14 bp, Homo sapiens
ttcggagcctgcct

SEQ ID NO: 6536106 - DNA, 15 bp, Homo sapiens
ttcggagcctgcctc

SEQ ID NO: 6536107 - DNA, 20 bp, Homo sapiens
ttcggagggccgcagggccc

SEQ ID NO: 6536108 - DNA, 14 bp, Homo sapiens
ttcggagtgaatgt

SEQ ID NO: 6536109 - DNA, 17 bp, Homo sapiens
ttcggagtgaatgtggc

SEQ ID NO: 6536110 - DNA, 14 bp, Homo sapiens
ttcggataattttc

SEQ ID NO: 6536111 - DNA, 17 bp, Homo sapiens
ttcggataattttcatt

SEQ ID NO: 6536112 - DNA, 22 bp, Homo sapiens
ttcggcaccttcccctgaggac

SEQ ID NO: 6536113 - DNA, 12 bp, Homo sapiens
ttcggcatttga

SEQ ID NO: 6536114 - DNA, 17 bp, Homo sapiens
ttcggccccatgtatct

SEQ ID NO: 6536115 - DNA, 18 bp, Homo sapiens
ttcggcctccatcctgag

SEQ ID NO: 6536116 - DNA, 23 bp, Homo sapiens
ttcggccttggtgaacacacacg

SEQ ID NO: 6536117 - DNA, 20 bp, Homo sapiens
ttcgggccaaggacctgaga

SEQ ID NO: 6536118 - DNA, 12 bp, Homo sapiens
ttcgggctgtgc

SEQ ID NO: 6536119 - DNA, 14 bp, Homo sapiens
ttcgggctgtgccc

SEQ ID NO: 6536120 - DNA, 17 bp, Homo sapiens
ttcggggaactcctgga

SEQ ID NO: 6536121 - DNA, 21 bp, Homo sapiens
ttcggggcgatgctccctcag

SEQ ID NO: 6536122 - DNA, 18 bp, Homo sapiens
ttcgggggaataaagaca

SEQ ID NO: 6536123 - DNA, 20 bp, Homo sapiens
ttcgggggagcagagagagc

SEQ ID NO: 6536124 - DNA, 21 bp, Homo sapiens
ttcggggtagaggctgggagg

SEQ ID NO: 6536125 - DNA, 15 bp, Homo sapiens
ttcggggtgaagcaa

SEQ ID NO: 6536126 - DNA, 12 bp, Homo sapiens
ttcggtctcctt

SEQ ID NO: 6536127 - DNA, 18 bp, Homo sapiens
ttcggttctccagaatgt

SEQ ID NO: 6536128 - DNA, 14 bp, Homo sapiens
ttcggttgcagggc

SEQ ID NO: 6536129 - DNA, 14 bp, Homo sapiens
ttcggtttctgagc

SEQ ID NO: 6536130 - DNA, 13 bp, Homo sapiens
ttcgtaacacagc

SEQ ID NO: 6536131 - DNA, 17 bp, Homo sapiens
ttcgtaagttctgtgca

SEQ ID NO: 6536132 - DNA, 18 bp, Homo sapiens
ttcgtaagttctgtgcag

SEQ ID NO: 6536133 - DNA, 16 bp, Homo sapiens
ttcgtaatagctcaga

SEQ ID NO: 6536134 - DNA, 22 bp, Homo sapiens
ttcgtacagttcttcgggaaga

SEQ ID NO: 6536135 - DNA, 20 bp, Homo sapiens
ttcgtacataataagtttca

SEQ ID NO: 6536136 - DNA, 16 bp, Homo sapiens
ttcgtaccgcttcctt

SEQ ID NO: 6536137 - DNA, 16 bp, Homo sapiens
ttcgtaccttcccact

SEQ ID NO: 6536138 - DNA, 15 bp, Homo sapiens
ttcgtagcatgagtt

SEQ ID NO: 6536139 - DNA, 15 bp, Homo sapiens
ttcgtataatcttgt

SEQ ID NO: 6536140 - DNA, 22 bp, Homo sapiens
ttcgtatagaaaaagcacagct

SEQ ID NO: 6536141 - DNA, 21 bp, Homo sapiens
ttcgtatgcactcccttgagg

SEQ ID NO: 6536142 - DNA, 16 bp, Homo sapiens
ttcgtcactcaaatga

SEQ ID NO: 6536143 - DNA, 13 bp, Homo sapiens
ttcgtcatcttcc

SEQ ID NO: 6536144 - DNA, 16 bp, Homo sapiens
ttcgtcatcttccctg

SEQ ID NO: 6536145 - DNA, 17 bp, Homo sapiens
ttcgtccacagcttcct

SEQ ID NO: 6536146 - DNA, 18 bp, Homo sapiens
ttcgtccacagcttcctg

SEQ ID NO: 6536147 - DNA, 14 bp, Homo sapiens
ttcgtctcagaagg

SEQ ID NO: 6536148 - DNA, 18 bp, Homo sapiens
ttcgtctccatctctggt

SEQ ID NO: 6536149 - DNA, 18 bp, Homo sapiens
ttcgtctgtcccagagct

SEQ ID NO: 6536150 - DNA, 12 bp, Homo sapiens
ttcgtctgttgt

SEQ ID NO: 6536151 - DNA, 18 bp, Homo sapiens
ttcgtcttccctgcttca

SEQ ID NO: 6536152 - DNA, 18 bp, Homo sapiens
ttcgtgaacatagagttt

SEQ ID NO: 6536153 - DNA, 20 bp, Homo sapiens
ttcgtgagccccatcttcac

SEQ ID NO: 6536154 - DNA, 11 bp, Homo sapiens
ttcgtgcattt

SEQ ID NO: 6536155 - DNA, 20 bp, Homo sapiens
ttcgtgcggaatcagcttct

SEQ ID NO: 6536156 - DNA, 11 bp, Homo sapiens
ttcgtgctgga

SEQ ID NO: 6536157 - DNA, 19 bp, Homo sapiens
ttcgtgctgtgctctggca

SEQ ID NO: 6536158 - DNA, 19 bp, Homo sapiens
ttcgtgcttcctcctgaca

SEQ ID NO: 6536159 - DNA, 18 bp, Homo sapiens
ttcgtggagccacaggca

SEQ ID NO: 6536160 - DNA, 13 bp, Homo sapiens
ttcgtggctgcaa

SEQ ID NO: 6536161 - DNA, 17 bp, Homo sapiens
ttcgtggtgatcaatta

SEQ ID NO: 6536162 - DNA, 13 bp, Homo sapiens
ttcgtgtgctgct

SEQ ID NO: 6536163 - DNA, 16 bp, Homo sapiens
ttcgtgtgctgctgct

SEQ ID NO: 6536164 - DNA, 17 bp, Homo sapiens
ttcgtgtgtgtctgctt

SEQ ID NO: 6536165 - DNA, 15 bp, Homo sapiens
ttcgtgttatgaatc

SEQ ID NO: 6536166 - DNA, 21 bp, Homo sapiens
ttcgtgtttttggttttctcc

SEQ ID NO: 6536167 - DNA, 13 bp, Homo sapiens
ttcgttaagcagt

SEQ ID NO: 6536168 - DNA, 18 bp, Homo sapiens
ttcgttaatagattattt

SEQ ID NO: 6536169 - DNA, 20 bp, Homo sapiens
ttcgttagtaatctgtataa

SEQ ID NO: 6536170 - DNA, 13 bp, Homo sapiens
ttcgttatctaat

SEQ ID NO: 6536171 - DNA, 20 bp, Homo sapiens
ttcgttccctgattatttat

SEQ ID NO: 6536172 - DNA, 17 bp, Homo sapiens
ttcgttctgtactgtta

SEQ ID NO: 6536173 - DNA, 12 bp, Homo sapiens
ttcgttctgtgg

SEQ ID NO: 6536174 - DNA, 15 bp, Homo sapiens
ttcgttcttgttctg

SEQ ID NO: 6536175 - DNA, 20 bp, Homo sapiens
ttcgttgcacagctgtttga

SEQ ID NO: 6536176 - DNA, 21 bp, Homo sapiens
ttcgttggttgtttctctgag

SEQ ID NO: 6536177 - DNA, 21 bp, Homo sapiens
ttcgtttagaatcagaataaa

SEQ ID NO: 6536178 - DNA, 15 bp, Homo sapiens
ttcgtttattttcaa

SEQ ID NO: 6536179 - DNA, 14 bp, Homo sapiens
ttcgtttctgtata

SEQ ID NO: 6536180 - DNA, 15 bp, Homo sapiens
ttcgtttgtttgttt

SEQ ID NO: 6536181 - DNA, 17 bp, Homo sapiens
ttcgtttgtttgtttca

SEQ ID NO: 6536182 - DNA, 12 bp, Homo sapiens
ttcgttttggag

SEQ ID NO: 6536183 - DNA, 12 bp, Homo sapiens
ttcgttttggtt

SEQ ID NO: 6536184 - DNA, 16 bp, Homo sapiens
ttctaaaaaagatact

SEQ ID NO: 6536185 - DNA, 18 bp, Homo sapiens
ttctaaaaaagatactgt

SEQ ID NO: 6536186 - DNA, 15 bp, Homo sapiens
ttctaaaaagtcaga

SEQ ID NO: 6536187 - DNA, 21 bp, Homo sapiens
tgtaattttttaaatgaaaat

SEQ ID NO: 6536188 - DNA, 23 bp, Homo sapiens
tgtaatttttttgaaaaaagttc

SEQ ID NO: 6536189 - DNA, 22 bp, Homo sapiens
tgtacaaaaaaatcttccaatt

SEQ ID NO: 6536190 - DNA, 12 bp, Homo sapiens
tgtacaaaaaag

SEQ ID NO: 6536191 - DNA, 15 bp, Homo sapiens
tgtacaaaaaagtta

SEQ ID NO: 6536192 - DNA, 18 bp, Homo sapiens
tgtacaaaaaagttataa

SEQ ID NO: 6536193 - DNA, 15 bp, Homo sapiens
tgtacaaaaacacaa

SEQ ID NO: 6536194 - DNA, 16 bp, Homo sapiens
tgtacaaaactgtaaa

SEQ ID NO: 6536195 - DNA, 13 bp, Homo sapiens
tgtacaaaagcaa

SEQ ID NO: 6536196 - DNA, 22 bp, Homo sapiens
tgtacaaaagggacatgaaata

SEQ ID NO: 6536197 - DNA, 14 bp, Homo sapiens
tgtacaaaagtacc

SEQ ID NO: 6536198 - DNA, 17 bp, Homo sapiens
tgtacaaaataaacaaa

SEQ ID NO: 6536199 - DNA, 22 bp, Homo sapiens
tgtacaaaataaacaaataaca

SEQ ID NO: 6536200 - DNA, 14 bp, Homo sapiens
tgtacaaaatggtc

SEQ ID NO: 6536201 - DNA, 16 bp, Homo sapiens
tgtacaaaattaagca

SEQ ID NO: 6536202 - DNA, 13 bp, Homo sapiens
tgtacaaacatgt

SEQ ID NO: 6536203 - DNA, 14 bp, Homo sapiens
tgtacaaacatgtt

SEQ ID NO: 6536204 - DNA, 17 bp, Homo sapiens
tgtacaaactatttcag

SEQ ID NO: 6536205 - DNA, 14 bp, Homo sapiens
tgtacaaagggaag

SEQ ID NO: 6536206 - DNA, 19 bp, Homo sapiens
tgtacaaagtagaagtctt

SEQ ID NO: 6536207 - DNA, 23 bp, Homo sapiens
tgtacaaagtagaagtcttagat

SEQ ID NO: 6536208 - DNA, 15 bp, Homo sapiens
tgtacaaagtattaa

SEQ ID NO: 6536209 - DNA, 21 bp, Homo sapiens
tgtacaaagtattaagcatat

SEQ ID NO: 6536210 - DNA, 19 bp, Homo sapiens
tgtacaaagttttcctttg

SEQ ID NO: 6536211 - DNA, 21 bp, Homo sapiens
tgtacaaagttttcctttgta

SEQ ID NO: 6536212 - DNA, 12 bp, Homo sapiens
tgtacaaataaa

SEQ ID NO: 6536213 - DNA, 13 bp, Homo sapiens
tgtacaaataaac

SEQ ID NO: 6536214 - DNA, 14 bp, Homo sapiens
tgtacaaataaacc

SEQ ID NO: 6536215 - DNA, 21 bp, Homo sapiens
tgtacaaataaacctgaggca

SEQ ID NO: 6536216 - DNA, 13 bp, Homo sapiens
tgtacaaatactg

SEQ ID NO: 6536217 - DNA, 15 bp, Homo sapiens
tgtacaaatataaga

SEQ ID NO: 6536218 - DNA, 15 bp, Homo sapiens
tgtacaaatgaaatt

SEQ ID NO: 6536219 - DNA, 17 bp, Homo sapiens
tgtacaaatgtaagcaa

SEQ ID NO: 6536220 - DNA, 19 bp, Homo sapiens
tgtacaaatgtaagcaaag

SEQ ID NO: 6536221 - DNA, 16 bp, Homo sapiens
tgtacaaatgtatttt

SEQ ID NO: 6536222 - DNA, 15 bp, Homo sapiens
tgtacaacaatgctt

SEQ ID NO: 6536223 - DNA, 12 bp, Homo sapiens
tgtacaaccctg

SEQ ID NO: 6536224 - DNA, 18 bp, Homo sapiens
tgtacaaccctgaccgtg

SEQ ID NO: 6536225 - DNA, 17 bp, Homo sapiens
tgtacaacctgtgatca

SEQ ID NO: 6536226 - DNA, 18 bp, Homo sapiens
tgtacaactttttaaata

SEQ ID NO: 6536227 - DNA, 19 bp, Homo sapiens
tgtacaaggtatttacaca

SEQ ID NO: 6536228 - DNA, 17 bp, Homo sapiens
tgtacaagtgctcagtt

SEQ ID NO: 6536229 - DNA, 23 bp, Homo sapiens
tgtacaagttgttattgttgaac

SEQ ID NO: 6536230 - DNA, 23 bp, Homo sapiens
tgtacaagttttgtataaataat

SEQ ID NO: 6536231 - DNA, 16 bp, Homo sapiens
tgtacaataaaaacat

SEQ ID NO: 6536232 - DNA, 16 bp, Homo sapiens
tgtacaatacaatgta

SEQ ID NO: 6536233 - DNA, 21 bp, Homo sapiens
tgtacaatacataactagttt

SEQ ID NO: 6536234 - DNA, 17 bp, Homo sapiens
tgtacaataccagatca

SEQ ID NO: 6536235 - DNA, 22 bp, Homo sapiens
tgtacaataccagatcactcaa

SEQ ID NO: 6536236 - DNA, 12 bp, Homo sapiens
tgtacaatcaaa

SEQ ID NO: 6536237 - DNA, 23 bp, Homo sapiens
tgtacaatcatgaacagctctga

SEQ ID NO: 6536238 - DNA, 14 bp, Homo sapiens
tgtacaatcatgtt

SEQ ID NO: 6536239 - DNA, 15 bp, Homo sapiens
tgtacaatcatgttc

SEQ ID NO: 6536240 - DNA, 14 bp, Homo sapiens
tgtacaatggttta

SEQ ID NO: 6536241 - DNA, 20 bp, Homo sapiens
tgtacaatggtttattccca

SEQ ID NO: 6536242 - DNA, 16 bp, Homo sapiens
tgtacaattaaaaacc

SEQ ID NO: 6536243 - DNA, 19 bp, Homo sapiens
tgtacaattactaaattgt

SEQ ID NO: 6536244 - DNA, 14 bp, Homo sapiens
tgtacaattatgtc

SEQ ID NO: 6536245 - DNA, 16 bp, Homo sapiens
tgtacaattatgtctc

SEQ ID NO: 6536246 - DNA, 15 bp, Homo sapiens
tgtacaattgatctt

SEQ ID NO: 6536247 - DNA, 16 bp, Homo sapiens
tgtacaattgatcttt

SEQ ID NO: 6536248 - DNA, 15 bp, Homo sapiens
tgtacaattttaaag

SEQ ID NO: 6536249 - DNA, 21 bp, Homo sapiens
tgtacaattttaaagttctta

SEQ ID NO: 6536250 - DNA, 12 bp, Homo sapiens
tgtacacacaca

SEQ ID NO: 6536251 - DNA, 21 bp, Homo sapiens
tgtacacacacagacacacaa

SEQ ID NO: 6536252 - DNA, 18 bp, Homo sapiens
tgtacacacggaccatgt

SEQ ID NO: 6536253 - DNA, 22 bp, Homo sapiens
tgtacacactggtacttagagt

SEQ ID NO: 6536254 - DNA, 14 bp, Homo sapiens
tgtacacactttat

SEQ ID NO: 6536255 - DNA, 22 bp, Homo sapiens
tgtacacatgggagtttagtgt

SEQ ID NO: 6536256 - DNA, 20 bp, Homo sapiens
tgtacacattcctgcattca

SEQ ID NO: 6536257 - DNA, 15 bp, Homo sapiens
tgtacacatttctta

SEQ ID NO: 6536258 - DNA, 14 bp, Homo sapiens
tgtacacattttgt

SEQ ID NO: 6536259 - DNA, 21 bp, Homo sapiens
tgtacacctgcggggccaccc

SEQ ID NO: 6536260 - DNA, 13 bp, Homo sapiens
tgtacacgggact

SEQ ID NO: 6536261 - DNA, 15 bp, Homo sapiens
tgtacacgggactga

SEQ ID NO: 6536262 - DNA, 17 bp, Homo sapiens
tgtacacgtgtcctgta

SEQ ID NO: 6536263 - DNA, 24 bp, Homo sapiens
tgtacactacattttttctaataa

SEQ ID NO: 6536264 - DNA, 16 bp, Homo sapiens
tgtacactgaatattt

SEQ ID NO: 6536265 - DNA, 19 bp, Homo sapiens
tgtacactgaatatttata

SEQ ID NO: 6536266 - DNA, 21 bp, Homo sapiens
tgtacactgaatatttatatt

SEQ ID NO: 6536267 - DNA, 17 bp, Homo sapiens
tgtacactgacttgaga

SEQ ID NO: 6536268 - DNA, 16 bp, Homo sapiens
tgtacacttgggtgaa

SEQ ID NO: 6536269 - DNA, 15 bp, Homo sapiens
tgtacactttttaca

SEQ ID NO: 6536270 - DNA, 18 bp, Homo sapiens
tgtacactttttacagca

SEQ ID NO: 6536271 - DNA, 13 bp, Homo sapiens
tgtacactttttt

SEQ ID NO: 6536272 - DNA, 13 bp, Homo sapiens
tgtacagaaaata

SEQ ID NO: 6536273 - DNA, 22 bp, Homo sapiens
tgtacagaaaatagcttttatt

SEQ ID NO: 6536274 - DNA, 19 bp, Homo sapiens
tgtacagaaacaactgcca

SEQ ID NO: 6536275 - DNA, 21 bp, Homo sapiens
tgtacagaaccagcactccca

SEQ ID NO: 6536276 - DNA, 22 bp, Homo sapiens
tgtacagaaccagcactcccag

SEQ ID NO: 6536277 - DNA, 17 bp, Homo sapiens
tgtacagaatcattgct

SEQ ID NO: 6536278 - DNA, 15 bp, Homo sapiens
tgtacagacagagaa

SEQ ID NO: 6536279 - DNA, 20 bp, Homo sapiens
tgtacagaccacctttcaca

SEQ ID NO: 6536280 - DNA, 17 bp, Homo sapiens
tgtacagaccgagaggc

SEQ ID NO: 6536281 - DNA, 17 bp, Homo sapiens
tgtacagacgtatgctt

SEQ ID NO: 6536282 - DNA, 20 bp, Homo sapiens
tgtacagacgtatgcttatt

SEQ ID NO: 6536283 - DNA, 18 bp, Homo sapiens
tgtacagactgttttact

SEQ ID NO: 6536284 - DNA, 21 bp, Homo sapiens
tgtacagagaactaacactat

SEQ ID NO: 6536285 - DNA, 14 bp, Homo sapiens
tgtacagagactct

SEQ ID NO: 6536286 - DNA, 17 bp, Homo sapiens
tgtacagagactctatt

SEQ ID NO: 6536287 - DNA, 21 bp, Homo sapiens
tgtacagagccgtaaaaactg

SEQ ID NO: 6536288 - DNA, 16 bp, Homo sapiens
tgtacagatgatgtaa

SEQ ID NO: 6536289 - DNA, 18 bp, Homo sapiens
tgtacagatgatgtaaaa

SEQ ID NO: 6536290 - DNA, 14 bp, Homo sapiens
tgtacagattcttt

SEQ ID NO: 6536291 - DNA, 22 bp, Homo sapiens
tgtacagattttatttgtaatt

SEQ ID NO: 6536292 - DNA, 23 bp, Homo sapiens
tgtacagcaaggagatttacaac

SEQ ID NO: 6536293 - DNA, 13 bp, Homo sapiens
tgtacagcatgca

SEQ ID NO: 6536294 - DNA, 20 bp, Homo sapiens
tgtacagcattaaaatttta

SEQ ID NO: 6536295 - DNA, 12 bp, Homo sapiens
tgtacagctctc

SEQ ID NO: 6536296 - DNA, 17 bp, Homo sapiens
tgtacaggaaaaaccga

SEQ ID NO: 6536297 - DNA, 21 bp, Homo sapiens
tgtacaggacatgtactgaga

SEQ ID NO: 6536298 - DNA, 16 bp, Homo sapiens
tgtacaggctgagaca

SEQ ID NO: 6536299 - DNA, 14 bp, Homo sapiens
tgtacaggggccat

SEQ ID NO: 6536300 - DNA, 13 bp, Homo sapiens
tgtacaggtcacc

SEQ ID NO: 6536301 - DNA, 22 bp, Homo sapiens
tgtacaggtcacccatcaggac

SEQ ID NO: 6536302 - DNA, 20 bp, Homo sapiens
tgtacagtaatatgtttaat

SEQ ID NO: 6536303 - DNA, 17 bp, Homo sapiens
tgtacagtagattttcc

SEQ ID NO: 6536304 - DNA, 15 bp, Homo sapiens
tgtacagtatgtgtc

SEQ ID NO: 6536305 - DNA, 18 bp, Homo sapiens
tgtacagtatgtgtctag

SEQ ID NO: 6536306 - DNA, 18 bp, Homo sapiens
tgtacagtatgttcaaag

SEQ ID NO: 6536307 - DNA, 14 bp, Homo sapiens
tgtacagtattgtg

SEQ ID NO: 6536308 - DNA, 22 bp, Homo sapiens
tgtacagtatttaccttccttt

SEQ ID NO: 6536309 - DNA, 18 bp, Homo sapiens
tgtacagtatttttcaga

SEQ ID NO: 6536310 - DNA, 22 bp, Homo sapiens
tgtacagtctcaattttgtatt

SEQ ID NO: 6536311 - DNA, 15 bp, Homo sapiens
tgtacagtctgctcc

SEQ ID NO: 6536312 - DNA, 15 bp, Homo sapiens
tgtacagtctgtcat

SEQ ID NO: 6536313 - DNA, 14 bp, Homo sapiens
tgtacagtctgtct

SEQ ID NO: 6536314 - DNA, 20 bp, Homo sapiens
tgtacagtctgtcttctgta

SEQ ID NO: 6536315 - DNA, 21 bp, Homo sapiens
tgtacagtcttgtattaagtt

SEQ ID NO: 6536316 - DNA, 15 bp, Homo sapiens
tgtacagtgtctttt

SEQ ID NO: 6536317 - DNA, 12 bp, Homo sapiens
tgtacagtgtta

SEQ ID NO: 6536318 - DNA, 14 bp, Homo sapiens
tgtacagtgttacc

SEQ ID NO: 6536319 - DNA, 14 bp, Homo sapiens
tgtacagttataca

SEQ ID NO: 6536320 - DNA, 17 bp, Homo sapiens
tgtacagttatctaagt

SEQ ID NO: 6536321 - DNA, 20 bp, Homo sapiens
tgtacagttcagttcctctt

SEQ ID NO: 6536322 - DNA, 15 bp, Homo sapiens
tgtacagtttggggc

SEQ ID NO: 6536323 - DNA, 13 bp, Homo sapiens
tgtacagtttgtt

SEQ ID NO: 6536324 - DNA, 14 bp, Homo sapiens
tgtacagtttgttt

SEQ ID NO: 6536325 - DNA, 22 bp, Homo sapiens
tgtacagtttgtttacacacgt

SEQ ID NO: 6536326 - DNA, 12 bp, Homo sapiens
tgtacagttttt

SEQ ID NO: 6536327 - DNA, 13 bp, Homo sapiens
tgtacataaaatt

SEQ ID NO: 6536328 - DNA, 16 bp, Homo sapiens
tgtacataaattccag

SEQ ID NO: 6536329 - DNA, 19 bp, Homo sapiens
tgtacataactcctgtccc

SEQ ID NO: 6536330 - DNA, 20 bp, Homo sapiens
tgtacataactcctgtccct

SEQ ID NO: 6536331 - DNA, 13 bp, Homo sapiens
tgtacataactga

SEQ ID NO: 6536332 - DNA, 15 bp, Homo sapiens
tgtacataactgaaa

SEQ ID NO: 6536333 - DNA, 17 bp, Homo sapiens
tgtacataactgaaaat

SEQ ID NO: 6536334 - DNA, 20 bp, Homo sapiens
tgtacataattgcatgaaaa

SEQ ID NO: 6536335 - DNA, 22 bp, Homo sapiens
tgtacataattgcatgaaaata

SEQ ID NO: 6536336 - DNA, 21 bp, Homo sapiens
tgtacatacattcatactgta

SEQ ID NO: 6536337 - DNA, 14 bp, Homo sapiens
tgtacatacattgt

SEQ ID NO: 6536338 - DNA, 16 bp, Homo sapiens
tgtacatacattgtat

SEQ ID NO: 6536339 - DNA, 18 bp, Homo sapiens
tgtacatacattgtatag

SEQ ID NO: 6536340 - DNA, 21 bp, Homo sapiens
tgtacataccctggccgcccc

SEQ ID NO: 6536341 - DNA, 15 bp, Homo sapiens
tgtacataccggggc

SEQ ID NO: 6536342 - DNA, 19 bp, Homo sapiens
tgtacatacgatttaaggt

SEQ ID NO: 6536343 - DNA, 21 bp, Homo sapiens
tgtacatacgatttaaggtat

SEQ ID NO: 6536344 - DNA, 20 bp, Homo sapiens
tgtacatacgtgttctatag

SEQ ID NO: 6536345 - DNA, 12 bp, Homo sapiens
tgtacatactgg

SEQ ID NO: 6536346 - DNA, 17 bp, Homo sapiens
tgtacatagaccctctt

SEQ ID NO: 6536347 - DNA, 15 bp, Homo sapiens
tgtacatagatgtat

SEQ ID NO: 6536348 - DNA, 18 bp, Homo sapiens
tgtacatagatgtatcat

SEQ ID NO: 6536349 - DNA, 21 bp, Homo sapiens
tgtacatagatgtatcattaa

SEQ ID NO: 6536350 - DNA, 22 bp, Homo sapiens
tgtacatagatgtatcattaat

SEQ ID NO: 6536351 - DNA, 11 bp, Homo sapiens
tgtacatagcc

SEQ ID NO: 6536352 - DNA, 15 bp, Homo sapiens
tgtacatagcctata

SEQ ID NO: 6536353 - DNA, 22 bp, Homo sapiens
tgtacatagcctatatttacag

SEQ ID NO: 6536354 - DNA, 17 bp, Homo sapiens
tgtacatagtaaagtat

SEQ ID NO: 6536355 - DNA, 18 bp, Homo sapiens
tgtacatagtaaagtatt

SEQ ID NO: 6536356 - DNA, 19 bp, Homo sapiens
tgtacatagtgctaacatg

SEQ ID NO: 6536357 - DNA, 20 bp, Homo sapiens
tgtacatagtgctaacatga

SEQ ID NO: 6536358 - DNA, 23 bp, Homo sapiens
tgtacatagtggtcatttggtgg

SEQ ID NO: 6536359 - DNA, 15 bp, Homo sapiens
tgtacatagtgtaat

SEQ ID NO: 6536360 - DNA, 15 bp, Homo sapiens
tgtacatatatgtat

SEQ ID NO: 6536361 - DNA, 14 bp, Homo sapiens
tgtacatatctttg

SEQ ID NO: 6536362 - DNA, 20 bp, Homo sapiens
tgtacatatctttgagttca

SEQ ID NO: 6536363 - DNA, 16 bp, Homo sapiens
tgtacatatggaaatg

SEQ ID NO: 6536364 - DNA, 21 bp, Homo sapiens
tgtacatatgtaaaataaaat

SEQ ID NO: 6536365 - DNA, 15 bp, Homo sapiens
tgtacatattatcat

SEQ ID NO: 6536366 - DNA, 18 bp, Homo sapiens
ttctaaaaagtcagatgt

SEQ ID NO: 6536367 - DNA, 12 bp, Homo sapiens
ttctaaaacaat

SEQ ID NO: 6536368 - DNA, 18 bp, Homo sapiens
ttctaaaactaaatagca

SEQ ID NO: 6536369 - DNA, 19 bp, Homo sapiens
ttctaaaactaaatagcat

SEQ ID NO: 6536370 - DNA, 11 bp, Homo sapiens
ttctaaaactc

SEQ ID NO: 6536371 - DNA, 14 bp, Homo sapiens
ttctaaaagaatat

SEQ ID NO: 6536372 - DNA, 12 bp, Homo sapiens
ttctaaaagcca

SEQ ID NO: 6536373 - DNA, 16 bp, Homo sapiens
ttctaaaataaatgtt

SEQ ID NO: 6536374 - DNA, 15 bp, Homo sapiens
ttctaaaatataaca

SEQ ID NO: 6536375 - DNA, 20 bp, Homo sapiens
ttctaaaatcttatagttct

SEQ ID NO: 6536376 - DNA, 21 bp, Homo sapiens
ttctaaaatcttatagttcta

SEQ ID NO: 6536377 - DNA, 15 bp, Homo sapiens
ttctaaaatgattgt

SEQ ID NO: 6536378 - DNA, 18 bp, Homo sapiens
ttctaaaatgcttttaat

SEQ ID NO: 6536379 - DNA, 19 bp, Homo sapiens
ttctaaaatgttaaaacat

SEQ ID NO: 6536380 - DNA, 22 bp, Homo sapiens
ttctaaacaagaaccatttgca

SEQ ID NO: 6536381 - DNA, 16 bp, Homo sapiens
ttctaaacaagatttt

SEQ ID NO: 6536382 - DNA, 12 bp, Homo sapiens
ttctaaacattt

SEQ ID NO: 6536383 - DNA, 20 bp, Homo sapiens
ttctaaaccacaaaagttgt

SEQ ID NO: 6536384 - DNA, 19 bp, Homo sapiens
ttctaaaccatgaaaagtt

SEQ ID NO: 6536385 - DNA, 23 bp, Homo sapiens
ttctaaacccaatccaaatggcg

SEQ ID NO: 6536386 - DNA, 14 bp, Homo sapiens
ttctaaacctgtgc

SEQ ID NO: 6536387 - DNA, 15 bp, Homo sapiens
ttctaaacctgtgcc

SEQ ID NO: 6536388 - DNA, 16 bp, Homo sapiens
ttctaaacctgtgcct

SEQ ID NO: 6536389 - DNA, 17 bp, Homo sapiens
ttctaaacctgtgcctc

SEQ ID NO: 6536390 - DNA, 18 bp, Homo sapiens
ttctaaacctgtgcctcc

SEQ ID NO: 6536391 - DNA, 16 bp, Homo sapiens
ttctaaacggtgacct

SEQ ID NO: 6536392 - DNA, 15 bp, Homo sapiens
ttctaaactggagac

SEQ ID NO: 6536393 - DNA, 18 bp, Homo sapiens
ttctaaactggagactgt

SEQ ID NO: 6536394 - DNA, 21 bp, Homo sapiens
ttctaaactgttttcatgtgt

SEQ ID NO: 6536395 - DNA, 12 bp, Homo sapiens
ttctaaagatag

SEQ ID NO: 6536396 - DNA, 12 bp, Homo sapiens
ttctaaagattc

SEQ ID NO: 6536397 - DNA, 13 bp, Homo sapiens
ttctaaagattct

SEQ ID NO: 6536398 - DNA, 16 bp, Homo sapiens
ttctaaagattctata

SEQ ID NO: 6536399 - DNA, 23 bp, Homo sapiens
ttctaaagattctatagttctag

SEQ ID NO: 6536400 - DNA, 20 bp, Homo sapiens
ttctaaagccacgctgtgtc

SEQ ID NO: 6536401 - DNA, 18 bp, Homo sapiens
ttctaaagccttaagtct

SEQ ID NO: 6536402 - DNA, 15 bp, Homo sapiens
ttctaaagctctgac

SEQ ID NO: 6536403 - DNA, 15 bp, Homo sapiens
ttctaaagctgaatg

SEQ ID NO: 6536404 - DNA, 23 bp, Homo sapiens
ttctaaaggagtttatgttccat

SEQ ID NO: 6536405 - DNA, 16 bp, Homo sapiens
ttctaaaggctacctt

SEQ ID NO: 6536406 - DNA, 19 bp, Homo sapiens
ttctaaaggctacctttgt

SEQ ID NO: 6536407 - DNA, 22 bp, Homo sapiens
ttctaaaggtaccaaacaagga

SEQ ID NO: 6536408 - DNA, 13 bp, Homo sapiens
ttctaaaggtcca

SEQ ID NO: 6536409 - DNA, 16 bp, Homo sapiens
ttctaaaggtccacag

SEQ ID NO: 6536410 - DNA, 22 bp, Homo sapiens
ttctaaaggtgttgtcccttct

SEQ ID NO: 6536411 - DNA, 18 bp, Homo sapiens
ttctaaaggtttcactgt

SEQ ID NO: 6536412 - DNA, 12 bp, Homo sapiens
ttctaaagtaaa

SEQ ID NO: 6536413 - DNA, 13 bp, Homo sapiens
ttctaaagtaaaa

SEQ ID NO: 6536414 - DNA, 15 bp, Homo sapiens
ttctaaagtaaaatt

SEQ ID NO: 6536415 - DNA, 19 bp, Homo sapiens
ttctaaagtaaaattgaag

SEQ ID NO: 6536416 - DNA, 17 bp, Homo sapiens
ttctaaagttctaagat

SEQ ID NO: 6536417 - DNA, 16 bp, Homo sapiens
ttctaaataaaaaaat

SEQ ID NO: 6536418 - DNA, 20 bp, Homo sapiens
ttctaaataaatttcccagt

SEQ ID NO: 6536419 - DNA, 17 bp, Homo sapiens
ttctaaatattgcttca

SEQ ID NO: 6536420 - DNA, 21 bp, Homo sapiens
ttctaaatattgcttcaattt

SEQ ID NO: 6536421 - DNA, 22 bp, Homo sapiens
ttctaaatccgacttgaatatt

SEQ ID NO: 6536422 - DNA, 21 bp, Homo sapiens
ttctaaatctccaaaataaaa

SEQ ID NO: 6536423 - DNA, 14 bp, Homo sapiens
ttctaaatgaagtg

SEQ ID NO: 6536424 - DNA, 18 bp, Homo sapiens
ttctaaatgaatgtttac

SEQ ID NO: 6536425 - DNA, 21 bp, Homo sapiens
ttctaaatgagacgaaatgct

SEQ ID NO: 6536426 - DNA, 18 bp, Homo sapiens
ttctaaatgttattactt

SEQ ID NO: 6536427 - DNA, 15 bp, Homo sapiens
ttctaaatgtttctt

SEQ ID NO: 6536428 - DNA, 21 bp, Homo sapiens
ttctaaattaatggtaaaata

SEQ ID NO: 6536429 - DNA, 13 bp, Homo sapiens
ttctaaattcact

SEQ ID NO: 6536430 - DNA, 20 bp, Homo sapiens
ttctaaatttatattcataa

SEQ ID NO: 6536431 - DNA, 20 bp, Homo sapiens
ttctaacaaaaaaatatatt

SEQ ID NO: 6536432 - DNA, 13 bp, Homo sapiens
ttctaacatgaaa

SEQ ID NO: 6536433 - DNA, 22 bp, Homo sapiens
ttctaaccacggttatttaagc

SEQ ID NO: 6536434 - DNA, 18 bp, Homo sapiens
ttctaaccccctctgctc

SEQ ID NO: 6536435 - DNA, 20 bp, Homo sapiens
ttctaaccttgaatgctgcc

SEQ ID NO: 6536436 - DNA, 24 bp, Homo sapiens
ttctaaccttgaatgctgccagtg

SEQ ID NO: 6536437 - DNA, 16 bp, Homo sapiens
ttctaacctttacatg

SEQ ID NO: 6536438 - DNA, 23 bp, Homo sapiens
ttctaacgcaaaaatagctcttg

SEQ ID NO: 6536439 - DNA, 15 bp, Homo sapiens
ttctaactccagtga

SEQ ID NO: 6536440 - DNA, 17 bp, Homo sapiens
ttctaactctgatgtaa

SEQ ID NO: 6536441 - DNA, 23 bp, Homo sapiens
ttctaactctgatgtaaatgaag

SEQ ID NO: 6536442 - DNA, 14 bp, Homo sapiens
ttctaactcttaga

SEQ ID NO: 6536443 - DNA, 15 bp, Homo sapiens
ttctaactcttagaa

SEQ ID NO: 6536444 - DNA, 12 bp, Homo sapiens
ttctaactgtaa

SEQ ID NO: 6536445 - DNA, 18 bp, Homo sapiens
ttctaactgtaaatcact

SEQ ID NO: 6536446 - DNA, 15 bp, Homo sapiens
ttctaactgtagcta

SEQ ID NO: 6536447 - DNA, 12 bp, Homo sapiens
ttctaacttatt

SEQ ID NO: 6536448 - DNA, 23 bp, Homo sapiens
ttctaacttatttataaaaagat

SEQ ID NO: 6536449 - DNA, 19 bp, Homo sapiens
ttctaactttattctttgt

SEQ ID NO: 6536450 - DNA, 16 bp, Homo sapiens
ttctaagaaaagcatt

SEQ ID NO: 6536451 - DNA, 16 bp, Homo sapiens
ttctaagaaaatgtag

SEQ ID NO: 6536452 - DNA, 21 bp, Homo sapiens
ttctaagaaatagagccaact

SEQ ID NO: 6536453 - DNA, 19 bp, Homo sapiens
ttctaagaaatatctgtga

SEQ ID NO: 6536454 - DNA, 12 bp, Homo sapiens
ttctaagaagac

SEQ ID NO: 6536455 - DNA, 14 bp, Homo sapiens
ttctaagaagacat

SEQ ID NO: 6536456 - DNA, 15 bp, Homo sapiens
ttctaagaagacatt

SEQ ID NO: 6536457 - DNA, 17 bp, Homo sapiens
ttctaagaagacatttt

SEQ ID NO: 6536458 - DNA, 19 bp, Homo sapiens
ttctaagaagttacttttt

SEQ ID NO: 6536459 - DNA, 18 bp, Homo sapiens
ttctaagaagttgtttga

SEQ ID NO: 6536460 - DNA, 21 bp, Homo sapiens
ttctaagactactaaggcctt

SEQ ID NO: 6536461 - DNA, 22 bp, Homo sapiens
ttctaagactcaaatgttctaa

SEQ ID NO: 6536462 - DNA, 15 bp, Homo sapiens
ttctaagactctgtg

SEQ ID NO: 6536463 - DNA, 18 bp, Homo sapiens
ttctaagagaagttattt

SEQ ID NO: 6536464 - DNA, 15 bp, Homo sapiens
ttctaagattctaaa

SEQ ID NO: 6536465 - DNA, 21 bp, Homo sapiens
ttctaagcaatgcaaatgtct

SEQ ID NO: 6536466 - DNA, 13 bp, Homo sapiens
ttctaagccctgt

SEQ ID NO: 6536467 - DNA, 21 bp, Homo sapiens
ttctaagccctgttctcctgt

SEQ ID NO: 6536468 - DNA, 23 bp, Homo sapiens
ttctaagcgcctattgtttgtaa

SEQ ID NO: 6536469 - DNA, 14 bp, Homo sapiens
ttctaaggaatatg

SEQ ID NO: 6536470 - DNA, 12 bp, Homo sapiens
ttctaaggctct

SEQ ID NO: 6536471 - DNA, 16 bp, Homo sapiens
ttctaaggctctgaga

SEQ ID NO: 6536472 - DNA, 17 bp, Homo sapiens
ttctaaggctctgagag

SEQ ID NO: 6536473 - DNA, 19 bp, Homo sapiens
ttctaagggaaaaagttgt

SEQ ID NO: 6536474 - DNA, 15 bp, Homo sapiens
ttctaagtaaaacca

SEQ ID NO: 6536475 - DNA, 16 bp, Homo sapiens
ttctaagtaaaaccac

SEQ ID NO: 6536476 - DNA, 18 bp, Homo sapiens
ttctaagtaaatacaatt

SEQ ID NO: 6536477 - DNA, 21 bp, Homo sapiens
ttctaagtaaatacaattttt

SEQ ID NO: 6536478 - DNA, 18 bp, Homo sapiens
ttctaagtcattcataaa

SEQ ID NO: 6536479 - DNA, 12 bp, Homo sapiens
ttctaagtcttt

SEQ ID NO: 6536480 - DNA, 20 bp, Homo sapiens
ttctaagtgaaatttctagc

SEQ ID NO: 6536481 - DNA, 14 bp, Homo sapiens
ttctaagtgggaga

SEQ ID NO: 6536482 - DNA, 13 bp, Homo sapiens
ttctaagttaaat

SEQ ID NO: 6536483 - DNA, 22 bp, Homo sapiens
ttctaagttagactcttcccct

SEQ ID NO: 6536484 - DNA, 19 bp, Homo sapiens
ttctaagttatttactttt

SEQ ID NO: 6536485 - DNA, 14 bp, Homo sapiens
ttctaataaagcca

SEQ ID NO: 6536486 - DNA, 20 bp, Homo sapiens
ttctaataaagccatttctt

SEQ ID NO: 6536487 - DNA, 16 bp, Homo sapiens
ttctaataaagtcatt

SEQ ID NO: 6536488 - DNA, 18 bp, Homo sapiens
ttctaataaattatacaa

SEQ ID NO: 6536489 - DNA, 17 bp, Homo sapiens
ttctaataagctagttg

SEQ ID NO: 6536490 - DNA, 15 bp, Homo sapiens
ttctaataatttcta

SEQ ID NO: 6536491 - DNA, 16 bp, Homo sapiens
ttctaataatttctaa

SEQ ID NO: 6536492 - DNA, 19 bp, Homo sapiens
ttctaatacgagccttctc

SEQ ID NO: 6536493 - DNA, 14 bp, Homo sapiens
ttctaatagaactc

SEQ ID NO: 6536494 - DNA, 22 bp, Homo sapiens
ttctaataggtactgccatatt

SEQ ID NO: 6536495 - DNA, 18 bp, Homo sapiens
ttctaatatttattgctt

SEQ ID NO: 6536496 - DNA, 19 bp, Homo sapiens
ttctaatatttattgcttt

SEQ ID NO: 6536497 - DNA, 16 bp, Homo sapiens
ttctaatcacagtgtt

SEQ ID NO: 6536498 - DNA, 14 bp, Homo sapiens
ttctaatccatgtg

SEQ ID NO: 6536499 - DNA, 15 bp, Homo sapiens
ttctaatccttttcc

SEQ ID NO: 6536500 - DNA, 13 bp, Homo sapiens
ttctaatgcatat

SEQ ID NO: 6536501 - DNA, 16 bp, Homo sapiens
ttctaatggccttcca

SEQ ID NO: 6536502 - DNA, 13 bp, Homo sapiens
ttctaatggtaac

SEQ ID NO: 6536503 - DNA, 16 bp, Homo sapiens
ttctaatgtaaatttt

SEQ ID NO: 6536504 - DNA, 18 bp, Homo sapiens
ttctaatgtagctatttt

SEQ ID NO: 6536505 - DNA, 13 bp, Homo sapiens
ttctaatgtcttc

SEQ ID NO: 6536506 - DNA, 14 bp, Homo sapiens
ttctaatgtcttca

SEQ ID NO: 6536507 - DNA, 23 bp, Homo sapiens
ttctaatgtgtgaatcagagcac

SEQ ID NO: 6536508 - DNA, 14 bp, Homo sapiens
ttctaatgttattt

SEQ ID NO: 6536509 - DNA, 18 bp, Homo sapiens
ttctaatgttattttcct

SEQ ID NO: 6536510 - DNA, 22 bp, Homo sapiens
ttctaatgttattttccttctg

SEQ ID NO: 6536511 - DNA, 23 bp, Homo sapiens
ttctaatgttattttccttctga

SEQ ID NO: 6536512 - DNA, 16 bp, Homo sapiens
ttctaatgtttactat

SEQ ID NO: 6536513 - DNA, 16 bp, Homo sapiens
ttctaattaaaattgt

SEQ ID NO: 6536514 - DNA, 23 bp, Homo sapiens
ttctaattccacaggtcatcaga

SEQ ID NO: 6536515 - DNA, 15 bp, Homo sapiens
ttctaattgccatgt

SEQ ID NO: 6536516 - DNA, 13 bp, Homo sapiens
ttctaattgctta

SEQ ID NO: 6536517 - DNA, 16 bp, Homo sapiens
ttctaattgcttattt

SEQ ID NO: 6536518 - DNA, 17 bp, Homo sapiens
ttctaatttgctgctga

SEQ ID NO: 6536519 - DNA, 20 bp, Homo sapiens
ttctaattttgtgctctttc

SEQ ID NO: 6536520 - DNA, 18 bp, Homo sapiens
ttctacaaaaaaccagga

SEQ ID NO: 6536521 - DNA, 12 bp, Homo sapiens
ttctacaaaaga

SEQ ID NO: 6536522 - DNA, 21 bp, Homo sapiens
ttctacaaaagaagtgtgact

SEQ ID NO: 6536523 - DNA, 15 bp, Homo sapiens
ttctacaaaataaca

SEQ ID NO: 6536524 - DNA, 22 bp, Homo sapiens
ttctacaaaataacattctgaa

SEQ ID NO: 6536525 - DNA, 18 bp, Homo sapiens
ttctacaaaatcctgatg

SEQ ID NO: 6536526 - DNA, 14 bp, Homo sapiens
ttctacaaagcact

SEQ ID NO: 6536527 - DNA, 18 bp, Homo sapiens
ttctacaactttaaaact

SEQ ID NO: 6536528 - DNA, 16 bp, Homo sapiens
ttctacaagcatattt

SEQ ID NO: 6536529 - DNA, 19 bp, Homo sapiens
ttctacaagcatatttgag

SEQ ID NO: 6536530 - DNA, 21 bp, Homo sapiens
ttctacaagcatatttgagaa

SEQ ID NO: 6536531 - DNA, 13 bp, Homo sapiens
ttctacaaggact

SEQ ID NO: 6536532 - DNA, 15 bp, Homo sapiens
ttctacaatgtgaac

SEQ ID NO: 6536533 - DNA, 16 bp, Homo sapiens
ttctacaatgtgaact

SEQ ID NO: 6536534 - DNA, 18 bp, Homo sapiens
ttctacaatgtgaacttt

SEQ ID NO: 6536535 - DNA, 19 bp, Homo sapiens
ttctacaatgtgaacttta

SEQ ID NO: 6536536 - DNA, 13 bp, Homo sapiens
ttctacacagtaa

SEQ ID NO: 6536537 - DNA, 22 bp, Homo sapiens
ttctacacagtaaaaacttgta

SEQ ID NO: 6536538 - DNA, 19 bp, Homo sapiens
ttctacacagtgggaactc

SEQ ID NO: 6536539 - DNA, 17 bp, Homo sapiens
ttctacacatatatgta

SEQ ID NO: 6536540 - DNA, 12 bp, Homo sapiens
ttctacacctgg

SEQ ID NO: 6536541 - DNA, 11 bp, Homo sapiens
ttctacactct

SEQ ID NO: 6536542 - DNA, 19 bp, Homo sapiens
ttctacagaacctgagggc

SEQ ID NO: 6536543 - DNA, 19 bp, Homo sapiens
ttctacagagaaaatgaat

SEQ ID NO: 6536544 - DNA, 21 bp, Homo sapiens
ttctacagcaaatttataatt

SEQ ID NO: 6536545 - DNA, 17 bp, Homo sapiens
ttctacagtattatgta

SEQ ID NO: 6536546 - DNA, 18 bp, Homo sapiens
tgtacatatttgtggaat

SEQ ID NO: 6536547 - DNA, 16 bp, Homo sapiens
tgtacatcccaaagga

SEQ ID NO: 6536548 - DNA, 20 bp, Homo sapiens
tgtacatcctgcagcttatt

SEQ ID NO: 6536549 - DNA, 18 bp, Homo sapiens
tgtacatctattttggat

SEQ ID NO: 6536550 - DNA, 19 bp, Homo sapiens
tgtacatctattttggatt

SEQ ID NO: 6536551 - DNA, 15 bp, Homo sapiens
tgtacatctggctta

SEQ ID NO: 6536552 - DNA, 21 bp, Homo sapiens
tgtacatctggcttattttaa

SEQ ID NO: 6536553 - DNA, 17 bp, Homo sapiens
tgtacatgaaaacacat

SEQ ID NO: 6536554 - DNA, 19 bp, Homo sapiens
tgtacatgaaaacacattt

SEQ ID NO: 6536555 - DNA, 20 bp, Homo sapiens
tgtacatgaaaacacatttt

SEQ ID NO: 6536556 - DNA, 16 bp, Homo sapiens
tgtacatgaagaatgt

SEQ ID NO: 6536557 - DNA, 18 bp, Homo sapiens
tgtacatgacatcaaaat

SEQ ID NO: 6536558 - DNA, 14 bp, Homo sapiens
tgtacatgcattca

SEQ ID NO: 6536559 - DNA, 22 bp, Homo sapiens
tgtacatgctatgctgaagaca

SEQ ID NO: 6536560 - DNA, 21 bp, Homo sapiens
tgtacatggaataacatgtaa

SEQ ID NO: 6536561 - DNA, 15 bp, Homo sapiens
tgtacatggaatttt

SEQ ID NO: 6536562 - DNA, 20 bp, Homo sapiens
tgtacatggaattttttgaa

SEQ ID NO: 6536563 - DNA, 21 bp, Homo sapiens
tgtacatggaattttttgaat

SEQ ID NO: 6536564 - DNA, 17 bp, Homo sapiens
tgtacatggcagagttt

SEQ ID NO: 6536565 - DNA, 14 bp, Homo sapiens
tgtacatgggacta

SEQ ID NO: 6536566 - DNA, 19 bp, Homo sapiens
tgtacatgggactatgctt

SEQ ID NO: 6536567 - DNA, 14 bp, Homo sapiens
tgtacatgtacata

SEQ ID NO: 6536568 - DNA, 16 bp, Homo sapiens
tgtacatgtacatagt

SEQ ID NO: 6536569 - DNA, 16 bp, Homo sapiens
tgtacatgtatgaaat

SEQ ID NO: 6536570 - DNA, 13 bp, Homo sapiens
tgtacatgtatta

SEQ ID NO: 6536571 - DNA, 17 bp, Homo sapiens
tgtacatgtggaaaact

SEQ ID NO: 6536572 - DNA, 12 bp, Homo sapiens
tgtacatgtgta

SEQ ID NO: 6536573 - DNA, 20 bp, Homo sapiens
tgtacatgtgtagcctgtgc

SEQ ID NO: 6536574 - DNA, 22 bp, Homo sapiens
tgtacatgtgtagggaaagtta

SEQ ID NO: 6536575 - DNA, 19 bp, Homo sapiens
tgtacatgtgtgcagagca

SEQ ID NO: 6536576 - DNA, 20 bp, Homo sapiens
tgtacatgtgtgcagagcag

SEQ ID NO: 6536577 - DNA, 21 bp, Homo sapiens
tgtacatgttcgggtgtgggt

SEQ ID NO: 6536578 - DNA, 18 bp, Homo sapiens
tgtacatgttcttgtcat

SEQ ID NO: 6536579 - DNA, 16 bp, Homo sapiens
tgtacattaaatacca

SEQ ID NO: 6536580 - DNA, 17 bp, Homo sapiens
tgtacattacagattaa

SEQ ID NO: 6536581 - DNA, 14 bp, Homo sapiens
tgtacattatgaag

SEQ ID NO: 6536582 - DNA, 17 bp, Homo sapiens
tgtacattccctgcatc

SEQ ID NO: 6536583 - DNA, 15 bp, Homo sapiens
tgtacatttaaaatt

SEQ ID NO: 6536584 - DNA, 20 bp, Homo sapiens
tgtacatttaaaattgctat

SEQ ID NO: 6536585 - DNA, 14 bp, Homo sapiens
tgtacatttaataa

SEQ ID NO: 6536586 - DNA, 20 bp, Homo sapiens
tgtacatttatgttccttta

SEQ ID NO: 6536587 - DNA, 20 bp, Homo sapiens
tgtacatttcacaggctaat

SEQ ID NO: 6536588 - DNA, 21 bp, Homo sapiens
tgtacatttccaaattcacaa

SEQ ID NO: 6536589 - DNA, 16 bp, Homo sapiens
tgtacatttctgaaat

SEQ ID NO: 6536590 - DNA, 15 bp, Homo sapiens
tgtacatttggaaca

SEQ ID NO: 6536591 - DNA, 23 bp, Homo sapiens
tgtacattttaaaggataatggt

SEQ ID NO: 6536592 - DNA, 18 bp, Homo sapiens
tgtacattttggatttct

SEQ ID NO: 6536593 - DNA, 19 bp, Homo sapiens
tgtacattttggatttctt

SEQ ID NO: 6536594 - DNA, 14 bp, Homo sapiens
tgtacattttgtaa

SEQ ID NO: 6536595 - DNA, 16 bp, Homo sapiens
tgtacattttgttgta

SEQ ID NO: 6536596 - DNA, 21 bp, Homo sapiens
tgtacatttttgatcaaatgt

SEQ ID NO: 6536597 - DNA, 22 bp, Homo sapiens
tgtacatttttgatcaaatgta

SEQ ID NO: 6536598 - DNA, 17 bp, Homo sapiens
tgtacattttttttcaa

SEQ ID NO: 6536599 - DNA, 14 bp, Homo sapiens
tgtaccaaagctgt

SEQ ID NO: 6536600 - DNA, 17 bp, Homo sapiens
tgtaccaaatctgacat

SEQ ID NO: 6536601 - DNA, 14 bp, Homo sapiens
tgtaccaagcccct

SEQ ID NO: 6536602 - DNA, 16 bp, Homo sapiens
tgtaccaagtgaaatt

SEQ ID NO: 6536603 - DNA, 23 bp, Homo sapiens
tgtaccacagacacaatatgtat

SEQ ID NO: 6536604 - DNA, 18 bp, Homo sapiens
tgtaccactgctaataaa

SEQ ID NO: 6536605 - DNA, 21 bp, Homo sapiens
tgtaccacttcctgaggcctc

SEQ ID NO: 6536606 - DNA, 22 bp, Homo sapiens
tgtaccacttctgtgggcatgg

SEQ ID NO: 6536607 - DNA, 16 bp, Homo sapiens
tgtaccagcccaggca

SEQ ID NO: 6536608 - DNA, 21 bp, Homo sapiens
tgtaccaggaaaggattttat

SEQ ID NO: 6536609 - DNA, 16 bp, Homo sapiens
tgtaccagtgaatttt

SEQ ID NO: 6536610 - DNA, 20 bp, Homo sapiens
tgtaccagtgaatttttgca

SEQ ID NO: 6536611 - DNA, 22 bp, Homo sapiens
tgtaccagtgtactgctttcaa

SEQ ID NO: 6536612 - DNA, 15 bp, Homo sapiens
tgtaccagttaattt

SEQ ID NO: 6536613 - DNA, 22 bp, Homo sapiens
tgtaccatagaaaaatgtataa

SEQ ID NO: 6536614 - DNA, 17 bp, Homo sapiens
tgtaccatatgtagcat

SEQ ID NO: 6536615 - DNA, 16 bp, Homo sapiens
tgtaccatattgctct

SEQ ID NO: 6536616 - DNA, 17 bp, Homo sapiens
tgtaccatcattttatt

SEQ ID NO: 6536617 - DNA, 21 bp, Homo sapiens
tgtaccatgaaacaaagctgc

SEQ ID NO: 6536618 - DNA, 18 bp, Homo sapiens
tgtaccatggttgtgcac

SEQ ID NO: 6536619 - DNA, 17 bp, Homo sapiens
tgtaccatgtacatgaa

SEQ ID NO: 6536620 - DNA, 13 bp, Homo sapiens
tgtaccatgttaa

SEQ ID NO: 6536621 - DNA, 13 bp, Homo sapiens
tgtaccattaaaa

SEQ ID NO: 6536622 - DNA, 15 bp, Homo sapiens
tgtaccattaaaata

SEQ ID NO: 6536623 - DNA, 15 bp, Homo sapiens
tgtaccattccttca

SEQ ID NO: 6536624 - DNA, 17 bp, Homo sapiens
tgtaccattccttcaaa

SEQ ID NO: 6536625 - DNA, 16 bp, Homo sapiens
tgtacccaatttaatt

SEQ ID NO: 6536626 - DNA, 19 bp, Homo sapiens
tgtacccaatttaattcca

SEQ ID NO: 6536627 - DNA, 18 bp, Homo sapiens
tgtacccaccatacagat

SEQ ID NO: 6536628 - DNA, 21 bp, Homo sapiens
tgtacccaccccagcacagcc

SEQ ID NO: 6536629 - DNA, 16 bp, Homo sapiens
tgtacccaccgggcca

SEQ ID NO: 6536630 - DNA, 20 bp, Homo sapiens
tgtacccaccgggccactcc

SEQ ID NO: 6536631 - DNA, 16 bp, Homo sapiens
tgtacccactcctcac

SEQ ID NO: 6536632 - DNA, 21 bp, Homo sapiens
tgtacccactcctcactgccc

SEQ ID NO: 6536633 - DNA, 13 bp, Homo sapiens
tgtacccagccac

SEQ ID NO: 6536634 - DNA, 13 bp, Homo sapiens
tgtacccagctcc

SEQ ID NO: 6536635 - DNA, 19 bp, Homo sapiens
tgtaccccatcccttcctc

SEQ ID NO: 6536636 - DNA, 16 bp, Homo sapiens
tgtaccccccaacccc

SEQ ID NO: 6536637 - DNA, 23 bp, Homo sapiens
tgtaccccccaacccctgaggaa

SEQ ID NO: 6536638 - DNA, 15 bp, Homo sapiens
tgtacccccgcccag

SEQ ID NO: 6536639 - DNA, 16 bp, Homo sapiens
tgtacccccgcccagg

SEQ ID NO: 6536640 - DNA, 22 bp, Homo sapiens
tgtacccccgcccaggctggcc

SEQ ID NO: 6536641 - DNA, 18 bp, Homo sapiens
tgtaccccctttcccttc

SEQ ID NO: 6536642 - DNA, 18 bp, Homo sapiens
tgtacccctctcagtctg

SEQ ID NO: 6536643 - DNA, 18 bp, Homo sapiens
tgtaccctatgttcactc

SEQ ID NO: 6536644 - DNA, 12 bp, Homo sapiens
tgtacccttaag

SEQ ID NO: 6536645 - DNA, 19 bp, Homo sapiens
tgtacccttcttgtctctc

SEQ ID NO: 6536646 - DNA, 19 bp, Homo sapiens
tgtacccttgttttgaaac

SEQ ID NO: 6536647 - DNA, 15 bp, Homo sapiens
tgtaccgagaactgg

SEQ ID NO: 6536648 - DNA, 22 bp, Homo sapiens
tgtaccgatgatactgtttctt

SEQ ID NO: 6536649 - DNA, 20 bp, Homo sapiens
tgtaccgcgtctaccctggg

SEQ ID NO: 6536650 - DNA, 14 bp, Homo sapiens
tgtacctaaagcaa

SEQ ID NO: 6536651 - DNA, 16 bp, Homo sapiens
tgtacctaagtaaatt

SEQ ID NO: 6536652 - DNA, 18 bp, Homo sapiens
tgtacctacagctaagct

SEQ ID NO: 6536653 - DNA, 16 bp, Homo sapiens
tgtacctattccttca

SEQ ID NO: 6536654 - DNA, 15 bp, Homo sapiens
tgtacctatttctga

SEQ ID NO: 6536655 - DNA, 19 bp, Homo sapiens
tgtacctatttctgatgat

SEQ ID NO: 6536656 - DNA, 14 bp, Homo sapiens
tgtacctcaaatga

SEQ ID NO: 6536657 - DNA, 21 bp, Homo sapiens
tgtacctcaaatgaattcttt

SEQ ID NO: 6536658 - DNA, 15 bp, Homo sapiens
tgtacctcagtggat

SEQ ID NO: 6536659 - DNA, 13 bp, Homo sapiens
tgtacctcccctg

SEQ ID NO: 6536660 - DNA, 22 bp, Homo sapiens
tgtacctcccctgccttgctgt

SEQ ID NO: 6536661 - DNA, 15 bp, Homo sapiens
tgtacctcctctcag

SEQ ID NO: 6536662 - DNA, 19 bp, Homo sapiens
tgtacctcctctcagtgtt

SEQ ID NO: 6536663 - DNA, 14 bp, Homo sapiens
tgtacctctagaat

SEQ ID NO: 6536664 - DNA, 18 bp, Homo sapiens
tgtacctctagaatccca

SEQ ID NO: 6536665 - DNA, 19 bp, Homo sapiens
tgtacctctagctgttctt

SEQ ID NO: 6536666 - DNA, 17 bp, Homo sapiens
tgtacctctattagttt

SEQ ID NO: 6536667 - DNA, 13 bp, Homo sapiens
tgtacctctctct

SEQ ID NO: 6536668 - DNA, 20 bp, Homo sapiens
tgtacctctctctgctcctc

SEQ ID NO: 6536669 - DNA, 17 bp, Homo sapiens
tgtacctctggctgact

SEQ ID NO: 6536670 - DNA, 14 bp, Homo sapiens
tgtacctcttgagc

SEQ ID NO: 6536671 - DNA, 21 bp, Homo sapiens
tgtacctcttttagtcatttt

SEQ ID NO: 6536672 - DNA, 18 bp, Homo sapiens
tgtacctgcccccaatcc

SEQ ID NO: 6536673 - DNA, 22 bp, Homo sapiens
tgtacctgcccccactcagcat

SEQ ID NO: 6536674 - DNA, 13 bp, Homo sapiens
tgtacctgctgga

SEQ ID NO: 6536675 - DNA, 16 bp, Homo sapiens
tgtacctgctggaaga

SEQ ID NO: 6536676 - DNA, 12 bp, Homo sapiens
tgtacctggctg

SEQ ID NO: 6536677 - DNA, 13 bp, Homo sapiens
tgtacctggctga

SEQ ID NO: 6536678 - DNA, 12 bp, Homo sapiens
tgtacctgtagg

SEQ ID NO: 6536679 - DNA, 17 bp, Homo sapiens
tgtacctgtaggaaaca

SEQ ID NO: 6536680 - DNA, 18 bp, Homo sapiens
tgtacctgtaggaaacag

SEQ ID NO: 6536681 - DNA, 15 bp, Homo sapiens
tgtacctgtggctgt

SEQ ID NO: 6536682 - DNA, 16 bp, Homo sapiens
tgtacctgtggctgtg

SEQ ID NO: 6536683 - DNA, 17 bp, Homo sapiens
tgtacctgttccttaga

SEQ ID NO: 6536684 - DNA, 19 bp, Homo sapiens
tgtaccttattgatctttg

SEQ ID NO: 6536685 - DNA, 22 bp, Homo sapiens
tgtaccttgtgtactttcttcc

SEQ ID NO: 6536686 - DNA, 13 bp, Homo sapiens
tgtacctttgtgt

SEQ ID NO: 6536687 - DNA, 15 bp, Homo sapiens
tgtaccttttaacac

SEQ ID NO: 6536688 - DNA, 22 bp, Homo sapiens
tgtaccttttgaggagccccag

SEQ ID NO: 6536689 - DNA, 21 bp, Homo sapiens
tgtaccttttttgttttttca

SEQ ID NO: 6536690 - DNA, 14 bp, Homo sapiens
tgtacgaagagtat

SEQ ID NO: 6536691 - DNA, 22 bp, Homo sapiens
tgtacgaagagtatttttgaca

SEQ ID NO: 6536692 - DNA, 14 bp, Homo sapiens
tgtacgcgccaccg

SEQ ID NO: 6536693 - DNA, 22 bp, Homo sapiens
tgtacgcgccaccgagtgcctt

SEQ ID NO: 6536694 - DNA, 15 bp, Homo sapiens
tgtacgtagccacag

SEQ ID NO: 6536695 - DNA, 17 bp, Homo sapiens
tgtacgtagccacagga

SEQ ID NO: 6536696 - DNA, 15 bp, Homo sapiens
tgtacgtggagaggg

SEQ ID NO: 6536697 - DNA, 17 bp, Homo sapiens
tgtacgttcttctattg

SEQ ID NO: 6536698 - DNA, 20 bp, Homo sapiens
tgtacgttttgcacattttg

SEQ ID NO: 6536699 - DNA, 20 bp, Homo sapiens
tgtactaaacagtaagatat

SEQ ID NO: 6536700 - DNA, 18 bp, Homo sapiens
tgtactaaacatttcctt

SEQ ID NO: 6536701 - DNA, 18 bp, Homo sapiens
tgtactaaagccaaacat

SEQ ID NO: 6536702 - DNA, 16 bp, Homo sapiens
tgtactaacccagtct

SEQ ID NO: 6536703 - DNA, 16 bp, Homo sapiens
tgtactaagccaggag

SEQ ID NO: 6536704 - DNA, 18 bp, Homo sapiens
tgtactaagccaggaggc

SEQ ID NO: 6536705 - DNA, 15 bp, Homo sapiens
tgtactaaggagcat

SEQ ID NO: 6536706 - DNA, 15 bp, Homo sapiens
tgtactacacttctg

SEQ ID NO: 6536707 - DNA, 22 bp, Homo sapiens
tgtactacacttctgaaactta

SEQ ID NO: 6536708 - DNA, 12 bp, Homo sapiens
tgtactacagct

SEQ ID NO: 6536709 - DNA, 16 bp, Homo sapiens
tgtactacagctatat

SEQ ID NO: 6536710 - DNA, 21 bp, Homo sapiens
tgtactacagctatatttgat

SEQ ID NO: 6536711 - DNA, 13 bp, Homo sapiens
tgtactaccccag

SEQ ID NO: 6536712 - DNA, 14 bp, Homo sapiens
tgtactacctgtgt

SEQ ID NO: 6536713 - DNA, 17 bp, Homo sapiens
tgtactacctgtgtata

SEQ ID NO: 6536714 - DNA, 21 bp, Homo sapiens
tgtactacgtgccagctctag

SEQ ID NO: 6536715 - DNA, 15 bp, Homo sapiens
tgtactactctaggg

SEQ ID NO: 6536716 - DNA, 19 bp, Homo sapiens
tgtactagtactgtgtact

SEQ ID NO: 6536717 - DNA, 19 bp, Homo sapiens
tgtactataacatagaatt

SEQ ID NO: 6536718 - DNA, 15 bp, Homo sapiens
tgtactataagtagt

SEQ ID NO: 6536719 - DNA, 19 bp, Homo sapiens
tgtactataagtagttggt

SEQ ID NO: 6536720 - DNA, 21 bp, Homo sapiens
tgtactatagcggcatataga

SEQ ID NO: 6536721 - DNA, 15 bp, Homo sapiens
tgtactatatgtata

SEQ ID NO: 6536722 - DNA, 21 bp, Homo sapiens
tgtactattgcttaaacaaaa

SEQ ID NO: 6536723 - DNA, 18 bp, Homo sapiens
tgtactatttaactgact

SEQ ID NO: 6536724 - DNA, 11 bp, Homo sapiens
tgtactcacat

SEQ ID NO: 6536725 - DNA, 21 bp, Homo sapiens
ttctacagtggttttatactg

SEQ ID NO: 6536726 - DNA, 17 bp, Homo sapiens
ttctacataattgtgac

SEQ ID NO: 6536727 - DNA, 15 bp, Homo sapiens
ttctacatactatgg

SEQ ID NO: 6536728 - DNA, 18 bp, Homo sapiens
ttctacatagtaactctt

SEQ ID NO: 6536729 - DNA, 14 bp, Homo sapiens
ttctacatgactgg

SEQ ID NO: 6536730 - DNA, 18 bp, Homo sapiens
ttctacatgactgggcct

SEQ ID NO: 6536731 - DNA, 17 bp, Homo sapiens
ttctacatgtaatgaca

SEQ ID NO: 6536732 - DNA, 18 bp, Homo sapiens
ttctacatgtaatgacac

SEQ ID NO: 6536733 - DNA, 17 bp, Homo sapiens
ttctacattaacttgaa

SEQ ID NO: 6536734 - DNA, 18 bp, Homo sapiens
ttctacattattgcttat

SEQ ID NO: 6536735 - DNA, 22 bp, Homo sapiens
ttctacatttcacctactttgt

SEQ ID NO: 6536736 - DNA, 17 bp, Homo sapiens
ttctacatttcttagac

SEQ ID NO: 6536737 - DNA, 17 bp, Homo sapiens
ttctaccaaatgtgtaa

SEQ ID NO: 6536738 - DNA, 14 bp, Homo sapiens
ttctaccaagctgt

SEQ ID NO: 6536739 - DNA, 21 bp, Homo sapiens
ttctaccacacacagcctgtc

SEQ ID NO: 6536740 - DNA, 19 bp, Homo sapiens
ttctaccaggcaaattcac

SEQ ID NO: 6536741 - DNA, 20 bp, Homo sapiens
ttctacccagatggaaaaat

SEQ ID NO: 6536742 - DNA, 12 bp, Homo sapiens
ttctacccagcg

SEQ ID NO: 6536743 - DNA, 20 bp, Homo sapiens
ttctacccagcgagccctgg

SEQ ID NO: 6536744 - DNA, 14 bp, Homo sapiens
ttctaccccacctg

SEQ ID NO: 6536745 - DNA, 19 bp, Homo sapiens
ttctaccccacctgacctc

SEQ ID NO: 6536746 - DNA, 14 bp, Homo sapiens
ttctaccctagcca

SEQ ID NO: 6536747 - DNA, 15 bp, Homo sapiens
ttctaccctagccat

SEQ ID NO: 6536748 - DNA, 21 bp, Homo sapiens
ttctaccctagccattcctgg

SEQ ID NO: 6536749 - DNA, 19 bp, Homo sapiens
ttctaccctcatcatcata

SEQ ID NO: 6536750 - DNA, 14 bp, Homo sapiens
ttctacccttttcc

SEQ ID NO: 6536751 - DNA, 17 bp, Homo sapiens
ttctacccttttccttt

SEQ ID NO: 6536752 - DNA, 23 bp, Homo sapiens
ttctaccggagagagaatgtatt

SEQ ID NO: 6536753 - DNA, 21 bp, Homo sapiens
ttctaccgtggatttgtactt

SEQ ID NO: 6536754 - DNA, 22 bp, Homo sapiens
ttctaccgtggatttgtacttg

SEQ ID NO: 6536755 - DNA, 13 bp, Homo sapiens
ttctacctcccag

SEQ ID NO: 6536756 - DNA, 15 bp, Homo sapiens
ttctacctcttccag

SEQ ID NO: 6536757 - DNA, 11 bp, Homo sapiens
ttctacctgcc

SEQ ID NO: 6536758 - DNA, 12 bp, Homo sapiens
ttctacctgcca

SEQ ID NO: 6536759 - DNA, 13 bp, Homo sapiens
ttctacctgccct

SEQ ID NO: 6536760 - DNA, 21 bp, Homo sapiens
ttctacctgtgttcattctta

SEQ ID NO: 6536761 - DNA, 16 bp, Homo sapiens
ttctacgcataaacta

SEQ ID NO: 6536762 - DNA, 14 bp, Homo sapiens
ttctacggatcatc

SEQ ID NO: 6536763 - DNA, 22 bp, Homo sapiens
ttctacgttatgaaaacagatg

SEQ ID NO: 6536764 - DNA, 14 bp, Homo sapiens
ttctacgtttcttt

SEQ ID NO: 6536765 - DNA, 20 bp, Homo sapiens
ttctactatatacatatata

SEQ ID NO: 6536766 - DNA, 16 bp, Homo sapiens
ttctactatgatcaga

SEQ ID NO: 6536767 - DNA, 21 bp, Homo sapiens
ttctactcacttttcccactc

SEQ ID NO: 6536768 - DNA, 17 bp, Homo sapiens
ttctactctgtcttaaa

SEQ ID NO: 6536769 - DNA, 21 bp, Homo sapiens
ttctactgccttgaaaaatga

SEQ ID NO: 6536770 - DNA, 23 bp, Homo sapiens
ttctactgccttgaaaaatgaca

SEQ ID NO: 6536771 - DNA, 24 bp, Homo sapiens
ttctactgttatgtgagaacatta

SEQ ID NO: 6536772 - DNA, 16 bp, Homo sapiens
ttctacttcccctggg

SEQ ID NO: 6536773 - DNA, 19 bp, Homo sapiens
ttctacttgctctggacct

SEQ ID NO: 6536774 - DNA, 17 bp, Homo sapiens
ttctactttcatcttaa

SEQ ID NO: 6536775 - DNA, 16 bp, Homo sapiens
ttctactttttccttc

SEQ ID NO: 6536776 - DNA, 22 bp, Homo sapiens
ttctagaaactctggctcagcc

SEQ ID NO: 6536777 - DNA, 19 bp, Homo sapiens
ttctagaaagagaaacagt

SEQ ID NO: 6536778 - DNA, 23 bp, Homo sapiens
ttctagaaatacacttttttcca

SEQ ID NO: 6536779 - DNA, 21 bp, Homo sapiens
ttctagaacatccctgccagc

SEQ ID NO: 6536780 - DNA, 22 bp, Homo sapiens
ttctagaacctgggctgtgctg

SEQ ID NO: 6536781 - DNA, 15 bp, Homo sapiens
ttctagaagcacatg

SEQ ID NO: 6536782 - DNA, 18 bp, Homo sapiens
ttctagaagcacatgtgt

SEQ ID NO: 6536783 - DNA, 19 bp, Homo sapiens
ttctagaagccacagtgcc

SEQ ID NO: 6536784 - DNA, 23 bp, Homo sapiens
ttctagaaggatgaacagttctc

SEQ ID NO: 6536785 - DNA, 18 bp, Homo sapiens
ttctagaagtttcccttc

SEQ ID NO: 6536786 - DNA, 14 bp, Homo sapiens
ttctagaatggttt

SEQ ID NO: 6536787 - DNA, 19 bp, Homo sapiens
ttctagacgcccctcccaa

SEQ ID NO: 6536788 - DNA, 17 bp, Homo sapiens
ttctagacttccccatc

SEQ ID NO: 6536789 - DNA, 12 bp, Homo sapiens
ttctagagaaga

SEQ ID NO: 6536790 - DNA, 14 bp, Homo sapiens
ttctagagaagagg

SEQ ID NO: 6536791 - DNA, 22 bp, Homo sapiens
ttctagagaagaggctggtgct

SEQ ID NO: 6536792 - DNA, 16 bp, Homo sapiens
ttctagagcactgcca

SEQ ID NO: 6536793 - DNA, 14 bp, Homo sapiens
ttctagagctttta

SEQ ID NO: 6536794 - DNA, 22 bp, Homo sapiens
ttctagaggctcatggccctgt

SEQ ID NO: 6536795 - DNA, 23 bp, Homo sapiens
ttctagagggagacttgttctag

SEQ ID NO: 6536796 - DNA, 20 bp, Homo sapiens
ttctagagtaattatctgtg

SEQ ID NO: 6536797 - DNA, 14 bp, Homo sapiens
ttctagagttcaga

SEQ ID NO: 6536798 - DNA, 15 bp, Homo sapiens
ttctagatcctgcac

SEQ ID NO: 6536799 - DNA, 18 bp, Homo sapiens
ttctagcaaatatgctgt

SEQ ID NO: 6536800 - DNA, 14 bp, Homo sapiens
ttctagcaactgtt

SEQ ID NO: 6536801 - DNA, 13 bp, Homo sapiens
ttctagcaatttt

SEQ ID NO: 6536802 - DNA, 17 bp, Homo sapiens
ttctagcacatcatggc

SEQ ID NO: 6536803 - DNA, 17 bp, Homo sapiens
ttctagcactggcctgc

SEQ ID NO: 6536804 - DNA, 22 bp, Homo sapiens
ttctagcagagaccctggtttt

SEQ ID NO: 6536805 - DNA, 13 bp, Homo sapiens
ttctagcaggcag

SEQ ID NO: 6536806 - DNA, 16 bp, Homo sapiens
ttctagcatggctgcc

SEQ ID NO: 6536807 - DNA, 16 bp, Homo sapiens
ttctagccaaactatt

SEQ ID NO: 6536808 - DNA, 14 bp, Homo sapiens
ttctagccacagtt

SEQ ID NO: 6536809 - DNA, 21 bp, Homo sapiens
ttctagccccgaggtggtggc

SEQ ID NO: 6536810 - DNA, 17 bp, Homo sapiens
ttctagctaatgtaata

SEQ ID NO: 6536811 - DNA, 19 bp, Homo sapiens
ttctagctagaaatatgat

SEQ ID NO: 6536812 - DNA, 19 bp, Homo sapiens
ttctagctctatttacttc

SEQ ID NO: 6536813 - DNA, 21 bp, Homo sapiens
ttctagctgagctttaaatca

SEQ ID NO: 6536814 - DNA, 13 bp, Homo sapiens
ttctagctgtctg

SEQ ID NO: 6536815 - DNA, 16 bp, Homo sapiens
ttctagctgtctgtga

SEQ ID NO: 6536816 - DNA, 20 bp, Homo sapiens
ttctagctgttgagctgttt

SEQ ID NO: 6536817 - DNA, 21 bp, Homo sapiens
ttctagctgttgagctgtttt

SEQ ID NO: 6536818 - DNA, 17 bp, Homo sapiens
ttctagcttagtgctat

SEQ ID NO: 6536819 - DNA, 16 bp, Homo sapiens
ttctagctttgttgtc

SEQ ID NO: 6536820 - DNA, 20 bp, Homo sapiens
ttctagctttgttgtcctcc

SEQ ID NO: 6536821 - DNA, 22 bp, Homo sapiens
ttctagctttgttgtcctccca

SEQ ID NO: 6536822 - DNA, 20 bp, Homo sapiens
ttctagcttttctctttccc

SEQ ID NO: 6536823 - DNA, 22 bp, Homo sapiens
ttctagcttttttcctcctttc

SEQ ID NO: 6536824 - DNA, 19 bp, Homo sapiens
ttctaggaagaattttaaa

SEQ ID NO: 6536825 - DNA, 23 bp, Homo sapiens
ttctaggaatggaggagccaggc

SEQ ID NO: 6536826 - DNA, 16 bp, Homo sapiens
ttctaggactgaatta

SEQ ID NO: 6536827 - DNA, 20 bp, Homo sapiens
ttctaggaggatgctgtgcc

SEQ ID NO: 6536828 - DNA, 21 bp, Homo sapiens
ttctaggagtcaactggctgg

SEQ ID NO: 6536829 - DNA, 20 bp, Homo sapiens
ttctaggatagcgctcccct

SEQ ID NO: 6536830 - DNA, 16 bp, Homo sapiens
ttctaggatagttgat

SEQ ID NO: 6536831 - DNA, 21 bp, Homo sapiens
ttctaggatagttgatgcatg

SEQ ID NO: 6536832 - DNA, 22 bp, Homo sapiens
ttctaggatagttgatgcatgt

SEQ ID NO: 6536833 - DNA, 20 bp, Homo sapiens
ttctaggatgaacaatgtat

SEQ ID NO: 6536834 - DNA, 23 bp, Homo sapiens
ttctaggcacaaggttggttgct

SEQ ID NO: 6536835 - DNA, 17 bp, Homo sapiens
ttctaggcatctcctct

SEQ ID NO: 6536836 - DNA, 21 bp, Homo sapiens
ttctaggcatctcctctcccc

SEQ ID NO: 6536837 - DNA, 19 bp, Homo sapiens
ttctaggcatctctgtact

SEQ ID NO: 6536838 - DNA, 14 bp, Homo sapiens
ttctaggcccccca

SEQ ID NO: 6536839 - DNA, 22 bp, Homo sapiens
ttctaggctacaattttctccc

SEQ ID NO: 6536840 - DNA, 17 bp, Homo sapiens
ttctaggggcaggtgaa

SEQ ID NO: 6536841 - DNA, 13 bp, Homo sapiens
ttctaggggtagc

SEQ ID NO: 6536842 - DNA, 14 bp, Homo sapiens
ttctaggggtagct

SEQ ID NO: 6536843 - DNA, 15 bp, Homo sapiens
ttctagggtccctga

SEQ ID NO: 6536844 - DNA, 16 bp, Homo sapiens
ttctagggtccctgaa

SEQ ID NO: 6536845 - DNA, 20 bp, Homo sapiens
ttctagggtgggccccagcc

SEQ ID NO: 6536846 - DNA, 17 bp, Homo sapiens
ttctaggtaggaagagc

SEQ ID NO: 6536847 - DNA, 15 bp, Homo sapiens
ttctaggtggcagga

SEQ ID NO: 6536848 - DNA, 20 bp, Homo sapiens
ttctaggtttctcttgtctt

SEQ ID NO: 6536849 - DNA, 20 bp, Homo sapiens
ttctagtaacagtatttcca

SEQ ID NO: 6536850 - DNA, 16 bp, Homo sapiens
ttctagtacataattg

SEQ ID NO: 6536851 - DNA, 19 bp, Homo sapiens
ttctagtacataattgatt

SEQ ID NO: 6536852 - DNA, 16 bp, Homo sapiens
ttctagtactgtattg

SEQ ID NO: 6536853 - DNA, 19 bp, Homo sapiens
ttctagtatttttttctta

SEQ ID NO: 6536854 - DNA, 20 bp, Homo sapiens
ttctagtcaactgctgtttt

SEQ ID NO: 6536855 - DNA, 23 bp, Homo sapiens
ttctagtctcctttgcactgagg

SEQ ID NO: 6536856 - DNA, 15 bp, Homo sapiens
ttctagtctctgatt

SEQ ID NO: 6536857 - DNA, 20 bp, Homo sapiens
ttctagtctggaactgctgc

SEQ ID NO: 6536858 - DNA, 16 bp, Homo sapiens
ttctagtctggtgttc

SEQ ID NO: 6536859 - DNA, 21 bp, Homo sapiens
ttctagtctggtgttctgagt

SEQ ID NO: 6536860 - DNA, 15 bp, Homo sapiens
ttctagtctgtttca

SEQ ID NO: 6536861 - DNA, 20 bp, Homo sapiens
ttctagtgagcctgggccag

SEQ ID NO: 6536862 - DNA, 23 bp, Homo sapiens
ttctagtgatgatggttcacgtt

SEQ ID NO: 6536863 - DNA, 17 bp, Homo sapiens
ttctagtgatttcctgt

SEQ ID NO: 6536864 - DNA, 20 bp, Homo sapiens
ttctagtgatttcctgtata

SEQ ID NO: 6536865 - DNA, 22 bp, Homo sapiens
ttctagtgatttcctgtataat

SEQ ID NO: 6536866 - DNA, 14 bp, Homo sapiens
ttctagtgctgctg

SEQ ID NO: 6536867 - DNA, 15 bp, Homo sapiens
ttctagtggctgttc

SEQ ID NO: 6536868 - DNA, 21 bp, Homo sapiens
ttctagtgggtttaatgttta

SEQ ID NO: 6536869 - DNA, 14 bp, Homo sapiens
ttctagtgtcactg

SEQ ID NO: 6536870 - DNA, 11 bp, Homo sapiens
ttctagtgtcc

SEQ ID NO: 6536871 - DNA, 13 bp, Homo sapiens
ttctagttcagag

SEQ ID NO: 6536872 - DNA, 16 bp, Homo sapiens
ttctagttctgccagg

SEQ ID NO: 6536873 - DNA, 19 bp, Homo sapiens
ttctagttgccctctacct

SEQ ID NO: 6536874 - DNA, 14 bp, Homo sapiens
ttctagttgctctt

SEQ ID NO: 6536875 - DNA, 18 bp, Homo sapiens
ttctagtttgcaacttca

SEQ ID NO: 6536876 - DNA, 15 bp, Homo sapiens
ttctagtttgcattc

SEQ ID NO: 6536877 - DNA, 19 bp, Homo sapiens
ttctagttttcagtttgta

SEQ ID NO: 6536878 - DNA, 23 bp, Homo sapiens
ttctagttttcagtttgtatata

SEQ ID NO: 6536879 - DNA, 15 bp, Homo sapiens
ttctagtttttaatt

SEQ ID NO: 6536880 - DNA, 14 bp, Homo sapiens
ttctataaatcagt

SEQ ID NO: 6536881 - DNA, 13 bp, Homo sapiens
ttctataaatgac

SEQ ID NO: 6536882 - DNA, 20 bp, Homo sapiens
ttctataaattgtagaacat

SEQ ID NO: 6536883 - DNA, 22 bp, Homo sapiens
ttctataaatttaagaaaacaa

SEQ ID NO: 6536884 - DNA, 13 bp, Homo sapiens
ttctataaggcca

SEQ ID NO: 6536885 - DNA, 21 bp, Homo sapiens
ttctataaggccataaaacag

SEQ ID NO: 6536886 - DNA, 23 bp, Homo sapiens
ttctataagtgtgaccagttttg

SEQ ID NO: 6536887 - DNA, 13 bp, Homo sapiens
ttctataagttgt

SEQ ID NO: 6536888 - DNA, 22 bp, Homo sapiens
ttctataagttttatgttaaat

SEQ ID NO: 6536889 - DNA, 16 bp, Homo sapiens
ttctataataagtttt

SEQ ID NO: 6536890 - DNA, 15 bp, Homo sapiens
ttctataatatttcc

SEQ ID NO: 6536891 - DNA, 16 bp, Homo sapiens
ttctataatgtgcctg

SEQ ID NO: 6536892 - DNA, 13 bp, Homo sapiens
ttctataatttaa

SEQ ID NO: 6536893 - DNA, 21 bp, Homo sapiens
ttctataatttccatttactt

SEQ ID NO: 6536894 - DNA, 14 bp, Homo sapiens
ttctatacaaatat

SEQ ID NO: 6536895 - DNA, 21 bp, Homo sapiens
ttctatacaaatataaatctt

SEQ ID NO: 6536896 - DNA, 18 bp, Homo sapiens
ttctatacacaccctgcc

SEQ ID NO: 6536897 - DNA, 13 bp, Homo sapiens
ttctatacagtag

SEQ ID NO: 6536898 - DNA, 19 bp, Homo sapiens
ttctatactgtttgtaata

SEQ ID NO: 6536899 - DNA, 19 bp, Homo sapiens
ttctatagcagtcatcatt

SEQ ID NO: 6536900 - DNA, 20 bp, Homo sapiens
ttctatagcatcacttaaaa

SEQ ID NO: 6536901 - DNA, 15 bp, Homo sapiens
ttctatagccaaaaa

SEQ ID NO: 6536902 - DNA, 19 bp, Homo sapiens
tgtactcacatataacatg

SEQ ID NO: 6536903 - DNA, 19 bp, Homo sapiens
tgtactcactgagtaacag

SEQ ID NO: 6536904 - DNA, 19 bp, Homo sapiens
tgtactcagagcagagcaa

SEQ ID NO: 6536905 - DNA, 12 bp, Homo sapiens
tgtactcagtgg

SEQ ID NO: 6536906 - DNA, 19 bp, Homo sapiens
tgtactcagtggacagtgc

SEQ ID NO: 6536907 - DNA, 14 bp, Homo sapiens
tgtactccagcctg

SEQ ID NO: 6536908 - DNA, 15 bp, Homo sapiens
tgtactccagcctgg

SEQ ID NO: 6536909 - DNA, 16 bp, Homo sapiens
tgtactccagcctggg

SEQ ID NO: 6536910 - DNA, 17 bp, Homo sapiens
tgtactccagcctgggc

SEQ ID NO: 6536911 - DNA, 16 bp, Homo sapiens
tgtactcccagcactt

SEQ ID NO: 6536912 - DNA, 13 bp, Homo sapiens
tgtactctggcct

SEQ ID NO: 6536913 - DNA, 14 bp, Homo sapiens
tgtactctggcctc

SEQ ID NO: 6536914 - DNA, 15 bp, Homo sapiens
tgtactctggcctct

SEQ ID NO: 6536915 - DNA, 13 bp, Homo sapiens
tgtactctgtgtg

SEQ ID NO: 6536916 - DNA, 18 bp, Homo sapiens
tgtactctgtgtgtgtat

SEQ ID NO: 6536917 - DNA, 20 bp, Homo sapiens
tgtactcttaggctaagaga

SEQ ID NO: 6536918 - DNA, 13 bp, Homo sapiens
tgtactcttccga

SEQ ID NO: 6536919 - DNA, 23 bp, Homo sapiens
tgtactcttccgatgtttgtgtc

SEQ ID NO: 6536920 - DNA, 13 bp, Homo sapiens
tgtactcttgctg

SEQ ID NO: 6536921 - DNA, 20 bp, Homo sapiens
tgtactgaaaaatggtaatt

SEQ ID NO: 6536922 - DNA, 17 bp, Homo sapiens
tgtactgaattctttat

SEQ ID NO: 6536923 - DNA, 15 bp, Homo sapiens
tgtactgagcactga

SEQ ID NO: 6536924 - DNA, 19 bp, Homo sapiens
tgtactgagccttgtaatt

SEQ ID NO: 6536925 - DNA, 22 bp, Homo sapiens
tgtactgagccttgtaattcta

SEQ ID NO: 6536926 - DNA, 18 bp, Homo sapiens
tgtactgagttctcatcc

SEQ ID NO: 6536927 - DNA, 12 bp, Homo sapiens
tgtactgataaa

SEQ ID NO: 6536928 - DNA, 18 bp, Homo sapiens
tgtactgatgattgtttg

SEQ ID NO: 6536929 - DNA, 17 bp, Homo sapiens
tgtactgatttcagtaa

SEQ ID NO: 6536930 - DNA, 18 bp, Homo sapiens
tgtactgcatgttaccat

SEQ ID NO: 6536931 - DNA, 14 bp, Homo sapiens
tgtactgcctgctt

SEQ ID NO: 6536932 - DNA, 15 bp, Homo sapiens
tgtactgctcaggct

SEQ ID NO: 6536933 - DNA, 16 bp, Homo sapiens
tgtactgctcaggctg

SEQ ID NO: 6536934 - DNA, 13 bp, Homo sapiens
tgtactgctttca

SEQ ID NO: 6536935 - DNA, 18 bp, Homo sapiens
tgtactggagagtggcaa

SEQ ID NO: 6536936 - DNA, 20 bp, Homo sapiens
tgtactggaggctctgttct

SEQ ID NO: 6536937 - DNA, 20 bp, Homo sapiens
tgtactggctcctctgtggt

SEQ ID NO: 6536938 - DNA, 15 bp, Homo sapiens
tgtactgggccatgt

SEQ ID NO: 6536939 - DNA, 13 bp, Homo sapiens
tgtactgggggtt

SEQ ID NO: 6536940 - DNA, 18 bp, Homo sapiens
tgtactggtaattgtaca

SEQ ID NO: 6536941 - DNA, 21 bp, Homo sapiens
tgtactggtcagcttgctcag

SEQ ID NO: 6536942 - DNA, 19 bp, Homo sapiens
tgtactggttagattcatt

SEQ ID NO: 6536943 - DNA, 14 bp, Homo sapiens
tgtactgtacataa

SEQ ID NO: 6536944 - DNA, 15 bp, Homo sapiens
tgtactgtactaatt

SEQ ID NO: 6536945 - DNA, 16 bp, Homo sapiens
tgtactgtagtttttc

SEQ ID NO: 6536946 - DNA, 19 bp, Homo sapiens
tgtactgtatagacagttt

SEQ ID NO: 6536947 - DNA, 17 bp, Homo sapiens
tgtactgtatgtgatga

SEQ ID NO: 6536948 - DNA, 12 bp, Homo sapiens
tgtactgtgctg

SEQ ID NO: 6536949 - DNA, 18 bp, Homo sapiens
tgtactgtgtttttaaat

SEQ ID NO: 6536950 - DNA, 18 bp, Homo sapiens
tgtactgttactgggccc

SEQ ID NO: 6536951 - DNA, 18 bp, Homo sapiens
tgtactgttcatacagtt

SEQ ID NO: 6536952 - DNA, 23 bp, Homo sapiens
tgtactgttcatacagttttata

SEQ ID NO: 6536953 - DNA, 23 bp, Homo sapiens
tgtactgttctcttcttgaacac

SEQ ID NO: 6536954 - DNA, 15 bp, Homo sapiens
tgtactgttctgtgt

SEQ ID NO: 6536955 - DNA, 24 bp, Homo sapiens
tgtactgtttaatgttctgtgata

SEQ ID NO: 6536956 - DNA, 13 bp, Homo sapiens
tgtactgtttgct

SEQ ID NO: 6536957 - DNA, 18 bp, Homo sapiens
tgtactgttttctgggcc

SEQ ID NO: 6536958 - DNA, 22 bp, Homo sapiens
tgtacttaaatggtaataagca

SEQ ID NO: 6536959 - DNA, 20 bp, Homo sapiens
tgtacttaataaattcagat

SEQ ID NO: 6536960 - DNA, 22 bp, Homo sapiens
tgtacttaataaattcagatat

SEQ ID NO: 6536961 - DNA, 21 bp, Homo sapiens
tgtacttacactgaaatccaa

SEQ ID NO: 6536962 - DNA, 13 bp, Homo sapiens
tgtacttacatgg

SEQ ID NO: 6536963 - DNA, 20 bp, Homo sapiens
tgtacttagccagttcaaag

SEQ ID NO: 6536964 - DNA, 18 bp, Homo sapiens
tgtacttattacagtctt

SEQ ID NO: 6536965 - DNA, 21 bp, Homo sapiens
tgtacttattacagtcttatt

SEQ ID NO: 6536966 - DNA, 20 bp, Homo sapiens
tgtacttattttccaataaa

SEQ ID NO: 6536967 - DNA, 21 bp, Homo sapiens
tgtacttcactgtcaggaaga

SEQ ID NO: 6536968 - DNA, 18 bp, Homo sapiens
tgtacttcagttctcatc

SEQ ID NO: 6536969 - DNA, 20 bp, Homo sapiens
tgtacttcataagatattct

SEQ ID NO: 6536970 - DNA, 18 bp, Homo sapiens
tgtacttcccgggccagg

SEQ ID NO: 6536971 - DNA, 21 bp, Homo sapiens
tgtacttcccgggccagggct

SEQ ID NO: 6536972 - DNA, 22 bp, Homo sapiens
tgtacttccctcttgaaacctg

SEQ ID NO: 6536973 - DNA, 12 bp, Homo sapiens
tgtacttcctga

SEQ ID NO: 6536974 - DNA, 12 bp, Homo sapiens
tgtacttctctg

SEQ ID NO: 6536975 - DNA, 16 bp, Homo sapiens
tgtacttcttattgca

SEQ ID NO: 6536976 - DNA, 20 bp, Homo sapiens
tgtacttcttattgcaaggc

SEQ ID NO: 6536977 - DNA, 18 bp, Homo sapiens
tgtacttgatactgaatg

SEQ ID NO: 6536978 - DNA, 15 bp, Homo sapiens
tgtacttgatttgat

SEQ ID NO: 6536979 - DNA, 23 bp, Homo sapiens
tgtacttgccctgaccatgcatt

SEQ ID NO: 6536980 - DNA, 15 bp, Homo sapiens
tgtacttgctcttga

SEQ ID NO: 6536981 - DNA, 22 bp, Homo sapiens
tgtacttggagtaattgcacat

SEQ ID NO: 6536982 - DNA, 18 bp, Homo sapiens
tgtacttgtgatgagaga

SEQ ID NO: 6536983 - DNA, 14 bp, Homo sapiens
tgtacttgtttcat

SEQ ID NO: 6536984 - DNA, 14 bp, Homo sapiens
tgtacttgtttgct

SEQ ID NO: 6536985 - DNA, 14 bp, Homo sapiens
tgtactttacaatc

SEQ ID NO: 6536986 - DNA, 15 bp, Homo sapiens
tgtactttatatctt

SEQ ID NO: 6536987 - DNA, 19 bp, Homo sapiens
tgtactttcattccctttc

SEQ ID NO: 6536988 - DNA, 14 bp, Homo sapiens
tgtactttcccagg

SEQ ID NO: 6536989 - DNA, 15 bp, Homo sapiens
tgtactttcccaggt

SEQ ID NO: 6536990 - DNA, 12 bp, Homo sapiens
tgtactttctgt

SEQ ID NO: 6536991 - DNA, 19 bp, Homo sapiens
tgtactttgattcacatgt

SEQ ID NO: 6536992 - DNA, 21 bp, Homo sapiens
tgtactttgatttacagtgcc

SEQ ID NO: 6536993 - DNA, 22 bp, Homo sapiens
tgtactttgccatttttctata

SEQ ID NO: 6536994 - DNA, 11 bp, Homo sapiens
tgtactttgtg

SEQ ID NO: 6536995 - DNA, 18 bp, Homo sapiens
tgtactttgttaaaaaca

SEQ ID NO: 6536996 - DNA, 23 bp, Homo sapiens
tgtactttgttaaaaacactgct

SEQ ID NO: 6536997 - DNA, 12 bp, Homo sapiens
tgtactttgttt

SEQ ID NO: 6536998 - DNA, 23 bp, Homo sapiens
tgtacttttaccagtttctttgt

SEQ ID NO: 6536999 - DNA, 12 bp, Homo sapiens
tgtacttttcat

SEQ ID NO: 6537000 - DNA, 17 bp, Homo sapiens
tgtacttttcattctct

SEQ ID NO: 6537001 - DNA, 20 bp, Homo sapiens
tgtacttttcctttgctagt

SEQ ID NO: 6537002 - DNA, 20 bp, Homo sapiens
tgtacttttctggttccaaa

SEQ ID NO: 6537003 - DNA, 16 bp, Homo sapiens
tgtacttttgtgttac

SEQ ID NO: 6537004 - DNA, 21 bp, Homo sapiens
tgtactttttagtaatttctt

SEQ ID NO: 6537005 - DNA, 15 bp, Homo sapiens
tgtactttttattgc

SEQ ID NO: 6537006 - DNA, 16 bp, Homo sapiens
tgtactttttattgca

SEQ ID NO: 6537007 - DNA, 15 bp, Homo sapiens
tgtactttttccaga

SEQ ID NO: 6537008 - DNA, 18 bp, Homo sapiens
tgtacttttttcaaatat

SEQ ID NO: 6537009 - DNA, 21 bp, Homo sapiens
tgtacttttttcaaatattga

SEQ ID NO: 6537010 - DNA, 23 bp, Homo sapiens
tgtacttttttcaaatattgaat

SEQ ID NO: 6537011 - DNA, 18 bp, Homo sapiens
tgtagaaaagaaaacatt

SEQ ID NO: 6537012 - DNA, 16 bp, Homo sapiens
tgtagaaaagagactt

SEQ ID NO: 6537013 - DNA, 22 bp, Homo sapiens
tgtagaaaagagacttctctgt

SEQ ID NO: 6537014 - DNA, 20 bp, Homo sapiens
tgtagaaaagggaactgaac

SEQ ID NO: 6537015 - DNA, 23 bp, Homo sapiens
tgtagaaacacagttttgaaaga

SEQ ID NO: 6537016 - DNA, 21 bp, Homo sapiens
tgtagaaaccagctcatgtgt

SEQ ID NO: 6537017 - DNA, 14 bp, Homo sapiens
tgtagaaactgagg

SEQ ID NO: 6537018 - DNA, 18 bp, Homo sapiens
tgtagaaactgaggccca

SEQ ID NO: 6537019 - DNA, 16 bp, Homo sapiens
tgtagaaagcaaacaa

SEQ ID NO: 6537020 - DNA, 14 bp, Homo sapiens
tgtagaaaggaaat

SEQ ID NO: 6537021 - DNA, 23 bp, Homo sapiens
tgtagaaaggaaatagactttgt

SEQ ID NO: 6537022 - DNA, 15 bp, Homo sapiens
tgtagaaaggaagcc

SEQ ID NO: 6537023 - DNA, 20 bp, Homo sapiens
tgtagaaaggttgattctca

SEQ ID NO: 6537024 - DNA, 15 bp, Homo sapiens
tgtagaaatctgtaa

SEQ ID NO: 6537025 - DNA, 21 bp, Homo sapiens
tgtagaaatgatgatgtggaa

SEQ ID NO: 6537026 - DNA, 21 bp, Homo sapiens
tgtagaaatggttgtattaga

SEQ ID NO: 6537027 - DNA, 11 bp, Homo sapiens
tgtagaaattc

SEQ ID NO: 6537028 - DNA, 17 bp, Homo sapiens
tgtagaacactaattca

SEQ ID NO: 6537029 - DNA, 20 bp, Homo sapiens
tgtagaacactaattcataa

SEQ ID NO: 6537030 - DNA, 17 bp, Homo sapiens
tgtagaactcactctgg

SEQ ID NO: 6537031 - DNA, 21 bp, Homo sapiens
tgtagaactcactctgggctg

SEQ ID NO: 6537032 - DNA, 16 bp, Homo sapiens
tgtagaactcagcagt

SEQ ID NO: 6537033 - DNA, 19 bp, Homo sapiens
tgtagaactcagcagttga

SEQ ID NO: 6537034 - DNA, 22 bp, Homo sapiens
tgtagaactgcaatttccattc

SEQ ID NO: 6537035 - DNA, 14 bp, Homo sapiens
tgtagaacttgaac

SEQ ID NO: 6537036 - DNA, 22 bp, Homo sapiens
tgtagaacttgttgctgatttt

SEQ ID NO: 6537037 - DNA, 11 bp, Homo sapiens
tgtagaagaaa

SEQ ID NO: 6537038 - DNA, 14 bp, Homo sapiens
tgtagaagaaaata

SEQ ID NO: 6537039 - DNA, 17 bp, Homo sapiens
tgtagaagaaagcaaaa

SEQ ID NO: 6537040 - DNA, 23 bp, Homo sapiens
tgtagaagaaagcaaaaaataaa

SEQ ID NO: 6537041 - DNA, 15 bp, Homo sapiens
tgtagaagagggaga

SEQ ID NO: 6537042 - DNA, 14 bp, Homo sapiens
tgtagaagatgacc

SEQ ID NO: 6537043 - DNA, 17 bp, Homo sapiens
tgtagaagatgacctcg

SEQ ID NO: 6537044 - DNA, 13 bp, Homo sapiens
tgtagaagatgga

SEQ ID NO: 6537045 - DNA, 17 bp, Homo sapiens
tgtagaagcattccttc

SEQ ID NO: 6537046 - DNA, 17 bp, Homo sapiens
tgtagaaggagacagag

SEQ ID NO: 6537047 - DNA, 17 bp, Homo sapiens
tgtagaagtctttcaga

SEQ ID NO: 6537048 - DNA, 22 bp, Homo sapiens
tgtagaagtggcatctgaaaac

SEQ ID NO: 6537049 - DNA, 22 bp, Homo sapiens
tgtagaataaatggtttctcat

SEQ ID NO: 6537050 - DNA, 22 bp, Homo sapiens
tgtagaataataataaaaagac

SEQ ID NO: 6537051 - DNA, 14 bp, Homo sapiens
tgtagaatatggct

SEQ ID NO: 6537052 - DNA, 20 bp, Homo sapiens
tgtagaatctcttcatgctt

SEQ ID NO: 6537053 - DNA, 21 bp, Homo sapiens
tgtagaatctcttcatgcttg

SEQ ID NO: 6537054 - DNA, 19 bp, Homo sapiens
tgtagaatcttagaggctt

SEQ ID NO: 6537055 - DNA, 17 bp, Homo sapiens
tgtagaatgctgtagaa

SEQ ID NO: 6537056 - DNA, 14 bp, Homo sapiens
tgtagaattgaaaa

SEQ ID NO: 6537057 - DNA, 15 bp, Homo sapiens
tgtagaattgtatat

SEQ ID NO: 6537058 - DNA, 19 bp, Homo sapiens
tgtagacaaagtacattct

SEQ ID NO: 6537059 - DNA, 18 bp, Homo sapiens
tgtagacacttacttgat

SEQ ID NO: 6537060 - DNA, 20 bp, Homo sapiens
tgtagacatacttgtacgct

SEQ ID NO: 6537061 - DNA, 11 bp, Homo sapiens
tgtagacattg

SEQ ID NO: 6537062 - DNA, 20 bp, Homo sapiens
tgtagacattgtaaataaat

SEQ ID NO: 6537063 - DNA, 17 bp, Homo sapiens
tgtagacattttgaaat

SEQ ID NO: 6537064 - DNA, 20 bp, Homo sapiens
tgtagacattttgaaataaa

SEQ ID NO: 6537065 - DNA, 19 bp, Homo sapiens
tgtagacctgagctgggag

SEQ ID NO: 6537066 - DNA, 17 bp, Homo sapiens
tgtagacgcacctgctg

SEQ ID NO: 6537067 - DNA, 18 bp, Homo sapiens
tgtagactatatacatgt

SEQ ID NO: 6537068 - DNA, 20 bp, Homo sapiens
tgtagactctaagatacact

SEQ ID NO: 6537069 - DNA, 22 bp, Homo sapiens
tgtagactcttgctcctgcttc

SEQ ID NO: 6537070 - DNA, 14 bp, Homo sapiens
tgtagactgatgtt

SEQ ID NO: 6537071 - DNA, 21 bp, Homo sapiens
tgtagactggccatgcaagtg

SEQ ID NO: 6537072 - DNA, 23 bp, Homo sapiens
tgtagagaaaaaaaaatatgtgt

SEQ ID NO: 6537073 - DNA, 19 bp, Homo sapiens
tgtagagaaaacatgcaga

SEQ ID NO: 6537074 - DNA, 17 bp, Homo sapiens
tgtagagaaaaggaggg

SEQ ID NO: 6537075 - DNA, 18 bp, Homo sapiens
tgtagagaatgtcactgt

SEQ ID NO: 6537076 - DNA, 15 bp, Homo sapiens
tgtagagacagggtc

SEQ ID NO: 6537077 - DNA, 11 bp, Homo sapiens
tgtagagactt

SEQ ID NO: 6537078 - DNA, 20 bp, Homo sapiens
tgtagagacttccgtcaccc

SEQ ID NO: 6537079 - DNA, 15 bp, Homo sapiens
tgtagagagaacagg

SEQ ID NO: 6537080 - DNA, 17 bp, Homo sapiens
ttctatagccaaagctg

SEQ ID NO: 6537081 - DNA, 14 bp, Homo sapiens
ttctatagcttttc

SEQ ID NO: 6537082 - DNA, 16 bp, Homo sapiens
ttctatagttctagac

SEQ ID NO: 6537083 - DNA, 21 bp, Homo sapiens
ttctatataaaatgtattcaa

SEQ ID NO: 6537084 - DNA, 19 bp, Homo sapiens
ttctatataaggaggaaaa

SEQ ID NO: 6537085 - DNA, 22 bp, Homo sapiens
ttctatataaggaggaaaacgg

SEQ ID NO: 6537086 - DNA, 21 bp, Homo sapiens
ttctatataattcctgttttt

SEQ ID NO: 6537087 - DNA, 14 bp, Homo sapiens
ttctatataatttt

SEQ ID NO: 6537088 - DNA, 15 bp, Homo sapiens
ttctatataattttt

SEQ ID NO: 6537089 - DNA, 19 bp, Homo sapiens
ttctatatatttgtttcaa

SEQ ID NO: 6537090 - DNA, 12 bp, Homo sapiens
ttctatatgaat

SEQ ID NO: 6537091 - DNA, 17 bp, Homo sapiens
ttctatatgatcctgaa

SEQ ID NO: 6537092 - DNA, 22 bp, Homo sapiens
ttctatatgtaacttcagatgt

SEQ ID NO: 6537093 - DNA, 17 bp, Homo sapiens
ttctatattcctccagc

SEQ ID NO: 6537094 - DNA, 18 bp, Homo sapiens
ttctatattcctccagct

SEQ ID NO: 6537095 - DNA, 17 bp, Homo sapiens
ttctatatttactgttt

SEQ ID NO: 6537096 - DNA, 18 bp, Homo sapiens
ttctatatttattttcag

SEQ ID NO: 6537097 - DNA, 14 bp, Homo sapiens
ttctatatttcata

SEQ ID NO: 6537098 - DNA, 19 bp, Homo sapiens
ttctatattttaatagaaa

SEQ ID NO: 6537099 - DNA, 14 bp, Homo sapiens
ttctatcacatatt

SEQ ID NO: 6537100 - DNA, 17 bp, Homo sapiens
ttctatcaggaaaacaa

SEQ ID NO: 6537101 - DNA, 17 bp, Homo sapiens
ttctatcagtactttta

SEQ ID NO: 6537102 - DNA, 23 bp, Homo sapiens
ttctatcagtacttttattaata

SEQ ID NO: 6537103 - DNA, 12 bp, Homo sapiens
ttctatcattcc

SEQ ID NO: 6537104 - DNA, 13 bp, Homo sapiens
ttctatcattttt

SEQ ID NO: 6537105 - DNA, 17 bp, Homo sapiens
ttctatcatttttgtac

SEQ ID NO: 6537106 - DNA, 18 bp, Homo sapiens
ttctatccccaatcagct

SEQ ID NO: 6537107 - DNA, 15 bp, Homo sapiens
ttctatcctcatctt

SEQ ID NO: 6537108 - DNA, 15 bp, Homo sapiens
ttctatcctctgtaa

SEQ ID NO: 6537109 - DNA, 17 bp, Homo sapiens
ttctatcgttattataa

SEQ ID NO: 6537110 - DNA, 17 bp, Homo sapiens
ttctatctctaagctgt

SEQ ID NO: 6537111 - DNA, 22 bp, Homo sapiens
ttctatgaactagtctacttct

SEQ ID NO: 6537112 - DNA, 16 bp, Homo sapiens
ttctatgaagagtatt

SEQ ID NO: 6537113 - DNA, 16 bp, Homo sapiens
ttctatgacaaattca

SEQ ID NO: 6537114 - DNA, 22 bp, Homo sapiens
ttctatgattaaactgggaaat

SEQ ID NO: 6537115 - DNA, 21 bp, Homo sapiens
ttctatgcataaaaaaatgat

SEQ ID NO: 6537116 - DNA, 22 bp, Homo sapiens
ttctatgccatttttagtttaa

SEQ ID NO: 6537117 - DNA, 16 bp, Homo sapiens
ttctatgcctgtattt

SEQ ID NO: 6537118 - DNA, 17 bp, Homo sapiens
ttctatgctgagtttgt

SEQ ID NO: 6537119 - DNA, 15 bp, Homo sapiens
ttctatgctgctttt

SEQ ID NO: 6537120 - DNA, 21 bp, Homo sapiens
ttctatgctgcttttatatct

SEQ ID NO: 6537121 - DNA, 19 bp, Homo sapiens
ttctatggaatagttctgt

SEQ ID NO: 6537122 - DNA, 22 bp, Homo sapiens
ttctatggaccaaatgtaaaat

SEQ ID NO: 6537123 - DNA, 23 bp, Homo sapiens
ttctatggaccaaatgtaaaata

SEQ ID NO: 6537124 - DNA, 15 bp, Homo sapiens
ttctatggattcact

SEQ ID NO: 6537125 - DNA, 17 bp, Homo sapiens
ttctatggattcacttc

SEQ ID NO: 6537126 - DNA, 15 bp, Homo sapiens
ttctatgggtgttat

SEQ ID NO: 6537127 - DNA, 19 bp, Homo sapiens
ttctatggttatgaaagaa

SEQ ID NO: 6537128 - DNA, 12 bp, Homo sapiens
ttctatgtaaat

SEQ ID NO: 6537129 - DNA, 12 bp, Homo sapiens
ttctatgtaact

SEQ ID NO: 6537130 - DNA, 13 bp, Homo sapiens
ttctatgtaactt

SEQ ID NO: 6537131 - DNA, 13 bp, Homo sapiens
ttctatgtactag

SEQ ID NO: 6537132 - DNA, 18 bp, Homo sapiens
ttctatgtactagtactg

SEQ ID NO: 6537133 - DNA, 21 bp, Homo sapiens
ttctatgtactagtactgtgt

SEQ ID NO: 6537134 - DNA, 16 bp, Homo sapiens
ttctatgtagaactgt

SEQ ID NO: 6537135 - DNA, 17 bp, Homo sapiens
ttctatgtagaactgtt

SEQ ID NO: 6537136 - DNA, 18 bp, Homo sapiens
ttctatgtccaacagagt

SEQ ID NO: 6537137 - DNA, 21 bp, Homo sapiens
ttctatgtctagcacatgttg

SEQ ID NO: 6537138 - DNA, 12 bp, Homo sapiens
ttctatgtgact

SEQ ID NO: 6537139 - DNA, 12 bp, Homo sapiens
ttctatgttaaa

SEQ ID NO: 6537140 - DNA, 16 bp, Homo sapiens
ttctatgttaaatact

SEQ ID NO: 6537141 - DNA, 17 bp, Homo sapiens
ttctatgttaaatactg

SEQ ID NO: 6537142 - DNA, 18 bp, Homo sapiens
ttctatgttaaatactgt

SEQ ID NO: 6537143 - DNA, 20 bp, Homo sapiens
ttctatgttaaatactgtgc

SEQ ID NO: 6537144 - DNA, 23 bp, Homo sapiens
ttctatgttaaatactgtgcaga

SEQ ID NO: 6537145 - DNA, 15 bp, Homo sapiens
ttctatgttaatatt

SEQ ID NO: 6537146 - DNA, 13 bp, Homo sapiens
ttctatgttggca

SEQ ID NO: 6537147 - DNA, 18 bp, Homo sapiens
ttctatgttggtttcagt

SEQ ID NO: 6537148 - DNA, 22 bp, Homo sapiens
ttctatgtttttttaattaaaa

SEQ ID NO: 6537149 - DNA, 18 bp, Homo sapiens
ttctattaaaagactcat

SEQ ID NO: 6537150 - DNA, 22 bp, Homo sapiens
ttctattaaaagactcatccgt

SEQ ID NO: 6537151 - DNA, 14 bp, Homo sapiens
ttctattaaaagtg

SEQ ID NO: 6537152 - DNA, 13 bp, Homo sapiens
ttctattaaaggt

SEQ ID NO: 6537153 - DNA, 15 bp, Homo sapiens
ttctattaaatagtt

SEQ ID NO: 6537154 - DNA, 20 bp, Homo sapiens
ttctattaagatatatttgt

SEQ ID NO: 6537155 - DNA, 22 bp, Homo sapiens
ttctattaatatcaactctgaa

SEQ ID NO: 6537156 - DNA, 13 bp, Homo sapiens
ttctattaatatt

SEQ ID NO: 6537157 - DNA, 20 bp, Homo sapiens
ttctattacccctcatttaa

SEQ ID NO: 6537158 - DNA, 21 bp, Homo sapiens
ttctattacctattaggtgga

SEQ ID NO: 6537159 - DNA, 17 bp, Homo sapiens
ttctattatctgggttt

SEQ ID NO: 6537160 - DNA, 18 bp, Homo sapiens
ttctattatggaaaactg

SEQ ID NO: 6537161 - DNA, 19 bp, Homo sapiens
ttctattatggaaaactgt

SEQ ID NO: 6537162 - DNA, 22 bp, Homo sapiens
ttctattcaaggtggccaaatt

SEQ ID NO: 6537163 - DNA, 16 bp, Homo sapiens
ttctattcagcaaaag

SEQ ID NO: 6537164 - DNA, 17 bp, Homo sapiens
ttctattcataataaac

SEQ ID NO: 6537165 - DNA, 19 bp, Homo sapiens
ttctattcattcattttga

SEQ ID NO: 6537166 - DNA, 18 bp, Homo sapiens
ttctattccatgtccata

SEQ ID NO: 6537167 - DNA, 22 bp, Homo sapiens
ttctattccctaacttgtgaag

SEQ ID NO: 6537168 - DNA, 13 bp, Homo sapiens
ttctattgaaaaa

SEQ ID NO: 6537169 - DNA, 16 bp, Homo sapiens
ttctattgaaaacagt

SEQ ID NO: 6537170 - DNA, 23 bp, Homo sapiens
ttctattgacttcaatgatagta

SEQ ID NO: 6537171 - DNA, 19 bp, Homo sapiens
ttctattgactttcttaaa

SEQ ID NO: 6537172 - DNA, 17 bp, Homo sapiens
ttctattgccttctttg

SEQ ID NO: 6537173 - DNA, 19 bp, Homo sapiens
ttctattgccttctttgaa

SEQ ID NO: 6537174 - DNA, 21 bp, Homo sapiens
ttctattgccttctttgaaga

SEQ ID NO: 6537175 - DNA, 12 bp, Homo sapiens
ttctattgtaaa

SEQ ID NO: 6537176 - DNA, 20 bp, Homo sapiens
ttctattgtactctgcttta

SEQ ID NO: 6537177 - DNA, 18 bp, Homo sapiens
ttctattgtgctttctat

SEQ ID NO: 6537178 - DNA, 19 bp, Homo sapiens
ttctattgttaaacaaatg

SEQ ID NO: 6537179 - DNA, 11 bp, Homo sapiens
ttctatttaaa

SEQ ID NO: 6537180 - DNA, 16 bp, Homo sapiens
ttctatttaaaaaata

SEQ ID NO: 6537181 - DNA, 17 bp, Homo sapiens
ttctatttaaaaaataa

SEQ ID NO: 6537182 - DNA, 13 bp, Homo sapiens
ttctatttaagtg

SEQ ID NO: 6537183 - DNA, 14 bp, Homo sapiens
ttctatttaatgga

SEQ ID NO: 6537184 - DNA, 16 bp, Homo sapiens
ttctatttaattgaaa

SEQ ID NO: 6537185 - DNA, 23 bp, Homo sapiens
ttctatttagttatttaagaaga

SEQ ID NO: 6537186 - DNA, 19 bp, Homo sapiens
ttctatttataagtgactt

SEQ ID NO: 6537187 - DNA, 17 bp, Homo sapiens
ttctatttattatgctt

SEQ ID NO: 6537188 - DNA, 15 bp, Homo sapiens
ttctatttatttact

SEQ ID NO: 6537189 - DNA, 15 bp, Homo sapiens
ttctatttcactgga

SEQ ID NO: 6537190 - DNA, 17 bp, Homo sapiens
ttctatttcactggagc

SEQ ID NO: 6537191 - DNA, 14 bp, Homo sapiens
ttctatttcataat

SEQ ID NO: 6537192 - DNA, 15 bp, Homo sapiens
ttctatttctatctg

SEQ ID NO: 6537193 - DNA, 19 bp, Homo sapiens
ttctatttctcctccatgg

SEQ ID NO: 6537194 - DNA, 14 bp, Homo sapiens
ttctatttctctat

SEQ ID NO: 6537195 - DNA, 14 bp, Homo sapiens
ttctatttcttgaa

SEQ ID NO: 6537196 - DNA, 13 bp, Homo sapiens
ttctatttgctat

SEQ ID NO: 6537197 - DNA, 12 bp, Homo sapiens
ttctatttggaa

SEQ ID NO: 6537198 - DNA, 14 bp, Homo sapiens
ttctatttggggct

SEQ ID NO: 6537199 - DNA, 22 bp, Homo sapiens
ttctattttaagactgatttta

SEQ ID NO: 6537200 - DNA, 18 bp, Homo sapiens
ttctattttattatgaag

SEQ ID NO: 6537201 - DNA, 17 bp, Homo sapiens
ttctattttcatgcaaa

SEQ ID NO: 6537202 - DNA, 20 bp, Homo sapiens
ttctattttcattttctgca

SEQ ID NO: 6537203 - DNA, 21 bp, Homo sapiens
ttctattttcattttctgcaa

SEQ ID NO: 6537204 - DNA, 16 bp, Homo sapiens
ttctattttctctgat

SEQ ID NO: 6537205 - DNA, 14 bp, Homo sapiens
ttctattttcttaa

SEQ ID NO: 6537206 - DNA, 15 bp, Homo sapiens
ttctattttcttaaa

SEQ ID NO: 6537207 - DNA, 20 bp, Homo sapiens
ttctattttgcaaacactgt

SEQ ID NO: 6537208 - DNA, 21 bp, Homo sapiens
ttctattttgctggagactat

SEQ ID NO: 6537209 - DNA, 17 bp, Homo sapiens
ttctatttttcttctaa

SEQ ID NO: 6537210 - DNA, 19 bp, Homo sapiens
ttctatttttcttctaaaa

SEQ ID NO: 6537211 - DNA, 15 bp, Homo sapiens
ttctatttttgtcct

SEQ ID NO: 6537212 - DNA, 19 bp, Homo sapiens
ttctatttttgtccttgca

SEQ ID NO: 6537213 - DNA, 22 bp, Homo sapiens
ttctattttttacttgttttcg

SEQ ID NO: 6537214 - DNA, 19 bp, Homo sapiens
ttctcaaaaattctcctaa

SEQ ID NO: 6537215 - DNA, 18 bp, Homo sapiens
ttctcaaaactgagccat

SEQ ID NO: 6537216 - DNA, 16 bp, Homo sapiens
ttctcaaaagaactta

SEQ ID NO: 6537217 - DNA, 17 bp, Homo sapiens
ttctcaaaagaggttac

SEQ ID NO: 6537218 - DNA, 18 bp, Homo sapiens
ttctcaaaagaggttact

SEQ ID NO: 6537219 - DNA, 23 bp, Homo sapiens
ttctcaaaagaggttactttagt

SEQ ID NO: 6537220 - DNA, 24 bp, Homo sapiens
ttctcaaaagaggttactttagtt

SEQ ID NO: 6537221 - DNA, 15 bp, Homo sapiens
ttctcaaaagcattt

SEQ ID NO: 6537222 - DNA, 18 bp, Homo sapiens
ttctcaaaagcatttatc

SEQ ID NO: 6537223 - DNA, 20 bp, Homo sapiens
ttctcaaaagcatttatcat

SEQ ID NO: 6537224 - DNA, 22 bp, Homo sapiens
ttctcaaacctgtttaaatatt

SEQ ID NO: 6537225 - DNA, 19 bp, Homo sapiens
ttctcaaagaaatttccac

SEQ ID NO: 6537226 - DNA, 20 bp, Homo sapiens
ttctcaaagaaatttccact

SEQ ID NO: 6537227 - DNA, 23 bp, Homo sapiens
ttctcaaagagggggctctgccc

SEQ ID NO: 6537228 - DNA, 19 bp, Homo sapiens
ttctcaaagatctgaatta

SEQ ID NO: 6537229 - DNA, 20 bp, Homo sapiens
ttctcaaaggccctcagtga

SEQ ID NO: 6537230 - DNA, 21 bp, Homo sapiens
ttctcaaagtctcatagcttt

SEQ ID NO: 6537231 - DNA, 14 bp, Homo sapiens
ttctcaaagttaaa

SEQ ID NO: 6537232 - DNA, 22 bp, Homo sapiens
ttctcaaagttaattcacctat

SEQ ID NO: 6537233 - DNA, 14 bp, Homo sapiens
ttctcaaagtttta

SEQ ID NO: 6537234 - DNA, 18 bp, Homo sapiens
ttctcaaagttttgaaaa

SEQ ID NO: 6537235 - DNA, 21 bp, Homo sapiens
ttctcaaagttttgaaaagct

SEQ ID NO: 6537236 - DNA, 22 bp, Homo sapiens
ttctcaaagttttgaaaagcta

SEQ ID NO: 6537237 - DNA, 14 bp, Homo sapiens
ttctcaaatgctgg

SEQ ID NO: 6537238 - DNA, 18 bp, Homo sapiens
ttctcaacatactgtaat

SEQ ID NO: 6537239 - DNA, 22 bp, Homo sapiens
ttctcaacatactgtaatcaaa

SEQ ID NO: 6537240 - DNA, 22 bp, Homo sapiens
ttctcaaccttatcaaggattt

SEQ ID NO: 6537241 - DNA, 22 bp, Homo sapiens
ttctcaactaaagaatagtgcc

SEQ ID NO: 6537242 - DNA, 14 bp, Homo sapiens
ttctcaagaatcta

SEQ ID NO: 6537243 - DNA, 17 bp, Homo sapiens
ttctcaagaatctagaa

SEQ ID NO: 6537244 - DNA, 13 bp, Homo sapiens
ttctcaagacctg

SEQ ID NO: 6537245 - DNA, 14 bp, Homo sapiens
ttctcaagcactga

SEQ ID NO: 6537246 - DNA, 23 bp, Homo sapiens
ttctcaagctggtggcctctgca

SEQ ID NO: 6537247 - DNA, 11 bp, Homo sapiens
ttctcaagtgc

SEQ ID NO: 6537248 - DNA, 17 bp, Homo sapiens
ttctcaagtgccttaat

SEQ ID NO: 6537249 - DNA, 16 bp, Homo sapiens
ttctcaagttctaaga

SEQ ID NO: 6537250 - DNA, 20 bp, Homo sapiens
ttctcaagttctaagattct

SEQ ID NO: 6537251 - DNA, 15 bp, Homo sapiens
ttctcaatagttctt

SEQ ID NO: 6537252 - DNA, 17 bp, Homo sapiens
ttctcaatcatgggaat

SEQ ID NO: 6537253 - DNA, 11 bp, Homo sapiens
ttctcaatgaa

SEQ ID NO: 6537254 - DNA, 11 bp, Homo sapiens
ttctcaatgta

SEQ ID NO: 6537255 - DNA, 18 bp, Homo sapiens
ttctcaattccaacagtt

SEQ ID NO: 6537256 - DNA, 21 bp, Homo sapiens
ttctcacacacaactgtccat

SEQ ID NO: 6537257 - DNA, 23 bp, Homo sapiens
ttctcacacggatttagtcccac

SEQ ID NO: 6537258 - DNA, 19 bp, Homo sapiens
tgtagagagagctgtatta

SEQ ID NO: 6537259 - DNA, 16 bp, Homo sapiens
tgtagagagataccat

SEQ ID NO: 6537260 - DNA, 20 bp, Homo sapiens
tgtagagagcagcattccca

SEQ ID NO: 6537261 - DNA, 16 bp, Homo sapiens
tgtagagcagggcaag

SEQ ID NO: 6537262 - DNA, 15 bp, Homo sapiens
tgtagagccagggtc

SEQ ID NO: 6537263 - DNA, 16 bp, Homo sapiens
tgtagagccagggtct

SEQ ID NO: 6537264 - DNA, 16 bp, Homo sapiens
tgtagaggagcctgga

SEQ ID NO: 6537265 - DNA, 19 bp, Homo sapiens
tgtagaggcataaacctgt

SEQ ID NO: 6537266 - DNA, 19 bp, Homo sapiens
tgtagagtcaatcatgtgt

SEQ ID NO: 6537267 - DNA, 14 bp, Homo sapiens
tgtagagtgcccat

SEQ ID NO: 6537268 - DNA, 15 bp, Homo sapiens
tgtagagtgcccatg

SEQ ID NO: 6537269 - DNA, 17 bp, Homo sapiens
tgtagagtggtctattt

SEQ ID NO: 6537270 - DNA, 18 bp, Homo sapiens
tgtagagttaagaagctg

SEQ ID NO: 6537271 - DNA, 21 bp, Homo sapiens
tgtagagttaagaagctgttg

SEQ ID NO: 6537272 - DNA, 13 bp, Homo sapiens
tgtagagttgctg

SEQ ID NO: 6537273 - DNA, 21 bp, Homo sapiens
tgtagataaataatgtagttt

SEQ ID NO: 6537274 - DNA, 15 bp, Homo sapiens
tgtagataacagcaa

SEQ ID NO: 6537275 - DNA, 14 bp, Homo sapiens
tgtagataagtgtt

SEQ ID NO: 6537276 - DNA, 19 bp, Homo sapiens
tgtagatacaatcagctgc

SEQ ID NO: 6537277 - DNA, 14 bp, Homo sapiens
tgtagatacagatc

SEQ ID NO: 6537278 - DNA, 19 bp, Homo sapiens
tgtagataccgagaatgat

SEQ ID NO: 6537279 - DNA, 23 bp, Homo sapiens
tgtagatataaatataaatatat

SEQ ID NO: 6537280 - DNA, 18 bp, Homo sapiens
tgtagatatatatttcca

SEQ ID NO: 6537281 - DNA, 19 bp, Homo sapiens
tgtagatatatatttccaa

SEQ ID NO: 6537282 - DNA, 18 bp, Homo sapiens
tgtagatatgtattcttt

SEQ ID NO: 6537283 - DNA, 15 bp, Homo sapiens
tgtagatattatgta

SEQ ID NO: 6537284 - DNA, 23 bp, Homo sapiens
tgtagatattatgtatagaaaat

SEQ ID NO: 6537285 - DNA, 24 bp, Homo sapiens
tgtagatattgttttctgtaaata

SEQ ID NO: 6537286 - DNA, 11 bp, Homo sapiens
tgtagatgaaa

SEQ ID NO: 6537287 - DNA, 13 bp, Homo sapiens
tgtagatgaactt

SEQ ID NO: 6537288 - DNA, 14 bp, Homo sapiens
tgtagatgcagaaa

SEQ ID NO: 6537289 - DNA, 21 bp, Homo sapiens
tgtagatggaaatcagttgtg

SEQ ID NO: 6537290 - DNA, 17 bp, Homo sapiens
tgtagatggcgatgtgt

SEQ ID NO: 6537291 - DNA, 18 bp, Homo sapiens
tgtagatggtgacctggg

SEQ ID NO: 6537292 - DNA, 17 bp, Homo sapiens
tgtagatgtattttcaa

SEQ ID NO: 6537293 - DNA, 21 bp, Homo sapiens
tgtagattaaggtgatgtgat

SEQ ID NO: 6537294 - DNA, 15 bp, Homo sapiens
tgtagattacctgcc

SEQ ID NO: 6537295 - DNA, 17 bp, Homo sapiens
tgtagattacctgccac

SEQ ID NO: 6537296 - DNA, 14 bp, Homo sapiens
tgtagattcatgca

SEQ ID NO: 6537297 - DNA, 14 bp, Homo sapiens
tgtagattgattgt

SEQ ID NO: 6537298 - DNA, 18 bp, Homo sapiens
tgtagattgattgtattg

SEQ ID NO: 6537299 - DNA, 13 bp, Homo sapiens
tgtagatttctga

SEQ ID NO: 6537300 - DNA, 14 bp, Homo sapiens
tgtagatttctgac

SEQ ID NO: 6537301 - DNA, 17 bp, Homo sapiens
tgtagatttgaaaattg

SEQ ID NO: 6537302 - DNA, 15 bp, Homo sapiens
tgtagcaaaccctgt

SEQ ID NO: 6537303 - DNA, 21 bp, Homo sapiens
tgtagcaaaccctgtcaaaca

SEQ ID NO: 6537304 - DNA, 23 bp, Homo sapiens
tgtagcaaaccctgtcaaacatt

SEQ ID NO: 6537305 - DNA, 17 bp, Homo sapiens
tgtagcaaattccaata

SEQ ID NO: 6537306 - DNA, 16 bp, Homo sapiens
tgtagcaaccatttgt

SEQ ID NO: 6537307 - DNA, 17 bp, Homo sapiens
tgtagcaaccatttgta

SEQ ID NO: 6537308 - DNA, 20 bp, Homo sapiens
tgtagcaaccttctgcattc

SEQ ID NO: 6537309 - DNA, 20 bp, Homo sapiens
tgtagcaagatgcaaatgca

SEQ ID NO: 6537310 - DNA, 14 bp, Homo sapiens
tgtagcaagctgag

SEQ ID NO: 6537311 - DNA, 21 bp, Homo sapiens
tgtagcaagtactttggctta

SEQ ID NO: 6537312 - DNA, 21 bp, Homo sapiens
tgtagcaataagctggactag

SEQ ID NO: 6537313 - DNA, 21 bp, Homo sapiens
tgtagcaatatatttgtaggt

SEQ ID NO: 6537314 - DNA, 11 bp, Homo sapiens
tgtagcaatgg

SEQ ID NO: 6537315 - DNA, 13 bp, Homo sapiens
tgtagcacaaaga

SEQ ID NO: 6537316 - DNA, 15 bp, Homo sapiens
tgtagcacttactgg

SEQ ID NO: 6537317 - DNA, 13 bp, Homo sapiens
tgtagcagaaagg

SEQ ID NO: 6537318 - DNA, 12 bp, Homo sapiens
tgtagcagcatt

SEQ ID NO: 6537319 - DNA, 11 bp, Homo sapiens
tgtagcagtga

SEQ ID NO: 6537320 - DNA, 19 bp, Homo sapiens
tgtagcagtgtgctttgca

SEQ ID NO: 6537321 - DNA, 12 bp, Homo sapiens
tgtagcataact

SEQ ID NO: 6537322 - DNA, 14 bp, Homo sapiens
tgtagcataactgt

SEQ ID NO: 6537323 - DNA, 15 bp, Homo sapiens
tgtagcataactgta

SEQ ID NO: 6537324 - DNA, 20 bp, Homo sapiens
tgtagcataactgtagctca

SEQ ID NO: 6537325 - DNA, 17 bp, Homo sapiens
tgtagcatcctggaata

SEQ ID NO: 6537326 - DNA, 18 bp, Homo sapiens
tgtagcatcctggaatat

SEQ ID NO: 6537327 - DNA, 16 bp, Homo sapiens
tgtagcatcttcctct

SEQ ID NO: 6537328 - DNA, 14 bp, Homo sapiens
tgtagcatgttcta

SEQ ID NO: 6537329 - DNA, 12 bp, Homo sapiens
tgtagcattgtt

SEQ ID NO: 6537330 - DNA, 22 bp, Homo sapiens
tgtagcatttaaaatggaaaat

SEQ ID NO: 6537331 - DNA, 18 bp, Homo sapiens
tgtagcatttcttgatgt

SEQ ID NO: 6537332 - DNA, 19 bp, Homo sapiens
tgtagcattttcctgttta

SEQ ID NO: 6537333 - DNA, 20 bp, Homo sapiens
tgtagcattttcctgtttac

SEQ ID NO: 6537334 - DNA, 19 bp, Homo sapiens
tgtagcatttttctaatag

SEQ ID NO: 6537335 - DNA, 13 bp, Homo sapiens
tgtagccacacca

SEQ ID NO: 6537336 - DNA, 18 bp, Homo sapiens
tgtagccacagctgctgt

SEQ ID NO: 6537337 - DNA, 22 bp, Homo sapiens
tgtagccacagctgctgttctc

SEQ ID NO: 6537338 - DNA, 24 bp, Homo sapiens
tgtagccacagctgctgttctcag

SEQ ID NO: 6537339 - DNA, 20 bp, Homo sapiens
tgtagccaggtactgcattc

SEQ ID NO: 6537340 - DNA, 20 bp, Homo sapiens
tgtagccaggtatggctctg

SEQ ID NO: 6537341 - DNA, 21 bp, Homo sapiens
tgtagccaggtatggctctgc

SEQ ID NO: 6537342 - DNA, 22 bp, Homo sapiens
tgtagccaggtatggctctgca

SEQ ID NO: 6537343 - DNA, 14 bp, Homo sapiens
tgtagccaggtccc

SEQ ID NO: 6537344 - DNA, 20 bp, Homo sapiens
tgtagccaggtccccctgca

SEQ ID NO: 6537345 - DNA, 21 bp, Homo sapiens
tgtagccaggtccccctgcag

SEQ ID NO: 6537346 - DNA, 21 bp, Homo sapiens
tgtagccatggctcaggcaag

SEQ ID NO: 6537347 - DNA, 20 bp, Homo sapiens
tgtagccatggctgggcgtg

SEQ ID NO: 6537348 - DNA, 14 bp, Homo sapiens
tgtagcccacactt

SEQ ID NO: 6537349 - DNA, 23 bp, Homo sapiens
tgtagcccatccttccctttgga

SEQ ID NO: 6537350 - DNA, 21 bp, Homo sapiens
tgtagccccaagaaggctggg

SEQ ID NO: 6537351 - DNA, 16 bp, Homo sapiens
tgtagccccagtcaga

SEQ ID NO: 6537352 - DNA, 16 bp, Homo sapiens
tgtagccccctggcct

SEQ ID NO: 6537353 - DNA, 22 bp, Homo sapiens
tgtagccccgggctgacccagt

SEQ ID NO: 6537354 - DNA, 15 bp, Homo sapiens
tgtagccctcccact

SEQ ID NO: 6537355 - DNA, 11 bp, Homo sapiens
tgtagccctgg

SEQ ID NO: 6537356 - DNA, 21 bp, Homo sapiens
tgtagccctggatggcctctg

SEQ ID NO: 6537357 - DNA, 14 bp, Homo sapiens
tgtagccctgggtt

SEQ ID NO: 6537358 - DNA, 15 bp, Homo sapiens
tgtagccgccctgag

SEQ ID NO: 6537359 - DNA, 19 bp, Homo sapiens
tgtagcctaaagggcaggg

SEQ ID NO: 6537360 - DNA, 21 bp, Homo sapiens
tgtagcctaaagggcagggcc

SEQ ID NO: 6537361 - DNA, 16 bp, Homo sapiens
tgtagcctaatattca

SEQ ID NO: 6537362 - DNA, 14 bp, Homo sapiens
tgtagcctcctttg

SEQ ID NO: 6537363 - DNA, 17 bp, Homo sapiens
tgtagcctgaagagttt

SEQ ID NO: 6537364 - DNA, 17 bp, Homo sapiens
tgtagcctgcgtcatgg

SEQ ID NO: 6537365 - DNA, 13 bp, Homo sapiens
tgtagcctggtct

SEQ ID NO: 6537366 - DNA, 17 bp, Homo sapiens
tgtagcctggtctgtgc

SEQ ID NO: 6537367 - DNA, 19 bp, Homo sapiens
tgtagcctggtctgtgcat

SEQ ID NO: 6537368 - DNA, 14 bp, Homo sapiens
tgtagcctgtgcat

SEQ ID NO: 6537369 - DNA, 23 bp, Homo sapiens
tgtagccttagtgtcacctttct

SEQ ID NO: 6537370 - DNA, 15 bp, Homo sapiens
tgtagccttctcccc

SEQ ID NO: 6537371 - DNA, 23 bp, Homo sapiens
tgtagccttgccttttaaaagaa

SEQ ID NO: 6537372 - DNA, 18 bp, Homo sapiens
tgtagccttttgactttc

SEQ ID NO: 6537373 - DNA, 16 bp, Homo sapiens
tgtagcgacagcattt

SEQ ID NO: 6537374 - DNA, 18 bp, Homo sapiens
tgtagcgaccccagactg

SEQ ID NO: 6537375 - DNA, 16 bp, Homo sapiens
tgtagcgtgtttacat

SEQ ID NO: 6537376 - DNA, 20 bp, Homo sapiens
tgtagcgtgtttacatgtgt

SEQ ID NO: 6537377 - DNA, 15 bp, Homo sapiens
tgtagctaacagtga

SEQ ID NO: 6537378 - DNA, 18 bp, Homo sapiens
tgtagctacaagggaagc

SEQ ID NO: 6537379 - DNA, 15 bp, Homo sapiens
tgtagctacagagaa

SEQ ID NO: 6537380 - DNA, 16 bp, Homo sapiens
tgtagctacagagaaa

SEQ ID NO: 6537381 - DNA, 21 bp, Homo sapiens
tgtagctagaacttctctaag

SEQ ID NO: 6537382 - DNA, 18 bp, Homo sapiens
tgtagctagtttaaaatt

SEQ ID NO: 6537383 - DNA, 22 bp, Homo sapiens
tgtagctattagcggctcctcg

SEQ ID NO: 6537384 - DNA, 15 bp, Homo sapiens
tgtagctcaagttta

SEQ ID NO: 6537385 - DNA, 17 bp, Homo sapiens
tgtagctcagtcatcaa

SEQ ID NO: 6537386 - DNA, 20 bp, Homo sapiens
tgtagctcccctgctgaggc

SEQ ID NO: 6537387 - DNA, 23 bp, Homo sapiens
tgtagctcccctgctgaggcagt

SEQ ID NO: 6537388 - DNA, 23 bp, Homo sapiens
tgtagctcccgagctactctctt

SEQ ID NO: 6537389 - DNA, 21 bp, Homo sapiens
tgtagctccctcctcccatct

SEQ ID NO: 6537390 - DNA, 21 bp, Homo sapiens
tgtagctctatggggggaggg

SEQ ID NO: 6537391 - DNA, 14 bp, Homo sapiens
tgtagctctgtcca

SEQ ID NO: 6537392 - DNA, 20 bp, Homo sapiens
tgtagctcttagtcctccct

SEQ ID NO: 6537393 - DNA, 21 bp, Homo sapiens
tgtagctgaaagagtatgtac

SEQ ID NO: 6537394 - DNA, 17 bp, Homo sapiens
tgtagctgagctgtgac

SEQ ID NO: 6537395 - DNA, 15 bp, Homo sapiens
tgtagctgaggaggc

SEQ ID NO: 6537396 - DNA, 21 bp, Homo sapiens
tgtagctgatgaaactcctga

SEQ ID NO: 6537397 - DNA, 17 bp, Homo sapiens
tgtagctgccaggcttt

SEQ ID NO: 6537398 - DNA, 13 bp, Homo sapiens
tgtagctgtaaaa

SEQ ID NO: 6537399 - DNA, 16 bp, Homo sapiens
tgtagctgtaagggca

SEQ ID NO: 6537400 - DNA, 17 bp, Homo sapiens
tgtagctgtaagggcag

SEQ ID NO: 6537401 - DNA, 19 bp, Homo sapiens
tgtagctgtcgtacattga

SEQ ID NO: 6537402 - DNA, 15 bp, Homo sapiens
tgtagctgtgacctg

SEQ ID NO: 6537403 - DNA, 20 bp, Homo sapiens
tgtagctgtgtggctttcct

SEQ ID NO: 6537404 - DNA, 16 bp, Homo sapiens
tgtagcttaaaaaaag

SEQ ID NO: 6537405 - DNA, 16 bp, Homo sapiens
tgtagcttatatttga

SEQ ID NO: 6537406 - DNA, 21 bp, Homo sapiens
tgtagcttatctgcccctccc

SEQ ID NO: 6537407 - DNA, 18 bp, Homo sapiens
tgtagcttcagtcattaa

SEQ ID NO: 6537408 - DNA, 16 bp, Homo sapiens
tgtagcttccacctca

SEQ ID NO: 6537409 - DNA, 15 bp, Homo sapiens
tgtagctttatcctt

SEQ ID NO: 6537410 - DNA, 12 bp, Homo sapiens
tgtagctttcct

SEQ ID NO: 6537411 - DNA, 13 bp, Homo sapiens
tgtagctttcctg

SEQ ID NO: 6537412 - DNA, 18 bp, Homo sapiens
tgtagctttcctggaagt

SEQ ID NO: 6537413 - DNA, 13 bp, Homo sapiens
tgtagctttgctc

SEQ ID NO: 6537414 - DNA, 15 bp, Homo sapiens
tgtagcttttcacct

SEQ ID NO: 6537415 - DNA, 18 bp, Homo sapiens
tgtagcttttggggaggg

SEQ ID NO: 6537416 - DNA, 16 bp, Homo sapiens
tgtagctttttattaa

SEQ ID NO: 6537417 - DNA, 15 bp, Homo sapiens
tgtaggaaatctgaa

SEQ ID NO: 6537418 - DNA, 22 bp, Homo sapiens
tgtaggaagaggccgctgcagg

SEQ ID NO: 6537419 - DNA, 23 bp, Homo sapiens
tgtaggaagaggccgctgcaggg

SEQ ID NO: 6537420 - DNA, 21 bp, Homo sapiens
tgtaggaagagtagcatttca

SEQ ID NO: 6537421 - DNA, 15 bp, Homo sapiens
tgtaggaagcatttt

SEQ ID NO: 6537422 - DNA, 21 bp, Homo sapiens
tgtaggaaggtctcattcttc

SEQ ID NO: 6537423 - DNA, 16 bp, Homo sapiens
tgtaggaatctgcctt

SEQ ID NO: 6537424 - DNA, 19 bp, Homo sapiens
tgtaggacttttaaacaaa

SEQ ID NO: 6537425 - DNA, 11 bp, Homo sapiens
tgtaggagaat

SEQ ID NO: 6537426 - DNA, 15 bp, Homo sapiens
tgtaggagagactgg

SEQ ID NO: 6537427 - DNA, 20 bp, Homo sapiens
tgtaggagaggttgtctgtg

SEQ ID NO: 6537428 - DNA, 23 bp, Homo sapiens
tgtaggagagtcggtctgctttg

SEQ ID NO: 6537429 - DNA, 13 bp, Homo sapiens
tgtaggagcaagg

SEQ ID NO: 6537430 - DNA, 22 bp, Homo sapiens
tgtaggagcaagggcacaaact

SEQ ID NO: 6537431 - DNA, 17 bp, Homo sapiens
tgtaggagctgaggttt

SEQ ID NO: 6537432 - DNA, 12 bp, Homo sapiens
tgtaggagctgc

SEQ ID NO: 6537433 - DNA, 13 bp, Homo sapiens
tgtaggagctgca

SEQ ID NO: 6537434 - DNA, 22 bp, Homo sapiens
tgtaggagctgccttggctcag

SEQ ID NO: 6537435 - DNA, 14 bp, Homo sapiens
tgtaggagggactg

SEQ ID NO: 6537436 - DNA, 20 bp, Homo sapiens
tgtaggataatataaaaagc

SEQ ID NO: 6537437 - DNA, 13 bp, Homo sapiens
ttctcacagaaga

SEQ ID NO: 6537438 - DNA, 12 bp, Homo sapiens
ttctcacagcac

SEQ ID NO: 6537439 - DNA, 13 bp, Homo sapiens
ttctcacattgct

SEQ ID NO: 6537440 - DNA, 12 bp, Homo sapiens
ttctcaccagct

SEQ ID NO: 6537441 - DNA, 14 bp, Homo sapiens
ttctcaccagctgc

SEQ ID NO: 6537442 - DNA, 18 bp, Homo sapiens
ttctcaccagctgcaaag

SEQ ID NO: 6537443 - DNA, 17 bp, Homo sapiens
ttctcaccctctgtcct

SEQ ID NO: 6537444 - DNA, 22 bp, Homo sapiens
ttctcacctaaaccctctgtga

SEQ ID NO: 6537445 - DNA, 23 bp, Homo sapiens
ttctcacctaaaccctctgtgaa

SEQ ID NO: 6537446 - DNA, 18 bp, Homo sapiens
ttctcacctgccttcaaa

SEQ ID NO: 6537447 - DNA, 23 bp, Homo sapiens
ttctcacgaaagtatttactttt

SEQ ID NO: 6537448 - DNA, 19 bp, Homo sapiens
ttctcacgctttgtttact

SEQ ID NO: 6537449 - DNA, 22 bp, Homo sapiens
ttctcacgctttgtttactctc

SEQ ID NO: 6537450 - DNA, 16 bp, Homo sapiens
ttctcactagtgtcag

SEQ ID NO: 6537451 - DNA, 17 bp, Homo sapiens
ttctcactatgtttctc

SEQ ID NO: 6537452 - DNA, 18 bp, Homo sapiens
ttctcactcctacctggt

SEQ ID NO: 6537453 - DNA, 13 bp, Homo sapiens
ttctcactgcctt

SEQ ID NO: 6537454 - DNA, 17 bp, Homo sapiens
ttctcactgtctcctgg

SEQ ID NO: 6537455 - DNA, 18 bp, Homo sapiens
ttctcactgttccctctg

SEQ ID NO: 6537456 - DNA, 20 bp, Homo sapiens
ttctcacttttggaaggtga

SEQ ID NO: 6537457 - DNA, 18 bp, Homo sapiens
ttctcagaaggcaaatga

SEQ ID NO: 6537458 - DNA, 21 bp, Homo sapiens
ttctcagaaggcaaatgactt

SEQ ID NO: 6537459 - DNA, 22 bp, Homo sapiens
ttctcagaagtgaaaaagactt

SEQ ID NO: 6537460 - DNA, 17 bp, Homo sapiens
ttctcagaataactacc

SEQ ID NO: 6537461 - DNA, 15 bp, Homo sapiens
ttctcagaatctacc

SEQ ID NO: 6537462 - DNA, 19 bp, Homo sapiens
ttctcagaatctacccaaa

SEQ ID NO: 6537463 - DNA, 23 bp, Homo sapiens
ttctcagaatctacccaaaggat

SEQ ID NO: 6537464 - DNA, 13 bp, Homo sapiens
ttctcagaatctc

SEQ ID NO: 6537465 - DNA, 19 bp, Homo sapiens
ttctcagaatctcaaataa

SEQ ID NO: 6537466 - DNA, 13 bp, Homo sapiens
ttctcagacctcc

SEQ ID NO: 6537467 - DNA, 22 bp, Homo sapiens
ttctcagactttggaaaatgca

SEQ ID NO: 6537468 - DNA, 23 bp, Homo sapiens
ttctcagactttggaaaatgcat

SEQ ID NO: 6537469 - DNA, 17 bp, Homo sapiens
ttctcagagattaaaaa

SEQ ID NO: 6537470 - DNA, 15 bp, Homo sapiens
ttctcagagcactgt

SEQ ID NO: 6537471 - DNA, 20 bp, Homo sapiens
ttctcagagctccacagaag

SEQ ID NO: 6537472 - DNA, 23 bp, Homo sapiens
ttctcagagctccacagaagaca

SEQ ID NO: 6537473 - DNA, 15 bp, Homo sapiens
ttctcagagtgttta

SEQ ID NO: 6537474 - DNA, 13 bp, Homo sapiens
ttctcagatattt

SEQ ID NO: 6537475 - DNA, 15 bp, Homo sapiens
ttctcagatttctga

SEQ ID NO: 6537476 - DNA, 20 bp, Homo sapiens
ttctcagatttctgaggaaa

SEQ ID NO: 6537477 - DNA, 15 bp, Homo sapiens
ttctcagcaagtgta

SEQ ID NO: 6537478 - DNA, 16 bp, Homo sapiens
ttctcagcaagtgtac

SEQ ID NO: 6537479 - DNA, 18 bp, Homo sapiens
ttctcagcaagtgtacag

SEQ ID NO: 6537480 - DNA, 22 bp, Homo sapiens
ttctcagccacaaaccctgcct

SEQ ID NO: 6537481 - DNA, 18 bp, Homo sapiens
ttctcagccccgggcctg

SEQ ID NO: 6537482 - DNA, 22 bp, Homo sapiens
ttctcagccttggttcctgatg

SEQ ID NO: 6537483 - DNA, 18 bp, Homo sapiens
ttctcagctccactctga

SEQ ID NO: 6537484 - DNA, 13 bp, Homo sapiens
ttctcagctccca

SEQ ID NO: 6537485 - DNA, 19 bp, Homo sapiens
ttctcagctcccatttcta

SEQ ID NO: 6537486 - DNA, 13 bp, Homo sapiens
ttctcagctcccc

SEQ ID NO: 6537487 - DNA, 20 bp, Homo sapiens
ttctcagctgtgccttccct

SEQ ID NO: 6537488 - DNA, 13 bp, Homo sapiens
ttctcaggaagat

SEQ ID NO: 6537489 - DNA, 20 bp, Homo sapiens
ttctcaggacacaggcctgt

SEQ ID NO: 6537490 - DNA, 21 bp, Homo sapiens
ttctcaggacgacgaatcttc

SEQ ID NO: 6537491 - DNA, 17 bp, Homo sapiens
ttctcaggccatcatca

SEQ ID NO: 6537492 - DNA, 17 bp, Homo sapiens
ttctcaggctggcatct

SEQ ID NO: 6537493 - DNA, 15 bp, Homo sapiens
ttctcagggaagtaa

SEQ ID NO: 6537494 - DNA, 17 bp, Homo sapiens
ttctcagggaagtaaga

SEQ ID NO: 6537495 - DNA, 13 bp, Homo sapiens
ttctcagggctcc

SEQ ID NO: 6537496 - DNA, 17 bp, Homo sapiens
ttctcagggctcctgcc

SEQ ID NO: 6537497 - DNA, 17 bp, Homo sapiens
ttctcagggggtcagca

SEQ ID NO: 6537498 - DNA, 20 bp, Homo sapiens
ttctcaggtaatcattttaa

SEQ ID NO: 6537499 - DNA, 23 bp, Homo sapiens
ttctcaggtaggaagcaacagct

SEQ ID NO: 6537500 - DNA, 19 bp, Homo sapiens
ttctcaggtgttgccaaat

SEQ ID NO: 6537501 - DNA, 13 bp, Homo sapiens
ttctcagtccttt

SEQ ID NO: 6537502 - DNA, 19 bp, Homo sapiens
ttctcagtgccaactgtgg

SEQ ID NO: 6537503 - DNA, 23 bp, Homo sapiens
ttctcagtggtcaccttcctcag

SEQ ID NO: 6537504 - DNA, 19 bp, Homo sapiens
ttctcagttgcagaaaatg

SEQ ID NO: 6537505 - DNA, 20 bp, Homo sapiens
ttctcagttgcagaaaatga

SEQ ID NO: 6537506 - DNA, 15 bp, Homo sapiens
ttctcagttttcata

SEQ ID NO: 6537507 - DNA, 15 bp, Homo sapiens
ttctcagtttttctt

SEQ ID NO: 6537508 - DNA, 16 bp, Homo sapiens
ttctcagtttttctta

SEQ ID NO: 6537509 - DNA, 18 bp, Homo sapiens
ttctcagtttttgctgat

SEQ ID NO: 6537510 - DNA, 17 bp, Homo sapiens
ttctcataaaactgtga

SEQ ID NO: 6537511 - DNA, 12 bp, Homo sapiens
ttctcataactt

SEQ ID NO: 6537512 - DNA, 22 bp, Homo sapiens
ttctcataagtagcattcatgt

SEQ ID NO: 6537513 - DNA, 24 bp, Homo sapiens
ttctcataagtagcattcatgtaa

SEQ ID NO: 6537514 - DNA, 18 bp, Homo sapiens
ttctcataattcctacag

SEQ ID NO: 6537515 - DNA, 19 bp, Homo sapiens
ttctcataattcctacagc

SEQ ID NO: 6537516 - DNA, 20 bp, Homo sapiens
ttctcataattcctacagca

SEQ ID NO: 6537517 - DNA, 16 bp, Homo sapiens
ttctcataattttgca

SEQ ID NO: 6537518 - DNA, 20 bp, Homo sapiens
ttctcatagaggaaattcaa

SEQ ID NO: 6537519 - DNA, 21 bp, Homo sapiens
ttctcatagcaggaaatgtag

SEQ ID NO: 6537520 - DNA, 17 bp, Homo sapiens
ttctcatagccccggtg

SEQ ID NO: 6537521 - DNA, 19 bp, Homo sapiens
ttctcatatccataaaatt

SEQ ID NO: 6537522 - DNA, 13 bp, Homo sapiens
ttctcatcagtag

SEQ ID NO: 6537523 - DNA, 17 bp, Homo sapiens
ttctcatcatattgtat

SEQ ID NO: 6537524 - DNA, 23 bp, Homo sapiens
ttctcatcatattgtatgtaagt

SEQ ID NO: 6537525 - DNA, 16 bp, Homo sapiens
ttctcatccaaaagtg

SEQ ID NO: 6537526 - DNA, 17 bp, Homo sapiens
ttctcatccaaaagtga

SEQ ID NO: 6537527 - DNA, 15 bp, Homo sapiens
ttctcatccatagta

SEQ ID NO: 6537528 - DNA, 17 bp, Homo sapiens
ttctcatcccacgcact

SEQ ID NO: 6537529 - DNA, 17 bp, Homo sapiens
ttctcatcccagtctga

SEQ ID NO: 6537530 - DNA, 22 bp, Homo sapiens
ttctcatcccagtctgatattc

SEQ ID NO: 6537531 - DNA, 13 bp, Homo sapiens
ttctcatctcccc

SEQ ID NO: 6537532 - DNA, 17 bp, Homo sapiens
ttctcatcttaaaaata

SEQ ID NO: 6537533 - DNA, 14 bp, Homo sapiens
ttctcatcttgcct

SEQ ID NO: 6537534 - DNA, 15 bp, Homo sapiens
ttctcatcttgtgaa

SEQ ID NO: 6537535 - DNA, 18 bp, Homo sapiens
ttctcatctttcttgatc

SEQ ID NO: 6537536 - DNA, 20 bp, Homo sapiens
ttctcatgatttacagagaa

SEQ ID NO: 6537537 - DNA, 15 bp, Homo sapiens
ttctcatgcactgca

SEQ ID NO: 6537538 - DNA, 22 bp, Homo sapiens
ttctcatgcactgcaaatactt

SEQ ID NO: 6537539 - DNA, 14 bp, Homo sapiens
ttctcatgcctcag

SEQ ID NO: 6537540 - DNA, 17 bp, Homo sapiens
ttctcatgctatttcta

SEQ ID NO: 6537541 - DNA, 14 bp, Homo sapiens
ttctcatggatttg

SEQ ID NO: 6537542 - DNA, 22 bp, Homo sapiens
ttctcatggctttgttaaactt

SEQ ID NO: 6537543 - DNA, 18 bp, Homo sapiens
ttctcatggtattatcta

SEQ ID NO: 6537544 - DNA, 23 bp, Homo sapiens
ttctcatgtagaacaagaaatct

SEQ ID NO: 6537545 - DNA, 18 bp, Homo sapiens
ttctcatgtgatcctttt

SEQ ID NO: 6537546 - DNA, 11 bp, Homo sapiens
ttctcatgtgc

SEQ ID NO: 6537547 - DNA, 17 bp, Homo sapiens
ttctcatgtgctttgta

SEQ ID NO: 6537548 - DNA, 13 bp, Homo sapiens
ttctcatgtgttt

SEQ ID NO: 6537549 - DNA, 20 bp, Homo sapiens
ttctcatgttaaatatttgt

SEQ ID NO: 6537550 - DNA, 21 bp, Homo sapiens
ttctcatgttaaatatttgtc

SEQ ID NO: 6537551 - DNA, 22 bp, Homo sapiens
ttctcatgttgaaactttaaga

SEQ ID NO: 6537552 - DNA, 20 bp, Homo sapiens
ttctcatgttgaagccactg

SEQ ID NO: 6537553 - DNA, 15 bp, Homo sapiens
ttctcatgtttgtgc

SEQ ID NO: 6537554 - DNA, 15 bp, Homo sapiens
ttctcattaaaagaa

SEQ ID NO: 6537555 - DNA, 13 bp, Homo sapiens
ttctcattaaact

SEQ ID NO: 6537556 - DNA, 21 bp, Homo sapiens
ttctcattaacaatattttat

SEQ ID NO: 6537557 - DNA, 18 bp, Homo sapiens
ttctcattccaacagtga

SEQ ID NO: 6537558 - DNA, 16 bp, Homo sapiens
ttctcattcccatgtg

SEQ ID NO: 6537559 - DNA, 11 bp, Homo sapiens
ttctcattctt

SEQ ID NO: 6537560 - DNA, 14 bp, Homo sapiens
ttctcattcttcta

SEQ ID NO: 6537561 - DNA, 23 bp, Homo sapiens
ttctcattgaattataaaagcca

SEQ ID NO: 6537562 - DNA, 13 bp, Homo sapiens
ttctcattgctgc

SEQ ID NO: 6537563 - DNA, 16 bp, Homo sapiens
ttctcattgctgcccg

SEQ ID NO: 6537564 - DNA, 20 bp, Homo sapiens
ttctcattggggttgcaaca

SEQ ID NO: 6537565 - DNA, 21 bp, Homo sapiens
ttctcattggggttgcaacaa

SEQ ID NO: 6537566 - DNA, 18 bp, Homo sapiens
ttctcatttatgttattt

SEQ ID NO: 6537567 - DNA, 22 bp, Homo sapiens
ttctcatttatgttatttatga

SEQ ID NO: 6537568 - DNA, 19 bp, Homo sapiens
ttctcatttcacccctccc

SEQ ID NO: 6537569 - DNA, 18 bp, Homo sapiens
ttctcatttgaaatgttt

SEQ ID NO: 6537570 - DNA, 20 bp, Homo sapiens
ttctcatttgccaataataa

SEQ ID NO: 6537571 - DNA, 20 bp, Homo sapiens
ttctcatttggtctgccaga

SEQ ID NO: 6537572 - DNA, 17 bp, Homo sapiens
ttctcattttttaaaaa

SEQ ID NO: 6537573 - DNA, 18 bp, Homo sapiens
ttctccaaaaatctgcct

SEQ ID NO: 6537574 - DNA, 19 bp, Homo sapiens
ttctccaaaaatctgcctg

SEQ ID NO: 6537575 - DNA, 20 bp, Homo sapiens
ttctccaaactgaagcagcc

SEQ ID NO: 6537576 - DNA, 17 bp, Homo sapiens
ttctccaaaggcactga

SEQ ID NO: 6537577 - DNA, 22 bp, Homo sapiens
ttctccaacatcacagcccagc

SEQ ID NO: 6537578 - DNA, 16 bp, Homo sapiens
ttctccaagaaagcca

SEQ ID NO: 6537579 - DNA, 19 bp, Homo sapiens
ttctccaatatcagtgctc

SEQ ID NO: 6537580 - DNA, 22 bp, Homo sapiens
ttctccacaacagcctggggtt

SEQ ID NO: 6537581 - DNA, 17 bp, Homo sapiens
ttctccacactccactg

SEQ ID NO: 6537582 - DNA, 19 bp, Homo sapiens
ttctccacactccactgac

SEQ ID NO: 6537583 - DNA, 15 bp, Homo sapiens
ttctccacagcaacc

SEQ ID NO: 6537584 - DNA, 15 bp, Homo sapiens
ttctccaccagcccc

SEQ ID NO: 6537585 - DNA, 16 bp, Homo sapiens
ttctccaccctgctct

SEQ ID NO: 6537586 - DNA, 12 bp, Homo sapiens
ttctccacctcc

SEQ ID NO: 6537587 - DNA, 13 bp, Homo sapiens
ttctccacctccc

SEQ ID NO: 6537588 - DNA, 20 bp, Homo sapiens
ttctccacctgccagggaca

SEQ ID NO: 6537589 - DNA, 21 bp, Homo sapiens
ttctccacgtctttcctgcta

SEQ ID NO: 6537590 - DNA, 19 bp, Homo sapiens
ttctccagaaaaatcaatc

SEQ ID NO: 6537591 - DNA, 12 bp, Homo sapiens
ttctccagaacc

SEQ ID NO: 6537592 - DNA, 13 bp, Homo sapiens
ttctccagaatgt

SEQ ID NO: 6537593 - DNA, 17 bp, Homo sapiens
ttctccagatttttaat

SEQ ID NO: 6537594 - DNA, 23 bp, Homo sapiens
ttctccagatttttcggaggccc

SEQ ID NO: 6537595 - DNA, 13 bp, Homo sapiens
ttctccagccagc

SEQ ID NO: 6537596 - DNA, 17 bp, Homo sapiens
ttctccagcccacaccc

SEQ ID NO: 6537597 - DNA, 22 bp, Homo sapiens
ttctccagcccacacccctcca

SEQ ID NO: 6537598 - DNA, 19 bp, Homo sapiens
ttctccagcccatgctggc

SEQ ID NO: 6537599 - DNA, 23 bp, Homo sapiens
ttctccagcccatgctggctggg

SEQ ID NO: 6537600 - DNA, 15 bp, Homo sapiens
ttctccagccctgac

SEQ ID NO: 6537601 - DNA, 19 bp, Homo sapiens
ttctccagcctcagcctcc

SEQ ID NO: 6537602 - DNA, 17 bp, Homo sapiens
ttctccagcctggaccc

SEQ ID NO: 6537603 - DNA, 13 bp, Homo sapiens
ttctccagctcag

SEQ ID NO: 6537604 - DNA, 17 bp, Homo sapiens
ttctccaggattccaaa

SEQ ID NO: 6537605 - DNA, 13 bp, Homo sapiens
ttctccaggccct

SEQ ID NO: 6537606 - DNA, 16 bp, Homo sapiens
ttctccaggcttcccc

SEQ ID NO: 6537607 - DNA, 14 bp, Homo sapiens
ttctccagggtcag

SEQ ID NO: 6537608 - DNA, 17 bp, Homo sapiens
ttctccagtcattatgt

SEQ ID NO: 6537609 - DNA, 14 bp, Homo sapiens
ttctccagtccctg

SEQ ID NO: 6537610 - DNA, 13 bp, Homo sapiens
ttctccagtggtg

SEQ ID NO: 6537611 - DNA, 19 bp, Homo sapiens
ttctccatcccctccctgc

SEQ ID NO: 6537612 - DNA, 22 bp, Homo sapiens
ttctccatgctgcaaaggagaa

SEQ ID NO: 6537613 - DNA, 23 bp, Homo sapiens
ttctccatgctgcaaaggagaag

SEQ ID NO: 6537614 - DNA, 22 bp, Homo sapiens
ttctccatggccaccttttcag

SEQ ID NO: 6537615 - DNA, 19 bp, Homo sapiens
tgtaggatgacaggctctc

SEQ ID NO: 6537616 - DNA, 23 bp, Homo sapiens
tgtaggatgacaggctctcctgg

SEQ ID NO: 6537617 - DNA, 14 bp, Homo sapiens
tgtaggatgtatgc

SEQ ID NO: 6537618 - DNA, 18 bp, Homo sapiens
tgtaggcacagagctgca

SEQ ID NO: 6537619 - DNA, 14 bp, Homo sapiens
tgtaggcaccacct

SEQ ID NO: 6537620 - DNA, 11 bp, Homo sapiens
tgtaggcagac

SEQ ID NO: 6537621 - DNA, 16 bp, Homo sapiens
tgtaggcagacacagg

SEQ ID NO: 6537622 - DNA, 23 bp, Homo sapiens
tgtaggccaccattataatttat

SEQ ID NO: 6537623 - DNA, 21 bp, Homo sapiens
tgtaggcccctggtctgccct

SEQ ID NO: 6537624 - DNA, 14 bp, Homo sapiens
tgtaggcctgcctt

SEQ ID NO: 6537625 - DNA, 18 bp, Homo sapiens
tgtaggcgcccctggggt

SEQ ID NO: 6537626 - DNA, 12 bp, Homo sapiens
tgtaggctgggg

SEQ ID NO: 6537627 - DNA, 21 bp, Homo sapiens
tgtaggctggggcggggccca

SEQ ID NO: 6537628 - DNA, 22 bp, Homo sapiens
tgtaggctggggcggggcccag

SEQ ID NO: 6537629 - DNA, 13 bp, Homo sapiens
tgtaggctgtggg

SEQ ID NO: 6537630 - DNA, 14 bp, Homo sapiens
tgtaggctgtgggg

SEQ ID NO: 6537631 - DNA, 17 bp, Homo sapiens
tgtaggctgttcccttt

SEQ ID NO: 6537632 - DNA, 21 bp, Homo sapiens
tgtaggctgttccctttgcct

SEQ ID NO: 6537633 - DNA, 17 bp, Homo sapiens
tgtaggcttagtttgtg

SEQ ID NO: 6537634 - DNA, 20 bp, Homo sapiens
tgtaggctttacttagctta

SEQ ID NO: 6537635 - DNA, 22 bp, Homo sapiens
tgtagggaaaaaaatgcttctt

SEQ ID NO: 6537636 - DNA, 17 bp, Homo sapiens
tgtagggagaagcttta

SEQ ID NO: 6537637 - DNA, 22 bp, Homo sapiens
tgtagggcaagggtgcctcagg

SEQ ID NO: 6537638 - DNA, 16 bp, Homo sapiens
tgtagggctggaccta

SEQ ID NO: 6537639 - DNA, 22 bp, Homo sapiens
tgtaggggagccacatttacat

SEQ ID NO: 6537640 - DNA, 14 bp, Homo sapiens
tgtaggggccacct

SEQ ID NO: 6537641 - DNA, 17 bp, Homo sapiens
tgtaggggccacctcct

SEQ ID NO: 6537642 - DNA, 23 bp, Homo sapiens
tgtaggggcttacaaagccttac

SEQ ID NO: 6537643 - DNA, 23 bp, Homo sapiens
tgtagggtagcggaaaagttgtc

SEQ ID NO: 6537644 - DNA, 16 bp, Homo sapiens
tgtagggttataataa

SEQ ID NO: 6537645 - DNA, 18 bp, Homo sapiens
tgtagggttctgctttta

SEQ ID NO: 6537646 - DNA, 13 bp, Homo sapiens
tgtagggtttcta

SEQ ID NO: 6537647 - DNA, 18 bp, Homo sapiens
tgtagggtttggacagac

SEQ ID NO: 6537648 - DNA, 20 bp, Homo sapiens
tgtagggtttggacagaccc

SEQ ID NO: 6537649 - DNA, 15 bp, Homo sapiens
tgtaggtaagactgt

SEQ ID NO: 6537650 - DNA, 17 bp, Homo sapiens
tgtaggtatactatgta

SEQ ID NO: 6537651 - DNA, 19 bp, Homo sapiens
tgtaggtatgtctgtgcca

SEQ ID NO: 6537652 - DNA, 16 bp, Homo sapiens
tgtaggtattaaagat

SEQ ID NO: 6537653 - DNA, 15 bp, Homo sapiens
tgtaggtcaggacca

SEQ ID NO: 6537654 - DNA, 20 bp, Homo sapiens
tgtaggtcaggaccatcaga

SEQ ID NO: 6537655 - DNA, 14 bp, Homo sapiens
tgtaggtcctcaga

SEQ ID NO: 6537656 - DNA, 19 bp, Homo sapiens
tgtaggtgaacagtcacgc

SEQ ID NO: 6537657 - DNA, 12 bp, Homo sapiens
tgtaggtgactt

SEQ ID NO: 6537658 - DNA, 14 bp, Homo sapiens
tgtaggtgagcctg

SEQ ID NO: 6537659 - DNA, 22 bp, Homo sapiens
tgtaggtgtctctgggcctgtg

SEQ ID NO: 6537660 - DNA, 19 bp, Homo sapiens
tgtaggtgtctgcacccag

SEQ ID NO: 6537661 - DNA, 20 bp, Homo sapiens
tgtaggtgtctgcacccagg

SEQ ID NO: 6537662 - DNA, 16 bp, Homo sapiens
tgtaggtgtctgcctt

SEQ ID NO: 6537663 - DNA, 13 bp, Homo sapiens
tgtaggtgttatg

SEQ ID NO: 6537664 - DNA, 14 bp, Homo sapiens
tgtaggttgcacac

SEQ ID NO: 6537665 - DNA, 11 bp, Homo sapiens
tgtaggttgct

SEQ ID NO: 6537666 - DNA, 14 bp, Homo sapiens
tgtaggttgtctaa

SEQ ID NO: 6537667 - DNA, 17 bp, Homo sapiens
tgtaggtttctctgcct

SEQ ID NO: 6537668 - DNA, 14 bp, Homo sapiens
tgtagtaaaagtgg

SEQ ID NO: 6537669 - DNA, 23 bp, Homo sapiens
tgtagtaaaagtggtctctgctg

SEQ ID NO: 6537670 - DNA, 19 bp, Homo sapiens
tgtagtaaagccgttgttt

SEQ ID NO: 6537671 - DNA, 20 bp, Homo sapiens
tgtagtaaagccgttgttta

SEQ ID NO: 6537672 - DNA, 22 bp, Homo sapiens
tgtagtaaagccgttgtttact

SEQ ID NO: 6537673 - DNA, 21 bp, Homo sapiens
tgtagtaaataatgctttgaa

SEQ ID NO: 6537674 - DNA, 23 bp, Homo sapiens
tgtagtaaatattatgattttat

SEQ ID NO: 6537675 - DNA, 14 bp, Homo sapiens
tgtagtaacactaa

SEQ ID NO: 6537676 - DNA, 22 bp, Homo sapiens
tgtagtaataaaaagtaacaca

SEQ ID NO: 6537677 - DNA, 19 bp, Homo sapiens
tgtagtaatctgcattatt

SEQ ID NO: 6537678 - DNA, 19 bp, Homo sapiens
tgtagtagcctttcctgat

SEQ ID NO: 6537679 - DNA, 23 bp, Homo sapiens
tgtagtagcgttttttaaatgta

SEQ ID NO: 6537680 - DNA, 20 bp, Homo sapiens
tgtagtagtcaaggtgctca

SEQ ID NO: 6537681 - DNA, 13 bp, Homo sapiens
tgtagtagtctca

SEQ ID NO: 6537682 - DNA, 23 bp, Homo sapiens
tgtagtatcaaatattagatgtg

SEQ ID NO: 6537683 - DNA, 18 bp, Homo sapiens
tgtagtatggcctgtgtc

SEQ ID NO: 6537684 - DNA, 18 bp, Homo sapiens
tgtagtatttatatttaa

SEQ ID NO: 6537685 - DNA, 20 bp, Homo sapiens
tgtagtatttttgccaaaat

SEQ ID NO: 6537686 - DNA, 14 bp, Homo sapiens
tgtagtcaagaggt

SEQ ID NO: 6537687 - DNA, 15 bp, Homo sapiens
tgtagtcacattagt

SEQ ID NO: 6537688 - DNA, 22 bp, Homo sapiens
tgtagtcagaattagctgcttc

SEQ ID NO: 6537689 - DNA, 19 bp, Homo sapiens
tgtagtcatttactaaaca

SEQ ID NO: 6537690 - DNA, 20 bp, Homo sapiens
tgtagtcatttactaaacat

SEQ ID NO: 6537691 - DNA, 13 bp, Homo sapiens
tgtagtcccagct

SEQ ID NO: 6537692 - DNA, 20 bp, Homo sapiens
tgtagtccgtgctgacagct

SEQ ID NO: 6537693 - DNA, 20 bp, Homo sapiens
tgtagtcctagctactcagg

SEQ ID NO: 6537694 - DNA, 21 bp, Homo sapiens
tgtagtcctcataaaaagcaa

SEQ ID NO: 6537695 - DNA, 22 bp, Homo sapiens
tgtagtcctttctgccttggcc

SEQ ID NO: 6537696 - DNA, 17 bp, Homo sapiens
tgtagtctcacactgtt

SEQ ID NO: 6537697 - DNA, 17 bp, Homo sapiens
tgtagtctcagctactt

SEQ ID NO: 6537698 - DNA, 14 bp, Homo sapiens
tgtagtctcaggac

SEQ ID NO: 6537699 - DNA, 14 bp, Homo sapiens
tgtagtcttatgaa

SEQ ID NO: 6537700 - DNA, 17 bp, Homo sapiens
tgtagtcttatgaatag

SEQ ID NO: 6537701 - DNA, 18 bp, Homo sapiens
tgtagtcttgacgaatat

SEQ ID NO: 6537702 - DNA, 12 bp, Homo sapiens
tgtagtcttgtc

SEQ ID NO: 6537703 - DNA, 20 bp, Homo sapiens
tgtagtctttttataggttt

SEQ ID NO: 6537704 - DNA, 21 bp, Homo sapiens
tgtagtctttttataggtttt

SEQ ID NO: 6537705 - DNA, 22 bp, Homo sapiens
tgtagtgaatcacgtaaagcta

SEQ ID NO: 6537706 - DNA, 14 bp, Homo sapiens
tgtagtgattcaaa

SEQ ID NO: 6537707 - DNA, 21 bp, Homo sapiens
tgtagtgatttttatgccacc

SEQ ID NO: 6537708 - DNA, 19 bp, Homo sapiens
tgtagtgcatttttaaact

SEQ ID NO: 6537709 - DNA, 21 bp, Homo sapiens
tgtagtgcatttttaaacttg

SEQ ID NO: 6537710 - DNA, 22 bp, Homo sapiens
tgtagtgcccctcccatggccc

SEQ ID NO: 6537711 - DNA, 21 bp, Homo sapiens
tgtagtgcctctttcatccac

SEQ ID NO: 6537712 - DNA, 15 bp, Homo sapiens
tgtagtgctttgaga

SEQ ID NO: 6537713 - DNA, 21 bp, Homo sapiens
tgtagtggaagagcagcctga

SEQ ID NO: 6537714 - DNA, 17 bp, Homo sapiens
tgtagtggttttaggat

SEQ ID NO: 6537715 - DNA, 22 bp, Homo sapiens
tgtagtggttttaggatactta

SEQ ID NO: 6537716 - DNA, 15 bp, Homo sapiens
tgtagtgtagtcagg

SEQ ID NO: 6537717 - DNA, 20 bp, Homo sapiens
tgtagtgtccattttgtgaa

SEQ ID NO: 6537718 - DNA, 15 bp, Homo sapiens
tgtagtgtgtttgtg

SEQ ID NO: 6537719 - DNA, 16 bp, Homo sapiens
tgtagtgtgtttgtga

SEQ ID NO: 6537720 - DNA, 17 bp, Homo sapiens
tgtagtgtgttttcata

SEQ ID NO: 6537721 - DNA, 13 bp, Homo sapiens
tgtagttaatata

SEQ ID NO: 6537722 - DNA, 18 bp, Homo sapiens
tgtagttacctactgagt

SEQ ID NO: 6537723 - DNA, 15 bp, Homo sapiens
tgtagttaggcctgg

SEQ ID NO: 6537724 - DNA, 18 bp, Homo sapiens
tgtagttcagatagagat

SEQ ID NO: 6537725 - DNA, 15 bp, Homo sapiens
tgtagttccctctgc

SEQ ID NO: 6537726 - DNA, 20 bp, Homo sapiens
tgtagttccctctgcctggg

SEQ ID NO: 6537727 - DNA, 21 bp, Homo sapiens
tgtagttccctctgcctggga

SEQ ID NO: 6537728 - DNA, 20 bp, Homo sapiens
tgtagttctgctccagacag

SEQ ID NO: 6537729 - DNA, 16 bp, Homo sapiens
tgtagttctgtgtact

SEQ ID NO: 6537730 - DNA, 13 bp, Homo sapiens
tgtagttcttagt

SEQ ID NO: 6537731 - DNA, 12 bp, Homo sapiens
tgtagttcttta

SEQ ID NO: 6537732 - DNA, 17 bp, Homo sapiens
tgtagttctttaaactg

SEQ ID NO: 6537733 - DNA, 16 bp, Homo sapiens
tgtagttctttgttcc

SEQ ID NO: 6537734 - DNA, 17 bp, Homo sapiens
tgtagttctttgttcct

SEQ ID NO: 6537735 - DNA, 14 bp, Homo sapiens
tgtagttgaactga

SEQ ID NO: 6537736 - DNA, 20 bp, Homo sapiens
tgtagttgaactgatagtta

SEQ ID NO: 6537737 - DNA, 16 bp, Homo sapiens
tgtagttgacaattct

SEQ ID NO: 6537738 - DNA, 20 bp, Homo sapiens
tgtagttgacaattctgcat

SEQ ID NO: 6537739 - DNA, 16 bp, Homo sapiens
tgtagttgatgtatcc

SEQ ID NO: 6537740 - DNA, 17 bp, Homo sapiens
tgtagttgatgtatcca

SEQ ID NO: 6537741 - DNA, 20 bp, Homo sapiens
tgtagttgcgtggactctgc

SEQ ID NO: 6537742 - DNA, 15 bp, Homo sapiens
tgtagtttaatactt

SEQ ID NO: 6537743 - DNA, 15 bp, Homo sapiens
tgtagtttagttctg

SEQ ID NO: 6537744 - DNA, 14 bp, Homo sapiens
tgtagtttgaaagt

SEQ ID NO: 6537745 - DNA, 22 bp, Homo sapiens
tgtagtttgaggaaatttgcag

SEQ ID NO: 6537746 - DNA, 23 bp, Homo sapiens
tgtagttttattttatgtttaga

SEQ ID NO: 6537747 - DNA, 21 bp, Homo sapiens
tgtagttttgtgatgcatttt

SEQ ID NO: 6537748 - DNA, 19 bp, Homo sapiens
tgtagtttttcttcaacat

SEQ ID NO: 6537749 - DNA, 15 bp, Homo sapiens
tgtagtttttgaaaa

SEQ ID NO: 6537750 - DNA, 22 bp, Homo sapiens
tgtagtttttttggtgctataa

SEQ ID NO: 6537751 - DNA, 21 bp, Homo sapiens
tgtataaaaaagaaaacttgt

SEQ ID NO: 6537752 - DNA, 15 bp, Homo sapiens
tgtataaaaacatga

SEQ ID NO: 6537753 - DNA, 13 bp, Homo sapiens
tgtataaaaagga

SEQ ID NO: 6537754 - DNA, 19 bp, Homo sapiens
tgtataaaaaggaaattag

SEQ ID NO: 6537755 - DNA, 22 bp, Homo sapiens
tgtataaaaataaaaaagatcc

SEQ ID NO: 6537756 - DNA, 14 bp, Homo sapiens
tgtataaaaatgta

SEQ ID NO: 6537757 - DNA, 15 bp, Homo sapiens
tgtataaaaatgtaa

SEQ ID NO: 6537758 - DNA, 20 bp, Homo sapiens
tgtataaaaattatcaaaaa

SEQ ID NO: 6537759 - DNA, 18 bp, Homo sapiens
tgtataaaacagtgtttc

SEQ ID NO: 6537760 - DNA, 13 bp, Homo sapiens
tgtataaaagttg

SEQ ID NO: 6537761 - DNA, 15 bp, Homo sapiens
tgtataaaagttgta

SEQ ID NO: 6537762 - DNA, 18 bp, Homo sapiens
tgtataaaagttgtactg

SEQ ID NO: 6537763 - DNA, 13 bp, Homo sapiens
tgtataaaataat

SEQ ID NO: 6537764 - DNA, 13 bp, Homo sapiens
tgtataaaataca

SEQ ID NO: 6537765 - DNA, 19 bp, Homo sapiens
tgtataaaatacatagtga

SEQ ID NO: 6537766 - DNA, 21 bp, Homo sapiens
tgtataaaatccaaaatgaat

SEQ ID NO: 6537767 - DNA, 14 bp, Homo sapiens
tgtataaaatgtaa

SEQ ID NO: 6537768 - DNA, 16 bp, Homo sapiens
tgtataaacaagaaaa

SEQ ID NO: 6537769 - DNA, 17 bp, Homo sapiens
tgtataaacaagaaaaa

SEQ ID NO: 6537770 - DNA, 16 bp, Homo sapiens
tgtataaactgtattt

SEQ ID NO: 6537771 - DNA, 14 bp, Homo sapiens
tgtataaagaaact

SEQ ID NO: 6537772 - DNA, 15 bp, Homo sapiens
tgtataaagattgta

SEQ ID NO: 6537773 - DNA, 14 bp, Homo sapiens
tgtataaataggag

SEQ ID NO: 6537774 - DNA, 19 bp, Homo sapiens
tgtataaatatacagtata

SEQ ID NO: 6537775 - DNA, 17 bp, Homo sapiens
tgtataaatccaatatc

SEQ ID NO: 6537776 - DNA, 21 bp, Homo sapiens
tgtataaatccaatatcatgt

SEQ ID NO: 6537777 - DNA, 23 bp, Homo sapiens
tgtataaatgaagtttatacagt

SEQ ID NO: 6537778 - DNA, 12 bp, Homo sapiens
tgtataaatgta

SEQ ID NO: 6537779 - DNA, 16 bp, Homo sapiens
tgtataaatgtatata

SEQ ID NO: 6537780 - DNA, 13 bp, Homo sapiens
tgtataaatgtct

SEQ ID NO: 6537781 - DNA, 13 bp, Homo sapiens
tgtataaatgtga

SEQ ID NO: 6537782 - DNA, 19 bp, Homo sapiens
tgtataaattaaataaact

SEQ ID NO: 6537783 - DNA, 22 bp, Homo sapiens
tgtataaattaaataaactgtt

SEQ ID NO: 6537784 - DNA, 23 bp, Homo sapiens
tgtataaattaaataaactgttt

SEQ ID NO: 6537785 - DNA, 23 bp, Homo sapiens
tgtataacaagccaaacattctt

SEQ ID NO: 6537786 - DNA, 15 bp, Homo sapiens
tgtataacaggttat

SEQ ID NO: 6537787 - DNA, 21 bp, Homo sapiens
tgtataacaggttattttagt

SEQ ID NO: 6537788 - DNA, 18 bp, Homo sapiens
tgtataacatcactgtca

SEQ ID NO: 6537789 - DNA, 17 bp, Homo sapiens
tgtataacattaagaaa

SEQ ID NO: 6537790 - DNA, 18 bp, Homo sapiens
tgtataacttcttaaaag

SEQ ID NO: 6537791 - DNA, 21 bp, Homo sapiens
tgtataacttcttaaaagttg

SEQ ID NO: 6537792 - DNA, 13 bp, Homo sapiens
tgtataactttaa

SEQ ID NO: 6537793 - DNA, 19 bp, Homo sapiens
ttctccatgggccaccgcc

SEQ ID NO: 6537794 - DNA, 15 bp, Homo sapiens
ttctccatgttggtc

SEQ ID NO: 6537795 - DNA, 12 bp, Homo sapiens
ttctccattaaa

SEQ ID NO: 6537796 - DNA, 17 bp, Homo sapiens
ttctccattccctagca

SEQ ID NO: 6537797 - DNA, 18 bp, Homo sapiens
ttctccattccctagcag

SEQ ID NO: 6537798 - DNA, 19 bp, Homo sapiens
ttctcccaacaacatgaaa

SEQ ID NO: 6537799 - DNA, 19 bp, Homo sapiens
ttctcccaactcagcctgt

SEQ ID NO: 6537800 - DNA, 20 bp, Homo sapiens
ttctcccaactcagcctgtt

SEQ ID NO: 6537801 - DNA, 17 bp, Homo sapiens
ttctcccaagaaacctg

SEQ ID NO: 6537802 - DNA, 13 bp, Homo sapiens
ttctcccacactg

SEQ ID NO: 6537803 - DNA, 22 bp, Homo sapiens
ttctcccacatgaggccatctc

SEQ ID NO: 6537804 - DNA, 23 bp, Homo sapiens
ttctcccacatgaggccatctca

SEQ ID NO: 6537805 - DNA, 14 bp, Homo sapiens
ttctcccacccctt

SEQ ID NO: 6537806 - DNA, 22 bp, Homo sapiens
ttctcccaccccttggcccctc

SEQ ID NO: 6537807 - DNA, 12 bp, Homo sapiens
ttctcccactct

SEQ ID NO: 6537808 - DNA, 18 bp, Homo sapiens
ttctcccactctcctagg

SEQ ID NO: 6537809 - DNA, 17 bp, Homo sapiens
ttctcccacttggccaa

SEQ ID NO: 6537810 - DNA, 17 bp, Homo sapiens
ttctcccagaaggctgg

SEQ ID NO: 6537811 - DNA, 15 bp, Homo sapiens
ttctcccagagcaca

SEQ ID NO: 6537812 - DNA, 21 bp, Homo sapiens
ttctcccagcactgcctcctg

SEQ ID NO: 6537813 - DNA, 15 bp, Homo sapiens
ttctcccagcctctt

SEQ ID NO: 6537814 - DNA, 21 bp, Homo sapiens
ttctcccagctctagcctctg

SEQ ID NO: 6537815 - DNA, 19 bp, Homo sapiens
ttctcccaggcaaggctgt

SEQ ID NO: 6537816 - DNA, 23 bp, Homo sapiens
ttctcccaggccaggctccttcc

SEQ ID NO: 6537817 - DNA, 11 bp, Homo sapiens
ttctcccaggg

SEQ ID NO: 6537818 - DNA, 14 bp, Homo sapiens
ttctcccagtgtga

SEQ ID NO: 6537819 - DNA, 21 bp, Homo sapiens
ttctcccagtgtgagacccca

SEQ ID NO: 6537820 - DNA, 15 bp, Homo sapiens
ttctcccatttcctg

SEQ ID NO: 6537821 - DNA, 20 bp, Homo sapiens
ttctccccaatgagacttgc

SEQ ID NO: 6537822 - DNA, 17 bp, Homo sapiens
ttctccccacagcctct

SEQ ID NO: 6537823 - DNA, 12 bp, Homo sapiens
ttctccccagaa

SEQ ID NO: 6537824 - DNA, 18 bp, Homo sapiens
ttctccccagagctgcct

SEQ ID NO: 6537825 - DNA, 15 bp, Homo sapiens
ttctccccagccaga

SEQ ID NO: 6537826 - DNA, 18 bp, Homo sapiens
ttctccccagctcccagg

SEQ ID NO: 6537827 - DNA, 18 bp, Homo sapiens
ttctccccccatcccagg

SEQ ID NO: 6537828 - DNA, 20 bp, Homo sapiens
ttctcccccccggggctggg

SEQ ID NO: 6537829 - DNA, 20 bp, Homo sapiens
ttctcccccgacactgctgc

SEQ ID NO: 6537830 - DNA, 14 bp, Homo sapiens
ttctcccccgccct

SEQ ID NO: 6537831 - DNA, 17 bp, Homo sapiens
ttctcccccgccctgcc

SEQ ID NO: 6537832 - DNA, 20 bp, Homo sapiens
ttctcccccgccctgccccg

SEQ ID NO: 6537833 - DNA, 21 bp, Homo sapiens
ttctcccccgccctgccccgc

SEQ ID NO: 6537834 - DNA, 14 bp, Homo sapiens
ttctccccggacac

SEQ ID NO: 6537835 - DNA, 10 bp, Homo sapiens
ttctcccctc

SEQ ID NO: 6537836 - DNA, 15 bp, Homo sapiens
ttctcccctccagac

SEQ ID NO: 6537837 - DNA, 19 bp, Homo sapiens
ttctcccctgcccccagga

SEQ ID NO: 6537838 - DNA, 22 bp, Homo sapiens
ttctcccctgcccccaggactg

SEQ ID NO: 6537839 - DNA, 15 bp, Homo sapiens
ttctccccttcacgt

SEQ ID NO: 6537840 - DNA, 13 bp, Homo sapiens
ttctccccttcct

SEQ ID NO: 6537841 - DNA, 15 bp, Homo sapiens
ttctcccgccattgg

SEQ ID NO: 6537842 - DNA, 20 bp, Homo sapiens
ttctcccgccattggcctta

SEQ ID NO: 6537843 - DNA, 14 bp, Homo sapiens
ttctcccgcctcag

SEQ ID NO: 6537844 - DNA, 17 bp, Homo sapiens
ttctcccgcctcagcct

SEQ ID NO: 6537845 - DNA, 13 bp, Homo sapiens
ttctcccgcttcc

SEQ ID NO: 6537846 - DNA, 19 bp, Homo sapiens
ttctcccgcttcctggcct

SEQ ID NO: 6537847 - DNA, 19 bp, Homo sapiens
ttctcccggaggccccggc

SEQ ID NO: 6537848 - DNA, 15 bp, Homo sapiens
ttctccctagaaaca

SEQ ID NO: 6537849 - DNA, 21 bp, Homo sapiens
ttctccctcacccccaggtgt

SEQ ID NO: 6537850 - DNA, 18 bp, Homo sapiens
ttctccctcccaccttaa

SEQ ID NO: 6537851 - DNA, 21 bp, Homo sapiens
ttctccctctcatgtccctcc

SEQ ID NO: 6537852 - DNA, 19 bp, Homo sapiens
ttctccctgaccttagcgt

SEQ ID NO: 6537853 - DNA, 18 bp, Homo sapiens
ttctccctgcacaagcca

SEQ ID NO: 6537854 - DNA, 16 bp, Homo sapiens
ttctccctgcagcctt

SEQ ID NO: 6537855 - DNA, 19 bp, Homo sapiens
ttctccctggatttttacc

SEQ ID NO: 6537856 - DNA, 15 bp, Homo sapiens
ttctccctgggaact

SEQ ID NO: 6537857 - DNA, 13 bp, Homo sapiens
ttctccctgggga

SEQ ID NO: 6537858 - DNA, 23 bp, Homo sapiens
ttctccctggggacggggctccc

SEQ ID NO: 6537859 - DNA, 23 bp, Homo sapiens
ttctccctggggatgtgctttgt

SEQ ID NO: 6537860 - DNA, 13 bp, Homo sapiens
ttctcccttcggt

SEQ ID NO: 6537861 - DNA, 18 bp, Homo sapiens
ttctcccttctctcaccc

SEQ ID NO: 6537862 - DNA, 23 bp, Homo sapiens
ttctcccttcttgggtctgccct

SEQ ID NO: 6537863 - DNA, 15 bp, Homo sapiens
ttctcccttgccctc

SEQ ID NO: 6537864 - DNA, 22 bp, Homo sapiens
ttctcccttttttttttaaatt

SEQ ID NO: 6537865 - DNA, 21 bp, Homo sapiens
ttctccgcattggaagagccc

SEQ ID NO: 6537866 - DNA, 22 bp, Homo sapiens
ttctccgcattggaagagcccg

SEQ ID NO: 6537867 - DNA, 13 bp, Homo sapiens
ttctccgccagcc

SEQ ID NO: 6537868 - DNA, 21 bp, Homo sapiens
ttctccgccagcctcctctgg

SEQ ID NO: 6537869 - DNA, 17 bp, Homo sapiens
ttctccggggtctgtgc

SEQ ID NO: 6537870 - DNA, 18 bp, Homo sapiens
ttctccggggtctgtgct

SEQ ID NO: 6537871 - DNA, 20 bp, Homo sapiens
ttctccggggtctgtgctgt

SEQ ID NO: 6537872 - DNA, 23 bp, Homo sapiens
ttctccggggtctgtgctgtgcc

SEQ ID NO: 6537873 - DNA, 17 bp, Homo sapiens
ttctccgggtgtggcct

SEQ ID NO: 6537874 - DNA, 20 bp, Homo sapiens
ttctccgttagctcctgtgg

SEQ ID NO: 6537875 - DNA, 16 bp, Homo sapiens
ttctcctaatgctctg

SEQ ID NO: 6537876 - DNA, 22 bp, Homo sapiens
ttctcctacttagggaagaaaa

SEQ ID NO: 6537877 - DNA, 20 bp, Homo sapiens
ttctcctcatccatttcttt

SEQ ID NO: 6537878 - DNA, 11 bp, Homo sapiens
ttctcctcccc

SEQ ID NO: 6537879 - DNA, 15 bp, Homo sapiens
ttctcctccccacct

SEQ ID NO: 6537880 - DNA, 18 bp, Homo sapiens
ttctcctccccacctgta

SEQ ID NO: 6537881 - DNA, 20 bp, Homo sapiens
ttctcctcccttccttttcc

SEQ ID NO: 6537882 - DNA, 14 bp, Homo sapiens
ttctcctccgcctg

SEQ ID NO: 6537883 - DNA, 24 bp, Homo sapiens
ttctcctcctcctccctcctcact

SEQ ID NO: 6537884 - DNA, 12 bp, Homo sapiens
ttctcctctccc

SEQ ID NO: 6537885 - DNA, 14 bp, Homo sapiens
ttctcctctctggg

SEQ ID NO: 6537886 - DNA, 17 bp, Homo sapiens
ttctcctctctgggcct

SEQ ID NO: 6537887 - DNA, 16 bp, Homo sapiens
ttctcctctttgagac

SEQ ID NO: 6537888 - DNA, 23 bp, Homo sapiens
ttctcctgaaacccaaagccctg

SEQ ID NO: 6537889 - DNA, 21 bp, Homo sapiens
ttctcctgaaatctacaggcc

SEQ ID NO: 6537890 - DNA, 13 bp, Homo sapiens
ttctcctgaatat

SEQ ID NO: 6537891 - DNA, 18 bp, Homo sapiens
ttctcctgacccagtccc

SEQ ID NO: 6537892 - DNA, 20 bp, Homo sapiens
ttctcctgatgttttgccgt

SEQ ID NO: 6537893 - DNA, 18 bp, Homo sapiens
ttctcctgatttgagttt

SEQ ID NO: 6537894 - DNA, 23 bp, Homo sapiens
ttctcctgcaaatttagtttgtt

SEQ ID NO: 6537895 - DNA, 11 bp, Homo sapiens
ttctcctgcca

SEQ ID NO: 6537896 - DNA, 14 bp, Homo sapiens
ttctcctgccccaa

SEQ ID NO: 6537897 - DNA, 19 bp, Homo sapiens
ttctcctgccctttcccag

SEQ ID NO: 6537898 - DNA, 12 bp, Homo sapiens
ttctcctgcctc

SEQ ID NO: 6537899 - DNA, 23 bp, Homo sapiens
ttctcctgcgccccgcccacacc

SEQ ID NO: 6537900 - DNA, 21 bp, Homo sapiens
ttctcctgggcccgctttgcc

SEQ ID NO: 6537901 - DNA, 23 bp, Homo sapiens
ttctcctggtgtttttctctctg

SEQ ID NO: 6537902 - DNA, 16 bp, Homo sapiens
ttctcctgtcagagat

SEQ ID NO: 6537903 - DNA, 12 bp, Homo sapiens
ttctcctgtctc

SEQ ID NO: 6537904 - DNA, 14 bp, Homo sapiens
ttctcctgtgaatg

SEQ ID NO: 6537905 - DNA, 15 bp, Homo sapiens
ttctcctgtgaatgg

SEQ ID NO: 6537906 - DNA, 12 bp, Homo sapiens
ttctcctgtgcc

SEQ ID NO: 6537907 - DNA, 12 bp, Homo sapiens
ttctccttaacc

SEQ ID NO: 6537908 - DNA, 15 bp, Homo sapiens
ttctccttcagccct

SEQ ID NO: 6537909 - DNA, 15 bp, Homo sapiens
ttctccttccccagg

SEQ ID NO: 6537910 - DNA, 16 bp, Homo sapiens
ttctccttccccagga

SEQ ID NO: 6537911 - DNA, 22 bp, Homo sapiens
ttctccttccccatttccactg

SEQ ID NO: 6537912 - DNA, 21 bp, Homo sapiens
ttctccttgaagcaaatgtgt

SEQ ID NO: 6537913 - DNA, 17 bp, Homo sapiens
ttctccttgataacagc

SEQ ID NO: 6537914 - DNA, 19 bp, Homo sapiens
ttctccttggtttgctagt

SEQ ID NO: 6537915 - DNA, 16 bp, Homo sapiens
ttctccttgtacttga

SEQ ID NO: 6537916 - DNA, 16 bp, Homo sapiens
ttctcctttattgctc

SEQ ID NO: 6537917 - DNA, 17 bp, Homo sapiens
ttctcctttattgctcc

SEQ ID NO: 6537918 - DNA, 17 bp, Homo sapiens
ttctcctttcacaacct

SEQ ID NO: 6537919 - DNA, 16 bp, Homo sapiens
ttctcctttcctacag

SEQ ID NO: 6537920 - DNA, 14 bp, Homo sapiens
ttctcctttgcagt

SEQ ID NO: 6537921 - DNA, 19 bp, Homo sapiens
ttctcctttggcatgttta

SEQ ID NO: 6537922 - DNA, 14 bp, Homo sapiens
ttctccttttccta

SEQ ID NO: 6537923 - DNA, 23 bp, Homo sapiens
ttctcgacccacgcagagaagcc

SEQ ID NO: 6537924 - DNA, 19 bp, Homo sapiens
ttctcgagtccaaaatcat

SEQ ID NO: 6537925 - DNA, 20 bp, Homo sapiens
ttctcgcattttctctagct

SEQ ID NO: 6537926 - DNA, 16 bp, Homo sapiens
ttctcgcctaggattt

SEQ ID NO: 6537927 - DNA, 22 bp, Homo sapiens
ttctcgctcccgccagcagcat

SEQ ID NO: 6537928 - DNA, 19 bp, Homo sapiens
ttctcggagctggcccagg

SEQ ID NO: 6537929 - DNA, 19 bp, Homo sapiens
ttctcggaggccaggccct

SEQ ID NO: 6537930 - DNA, 21 bp, Homo sapiens
ttctcggcaccagtgcctcag

SEQ ID NO: 6537931 - DNA, 17 bp, Homo sapiens
ttctcggctcaggctct

SEQ ID NO: 6537932 - DNA, 13 bp, Homo sapiens
ttctcgggaaatt

SEQ ID NO: 6537933 - DNA, 18 bp, Homo sapiens
ttctcgtagatgctgcct

SEQ ID NO: 6537934 - DNA, 13 bp, Homo sapiens
ttctcgtccccct

SEQ ID NO: 6537935 - DNA, 16 bp, Homo sapiens
ttctcgtccccctccc

SEQ ID NO: 6537936 - DNA, 18 bp, Homo sapiens
ttctcgtccccctccctg

SEQ ID NO: 6537937 - DNA, 21 bp, Homo sapiens
ttctcgtcttcctctctctca

SEQ ID NO: 6537938 - DNA, 22 bp, Homo sapiens
ttctcgtcttcctctctctcac

SEQ ID NO: 6537939 - DNA, 15 bp, Homo sapiens
ttctcgtgacccagt

SEQ ID NO: 6537940 - DNA, 14 bp, Homo sapiens
ttctcgtgccctta

SEQ ID NO: 6537941 - DNA, 17 bp, Homo sapiens
ttctcgtgcctccccac

SEQ ID NO: 6537942 - DNA, 18 bp, Homo sapiens
ttctcgttgccctaattc

SEQ ID NO: 6537943 - DNA, 23 bp, Homo sapiens
ttctcgttgccctaattcatctt

SEQ ID NO: 6537944 - DNA, 23 bp, Homo sapiens
ttctcgtttttatagtcaatggc

SEQ ID NO: 6537945 - DNA, 13 bp, Homo sapiens
ttctctaaactgt

SEQ ID NO: 6537946 - DNA, 18 bp, Homo sapiens
ttctctaaagtcactagt

SEQ ID NO: 6537947 - DNA, 23 bp, Homo sapiens
ttctctaaatgaggggcctcagg

SEQ ID NO: 6537948 - DNA, 17 bp, Homo sapiens
ttctctaacccctagtg

SEQ ID NO: 6537949 - DNA, 16 bp, Homo sapiens
ttctctaactcctgcc

SEQ ID NO: 6537950 - DNA, 18 bp, Homo sapiens
ttctctaactcctgccat

SEQ ID NO: 6537951 - DNA, 23 bp, Homo sapiens
ttctctaagatgaatccaaatgt

SEQ ID NO: 6537952 - DNA, 22 bp, Homo sapiens
ttctctaagcctatacgtttct

SEQ ID NO: 6537953 - DNA, 18 bp, Homo sapiens
ttctctaagttccactga

SEQ ID NO: 6537954 - DNA, 19 bp, Homo sapiens
ttctctaataaaattcaga

SEQ ID NO: 6537955 - DNA, 16 bp, Homo sapiens
ttctctaataagaaaa

SEQ ID NO: 6537956 - DNA, 15 bp, Homo sapiens
ttctctaatcgaaag

SEQ ID NO: 6537957 - DNA, 16 bp, Homo sapiens
ttctctacccatctcc

SEQ ID NO: 6537958 - DNA, 23 bp, Homo sapiens
ttctctacccatcttaaaaacaa

SEQ ID NO: 6537959 - DNA, 17 bp, Homo sapiens
ttctctactctagggaa

SEQ ID NO: 6537960 - DNA, 20 bp, Homo sapiens
ttctctactttgaggaaacc

SEQ ID NO: 6537961 - DNA, 18 bp, Homo sapiens
ttctctagaagctgtctg

SEQ ID NO: 6537962 - DNA, 15 bp, Homo sapiens
ttctctagaggctgg

SEQ ID NO: 6537963 - DNA, 19 bp, Homo sapiens
ttctctagctggtggtttc

SEQ ID NO: 6537964 - DNA, 23 bp, Homo sapiens
ttctctagtcatttgttaatatt

SEQ ID NO: 6537965 - DNA, 21 bp, Homo sapiens
ttctctagtttgattaaattc

SEQ ID NO: 6537966 - DNA, 18 bp, Homo sapiens
ttctctataaaaaatatg

SEQ ID NO: 6537967 - DNA, 13 bp, Homo sapiens
ttctctatatttt

SEQ ID NO: 6537968 - DNA, 21 bp, Homo sapiens
ttctctatatttttatttcat

SEQ ID NO: 6537969 - DNA, 13 bp, Homo sapiens
ttctctatcattt

SEQ ID NO: 6537970 - DNA, 17 bp, Homo sapiens
ttctctatgtttattct

SEQ ID NO: 6537971 - DNA, 22 bp, Homo sapiens
tgtataagattagaatgaaaat

SEQ ID NO: 6537972 - DNA, 14 bp, Homo sapiens
tgtataagcatgct

SEQ ID NO: 6537973 - DNA, 16 bp, Homo sapiens
tgtataagcatgcttt

SEQ ID NO: 6537974 - DNA, 18 bp, Homo sapiens
tgtataagctactcactt

SEQ ID NO: 6537975 - DNA, 14 bp, Homo sapiens
tgtataagctgtaa

SEQ ID NO: 6537976 - DNA, 14 bp, Homo sapiens
tgtataaggacagt

SEQ ID NO: 6537977 - DNA, 19 bp, Homo sapiens
tgtataaggagctttgctc

SEQ ID NO: 6537978 - DNA, 21 bp, Homo sapiens
tgtataaggtaataaaactct

SEQ ID NO: 6537979 - DNA, 17 bp, Homo sapiens
tgtataagtaagaaaat

SEQ ID NO: 6537980 - DNA, 18 bp, Homo sapiens
tgtataagtaagaaaata

SEQ ID NO: 6537981 - DNA, 20 bp, Homo sapiens
tgtataagtaagaaaatatt

SEQ ID NO: 6537982 - DNA, 23 bp, Homo sapiens
tgtataagtagatctgctttctg

SEQ ID NO: 6537983 - DNA, 17 bp, Homo sapiens
tgtataagtcaagcaca

SEQ ID NO: 6537984 - DNA, 18 bp, Homo sapiens
tgtataagtcaagcacat

SEQ ID NO: 6537985 - DNA, 16 bp, Homo sapiens
tgtataagtccttgca

SEQ ID NO: 6537986 - DNA, 22 bp, Homo sapiens
tgtataagtgcacacagaaata

SEQ ID NO: 6537987 - DNA, 21 bp, Homo sapiens
tgtataagtggaggcacttta

SEQ ID NO: 6537988 - DNA, 22 bp, Homo sapiens
tgtataagttgaaggaaaatgt

SEQ ID NO: 6537989 - DNA, 16 bp, Homo sapiens
tgtataagttgaggca

SEQ ID NO: 6537990 - DNA, 15 bp, Homo sapiens
tgtataatactttgt

SEQ ID NO: 6537991 - DNA, 20 bp, Homo sapiens
tgtataatactttgtataca

SEQ ID NO: 6537992 - DNA, 18 bp, Homo sapiens
tgtataatagagataagt

SEQ ID NO: 6537993 - DNA, 15 bp, Homo sapiens
tgtataatatatatc

SEQ ID NO: 6537994 - DNA, 13 bp, Homo sapiens
tgtataatcccac

SEQ ID NO: 6537995 - DNA, 20 bp, Homo sapiens
tgtataatcccacccacctc

SEQ ID NO: 6537996 - DNA, 14 bp, Homo sapiens
tgtataatctattt

SEQ ID NO: 6537997 - DNA, 15 bp, Homo sapiens
tgtataatgactttt

SEQ ID NO: 6537998 - DNA, 17 bp, Homo sapiens
tgtataatgtgattttt

SEQ ID NO: 6537999 - DNA, 17 bp, Homo sapiens
tgtataattaatgctta

SEQ ID NO: 6538000 - DNA, 21 bp, Homo sapiens
tgtataattggatttcctaat

SEQ ID NO: 6538001 - DNA, 23 bp, Homo sapiens
tgtataatttaacagtgcccttt

SEQ ID NO: 6538002 - DNA, 13 bp, Homo sapiens
tgtataatttcga

SEQ ID NO: 6538003 - DNA, 13 bp, Homo sapiens
tgtatacaaacag

SEQ ID NO: 6538004 - DNA, 16 bp, Homo sapiens
tgtatacaaacaggtg

SEQ ID NO: 6538005 - DNA, 16 bp, Homo sapiens
tgtatacaaatatatt

SEQ ID NO: 6538006 - DNA, 23 bp, Homo sapiens
tgtatacaaggatcagattcttg

SEQ ID NO: 6538007 - DNA, 13 bp, Homo sapiens
tgtatacagtgca

SEQ ID NO: 6538008 - DNA, 13 bp, Homo sapiens
tgtatacatacat

SEQ ID NO: 6538009 - DNA, 13 bp, Homo sapiens
tgtatacatatag

SEQ ID NO: 6538010 - DNA, 14 bp, Homo sapiens
tgtatacatataga

SEQ ID NO: 6538011 - DNA, 23 bp, Homo sapiens
tgtatacatatgtatgtgtgagt

SEQ ID NO: 6538012 - DNA, 15 bp, Homo sapiens
tgtatacatcctggg

SEQ ID NO: 6538013 - DNA, 13 bp, Homo sapiens
tgtatacatctta

SEQ ID NO: 6538014 - DNA, 12 bp, Homo sapiens
tgtatacatgtg

SEQ ID NO: 6538015 - DNA, 14 bp, Homo sapiens
tgtatacatgtgtg

SEQ ID NO: 6538016 - DNA, 21 bp, Homo sapiens
tgtatacattttgttatagaa

SEQ ID NO: 6538017 - DNA, 15 bp, Homo sapiens
tgtataccaatgtgt

SEQ ID NO: 6538018 - DNA, 23 bp, Homo sapiens
tgtataccaatgtgttttctgta

SEQ ID NO: 6538019 - DNA, 23 bp, Homo sapiens
tgtataccccgtgaagcatccag

SEQ ID NO: 6538020 - DNA, 19 bp, Homo sapiens
tgtatacgtttcaaaaaca

SEQ ID NO: 6538021 - DNA, 15 bp, Homo sapiens
tgtatactatagtac

SEQ ID NO: 6538022 - DNA, 17 bp, Homo sapiens
tgtatactatagtacca

SEQ ID NO: 6538023 - DNA, 13 bp, Homo sapiens
tgtatactgtaaa

SEQ ID NO: 6538024 - DNA, 14 bp, Homo sapiens
tgtatactgtaaaa

SEQ ID NO: 6538025 - DNA, 18 bp, Homo sapiens
tgtatactgtaaaagtta

SEQ ID NO: 6538026 - DNA, 21 bp, Homo sapiens
tgtatactgtaatcgtgctat

SEQ ID NO: 6538027 - DNA, 13 bp, Homo sapiens
tgtatacttaata

SEQ ID NO: 6538028 - DNA, 23 bp, Homo sapiens
tgtatacttaatactgaatttct

SEQ ID NO: 6538029 - DNA, 23 bp, Homo sapiens
tgtatacttatcttgctccattg

SEQ ID NO: 6538030 - DNA, 15 bp, Homo sapiens
tgtatacttcattag

SEQ ID NO: 6538031 - DNA, 14 bp, Homo sapiens
tgtatacttgaaaa

SEQ ID NO: 6538032 - DNA, 11 bp, Homo sapiens
tgtatacttta

SEQ ID NO: 6538033 - DNA, 12 bp, Homo sapiens
tgtatactttag

SEQ ID NO: 6538034 - DNA, 13 bp, Homo sapiens
tgtatactttagt

SEQ ID NO: 6538035 - DNA, 13 bp, Homo sapiens
tgtatagaaaata

SEQ ID NO: 6538036 - DNA, 21 bp, Homo sapiens
tgtatagaaaataaaataaat

SEQ ID NO: 6538037 - DNA, 16 bp, Homo sapiens
tgtatagaaaattctt

SEQ ID NO: 6538038 - DNA, 21 bp, Homo sapiens
tgtatagaaaattcttgagaa

SEQ ID NO: 6538039 - DNA, 17 bp, Homo sapiens
tgtatagacagtttgta

SEQ ID NO: 6538040 - DNA, 12 bp, Homo sapiens
tgtatagaccaa

SEQ ID NO: 6538041 - DNA, 16 bp, Homo sapiens
tgtatagaccaaagca

SEQ ID NO: 6538042 - DNA, 19 bp, Homo sapiens
tgtatagatgcaagatatt

SEQ ID NO: 6538043 - DNA, 20 bp, Homo sapiens
tgtatagatgcaagatattt

SEQ ID NO: 6538044 - DNA, 23 bp, Homo sapiens
tgtatagattagagagtgttgaa

SEQ ID NO: 6538045 - DNA, 19 bp, Homo sapiens
tgtatagattataaaatta

SEQ ID NO: 6538046 - DNA, 15 bp, Homo sapiens
tgtatagcaacctat

SEQ ID NO: 6538047 - DNA, 13 bp, Homo sapiens
tgtatagcatgaa

SEQ ID NO: 6538048 - DNA, 18 bp, Homo sapiens
tgtatagctcttttccta

SEQ ID NO: 6538049 - DNA, 23 bp, Homo sapiens
tgtatagcttacctgaacaggaa

SEQ ID NO: 6538050 - DNA, 15 bp, Homo sapiens
tgtatagctttaaca

SEQ ID NO: 6538051 - DNA, 16 bp, Homo sapiens
tgtatagcttttatct

SEQ ID NO: 6538052 - DNA, 17 bp, Homo sapiens
tgtataggaatttgtat

SEQ ID NO: 6538053 - DNA, 21 bp, Homo sapiens
tgtataggccatctgtaaata

SEQ ID NO: 6538054 - DNA, 17 bp, Homo sapiens
tgtatagggaattttca

SEQ ID NO: 6538055 - DNA, 20 bp, Homo sapiens
tgtataggggaaaatattat

SEQ ID NO: 6538056 - DNA, 18 bp, Homo sapiens
tgtataggtagatccaga

SEQ ID NO: 6538057 - DNA, 15 bp, Homo sapiens
tgtatagtaaatcac

SEQ ID NO: 6538058 - DNA, 15 bp, Homo sapiens
tgtatagtaatcatt

SEQ ID NO: 6538059 - DNA, 19 bp, Homo sapiens
tgtatagtaccagaagcaa

SEQ ID NO: 6538060 - DNA, 20 bp, Homo sapiens
tgtatagtattggaaaataa

SEQ ID NO: 6538061 - DNA, 17 bp, Homo sapiens
tgtatagtatttgaaaa

SEQ ID NO: 6538062 - DNA, 19 bp, Homo sapiens
tgtatagtgagtgtggctt

SEQ ID NO: 6538063 - DNA, 19 bp, Homo sapiens
tgtatagtgcctaaaattg

SEQ ID NO: 6538064 - DNA, 15 bp, Homo sapiens
tgtatagtgtaaaat

SEQ ID NO: 6538065 - DNA, 18 bp, Homo sapiens
tgtatagttatatgtaca

SEQ ID NO: 6538066 - DNA, 13 bp, Homo sapiens
tgtatagttgctt

SEQ ID NO: 6538067 - DNA, 14 bp, Homo sapiens
tgtatagttgcttg

SEQ ID NO: 6538068 - DNA, 14 bp, Homo sapiens
tgtatagttgcttt

SEQ ID NO: 6538069 - DNA, 23 bp, Homo sapiens
tgtatagttttacactctagtgc

SEQ ID NO: 6538070 - DNA, 23 bp, Homo sapiens
tgtatagttttataaaactcagt

SEQ ID NO: 6538071 - DNA, 12 bp, Homo sapiens
tgtatataaaaa

SEQ ID NO: 6538072 - DNA, 12 bp, Homo sapiens
tgtatataaaat

SEQ ID NO: 6538073 - DNA, 19 bp, Homo sapiens
tgtatataaaatattttca

SEQ ID NO: 6538074 - DNA, 14 bp, Homo sapiens
tgtatataaaatgt

SEQ ID NO: 6538075 - DNA, 16 bp, Homo sapiens
tgtatataaaatgtgc

SEQ ID NO: 6538076 - DNA, 18 bp, Homo sapiens
tgtatataaaatgtgcga

SEQ ID NO: 6538077 - DNA, 22 bp, Homo sapiens
tgtatataaaattagattagaa

SEQ ID NO: 6538078 - DNA, 19 bp, Homo sapiens
tgtatataaacatattttt

SEQ ID NO: 6538079 - DNA, 19 bp, Homo sapiens
tgtatataaacgtgtcccg

SEQ ID NO: 6538080 - DNA, 18 bp, Homo sapiens
tgtatataaatgggaaca

SEQ ID NO: 6538081 - DNA, 20 bp, Homo sapiens
tgtatataaatgggaacatt

SEQ ID NO: 6538082 - DNA, 14 bp, Homo sapiens
tgtatataaatgtg

SEQ ID NO: 6538083 - DNA, 14 bp, Homo sapiens
tgtatataatttta

SEQ ID NO: 6538084 - DNA, 15 bp, Homo sapiens
tgtatatacaataac

SEQ ID NO: 6538085 - DNA, 14 bp, Homo sapiens
tgtatatacacatc

SEQ ID NO: 6538086 - DNA, 17 bp, Homo sapiens
tgtatatacagttattt

SEQ ID NO: 6538087 - DNA, 21 bp, Homo sapiens
tgtatatacatattataaata

SEQ ID NO: 6538088 - DNA, 21 bp, Homo sapiens
tgtatataccttttgttacca

SEQ ID NO: 6538089 - DNA, 17 bp, Homo sapiens
tgtatatacgcatctat

SEQ ID NO: 6538090 - DNA, 17 bp, Homo sapiens
tgtatatagatgtctgt

SEQ ID NO: 6538091 - DNA, 21 bp, Homo sapiens
tgtatatagatgtctgtgtat

SEQ ID NO: 6538092 - DNA, 22 bp, Homo sapiens
tgtatatagatgtctgtgtata

SEQ ID NO: 6538093 - DNA, 21 bp, Homo sapiens
tgtatatagctctacacaaca

SEQ ID NO: 6538094 - DNA, 22 bp, Homo sapiens
tgtatatagctctacacaacat

SEQ ID NO: 6538095 - DNA, 21 bp, Homo sapiens
tgtatataggacaaaatgtta

SEQ ID NO: 6538096 - DNA, 12 bp, Homo sapiens
tgtatatagttt

SEQ ID NO: 6538097 - DNA, 13 bp, Homo sapiens
tgtatatatacat

SEQ ID NO: 6538098 - DNA, 18 bp, Homo sapiens
tgtatatatacatacact

SEQ ID NO: 6538099 - DNA, 20 bp, Homo sapiens
tgtatatatacatacacttg

SEQ ID NO: 6538100 - DNA, 14 bp, Homo sapiens
tgtatatatatata

SEQ ID NO: 6538101 - DNA, 19 bp, Homo sapiens
tgtatatatatatgtgtgt

SEQ ID NO: 6538102 - DNA, 20 bp, Homo sapiens
tgtatatatatatgtgtgtg

SEQ ID NO: 6538103 - DNA, 16 bp, Homo sapiens
tgtatatatatgtgaa

SEQ ID NO: 6538104 - DNA, 21 bp, Homo sapiens
tgtatatatatgtgaggatgt

SEQ ID NO: 6538105 - DNA, 17 bp, Homo sapiens
tgtatatatattaagag

SEQ ID NO: 6538106 - DNA, 16 bp, Homo sapiens
tgtatatatctattat

SEQ ID NO: 6538107 - DNA, 20 bp, Homo sapiens
tgtatatatcttataactgt

SEQ ID NO: 6538108 - DNA, 20 bp, Homo sapiens
tgtatatatgtcaaattgtc

SEQ ID NO: 6538109 - DNA, 12 bp, Homo sapiens
tgtatatatgtg

SEQ ID NO: 6538110 - DNA, 15 bp, Homo sapiens
tgtatatatgtgtat

SEQ ID NO: 6538111 - DNA, 16 bp, Homo sapiens
tgtatatatgtgtata

SEQ ID NO: 6538112 - DNA, 20 bp, Homo sapiens
tgtatatatgtgtatatata

SEQ ID NO: 6538113 - DNA, 23 bp, Homo sapiens
tgtatatatgtgtatatatacat

SEQ ID NO: 6538114 - DNA, 20 bp, Homo sapiens
tgtatatatgtgtgccctgg

SEQ ID NO: 6538115 - DNA, 15 bp, Homo sapiens
tgtatatatgtgtgt

SEQ ID NO: 6538116 - DNA, 18 bp, Homo sapiens
tgtatatatgtgtgttta

SEQ ID NO: 6538117 - DNA, 14 bp, Homo sapiens
tgtatatattatta

SEQ ID NO: 6538118 - DNA, 20 bp, Homo sapiens
tgtatatattattataatct

SEQ ID NO: 6538119 - DNA, 18 bp, Homo sapiens
tgtatatatttattattt

SEQ ID NO: 6538120 - DNA, 22 bp, Homo sapiens
tgtatatatttcctatattgtt

SEQ ID NO: 6538121 - DNA, 17 bp, Homo sapiens
tgtatatattttatatg

SEQ ID NO: 6538122 - DNA, 22 bp, Homo sapiens
tgtatatattttgtgtgaaatt

SEQ ID NO: 6538123 - DNA, 13 bp, Homo sapiens
tgtatatattttt

SEQ ID NO: 6538124 - DNA, 15 bp, Homo sapiens
tgtatatcactaaaa

SEQ ID NO: 6538125 - DNA, 18 bp, Homo sapiens
tgtatatcactaaaagca

SEQ ID NO: 6538126 - DNA, 13 bp, Homo sapiens
tgtatatcagaaa

SEQ ID NO: 6538127 - DNA, 14 bp, Homo sapiens
tgtatatcagaaaa

SEQ ID NO: 6538128 - DNA, 11 bp, Homo sapiens
tgtatatcagc

SEQ ID NO: 6538129 - DNA, 22 bp, Homo sapiens
tgtatatcagctctaaagcaga

SEQ ID NO: 6538130 - DNA, 18 bp, Homo sapiens
tgtatatcatgaagcctt

SEQ ID NO: 6538131 - DNA, 17 bp, Homo sapiens
tgtatatcattctacag

SEQ ID NO: 6538132 - DNA, 22 bp, Homo sapiens
tgtatatcattctacagaataa

SEQ ID NO: 6538133 - DNA, 15 bp, Homo sapiens
tgtatatccttccaa

SEQ ID NO: 6538134 - DNA, 17 bp, Homo sapiens
tgtatatctcttggaaa

SEQ ID NO: 6538135 - DNA, 19 bp, Homo sapiens
tgtatatctcttggaaaat

SEQ ID NO: 6538136 - DNA, 13 bp, Homo sapiens
tgtatatctgtaa

SEQ ID NO: 6538137 - DNA, 14 bp, Homo sapiens
tgtatatctgtaat

SEQ ID NO: 6538138 - DNA, 13 bp, Homo sapiens
tgtatatctgtgt

SEQ ID NO: 6538139 - DNA, 12 bp, Homo sapiens
tgtatatcttct

SEQ ID NO: 6538140 - DNA, 17 bp, Homo sapiens
tgtatatctttgcactg

SEQ ID NO: 6538141 - DNA, 15 bp, Homo sapiens
tgtatatgactgcat

SEQ ID NO: 6538142 - DNA, 18 bp, Homo sapiens
tgtatatgaggatgtatg

SEQ ID NO: 6538143 - DNA, 21 bp, Homo sapiens
tgtatatgaggatgtatgtgt

SEQ ID NO: 6538144 - DNA, 22 bp, Homo sapiens
tgtatatgaggatgtatgtgta

SEQ ID NO: 6538145 - DNA, 13 bp, Homo sapiens
tgtatatgattat

SEQ ID NO: 6538146 - DNA, 15 bp, Homo sapiens
tgtatatgattctct

SEQ ID NO: 6538147 - DNA, 18 bp, Homo sapiens
tgtatatgattctctgtg

SEQ ID NO: 6538148 - DNA, 21 bp, Homo sapiens
tgtatatgattctcttgagat

SEQ ID NO: 6538149 - DNA, 14 bp, Homo sapiens
tgtatatgctgcat

SEQ ID NO: 6538150 - DNA, 11 bp, Homo sapiens
ttctctattgt

SEQ ID NO: 6538151 - DNA, 15 bp, Homo sapiens
ttctctattgtaatt

SEQ ID NO: 6538152 - DNA, 17 bp, Homo sapiens
ttctctatttttgttaa

SEQ ID NO: 6538153 - DNA, 19 bp, Homo sapiens
ttctctcaaccttggcctt

SEQ ID NO: 6538154 - DNA, 21 bp, Homo sapiens
ttctctcaaccttggccttct

SEQ ID NO: 6538155 - DNA, 22 bp, Homo sapiens
ttctctcaaccttggccttctc

SEQ ID NO: 6538156 - DNA, 14 bp, Homo sapiens
ttctctcaaggaga

SEQ ID NO: 6538157 - DNA, 22 bp, Homo sapiens
ttctctcaatttgaaacacaag

SEQ ID NO: 6538158 - DNA, 20 bp, Homo sapiens
ttctctcagccttacatttg

SEQ ID NO: 6538159 - DNA, 12 bp, Homo sapiens
ttctctcagtga

SEQ ID NO: 6538160 - DNA, 20 bp, Homo sapiens
ttctctcatagaacattgat

SEQ ID NO: 6538161 - DNA, 21 bp, Homo sapiens
ttctctcatagaacattgatc

SEQ ID NO: 6538162 - DNA, 23 bp, Homo sapiens
ttctctcatagaacattgatctg

SEQ ID NO: 6538163 - DNA, 12 bp, Homo sapiens
ttctctcatcta

SEQ ID NO: 6538164 - DNA, 22 bp, Homo sapiens
ttctctcatctaactgatgagt

SEQ ID NO: 6538165 - DNA, 12 bp, Homo sapiens
ttctctcatctc

SEQ ID NO: 6538166 - DNA, 20 bp, Homo sapiens
ttctctcatctcttagctcc

SEQ ID NO: 6538167 - DNA, 20 bp, Homo sapiens
ttctctcatctgatcacttc

SEQ ID NO: 6538168 - DNA, 24 bp, Homo sapiens
ttctctcatctgatcacttcatgt

SEQ ID NO: 6538169 - DNA, 21 bp, Homo sapiens
ttctctccaccttagtacttt

SEQ ID NO: 6538170 - DNA, 16 bp, Homo sapiens
ttctctccagcccctg

SEQ ID NO: 6538171 - DNA, 12 bp, Homo sapiens
ttctctccagct

SEQ ID NO: 6538172 - DNA, 19 bp, Homo sapiens
ttctctcccaacgctgaag

SEQ ID NO: 6538173 - DNA, 20 bp, Homo sapiens
ttctctcccacgtgcacagc

SEQ ID NO: 6538174 - DNA, 15 bp, Homo sapiens
ttctctcccatcctg

SEQ ID NO: 6538175 - DNA, 16 bp, Homo sapiens
ttctctcccctcacat

SEQ ID NO: 6538176 - DNA, 17 bp, Homo sapiens
ttctctccccttttcct

SEQ ID NO: 6538177 - DNA, 22 bp, Homo sapiens
ttctctccccttttccttcaga

SEQ ID NO: 6538178 - DNA, 19 bp, Homo sapiens
ttctctcccttcctctctc

SEQ ID NO: 6538179 - DNA, 21 bp, Homo sapiens
ttctctcccttcctctctcct

SEQ ID NO: 6538180 - DNA, 16 bp, Homo sapiens
ttctctccgcgggtgg

SEQ ID NO: 6538181 - DNA, 21 bp, Homo sapiens
ttctctcctaatgatgacttg

SEQ ID NO: 6538182 - DNA, 11 bp, Homo sapiens
ttctctcctca

SEQ ID NO: 6538183 - DNA, 12 bp, Homo sapiens
ttctctcctcag

SEQ ID NO: 6538184 - DNA, 19 bp, Homo sapiens
ttctctcctcagtttacat

SEQ ID NO: 6538185 - DNA, 22 bp, Homo sapiens
ttctctcctcagtttacatctt

SEQ ID NO: 6538186 - DNA, 15 bp, Homo sapiens
ttctctcctccccaa

SEQ ID NO: 6538187 - DNA, 15 bp, Homo sapiens
ttctctcctccccta

SEQ ID NO: 6538188 - DNA, 20 bp, Homo sapiens
ttctctcctcccctacacca

SEQ ID NO: 6538189 - DNA, 20 bp, Homo sapiens
ttctctcctgtgtgcttgtc

SEQ ID NO: 6538190 - DNA, 16 bp, Homo sapiens
ttctctccttccctct

SEQ ID NO: 6538191 - DNA, 17 bp, Homo sapiens
ttctctccttccctctt

SEQ ID NO: 6538192 - DNA, 21 bp, Homo sapiens
ttctctccttccctctttccc

SEQ ID NO: 6538193 - DNA, 23 bp, Homo sapiens
ttctctccttggcctttcctgga

SEQ ID NO: 6538194 - DNA, 11 bp, Homo sapiens
ttctctccttt

SEQ ID NO: 6538195 - DNA, 13 bp, Homo sapiens
ttctctctatgca

SEQ ID NO: 6538196 - DNA, 15 bp, Homo sapiens
ttctctctatgcaaa

SEQ ID NO: 6538197 - DNA, 18 bp, Homo sapiens
ttctctctatggtaaaga

SEQ ID NO: 6538198 - DNA, 11 bp, Homo sapiens
ttctctctcct

SEQ ID NO: 6538199 - DNA, 19 bp, Homo sapiens
ttctctctcctggtgtggg

SEQ ID NO: 6538200 - DNA, 13 bp, Homo sapiens
ttctctctctaag

SEQ ID NO: 6538201 - DNA, 22 bp, Homo sapiens
ttctctctctctttgttacata

SEQ ID NO: 6538202 - DNA, 12 bp, Homo sapiens
ttctctctctgg

SEQ ID NO: 6538203 - DNA, 13 bp, Homo sapiens
ttctctctctggt

SEQ ID NO: 6538204 - DNA, 12 bp, Homo sapiens
ttctctctgagc

SEQ ID NO: 6538205 - DNA, 14 bp, Homo sapiens
ttctctctgagctg

SEQ ID NO: 6538206 - DNA, 13 bp, Homo sapiens
ttctctctgccca

SEQ ID NO: 6538207 - DNA, 12 bp, Homo sapiens
ttctctctgctc

SEQ ID NO: 6538208 - DNA, 15 bp, Homo sapiens
ttctctctggcttct

SEQ ID NO: 6538209 - DNA, 19 bp, Homo sapiens
ttctctctggcttctctct

SEQ ID NO: 6538210 - DNA, 20 bp, Homo sapiens
ttctctctggcttctctctt

SEQ ID NO: 6538211 - DNA, 14 bp, Homo sapiens
ttctctctgtgctg

SEQ ID NO: 6538212 - DNA, 14 bp, Homo sapiens
ttctctctgtgtgg

SEQ ID NO: 6538213 - DNA, 11 bp, Homo sapiens
ttctctctgtt

SEQ ID NO: 6538214 - DNA, 17 bp, Homo sapiens
ttctctctgttcccttc

SEQ ID NO: 6538215 - DNA, 13 bp, Homo sapiens
ttctctcttcaat

SEQ ID NO: 6538216 - DNA, 12 bp, Homo sapiens
ttctctcttccc

SEQ ID NO: 6538217 - DNA, 22 bp, Homo sapiens
ttctctcttgattgatttttaa

SEQ ID NO: 6538218 - DNA, 10 bp, Homo sapiens
ttctctcttt

SEQ ID NO: 6538219 - DNA, 12 bp, Homo sapiens
ttctctctttct

SEQ ID NO: 6538220 - DNA, 12 bp, Homo sapiens
ttctctctttgt

SEQ ID NO: 6538221 - DNA, 19 bp, Homo sapiens
ttctctcttttaaagtatt

SEQ ID NO: 6538222 - DNA, 16 bp, Homo sapiens
ttctctcttttcctcc

SEQ ID NO: 6538223 - DNA, 22 bp, Homo sapiens
ttctctgaatcagaaaagctat

SEQ ID NO: 6538224 - DNA, 16 bp, Homo sapiens
ttctctgagctgtgca

SEQ ID NO: 6538225 - DNA, 17 bp, Homo sapiens
ttctctgagctgtgcag

SEQ ID NO: 6538226 - DNA, 18 bp, Homo sapiens
ttctctgagctgtgcagg

SEQ ID NO: 6538227 - DNA, 16 bp, Homo sapiens
ttctctgagtcagctg

SEQ ID NO: 6538228 - DNA, 14 bp, Homo sapiens
ttctctgatgcaga

SEQ ID NO: 6538229 - DNA, 17 bp, Homo sapiens
ttctctgatgcagaaat

SEQ ID NO: 6538230 - DNA, 21 bp, Homo sapiens
ttctctgattatgtgccctgg

SEQ ID NO: 6538231 - DNA, 20 bp, Homo sapiens
ttctctgatttgtaatgagc

SEQ ID NO: 6538232 - DNA, 14 bp, Homo sapiens
ttctctgcaatgct

SEQ ID NO: 6538233 - DNA, 16 bp, Homo sapiens
ttctctgcaatgcttc

SEQ ID NO: 6538234 - DNA, 12 bp, Homo sapiens
ttctctgcagta

SEQ ID NO: 6538235 - DNA, 10 bp, Homo sapiens
ttctctgcca

SEQ ID NO: 6538236 - DNA, 15 bp, Homo sapiens
ttctctgcccagctt

SEQ ID NO: 6538237 - DNA, 20 bp, Homo sapiens
ttctctgcccagcttttcat

SEQ ID NO: 6538238 - DNA, 23 bp, Homo sapiens
ttctctgcccgggccccttgctg

SEQ ID NO: 6538239 - DNA, 12 bp, Homo sapiens
ttctctgccctt

SEQ ID NO: 6538240 - DNA, 22 bp, Homo sapiens
ttctctgccgctacctccctcc

SEQ ID NO: 6538241 - DNA, 13 bp, Homo sapiens
ttctctgcctcct

SEQ ID NO: 6538242 - DNA, 19 bp, Homo sapiens
ttctctgcctcctcctcac

SEQ ID NO: 6538243 - DNA, 17 bp, Homo sapiens
ttctctgcctctgggca

SEQ ID NO: 6538244 - DNA, 23 bp, Homo sapiens
ttctctgcctctgggcagcctgc

SEQ ID NO: 6538245 - DNA, 11 bp, Homo sapiens
ttctctgcctt

SEQ ID NO: 6538246 - DNA, 17 bp, Homo sapiens
ttctctgcgagcaacag

SEQ ID NO: 6538247 - DNA, 15 bp, Homo sapiens
ttctctgctagattt

SEQ ID NO: 6538248 - DNA, 21 bp, Homo sapiens
ttctctgctatatataaaacg

SEQ ID NO: 6538249 - DNA, 11 bp, Homo sapiens
ttctctgctcc

SEQ ID NO: 6538250 - DNA, 15 bp, Homo sapiens
ttctctgctgcctct

SEQ ID NO: 6538251 - DNA, 10 bp, Homo sapiens
ttctctgctt

SEQ ID NO: 6538252 - DNA, 21 bp, Homo sapiens
ttctctgcttacccttcacct

SEQ ID NO: 6538253 - DNA, 11 bp, Homo sapiens
ttctctgcttc

SEQ ID NO: 6538254 - DNA, 12 bp, Homo sapiens
ttctctgctttt

SEQ ID NO: 6538255 - DNA, 16 bp, Homo sapiens
ttctctggcaaacttt

SEQ ID NO: 6538256 - DNA, 14 bp, Homo sapiens
ttctctggctccag

SEQ ID NO: 6538257 - DNA, 16 bp, Homo sapiens
ttctctggctccagaa

SEQ ID NO: 6538258 - DNA, 16 bp, Homo sapiens
ttctctggctggaata

SEQ ID NO: 6538259 - DNA, 17 bp, Homo sapiens
ttctctgggaccaggct

SEQ ID NO: 6538260 - DNA, 15 bp, Homo sapiens
ttctctgggagaaaa

SEQ ID NO: 6538261 - DNA, 12 bp, Homo sapiens
ttctctgggctt

SEQ ID NO: 6538262 - DNA, 22 bp, Homo sapiens
ttctctggtacaatttcttttg

SEQ ID NO: 6538263 - DNA, 17 bp, Homo sapiens
ttctctggtctccttga

SEQ ID NO: 6538264 - DNA, 23 bp, Homo sapiens
ttctctgtaagtaattgccacag

SEQ ID NO: 6538265 - DNA, 19 bp, Homo sapiens
ttctctgtaagtgtagctc

SEQ ID NO: 6538266 - DNA, 11 bp, Homo sapiens
ttctctgtaca

SEQ ID NO: 6538267 - DNA, 12 bp, Homo sapiens
ttctctgtacat

SEQ ID NO: 6538268 - DNA, 13 bp, Homo sapiens
ttctctgtacttt

SEQ ID NO: 6538269 - DNA, 15 bp, Homo sapiens
ttctctgtagctgct

SEQ ID NO: 6538270 - DNA, 17 bp, Homo sapiens
ttctctgtagggaactc

SEQ ID NO: 6538271 - DNA, 13 bp, Homo sapiens
ttctctgtagttc

SEQ ID NO: 6538272 - DNA, 19 bp, Homo sapiens
ttctctgtatattgggctc

SEQ ID NO: 6538273 - DNA, 18 bp, Homo sapiens
ttctctgtatatttatga

SEQ ID NO: 6538274 - DNA, 19 bp, Homo sapiens
ttctctgtatgaatgtgat

SEQ ID NO: 6538275 - DNA, 16 bp, Homo sapiens
ttctctgtccagggct

SEQ ID NO: 6538276 - DNA, 22 bp, Homo sapiens
ttctctgtccagggcttcagat

SEQ ID NO: 6538277 - DNA, 18 bp, Homo sapiens
ttctctgtcctacttctg

SEQ ID NO: 6538278 - DNA, 19 bp, Homo sapiens
ttctctgtcctacttctga

SEQ ID NO: 6538279 - DNA, 21 bp, Homo sapiens
ttctctgtcctacttctgact

SEQ ID NO: 6538280 - DNA, 19 bp, Homo sapiens
ttctctgtcctctgctttg

SEQ ID NO: 6538281 - DNA, 17 bp, Homo sapiens
ttctctgtctcagactt

SEQ ID NO: 6538282 - DNA, 17 bp, Homo sapiens
ttctctgtctcatgtgt

SEQ ID NO: 6538283 - DNA, 13 bp, Homo sapiens
ttctctgtctctg

SEQ ID NO: 6538284 - DNA, 12 bp, Homo sapiens
ttctctgtgaac

SEQ ID NO: 6538285 - DNA, 20 bp, Homo sapiens
ttctctgtgcccctgtaaat

SEQ ID NO: 6538286 - DNA, 15 bp, Homo sapiens
ttctctgtgctctga

SEQ ID NO: 6538287 - DNA, 21 bp, Homo sapiens
ttctctgtgctctgaatggga

SEQ ID NO: 6538288 - DNA, 18 bp, Homo sapiens
ttctctgtggcaaagcag

SEQ ID NO: 6538289 - DNA, 14 bp, Homo sapiens
ttctctgtgtgcac

SEQ ID NO: 6538290 - DNA, 18 bp, Homo sapiens
ttctctgtgtttgttcct

SEQ ID NO: 6538291 - DNA, 24 bp, Homo sapiens
ttctctgtgtttgttcctacagcc

SEQ ID NO: 6538292 - DNA, 15 bp, Homo sapiens
ttctctgttcccttg

SEQ ID NO: 6538293 - DNA, 16 bp, Homo sapiens
ttctctgttgtcaaac

SEQ ID NO: 6538294 - DNA, 16 bp, Homo sapiens
ttctcttaagctgccc

SEQ ID NO: 6538295 - DNA, 21 bp, Homo sapiens
ttctcttaatcactactgtat

SEQ ID NO: 6538296 - DNA, 14 bp, Homo sapiens
ttctcttactgcaa

SEQ ID NO: 6538297 - DNA, 16 bp, Homo sapiens
ttctcttactgcaaat

SEQ ID NO: 6538298 - DNA, 23 bp, Homo sapiens
ttctcttagagattttcatttta

SEQ ID NO: 6538299 - DNA, 17 bp, Homo sapiens
ttctcttatctgccatg

SEQ ID NO: 6538300 - DNA, 13 bp, Homo sapiens
ttctcttcactca

SEQ ID NO: 6538301 - DNA, 18 bp, Homo sapiens
ttctcttcactcccaata

SEQ ID NO: 6538302 - DNA, 13 bp, Homo sapiens
ttctcttcagtgt

SEQ ID NO: 6538303 - DNA, 19 bp, Homo sapiens
ttctcttcatattcagctt

SEQ ID NO: 6538304 - DNA, 16 bp, Homo sapiens
ttctcttcattttccc

SEQ ID NO: 6538305 - DNA, 14 bp, Homo sapiens
ttctcttcccaggc

SEQ ID NO: 6538306 - DNA, 15 bp, Homo sapiens
ttctcttcccaggcc

SEQ ID NO: 6538307 - DNA, 17 bp, Homo sapiens
ttctcttccccttagaa

SEQ ID NO: 6538308 - DNA, 18 bp, Homo sapiens
ttctcttccccttcctgt

SEQ ID NO: 6538309 - DNA, 22 bp, Homo sapiens
ttctcttccccttcctgtttca

SEQ ID NO: 6538310 - DNA, 13 bp, Homo sapiens
ttctcttccctga

SEQ ID NO: 6538311 - DNA, 14 bp, Homo sapiens
ttctcttccctgaa

SEQ ID NO: 6538312 - DNA, 19 bp, Homo sapiens
ttctcttccgcagcccctt

SEQ ID NO: 6538313 - DNA, 20 bp, Homo sapiens
ttctcttcctagatctgcag

SEQ ID NO: 6538314 - DNA, 18 bp, Homo sapiens
ttctcttccttttatata

SEQ ID NO: 6538315 - DNA, 13 bp, Homo sapiens
ttctcttctatcc

SEQ ID NO: 6538316 - DNA, 17 bp, Homo sapiens
ttctcttctctgcaatg

SEQ ID NO: 6538317 - DNA, 14 bp, Homo sapiens
ttctcttctctgtt

SEQ ID NO: 6538318 - DNA, 18 bp, Homo sapiens
ttctcttctgttctgatt

SEQ ID NO: 6538319 - DNA, 12 bp, Homo sapiens
ttctcttctttg

SEQ ID NO: 6538320 - DNA, 20 bp, Homo sapiens
ttctcttgacagtctgaagc

SEQ ID NO: 6538321 - DNA, 21 bp, Homo sapiens
ttctcttgagcagttagcaga

SEQ ID NO: 6538322 - DNA, 14 bp, Homo sapiens
ttctcttgcattgt

SEQ ID NO: 6538323 - DNA, 22 bp, Homo sapiens
ttctcttgcattgtgacaagaa

SEQ ID NO: 6538324 - DNA, 23 bp, Homo sapiens
ttctcttgccccaaatcacaaac

SEQ ID NO: 6538325 - DNA, 18 bp, Homo sapiens
ttctcttgggcaggcaga

SEQ ID NO: 6538326 - DNA, 15 bp, Homo sapiens
ttctcttgggctgag

SEQ ID NO: 6538327 - DNA, 11 bp, Homo sapiens
ttctcttggtg

SEQ ID NO: 6538328 - DNA, 17 bp, Homo sapiens
ttctcttggtgaaataa

SEQ ID NO: 6538329 - DNA, 19 bp, Homo sapiens
ttctcttgtataagatcct

SEQ ID NO: 6538330 - DNA, 13 bp, Homo sapiens
ttctcttgtcctt

SEQ ID NO: 6538331 - DNA, 21 bp, Homo sapiens
ttctcttgtttaaaaaaagaa

SEQ ID NO: 6538332 - DNA, 19 bp, Homo sapiens
tgtatatggtatatataca

SEQ ID NO: 6538333 - DNA, 23 bp, Homo sapiens
tgtatatggtgattcaaatgcaa

SEQ ID NO: 6538334 - DNA, 21 bp, Homo sapiens
tgtatatgtagatgtatgcac

SEQ ID NO: 6538335 - DNA, 16 bp, Homo sapiens
tgtatatgtatatcta

SEQ ID NO: 6538336 - DNA, 17 bp, Homo sapiens
tgtatatgtatatctat

SEQ ID NO: 6538337 - DNA, 14 bp, Homo sapiens
tgtatatgtattcc

SEQ ID NO: 6538338 - DNA, 13 bp, Homo sapiens
tgtatatgtattt

SEQ ID NO: 6538339 - DNA, 14 bp, Homo sapiens
tgtatatgtcaaaa

SEQ ID NO: 6538340 - DNA, 14 bp, Homo sapiens
tgtatatgtcattt

SEQ ID NO: 6538341 - DNA, 21 bp, Homo sapiens
tgtatatgtctagataaaagg

SEQ ID NO: 6538342 - DNA, 13 bp, Homo sapiens
tgtatatgttatt

SEQ ID NO: 6538343 - DNA, 19 bp, Homo sapiens
tgtatattaaaatagcata

SEQ ID NO: 6538344 - DNA, 20 bp, Homo sapiens
tgtatattaaaatagcatac

SEQ ID NO: 6538345 - DNA, 16 bp, Homo sapiens
tgtatattaaggtgtg

SEQ ID NO: 6538346 - DNA, 15 bp, Homo sapiens
tgtatattacaatga

SEQ ID NO: 6538347 - DNA, 23 bp, Homo sapiens
tgtatattacacatttgtacaga

SEQ ID NO: 6538348 - DNA, 15 bp, Homo sapiens
tgtatattacaccaa

SEQ ID NO: 6538349 - DNA, 16 bp, Homo sapiens
tgtatattacaccaat

SEQ ID NO: 6538350 - DNA, 19 bp, Homo sapiens
tgtatattatggtgtaatg

SEQ ID NO: 6538351 - DNA, 16 bp, Homo sapiens
tgtatattatgtttat

SEQ ID NO: 6538352 - DNA, 12 bp, Homo sapiens
tgtatattattt

SEQ ID NO: 6538353 - DNA, 13 bp, Homo sapiens
tgtatattatttg

SEQ ID NO: 6538354 - DNA, 16 bp, Homo sapiens
tgtatattatttggca

SEQ ID NO: 6538355 - DNA, 18 bp, Homo sapiens
tgtatattatttggcagt

SEQ ID NO: 6538356 - DNA, 24 bp, Homo sapiens
tgtatattatttggcagtttggta

SEQ ID NO: 6538357 - DNA, 12 bp, Homo sapiens
tgtatattcact

SEQ ID NO: 6538358 - DNA, 16 bp, Homo sapiens
tgtatattccaccatt

SEQ ID NO: 6538359 - DNA, 18 bp, Homo sapiens
tgtatattccatgtataa

SEQ ID NO: 6538360 - DNA, 18 bp, Homo sapiens
tgtatattccctgtggaa

SEQ ID NO: 6538361 - DNA, 13 bp, Homo sapiens
tgtatattccttt

SEQ ID NO: 6538362 - DNA, 14 bp, Homo sapiens
tgtatattcctttg

SEQ ID NO: 6538363 - DNA, 15 bp, Homo sapiens
tgtatattcctttta

SEQ ID NO: 6538364 - DNA, 18 bp, Homo sapiens
tgtatattctattttaca

SEQ ID NO: 6538365 - DNA, 14 bp, Homo sapiens
tgtatattctggaa

SEQ ID NO: 6538366 - DNA, 16 bp, Homo sapiens
tgtatattgaaaagat

SEQ ID NO: 6538367 - DNA, 23 bp, Homo sapiens
tgtatattgagaatcccttaaaa

SEQ ID NO: 6538368 - DNA, 17 bp, Homo sapiens
tgtatattgggctcaga

SEQ ID NO: 6538369 - DNA, 21 bp, Homo sapiens
tgtatattggtgtatattata

SEQ ID NO: 6538370 - DNA, 20 bp, Homo sapiens
tgtatattggttttatgatg

SEQ ID NO: 6538371 - DNA, 21 bp, Homo sapiens
tgtatattggttttatgatga

SEQ ID NO: 6538372 - DNA, 13 bp, Homo sapiens
tgtatattgtaat

SEQ ID NO: 6538373 - DNA, 19 bp, Homo sapiens
tgtatattgtcagatattt

SEQ ID NO: 6538374 - DNA, 20 bp, Homo sapiens
tgtatattgtgtttgtgtat

SEQ ID NO: 6538375 - DNA, 22 bp, Homo sapiens
tgtatatttaacttctagttgc

SEQ ID NO: 6538376 - DNA, 17 bp, Homo sapiens
tgtatatttattcataa

SEQ ID NO: 6538377 - DNA, 18 bp, Homo sapiens
tgtatatttgaaactgct

SEQ ID NO: 6538378 - DNA, 21 bp, Homo sapiens
tgtatatttgattcttaacta

SEQ ID NO: 6538379 - DNA, 14 bp, Homo sapiens
tgtatatttgattt

SEQ ID NO: 6538380 - DNA, 16 bp, Homo sapiens
tgtatatttgatttat

SEQ ID NO: 6538381 - DNA, 17 bp, Homo sapiens
tgtatatttgatttatt

SEQ ID NO: 6538382 - DNA, 19 bp, Homo sapiens
tgtatatttgatttattaa

SEQ ID NO: 6538383 - DNA, 14 bp, Homo sapiens
tgtatatttgcata

SEQ ID NO: 6538384 - DNA, 12 bp, Homo sapiens
tgtatatttgta

SEQ ID NO: 6538385 - DNA, 16 bp, Homo sapiens
tgtatatttgtaaagc

SEQ ID NO: 6538386 - DNA, 19 bp, Homo sapiens
tgtatatttgtaatatatg

SEQ ID NO: 6538387 - DNA, 16 bp, Homo sapiens
tgtatatttgtatgat

SEQ ID NO: 6538388 - DNA, 18 bp, Homo sapiens
tgtatatttgtatgatat

SEQ ID NO: 6538389 - DNA, 19 bp, Homo sapiens
tgtatatttgtatgatatt

SEQ ID NO: 6538390 - DNA, 23 bp, Homo sapiens
tgtatatttgtgatagcactttc

SEQ ID NO: 6538391 - DNA, 12 bp, Homo sapiens
tgtatattttaa

SEQ ID NO: 6538392 - DNA, 22 bp, Homo sapiens
tgtatattttaatagaattttt

SEQ ID NO: 6538393 - DNA, 16 bp, Homo sapiens
tgtatattttaatgtt

SEQ ID NO: 6538394 - DNA, 14 bp, Homo sapiens
tgtatattttgtta

SEQ ID NO: 6538395 - DNA, 20 bp, Homo sapiens
tgtatatttttaaagaatgt

SEQ ID NO: 6538396 - DNA, 22 bp, Homo sapiens
tgtatatttttatattgttttt

SEQ ID NO: 6538397 - DNA, 18 bp, Homo sapiens
tgtatatttttgatcttt

SEQ ID NO: 6538398 - DNA, 18 bp, Homo sapiens
tgtatcaaaatgctctta

SEQ ID NO: 6538399 - DNA, 17 bp, Homo sapiens
tgtatcaaacccacgat

SEQ ID NO: 6538400 - DNA, 15 bp, Homo sapiens
tgtatcaaactagtg

SEQ ID NO: 6538401 - DNA, 20 bp, Homo sapiens
tgtatcaaactgtataactt

SEQ ID NO: 6538402 - DNA, 14 bp, Homo sapiens
tgtatcaaatacat

SEQ ID NO: 6538403 - DNA, 23 bp, Homo sapiens
tgtatcaaatacatttaaaacat

SEQ ID NO: 6538404 - DNA, 14 bp, Homo sapiens
tgtatcaaatctgt

SEQ ID NO: 6538405 - DNA, 18 bp, Homo sapiens
tgtatcaacccagaaaca

SEQ ID NO: 6538406 - DNA, 19 bp, Homo sapiens
tgtatcaataaaattctgt

SEQ ID NO: 6538407 - DNA, 21 bp, Homo sapiens
tgtatcaataaaattctgtaa

SEQ ID NO: 6538408 - DNA, 15 bp, Homo sapiens
tgtatcacaaatctt

SEQ ID NO: 6538409 - DNA, 18 bp, Homo sapiens
tgtatcacaaatcttaac

SEQ ID NO: 6538410 - DNA, 16 bp, Homo sapiens
tgtatcacacctaatc

SEQ ID NO: 6538411 - DNA, 23 bp, Homo sapiens
tgtatcactctgtgtctgagtgg

SEQ ID NO: 6538412 - DNA, 23 bp, Homo sapiens
tgtatcactgccttcgtttatat

SEQ ID NO: 6538413 - DNA, 19 bp, Homo sapiens
tgtatcagaagagagggga

SEQ ID NO: 6538414 - DNA, 14 bp, Homo sapiens
tgtatcagctctct

SEQ ID NO: 6538415 - DNA, 17 bp, Homo sapiens
tgtatcagctctctgct

SEQ ID NO: 6538416 - DNA, 22 bp, Homo sapiens
tgtatcagctctctgctgggtc

SEQ ID NO: 6538417 - DNA, 21 bp, Homo sapiens
tgtatcaggaaatatatatgt

SEQ ID NO: 6538418 - DNA, 16 bp, Homo sapiens
tgtatcaggtcaggga

SEQ ID NO: 6538419 - DNA, 19 bp, Homo sapiens
tgtatcagtaccatttgat

SEQ ID NO: 6538420 - DNA, 23 bp, Homo sapiens
tgtatcagtcagtgctggagaaa

SEQ ID NO: 6538421 - DNA, 23 bp, Homo sapiens
tgtatcagtgtttatgtgctatt

SEQ ID NO: 6538422 - DNA, 22 bp, Homo sapiens
tgtatcagttttctaagaactt

SEQ ID NO: 6538423 - DNA, 19 bp, Homo sapiens
tgtatcataattaccaagt

SEQ ID NO: 6538424 - DNA, 15 bp, Homo sapiens
tgtatcatagaaatg

SEQ ID NO: 6538425 - DNA, 17 bp, Homo sapiens
tgtatcatagaaatgta

SEQ ID NO: 6538426 - DNA, 21 bp, Homo sapiens
tgtatcatctggataggagcc

SEQ ID NO: 6538427 - DNA, 16 bp, Homo sapiens
tgtatcatctttgcca

SEQ ID NO: 6538428 - DNA, 14 bp, Homo sapiens
tgtatcatgaagaa

SEQ ID NO: 6538429 - DNA, 14 bp, Homo sapiens
tgtatcatgtttta

SEQ ID NO: 6538430 - DNA, 13 bp, Homo sapiens
tgtatcattaaaa

SEQ ID NO: 6538431 - DNA, 23 bp, Homo sapiens
tgtatcattaaaatatatgttct

SEQ ID NO: 6538432 - DNA, 14 bp, Homo sapiens
tgtatcattaatgt

SEQ ID NO: 6538433 - DNA, 21 bp, Homo sapiens
tgtatcatttcatgctttgat

SEQ ID NO: 6538434 - DNA, 17 bp, Homo sapiens
tgtatcatttgaacaac

SEQ ID NO: 6538435 - DNA, 16 bp, Homo sapiens
tgtatcatttttgtgc

SEQ ID NO: 6538436 - DNA, 17 bp, Homo sapiens
tgtatcatttttgtgca

SEQ ID NO: 6538437 - DNA, 18 bp, Homo sapiens
tgtatcatttttgtgcac

SEQ ID NO: 6538438 - DNA, 13 bp, Homo sapiens
tgtatccagagct

SEQ ID NO: 6538439 - DNA, 16 bp, Homo sapiens
tgtatccatgtaatga

SEQ ID NO: 6538440 - DNA, 20 bp, Homo sapiens
tgtatccatgtaatgatctt

SEQ ID NO: 6538441 - DNA, 21 bp, Homo sapiens
tgtatccatgtaatgatcttg

SEQ ID NO: 6538442 - DNA, 16 bp, Homo sapiens
tgtatccccagtgccc

SEQ ID NO: 6538443 - DNA, 20 bp, Homo sapiens
tgtatcccccccctgtatag

SEQ ID NO: 6538444 - DNA, 22 bp, Homo sapiens
tgtatcccccccctgtatagtt

SEQ ID NO: 6538445 - DNA, 14 bp, Homo sapiens
tgtatcccctgcag

SEQ ID NO: 6538446 - DNA, 13 bp, Homo sapiens
tgtatccgtgaat

SEQ ID NO: 6538447 - DNA, 14 bp, Homo sapiens
tgtatcctgacagc

SEQ ID NO: 6538448 - DNA, 20 bp, Homo sapiens
tgtatcctgaggctgagaga

SEQ ID NO: 6538449 - DNA, 19 bp, Homo sapiens
tgtatcctggcaaataata

SEQ ID NO: 6538450 - DNA, 12 bp, Homo sapiens
tgtatcctggcc

SEQ ID NO: 6538451 - DNA, 17 bp, Homo sapiens
tgtatcctggccctggg

SEQ ID NO: 6538452 - DNA, 18 bp, Homo sapiens
tgtatcctggggctccct

SEQ ID NO: 6538453 - DNA, 21 bp, Homo sapiens
tgtatccttccaatttggaat

SEQ ID NO: 6538454 - DNA, 21 bp, Homo sapiens
tgtatcctttatttctgataa

SEQ ID NO: 6538455 - DNA, 16 bp, Homo sapiens
tgtatcgcatattagt

SEQ ID NO: 6538456 - DNA, 21 bp, Homo sapiens
tgtatcgcatattagttaatc

SEQ ID NO: 6538457 - DNA, 18 bp, Homo sapiens
tgtatcggagacagtgat

SEQ ID NO: 6538458 - DNA, 19 bp, Homo sapiens
tgtatcgtaaccagccaga

SEQ ID NO: 6538459 - DNA, 21 bp, Homo sapiens
tgtatcgtatagctgtattga

SEQ ID NO: 6538460 - DNA, 18 bp, Homo sapiens
tgtatcgtggagaaacaa

SEQ ID NO: 6538461 - DNA, 15 bp, Homo sapiens
tgtatctaaaaaata

SEQ ID NO: 6538462 - DNA, 16 bp, Homo sapiens
tgtatctaaaaaataa

SEQ ID NO: 6538463 - DNA, 19 bp, Homo sapiens
tgtatctacagtaatgaaa

SEQ ID NO: 6538464 - DNA, 16 bp, Homo sapiens
tgtatctacattaaaa

SEQ ID NO: 6538465 - DNA, 22 bp, Homo sapiens
tgtatctacattaaaatgacaa

SEQ ID NO: 6538466 - DNA, 15 bp, Homo sapiens
tgtatctacctcact

SEQ ID NO: 6538467 - DNA, 19 bp, Homo sapiens
tgtatctaggcatttcatt

SEQ ID NO: 6538468 - DNA, 17 bp, Homo sapiens
tgtatctagtgcagctg

SEQ ID NO: 6538469 - DNA, 18 bp, Homo sapiens
tgtatctagtggtctgat

SEQ ID NO: 6538470 - DNA, 20 bp, Homo sapiens
tgtatctagtggtctgattt

SEQ ID NO: 6538471 - DNA, 21 bp, Homo sapiens
tgtatctagtgtgtcctgtga

SEQ ID NO: 6538472 - DNA, 16 bp, Homo sapiens
tgtatctatgcaaagc

SEQ ID NO: 6538473 - DNA, 17 bp, Homo sapiens
tgtatctatttgtacaa

SEQ ID NO: 6538474 - DNA, 19 bp, Homo sapiens
tgtatctatttgtacaatt

SEQ ID NO: 6538475 - DNA, 17 bp, Homo sapiens
tgtatctcaataaagca

SEQ ID NO: 6538476 - DNA, 18 bp, Homo sapiens
tgtatctcatttaatttg

SEQ ID NO: 6538477 - DNA, 12 bp, Homo sapiens
tgtatctcctcc

SEQ ID NO: 6538478 - DNA, 23 bp, Homo sapiens
tgtatctgagttgccaagacaaa

SEQ ID NO: 6538479 - DNA, 19 bp, Homo sapiens
tgtatctgcaggcagacac

SEQ ID NO: 6538480 - DNA, 20 bp, Homo sapiens
tgtatctgcaggcagacacg

SEQ ID NO: 6538481 - DNA, 22 bp, Homo sapiens
tgtatctgcaggcagacacgga

SEQ ID NO: 6538482 - DNA, 23 bp, Homo sapiens
tgtatctgtagtcttttattttt

SEQ ID NO: 6538483 - DNA, 12 bp, Homo sapiens
tgtatctgtcta

SEQ ID NO: 6538484 - DNA, 19 bp, Homo sapiens
tgtatctgtctactttctc

SEQ ID NO: 6538485 - DNA, 16 bp, Homo sapiens
tgtatctgtctttcca

SEQ ID NO: 6538486 - DNA, 11 bp, Homo sapiens
tgtatctgtgt

SEQ ID NO: 6538487 - DNA, 16 bp, Homo sapiens
tgtatctgtgtagact

SEQ ID NO: 6538488 - DNA, 15 bp, Homo sapiens
tgtatcttaaatttg

SEQ ID NO: 6538489 - DNA, 22 bp, Homo sapiens
tgtatcttaatatatacatttt

SEQ ID NO: 6538490 - DNA, 17 bp, Homo sapiens
tgtatcttatttatata

SEQ ID NO: 6538491 - DNA, 16 bp, Homo sapiens
tgtatcttccatattt

SEQ ID NO: 6538492 - DNA, 13 bp, Homo sapiens
tgtatcttccttt

SEQ ID NO: 6538493 - DNA, 19 bp, Homo sapiens
tgtatcttctgcagacact

SEQ ID NO: 6538494 - DNA, 17 bp, Homo sapiens
tgtatcttgattaatgt

SEQ ID NO: 6538495 - DNA, 14 bp, Homo sapiens
tgtatctttattaa

SEQ ID NO: 6538496 - DNA, 19 bp, Homo sapiens
tgtatctttattaaaacaa

SEQ ID NO: 6538497 - DNA, 22 bp, Homo sapiens
tgtatctttattaaaacaaaag

SEQ ID NO: 6538498 - DNA, 12 bp, Homo sapiens
tgtatctttctt

SEQ ID NO: 6538499 - DNA, 18 bp, Homo sapiens
tgtatctttggggaaact

SEQ ID NO: 6538500 - DNA, 12 bp, Homo sapiens
tgtatctttgta

SEQ ID NO: 6538501 - DNA, 22 bp, Homo sapiens
tgtatcttttattttcctgtct

SEQ ID NO: 6538502 - DNA, 17 bp, Homo sapiens
tgtatctttttgaaaat

SEQ ID NO: 6538503 - DNA, 18 bp, Homo sapiens
tgtatgaaaaattgggga

SEQ ID NO: 6538504 - DNA, 20 bp, Homo sapiens
tgtatgaaaaattggggagg

SEQ ID NO: 6538505 - DNA, 22 bp, Homo sapiens
tgtatgaaaatccttttaacca

SEQ ID NO: 6538506 - DNA, 21 bp, Homo sapiens
tgtatgaacatggagaggact

SEQ ID NO: 6538507 - DNA, 21 bp, Homo sapiens
tgtatgaaggaatcattccag

SEQ ID NO: 6538508 - DNA, 16 bp, Homo sapiens
tgtatgaagtactttt

SEQ ID NO: 6538509 - DNA, 12 bp, Homo sapiens
tgtatgaatgta

SEQ ID NO: 6538510 - DNA, 19 bp, Homo sapiens
ttctctttaaaatatttgt

SEQ ID NO: 6538511 - DNA, 21 bp, Homo sapiens
ttctctttaactcaggactcc

SEQ ID NO: 6538512 - DNA, 19 bp, Homo sapiens
ttctctttaccttctaaaa

SEQ ID NO: 6538513 - DNA, 20 bp, Homo sapiens
ttctctttagggaacaagga

SEQ ID NO: 6538514 - DNA, 14 bp, Homo sapiens
ttctctttccctgg

SEQ ID NO: 6538515 - DNA, 13 bp, Homo sapiens
ttctctttcctct

SEQ ID NO: 6538516 - DNA, 22 bp, Homo sapiens
ttctctttccttggctcccatt

SEQ ID NO: 6538517 - DNA, 16 bp, Homo sapiens
ttctctttctctcctt

SEQ ID NO: 6538518 - DNA, 14 bp, Homo sapiens
ttctctttctctct

SEQ ID NO: 6538519 - DNA, 18 bp, Homo sapiens
ttctctttctctctcact

SEQ ID NO: 6538520 - DNA, 17 bp, Homo sapiens
ttctctttctctcttcc

SEQ ID NO: 6538521 - DNA, 13 bp, Homo sapiens
ttctctttctgtt

SEQ ID NO: 6538522 - DNA, 20 bp, Homo sapiens
ttctctttcttattttgtaa

SEQ ID NO: 6538523 - DNA, 12 bp, Homo sapiens
ttctctttgact

SEQ ID NO: 6538524 - DNA, 11 bp, Homo sapiens
ttctctttgat

SEQ ID NO: 6538525 - DNA, 16 bp, Homo sapiens
ttctctttgataacaa

SEQ ID NO: 6538526 - DNA, 18 bp, Homo sapiens
ttctctttgataacaaaa

SEQ ID NO: 6538527 - DNA, 19 bp, Homo sapiens
ttctctttgcctgaagaaa

SEQ ID NO: 6538528 - DNA, 17 bp, Homo sapiens
ttctctttgccttgatg

SEQ ID NO: 6538529 - DNA, 14 bp, Homo sapiens
ttctctttgctgac

SEQ ID NO: 6538530 - DNA, 14 bp, Homo sapiens
ttctctttggagga

SEQ ID NO: 6538531 - DNA, 12 bp, Homo sapiens
ttctctttgtgc

SEQ ID NO: 6538532 - DNA, 15 bp, Homo sapiens
ttctctttgtttctg

SEQ ID NO: 6538533 - DNA, 16 bp, Homo sapiens
ttctcttttattctgt

SEQ ID NO: 6538534 - DNA, 20 bp, Homo sapiens
ttctcttttcccctttcctg

SEQ ID NO: 6538535 - DNA, 13 bp, Homo sapiens
ttctcttttcctc

SEQ ID NO: 6538536 - DNA, 17 bp, Homo sapiens
ttctcttttcctcgcag

SEQ ID NO: 6538537 - DNA, 22 bp, Homo sapiens
ttctcttttgtcctcacatgca

SEQ ID NO: 6538538 - DNA, 17 bp, Homo sapiens
ttctctttttgaaaaaa

SEQ ID NO: 6538539 - DNA, 21 bp, Homo sapiens
ttctgaaaaagacataaaaca

SEQ ID NO: 6538540 - DNA, 16 bp, Homo sapiens
ttctgaaaaatgaatg

SEQ ID NO: 6538541 - DNA, 13 bp, Homo sapiens
ttctgaaaacact

SEQ ID NO: 6538542 - DNA, 17 bp, Homo sapiens
ttctgaaaagaaataat

SEQ ID NO: 6538543 - DNA, 15 bp, Homo sapiens
ttctgaaaatataac

SEQ ID NO: 6538544 - DNA, 17 bp, Homo sapiens
ttctgaaaatttatata

SEQ ID NO: 6538545 - DNA, 15 bp, Homo sapiens
ttctgaaacacacga

SEQ ID NO: 6538546 - DNA, 16 bp, Homo sapiens
ttctgaaagaattatt

SEQ ID NO: 6538547 - DNA, 22 bp, Homo sapiens
ttctgaaaggaaatacacttct

SEQ ID NO: 6538548 - DNA, 18 bp, Homo sapiens
ttctgaaaggtgctttct

SEQ ID NO: 6538549 - DNA, 21 bp, Homo sapiens
ttctgaaaggtgctttctcca

SEQ ID NO: 6538550 - DNA, 19 bp, Homo sapiens
ttctgaaagttacccactg

SEQ ID NO: 6538551 - DNA, 22 bp, Homo sapiens
ttctgaaatgacagaatgctgt

SEQ ID NO: 6538552 - DNA, 15 bp, Homo sapiens
ttctgaaatgtgacc

SEQ ID NO: 6538553 - DNA, 16 bp, Homo sapiens
ttctgaaattaggaaa

SEQ ID NO: 6538554 - DNA, 21 bp, Homo sapiens
ttctgaaatttcctgggagct

SEQ ID NO: 6538555 - DNA, 20 bp, Homo sapiens
ttctgaaatttttttcctaa

SEQ ID NO: 6538556 - DNA, 21 bp, Homo sapiens
ttctgaaatttttttcctaag

SEQ ID NO: 6538557 - DNA, 13 bp, Homo sapiens
ttctgaacaaaag

SEQ ID NO: 6538558 - DNA, 23 bp, Homo sapiens
ttctgaacaatggggactttgtt

SEQ ID NO: 6538559 - DNA, 15 bp, Homo sapiens
ttctgaacagctggt

SEQ ID NO: 6538560 - DNA, 21 bp, Homo sapiens
ttctgaaccctccaaaggaac

SEQ ID NO: 6538561 - DNA, 18 bp, Homo sapiens
ttctgaactcaaactgag

SEQ ID NO: 6538562 - DNA, 14 bp, Homo sapiens
ttctgaactcaagc

SEQ ID NO: 6538563 - DNA, 12 bp, Homo sapiens
ttctgaactcgc

SEQ ID NO: 6538564 - DNA, 15 bp, Homo sapiens
ttctgaactctgaca

SEQ ID NO: 6538565 - DNA, 15 bp, Homo sapiens
ttctgaactgttaca

SEQ ID NO: 6538566 - DNA, 22 bp, Homo sapiens
ttctgaacttggcgctgcccct

SEQ ID NO: 6538567 - DNA, 23 bp, Homo sapiens
ttctgaagatcagaacattcagc

SEQ ID NO: 6538568 - DNA, 22 bp, Homo sapiens
ttctgaagccatgtagccaccc

SEQ ID NO: 6538569 - DNA, 23 bp, Homo sapiens
ttctgaagctagaaacaatctat

SEQ ID NO: 6538570 - DNA, 19 bp, Homo sapiens
ttctgaagcttatgtttct

SEQ ID NO: 6538571 - DNA, 22 bp, Homo sapiens
ttctgaagggcatacaatgaaa

SEQ ID NO: 6538572 - DNA, 19 bp, Homo sapiens
ttctgaaggtaaagggaca

SEQ ID NO: 6538573 - DNA, 23 bp, Homo sapiens
ttctgaaggttggaactgctgcc

SEQ ID NO: 6538574 - DNA, 18 bp, Homo sapiens
ttctgaagtatgaagtct

SEQ ID NO: 6538575 - DNA, 20 bp, Homo sapiens
ttctgaagtatgaagtctga

SEQ ID NO: 6538576 - DNA, 17 bp, Homo sapiens
ttctgaagtgcttgtat

SEQ ID NO: 6538577 - DNA, 22 bp, Homo sapiens
ttctgaagtgggaaaaaataga

SEQ ID NO: 6538578 - DNA, 20 bp, Homo sapiens
ttctgaagtgtgtccatcct

SEQ ID NO: 6538579 - DNA, 13 bp, Homo sapiens
ttctgaagttata

SEQ ID NO: 6538580 - DNA, 15 bp, Homo sapiens
ttctgaagttatatt

SEQ ID NO: 6538581 - DNA, 13 bp, Homo sapiens
ttctgaagtttta

SEQ ID NO: 6538582 - DNA, 20 bp, Homo sapiens
ttctgaagttttattttaaa

SEQ ID NO: 6538583 - DNA, 21 bp, Homo sapiens
ttctgaagttttattttaaat

SEQ ID NO: 6538584 - DNA, 17 bp, Homo sapiens
ttctgaataacatttgt

SEQ ID NO: 6538585 - DNA, 15 bp, Homo sapiens
ttctgaataacttga

SEQ ID NO: 6538586 - DNA, 19 bp, Homo sapiens
ttctgaatacaaagtgatg

SEQ ID NO: 6538587 - DNA, 11 bp, Homo sapiens
ttctgaatatg

SEQ ID NO: 6538588 - DNA, 17 bp, Homo sapiens
ttctgaatattggacat

SEQ ID NO: 6538589 - DNA, 23 bp, Homo sapiens
ttctgaatcaccaattaaaaacc

SEQ ID NO: 6538590 - DNA, 22 bp, Homo sapiens
ttctgaatgaagccttctgacc

SEQ ID NO: 6538591 - DNA, 21 bp, Homo sapiens
ttctgaatgggcaattccaga

SEQ ID NO: 6538592 - DNA, 17 bp, Homo sapiens
ttctgaatgtttgtgtc

SEQ ID NO: 6538593 - DNA, 21 bp, Homo sapiens
ttctgaatgtttgtgtctgtg

SEQ ID NO: 6538594 - DNA, 22 bp, Homo sapiens
ttctgaatgtttgtgtctgtgg

SEQ ID NO: 6538595 - DNA, 11 bp, Homo sapiens
ttctgaattgg

SEQ ID NO: 6538596 - DNA, 19 bp, Homo sapiens
ttctgaatttcattctctt

SEQ ID NO: 6538597 - DNA, 14 bp, Homo sapiens
ttctgaatttgcaa

SEQ ID NO: 6538598 - DNA, 20 bp, Homo sapiens
ttctgaatttgcaaagtact

SEQ ID NO: 6538599 - DNA, 22 bp, Homo sapiens
ttctgacaaaaagtttccatat

SEQ ID NO: 6538600 - DNA, 18 bp, Homo sapiens
ttctgacaataaataata

SEQ ID NO: 6538601 - DNA, 13 bp, Homo sapiens
ttctgacaattaa

SEQ ID NO: 6538602 - DNA, 15 bp, Homo sapiens
ttctgacaattaaca

SEQ ID NO: 6538603 - DNA, 22 bp, Homo sapiens
ttctgacacgacttctgtttca

SEQ ID NO: 6538604 - DNA, 13 bp, Homo sapiens
ttctgacacttgt

SEQ ID NO: 6538605 - DNA, 22 bp, Homo sapiens
ttctgacagcccaacttccaga

SEQ ID NO: 6538606 - DNA, 13 bp, Homo sapiens
ttctgacagtgtt

SEQ ID NO: 6538607 - DNA, 15 bp, Homo sapiens
ttctgacatcagcac

SEQ ID NO: 6538608 - DNA, 18 bp, Homo sapiens
ttctgacatgcattgttg

SEQ ID NO: 6538609 - DNA, 15 bp, Homo sapiens
ttctgacattaacag

SEQ ID NO: 6538610 - DNA, 19 bp, Homo sapiens
ttctgacatttatatttgt

SEQ ID NO: 6538611 - DNA, 12 bp, Homo sapiens
ttctgaccaaaa

SEQ ID NO: 6538612 - DNA, 22 bp, Homo sapiens
ttctgaccacacttcctgtcca

SEQ ID NO: 6538613 - DNA, 20 bp, Homo sapiens
ttctgaccacagcatcattt

SEQ ID NO: 6538614 - DNA, 14 bp, Homo sapiens
ttctgaccatttca

SEQ ID NO: 6538615 - DNA, 14 bp, Homo sapiens
ttctgaccccactt

SEQ ID NO: 6538616 - DNA, 18 bp, Homo sapiens
ttctgaccctgcttcaaa

SEQ ID NO: 6538617 - DNA, 23 bp, Homo sapiens
ttctgaccgttaaaaaattcttg

SEQ ID NO: 6538618 - DNA, 18 bp, Homo sapiens
ttctgacctcaagtgatt

SEQ ID NO: 6538619 - DNA, 13 bp, Homo sapiens
ttctgacctcagc

SEQ ID NO: 6538620 - DNA, 14 bp, Homo sapiens
ttctgacctcagca

SEQ ID NO: 6538621 - DNA, 12 bp, Homo sapiens
ttctgacctggg

SEQ ID NO: 6538622 - DNA, 16 bp, Homo sapiens
ttctgaccttcagctc

SEQ ID NO: 6538623 - DNA, 21 bp, Homo sapiens
ttctgaccttgtgaacatcag

SEQ ID NO: 6538624 - DNA, 20 bp, Homo sapiens
ttctgacgcagcctgagaat

SEQ ID NO: 6538625 - DNA, 17 bp, Homo sapiens
ttctgacggccctgcaa

SEQ ID NO: 6538626 - DNA, 22 bp, Homo sapiens
ttctgacgtcagcgcaccaaaa

SEQ ID NO: 6538627 - DNA, 19 bp, Homo sapiens
ttctgactcggtttctcca

SEQ ID NO: 6538628 - DNA, 16 bp, Homo sapiens
ttctgactctgagcta

SEQ ID NO: 6538629 - DNA, 14 bp, Homo sapiens
ttctgactcttccc

SEQ ID NO: 6538630 - DNA, 13 bp, Homo sapiens
ttctgactgcaac

SEQ ID NO: 6538631 - DNA, 11 bp, Homo sapiens
ttctgactgtc

SEQ ID NO: 6538632 - DNA, 15 bp, Homo sapiens
ttctgactgtccagg

SEQ ID NO: 6538633 - DNA, 12 bp, Homo sapiens
ttctgactgttt

SEQ ID NO: 6538634 - DNA, 15 bp, Homo sapiens
ttctgactgtttatt

SEQ ID NO: 6538635 - DNA, 20 bp, Homo sapiens
ttctgactgtttatttaagg

SEQ ID NO: 6538636 - DNA, 21 bp, Homo sapiens
ttctgacttacttaaccaggt

SEQ ID NO: 6538637 - DNA, 22 bp, Homo sapiens
ttctgacttcatagatttcctt

SEQ ID NO: 6538638 - DNA, 16 bp, Homo sapiens
ttctgacttctagctg

SEQ ID NO: 6538639 - DNA, 13 bp, Homo sapiens
ttctgactttact

SEQ ID NO: 6538640 - DNA, 21 bp, Homo sapiens
ttctgactttgaatttatata

SEQ ID NO: 6538641 - DNA, 13 bp, Homo sapiens
ttctgacttttac

SEQ ID NO: 6538642 - DNA, 14 bp, Homo sapiens
ttctgagaaaacaa

SEQ ID NO: 6538643 - DNA, 21 bp, Homo sapiens
ttctgagaaagactattcaaa

SEQ ID NO: 6538644 - DNA, 21 bp, Homo sapiens
ttctgagaagcgctgccctgt

SEQ ID NO: 6538645 - DNA, 13 bp, Homo sapiens
ttctgagaccaaa

SEQ ID NO: 6538646 - DNA, 13 bp, Homo sapiens
ttctgagagctgt

SEQ ID NO: 6538647 - DNA, 18 bp, Homo sapiens
ttctgagatccagcacaa

SEQ ID NO: 6538648 - DNA, 23 bp, Homo sapiens
ttctgagatggctcccaggggct

SEQ ID NO: 6538649 - DNA, 19 bp, Homo sapiens
ttctgagcaaaggccctgg

SEQ ID NO: 6538650 - DNA, 20 bp, Homo sapiens
ttctgagcaccgaatattga

SEQ ID NO: 6538651 - DNA, 23 bp, Homo sapiens
ttctgagcacgggcaaagaaaac

SEQ ID NO: 6538652 - DNA, 15 bp, Homo sapiens
ttctgagcagtgcct

SEQ ID NO: 6538653 - DNA, 13 bp, Homo sapiens
ttctgagccccag

SEQ ID NO: 6538654 - DNA, 15 bp, Homo sapiens
ttctgagccccagcc

SEQ ID NO: 6538655 - DNA, 17 bp, Homo sapiens
ttctgagccccagcccc

SEQ ID NO: 6538656 - DNA, 21 bp, Homo sapiens
ttctgagcccccacctgcctg

SEQ ID NO: 6538657 - DNA, 22 bp, Homo sapiens
ttctgagcccccacctgcctga

SEQ ID NO: 6538658 - DNA, 20 bp, Homo sapiens
ttctgagcccgggctgcctg

SEQ ID NO: 6538659 - DNA, 17 bp, Homo sapiens
ttctgagccttctactt

SEQ ID NO: 6538660 - DNA, 13 bp, Homo sapiens
ttctgagccttga

SEQ ID NO: 6538661 - DNA, 17 bp, Homo sapiens
ttctgagctataacatt

SEQ ID NO: 6538662 - DNA, 23 bp, Homo sapiens
ttctgagctatttcatctatttt

SEQ ID NO: 6538663 - DNA, 13 bp, Homo sapiens
ttctgagctcctg

SEQ ID NO: 6538664 - DNA, 20 bp, Homo sapiens
ttctgagcttacgtagttct

SEQ ID NO: 6538665 - DNA, 17 bp, Homo sapiens
ttctgaggtaagtgtat

SEQ ID NO: 6538666 - DNA, 23 bp, Homo sapiens
ttctgaggtaagtgtatgatctt

SEQ ID NO: 6538667 - DNA, 23 bp, Homo sapiens
ttctgagtacttgatttcaggtc

SEQ ID NO: 6538668 - DNA, 13 bp, Homo sapiens
ttctgagtattct

SEQ ID NO: 6538669 - DNA, 16 bp, Homo sapiens
ttctgagtgaatgtta

SEQ ID NO: 6538670 - DNA, 15 bp, Homo sapiens
ttctgagtgatccag

SEQ ID NO: 6538671 - DNA, 18 bp, Homo sapiens
ttctgagtgccttctgtg

SEQ ID NO: 6538672 - DNA, 16 bp, Homo sapiens
ttctgagtttcattct

SEQ ID NO: 6538673 - DNA, 19 bp, Homo sapiens
ttctgagtttcattctcct

SEQ ID NO: 6538674 - DNA, 20 bp, Homo sapiens
ttctgagtttcattctcctg

SEQ ID NO: 6538675 - DNA, 14 bp, Homo sapiens
ttctgagttttgtg

SEQ ID NO: 6538676 - DNA, 23 bp, Homo sapiens
ttctgagttttgtgtttgttgta

SEQ ID NO: 6538677 - DNA, 23 bp, Homo sapiens
ttctgataactagatggtgctga

SEQ ID NO: 6538678 - DNA, 20 bp, Homo sapiens
ttctgataagactggaaaat

SEQ ID NO: 6538679 - DNA, 15 bp, Homo sapiens
ttctgataatgtatt

SEQ ID NO: 6538680 - DNA, 17 bp, Homo sapiens
ttctgatacatctgtca

SEQ ID NO: 6538681 - DNA, 12 bp, Homo sapiens
ttctgatacatt

SEQ ID NO: 6538682 - DNA, 14 bp, Homo sapiens
ttctgatacattag

SEQ ID NO: 6538683 - DNA, 14 bp, Homo sapiens
ttctgataggaggg

SEQ ID NO: 6538684 - DNA, 20 bp, Homo sapiens
ttctgatagtagtctttaaa

SEQ ID NO: 6538685 - DNA, 18 bp, Homo sapiens
ttctgatatagaattgca

SEQ ID NO: 6538686 - DNA, 20 bp, Homo sapiens
ttctgatatgtgaatttgtt

SEQ ID NO: 6538687 - DNA, 14 bp, Homo sapiens
ttctgatattaatt

SEQ ID NO: 6538688 - DNA, 15 bp, Homo sapiens
tgtatgaattttgta

SEQ ID NO: 6538689 - DNA, 16 bp, Homo sapiens
tgtatgaattttgtaa

SEQ ID NO: 6538690 - DNA, 22 bp, Homo sapiens
tgtatgaattttgtaagtataa

SEQ ID NO: 6538691 - DNA, 23 bp, Homo sapiens
tgtatgacagtgaagcagcactg

SEQ ID NO: 6538692 - DNA, 18 bp, Homo sapiens
tgtatgacccctggccac

SEQ ID NO: 6538693 - DNA, 14 bp, Homo sapiens
tgtatgactaaaga

SEQ ID NO: 6538694 - DNA, 20 bp, Homo sapiens
tgtatgactaaagagagaat

SEQ ID NO: 6538695 - DNA, 17 bp, Homo sapiens
tgtatgactgcacatga

SEQ ID NO: 6538696 - DNA, 17 bp, Homo sapiens
tgtatgacttctgctga

SEQ ID NO: 6538697 - DNA, 16 bp, Homo sapiens
tgtatgagaagtactt

SEQ ID NO: 6538698 - DNA, 21 bp, Homo sapiens
tgtatgagaagtactttgtgc

SEQ ID NO: 6538699 - DNA, 15 bp, Homo sapiens
tgtatgaggagagct

SEQ ID NO: 6538700 - DNA, 17 bp, Homo sapiens
tgtatgaggtcctcagg

SEQ ID NO: 6538701 - DNA, 22 bp, Homo sapiens
tgtatgaggtcctcaggtcagc

SEQ ID NO: 6538702 - DNA, 19 bp, Homo sapiens
tgtatgagttgcatttgta

SEQ ID NO: 6538703 - DNA, 20 bp, Homo sapiens
tgtatgagttgcatttgtaa

SEQ ID NO: 6538704 - DNA, 14 bp, Homo sapiens
tgtatgatactaaa

SEQ ID NO: 6538705 - DNA, 16 bp, Homo sapiens
tgtatgatattccata

SEQ ID NO: 6538706 - DNA, 21 bp, Homo sapiens
tgtatgatattccatagtata

SEQ ID NO: 6538707 - DNA, 12 bp, Homo sapiens
tgtatgatcaaa

SEQ ID NO: 6538708 - DNA, 18 bp, Homo sapiens
tgtatgatcaaatgttta

SEQ ID NO: 6538709 - DNA, 23 bp, Homo sapiens
tgtatgatcaaatgtttaatcat

SEQ ID NO: 6538710 - DNA, 12 bp, Homo sapiens
tgtatgatgtat

SEQ ID NO: 6538711 - DNA, 13 bp, Homo sapiens
tgtatgatgtgtt

SEQ ID NO: 6538712 - DNA, 15 bp, Homo sapiens
tgtatgattcccagc

SEQ ID NO: 6538713 - DNA, 16 bp, Homo sapiens
tgtatgattcccagcc

SEQ ID NO: 6538714 - DNA, 17 bp, Homo sapiens
tgtatgcaacaggcact

SEQ ID NO: 6538715 - DNA, 18 bp, Homo sapiens
tgtatgcaagcagtttca

SEQ ID NO: 6538716 - DNA, 16 bp, Homo sapiens
tgtatgcacacacata

SEQ ID NO: 6538717 - DNA, 21 bp, Homo sapiens
tgtatgcacacacatatatta

SEQ ID NO: 6538718 - DNA, 16 bp, Homo sapiens
tgtatgcacagtaaaa

SEQ ID NO: 6538719 - DNA, 18 bp, Homo sapiens
tgtatgcacatgaactta

SEQ ID NO: 6538720 - DNA, 14 bp, Homo sapiens
tgtatgcactttgt

SEQ ID NO: 6538721 - DNA, 17 bp, Homo sapiens
tgtatgcagctatctgg

SEQ ID NO: 6538722 - DNA, 13 bp, Homo sapiens
tgtatgcagggag

SEQ ID NO: 6538723 - DNA, 18 bp, Homo sapiens
tgtatgcagggagcactg

SEQ ID NO: 6538724 - DNA, 14 bp, Homo sapiens
tgtatgcatcagat

SEQ ID NO: 6538725 - DNA, 23 bp, Homo sapiens
tgtatgcatcagataacaactgt

SEQ ID NO: 6538726 - DNA, 19 bp, Homo sapiens
tgtatgccacacctggcct

SEQ ID NO: 6538727 - DNA, 20 bp, Homo sapiens
tgtatgccttcgggaaaatt

SEQ ID NO: 6538728 - DNA, 22 bp, Homo sapiens
tgtatgccttcgggaaaattca

SEQ ID NO: 6538729 - DNA, 22 bp, Homo sapiens
tgtatgcctttaaatctgtgat

SEQ ID NO: 6538730 - DNA, 16 bp, Homo sapiens
tgtatgcggaattcca

SEQ ID NO: 6538731 - DNA, 23 bp, Homo sapiens
tgtatgcggtgacggcggggtgt

SEQ ID NO: 6538732 - DNA, 14 bp, Homo sapiens
tgtatgctaaatga

SEQ ID NO: 6538733 - DNA, 13 bp, Homo sapiens
tgtatgctgaatt

SEQ ID NO: 6538734 - DNA, 15 bp, Homo sapiens
tgtatgctgatcatc

SEQ ID NO: 6538735 - DNA, 14 bp, Homo sapiens
tgtatgctgatgat

SEQ ID NO: 6538736 - DNA, 21 bp, Homo sapiens
tgtatgctggtagctagtgat

SEQ ID NO: 6538737 - DNA, 13 bp, Homo sapiens
tgtatgcttcata

SEQ ID NO: 6538738 - DNA, 14 bp, Homo sapiens
tgtatgcttcatac

SEQ ID NO: 6538739 - DNA, 20 bp, Homo sapiens
tgtatgcttttataggcctg

SEQ ID NO: 6538740 - DNA, 22 bp, Homo sapiens
tgtatgcttttataggcctgtg

SEQ ID NO: 6538741 - DNA, 19 bp, Homo sapiens
tgtatggaaacactgattt

SEQ ID NO: 6538742 - DNA, 20 bp, Homo sapiens
tgtatggaaacactgatttt

SEQ ID NO: 6538743 - DNA, 18 bp, Homo sapiens
tgtatggaaataaatgta

SEQ ID NO: 6538744 - DNA, 19 bp, Homo sapiens
tgtatggaagacaaataca

SEQ ID NO: 6538745 - DNA, 16 bp, Homo sapiens
tgtatggaatacagtg

SEQ ID NO: 6538746 - DNA, 19 bp, Homo sapiens
tgtatggaatacagtgtta

SEQ ID NO: 6538747 - DNA, 23 bp, Homo sapiens
tgtatggacgtgtgtgaatggtt

SEQ ID NO: 6538748 - DNA, 16 bp, Homo sapiens
tgtatggatagtaaaa

SEQ ID NO: 6538749 - DNA, 23 bp, Homo sapiens
tgtatggatatatttgaaatagt

SEQ ID NO: 6538750 - DNA, 15 bp, Homo sapiens
tgtatggatatgtgt

SEQ ID NO: 6538751 - DNA, 18 bp, Homo sapiens
tgtatggatatgtgtaaa

SEQ ID NO: 6538752 - DNA, 13 bp, Homo sapiens
tgtatggatttaa

SEQ ID NO: 6538753 - DNA, 18 bp, Homo sapiens
tgtatggcccaggcagcc

SEQ ID NO: 6538754 - DNA, 18 bp, Homo sapiens
tgtatgggagcttaactt

SEQ ID NO: 6538755 - DNA, 15 bp, Homo sapiens
tgtatgggcaaaaaa

SEQ ID NO: 6538756 - DNA, 13 bp, Homo sapiens
tgtatggggaggc

SEQ ID NO: 6538757 - DNA, 19 bp, Homo sapiens
tgtatgggtagcactacta

SEQ ID NO: 6538758 - DNA, 20 bp, Homo sapiens
tgtatgggtagggtaaatca

SEQ ID NO: 6538759 - DNA, 22 bp, Homo sapiens
tgtatgggtagggtaaatcagt

SEQ ID NO: 6538760 - DNA, 18 bp, Homo sapiens
tgtatgggtcattctcac

SEQ ID NO: 6538761 - DNA, 10 bp, Homo sapiens
tgtatgtaaa

SEQ ID NO: 6538762 - DNA, 23 bp, Homo sapiens
tgtatgtaaagttcctgctgtaa

SEQ ID NO: 6538763 - DNA, 14 bp, Homo sapiens
tgtatgtaaatctg

SEQ ID NO: 6538764 - DNA, 15 bp, Homo sapiens
tgtatgtaaatgtgc

SEQ ID NO: 6538765 - DNA, 17 bp, Homo sapiens
tgtatgtacaatacaat

SEQ ID NO: 6538766 - DNA, 20 bp, Homo sapiens
tgtatgtacaatacaatgta

SEQ ID NO: 6538767 - DNA, 21 bp, Homo sapiens
tgtatgtacaatacaatgtac

SEQ ID NO: 6538768 - DNA, 13 bp, Homo sapiens
tgtatgtacatac

SEQ ID NO: 6538769 - DNA, 15 bp, Homo sapiens
tgtatgtacttacat

SEQ ID NO: 6538770 - DNA, 16 bp, Homo sapiens
tgtatgtacttacatg

SEQ ID NO: 6538771 - DNA, 20 bp, Homo sapiens
tgtatgtacttagctgtact

SEQ ID NO: 6538772 - DNA, 14 bp, Homo sapiens
tgtatgtagaagca

SEQ ID NO: 6538773 - DNA, 15 bp, Homo sapiens
tgtatgtagaagcat

SEQ ID NO: 6538774 - DNA, 13 bp, Homo sapiens
tgtatgtataatt

SEQ ID NO: 6538775 - DNA, 17 bp, Homo sapiens
tgtatgtattagtgata

SEQ ID NO: 6538776 - DNA, 22 bp, Homo sapiens
tgtatgtcaataaacaacagct

SEQ ID NO: 6538777 - DNA, 15 bp, Homo sapiens
tgtatgtcagtgcta

SEQ ID NO: 6538778 - DNA, 19 bp, Homo sapiens
tgtatgtcagtggtttcta

SEQ ID NO: 6538779 - DNA, 17 bp, Homo sapiens
tgtatgtctaattgagt

SEQ ID NO: 6538780 - DNA, 17 bp, Homo sapiens
tgtatgtctatgtgtat

SEQ ID NO: 6538781 - DNA, 18 bp, Homo sapiens
tgtatgtctcgtggtagg

SEQ ID NO: 6538782 - DNA, 12 bp, Homo sapiens
tgtatgtctgcc

SEQ ID NO: 6538783 - DNA, 19 bp, Homo sapiens
tgtatgtcttggacactgt

SEQ ID NO: 6538784 - DNA, 11 bp, Homo sapiens
tgtatgtgaac

SEQ ID NO: 6538785 - DNA, 22 bp, Homo sapiens
tgtatgtgaacaaatcaaattg

SEQ ID NO: 6538786 - DNA, 17 bp, Homo sapiens
tgtatgtgacaacattt

SEQ ID NO: 6538787 - DNA, 18 bp, Homo sapiens
tgtatgtgcacatgtgtc

SEQ ID NO: 6538788 - DNA, 17 bp, Homo sapiens
tgtatgtggaagtatac

SEQ ID NO: 6538789 - DNA, 23 bp, Homo sapiens
tgtatgtggaagtatacctggct

SEQ ID NO: 6538790 - DNA, 22 bp, Homo sapiens
tgtatgtggatacagtcattat

SEQ ID NO: 6538791 - DNA, 15 bp, Homo sapiens
tgtatgtgtagtgtg

SEQ ID NO: 6538792 - DNA, 13 bp, Homo sapiens
tgtatgtgtatat

SEQ ID NO: 6538793 - DNA, 16 bp, Homo sapiens
tgtatgtgtatatgtt

SEQ ID NO: 6538794 - DNA, 12 bp, Homo sapiens
tgtatgtgtcac

SEQ ID NO: 6538795 - DNA, 17 bp, Homo sapiens
tgtatgtgtctcccagg

SEQ ID NO: 6538796 - DNA, 12 bp, Homo sapiens
tgtatgtgtgaa

SEQ ID NO: 6538797 - DNA, 16 bp, Homo sapiens
tgtatgtgtggctgtg

SEQ ID NO: 6538798 - DNA, 19 bp, Homo sapiens
tgtatgtgtggctgtgggt

SEQ ID NO: 6538799 - DNA, 22 bp, Homo sapiens
tgtatgtgtgtaggttatcttt

SEQ ID NO: 6538800 - DNA, 17 bp, Homo sapiens
tgtatgtgtgtctattt

SEQ ID NO: 6538801 - DNA, 13 bp, Homo sapiens
tgtatgtgtgtgg

SEQ ID NO: 6538802 - DNA, 15 bp, Homo sapiens
tgtatgttaaagaga

SEQ ID NO: 6538803 - DNA, 14 bp, Homo sapiens
tgtatgttaaagca

SEQ ID NO: 6538804 - DNA, 15 bp, Homo sapiens
tgtatgttatgaaca

SEQ ID NO: 6538805 - DNA, 16 bp, Homo sapiens
tgtatgtttacatatc

SEQ ID NO: 6538806 - DNA, 13 bp, Homo sapiens
tgtatgtttagta

SEQ ID NO: 6538807 - DNA, 19 bp, Homo sapiens
tgtatgtttgctgattatt

SEQ ID NO: 6538808 - DNA, 17 bp, Homo sapiens
tgtatgttttatatcaa

SEQ ID NO: 6538809 - DNA, 15 bp, Homo sapiens
tgtatgtttttactg

SEQ ID NO: 6538810 - DNA, 16 bp, Homo sapiens
tgtatgtttttcagtt

SEQ ID NO: 6538811 - DNA, 17 bp, Homo sapiens
tgtatgtttttttccaa

SEQ ID NO: 6538812 - DNA, 17 bp, Homo sapiens
tgtatgttttttttctg

SEQ ID NO: 6538813 - DNA, 19 bp, Homo sapiens
tgtattaaaaaaaacaaaa

SEQ ID NO: 6538814 - DNA, 20 bp, Homo sapiens
tgtattaaaaaaaacaaaaa

SEQ ID NO: 6538815 - DNA, 18 bp, Homo sapiens
tgtattaaaaatagatat

SEQ ID NO: 6538816 - DNA, 22 bp, Homo sapiens
tgtattaaacctttccatttta

SEQ ID NO: 6538817 - DNA, 17 bp, Homo sapiens
tgtattaaacttttcat

SEQ ID NO: 6538818 - DNA, 15 bp, Homo sapiens
tgtattaaatggttt

SEQ ID NO: 6538819 - DNA, 23 bp, Homo sapiens
tgtattaaattacatttgtaatt

SEQ ID NO: 6538820 - DNA, 12 bp, Homo sapiens
tgtattaacaaa

SEQ ID NO: 6538821 - DNA, 14 bp, Homo sapiens
tgtattaacaaaag

SEQ ID NO: 6538822 - DNA, 18 bp, Homo sapiens
tgtattaacaaagttact

SEQ ID NO: 6538823 - DNA, 21 bp, Homo sapiens
tgtattaacactactcaaagc

SEQ ID NO: 6538824 - DNA, 14 bp, Homo sapiens
tgtattaacatgca

SEQ ID NO: 6538825 - DNA, 21 bp, Homo sapiens
tgtattaacctacctgtgaat

SEQ ID NO: 6538826 - DNA, 19 bp, Homo sapiens
tgtattaactgggtaccca

SEQ ID NO: 6538827 - DNA, 12 bp, Homo sapiens
tgtattaagaat

SEQ ID NO: 6538828 - DNA, 18 bp, Homo sapiens
tgtattaagagtgaaaat

SEQ ID NO: 6538829 - DNA, 18 bp, Homo sapiens
tgtattaagggatttagt

SEQ ID NO: 6538830 - DNA, 21 bp, Homo sapiens
tgtattaagttgttaataaaa

SEQ ID NO: 6538831 - DNA, 15 bp, Homo sapiens
tgtattaataaagca

SEQ ID NO: 6538832 - DNA, 18 bp, Homo sapiens
tgtattaataaagcattc

SEQ ID NO: 6538833 - DNA, 17 bp, Homo sapiens
tgtattaataaatagag

SEQ ID NO: 6538834 - DNA, 22 bp, Homo sapiens
tgtattaataaatagagcaatt

SEQ ID NO: 6538835 - DNA, 13 bp, Homo sapiens
tgtattaatacca

SEQ ID NO: 6538836 - DNA, 14 bp, Homo sapiens
tgtattaatactta

SEQ ID NO: 6538837 - DNA, 18 bp, Homo sapiens
tgtattaatcatagatta

SEQ ID NO: 6538838 - DNA, 18 bp, Homo sapiens
tgtattaatctctgtgtg

SEQ ID NO: 6538839 - DNA, 19 bp, Homo sapiens
tgtattaatctgtttgtgc

SEQ ID NO: 6538840 - DNA, 10 bp, Homo sapiens
tgtattaatg

SEQ ID NO: 6538841 - DNA, 12 bp, Homo sapiens
tgtattaattat

SEQ ID NO: 6538842 - DNA, 13 bp, Homo sapiens
tgtattacaaatc

SEQ ID NO: 6538843 - DNA, 22 bp, Homo sapiens
tgtattacaaatccaatgaaat

SEQ ID NO: 6538844 - DNA, 20 bp, Homo sapiens
tgtattacaacaatctggag

SEQ ID NO: 6538845 - DNA, 21 bp, Homo sapiens
tgtattacataaataaattaa

SEQ ID NO: 6538846 - DNA, 16 bp, Homo sapiens
tgtattaccattactt

SEQ ID NO: 6538847 - DNA, 19 bp, Homo sapiens
tgtattactagaagatgaa

SEQ ID NO: 6538848 - DNA, 17 bp, Homo sapiens
tgtattactttctctgt

SEQ ID NO: 6538849 - DNA, 13 bp, Homo sapiens
tgtattagatgtg

SEQ ID NO: 6538850 - DNA, 15 bp, Homo sapiens
tgtattagatgtggt

SEQ ID NO: 6538851 - DNA, 19 bp, Homo sapiens
tgtattagatgttctctat

SEQ ID NO: 6538852 - DNA, 14 bp, Homo sapiens
tgtattagccagtc

SEQ ID NO: 6538853 - DNA, 20 bp, Homo sapiens
tgtattagccagtcattgta

SEQ ID NO: 6538854 - DNA, 21 bp, Homo sapiens
tgtattaggtgtcatttccat

SEQ ID NO: 6538855 - DNA, 18 bp, Homo sapiens
tgtattagtgatatttct

SEQ ID NO: 6538856 - DNA, 14 bp, Homo sapiens
tgtattataacagt

SEQ ID NO: 6538857 - DNA, 21 bp, Homo sapiens
tgtattatcacatcaagcatg

SEQ ID NO: 6538858 - DNA, 15 bp, Homo sapiens
tgtattatcactgtc

SEQ ID NO: 6538859 - DNA, 15 bp, Homo sapiens
tgtattatcagtgaa

SEQ ID NO: 6538860 - DNA, 11 bp, Homo sapiens
tgtattatgtg

SEQ ID NO: 6538861 - DNA, 19 bp, Homo sapiens
tgtattatgtgcctaattt

SEQ ID NO: 6538862 - DNA, 15 bp, Homo sapiens
tgtattattacaaat

SEQ ID NO: 6538863 - DNA, 15 bp, Homo sapiens
tgtattattatatat

SEQ ID NO: 6538864 - DNA, 14 bp, Homo sapiens
tgtattattgctgt

SEQ ID NO: 6538865 - DNA, 16 bp, Homo sapiens
tgtattattgtaaagt

SEQ ID NO: 6538866 - DNA, 18 bp, Homo sapiens
tgtattatttacatttaa

SEQ ID NO: 6538867 - DNA, 21 bp, Homo sapiens
tgtattatttacatttaatag

SEQ ID NO: 6538868 - DNA, 15 bp, Homo sapiens
ttctgatcactgaaa

SEQ ID NO: 6538869 - DNA, 20 bp, Homo sapiens
ttctgatcactgaaataaaa

SEQ ID NO: 6538870 - DNA, 12 bp, Homo sapiens
ttctgatcagag

SEQ ID NO: 6538871 - DNA, 13 bp, Homo sapiens
ttctgatcagagg

SEQ ID NO: 6538872 - DNA, 17 bp, Homo sapiens
ttctgatcagtctgtct

SEQ ID NO: 6538873 - DNA, 20 bp, Homo sapiens
ttctgatcagtctgtctgga

SEQ ID NO: 6538874 - DNA, 21 bp, Homo sapiens
ttctgatcgtctcggcccctc

SEQ ID NO: 6538875 - DNA, 16 bp, Homo sapiens
ttctgatctgtacttt

SEQ ID NO: 6538876 - DNA, 22 bp, Homo sapiens
ttctgatcttggaaaaacagcg

SEQ ID NO: 6538877 - DNA, 13 bp, Homo sapiens
ttctgatgaagtt

SEQ ID NO: 6538878 - DNA, 14 bp, Homo sapiens
ttctgatgagcaac

SEQ ID NO: 6538879 - DNA, 17 bp, Homo sapiens
ttctgatgaggcatttt

SEQ ID NO: 6538880 - DNA, 13 bp, Homo sapiens
ttctgatgatgtc

SEQ ID NO: 6538881 - DNA, 18 bp, Homo sapiens
ttctgatgatgtgcctgg

SEQ ID NO: 6538882 - DNA, 15 bp, Homo sapiens
ttctgatgcccaccg

SEQ ID NO: 6538883 - DNA, 18 bp, Homo sapiens
ttctgatgggtcccaaaa

SEQ ID NO: 6538884 - DNA, 16 bp, Homo sapiens
ttctgatgtctctaaa

SEQ ID NO: 6538885 - DNA, 22 bp, Homo sapiens
ttctgatgtgtgttgtcagcct

SEQ ID NO: 6538886 - DNA, 13 bp, Homo sapiens
ttctgatgtttat

SEQ ID NO: 6538887 - DNA, 13 bp, Homo sapiens
ttctgatgtttct

SEQ ID NO: 6538888 - DNA, 17 bp, Homo sapiens
ttctgatgtttctgtga

SEQ ID NO: 6538889 - DNA, 18 bp, Homo sapiens
ttctgatgtttctgtgaa

SEQ ID NO: 6538890 - DNA, 15 bp, Homo sapiens
ttctgatgttttatt

SEQ ID NO: 6538891 - DNA, 18 bp, Homo sapiens
ttctgattaatatattta

SEQ ID NO: 6538892 - DNA, 13 bp, Homo sapiens
ttctgattagagt

SEQ ID NO: 6538893 - DNA, 13 bp, Homo sapiens
ttctgattagctt

SEQ ID NO: 6538894 - DNA, 15 bp, Homo sapiens
ttctgattagctttg

SEQ ID NO: 6538895 - DNA, 17 bp, Homo sapiens
ttctgattataagacaa

SEQ ID NO: 6538896 - DNA, 16 bp, Homo sapiens
ttctgattattacaac

SEQ ID NO: 6538897 - DNA, 12 bp, Homo sapiens
ttctgattccac

SEQ ID NO: 6538898 - DNA, 18 bp, Homo sapiens
ttctgattccgcaccctg

SEQ ID NO: 6538899 - DNA, 19 bp, Homo sapiens
ttctgattccgcaccctgc

SEQ ID NO: 6538900 - DNA, 10 bp, Homo sapiens
ttctgattct

SEQ ID NO: 6538901 - DNA, 20 bp, Homo sapiens
ttctgattctgattgctatc

SEQ ID NO: 6538902 - DNA, 18 bp, Homo sapiens
ttctgattgctatcagca

SEQ ID NO: 6538903 - DNA, 14 bp, Homo sapiens
ttctgattggtctg

SEQ ID NO: 6538904 - DNA, 20 bp, Homo sapiens
ttctgatttagcaatgctgt

SEQ ID NO: 6538905 - DNA, 13 bp, Homo sapiens
ttctgatttcact

SEQ ID NO: 6538906 - DNA, 14 bp, Homo sapiens
ttctgatttcagtt

SEQ ID NO: 6538907 - DNA, 18 bp, Homo sapiens
ttctgatttcataattca

SEQ ID NO: 6538908 - DNA, 20 bp, Homo sapiens
ttctgatttctgaagtgctt

SEQ ID NO: 6538909 - DNA, 21 bp, Homo sapiens
ttctgatttgccactgatatt

SEQ ID NO: 6538910 - DNA, 13 bp, Homo sapiens
ttctgatttgtat

SEQ ID NO: 6538911 - DNA, 14 bp, Homo sapiens
ttctgatttttctc

SEQ ID NO: 6538912 - DNA, 17 bp, Homo sapiens
ttctgatttttctcttt

SEQ ID NO: 6538913 - DNA, 14 bp, Homo sapiens
ttctgcaaaataca

SEQ ID NO: 6538914 - DNA, 12 bp, Homo sapiens
ttctgcaaacaa

SEQ ID NO: 6538915 - DNA, 22 bp, Homo sapiens
ttctgcaaaggtggcaatgctt

SEQ ID NO: 6538916 - DNA, 13 bp, Homo sapiens
ttctgcaaagtgt

SEQ ID NO: 6538917 - DNA, 23 bp, Homo sapiens
ttctgcaaatagaaaacaggaaa

SEQ ID NO: 6538918 - DNA, 15 bp, Homo sapiens
ttctgcaactgaaat

SEQ ID NO: 6538919 - DNA, 12 bp, Homo sapiens
ttctgcaagaat

SEQ ID NO: 6538920 - DNA, 17 bp, Homo sapiens
ttctgcaagaattaaaa

SEQ ID NO: 6538921 - DNA, 21 bp, Homo sapiens
ttctgcaagcacatctgcatt

SEQ ID NO: 6538922 - DNA, 16 bp, Homo sapiens
ttctgcaagtttctgt

SEQ ID NO: 6538923 - DNA, 11 bp, Homo sapiens
ttctgcaataa

SEQ ID NO: 6538924 - DNA, 14 bp, Homo sapiens
ttctgcaataacag

SEQ ID NO: 6538925 - DNA, 22 bp, Homo sapiens
ttctgcaataacagttttaaga

SEQ ID NO: 6538926 - DNA, 12 bp, Homo sapiens
ttctgcacagct

SEQ ID NO: 6538927 - DNA, 22 bp, Homo sapiens
ttctgcacagcttttccaaaat

SEQ ID NO: 6538928 - DNA, 17 bp, Homo sapiens
ttctgcacaggtctctg

SEQ ID NO: 6538929 - DNA, 14 bp, Homo sapiens
ttctgcacatacag

SEQ ID NO: 6538930 - DNA, 21 bp, Homo sapiens
ttctgcacccagaaattcctt

SEQ ID NO: 6538931 - DNA, 21 bp, Homo sapiens
ttctgcaccccaattgggaat

SEQ ID NO: 6538932 - DNA, 12 bp, Homo sapiens
ttctgcaccctc

SEQ ID NO: 6538933 - DNA, 16 bp, Homo sapiens
ttctgcaccctccacc

SEQ ID NO: 6538934 - DNA, 19 bp, Homo sapiens
ttctgcaccctccaccctg

SEQ ID NO: 6538935 - DNA, 15 bp, Homo sapiens
ttctgcaccttatct

SEQ ID NO: 6538936 - DNA, 16 bp, Homo sapiens
ttctgcaccttgccag

SEQ ID NO: 6538937 - DNA, 14 bp, Homo sapiens
ttctgcactcctgg

SEQ ID NO: 6538938 - DNA, 12 bp, Homo sapiens
ttctgcactgaa

SEQ ID NO: 6538939 - DNA, 17 bp, Homo sapiens
ttctgcactgagcagag

SEQ ID NO: 6538940 - DNA, 12 bp, Homo sapiens
ttctgcagaaga

SEQ ID NO: 6538941 - DNA, 23 bp, Homo sapiens
ttctgcagaatcagcatgattct

SEQ ID NO: 6538942 - DNA, 14 bp, Homo sapiens
ttctgcagagactt

SEQ ID NO: 6538943 - DNA, 18 bp, Homo sapiens
ttctgcagaggcagcagg

SEQ ID NO: 6538944 - DNA, 18 bp, Homo sapiens
ttctgcagagtggtgaag

SEQ ID NO: 6538945 - DNA, 23 bp, Homo sapiens
ttctgcagagtttccaaaaccag

SEQ ID NO: 6538946 - DNA, 15 bp, Homo sapiens
ttctgcagcaactcc

SEQ ID NO: 6538947 - DNA, 21 bp, Homo sapiens
ttctgcagcaactcccacgac

SEQ ID NO: 6538948 - DNA, 21 bp, Homo sapiens
ttctgcagcatgacctgtgac

SEQ ID NO: 6538949 - DNA, 20 bp, Homo sapiens
ttctgcagcccgatgtccct

SEQ ID NO: 6538950 - DNA, 22 bp, Homo sapiens
ttctgcagcccgatgtccctgt

SEQ ID NO: 6538951 - DNA, 20 bp, Homo sapiens
ttctgcagcccttgggcagt

SEQ ID NO: 6538952 - DNA, 22 bp, Homo sapiens
ttctgcagcctcggcctaggtc

SEQ ID NO: 6538953 - DNA, 16 bp, Homo sapiens
ttctgcagctttggct

SEQ ID NO: 6538954 - DNA, 13 bp, Homo sapiens
ttctgcaggaatc

SEQ ID NO: 6538955 - DNA, 23 bp, Homo sapiens
ttctgcatagcgaaataaaaatg

SEQ ID NO: 6538956 - DNA, 17 bp, Homo sapiens
ttctgcatatgttgaat

SEQ ID NO: 6538957 - DNA, 21 bp, Homo sapiens
ttctgcatatgttgaatactt

SEQ ID NO: 6538958 - DNA, 22 bp, Homo sapiens
ttctgcatatgttgaatacttt

SEQ ID NO: 6538959 - DNA, 19 bp, Homo sapiens
ttctgcatgccctccccac

SEQ ID NO: 6538960 - DNA, 18 bp, Homo sapiens
ttctgcatgcttagagca

SEQ ID NO: 6538961 - DNA, 19 bp, Homo sapiens
ttctgcatggattcagcat

SEQ ID NO: 6538962 - DNA, 20 bp, Homo sapiens
ttctgcatggattcagcatg

SEQ ID NO: 6538963 - DNA, 21 bp, Homo sapiens
ttctgcattactattaactct

SEQ ID NO: 6538964 - DNA, 23 bp, Homo sapiens
ttctgcattcacagcgcctcctg

SEQ ID NO: 6538965 - DNA, 21 bp, Homo sapiens
ttctgcattcatttttatagc

SEQ ID NO: 6538966 - DNA, 18 bp, Homo sapiens
ttctgcattgagaaggaa

SEQ ID NO: 6538967 - DNA, 12 bp, Homo sapiens
ttctgcatttag

SEQ ID NO: 6538968 - DNA, 13 bp, Homo sapiens
ttctgcatttagc

SEQ ID NO: 6538969 - DNA, 19 bp, Homo sapiens
ttctgcatttagctgtatt

SEQ ID NO: 6538970 - DNA, 20 bp, Homo sapiens
ttctgcatttagctgtattc

SEQ ID NO: 6538971 - DNA, 23 bp, Homo sapiens
ttctgcattttattctggatgga

SEQ ID NO: 6538972 - DNA, 18 bp, Homo sapiens
ttctgcattttgctattg

SEQ ID NO: 6538973 - DNA, 15 bp, Homo sapiens
ttctgccaaaataaa

SEQ ID NO: 6538974 - DNA, 20 bp, Homo sapiens
ttctgccactgaggagacag

SEQ ID NO: 6538975 - DNA, 20 bp, Homo sapiens
ttctgccacttctgcgggct

SEQ ID NO: 6538976 - DNA, 14 bp, Homo sapiens
ttctgccacttgca

SEQ ID NO: 6538977 - DNA, 12 bp, Homo sapiens
ttctgccaggag

SEQ ID NO: 6538978 - DNA, 14 bp, Homo sapiens
ttctgccataacag

SEQ ID NO: 6538979 - DNA, 21 bp, Homo sapiens
ttctgccatgggagagtccag

SEQ ID NO: 6538980 - DNA, 23 bp, Homo sapiens
ttctgcccagccctctgtggcca

SEQ ID NO: 6538981 - DNA, 23 bp, Homo sapiens
ttctgccccacacccagccagct

SEQ ID NO: 6538982 - DNA, 16 bp, Homo sapiens
ttctgccccagcttta

SEQ ID NO: 6538983 - DNA, 19 bp, Homo sapiens
ttctgccccctgcagaacc

SEQ ID NO: 6538984 - DNA, 20 bp, Homo sapiens
ttctgcccggctacatcagc

SEQ ID NO: 6538985 - DNA, 14 bp, Homo sapiens
ttctgccctcctgc

SEQ ID NO: 6538986 - DNA, 15 bp, Homo sapiens
ttctgccctgagccc

SEQ ID NO: 6538987 - DNA, 22 bp, Homo sapiens
ttctgccctgcctgaggaggag

SEQ ID NO: 6538988 - DNA, 20 bp, Homo sapiens
ttctgccctggctgctgccc

SEQ ID NO: 6538989 - DNA, 15 bp, Homo sapiens
ttctgccgcagccct

SEQ ID NO: 6538990 - DNA, 16 bp, Homo sapiens
ttctgccgcagccctg

SEQ ID NO: 6538991 - DNA, 23 bp, Homo sapiens
ttctgccgcagccctgcagaggg

SEQ ID NO: 6538992 - DNA, 17 bp, Homo sapiens
ttctgccggccctgggg

SEQ ID NO: 6538993 - DNA, 15 bp, Homo sapiens
ttctgcctaacttgt

SEQ ID NO: 6538994 - DNA, 22 bp, Homo sapiens
ttctgcctagagtgtagcctaa

SEQ ID NO: 6538995 - DNA, 22 bp, Homo sapiens
ttctgcctataaatttactctg

SEQ ID NO: 6538996 - DNA, 21 bp, Homo sapiens
ttctgcctcagcctcctgagt

SEQ ID NO: 6538997 - DNA, 14 bp, Homo sapiens
ttctgcctcagctt

SEQ ID NO: 6538998 - DNA, 12 bp, Homo sapiens
ttctgcctcctt

SEQ ID NO: 6538999 - DNA, 13 bp, Homo sapiens
ttctgcctctaag

SEQ ID NO: 6539000 - DNA, 16 bp, Homo sapiens
ttctgcctctattttt

SEQ ID NO: 6539001 - DNA, 16 bp, Homo sapiens
ttctgcctctccaggc

SEQ ID NO: 6539002 - DNA, 18 bp, Homo sapiens
ttctgcctctctaggacc

SEQ ID NO: 6539003 - DNA, 22 bp, Homo sapiens
ttctgcctctgatgtattttgt

SEQ ID NO: 6539004 - DNA, 11 bp, Homo sapiens
ttctgcctgag

SEQ ID NO: 6539005 - DNA, 16 bp, Homo sapiens
ttctgcctgagattct

SEQ ID NO: 6539006 - DNA, 17 bp, Homo sapiens
ttctgcctgccagctgc

SEQ ID NO: 6539007 - DNA, 22 bp, Homo sapiens
ttctgcctgccagctgcactga

SEQ ID NO: 6539008 - DNA, 20 bp, Homo sapiens
ttctgcctgcctcctccctc

SEQ ID NO: 6539009 - DNA, 14 bp, Homo sapiens
ttctgcctgcctgg

SEQ ID NO: 6539010 - DNA, 15 bp, Homo sapiens
ttctgcctgcctggg

SEQ ID NO: 6539011 - DNA, 11 bp, Homo sapiens
ttctgcctggg

SEQ ID NO: 6539012 - DNA, 19 bp, Homo sapiens
ttctgcctgggcaatggcc

SEQ ID NO: 6539013 - DNA, 11 bp, Homo sapiens
ttctgccttcc

SEQ ID NO: 6539014 - DNA, 18 bp, Homo sapiens
ttctgccttggattccta

SEQ ID NO: 6539015 - DNA, 16 bp, Homo sapiens
ttctgcctttgatgtt

SEQ ID NO: 6539016 - DNA, 12 bp, Homo sapiens
ttctgccttttc

SEQ ID NO: 6539017 - DNA, 15 bp, Homo sapiens
ttctgcgctgtgtac

SEQ ID NO: 6539018 - DNA, 16 bp, Homo sapiens
ttctgcgggctccctc

SEQ ID NO: 6539019 - DNA, 19 bp, Homo sapiens
ttctgcgggctccctcctc

SEQ ID NO: 6539020 - DNA, 20 bp, Homo sapiens
ttctgcgggctccctcctct

SEQ ID NO: 6539021 - DNA, 23 bp, Homo sapiens
ttctgcgggctccctcctctggc

SEQ ID NO: 6539022 - DNA, 24 bp, Homo sapiens
ttctgcgtccaccaggcctcactg

SEQ ID NO: 6539023 - DNA, 17 bp, Homo sapiens
ttctgctacttcactgt

SEQ ID NO: 6539024 - DNA, 17 bp, Homo sapiens
ttctgctcacattccct

SEQ ID NO: 6539025 - DNA, 20 bp, Homo sapiens
ttctgctcacattccctctc

SEQ ID NO: 6539026 - DNA, 20 bp, Homo sapiens
ttctgctcagctctgggcca

SEQ ID NO: 6539027 - DNA, 14 bp, Homo sapiens
ttctgctcatcatt

SEQ ID NO: 6539028 - DNA, 21 bp, Homo sapiens
ttctgctcatcattctctgtc

SEQ ID NO: 6539029 - DNA, 17 bp, Homo sapiens
ttctgctccacccttgg

SEQ ID NO: 6539030 - DNA, 20 bp, Homo sapiens
ttctgctccataccttttct

SEQ ID NO: 6539031 - DNA, 23 bp, Homo sapiens
ttctgctcccaccccagaaatca

SEQ ID NO: 6539032 - DNA, 15 bp, Homo sapiens
ttctgctcctctcca

SEQ ID NO: 6539033 - DNA, 16 bp, Homo sapiens
ttctgctcctctccag

SEQ ID NO: 6539034 - DNA, 13 bp, Homo sapiens
ttctgctcctgct

SEQ ID NO: 6539035 - DNA, 23 bp, Homo sapiens
ttctgctctaagaagctgcaata

SEQ ID NO: 6539036 - DNA, 15 bp, Homo sapiens
ttctgctctgccatc

SEQ ID NO: 6539037 - DNA, 16 bp, Homo sapiens
ttctgctctgccatct

SEQ ID NO: 6539038 - DNA, 13 bp, Homo sapiens
ttctgctctgccc

SEQ ID NO: 6539039 - DNA, 19 bp, Homo sapiens
ttctgctctgcccatgcct

SEQ ID NO: 6539040 - DNA, 18 bp, Homo sapiens
ttctgctcttccaaagct

SEQ ID NO: 6539041 - DNA, 15 bp, Homo sapiens
ttctgctcttttcct

SEQ ID NO: 6539042 - DNA, 15 bp, Homo sapiens
ttctgctgaaagact

SEQ ID NO: 6539043 - DNA, 16 bp, Homo sapiens
ttctgctgaaagactc

SEQ ID NO: 6539044 - DNA, 16 bp, Homo sapiens
ttctgctgcccaggcc

SEQ ID NO: 6539045 - DNA, 20 bp, Homo sapiens
ttctgctgcccaggccacag

SEQ ID NO: 6539046 - DNA, 14 bp, Homo sapiens
ttctgctgccctct

SEQ ID NO: 6539047 - DNA, 14 bp, Homo sapiens
ttctgctgctggcc

SEQ ID NO: 6539048 - DNA, 21 bp, Homo sapiens
tgtattatttcaccagcagca

SEQ ID NO: 6539049 - DNA, 20 bp, Homo sapiens
tgtattatttcattatgtaa

SEQ ID NO: 6539050 - DNA, 22 bp, Homo sapiens
tgtattcaaatttgtgtcatac

SEQ ID NO: 6539051 - DNA, 14 bp, Homo sapiens
tgtattcaagcaaa

SEQ ID NO: 6539052 - DNA, 21 bp, Homo sapiens
tgtattcaagcaaacatcaaa

SEQ ID NO: 6539053 - DNA, 17 bp, Homo sapiens
tgtattcacacacccct

SEQ ID NO: 6539054 - DNA, 22 bp, Homo sapiens
tgtattcacgccattggttgga

SEQ ID NO: 6539055 - DNA, 14 bp, Homo sapiens
tgtattcactaaaa

SEQ ID NO: 6539056 - DNA, 17 bp, Homo sapiens
tgtattcactaaaataa

SEQ ID NO: 6539057 - DNA, 18 bp, Homo sapiens
tgtattcactaaaataaa

SEQ ID NO: 6539058 - DNA, 17 bp, Homo sapiens
tgtattcagaggcagtg

SEQ ID NO: 6539059 - DNA, 21 bp, Homo sapiens
tgtattcagatcgtattaatt

SEQ ID NO: 6539060 - DNA, 18 bp, Homo sapiens
tgtattcataagattttt

SEQ ID NO: 6539061 - DNA, 16 bp, Homo sapiens
tgtattcatactgaca

SEQ ID NO: 6539062 - DNA, 16 bp, Homo sapiens
tgtattcatatttgta

SEQ ID NO: 6539063 - DNA, 12 bp, Homo sapiens
tgtattcatgtt

SEQ ID NO: 6539064 - DNA, 15 bp, Homo sapiens
tgtattcatgttcat

SEQ ID NO: 6539065 - DNA, 19 bp, Homo sapiens
tgtattcatgttcatgtga

SEQ ID NO: 6539066 - DNA, 22 bp, Homo sapiens
tgtattcattgaagtcagatgt

SEQ ID NO: 6539067 - DNA, 21 bp, Homo sapiens
tgtattccaagacatgtctgt

SEQ ID NO: 6539068 - DNA, 13 bp, Homo sapiens
tgtattcccttca

SEQ ID NO: 6539069 - DNA, 20 bp, Homo sapiens
tgtattcccttttatttcca

SEQ ID NO: 6539070 - DNA, 14 bp, Homo sapiens
tgtattcctttaaa

SEQ ID NO: 6539071 - DNA, 18 bp, Homo sapiens
tgtattcctttaaaatat

SEQ ID NO: 6539072 - DNA, 19 bp, Homo sapiens
tgtattcctttaaaatatt

SEQ ID NO: 6539073 - DNA, 20 bp, Homo sapiens
tgtattctagctaatgtaat

SEQ ID NO: 6539074 - DNA, 22 bp, Homo sapiens
tgtattctagctaatgtaataa

SEQ ID NO: 6539075 - DNA, 20 bp, Homo sapiens
tgtattctctcctgtacctc

SEQ ID NO: 6539076 - DNA, 14 bp, Homo sapiens
tgtattctctgagc

SEQ ID NO: 6539077 - DNA, 20 bp, Homo sapiens
tgtattctctgagctgtgca

SEQ ID NO: 6539078 - DNA, 21 bp, Homo sapiens
tgtattctctgagctgtgcag

SEQ ID NO: 6539079 - DNA, 13 bp, Homo sapiens
tgtattctctgta

SEQ ID NO: 6539080 - DNA, 21 bp, Homo sapiens
tgtattctctgtccagggctt

SEQ ID NO: 6539081 - DNA, 22 bp, Homo sapiens
tgtattctctttaccttctaaa

SEQ ID NO: 6539082 - DNA, 20 bp, Homo sapiens
tgtattctgcaacagcctgt

SEQ ID NO: 6539083 - DNA, 17 bp, Homo sapiens
tgtattctggctgcaag

SEQ ID NO: 6539084 - DNA, 14 bp, Homo sapiens
tgtattctgtaaaa

SEQ ID NO: 6539085 - DNA, 12 bp, Homo sapiens
tgtattctgtat

SEQ ID NO: 6539086 - DNA, 22 bp, Homo sapiens
tgtattctgttggccagcacgt

SEQ ID NO: 6539087 - DNA, 17 bp, Homo sapiens
tgtattcttcatgaaat

SEQ ID NO: 6539088 - DNA, 22 bp, Homo sapiens
tgtattcttctgtatttctagg

SEQ ID NO: 6539089 - DNA, 18 bp, Homo sapiens
tgtattcttgttcccgaa

SEQ ID NO: 6539090 - DNA, 15 bp, Homo sapiens
tgtattcttgtttga

SEQ ID NO: 6539091 - DNA, 16 bp, Homo sapiens
tgtattcttgtttgaa

SEQ ID NO: 6539092 - DNA, 14 bp, Homo sapiens
tgtattcttttata

SEQ ID NO: 6539093 - DNA, 20 bp, Homo sapiens
tgtattcttttatataacta

SEQ ID NO: 6539094 - DNA, 18 bp, Homo sapiens
tgtattcttttctcagtg

SEQ ID NO: 6539095 - DNA, 15 bp, Homo sapiens
tgtattgaaaacact

SEQ ID NO: 6539096 - DNA, 18 bp, Homo sapiens
tgtattgaaaacacttag

SEQ ID NO: 6539097 - DNA, 22 bp, Homo sapiens
tgtattgaacttggaaagaaat

SEQ ID NO: 6539098 - DNA, 21 bp, Homo sapiens
tgtattgaatattttattaaa

SEQ ID NO: 6539099 - DNA, 15 bp, Homo sapiens
tgtattgaatcatgt

SEQ ID NO: 6539100 - DNA, 20 bp, Homo sapiens
tgtattgaatcatgtagtat

SEQ ID NO: 6539101 - DNA, 16 bp, Homo sapiens
tgtattgactgtacca

SEQ ID NO: 6539102 - DNA, 22 bp, Homo sapiens
tgtattgactttatgttgtatg

SEQ ID NO: 6539103 - DNA, 22 bp, Homo sapiens
tgtattgagggccagtgatgat

SEQ ID NO: 6539104 - DNA, 22 bp, Homo sapiens
tgtattgagtcttaactgtatt

SEQ ID NO: 6539105 - DNA, 23 bp, Homo sapiens
tgtattgatgacagtagtaccaa

SEQ ID NO: 6539106 - DNA, 15 bp, Homo sapiens
tgtattgatgcaata

SEQ ID NO: 6539107 - DNA, 16 bp, Homo sapiens
tgtattgatgcaatat

SEQ ID NO: 6539108 - DNA, 17 bp, Homo sapiens
tgtattgatgcaatata

SEQ ID NO: 6539109 - DNA, 23 bp, Homo sapiens
tgtattgatgcaatataagcata

SEQ ID NO: 6539110 - DNA, 12 bp, Homo sapiens
tgtattgattca

SEQ ID NO: 6539111 - DNA, 21 bp, Homo sapiens
tgtattgattttcacagcttt

SEQ ID NO: 6539112 - DNA, 18 bp, Homo sapiens
tgtattgatttttaagaa

SEQ ID NO: 6539113 - DNA, 14 bp, Homo sapiens
tgtattgcacattg

SEQ ID NO: 6539114 - DNA, 19 bp, Homo sapiens
tgtattgcatatatacata

SEQ ID NO: 6539115 - DNA, 15 bp, Homo sapiens
tgtattgcatgcaat

SEQ ID NO: 6539116 - DNA, 17 bp, Homo sapiens
tgtattgcgtcttagca

SEQ ID NO: 6539117 - DNA, 17 bp, Homo sapiens
tgtattgctgctgtgcg

SEQ ID NO: 6539118 - DNA, 22 bp, Homo sapiens
tgtattgctgctgtgcgtggaa

SEQ ID NO: 6539119 - DNA, 15 bp, Homo sapiens
tgtattgcttatttt

SEQ ID NO: 6539120 - DNA, 15 bp, Homo sapiens
tgtattgcttcctga

SEQ ID NO: 6539121 - DNA, 12 bp, Homo sapiens
tgtattggaatt

SEQ ID NO: 6539122 - DNA, 19 bp, Homo sapiens
tgtattggatatataagag

SEQ ID NO: 6539123 - DNA, 13 bp, Homo sapiens
tgtattggcctgg

SEQ ID NO: 6539124 - DNA, 18 bp, Homo sapiens
tgtattgggccttttgga

SEQ ID NO: 6539125 - DNA, 22 bp, Homo sapiens
tgtattgggccttttggatatg

SEQ ID NO: 6539126 - DNA, 14 bp, Homo sapiens
tgtattgtaaaaaa

SEQ ID NO: 6539127 - DNA, 19 bp, Homo sapiens
tgtattgtaaacatgtgtt

SEQ ID NO: 6539128 - DNA, 15 bp, Homo sapiens
tgtattgtaaatgtg

SEQ ID NO: 6539129 - DNA, 16 bp, Homo sapiens
tgtattgtaaatgtgg

SEQ ID NO: 6539130 - DNA, 18 bp, Homo sapiens
tgtattgtaaatgtggat

SEQ ID NO: 6539131 - DNA, 11 bp, Homo sapiens
tgtattgtaat

SEQ ID NO: 6539132 - DNA, 17 bp, Homo sapiens
tgtattgtaatctttca

SEQ ID NO: 6539133 - DNA, 17 bp, Homo sapiens
tgtattgtacataaaat

SEQ ID NO: 6539134 - DNA, 16 bp, Homo sapiens
tgtattgtatattaca

SEQ ID NO: 6539135 - DNA, 21 bp, Homo sapiens
tgtattgtatattacaatgat

SEQ ID NO: 6539136 - DNA, 14 bp, Homo sapiens
tgtattgtcctatt

SEQ ID NO: 6539137 - DNA, 16 bp, Homo sapiens
tgtattgtctgacaca

SEQ ID NO: 6539138 - DNA, 18 bp, Homo sapiens
tgtattgtgcaatgtgta

SEQ ID NO: 6539139 - DNA, 20 bp, Homo sapiens
tgtattgtgcaatgtgtata

SEQ ID NO: 6539140 - DNA, 21 bp, Homo sapiens
tgtattgtgcgctaaactttt

SEQ ID NO: 6539141 - DNA, 12 bp, Homo sapiens
tgtattgttaat

SEQ ID NO: 6539142 - DNA, 19 bp, Homo sapiens
tgtattgttcccagtgaca

SEQ ID NO: 6539143 - DNA, 22 bp, Homo sapiens
tgtattgttgaaaaagtttgtt

SEQ ID NO: 6539144 - DNA, 16 bp, Homo sapiens
tgtattgttttactcc

SEQ ID NO: 6539145 - DNA, 23 bp, Homo sapiens
tgtattgttttactcctttttat

SEQ ID NO: 6539146 - DNA, 16 bp, Homo sapiens
tgtattgttttcccaa

SEQ ID NO: 6539147 - DNA, 21 bp, Homo sapiens
tgtatttaaaaaaaagaaact

SEQ ID NO: 6539148 - DNA, 17 bp, Homo sapiens
tgtatttaaaaacaaaa

SEQ ID NO: 6539149 - DNA, 17 bp, Homo sapiens
tgtatttaaaaacattt

SEQ ID NO: 6539150 - DNA, 22 bp, Homo sapiens
tgtatttaaaaagaaacagaaa

SEQ ID NO: 6539151 - DNA, 14 bp, Homo sapiens
tgtatttaaaacat

SEQ ID NO: 6539152 - DNA, 22 bp, Homo sapiens
tgtatttaaaacatttcatgta

SEQ ID NO: 6539153 - DNA, 15 bp, Homo sapiens
tgtatttaacagaaa

SEQ ID NO: 6539154 - DNA, 18 bp, Homo sapiens
tgtatttaacagggaggg

SEQ ID NO: 6539155 - DNA, 12 bp, Homo sapiens
tgtatttaagaa

SEQ ID NO: 6539156 - DNA, 15 bp, Homo sapiens
tgtatttaagacata

SEQ ID NO: 6539157 - DNA, 12 bp, Homo sapiens
tgtatttaagca

SEQ ID NO: 6539158 - DNA, 16 bp, Homo sapiens
tgtatttaagcaaata

SEQ ID NO: 6539159 - DNA, 19 bp, Homo sapiens
tgtatttaagcaaatactt

SEQ ID NO: 6539160 - DNA, 22 bp, Homo sapiens
tgtatttaatacacaatgcatc

SEQ ID NO: 6539161 - DNA, 14 bp, Homo sapiens
tgtatttaatgatt

SEQ ID NO: 6539162 - DNA, 16 bp, Homo sapiens
tgtatttaatgatttt

SEQ ID NO: 6539163 - DNA, 12 bp, Homo sapiens
tgtatttaatgt

SEQ ID NO: 6539164 - DNA, 16 bp, Homo sapiens
tgtatttaattataaa

SEQ ID NO: 6539165 - DNA, 20 bp, Homo sapiens
tgtatttaattcttcacctt

SEQ ID NO: 6539166 - DNA, 18 bp, Homo sapiens
tgtatttaattgtaaact

SEQ ID NO: 6539167 - DNA, 19 bp, Homo sapiens
tgtatttaattgtaaactg

SEQ ID NO: 6539168 - DNA, 22 bp, Homo sapiens
tgtatttaattgtaaactgtac

SEQ ID NO: 6539169 - DNA, 17 bp, Homo sapiens
tgtatttagtaaaaata

SEQ ID NO: 6539170 - DNA, 14 bp, Homo sapiens
tgtatttagtgaca

SEQ ID NO: 6539171 - DNA, 21 bp, Homo sapiens
tgtatttataaatatatttaa

SEQ ID NO: 6539172 - DNA, 16 bp, Homo sapiens
tgtatttataatttaa

SEQ ID NO: 6539173 - DNA, 19 bp, Homo sapiens
tgtatttataatttaaatg

SEQ ID NO: 6539174 - DNA, 20 bp, Homo sapiens
tgtatttatatataaaaaga

SEQ ID NO: 6539175 - DNA, 13 bp, Homo sapiens
tgtatttatgtgt

SEQ ID NO: 6539176 - DNA, 16 bp, Homo sapiens
tgtatttatgtgtata

SEQ ID NO: 6539177 - DNA, 20 bp, Homo sapiens
tgtatttatgtgtatatttg

SEQ ID NO: 6539178 - DNA, 16 bp, Homo sapiens
tgtatttattatttga

SEQ ID NO: 6539179 - DNA, 14 bp, Homo sapiens
tgtatttattcaat

SEQ ID NO: 6539180 - DNA, 19 bp, Homo sapiens
tgtatttattcaataaagt

SEQ ID NO: 6539181 - DNA, 14 bp, Homo sapiens
tgtatttattccat

SEQ ID NO: 6539182 - DNA, 15 bp, Homo sapiens
tgtatttattctttt

SEQ ID NO: 6539183 - DNA, 15 bp, Homo sapiens
tgtatttatttaaaa

SEQ ID NO: 6539184 - DNA, 17 bp, Homo sapiens
tgtatttatttaaaact

SEQ ID NO: 6539185 - DNA, 18 bp, Homo sapiens
tgtatttatttaaaactc

SEQ ID NO: 6539186 - DNA, 16 bp, Homo sapiens
tgtatttatttaaaag

SEQ ID NO: 6539187 - DNA, 20 bp, Homo sapiens
tgtatttatttaaaagattc

SEQ ID NO: 6539188 - DNA, 20 bp, Homo sapiens
tgtatttatttagtatttat

SEQ ID NO: 6539189 - DNA, 15 bp, Homo sapiens
tgtatttcagggacc

SEQ ID NO: 6539190 - DNA, 22 bp, Homo sapiens
tgtatttcagggacctcagggg

SEQ ID NO: 6539191 - DNA, 13 bp, Homo sapiens
tgtatttcagtat

SEQ ID NO: 6539192 - DNA, 15 bp, Homo sapiens
tgtatttccaacaaa

SEQ ID NO: 6539193 - DNA, 23 bp, Homo sapiens
tgtatttccccaacatgtaataa

SEQ ID NO: 6539194 - DNA, 12 bp, Homo sapiens
tgtatttcctga

SEQ ID NO: 6539195 - DNA, 19 bp, Homo sapiens
tgtatttcctgaaataaat

SEQ ID NO: 6539196 - DNA, 15 bp, Homo sapiens
tgtatttctaagaag

SEQ ID NO: 6539197 - DNA, 18 bp, Homo sapiens
tgtatttctatacagtag

SEQ ID NO: 6539198 - DNA, 21 bp, Homo sapiens
tgtatttctccatcctgcaga

SEQ ID NO: 6539199 - DNA, 14 bp, Homo sapiens
tgtatttctctgtg

SEQ ID NO: 6539200 - DNA, 15 bp, Homo sapiens
tgtatttctctgtga

SEQ ID NO: 6539201 - DNA, 16 bp, Homo sapiens
tgtatttctctgtgaa

SEQ ID NO: 6539202 - DNA, 12 bp, Homo sapiens
tgtatttctgta

SEQ ID NO: 6539203 - DNA, 13 bp, Homo sapiens
tgtatttctgtag

SEQ ID NO: 6539204 - DNA, 17 bp, Homo sapiens
tgtatttctgtagaatg

SEQ ID NO: 6539205 - DNA, 21 bp, Homo sapiens
tgtatttctgtggaaaacaat

SEQ ID NO: 6539206 - DNA, 19 bp, Homo sapiens
tgtatttcttaagaattca

SEQ ID NO: 6539207 - DNA, 13 bp, Homo sapiens
tgtatttcttata

SEQ ID NO: 6539208 - DNA, 15 bp, Homo sapiens
tgtatttctttagaa

SEQ ID NO: 6539209 - DNA, 14 bp, Homo sapiens
tgtatttcttttat

SEQ ID NO: 6539210 - DNA, 19 bp, Homo sapiens
tgtatttcttttatatata

SEQ ID NO: 6539211 - DNA, 23 bp, Homo sapiens
tgtatttcttttatatataaaat

SEQ ID NO: 6539212 - DNA, 22 bp, Homo sapiens
tgtatttgaaaattacatgttt

SEQ ID NO: 6539213 - DNA, 20 bp, Homo sapiens
tgtatttgagaagataatca

SEQ ID NO: 6539214 - DNA, 14 bp, Homo sapiens
tgtatttgagagac

SEQ ID NO: 6539215 - DNA, 15 bp, Homo sapiens
tgtatttgagagact

SEQ ID NO: 6539216 - DNA, 20 bp, Homo sapiens
tgtatttgagagactgccat

SEQ ID NO: 6539217 - DNA, 15 bp, Homo sapiens
tgtatttgaggaaac

SEQ ID NO: 6539218 - DNA, 23 bp, Homo sapiens
tgtatttgaggaaactcatacag

SEQ ID NO: 6539219 - DNA, 15 bp, Homo sapiens
tgtatttgatgtctt

SEQ ID NO: 6539220 - DNA, 13 bp, Homo sapiens
tgtatttgctaat

SEQ ID NO: 6539221 - DNA, 20 bp, Homo sapiens
tgtatttgctgccagacact

SEQ ID NO: 6539222 - DNA, 13 bp, Homo sapiens
tgtatttggaaat

SEQ ID NO: 6539223 - DNA, 23 bp, Homo sapiens
tgtatttggaatatttgaataat

SEQ ID NO: 6539224 - DNA, 14 bp, Homo sapiens
tgtatttgtagtgt

SEQ ID NO: 6539225 - DNA, 17 bp, Homo sapiens
tgtatttgtatgtactg

SEQ ID NO: 6539226 - DNA, 23 bp, Homo sapiens
ttctgctgcttgagttgcctgat

SEQ ID NO: 6539227 - DNA, 13 bp, Homo sapiens
ttctgctggataa

SEQ ID NO: 6539228 - DNA, 12 bp, Homo sapiens
ttctgctggcct

SEQ ID NO: 6539229 - DNA, 20 bp, Homo sapiens
ttctgctggcctctgcgagt

SEQ ID NO: 6539230 - DNA, 19 bp, Homo sapiens
ttctgctggcctggatctc

SEQ ID NO: 6539231 - DNA, 13 bp, Homo sapiens
ttctgctgggctg

SEQ ID NO: 6539232 - DNA, 21 bp, Homo sapiens
ttctgctggggcctgggacaa

SEQ ID NO: 6539233 - DNA, 13 bp, Homo sapiens
ttctgctgtttaa

SEQ ID NO: 6539234 - DNA, 20 bp, Homo sapiens
ttctgcttaaagttgtaaca

SEQ ID NO: 6539235 - DNA, 17 bp, Homo sapiens
ttctgcttatttcatct

SEQ ID NO: 6539236 - DNA, 19 bp, Homo sapiens
ttctgcttatttcatctgt

SEQ ID NO: 6539237 - DNA, 17 bp, Homo sapiens
ttctgcttccacatgtg

SEQ ID NO: 6539238 - DNA, 19 bp, Homo sapiens
ttctgcttccgtattttaa

SEQ ID NO: 6539239 - DNA, 12 bp, Homo sapiens
ttctgcttctcc

SEQ ID NO: 6539240 - DNA, 17 bp, Homo sapiens
ttctgcttgagaatatt

SEQ ID NO: 6539241 - DNA, 16 bp, Homo sapiens
ttctgcttgtgacatt

SEQ ID NO: 6539242 - DNA, 13 bp, Homo sapiens
ttctgctttagac

SEQ ID NO: 6539243 - DNA, 14 bp, Homo sapiens
ttctgctttcactt

SEQ ID NO: 6539244 - DNA, 14 bp, Homo sapiens
ttctgctttctccc

SEQ ID NO: 6539245 - DNA, 15 bp, Homo sapiens
ttctgctttctgcct

SEQ ID NO: 6539246 - DNA, 20 bp, Homo sapiens
ttctgctttgttgtgtgcct

SEQ ID NO: 6539247 - DNA, 22 bp, Homo sapiens
ttctgctttgttgtgtgcctct

SEQ ID NO: 6539248 - DNA, 19 bp, Homo sapiens
ttctggaaaaaaaatatat

SEQ ID NO: 6539249 - DNA, 21 bp, Homo sapiens
ttctggaaaaaaaatatatat

SEQ ID NO: 6539250 - DNA, 15 bp, Homo sapiens
ttctggaaaatgctt

SEQ ID NO: 6539251 - DNA, 17 bp, Homo sapiens
ttctggaaaatgcttct

SEQ ID NO: 6539252 - DNA, 17 bp, Homo sapiens
ttctggaaaccaaatag

SEQ ID NO: 6539253 - DNA, 11 bp, Homo sapiens
ttctggaaatt

SEQ ID NO: 6539254 - DNA, 19 bp, Homo sapiens
ttctggaagactgctcccg

SEQ ID NO: 6539255 - DNA, 19 bp, Homo sapiens
ttctggaatacatgaaata

SEQ ID NO: 6539256 - DNA, 12 bp, Homo sapiens
ttctggaatgct

SEQ ID NO: 6539257 - DNA, 16 bp, Homo sapiens
ttctggaatggaattg

SEQ ID NO: 6539258 - DNA, 23 bp, Homo sapiens
ttctggaattgatgtttacatgt

SEQ ID NO: 6539259 - DNA, 23 bp, Homo sapiens
ttctggaattgggctccgtggtg

SEQ ID NO: 6539260 - DNA, 20 bp, Homo sapiens
ttctggaatttacctcccct

SEQ ID NO: 6539261 - DNA, 14 bp, Homo sapiens
ttctggaatttgtt

SEQ ID NO: 6539262 - DNA, 18 bp, Homo sapiens
ttctggaatttgttcaag

SEQ ID NO: 6539263 - DNA, 19 bp, Homo sapiens
ttctggacagtcagctctt

SEQ ID NO: 6539264 - DNA, 22 bp, Homo sapiens
ttctggacagtcagctcttcat

SEQ ID NO: 6539265 - DNA, 13 bp, Homo sapiens
ttctggacattct

SEQ ID NO: 6539266 - DNA, 19 bp, Homo sapiens
ttctggacccgttcaactt

SEQ ID NO: 6539267 - DNA, 19 bp, Homo sapiens
ttctggacccttataaaat

SEQ ID NO: 6539268 - DNA, 20 bp, Homo sapiens
ttctggactacacccaagcc

SEQ ID NO: 6539269 - DNA, 15 bp, Homo sapiens
ttctggactctggac

SEQ ID NO: 6539270 - DNA, 21 bp, Homo sapiens
ttctggactggcgttcacctc

SEQ ID NO: 6539271 - DNA, 19 bp, Homo sapiens
ttctggacttggtcttgaa

SEQ ID NO: 6539272 - DNA, 14 bp, Homo sapiens
ttctggagacagaa

SEQ ID NO: 6539273 - DNA, 22 bp, Homo sapiens
ttctggagatggaagcttgttg

SEQ ID NO: 6539274 - DNA, 21 bp, Homo sapiens
ttctggagcaatctgaccctt

SEQ ID NO: 6539275 - DNA, 10 bp, Homo sapiens
ttctggagcc

SEQ ID NO: 6539276 - DNA, 13 bp, Homo sapiens
ttctggagccctt

SEQ ID NO: 6539277 - DNA, 18 bp, Homo sapiens
ttctggagctgctgttcc

SEQ ID NO: 6539278 - DNA, 22 bp, Homo sapiens
ttctggagctgctgttccaaca

SEQ ID NO: 6539279 - DNA, 14 bp, Homo sapiens
ttctggagctggga

SEQ ID NO: 6539280 - DNA, 14 bp, Homo sapiens
ttctggaggggcag

SEQ ID NO: 6539281 - DNA, 18 bp, Homo sapiens
ttctggaggtggggaggg

SEQ ID NO: 6539282 - DNA, 21 bp, Homo sapiens
ttctggaggtggggagggcct

SEQ ID NO: 6539283 - DNA, 20 bp, Homo sapiens
ttctggaggttgataacttt

SEQ ID NO: 6539284 - DNA, 15 bp, Homo sapiens
ttctggagtctccag

SEQ ID NO: 6539285 - DNA, 18 bp, Homo sapiens
ttctggagtgattctaga

SEQ ID NO: 6539286 - DNA, 14 bp, Homo sapiens
ttctggagtttctc

SEQ ID NO: 6539287 - DNA, 18 bp, Homo sapiens
ttctggataaaccaccct

SEQ ID NO: 6539288 - DNA, 20 bp, Homo sapiens
ttctggatagagtcctggga

SEQ ID NO: 6539289 - DNA, 15 bp, Homo sapiens
ttctggatatagcta

SEQ ID NO: 6539290 - DNA, 14 bp, Homo sapiens
ttctggatctcctg

SEQ ID NO: 6539291 - DNA, 15 bp, Homo sapiens
ttctggatgcatttc

SEQ ID NO: 6539292 - DNA, 20 bp, Homo sapiens
ttctggatgcatttctctgg

SEQ ID NO: 6539293 - DNA, 15 bp, Homo sapiens
ttctggatggcatct

SEQ ID NO: 6539294 - DNA, 23 bp, Homo sapiens
ttctggatggccgggctgctgct

SEQ ID NO: 6539295 - DNA, 19 bp, Homo sapiens
ttctggattagaatgccgg

SEQ ID NO: 6539296 - DNA, 21 bp, Homo sapiens
ttctggattttcccctgaaga

SEQ ID NO: 6539297 - DNA, 23 bp, Homo sapiens
ttctggattttcccctgaagact

SEQ ID NO: 6539298 - DNA, 11 bp, Homo sapiens
ttctggcaaat

SEQ ID NO: 6539299 - DNA, 19 bp, Homo sapiens
ttctggcaaatattttgtc

SEQ ID NO: 6539300 - DNA, 15 bp, Homo sapiens
ttctggcaagagcag

SEQ ID NO: 6539301 - DNA, 23 bp, Homo sapiens
ttctggcagatgtaggtaaagag

SEQ ID NO: 6539302 - DNA, 17 bp, Homo sapiens
ttctggcaggtcctccc

SEQ ID NO: 6539303 - DNA, 20 bp, Homo sapiens
ttctggcataactaaaatta

SEQ ID NO: 6539304 - DNA, 17 bp, Homo sapiens
ttctggcattttctgtt

SEQ ID NO: 6539305 - DNA, 20 bp, Homo sapiens
ttctggcattttctgttcca

SEQ ID NO: 6539306 - DNA, 16 bp, Homo sapiens
ttctggccagtgttta

SEQ ID NO: 6539307 - DNA, 17 bp, Homo sapiens
ttctggccagtgtttaa

SEQ ID NO: 6539308 - DNA, 21 bp, Homo sapiens
ttctggccagtgtttaaaact

SEQ ID NO: 6539309 - DNA, 22 bp, Homo sapiens
ttctggccagtgtttaaaactt

SEQ ID NO: 6539310 - DNA, 19 bp, Homo sapiens
ttctggccggtgctgggtt

SEQ ID NO: 6539311 - DNA, 22 bp, Homo sapiens
ttctggcctccagcctttgctc

SEQ ID NO: 6539312 - DNA, 14 bp, Homo sapiens
ttctggcctcccac

SEQ ID NO: 6539313 - DNA, 15 bp, Homo sapiens
ttctggcctcccaca

SEQ ID NO: 6539314 - DNA, 12 bp, Homo sapiens
ttctggcctcct

SEQ ID NO: 6539315 - DNA, 18 bp, Homo sapiens
ttctggcctctggcctgg

SEQ ID NO: 6539316 - DNA, 20 bp, Homo sapiens
ttctggcctctggcctggga

SEQ ID NO: 6539317 - DNA, 20 bp, Homo sapiens
ttctggcctttcctctctcc

SEQ ID NO: 6539318 - DNA, 21 bp, Homo sapiens
ttctggcctttcctctctcct

SEQ ID NO: 6539319 - DNA, 17 bp, Homo sapiens
ttctggcgcccctgcct

SEQ ID NO: 6539320 - DNA, 18 bp, Homo sapiens
ttctggcgcccctgcctg

SEQ ID NO: 6539321 - DNA, 15 bp, Homo sapiens
ttctggctcttccag

SEQ ID NO: 6539322 - DNA, 16 bp, Homo sapiens
ttctggctcttccagg

SEQ ID NO: 6539323 - DNA, 17 bp, Homo sapiens
ttctggctcttccaggc

SEQ ID NO: 6539324 - DNA, 20 bp, Homo sapiens
ttctggctgccccaacctgc

SEQ ID NO: 6539325 - DNA, 13 bp, Homo sapiens
ttctggctgggga

SEQ ID NO: 6539326 - DNA, 16 bp, Homo sapiens
ttctggcttcagcccc

SEQ ID NO: 6539327 - DNA, 16 bp, Homo sapiens
ttctggctttttgaat

SEQ ID NO: 6539328 - DNA, 15 bp, Homo sapiens
ttctgggaaaggtgc

SEQ ID NO: 6539329 - DNA, 18 bp, Homo sapiens
ttctgggaaaggtgctca

SEQ ID NO: 6539330 - DNA, 19 bp, Homo sapiens
ttctgggaaaggtgctcaa

SEQ ID NO: 6539331 - DNA, 20 bp, Homo sapiens
ttctgggaaaggtgctcaaa

SEQ ID NO: 6539332 - DNA, 22 bp, Homo sapiens
ttctgggacacagttcaattct

SEQ ID NO: 6539333 - DNA, 22 bp, Homo sapiens
ttctgggacaggcaccatgctg

SEQ ID NO: 6539334 - DNA, 22 bp, Homo sapiens
ttctgggagacacccaaagggt

SEQ ID NO: 6539335 - DNA, 22 bp, Homo sapiens
ttctgggagctcaaggccacct

SEQ ID NO: 6539336 - DNA, 23 bp, Homo sapiens
ttctgggatatatggaggattct

SEQ ID NO: 6539337 - DNA, 16 bp, Homo sapiens
ttctgggatgtcacag

SEQ ID NO: 6539338 - DNA, 20 bp, Homo sapiens
ttctgggcaccacaaaatat

SEQ ID NO: 6539339 - DNA, 11 bp, Homo sapiens
ttctgggcaga

SEQ ID NO: 6539340 - DNA, 22 bp, Homo sapiens
ttctgggcagatgaaaagctac

SEQ ID NO: 6539341 - DNA, 23 bp, Homo sapiens
ttctgggcatggcagggccaggc

SEQ ID NO: 6539342 - DNA, 15 bp, Homo sapiens
ttctgggcctgacca

SEQ ID NO: 6539343 - DNA, 11 bp, Homo sapiens
ttctgggctct

SEQ ID NO: 6539344 - DNA, 15 bp, Homo sapiens
ttctgggctctgcca

SEQ ID NO: 6539345 - DNA, 13 bp, Homo sapiens
ttctgggctctgg

SEQ ID NO: 6539346 - DNA, 12 bp, Homo sapiens
ttctgggctctt

SEQ ID NO: 6539347 - DNA, 14 bp, Homo sapiens
ttctgggctggggc

SEQ ID NO: 6539348 - DNA, 19 bp, Homo sapiens
ttctgggcttggggtgtgg

SEQ ID NO: 6539349 - DNA, 22 bp, Homo sapiens
ttctgggctttctcctggagat

SEQ ID NO: 6539350 - DNA, 15 bp, Homo sapiens
ttctggggaaaaaaa

SEQ ID NO: 6539351 - DNA, 22 bp, Homo sapiens
ttctggggaaaaaaaagagact

SEQ ID NO: 6539352 - DNA, 19 bp, Homo sapiens
ttctggggagggacacaga

SEQ ID NO: 6539353 - DNA, 18 bp, Homo sapiens
ttctggggccagcccctc

SEQ ID NO: 6539354 - DNA, 13 bp, Homo sapiens
ttctggggcccag

SEQ ID NO: 6539355 - DNA, 14 bp, Homo sapiens
ttctggggcccagg

SEQ ID NO: 6539356 - DNA, 15 bp, Homo sapiens
ttctggggcccagga

SEQ ID NO: 6539357 - DNA, 23 bp, Homo sapiens
ttctggggcccaggaagcccaca

SEQ ID NO: 6539358 - DNA, 23 bp, Homo sapiens
ttctgggggatttcaagggactg

SEQ ID NO: 6539359 - DNA, 14 bp, Homo sapiens
ttctgggtaattca

SEQ ID NO: 6539360 - DNA, 17 bp, Homo sapiens
ttctgggtcttttgcta

SEQ ID NO: 6539361 - DNA, 10 bp, Homo sapiens
ttctgggtga

SEQ ID NO: 6539362 - DNA, 20 bp, Homo sapiens
ttctgggtgataattttgaa

SEQ ID NO: 6539363 - DNA, 18 bp, Homo sapiens
ttctgggtggcctcggga

SEQ ID NO: 6539364 - DNA, 21 bp, Homo sapiens
ttctgggtggctcctgccact

SEQ ID NO: 6539365 - DNA, 17 bp, Homo sapiens
ttctgggtgttgaccac

SEQ ID NO: 6539366 - DNA, 18 bp, Homo sapiens
ttctgggtttgaagctgc

SEQ ID NO: 6539367 - DNA, 23 bp, Homo sapiens
ttctgggtttgcccagtcctggg

SEQ ID NO: 6539368 - DNA, 16 bp, Homo sapiens
ttctggtaaaaagaaa

SEQ ID NO: 6539369 - DNA, 14 bp, Homo sapiens
ttctggtaacctgt

SEQ ID NO: 6539370 - DNA, 22 bp, Homo sapiens
ttctggtaagactgctggttga

SEQ ID NO: 6539371 - DNA, 11 bp, Homo sapiens
ttctggtaatc

SEQ ID NO: 6539372 - DNA, 15 bp, Homo sapiens
ttctggtactctcct

SEQ ID NO: 6539373 - DNA, 19 bp, Homo sapiens
ttctggtagatagaaataa

SEQ ID NO: 6539374 - DNA, 19 bp, Homo sapiens
ttctggtccctcttctctc

SEQ ID NO: 6539375 - DNA, 13 bp, Homo sapiens
ttctggtcctgtt

SEQ ID NO: 6539376 - DNA, 16 bp, Homo sapiens
ttctggtcctttttgg

SEQ ID NO: 6539377 - DNA, 14 bp, Homo sapiens
ttctggtctctcta

SEQ ID NO: 6539378 - DNA, 20 bp, Homo sapiens
ttctggtctgtgtgtgttct

SEQ ID NO: 6539379 - DNA, 17 bp, Homo sapiens
ttctggtcttcactgcc

SEQ ID NO: 6539380 - DNA, 18 bp, Homo sapiens
ttctggtcttcactgcca

SEQ ID NO: 6539381 - DNA, 15 bp, Homo sapiens
ttctggtgaccagac

SEQ ID NO: 6539382 - DNA, 17 bp, Homo sapiens
ttctggtgaccagactt

SEQ ID NO: 6539383 - DNA, 17 bp, Homo sapiens
ttctggtgcatgttctt

SEQ ID NO: 6539384 - DNA, 22 bp, Homo sapiens
ttctggtgctactccatgcagg

SEQ ID NO: 6539385 - DNA, 13 bp, Homo sapiens
ttctggtggcccc

SEQ ID NO: 6539386 - DNA, 14 bp, Homo sapiens
ttctggtggcccca

SEQ ID NO: 6539387 - DNA, 18 bp, Homo sapiens
ttctggtggggctgtcct

SEQ ID NO: 6539388 - DNA, 19 bp, Homo sapiens
ttctggtggggctgtcctg

SEQ ID NO: 6539389 - DNA, 22 bp, Homo sapiens
ttctggtggggctgtcctgctg

SEQ ID NO: 6539390 - DNA, 18 bp, Homo sapiens
ttctggtgtatattttaa

SEQ ID NO: 6539391 - DNA, 21 bp, Homo sapiens
ttctggtgtgaactaaacttt

SEQ ID NO: 6539392 - DNA, 16 bp, Homo sapiens
ttctggtgttacacat

SEQ ID NO: 6539393 - DNA, 19 bp, Homo sapiens
ttctggtgttgactggact

SEQ ID NO: 6539394 - DNA, 18 bp, Homo sapiens
ttctggtgttggacaagc

SEQ ID NO: 6539395 - DNA, 16 bp, Homo sapiens
ttctggttacaattta

SEQ ID NO: 6539396 - DNA, 19 bp, Homo sapiens
ttctggttagctcagcccc

SEQ ID NO: 6539397 - DNA, 23 bp, Homo sapiens
ttctggttatttatggtttctgt

SEQ ID NO: 6539398 - DNA, 15 bp, Homo sapiens
ttctggttccagggt

SEQ ID NO: 6539399 - DNA, 17 bp, Homo sapiens
ttctggttccagggtcc

SEQ ID NO: 6539400 - DNA, 12 bp, Homo sapiens
ttctggttctaa

SEQ ID NO: 6539401 - DNA, 16 bp, Homo sapiens
ttctggttgcttcaga

SEQ ID NO: 6539402 - DNA, 19 bp, Homo sapiens
ttctggttgtttttaaaca

SEQ ID NO: 6539403 - DNA, 17 bp, Homo sapiens
ttctggtttaaacttgt

SEQ ID NO: 6539404 - DNA, 15 bp, Homo sapiens
tgtatttgtattaat

SEQ ID NO: 6539405 - DNA, 17 bp, Homo sapiens
tgtatttgtattaataa

SEQ ID NO: 6539406 - DNA, 15 bp, Homo sapiens
tgtatttgtattccc

SEQ ID NO: 6539407 - DNA, 16 bp, Homo sapiens
tgtatttgtattctct

SEQ ID NO: 6539408 - DNA, 13 bp, Homo sapiens
tgtatttgttaat

SEQ ID NO: 6539409 - DNA, 18 bp, Homo sapiens
tgtatttgttaatggttt

SEQ ID NO: 6539410 - DNA, 20 bp, Homo sapiens
tgtatttgttaatggtttga

SEQ ID NO: 6539411 - DNA, 20 bp, Homo sapiens
tgtatttgttatttattaaa

SEQ ID NO: 6539412 - DNA, 18 bp, Homo sapiens
tgtatttgttcatgtttg

SEQ ID NO: 6539413 - DNA, 15 bp, Homo sapiens
tgtatttgtttgcat

SEQ ID NO: 6539414 - DNA, 18 bp, Homo sapiens
tgtattttaaaagaatga

SEQ ID NO: 6539415 - DNA, 18 bp, Homo sapiens
tgtattttaacactttgt

SEQ ID NO: 6539416 - DNA, 20 bp, Homo sapiens
tgtattttaacactttgtat

SEQ ID NO: 6539417 - DNA, 15 bp, Homo sapiens
tgtattttaactcat

SEQ ID NO: 6539418 - DNA, 13 bp, Homo sapiens
tgtattttaataa

SEQ ID NO: 6539419 - DNA, 23 bp, Homo sapiens
tgtattttagatatattctctaa

SEQ ID NO: 6539420 - DNA, 18 bp, Homo sapiens
tgtattttatgtatgttt

SEQ ID NO: 6539421 - DNA, 13 bp, Homo sapiens
tgtattttatgtt

SEQ ID NO: 6539422 - DNA, 14 bp, Homo sapiens
tgtattttattgta

SEQ ID NO: 6539423 - DNA, 19 bp, Homo sapiens
tgtattttatttagacaag

SEQ ID NO: 6539424 - DNA, 22 bp, Homo sapiens
tgtattttatttagacaagaga

SEQ ID NO: 6539425 - DNA, 15 bp, Homo sapiens
tgtattttcaaatgt

SEQ ID NO: 6539426 - DNA, 22 bp, Homo sapiens
tgtattttcatttaactacaaa

SEQ ID NO: 6539427 - DNA, 11 bp, Homo sapiens
tgtattttcca

SEQ ID NO: 6539428 - DNA, 13 bp, Homo sapiens
tgtattttccaag

SEQ ID NO: 6539429 - DNA, 21 bp, Homo sapiens
tgtattttccaagtgtgcata

SEQ ID NO: 6539430 - DNA, 23 bp, Homo sapiens
tgtattttccaagtgtgcatatt

SEQ ID NO: 6539431 - DNA, 13 bp, Homo sapiens
tgtattttccacc

SEQ ID NO: 6539432 - DNA, 13 bp, Homo sapiens
tgtattttcctgg

SEQ ID NO: 6539433 - DNA, 14 bp, Homo sapiens
tgtattttcctgga

SEQ ID NO: 6539434 - DNA, 15 bp, Homo sapiens
tgtattttctgtcac

SEQ ID NO: 6539435 - DNA, 14 bp, Homo sapiens
tgtattttctgtgt

SEQ ID NO: 6539436 - DNA, 21 bp, Homo sapiens
tgtattttctgtgttgttcat

SEQ ID NO: 6539437 - DNA, 15 bp, Homo sapiens
tgtattttctttcac

SEQ ID NO: 6539438 - DNA, 21 bp, Homo sapiens
tgtattttcttttatatctgt

SEQ ID NO: 6539439 - DNA, 15 bp, Homo sapiens
tgtattttgaaaaca

SEQ ID NO: 6539440 - DNA, 17 bp, Homo sapiens
tgtattttgaaaacact

SEQ ID NO: 6539441 - DNA, 18 bp, Homo sapiens
tgtattttgaaaacactt

SEQ ID NO: 6539442 - DNA, 13 bp, Homo sapiens
tgtattttgaaat

SEQ ID NO: 6539443 - DNA, 13 bp, Homo sapiens
tgtattttgaaga

SEQ ID NO: 6539444 - DNA, 22 bp, Homo sapiens
tgtattttgaagaatatttaag

SEQ ID NO: 6539445 - DNA, 14 bp, Homo sapiens
tgtattttgatgag

SEQ ID NO: 6539446 - DNA, 14 bp, Homo sapiens
tgtattttgcatac

SEQ ID NO: 6539447 - DNA, 22 bp, Homo sapiens
tgtattttggaggtgcttgatc

SEQ ID NO: 6539448 - DNA, 18 bp, Homo sapiens
tgtattttggctttctcc

SEQ ID NO: 6539449 - DNA, 17 bp, Homo sapiens
tgtattttgtaaactga

SEQ ID NO: 6539450 - DNA, 15 bp, Homo sapiens
tgtattttgtccaag

SEQ ID NO: 6539451 - DNA, 14 bp, Homo sapiens
tgtattttgtgtga

SEQ ID NO: 6539452 - DNA, 16 bp, Homo sapiens
tgtattttgttaaagc

SEQ ID NO: 6539453 - DNA, 18 bp, Homo sapiens
tgtattttgttttccttt

SEQ ID NO: 6539454 - DNA, 20 bp, Homo sapiens
tgtatttttaaattctgctc

SEQ ID NO: 6539455 - DNA, 14 bp, Homo sapiens
tgtatttttaatgg

SEQ ID NO: 6539456 - DNA, 21 bp, Homo sapiens
tgtatttttactattgaactg

SEQ ID NO: 6539457 - DNA, 21 bp, Homo sapiens
tgtatttttagtagagacagg

SEQ ID NO: 6539458 - DNA, 19 bp, Homo sapiens
tgtatttttattttcctgt

SEQ ID NO: 6539459 - DNA, 21 bp, Homo sapiens
tgtatttttatttttgcacaa

SEQ ID NO: 6539460 - DNA, 21 bp, Homo sapiens
tgtatttttcaaggcatttat

SEQ ID NO: 6539461 - DNA, 18 bp, Homo sapiens
tgtatttttcatctttaa

SEQ ID NO: 6539462 - DNA, 21 bp, Homo sapiens
tgtatttttcctctttcactt

SEQ ID NO: 6539463 - DNA, 18 bp, Homo sapiens
tgtatttttctaaactcc

SEQ ID NO: 6539464 - DNA, 19 bp, Homo sapiens
tgtatttttctacattatt

SEQ ID NO: 6539465 - DNA, 14 bp, Homo sapiens
tgtatttttcttgc

SEQ ID NO: 6539466 - DNA, 21 bp, Homo sapiens
tgtatttttcttgctgttcag

SEQ ID NO: 6539467 - DNA, 23 bp, Homo sapiens
tgtatttttgattgttatgtaaa

SEQ ID NO: 6539468 - DNA, 16 bp, Homo sapiens
tgtatttttgttagtt

SEQ ID NO: 6539469 - DNA, 22 bp, Homo sapiens
tgtatttttgttgcagtgtagt

SEQ ID NO: 6539470 - DNA, 14 bp, Homo sapiens
tgtattttttaaaa

SEQ ID NO: 6539471 - DNA, 21 bp, Homo sapiens
tgtattttttaaaacactaaa

SEQ ID NO: 6539472 - DNA, 21 bp, Homo sapiens
tgtattttttaaaattgattt

SEQ ID NO: 6539473 - DNA, 22 bp, Homo sapiens
tgtattttttaaaattgatttt

SEQ ID NO: 6539474 - DNA, 20 bp, Homo sapiens
tgtattttttatttacattt

SEQ ID NO: 6539475 - DNA, 22 bp, Homo sapiens
tgtattttttatttacatttta

SEQ ID NO: 6539476 - DNA, 18 bp, Homo sapiens
tgtattttttcatagtcc

SEQ ID NO: 6539477 - DNA, 13 bp, Homo sapiens
tgtattttttcct

SEQ ID NO: 6539478 - DNA, 14 bp, Homo sapiens
tgtattttttcctt

SEQ ID NO: 6539479 - DNA, 15 bp, Homo sapiens
tgtattttttcctta

SEQ ID NO: 6539480 - DNA, 19 bp, Homo sapiens
tgtattttttccttaagag

SEQ ID NO: 6539481 - DNA, 22 bp, Homo sapiens
tgtatttttttaactacataaa

SEQ ID NO: 6539482 - DNA, 14 bp, Homo sapiens
tgtatttttttact

SEQ ID NO: 6539483 - DNA, 14 bp, Homo sapiens
tgtatttttttcca

SEQ ID NO: 6539484 - DNA, 21 bp, Homo sapiens
tgtatttttttttctaagaga

SEQ ID NO: 6539485 - DNA, 22 bp, Homo sapiens
tgtatttttttttctaagagaa

SEQ ID NO: 6539486 - DNA, 12 bp, Homo sapiens
tgtcaaaaaggg

SEQ ID NO: 6539487 - DNA, 23 bp, Homo sapiens
tgtcaaaaatgtcttgggtaggc

SEQ ID NO: 6539488 - DNA, 13 bp, Homo sapiens
tgtcaaaacactg

SEQ ID NO: 6539489 - DNA, 19 bp, Homo sapiens
tgtcaaaactactgacagg

SEQ ID NO: 6539490 - DNA, 21 bp, Homo sapiens
tgtcaaaactccactcagcac

SEQ ID NO: 6539491 - DNA, 17 bp, Homo sapiens
tgtcaaaagttggacta

SEQ ID NO: 6539492 - DNA, 21 bp, Homo sapiens
tgtcaaaagttggactaaatg

SEQ ID NO: 6539493 - DNA, 19 bp, Homo sapiens
tgtcaaaatatttctcatc

SEQ ID NO: 6539494 - DNA, 23 bp, Homo sapiens
tgtcaaaatatttctcatctgca

SEQ ID NO: 6539495 - DNA, 13 bp, Homo sapiens
tgtcaaaatgtga

SEQ ID NO: 6539496 - DNA, 17 bp, Homo sapiens
tgtcaaacaaagccaga

SEQ ID NO: 6539497 - DNA, 18 bp, Homo sapiens
tgtcaaacagtgccaaat

SEQ ID NO: 6539498 - DNA, 21 bp, Homo sapiens
tgtcaaacgtgccccccagtt

SEQ ID NO: 6539499 - DNA, 20 bp, Homo sapiens
tgtcaaactgaaattcagag

SEQ ID NO: 6539500 - DNA, 18 bp, Homo sapiens
tgtcaaactgtagaaatg

SEQ ID NO: 6539501 - DNA, 13 bp, Homo sapiens
tgtcaaagaagct

SEQ ID NO: 6539502 - DNA, 14 bp, Homo sapiens
tgtcaaagaagctt

SEQ ID NO: 6539503 - DNA, 14 bp, Homo sapiens
tgtcaaagatgccc

SEQ ID NO: 6539504 - DNA, 20 bp, Homo sapiens
tgtcaaaggtcgggacagct

SEQ ID NO: 6539505 - DNA, 15 bp, Homo sapiens
tgtcaaataaaatga

SEQ ID NO: 6539506 - DNA, 19 bp, Homo sapiens
tgtcaaatatatttaacta

SEQ ID NO: 6539507 - DNA, 15 bp, Homo sapiens
tgtcaaatgaacttt

SEQ ID NO: 6539508 - DNA, 22 bp, Homo sapiens
tgtcaacaaaaagacatggaag

SEQ ID NO: 6539509 - DNA, 22 bp, Homo sapiens
tgtcaacaaggggtcaatgtca

SEQ ID NO: 6539510 - DNA, 23 bp, Homo sapiens
tgtcaacaaggggtcaatgtcat

SEQ ID NO: 6539511 - DNA, 15 bp, Homo sapiens
tgtcaacacaaagac

SEQ ID NO: 6539512 - DNA, 13 bp, Homo sapiens
tgtcaacaccaga

SEQ ID NO: 6539513 - DNA, 17 bp, Homo sapiens
tgtcaacatgaaacacc

SEQ ID NO: 6539514 - DNA, 14 bp, Homo sapiens
tgtcaacattgtga

SEQ ID NO: 6539515 - DNA, 15 bp, Homo sapiens
tgtcaacattgtgat

SEQ ID NO: 6539516 - DNA, 17 bp, Homo sapiens
tgtcaaccagacagagg

SEQ ID NO: 6539517 - DNA, 16 bp, Homo sapiens
tgtcaacctgaattaa

SEQ ID NO: 6539518 - DNA, 20 bp, Homo sapiens
tgtcaacctgaattaaagtc

SEQ ID NO: 6539519 - DNA, 18 bp, Homo sapiens
tgtcaacctttgtaagaa

SEQ ID NO: 6539520 - DNA, 15 bp, Homo sapiens
tgtcaactctttgtt

SEQ ID NO: 6539521 - DNA, 22 bp, Homo sapiens
tgtcaacttcagttgaaaagag

SEQ ID NO: 6539522 - DNA, 15 bp, Homo sapiens
tgtcaactttcattt

SEQ ID NO: 6539523 - DNA, 16 bp, Homo sapiens
tgtcaactttcatttg

SEQ ID NO: 6539524 - DNA, 17 bp, Homo sapiens
tgtcaacttttaacttt

SEQ ID NO: 6539525 - DNA, 15 bp, Homo sapiens
tgtcaagaaaaggag

SEQ ID NO: 6539526 - DNA, 21 bp, Homo sapiens
tgtcaagaatagcattgtaaa

SEQ ID NO: 6539527 - DNA, 15 bp, Homo sapiens
tgtcaagacatttct

SEQ ID NO: 6539528 - DNA, 18 bp, Homo sapiens
tgtcaagagagagtcaaa

SEQ ID NO: 6539529 - DNA, 17 bp, Homo sapiens
tgtcaagagtagttata

SEQ ID NO: 6539530 - DNA, 20 bp, Homo sapiens
tgtcaagagtagttatataa

SEQ ID NO: 6539531 - DNA, 19 bp, Homo sapiens
tgtcaagagtcgctgtgcc

SEQ ID NO: 6539532 - DNA, 22 bp, Homo sapiens
tgtcaagatgagtggttttctt

SEQ ID NO: 6539533 - DNA, 15 bp, Homo sapiens
tgtcaagattcagct

SEQ ID NO: 6539534 - DNA, 16 bp, Homo sapiens
tgtcaagattcagcta

SEQ ID NO: 6539535 - DNA, 15 bp, Homo sapiens
tgtcaagattgcaaa

SEQ ID NO: 6539536 - DNA, 23 bp, Homo sapiens
tgtcaagcatattggaaagtgat

SEQ ID NO: 6539537 - DNA, 20 bp, Homo sapiens
tgtcaagccatttttacatc

SEQ ID NO: 6539538 - DNA, 18 bp, Homo sapiens
tgtcaagcctgtgcaaaa

SEQ ID NO: 6539539 - DNA, 20 bp, Homo sapiens
tgtcaagcctgtgcaaaaaa

SEQ ID NO: 6539540 - DNA, 15 bp, Homo sapiens
tgtcaagctgctctg

SEQ ID NO: 6539541 - DNA, 17 bp, Homo sapiens
tgtcaagcttactacag

SEQ ID NO: 6539542 - DNA, 19 bp, Homo sapiens
tgtcaaggccgagggccag

SEQ ID NO: 6539543 - DNA, 21 bp, Homo sapiens
tgtcaaggccgagggccaggc

SEQ ID NO: 6539544 - DNA, 21 bp, Homo sapiens
tgtcaagggttcaagattgtt

SEQ ID NO: 6539545 - DNA, 17 bp, Homo sapiens
tgtcaaggtgaagcaca

SEQ ID NO: 6539546 - DNA, 16 bp, Homo sapiens
tgtcaagtctctgctg

SEQ ID NO: 6539547 - DNA, 12 bp, Homo sapiens
tgtcaagtgcct

SEQ ID NO: 6539548 - DNA, 16 bp, Homo sapiens
tgtcaagtgcctgcac

SEQ ID NO: 6539549 - DNA, 18 bp, Homo sapiens
tgtcaagtggcaaagctg

SEQ ID NO: 6539550 - DNA, 20 bp, Homo sapiens
tgtcaagtgttttactatct

SEQ ID NO: 6539551 - DNA, 19 bp, Homo sapiens
tgtcaagttaacaaggaat

SEQ ID NO: 6539552 - DNA, 20 bp, Homo sapiens
tgtcaagttaacaaggaatg

SEQ ID NO: 6539553 - DNA, 18 bp, Homo sapiens
tgtcaagttcctttgggt

SEQ ID NO: 6539554 - DNA, 14 bp, Homo sapiens
tgtcaagttgtgct

SEQ ID NO: 6539555 - DNA, 16 bp, Homo sapiens
tgtcaagttgtgcttg

SEQ ID NO: 6539556 - DNA, 14 bp, Homo sapiens
tgtcaataaaaata

SEQ ID NO: 6539557 - DNA, 20 bp, Homo sapiens
tgtcaataaaaataaatcta

SEQ ID NO: 6539558 - DNA, 18 bp, Homo sapiens
tgtcaataaacaacagct

SEQ ID NO: 6539559 - DNA, 21 bp, Homo sapiens
tgtcaataaacagcttcatgc

SEQ ID NO: 6539560 - DNA, 11 bp, Homo sapiens
tgtcaataaat

SEQ ID NO: 6539561 - DNA, 15 bp, Homo sapiens
tgtcaataaatgaca

SEQ ID NO: 6539562 - DNA, 18 bp, Homo sapiens
tgtcaataaatgttgaaa

SEQ ID NO: 6539563 - DNA, 17 bp, Homo sapiens
tgtcaatacccctgtta

SEQ ID NO: 6539564 - DNA, 23 bp, Homo sapiens
tgtcaatacccctgttaagcaat

SEQ ID NO: 6539565 - DNA, 13 bp, Homo sapiens
tgtcaatactgag

SEQ ID NO: 6539566 - DNA, 13 bp, Homo sapiens
tgtcaatattaaa

SEQ ID NO: 6539567 - DNA, 18 bp, Homo sapiens
tgtcaatattaaatacag

SEQ ID NO: 6539568 - DNA, 21 bp, Homo sapiens
tgtcaatattggtgtactgta

SEQ ID NO: 6539569 - DNA, 17 bp, Homo sapiens
tgtcaatatttagtaaa

SEQ ID NO: 6539570 - DNA, 13 bp, Homo sapiens
tgtcaatatttga

SEQ ID NO: 6539571 - DNA, 16 bp, Homo sapiens
tgtcaatccaatctgt

SEQ ID NO: 6539572 - DNA, 17 bp, Homo sapiens
tgtcaatccagatggtg

SEQ ID NO: 6539573 - DNA, 15 bp, Homo sapiens
tgtcaatctgtccgt

SEQ ID NO: 6539574 - DNA, 17 bp, Homo sapiens
tgtcaatcttaagagga

SEQ ID NO: 6539575 - DNA, 22 bp, Homo sapiens
tgtcaatgaggttatgagaaaa

SEQ ID NO: 6539576 - DNA, 23 bp, Homo sapiens
tgtcaatgccaggatttctcatt

SEQ ID NO: 6539577 - DNA, 18 bp, Homo sapiens
tgtcaatggttatgggtc

SEQ ID NO: 6539578 - DNA, 15 bp, Homo sapiens
tgtcaatgtttgctt

SEQ ID NO: 6539579 - DNA, 19 bp, Homo sapiens
tgtcaattacaggaagtac

SEQ ID NO: 6539580 - DNA, 19 bp, Homo sapiens
tgtcaattcataaaaacaa

SEQ ID NO: 6539581 - DNA, 20 bp, Homo sapiens
tgtcaattcattaataaaat

SEQ ID NO: 6539582 - DNA, 14 bp, Homo sapiens
ttctggtttggcat

SEQ ID NO: 6539583 - DNA, 14 bp, Homo sapiens
ttctggttttagga

SEQ ID NO: 6539584 - DNA, 16 bp, Homo sapiens
ttctgtaaaatggaaa

SEQ ID NO: 6539585 - DNA, 19 bp, Homo sapiens
ttctgtaaaatggaaaact

SEQ ID NO: 6539586 - DNA, 20 bp, Homo sapiens
ttctgtaaaatttgtttaga

SEQ ID NO: 6539587 - DNA, 14 bp, Homo sapiens
ttctgtaaagcaaa

SEQ ID NO: 6539588 - DNA, 15 bp, Homo sapiens
ttctgtaaataacct

SEQ ID NO: 6539589 - DNA, 22 bp, Homo sapiens
ttctgtaaataatgtgcactga

SEQ ID NO: 6539590 - DNA, 14 bp, Homo sapiens
ttctgtaaatacca

SEQ ID NO: 6539591 - DNA, 23 bp, Homo sapiens
ttctgtaaataccattgacacat

SEQ ID NO: 6539592 - DNA, 16 bp, Homo sapiens
ttctgtaacaaattgg

SEQ ID NO: 6539593 - DNA, 23 bp, Homo sapiens
ttctgtaactattgggtgaatat

SEQ ID NO: 6539594 - DNA, 13 bp, Homo sapiens
ttctgtaactgtg

SEQ ID NO: 6539595 - DNA, 15 bp, Homo sapiens
ttctgtaataaaact

SEQ ID NO: 6539596 - DNA, 23 bp, Homo sapiens
ttctgtaataactagaacaaata

SEQ ID NO: 6539597 - DNA, 20 bp, Homo sapiens
ttctgtaatatttacaatgt

SEQ ID NO: 6539598 - DNA, 17 bp, Homo sapiens
ttctgtaatggaactga

SEQ ID NO: 6539599 - DNA, 14 bp, Homo sapiens
ttctgtaatgtaaa

SEQ ID NO: 6539600 - DNA, 16 bp, Homo sapiens
ttctgtaatgtaaata

SEQ ID NO: 6539601 - DNA, 19 bp, Homo sapiens
ttctgtaatgtaaataaac

SEQ ID NO: 6539602 - DNA, 22 bp, Homo sapiens
ttctgtaattacatatttgact

SEQ ID NO: 6539603 - DNA, 12 bp, Homo sapiens
ttctgtaattct

SEQ ID NO: 6539604 - DNA, 18 bp, Homo sapiens
ttctgtaatttaaaagct

SEQ ID NO: 6539605 - DNA, 14 bp, Homo sapiens
ttctgtaatttgaa

SEQ ID NO: 6539606 - DNA, 15 bp, Homo sapiens
ttctgtacatagcct

SEQ ID NO: 6539607 - DNA, 19 bp, Homo sapiens
ttctgtacatttgcaatta

SEQ ID NO: 6539608 - DNA, 19 bp, Homo sapiens
ttctgtaccaaaaatagac

SEQ ID NO: 6539609 - DNA, 15 bp, Homo sapiens
ttctgtactaaacat

SEQ ID NO: 6539610 - DNA, 15 bp, Homo sapiens
ttctgtacttcctga

SEQ ID NO: 6539611 - DNA, 13 bp, Homo sapiens
ttctgtacttttt

SEQ ID NO: 6539612 - DNA, 15 bp, Homo sapiens
ttctgtagaaatggt

SEQ ID NO: 6539613 - DNA, 18 bp, Homo sapiens
ttctgtagaaatggttgt

SEQ ID NO: 6539614 - DNA, 20 bp, Homo sapiens
ttctgtagaaatggttgtat

SEQ ID NO: 6539615 - DNA, 16 bp, Homo sapiens
ttctgtagacttttga

SEQ ID NO: 6539616 - DNA, 20 bp, Homo sapiens
ttctgtagattcatgcaagt

SEQ ID NO: 6539617 - DNA, 13 bp, Homo sapiens
ttctgtagattct

SEQ ID NO: 6539618 - DNA, 18 bp, Homo sapiens
ttctgtagcctaaaacga

SEQ ID NO: 6539619 - DNA, 14 bp, Homo sapiens
ttctgtagctcagt

SEQ ID NO: 6539620 - DNA, 21 bp, Homo sapiens
ttctgtagcttatctgcccct

SEQ ID NO: 6539621 - DNA, 16 bp, Homo sapiens
ttctgtaggttaaaaa

SEQ ID NO: 6539622 - DNA, 18 bp, Homo sapiens
ttctgtaggtttctctct

SEQ ID NO: 6539623 - DNA, 23 bp, Homo sapiens
ttctgtaggtttctctcttccct

SEQ ID NO: 6539624 - DNA, 20 bp, Homo sapiens
ttctgtagtcatttactaaa

SEQ ID NO: 6539625 - DNA, 22 bp, Homo sapiens
ttctgtagtcatttactaaaca

SEQ ID NO: 6539626 - DNA, 13 bp, Homo sapiens
ttctgtataaatg

SEQ ID NO: 6539627 - DNA, 14 bp, Homo sapiens
ttctgtatagatta

SEQ ID NO: 6539628 - DNA, 16 bp, Homo sapiens
ttctgtatataaatgg

SEQ ID NO: 6539629 - DNA, 18 bp, Homo sapiens
ttctgtatataaatggga

SEQ ID NO: 6539630 - DNA, 14 bp, Homo sapiens
ttctgtatatagat

SEQ ID NO: 6539631 - DNA, 21 bp, Homo sapiens
ttctgtatatgattctctgtg

SEQ ID NO: 6539632 - DNA, 16 bp, Homo sapiens
ttctgtatatttgtca

SEQ ID NO: 6539633 - DNA, 17 bp, Homo sapiens
ttctgtatatttgtcat

SEQ ID NO: 6539634 - DNA, 18 bp, Homo sapiens
ttctgtatatttgtcatg

SEQ ID NO: 6539635 - DNA, 21 bp, Homo sapiens
ttctgtatctactttaataaa

SEQ ID NO: 6539636 - DNA, 14 bp, Homo sapiens
ttctgtatttgaaa

SEQ ID NO: 6539637 - DNA, 17 bp, Homo sapiens
ttctgtatttgaaagtg

SEQ ID NO: 6539638 - DNA, 13 bp, Homo sapiens
ttctgtattttaa

SEQ ID NO: 6539639 - DNA, 12 bp, Homo sapiens
ttctgtattttc

SEQ ID NO: 6539640 - DNA, 20 bp, Homo sapiens
ttctgtatttttttttctaa

SEQ ID NO: 6539641 - DNA, 22 bp, Homo sapiens
ttctgtatttttttttctaaga

SEQ ID NO: 6539642 - DNA, 22 bp, Homo sapiens
ttctgtcaaagtcagaacaaat

SEQ ID NO: 6539643 - DNA, 14 bp, Homo sapiens
ttctgtcaatgaaa

SEQ ID NO: 6539644 - DNA, 19 bp, Homo sapiens
ttctgtcacagtaaaaata

SEQ ID NO: 6539645 - DNA, 18 bp, Homo sapiens
ttctgtcaccaaatttgt

SEQ ID NO: 6539646 - DNA, 16 bp, Homo sapiens
ttctgtcagatgagaa

SEQ ID NO: 6539647 - DNA, 24 bp, Homo sapiens
ttctgtcagatgagaacaaagctg

SEQ ID NO: 6539648 - DNA, 12 bp, Homo sapiens
ttctgtcatccc

SEQ ID NO: 6539649 - DNA, 22 bp, Homo sapiens
ttctgtcatctaccttttctct

SEQ ID NO: 6539650 - DNA, 16 bp, Homo sapiens
ttctgtccagtttcca

SEQ ID NO: 6539651 - DNA, 12 bp, Homo sapiens
ttctgtccatca

SEQ ID NO: 6539652 - DNA, 17 bp, Homo sapiens
ttctgtccatcagtgca

SEQ ID NO: 6539653 - DNA, 13 bp, Homo sapiens
ttctgtcccaagt

SEQ ID NO: 6539654 - DNA, 14 bp, Homo sapiens
ttctgtcccaagtc

SEQ ID NO: 6539655 - DNA, 15 bp, Homo sapiens
ttctgtcccaagtct

SEQ ID NO: 6539656 - DNA, 13 bp, Homo sapiens
ttctgtccccagc

SEQ ID NO: 6539657 - DNA, 22 bp, Homo sapiens
ttctgtcccgtaaatcatattt

SEQ ID NO: 6539658 - DNA, 17 bp, Homo sapiens
ttctgtccgagctttga

SEQ ID NO: 6539659 - DNA, 19 bp, Homo sapiens
ttctgtcctactctgtgtc

SEQ ID NO: 6539660 - DNA, 21 bp, Homo sapiens
ttctgtcctcaggtgaataac

SEQ ID NO: 6539661 - DNA, 21 bp, Homo sapiens
ttctgtccttggcaactttct

SEQ ID NO: 6539662 - DNA, 15 bp, Homo sapiens
ttctgtcgtccccag

SEQ ID NO: 6539663 - DNA, 16 bp, Homo sapiens
ttctgtcgtccccaga

SEQ ID NO: 6539664 - DNA, 19 bp, Homo sapiens
ttctgtcgtccccagacca

SEQ ID NO: 6539665 - DNA, 18 bp, Homo sapiens
ttctgtctagactggcct

SEQ ID NO: 6539666 - DNA, 13 bp, Homo sapiens
ttctgtctccagc

SEQ ID NO: 6539667 - DNA, 19 bp, Homo sapiens
ttctgtctcccttctctct

SEQ ID NO: 6539668 - DNA, 14 bp, Homo sapiens
ttctgtctctccct

SEQ ID NO: 6539669 - DNA, 17 bp, Homo sapiens
ttctgtctctctctctt

SEQ ID NO: 6539670 - DNA, 15 bp, Homo sapiens
ttctgtctctctctt

SEQ ID NO: 6539671 - DNA, 14 bp, Homo sapiens
ttctgtctctcttg

SEQ ID NO: 6539672 - DNA, 13 bp, Homo sapiens
ttctgtctctgcc

SEQ ID NO: 6539673 - DNA, 19 bp, Homo sapiens
ttctgtctctgcctccctc

SEQ ID NO: 6539674 - DNA, 21 bp, Homo sapiens
ttctgtctctgcctccctcac

SEQ ID NO: 6539675 - DNA, 16 bp, Homo sapiens
ttctgtctctgcttgg

SEQ ID NO: 6539676 - DNA, 15 bp, Homo sapiens
ttctgtctgaattat

SEQ ID NO: 6539677 - DNA, 17 bp, Homo sapiens
ttctgtcttctacagat

SEQ ID NO: 6539678 - DNA, 13 bp, Homo sapiens
ttctgtcttgtag

SEQ ID NO: 6539679 - DNA, 15 bp, Homo sapiens
ttctgtgaaactaat

SEQ ID NO: 6539680 - DNA, 15 bp, Homo sapiens
ttctgtgaaagaagt

SEQ ID NO: 6539681 - DNA, 18 bp, Homo sapiens
ttctgtgaaagaagtatt

SEQ ID NO: 6539682 - DNA, 15 bp, Homo sapiens
ttctgtgaaatataa

SEQ ID NO: 6539683 - DNA, 17 bp, Homo sapiens
ttctgtgaaattctcag

SEQ ID NO: 6539684 - DNA, 13 bp, Homo sapiens
ttctgtgaagagg

SEQ ID NO: 6539685 - DNA, 17 bp, Homo sapiens
ttctgtgaagcaaaaag

SEQ ID NO: 6539686 - DNA, 16 bp, Homo sapiens
ttctgtgaagcccttt

SEQ ID NO: 6539687 - DNA, 23 bp, Homo sapiens
ttctgtgaagccctttgcctgta

SEQ ID NO: 6539688 - DNA, 15 bp, Homo sapiens
ttctgtgacccatct

SEQ ID NO: 6539689 - DNA, 18 bp, Homo sapiens
ttctgtgacccatctgta

SEQ ID NO: 6539690 - DNA, 19 bp, Homo sapiens
ttctgtgacccatctgtag

SEQ ID NO: 6539691 - DNA, 17 bp, Homo sapiens
ttctgtgatcatttatt

SEQ ID NO: 6539692 - DNA, 17 bp, Homo sapiens
ttctgtgatgagctgat

SEQ ID NO: 6539693 - DNA, 19 bp, Homo sapiens
ttctgtgcagataaacaga

SEQ ID NO: 6539694 - DNA, 21 bp, Homo sapiens
ttctgtgcagataaacagaaa

SEQ ID NO: 6539695 - DNA, 12 bp, Homo sapiens
ttctgtgcagtt

SEQ ID NO: 6539696 - DNA, 14 bp, Homo sapiens
ttctgtgcataaaa

SEQ ID NO: 6539697 - DNA, 18 bp, Homo sapiens
ttctgtgcatctggcctg

SEQ ID NO: 6539698 - DNA, 17 bp, Homo sapiens
ttctgtgcatgtgcagg

SEQ ID NO: 6539699 - DNA, 20 bp, Homo sapiens
ttctgtgcattcatgcaaga

SEQ ID NO: 6539700 - DNA, 23 bp, Homo sapiens
ttctgtgcccagaatactgatgg

SEQ ID NO: 6539701 - DNA, 13 bp, Homo sapiens
ttctgtgcccagc

SEQ ID NO: 6539702 - DNA, 14 bp, Homo sapiens
ttctgtgcccagct

SEQ ID NO: 6539703 - DNA, 13 bp, Homo sapiens
ttctgtgccctcc

SEQ ID NO: 6539704 - DNA, 12 bp, Homo sapiens
ttctgtgcctcc

SEQ ID NO: 6539705 - DNA, 14 bp, Homo sapiens
ttctgtgcctcccc

SEQ ID NO: 6539706 - DNA, 16 bp, Homo sapiens
ttctgtgcctcccccc

SEQ ID NO: 6539707 - DNA, 19 bp, Homo sapiens
ttctgtgcctccccccaga

SEQ ID NO: 6539708 - DNA, 15 bp, Homo sapiens
ttctgtgcctgaata

SEQ ID NO: 6539709 - DNA, 17 bp, Homo sapiens
ttctgtgcgtctgtttt

SEQ ID NO: 6539710 - DNA, 18 bp, Homo sapiens
ttctgtggaaagtgtaaa

SEQ ID NO: 6539711 - DNA, 19 bp, Homo sapiens
ttctgtggaaagtgtaaag

SEQ ID NO: 6539712 - DNA, 22 bp, Homo sapiens
ttctgtggaagtagctttgaac

SEQ ID NO: 6539713 - DNA, 18 bp, Homo sapiens
ttctgtggatacagtgcc

SEQ ID NO: 6539714 - DNA, 21 bp, Homo sapiens
ttctgtggatacagtgcccac

SEQ ID NO: 6539715 - DNA, 22 bp, Homo sapiens
ttctgtggatacagtgcccacc

SEQ ID NO: 6539716 - DNA, 22 bp, Homo sapiens
ttctgtggatgccgatttctgt

SEQ ID NO: 6539717 - DNA, 15 bp, Homo sapiens
ttctgtggattctat

SEQ ID NO: 6539718 - DNA, 21 bp, Homo sapiens
ttctgtggccgccatctgcgc

SEQ ID NO: 6539719 - DNA, 22 bp, Homo sapiens
ttctgtggctaaacagatgtaa

SEQ ID NO: 6539720 - DNA, 16 bp, Homo sapiens
ttctgtggctcacaga

SEQ ID NO: 6539721 - DNA, 17 bp, Homo sapiens
ttctgtgggcagctggc

SEQ ID NO: 6539722 - DNA, 22 bp, Homo sapiens
ttctgtgggcagctggctctga

SEQ ID NO: 6539723 - DNA, 16 bp, Homo sapiens
ttctgtggggcccctc

SEQ ID NO: 6539724 - DNA, 20 bp, Homo sapiens
ttctgtggggcccctcacct

SEQ ID NO: 6539725 - DNA, 23 bp, Homo sapiens
ttctgtggggcccctcacctact

SEQ ID NO: 6539726 - DNA, 23 bp, Homo sapiens
ttctgtgggtttctaaagctgcc

SEQ ID NO: 6539727 - DNA, 16 bp, Homo sapiens
ttctgtggttcctctg

SEQ ID NO: 6539728 - DNA, 20 bp, Homo sapiens
ttctgtggttcctctgctca

SEQ ID NO: 6539729 - DNA, 23 bp, Homo sapiens
ttctgtggttttcccctccctgg

SEQ ID NO: 6539730 - DNA, 16 bp, Homo sapiens
ttctgtgtaaaatgag

SEQ ID NO: 6539731 - DNA, 17 bp, Homo sapiens
ttctgtgtaaaatgagt

SEQ ID NO: 6539732 - DNA, 15 bp, Homo sapiens
ttctgtgtaaccatt

SEQ ID NO: 6539733 - DNA, 13 bp, Homo sapiens
ttctgtgtagaca

SEQ ID NO: 6539734 - DNA, 14 bp, Homo sapiens
ttctgtgtagacat

SEQ ID NO: 6539735 - DNA, 14 bp, Homo sapiens
ttctgtgtatctct

SEQ ID NO: 6539736 - DNA, 16 bp, Homo sapiens
ttctgtgtattaacat

SEQ ID NO: 6539737 - DNA, 17 bp, Homo sapiens
ttctgtgtatttaattg

SEQ ID NO: 6539738 - DNA, 21 bp, Homo sapiens
ttctgtgtatttaattgtaaa

SEQ ID NO: 6539739 - DNA, 22 bp, Homo sapiens
ttctgtgtatttaattgtaaac

SEQ ID NO: 6539740 - DNA, 22 bp, Homo sapiens
ttctgtgtcacagttcttggtg

SEQ ID NO: 6539741 - DNA, 19 bp, Homo sapiens
ttctgtgtcagagcccagc

SEQ ID NO: 6539742 - DNA, 13 bp, Homo sapiens
ttctgtgtgaggt

SEQ ID NO: 6539743 - DNA, 14 bp, Homo sapiens
ttctgtgtgcacag

SEQ ID NO: 6539744 - DNA, 10 bp, Homo sapiens
ttctgtgtgt

SEQ ID NO: 6539745 - DNA, 14 bp, Homo sapiens
ttctgtgtgtccgt

SEQ ID NO: 6539746 - DNA, 15 bp, Homo sapiens
ttctgtgtgttcctg

SEQ ID NO: 6539747 - DNA, 16 bp, Homo sapiens
ttctgtgtgttcctgg

SEQ ID NO: 6539748 - DNA, 13 bp, Homo sapiens
ttctgtgttactt

SEQ ID NO: 6539749 - DNA, 15 bp, Homo sapiens
ttctgtgttcatttt

SEQ ID NO: 6539750 - DNA, 15 bp, Homo sapiens
ttctgtgttgaaata

SEQ ID NO: 6539751 - DNA, 12 bp, Homo sapiens
ttctgtgtttta

SEQ ID NO: 6539752 - DNA, 13 bp, Homo sapiens
ttctgttaaatat

SEQ ID NO: 6539753 - DNA, 14 bp, Homo sapiens
ttctgttaactgaa

SEQ ID NO: 6539754 - DNA, 17 bp, Homo sapiens
ttctgttacaaaatgta

SEQ ID NO: 6539755 - DNA, 19 bp, Homo sapiens
ttctgttatatcccctgct

SEQ ID NO: 6539756 - DNA, 23 bp, Homo sapiens
ttctgttatctcaggtgagctgg

SEQ ID NO: 6539757 - DNA, 12 bp, Homo sapiens
ttctgttcactt

SEQ ID NO: 6539758 - DNA, 19 bp, Homo sapiens
ttctgttcagattaaaaaa

SEQ ID NO: 6539759 - DNA, 13 bp, Homo sapiens
ttctgttcatctc

SEQ ID NO: 6539760 - DNA, 17 bp, Homo sapiens
ttctgttcatctctttg

SEQ ID NO: 6539761 - DNA, 19 bp, Homo sapiens
ttctgttccaaattcagtt

SEQ ID NO: 6539762 - DNA, 20 bp, Homo sapiens
tgtcaattgtacgcgccacc

SEQ ID NO: 6539763 - DNA, 16 bp, Homo sapiens
tgtcaatttataatga

SEQ ID NO: 6539764 - DNA, 17 bp, Homo sapiens
tgtcaatttatgaatat

SEQ ID NO: 6539765 - DNA, 16 bp, Homo sapiens
tgtcaatttctgtgtt

SEQ ID NO: 6539766 - DNA, 16 bp, Homo sapiens
tgtcaatttgtatatc

SEQ ID NO: 6539767 - DNA, 19 bp, Homo sapiens
tgtcaatttttaaaacttt

SEQ ID NO: 6539768 - DNA, 15 bp, Homo sapiens
tgtcacaaagagctg

SEQ ID NO: 6539769 - DNA, 21 bp, Homo sapiens
tgtcacaagtggtgtttattg

SEQ ID NO: 6539770 - DNA, 18 bp, Homo sapiens
tgtcacaataaagtttat

SEQ ID NO: 6539771 - DNA, 13 bp, Homo sapiens
tgtcacacactgg

SEQ ID NO: 6539772 - DNA, 22 bp, Homo sapiens
tgtcacacccatggcctcagcc

SEQ ID NO: 6539773 - DNA, 16 bp, Homo sapiens
tgtcacaccctgactt

SEQ ID NO: 6539774 - DNA, 13 bp, Homo sapiens
tgtcacactaaaa

SEQ ID NO: 6539775 - DNA, 21 bp, Homo sapiens
tgtcacactaaaatttaattg

SEQ ID NO: 6539776 - DNA, 15 bp, Homo sapiens
tgtcacactgagctg

SEQ ID NO: 6539777 - DNA, 15 bp, Homo sapiens
tgtcacactggctat

SEQ ID NO: 6539778 - DNA, 21 bp, Homo sapiens
tgtcacactggtgctgagtga

SEQ ID NO: 6539779 - DNA, 19 bp, Homo sapiens
tgtcacagaaatcagagga

SEQ ID NO: 6539780 - DNA, 22 bp, Homo sapiens
tgtcacagacgtgaaagccaga

SEQ ID NO: 6539781 - DNA, 14 bp, Homo sapiens
tgtcacagaggcag

SEQ ID NO: 6539782 - DNA, 15 bp, Homo sapiens
tgtcacagctcttgt

SEQ ID NO: 6539783 - DNA, 16 bp, Homo sapiens
tgtcacagctcttgtt

SEQ ID NO: 6539784 - DNA, 17 bp, Homo sapiens
tgtcacaggcaggtcca

SEQ ID NO: 6539785 - DNA, 14 bp, Homo sapiens
tgtcacaggctggg

SEQ ID NO: 6539786 - DNA, 11 bp, Homo sapiens
tgtcacagggc

SEQ ID NO: 6539787 - DNA, 14 bp, Homo sapiens
tgtcacagggccaa

SEQ ID NO: 6539788 - DNA, 18 bp, Homo sapiens
tgtcacagggtgttcttt

SEQ ID NO: 6539789 - DNA, 21 bp, Homo sapiens
tgtcacaggttttcagagaat

SEQ ID NO: 6539790 - DNA, 15 bp, Homo sapiens
tgtcacagtaatgca

SEQ ID NO: 6539791 - DNA, 19 bp, Homo sapiens
tgtcacagtccaaccagaa

SEQ ID NO: 6539792 - DNA, 22 bp, Homo sapiens
tgtcacagtccaaccagaaaca

SEQ ID NO: 6539793 - DNA, 17 bp, Homo sapiens
tgtcacagtcttgtgaa

SEQ ID NO: 6539794 - DNA, 23 bp, Homo sapiens
tgtcacagtcttgtgaactttga

SEQ ID NO: 6539795 - DNA, 18 bp, Homo sapiens
tgtcacatcaagcatcat

SEQ ID NO: 6539796 - DNA, 23 bp, Homo sapiens
tgtcacatcaagcatcattgtcc

SEQ ID NO: 6539797 - DNA, 15 bp, Homo sapiens
tgtcacatcagataa

SEQ ID NO: 6539798 - DNA, 18 bp, Homo sapiens
tgtcacatcctaatagaa

SEQ ID NO: 6539799 - DNA, 21 bp, Homo sapiens
tgtcacatctatccacactgt

SEQ ID NO: 6539800 - DNA, 18 bp, Homo sapiens
tgtcacatggtgccccta

SEQ ID NO: 6539801 - DNA, 14 bp, Homo sapiens
tgtcacattctatt

SEQ ID NO: 6539802 - DNA, 16 bp, Homo sapiens
tgtcacattgcattct

SEQ ID NO: 6539803 - DNA, 21 bp, Homo sapiens
tgtcacattgcattctattgc

SEQ ID NO: 6539804 - DNA, 22 bp, Homo sapiens
tgtcacattgcattctattgcc

SEQ ID NO: 6539805 - DNA, 17 bp, Homo sapiens
tgtcacatttgaattct

SEQ ID NO: 6539806 - DNA, 23 bp, Homo sapiens
tgtcaccaaggaaacgctacctc

SEQ ID NO: 6539807 - DNA, 18 bp, Homo sapiens
tgtcaccaccctgctcat

SEQ ID NO: 6539808 - DNA, 16 bp, Homo sapiens
tgtcaccaccttccca

SEQ ID NO: 6539809 - DNA, 20 bp, Homo sapiens
tgtcaccactacagtaagct

SEQ ID NO: 6539810 - DNA, 12 bp, Homo sapiens
tgtcaccagagc

SEQ ID NO: 6539811 - DNA, 17 bp, Homo sapiens
tgtcaccagcaacatct

SEQ ID NO: 6539812 - DNA, 13 bp, Homo sapiens
tgtcaccagcctg

SEQ ID NO: 6539813 - DNA, 14 bp, Homo sapiens
tgtcaccagcctgt

SEQ ID NO: 6539814 - DNA, 17 bp, Homo sapiens
tgtcaccagtcctgccc

SEQ ID NO: 6539815 - DNA, 14 bp, Homo sapiens
tgtcaccagttaaa

SEQ ID NO: 6539816 - DNA, 23 bp, Homo sapiens
tgtcacccaaaccggcaggtgcg

SEQ ID NO: 6539817 - DNA, 22 bp, Homo sapiens
tgtcacccagcaaggcacaggc

SEQ ID NO: 6539818 - DNA, 19 bp, Homo sapiens
tgtcacccaggctggagtg

SEQ ID NO: 6539819 - DNA, 22 bp, Homo sapiens
tgtcacccaggttggagtgcag

SEQ ID NO: 6539820 - DNA, 14 bp, Homo sapiens
tgtcaccccagagc

SEQ ID NO: 6539821 - DNA, 19 bp, Homo sapiens
tgtcaccccagagccacac

SEQ ID NO: 6539822 - DNA, 15 bp, Homo sapiens
tgtcacccccactcc

SEQ ID NO: 6539823 - DNA, 16 bp, Homo sapiens
tgtcacccccactccc

SEQ ID NO: 6539824 - DNA, 18 bp, Homo sapiens
tgtcaccctccacctctt

SEQ ID NO: 6539825 - DNA, 18 bp, Homo sapiens
tgtcaccctgagcatctg

SEQ ID NO: 6539826 - DNA, 16 bp, Homo sapiens
tgtcaccctgcagagc

SEQ ID NO: 6539827 - DNA, 17 bp, Homo sapiens
tgtcaccctgcagagct

SEQ ID NO: 6539828 - DNA, 17 bp, Homo sapiens
tgtcaccctgcaggact

SEQ ID NO: 6539829 - DNA, 14 bp, Homo sapiens
tgtcaccctggcca

SEQ ID NO: 6539830 - DNA, 15 bp, Homo sapiens
tgtcaccctgtgggt

SEQ ID NO: 6539831 - DNA, 22 bp, Homo sapiens
tgtcacccttaggccagcacca

SEQ ID NO: 6539832 - DNA, 18 bp, Homo sapiens
tgtcaccggtcagtgcct

SEQ ID NO: 6539833 - DNA, 15 bp, Homo sapiens
tgtcacctcagctga

SEQ ID NO: 6539834 - DNA, 17 bp, Homo sapiens
tgtcacctccttcccca

SEQ ID NO: 6539835 - DNA, 19 bp, Homo sapiens
tgtcacctccttccccagc

SEQ ID NO: 6539836 - DNA, 21 bp, Homo sapiens
tgtcacctccttccccagctc

SEQ ID NO: 6539837 - DNA, 16 bp, Homo sapiens
tgtcacctctctcaga

SEQ ID NO: 6539838 - DNA, 18 bp, Homo sapiens
tgtcacctctctcagagc

SEQ ID NO: 6539839 - DNA, 22 bp, Homo sapiens
tgtcacctctgtgacccctcct

SEQ ID NO: 6539840 - DNA, 13 bp, Homo sapiens
tgtcacctctgtt

SEQ ID NO: 6539841 - DNA, 16 bp, Homo sapiens
tgtcacctcttccgac

SEQ ID NO: 6539842 - DNA, 13 bp, Homo sapiens
tgtcacctgaaga

SEQ ID NO: 6539843 - DNA, 15 bp, Homo sapiens
tgtcacctgctcaca

SEQ ID NO: 6539844 - DNA, 17 bp, Homo sapiens
tgtcacctgctcacagg

SEQ ID NO: 6539845 - DNA, 17 bp, Homo sapiens
tgtcacctgcttctctg

SEQ ID NO: 6539846 - DNA, 20 bp, Homo sapiens
tgtcacctgcttctctgccc

SEQ ID NO: 6539847 - DNA, 20 bp, Homo sapiens
tgtcacctggctgctaggcc

SEQ ID NO: 6539848 - DNA, 14 bp, Homo sapiens
tgtcacctgtgctt

SEQ ID NO: 6539849 - DNA, 13 bp, Homo sapiens
tgtcaccttcacc

SEQ ID NO: 6539850 - DNA, 16 bp, Homo sapiens
tgtcaccttttcttgc

SEQ ID NO: 6539851 - DNA, 14 bp, Homo sapiens
tgtcacgaatatgg

SEQ ID NO: 6539852 - DNA, 13 bp, Homo sapiens
tgtcacgagccct

SEQ ID NO: 6539853 - DNA, 18 bp, Homo sapiens
tgtcacgatcacaggcct

SEQ ID NO: 6539854 - DNA, 14 bp, Homo sapiens
tgtcacgccagact

SEQ ID NO: 6539855 - DNA, 20 bp, Homo sapiens
tgtcacgctcatgtcctgtc

SEQ ID NO: 6539856 - DNA, 14 bp, Homo sapiens
tgtcacggccaggc

SEQ ID NO: 6539857 - DNA, 19 bp, Homo sapiens
tgtcacgtgaaatatttaa

SEQ ID NO: 6539858 - DNA, 20 bp, Homo sapiens
tgtcacgtgaccctgtgccc

SEQ ID NO: 6539859 - DNA, 19 bp, Homo sapiens
tgtcactaaacaagaaatc

SEQ ID NO: 6539860 - DNA, 21 bp, Homo sapiens
tgtcactaaatggcagtgaga

SEQ ID NO: 6539861 - DNA, 16 bp, Homo sapiens
tgtcactaagaatata

SEQ ID NO: 6539862 - DNA, 17 bp, Homo sapiens
tgtcactagcagctgca

SEQ ID NO: 6539863 - DNA, 20 bp, Homo sapiens
tgtcactcaaggcggtgctt

SEQ ID NO: 6539864 - DNA, 22 bp, Homo sapiens
tgtcactcacatggacccaaga

SEQ ID NO: 6539865 - DNA, 12 bp, Homo sapiens
tgtcactcactg

SEQ ID NO: 6539866 - DNA, 15 bp, Homo sapiens
tgtcactcagcccct

SEQ ID NO: 6539867 - DNA, 15 bp, Homo sapiens
tgtcactcagctgag

SEQ ID NO: 6539868 - DNA, 16 bp, Homo sapiens
tgtcactcagctgaga

SEQ ID NO: 6539869 - DNA, 15 bp, Homo sapiens
tgtcactcaggctgg

SEQ ID NO: 6539870 - DNA, 23 bp, Homo sapiens
tgtcactcattgctgagcctctg

SEQ ID NO: 6539871 - DNA, 13 bp, Homo sapiens
tgtcactcccaga

SEQ ID NO: 6539872 - DNA, 14 bp, Homo sapiens
tgtcactcccagac

SEQ ID NO: 6539873 - DNA, 16 bp, Homo sapiens
tgtcactctgcctcta

SEQ ID NO: 6539874 - DNA, 19 bp, Homo sapiens
tgtcactctgcctctaagg

SEQ ID NO: 6539875 - DNA, 14 bp, Homo sapiens
tgtcactgaagatt

SEQ ID NO: 6539876 - DNA, 18 bp, Homo sapiens
tgtcactgacacaaagga

SEQ ID NO: 6539877 - DNA, 20 bp, Homo sapiens
tgtcactgacacaaaggaag

SEQ ID NO: 6539878 - DNA, 15 bp, Homo sapiens
tgtcactgagctgtg

SEQ ID NO: 6539879 - DNA, 15 bp, Homo sapiens
tgtcactgcaggcac

SEQ ID NO: 6539880 - DNA, 19 bp, Homo sapiens
tgtcactgccgacatccct

SEQ ID NO: 6539881 - DNA, 12 bp, Homo sapiens
tgtcactgctgt

SEQ ID NO: 6539882 - DNA, 13 bp, Homo sapiens
tgtcactgctttt

SEQ ID NO: 6539883 - DNA, 20 bp, Homo sapiens
tgtcactggaacctccctgg

SEQ ID NO: 6539884 - DNA, 17 bp, Homo sapiens
tgtcactggcagagcac

SEQ ID NO: 6539885 - DNA, 18 bp, Homo sapiens
tgtcactggcagagcaca

SEQ ID NO: 6539886 - DNA, 13 bp, Homo sapiens
tgtcactggctgc

SEQ ID NO: 6539887 - DNA, 17 bp, Homo sapiens
tgtcactggctgcctcc

SEQ ID NO: 6539888 - DNA, 22 bp, Homo sapiens
tgtcactggctgcctccactcc

SEQ ID NO: 6539889 - DNA, 15 bp, Homo sapiens
tgtcactggctggct

SEQ ID NO: 6539890 - DNA, 23 bp, Homo sapiens
tgtcactggtagaccaaaataaa

SEQ ID NO: 6539891 - DNA, 14 bp, Homo sapiens
tgtcactgtagttt

SEQ ID NO: 6539892 - DNA, 22 bp, Homo sapiens
tgtcactgtccaggtaggaaac

SEQ ID NO: 6539893 - DNA, 22 bp, Homo sapiens
tgtcactgtccctcctggtgtc

SEQ ID NO: 6539894 - DNA, 21 bp, Homo sapiens
tgtcactgtcttcacaacctc

SEQ ID NO: 6539895 - DNA, 15 bp, Homo sapiens
tgtcactgtggtcct

SEQ ID NO: 6539896 - DNA, 12 bp, Homo sapiens
tgtcactgttat

SEQ ID NO: 6539897 - DNA, 15 bp, Homo sapiens
tgtcactgttataaa

SEQ ID NO: 6539898 - DNA, 13 bp, Homo sapiens
tgtcactgtttct

SEQ ID NO: 6539899 - DNA, 17 bp, Homo sapiens
tgtcactgtttctctgc

SEQ ID NO: 6539900 - DNA, 14 bp, Homo sapiens
tgtcactgttttta

SEQ ID NO: 6539901 - DNA, 15 bp, Homo sapiens
tgtcacttatttcct

SEQ ID NO: 6539902 - DNA, 15 bp, Homo sapiens
tgtcacttcatattt

SEQ ID NO: 6539903 - DNA, 18 bp, Homo sapiens
tgtcacttgactcttgaa

SEQ ID NO: 6539904 - DNA, 13 bp, Homo sapiens
tgtcacttgcatg

SEQ ID NO: 6539905 - DNA, 15 bp, Homo sapiens
tgtcacttgcatgtc

SEQ ID NO: 6539906 - DNA, 16 bp, Homo sapiens
tgtcacttgccacatg

SEQ ID NO: 6539907 - DNA, 17 bp, Homo sapiens
tgtcacttgctgctttt

SEQ ID NO: 6539908 - DNA, 22 bp, Homo sapiens
tgtcacttgctggctgtgaaac

SEQ ID NO: 6539909 - DNA, 23 bp, Homo sapiens
tgtcacttggtggcggggtgggg

SEQ ID NO: 6539910 - DNA, 22 bp, Homo sapiens
tgtcacttgtaggtttctctgc

SEQ ID NO: 6539911 - DNA, 17 bp, Homo sapiens
tgtcacttgtgctttgc

SEQ ID NO: 6539912 - DNA, 15 bp, Homo sapiens
tgtcactttgctctg

SEQ ID NO: 6539913 - DNA, 16 bp, Homo sapiens
tgtcactttgctctgg

SEQ ID NO: 6539914 - DNA, 17 bp, Homo sapiens
tgtcactttgctctggg

SEQ ID NO: 6539915 - DNA, 17 bp, Homo sapiens
tgtcacttttccttttc

SEQ ID NO: 6539916 - DNA, 21 bp, Homo sapiens
tgtcactttttgaggcaaaag

SEQ ID NO: 6539917 - DNA, 16 bp, Homo sapiens
tgtcagaaaaaatatg

SEQ ID NO: 6539918 - DNA, 19 bp, Homo sapiens
tgtcagaaaaacaataaga

SEQ ID NO: 6539919 - DNA, 22 bp, Homo sapiens
tgtcagaaaaacaataagagcg

SEQ ID NO: 6539920 - DNA, 20 bp, Homo sapiens
tgtcagaaaccctggtctcc

SEQ ID NO: 6539921 - DNA, 21 bp, Homo sapiens
tgtcagaactagaatttgatt

SEQ ID NO: 6539922 - DNA, 16 bp, Homo sapiens
tgtcagaataaagaac

SEQ ID NO: 6539923 - DNA, 17 bp, Homo sapiens
tgtcagaataaagaaca

SEQ ID NO: 6539924 - DNA, 19 bp, Homo sapiens
tgtcagaataaagaacatt

SEQ ID NO: 6539925 - DNA, 19 bp, Homo sapiens
tgtcagaatcatgctgttc

SEQ ID NO: 6539926 - DNA, 23 bp, Homo sapiens
tgtcagaatggaatccatctgtc

SEQ ID NO: 6539927 - DNA, 24 bp, Homo sapiens
tgtcagaatggaatccatctgtct

SEQ ID NO: 6539928 - DNA, 12 bp, Homo sapiens
tgtcagaatgtt

SEQ ID NO: 6539929 - DNA, 18 bp, Homo sapiens
tgtcagacaataccactg

SEQ ID NO: 6539930 - DNA, 14 bp, Homo sapiens
tgtcagacacagat

SEQ ID NO: 6539931 - DNA, 16 bp, Homo sapiens
tgtcagacataaagcc

SEQ ID NO: 6539932 - DNA, 15 bp, Homo sapiens
tgtcagaccctggag

SEQ ID NO: 6539933 - DNA, 19 bp, Homo sapiens
tgtcagaccttcttccaca

SEQ ID NO: 6539934 - DNA, 19 bp, Homo sapiens
tgtcagactatccatttta

SEQ ID NO: 6539935 - DNA, 23 bp, Homo sapiens
tgtcagactatccattttacact

SEQ ID NO: 6539936 - DNA, 20 bp, Homo sapiens
tgtcagactttgctgcattt

SEQ ID NO: 6539937 - DNA, 21 bp, Homo sapiens
tgtcagactttgctgcatttt

SEQ ID NO: 6539938 - DNA, 19 bp, Homo sapiens
tgtcagagaaaatgaattt

SEQ ID NO: 6539939 - DNA, 14 bp, Homo sapiens
tgtcagagaatatg

SEQ ID NO: 6539940 - DNA, 18 bp, Homo sapiens
tgtcagagatctgggagg

SEQ ID NO: 6539941 - DNA, 23 bp, Homo sapiens
ttctgttccaacctcctgctctg

SEQ ID NO: 6539942 - DNA, 18 bp, Homo sapiens
ttctgttcccaaggaagc

SEQ ID NO: 6539943 - DNA, 13 bp, Homo sapiens
ttctgttccccag

SEQ ID NO: 6539944 - DNA, 17 bp, Homo sapiens
ttctgttcctttttgta

SEQ ID NO: 6539945 - DNA, 18 bp, Homo sapiens
ttctgttcgaagttcatt

SEQ ID NO: 6539946 - DNA, 14 bp, Homo sapiens
ttctgttctagttt

SEQ ID NO: 6539947 - DNA, 13 bp, Homo sapiens
ttctgttctcatt

SEQ ID NO: 6539948 - DNA, 15 bp, Homo sapiens
ttctgttctctgctg

SEQ ID NO: 6539949 - DNA, 16 bp, Homo sapiens
ttctgttctctgctga

SEQ ID NO: 6539950 - DNA, 13 bp, Homo sapiens
ttctgttctgata

SEQ ID NO: 6539951 - DNA, 15 bp, Homo sapiens
ttctgttctgctggg

SEQ ID NO: 6539952 - DNA, 15 bp, Homo sapiens
ttctgttctggagga

SEQ ID NO: 6539953 - DNA, 16 bp, Homo sapiens
ttctgttctggaggaa

SEQ ID NO: 6539954 - DNA, 14 bp, Homo sapiens
ttctgttctggggg

SEQ ID NO: 6539955 - DNA, 15 bp, Homo sapiens
ttctgttctgttgat

SEQ ID NO: 6539956 - DNA, 16 bp, Homo sapiens
ttctgttcttacaaat

SEQ ID NO: 6539957 - DNA, 11 bp, Homo sapiens
ttctgttgaag

SEQ ID NO: 6539958 - DNA, 15 bp, Homo sapiens
ttctgttgaagatta

SEQ ID NO: 6539959 - DNA, 24 bp, Homo sapiens
ttctgttgatcccacttcactgtg

SEQ ID NO: 6539960 - DNA, 22 bp, Homo sapiens
ttctgttgcccaggctggcctg

SEQ ID NO: 6539961 - DNA, 18 bp, Homo sapiens
ttctgttggccagcacgt

SEQ ID NO: 6539962 - DNA, 19 bp, Homo sapiens
ttctgttggtctacagaaa

SEQ ID NO: 6539963 - DNA, 16 bp, Homo sapiens
ttctgttggtcttaac

SEQ ID NO: 6539964 - DNA, 22 bp, Homo sapiens
ttctgttggtcttaactaatgt

SEQ ID NO: 6539965 - DNA, 13 bp, Homo sapiens
ttctgttgtaact

SEQ ID NO: 6539966 - DNA, 17 bp, Homo sapiens
ttctgttgtaacttatg

SEQ ID NO: 6539967 - DNA, 19 bp, Homo sapiens
ttctgttgttttgtgtata

SEQ ID NO: 6539968 - DNA, 12 bp, Homo sapiens
ttctgtttaact

SEQ ID NO: 6539969 - DNA, 18 bp, Homo sapiens
ttctgtttagataataca

SEQ ID NO: 6539970 - DNA, 16 bp, Homo sapiens
ttctgtttaggaagaa

SEQ ID NO: 6539971 - DNA, 20 bp, Homo sapiens
ttctgtttataatgaagaac

SEQ ID NO: 6539972 - DNA, 14 bp, Homo sapiens
ttctgtttattatg

SEQ ID NO: 6539973 - DNA, 20 bp, Homo sapiens
ttctgtttattatgacaaat

SEQ ID NO: 6539974 - DNA, 17 bp, Homo sapiens
ttctgtttattcttcca

SEQ ID NO: 6539975 - DNA, 15 bp, Homo sapiens
ttctgtttcaaagca

SEQ ID NO: 6539976 - DNA, 18 bp, Homo sapiens
ttctgtttcagagcataa

SEQ ID NO: 6539977 - DNA, 13 bp, Homo sapiens
ttctgtttcctct

SEQ ID NO: 6539978 - DNA, 14 bp, Homo sapiens
ttctgtttcctggc

SEQ ID NO: 6539979 - DNA, 13 bp, Homo sapiens
ttctgtttcctgt

SEQ ID NO: 6539980 - DNA, 15 bp, Homo sapiens
ttctgtttcctgtgt

SEQ ID NO: 6539981 - DNA, 17 bp, Homo sapiens
ttctgtttcctgtgtct

SEQ ID NO: 6539982 - DNA, 20 bp, Homo sapiens
ttctgtttcctgtgtctcca

SEQ ID NO: 6539983 - DNA, 12 bp, Homo sapiens
ttctgtttctca

SEQ ID NO: 6539984 - DNA, 14 bp, Homo sapiens
ttctgtttctgttt

SEQ ID NO: 6539985 - DNA, 12 bp, Homo sapiens
ttctgtttcttc

SEQ ID NO: 6539986 - DNA, 18 bp, Homo sapiens
ttctgtttgaattttcaa

SEQ ID NO: 6539987 - DNA, 15 bp, Homo sapiens
ttctgtttggcactt

SEQ ID NO: 6539988 - DNA, 22 bp, Homo sapiens
ttctgtttgtaaattatttgct

SEQ ID NO: 6539989 - DNA, 13 bp, Homo sapiens
ttctgttttcaat

SEQ ID NO: 6539990 - DNA, 13 bp, Homo sapiens
ttctgttttgtta

SEQ ID NO: 6539991 - DNA, 23 bp, Homo sapiens
ttctgttttgtttggcaaggaaa

SEQ ID NO: 6539992 - DNA, 13 bp, Homo sapiens
ttctgtttttctc

SEQ ID NO: 6539993 - DNA, 18 bp, Homo sapiens
ttctgtttttctcaaata

SEQ ID NO: 6539994 - DNA, 20 bp, Homo sapiens
ttctgttttttctgtacaca

SEQ ID NO: 6539995 - DNA, 21 bp, Homo sapiens
ttctgttttttttttttgtat

SEQ ID NO: 6539996 - DNA, 22 bp, Homo sapiens
ttctgttttttttttttgtatt

SEQ ID NO: 6539997 - DNA, 17 bp, Homo sapiens
ttcttaaaaaaataaaa

SEQ ID NO: 6539998 - DNA, 16 bp, Homo sapiens
ttcttaaaaactgtgt

SEQ ID NO: 6539999 - DNA, 18 bp, Homo sapiens
ttcttaaaaactgtgtat

SEQ ID NO: 6540000 - DNA, 17 bp, Homo sapiens
ttcttaaaaatgcattt

SEQ ID NO: 6540001 - DNA, 22 bp, Homo sapiens
ttcttaaaaatgcatttaagtt

SEQ ID NO: 6540002 - DNA, 12 bp, Homo sapiens
ttcttaaaacac

SEQ ID NO: 6540003 - DNA, 15 bp, Homo sapiens
ttcttaaaacacatg

SEQ ID NO: 6540004 - DNA, 14 bp, Homo sapiens
ttcttaaaacacta

SEQ ID NO: 6540005 - DNA, 20 bp, Homo sapiens
ttcttaaaaccaatcaataa

SEQ ID NO: 6540006 - DNA, 19 bp, Homo sapiens
ttcttaaaactttattaaa

SEQ ID NO: 6540007 - DNA, 20 bp, Homo sapiens
ttcttaaaactttattaaaa

SEQ ID NO: 6540008 - DNA, 21 bp, Homo sapiens
ttcttaaaaggcccatagcag

SEQ ID NO: 6540009 - DNA, 18 bp, Homo sapiens
ttcttaaaagggaaatta

SEQ ID NO: 6540010 - DNA, 12 bp, Homo sapiens
ttcttaaaagta

SEQ ID NO: 6540011 - DNA, 18 bp, Homo sapiens
ttcttaaaagtactttaa

SEQ ID NO: 6540012 - DNA, 19 bp, Homo sapiens
ttcttaaaagtactttaaa

SEQ ID NO: 6540013 - DNA, 23 bp, Homo sapiens
ttcttaaaagtactttaaaaagg

SEQ ID NO: 6540014 - DNA, 15 bp, Homo sapiens
ttcttaaaagtttct

SEQ ID NO: 6540015 - DNA, 12 bp, Homo sapiens
ttcttaaaatat

SEQ ID NO: 6540016 - DNA, 15 bp, Homo sapiens
ttcttaaaatatatt

SEQ ID NO: 6540017 - DNA, 21 bp, Homo sapiens
ttcttaaaatatatttcagat

SEQ ID NO: 6540018 - DNA, 13 bp, Homo sapiens
ttcttaaaatatt

SEQ ID NO: 6540019 - DNA, 14 bp, Homo sapiens
ttcttaaaatattg

SEQ ID NO: 6540020 - DNA, 22 bp, Homo sapiens
ttcttaaaatgcaatatttgta

SEQ ID NO: 6540021 - DNA, 12 bp, Homo sapiens
ttcttaaaatgt

SEQ ID NO: 6540022 - DNA, 19 bp, Homo sapiens
ttcttaaaattcaagaaaa

SEQ ID NO: 6540023 - DNA, 14 bp, Homo sapiens
ttcttaaaccaacc

SEQ ID NO: 6540024 - DNA, 13 bp, Homo sapiens
ttcttaaagagtt

SEQ ID NO: 6540025 - DNA, 14 bp, Homo sapiens
ttcttaaaggcctg

SEQ ID NO: 6540026 - DNA, 15 bp, Homo sapiens
ttcttaaaggcctgg

SEQ ID NO: 6540027 - DNA, 15 bp, Homo sapiens
ttcttaaagtgccag

SEQ ID NO: 6540028 - DNA, 21 bp, Homo sapiens
ttcttaaagtttaaagttgca

SEQ ID NO: 6540029 - DNA, 11 bp, Homo sapiens
ttcttaaataa

SEQ ID NO: 6540030 - DNA, 19 bp, Homo sapiens
ttcttaaataagaaacttt

SEQ ID NO: 6540031 - DNA, 19 bp, Homo sapiens
ttcttaaataataaagatc

SEQ ID NO: 6540032 - DNA, 11 bp, Homo sapiens
ttcttaaatat

SEQ ID NO: 6540033 - DNA, 14 bp, Homo sapiens
ttcttaaatatctt

SEQ ID NO: 6540034 - DNA, 16 bp, Homo sapiens
ttcttaaatatctttt

SEQ ID NO: 6540035 - DNA, 13 bp, Homo sapiens
ttcttaaatgttt

SEQ ID NO: 6540036 - DNA, 15 bp, Homo sapiens
ttcttaaatgtttat

SEQ ID NO: 6540037 - DNA, 21 bp, Homo sapiens
ttcttaaattttgtaggattt

SEQ ID NO: 6540038 - DNA, 23 bp, Homo sapiens
ttcttaacaaactcttcagttaa

SEQ ID NO: 6540039 - DNA, 13 bp, Homo sapiens
ttcttaacagttt

SEQ ID NO: 6540040 - DNA, 15 bp, Homo sapiens
ttcttaacatagcca

SEQ ID NO: 6540041 - DNA, 14 bp, Homo sapiens
ttcttaacatgctt

SEQ ID NO: 6540042 - DNA, 13 bp, Homo sapiens
ttcttaactaaaa

SEQ ID NO: 6540043 - DNA, 18 bp, Homo sapiens
ttcttaagacatgtatca

SEQ ID NO: 6540044 - DNA, 21 bp, Homo sapiens
ttcttaagacgtgattttgct

SEQ ID NO: 6540045 - DNA, 20 bp, Homo sapiens
ttcttaagatttctcctgac

SEQ ID NO: 6540046 - DNA, 23 bp, Homo sapiens
ttcttaagcactttgaaaatatt

SEQ ID NO: 6540047 - DNA, 21 bp, Homo sapiens
ttcttaagccctttgctctgg

SEQ ID NO: 6540048 - DNA, 23 bp, Homo sapiens
ttcttaagccctttgctctggag

SEQ ID NO: 6540049 - DNA, 20 bp, Homo sapiens
ttcttaagccgatggtcact

SEQ ID NO: 6540050 - DNA, 20 bp, Homo sapiens
ttcttaaggacagtgttcaa

SEQ ID NO: 6540051 - DNA, 22 bp, Homo sapiens
ttcttaaggattgtgatatttt

SEQ ID NO: 6540052 - DNA, 23 bp, Homo sapiens
ttcttaaggtgaggcctgtctgt

SEQ ID NO: 6540053 - DNA, 22 bp, Homo sapiens
ttcttaagtatgttattttctg

SEQ ID NO: 6540054 - DNA, 22 bp, Homo sapiens
ttcttaatagaaagtcagatga

SEQ ID NO: 6540055 - DNA, 13 bp, Homo sapiens
ttcttaatataca

SEQ ID NO: 6540056 - DNA, 18 bp, Homo sapiens
ttcttaatatatagcatt

SEQ ID NO: 6540057 - DNA, 21 bp, Homo sapiens
ttcttaatcttttcacaaata

SEQ ID NO: 6540058 - DNA, 20 bp, Homo sapiens
ttcttaatgctttcctccct

SEQ ID NO: 6540059 - DNA, 21 bp, Homo sapiens
ttcttaatgtacatagtgcta

SEQ ID NO: 6540060 - DNA, 14 bp, Homo sapiens
ttcttaatgtctgt

SEQ ID NO: 6540061 - DNA, 21 bp, Homo sapiens
ttcttaatgtctgtcagaaga

SEQ ID NO: 6540062 - DNA, 13 bp, Homo sapiens
ttcttaattaatt

SEQ ID NO: 6540063 - DNA, 14 bp, Homo sapiens
ttcttaattaattt

SEQ ID NO: 6540064 - DNA, 12 bp, Homo sapiens
ttcttaattatg

SEQ ID NO: 6540065 - DNA, 20 bp, Homo sapiens
ttcttaattgcactctaaaa

SEQ ID NO: 6540066 - DNA, 18 bp, Homo sapiens
ttcttaatttatgtaagg

SEQ ID NO: 6540067 - DNA, 14 bp, Homo sapiens
ttcttaatttggaa

SEQ ID NO: 6540068 - DNA, 21 bp, Homo sapiens
ttcttaatttggataataaaa

SEQ ID NO: 6540069 - DNA, 20 bp, Homo sapiens
ttcttaattttagggacagc

SEQ ID NO: 6540070 - DNA, 12 bp, Homo sapiens
ttcttacaagga

SEQ ID NO: 6540071 - DNA, 12 bp, Homo sapiens
ttcttacacata

SEQ ID NO: 6540072 - DNA, 14 bp, Homo sapiens
ttcttacagcacat

SEQ ID NO: 6540073 - DNA, 16 bp, Homo sapiens
ttcttacataattttt

SEQ ID NO: 6540074 - DNA, 14 bp, Homo sapiens
ttcttacatgcatt

SEQ ID NO: 6540075 - DNA, 16 bp, Homo sapiens
ttcttacccaaagcac

SEQ ID NO: 6540076 - DNA, 18 bp, Homo sapiens
ttcttaccctagttctct

SEQ ID NO: 6540077 - DNA, 20 bp, Homo sapiens
ttcttaccctctctttcaat

SEQ ID NO: 6540078 - DNA, 15 bp, Homo sapiens
ttcttaccgaaatga

SEQ ID NO: 6540079 - DNA, 19 bp, Homo sapiens
ttcttaccgaaatgaaaat

SEQ ID NO: 6540080 - DNA, 19 bp, Homo sapiens
ttcttacgaacgccacggc

SEQ ID NO: 6540081 - DNA, 18 bp, Homo sapiens
ttcttactaaaaagtata

SEQ ID NO: 6540082 - DNA, 20 bp, Homo sapiens
ttcttactaaaaagtataaa

SEQ ID NO: 6540083 - DNA, 17 bp, Homo sapiens
ttcttactcctcctctt

SEQ ID NO: 6540084 - DNA, 14 bp, Homo sapiens
ttcttactgacacc

SEQ ID NO: 6540085 - DNA, 16 bp, Homo sapiens
ttcttactgataattt

SEQ ID NO: 6540086 - DNA, 24 bp, Homo sapiens
ttcttagaaaattaaaataggcat

SEQ ID NO: 6540087 - DNA, 12 bp, Homo sapiens
ttcttagaaatt

SEQ ID NO: 6540088 - DNA, 18 bp, Homo sapiens
ttcttagacttttccaat

SEQ ID NO: 6540089 - DNA, 22 bp, Homo sapiens
ttcttagagcagattctagcac

SEQ ID NO: 6540090 - DNA, 13 bp, Homo sapiens
ttcttagagtgta

SEQ ID NO: 6540091 - DNA, 13 bp, Homo sapiens
ttcttagagtttt

SEQ ID NO: 6540092 - DNA, 17 bp, Homo sapiens
ttcttagcctgtggcag

SEQ ID NO: 6540093 - DNA, 18 bp, Homo sapiens
ttcttagcctgtggcagt

SEQ ID NO: 6540094 - DNA, 23 bp, Homo sapiens
ttcttagcctgtggcagtaaaga

SEQ ID NO: 6540095 - DNA, 23 bp, Homo sapiens
ttcttagctcaatgagcatgttt

SEQ ID NO: 6540096 - DNA, 18 bp, Homo sapiens
ttcttagctgcactgttt

SEQ ID NO: 6540097 - DNA, 15 bp, Homo sapiens
ttcttagctttgaaa

SEQ ID NO: 6540098 - DNA, 16 bp, Homo sapiens
ttcttagctttgaaac

SEQ ID NO: 6540099 - DNA, 17 bp, Homo sapiens
ttcttagctttgaaact

SEQ ID NO: 6540100 - DNA, 22 bp, Homo sapiens
ttcttaggagcaagaagaaaat

SEQ ID NO: 6540101 - DNA, 23 bp, Homo sapiens
ttcttaggagcaagaagaaaatg

SEQ ID NO: 6540102 - DNA, 23 bp, Homo sapiens
ttcttagggcacatgaaaaattt

SEQ ID NO: 6540103 - DNA, 19 bp, Homo sapiens
ttcttagggttatgattaa

SEQ ID NO: 6540104 - DNA, 14 bp, Homo sapiens
ttcttaggtttact

SEQ ID NO: 6540105 - DNA, 15 bp, Homo sapiens
ttcttaggtttactg

SEQ ID NO: 6540106 - DNA, 17 bp, Homo sapiens
ttcttaggtttactgtg

SEQ ID NO: 6540107 - DNA, 18 bp, Homo sapiens
ttcttaggtttactgtga

SEQ ID NO: 6540108 - DNA, 21 bp, Homo sapiens
ttcttaggtttactgtgaaga

SEQ ID NO: 6540109 - DNA, 19 bp, Homo sapiens
ttcttagtgcttcagagtt

SEQ ID NO: 6540110 - DNA, 13 bp, Homo sapiens
ttcttagtgtcac

SEQ ID NO: 6540111 - DNA, 20 bp, Homo sapiens
ttcttagtgtggtatttgct

SEQ ID NO: 6540112 - DNA, 18 bp, Homo sapiens
ttcttagttctcactgtt

SEQ ID NO: 6540113 - DNA, 17 bp, Homo sapiens
ttcttagtttcagaagt

SEQ ID NO: 6540114 - DNA, 14 bp, Homo sapiens
ttcttataaatatg

SEQ ID NO: 6540115 - DNA, 17 bp, Homo sapiens
ttcttataaatatgaag

SEQ ID NO: 6540116 - DNA, 13 bp, Homo sapiens
ttcttataatact

SEQ ID NO: 6540117 - DNA, 20 bp, Homo sapiens
ttcttatacgcttttctttg

SEQ ID NO: 6540118 - DNA, 16 bp, Homo sapiens
ttcttatatctgaaga

SEQ ID NO: 6540119 - DNA, 21 bp, Homo sapiens
ttcttatatctgaagattgaa

SEQ ID NO: 6540120 - DNA, 14 bp, Homo sapiens
ttcttatattattc

SEQ ID NO: 6540121 - DNA, 13 bp, Homo sapiens
tgtcagagatgtt

SEQ ID NO: 6540122 - DNA, 16 bp, Homo sapiens
tgtcagagcccagccc

SEQ ID NO: 6540123 - DNA, 21 bp, Homo sapiens
tgtcagagctatgttccctcc

SEQ ID NO: 6540124 - DNA, 14 bp, Homo sapiens
tgtcagagctggga

SEQ ID NO: 6540125 - DNA, 19 bp, Homo sapiens
tgtcagagctgttataaat

SEQ ID NO: 6540126 - DNA, 20 bp, Homo sapiens
tgtcagagctgttggcctcg

SEQ ID NO: 6540127 - DNA, 17 bp, Homo sapiens
tgtcagaggaccccagg

SEQ ID NO: 6540128 - DNA, 19 bp, Homo sapiens
tgtcagaggaccccagggt

SEQ ID NO: 6540129 - DNA, 12 bp, Homo sapiens
tgtcagaggcta

SEQ ID NO: 6540130 - DNA, 16 bp, Homo sapiens
tgtcagagttctgctc

SEQ ID NO: 6540131 - DNA, 23 bp, Homo sapiens
tgtcagataagccggtgggggga

SEQ ID NO: 6540132 - DNA, 16 bp, Homo sapiens
tgtcagataagtgtaa

SEQ ID NO: 6540133 - DNA, 15 bp, Homo sapiens
tgtcagatatgatat

SEQ ID NO: 6540134 - DNA, 20 bp, Homo sapiens
tgtcagatattcatattgac

SEQ ID NO: 6540135 - DNA, 20 bp, Homo sapiens
tgtcagatattttttcagaa

SEQ ID NO: 6540136 - DNA, 23 bp, Homo sapiens
tgtcagatattttttcagaaata

SEQ ID NO: 6540137 - DNA, 17 bp, Homo sapiens
tgtcagatcgttcattg

SEQ ID NO: 6540138 - DNA, 17 bp, Homo sapiens
tgtcagatgagaacaaa

SEQ ID NO: 6540139 - DNA, 19 bp, Homo sapiens
tgtcagatgagaacaaagc

SEQ ID NO: 6540140 - DNA, 20 bp, Homo sapiens
tgtcagatgagaacaaagct

SEQ ID NO: 6540141 - DNA, 10 bp, Homo sapiens
tgtcagatgc

SEQ ID NO: 6540142 - DNA, 14 bp, Homo sapiens
tgtcagattaaatt

SEQ ID NO: 6540143 - DNA, 18 bp, Homo sapiens
tgtcagattaaattacag

SEQ ID NO: 6540144 - DNA, 14 bp, Homo sapiens
tgtcagattcacac

SEQ ID NO: 6540145 - DNA, 19 bp, Homo sapiens
tgtcagcaaaaagcaaaat

SEQ ID NO: 6540146 - DNA, 23 bp, Homo sapiens
tgtcagcaaaaagcaaaatcatt

SEQ ID NO: 6540147 - DNA, 19 bp, Homo sapiens
tgtcagcaagaggaggaca

SEQ ID NO: 6540148 - DNA, 23 bp, Homo sapiens
tgtcagcacacacttacagagca

SEQ ID NO: 6540149 - DNA, 11 bp, Homo sapiens
tgtcagcagac

SEQ ID NO: 6540150 - DNA, 17 bp, Homo sapiens
tgtcagcagacacacat

SEQ ID NO: 6540151 - DNA, 18 bp, Homo sapiens
tgtcagcagctctgagac

SEQ ID NO: 6540152 - DNA, 21 bp, Homo sapiens
tgtcagcaggcaggctgggga

SEQ ID NO: 6540153 - DNA, 15 bp, Homo sapiens
tgtcagcatagaagt

SEQ ID NO: 6540154 - DNA, 10 bp, Homo sapiens
tgtcagcatc

SEQ ID NO: 6540155 - DNA, 11 bp, Homo sapiens
tgtcagcatct

SEQ ID NO: 6540156 - DNA, 12 bp, Homo sapiens
tgtcagcatctg

SEQ ID NO: 6540157 - DNA, 18 bp, Homo sapiens
tgtcagcatctgaccatc

SEQ ID NO: 6540158 - DNA, 20 bp, Homo sapiens
tgtcagcatctgaccatctg

SEQ ID NO: 6540159 - DNA, 16 bp, Homo sapiens
tgtcagcatctggctg

SEQ ID NO: 6540160 - DNA, 18 bp, Homo sapiens
tgtcagcatcttctcact

SEQ ID NO: 6540161 - DNA, 16 bp, Homo sapiens
tgtcagcatgaatttg

SEQ ID NO: 6540162 - DNA, 20 bp, Homo sapiens
tgtcagcatgaatttgtaat

SEQ ID NO: 6540163 - DNA, 19 bp, Homo sapiens
tgtcagcatgcatagtgct

SEQ ID NO: 6540164 - DNA, 22 bp, Homo sapiens
tgtcagcattcctattaatgtc

SEQ ID NO: 6540165 - DNA, 20 bp, Homo sapiens
tgtcagccaacattgccttg

SEQ ID NO: 6540166 - DNA, 13 bp, Homo sapiens
tgtcagccacctc

SEQ ID NO: 6540167 - DNA, 14 bp, Homo sapiens
tgtcagccacctcc

SEQ ID NO: 6540168 - DNA, 13 bp, Homo sapiens
tgtcagccagccg

SEQ ID NO: 6540169 - DNA, 19 bp, Homo sapiens
tgtcagccagccgccctgg

SEQ ID NO: 6540170 - DNA, 22 bp, Homo sapiens
tgtcagccagccgccctgggct

SEQ ID NO: 6540171 - DNA, 20 bp, Homo sapiens
tgtcagccatcgtcctggga

SEQ ID NO: 6540172 - DNA, 21 bp, Homo sapiens
tgtcagccatcgtcctgggac

SEQ ID NO: 6540173 - DNA, 20 bp, Homo sapiens
tgtcagccattgcacccagc

SEQ ID NO: 6540174 - DNA, 20 bp, Homo sapiens
tgtcagcccaagcagagtga

SEQ ID NO: 6540175 - DNA, 12 bp, Homo sapiens
tgtcagcccctc

SEQ ID NO: 6540176 - DNA, 20 bp, Homo sapiens
tgtcagccgagccgggcctg

SEQ ID NO: 6540177 - DNA, 23 bp, Homo sapiens
tgtcagccgagccgggcctgggg

SEQ ID NO: 6540178 - DNA, 15 bp, Homo sapiens
tgtcagccgggccct

SEQ ID NO: 6540179 - DNA, 16 bp, Homo sapiens
tgtcagccgggccctg

SEQ ID NO: 6540180 - DNA, 22 bp, Homo sapiens
tgtcagccgggccctgagtaat

SEQ ID NO: 6540181 - DNA, 21 bp, Homo sapiens
tgtcagcctgaagatcagagc

SEQ ID NO: 6540182 - DNA, 14 bp, Homo sapiens
tgtcagcctgtgct

SEQ ID NO: 6540183 - DNA, 13 bp, Homo sapiens
tgtcagccttgca

SEQ ID NO: 6540184 - DNA, 19 bp, Homo sapiens
tgtcagcgtttctccacct

SEQ ID NO: 6540185 - DNA, 17 bp, Homo sapiens
tgtcagctacatgaagt

SEQ ID NO: 6540186 - DNA, 18 bp, Homo sapiens
tgtcagctactaatgatg

SEQ ID NO: 6540187 - DNA, 19 bp, Homo sapiens
tgtcagctcaggcagctcg

SEQ ID NO: 6540188 - DNA, 20 bp, Homo sapiens
tgtcagctcccctcggagaa

SEQ ID NO: 6540189 - DNA, 20 bp, Homo sapiens
tgtcagctctcatctgaggc

SEQ ID NO: 6540190 - DNA, 16 bp, Homo sapiens
tgtcagctgaacctgg

SEQ ID NO: 6540191 - DNA, 13 bp, Homo sapiens
tgtcagctgaggc

SEQ ID NO: 6540192 - DNA, 14 bp, Homo sapiens
tgtcagctgaggct

SEQ ID NO: 6540193 - DNA, 15 bp, Homo sapiens
tgtcagctgtgggga

SEQ ID NO: 6540194 - DNA, 16 bp, Homo sapiens
tgtcagcttaaaattg

SEQ ID NO: 6540195 - DNA, 15 bp, Homo sapiens
tgtcagcttatccta

SEQ ID NO: 6540196 - DNA, 13 bp, Homo sapiens
tgtcagcttccca

SEQ ID NO: 6540197 - DNA, 15 bp, Homo sapiens
tgtcagcttcccagc

SEQ ID NO: 6540198 - DNA, 20 bp, Homo sapiens
tgtcaggaacagaaggatga

SEQ ID NO: 6540199 - DNA, 15 bp, Homo sapiens
tgtcaggacccaggc

SEQ ID NO: 6540200 - DNA, 16 bp, Homo sapiens
tgtcaggagagcagcg

SEQ ID NO: 6540201 - DNA, 22 bp, Homo sapiens
tgtcaggcacagtaagcatgct

SEQ ID NO: 6540202 - DNA, 20 bp, Homo sapiens
tgtcaggcagtagcagctgt

SEQ ID NO: 6540203 - DNA, 20 bp, Homo sapiens
tgtcaggcatggctcagagc

SEQ ID NO: 6540204 - DNA, 22 bp, Homo sapiens
tgtcaggcccccagtgggacca

SEQ ID NO: 6540205 - DNA, 22 bp, Homo sapiens
tgtcaggcccgtcggagctgcc

SEQ ID NO: 6540206 - DNA, 23 bp, Homo sapiens
tgtcaggcccgtcggagctgcct

SEQ ID NO: 6540207 - DNA, 15 bp, Homo sapiens
tgtcaggccctctgc

SEQ ID NO: 6540208 - DNA, 19 bp, Homo sapiens
tgtcaggccctctgcctgc

SEQ ID NO: 6540209 - DNA, 21 bp, Homo sapiens
tgtcaggccctctgcctgcac

SEQ ID NO: 6540210 - DNA, 22 bp, Homo sapiens
tgtcaggccctctgcctgcact

SEQ ID NO: 6540211 - DNA, 18 bp, Homo sapiens
tgtcaggctacaaggtag

SEQ ID NO: 6540212 - DNA, 14 bp, Homo sapiens
tgtcaggctctggc

SEQ ID NO: 6540213 - DNA, 16 bp, Homo sapiens
tgtcagggagggccag

SEQ ID NO: 6540214 - DNA, 17 bp, Homo sapiens
tgtcagggagggccagg

SEQ ID NO: 6540215 - DNA, 19 bp, Homo sapiens
tgtcagggagtgttcccta

SEQ ID NO: 6540216 - DNA, 12 bp, Homo sapiens
tgtcagggatga

SEQ ID NO: 6540217 - DNA, 21 bp, Homo sapiens
tgtcagggatttagcccatga

SEQ ID NO: 6540218 - DNA, 22 bp, Homo sapiens
tgtcagggccaggtgcagacct

SEQ ID NO: 6540219 - DNA, 15 bp, Homo sapiens
tgtcagggtccagga

SEQ ID NO: 6540220 - DNA, 21 bp, Homo sapiens
tgtcagggtccaggagagcct

SEQ ID NO: 6540221 - DNA, 18 bp, Homo sapiens
tgtcagggtctccttcct

SEQ ID NO: 6540222 - DNA, 19 bp, Homo sapiens
tgtcagggttggaaagtcc

SEQ ID NO: 6540223 - DNA, 15 bp, Homo sapiens
tgtcaggtcccagcg

SEQ ID NO: 6540224 - DNA, 16 bp, Homo sapiens
tgtcaggtggggcagc

SEQ ID NO: 6540225 - DNA, 18 bp, Homo sapiens
tgtcaggtggggcagctt

SEQ ID NO: 6540226 - DNA, 23 bp, Homo sapiens
tgtcaggtggttaccaggcactg

SEQ ID NO: 6540227 - DNA, 15 bp, Homo sapiens
tgtcaggttatttat

SEQ ID NO: 6540228 - DNA, 17 bp, Homo sapiens
tgtcagtactaaggtga

SEQ ID NO: 6540229 - DNA, 16 bp, Homo sapiens
tgtcagtagtgctaat

SEQ ID NO: 6540230 - DNA, 14 bp, Homo sapiens
tgtcagtatccagg

SEQ ID NO: 6540231 - DNA, 20 bp, Homo sapiens
tgtcagtatctgtatctctc

SEQ ID NO: 6540232 - DNA, 19 bp, Homo sapiens
tgtcagtatgtggaagtgt

SEQ ID NO: 6540233 - DNA, 16 bp, Homo sapiens
tgtcagtattattcta

SEQ ID NO: 6540234 - DNA, 14 bp, Homo sapiens
tgtcagtatttact

SEQ ID NO: 6540235 - DNA, 13 bp, Homo sapiens
tgtcagtatttca

SEQ ID NO: 6540236 - DNA, 22 bp, Homo sapiens
tgtcagtcacagccacccctga

SEQ ID NO: 6540237 - DNA, 16 bp, Homo sapiens
tgtcagtcgtgttgct

SEQ ID NO: 6540238 - DNA, 20 bp, Homo sapiens
tgtcagtctgcttagaaata

SEQ ID NO: 6540239 - DNA, 13 bp, Homo sapiens
tgtcagtctgtcc

SEQ ID NO: 6540240 - DNA, 15 bp, Homo sapiens
tgtcagtctgtccac

SEQ ID NO: 6540241 - DNA, 15 bp, Homo sapiens
tgtcagtgaggactc

SEQ ID NO: 6540242 - DNA, 14 bp, Homo sapiens
tgtcagtgcagccc

SEQ ID NO: 6540243 - DNA, 21 bp, Homo sapiens
tgtcagtgctagatttagcac

SEQ ID NO: 6540244 - DNA, 16 bp, Homo sapiens
tgtcagtggggcagcc

SEQ ID NO: 6540245 - DNA, 19 bp, Homo sapiens
tgtcagtggggcagcctct

SEQ ID NO: 6540246 - DNA, 19 bp, Homo sapiens
tgtcagtggggctctctga

SEQ ID NO: 6540247 - DNA, 14 bp, Homo sapiens
tgtcagtggtttct

SEQ ID NO: 6540248 - DNA, 19 bp, Homo sapiens
tgtcagtgtagacacaggt

SEQ ID NO: 6540249 - DNA, 19 bp, Homo sapiens
tgtcagtgtcattattagt

SEQ ID NO: 6540250 - DNA, 12 bp, Homo sapiens
tgtcagtgtgaa

SEQ ID NO: 6540251 - DNA, 12 bp, Homo sapiens
tgtcagtgtgac

SEQ ID NO: 6540252 - DNA, 20 bp, Homo sapiens
tgtcagtgtgactgatctct

SEQ ID NO: 6540253 - DNA, 20 bp, Homo sapiens
tgtcagtgttaaagattttg

SEQ ID NO: 6540254 - DNA, 13 bp, Homo sapiens
tgtcagtgttttt

SEQ ID NO: 6540255 - DNA, 14 bp, Homo sapiens
tgtcagttcatcct

SEQ ID NO: 6540256 - DNA, 15 bp, Homo sapiens
tgtcagttcatcctg

SEQ ID NO: 6540257 - DNA, 21 bp, Homo sapiens
tgtcagttccaaacagacaaa

SEQ ID NO: 6540258 - DNA, 23 bp, Homo sapiens
tgtcagttcttggtgctctgtgt

SEQ ID NO: 6540259 - DNA, 18 bp, Homo sapiens
tgtcagttgtacttctgc

SEQ ID NO: 6540260 - DNA, 17 bp, Homo sapiens
tgtcagttgttatttat

SEQ ID NO: 6540261 - DNA, 18 bp, Homo sapiens
tgtcagttgttatttatt

SEQ ID NO: 6540262 - DNA, 22 bp, Homo sapiens
tgtcagttgttatttattgaaa

SEQ ID NO: 6540263 - DNA, 22 bp, Homo sapiens
tgtcagtttatgttttggtcca

SEQ ID NO: 6540264 - DNA, 19 bp, Homo sapiens
tgtcagtttcagatcctga

SEQ ID NO: 6540265 - DNA, 15 bp, Homo sapiens
tgtcagtttcccctc

SEQ ID NO: 6540266 - DNA, 17 bp, Homo sapiens
tgtcagtttcctctcct

SEQ ID NO: 6540267 - DNA, 15 bp, Homo sapiens
tgtcagtttgtgaag

SEQ ID NO: 6540268 - DNA, 16 bp, Homo sapiens
tgtcagttttgttcac

SEQ ID NO: 6540269 - DNA, 13 bp, Homo sapiens
tgtcataaaatgc

SEQ ID NO: 6540270 - DNA, 21 bp, Homo sapiens
tgtcataaaatgcatactgtt

SEQ ID NO: 6540271 - DNA, 16 bp, Homo sapiens
tgtcataaaatgctat

SEQ ID NO: 6540272 - DNA, 23 bp, Homo sapiens
tgtcataaaatgctattttaaaa

SEQ ID NO: 6540273 - DNA, 16 bp, Homo sapiens
tgtcataaactttctc

SEQ ID NO: 6540274 - DNA, 19 bp, Homo sapiens
tgtcataaagattataata

SEQ ID NO: 6540275 - DNA, 14 bp, Homo sapiens
tgtcataaagttga

SEQ ID NO: 6540276 - DNA, 13 bp, Homo sapiens
tgtcataaatgtc

SEQ ID NO: 6540277 - DNA, 17 bp, Homo sapiens
tgtcataaattactgtt

SEQ ID NO: 6540278 - DNA, 23 bp, Homo sapiens
tgtcataacatccagagctttgt

SEQ ID NO: 6540279 - DNA, 18 bp, Homo sapiens
tgtcataacatttaaaga

SEQ ID NO: 6540280 - DNA, 19 bp, Homo sapiens
tgtcataacatttaaagag

SEQ ID NO: 6540281 - DNA, 22 bp, Homo sapiens
tgtcataacatttaaagagatt

SEQ ID NO: 6540282 - DNA, 22 bp, Homo sapiens
tgtcataatatttgaacaaaaa

SEQ ID NO: 6540283 - DNA, 19 bp, Homo sapiens
tgtcataatctctttccat

SEQ ID NO: 6540284 - DNA, 15 bp, Homo sapiens
tgtcatactctgtgt

SEQ ID NO: 6540285 - DNA, 20 bp, Homo sapiens
tgtcatactgtgcaggcctg

SEQ ID NO: 6540286 - DNA, 22 bp, Homo sapiens
tgtcatactgtgcaggcctgtc

SEQ ID NO: 6540287 - DNA, 15 bp, Homo sapiens
tgtcatagaaattac

SEQ ID NO: 6540288 - DNA, 16 bp, Homo sapiens
tgtcatagaaattaca

SEQ ID NO: 6540289 - DNA, 13 bp, Homo sapiens
tgtcatagccagt

SEQ ID NO: 6540290 - DNA, 20 bp, Homo sapiens
tgtcatagtcttgaaatgaa

SEQ ID NO: 6540291 - DNA, 23 bp, Homo sapiens
tgtcatagtcttgaaatgaaagg

SEQ ID NO: 6540292 - DNA, 13 bp, Homo sapiens
tgtcatataaacc

SEQ ID NO: 6540293 - DNA, 22 bp, Homo sapiens
tgtcatatatggggggccaaca

SEQ ID NO: 6540294 - DNA, 17 bp, Homo sapiens
tgtcatatattcatgta

SEQ ID NO: 6540295 - DNA, 17 bp, Homo sapiens
tgtcatatgactgatta

SEQ ID NO: 6540296 - DNA, 19 bp, Homo sapiens
tgtcatatgactgattact

SEQ ID NO: 6540297 - DNA, 20 bp, Homo sapiens
tgtcatatgtagccttcaca

SEQ ID NO: 6540298 - DNA, 19 bp, Homo sapiens
tgtcatcaacattcttgtg

SEQ ID NO: 6540299 - DNA, 22 bp, Homo sapiens
ttcttatcacataagagagatg

SEQ ID NO: 6540300 - DNA, 14 bp, Homo sapiens
ttcttatccttaca

SEQ ID NO: 6540301 - DNA, 14 bp, Homo sapiens
ttcttatctaaacc

SEQ ID NO: 6540302 - DNA, 12 bp, Homo sapiens
ttcttatgagct

SEQ ID NO: 6540303 - DNA, 18 bp, Homo sapiens
ttcttatgaggaggggag

SEQ ID NO: 6540304 - DNA, 17 bp, Homo sapiens
ttcttatgcaaaatgga

SEQ ID NO: 6540305 - DNA, 17 bp, Homo sapiens
ttcttatggaattgatt

SEQ ID NO: 6540306 - DNA, 18 bp, Homo sapiens
ttcttatggaattgattt

SEQ ID NO: 6540307 - DNA, 16 bp, Homo sapiens
ttcttatgtgacatta

SEQ ID NO: 6540308 - DNA, 21 bp, Homo sapiens
ttcttatgtgacattaacaaa

SEQ ID NO: 6540309 - DNA, 17 bp, Homo sapiens
ttcttattactattatt

SEQ ID NO: 6540310 - DNA, 14 bp, Homo sapiens
ttcttattcagtga

SEQ ID NO: 6540311 - DNA, 22 bp, Homo sapiens
ttcttattcatgctttctcctt

SEQ ID NO: 6540312 - DNA, 16 bp, Homo sapiens
ttcttattggaaatgt

SEQ ID NO: 6540313 - DNA, 21 bp, Homo sapiens
ttcttatttaaattttcagaa

SEQ ID NO: 6540314 - DNA, 21 bp, Homo sapiens
ttcttatttaatcttttctta

SEQ ID NO: 6540315 - DNA, 15 bp, Homo sapiens
ttcttatttatgtaa

SEQ ID NO: 6540316 - DNA, 17 bp, Homo sapiens
ttcttatttatgtaaca

SEQ ID NO: 6540317 - DNA, 14 bp, Homo sapiens
ttcttatttcatga

SEQ ID NO: 6540318 - DNA, 15 bp, Homo sapiens
ttcttatttcccctt

SEQ ID NO: 6540319 - DNA, 13 bp, Homo sapiens
ttcttatttgcaa

SEQ ID NO: 6540320 - DNA, 13 bp, Homo sapiens
ttcttatttgttt

SEQ ID NO: 6540321 - DNA, 20 bp, Homo sapiens
ttcttatttgtttggtcact

SEQ ID NO: 6540322 - DNA, 20 bp, Homo sapiens
ttcttattttgcattccaga

SEQ ID NO: 6540323 - DNA, 13 bp, Homo sapiens
ttcttattttgtg

SEQ ID NO: 6540324 - DNA, 14 bp, Homo sapiens
ttcttatttttgtc

SEQ ID NO: 6540325 - DNA, 21 bp, Homo sapiens
ttcttcaaaatataaaatgcc

SEQ ID NO: 6540326 - DNA, 15 bp, Homo sapiens
ttcttcaaaatgtat

SEQ ID NO: 6540327 - DNA, 19 bp, Homo sapiens
ttcttcaaaatgtatatat

SEQ ID NO: 6540328 - DNA, 21 bp, Homo sapiens
ttcttcaaacagtatataact

SEQ ID NO: 6540329 - DNA, 16 bp, Homo sapiens
ttcttcaaacctttgt

SEQ ID NO: 6540330 - DNA, 19 bp, Homo sapiens
ttcttcaaagccacatttt

SEQ ID NO: 6540331 - DNA, 21 bp, Homo sapiens
ttcttcaaatacaaagtaaat

SEQ ID NO: 6540332 - DNA, 13 bp, Homo sapiens
ttcttcaaatctc

SEQ ID NO: 6540333 - DNA, 16 bp, Homo sapiens
ttcttcaaatctcagc

SEQ ID NO: 6540334 - DNA, 22 bp, Homo sapiens
ttcttcaaatctcagcaaagct

SEQ ID NO: 6540335 - DNA, 16 bp, Homo sapiens
ttcttcaaatgtttaa

SEQ ID NO: 6540336 - DNA, 19 bp, Homo sapiens
ttcttcaacaggagaattt

SEQ ID NO: 6540337 - DNA, 14 bp, Homo sapiens
ttcttcaactcctg

SEQ ID NO: 6540338 - DNA, 11 bp, Homo sapiens
ttcttcaagag

SEQ ID NO: 6540339 - DNA, 12 bp, Homo sapiens
ttcttcaagagg

SEQ ID NO: 6540340 - DNA, 12 bp, Homo sapiens
ttcttcaagatc

SEQ ID NO: 6540341 - DNA, 18 bp, Homo sapiens
ttcttcaagatcccattt

SEQ ID NO: 6540342 - DNA, 14 bp, Homo sapiens
ttcttcaatacaaa

SEQ ID NO: 6540343 - DNA, 17 bp, Homo sapiens
ttcttcaatgtgaaact

SEQ ID NO: 6540344 - DNA, 21 bp, Homo sapiens
ttcttcacagtgcagcttgca

SEQ ID NO: 6540345 - DNA, 18 bp, Homo sapiens
ttcttcacatgtttaact

SEQ ID NO: 6540346 - DNA, 21 bp, Homo sapiens
ttcttcacctaagtctctgtg

SEQ ID NO: 6540347 - DNA, 21 bp, Homo sapiens
ttcttcacctgttatgtatga

SEQ ID NO: 6540348 - DNA, 22 bp, Homo sapiens
ttcttcacctgttatgtatgaa

SEQ ID NO: 6540349 - DNA, 16 bp, Homo sapiens
ttcttcacctttgtaa

SEQ ID NO: 6540350 - DNA, 14 bp, Homo sapiens
ttcttcactgcaac

SEQ ID NO: 6540351 - DNA, 18 bp, Homo sapiens
ttcttcacttacaagaaa

SEQ ID NO: 6540352 - DNA, 14 bp, Homo sapiens
ttcttcacttctgg

SEQ ID NO: 6540353 - DNA, 14 bp, Homo sapiens
ttcttcacttttgc

SEQ ID NO: 6540354 - DNA, 18 bp, Homo sapiens
ttcttcacttttgcaagg

SEQ ID NO: 6540355 - DNA, 16 bp, Homo sapiens
ttcttcagaattagat

SEQ ID NO: 6540356 - DNA, 19 bp, Homo sapiens
ttcttcagactgaggcctt

SEQ ID NO: 6540357 - DNA, 14 bp, Homo sapiens
ttcttcagagatca

SEQ ID NO: 6540358 - DNA, 15 bp, Homo sapiens
ttcttcagagtgaag

SEQ ID NO: 6540359 - DNA, 17 bp, Homo sapiens
ttcttcagatcagtgct

SEQ ID NO: 6540360 - DNA, 14 bp, Homo sapiens
ttcttcagcattta

SEQ ID NO: 6540361 - DNA, 18 bp, Homo sapiens
ttcttcagcgtaaaatgg

SEQ ID NO: 6540362 - DNA, 22 bp, Homo sapiens
ttcttcagcgtaaaatggtgaa

SEQ ID NO: 6540363 - DNA, 18 bp, Homo sapiens
ttcttcaggaaaataaat

SEQ ID NO: 6540364 - DNA, 23 bp, Homo sapiens
ttcttcaggctgcctaagacatg

SEQ ID NO: 6540365 - DNA, 18 bp, Homo sapiens
ttcttcagggccagtcct

SEQ ID NO: 6540366 - DNA, 16 bp, Homo sapiens
ttcttcaggtaacact

SEQ ID NO: 6540367 - DNA, 17 bp, Homo sapiens
ttcttcaggtaacacta

SEQ ID NO: 6540368 - DNA, 11 bp, Homo sapiens
ttcttcagttg

SEQ ID NO: 6540369 - DNA, 13 bp, Homo sapiens
ttcttcagttggt

SEQ ID NO: 6540370 - DNA, 21 bp, Homo sapiens
ttcttcataacaattttagga

SEQ ID NO: 6540371 - DNA, 20 bp, Homo sapiens
ttcttcatattctaaaacca

SEQ ID NO: 6540372 - DNA, 21 bp, Homo sapiens
ttcttcatccaacttccaaga

SEQ ID NO: 6540373 - DNA, 22 bp, Homo sapiens
ttcttcatccatagacacagta

SEQ ID NO: 6540374 - DNA, 13 bp, Homo sapiens
ttcttcatcttga

SEQ ID NO: 6540375 - DNA, 15 bp, Homo sapiens
ttcttcatgaaatgt

SEQ ID NO: 6540376 - DNA, 17 bp, Homo sapiens
ttcttcatgaaatgtgt

SEQ ID NO: 6540377 - DNA, 14 bp, Homo sapiens
ttcttcatgcaatg

SEQ ID NO: 6540378 - DNA, 17 bp, Homo sapiens
ttcttcatgcaatgaca

SEQ ID NO: 6540379 - DNA, 14 bp, Homo sapiens
ttcttcatgcatta

SEQ ID NO: 6540380 - DNA, 21 bp, Homo sapiens
ttcttcattatagtaaatcta

SEQ ID NO: 6540381 - DNA, 19 bp, Homo sapiens
ttcttccaacacatttcac

SEQ ID NO: 6540382 - DNA, 14 bp, Homo sapiens
ttcttccaacatgt

SEQ ID NO: 6540383 - DNA, 21 bp, Homo sapiens
ttcttccacaagagcccaggc

SEQ ID NO: 6540384 - DNA, 24 bp, Homo sapiens
ttcttccagtgaggcatctctctg

SEQ ID NO: 6540385 - DNA, 22 bp, Homo sapiens
ttcttccagttactttccaatt

SEQ ID NO: 6540386 - DNA, 17 bp, Homo sapiens
ttcttccatattagtgt

SEQ ID NO: 6540387 - DNA, 13 bp, Homo sapiens
ttcttccatccca

SEQ ID NO: 6540388 - DNA, 14 bp, Homo sapiens
ttcttccatcccag

SEQ ID NO: 6540389 - DNA, 14 bp, Homo sapiens
ttcttccatctgat

SEQ ID NO: 6540390 - DNA, 19 bp, Homo sapiens
ttcttccattaaattgcct

SEQ ID NO: 6540391 - DNA, 19 bp, Homo sapiens
ttcttcccaaatcaaaata

SEQ ID NO: 6540392 - DNA, 19 bp, Homo sapiens
ttcttcccatcactggagc

SEQ ID NO: 6540393 - DNA, 17 bp, Homo sapiens
ttcttcccattctccat

SEQ ID NO: 6540394 - DNA, 21 bp, Homo sapiens
ttcttccccaaggcactgagc

SEQ ID NO: 6540395 - DNA, 13 bp, Homo sapiens
ttcttccccacaa

SEQ ID NO: 6540396 - DNA, 13 bp, Homo sapiens
ttcttccccaccc

SEQ ID NO: 6540397 - DNA, 20 bp, Homo sapiens
ttcttccccaggtccttcct

SEQ ID NO: 6540398 - DNA, 20 bp, Homo sapiens
ttcttcccccacttcccctc

SEQ ID NO: 6540399 - DNA, 16 bp, Homo sapiens
ttcttcccccagggtc

SEQ ID NO: 6540400 - DNA, 17 bp, Homo sapiens
ttcttcccccttcacat

SEQ ID NO: 6540401 - DNA, 16 bp, Homo sapiens
ttcttcccctcctgta

SEQ ID NO: 6540402 - DNA, 18 bp, Homo sapiens
ttcttcccgccccacctc

SEQ ID NO: 6540403 - DNA, 22 bp, Homo sapiens
ttcttcccgccccacctcccat

SEQ ID NO: 6540404 - DNA, 19 bp, Homo sapiens
ttcttcccgtgtgtatttc

SEQ ID NO: 6540405 - DNA, 16 bp, Homo sapiens
ttcttccctaaaatgt

SEQ ID NO: 6540406 - DNA, 13 bp, Homo sapiens
ttcttccctagct

SEQ ID NO: 6540407 - DNA, 13 bp, Homo sapiens
ttcttccctgggg

SEQ ID NO: 6540408 - DNA, 14 bp, Homo sapiens
ttcttccctggggg

SEQ ID NO: 6540409 - DNA, 18 bp, Homo sapiens
ttcttcccttaaaattta

SEQ ID NO: 6540410 - DNA, 16 bp, Homo sapiens
ttcttcccttcaaggt

SEQ ID NO: 6540411 - DNA, 20 bp, Homo sapiens
ttcttcccttttacatactg

SEQ ID NO: 6540412 - DNA, 21 bp, Homo sapiens
ttcttcccttttacatactgc

SEQ ID NO: 6540413 - DNA, 17 bp, Homo sapiens
ttcttcctaggtccaag

SEQ ID NO: 6540414 - DNA, 12 bp, Homo sapiens
ttcttcctcaca

SEQ ID NO: 6540415 - DNA, 23 bp, Homo sapiens
ttcttcctcacactgctgtcctc

SEQ ID NO: 6540416 - DNA, 12 bp, Homo sapiens
ttcttcctcagc

SEQ ID NO: 6540417 - DNA, 20 bp, Homo sapiens
ttcttcctcagccagcctcg

SEQ ID NO: 6540418 - DNA, 13 bp, Homo sapiens
ttcttcctcagct

SEQ ID NO: 6540419 - DNA, 15 bp, Homo sapiens
ttcttcctcagctgg

SEQ ID NO: 6540420 - DNA, 16 bp, Homo sapiens
ttcttcctccagctgc

SEQ ID NO: 6540421 - DNA, 20 bp, Homo sapiens
ttcttcctccagtctgttct

SEQ ID NO: 6540422 - DNA, 23 bp, Homo sapiens
ttcttcctccctccctctttccc

SEQ ID NO: 6540423 - DNA, 12 bp, Homo sapiens
ttcttcctcctc

SEQ ID NO: 6540424 - DNA, 13 bp, Homo sapiens
ttcttcctcctct

SEQ ID NO: 6540425 - DNA, 19 bp, Homo sapiens
ttcttcctctccttcccac

SEQ ID NO: 6540426 - DNA, 12 bp, Homo sapiens
ttcttcctctgc

SEQ ID NO: 6540427 - DNA, 14 bp, Homo sapiens
ttcttcctctgcat

SEQ ID NO: 6540428 - DNA, 13 bp, Homo sapiens
ttcttcctctgct

SEQ ID NO: 6540429 - DNA, 18 bp, Homo sapiens
ttcttcctcttacctgta

SEQ ID NO: 6540430 - DNA, 15 bp, Homo sapiens
ttcttcctcttcttt

SEQ ID NO: 6540431 - DNA, 12 bp, Homo sapiens
ttcttcctgcaa

SEQ ID NO: 6540432 - DNA, 15 bp, Homo sapiens
ttcttcctgccagca

SEQ ID NO: 6540433 - DNA, 13 bp, Homo sapiens
ttcttcctgctgg

SEQ ID NO: 6540434 - DNA, 14 bp, Homo sapiens
ttcttcctggatgg

SEQ ID NO: 6540435 - DNA, 14 bp, Homo sapiens
ttcttcctggccgc

SEQ ID NO: 6540436 - DNA, 22 bp, Homo sapiens
ttcttccttaattcactcccac

SEQ ID NO: 6540437 - DNA, 12 bp, Homo sapiens
ttcttccttcca

SEQ ID NO: 6540438 - DNA, 12 bp, Homo sapiens
ttcttccttcct

SEQ ID NO: 6540439 - DNA, 14 bp, Homo sapiens
ttcttccttctcag

SEQ ID NO: 6540440 - DNA, 13 bp, Homo sapiens
ttcttccttgcca

SEQ ID NO: 6540441 - DNA, 21 bp, Homo sapiens
ttcttccttgccacaatcact

SEQ ID NO: 6540442 - DNA, 18 bp, Homo sapiens
ttcttcctttcttccttg

SEQ ID NO: 6540443 - DNA, 16 bp, Homo sapiens
ttcttcgactgttgtt

SEQ ID NO: 6540444 - DNA, 23 bp, Homo sapiens
ttcttcgaggtggatcacagagg

SEQ ID NO: 6540445 - DNA, 14 bp, Homo sapiens
ttcttcgctgctct

SEQ ID NO: 6540446 - DNA, 16 bp, Homo sapiens
ttcttcgctgctctag

SEQ ID NO: 6540447 - DNA, 23 bp, Homo sapiens
ttcttcgctggactattgtgcca

SEQ ID NO: 6540448 - DNA, 17 bp, Homo sapiens
ttcttcgtatatacaca

SEQ ID NO: 6540449 - DNA, 18 bp, Homo sapiens
ttcttcgttctttttaag

SEQ ID NO: 6540450 - DNA, 16 bp, Homo sapiens
ttcttctaaaactact

SEQ ID NO: 6540451 - DNA, 18 bp, Homo sapiens
ttcttctaaaactactgc

SEQ ID NO: 6540452 - DNA, 14 bp, Homo sapiens
ttcttctaaaattg

SEQ ID NO: 6540453 - DNA, 17 bp, Homo sapiens
ttcttctaaaattgaag

SEQ ID NO: 6540454 - DNA, 23 bp, Homo sapiens
ttcttctaaagcactggtttcaa

SEQ ID NO: 6540455 - DNA, 13 bp, Homo sapiens
ttcttctaaatga

SEQ ID NO: 6540456 - DNA, 15 bp, Homo sapiens
ttcttctaagaagac

SEQ ID NO: 6540457 - DNA, 22 bp, Homo sapiens
ttcttctaagaagacattttgt

SEQ ID NO: 6540458 - DNA, 21 bp, Homo sapiens
ttcttctacaaccagagcccc

SEQ ID NO: 6540459 - DNA, 23 bp, Homo sapiens
ttcttctaccacacctggaaaca

SEQ ID NO: 6540460 - DNA, 20 bp, Homo sapiens
ttcttctagaagataacatt

SEQ ID NO: 6540461 - DNA, 22 bp, Homo sapiens
ttcttctagaagataacatttt

SEQ ID NO: 6540462 - DNA, 21 bp, Homo sapiens
ttcttctagaatgtaaagtta

SEQ ID NO: 6540463 - DNA, 19 bp, Homo sapiens
ttcttctagctgagcttta

SEQ ID NO: 6540464 - DNA, 17 bp, Homo sapiens
ttcttctaggggtagct

SEQ ID NO: 6540465 - DNA, 22 bp, Homo sapiens
ttcttctatatccaaaattcag

SEQ ID NO: 6540466 - DNA, 18 bp, Homo sapiens
ttcttctcaaaaaataat

SEQ ID NO: 6540467 - DNA, 22 bp, Homo sapiens
ttcttctcaaaaaataattagt

SEQ ID NO: 6540468 - DNA, 23 bp, Homo sapiens
ttcttctcaggcatgaacatgta

SEQ ID NO: 6540469 - DNA, 19 bp, Homo sapiens
ttcttctcattcttctaaa

SEQ ID NO: 6540470 - DNA, 16 bp, Homo sapiens
ttcttctcccctttca

SEQ ID NO: 6540471 - DNA, 15 bp, Homo sapiens
ttcttctcctatgtg

SEQ ID NO: 6540472 - DNA, 15 bp, Homo sapiens
ttcttctcctgtgat

SEQ ID NO: 6540473 - DNA, 14 bp, Homo sapiens
ttcttctctagctg

SEQ ID NO: 6540474 - DNA, 13 bp, Homo sapiens
ttcttctctctgt

SEQ ID NO: 6540475 - DNA, 15 bp, Homo sapiens
ttcttctctgcctcc

SEQ ID NO: 6540476 - DNA, 14 bp, Homo sapiens
ttcttctctgctgc

SEQ ID NO: 6540477 - DNA, 13 bp, Homo sapiens
ttcttctctggag

SEQ ID NO: 6540478 - DNA, 15 bp, Homo sapiens
ttcttctctgtgaga

SEQ ID NO: 6540479 - DNA, 22 bp, Homo sapiens
ttcttctctgtgagaaggttta

SEQ ID NO: 6540480 - DNA, 23 bp, Homo sapiens
tgtcatcaatagtgtcctatgca

SEQ ID NO: 6540481 - DNA, 15 bp, Homo sapiens
tgtcatcaattgaat

SEQ ID NO: 6540482 - DNA, 16 bp, Homo sapiens
tgtcatcaccatggaa

SEQ ID NO: 6540483 - DNA, 11 bp, Homo sapiens
tgtcatcactc

SEQ ID NO: 6540484 - DNA, 17 bp, Homo sapiens
tgtcatcactccctgga

SEQ ID NO: 6540485 - DNA, 22 bp, Homo sapiens
tgtcatcactctaggttttaca

SEQ ID NO: 6540486 - DNA, 13 bp, Homo sapiens
tgtcatcagaact

SEQ ID NO: 6540487 - DNA, 17 bp, Homo sapiens
tgtcatcagaagataac

SEQ ID NO: 6540488 - DNA, 20 bp, Homo sapiens
tgtcatcagaggggagcagc

SEQ ID NO: 6540489 - DNA, 18 bp, Homo sapiens
tgtcatcagccaccatcc

SEQ ID NO: 6540490 - DNA, 23 bp, Homo sapiens
tgtcatcatcagacttgcggcca

SEQ ID NO: 6540491 - DNA, 19 bp, Homo sapiens
tgtcatcatcatggccagc

SEQ ID NO: 6540492 - DNA, 21 bp, Homo sapiens
tgtcatcatgcttatgttaaa

SEQ ID NO: 6540493 - DNA, 18 bp, Homo sapiens
tgtcatcattgtatatat

SEQ ID NO: 6540494 - DNA, 19 bp, Homo sapiens
tgtcatcattgtatatatg

SEQ ID NO: 6540495 - DNA, 22 bp, Homo sapiens
tgtcatcattgtatatatgtgt

SEQ ID NO: 6540496 - DNA, 21 bp, Homo sapiens
tgtcatccacacaacaccagg

SEQ ID NO: 6540497 - DNA, 22 bp, Homo sapiens
tgtcatccacacaacaccagga

SEQ ID NO: 6540498 - DNA, 16 bp, Homo sapiens
tgtcatcctcaaagaa

SEQ ID NO: 6540499 - DNA, 21 bp, Homo sapiens
tgtcatcctcaaagaaagtgt

SEQ ID NO: 6540500 - DNA, 18 bp, Homo sapiens
tgtcatcctcccttgccc

SEQ ID NO: 6540501 - DNA, 16 bp, Homo sapiens
tgtcatcctctggaag

SEQ ID NO: 6540502 - DNA, 19 bp, Homo sapiens
tgtcatcgttccccacccc

SEQ ID NO: 6540503 - DNA, 21 bp, Homo sapiens
tgtcatcgttccccacccctt

SEQ ID NO: 6540504 - DNA, 14 bp, Homo sapiens
tgtcatctgagaat

SEQ ID NO: 6540505 - DNA, 13 bp, Homo sapiens
tgtcatctgagga

SEQ ID NO: 6540506 - DNA, 14 bp, Homo sapiens
tgtcatctgaggag

SEQ ID NO: 6540507 - DNA, 18 bp, Homo sapiens
tgtcatctgcatgtctac

SEQ ID NO: 6540508 - DNA, 12 bp, Homo sapiens
tgtcatctgcca

SEQ ID NO: 6540509 - DNA, 18 bp, Homo sapiens
tgtcatctgctccttcct

SEQ ID NO: 6540510 - DNA, 13 bp, Homo sapiens
tgtcatctgctgc

SEQ ID NO: 6540511 - DNA, 13 bp, Homo sapiens
tgtcatctgtcag

SEQ ID NO: 6540512 - DNA, 15 bp, Homo sapiens
tgtcatctgtcagct

SEQ ID NO: 6540513 - DNA, 16 bp, Homo sapiens
tgtcatctgtcagctt

SEQ ID NO: 6540514 - DNA, 23 bp, Homo sapiens
tgtcatctttcttctattttatt

SEQ ID NO: 6540515 - DNA, 11 bp, Homo sapiens
tgtcatctttt

SEQ ID NO: 6540516 - DNA, 14 bp, Homo sapiens
tgtcatcttttcaa

SEQ ID NO: 6540517 - DNA, 20 bp, Homo sapiens
tgtcatctttttctagagtt

SEQ ID NO: 6540518 - DNA, 21 bp, Homo sapiens
tgtcatgaaagcacctgccct

SEQ ID NO: 6540519 - DNA, 16 bp, Homo sapiens
tgtcatgaacatgttc

SEQ ID NO: 6540520 - DNA, 16 bp, Homo sapiens
tgtcatgaattcttat

SEQ ID NO: 6540521 - DNA, 13 bp, Homo sapiens
tgtcatgcatgaa

SEQ ID NO: 6540522 - DNA, 23 bp, Homo sapiens
tgtcatgcccccctcaaacctcc

SEQ ID NO: 6540523 - DNA, 19 bp, Homo sapiens
tgtcatgcctcactttctt

SEQ ID NO: 6540524 - DNA, 22 bp, Homo sapiens
tgtcatgcctcactttcttcta

SEQ ID NO: 6540525 - DNA, 19 bp, Homo sapiens
tgtcatgcggtttccaagg

SEQ ID NO: 6540526 - DNA, 23 bp, Homo sapiens
tgtcatgcggtttccaaggtgca

SEQ ID NO: 6540527 - DNA, 21 bp, Homo sapiens
tgtcatgctcacttttgtgaa

SEQ ID NO: 6540528 - DNA, 15 bp, Homo sapiens
tgtcatgctgcctta

SEQ ID NO: 6540529 - DNA, 16 bp, Homo sapiens
tgtcatgctgggattt

SEQ ID NO: 6540530 - DNA, 17 bp, Homo sapiens
tgtcatggaaaagccca

SEQ ID NO: 6540531 - DNA, 23 bp, Homo sapiens
tgtcatggatcgtgttggtattt

SEQ ID NO: 6540532 - DNA, 22 bp, Homo sapiens
tgtcatggctgaagttggccac

SEQ ID NO: 6540533 - DNA, 19 bp, Homo sapiens
tgtcatggtcctttctgga

SEQ ID NO: 6540534 - DNA, 20 bp, Homo sapiens
tgtcatggtcctttctggaa

SEQ ID NO: 6540535 - DNA, 14 bp, Homo sapiens
tgtcatggtgacca

SEQ ID NO: 6540536 - DNA, 20 bp, Homo sapiens
tgtcatggtgatgcaagtca

SEQ ID NO: 6540537 - DNA, 17 bp, Homo sapiens
tgtcatggttacaaact

SEQ ID NO: 6540538 - DNA, 20 bp, Homo sapiens
tgtcatgtaatactgaacca

SEQ ID NO: 6540539 - DNA, 17 bp, Homo sapiens
tgtcatgtaccatcaat

SEQ ID NO: 6540540 - DNA, 21 bp, Homo sapiens
tgtcatgtactgacaactgtt

SEQ ID NO: 6540541 - DNA, 18 bp, Homo sapiens
tgtcatgtctgcttgtca

SEQ ID NO: 6540542 - DNA, 19 bp, Homo sapiens
tgtcatgtgaatccctcaa

SEQ ID NO: 6540543 - DNA, 14 bp, Homo sapiens
tgtcatgtgcagat

SEQ ID NO: 6540544 - DNA, 18 bp, Homo sapiens
tgtcatgtgcgaacacag

SEQ ID NO: 6540545 - DNA, 19 bp, Homo sapiens
tgtcatgtgcgaacacagt

SEQ ID NO: 6540546 - DNA, 14 bp, Homo sapiens
tgtcatgtgtataa

SEQ ID NO: 6540547 - DNA, 17 bp, Homo sapiens
tgtcatgtgttcccttt

SEQ ID NO: 6540548 - DNA, 13 bp, Homo sapiens
tgtcatgttatgc

SEQ ID NO: 6540549 - DNA, 19 bp, Homo sapiens
tgtcatgttatgcagtgaa

SEQ ID NO: 6540550 - DNA, 18 bp, Homo sapiens
tgtcatgtttattctaat

SEQ ID NO: 6540551 - DNA, 18 bp, Homo sapiens
tgtcattaaaataaataa

SEQ ID NO: 6540552 - DNA, 19 bp, Homo sapiens
tgtcattaaaataaataaa

SEQ ID NO: 6540553 - DNA, 13 bp, Homo sapiens
tgtcattaaaggt

SEQ ID NO: 6540554 - DNA, 17 bp, Homo sapiens
tgtcattaaaggtatca

SEQ ID NO: 6540555 - DNA, 15 bp, Homo sapiens
tgtcattaatgtgtt

SEQ ID NO: 6540556 - DNA, 14 bp, Homo sapiens
tgtcattacaacct

SEQ ID NO: 6540557 - DNA, 15 bp, Homo sapiens
tgtcattacatagaa

SEQ ID NO: 6540558 - DNA, 20 bp, Homo sapiens
tgtcattagcctgagtagaa

SEQ ID NO: 6540559 - DNA, 24 bp, Homo sapiens
tgtcattagtgagacatatttaca

SEQ ID NO: 6540560 - DNA, 12 bp, Homo sapiens
tgtcattatatt

SEQ ID NO: 6540561 - DNA, 13 bp, Homo sapiens
tgtcattatattc

SEQ ID NO: 6540562 - DNA, 15 bp, Homo sapiens
tgtcattatattcta

SEQ ID NO: 6540563 - DNA, 18 bp, Homo sapiens
tgtcattatattctaatt

SEQ ID NO: 6540564 - DNA, 12 bp, Homo sapiens
tgtcattattcc

SEQ ID NO: 6540565 - DNA, 14 bp, Homo sapiens
tgtcattattccat

SEQ ID NO: 6540566 - DNA, 16 bp, Homo sapiens
tgtcattcaaatgggt

SEQ ID NO: 6540567 - DNA, 12 bp, Homo sapiens
tgtcattcagga

SEQ ID NO: 6540568 - DNA, 15 bp, Homo sapiens
tgtcattcagttcta

SEQ ID NO: 6540569 - DNA, 16 bp, Homo sapiens
tgtcattcagttctag

SEQ ID NO: 6540570 - DNA, 16 bp, Homo sapiens
tgtcattccagagtgc

SEQ ID NO: 6540571 - DNA, 18 bp, Homo sapiens
tgtcattcccctttgcac

SEQ ID NO: 6540572 - DNA, 23 bp, Homo sapiens
tgtcattcgctactatgatttaa

SEQ ID NO: 6540573 - DNA, 15 bp, Homo sapiens
tgtcattctcatcca

SEQ ID NO: 6540574 - DNA, 18 bp, Homo sapiens
tgtcattctcatccaaaa

SEQ ID NO: 6540575 - DNA, 13 bp, Homo sapiens
tgtcattctgcct

SEQ ID NO: 6540576 - DNA, 18 bp, Homo sapiens
tgtcattctgcctgctcc

SEQ ID NO: 6540577 - DNA, 19 bp, Homo sapiens
tgtcattctgcctgctcca

SEQ ID NO: 6540578 - DNA, 16 bp, Homo sapiens
tgtcattgaaaaacta

SEQ ID NO: 6540579 - DNA, 16 bp, Homo sapiens
tgtcattgagcctggc

SEQ ID NO: 6540580 - DNA, 15 bp, Homo sapiens
tgtcattgccttcgc

SEQ ID NO: 6540581 - DNA, 13 bp, Homo sapiens
tgtcattgctaaa

SEQ ID NO: 6540582 - DNA, 18 bp, Homo sapiens
tgtcattgcttcttctga

SEQ ID NO: 6540583 - DNA, 13 bp, Homo sapiens
tgtcattgcttta

SEQ ID NO: 6540584 - DNA, 14 bp, Homo sapiens
tgtcattgctttac

SEQ ID NO: 6540585 - DNA, 17 bp, Homo sapiens
tgtcattggttacaaat

SEQ ID NO: 6540586 - DNA, 15 bp, Homo sapiens
tgtcattgtccagct

SEQ ID NO: 6540587 - DNA, 20 bp, Homo sapiens
tgtcattgttaaatacacat

SEQ ID NO: 6540588 - DNA, 20 bp, Homo sapiens
tgtcattgttatataatcat

SEQ ID NO: 6540589 - DNA, 23 bp, Homo sapiens
tgtcattgttatataatcattat

SEQ ID NO: 6540590 - DNA, 17 bp, Homo sapiens
tgtcatttatgtgtcag

SEQ ID NO: 6540591 - DNA, 15 bp, Homo sapiens
tgtcatttcagaagt

SEQ ID NO: 6540592 - DNA, 22 bp, Homo sapiens
tgtcatttcatacaaattttcc

SEQ ID NO: 6540593 - DNA, 22 bp, Homo sapiens
tgtcatttcatgtcctgtgtca

SEQ ID NO: 6540594 - DNA, 16 bp, Homo sapiens
tgtcatttcattgcac

SEQ ID NO: 6540595 - DNA, 17 bp, Homo sapiens
tgtcatttcatttccta

SEQ ID NO: 6540596 - DNA, 20 bp, Homo sapiens
tgtcatttctactttgacta

SEQ ID NO: 6540597 - DNA, 22 bp, Homo sapiens
tgtcatttctatattcctccag

SEQ ID NO: 6540598 - DNA, 23 bp, Homo sapiens
tgtcatttctatattcctccagc

SEQ ID NO: 6540599 - DNA, 20 bp, Homo sapiens
tgtcatttctctttcaaaaa

SEQ ID NO: 6540600 - DNA, 22 bp, Homo sapiens
tgtcatttcttcacttcaagct

SEQ ID NO: 6540601 - DNA, 22 bp, Homo sapiens
tgtcatttgacaacacatgtgg

SEQ ID NO: 6540602 - DNA, 16 bp, Homo sapiens
tgtcatttgagcaggg

SEQ ID NO: 6540603 - DNA, 22 bp, Homo sapiens
tgtcatttgagcagggctcagc

SEQ ID NO: 6540604 - DNA, 15 bp, Homo sapiens
tgtcatttgcacaca

SEQ ID NO: 6540605 - DNA, 12 bp, Homo sapiens
tgtcatttgcta

SEQ ID NO: 6540606 - DNA, 13 bp, Homo sapiens
tgtcatttgctaa

SEQ ID NO: 6540607 - DNA, 14 bp, Homo sapiens
tgtcatttgctaat

SEQ ID NO: 6540608 - DNA, 20 bp, Homo sapiens
tgtcatttgctaatgaattt

SEQ ID NO: 6540609 - DNA, 12 bp, Homo sapiens
tgtcatttgctt

SEQ ID NO: 6540610 - DNA, 16 bp, Homo sapiens
tgtcattttatgctaa

SEQ ID NO: 6540611 - DNA, 18 bp, Homo sapiens
tgtcattttcagatcctt

SEQ ID NO: 6540612 - DNA, 20 bp, Homo sapiens
tgtcattttcagatccttcc

SEQ ID NO: 6540613 - DNA, 15 bp, Homo sapiens
tgtcattttctgtta

SEQ ID NO: 6540614 - DNA, 23 bp, Homo sapiens
tgtcattttctgttatacacagt

SEQ ID NO: 6540615 - DNA, 14 bp, Homo sapiens
tgtcattttcttga

SEQ ID NO: 6540616 - DNA, 12 bp, Homo sapiens
tgtcattttgaa

SEQ ID NO: 6540617 - DNA, 19 bp, Homo sapiens
tgtcattttgaagctaatt

SEQ ID NO: 6540618 - DNA, 14 bp, Homo sapiens
tgtcattttgcact

SEQ ID NO: 6540619 - DNA, 13 bp, Homo sapiens
tgtcattttggta

SEQ ID NO: 6540620 - DNA, 14 bp, Homo sapiens
tgtcatttttaata

SEQ ID NO: 6540621 - DNA, 22 bp, Homo sapiens
tgtcatttttaatattactgtc

SEQ ID NO: 6540622 - DNA, 15 bp, Homo sapiens
tgtcatttttgcagt

SEQ ID NO: 6540623 - DNA, 19 bp, Homo sapiens
tgtccaaaaccgccagctc

SEQ ID NO: 6540624 - DNA, 20 bp, Homo sapiens
tgtccaaaagatacccaaat

SEQ ID NO: 6540625 - DNA, 16 bp, Homo sapiens
tgtccaaaatttatat

SEQ ID NO: 6540626 - DNA, 17 bp, Homo sapiens
tgtccaaaatttatatt

SEQ ID NO: 6540627 - DNA, 22 bp, Homo sapiens
tgtccaaacaggtgctggccca

SEQ ID NO: 6540628 - DNA, 17 bp, Homo sapiens
tgtccaaacatttcatc

SEQ ID NO: 6540629 - DNA, 23 bp, Homo sapiens
tgtccaaaccaaccgcacatgca

SEQ ID NO: 6540630 - DNA, 19 bp, Homo sapiens
tgtccaaaccagcaaactt

SEQ ID NO: 6540631 - DNA, 17 bp, Homo sapiens
tgtccaaagaggctgcc

SEQ ID NO: 6540632 - DNA, 19 bp, Homo sapiens
tgtccaaagaggctgcccc

SEQ ID NO: 6540633 - DNA, 17 bp, Homo sapiens
tgtccaaagcagggtct

SEQ ID NO: 6540634 - DNA, 18 bp, Homo sapiens
tgtccaaagcagggtctg

SEQ ID NO: 6540635 - DNA, 15 bp, Homo sapiens
tgtccaaagctgaaa

SEQ ID NO: 6540636 - DNA, 19 bp, Homo sapiens
tgtccaaaggaggctggca

SEQ ID NO: 6540637 - DNA, 20 bp, Homo sapiens
tgtccaaatactctgaaatg

SEQ ID NO: 6540638 - DNA, 15 bp, Homo sapiens
tgtccaaatttaatg

SEQ ID NO: 6540639 - DNA, 16 bp, Homo sapiens
tgtccaaatttaatgt

SEQ ID NO: 6540640 - DNA, 14 bp, Homo sapiens
tgtccaacaataaa

SEQ ID NO: 6540641 - DNA, 20 bp, Homo sapiens
tgtccaacatggtaattcac

SEQ ID NO: 6540642 - DNA, 14 bp, Homo sapiens
tgtccaacatggtg

SEQ ID NO: 6540643 - DNA, 20 bp, Homo sapiens
tgtccaacccctcccccacg

SEQ ID NO: 6540644 - DNA, 21 bp, Homo sapiens
tgtccaacccctcccccacgt

SEQ ID NO: 6540645 - DNA, 22 bp, Homo sapiens
tgtccaacctaacccctttcct

SEQ ID NO: 6540646 - DNA, 22 bp, Homo sapiens
tgtccaactaaaaacaaaccct

SEQ ID NO: 6540647 - DNA, 14 bp, Homo sapiens
tgtccaactccagt

SEQ ID NO: 6540648 - DNA, 15 bp, Homo sapiens
tgtccaactctgtat

SEQ ID NO: 6540649 - DNA, 16 bp, Homo sapiens
tgtccaagaactctaa

SEQ ID NO: 6540650 - DNA, 22 bp, Homo sapiens
tgtccaagaagcccaggaaagg

SEQ ID NO: 6540651 - DNA, 12 bp, Homo sapiens
tgtccaagacag

SEQ ID NO: 6540652 - DNA, 23 bp, Homo sapiens
tgtccaagacaggggcctaagga

SEQ ID NO: 6540653 - DNA, 11 bp, Homo sapiens
tgtccaagcat

SEQ ID NO: 6540654 - DNA, 18 bp, Homo sapiens
tgtccaagcatcagcaag

SEQ ID NO: 6540655 - DNA, 16 bp, Homo sapiens
tgtccaagtgtttctt

SEQ ID NO: 6540656 - DNA, 17 bp, Homo sapiens
tgtccaagtgtttcttg

SEQ ID NO: 6540657 - DNA, 14 bp, Homo sapiens
tgtccaatcctatg

SEQ ID NO: 6540658 - DNA, 13 bp, Homo sapiens
tgtccaatgtggt

SEQ ID NO: 6540659 - DNA, 19 bp, Homo sapiens
ttcttctcttagattctta

SEQ ID NO: 6540660 - DNA, 12 bp, Homo sapiens
ttcttctcttta

SEQ ID NO: 6540661 - DNA, 14 bp, Homo sapiens
ttcttctgaggcct

SEQ ID NO: 6540662 - DNA, 14 bp, Homo sapiens
ttcttctgccactt

SEQ ID NO: 6540663 - DNA, 16 bp, Homo sapiens
ttcttctgccacttct

SEQ ID NO: 6540664 - DNA, 12 bp, Homo sapiens
ttcttctgcctc

SEQ ID NO: 6540665 - DNA, 15 bp, Homo sapiens
ttcttctgtaatatt

SEQ ID NO: 6540666 - DNA, 23 bp, Homo sapiens
ttcttctgtaatatttacaatgt

SEQ ID NO: 6540667 - DNA, 13 bp, Homo sapiens
ttcttctgtattt

SEQ ID NO: 6540668 - DNA, 13 bp, Homo sapiens
ttcttctgtgtta

SEQ ID NO: 6540669 - DNA, 15 bp, Homo sapiens
ttcttcttacacttc

SEQ ID NO: 6540670 - DNA, 15 bp, Homo sapiens
ttcttcttattttgt

SEQ ID NO: 6540671 - DNA, 13 bp, Homo sapiens
ttcttcttcacat

SEQ ID NO: 6540672 - DNA, 13 bp, Homo sapiens
ttcttcttcctga

SEQ ID NO: 6540673 - DNA, 15 bp, Homo sapiens
ttcttcttctaagaa

SEQ ID NO: 6540674 - DNA, 13 bp, Homo sapiens
ttcttctttcatt

SEQ ID NO: 6540675 - DNA, 21 bp, Homo sapiens
ttcttctttgtggtctttttc

SEQ ID NO: 6540676 - DNA, 13 bp, Homo sapiens
ttcttcttttaaa

SEQ ID NO: 6540677 - DNA, 16 bp, Homo sapiens
ttcttctttttgctgt

SEQ ID NO: 6540678 - DNA, 17 bp, Homo sapiens
ttcttctttttgcttca

SEQ ID NO: 6540679 - DNA, 21 bp, Homo sapiens
ttcttgaaaaaaaaaatatgt

SEQ ID NO: 6540680 - DNA, 20 bp, Homo sapiens
ttcttgaaaactgggacgtg

SEQ ID NO: 6540681 - DNA, 17 bp, Homo sapiens
ttcttgaaaagccttgg

SEQ ID NO: 6540682 - DNA, 19 bp, Homo sapiens
ttcttgaaagtattgtgtt

SEQ ID NO: 6540683 - DNA, 20 bp, Homo sapiens
ttcttgaacactcatgctga

SEQ ID NO: 6540684 - DNA, 21 bp, Homo sapiens
ttcttgaacactcatgctgaa

SEQ ID NO: 6540685 - DNA, 22 bp, Homo sapiens
ttcttgaacagccatatctgaa

SEQ ID NO: 6540686 - DNA, 23 bp, Homo sapiens
ttcttgaagctgggctgtctctc

SEQ ID NO: 6540687 - DNA, 12 bp, Homo sapiens
ttcttgaataaa

SEQ ID NO: 6540688 - DNA, 16 bp, Homo sapiens
ttcttgaatataaaaa

SEQ ID NO: 6540689 - DNA, 23 bp, Homo sapiens
ttcttgaatggcaatgttttgct

SEQ ID NO: 6540690 - DNA, 16 bp, Homo sapiens
ttcttgaattgttatg

SEQ ID NO: 6540691 - DNA, 20 bp, Homo sapiens
ttcttgaattgttatgaaaa

SEQ ID NO: 6540692 - DNA, 21 bp, Homo sapiens
ttcttgaattgttatgaaaat

SEQ ID NO: 6540693 - DNA, 22 bp, Homo sapiens
ttcttgacaagctgacttggca

SEQ ID NO: 6540694 - DNA, 20 bp, Homo sapiens
ttcttgacaatcatctccaa

SEQ ID NO: 6540695 - DNA, 15 bp, Homo sapiens
ttcttgacagtgaga

SEQ ID NO: 6540696 - DNA, 22 bp, Homo sapiens
ttcttgaccttatgccattcca

SEQ ID NO: 6540697 - DNA, 23 bp, Homo sapiens
ttcttgagcaccaggtgttaaaa

SEQ ID NO: 6540698 - DNA, 18 bp, Homo sapiens
ttcttgaggaaaatattg

SEQ ID NO: 6540699 - DNA, 21 bp, Homo sapiens
ttcttgaggggaagctagtct

SEQ ID NO: 6540700 - DNA, 18 bp, Homo sapiens
ttcttgaggtctcttttc

SEQ ID NO: 6540701 - DNA, 16 bp, Homo sapiens
ttcttgagttttgata

SEQ ID NO: 6540702 - DNA, 20 bp, Homo sapiens
ttcttgataattttccttta

SEQ ID NO: 6540703 - DNA, 16 bp, Homo sapiens
ttcttgatcttaaaga

SEQ ID NO: 6540704 - DNA, 22 bp, Homo sapiens
ttcttgatgatcctcaaggaaa

SEQ ID NO: 6540705 - DNA, 20 bp, Homo sapiens
ttcttgatgtaaaatcttgt

SEQ ID NO: 6540706 - DNA, 16 bp, Homo sapiens
ttcttgatgttgctta

SEQ ID NO: 6540707 - DNA, 15 bp, Homo sapiens
ttcttgattttcaag

SEQ ID NO: 6540708 - DNA, 17 bp, Homo sapiens
ttcttgcaaaacaaaca

SEQ ID NO: 6540709 - DNA, 16 bp, Homo sapiens
ttcttgcaaatacctc

SEQ ID NO: 6540710 - DNA, 22 bp, Homo sapiens
ttcttgcaagcaacaagctatt

SEQ ID NO: 6540711 - DNA, 17 bp, Homo sapiens
ttcttgcaagctccagt

SEQ ID NO: 6540712 - DNA, 22 bp, Homo sapiens
ttcttgcaagggaagagccttt

SEQ ID NO: 6540713 - DNA, 11 bp, Homo sapiens
ttcttgcaata

SEQ ID NO: 6540714 - DNA, 15 bp, Homo sapiens
ttcttgcaccctcat

SEQ ID NO: 6540715 - DNA, 12 bp, Homo sapiens
ttcttgcactga

SEQ ID NO: 6540716 - DNA, 19 bp, Homo sapiens
ttcttgcactgaatatata

SEQ ID NO: 6540717 - DNA, 20 bp, Homo sapiens
ttcttgcactgtatccaagt

SEQ ID NO: 6540718 - DNA, 14 bp, Homo sapiens
ttcttgcatatttt

SEQ ID NO: 6540719 - DNA, 19 bp, Homo sapiens
ttcttgccacacagtgggc

SEQ ID NO: 6540720 - DNA, 14 bp, Homo sapiens
ttcttgccagctca

SEQ ID NO: 6540721 - DNA, 15 bp, Homo sapiens
ttcttgccagctcag

SEQ ID NO: 6540722 - DNA, 18 bp, Homo sapiens
ttcttgcctgaactcctg

SEQ ID NO: 6540723 - DNA, 15 bp, Homo sapiens
ttcttgccttttgtt

SEQ ID NO: 6540724 - DNA, 22 bp, Homo sapiens
ttcttgcgatagtttactgaga

SEQ ID NO: 6540725 - DNA, 22 bp, Homo sapiens
ttcttgcggcaccgcccaccca

SEQ ID NO: 6540726 - DNA, 14 bp, Homo sapiens
ttcttgctaacttt

SEQ ID NO: 6540727 - DNA, 13 bp, Homo sapiens
ttcttgctagcta

SEQ ID NO: 6540728 - DNA, 19 bp, Homo sapiens
ttcttgctatatgatttag

SEQ ID NO: 6540729 - DNA, 14 bp, Homo sapiens
ttcttgctatgtta

SEQ ID NO: 6540730 - DNA, 19 bp, Homo sapiens
ttcttgctctctctccctg

SEQ ID NO: 6540731 - DNA, 11 bp, Homo sapiens
ttcttgctgct

SEQ ID NO: 6540732 - DNA, 12 bp, Homo sapiens
ttcttgctgctt

SEQ ID NO: 6540733 - DNA, 14 bp, Homo sapiens
ttcttgctggttgt

SEQ ID NO: 6540734 - DNA, 17 bp, Homo sapiens
ttcttgctgttcagtgc

SEQ ID NO: 6540735 - DNA, 17 bp, Homo sapiens
ttcttgcttctttctag

SEQ ID NO: 6540736 - DNA, 15 bp, Homo sapiens
ttcttgcttgtaaaa

SEQ ID NO: 6540737 - DNA, 13 bp, Homo sapiens
ttcttgcttgtac

SEQ ID NO: 6540738 - DNA, 22 bp, Homo sapiens
ttcttgcttgtacctctggctg

SEQ ID NO: 6540739 - DNA, 19 bp, Homo sapiens
ttcttggaaaaaaattaca

SEQ ID NO: 6540740 - DNA, 20 bp, Homo sapiens
ttcttggaactgtcccagct

SEQ ID NO: 6540741 - DNA, 20 bp, Homo sapiens
ttcttggagctttggaatat

SEQ ID NO: 6540742 - DNA, 18 bp, Homo sapiens
ttcttggagtcttccaaa

SEQ ID NO: 6540743 - DNA, 22 bp, Homo sapiens
ttcttggcaaaagccttgtgta

SEQ ID NO: 6540744 - DNA, 14 bp, Homo sapiens
ttcttggcaaattt

SEQ ID NO: 6540745 - DNA, 21 bp, Homo sapiens
ttcttggcaataaattttgaa

SEQ ID NO: 6540746 - DNA, 18 bp, Homo sapiens
ttcttggccactgaatta

SEQ ID NO: 6540747 - DNA, 15 bp, Homo sapiens
ttcttggcccaggat

SEQ ID NO: 6540748 - DNA, 20 bp, Homo sapiens
ttcttggcctcaagttcaat

SEQ ID NO: 6540749 - DNA, 13 bp, Homo sapiens
ttcttggcttcct

SEQ ID NO: 6540750 - DNA, 16 bp, Homo sapiens
ttcttgggaaaatatc

SEQ ID NO: 6540751 - DNA, 14 bp, Homo sapiens
ttcttgggaaacac

SEQ ID NO: 6540752 - DNA, 17 bp, Homo sapiens
ttcttgggaaagagaca

SEQ ID NO: 6540753 - DNA, 17 bp, Homo sapiens
ttcttgggactgctgtg

SEQ ID NO: 6540754 - DNA, 19 bp, Homo sapiens
ttcttgggactgctgtgaa

SEQ ID NO: 6540755 - DNA, 19 bp, Homo sapiens
ttcttgggatagtgttctg

SEQ ID NO: 6540756 - DNA, 22 bp, Homo sapiens
ttcttgggcaagcagaaaaatt

SEQ ID NO: 6540757 - DNA, 22 bp, Homo sapiens
ttcttgggcagtctttcttgaa

SEQ ID NO: 6540758 - DNA, 22 bp, Homo sapiens
ttcttgggcattcttttgctgt

SEQ ID NO: 6540759 - DNA, 23 bp, Homo sapiens
ttcttgggctaggtagtggggac

SEQ ID NO: 6540760 - DNA, 18 bp, Homo sapiens
ttcttggggcccagtgca

SEQ ID NO: 6540761 - DNA, 18 bp, Homo sapiens
ttcttggggccctacacc

SEQ ID NO: 6540762 - DNA, 23 bp, Homo sapiens
ttcttggggtactcttgatgtga

SEQ ID NO: 6540763 - DNA, 17 bp, Homo sapiens
ttcttggggtcccaggg

SEQ ID NO: 6540764 - DNA, 12 bp, Homo sapiens
ttcttgggtagt

SEQ ID NO: 6540765 - DNA, 15 bp, Homo sapiens
ttcttggtagagatt

SEQ ID NO: 6540766 - DNA, 15 bp, Homo sapiens
ttcttggtgcattcg

SEQ ID NO: 6540767 - DNA, 21 bp, Homo sapiens
ttcttggtgcttacacatctc

SEQ ID NO: 6540768 - DNA, 14 bp, Homo sapiens
ttcttggtggcaga

SEQ ID NO: 6540769 - DNA, 14 bp, Homo sapiens
ttcttggttattct

SEQ ID NO: 6540770 - DNA, 14 bp, Homo sapiens
ttcttggttcctgg

SEQ ID NO: 6540771 - DNA, 17 bp, Homo sapiens
ttcttggttcctgtttg

SEQ ID NO: 6540772 - DNA, 22 bp, Homo sapiens
ttcttggttgaggaaacaaaca

SEQ ID NO: 6540773 - DNA, 18 bp, Homo sapiens
ttcttggtttcagccaag

SEQ ID NO: 6540774 - DNA, 14 bp, Homo sapiens
ttcttggtttctgg

SEQ ID NO: 6540775 - DNA, 17 bp, Homo sapiens
ttcttggtttctggata

SEQ ID NO: 6540776 - DNA, 17 bp, Homo sapiens
ttcttggtttggggaga

SEQ ID NO: 6540777 - DNA, 13 bp, Homo sapiens
ttcttggtttgta

SEQ ID NO: 6540778 - DNA, 17 bp, Homo sapiens
ttcttggtttgtaaatt

SEQ ID NO: 6540779 - DNA, 23 bp, Homo sapiens
ttcttggtttgtaaattaacttt

SEQ ID NO: 6540780 - DNA, 14 bp, Homo sapiens
ttcttgtaaaactg

SEQ ID NO: 6540781 - DNA, 16 bp, Homo sapiens
ttcttgtaaaactgtg

SEQ ID NO: 6540782 - DNA, 18 bp, Homo sapiens
ttcttgtaaaactgtgac

SEQ ID NO: 6540783 - DNA, 22 bp, Homo sapiens
ttcttgtaaaactgtgacattc

SEQ ID NO: 6540784 - DNA, 14 bp, Homo sapiens
ttcttgtaaatctt

SEQ ID NO: 6540785 - DNA, 13 bp, Homo sapiens
ttcttgtaaatgt

SEQ ID NO: 6540786 - DNA, 18 bp, Homo sapiens
ttcttgtaaatgtgttgg

SEQ ID NO: 6540787 - DNA, 15 bp, Homo sapiens
ttcttgtaactttct

SEQ ID NO: 6540788 - DNA, 20 bp, Homo sapiens
ttcttgtaactttcttcaaa

SEQ ID NO: 6540789 - DNA, 19 bp, Homo sapiens
ttcttgtaaggctttgatt

SEQ ID NO: 6540790 - DNA, 22 bp, Homo sapiens
ttcttgtatctggattcaaatt

SEQ ID NO: 6540791 - DNA, 19 bp, Homo sapiens
ttcttgtattaagaatgaa

SEQ ID NO: 6540792 - DNA, 16 bp, Homo sapiens
ttcttgtcagacataa

SEQ ID NO: 6540793 - DNA, 17 bp, Homo sapiens
ttcttgtcagacataaa

SEQ ID NO: 6540794 - DNA, 19 bp, Homo sapiens
ttcttgtcagacataaagc

SEQ ID NO: 6540795 - DNA, 13 bp, Homo sapiens
ttcttgtctataa

SEQ ID NO: 6540796 - DNA, 14 bp, Homo sapiens
ttcttgtctataaa

SEQ ID NO: 6540797 - DNA, 21 bp, Homo sapiens
ttcttgtctataaagcattta

SEQ ID NO: 6540798 - DNA, 15 bp, Homo sapiens
ttcttgtctatagtt

SEQ ID NO: 6540799 - DNA, 19 bp, Homo sapiens
ttcttgtctgattggctca

SEQ ID NO: 6540800 - DNA, 15 bp, Homo sapiens
ttcttgtctttcctc

SEQ ID NO: 6540801 - DNA, 11 bp, Homo sapiens
ttcttgtgaag

SEQ ID NO: 6540802 - DNA, 17 bp, Homo sapiens
ttcttgtgaaggccatg

SEQ ID NO: 6540803 - DNA, 14 bp, Homo sapiens
ttcttgtgatcctt

SEQ ID NO: 6540804 - DNA, 15 bp, Homo sapiens
ttcttgtgcatgttt

SEQ ID NO: 6540805 - DNA, 13 bp, Homo sapiens
ttcttgtgccctg

SEQ ID NO: 6540806 - DNA, 17 bp, Homo sapiens
ttcttgtgcctcggcct

SEQ ID NO: 6540807 - DNA, 15 bp, Homo sapiens
ttcttgtggaagaca

SEQ ID NO: 6540808 - DNA, 21 bp, Homo sapiens
ttcttgtgggagacagcagcc

SEQ ID NO: 6540809 - DNA, 14 bp, Homo sapiens
ttcttgtggttaaa

SEQ ID NO: 6540810 - DNA, 18 bp, Homo sapiens
ttcttgtgtgtatgcaca

SEQ ID NO: 6540811 - DNA, 22 bp, Homo sapiens
ttcttgtgtgtatgcacatgaa

SEQ ID NO: 6540812 - DNA, 16 bp, Homo sapiens
ttcttgtgtttgaaac

SEQ ID NO: 6540813 - DNA, 17 bp, Homo sapiens
ttcttgtgtttgaaaca

SEQ ID NO: 6540814 - DNA, 14 bp, Homo sapiens
ttcttgttctgttt

SEQ ID NO: 6540815 - DNA, 18 bp, Homo sapiens
ttcttgttggtagcatgt

SEQ ID NO: 6540816 - DNA, 19 bp, Homo sapiens
ttcttgttgtacccttgtt

SEQ ID NO: 6540817 - DNA, 15 bp, Homo sapiens
ttcttgtttattgag

SEQ ID NO: 6540818 - DNA, 14 bp, Homo sapiens
ttcttgtttgaatt

SEQ ID NO: 6540819 - DNA, 13 bp, Homo sapiens
ttcttgtttgtca

SEQ ID NO: 6540820 - DNA, 16 bp, Homo sapiens
ttcttgtttgtcagca

SEQ ID NO: 6540821 - DNA, 17 bp, Homo sapiens
ttcttgttttacatttg

SEQ ID NO: 6540822 - DNA, 16 bp, Homo sapiens
ttcttgttttgcttcc

SEQ ID NO: 6540823 - DNA, 21 bp, Homo sapiens
ttcttgttttgttatataaaa

SEQ ID NO: 6540824 - DNA, 14 bp, Homo sapiens
ttctttaaaaaaga

SEQ ID NO: 6540825 - DNA, 15 bp, Homo sapiens
ttctttaaaaaagaa

SEQ ID NO: 6540826 - DNA, 13 bp, Homo sapiens
ttctttaaaagaa

SEQ ID NO: 6540827 - DNA, 16 bp, Homo sapiens
ttctttaaaagaatga

SEQ ID NO: 6540828 - DNA, 18 bp, Homo sapiens
ttctttaaaagaatgact

SEQ ID NO: 6540829 - DNA, 19 bp, Homo sapiens
ttctttaaaagaatgacta

SEQ ID NO: 6540830 - DNA, 23 bp, Homo sapiens
ttctttaaaataaaaaagcaaaa

SEQ ID NO: 6540831 - DNA, 15 bp, Homo sapiens
ttctttaaactactg

SEQ ID NO: 6540832 - DNA, 22 bp, Homo sapiens
ttctttaaagaagttgaagttt

SEQ ID NO: 6540833 - DNA, 14 bp, Homo sapiens
ttctttaaagccag

SEQ ID NO: 6540834 - DNA, 18 bp, Homo sapiens
ttctttaaagccagtcat

SEQ ID NO: 6540835 - DNA, 21 bp, Homo sapiens
ttctttaaagccagtcatcat

SEQ ID NO: 6540836 - DNA, 14 bp, Homo sapiens
ttctttaaatcaaa

SEQ ID NO: 6540837 - DNA, 21 bp, Homo sapiens
ttctttaaatcagtattccat

SEQ ID NO: 6540838 - DNA, 18 bp, Homo sapiens
ttctttaaatttcaaatg

SEQ ID NO: 6540839 - DNA, 18 bp, Homo sapiens
tgtccaattatgcactgg

SEQ ID NO: 6540840 - DNA, 22 bp, Homo sapiens
tgtccaatttcgggagccttgt

SEQ ID NO: 6540841 - DNA, 16 bp, Homo sapiens
tgtccaatttctgctg

SEQ ID NO: 6540842 - DNA, 17 bp, Homo sapiens
tgtccaatttctgctgt

SEQ ID NO: 6540843 - DNA, 17 bp, Homo sapiens
tgtccacactaccagtt

SEQ ID NO: 6540844 - DNA, 20 bp, Homo sapiens
tgtccacagagtttgtagta

SEQ ID NO: 6540845 - DNA, 19 bp, Homo sapiens
tgtccacagatgcctccac

SEQ ID NO: 6540846 - DNA, 18 bp, Homo sapiens
tgtccacaggcttctgag

SEQ ID NO: 6540847 - DNA, 18 bp, Homo sapiens
tgtccacatccccagagc

SEQ ID NO: 6540848 - DNA, 19 bp, Homo sapiens
tgtccacatccccagagcc

SEQ ID NO: 6540849 - DNA, 23 bp, Homo sapiens
tgtccacatccccagagcccagc

SEQ ID NO: 6540850 - DNA, 14 bp, Homo sapiens
tgtccacatctgcc

SEQ ID NO: 6540851 - DNA, 16 bp, Homo sapiens
tgtccacatctgcctc

SEQ ID NO: 6540852 - DNA, 17 bp, Homo sapiens
tgtccacatctgcctcc

SEQ ID NO: 6540853 - DNA, 19 bp, Homo sapiens
tgtccacattctacttcag

SEQ ID NO: 6540854 - DNA, 20 bp, Homo sapiens
tgtccaccacttcaggggat

SEQ ID NO: 6540855 - DNA, 21 bp, Homo sapiens
tgtccaccagtttatacagaa

SEQ ID NO: 6540856 - DNA, 12 bp, Homo sapiens
tgtccaccatgc

SEQ ID NO: 6540857 - DNA, 21 bp, Homo sapiens
tgtccacccacctatgtgcca

SEQ ID NO: 6540858 - DNA, 11 bp, Homo sapiens
tgtccaccccc

SEQ ID NO: 6540859 - DNA, 17 bp, Homo sapiens
tgtccacccccgcctcc

SEQ ID NO: 6540860 - DNA, 22 bp, Homo sapiens
tgtccaccctcatttctgccag

SEQ ID NO: 6540861 - DNA, 23 bp, Homo sapiens
tgtccaccctcatttctgccagc

SEQ ID NO: 6540862 - DNA, 23 bp, Homo sapiens
tgtccacctgtgagaaaggaaaa

SEQ ID NO: 6540863 - DNA, 20 bp, Homo sapiens
tgtccaccttctgccaaggc

SEQ ID NO: 6540864 - DNA, 17 bp, Homo sapiens
tgtccacgactgtctcc

SEQ ID NO: 6540865 - DNA, 21 bp, Homo sapiens
tgtccacgtacttaatttact

SEQ ID NO: 6540866 - DNA, 22 bp, Homo sapiens
tgtccacgtacttaatttactt

SEQ ID NO: 6540867 - DNA, 19 bp, Homo sapiens
tgtccacgtgtgtgtgtga

SEQ ID NO: 6540868 - DNA, 21 bp, Homo sapiens
tgtccacgtttttggaaaatg

SEQ ID NO: 6540869 - DNA, 23 bp, Homo sapiens
tgtccactctgaataccaagtgt

SEQ ID NO: 6540870 - DNA, 13 bp, Homo sapiens
tgtccactgtgta

SEQ ID NO: 6540871 - DNA, 22 bp, Homo sapiens
tgtccacttgtgggtcctgggg

SEQ ID NO: 6540872 - DNA, 14 bp, Homo sapiens
tgtccagaaaatag

SEQ ID NO: 6540873 - DNA, 24 bp, Homo sapiens
tgtccagaaaatagggtggacaga

SEQ ID NO: 6540874 - DNA, 15 bp, Homo sapiens
tgtccagaagaatat

SEQ ID NO: 6540875 - DNA, 20 bp, Homo sapiens
tgtccagaagaatattcagg

SEQ ID NO: 6540876 - DNA, 21 bp, Homo sapiens
tgtccagaagaatattcagga

SEQ ID NO: 6540877 - DNA, 13 bp, Homo sapiens
tgtccagacagcc

SEQ ID NO: 6540878 - DNA, 16 bp, Homo sapiens
tgtccagacagcctgt

SEQ ID NO: 6540879 - DNA, 22 bp, Homo sapiens
tgtccagaccattgtcttccaa

SEQ ID NO: 6540880 - DNA, 14 bp, Homo sapiens
tgtccagactgtgg

SEQ ID NO: 6540881 - DNA, 12 bp, Homo sapiens
tgtccagagaca

SEQ ID NO: 6540882 - DNA, 11 bp, Homo sapiens
tgtccagagag

SEQ ID NO: 6540883 - DNA, 17 bp, Homo sapiens
tgtccagagctggccag

SEQ ID NO: 6540884 - DNA, 18 bp, Homo sapiens
tgtccagagggactggac

SEQ ID NO: 6540885 - DNA, 20 bp, Homo sapiens
tgtccagagggactggacag

SEQ ID NO: 6540886 - DNA, 15 bp, Homo sapiens
tgtccagagtctctt

SEQ ID NO: 6540887 - DNA, 20 bp, Homo sapiens
tgtccagagtgagcaaggat

SEQ ID NO: 6540888 - DNA, 22 bp, Homo sapiens
tgtccagattattggctgcttt

SEQ ID NO: 6540889 - DNA, 20 bp, Homo sapiens
tgtccagcaccttgtgcctg

SEQ ID NO: 6540890 - DNA, 12 bp, Homo sapiens
tgtccagcagct

SEQ ID NO: 6540891 - DNA, 14 bp, Homo sapiens
tgtccagcagctgc

SEQ ID NO: 6540892 - DNA, 15 bp, Homo sapiens
tgtccagcagctgcg

SEQ ID NO: 6540893 - DNA, 21 bp, Homo sapiens
tgtccagcagctgcgggtctg

SEQ ID NO: 6540894 - DNA, 19 bp, Homo sapiens
tgtccagcatggatgaaac

SEQ ID NO: 6540895 - DNA, 18 bp, Homo sapiens
tgtccagcattgaagaga

SEQ ID NO: 6540896 - DNA, 20 bp, Homo sapiens
tgtccagccccgtagacgtg

SEQ ID NO: 6540897 - DNA, 14 bp, Homo sapiens
tgtccagccgtgtg

SEQ ID NO: 6540898 - DNA, 18 bp, Homo sapiens
tgtccagccgtgtgtgca

SEQ ID NO: 6540899 - DNA, 23 bp, Homo sapiens
tgtccagccgtgtgtgcatgtgc

SEQ ID NO: 6540900 - DNA, 14 bp, Homo sapiens
tgtccagcctgggc

SEQ ID NO: 6540901 - DNA, 12 bp, Homo sapiens
tgtccagctcca

SEQ ID NO: 6540902 - DNA, 20 bp, Homo sapiens
tgtccagctccaacctgcaa

SEQ ID NO: 6540903 - DNA, 17 bp, Homo sapiens
tgtccagctcccgctgt

SEQ ID NO: 6540904 - DNA, 20 bp, Homo sapiens
tgtccagctgggacctaatg

SEQ ID NO: 6540905 - DNA, 13 bp, Homo sapiens
tgtccagcttcca

SEQ ID NO: 6540906 - DNA, 15 bp, Homo sapiens
tgtccagcttccaaa

SEQ ID NO: 6540907 - DNA, 22 bp, Homo sapiens
tgtccagcttctcttgaaaact

SEQ ID NO: 6540908 - DNA, 21 bp, Homo sapiens
tgtccaggaaaccctggcttg

SEQ ID NO: 6540909 - DNA, 12 bp, Homo sapiens
tgtccaggaagt

SEQ ID NO: 6540910 - DNA, 16 bp, Homo sapiens
tgtccaggagccccgc

SEQ ID NO: 6540911 - DNA, 14 bp, Homo sapiens
tgtccaggatcaaa

SEQ ID NO: 6540912 - DNA, 18 bp, Homo sapiens
tgtccaggatcaaaagaa

SEQ ID NO: 6540913 - DNA, 19 bp, Homo sapiens
tgtccaggcactgctgccc

SEQ ID NO: 6540914 - DNA, 20 bp, Homo sapiens
tgtccaggcagctccctcct

SEQ ID NO: 6540915 - DNA, 23 bp, Homo sapiens
tgtccaggcagctccctcctgca

SEQ ID NO: 6540916 - DNA, 12 bp, Homo sapiens
tgtccaggccac

SEQ ID NO: 6540917 - DNA, 18 bp, Homo sapiens
tgtccaggccactgtggc

SEQ ID NO: 6540918 - DNA, 18 bp, Homo sapiens
tgtccaggctggagtgca

SEQ ID NO: 6540919 - DNA, 17 bp, Homo sapiens
tgtccagggcccatgta

SEQ ID NO: 6540920 - DNA, 19 bp, Homo sapiens
tgtccagggccctgagctc

SEQ ID NO: 6540921 - DNA, 14 bp, Homo sapiens
tgtccagggcttca

SEQ ID NO: 6540922 - DNA, 18 bp, Homo sapiens
tgtccagggtcctctagc

SEQ ID NO: 6540923 - DNA, 20 bp, Homo sapiens
tgtccaggtgagtgtgaggg

SEQ ID NO: 6540924 - DNA, 19 bp, Homo sapiens
tgtccaggttgatcttgaa

SEQ ID NO: 6540925 - DNA, 16 bp, Homo sapiens
tgtccagtaagatcac

SEQ ID NO: 6540926 - DNA, 17 bp, Homo sapiens
tgtccagtaagatcact

SEQ ID NO: 6540927 - DNA, 16 bp, Homo sapiens
tgtccagtcatcctgc

SEQ ID NO: 6540928 - DNA, 21 bp, Homo sapiens
tgtccagtcatcctgccctgc

SEQ ID NO: 6540929 - DNA, 15 bp, Homo sapiens
tgtccagtgcccatt

SEQ ID NO: 6540930 - DNA, 15 bp, Homo sapiens
tgtccagtgcctaca

SEQ ID NO: 6540931 - DNA, 14 bp, Homo sapiens
tgtccagttttctt

SEQ ID NO: 6540932 - DNA, 21 bp, Homo sapiens
tgtccagttttggaggctgag

SEQ ID NO: 6540933 - DNA, 12 bp, Homo sapiens
tgtccataaagt

SEQ ID NO: 6540934 - DNA, 15 bp, Homo sapiens
tgtccataaataaag

SEQ ID NO: 6540935 - DNA, 17 bp, Homo sapiens
tgtccataagagaaatg

SEQ ID NO: 6540936 - DNA, 19 bp, Homo sapiens
tgtccataagagaaatggt

SEQ ID NO: 6540937 - DNA, 21 bp, Homo sapiens
tgtccatatcagacctctgat

SEQ ID NO: 6540938 - DNA, 18 bp, Homo sapiens
tgtccatcagatgacaag

SEQ ID NO: 6540939 - DNA, 13 bp, Homo sapiens
tgtccatcagtgc

SEQ ID NO: 6540940 - DNA, 19 bp, Homo sapiens
tgtccatcccttttcctgt

SEQ ID NO: 6540941 - DNA, 13 bp, Homo sapiens
tgtccatccgtct

SEQ ID NO: 6540942 - DNA, 20 bp, Homo sapiens
tgtccatccgtctctgtccg

SEQ ID NO: 6540943 - DNA, 23 bp, Homo sapiens
tgtccatcctcctctccatgcaa

SEQ ID NO: 6540944 - DNA, 14 bp, Homo sapiens
tgtccatcctgacc

SEQ ID NO: 6540945 - DNA, 16 bp, Homo sapiens
tgtccatctgcccgcc

SEQ ID NO: 6540946 - DNA, 17 bp, Homo sapiens
tgtccatctgcccgcct

SEQ ID NO: 6540947 - DNA, 19 bp, Homo sapiens
tgtccatctgcccgcctgc

SEQ ID NO: 6540948 - DNA, 22 bp, Homo sapiens
tgtccatctgcccgcctgccca

SEQ ID NO: 6540949 - DNA, 23 bp, Homo sapiens
tgtccatcttgtttcatttgctt

SEQ ID NO: 6540950 - DNA, 19 bp, Homo sapiens
tgtccatgaaaaacagcag

SEQ ID NO: 6540951 - DNA, 15 bp, Homo sapiens
tgtccatggcctttc

SEQ ID NO: 6540952 - DNA, 12 bp, Homo sapiens
tgtccatgtccc

SEQ ID NO: 6540953 - DNA, 11 bp, Homo sapiens
tgtccatgtgc

SEQ ID NO: 6540954 - DNA, 14 bp, Homo sapiens
tgtccatgtgcttc

SEQ ID NO: 6540955 - DNA, 15 bp, Homo sapiens
tgtccatgtgtgtgc

SEQ ID NO: 6540956 - DNA, 17 bp, Homo sapiens
tgtccattatctgctgt

SEQ ID NO: 6540957 - DNA, 19 bp, Homo sapiens
tgtccattattcaagaaag

SEQ ID NO: 6540958 - DNA, 20 bp, Homo sapiens
tgtccattgccacggccatg

SEQ ID NO: 6540959 - DNA, 13 bp, Homo sapiens
tgtccattgtaaa

SEQ ID NO: 6540960 - DNA, 14 bp, Homo sapiens
tgtccattgtccaa

SEQ ID NO: 6540961 - DNA, 21 bp, Homo sapiens
tgtccatttatccacaggaaa

SEQ ID NO: 6540962 - DNA, 22 bp, Homo sapiens
tgtccattttgcaaacccaact

SEQ ID NO: 6540963 - DNA, 19 bp, Homo sapiens
tgtccattttgtgaagccc

SEQ ID NO: 6540964 - DNA, 16 bp, Homo sapiens
tgtccatttttacaag

SEQ ID NO: 6540965 - DNA, 15 bp, Homo sapiens
tgtcccaaatccgcc

SEQ ID NO: 6540966 - DNA, 22 bp, Homo sapiens
tgtcccaacaaccacacttaaa

SEQ ID NO: 6540967 - DNA, 14 bp, Homo sapiens
tgtcccaagccggg

SEQ ID NO: 6540968 - DNA, 22 bp, Homo sapiens
tgtcccaagctttgaatacccc

SEQ ID NO: 6540969 - DNA, 13 bp, Homo sapiens
tgtcccaagtgcc

SEQ ID NO: 6540970 - DNA, 18 bp, Homo sapiens
tgtcccaatagctctact

SEQ ID NO: 6540971 - DNA, 12 bp, Homo sapiens
tgtcccacaaaa

SEQ ID NO: 6540972 - DNA, 12 bp, Homo sapiens
tgtcccacagct

SEQ ID NO: 6540973 - DNA, 13 bp, Homo sapiens
tgtcccacagctt

SEQ ID NO: 6540974 - DNA, 14 bp, Homo sapiens
tgtcccacagcttg

SEQ ID NO: 6540975 - DNA, 15 bp, Homo sapiens
tgtcccacatggcca

SEQ ID NO: 6540976 - DNA, 22 bp, Homo sapiens
tgtcccaccaactctgcactcc

SEQ ID NO: 6540977 - DNA, 23 bp, Homo sapiens
tgtcccaccaactctgcactcca

SEQ ID NO: 6540978 - DNA, 18 bp, Homo sapiens
tgtcccaccatacgagca

SEQ ID NO: 6540979 - DNA, 23 bp, Homo sapiens
tgtcccaccatacgagcacctcc

SEQ ID NO: 6540980 - DNA, 19 bp, Homo sapiens
tgtcccacccacacagctg

SEQ ID NO: 6540981 - DNA, 20 bp, Homo sapiens
tgtcccacccacacagctgc

SEQ ID NO: 6540982 - DNA, 23 bp, Homo sapiens
tgtcccacccacacagctgccct

SEQ ID NO: 6540983 - DNA, 18 bp, Homo sapiens
tgtcccacccccaccccc

SEQ ID NO: 6540984 - DNA, 20 bp, Homo sapiens
tgtcccacccccttccccca

SEQ ID NO: 6540985 - DNA, 13 bp, Homo sapiens
tgtcccaccccta

SEQ ID NO: 6540986 - DNA, 21 bp, Homo sapiens
tgtcccacccctagccaccag

SEQ ID NO: 6540987 - DNA, 22 bp, Homo sapiens
tgtcccaccgggagcctccccc

SEQ ID NO: 6540988 - DNA, 22 bp, Homo sapiens
tgtcccacctcttctcttcctg

SEQ ID NO: 6540989 - DNA, 23 bp, Homo sapiens
tgtcccacctcttctcttcctgt

SEQ ID NO: 6540990 - DNA, 17 bp, Homo sapiens
tgtcccacgtgtcttcc

SEQ ID NO: 6540991 - DNA, 17 bp, Homo sapiens
tgtcccactcaagccaa

SEQ ID NO: 6540992 - DNA, 20 bp, Homo sapiens
tgtcccactcaagccaagca

SEQ ID NO: 6540993 - DNA, 22 bp, Homo sapiens
tgtcccactggctcctcccagc

SEQ ID NO: 6540994 - DNA, 15 bp, Homo sapiens
tgtcccactgggaca

SEQ ID NO: 6540995 - DNA, 14 bp, Homo sapiens
tgtcccagaagatg

SEQ ID NO: 6540996 - DNA, 21 bp, Homo sapiens
tgtcccagaagatgactgagg

SEQ ID NO: 6540997 - DNA, 22 bp, Homo sapiens
tgtcccagagcttattggccac

SEQ ID NO: 6540998 - DNA, 22 bp, Homo sapiens
tgtcccagaggttatctgcctg

SEQ ID NO: 6540999 - DNA, 21 bp, Homo sapiens
tgtcccagatcgtctccaatt

SEQ ID NO: 6541000 - DNA, 16 bp, Homo sapiens
tgtcccagatgctgtc

SEQ ID NO: 6541001 - DNA, 20 bp, Homo sapiens
tgtcccagatgggccacggc

SEQ ID NO: 6541002 - DNA, 13 bp, Homo sapiens
tgtcccagccacg

SEQ ID NO: 6541003 - DNA, 18 bp, Homo sapiens
tgtcccagccagtgagga

SEQ ID NO: 6541004 - DNA, 16 bp, Homo sapiens
tgtcccagcccctggt

SEQ ID NO: 6541005 - DNA, 12 bp, Homo sapiens
tgtcccaggact

SEQ ID NO: 6541006 - DNA, 20 bp, Homo sapiens
tgtcccaggactcaccctcc

SEQ ID NO: 6541007 - DNA, 10 bp, Homo sapiens
tgtcccaggc

SEQ ID NO: 6541008 - DNA, 14 bp, Homo sapiens
tgtcccaggcagcg

SEQ ID NO: 6541009 - DNA, 14 bp, Homo sapiens
tgtcccaggcaggg

SEQ ID NO: 6541010 - DNA, 17 bp, Homo sapiens
tgtcccaggcagggaga

SEQ ID NO: 6541011 - DNA, 20 bp, Homo sapiens
tgtcccaggcatgcagctgc

SEQ ID NO: 6541012 - DNA, 23 bp, Homo sapiens
tgtcccaggcatgcagctgcctg

SEQ ID NO: 6541013 - DNA, 13 bp, Homo sapiens
tgtcccaggccgg

SEQ ID NO: 6541014 - DNA, 17 bp, Homo sapiens
tgtcccaggtcctcact

SEQ ID NO: 6541015 - DNA, 15 bp, Homo sapiens
tgtcccagtcagaaa

SEQ ID NO: 6541016 - DNA, 17 bp, Homo sapiens
aagatgtctatgtagct

SEQ ID NO: 6541017 - DNA, 17 bp, Homo sapiens
aagatgtctcagagcct

SEQ ID NO: 6541018 - DNA, 13 bp, Homo sapiens
aagatgtctcctc

SEQ ID NO: 6541019 - DNA, 17 bp, Homo sapiens
aagatgtctcctcaagc

SEQ ID NO: 6541020 - DNA, 21 bp, Homo sapiens
aagatgtctcctcaagcctgt

SEQ ID NO: 6541021 - DNA, 20 bp, Homo sapiens
aagatgtctgtttgctgatg

SEQ ID NO: 6541022 - DNA, 15 bp, Homo sapiens
aagatgtgaaaactc

SEQ ID NO: 6541023 - DNA, 13 bp, Homo sapiens
aagatgtgaatta

SEQ ID NO: 6541024 - DNA, 21 bp, Homo sapiens
aagatgtgaattattgacact

SEQ ID NO: 6541025 - DNA, 23 bp, Homo sapiens
aagatgtgaattattgacactga

SEQ ID NO: 6541026 - DNA, 20 bp, Homo sapiens
aagatgtgatattctaagac

SEQ ID NO: 6541027 - DNA, 21 bp, Homo sapiens
aagatgtgatattctaagact

SEQ ID NO: 6541028 - DNA, 19 bp, Homo sapiens
aagatgtggatccctttag

SEQ ID NO: 6541029 - DNA, 22 bp, Homo sapiens
aagatgtgtaaataagcgttta

SEQ ID NO: 6541030 - DNA, 19 bp, Homo sapiens
aagatgtgttcaggcattc

SEQ ID NO: 6541031 - DNA, 17 bp, Homo sapiens
aagatgtgttcttattt

SEQ ID NO: 6541032 - DNA, 23 bp, Homo sapiens
aagatgttaaaatcggtttttaa

SEQ ID NO: 6541033 - DNA, 14 bp, Homo sapiens
aagatgttaaatgg

SEQ ID NO: 6541034 - DNA, 11 bp, Homo sapiens
aagatgttaag

SEQ ID NO: 6541035 - DNA, 15 bp, Homo sapiens
aagatgttatacaac

SEQ ID NO: 6541036 - DNA, 19 bp, Homo sapiens
aagatgttatattaaagaa

SEQ ID NO: 6541037 - DNA, 15 bp, Homo sapiens
aagatgttgtgtctt

SEQ ID NO: 6541038 - DNA, 14 bp, Homo sapiens
aagatgtttaactt

SEQ ID NO: 6541039 - DNA, 17 bp, Homo sapiens
aagatgtttacattttt

SEQ ID NO: 6541040 - DNA, 14 bp, Homo sapiens
aagatgtttatctg

SEQ ID NO: 6541041 - DNA, 13 bp, Homo sapiens
aagatgtttattg

SEQ ID NO: 6541042 - DNA, 19 bp, Homo sapiens
aagatgtttcattttactg

SEQ ID NO: 6541043 - DNA, 20 bp, Homo sapiens
aagatgtttcttgccttttg

SEQ ID NO: 6541044 - DNA, 16 bp, Homo sapiens
aagatgtttggacacc

SEQ ID NO: 6541045 - DNA, 16 bp, Homo sapiens
aagatgtttgtcagat

SEQ ID NO: 6541046 - DNA, 23 bp, Homo sapiens
aagatgttttgtataaaatctga

SEQ ID NO: 6541047 - DNA, 14 bp, Homo sapiens
aagatgtttttaga

SEQ ID NO: 6541048 - DNA, 21 bp, Homo sapiens
aagattaaaaccacagaacag

SEQ ID NO: 6541049 - DNA, 13 bp, Homo sapiens
aagattaaaggaa

SEQ ID NO: 6541050 - DNA, 16 bp, Homo sapiens
aagattaaaggaagga

SEQ ID NO: 6541051 - DNA, 12 bp, Homo sapiens
aagattaaatat

SEQ ID NO: 6541052 - DNA, 13 bp, Homo sapiens
aagattaaatata

SEQ ID NO: 6541053 - DNA, 21 bp, Homo sapiens
aagattaaattatatctgagg

SEQ ID NO: 6541054 - DNA, 14 bp, Homo sapiens
aagattaacaacac

SEQ ID NO: 6541055 - DNA, 20 bp, Homo sapiens
aagattaactggtagttcat

SEQ ID NO: 6541056 - DNA, 23 bp, Homo sapiens
aagattaactttcaaaagcaaac

SEQ ID NO: 6541057 - DNA, 18 bp, Homo sapiens
aagattaatgtaggatga

SEQ ID NO: 6541058 - DNA, 17 bp, Homo sapiens
aagattactgaaatata

SEQ ID NO: 6541059 - DNA, 20 bp, Homo sapiens
aagattacttagaggaaata

SEQ ID NO: 6541060 - DNA, 17 bp, Homo sapiens
aagattactttttcttt

SEQ ID NO: 6541061 - DNA, 21 bp, Homo sapiens
aagattagaaagaattagcca

SEQ ID NO: 6541062 - DNA, 11 bp, Homo sapiens
aagattagaag

SEQ ID NO: 6541063 - DNA, 13 bp, Homo sapiens
aagattagaatga

SEQ ID NO: 6541064 - DNA, 20 bp, Homo sapiens
aagattagaggtttgtcaac

SEQ ID NO: 6541065 - DNA, 21 bp, Homo sapiens
aagattagcaaggtcatttct

SEQ ID NO: 6541066 - DNA, 22 bp, Homo sapiens
aagattagcaaggtcatttctt

SEQ ID NO: 6541067 - DNA, 18 bp, Homo sapiens
aagattagggaaaatgga

SEQ ID NO: 6541068 - DNA, 21 bp, Homo sapiens
aagattaggtcgttttccaaa

SEQ ID NO: 6541069 - DNA, 22 bp, Homo sapiens
aagattagttgaatataagaaa

SEQ ID NO: 6541070 - DNA, 14 bp, Homo sapiens
aagattataattgt

SEQ ID NO: 6541071 - DNA, 20 bp, Homo sapiens
aagattataattgttgcata

SEQ ID NO: 6541072 - DNA, 17 bp, Homo sapiens
aagattatagattctaa

SEQ ID NO: 6541073 - DNA, 21 bp, Homo sapiens
aagattatatacaaagctgtc

SEQ ID NO: 6541074 - DNA, 16 bp, Homo sapiens
aagattatatatcata

SEQ ID NO: 6541075 - DNA, 23 bp, Homo sapiens
aagattatatatcataaagtatg

SEQ ID NO: 6541076 - DNA, 16 bp, Homo sapiens
aagattatatgaagtt

SEQ ID NO: 6541077 - DNA, 22 bp, Homo sapiens
aagattatatgaagtttaaatt

SEQ ID NO: 6541078 - DNA, 11 bp, Homo sapiens
aagattatatt

SEQ ID NO: 6541079 - DNA, 12 bp, Homo sapiens
aagattatctga

SEQ ID NO: 6541080 - DNA, 23 bp, Homo sapiens
aagattatctgattcctttaaaa

SEQ ID NO: 6541081 - DNA, 20 bp, Homo sapiens
aagattatgatgcatacagt

SEQ ID NO: 6541082 - DNA, 22 bp, Homo sapiens
aagattatgtattggcatttat

SEQ ID NO: 6541083 - DNA, 16 bp, Homo sapiens
aagattatgtgacttg

SEQ ID NO: 6541084 - DNA, 12 bp, Homo sapiens
aagattattgtc

SEQ ID NO: 6541085 - DNA, 18 bp, Homo sapiens
aagattatttaaatgctt

SEQ ID NO: 6541086 - DNA, 16 bp, Homo sapiens
aagattattttttaaa

SEQ ID NO: 6541087 - DNA, 15 bp, Homo sapiens
aagattcaaagagac

SEQ ID NO: 6541088 - DNA, 18 bp, Homo sapiens
aagattcaaatctcttgc

SEQ ID NO: 6541089 - DNA, 21 bp, Homo sapiens
aagattcacctaagagattct

SEQ ID NO: 6541090 - DNA, 17 bp, Homo sapiens
aagattcatccatttat

SEQ ID NO: 6541091 - DNA, 21 bp, Homo sapiens
aagattcatttttaatcatga

SEQ ID NO: 6541092 - DNA, 21 bp, Homo sapiens
aagattccacagagatgttta

SEQ ID NO: 6541093 - DNA, 12 bp, Homo sapiens
aagattccatgg

SEQ ID NO: 6541094 - DNA, 16 bp, Homo sapiens
aagattccattttgga

SEQ ID NO: 6541095 - DNA, 17 bp, Homo sapiens
aagattccattttggaa

SEQ ID NO: 6541096 - DNA, 13 bp, Homo sapiens
aagattcccagag

SEQ ID NO: 6541097 - DNA, 14 bp, Homo sapiens
aagattcccagaga

SEQ ID NO: 6541098 - DNA, 15 bp, Homo sapiens
aagattcccagagac

SEQ ID NO: 6541099 - DNA, 14 bp, Homo sapiens
aagattcccaggag

SEQ ID NO: 6541100 - DNA, 21 bp, Homo sapiens
aagattcccaggagttctgct

SEQ ID NO: 6541101 - DNA, 22 bp, Homo sapiens
aagattccttttcttgtttatc

SEQ ID NO: 6541102 - DNA, 12 bp, Homo sapiens
aagattctaaaa

SEQ ID NO: 6541103 - DNA, 18 bp, Homo sapiens
aagattctaaaacattct

SEQ ID NO: 6541104 - DNA, 13 bp, Homo sapiens
aagattctaaagc

SEQ ID NO: 6541105 - DNA, 16 bp, Homo sapiens
aagattctaatgatga

SEQ ID NO: 6541106 - DNA, 14 bp, Homo sapiens
aagattctactaac

SEQ ID NO: 6541107 - DNA, 21 bp, Homo sapiens
aagattctactcttgtcattt

SEQ ID NO: 6541108 - DNA, 17 bp, Homo sapiens
aagattctatagttcta

SEQ ID NO: 6541109 - DNA, 19 bp, Homo sapiens
aagattctatagttctaga

SEQ ID NO: 6541110 - DNA, 17 bp, Homo sapiens
aagattctcctgtgcta

SEQ ID NO: 6541111 - DNA, 19 bp, Homo sapiens
aagattctcgccccttccc

SEQ ID NO: 6541112 - DNA, 12 bp, Homo sapiens
aagattctgcat

SEQ ID NO: 6541113 - DNA, 22 bp, Homo sapiens
aagattcttcccattctccatt

SEQ ID NO: 6541114 - DNA, 22 bp, Homo sapiens
aagattcttcttaaaagtttct

SEQ ID NO: 6541115 - DNA, 13 bp, Homo sapiens
aagattctttaaa

SEQ ID NO: 6541116 - DNA, 16 bp, Homo sapiens
aagattcttttaaatt

SEQ ID NO: 6541117 - DNA, 17 bp, Homo sapiens
aagattcttttaaatta

SEQ ID NO: 6541118 - DNA, 20 bp, Homo sapiens
aagattcttttaaattagaa

SEQ ID NO: 6541119 - DNA, 18 bp, Homo sapiens
aagattgaaatttgaact

SEQ ID NO: 6541120 - DNA, 19 bp, Homo sapiens
aagattgagaagttacttt

SEQ ID NO: 6541121 - DNA, 13 bp, Homo sapiens
aagattgcaaagg

SEQ ID NO: 6541122 - DNA, 16 bp, Homo sapiens
aagattgcaaggaagg

SEQ ID NO: 6541123 - DNA, 18 bp, Homo sapiens
aagattgctttaagaaac

SEQ ID NO: 6541124 - DNA, 19 bp, Homo sapiens
aagattggaaagacaggaa

SEQ ID NO: 6541125 - DNA, 13 bp, Homo sapiens
aagattggagctg

SEQ ID NO: 6541126 - DNA, 20 bp, Homo sapiens
aagattggttgcctctgcct

SEQ ID NO: 6541127 - DNA, 17 bp, Homo sapiens
aagattgtaaaaataat

SEQ ID NO: 6541128 - DNA, 13 bp, Homo sapiens
aagattgtaaact

SEQ ID NO: 6541129 - DNA, 15 bp, Homo sapiens
aagattgtaaactaa

SEQ ID NO: 6541130 - DNA, 16 bp, Homo sapiens
aagattgtaaactaaa

SEQ ID NO: 6541131 - DNA, 21 bp, Homo sapiens
aagattgtaaactaaagtgtg

SEQ ID NO: 6541132 - DNA, 13 bp, Homo sapiens
aagattgtaattc

SEQ ID NO: 6541133 - DNA, 14 bp, Homo sapiens
aagattgtaattca

SEQ ID NO: 6541134 - DNA, 19 bp, Homo sapiens
aagattgtacttagccagt

SEQ ID NO: 6541135 - DNA, 22 bp, Homo sapiens
aagattgtacttagccagttca

SEQ ID NO: 6541136 - DNA, 14 bp, Homo sapiens
aagattgtagcaat

SEQ ID NO: 6541137 - DNA, 16 bp, Homo sapiens
aagattgtattgctgt

SEQ ID NO: 6541138 - DNA, 18 bp, Homo sapiens
aagattgtccttttctcc

SEQ ID NO: 6541139 - DNA, 21 bp, Homo sapiens
aagattgtccttttctcccat

SEQ ID NO: 6541140 - DNA, 19 bp, Homo sapiens
aagattgttattaaatgta

SEQ ID NO: 6541141 - DNA, 19 bp, Homo sapiens
aagattgttggcagtttcc

SEQ ID NO: 6541142 - DNA, 20 bp, Homo sapiens
aagattgtttatctagatgt

SEQ ID NO: 6541143 - DNA, 12 bp, Homo sapiens
aagatttaagca

SEQ ID NO: 6541144 - DNA, 12 bp, Homo sapiens
aagatttaatat

SEQ ID NO: 6541145 - DNA, 18 bp, Homo sapiens
aagatttaatttgccaaa

SEQ ID NO: 6541146 - DNA, 23 bp, Homo sapiens
aagatttaatttgccaaaataat

SEQ ID NO: 6541147 - DNA, 12 bp, Homo sapiens
aagatttacatt

SEQ ID NO: 6541148 - DNA, 23 bp, Homo sapiens
aagatttaccttttctgttgtac

SEQ ID NO: 6541149 - DNA, 21 bp, Homo sapiens
aagatttagaaaaaagtttac

SEQ ID NO: 6541150 - DNA, 15 bp, Homo sapiens
aagatttagatgttt

SEQ ID NO: 6541151 - DNA, 18 bp, Homo sapiens
aagatttatacagttgaa

SEQ ID NO: 6541152 - DNA, 18 bp, Homo sapiens
aagatttatcaaatcagt

SEQ ID NO: 6541153 - DNA, 19 bp, Homo sapiens
aagatttatgaacagaaat

SEQ ID NO: 6541154 - DNA, 12 bp, Homo sapiens
aagatttattat

SEQ ID NO: 6541155 - DNA, 17 bp, Homo sapiens
aagatttcagagctgag

SEQ ID NO: 6541156 - DNA, 20 bp, Homo sapiens
aagatttcagagctgaggct

SEQ ID NO: 6541157 - DNA, 15 bp, Homo sapiens
aagatttcatatcta

SEQ ID NO: 6541158 - DNA, 23 bp, Homo sapiens
aagatttcatatctaactttgta

SEQ ID NO: 6541159 - DNA, 22 bp, Homo sapiens
aagatttccacaattcttctgt

SEQ ID NO: 6541160 - DNA, 16 bp, Homo sapiens
aagatttccatataaa

SEQ ID NO: 6541161 - DNA, 20 bp, Homo sapiens
aagatttctagtaggcagca

SEQ ID NO: 6541162 - DNA, 16 bp, Homo sapiens
aagatttgaaaacaaa

SEQ ID NO: 6541163 - DNA, 16 bp, Homo sapiens
aagatttgaccaaatc

SEQ ID NO: 6541164 - DNA, 22 bp, Homo sapiens
aagatttgatgctggagaggtt

SEQ ID NO: 6541165 - DNA, 12 bp, Homo sapiens
aagatttggaaa

SEQ ID NO: 6541166 - DNA, 20 bp, Homo sapiens
aagatttgtgaactggaaga

SEQ ID NO: 6541167 - DNA, 22 bp, Homo sapiens
aagatttgtgaactggaagaaa

SEQ ID NO: 6541168 - DNA, 21 bp, Homo sapiens
aagatttgttttgtcaagtgt

SEQ ID NO: 6541169 - DNA, 16 bp, Homo sapiens
aagattttaaagacat

SEQ ID NO: 6541170 - DNA, 13 bp, Homo sapiens
aagattttagaat

SEQ ID NO: 6541171 - DNA, 19 bp, Homo sapiens
aagattttagggcttttat

SEQ ID NO: 6541172 - DNA, 18 bp, Homo sapiens
aagattttatccctttct

SEQ ID NO: 6541173 - DNA, 17 bp, Homo sapiens
aagattttatgcacagc

SEQ ID NO: 6541174 - DNA, 13 bp, Homo sapiens
aagattttatgtg

SEQ ID NO: 6541175 - DNA, 21 bp, Homo sapiens
aagattttatgtgcttgaaga

SEQ ID NO: 6541176 - DNA, 17 bp, Homo sapiens
aagattttattttcaag

SEQ ID NO: 6541177 - DNA, 13 bp, Homo sapiens
aagattttcattg

SEQ ID NO: 6541178 - DNA, 14 bp, Homo sapiens
aagattttcattga

SEQ ID NO: 6541179 - DNA, 21 bp, Homo sapiens
aagattttccttttttataca

SEQ ID NO: 6541180 - DNA, 19 bp, Homo sapiens
aagattttgaaatttttat

SEQ ID NO: 6541181 - DNA, 16 bp, Homo sapiens
aagattttgaaggaaa

SEQ ID NO: 6541182 - DNA, 13 bp, Homo sapiens
aagattttgatct

SEQ ID NO: 6541183 - DNA, 23 bp, Homo sapiens
aagattttggagggtcctccaca

SEQ ID NO: 6541184 - DNA, 20 bp, Homo sapiens
aagattttgtgaaatttcat

SEQ ID NO: 6541185 - DNA, 20 bp, Homo sapiens
aagattttgttttgttggac

SEQ ID NO: 6541186 - DNA, 21 bp, Homo sapiens
aagatttttaattacaataat

SEQ ID NO: 6541187 - DNA, 15 bp, Homo sapiens
aagatttttactaat

SEQ ID NO: 6541188 - DNA, 21 bp, Homo sapiens
aagatttttactaatatatat

SEQ ID NO: 6541189 - DNA, 18 bp, Homo sapiens
aagatttttaggagtgat

SEQ ID NO: 6541190 - DNA, 20 bp, Homo sapiens
aagatttttctcaaagtttt

SEQ ID NO: 6541191 - DNA, 21 bp, Homo sapiens
aagatttttctcaaagttttg

SEQ ID NO: 6541192 - DNA, 13 bp, Homo sapiens
aagattttttaat

SEQ ID NO: 6541193 - DNA, 20 bp, Homo sapiens
aagcaaaaaaggtaactaac

SEQ ID NO: 6541194 - DNA, 18 bp, Homo sapiens
tgtcccagtccaaattgt

SEQ ID NO: 6541195 - DNA, 18 bp, Homo sapiens
tgtcccagtcccagcctc

SEQ ID NO: 6541196 - DNA, 17 bp, Homo sapiens
tgtcccagtgtctggcc

SEQ ID NO: 6541197 - DNA, 20 bp, Homo sapiens
tgtcccagtttcccactctg

SEQ ID NO: 6541198 - DNA, 16 bp, Homo sapiens
tgtcccatccccaggt

SEQ ID NO: 6541199 - DNA, 15 bp, Homo sapiens
tgtcccatccttccc

SEQ ID NO: 6541200 - DNA, 19 bp, Homo sapiens
tgtcccatctggtcatttg

SEQ ID NO: 6541201 - DNA, 21 bp, Homo sapiens
tgtcccatgacccacccctgt

SEQ ID NO: 6541202 - DNA, 18 bp, Homo sapiens
tgtcccatgatccctgtg

SEQ ID NO: 6541203 - DNA, 13 bp, Homo sapiens
tgtcccatgggga

SEQ ID NO: 6541204 - DNA, 19 bp, Homo sapiens
tgtcccatgtgagctgctg

SEQ ID NO: 6541205 - DNA, 14 bp, Homo sapiens
tgtcccattccctg

SEQ ID NO: 6541206 - DNA, 16 bp, Homo sapiens
tgtcccattccctggg

SEQ ID NO: 6541207 - DNA, 18 bp, Homo sapiens
tgtcccattccctgggat

SEQ ID NO: 6541208 - DNA, 17 bp, Homo sapiens
tgtcccattctagatcc

SEQ ID NO: 6541209 - DNA, 15 bp, Homo sapiens
tgtcccatttccttg

SEQ ID NO: 6541210 - DNA, 18 bp, Homo sapiens
tgtcccatttccttggag

SEQ ID NO: 6541211 - DNA, 20 bp, Homo sapiens
tgtcccatttctaaaggcct

SEQ ID NO: 6541212 - DNA, 18 bp, Homo sapiens
tgtccccaaacctgcaag

SEQ ID NO: 6541213 - DNA, 24 bp, Homo sapiens
tgtccccaaaggacgcctgcagga

SEQ ID NO: 6541214 - DNA, 12 bp, Homo sapiens
tgtccccaaagt

SEQ ID NO: 6541215 - DNA, 22 bp, Homo sapiens
tgtccccaaatccgaacctcct

SEQ ID NO: 6541216 - DNA, 14 bp, Homo sapiens
tgtccccaacagcg

SEQ ID NO: 6541217 - DNA, 14 bp, Homo sapiens
tgtccccacactcc

SEQ ID NO: 6541218 - DNA, 15 bp, Homo sapiens
tgtccccacactcct

SEQ ID NO: 6541219 - DNA, 11 bp, Homo sapiens
tgtccccacca

SEQ ID NO: 6541220 - DNA, 12 bp, Homo sapiens
tgtccccaccat

SEQ ID NO: 6541221 - DNA, 16 bp, Homo sapiens
tgtccccaccatctgc

SEQ ID NO: 6541222 - DNA, 17 bp, Homo sapiens
tgtccccaccctccact

SEQ ID NO: 6541223 - DNA, 18 bp, Homo sapiens
tgtccccaccctccactc

SEQ ID NO: 6541224 - DNA, 22 bp, Homo sapiens
tgtccccaccctccactcagct

SEQ ID NO: 6541225 - DNA, 22 bp, Homo sapiens
tgtccccaccgcagacaggacc

SEQ ID NO: 6541226 - DNA, 13 bp, Homo sapiens
tgtccccactgcc

SEQ ID NO: 6541227 - DNA, 23 bp, Homo sapiens
tgtccccagaccaaccctgggac

SEQ ID NO: 6541228 - DNA, 20 bp, Homo sapiens
tgtccccagcctacctctcc

SEQ ID NO: 6541229 - DNA, 12 bp, Homo sapiens
tgtccccaggcc

SEQ ID NO: 6541230 - DNA, 20 bp, Homo sapiens
tgtccccaggcccagccctc

SEQ ID NO: 6541231 - DNA, 15 bp, Homo sapiens
tgtccccaggggcac

SEQ ID NO: 6541232 - DNA, 16 bp, Homo sapiens
tgtccccaggggcaca

SEQ ID NO: 6541233 - DNA, 17 bp, Homo sapiens
tgtccccaggggcacac

SEQ ID NO: 6541234 - DNA, 22 bp, Homo sapiens
tgtccccaggggcacacttccc

SEQ ID NO: 6541235 - DNA, 13 bp, Homo sapiens
tgtccccaggtcc

SEQ ID NO: 6541236 - DNA, 20 bp, Homo sapiens
tgtccccaggtcctgtctct

SEQ ID NO: 6541237 - DNA, 23 bp, Homo sapiens
tgtccccagtccccagccctggg

SEQ ID NO: 6541238 - DNA, 18 bp, Homo sapiens
tgtccccagtgtggactc

SEQ ID NO: 6541239 - DNA, 24 bp, Homo sapiens
tgtccccagtgtggactctggact

SEQ ID NO: 6541240 - DNA, 22 bp, Homo sapiens
tgtccccataagacaaacactg

SEQ ID NO: 6541241 - DNA, 23 bp, Homo sapiens
tgtccccataagacaaacactgc

SEQ ID NO: 6541242 - DNA, 22 bp, Homo sapiens
tgtccccatctaggtcctggct

SEQ ID NO: 6541243 - DNA, 14 bp, Homo sapiens
tgtcccccaacttg

SEQ ID NO: 6541244 - DNA, 12 bp, Homo sapiens
tgtcccccacct

SEQ ID NO: 6541245 - DNA, 14 bp, Homo sapiens
tgtcccccactctc

SEQ ID NO: 6541246 - DNA, 17 bp, Homo sapiens
tgtcccccagctctggt

SEQ ID NO: 6541247 - DNA, 16 bp, Homo sapiens
tgtcccccatcatgtg

SEQ ID NO: 6541248 - DNA, 19 bp, Homo sapiens
tgtccccccactccctcac

SEQ ID NO: 6541249 - DNA, 14 bp, Homo sapiens
tgtcccccccagtg

SEQ ID NO: 6541250 - DNA, 18 bp, Homo sapiens
tgtcccccctgtggtctg

SEQ ID NO: 6541251 - DNA, 17 bp, Homo sapiens
tgtcccccgtgcacggt

SEQ ID NO: 6541252 - DNA, 17 bp, Homo sapiens
tgtccccctacccaccg

SEQ ID NO: 6541253 - DNA, 18 bp, Homo sapiens
tgtccccctcctcccagg

SEQ ID NO: 6541254 - DNA, 14 bp, Homo sapiens
tgtccccctgagat

SEQ ID NO: 6541255 - DNA, 18 bp, Homo sapiens
tgtccccgccttccctca

SEQ ID NO: 6541256 - DNA, 15 bp, Homo sapiens
tgtccccgctggctc

SEQ ID NO: 6541257 - DNA, 18 bp, Homo sapiens
tgtccccggggcccaggg

SEQ ID NO: 6541258 - DNA, 16 bp, Homo sapiens
tgtcccctatcctccc

SEQ ID NO: 6541259 - DNA, 23 bp, Homo sapiens
tgtcccctatggggatggtccac

SEQ ID NO: 6541260 - DNA, 17 bp, Homo sapiens
tgtcccctcacagactc

SEQ ID NO: 6541261 - DNA, 16 bp, Homo sapiens
tgtcccctcactctgt

SEQ ID NO: 6541262 - DNA, 14 bp, Homo sapiens
tgtcccctcagctc

SEQ ID NO: 6541263 - DNA, 12 bp, Homo sapiens
tgtcccctccca

SEQ ID NO: 6541264 - DNA, 16 bp, Homo sapiens
tgtcccctcccagagc

SEQ ID NO: 6541265 - DNA, 21 bp, Homo sapiens
tgtcccctcctcactcccttc

SEQ ID NO: 6541266 - DNA, 20 bp, Homo sapiens
tgtcccctccttccagcctg

SEQ ID NO: 6541267 - DNA, 15 bp, Homo sapiens
tgtcccctcttgccc

SEQ ID NO: 6541268 - DNA, 17 bp, Homo sapiens
tgtcccctcttgcccca

SEQ ID NO: 6541269 - DNA, 13 bp, Homo sapiens
tgtcccctgcccc

SEQ ID NO: 6541270 - DNA, 20 bp, Homo sapiens
tgtcccctgccccagaggtc

SEQ ID NO: 6541271 - DNA, 15 bp, Homo sapiens
tgtcccctgtcccac

SEQ ID NO: 6541272 - DNA, 15 bp, Homo sapiens
tgtccccttcatcct

SEQ ID NO: 6541273 - DNA, 15 bp, Homo sapiens
tgtccccttccaggg

SEQ ID NO: 6541274 - DNA, 15 bp, Homo sapiens
tgtccccttcccctg

SEQ ID NO: 6541275 - DNA, 17 bp, Homo sapiens
tgtccccttcccctgct

SEQ ID NO: 6541276 - DNA, 20 bp, Homo sapiens
tgtccccttctctcatctct

SEQ ID NO: 6541277 - DNA, 22 bp, Homo sapiens
tgtccccttctctcatctctta

SEQ ID NO: 6541278 - DNA, 23 bp, Homo sapiens
tgtcccgccttcctcctccacag

SEQ ID NO: 6541279 - DNA, 16 bp, Homo sapiens
tgtcccgcggtgctga

SEQ ID NO: 6541280 - DNA, 16 bp, Homo sapiens
tgtcccggggtcctgt

SEQ ID NO: 6541281 - DNA, 18 bp, Homo sapiens
tgtcccgggtactcagtc

SEQ ID NO: 6541282 - DNA, 17 bp, Homo sapiens
tgtcccggttcaccttg

SEQ ID NO: 6541283 - DNA, 19 bp, Homo sapiens
tgtccctaagtaagtttct

SEQ ID NO: 6541284 - DNA, 12 bp, Homo sapiens
tgtccctacacc

SEQ ID NO: 6541285 - DNA, 15 bp, Homo sapiens
tgtccctacaggagg

SEQ ID NO: 6541286 - DNA, 20 bp, Homo sapiens
tgtccctaccactgagccct

SEQ ID NO: 6541287 - DNA, 14 bp, Homo sapiens
tgtccctacccact

SEQ ID NO: 6541288 - DNA, 16 bp, Homo sapiens
tgtccctacccactct

SEQ ID NO: 6541289 - DNA, 22 bp, Homo sapiens
tgtccctaccgagtctcttctc

SEQ ID NO: 6541290 - DNA, 22 bp, Homo sapiens
tgtccctagctcacactcatcc

SEQ ID NO: 6541291 - DNA, 22 bp, Homo sapiens
tgtccctagggctctccaagca

SEQ ID NO: 6541292 - DNA, 21 bp, Homo sapiens
tgtccctagtaaaaatacaaa

SEQ ID NO: 6541293 - DNA, 19 bp, Homo sapiens
tgtccctcaaatgacccaa

SEQ ID NO: 6541294 - DNA, 19 bp, Homo sapiens
tgtccctccaaggctgtct

SEQ ID NO: 6541295 - DNA, 13 bp, Homo sapiens
tgtccctccaggg

SEQ ID NO: 6541296 - DNA, 20 bp, Homo sapiens
tgtccctcccacctctgtga

SEQ ID NO: 6541297 - DNA, 13 bp, Homo sapiens
tgtccctcccact

SEQ ID NO: 6541298 - DNA, 18 bp, Homo sapiens
tgtccctcccactccctg

SEQ ID NO: 6541299 - DNA, 20 bp, Homo sapiens
tgtccctcccactccctggg

SEQ ID NO: 6541300 - DNA, 13 bp, Homo sapiens
tgtccctcctggt

SEQ ID NO: 6541301 - DNA, 15 bp, Homo sapiens
tgtccctccttgagc

SEQ ID NO: 6541302 - DNA, 22 bp, Homo sapiens
tgtccctctagtgccttcttta

SEQ ID NO: 6541303 - DNA, 19 bp, Homo sapiens
tgtccctctcagtgccttc

SEQ ID NO: 6541304 - DNA, 21 bp, Homo sapiens
tgtccctctcagtgccttctc

SEQ ID NO: 6541305 - DNA, 22 bp, Homo sapiens
tgtccctctcagtgccttctct

SEQ ID NO: 6541306 - DNA, 12 bp, Homo sapiens
tgtccctctcct

SEQ ID NO: 6541307 - DNA, 21 bp, Homo sapiens
tgtccctctcctatgtggcag

SEQ ID NO: 6541308 - DNA, 21 bp, Homo sapiens
tgtccctctcggaaggctggc

SEQ ID NO: 6541309 - DNA, 13 bp, Homo sapiens
tgtccctctgtgg

SEQ ID NO: 6541310 - DNA, 14 bp, Homo sapiens
tgtccctgcactgt

SEQ ID NO: 6541311 - DNA, 16 bp, Homo sapiens
tgtccctgcactgtgc

SEQ ID NO: 6541312 - DNA, 22 bp, Homo sapiens
tgtccctgcacttgcagactct

SEQ ID NO: 6541313 - DNA, 15 bp, Homo sapiens
tgtccctgcagggcc

SEQ ID NO: 6541314 - DNA, 16 bp, Homo sapiens
tgtccctgcagggcca

SEQ ID NO: 6541315 - DNA, 12 bp, Homo sapiens
tgtccctgcccc

SEQ ID NO: 6541316 - DNA, 14 bp, Homo sapiens
tgtccctgcctggc

SEQ ID NO: 6541317 - DNA, 14 bp, Homo sapiens
tgtccctgccttca

SEQ ID NO: 6541318 - DNA, 13 bp, Homo sapiens
tgtccctgctggg

SEQ ID NO: 6541319 - DNA, 15 bp, Homo sapiens
tgtccctggacacag

SEQ ID NO: 6541320 - DNA, 18 bp, Homo sapiens
tgtccctggacacagctc

SEQ ID NO: 6541321 - DNA, 20 bp, Homo sapiens
tgtccctggacacagctctt

SEQ ID NO: 6541322 - DNA, 21 bp, Homo sapiens
tgtccctggacacagctcttc

SEQ ID NO: 6541323 - DNA, 23 bp, Homo sapiens
tgtccctggacacagctcttcat

SEQ ID NO: 6541324 - DNA, 19 bp, Homo sapiens
tgtccctggcgctgtgcta

SEQ ID NO: 6541325 - DNA, 14 bp, Homo sapiens
tgtccctgggccag

SEQ ID NO: 6541326 - DNA, 15 bp, Homo sapiens
tgtccctgggccagg

SEQ ID NO: 6541327 - DNA, 19 bp, Homo sapiens
tgtccctggggcactcccc

SEQ ID NO: 6541328 - DNA, 22 bp, Homo sapiens
tgtccctgggggagtaattctg

SEQ ID NO: 6541329 - DNA, 17 bp, Homo sapiens
tgtccctggtgcagagg

SEQ ID NO: 6541330 - DNA, 13 bp, Homo sapiens
tgtccctgtcacc

SEQ ID NO: 6541331 - DNA, 12 bp, Homo sapiens
tgtccctgtcag

SEQ ID NO: 6541332 - DNA, 17 bp, Homo sapiens
tgtccctgtcaggacac

SEQ ID NO: 6541333 - DNA, 15 bp, Homo sapiens
tgtccctgtcccctc

SEQ ID NO: 6541334 - DNA, 17 bp, Homo sapiens
tgtccctgtcccctcct

SEQ ID NO: 6541335 - DNA, 16 bp, Homo sapiens
tgtccctgtccctgcc

SEQ ID NO: 6541336 - DNA, 18 bp, Homo sapiens
tgtccctgtccctgcccc

SEQ ID NO: 6541337 - DNA, 17 bp, Homo sapiens
tgtccctgtccttccct

SEQ ID NO: 6541338 - DNA, 15 bp, Homo sapiens
tgtccctgtccttct

SEQ ID NO: 6541339 - DNA, 16 bp, Homo sapiens
tgtccctgtccttcta

SEQ ID NO: 6541340 - DNA, 18 bp, Homo sapiens
tgtccctgtgggctcaca

SEQ ID NO: 6541341 - DNA, 20 bp, Homo sapiens
tgtccctgtgggctcacacc

SEQ ID NO: 6541342 - DNA, 23 bp, Homo sapiens
tgtcccttaataaaaatatatat

SEQ ID NO: 6541343 - DNA, 19 bp, Homo sapiens
tgtcccttacgtgagtcct

SEQ ID NO: 6541344 - DNA, 23 bp, Homo sapiens
tgtcccttacgtgagtcctggca

SEQ ID NO: 6541345 - DNA, 13 bp, Homo sapiens
tgtcccttccagg

SEQ ID NO: 6541346 - DNA, 22 bp, Homo sapiens
tgtcccttccatttctactgta

SEQ ID NO: 6541347 - DNA, 17 bp, Homo sapiens
tgtcccttcgagtccag

SEQ ID NO: 6541348 - DNA, 12 bp, Homo sapiens
tgtcccttgatg

SEQ ID NO: 6541349 - DNA, 17 bp, Homo sapiens
tgtcccttgatgcacag

SEQ ID NO: 6541350 - DNA, 20 bp, Homo sapiens
tgtcccttgatgcacagaga

SEQ ID NO: 6541351 - DNA, 14 bp, Homo sapiens
tgtcccttgcctct

SEQ ID NO: 6541352 - DNA, 23 bp, Homo sapiens
tgtcccttgcttgcctgcagggc

SEQ ID NO: 6541353 - DNA, 14 bp, Homo sapiens
tgtcccttggagct

SEQ ID NO: 6541354 - DNA, 20 bp, Homo sapiens
tgtccctttctgtgtgaaga

SEQ ID NO: 6541355 - DNA, 12 bp, Homo sapiens
tgtccctttctt

SEQ ID NO: 6541356 - DNA, 16 bp, Homo sapiens
tgtccctttcttctcc

SEQ ID NO: 6541357 - DNA, 17 bp, Homo sapiens
tgtccctttcttctccc

SEQ ID NO: 6541358 - DNA, 12 bp, Homo sapiens
tgtcccttttcc

SEQ ID NO: 6541359 - DNA, 13 bp, Homo sapiens
tgtcccttttccc

SEQ ID NO: 6541360 - DNA, 15 bp, Homo sapiens
tgtcccttttctttg

SEQ ID NO: 6541361 - DNA, 22 bp, Homo sapiens
tgtccgacctacgttcctggcc

SEQ ID NO: 6541362 - DNA, 15 bp, Homo sapiens
tgtccgactcttctg

SEQ ID NO: 6541363 - DNA, 12 bp, Homo sapiens
tgtccgccctct

SEQ ID NO: 6541364 - DNA, 13 bp, Homo sapiens
tgtccgccctctt

SEQ ID NO: 6541365 - DNA, 13 bp, Homo sapiens
tgtccgcctctgc

SEQ ID NO: 6541366 - DNA, 20 bp, Homo sapiens
tgtccgcgtcctttcctctc

SEQ ID NO: 6541367 - DNA, 17 bp, Homo sapiens
tgtccgctctctcatgt

SEQ ID NO: 6541368 - DNA, 22 bp, Homo sapiens
tgtccgctgggtggtaccctct

SEQ ID NO: 6541369 - DNA, 23 bp, Homo sapiens
tgtccgctgggtggtaccctctg

SEQ ID NO: 6541370 - DNA, 17 bp, Homo sapiens
tgtccgctgtctccctc

SEQ ID NO: 6541371 - DNA, 18 bp, Homo sapiens
tgtccggagcgaccctgg

SEQ ID NO: 6541372 - DNA, 21 bp, Homo sapiens
tgtccggagcgaccctggctc

SEQ ID NO: 6541373 - DNA, 22 bp, Homo sapiens
tgtccggaggatattaaaatgc

SEQ ID NO: 6541374 - DNA, 18 bp, Homo sapiens
tgtccggcccagtgccag

SEQ ID NO: 6541375 - DNA, 20 bp, Homo sapiens
tgtccggcccagtgccagct

SEQ ID NO: 6541376 - DNA, 19 bp, Homo sapiens
tgtccgggtgccagggctg

SEQ ID NO: 6541377 - DNA, 16 bp, Homo sapiens
tgtccgtagtatcaga

SEQ ID NO: 6541378 - DNA, 23 bp, Homo sapiens
tgtccgtcctgctcgccctgtgc

SEQ ID NO: 6541379 - DNA, 20 bp, Homo sapiens
tgtccgtctctcttgcttga

SEQ ID NO: 6541380 - DNA, 22 bp, Homo sapiens
tgtccgtctctcttgcttgagg

SEQ ID NO: 6541381 - DNA, 23 bp, Homo sapiens
tgtccgtctctcttgcttgagga

SEQ ID NO: 6541382 - DNA, 20 bp, Homo sapiens
tgtccgtctgtcctgcgcct

SEQ ID NO: 6541383 - DNA, 14 bp, Homo sapiens
tgtccgtctgtctg

SEQ ID NO: 6541384 - DNA, 15 bp, Homo sapiens
tgtccgtgtgcctcc

SEQ ID NO: 6541385 - DNA, 20 bp, Homo sapiens
tgtccgtgtgcctcctgtgt

SEQ ID NO: 6541386 - DNA, 15 bp, Homo sapiens
tgtccgttccaggag

SEQ ID NO: 6541387 - DNA, 17 bp, Homo sapiens
tgtccgttccaggagca

SEQ ID NO: 6541388 - DNA, 20 bp, Homo sapiens
tgtccgtttgagtgtctgcg

SEQ ID NO: 6541389 - DNA, 22 bp, Homo sapiens
tgtccgtttgagtgtctgcgcc

SEQ ID NO: 6541390 - DNA, 20 bp, Homo sapiens
tgtcctaaaccgtcccctcc

SEQ ID NO: 6541391 - DNA, 20 bp, Homo sapiens
tgtcctaaagaagacatttt

SEQ ID NO: 6541392 - DNA, 22 bp, Homo sapiens
tgtcctaaatgcaaagcacacc

SEQ ID NO: 6541393 - DNA, 21 bp, Homo sapiens
tgtcctaagagatttatcttt

SEQ ID NO: 6541394 - DNA, 22 bp, Homo sapiens
tgtcctaagtgtcaagtcctga

SEQ ID NO: 6541395 - DNA, 16 bp, Homo sapiens
tgtcctaatcatacac

SEQ ID NO: 6541396 - DNA, 22 bp, Homo sapiens
tgtcctaatcatataccagagg

SEQ ID NO: 6541397 - DNA, 14 bp, Homo sapiens
tgtcctaattcttc

SEQ ID NO: 6541398 - DNA, 14 bp, Homo sapiens
tgtcctacagaaaa

SEQ ID NO: 6541399 - DNA, 15 bp, Homo sapiens
tgtcctacagaaaaa

SEQ ID NO: 6541400 - DNA, 14 bp, Homo sapiens
tgtcctacagtgac

SEQ ID NO: 6541401 - DNA, 20 bp, Homo sapiens
tgtcctaccagttgccctag

SEQ ID NO: 6541402 - DNA, 13 bp, Homo sapiens
tgtcctacccgcc

SEQ ID NO: 6541403 - DNA, 15 bp, Homo sapiens
tgtcctacgtccaag

SEQ ID NO: 6541404 - DNA, 17 bp, Homo sapiens
tgtcctactctgtgtca

SEQ ID NO: 6541405 - DNA, 17 bp, Homo sapiens
tgtcctacttctgactt

SEQ ID NO: 6541406 - DNA, 18 bp, Homo sapiens
tgtcctacttctgacttt

SEQ ID NO: 6541407 - DNA, 22 bp, Homo sapiens
tgtcctacttctgactttactt

SEQ ID NO: 6541408 - DNA, 15 bp, Homo sapiens
tgtcctagcacagat

SEQ ID NO: 6541409 - DNA, 21 bp, Homo sapiens
tgtcctagccaggtctcctgg

SEQ ID NO: 6541410 - DNA, 22 bp, Homo sapiens
tgtcctagccaggtctcctggg

SEQ ID NO: 6541411 - DNA, 20 bp, Homo sapiens
tgtcctaggagtatcctcat

SEQ ID NO: 6541412 - DNA, 17 bp, Homo sapiens
tgtcctaggctctgggt

SEQ ID NO: 6541413 - DNA, 14 bp, Homo sapiens
tgtcctataattct

SEQ ID NO: 6541414 - DNA, 15 bp, Homo sapiens
tgtcctatccccgga

SEQ ID NO: 6541415 - DNA, 21 bp, Homo sapiens
tgtcctatccccggacgcatg

SEQ ID NO: 6541416 - DNA, 16 bp, Homo sapiens
tgtcctatccctggac

SEQ ID NO: 6541417 - DNA, 19 bp, Homo sapiens
tgtcctatctatcttccaa

SEQ ID NO: 6541418 - DNA, 20 bp, Homo sapiens
tgtcctatctccagcggccc

SEQ ID NO: 6541419 - DNA, 22 bp, Homo sapiens
tgtcctatgggagtcaagtgtg

SEQ ID NO: 6541420 - DNA, 18 bp, Homo sapiens
tgtcctatgtatatcttc

SEQ ID NO: 6541421 - DNA, 20 bp, Homo sapiens
tgtcctatgtcaatttgtat

SEQ ID NO: 6541422 - DNA, 21 bp, Homo sapiens
tgtcctatgtcaatttgtata

SEQ ID NO: 6541423 - DNA, 14 bp, Homo sapiens
tgtcctatgtgtga

SEQ ID NO: 6541424 - DNA, 22 bp, Homo sapiens
tgtcctcaaccccaaatccccc

SEQ ID NO: 6541425 - DNA, 17 bp, Homo sapiens
tgtcctcaagaagaaag

SEQ ID NO: 6541426 - DNA, 19 bp, Homo sapiens
tgtcctcaagaagaaagtg

SEQ ID NO: 6541427 - DNA, 13 bp, Homo sapiens
tgtcctcacatgc

SEQ ID NO: 6541428 - DNA, 20 bp, Homo sapiens
tgtcctcaccatgatggggc

SEQ ID NO: 6541429 - DNA, 18 bp, Homo sapiens
tgtcctcaccctgtggga

SEQ ID NO: 6541430 - DNA, 19 bp, Homo sapiens
tgtcctcacgccccctgtg

SEQ ID NO: 6541431 - DNA, 16 bp, Homo sapiens
tgtcctcagaggcgtg

SEQ ID NO: 6541432 - DNA, 20 bp, Homo sapiens
tgtcctcagccttgccagag

SEQ ID NO: 6541433 - DNA, 19 bp, Homo sapiens
tgtcctcaggtggccatgc

SEQ ID NO: 6541434 - DNA, 20 bp, Homo sapiens
tgtcctcagtccatttatat

SEQ ID NO: 6541435 - DNA, 23 bp, Homo sapiens
tgtcctcatgtgagaaagcagat

SEQ ID NO: 6541436 - DNA, 15 bp, Homo sapiens
tgtcctcattcttct

SEQ ID NO: 6541437 - DNA, 16 bp, Homo sapiens
tgtcctcattcttctc

SEQ ID NO: 6541438 - DNA, 23 bp, Homo sapiens
tgtcctccaacaccaagcacagc

SEQ ID NO: 6541439 - DNA, 15 bp, Homo sapiens
tgtcctccaccacaa

SEQ ID NO: 6541440 - DNA, 16 bp, Homo sapiens
tgtcctccagaagcct

SEQ ID NO: 6541441 - DNA, 23 bp, Homo sapiens
tgtcctccagaagcctctggcta

SEQ ID NO: 6541442 - DNA, 15 bp, Homo sapiens
tgtcctccaggagct

SEQ ID NO: 6541443 - DNA, 15 bp, Homo sapiens
tgtcctccagggcga

SEQ ID NO: 6541444 - DNA, 21 bp, Homo sapiens
tgtcctcccacagacctgcag

SEQ ID NO: 6541445 - DNA, 13 bp, Homo sapiens
tgtcctcccagga

SEQ ID NO: 6541446 - DNA, 14 bp, Homo sapiens
tgtcctcccaggct

SEQ ID NO: 6541447 - DNA, 13 bp, Homo sapiens
tgtcctcccatcc

SEQ ID NO: 6541448 - DNA, 17 bp, Homo sapiens
tgtcctcccatcccctg

SEQ ID NO: 6541449 - DNA, 18 bp, Homo sapiens
tgtcctcccatcccctgg

SEQ ID NO: 6541450 - DNA, 19 bp, Homo sapiens
tgtcctcccatcccctgga

SEQ ID NO: 6541451 - DNA, 17 bp, Homo sapiens
tgtcctcccctcaagga

SEQ ID NO: 6541452 - DNA, 18 bp, Homo sapiens
tgtcctcccctcaaggac

SEQ ID NO: 6541453 - DNA, 23 bp, Homo sapiens
tgtcctcccgagctcctcttcca

SEQ ID NO: 6541454 - DNA, 19 bp, Homo sapiens
tgtcctccctccacctacc

SEQ ID NO: 6541455 - DNA, 21 bp, Homo sapiens
tgtcctccgccttaccaggag

SEQ ID NO: 6541456 - DNA, 13 bp, Homo sapiens
tgtcctcctctgt

SEQ ID NO: 6541457 - DNA, 21 bp, Homo sapiens
tgtcctcctgctctgcttcct

SEQ ID NO: 6541458 - DNA, 14 bp, Homo sapiens
tgtcctcctgctgc

SEQ ID NO: 6541459 - DNA, 14 bp, Homo sapiens
tgtcctcctggcac

SEQ ID NO: 6541460 - DNA, 12 bp, Homo sapiens
tgtcctcctggt

SEQ ID NO: 6541461 - DNA, 11 bp, Homo sapiens
tgtcctccttc

SEQ ID NO: 6541462 - DNA, 19 bp, Homo sapiens
tgtcctccttcctgggacc

SEQ ID NO: 6541463 - DNA, 17 bp, Homo sapiens
tgtcctcgcactgccca

SEQ ID NO: 6541464 - DNA, 22 bp, Homo sapiens
tgtcctctacataccacactta

SEQ ID NO: 6541465 - DNA, 16 bp, Homo sapiens
tgtcctctcagaactc

SEQ ID NO: 6541466 - DNA, 15 bp, Homo sapiens
tgtcctctccccctt

SEQ ID NO: 6541467 - DNA, 23 bp, Homo sapiens
tgtcctctcccccttcagctcct

SEQ ID NO: 6541468 - DNA, 14 bp, Homo sapiens
tgtcctctgcctgg

SEQ ID NO: 6541469 - DNA, 15 bp, Homo sapiens
tgtcctctgcctggg

SEQ ID NO: 6541470 - DNA, 16 bp, Homo sapiens
tgtcctctgcctgggc

SEQ ID NO: 6541471 - DNA, 20 bp, Homo sapiens
tgtcctctgtccgtctgtcc

SEQ ID NO: 6541472 - DNA, 18 bp, Homo sapiens
tgtcctcttaagacacta

SEQ ID NO: 6541473 - DNA, 13 bp, Homo sapiens
tgtcctcttccct

SEQ ID NO: 6541474 - DNA, 21 bp, Homo sapiens
tgtcctcttctgctcttttcc

SEQ ID NO: 6541475 - DNA, 22 bp, Homo sapiens
tgtcctcttctgctcttttcct

SEQ ID NO: 6541476 - DNA, 19 bp, Homo sapiens
tgtcctcttctgtgagtca

SEQ ID NO: 6541477 - DNA, 17 bp, Homo sapiens
tgtcctctttactccct

SEQ ID NO: 6541478 - DNA, 22 bp, Homo sapiens
tgtcctctttactcccttcctg

SEQ ID NO: 6541479 - DNA, 16 bp, Homo sapiens
tgtcctctttcagaaa

SEQ ID NO: 6541480 - DNA, 16 bp, Homo sapiens
tgtcctctttcagctc

SEQ ID NO: 6541481 - DNA, 21 bp, Homo sapiens
tgtcctctttcagctcctgac

SEQ ID NO: 6541482 - DNA, 20 bp, Homo sapiens
tgtcctcttttgttgtttct

SEQ ID NO: 6541483 - DNA, 20 bp, Homo sapiens
tgtcctgaaacatgaaccca

SEQ ID NO: 6541484 - DNA, 22 bp, Homo sapiens
tgtcctgaaagcggctgcctcc

SEQ ID NO: 6541485 - DNA, 23 bp, Homo sapiens
tgtcctgaaagcggctgcctcca

SEQ ID NO: 6541486 - DNA, 18 bp, Homo sapiens
tgtcctgaagctgctgga

SEQ ID NO: 6541487 - DNA, 15 bp, Homo sapiens
tgtcctgaaggcctg

SEQ ID NO: 6541488 - DNA, 18 bp, Homo sapiens
tgtcctgaaggcctgagg

SEQ ID NO: 6541489 - DNA, 19 bp, Homo sapiens
tgtcctgaatggctttgtc

SEQ ID NO: 6541490 - DNA, 12 bp, Homo sapiens
tgtcctgaccac

SEQ ID NO: 6541491 - DNA, 15 bp, Homo sapiens
tgtcctgaccaccct

SEQ ID NO: 6541492 - DNA, 17 bp, Homo sapiens
tgtcctgaccaccctcc

SEQ ID NO: 6541493 - DNA, 19 bp, Homo sapiens
tgtcctgaccaccctcccc

SEQ ID NO: 6541494 - DNA, 15 bp, Homo sapiens
tgtcctgactgtcct

SEQ ID NO: 6541495 - DNA, 21 bp, Homo sapiens
tgtcctgagccccagggagag

SEQ ID NO: 6541496 - DNA, 17 bp, Homo sapiens
tgtcctgagccccctgc

SEQ ID NO: 6541497 - DNA, 22 bp, Homo sapiens
tgtcctgagccccctgcaccca

SEQ ID NO: 6541498 - DNA, 11 bp, Homo sapiens
tgtcctgaggc

SEQ ID NO: 6541499 - DNA, 19 bp, Homo sapiens
tgtcctgatggtcagctcc

SEQ ID NO: 6541500 - DNA, 20 bp, Homo sapiens
tgtcctgatgtttttctgtg

SEQ ID NO: 6541501 - DNA, 12 bp, Homo sapiens
tgtcctgatttc

SEQ ID NO: 6541502 - DNA, 20 bp, Homo sapiens
tgtcctgcacaccctgggcc

SEQ ID NO: 6541503 - DNA, 14 bp, Homo sapiens
tgtcctgcagagct

SEQ ID NO: 6541504 - DNA, 18 bp, Homo sapiens
tgtcctgcagcaaacact

SEQ ID NO: 6541505 - DNA, 16 bp, Homo sapiens
tgtcctgcagtgctca

SEQ ID NO: 6541506 - DNA, 11 bp, Homo sapiens
tgtcctgcatg

SEQ ID NO: 6541507 - DNA, 21 bp, Homo sapiens
tgtcctgcatgcataatgaac

SEQ ID NO: 6541508 - DNA, 13 bp, Homo sapiens
tgtcctgcatgta

SEQ ID NO: 6541509 - DNA, 11 bp, Homo sapiens
tgtcctgccca

SEQ ID NO: 6541510 - DNA, 15 bp, Homo sapiens
tgtcctgcccaccct

SEQ ID NO: 6541511 - DNA, 12 bp, Homo sapiens
tgtcctgcctcc

SEQ ID NO: 6541512 - DNA, 13 bp, Homo sapiens
tgtcctgcctcct

SEQ ID NO: 6541513 - DNA, 17 bp, Homo sapiens
tgtcctgcctcctcatc

SEQ ID NO: 6541514 - DNA, 22 bp, Homo sapiens
tgtcctgcctctctgctccaga

SEQ ID NO: 6541515 - DNA, 15 bp, Homo sapiens
tgtcctgcctcttgt

SEQ ID NO: 6541516 - DNA, 15 bp, Homo sapiens
tgtcctgcctgtctg

SEQ ID NO: 6541517 - DNA, 16 bp, Homo sapiens
tgtcctgcctgtctgc

SEQ ID NO: 6541518 - DNA, 19 bp, Homo sapiens
tgtcctgcctgtctgcccc

SEQ ID NO: 6541519 - DNA, 16 bp, Homo sapiens
tgtcctgcctgtggcc

SEQ ID NO: 6541520 - DNA, 12 bp, Homo sapiens
tgtcctgccttg

SEQ ID NO: 6541521 - DNA, 13 bp, Homo sapiens
tgtcctgccttga

SEQ ID NO: 6541522 - DNA, 16 bp, Homo sapiens
tgtcctgcgcctgcgc

SEQ ID NO: 6541523 - DNA, 21 bp, Homo sapiens
tgtcctgctacctttgtctca

SEQ ID NO: 6541524 - DNA, 22 bp, Homo sapiens
tgtcctgctacctttgtctcac

SEQ ID NO: 6541525 - DNA, 14 bp, Homo sapiens
tgtcctgctagctg

SEQ ID NO: 6541526 - DNA, 15 bp, Homo sapiens
tgtcctgctagctgt

SEQ ID NO: 6541527 - DNA, 17 bp, Homo sapiens
tgtcctgctcacgtctg

SEQ ID NO: 6541528 - DNA, 14 bp, Homo sapiens
tgtcctgctccaca

SEQ ID NO: 6541529 - DNA, 15 bp, Homo sapiens
tgtcctgctccacag

SEQ ID NO: 6541530 - DNA, 18 bp, Homo sapiens
tgtcctgctccacagtgt

SEQ ID NO: 6541531 - DNA, 19 bp, Homo sapiens
tgtcctgctctcttcagga

SEQ ID NO: 6541532 - DNA, 13 bp, Homo sapiens
tgtcctgctctgt

SEQ ID NO: 6541533 - DNA, 19 bp, Homo sapiens
tgtcctgctggcttccagc

SEQ ID NO: 6541534 - DNA, 20 bp, Homo sapiens
tgtcctgctggcttccagct

SEQ ID NO: 6541535 - DNA, 11 bp, Homo sapiens
tgtcctgctgt

SEQ ID NO: 6541536 - DNA, 22 bp, Homo sapiens
tgtcctggaagtgtgtgtttct

SEQ ID NO: 6541537 - DNA, 17 bp, Homo sapiens
tgtcctggaccctggcc

SEQ ID NO: 6541538 - DNA, 19 bp, Homo sapiens
tgtcctggaccctggccta

SEQ ID NO: 6541539 - DNA, 16 bp, Homo sapiens
tgtcctggcccttcag

SEQ ID NO: 6541540 - DNA, 23 bp, Homo sapiens
tgtcctggctgctctcatgcctg

SEQ ID NO: 6541541 - DNA, 15 bp, Homo sapiens
tgtcctggctgtgca

SEQ ID NO: 6541542 - DNA, 18 bp, Homo sapiens
tgtcctggctgtgcacat

SEQ ID NO: 6541543 - DNA, 23 bp, Homo sapiens
tgtcctgggcatgggtccagggc

SEQ ID NO: 6541544 - DNA, 11 bp, Homo sapiens
tgtcctgggcg

SEQ ID NO: 6541545 - DNA, 18 bp, Homo sapiens
tgtcctgggcgccctgga

SEQ ID NO: 6541546 - DNA, 21 bp, Homo sapiens
tgtcctgggggatgcaaataa

SEQ ID NO: 6541547 - DNA, 23 bp, Homo sapiens
tgtcctggtaattcctctccagg

SEQ ID NO: 6541548 - DNA, 22 bp, Homo sapiens
tgtcctggtggctgggcccagc

SEQ ID NO: 6541549 - DNA, 19 bp, Homo sapiens
tgtcctggtggtattttca

SEQ ID NO: 6541550 - DNA, 20 bp, Homo sapiens
aagcaaaaaatgaatgtcta

SEQ ID NO: 6541551 - DNA, 22 bp, Homo sapiens
aagcaaaaactagtaaagacat

SEQ ID NO: 6541552 - DNA, 20 bp, Homo sapiens
aagcaaaaagaacaaagctg

SEQ ID NO: 6541553 - DNA, 18 bp, Homo sapiens
aagcaaaaagatgccttt

SEQ ID NO: 6541554 - DNA, 19 bp, Homo sapiens
aagcaaaacagttctcaga

SEQ ID NO: 6541555 - DNA, 16 bp, Homo sapiens
aagcaaaactttcctc

SEQ ID NO: 6541556 - DNA, 12 bp, Homo sapiens
aagcaaaagact

SEQ ID NO: 6541557 - DNA, 12 bp, Homo sapiens
aagcaaaaggca

SEQ ID NO: 6541558 - DNA, 14 bp, Homo sapiens
aagcaaaaggctga

SEQ ID NO: 6541559 - DNA, 18 bp, Homo sapiens
aagcaaaaggctgagaag

SEQ ID NO: 6541560 - DNA, 14 bp, Homo sapiens
aagcaaaagtaatc

SEQ ID NO: 6541561 - DNA, 13 bp, Homo sapiens
aagcaaaatagta

SEQ ID NO: 6541562 - DNA, 19 bp, Homo sapiens
aagcaaaatagtattgctg

SEQ ID NO: 6541563 - DNA, 18 bp, Homo sapiens
aagcaaaatatttgtgaa

SEQ ID NO: 6541564 - DNA, 17 bp, Homo sapiens
aagcaaaatcatggaat

SEQ ID NO: 6541565 - DNA, 17 bp, Homo sapiens
aagcaaaatgaaaagag

SEQ ID NO: 6541566 - DNA, 13 bp, Homo sapiens
aagcaaaatgtga

SEQ ID NO: 6541567 - DNA, 21 bp, Homo sapiens
aagcaaaattataagaagagg

SEQ ID NO: 6541568 - DNA, 12 bp, Homo sapiens
aagcaaaatttt

SEQ ID NO: 6541569 - DNA, 16 bp, Homo sapiens
aagcaaaatttttaaa

SEQ ID NO: 6541570 - DNA, 18 bp, Homo sapiens
aagcaaaatttttaaaac

SEQ ID NO: 6541571 - DNA, 16 bp, Homo sapiens
aagcaaacagggtggc

SEQ ID NO: 6541572 - DNA, 13 bp, Homo sapiens
aagcaaacatcaa

SEQ ID NO: 6541573 - DNA, 22 bp, Homo sapiens
aagcaaacatcaaataaatttc

SEQ ID NO: 6541574 - DNA, 19 bp, Homo sapiens
aagcaaacccagacggctc

SEQ ID NO: 6541575 - DNA, 21 bp, Homo sapiens
aagcaaactctaaaattataa

SEQ ID NO: 6541576 - DNA, 12 bp, Homo sapiens
aagcaaagaacc

SEQ ID NO: 6541577 - DNA, 16 bp, Homo sapiens
aagcaaagatttcagt

SEQ ID NO: 6541578 - DNA, 23 bp, Homo sapiens
aagcaaagcgctaagtaaaaata

SEQ ID NO: 6541579 - DNA, 15 bp, Homo sapiens
aagcaaaggatgtgt

SEQ ID NO: 6541580 - DNA, 13 bp, Homo sapiens
aagcaaaggcagt

SEQ ID NO: 6541581 - DNA, 15 bp, Homo sapiens
aagcaaaggggggag

SEQ ID NO: 6541582 - DNA, 17 bp, Homo sapiens
aagcaaaggtgaagaga

SEQ ID NO: 6541583 - DNA, 13 bp, Homo sapiens
aagcaaaggtgca

SEQ ID NO: 6541584 - DNA, 12 bp, Homo sapiens
aagcaaagtgaa

SEQ ID NO: 6541585 - DNA, 13 bp, Homo sapiens
aagcaaagtgctg

SEQ ID NO: 6541586 - DNA, 17 bp, Homo sapiens
aagcaaagttgggtgta

SEQ ID NO: 6541587 - DNA, 14 bp, Homo sapiens
aagcaaataaatat

SEQ ID NO: 6541588 - DNA, 13 bp, Homo sapiens
aagcaaatataaa

SEQ ID NO: 6541589 - DNA, 15 bp, Homo sapiens
aagcaaatcagaaaa

SEQ ID NO: 6541590 - DNA, 17 bp, Homo sapiens
aagcaaatcagaaactt

SEQ ID NO: 6541591 - DNA, 17 bp, Homo sapiens
aagcaaatcagacacaa

SEQ ID NO: 6541592 - DNA, 14 bp, Homo sapiens
aagcaaatcatttg

SEQ ID NO: 6541593 - DNA, 17 bp, Homo sapiens
aagcaaatcgaatgaaa

SEQ ID NO: 6541594 - DNA, 18 bp, Homo sapiens
aagcaaatcgaatgaaat

SEQ ID NO: 6541595 - DNA, 23 bp, Homo sapiens
aagcaaatctttctgtaaacaga

SEQ ID NO: 6541596 - DNA, 15 bp, Homo sapiens
aagcaaatgcattct

SEQ ID NO: 6541597 - DNA, 18 bp, Homo sapiens
aagcaaatgcctgccaaa

SEQ ID NO: 6541598 - DNA, 16 bp, Homo sapiens
aagcaaatgtcatgct

SEQ ID NO: 6541599 - DNA, 19 bp, Homo sapiens
aagcaaatgttaaaagttt

SEQ ID NO: 6541600 - DNA, 16 bp, Homo sapiens
aagcaaatgttgggaa

SEQ ID NO: 6541601 - DNA, 16 bp, Homo sapiens
aagcaaattactccaa

SEQ ID NO: 6541602 - DNA, 23 bp, Homo sapiens
aagcaaattatttttaaaagaaa

SEQ ID NO: 6541603 - DNA, 22 bp, Homo sapiens
aagcaaatttcaaaagacatgt

SEQ ID NO: 6541604 - DNA, 15 bp, Homo sapiens
aagcaacaactttgt

SEQ ID NO: 6541605 - DNA, 17 bp, Homo sapiens
aagcaacaatggatatt

SEQ ID NO: 6541606 - DNA, 22 bp, Homo sapiens
aagcaacaattttcagatttgc

SEQ ID NO: 6541607 - DNA, 21 bp, Homo sapiens
aagcaacacaagacacctttt

SEQ ID NO: 6541608 - DNA, 19 bp, Homo sapiens
aagcaacagcctttgaatg

SEQ ID NO: 6541609 - DNA, 21 bp, Homo sapiens
aagcaacagcctttgaatgta

SEQ ID NO: 6541610 - DNA, 20 bp, Homo sapiens
aagcaacatgaattaagaac

SEQ ID NO: 6541611 - DNA, 13 bp, Homo sapiens
aagcaacatggct

SEQ ID NO: 6541612 - DNA, 14 bp, Homo sapiens
aagcaacatggctt

SEQ ID NO: 6541613 - DNA, 20 bp, Homo sapiens
aagcaacattcatagtcttt

SEQ ID NO: 6541614 - DNA, 13 bp, Homo sapiens
aagcaacatttgt

SEQ ID NO: 6541615 - DNA, 18 bp, Homo sapiens
aagcaacatttgtatgga

SEQ ID NO: 6541616 - DNA, 21 bp, Homo sapiens
aagcaacatttgtatggattt

SEQ ID NO: 6541617 - DNA, 18 bp, Homo sapiens
aagcaaccacactgcttg

SEQ ID NO: 6541618 - DNA, 16 bp, Homo sapiens
aagcaacccaaactga

SEQ ID NO: 6541619 - DNA, 20 bp, Homo sapiens
aagcaacccgctggagccca

SEQ ID NO: 6541620 - DNA, 22 bp, Homo sapiens
aagcaacccgctggagcccaca

SEQ ID NO: 6541621 - DNA, 15 bp, Homo sapiens
aagcaacctcagtaa

SEQ ID NO: 6541622 - DNA, 20 bp, Homo sapiens
aagcaacctcagtaatttag

SEQ ID NO: 6541623 - DNA, 19 bp, Homo sapiens
aagcaacctcccaacccag

SEQ ID NO: 6541624 - DNA, 18 bp, Homo sapiens
aagcaacctgggtccaaa

SEQ ID NO: 6541625 - DNA, 20 bp, Homo sapiens
aagcaacctgggtccaaata

SEQ ID NO: 6541626 - DNA, 16 bp, Homo sapiens
aagcaaccttaaagca

SEQ ID NO: 6541627 - DNA, 23 bp, Homo sapiens
aagcaaccttaaagcaataagtt

SEQ ID NO: 6541628 - DNA, 21 bp, Homo sapiens
aagcaacgggaacacctgctg

SEQ ID NO: 6541629 - DNA, 16 bp, Homo sapiens
aagcaacgtgttaatt

SEQ ID NO: 6541630 - DNA, 20 bp, Homo sapiens
aagcaactaagttaataata

SEQ ID NO: 6541631 - DNA, 19 bp, Homo sapiens
aagcaactacaacttctcc

SEQ ID NO: 6541632 - DNA, 19 bp, Homo sapiens
aagcaactaggccttcagt

SEQ ID NO: 6541633 - DNA, 20 bp, Homo sapiens
aagcaactccgtgtgcctgg

SEQ ID NO: 6541634 - DNA, 21 bp, Homo sapiens
aagcaactccgtgtgcctggg

SEQ ID NO: 6541635 - DNA, 16 bp, Homo sapiens
aagcaactgtctattt

SEQ ID NO: 6541636 - DNA, 17 bp, Homo sapiens
aagcaactgtctatttc

SEQ ID NO: 6541637 - DNA, 21 bp, Homo sapiens
aagcaactgtctatttctgct

SEQ ID NO: 6541638 - DNA, 14 bp, Homo sapiens
aagcaactgttatg

SEQ ID NO: 6541639 - DNA, 16 bp, Homo sapiens
aagcaacttgatggaa

SEQ ID NO: 6541640 - DNA, 16 bp, Homo sapiens
aagcaacttgcttcta

SEQ ID NO: 6541641 - DNA, 13 bp, Homo sapiens
aagcaagaaacag

SEQ ID NO: 6541642 - DNA, 15 bp, Homo sapiens
aagcaagaaagaaac

SEQ ID NO: 6541643 - DNA, 19 bp, Homo sapiens
aagcaagaaagccgtactg

SEQ ID NO: 6541644 - DNA, 12 bp, Homo sapiens
aagcaagaagaa

SEQ ID NO: 6541645 - DNA, 15 bp, Homo sapiens
aagcaagaagaattg

SEQ ID NO: 6541646 - DNA, 21 bp, Homo sapiens
aagcaagacagtggcactaaa

SEQ ID NO: 6541647 - DNA, 23 bp, Homo sapiens
aagcaagaccatggggtggaagg

SEQ ID NO: 6541648 - DNA, 18 bp, Homo sapiens
aagcaagatcgctgtgct

SEQ ID NO: 6541649 - DNA, 18 bp, Homo sapiens
aagcaagatctactacat

SEQ ID NO: 6541650 - DNA, 15 bp, Homo sapiens
aagcaagatgagctg

SEQ ID NO: 6541651 - DNA, 17 bp, Homo sapiens
aagcaagatgagctgtg

SEQ ID NO: 6541652 - DNA, 16 bp, Homo sapiens
aagcaagcaacacaga

SEQ ID NO: 6541653 - DNA, 17 bp, Homo sapiens
aagcaagcacctgggtg

SEQ ID NO: 6541654 - DNA, 19 bp, Homo sapiens
aagcaagcacctgggtgtg

SEQ ID NO: 6541655 - DNA, 15 bp, Homo sapiens
aagcaagcattcaga

SEQ ID NO: 6541656 - DNA, 19 bp, Homo sapiens
aagcaagcattcagaagaa

SEQ ID NO: 6541657 - DNA, 18 bp, Homo sapiens
aagcaagccaatttggaa

SEQ ID NO: 6541658 - DNA, 13 bp, Homo sapiens
aagcaagccagga

SEQ ID NO: 6541659 - DNA, 15 bp, Homo sapiens
aagcaagctggatgc

SEQ ID NO: 6541660 - DNA, 23 bp, Homo sapiens
aagcaagctggatgcagtggctc

SEQ ID NO: 6541661 - DNA, 17 bp, Homo sapiens
aagcaagctgtgttact

SEQ ID NO: 6541662 - DNA, 22 bp, Homo sapiens
aagcaagctgtgttacttgaag

SEQ ID NO: 6541663 - DNA, 23 bp, Homo sapiens
aagcaagctgtgttacttgaagt

SEQ ID NO: 6541664 - DNA, 13 bp, Homo sapiens
aagcaagcttaat

SEQ ID NO: 6541665 - DNA, 21 bp, Homo sapiens
aagcaaggaagtaagggagtc

SEQ ID NO: 6541666 - DNA, 19 bp, Homo sapiens
aagcaaggatctttcaccc

SEQ ID NO: 6541667 - DNA, 15 bp, Homo sapiens
aagcaaggcaaaaat

SEQ ID NO: 6541668 - DNA, 17 bp, Homo sapiens
aagcaagggagaaaaga

SEQ ID NO: 6541669 - DNA, 17 bp, Homo sapiens
aagcaagggcaaacagt

SEQ ID NO: 6541670 - DNA, 16 bp, Homo sapiens
aagcaagggctccagc

SEQ ID NO: 6541671 - DNA, 16 bp, Homo sapiens
aagcaagggtctcctt

SEQ ID NO: 6541672 - DNA, 19 bp, Homo sapiens
aagcaagtagctttccaca

SEQ ID NO: 6541673 - DNA, 16 bp, Homo sapiens
aagcaagtattagaat

SEQ ID NO: 6541674 - DNA, 20 bp, Homo sapiens
aagcaagtgagtctggtgga

SEQ ID NO: 6541675 - DNA, 19 bp, Homo sapiens
aagcaagttcgtctgttgt

SEQ ID NO: 6541676 - DNA, 16 bp, Homo sapiens
aagcaataaaactgct

SEQ ID NO: 6541677 - DNA, 22 bp, Homo sapiens
aagcaataactatttttcctca

SEQ ID NO: 6541678 - DNA, 20 bp, Homo sapiens
aagcaataactccaagcaga

SEQ ID NO: 6541679 - DNA, 14 bp, Homo sapiens
aagcaataaggaaa

SEQ ID NO: 6541680 - DNA, 24 bp, Homo sapiens
aagcaataagttcattaaacagaa

SEQ ID NO: 6541681 - DNA, 20 bp, Homo sapiens
aagcaataatcctattgtac

SEQ ID NO: 6541682 - DNA, 21 bp, Homo sapiens
aagcaataatggtcccatcca

SEQ ID NO: 6541683 - DNA, 20 bp, Homo sapiens
aagcaataattaggatctat

SEQ ID NO: 6541684 - DNA, 13 bp, Homo sapiens
aagcaataattgt

SEQ ID NO: 6541685 - DNA, 14 bp, Homo sapiens
aagcaataattgtt

SEQ ID NO: 6541686 - DNA, 17 bp, Homo sapiens
aagcaataattgtttcc

SEQ ID NO: 6541687 - DNA, 18 bp, Homo sapiens
aagcaataattgtttcca

SEQ ID NO: 6541688 - DNA, 14 bp, Homo sapiens
aagcaatacaactt

SEQ ID NO: 6541689 - DNA, 15 bp, Homo sapiens
aagcaatacaacttt

SEQ ID NO: 6541690 - DNA, 18 bp, Homo sapiens
aagcaatacgtttgtgca

SEQ ID NO: 6541691 - DNA, 20 bp, Homo sapiens
aagcaatacgtttgtgcaga

SEQ ID NO: 6541692 - DNA, 21 bp, Homo sapiens
aagcaatacgtttgtgcagaa

SEQ ID NO: 6541693 - DNA, 22 bp, Homo sapiens
aagcaatacgtttgtgcagaat

SEQ ID NO: 6541694 - DNA, 18 bp, Homo sapiens
aagcaatactgccgctgc

SEQ ID NO: 6541695 - DNA, 15 bp, Homo sapiens
aagcaatagaaacaa

SEQ ID NO: 6541696 - DNA, 13 bp, Homo sapiens
aagcaatatgcat

SEQ ID NO: 6541697 - DNA, 17 bp, Homo sapiens
aagcaatattgtatatt

SEQ ID NO: 6541698 - DNA, 17 bp, Homo sapiens
aagcaatattttggagt

SEQ ID NO: 6541699 - DNA, 12 bp, Homo sapiens
aagcaatcaaga

SEQ ID NO: 6541700 - DNA, 18 bp, Homo sapiens
aagcaatcactgggccca

SEQ ID NO: 6541701 - DNA, 20 bp, Homo sapiens
aagcaatcactgggcccaga

SEQ ID NO: 6541702 - DNA, 18 bp, Homo sapiens
aagcaatcctcctgagtg

SEQ ID NO: 6541703 - DNA, 16 bp, Homo sapiens
aagcaatcctcctgcc

SEQ ID NO: 6541704 - DNA, 21 bp, Homo sapiens
aagcaatcctcctgcctcagc

SEQ ID NO: 6541705 - DNA, 22 bp, Homo sapiens
aagcaatcctctcacctcagcc

SEQ ID NO: 6541706 - DNA, 14 bp, Homo sapiens
aagcaatctggaag

SEQ ID NO: 6541707 - DNA, 13 bp, Homo sapiens
aagcaatcttggc

SEQ ID NO: 6541708 - DNA, 11 bp, Homo sapiens
aagcaatgcat

SEQ ID NO: 6541709 - DNA, 13 bp, Homo sapiens
aagcaatggttga

SEQ ID NO: 6541710 - DNA, 14 bp, Homo sapiens
aagcaattaaatga

SEQ ID NO: 6541711 - DNA, 16 bp, Homo sapiens
aagcaattaaatgata

SEQ ID NO: 6541712 - DNA, 15 bp, Homo sapiens
aagcaattagacaag

SEQ ID NO: 6541713 - DNA, 16 bp, Homo sapiens
aagcaattaggtagca

SEQ ID NO: 6541714 - DNA, 21 bp, Homo sapiens
aagcaattaggtagcacagca

SEQ ID NO: 6541715 - DNA, 17 bp, Homo sapiens
aagcaattatttttaaa

SEQ ID NO: 6541716 - DNA, 13 bp, Homo sapiens
aagcaattctaag

SEQ ID NO: 6541717 - DNA, 15 bp, Homo sapiens
aagcaattgaaaagg

SEQ ID NO: 6541718 - DNA, 16 bp, Homo sapiens
aagcaattgccctgta

SEQ ID NO: 6541719 - DNA, 17 bp, Homo sapiens
aagcaattgctcatgtt

SEQ ID NO: 6541720 - DNA, 17 bp, Homo sapiens
aagcaatttatatcttt

SEQ ID NO: 6541721 - DNA, 19 bp, Homo sapiens
aagcaatttatatctttat

SEQ ID NO: 6541722 - DNA, 23 bp, Homo sapiens
aagcaatttatatctttatgcaa

SEQ ID NO: 6541723 - DNA, 18 bp, Homo sapiens
aagcaatttcagttttaa

SEQ ID NO: 6541724 - DNA, 15 bp, Homo sapiens
aagcaatttcttgct

SEQ ID NO: 6541725 - DNA, 20 bp, Homo sapiens
aagcacaaaaaatttaagag

SEQ ID NO: 6541726 - DNA, 18 bp, Homo sapiens
aagcacaaaagacaagca

SEQ ID NO: 6541727 - DNA, 16 bp, Homo sapiens
aagcacaaaccctggg

SEQ ID NO: 6541728 - DNA, 19 bp, Homo sapiens
aagcacaaaccctggggac

SEQ ID NO: 6541729 - DNA, 23 bp, Homo sapiens
tgtcctgtaaacactcagctgtt

SEQ ID NO: 6541730 - DNA, 15 bp, Homo sapiens
tgtcctgtaaaggtt

SEQ ID NO: 6541731 - DNA, 15 bp, Homo sapiens
tgtcctgtcctggtc

SEQ ID NO: 6541732 - DNA, 13 bp, Homo sapiens
tgtcctgtctttg

SEQ ID NO: 6541733 - DNA, 22 bp, Homo sapiens
tgtcctgtgaaatattcttagg

SEQ ID NO: 6541734 - DNA, 18 bp, Homo sapiens
tgtcctgtgagatgtgta

SEQ ID NO: 6541735 - DNA, 14 bp, Homo sapiens
tgtcctgtgatgtc

SEQ ID NO: 6541736 - DNA, 23 bp, Homo sapiens
tgtcctgtgctttctgcatgctt

SEQ ID NO: 6541737 - DNA, 21 bp, Homo sapiens
tgtcctgtggcatgcaaaaga

SEQ ID NO: 6541738 - DNA, 12 bp, Homo sapiens
tgtcctgtgtca

SEQ ID NO: 6541739 - DNA, 19 bp, Homo sapiens
tgtcctgtgtcagtttatg

SEQ ID NO: 6541740 - DNA, 21 bp, Homo sapiens
tgtcctgtgtcagtttatgtt

SEQ ID NO: 6541741 - DNA, 12 bp, Homo sapiens
tgtcctgtgtct

SEQ ID NO: 6541742 - DNA, 17 bp, Homo sapiens
tgtcctgtgtctatgta

SEQ ID NO: 6541743 - DNA, 19 bp, Homo sapiens
tgtcctgttgattaatttc

SEQ ID NO: 6541744 - DNA, 18 bp, Homo sapiens
tgtccttaaaatgtggtc

SEQ ID NO: 6541745 - DNA, 16 bp, Homo sapiens
tgtccttaacccacct

SEQ ID NO: 6541746 - DNA, 17 bp, Homo sapiens
tgtccttaacccacctc

SEQ ID NO: 6541747 - DNA, 20 bp, Homo sapiens
tgtccttaacccacctctcc

SEQ ID NO: 6541748 - DNA, 23 bp, Homo sapiens
tgtccttaacccacctctcctgc

SEQ ID NO: 6541749 - DNA, 18 bp, Homo sapiens
tgtccttactcagagctg

SEQ ID NO: 6541750 - DNA, 23 bp, Homo sapiens
tgtccttagactccttctcccca

SEQ ID NO: 6541751 - DNA, 16 bp, Homo sapiens
tgtccttagcctggac

SEQ ID NO: 6541752 - DNA, 22 bp, Homo sapiens
tgtccttagcctggacctctga

SEQ ID NO: 6541753 - DNA, 18 bp, Homo sapiens
tgtccttagtgatgtgtg

SEQ ID NO: 6541754 - DNA, 17 bp, Homo sapiens
tgtccttagtgtataaa

SEQ ID NO: 6541755 - DNA, 21 bp, Homo sapiens
tgtccttattcttgtggttaa

SEQ ID NO: 6541756 - DNA, 23 bp, Homo sapiens
tgtccttcacggcactggatccc

SEQ ID NO: 6541757 - DNA, 15 bp, Homo sapiens
tgtccttcagagctc

SEQ ID NO: 6541758 - DNA, 14 bp, Homo sapiens
tgtccttcccccag

SEQ ID NO: 6541759 - DNA, 13 bp, Homo sapiens
tgtccttcccctt

SEQ ID NO: 6541760 - DNA, 16 bp, Homo sapiens
tgtccttccccttccc

SEQ ID NO: 6541761 - DNA, 11 bp, Homo sapiens
tgtccttccct

SEQ ID NO: 6541762 - DNA, 13 bp, Homo sapiens
tgtccttccctgc

SEQ ID NO: 6541763 - DNA, 15 bp, Homo sapiens
tgtccttccctgcca

SEQ ID NO: 6541764 - DNA, 16 bp, Homo sapiens
tgtccttccctgttct

SEQ ID NO: 6541765 - DNA, 22 bp, Homo sapiens
tgtccttcctccacaaggtccc

SEQ ID NO: 6541766 - DNA, 12 bp, Homo sapiens
tgtccttctaca

SEQ ID NO: 6541767 - DNA, 13 bp, Homo sapiens
tgtccttctcctc

SEQ ID NO: 6541768 - DNA, 22 bp, Homo sapiens
tgtccttctcctcttgtagcca

SEQ ID NO: 6541769 - DNA, 19 bp, Homo sapiens
tgtccttctctcacctcct

SEQ ID NO: 6541770 - DNA, 21 bp, Homo sapiens
tgtccttctctcacctcctaa

SEQ ID NO: 6541771 - DNA, 21 bp, Homo sapiens
tgtccttgaagcttgtatctg

SEQ ID NO: 6541772 - DNA, 16 bp, Homo sapiens
tgtccttgaatgccat

SEQ ID NO: 6541773 - DNA, 13 bp, Homo sapiens
tgtccttgcacct

SEQ ID NO: 6541774 - DNA, 14 bp, Homo sapiens
tgtccttgcacctg

SEQ ID NO: 6541775 - DNA, 14 bp, Homo sapiens
tgtccttgctcctg

SEQ ID NO: 6541776 - DNA, 15 bp, Homo sapiens
tgtccttgctcctgg

SEQ ID NO: 6541777 - DNA, 17 bp, Homo sapiens
tgtccttggggcacagt

SEQ ID NO: 6541778 - DNA, 18 bp, Homo sapiens
tgtccttgggttgctggt

SEQ ID NO: 6541779 - DNA, 20 bp, Homo sapiens
tgtccttgtcacgatcacag

SEQ ID NO: 6541780 - DNA, 23 bp, Homo sapiens
tgtccttgtcgtagagccctcca

SEQ ID NO: 6541781 - DNA, 13 bp, Homo sapiens
tgtcctttatgta

SEQ ID NO: 6541782 - DNA, 14 bp, Homo sapiens
tgtcctttcccctc

SEQ ID NO: 6541783 - DNA, 17 bp, Homo sapiens
tgtcctttcccctctct

SEQ ID NO: 6541784 - DNA, 18 bp, Homo sapiens
tgtcctttcccctctctg

SEQ ID NO: 6541785 - DNA, 15 bp, Homo sapiens
tgtcctttccctgga

SEQ ID NO: 6541786 - DNA, 23 bp, Homo sapiens
tgtcctttcccttcagtaccctc

SEQ ID NO: 6541787 - DNA, 19 bp, Homo sapiens
tgtcctttctagagcactg

SEQ ID NO: 6541788 - DNA, 16 bp, Homo sapiens
tgtcctttctccaggc

SEQ ID NO: 6541789 - DNA, 19 bp, Homo sapiens
tgtcctttctccaggccct

SEQ ID NO: 6541790 - DNA, 16 bp, Homo sapiens
tgtcctttctccagtg

SEQ ID NO: 6541791 - DNA, 13 bp, Homo sapiens
tgtcctttctctc

SEQ ID NO: 6541792 - DNA, 19 bp, Homo sapiens
tgtcctttctctctaattc

SEQ ID NO: 6541793 - DNA, 17 bp, Homo sapiens
tgtcctttgagaaagaa

SEQ ID NO: 6541794 - DNA, 15 bp, Homo sapiens
tgtcctttgaggccc

SEQ ID NO: 6541795 - DNA, 21 bp, Homo sapiens
tgtcctttgcaattgctcttc

SEQ ID NO: 6541796 - DNA, 13 bp, Homo sapiens
tgtccttttcata

SEQ ID NO: 6541797 - DNA, 18 bp, Homo sapiens
tgtccttttctcccattt

SEQ ID NO: 6541798 - DNA, 17 bp, Homo sapiens
tgtccttttcttttctt

SEQ ID NO: 6541799 - DNA, 18 bp, Homo sapiens
tgtcctttttcactttga

SEQ ID NO: 6541800 - DNA, 16 bp, Homo sapiens
tgtcctttttcctctc

SEQ ID NO: 6541801 - DNA, 21 bp, Homo sapiens
tgtcctttttcctctccacac

SEQ ID NO: 6541802 - DNA, 16 bp, Homo sapiens
tgtcctttttgttatt

SEQ ID NO: 6541803 - DNA, 17 bp, Homo sapiens
tgtcctttttgttatta

SEQ ID NO: 6541804 - DNA, 22 bp, Homo sapiens
tgtcgaaacctacaagatttcc

SEQ ID NO: 6541805 - DNA, 20 bp, Homo sapiens
tgtcgaaggggaggcacact

SEQ ID NO: 6541806 - DNA, 17 bp, Homo sapiens
tgtcgagagctggccaa

SEQ ID NO: 6541807 - DNA, 19 bp, Homo sapiens
tgtcgatatttccatcatt

SEQ ID NO: 6541808 - DNA, 19 bp, Homo sapiens
tgtcgatcaagagaatcaa

SEQ ID NO: 6541809 - DNA, 21 bp, Homo sapiens
tgtcgccacacgcctctgtgt

SEQ ID NO: 6541810 - DNA, 16 bp, Homo sapiens
tgtcgcccacccagct

SEQ ID NO: 6541811 - DNA, 22 bp, Homo sapiens
tgtcgcccacccagctggtcct

SEQ ID NO: 6541812 - DNA, 15 bp, Homo sapiens
tgtcgcccaggctgg

SEQ ID NO: 6541813 - DNA, 16 bp, Homo sapiens
tgtcgcccaggctgga

SEQ ID NO: 6541814 - DNA, 15 bp, Homo sapiens
tgtcgccccaggccc

SEQ ID NO: 6541815 - DNA, 23 bp, Homo sapiens
tgtcgcccctccttttggcctgg

SEQ ID NO: 6541816 - DNA, 13 bp, Homo sapiens
tgtcgcccttctc

SEQ ID NO: 6541817 - DNA, 13 bp, Homo sapiens
tgtcgccgtccct

SEQ ID NO: 6541818 - DNA, 19 bp, Homo sapiens
tgtcgccgtccctctgcct

SEQ ID NO: 6541819 - DNA, 20 bp, Homo sapiens
tgtcgcgccttctccccccc

SEQ ID NO: 6541820 - DNA, 16 bp, Homo sapiens
tgtcgctcaggctgga

SEQ ID NO: 6541821 - DNA, 15 bp, Homo sapiens
tgtcgctgcctccat

SEQ ID NO: 6541822 - DNA, 21 bp, Homo sapiens
tgtcgctgggtcagtgctgga

SEQ ID NO: 6541823 - DNA, 18 bp, Homo sapiens
tgtcgctttctcagtgtg

SEQ ID NO: 6541824 - DNA, 22 bp, Homo sapiens
tgtcggagaggctgtctggggc

SEQ ID NO: 6541825 - DNA, 19 bp, Homo sapiens
tgtcggaggaaagacaaca

SEQ ID NO: 6541826 - DNA, 13 bp, Homo sapiens
tgtcggcaccatg

SEQ ID NO: 6541827 - DNA, 17 bp, Homo sapiens
tgtcggccacaccccag

SEQ ID NO: 6541828 - DNA, 22 bp, Homo sapiens
tgtcggccacaccccagactcc

SEQ ID NO: 6541829 - DNA, 20 bp, Homo sapiens
tgtcggccccaccagtgcct

SEQ ID NO: 6541830 - DNA, 14 bp, Homo sapiens
tgtcggcctctaac

SEQ ID NO: 6541831 - DNA, 22 bp, Homo sapiens
tgtcggcctctaaccccaggcc

SEQ ID NO: 6541832 - DNA, 23 bp, Homo sapiens
tgtcgggaccacatctgtcctca

SEQ ID NO: 6541833 - DNA, 21 bp, Homo sapiens
tgtcgggcaagatagctcctt

SEQ ID NO: 6541834 - DNA, 15 bp, Homo sapiens
tgtcgggcaccagcc

SEQ ID NO: 6541835 - DNA, 14 bp, Homo sapiens
tgtcgggcatgaca

SEQ ID NO: 6541836 - DNA, 22 bp, Homo sapiens
tgtcgggcccgcactcaggagc

SEQ ID NO: 6541837 - DNA, 12 bp, Homo sapiens
tgtcgggccctt

SEQ ID NO: 6541838 - DNA, 22 bp, Homo sapiens
tgtcgggcccttcttgctgccc

SEQ ID NO: 6541839 - DNA, 20 bp, Homo sapiens
tgtcgggctttgtgtgaagg

SEQ ID NO: 6541840 - DNA, 14 bp, Homo sapiens
tgtcggggtggggg

SEQ ID NO: 6541841 - DNA, 19 bp, Homo sapiens
tgtcggggttggggtggga

SEQ ID NO: 6541842 - DNA, 21 bp, Homo sapiens
tgtcggggttggggtgggagg

SEQ ID NO: 6541843 - DNA, 19 bp, Homo sapiens
tgtcggtggctgcctttga

SEQ ID NO: 6541844 - DNA, 14 bp, Homo sapiens
tgtcggtgtgctgt

SEQ ID NO: 6541845 - DNA, 16 bp, Homo sapiens
tgtcgtaaagatttgg

SEQ ID NO: 6541846 - DNA, 17 bp, Homo sapiens
tgtcgtaatttgcactt

SEQ ID NO: 6541847 - DNA, 13 bp, Homo sapiens
tgtcgtccccaga

SEQ ID NO: 6541848 - DNA, 22 bp, Homo sapiens
tgtcgtctctcccaccccctcc

SEQ ID NO: 6541849 - DNA, 18 bp, Homo sapiens
tgtcgtctgactctgggt

SEQ ID NO: 6541850 - DNA, 14 bp, Homo sapiens
tgtcgtctgtgaat

SEQ ID NO: 6541851 - DNA, 23 bp, Homo sapiens
tgtcgtgagtgtctcttgtctaa

SEQ ID NO: 6541852 - DNA, 15 bp, Homo sapiens
tgtcgtgccagtcct

SEQ ID NO: 6541853 - DNA, 16 bp, Homo sapiens
tgtcgtgggatggcat

SEQ ID NO: 6541854 - DNA, 14 bp, Homo sapiens
tgtcgtgtccagcc

SEQ ID NO: 6541855 - DNA, 15 bp, Homo sapiens
tgtcgtgtctgctgt

SEQ ID NO: 6541856 - DNA, 23 bp, Homo sapiens
tgtcgttaaaaagttgtttgttt

SEQ ID NO: 6541857 - DNA, 21 bp, Homo sapiens
tgtcgttcccttgtgtctgtt

SEQ ID NO: 6541858 - DNA, 23 bp, Homo sapiens
tgtcgttcccttgtgtctgttgc

SEQ ID NO: 6541859 - DNA, 14 bp, Homo sapiens
tgtcgtttgtgaac

SEQ ID NO: 6541860 - DNA, 21 bp, Homo sapiens
tgtcgttttgacactgcctag

SEQ ID NO: 6541861 - DNA, 15 bp, Homo sapiens
tgtcgtttttattcc

SEQ ID NO: 6541862 - DNA, 18 bp, Homo sapiens
tgtcgtttttttcttgtg

SEQ ID NO: 6541863 - DNA, 12 bp, Homo sapiens
tgtctaaaaaca

SEQ ID NO: 6541864 - DNA, 13 bp, Homo sapiens
tgtctaaaacaat

SEQ ID NO: 6541865 - DNA, 15 bp, Homo sapiens
tgtctaaaacaataa

SEQ ID NO: 6541866 - DNA, 16 bp, Homo sapiens
tgtctaaaagattctt

SEQ ID NO: 6541867 - DNA, 22 bp, Homo sapiens
tgtctaaaagattctttaaact

SEQ ID NO: 6541868 - DNA, 23 bp, Homo sapiens
tgtctaaaagattctttaaacta

SEQ ID NO: 6541869 - DNA, 22 bp, Homo sapiens
tgtctaaaatgcctcagtgtat

SEQ ID NO: 6541870 - DNA, 14 bp, Homo sapiens
tgtctaaaatgtca

SEQ ID NO: 6541871 - DNA, 16 bp, Homo sapiens
tgtctaaacaatgctg

SEQ ID NO: 6541872 - DNA, 12 bp, Homo sapiens
tgtctaaagatc

SEQ ID NO: 6541873 - DNA, 21 bp, Homo sapiens
tgtctaaagccttaactaaga

SEQ ID NO: 6541874 - DNA, 19 bp, Homo sapiens
tgtctaaagtgtattttca

SEQ ID NO: 6541875 - DNA, 18 bp, Homo sapiens
tgtctaaatttgaatgtt

SEQ ID NO: 6541876 - DNA, 18 bp, Homo sapiens
tgtctaacccccagctgg

SEQ ID NO: 6541877 - DNA, 20 bp, Homo sapiens
tgtctaacctacgaccccag

SEQ ID NO: 6541878 - DNA, 18 bp, Homo sapiens
tgtctaactcagaattat

SEQ ID NO: 6541879 - DNA, 13 bp, Homo sapiens
tgtctaacttaaa

SEQ ID NO: 6541880 - DNA, 22 bp, Homo sapiens
tgtctaactttagaagtgcatt

SEQ ID NO: 6541881 - DNA, 15 bp, Homo sapiens
tgtctaagaaacatt

SEQ ID NO: 6541882 - DNA, 22 bp, Homo sapiens
tgtctaagagatctggtcaaag

SEQ ID NO: 6541883 - DNA, 14 bp, Homo sapiens
tgtctaagatagta

SEQ ID NO: 6541884 - DNA, 21 bp, Homo sapiens
tgtctaagattaatagcattc

SEQ ID NO: 6541885 - DNA, 21 bp, Homo sapiens
tgtctaagcagttttgtaaat

SEQ ID NO: 6541886 - DNA, 18 bp, Homo sapiens
tgtctaatgtattttatt

SEQ ID NO: 6541887 - DNA, 21 bp, Homo sapiens
tgtctaatttgcacctttgtc

SEQ ID NO: 6541888 - DNA, 15 bp, Homo sapiens
tgtctacaaaagcaa

SEQ ID NO: 6541889 - DNA, 23 bp, Homo sapiens
tgtctacacagatgttcacccaa

SEQ ID NO: 6541890 - DNA, 17 bp, Homo sapiens
tgtctacactaagagag

SEQ ID NO: 6541891 - DNA, 18 bp, Homo sapiens
tgtctacagtagctgcta

SEQ ID NO: 6541892 - DNA, 21 bp, Homo sapiens
tgtctacatgaaagtcctcag

SEQ ID NO: 6541893 - DNA, 16 bp, Homo sapiens
tgtctaccatctccct

SEQ ID NO: 6541894 - DNA, 13 bp, Homo sapiens
tgtctacctcaca

SEQ ID NO: 6541895 - DNA, 20 bp, Homo sapiens
tgtctacctcacagaaatgt

SEQ ID NO: 6541896 - DNA, 16 bp, Homo sapiens
tgtctacctctgactt

SEQ ID NO: 6541897 - DNA, 15 bp, Homo sapiens
tgtctacctggcaga

SEQ ID NO: 6541898 - DNA, 19 bp, Homo sapiens
tgtctactcagcatttgat

SEQ ID NO: 6541899 - DNA, 22 bp, Homo sapiens
tgtctactcagcatttgattaa

SEQ ID NO: 6541900 - DNA, 15 bp, Homo sapiens
tgtctactcctagaa

SEQ ID NO: 6541901 - DNA, 17 bp, Homo sapiens
tgtctactcctagaaga

SEQ ID NO: 6541902 - DNA, 13 bp, Homo sapiens
tgtctactcctca

SEQ ID NO: 6541903 - DNA, 14 bp, Homo sapiens
tgtctactgaagct

SEQ ID NO: 6541904 - DNA, 13 bp, Homo sapiens
tgtctactgcttg

SEQ ID NO: 6541905 - DNA, 14 bp, Homo sapiens
tgtctactggacaa

SEQ ID NO: 6541906 - DNA, 17 bp, Homo sapiens
tgtctactttctcttgt

SEQ ID NO: 6541907 - DNA, 22 bp, Homo sapiens
ttctttaaccctcactgggact

SEQ ID NO: 6541908 - DNA, 14 bp, Homo sapiens
ttctttaacttaat

SEQ ID NO: 6541909 - DNA, 21 bp, Homo sapiens
ttctttaagaattacaggttg

SEQ ID NO: 6541910 - DNA, 22 bp, Homo sapiens
ttctttaaggaagaataaaaaa

SEQ ID NO: 6541911 - DNA, 13 bp, Homo sapiens
ttctttaaggaga

SEQ ID NO: 6541912 - DNA, 14 bp, Homo sapiens
ttctttaatatgat

SEQ ID NO: 6541913 - DNA, 12 bp, Homo sapiens
ttctttaatgct

SEQ ID NO: 6541914 - DNA, 12 bp, Homo sapiens
ttctttaatttt

SEQ ID NO: 6541915 - DNA, 17 bp, Homo sapiens
ttctttaatttttctgt

SEQ ID NO: 6541916 - DNA, 20 bp, Homo sapiens
ttctttacaaaatgaatgca

SEQ ID NO: 6541917 - DNA, 16 bp, Homo sapiens
ttctttactaaagata

SEQ ID NO: 6541918 - DNA, 20 bp, Homo sapiens
ttctttactatgtttctcag

SEQ ID NO: 6541919 - DNA, 18 bp, Homo sapiens
ttctttactattaaaata

SEQ ID NO: 6541920 - DNA, 17 bp, Homo sapiens
ttctttactcctttggc

SEQ ID NO: 6541921 - DNA, 22 bp, Homo sapiens
ttctttactggtgatttctgag

SEQ ID NO: 6541922 - DNA, 13 bp, Homo sapiens
ttctttagaattt

SEQ ID NO: 6541923 - DNA, 20 bp, Homo sapiens
ttctttagagaactgaaaag

SEQ ID NO: 6541924 - DNA, 21 bp, Homo sapiens
ttctttagagaactgaaaaga

SEQ ID NO: 6541925 - DNA, 12 bp, Homo sapiens
ttctttagagat

SEQ ID NO: 6541926 - DNA, 18 bp, Homo sapiens
ttctttagagcattgcca

SEQ ID NO: 6541927 - DNA, 15 bp, Homo sapiens
ttctttagaggcttt

SEQ ID NO: 6541928 - DNA, 18 bp, Homo sapiens
ttctttagaggctttcaa

SEQ ID NO: 6541929 - DNA, 23 bp, Homo sapiens
ttctttagaggctttcaaatgta

SEQ ID NO: 6541930 - DNA, 16 bp, Homo sapiens
ttctttagatgccaaa

SEQ ID NO: 6541931 - DNA, 22 bp, Homo sapiens
ttctttagcatttttatgcaga

SEQ ID NO: 6541932 - DNA, 16 bp, Homo sapiens
ttctttagctgtcact

SEQ ID NO: 6541933 - DNA, 19 bp, Homo sapiens
ttctttagcttacctgggc

SEQ ID NO: 6541934 - DNA, 14 bp, Homo sapiens
ttctttaggagatt

SEQ ID NO: 6541935 - DNA, 20 bp, Homo sapiens
ttctttaggtgcctcctgtc

SEQ ID NO: 6541936 - DNA, 22 bp, Homo sapiens
ttctttagtactcaatgtttct

SEQ ID NO: 6541937 - DNA, 13 bp, Homo sapiens
ttctttagtcatt

SEQ ID NO: 6541938 - DNA, 19 bp, Homo sapiens
ttctttagtcatttaagaa

SEQ ID NO: 6541939 - DNA, 18 bp, Homo sapiens
ttctttataaaaagtgaa

SEQ ID NO: 6541940 - DNA, 16 bp, Homo sapiens
ttctttataaaatgta

SEQ ID NO: 6541941 - DNA, 11 bp, Homo sapiens
ttctttataac

SEQ ID NO: 6541942 - DNA, 22 bp, Homo sapiens
ttctttataagaaagcctgagt

SEQ ID NO: 6541943 - DNA, 14 bp, Homo sapiens
ttctttataattga

SEQ ID NO: 6541944 - DNA, 15 bp, Homo sapiens
ttctttatactgtaa

SEQ ID NO: 6541945 - DNA, 13 bp, Homo sapiens
ttctttatagtga

SEQ ID NO: 6541946 - DNA, 19 bp, Homo sapiens
ttctttatagtgaagtgtt

SEQ ID NO: 6541947 - DNA, 20 bp, Homo sapiens
ttctttatagtgaagtgtta

SEQ ID NO: 6541948 - DNA, 21 bp, Homo sapiens
ttctttatatacaataatgga

SEQ ID NO: 6541949 - DNA, 15 bp, Homo sapiens
ttctttatatacctt

SEQ ID NO: 6541950 - DNA, 18 bp, Homo sapiens
ttctttatatatggacag

SEQ ID NO: 6541951 - DNA, 23 bp, Homo sapiens
ttctttatatatggacagcttta

SEQ ID NO: 6541952 - DNA, 21 bp, Homo sapiens
ttctttatatggaacgcattt

SEQ ID NO: 6541953 - DNA, 18 bp, Homo sapiens
ttctttattctgcggtga

SEQ ID NO: 6541954 - DNA, 15 bp, Homo sapiens
ttctttattgcacta

SEQ ID NO: 6541955 - DNA, 12 bp, Homo sapiens
ttctttcaagat

SEQ ID NO: 6541956 - DNA, 23 bp, Homo sapiens
ttctttcaagggctttcctgtgc

SEQ ID NO: 6541957 - DNA, 22 bp, Homo sapiens
ttctttcaagtgaatctaaaag

SEQ ID NO: 6541958 - DNA, 15 bp, Homo sapiens
ttctttcaattctgt

SEQ ID NO: 6541959 - DNA, 14 bp, Homo sapiens
ttctttcacaagta

SEQ ID NO: 6541960 - DNA, 16 bp, Homo sapiens
ttctttcacccatcct

SEQ ID NO: 6541961 - DNA, 17 bp, Homo sapiens
ttctttcatacattata

SEQ ID NO: 6541962 - DNA, 22 bp, Homo sapiens
ttctttcatctggggatgacaa

SEQ ID NO: 6541963 - DNA, 13 bp, Homo sapiens
ttctttcatttct

SEQ ID NO: 6541964 - DNA, 14 bp, Homo sapiens
ttctttccaaagta

SEQ ID NO: 6541965 - DNA, 21 bp, Homo sapiens
ttctttccaaagtacactgtt

SEQ ID NO: 6541966 - DNA, 12 bp, Homo sapiens
ttctttccatga

SEQ ID NO: 6541967 - DNA, 15 bp, Homo sapiens
ttctttccatgcagt

SEQ ID NO: 6541968 - DNA, 21 bp, Homo sapiens
ttctttccattcttcttgcta

SEQ ID NO: 6541969 - DNA, 13 bp, Homo sapiens
ttctttcccacac

SEQ ID NO: 6541970 - DNA, 14 bp, Homo sapiens
ttctttcccatgta

SEQ ID NO: 6541971 - DNA, 10 bp, Homo sapiens
ttctttcccc

SEQ ID NO: 6541972 - DNA, 19 bp, Homo sapiens
ttctttcccttagtgactc

SEQ ID NO: 6541973 - DNA, 14 bp, Homo sapiens
ttctttcccttcct

SEQ ID NO: 6541974 - DNA, 11 bp, Homo sapiens
ttctttcctcc

SEQ ID NO: 6541975 - DNA, 21 bp, Homo sapiens
ttctttcctccccctgcaact

SEQ ID NO: 6541976 - DNA, 16 bp, Homo sapiens
ttctttcctctttctg

SEQ ID NO: 6541977 - DNA, 20 bp, Homo sapiens
ttctttcctctttctgctct

SEQ ID NO: 6541978 - DNA, 21 bp, Homo sapiens
ttctttcctctttctgctctg

SEQ ID NO: 6541979 - DNA, 13 bp, Homo sapiens
ttctttcctgcct

SEQ ID NO: 6541980 - DNA, 15 bp, Homo sapiens
ttctttcctttaaaa

SEQ ID NO: 6541981 - DNA, 13 bp, Homo sapiens
ttctttcctttcc

SEQ ID NO: 6541982 - DNA, 17 bp, Homo sapiens
ttctttctaactgtagc

SEQ ID NO: 6541983 - DNA, 16 bp, Homo sapiens
ttctttctaatacaag

SEQ ID NO: 6541984 - DNA, 14 bp, Homo sapiens
ttctttctatgtag

SEQ ID NO: 6541985 - DNA, 17 bp, Homo sapiens
ttctttctattttcaca

SEQ ID NO: 6541986 - DNA, 13 bp, Homo sapiens
ttctttctcccta

SEQ ID NO: 6541987 - DNA, 12 bp, Homo sapiens
ttctttctctaa

SEQ ID NO: 6541988 - DNA, 13 bp, Homo sapiens
ttctttctcttcc

SEQ ID NO: 6541989 - DNA, 14 bp, Homo sapiens
ttctttctcttccc

SEQ ID NO: 6541990 - DNA, 13 bp, Homo sapiens
ttctttctgctat

SEQ ID NO: 6541991 - DNA, 12 bp, Homo sapiens
ttctttctggct

SEQ ID NO: 6541992 - DNA, 22 bp, Homo sapiens
ttctttctggctatgcatttga

SEQ ID NO: 6541993 - DNA, 17 bp, Homo sapiens
ttctttctgtctccctt

SEQ ID NO: 6541994 - DNA, 14 bp, Homo sapiens
ttctttctgtctct

SEQ ID NO: 6541995 - DNA, 12 bp, Homo sapiens
ttctttcttcct

SEQ ID NO: 6541996 - DNA, 14 bp, Homo sapiens
ttctttcttcctct

SEQ ID NO: 6541997 - DNA, 14 bp, Homo sapiens
ttctttcttgctgg

SEQ ID NO: 6541998 - DNA, 14 bp, Homo sapiens
ttctttcttggtgc

SEQ ID NO: 6541999 - DNA, 15 bp, Homo sapiens
ttctttctttcctta

SEQ ID NO: 6542000 - DNA, 18 bp, Homo sapiens
ttctttcttttgtgttgg

SEQ ID NO: 6542001 - DNA, 17 bp, Homo sapiens
ttctttctttttctgga

SEQ ID NO: 6542002 - DNA, 19 bp, Homo sapiens
ttctttgaaaaaaaataaa

SEQ ID NO: 6542003 - DNA, 23 bp, Homo sapiens
ttctttgaaaatagttattcagt

SEQ ID NO: 6542004 - DNA, 12 bp, Homo sapiens
ttctttgaagaa

SEQ ID NO: 6542005 - DNA, 18 bp, Homo sapiens
ttctttgaataaatgtca

SEQ ID NO: 6542006 - DNA, 15 bp, Homo sapiens
ttctttgaatttact

SEQ ID NO: 6542007 - DNA, 16 bp, Homo sapiens
ttctttgaattttcat

SEQ ID NO: 6542008 - DNA, 18 bp, Homo sapiens
ttctttgaattttcattt

SEQ ID NO: 6542009 - DNA, 18 bp, Homo sapiens
ttctttgaccaaactgtg

SEQ ID NO: 6542010 - DNA, 22 bp, Homo sapiens
ttctttgaccaaactgtgggta

SEQ ID NO: 6542011 - DNA, 18 bp, Homo sapiens
ttctttgaccagatcttt

SEQ ID NO: 6542012 - DNA, 21 bp, Homo sapiens
ttctttgacctcttctctcct

SEQ ID NO: 6542013 - DNA, 21 bp, Homo sapiens
ttctttgagggactgcctctg

SEQ ID NO: 6542014 - DNA, 16 bp, Homo sapiens
ttctttgataatgtta

SEQ ID NO: 6542015 - DNA, 22 bp, Homo sapiens
ttctttgataatgttaaatttg

SEQ ID NO: 6542016 - DNA, 17 bp, Homo sapiens
ttctttgatcatgaata

SEQ ID NO: 6542017 - DNA, 18 bp, Homo sapiens
ttctttgatgttaacaca

SEQ ID NO: 6542018 - DNA, 13 bp, Homo sapiens
ttctttgattctc

SEQ ID NO: 6542019 - DNA, 23 bp, Homo sapiens
ttctttgattctccttttatgtg

SEQ ID NO: 6542020 - DNA, 12 bp, Homo sapiens
ttctttgcaaag

SEQ ID NO: 6542021 - DNA, 14 bp, Homo sapiens
ttctttgcaccaaa

SEQ ID NO: 6542022 - DNA, 19 bp, Homo sapiens
ttctttgcactttttctta

SEQ ID NO: 6542023 - DNA, 14 bp, Homo sapiens
ttctttgccacctt

SEQ ID NO: 6542024 - DNA, 14 bp, Homo sapiens
ttctttgcctgttc

SEQ ID NO: 6542025 - DNA, 13 bp, Homo sapiens
ttctttgctagtt

SEQ ID NO: 6542026 - DNA, 22 bp, Homo sapiens
ttctttgctagttggagtgctt

SEQ ID NO: 6542027 - DNA, 17 bp, Homo sapiens
ttctttgctgcccctgt

SEQ ID NO: 6542028 - DNA, 16 bp, Homo sapiens
ttctttgctgtaagat

SEQ ID NO: 6542029 - DNA, 22 bp, Homo sapiens
ttctttgcttgaacacagtatt

SEQ ID NO: 6542030 - DNA, 15 bp, Homo sapiens
ttctttgctttctcg

SEQ ID NO: 6542031 - DNA, 20 bp, Homo sapiens
ttctttggagttaaaatgca

SEQ ID NO: 6542032 - DNA, 21 bp, Homo sapiens
ttctttggattctaaatacat

SEQ ID NO: 6542033 - DNA, 22 bp, Homo sapiens
ttctttggccccttgctggagt

SEQ ID NO: 6542034 - DNA, 20 bp, Homo sapiens
ttctttggcctacattcttt

SEQ ID NO: 6542035 - DNA, 20 bp, Homo sapiens
ttctttgggaatatttgaat

SEQ ID NO: 6542036 - DNA, 13 bp, Homo sapiens
ttctttgggccag

SEQ ID NO: 6542037 - DNA, 21 bp, Homo sapiens
ttctttggggaaaaattcttg

SEQ ID NO: 6542038 - DNA, 20 bp, Homo sapiens
ttctttgggggtggaaaagg

SEQ ID NO: 6542039 - DNA, 19 bp, Homo sapiens
ttctttggtaggtaaatct

SEQ ID NO: 6542040 - DNA, 20 bp, Homo sapiens
ttctttggttccatgttgac

SEQ ID NO: 6542041 - DNA, 22 bp, Homo sapiens
ttctttggtttcccaagagcta

SEQ ID NO: 6542042 - DNA, 14 bp, Homo sapiens
ttctttgtaaaggt

SEQ ID NO: 6542043 - DNA, 15 bp, Homo sapiens
ttctttgtaaaggtc

SEQ ID NO: 6542044 - DNA, 16 bp, Homo sapiens
ttctttgtaaaggtca

SEQ ID NO: 6542045 - DNA, 13 bp, Homo sapiens
ttctttgtaatga

SEQ ID NO: 6542046 - DNA, 21 bp, Homo sapiens
ttctttgtagaataaatggtt

SEQ ID NO: 6542047 - DNA, 15 bp, Homo sapiens
ttctttgtagcattt

SEQ ID NO: 6542048 - DNA, 17 bp, Homo sapiens
ttctttgtatcttaaat

SEQ ID NO: 6542049 - DNA, 18 bp, Homo sapiens
ttctttgtattaccaaag

SEQ ID NO: 6542050 - DNA, 22 bp, Homo sapiens
ttctttgtcattcagttctagg

SEQ ID NO: 6542051 - DNA, 14 bp, Homo sapiens
ttctttgtgcctga

SEQ ID NO: 6542052 - DNA, 15 bp, Homo sapiens
ttctttgtgcctttg

SEQ ID NO: 6542053 - DNA, 23 bp, Homo sapiens
ttctttgtggtctttttcctgaa

SEQ ID NO: 6542054 - DNA, 19 bp, Homo sapiens
ttctttgtgtagctttgct

SEQ ID NO: 6542055 - DNA, 18 bp, Homo sapiens
ttctttgtgtagtatctt

SEQ ID NO: 6542056 - DNA, 16 bp, Homo sapiens
ttctttgttacaggca

SEQ ID NO: 6542057 - DNA, 13 bp, Homo sapiens
ttctttgttcctg

SEQ ID NO: 6542058 - DNA, 12 bp, Homo sapiens
ttctttgttctt

SEQ ID NO: 6542059 - DNA, 12 bp, Homo sapiens
ttctttgttgct

SEQ ID NO: 6542060 - DNA, 13 bp, Homo sapiens
ttctttgtttcct

SEQ ID NO: 6542061 - DNA, 12 bp, Homo sapiens
ttctttgtttct

SEQ ID NO: 6542062 - DNA, 20 bp, Homo sapiens
ttctttgtttctttcttcct

SEQ ID NO: 6542063 - DNA, 14 bp, Homo sapiens
ttcttttaaacata

SEQ ID NO: 6542064 - DNA, 17 bp, Homo sapiens
ttcttttaagaatcaat

SEQ ID NO: 6542065 - DNA, 22 bp, Homo sapiens
ttcttttaagcatttgtatatt

SEQ ID NO: 6542066 - DNA, 17 bp, Homo sapiens
ttcttttaagccctgct

SEQ ID NO: 6542067 - DNA, 18 bp, Homo sapiens
ttcttttaagccctgctc

SEQ ID NO: 6542068 - DNA, 13 bp, Homo sapiens
ttcttttaagtat

SEQ ID NO: 6542069 - DNA, 13 bp, Homo sapiens
ttcttttaatttt

SEQ ID NO: 6542070 - DNA, 14 bp, Homo sapiens
ttcttttacagact

SEQ ID NO: 6542071 - DNA, 22 bp, Homo sapiens
ttcttttaccccacgaagacat

SEQ ID NO: 6542072 - DNA, 15 bp, Homo sapiens
ttcttttactatctt

SEQ ID NO: 6542073 - DNA, 17 bp, Homo sapiens
ttcttttactatctttt

SEQ ID NO: 6542074 - DNA, 15 bp, Homo sapiens
ttcttttagaaaagg

SEQ ID NO: 6542075 - DNA, 13 bp, Homo sapiens
ttcttttagagag

SEQ ID NO: 6542076 - DNA, 18 bp, Homo sapiens
ttcttttagtcagaaatg

SEQ ID NO: 6542077 - DNA, 20 bp, Homo sapiens
ttcttttagtcagaaatgat

SEQ ID NO: 6542078 - DNA, 21 bp, Homo sapiens
ttcttttagtcagaaatgatt

SEQ ID NO: 6542079 - DNA, 21 bp, Homo sapiens
ttcttttataaaaaaaatgaa

SEQ ID NO: 6542080 - DNA, 22 bp, Homo sapiens
ttcttttataataatgaatgtg

SEQ ID NO: 6542081 - DNA, 15 bp, Homo sapiens
ttcttttatataact

SEQ ID NO: 6542082 - DNA, 16 bp, Homo sapiens
ttcttttatatataaa

SEQ ID NO: 6542083 - DNA, 18 bp, Homo sapiens
ttcttttatatataaaat

SEQ ID NO: 6542084 - DNA, 14 bp, Homo sapiens
ttcttttatatctg

SEQ ID NO: 6542085 - DNA, 17 bp, Homo sapiens
ttcttttattatcagtt

SEQ ID NO: 6542086 - DNA, 16 bp, Homo sapiens
ttcttttcaatgcaat

SEQ ID NO: 6542087 - DNA, 12 bp, Homo sapiens
ttcttttcacat

SEQ ID NO: 6542088 - DNA, 22 bp, Homo sapiens
tgtctactttttaatttttaag

SEQ ID NO: 6542089 - DNA, 22 bp, Homo sapiens
tgtctagaaagtaagaaaacaa

SEQ ID NO: 6542090 - DNA, 12 bp, Homo sapiens
tgtctagaatgt

SEQ ID NO: 6542091 - DNA, 22 bp, Homo sapiens
tgtctagagaacactgtgctct

SEQ ID NO: 6542092 - DNA, 13 bp, Homo sapiens
tgtctagagcaac

SEQ ID NO: 6542093 - DNA, 22 bp, Homo sapiens
tgtctagagcctcttggggaag

SEQ ID NO: 6542094 - DNA, 16 bp, Homo sapiens
tgtctagagctcatca

SEQ ID NO: 6542095 - DNA, 14 bp, Homo sapiens
tgtctagaggcaac

SEQ ID NO: 6542096 - DNA, 14 bp, Homo sapiens
tgtctagagtagct

SEQ ID NO: 6542097 - DNA, 14 bp, Homo sapiens
tgtctagatggatg

SEQ ID NO: 6542098 - DNA, 17 bp, Homo sapiens
tgtctagatggatgaat

SEQ ID NO: 6542099 - DNA, 19 bp, Homo sapiens
tgtctagatttatcagagt

SEQ ID NO: 6542100 - DNA, 12 bp, Homo sapiens
tgtctagatttt

SEQ ID NO: 6542101 - DNA, 15 bp, Homo sapiens
tgtctagattttgaa

SEQ ID NO: 6542102 - DNA, 17 bp, Homo sapiens
tgtctagattttgaaaa

SEQ ID NO: 6542103 - DNA, 18 bp, Homo sapiens
tgtctagattttgaaaaa

SEQ ID NO: 6542104 - DNA, 15 bp, Homo sapiens
tgtctagcaaagcca

SEQ ID NO: 6542105 - DNA, 18 bp, Homo sapiens
tgtctagcacttccttgc

SEQ ID NO: 6542106 - DNA, 20 bp, Homo sapiens
tgtctagcatgccaacaaga

SEQ ID NO: 6542107 - DNA, 15 bp, Homo sapiens
tgtctagccactccc

SEQ ID NO: 6542108 - DNA, 18 bp, Homo sapiens
tgtctagccactccctcc

SEQ ID NO: 6542109 - DNA, 20 bp, Homo sapiens
tgtctagccttagtcaataa

SEQ ID NO: 6542110 - DNA, 19 bp, Homo sapiens
tgtctaggaaggtgtgatg

SEQ ID NO: 6542111 - DNA, 17 bp, Homo sapiens
tgtctaggcaggacctg

SEQ ID NO: 6542112 - DNA, 22 bp, Homo sapiens
tgtctaggtagagatattggaa

SEQ ID NO: 6542113 - DNA, 18 bp, Homo sapiens
tgtctaggtcagtaccca

SEQ ID NO: 6542114 - DNA, 22 bp, Homo sapiens
tgtctaggttaaagctaaactg

SEQ ID NO: 6542115 - DNA, 17 bp, Homo sapiens
tgtctagtcattgtcat

SEQ ID NO: 6542116 - DNA, 22 bp, Homo sapiens
tgtctagtgtttttttccctct

SEQ ID NO: 6542117 - DNA, 15 bp, Homo sapiens
tgtctagttgtttga

SEQ ID NO: 6542118 - DNA, 14 bp, Homo sapiens
tgtctagtttctag

SEQ ID NO: 6542119 - DNA, 16 bp, Homo sapiens
tgtctagtttgcatac

SEQ ID NO: 6542120 - DNA, 21 bp, Homo sapiens
tgtctagtttgcatacttcct

SEQ ID NO: 6542121 - DNA, 22 bp, Homo sapiens
tgtctagtttgcatacttcctg

SEQ ID NO: 6542122 - DNA, 17 bp, Homo sapiens
tgtctataagtatataa

SEQ ID NO: 6542123 - DNA, 20 bp, Homo sapiens
tgtctatatttaaatcattt

SEQ ID NO: 6542124 - DNA, 15 bp, Homo sapiens
tgtctatcatatgaa

SEQ ID NO: 6542125 - DNA, 15 bp, Homo sapiens
tgtctatctctaata

SEQ ID NO: 6542126 - DNA, 15 bp, Homo sapiens
tgtctatgaactaga

SEQ ID NO: 6542127 - DNA, 18 bp, Homo sapiens
tgtctatgaagttgctgt

SEQ ID NO: 6542128 - DNA, 20 bp, Homo sapiens
tgtctatgatgttgctgttc

SEQ ID NO: 6542129 - DNA, 16 bp, Homo sapiens
tgtctatgcagcctgc

SEQ ID NO: 6542130 - DNA, 19 bp, Homo sapiens
tgtctatggggatacatga

SEQ ID NO: 6542131 - DNA, 19 bp, Homo sapiens
tgtctatgtagctgaaaat

SEQ ID NO: 6542132 - DNA, 19 bp, Homo sapiens
tgtctattaaaattctgat

SEQ ID NO: 6542133 - DNA, 17 bp, Homo sapiens
tgtctattattatgaag

SEQ ID NO: 6542134 - DNA, 19 bp, Homo sapiens
tgtctattcaaaatatcaa

SEQ ID NO: 6542135 - DNA, 16 bp, Homo sapiens
tgtctattccattccc

SEQ ID NO: 6542136 - DNA, 19 bp, Homo sapiens
tgtctattctgagccttga

SEQ ID NO: 6542137 - DNA, 14 bp, Homo sapiens
tgtctatttctgct

SEQ ID NO: 6542138 - DNA, 22 bp, Homo sapiens
tgtctattttgtaactgtaaag

SEQ ID NO: 6542139 - DNA, 23 bp, Homo sapiens
tgtctcaaaaaaaaaaaaaacaa

SEQ ID NO: 6542140 - DNA, 21 bp, Homo sapiens
tgtctcaaaaaaagaaaaaga

SEQ ID NO: 6542141 - DNA, 18 bp, Homo sapiens
tgtctcaaaaataatata

SEQ ID NO: 6542142 - DNA, 21 bp, Homo sapiens
tgtctcaaaaatccttatgca

SEQ ID NO: 6542143 - DNA, 14 bp, Homo sapiens
tgtctcaaaataaa

SEQ ID NO: 6542144 - DNA, 15 bp, Homo sapiens
tgtctcaaaataaaa

SEQ ID NO: 6542145 - DNA, 18 bp, Homo sapiens
tgtctcaaaggagctttc

SEQ ID NO: 6542146 - DNA, 19 bp, Homo sapiens
tgtctcaaaggagctttct

SEQ ID NO: 6542147 - DNA, 17 bp, Homo sapiens
tgtctcaagagggcact

SEQ ID NO: 6542148 - DNA, 19 bp, Homo sapiens
tgtctcaagagggcactgg

SEQ ID NO: 6542149 - DNA, 19 bp, Homo sapiens
tgtctcaagctcttcctta

SEQ ID NO: 6542150 - DNA, 16 bp, Homo sapiens
tgtctcaatagctcca

SEQ ID NO: 6542151 - DNA, 19 bp, Homo sapiens
tgtctcaatgctcataacg

SEQ ID NO: 6542152 - DNA, 13 bp, Homo sapiens
tgtctcacagagg

SEQ ID NO: 6542153 - DNA, 13 bp, Homo sapiens
tgtctcaccagct

SEQ ID NO: 6542154 - DNA, 23 bp, Homo sapiens
tgtctcaccagctcagccccggc

SEQ ID NO: 6542155 - DNA, 16 bp, Homo sapiens
tgtctcacctggactt

SEQ ID NO: 6542156 - DNA, 16 bp, Homo sapiens
tgtctcacgattccag

SEQ ID NO: 6542157 - DNA, 15 bp, Homo sapiens
tgtctcacgcagcca

SEQ ID NO: 6542158 - DNA, 20 bp, Homo sapiens
tgtctcactaaagcatgaaa

SEQ ID NO: 6542159 - DNA, 23 bp, Homo sapiens
tgtctcactaaagcatgaaatgt

SEQ ID NO: 6542160 - DNA, 17 bp, Homo sapiens
tgtctcactgaaacatt

SEQ ID NO: 6542161 - DNA, 13 bp, Homo sapiens
tgtctcactgttc

SEQ ID NO: 6542162 - DNA, 14 bp, Homo sapiens
tgtctcactgttct

SEQ ID NO: 6542163 - DNA, 16 bp, Homo sapiens
tgtctcactgttctgc

SEQ ID NO: 6542164 - DNA, 13 bp, Homo sapiens
tgtctcactgttt

SEQ ID NO: 6542165 - DNA, 14 bp, Homo sapiens
tgtctcacttttta

SEQ ID NO: 6542166 - DNA, 12 bp, Homo sapiens
tgtctcagagcc

SEQ ID NO: 6542167 - DNA, 16 bp, Homo sapiens
tgtctcagattgacct

SEQ ID NO: 6542168 - DNA, 23 bp, Homo sapiens
tgtctcagccgagcccaggggag

SEQ ID NO: 6542169 - DNA, 18 bp, Homo sapiens
tgtctcagcctcctgagt

SEQ ID NO: 6542170 - DNA, 17 bp, Homo sapiens
tgtctcaggactctgaa

SEQ ID NO: 6542171 - DNA, 22 bp, Homo sapiens
tgtctcaggagcaccctgtctt

SEQ ID NO: 6542172 - DNA, 19 bp, Homo sapiens
tgtctcaggagtagtctca

SEQ ID NO: 6542173 - DNA, 16 bp, Homo sapiens
tgtctcaggctcaagt

SEQ ID NO: 6542174 - DNA, 13 bp, Homo sapiens
tgtctcaggctgc

SEQ ID NO: 6542175 - DNA, 11 bp, Homo sapiens
tgtctcagtga

SEQ ID NO: 6542176 - DNA, 15 bp, Homo sapiens
tgtctcagttggaaa

SEQ ID NO: 6542177 - DNA, 14 bp, Homo sapiens
tgtctcatagaact

SEQ ID NO: 6542178 - DNA, 20 bp, Homo sapiens
tgtctcatatatttggagtt

SEQ ID NO: 6542179 - DNA, 19 bp, Homo sapiens
tgtctcatccacataagca

SEQ ID NO: 6542180 - DNA, 17 bp, Homo sapiens
tgtctcatccatcatca

SEQ ID NO: 6542181 - DNA, 14 bp, Homo sapiens
tgtctcatcctcct

SEQ ID NO: 6542182 - DNA, 19 bp, Homo sapiens
tgtctcatcctcctggaac

SEQ ID NO: 6542183 - DNA, 22 bp, Homo sapiens
tgtctcatgatgtaaaaaatat

SEQ ID NO: 6542184 - DNA, 14 bp, Homo sapiens
tgtctcatggtccc

SEQ ID NO: 6542185 - DNA, 12 bp, Homo sapiens
tgtctcatgttt

SEQ ID NO: 6542186 - DNA, 19 bp, Homo sapiens
tgtctcatttaggactggg

SEQ ID NO: 6542187 - DNA, 14 bp, Homo sapiens
tgtctcatttgcca

SEQ ID NO: 6542188 - DNA, 14 bp, Homo sapiens
tgtctcattttaat

SEQ ID NO: 6542189 - DNA, 17 bp, Homo sapiens
tgtctccaaagaagata

SEQ ID NO: 6542190 - DNA, 17 bp, Homo sapiens
tgtctccaaccccccag

SEQ ID NO: 6542191 - DNA, 20 bp, Homo sapiens
tgtctccaaccccccagcac

SEQ ID NO: 6542192 - DNA, 23 bp, Homo sapiens
tgtctccaaccccccagcactga

SEQ ID NO: 6542193 - DNA, 16 bp, Homo sapiens
tgtctccaagaatgtt

SEQ ID NO: 6542194 - DNA, 20 bp, Homo sapiens
tgtctccaagcctctgtctt

SEQ ID NO: 6542195 - DNA, 15 bp, Homo sapiens
tgtctccaagtagtc

SEQ ID NO: 6542196 - DNA, 12 bp, Homo sapiens
tgtctccagacc

SEQ ID NO: 6542197 - DNA, 14 bp, Homo sapiens
tgtctccagacccc

SEQ ID NO: 6542198 - DNA, 11 bp, Homo sapiens
tgtctccagct

SEQ ID NO: 6542199 - DNA, 12 bp, Homo sapiens
tgtctccagctg

SEQ ID NO: 6542200 - DNA, 16 bp, Homo sapiens
tgtctccagctgattt

SEQ ID NO: 6542201 - DNA, 13 bp, Homo sapiens
tgtctccagctgc

SEQ ID NO: 6542202 - DNA, 15 bp, Homo sapiens
tgtctccagctgcct

SEQ ID NO: 6542203 - DNA, 17 bp, Homo sapiens
tgtctccagctgcctgg

SEQ ID NO: 6542204 - DNA, 13 bp, Homo sapiens
tgtctccaggcag

SEQ ID NO: 6542205 - DNA, 18 bp, Homo sapiens
tgtctccagggcccccac

SEQ ID NO: 6542206 - DNA, 17 bp, Homo sapiens
tgtctccaggtaacttt

SEQ ID NO: 6542207 - DNA, 17 bp, Homo sapiens
tgtctccataatgccac

SEQ ID NO: 6542208 - DNA, 19 bp, Homo sapiens
tgtctccataatgccactg

SEQ ID NO: 6542209 - DNA, 18 bp, Homo sapiens
tgtctccatgctggatac

SEQ ID NO: 6542210 - DNA, 10 bp, Homo sapiens
tgtctcccaa

SEQ ID NO: 6542211 - DNA, 16 bp, Homo sapiens
tgtctcccacacccac

SEQ ID NO: 6542212 - DNA, 15 bp, Homo sapiens
tgtctcccacttccc

SEQ ID NO: 6542213 - DNA, 17 bp, Homo sapiens
tgtctcccagggacatg

SEQ ID NO: 6542214 - DNA, 19 bp, Homo sapiens
tgtctcccgtgcatgctct

SEQ ID NO: 6542215 - DNA, 21 bp, Homo sapiens
tgtctcccgtgcatgctctgc

SEQ ID NO: 6542216 - DNA, 20 bp, Homo sapiens
tgtctccctataatgctgga

SEQ ID NO: 6542217 - DNA, 23 bp, Homo sapiens
tgtctccctccccaaatggctgc

SEQ ID NO: 6542218 - DNA, 17 bp, Homo sapiens
tgtctccctcccctctc

SEQ ID NO: 6542219 - DNA, 14 bp, Homo sapiens
tgtctccctcctga

SEQ ID NO: 6542220 - DNA, 16 bp, Homo sapiens
tgtctccctggccctc

SEQ ID NO: 6542221 - DNA, 19 bp, Homo sapiens
tgtctccctggttgcctct

SEQ ID NO: 6542222 - DNA, 15 bp, Homo sapiens
tgtctcccttctctc

SEQ ID NO: 6542223 - DNA, 16 bp, Homo sapiens
tgtctcctaagcacct

SEQ ID NO: 6542224 - DNA, 14 bp, Homo sapiens
tgtctcctactcct

SEQ ID NO: 6542225 - DNA, 15 bp, Homo sapiens
tgtctcctactctgt

SEQ ID NO: 6542226 - DNA, 12 bp, Homo sapiens
tgtctcctcaac

SEQ ID NO: 6542227 - DNA, 20 bp, Homo sapiens
tgtctcctcaagcctgtggg

SEQ ID NO: 6542228 - DNA, 20 bp, Homo sapiens
tgtctcctcccaggtttctt

SEQ ID NO: 6542229 - DNA, 18 bp, Homo sapiens
tgtctcctccctgggcta

SEQ ID NO: 6542230 - DNA, 15 bp, Homo sapiens
tgtctcctctctggt

SEQ ID NO: 6542231 - DNA, 15 bp, Homo sapiens
tgtctcctctgtcag

SEQ ID NO: 6542232 - DNA, 17 bp, Homo sapiens
tgtctcctgtccccggc

SEQ ID NO: 6542233 - DNA, 11 bp, Homo sapiens
tgtctccttcc

SEQ ID NO: 6542234 - DNA, 20 bp, Homo sapiens
tgtctccttcccactgtcct

SEQ ID NO: 6542235 - DNA, 21 bp, Homo sapiens
tgtctcctttcaccccagggc

SEQ ID NO: 6542236 - DNA, 18 bp, Homo sapiens
tgtctcctttctgactgt

SEQ ID NO: 6542237 - DNA, 19 bp, Homo sapiens
tgtctcctttgcaggctca

SEQ ID NO: 6542238 - DNA, 14 bp, Homo sapiens
tgtctcctttgctc

SEQ ID NO: 6542239 - DNA, 18 bp, Homo sapiens
tgtctcctttgctcttgc

SEQ ID NO: 6542240 - DNA, 15 bp, Homo sapiens
tgtctcgaactattt

SEQ ID NO: 6542241 - DNA, 19 bp, Homo sapiens
tgtctcgagcgccctgcag

SEQ ID NO: 6542242 - DNA, 20 bp, Homo sapiens
tgtctcgagcgccctgcaga

SEQ ID NO: 6542243 - DNA, 21 bp, Homo sapiens
tgtctcgatgccataatcaga

SEQ ID NO: 6542244 - DNA, 14 bp, Homo sapiens
tgtctcgatgcctg

SEQ ID NO: 6542245 - DNA, 16 bp, Homo sapiens
tgtctcggcagaggtg

SEQ ID NO: 6542246 - DNA, 18 bp, Homo sapiens
tgtctcggcagaggtggt

SEQ ID NO: 6542247 - DNA, 18 bp, Homo sapiens
tgtctcggctctgcatgt

SEQ ID NO: 6542248 - DNA, 20 bp, Homo sapiens
tgtctctaaccattcaaatg

SEQ ID NO: 6542249 - DNA, 16 bp, Homo sapiens
tgtctctaacttattt

SEQ ID NO: 6542250 - DNA, 12 bp, Homo sapiens
tgtctctacaaa

SEQ ID NO: 6542251 - DNA, 22 bp, Homo sapiens
tgtctctacaaaaaataaaata

SEQ ID NO: 6542252 - DNA, 22 bp, Homo sapiens
tgtctctaccaaaaaaaggaag

SEQ ID NO: 6542253 - DNA, 23 bp, Homo sapiens
tgtctctacccactatgcacaga

SEQ ID NO: 6542254 - DNA, 22 bp, Homo sapiens
tgtctctagaagtgccatctca

SEQ ID NO: 6542255 - DNA, 15 bp, Homo sapiens
tgtctctagcagtga

SEQ ID NO: 6542256 - DNA, 17 bp, Homo sapiens
tgtctctagcagtgagt

SEQ ID NO: 6542257 - DNA, 17 bp, Homo sapiens
tgtctctagctgttctg

SEQ ID NO: 6542258 - DNA, 18 bp, Homo sapiens
tgtctctagctgttctgg

SEQ ID NO: 6542259 - DNA, 20 bp, Homo sapiens
tgtctctattagctgggttc

SEQ ID NO: 6542260 - DNA, 17 bp, Homo sapiens
tgtctctatttatgaga

SEQ ID NO: 6542261 - DNA, 13 bp, Homo sapiens
tgtctctcagaat

SEQ ID NO: 6542262 - DNA, 14 bp, Homo sapiens
tgtctctccagtga

SEQ ID NO: 6542263 - DNA, 19 bp, Homo sapiens
tgtctctcctagcccctct

SEQ ID NO: 6542264 - DNA, 17 bp, Homo sapiens
tgtctctcctgcccctt

SEQ ID NO: 6542265 - DNA, 13 bp, Homo sapiens
tgtctctcctggc

SEQ ID NO: 6542266 - DNA, 16 bp, Homo sapiens
tgtctctcctggctgg

SEQ ID NO: 6542267 - DNA, 12 bp, Homo sapiens
tgtctctccttt

SEQ ID NO: 6542268 - DNA, 13 bp, Homo sapiens
ttcttttcacatt

SEQ ID NO: 6542269 - DNA, 17 bp, Homo sapiens
ttcttttcacattctta

SEQ ID NO: 6542270 - DNA, 22 bp, Homo sapiens
ttcttttcagcttgtttctata

SEQ ID NO: 6542271 - DNA, 23 bp, Homo sapiens
ttcttttcagcttgtttctatac

SEQ ID NO: 6542272 - DNA, 14 bp, Homo sapiens
ttcttttctattta

SEQ ID NO: 6542273 - DNA, 17 bp, Homo sapiens
ttcttttctatttttta

SEQ ID NO: 6542274 - DNA, 22 bp, Homo sapiens
ttcttttctcatgtgtttgcat

SEQ ID NO: 6542275 - DNA, 18 bp, Homo sapiens
ttcttttctggaaacata

SEQ ID NO: 6542276 - DNA, 15 bp, Homo sapiens
ttcttttctggccaa

SEQ ID NO: 6542277 - DNA, 14 bp, Homo sapiens
ttcttttctttgta

SEQ ID NO: 6542278 - DNA, 23 bp, Homo sapiens
ttcttttgaactgttagatgctg

SEQ ID NO: 6542279 - DNA, 12 bp, Homo sapiens
ttcttttgaatt

SEQ ID NO: 6542280 - DNA, 11 bp, Homo sapiens
ttcttttgata

SEQ ID NO: 6542281 - DNA, 23 bp, Homo sapiens
ttcttttgcaggagtttgtggta

SEQ ID NO: 6542282 - DNA, 20 bp, Homo sapiens
ttcttttgccgttattaaaa

SEQ ID NO: 6542283 - DNA, 13 bp, Homo sapiens
ttcttttgctttc

SEQ ID NO: 6542284 - DNA, 12 bp, Homo sapiens
ttcttttggaaa

SEQ ID NO: 6542285 - DNA, 14 bp, Homo sapiens
ttcttttggcttcc

SEQ ID NO: 6542286 - DNA, 13 bp, Homo sapiens
ttcttttggtaaa

SEQ ID NO: 6542287 - DNA, 12 bp, Homo sapiens
ttcttttgtaag

SEQ ID NO: 6542288 - DNA, 14 bp, Homo sapiens
ttcttttgtaagtg

SEQ ID NO: 6542289 - DNA, 14 bp, Homo sapiens
ttcttttgtacttt

SEQ ID NO: 6542290 - DNA, 20 bp, Homo sapiens
ttcttttgtatgtaaatgtg

SEQ ID NO: 6542291 - DNA, 22 bp, Homo sapiens
ttcttttgtgttggatttgttt

SEQ ID NO: 6542292 - DNA, 15 bp, Homo sapiens
ttcttttgttactgt

SEQ ID NO: 6542293 - DNA, 16 bp, Homo sapiens
ttcttttgttactgtt

SEQ ID NO: 6542294 - DNA, 19 bp, Homo sapiens
ttcttttgttactgttctt

SEQ ID NO: 6542295 - DNA, 21 bp, Homo sapiens
ttcttttgttactgttcttgc

SEQ ID NO: 6542296 - DNA, 23 bp, Homo sapiens
ttcttttgttactgttcttgctg

SEQ ID NO: 6542297 - DNA, 14 bp, Homo sapiens
ttcttttgtttggt

SEQ ID NO: 6542298 - DNA, 22 bp, Homo sapiens
ttctttttaaaaagttgcacat

SEQ ID NO: 6542299 - DNA, 16 bp, Homo sapiens
ttctttttaaaatggt

SEQ ID NO: 6542300 - DNA, 12 bp, Homo sapiens
ttctttttaaag

SEQ ID NO: 6542301 - DNA, 19 bp, Homo sapiens
ttctttttaaagtttgttc

SEQ ID NO: 6542302 - DNA, 21 bp, Homo sapiens
ttctttttaaagtttgttcac

SEQ ID NO: 6542303 - DNA, 13 bp, Homo sapiens
ttctttttacagc

SEQ ID NO: 6542304 - DNA, 15 bp, Homo sapiens
ttctttttattttct

SEQ ID NO: 6542305 - DNA, 20 bp, Homo sapiens
ttctttttattttgcactct

SEQ ID NO: 6542306 - DNA, 16 bp, Homo sapiens
ttctttttatttttta

SEQ ID NO: 6542307 - DNA, 17 bp, Homo sapiens
ttctttttccctttcct

SEQ ID NO: 6542308 - DNA, 15 bp, Homo sapiens
ttctttttccttcat

SEQ ID NO: 6542309 - DNA, 17 bp, Homo sapiens
ttctttttctacatgtg

SEQ ID NO: 6542310 - DNA, 18 bp, Homo sapiens
ttctttttctacatgtga

SEQ ID NO: 6542311 - DNA, 12 bp, Homo sapiens
ttctttttctga

SEQ ID NO: 6542312 - DNA, 15 bp, Homo sapiens
ttctttttctgtctc

SEQ ID NO: 6542313 - DNA, 16 bp, Homo sapiens
ttctttttctgtctct

SEQ ID NO: 6542314 - DNA, 16 bp, Homo sapiens
ttctttttcttaccct

SEQ ID NO: 6542315 - DNA, 16 bp, Homo sapiens
ttctttttgaagtatt

SEQ ID NO: 6542316 - DNA, 18 bp, Homo sapiens
ttctttttgaagtattta

SEQ ID NO: 6542317 - DNA, 13 bp, Homo sapiens
ttctttttgctct

SEQ ID NO: 6542318 - DNA, 14 bp, Homo sapiens
ttctttttgctcta

SEQ ID NO: 6542319 - DNA, 18 bp, Homo sapiens
ttctttttggcattatct

SEQ ID NO: 6542320 - DNA, 13 bp, Homo sapiens
ttctttttgtaca

SEQ ID NO: 6542321 - DNA, 17 bp, Homo sapiens
ttcttttttaaaatcaa

SEQ ID NO: 6542322 - DNA, 18 bp, Homo sapiens
ttcttttttaaatgtttc

SEQ ID NO: 6542323 - DNA, 14 bp, Homo sapiens
ttcttttttaaatt

SEQ ID NO: 6542324 - DNA, 14 bp, Homo sapiens
ttcttttttaagtt

SEQ ID NO: 6542325 - DNA, 20 bp, Homo sapiens
ttcttttttatcttgcactt

SEQ ID NO: 6542326 - DNA, 16 bp, Homo sapiens
ttcttttttatgtgat

SEQ ID NO: 6542327 - DNA, 20 bp, Homo sapiens
ttcttttttattaatcactg

SEQ ID NO: 6542328 - DNA, 20 bp, Homo sapiens
ttcttttttcccctttcttg

SEQ ID NO: 6542329 - DNA, 22 bp, Homo sapiens
ttcttttttgatatagaagtat

SEQ ID NO: 6542330 - DNA, 23 bp, Homo sapiens
ttcttttttggccatctgctcct

SEQ ID NO: 6542331 - DNA, 16 bp, Homo sapiens
ttcttttttgtacagt

SEQ ID NO: 6542332 - DNA, 22 bp, Homo sapiens
ttcttttttgtgtgatttaaga

SEQ ID NO: 6542333 - DNA, 15 bp, Homo sapiens
ttctttttttaactg

SEQ ID NO: 6542334 - DNA, 15 bp, Homo sapiens
ttctttttttgcata

SEQ ID NO: 6542335 - DNA, 15 bp, Homo sapiens
ttctttttttgcttt

SEQ ID NO: 6542336 - DNA, 17 bp, Homo sapiens
ttcttttttttcttggt

SEQ ID NO: 6542337 - DNA, 17 bp, Homo sapiens
ttcttttttttttcatt

SEQ ID NO: 6542338 - DNA, 21 bp, Homo sapiens
ttcttttttttttttttgaga

SEQ ID NO: 6542339 - DNA, 23 bp, Homo sapiens
ttctttttttttttttttgaaag

SEQ ID NO: 6542340 - DNA, 23 bp, Homo sapiens
ttgaaaaaaaaaatgttgagaag

SEQ ID NO: 6542341 - DNA, 16 bp, Homo sapiens
ttgaaaaaaaagtttt

SEQ ID NO: 6542342 - DNA, 14 bp, Homo sapiens
ttgaaaaaaaatag

SEQ ID NO: 6542343 - DNA, 20 bp, Homo sapiens
ttgaaaaaaaatagatgttt

SEQ ID NO: 6542344 - DNA, 20 bp, Homo sapiens
ttgaaaaaaacttcattctc

SEQ ID NO: 6542345 - DNA, 17 bp, Homo sapiens
ttgaaaaaaagaaagca

SEQ ID NO: 6542346 - DNA, 21 bp, Homo sapiens
ttgaaaaaaagtgctgaaaat

SEQ ID NO: 6542347 - DNA, 22 bp, Homo sapiens
ttgaaaaaactttctctttgcc

SEQ ID NO: 6542348 - DNA, 22 bp, Homo sapiens
ttgaaaaaagaaattccctgga

SEQ ID NO: 6542349 - DNA, 16 bp, Homo sapiens
ttgaaaaaagaagttt

SEQ ID NO: 6542350 - DNA, 14 bp, Homo sapiens
ttgaaaaaagagaa

SEQ ID NO: 6542351 - DNA, 11 bp, Homo sapiens
ttgaaaaaagc

SEQ ID NO: 6542352 - DNA, 13 bp, Homo sapiens
ttgaaaaaagctc

SEQ ID NO: 6542353 - DNA, 20 bp, Homo sapiens
ttgaaaaaagctcatttcat

SEQ ID NO: 6542354 - DNA, 18 bp, Homo sapiens
ttgaaaaaagttcaatgt

SEQ ID NO: 6542355 - DNA, 12 bp, Homo sapiens
ttgaaaaacaaa

SEQ ID NO: 6542356 - DNA, 14 bp, Homo sapiens
ttgaaaaactaatt

SEQ ID NO: 6542357 - DNA, 12 bp, Homo sapiens
ttgaaaaacttt

SEQ ID NO: 6542358 - DNA, 14 bp, Homo sapiens
ttgaaaaagaaaac

SEQ ID NO: 6542359 - DNA, 16 bp, Homo sapiens
ttgaaaaagacattca

SEQ ID NO: 6542360 - DNA, 22 bp, Homo sapiens
ttgaaaaagagaacagaaaaca

SEQ ID NO: 6542361 - DNA, 12 bp, Homo sapiens
ttgaaaaagata

SEQ ID NO: 6542362 - DNA, 14 bp, Homo sapiens
ttgaaaaagataaa

SEQ ID NO: 6542363 - DNA, 17 bp, Homo sapiens
ttgaaaaagtaggctgc

SEQ ID NO: 6542364 - DNA, 17 bp, Homo sapiens
ttgaaaaagtattgttt

SEQ ID NO: 6542365 - DNA, 16 bp, Homo sapiens
ttgaaaaagtgtacat

SEQ ID NO: 6542366 - DNA, 17 bp, Homo sapiens
ttgaaaaagttccatag

SEQ ID NO: 6542367 - DNA, 15 bp, Homo sapiens
ttgaaaaagtttgtt

SEQ ID NO: 6542368 - DNA, 13 bp, Homo sapiens
ttgaaaaataaaa

SEQ ID NO: 6542369 - DNA, 22 bp, Homo sapiens
ttgaaaaatacgttttgtgtat

SEQ ID NO: 6542370 - DNA, 13 bp, Homo sapiens
ttgaaaaatactg

SEQ ID NO: 6542371 - DNA, 17 bp, Homo sapiens
ttgaaaaatataaaatt

SEQ ID NO: 6542372 - DNA, 21 bp, Homo sapiens
ttgaaaaatattgctaaaagt

SEQ ID NO: 6542373 - DNA, 16 bp, Homo sapiens
ttgaaaaatgacaatt

SEQ ID NO: 6542374 - DNA, 21 bp, Homo sapiens
ttgaaaaatgacaattgtgaa

SEQ ID NO: 6542375 - DNA, 22 bp, Homo sapiens
ttgaaaaattatcagttatatt

SEQ ID NO: 6542376 - DNA, 16 bp, Homo sapiens
ttgaaaaattcctatt

SEQ ID NO: 6542377 - DNA, 20 bp, Homo sapiens
ttgaaaaattcctattgtga

SEQ ID NO: 6542378 - DNA, 13 bp, Homo sapiens
ttgaaaacaaaaa

SEQ ID NO: 6542379 - DNA, 18 bp, Homo sapiens
ttgaaaacaccaagagta

SEQ ID NO: 6542380 - DNA, 15 bp, Homo sapiens
ttgaaaacactaaca

SEQ ID NO: 6542381 - DNA, 16 bp, Homo sapiens
ttgaaaacactaacaa

SEQ ID NO: 6542382 - DNA, 13 bp, Homo sapiens
ttgaaaacactta

SEQ ID NO: 6542383 - DNA, 21 bp, Homo sapiens
ttgaaaacacttattttacac

SEQ ID NO: 6542384 - DNA, 15 bp, Homo sapiens
ttgaaaacagaaatt

SEQ ID NO: 6542385 - DNA, 19 bp, Homo sapiens
ttgaaaacagatattacag

SEQ ID NO: 6542386 - DNA, 17 bp, Homo sapiens
ttgaaaaccaaaatgac

SEQ ID NO: 6542387 - DNA, 21 bp, Homo sapiens
ttgaaaaccaaaatgacatct

SEQ ID NO: 6542388 - DNA, 17 bp, Homo sapiens
ttgaaaaccatatttta

SEQ ID NO: 6542389 - DNA, 16 bp, Homo sapiens
ttgaaaacccctggct

SEQ ID NO: 6542390 - DNA, 18 bp, Homo sapiens
ttgaaaactgacatcaga

SEQ ID NO: 6542391 - DNA, 22 bp, Homo sapiens
ttgaaaactgacatcagatttc

SEQ ID NO: 6542392 - DNA, 16 bp, Homo sapiens
ttgaaaacttcagaag

SEQ ID NO: 6542393 - DNA, 16 bp, Homo sapiens
ttgaaaacttctcatt

SEQ ID NO: 6542394 - DNA, 19 bp, Homo sapiens
ttgaaaacttgctgaaaaa

SEQ ID NO: 6542395 - DNA, 13 bp, Homo sapiens
ttgaaaacttttc

SEQ ID NO: 6542396 - DNA, 14 bp, Homo sapiens
ttgaaaacttttct

SEQ ID NO: 6542397 - DNA, 17 bp, Homo sapiens
ttgaaaacttttctcag

SEQ ID NO: 6542398 - DNA, 13 bp, Homo sapiens
ttgaaaagaaagt

SEQ ID NO: 6542399 - DNA, 15 bp, Homo sapiens
ttgaaaagaaagtgt

SEQ ID NO: 6542400 - DNA, 18 bp, Homo sapiens
ttgaaaagaagaaagtct

SEQ ID NO: 6542401 - DNA, 16 bp, Homo sapiens
ttgaaaagactccaaa

SEQ ID NO: 6542402 - DNA, 13 bp, Homo sapiens
ttgaaaagagaca

SEQ ID NO: 6542403 - DNA, 13 bp, Homo sapiens
ttgaaaagagctg

SEQ ID NO: 6542404 - DNA, 14 bp, Homo sapiens
ttgaaaagaggtgt

SEQ ID NO: 6542405 - DNA, 23 bp, Homo sapiens
ttgaaaagatgtacctggtggat

SEQ ID NO: 6542406 - DNA, 18 bp, Homo sapiens
ttgaaaagattctgaaac

SEQ ID NO: 6542407 - DNA, 17 bp, Homo sapiens
ttgaaaagcagacattt

SEQ ID NO: 6542408 - DNA, 22 bp, Homo sapiens
ttgaaaagccatgtttaagatt

SEQ ID NO: 6542409 - DNA, 22 bp, Homo sapiens
ttgaaaagctattagccaggat

SEQ ID NO: 6542410 - DNA, 18 bp, Homo sapiens
ttgaaaagctgactgttt

SEQ ID NO: 6542411 - DNA, 20 bp, Homo sapiens
ttgaaaaggaacttgccctg

SEQ ID NO: 6542412 - DNA, 19 bp, Homo sapiens
ttgaaaaggtctaagcaag

SEQ ID NO: 6542413 - DNA, 23 bp, Homo sapiens
ttgaaaagtatcaggaatataaa

SEQ ID NO: 6542414 - DNA, 15 bp, Homo sapiens
ttgaaaagtcaaact

SEQ ID NO: 6542415 - DNA, 14 bp, Homo sapiens
ttgaaaagtgtcct

SEQ ID NO: 6542416 - DNA, 13 bp, Homo sapiens
ttgaaaagtgttc

SEQ ID NO: 6542417 - DNA, 16 bp, Homo sapiens
ttgaaaagtttcctag

SEQ ID NO: 6542418 - DNA, 22 bp, Homo sapiens
ttgaaaataacctaattaatat

SEQ ID NO: 6542419 - DNA, 22 bp, Homo sapiens
ttgaaaatacttttgcattttt

SEQ ID NO: 6542420 - DNA, 23 bp, Homo sapiens
ttgaaaatagtttattttaaaac

SEQ ID NO: 6542421 - DNA, 14 bp, Homo sapiens
ttgaaaatattatc

SEQ ID NO: 6542422 - DNA, 23 bp, Homo sapiens
ttgaaaatattatctttgtaatt

SEQ ID NO: 6542423 - DNA, 17 bp, Homo sapiens
ttgaaaatatttctatg

SEQ ID NO: 6542424 - DNA, 21 bp, Homo sapiens
ttgaaaatatttctctagtgt

SEQ ID NO: 6542425 - DNA, 13 bp, Homo sapiens
ttgaaaatatttt

SEQ ID NO: 6542426 - DNA, 14 bp, Homo sapiens
ttgaaaatgaaatg

SEQ ID NO: 6542427 - DNA, 11 bp, Homo sapiens
ttgaaaatgag

SEQ ID NO: 6542428 - DNA, 16 bp, Homo sapiens
ttgaaaatgcaactct

SEQ ID NO: 6542429 - DNA, 13 bp, Homo sapiens
ttgaaaatgccac

SEQ ID NO: 6542430 - DNA, 21 bp, Homo sapiens
ttgaaaatgctcttaaaatat

SEQ ID NO: 6542431 - DNA, 16 bp, Homo sapiens
ttgaaaatgtccagga

SEQ ID NO: 6542432 - DNA, 14 bp, Homo sapiens
ttgaaaattacctt

SEQ ID NO: 6542433 - DNA, 18 bp, Homo sapiens
ttgaaaattatgcaaaag

SEQ ID NO: 6542434 - DNA, 23 bp, Homo sapiens
ttgaaaattatgcaaaagcagct

SEQ ID NO: 6542435 - DNA, 15 bp, Homo sapiens
ttgaaaattatttta

SEQ ID NO: 6542436 - DNA, 19 bp, Homo sapiens
ttgaaaattattttaaaca

SEQ ID NO: 6542437 - DNA, 20 bp, Homo sapiens
ttgaaaattattttaaacaa

SEQ ID NO: 6542438 - DNA, 20 bp, Homo sapiens
ttgaaaattcaaaaagtgtt

SEQ ID NO: 6542439 - DNA, 16 bp, Homo sapiens
ttgaaacaaagaaggt

SEQ ID NO: 6542440 - DNA, 16 bp, Homo sapiens
ttgaaacaacattatt

SEQ ID NO: 6542441 - DNA, 19 bp, Homo sapiens
ttgaaacaacattatttta

SEQ ID NO: 6542442 - DNA, 17 bp, Homo sapiens
ttgaaacacaataccta

SEQ ID NO: 6542443 - DNA, 21 bp, Homo sapiens
ttgaaacacacagtgaccaag

SEQ ID NO: 6542444 - DNA, 12 bp, Homo sapiens
ttgaaacagaaa

SEQ ID NO: 6542445 - DNA, 15 bp, Homo sapiens
ttgaaacagaaaaat

SEQ ID NO: 6542446 - DNA, 17 bp, Homo sapiens
ttgaaacatttataaac

SEQ ID NO: 6542447 - DNA, 19 bp, Homo sapiens
ttgaaaccaagttgaaaaa

SEQ ID NO: 6542448 - DNA, 16 bp, Homo sapiens
tgtctctccttttctt

SEQ ID NO: 6542449 - DNA, 20 bp, Homo sapiens
tgtctctccttttcttttgt

SEQ ID NO: 6542450 - DNA, 22 bp, Homo sapiens
tgtctctccttttcttttgtta

SEQ ID NO: 6542451 - DNA, 10 bp, Homo sapiens
tgtctctctc

SEQ ID NO: 6542452 - DNA, 14 bp, Homo sapiens
tgtctctctgccaa

SEQ ID NO: 6542453 - DNA, 16 bp, Homo sapiens
tgtctctctgccaaga

SEQ ID NO: 6542454 - DNA, 10 bp, Homo sapiens
tgtctctctt

SEQ ID NO: 6542455 - DNA, 21 bp, Homo sapiens
tgtctctcttcagactctcag

SEQ ID NO: 6542456 - DNA, 22 bp, Homo sapiens
tgtctctcttcggtggccttga

SEQ ID NO: 6542457 - DNA, 14 bp, Homo sapiens
tgtctctcttgttg

SEQ ID NO: 6542458 - DNA, 14 bp, Homo sapiens
tgtctctgacaaag

SEQ ID NO: 6542459 - DNA, 20 bp, Homo sapiens
tgtctctgacaaagtgtgtc

SEQ ID NO: 6542460 - DNA, 13 bp, Homo sapiens
tgtctctgagccc

SEQ ID NO: 6542461 - DNA, 11 bp, Homo sapiens
tgtctctgagg

SEQ ID NO: 6542462 - DNA, 12 bp, Homo sapiens
tgtctctgcatc

SEQ ID NO: 6542463 - DNA, 18 bp, Homo sapiens
tgtctctgcatctgactc

SEQ ID NO: 6542464 - DNA, 14 bp, Homo sapiens
tgtctctgccatgt

SEQ ID NO: 6542465 - DNA, 22 bp, Homo sapiens
tgtctctgcctccctcaccctg

SEQ ID NO: 6542466 - DNA, 22 bp, Homo sapiens
tgtctctgctcgccctcctttc

SEQ ID NO: 6542467 - DNA, 13 bp, Homo sapiens
tgtctctgctctt

SEQ ID NO: 6542468 - DNA, 13 bp, Homo sapiens
tgtctctgcttcc

SEQ ID NO: 6542469 - DNA, 14 bp, Homo sapiens
tgtctctgcttcca

SEQ ID NO: 6542470 - DNA, 12 bp, Homo sapiens
tgtctctgcttg

SEQ ID NO: 6542471 - DNA, 22 bp, Homo sapiens
tgtctctgctttccttttctct

SEQ ID NO: 6542472 - DNA, 12 bp, Homo sapiens
tgtctctggagt

SEQ ID NO: 6542473 - DNA, 15 bp, Homo sapiens
tgtctctggagtgat

SEQ ID NO: 6542474 - DNA, 19 bp, Homo sapiens
tgtctctggcgtgtgggta

SEQ ID NO: 6542475 - DNA, 13 bp, Homo sapiens
tgtctctggctac

SEQ ID NO: 6542476 - DNA, 19 bp, Homo sapiens
tgtctctgggcctgtgtgt

SEQ ID NO: 6542477 - DNA, 20 bp, Homo sapiens
tgtctctgggcctgtgtgtg

SEQ ID NO: 6542478 - DNA, 15 bp, Homo sapiens
tgtctctgggctgag

SEQ ID NO: 6542479 - DNA, 12 bp, Homo sapiens
tgtctctggggc

SEQ ID NO: 6542480 - DNA, 12 bp, Homo sapiens
tgtctctgtccc

SEQ ID NO: 6542481 - DNA, 23 bp, Homo sapiens
tgtctctgtccctcactgccttc

SEQ ID NO: 6542482 - DNA, 13 bp, Homo sapiens
tgtctctgtgaga

SEQ ID NO: 6542483 - DNA, 12 bp, Homo sapiens
tgtctctgtgtg

SEQ ID NO: 6542484 - DNA, 22 bp, Homo sapiens
tgtctctgttggtccactgtgt

SEQ ID NO: 6542485 - DNA, 13 bp, Homo sapiens
tgtctcttagaaa

SEQ ID NO: 6542486 - DNA, 15 bp, Homo sapiens
tgtctcttatggatg

SEQ ID NO: 6542487 - DNA, 14 bp, Homo sapiens
tgtctcttccatgc

SEQ ID NO: 6542488 - DNA, 15 bp, Homo sapiens
tgtctcttcctctgc

SEQ ID NO: 6542489 - DNA, 16 bp, Homo sapiens
tgtctcttcctctgca

SEQ ID NO: 6542490 - DNA, 15 bp, Homo sapiens
tgtctcttcctctgt

SEQ ID NO: 6542491 - DNA, 15 bp, Homo sapiens
tgtctcttgaaaaat

SEQ ID NO: 6542492 - DNA, 20 bp, Homo sapiens
tgtctcttgagcatcaatct

SEQ ID NO: 6542493 - DNA, 14 bp, Homo sapiens
tgtctcttgagttt

SEQ ID NO: 6542494 - DNA, 17 bp, Homo sapiens
tgtctcttgagtttgtc

SEQ ID NO: 6542495 - DNA, 16 bp, Homo sapiens
tgtctcttggaaatgt

SEQ ID NO: 6542496 - DNA, 19 bp, Homo sapiens
tgtctcttggtcctgctgc

SEQ ID NO: 6542497 - DNA, 20 bp, Homo sapiens
tgtctcttggtcctgctgca

SEQ ID NO: 6542498 - DNA, 14 bp, Homo sapiens
tgtctcttgtagaa

SEQ ID NO: 6542499 - DNA, 18 bp, Homo sapiens
tgtctcttgtagaagatg

SEQ ID NO: 6542500 - DNA, 14 bp, Homo sapiens
tgtctctttgcaac

SEQ ID NO: 6542501 - DNA, 19 bp, Homo sapiens
tgtctctttggggagagct

SEQ ID NO: 6542502 - DNA, 18 bp, Homo sapiens
tgtctcttttctctttct

SEQ ID NO: 6542503 - DNA, 22 bp, Homo sapiens
tgtctcttttctcttttgcttt

SEQ ID NO: 6542504 - DNA, 20 bp, Homo sapiens
tgtctgaaaaagtgttttta

SEQ ID NO: 6542505 - DNA, 23 bp, Homo sapiens
tgtctgaaaaatgcctgctgctg

SEQ ID NO: 6542506 - DNA, 15 bp, Homo sapiens
tgtctgaaatggaac

SEQ ID NO: 6542507 - DNA, 18 bp, Homo sapiens
tgtctgaacaatctccaa

SEQ ID NO: 6542508 - DNA, 14 bp, Homo sapiens
tgtctgaacccagg

SEQ ID NO: 6542509 - DNA, 17 bp, Homo sapiens
tgtctgaacccaggcag

SEQ ID NO: 6542510 - DNA, 21 bp, Homo sapiens
tgtctgaacccaggcagctgg

SEQ ID NO: 6542511 - DNA, 17 bp, Homo sapiens
tgtctgaaggacacttc

SEQ ID NO: 6542512 - DNA, 23 bp, Homo sapiens
tgtctgaaggacacttcctgcct

SEQ ID NO: 6542513 - DNA, 20 bp, Homo sapiens
tgtctgaaggtaatactata

SEQ ID NO: 6542514 - DNA, 18 bp, Homo sapiens
tgtctgaatattctagaa

SEQ ID NO: 6542515 - DNA, 15 bp, Homo sapiens
tgtctgaatgtattt

SEQ ID NO: 6542516 - DNA, 15 bp, Homo sapiens
tgtctgaattgagaa

SEQ ID NO: 6542517 - DNA, 18 bp, Homo sapiens
tgtctgaattgagaaaag

SEQ ID NO: 6542518 - DNA, 14 bp, Homo sapiens
tgtctgacacatgc

SEQ ID NO: 6542519 - DNA, 16 bp, Homo sapiens
tgtctgaccagagaat

SEQ ID NO: 6542520 - DNA, 19 bp, Homo sapiens
tgtctgaccagagaatgca

SEQ ID NO: 6542521 - DNA, 14 bp, Homo sapiens
tgtctgaccttcca

SEQ ID NO: 6542522 - DNA, 22 bp, Homo sapiens
tgtctgactcaggcgcctggca

SEQ ID NO: 6542523 - DNA, 13 bp, Homo sapiens
tgtctgagacagg

SEQ ID NO: 6542524 - DNA, 14 bp, Homo sapiens
tgtctgagacaggt

SEQ ID NO: 6542525 - DNA, 23 bp, Homo sapiens
tgtctgagacaggtgcctaacct

SEQ ID NO: 6542526 - DNA, 18 bp, Homo sapiens
tgtctgagagaccatctc

SEQ ID NO: 6542527 - DNA, 19 bp, Homo sapiens
tgtctgagagaccatctcc

SEQ ID NO: 6542528 - DNA, 18 bp, Homo sapiens
tgtctgagagtttagttg

SEQ ID NO: 6542529 - DNA, 15 bp, Homo sapiens
tgtctgagcccaacc

SEQ ID NO: 6542530 - DNA, 19 bp, Homo sapiens
tgtctgagcccaacccttc

SEQ ID NO: 6542531 - DNA, 17 bp, Homo sapiens
tgtctgagccctcaaag

SEQ ID NO: 6542532 - DNA, 18 bp, Homo sapiens
tgtctgagccctcaaagt

SEQ ID NO: 6542533 - DNA, 13 bp, Homo sapiens
tgtctgagccctg

SEQ ID NO: 6542534 - DNA, 16 bp, Homo sapiens
tgtctgagccctgccc

SEQ ID NO: 6542535 - DNA, 20 bp, Homo sapiens
tgtctgagccctgccctcac

SEQ ID NO: 6542536 - DNA, 22 bp, Homo sapiens
tgtctgagccctgccctcactc

SEQ ID NO: 6542537 - DNA, 13 bp, Homo sapiens
tgtctgagcctct

SEQ ID NO: 6542538 - DNA, 21 bp, Homo sapiens
tgtctgagcggcgcagagccc

SEQ ID NO: 6542539 - DNA, 18 bp, Homo sapiens
tgtctgaggcctcatccc

SEQ ID NO: 6542540 - DNA, 18 bp, Homo sapiens
tgtctgagtagtggccac

SEQ ID NO: 6542541 - DNA, 19 bp, Homo sapiens
tgtctgagtagtggccact

SEQ ID NO: 6542542 - DNA, 17 bp, Homo sapiens
tgtctgagtgaacctgt

SEQ ID NO: 6542543 - DNA, 20 bp, Homo sapiens
tgtctgatagagtttaacag

SEQ ID NO: 6542544 - DNA, 16 bp, Homo sapiens
tgtctgatctgtgctt

SEQ ID NO: 6542545 - DNA, 15 bp, Homo sapiens
tgtctgattggcttg

SEQ ID NO: 6542546 - DNA, 23 bp, Homo sapiens
tgtctgattggcttgtagaattg

SEQ ID NO: 6542547 - DNA, 22 bp, Homo sapiens
tgtctgcaaaggagggcctcag

SEQ ID NO: 6542548 - DNA, 22 bp, Homo sapiens
tgtctgcaacatggattccaaa

SEQ ID NO: 6542549 - DNA, 21 bp, Homo sapiens
tgtctgcacaccttgaatctg

SEQ ID NO: 6542550 - DNA, 13 bp, Homo sapiens
tgtctgcacagag

SEQ ID NO: 6542551 - DNA, 17 bp, Homo sapiens
tgtctgcacagagggtc

SEQ ID NO: 6542552 - DNA, 16 bp, Homo sapiens
tgtctgcaccttagaa

SEQ ID NO: 6542553 - DNA, 21 bp, Homo sapiens
tgtctgcaccttagaaaaaaa

SEQ ID NO: 6542554 - DNA, 16 bp, Homo sapiens
tgtctgcactgaggat

SEQ ID NO: 6542555 - DNA, 22 bp, Homo sapiens
tgtctgcagacaagtcttgctg

SEQ ID NO: 6542556 - DNA, 15 bp, Homo sapiens
tgtctgcagctcctg

SEQ ID NO: 6542557 - DNA, 12 bp, Homo sapiens
tgtctgcagctg

SEQ ID NO: 6542558 - DNA, 17 bp, Homo sapiens
tgtctgcaggtgtctga

SEQ ID NO: 6542559 - DNA, 17 bp, Homo sapiens
tgtctgcaggtttctcc

SEQ ID NO: 6542560 - DNA, 19 bp, Homo sapiens
tgtctgcagtgtgcccccc

SEQ ID NO: 6542561 - DNA, 18 bp, Homo sapiens
tgtctgcatggcagaagc

SEQ ID NO: 6542562 - DNA, 15 bp, Homo sapiens
tgtctgcattgttat

SEQ ID NO: 6542563 - DNA, 13 bp, Homo sapiens
tgtctgcatttcg

SEQ ID NO: 6542564 - DNA, 20 bp, Homo sapiens
tgtctgccaaaatgcaacat

SEQ ID NO: 6542565 - DNA, 15 bp, Homo sapiens
tgtctgccaaacaca

SEQ ID NO: 6542566 - DNA, 16 bp, Homo sapiens
tgtctgccaaacacat

SEQ ID NO: 6542567 - DNA, 16 bp, Homo sapiens
tgtctgccacattaac

SEQ ID NO: 6542568 - DNA, 12 bp, Homo sapiens
tgtctgccaggc

SEQ ID NO: 6542569 - DNA, 16 bp, Homo sapiens
tgtctgccaggcactc

SEQ ID NO: 6542570 - DNA, 22 bp, Homo sapiens
tgtctgccaggcactctcatca

SEQ ID NO: 6542571 - DNA, 17 bp, Homo sapiens
tgtctgccccaagtttt

SEQ ID NO: 6542572 - DNA, 14 bp, Homo sapiens
tgtctgccccagcc

SEQ ID NO: 6542573 - DNA, 23 bp, Homo sapiens
tgtctgccctctgggtccctcct

SEQ ID NO: 6542574 - DNA, 11 bp, Homo sapiens
tgtctgccctt

SEQ ID NO: 6542575 - DNA, 13 bp, Homo sapiens
tgtctgcctcctg

SEQ ID NO: 6542576 - DNA, 23 bp, Homo sapiens
tgtctgcctcctgctttgggaag

SEQ ID NO: 6542577 - DNA, 14 bp, Homo sapiens
tgtctgcctcttag

SEQ ID NO: 6542578 - DNA, 13 bp, Homo sapiens
tgtctgcctggag

SEQ ID NO: 6542579 - DNA, 21 bp, Homo sapiens
tgtctgcctggagtgctgtgc

SEQ ID NO: 6542580 - DNA, 15 bp, Homo sapiens
tgtctgcctgtattt

SEQ ID NO: 6542581 - DNA, 20 bp, Homo sapiens
tgtctgccttaggctgctgg

SEQ ID NO: 6542582 - DNA, 15 bp, Homo sapiens
tgtctgccttcacaa

SEQ ID NO: 6542583 - DNA, 19 bp, Homo sapiens
tgtctgcgccccgcctccc

SEQ ID NO: 6542584 - DNA, 17 bp, Homo sapiens
tgtctgcgtgggtcaga

SEQ ID NO: 6542585 - DNA, 21 bp, Homo sapiens
tgtctgcgtggttcctttctc

SEQ ID NO: 6542586 - DNA, 13 bp, Homo sapiens
tgtctgctaacat

SEQ ID NO: 6542587 - DNA, 21 bp, Homo sapiens
tgtctgctaggcgctggggag

SEQ ID NO: 6542588 - DNA, 14 bp, Homo sapiens
tgtctgctcaatgc

SEQ ID NO: 6542589 - DNA, 13 bp, Homo sapiens
tgtctgctctgca

SEQ ID NO: 6542590 - DNA, 16 bp, Homo sapiens
tgtctgctctgcatat

SEQ ID NO: 6542591 - DNA, 19 bp, Homo sapiens
tgtctgctgagttggcctg

SEQ ID NO: 6542592 - DNA, 15 bp, Homo sapiens
tgtctgctgccagca

SEQ ID NO: 6542593 - DNA, 18 bp, Homo sapiens
tgtctgctgccagcacag

SEQ ID NO: 6542594 - DNA, 22 bp, Homo sapiens
tgtctgctgcctccaagtcatg

SEQ ID NO: 6542595 - DNA, 23 bp, Homo sapiens
tgtctgctgcctccaagtcatgg

SEQ ID NO: 6542596 - DNA, 15 bp, Homo sapiens
tgtctgctgctgcct

SEQ ID NO: 6542597 - DNA, 14 bp, Homo sapiens
tgtctgcttctgtc

SEQ ID NO: 6542598 - DNA, 13 bp, Homo sapiens
tgtctgcttgtca

SEQ ID NO: 6542599 - DNA, 20 bp, Homo sapiens
tgtctgctttaaagggcctg

SEQ ID NO: 6542600 - DNA, 17 bp, Homo sapiens
tgtctggaagatgggga

SEQ ID NO: 6542601 - DNA, 13 bp, Homo sapiens
tgtctggaagctg

SEQ ID NO: 6542602 - DNA, 17 bp, Homo sapiens
tgtctggaagctgagca

SEQ ID NO: 6542603 - DNA, 23 bp, Homo sapiens
tgtctggaatcccagctccgctg

SEQ ID NO: 6542604 - DNA, 19 bp, Homo sapiens
tgtctggacattcagaaca

SEQ ID NO: 6542605 - DNA, 21 bp, Homo sapiens
tgtctggactagaaaatctga

SEQ ID NO: 6542606 - DNA, 12 bp, Homo sapiens
tgtctggagacc

SEQ ID NO: 6542607 - DNA, 18 bp, Homo sapiens
tgtctggagcctgcaggc

SEQ ID NO: 6542608 - DNA, 22 bp, Homo sapiens
tgtctggaggggagctctgtct

SEQ ID NO: 6542609 - DNA, 15 bp, Homo sapiens
tgtctggaggttcct

SEQ ID NO: 6542610 - DNA, 22 bp, Homo sapiens
tgtctggagtggtaacagctct

SEQ ID NO: 6542611 - DNA, 14 bp, Homo sapiens
tgtctggatcagta

SEQ ID NO: 6542612 - DNA, 14 bp, Homo sapiens
tgtctggcaaggac

SEQ ID NO: 6542613 - DNA, 19 bp, Homo sapiens
tgtctggcaatgccacagc

SEQ ID NO: 6542614 - DNA, 22 bp, Homo sapiens
tgtctggcaatgccacagccct

SEQ ID NO: 6542615 - DNA, 17 bp, Homo sapiens
tgtctggcacagcctgg

SEQ ID NO: 6542616 - DNA, 17 bp, Homo sapiens
tgtctggcagatgaggg

SEQ ID NO: 6542617 - DNA, 20 bp, Homo sapiens
tgtctggcagatgagggctg

SEQ ID NO: 6542618 - DNA, 23 bp, Homo sapiens
tgtctggcaggctactctgccca

SEQ ID NO: 6542619 - DNA, 12 bp, Homo sapiens
tgtctggccagg

SEQ ID NO: 6542620 - DNA, 15 bp, Homo sapiens
tgtctggccaggcct

SEQ ID NO: 6542621 - DNA, 14 bp, Homo sapiens
tgtctggcccagcc

SEQ ID NO: 6542622 - DNA, 18 bp, Homo sapiens
tgtctggcccagccatgg

SEQ ID NO: 6542623 - DNA, 23 bp, Homo sapiens
tgtctggcgttctcaagaatcta

SEQ ID NO: 6542624 - DNA, 15 bp, Homo sapiens
tgtctggctgtggcc

SEQ ID NO: 6542625 - DNA, 19 bp, Homo sapiens
tgtctggctgtggcccctc

SEQ ID NO: 6542626 - DNA, 24 bp, Homo sapiens
tgtctggcttcgcagctctggcct

SEQ ID NO: 6542627 - DNA, 21 bp, Homo sapiens
tgtctggctttttcctctgag

SEQ ID NO: 6542628 - DNA, 21 bp, Homo sapiens
ttgaaaccaccgtgaaccaga

SEQ ID NO: 6542629 - DNA, 16 bp, Homo sapiens
ttgaaaccaggacatt

SEQ ID NO: 6542630 - DNA, 13 bp, Homo sapiens
ttgaaaccagtat

SEQ ID NO: 6542631 - DNA, 15 bp, Homo sapiens
ttgaaaccagtattt

SEQ ID NO: 6542632 - DNA, 18 bp, Homo sapiens
ttgaaacccacagtttta

SEQ ID NO: 6542633 - DNA, 19 bp, Homo sapiens
ttgaaacccacagttttag

SEQ ID NO: 6542634 - DNA, 16 bp, Homo sapiens
ttgaaacctgctctgt

SEQ ID NO: 6542635 - DNA, 20 bp, Homo sapiens
ttgaaacggatgatttctat

SEQ ID NO: 6542636 - DNA, 21 bp, Homo sapiens
ttgaaacggatgatttctatg

SEQ ID NO: 6542637 - DNA, 18 bp, Homo sapiens
ttgaaacgttatgatgac

SEQ ID NO: 6542638 - DNA, 13 bp, Homo sapiens
ttgaaactaaaat

SEQ ID NO: 6542639 - DNA, 16 bp, Homo sapiens
ttgaaactaaaataaa

SEQ ID NO: 6542640 - DNA, 18 bp, Homo sapiens
ttgaaactactacaatga

SEQ ID NO: 6542641 - DNA, 18 bp, Homo sapiens
ttgaaactagaaatctgt

SEQ ID NO: 6542642 - DNA, 17 bp, Homo sapiens
ttgaaactagaagtcaa

SEQ ID NO: 6542643 - DNA, 18 bp, Homo sapiens
ttgaaactagaagtcaaa

SEQ ID NO: 6542644 - DNA, 19 bp, Homo sapiens
ttgaaactagttattttat

SEQ ID NO: 6542645 - DNA, 17 bp, Homo sapiens
ttgaaactcactagtaa

SEQ ID NO: 6542646 - DNA, 22 bp, Homo sapiens
ttgaaactcgcgagtgtaactt

SEQ ID NO: 6542647 - DNA, 23 bp, Homo sapiens
ttgaaactgagatgtgaacacat

SEQ ID NO: 6542648 - DNA, 22 bp, Homo sapiens
ttgaaactgtaaatatgtttgt

SEQ ID NO: 6542649 - DNA, 20 bp, Homo sapiens
ttgaaactgtatttacttgt

SEQ ID NO: 6542650 - DNA, 18 bp, Homo sapiens
ttgaaacttgagtttgtt

SEQ ID NO: 6542651 - DNA, 19 bp, Homo sapiens
ttgaaacttggttcccaga

SEQ ID NO: 6542652 - DNA, 14 bp, Homo sapiens
ttgaaactttgaga

SEQ ID NO: 6542653 - DNA, 20 bp, Homo sapiens
ttgaaactttgagatctaaa

SEQ ID NO: 6542654 - DNA, 20 bp, Homo sapiens
ttgaaactttgggaaaacat

SEQ ID NO: 6542655 - DNA, 19 bp, Homo sapiens
ttgaaagaaaaaaaaatac

SEQ ID NO: 6542656 - DNA, 18 bp, Homo sapiens
ttgaaagaagtcaaatga

SEQ ID NO: 6542657 - DNA, 15 bp, Homo sapiens
ttgaaagaatgtaaa

SEQ ID NO: 6542658 - DNA, 16 bp, Homo sapiens
ttgaaagaattatcct

SEQ ID NO: 6542659 - DNA, 17 bp, Homo sapiens
ttgaaagaattctattt

SEQ ID NO: 6542660 - DNA, 18 bp, Homo sapiens
ttgaaagacaaaatttag

SEQ ID NO: 6542661 - DNA, 18 bp, Homo sapiens
ttgaaagacatcaatgaa

SEQ ID NO: 6542662 - DNA, 20 bp, Homo sapiens
ttgaaagagaaccagtttca

SEQ ID NO: 6542663 - DNA, 18 bp, Homo sapiens
ttgaaagatgtatggatt

SEQ ID NO: 6542664 - DNA, 15 bp, Homo sapiens
ttgaaagattcaggt

SEQ ID NO: 6542665 - DNA, 18 bp, Homo sapiens
ttgaaagattttattgta

SEQ ID NO: 6542666 - DNA, 22 bp, Homo sapiens
ttgaaagattttattgtataaa

SEQ ID NO: 6542667 - DNA, 20 bp, Homo sapiens
ttgaaagcaaaaatgctaat

SEQ ID NO: 6542668 - DNA, 21 bp, Homo sapiens
ttgaaagcaaaaatgctaata

SEQ ID NO: 6542669 - DNA, 16 bp, Homo sapiens
ttgaaagccaagtgtt

SEQ ID NO: 6542670 - DNA, 19 bp, Homo sapiens
ttgaaagccccagaaatca

SEQ ID NO: 6542671 - DNA, 18 bp, Homo sapiens
ttgaaagctgaaaagcat

SEQ ID NO: 6542672 - DNA, 22 bp, Homo sapiens
ttgaaagctgtggccagcttgt

SEQ ID NO: 6542673 - DNA, 21 bp, Homo sapiens
ttgaaagcttttaaaatgtag

SEQ ID NO: 6542674 - DNA, 20 bp, Homo sapiens
ttgaaaggagaaaaaaaaag

SEQ ID NO: 6542675 - DNA, 22 bp, Homo sapiens
ttgaaaggcaggaagggaagcg

SEQ ID NO: 6542676 - DNA, 23 bp, Homo sapiens
ttgaaaggggacacctgtacatt

SEQ ID NO: 6542677 - DNA, 21 bp, Homo sapiens
ttgaaaggggttgtgaagagg

SEQ ID NO: 6542678 - DNA, 19 bp, Homo sapiens
ttgaaaggtccaaatgttt

SEQ ID NO: 6542679 - DNA, 22 bp, Homo sapiens
ttgaaaggttttttttcagttg

SEQ ID NO: 6542680 - DNA, 12 bp, Homo sapiens
ttgaaagtagag

SEQ ID NO: 6542681 - DNA, 20 bp, Homo sapiens
ttgaaagtattcagaaatta

SEQ ID NO: 6542682 - DNA, 23 bp, Homo sapiens
ttgaaagtattcagaaattaaaa

SEQ ID NO: 6542683 - DNA, 22 bp, Homo sapiens
ttgaaagtgaataaacttcagc

SEQ ID NO: 6542684 - DNA, 22 bp, Homo sapiens
ttgaaagtgcttcaagggtaat

SEQ ID NO: 6542685 - DNA, 20 bp, Homo sapiens
ttgaaagtgggcaaaagctt

SEQ ID NO: 6542686 - DNA, 15 bp, Homo sapiens
ttgaaagttagagat

SEQ ID NO: 6542687 - DNA, 17 bp, Homo sapiens
ttgaaagttagagattt

SEQ ID NO: 6542688 - DNA, 16 bp, Homo sapiens
ttgaaagttgtacatg

SEQ ID NO: 6542689 - DNA, 17 bp, Homo sapiens
ttgaaagttttcagaac

SEQ ID NO: 6542690 - DNA, 21 bp, Homo sapiens
ttgaaagttttccagtattga

SEQ ID NO: 6542691 - DNA, 18 bp, Homo sapiens
ttgaaagtttttaatatt

SEQ ID NO: 6542692 - DNA, 16 bp, Homo sapiens
ttgaaataaaaagagt

SEQ ID NO: 6542693 - DNA, 17 bp, Homo sapiens
ttgaaataaaaagagta

SEQ ID NO: 6542694 - DNA, 14 bp, Homo sapiens
ttgaaataaaacat

SEQ ID NO: 6542695 - DNA, 12 bp, Homo sapiens
ttgaaataagct

SEQ ID NO: 6542696 - DNA, 15 bp, Homo sapiens
ttgaaataataaatc

SEQ ID NO: 6542697 - DNA, 18 bp, Homo sapiens
ttgaaatacctcatgttt

SEQ ID NO: 6542698 - DNA, 20 bp, Homo sapiens
ttgaaatacctcatgtttat

SEQ ID NO: 6542699 - DNA, 14 bp, Homo sapiens
ttgaaatactaaaa

SEQ ID NO: 6542700 - DNA, 18 bp, Homo sapiens
ttgaaatactaaaagcaa

SEQ ID NO: 6542701 - DNA, 18 bp, Homo sapiens
ttgaaatacttgaaaact

SEQ ID NO: 6542702 - DNA, 17 bp, Homo sapiens
ttgaaatagaaaatgta

SEQ ID NO: 6542703 - DNA, 21 bp, Homo sapiens
ttgaaatagattttttcattt

SEQ ID NO: 6542704 - DNA, 19 bp, Homo sapiens
ttgaaatagtatacattgt

SEQ ID NO: 6542705 - DNA, 19 bp, Homo sapiens
ttgaaatagttcaaactgc

SEQ ID NO: 6542706 - DNA, 21 bp, Homo sapiens
ttgaaatagtttccaagaaat

SEQ ID NO: 6542707 - DNA, 20 bp, Homo sapiens
ttgaaatataggaacttaaa

SEQ ID NO: 6542708 - DNA, 14 bp, Homo sapiens
ttgaaatatgcatg

SEQ ID NO: 6542709 - DNA, 21 bp, Homo sapiens
ttgaaatatggtcttttggtt

SEQ ID NO: 6542710 - DNA, 20 bp, Homo sapiens
ttgaaatatgtagtattaaa

SEQ ID NO: 6542711 - DNA, 16 bp, Homo sapiens
ttgaaatcaaatgttt

SEQ ID NO: 6542712 - DNA, 19 bp, Homo sapiens
ttgaaatcaatgcaagagt

SEQ ID NO: 6542713 - DNA, 18 bp, Homo sapiens
ttgaaatcacctggtatt

SEQ ID NO: 6542714 - DNA, 15 bp, Homo sapiens
ttgaaatcagcatga

SEQ ID NO: 6542715 - DNA, 19 bp, Homo sapiens
ttgaaatcagcatgacaaa

SEQ ID NO: 6542716 - DNA, 21 bp, Homo sapiens
ttgaaatcagtaaacactgtg

SEQ ID NO: 6542717 - DNA, 17 bp, Homo sapiens
ttgaaatgaaagggaaa

SEQ ID NO: 6542718 - DNA, 20 bp, Homo sapiens
ttgaaatgaaatttaaacat

SEQ ID NO: 6542719 - DNA, 21 bp, Homo sapiens
ttgaaatgaaatttaaacatt

SEQ ID NO: 6542720 - DNA, 21 bp, Homo sapiens
ttgaaatgaggtctgtttaaa

SEQ ID NO: 6542721 - DNA, 21 bp, Homo sapiens
ttgaaatgctcttttgcacaa

SEQ ID NO: 6542722 - DNA, 16 bp, Homo sapiens
ttgaaatgctgtattt

SEQ ID NO: 6542723 - DNA, 12 bp, Homo sapiens
ttgaaatgggca

SEQ ID NO: 6542724 - DNA, 13 bp, Homo sapiens
ttgaaatgtaatt

SEQ ID NO: 6542725 - DNA, 14 bp, Homo sapiens
ttgaaatgtcacgt

SEQ ID NO: 6542726 - DNA, 18 bp, Homo sapiens
ttgaaatgtggttttcct

SEQ ID NO: 6542727 - DNA, 19 bp, Homo sapiens
ttgaaatgtggttttcctg

SEQ ID NO: 6542728 - DNA, 20 bp, Homo sapiens
ttgaaatgtttaataaagct

SEQ ID NO: 6542729 - DNA, 23 bp, Homo sapiens
ttgaaatgtttaataaagcttta

SEQ ID NO: 6542730 - DNA, 15 bp, Homo sapiens
ttgaaattactgtgt

SEQ ID NO: 6542731 - DNA, 17 bp, Homo sapiens
ttgaaattatatctgtg

SEQ ID NO: 6542732 - DNA, 23 bp, Homo sapiens
ttgaaattatgtatgtttacata

SEQ ID NO: 6542733 - DNA, 17 bp, Homo sapiens
ttgaaattatgtgacat

SEQ ID NO: 6542734 - DNA, 15 bp, Homo sapiens
ttgaaattcccccac

SEQ ID NO: 6542735 - DNA, 13 bp, Homo sapiens
ttgaaattctatt

SEQ ID NO: 6542736 - DNA, 14 bp, Homo sapiens
ttgaaattctgaat

SEQ ID NO: 6542737 - DNA, 20 bp, Homo sapiens
ttgaaattctgaatttgcaa

SEQ ID NO: 6542738 - DNA, 21 bp, Homo sapiens
ttgaaattctgaatttgcaaa

SEQ ID NO: 6542739 - DNA, 22 bp, Homo sapiens
ttgaaattctgaatttgcaaag

SEQ ID NO: 6542740 - DNA, 18 bp, Homo sapiens
ttgaaattggaaaggact

SEQ ID NO: 6542741 - DNA, 14 bp, Homo sapiens
ttgaaattgtaatt

SEQ ID NO: 6542742 - DNA, 17 bp, Homo sapiens
ttgaaattgtattacaa

SEQ ID NO: 6542743 - DNA, 13 bp, Homo sapiens
ttgaaattgtgaa

SEQ ID NO: 6542744 - DNA, 19 bp, Homo sapiens
ttgaaatttaaaaataaag

SEQ ID NO: 6542745 - DNA, 16 bp, Homo sapiens
ttgaaatttacacagt

SEQ ID NO: 6542746 - DNA, 19 bp, Homo sapiens
ttgaaatttacacagtgag

SEQ ID NO: 6542747 - DNA, 13 bp, Homo sapiens
ttgaaatttctca

SEQ ID NO: 6542748 - DNA, 15 bp, Homo sapiens
ttgaaattttctgta

SEQ ID NO: 6542749 - DNA, 15 bp, Homo sapiens
ttgaaattttgcaaa

SEQ ID NO: 6542750 - DNA, 19 bp, Homo sapiens
ttgaaattttgcaaatata

SEQ ID NO: 6542751 - DNA, 23 bp, Homo sapiens
ttgaacaaaaatgtttccactgg

SEQ ID NO: 6542752 - DNA, 21 bp, Homo sapiens
ttgaacaacccaatctggctg

SEQ ID NO: 6542753 - DNA, 22 bp, Homo sapiens
ttgaacaacccaatctggctgg

SEQ ID NO: 6542754 - DNA, 15 bp, Homo sapiens
ttgaacaactcgaat

SEQ ID NO: 6542755 - DNA, 21 bp, Homo sapiens
ttgaacaactcgaatcactca

SEQ ID NO: 6542756 - DNA, 20 bp, Homo sapiens
ttgaacaagatttccctaaa

SEQ ID NO: 6542757 - DNA, 20 bp, Homo sapiens
ttgaacaagttgtttcattg

SEQ ID NO: 6542758 - DNA, 16 bp, Homo sapiens
ttgaacaataaagttt

SEQ ID NO: 6542759 - DNA, 13 bp, Homo sapiens
ttgaacacagttg

SEQ ID NO: 6542760 - DNA, 19 bp, Homo sapiens
ttgaacactgcaccctcca

SEQ ID NO: 6542761 - DNA, 16 bp, Homo sapiens
ttgaacagagctagag

SEQ ID NO: 6542762 - DNA, 23 bp, Homo sapiens
ttgaacagctgtgagccatgcct

SEQ ID NO: 6542763 - DNA, 13 bp, Homo sapiens
ttgaacatgaact

SEQ ID NO: 6542764 - DNA, 15 bp, Homo sapiens
ttgaacatgtggctt

SEQ ID NO: 6542765 - DNA, 21 bp, Homo sapiens
ttgaacattttatcattaatt

SEQ ID NO: 6542766 - DNA, 15 bp, Homo sapiens
ttgaaccaaaacata

SEQ ID NO: 6542767 - DNA, 18 bp, Homo sapiens
ttgaaccaaaacattccg

SEQ ID NO: 6542768 - DNA, 17 bp, Homo sapiens
ttgaaccataaaatgtc

SEQ ID NO: 6542769 - DNA, 14 bp, Homo sapiens
ttgaaccatagtta

SEQ ID NO: 6542770 - DNA, 20 bp, Homo sapiens
ttgaaccattatactttata

SEQ ID NO: 6542771 - DNA, 22 bp, Homo sapiens
ttgaaccattatactttatatc

SEQ ID NO: 6542772 - DNA, 14 bp, Homo sapiens
ttgaacccaggaga

SEQ ID NO: 6542773 - DNA, 17 bp, Homo sapiens
ttgaaccccctccctgt

SEQ ID NO: 6542774 - DNA, 19 bp, Homo sapiens
ttgaaccgccggttcattt

SEQ ID NO: 6542775 - DNA, 16 bp, Homo sapiens
ttgaaccgtcaatgtg

SEQ ID NO: 6542776 - DNA, 13 bp, Homo sapiens
ttgaacctatttc

SEQ ID NO: 6542777 - DNA, 12 bp, Homo sapiens
ttgaacctcatt

SEQ ID NO: 6542778 - DNA, 19 bp, Homo sapiens
ttgaacctgatgaaaataa

SEQ ID NO: 6542779 - DNA, 12 bp, Homo sapiens
ttgaacctggga

SEQ ID NO: 6542780 - DNA, 23 bp, Homo sapiens
ttgaacctgtgagtaaatattga

SEQ ID NO: 6542781 - DNA, 17 bp, Homo sapiens
ttgaaccttaaaaggta

SEQ ID NO: 6542782 - DNA, 20 bp, Homo sapiens
ttgaacctttttttttgaaa

SEQ ID NO: 6542783 - DNA, 17 bp, Homo sapiens
ttgaacgagcagcccag

SEQ ID NO: 6542784 - DNA, 21 bp, Homo sapiens
ttgaacgcttaagtcatcatt

SEQ ID NO: 6542785 - DNA, 16 bp, Homo sapiens
ttgaacgtgccagcag

SEQ ID NO: 6542786 - DNA, 15 bp, Homo sapiens
ttgaacgtgcttctt

SEQ ID NO: 6542787 - DNA, 17 bp, Homo sapiens
ttgaacgtgcttctttg

SEQ ID NO: 6542788 - DNA, 19 bp, Homo sapiens
ttgaacgtgcttctttgta

SEQ ID NO: 6542789 - DNA, 18 bp, Homo sapiens
ttgaacgttttctaattg

SEQ ID NO: 6542790 - DNA, 21 bp, Homo sapiens
ttgaacgttttctaattgctt

SEQ ID NO: 6542791 - DNA, 21 bp, Homo sapiens
ttgaactaacataatcttaaa

SEQ ID NO: 6542792 - DNA, 22 bp, Homo sapiens
ttgaactaagaaacttttgtaa

SEQ ID NO: 6542793 - DNA, 19 bp, Homo sapiens
ttgaactatgaacactgtc

SEQ ID NO: 6542794 - DNA, 16 bp, Homo sapiens
ttgaactatgactgga

SEQ ID NO: 6542795 - DNA, 19 bp, Homo sapiens
ttgaactatgactggagta

SEQ ID NO: 6542796 - DNA, 16 bp, Homo sapiens
ttgaactcctggcctc

SEQ ID NO: 6542797 - DNA, 15 bp, Homo sapiens
ttgaactcctgggct

SEQ ID NO: 6542798 - DNA, 19 bp, Homo sapiens
ttgaactcttcaatctctt

SEQ ID NO: 6542799 - DNA, 20 bp, Homo sapiens
ttgaactcttcactcttcaa

SEQ ID NO: 6542800 - DNA, 12 bp, Homo sapiens
ttgaactgaagg

SEQ ID NO: 6542801 - DNA, 16 bp, Homo sapiens
ttgaactgataaagat

SEQ ID NO: 6542802 - DNA, 21 bp, Homo sapiens
ttgaactgatagttactgttg

SEQ ID NO: 6542803 - DNA, 18 bp, Homo sapiens
ttgaactgcaggaagaga

SEQ ID NO: 6542804 - DNA, 18 bp, Homo sapiens
tgtctgggaaagcagagt

SEQ ID NO: 6542805 - DNA, 15 bp, Homo sapiens
tgtctgggaattgtg

SEQ ID NO: 6542806 - DNA, 18 bp, Homo sapiens
tgtctgggagagcctggc

SEQ ID NO: 6542807 - DNA, 11 bp, Homo sapiens
tgtctgggctg

SEQ ID NO: 6542808 - DNA, 12 bp, Homo sapiens
tgtctgggctga

SEQ ID NO: 6542809 - DNA, 14 bp, Homo sapiens
tgtctggggacagg

SEQ ID NO: 6542810 - DNA, 21 bp, Homo sapiens
tgtctggggagcgggtctgct

SEQ ID NO: 6542811 - DNA, 22 bp, Homo sapiens
tgtctggggagggtcaagggct

SEQ ID NO: 6542812 - DNA, 22 bp, Homo sapiens
tgtctggggccgaggggccagg

SEQ ID NO: 6542813 - DNA, 18 bp, Homo sapiens
tgtctggggtgagggagt

SEQ ID NO: 6542814 - DNA, 15 bp, Homo sapiens
tgtctgggtgctact

SEQ ID NO: 6542815 - DNA, 20 bp, Homo sapiens
tgtctgggtgctactgggga

SEQ ID NO: 6542816 - DNA, 21 bp, Homo sapiens
tgtctgggtgctactggggaa

SEQ ID NO: 6542817 - DNA, 16 bp, Homo sapiens
tgtctgggtttgagaa

SEQ ID NO: 6542818 - DNA, 17 bp, Homo sapiens
tgtctgggtttgagaaa

SEQ ID NO: 6542819 - DNA, 18 bp, Homo sapiens
tgtctgggtttggcccaa

SEQ ID NO: 6542820 - DNA, 19 bp, Homo sapiens
tgtctgggtttggcccaag

SEQ ID NO: 6542821 - DNA, 22 bp, Homo sapiens
tgtctgggtttggcccaagact

SEQ ID NO: 6542822 - DNA, 18 bp, Homo sapiens
tgtctggtccacacacca

SEQ ID NO: 6542823 - DNA, 21 bp, Homo sapiens
tgtctggtggtggcaccatct

SEQ ID NO: 6542824 - DNA, 17 bp, Homo sapiens
tgtctggtgtttgtcat

SEQ ID NO: 6542825 - DNA, 20 bp, Homo sapiens
tgtctggtgtttgtcatggt

SEQ ID NO: 6542826 - DNA, 22 bp, Homo sapiens
tgtctggttctcaattccaaca

SEQ ID NO: 6542827 - DNA, 22 bp, Homo sapiens
tgtctggttttaacaatttcct

SEQ ID NO: 6542828 - DNA, 21 bp, Homo sapiens
tgtctgtaaaaaatgtatgct

SEQ ID NO: 6542829 - DNA, 16 bp, Homo sapiens
tgtctgtaaatcaaga

SEQ ID NO: 6542830 - DNA, 18 bp, Homo sapiens
tgtctgtaaatctaacat

SEQ ID NO: 6542831 - DNA, 21 bp, Homo sapiens
tgtctgtaaatctaacattat

SEQ ID NO: 6542832 - DNA, 23 bp, Homo sapiens
tgtctgtaatcacactctcttct

SEQ ID NO: 6542833 - DNA, 15 bp, Homo sapiens
tgtctgtacacgtgt

SEQ ID NO: 6542834 - DNA, 21 bp, Homo sapiens
tgtctgtacacgtgtcctgta

SEQ ID NO: 6542835 - DNA, 13 bp, Homo sapiens
tgtctgtacatac

SEQ ID NO: 6542836 - DNA, 15 bp, Homo sapiens
tgtctgtactaaaaa

SEQ ID NO: 6542837 - DNA, 15 bp, Homo sapiens
tgtctgtagagaatg

SEQ ID NO: 6542838 - DNA, 20 bp, Homo sapiens
tgtctgtagagggccctggt

SEQ ID NO: 6542839 - DNA, 13 bp, Homo sapiens
tgtctgtagtgtt

SEQ ID NO: 6542840 - DNA, 14 bp, Homo sapiens
tgtctgtagtgttt

SEQ ID NO: 6542841 - DNA, 16 bp, Homo sapiens
tgtctgtatccccagt

SEQ ID NO: 6542842 - DNA, 22 bp, Homo sapiens
tgtctgtatttcatgtggctgt

SEQ ID NO: 6542843 - DNA, 22 bp, Homo sapiens
tgtctgtcaaatgtttccttaa

SEQ ID NO: 6542844 - DNA, 16 bp, Homo sapiens
tgtctgtcaatcacag

SEQ ID NO: 6542845 - DNA, 12 bp, Homo sapiens
tgtctgtcacag

SEQ ID NO: 6542846 - DNA, 20 bp, Homo sapiens
tgtctgtcacaggctgggtc

SEQ ID NO: 6542847 - DNA, 21 bp, Homo sapiens
tgtctgtcaccagctatctgt

SEQ ID NO: 6542848 - DNA, 24 bp, Homo sapiens
tgtctgtcaccagctatctgtcat

SEQ ID NO: 6542849 - DNA, 15 bp, Homo sapiens
tgtctgtcagctgtg

SEQ ID NO: 6542850 - DNA, 21 bp, Homo sapiens
tgtctgtccaacccctccccc

SEQ ID NO: 6542851 - DNA, 16 bp, Homo sapiens
tgtctgtcccagttaa

SEQ ID NO: 6542852 - DNA, 16 bp, Homo sapiens
tgtctgtcccggggtc

SEQ ID NO: 6542853 - DNA, 21 bp, Homo sapiens
tgtctgtcccggggtcctgtg

SEQ ID NO: 6542854 - DNA, 23 bp, Homo sapiens
tgtctgtccctgaactcccagaa

SEQ ID NO: 6542855 - DNA, 12 bp, Homo sapiens
tgtctgtccctt

SEQ ID NO: 6542856 - DNA, 17 bp, Homo sapiens
tgtctgtcctcagagca

SEQ ID NO: 6542857 - DNA, 18 bp, Homo sapiens
tgtctgtcctcagagcag

SEQ ID NO: 6542858 - DNA, 23 bp, Homo sapiens
tgtctgtcctcagagcaggggcc

SEQ ID NO: 6542859 - DNA, 19 bp, Homo sapiens
tgtctgtcgcccttctccc

SEQ ID NO: 6542860 - DNA, 12 bp, Homo sapiens
tgtctgtctaca

SEQ ID NO: 6542861 - DNA, 19 bp, Homo sapiens
tgtctgtctctccatctgt

SEQ ID NO: 6542862 - DNA, 23 bp, Homo sapiens
tgtctgtctctccccctctgtct

SEQ ID NO: 6542863 - DNA, 13 bp, Homo sapiens
tgtctgtctgagg

SEQ ID NO: 6542864 - DNA, 13 bp, Homo sapiens
tgtctgtctgcag

SEQ ID NO: 6542865 - DNA, 14 bp, Homo sapiens
tgtctgtctggcac

SEQ ID NO: 6542866 - DNA, 16 bp, Homo sapiens
tgtctgtctgtctgtc

SEQ ID NO: 6542867 - DNA, 13 bp, Homo sapiens
tgtctgtctgtgg

SEQ ID NO: 6542868 - DNA, 14 bp, Homo sapiens
tgtctgtctgtggg

SEQ ID NO: 6542869 - DNA, 14 bp, Homo sapiens
tgtctgtcttcctt

SEQ ID NO: 6542870 - DNA, 14 bp, Homo sapiens
tgtctgtctttgca

SEQ ID NO: 6542871 - DNA, 17 bp, Homo sapiens
tgtctgtgatctctgct

SEQ ID NO: 6542872 - DNA, 18 bp, Homo sapiens
tgtctgtgatctctgctg

SEQ ID NO: 6542873 - DNA, 14 bp, Homo sapiens
tgtctgtgcacatg

SEQ ID NO: 6542874 - DNA, 20 bp, Homo sapiens
tgtctgtgcacatgcctctg

SEQ ID NO: 6542875 - DNA, 15 bp, Homo sapiens
tgtctgtgcagatgc

SEQ ID NO: 6542876 - DNA, 22 bp, Homo sapiens
tgtctgtgcagatgctttgccc

SEQ ID NO: 6542877 - DNA, 13 bp, Homo sapiens
tgtctgtgccatg

SEQ ID NO: 6542878 - DNA, 11 bp, Homo sapiens
tgtctgtgcta

SEQ ID NO: 6542879 - DNA, 21 bp, Homo sapiens
tgtctgtgctagggaaacttc

SEQ ID NO: 6542880 - DNA, 14 bp, Homo sapiens
tgtctgtgctgtgt

SEQ ID NO: 6542881 - DNA, 17 bp, Homo sapiens
tgtctgtggatggtcat

SEQ ID NO: 6542882 - DNA, 13 bp, Homo sapiens
tgtctgtggccct

SEQ ID NO: 6542883 - DNA, 14 bp, Homo sapiens
tgtctgtggccctc

SEQ ID NO: 6542884 - DNA, 15 bp, Homo sapiens
tgtctgtggccctct

SEQ ID NO: 6542885 - DNA, 17 bp, Homo sapiens
tgtctgtggccctctct

SEQ ID NO: 6542886 - DNA, 14 bp, Homo sapiens
tgtctgtgtataca

SEQ ID NO: 6542887 - DNA, 14 bp, Homo sapiens
tgtctgtgtcccag

SEQ ID NO: 6542888 - DNA, 17 bp, Homo sapiens
tgtctgtgtcccagcca

SEQ ID NO: 6542889 - DNA, 12 bp, Homo sapiens
tgtctgtgtgct

SEQ ID NO: 6542890 - DNA, 15 bp, Homo sapiens
tgtctgtgtgctact

SEQ ID NO: 6542891 - DNA, 18 bp, Homo sapiens
tgtctgtgtgctactaac

SEQ ID NO: 6542892 - DNA, 20 bp, Homo sapiens
tgtctgtgttttgaaagaat

SEQ ID NO: 6542893 - DNA, 13 bp, Homo sapiens
tgtctgttcagtt

SEQ ID NO: 6542894 - DNA, 13 bp, Homo sapiens
tgtctgttcccag

SEQ ID NO: 6542895 - DNA, 14 bp, Homo sapiens
tgtctgttcccagc

SEQ ID NO: 6542896 - DNA, 18 bp, Homo sapiens
tgtctgttcccagcccct

SEQ ID NO: 6542897 - DNA, 21 bp, Homo sapiens
tgtctgttcccagcccctgca

SEQ ID NO: 6542898 - DNA, 15 bp, Homo sapiens
tgtctgttctacata

SEQ ID NO: 6542899 - DNA, 21 bp, Homo sapiens
tgtctgttctacatagatgct

SEQ ID NO: 6542900 - DNA, 14 bp, Homo sapiens
tgtctgttgaacag

SEQ ID NO: 6542901 - DNA, 15 bp, Homo sapiens
tgtctgtttaagaaa

SEQ ID NO: 6542902 - DNA, 16 bp, Homo sapiens
tgtctgtttaagaaaa

SEQ ID NO: 6542903 - DNA, 17 bp, Homo sapiens
tgtctgtttaagaaaag

SEQ ID NO: 6542904 - DNA, 21 bp, Homo sapiens
tgtctgtttaagaaaagtatt

SEQ ID NO: 6542905 - DNA, 21 bp, Homo sapiens
tgtctgtttattaactactga

SEQ ID NO: 6542906 - DNA, 22 bp, Homo sapiens
tgtctgtttattaactactgaa

SEQ ID NO: 6542907 - DNA, 14 bp, Homo sapiens
tgtctgtttcagaa

SEQ ID NO: 6542908 - DNA, 22 bp, Homo sapiens
tgtctgtttgctcaaaattgct

SEQ ID NO: 6542909 - DNA, 20 bp, Homo sapiens
tgtctgtttgtttcaagaac

SEQ ID NO: 6542910 - DNA, 13 bp, Homo sapiens
tgtctgttttcca

SEQ ID NO: 6542911 - DNA, 18 bp, Homo sapiens
tgtctgtttttgtatctt

SEQ ID NO: 6542912 - DNA, 21 bp, Homo sapiens
tgtcttaaaaccagagaatct

SEQ ID NO: 6542913 - DNA, 13 bp, Homo sapiens
tgtcttaaaaggt

SEQ ID NO: 6542914 - DNA, 18 bp, Homo sapiens
tgtcttaaactaaatgtg

SEQ ID NO: 6542915 - DNA, 22 bp, Homo sapiens
tgtcttaaagggaatcattttt

SEQ ID NO: 6542916 - DNA, 23 bp, Homo sapiens
tgtcttaaaggggcctgcgcagg

SEQ ID NO: 6542917 - DNA, 20 bp, Homo sapiens
tgtcttaaataaaagaaatg

SEQ ID NO: 6542918 - DNA, 14 bp, Homo sapiens
tgtcttaaatcagt

SEQ ID NO: 6542919 - DNA, 17 bp, Homo sapiens
tgtcttaaatcagttta

SEQ ID NO: 6542920 - DNA, 23 bp, Homo sapiens
tgtcttaaatgctcataaagatg

SEQ ID NO: 6542921 - DNA, 18 bp, Homo sapiens
tgtcttaacaaatcagat

SEQ ID NO: 6542922 - DNA, 17 bp, Homo sapiens
tgtcttaacctcaggga

SEQ ID NO: 6542923 - DNA, 20 bp, Homo sapiens
tgtcttaagatggaaataca

SEQ ID NO: 6542924 - DNA, 17 bp, Homo sapiens
tgtcttaagtgtttctc

SEQ ID NO: 6542925 - DNA, 18 bp, Homo sapiens
tgtcttaagtgtttctca

SEQ ID NO: 6542926 - DNA, 19 bp, Homo sapiens
tgtcttaagtgtttctcaa

SEQ ID NO: 6542927 - DNA, 18 bp, Homo sapiens
tgtcttaatcgatctggt

SEQ ID NO: 6542928 - DNA, 13 bp, Homo sapiens
tgtcttaatctct

SEQ ID NO: 6542929 - DNA, 15 bp, Homo sapiens
tgtcttaatgaagtt

SEQ ID NO: 6542930 - DNA, 18 bp, Homo sapiens
tgtcttaatgaagtttga

SEQ ID NO: 6542931 - DNA, 12 bp, Homo sapiens
tgtcttaattaa

SEQ ID NO: 6542932 - DNA, 14 bp, Homo sapiens
tgtcttaattaaaa

SEQ ID NO: 6542933 - DNA, 16 bp, Homo sapiens
tgtcttaattaagtaa

SEQ ID NO: 6542934 - DNA, 14 bp, Homo sapiens
tgtcttaattatta

SEQ ID NO: 6542935 - DNA, 22 bp, Homo sapiens
tgtcttacaactgactgactta

SEQ ID NO: 6542936 - DNA, 16 bp, Homo sapiens
tgtcttacattggctt

SEQ ID NO: 6542937 - DNA, 18 bp, Homo sapiens
tgtcttacattggctttt

SEQ ID NO: 6542938 - DNA, 17 bp, Homo sapiens
tgtcttactactttaaa

SEQ ID NO: 6542939 - DNA, 16 bp, Homo sapiens
tgtcttactcaagata

SEQ ID NO: 6542940 - DNA, 22 bp, Homo sapiens
tgtcttagaagaaattaatata

SEQ ID NO: 6542941 - DNA, 13 bp, Homo sapiens
tgtcttagagaga

SEQ ID NO: 6542942 - DNA, 14 bp, Homo sapiens
tgtcttagagagag

SEQ ID NO: 6542943 - DNA, 15 bp, Homo sapiens
tgtcttagagagaga

SEQ ID NO: 6542944 - DNA, 18 bp, Homo sapiens
tgtcttagggaattctga

SEQ ID NO: 6542945 - DNA, 20 bp, Homo sapiens
tgtcttagtcataccatcca

SEQ ID NO: 6542946 - DNA, 19 bp, Homo sapiens
tgtcttagtgcaaaaaaca

SEQ ID NO: 6542947 - DNA, 13 bp, Homo sapiens
tgtcttagttgat

SEQ ID NO: 6542948 - DNA, 18 bp, Homo sapiens
tgtcttagtttgaatgaa

SEQ ID NO: 6542949 - DNA, 16 bp, Homo sapiens
tgtcttataagaaaac

SEQ ID NO: 6542950 - DNA, 22 bp, Homo sapiens
tgtcttatatatatttctttgt

SEQ ID NO: 6542951 - DNA, 19 bp, Homo sapiens
tgtcttatggcgttgcagg

SEQ ID NO: 6542952 - DNA, 14 bp, Homo sapiens
tgtcttatggtctt

SEQ ID NO: 6542953 - DNA, 14 bp, Homo sapiens
tgtcttatgtgaaa

SEQ ID NO: 6542954 - DNA, 22 bp, Homo sapiens
tgtcttattaggataatacata

SEQ ID NO: 6542955 - DNA, 22 bp, Homo sapiens
tgtcttattcctaattcctgta

SEQ ID NO: 6542956 - DNA, 13 bp, Homo sapiens
tgtcttattctta

SEQ ID NO: 6542957 - DNA, 13 bp, Homo sapiens
tgtcttattgcac

SEQ ID NO: 6542958 - DNA, 22 bp, Homo sapiens
tgtcttattttattatttctaa

SEQ ID NO: 6542959 - DNA, 15 bp, Homo sapiens
tgtcttcaaaatata

SEQ ID NO: 6542960 - DNA, 18 bp, Homo sapiens
tgtcttcaaccctgccct

SEQ ID NO: 6542961 - DNA, 23 bp, Homo sapiens
tgtcttcaaccctgccctgcacc

SEQ ID NO: 6542962 - DNA, 13 bp, Homo sapiens
tgtcttcaatgat

SEQ ID NO: 6542963 - DNA, 20 bp, Homo sapiens
tgtcttcaatggaatacagt

SEQ ID NO: 6542964 - DNA, 21 bp, Homo sapiens
tgtcttcaatttgtataaaat

SEQ ID NO: 6542965 - DNA, 19 bp, Homo sapiens
tgtcttcacagctctgtgt

SEQ ID NO: 6542966 - DNA, 15 bp, Homo sapiens
tgtcttcacctgcca

SEQ ID NO: 6542967 - DNA, 16 bp, Homo sapiens
tgtcttcacctgccac

SEQ ID NO: 6542968 - DNA, 15 bp, Homo sapiens
tgtcttcactcttca

SEQ ID NO: 6542969 - DNA, 13 bp, Homo sapiens
tgtcttcacttaa

SEQ ID NO: 6542970 - DNA, 13 bp, Homo sapiens
tgtcttcagagca

SEQ ID NO: 6542971 - DNA, 21 bp, Homo sapiens
tgtcttcagaggctcatctaa

SEQ ID NO: 6542972 - DNA, 22 bp, Homo sapiens
tgtcttcagcagtcaatacaaa

SEQ ID NO: 6542973 - DNA, 16 bp, Homo sapiens
tgtcttcagtctcaca

SEQ ID NO: 6542974 - DNA, 17 bp, Homo sapiens
tgtcttcagtctcacag

SEQ ID NO: 6542975 - DNA, 22 bp, Homo sapiens
tgtcttcagtctcacagagaag

SEQ ID NO: 6542976 - DNA, 23 bp, Homo sapiens
tgtcttcagtggaacacaaatga

SEQ ID NO: 6542977 - DNA, 15 bp, Homo sapiens
tgtcttcatagcaga

SEQ ID NO: 6542978 - DNA, 16 bp, Homo sapiens
tgtcttcatcacttct

SEQ ID NO: 6542979 - DNA, 21 bp, Homo sapiens
tgtcttcatccttagcaacag

SEQ ID NO: 6542980 - DNA, 12 bp, Homo sapiens
tgtcttcatgta

SEQ ID NO: 6542981 - DNA, 17 bp, Homo sapiens
tgtcttcatgttgatgt

SEQ ID NO: 6542982 - DNA, 15 bp, Homo sapiens
tgtcttccaacccca

SEQ ID NO: 6542983 - DNA, 23 bp, Homo sapiens
ttgaactggcaattgtctattta

SEQ ID NO: 6542984 - DNA, 14 bp, Homo sapiens
ttgaactgtaaact

SEQ ID NO: 6542985 - DNA, 23 bp, Homo sapiens
ttgaactgtattctagtggctgt

SEQ ID NO: 6542986 - DNA, 17 bp, Homo sapiens
ttgaactgtggccacct

SEQ ID NO: 6542987 - DNA, 15 bp, Homo sapiens
ttgaactgttagaat

SEQ ID NO: 6542988 - DNA, 19 bp, Homo sapiens
ttgaactgttagatgctga

SEQ ID NO: 6542989 - DNA, 21 bp, Homo sapiens
ttgaactgttctggcctcaga

SEQ ID NO: 6542990 - DNA, 18 bp, Homo sapiens
ttgaactgtttaacactt

SEQ ID NO: 6542991 - DNA, 18 bp, Homo sapiens
ttgaacttcctgcaggta

SEQ ID NO: 6542992 - DNA, 15 bp, Homo sapiens
ttgaacttgaaaaaa

SEQ ID NO: 6542993 - DNA, 16 bp, Homo sapiens
ttgaacttgattgcct

SEQ ID NO: 6542994 - DNA, 18 bp, Homo sapiens
ttgaactttccaaaacct

SEQ ID NO: 6542995 - DNA, 22 bp, Homo sapiens
ttgaactttcctggatgtctga

SEQ ID NO: 6542996 - DNA, 20 bp, Homo sapiens
ttgaactttgacctctgcag

SEQ ID NO: 6542997 - DNA, 13 bp, Homo sapiens
ttgaactttgcca

SEQ ID NO: 6542998 - DNA, 15 bp, Homo sapiens
ttgaactttgccaaa

SEQ ID NO: 6542999 - DNA, 13 bp, Homo sapiens
ttgaactttggaa

SEQ ID NO: 6543000 - DNA, 14 bp, Homo sapiens
ttgaactttggaac

SEQ ID NO: 6543001 - DNA, 20 bp, Homo sapiens
ttgaacttttcattccctgt

SEQ ID NO: 6543002 - DNA, 16 bp, Homo sapiens
ttgaacttttttccac

SEQ ID NO: 6543003 - DNA, 15 bp, Homo sapiens
ttgaagaaaacacaa

SEQ ID NO: 6543004 - DNA, 21 bp, Homo sapiens
ttgaagaaaagaaaaaacaac

SEQ ID NO: 6543005 - DNA, 23 bp, Homo sapiens
ttgaagaaaagaaaaaacaacta

SEQ ID NO: 6543006 - DNA, 16 bp, Homo sapiens
ttgaagaaaagcactt

SEQ ID NO: 6543007 - DNA, 16 bp, Homo sapiens
ttgaagaaaatgactt

SEQ ID NO: 6543008 - DNA, 21 bp, Homo sapiens
ttgaagaaaatgactttattt

SEQ ID NO: 6543009 - DNA, 19 bp, Homo sapiens
ttgaagaaacagataccat

SEQ ID NO: 6543010 - DNA, 14 bp, Homo sapiens
ttgaagaaacgctt

SEQ ID NO: 6543011 - DNA, 20 bp, Homo sapiens
ttgaagaaattataaagata

SEQ ID NO: 6543012 - DNA, 14 bp, Homo sapiens
ttgaagaactgcac

SEQ ID NO: 6543013 - DNA, 20 bp, Homo sapiens
ttgaagaagaaccagcccag

SEQ ID NO: 6543014 - DNA, 18 bp, Homo sapiens
ttgaagaaggtggacctt

SEQ ID NO: 6543015 - DNA, 22 bp, Homo sapiens
ttgaagaaggtggaccttttaa

SEQ ID NO: 6543016 - DNA, 20 bp, Homo sapiens
ttgaagaatagtcataacta

SEQ ID NO: 6543017 - DNA, 14 bp, Homo sapiens
ttgaagaatattta

SEQ ID NO: 6543018 - DNA, 14 bp, Homo sapiens
ttgaagaatctgcc

SEQ ID NO: 6543019 - DNA, 19 bp, Homo sapiens
ttgaagaatgttaagactt

SEQ ID NO: 6543020 - DNA, 17 bp, Homo sapiens
ttgaagacaaaaatact

SEQ ID NO: 6543021 - DNA, 13 bp, Homo sapiens
ttgaagacaattt

SEQ ID NO: 6543022 - DNA, 19 bp, Homo sapiens
ttgaagacaatttgataca

SEQ ID NO: 6543023 - DNA, 17 bp, Homo sapiens
ttgaagacagagctaca

SEQ ID NO: 6543024 - DNA, 19 bp, Homo sapiens
ttgaagacatatcatgtgt

SEQ ID NO: 6543025 - DNA, 20 bp, Homo sapiens
ttgaagacctaaccagggcc

SEQ ID NO: 6543026 - DNA, 14 bp, Homo sapiens
ttgaagacgtggac

SEQ ID NO: 6543027 - DNA, 21 bp, Homo sapiens
ttgaagaggaaaatgaataat

SEQ ID NO: 6543028 - DNA, 10 bp, Homo sapiens
ttgaagaggc

SEQ ID NO: 6543029 - DNA, 19 bp, Homo sapiens
ttgaagaggggagctcagt

SEQ ID NO: 6543030 - DNA, 17 bp, Homo sapiens
ttgaagaggggaggggc

SEQ ID NO: 6543031 - DNA, 15 bp, Homo sapiens
ttgaagaggtgagca

SEQ ID NO: 6543032 - DNA, 20 bp, Homo sapiens
ttgaagataataatcttggc

SEQ ID NO: 6543033 - DNA, 13 bp, Homo sapiens
ttgaagatgtagc

SEQ ID NO: 6543034 - DNA, 15 bp, Homo sapiens
ttgaagatgtagctt

SEQ ID NO: 6543035 - DNA, 16 bp, Homo sapiens
ttgaagatgtagcttc

SEQ ID NO: 6543036 - DNA, 12 bp, Homo sapiens
ttgaagatgtcc

SEQ ID NO: 6543037 - DNA, 13 bp, Homo sapiens
ttgaagattctat

SEQ ID NO: 6543038 - DNA, 17 bp, Homo sapiens
ttgaagatttgaggact

SEQ ID NO: 6543039 - DNA, 20 bp, Homo sapiens
ttgaagcaaatcgaatgaaa

SEQ ID NO: 6543040 - DNA, 17 bp, Homo sapiens
ttgaagcaataactcca

SEQ ID NO: 6543041 - DNA, 22 bp, Homo sapiens
ttgaagcaataactccaagcag

SEQ ID NO: 6543042 - DNA, 20 bp, Homo sapiens
ttgaagcacagtgatcaagt

SEQ ID NO: 6543043 - DNA, 22 bp, Homo sapiens
ttgaagcaccatggtgtgtcat

SEQ ID NO: 6543044 - DNA, 11 bp, Homo sapiens
ttgaagcagct

SEQ ID NO: 6543045 - DNA, 16 bp, Homo sapiens
ttgaagcagctctgcc

SEQ ID NO: 6543046 - DNA, 15 bp, Homo sapiens
ttgaagcagttgtgt

SEQ ID NO: 6543047 - DNA, 22 bp, Homo sapiens
ttgaagcatagctacaatttgt

SEQ ID NO: 6543048 - DNA, 17 bp, Homo sapiens
ttgaagcattttataaa

SEQ ID NO: 6543049 - DNA, 11 bp, Homo sapiens
ttgaagccaaa

SEQ ID NO: 6543050 - DNA, 13 bp, Homo sapiens
ttgaagccactga

SEQ ID NO: 6543051 - DNA, 21 bp, Homo sapiens
ttgaagccactgaagctggga

SEQ ID NO: 6543052 - DNA, 19 bp, Homo sapiens
ttgaagccgactctggccc

SEQ ID NO: 6543053 - DNA, 16 bp, Homo sapiens
ttgaagcctgctcctt

SEQ ID NO: 6543054 - DNA, 20 bp, Homo sapiens
ttgaagcctttttttagtaa

SEQ ID NO: 6543055 - DNA, 15 bp, Homo sapiens
ttgaagcgagtcatt

SEQ ID NO: 6543056 - DNA, 18 bp, Homo sapiens
ttgaagctaaaaggaaaa

SEQ ID NO: 6543057 - DNA, 11 bp, Homo sapiens
ttgaagctaac

SEQ ID NO: 6543058 - DNA, 17 bp, Homo sapiens
ttgaagctaattatttt

SEQ ID NO: 6543059 - DNA, 24 bp, Homo sapiens
ttgaagcttgcaccttttcatgta

SEQ ID NO: 6543060 - DNA, 14 bp, Homo sapiens
ttgaagctttgtag

SEQ ID NO: 6543061 - DNA, 19 bp, Homo sapiens
ttgaaggaaagctatatct

SEQ ID NO: 6543062 - DNA, 18 bp, Homo sapiens
ttgaaggaaccaagtgca

SEQ ID NO: 6543063 - DNA, 15 bp, Homo sapiens
ttgaaggaagaggga

SEQ ID NO: 6543064 - DNA, 16 bp, Homo sapiens
ttgaaggaatacaata

SEQ ID NO: 6543065 - DNA, 13 bp, Homo sapiens
ttgaaggactaca

SEQ ID NO: 6543066 - DNA, 17 bp, Homo sapiens
ttgaaggagaaaataga

SEQ ID NO: 6543067 - DNA, 22 bp, Homo sapiens
ttgaaggagaatggcatggcag

SEQ ID NO: 6543068 - DNA, 22 bp, Homo sapiens
ttgaaggattgcatcctgctgg

SEQ ID NO: 6543069 - DNA, 15 bp, Homo sapiens
ttgaaggcaaaattg

SEQ ID NO: 6543070 - DNA, 20 bp, Homo sapiens
ttgaaggccctgctgagtca

SEQ ID NO: 6543071 - DNA, 13 bp, Homo sapiens
ttgaaggcctgga

SEQ ID NO: 6543072 - DNA, 20 bp, Homo sapiens
ttgaaggcttaattgactga

SEQ ID NO: 6543073 - DNA, 17 bp, Homo sapiens
ttgaagggaaatttcag

SEQ ID NO: 6543074 - DNA, 15 bp, Homo sapiens
ttgaagggaggggct

SEQ ID NO: 6543075 - DNA, 19 bp, Homo sapiens
ttgaagggcaagaaatggc

SEQ ID NO: 6543076 - DNA, 17 bp, Homo sapiens
ttgaagggccagagcca

SEQ ID NO: 6543077 - DNA, 19 bp, Homo sapiens
ttgaagggccagagccagg

SEQ ID NO: 6543078 - DNA, 19 bp, Homo sapiens
ttgaaggggcttctaatga

SEQ ID NO: 6543079 - DNA, 16 bp, Homo sapiens
ttgaagggggatgcag

SEQ ID NO: 6543080 - DNA, 18 bp, Homo sapiens
ttgaagggtaaagaagtt

SEQ ID NO: 6543081 - DNA, 19 bp, Homo sapiens
ttgaagggtaaagaagttt

SEQ ID NO: 6543082 - DNA, 13 bp, Homo sapiens
ttgaagggtcctg

SEQ ID NO: 6543083 - DNA, 14 bp, Homo sapiens
ttgaagggtcctgc

SEQ ID NO: 6543084 - DNA, 16 bp, Homo sapiens
ttgaaggtagaatgtt

SEQ ID NO: 6543085 - DNA, 17 bp, Homo sapiens
ttgaaggttaaaggaaa

SEQ ID NO: 6543086 - DNA, 12 bp, Homo sapiens
ttgaaggtttca

SEQ ID NO: 6543087 - DNA, 18 bp, Homo sapiens
ttgaaggtttcagatgag

SEQ ID NO: 6543088 - DNA, 19 bp, Homo sapiens
ttgaaggtttgatgccaaa

SEQ ID NO: 6543089 - DNA, 21 bp, Homo sapiens
ttgaaggtttgatgccaaagc

SEQ ID NO: 6543090 - DNA, 16 bp, Homo sapiens
ttgaaggtttttgata

SEQ ID NO: 6543091 - DNA, 14 bp, Homo sapiens
ttgaagtaaaatgt

SEQ ID NO: 6543092 - DNA, 15 bp, Homo sapiens
ttgaagtaaactttt

SEQ ID NO: 6543093 - DNA, 21 bp, Homo sapiens
ttgaagtaactataacaaaaa

SEQ ID NO: 6543094 - DNA, 19 bp, Homo sapiens
ttgaagtaagttcatcaaa

SEQ ID NO: 6543095 - DNA, 21 bp, Homo sapiens
ttgaagtacagcataagggaa

SEQ ID NO: 6543096 - DNA, 14 bp, Homo sapiens
ttgaagtatattct

SEQ ID NO: 6543097 - DNA, 22 bp, Homo sapiens
ttgaagtatattcttattggaa

SEQ ID NO: 6543098 - DNA, 18 bp, Homo sapiens
ttgaagtatctgtacctg

SEQ ID NO: 6543099 - DNA, 15 bp, Homo sapiens
ttgaagtcacccggc

SEQ ID NO: 6543100 - DNA, 21 bp, Homo sapiens
ttgaagtcagccacactgggc

SEQ ID NO: 6543101 - DNA, 23 bp, Homo sapiens
ttgaagtcagccacactgggcct

SEQ ID NO: 6543102 - DNA, 20 bp, Homo sapiens
ttgaagtcatcttagctttc

SEQ ID NO: 6543103 - DNA, 19 bp, Homo sapiens
ttgaagtctataaaaaata

SEQ ID NO: 6543104 - DNA, 17 bp, Homo sapiens
ttgaagtctccttttgt

SEQ ID NO: 6543105 - DNA, 17 bp, Homo sapiens
ttgaagtcttccctcag

SEQ ID NO: 6543106 - DNA, 18 bp, Homo sapiens
ttgaagtcttccctcaga

SEQ ID NO: 6543107 - DNA, 22 bp, Homo sapiens
ttgaagtcttcttatctaaacc

SEQ ID NO: 6543108 - DNA, 18 bp, Homo sapiens
ttgaagtctttaataaat

SEQ ID NO: 6543109 - DNA, 20 bp, Homo sapiens
ttgaagtctttaataaataa

SEQ ID NO: 6543110 - DNA, 23 bp, Homo sapiens
ttgaagtgaaatctgtgcaataa

SEQ ID NO: 6543111 - DNA, 21 bp, Homo sapiens
ttgaagtgaacaaatttcaaa

SEQ ID NO: 6543112 - DNA, 20 bp, Homo sapiens
ttgaagtgagaaaatgaaca

SEQ ID NO: 6543113 - DNA, 12 bp, Homo sapiens
ttgaagtgagag

SEQ ID NO: 6543114 - DNA, 21 bp, Homo sapiens
ttgaagtgcctctgattctat

SEQ ID NO: 6543115 - DNA, 18 bp, Homo sapiens
ttgaagtggccagatgag

SEQ ID NO: 6543116 - DNA, 18 bp, Homo sapiens
ttgaagtgtaggcagaca

SEQ ID NO: 6543117 - DNA, 20 bp, Homo sapiens
ttgaagtgtaggcagacaca

SEQ ID NO: 6543118 - DNA, 13 bp, Homo sapiens
ttgaagtgtcttc

SEQ ID NO: 6543119 - DNA, 22 bp, Homo sapiens
ttgaagtgtcttctgttcccaa

SEQ ID NO: 6543120 - DNA, 13 bp, Homo sapiens
ttgaagttaactg

SEQ ID NO: 6543121 - DNA, 15 bp, Homo sapiens
ttgaagttatttaga

SEQ ID NO: 6543122 - DNA, 20 bp, Homo sapiens
ttgaagttatttagaaatat

SEQ ID NO: 6543123 - DNA, 11 bp, Homo sapiens
ttgaagttgtt

SEQ ID NO: 6543124 - DNA, 21 bp, Homo sapiens
ttgaagttgttactaactaaa

SEQ ID NO: 6543125 - DNA, 13 bp, Homo sapiens
ttgaagtttacat

SEQ ID NO: 6543126 - DNA, 16 bp, Homo sapiens
ttgaagtttacatttt

SEQ ID NO: 6543127 - DNA, 19 bp, Homo sapiens
ttgaagtttcaagttttaa

SEQ ID NO: 6543128 - DNA, 15 bp, Homo sapiens
ttgaagtttgaacca

SEQ ID NO: 6543129 - DNA, 23 bp, Homo sapiens
ttgaataaaaagtgaacttttgt

SEQ ID NO: 6543130 - DNA, 14 bp, Homo sapiens
ttgaataaaaatag

SEQ ID NO: 6543131 - DNA, 20 bp, Homo sapiens
ttgaataaaaatatgtacaa

SEQ ID NO: 6543132 - DNA, 22 bp, Homo sapiens
ttgaataaagaatacttgaact

SEQ ID NO: 6543133 - DNA, 21 bp, Homo sapiens
ttgaataaagcctgcttttta

SEQ ID NO: 6543134 - DNA, 15 bp, Homo sapiens
ttgaataaagtattc

SEQ ID NO: 6543135 - DNA, 17 bp, Homo sapiens
ttgaataaagtattcta

SEQ ID NO: 6543136 - DNA, 18 bp, Homo sapiens
ttgaataaagtctgagtg

SEQ ID NO: 6543137 - DNA, 19 bp, Homo sapiens
ttgaataaagtctgagtgg

SEQ ID NO: 6543138 - DNA, 12 bp, Homo sapiens
ttgaataaataa

SEQ ID NO: 6543139 - DNA, 21 bp, Homo sapiens
ttgaataaatgtatctgaata

SEQ ID NO: 6543140 - DNA, 14 bp, Homo sapiens
ttgaataaatgtgt

SEQ ID NO: 6543141 - DNA, 23 bp, Homo sapiens
ttgaataagcagaacatactgtt

SEQ ID NO: 6543142 - DNA, 14 bp, Homo sapiens
ttgaataagtattc

SEQ ID NO: 6543143 - DNA, 23 bp, Homo sapiens
ttgaataataaatcgatccatgt

SEQ ID NO: 6543144 - DNA, 15 bp, Homo sapiens
ttgaataatgtctag

SEQ ID NO: 6543145 - DNA, 13 bp, Homo sapiens
ttgaataatgttt

SEQ ID NO: 6543146 - DNA, 20 bp, Homo sapiens
ttgaataatgttttttgaag

SEQ ID NO: 6543147 - DNA, 12 bp, Homo sapiens
ttgaataatttg

SEQ ID NO: 6543148 - DNA, 19 bp, Homo sapiens
ttgaatacccccagagacc

SEQ ID NO: 6543149 - DNA, 12 bp, Homo sapiens
ttgaatactgtc

SEQ ID NO: 6543150 - DNA, 15 bp, Homo sapiens
ttgaatactgtctgt

SEQ ID NO: 6543151 - DNA, 19 bp, Homo sapiens
ttgaatactttgaatgtgt

SEQ ID NO: 6543152 - DNA, 13 bp, Homo sapiens
ttgaatacttttt

SEQ ID NO: 6543153 - DNA, 19 bp, Homo sapiens
ttgaataggaaataaaatt

SEQ ID NO: 6543154 - DNA, 18 bp, Homo sapiens
ttgaataggaagatcgtt

SEQ ID NO: 6543155 - DNA, 13 bp, Homo sapiens
ttgaataggagtt

SEQ ID NO: 6543156 - DNA, 20 bp, Homo sapiens
ttgaataggcattaaatgca

SEQ ID NO: 6543157 - DNA, 23 bp, Homo sapiens
ttgaatagggctaggaatataga

SEQ ID NO: 6543158 - DNA, 20 bp, Homo sapiens
ttgaataggggaaagaaatt

SEQ ID NO: 6543159 - DNA, 15 bp, Homo sapiens
ttgaatagtattgtg

SEQ ID NO: 6543160 - DNA, 16 bp, Homo sapiens
ttgaatagtattgtgt

SEQ ID NO: 6543161 - DNA, 17 bp, Homo sapiens
ttgaatataaaaaatca

SEQ ID NO: 6543162 - DNA, 20 bp, Homo sapiens
tgtcttccaaccccagctgg

SEQ ID NO: 6543163 - DNA, 23 bp, Homo sapiens
tgtcttccaggtccaaacccttc

SEQ ID NO: 6543164 - DNA, 17 bp, Homo sapiens
tgtcttccataatgtat

SEQ ID NO: 6543165 - DNA, 18 bp, Homo sapiens
tgtcttccatgtgaacag

SEQ ID NO: 6543166 - DNA, 22 bp, Homo sapiens
tgtcttcccccctctcctccca

SEQ ID NO: 6543167 - DNA, 23 bp, Homo sapiens
tgtcttcccccctctcctcccag

SEQ ID NO: 6543168 - DNA, 12 bp, Homo sapiens
tgtcttcccctg

SEQ ID NO: 6543169 - DNA, 13 bp, Homo sapiens
tgtcttccctggg

SEQ ID NO: 6543170 - DNA, 23 bp, Homo sapiens
tgtcttccctgggctgccaccag

SEQ ID NO: 6543171 - DNA, 12 bp, Homo sapiens
tgtcttcccttc

SEQ ID NO: 6543172 - DNA, 11 bp, Homo sapiens
tgtcttcctca

SEQ ID NO: 6543173 - DNA, 13 bp, Homo sapiens
tgtcttcctctgc

SEQ ID NO: 6543174 - DNA, 15 bp, Homo sapiens
tgtcttcctctgcaa

SEQ ID NO: 6543175 - DNA, 21 bp, Homo sapiens
tgtcttcctctgcaagtgctc

SEQ ID NO: 6543176 - DNA, 14 bp, Homo sapiens
tgtcttcctgtggg

SEQ ID NO: 6543177 - DNA, 14 bp, Homo sapiens
tgtcttccttttct

SEQ ID NO: 6543178 - DNA, 20 bp, Homo sapiens
tgtcttcgctggctcctacc

SEQ ID NO: 6543179 - DNA, 19 bp, Homo sapiens
tgtcttcggaaaccttggt

SEQ ID NO: 6543180 - DNA, 17 bp, Homo sapiens
tgtcttcgtacagttct

SEQ ID NO: 6543181 - DNA, 22 bp, Homo sapiens
tgtcttctcaggctctgccctg

SEQ ID NO: 6543182 - DNA, 23 bp, Homo sapiens
tgtcttctcaggctctgccctgc

SEQ ID NO: 6543183 - DNA, 12 bp, Homo sapiens
tgtcttctccca

SEQ ID NO: 6543184 - DNA, 18 bp, Homo sapiens
tgtcttctctatcctctc

SEQ ID NO: 6543185 - DNA, 14 bp, Homo sapiens
tgtcttctctccac

SEQ ID NO: 6543186 - DNA, 14 bp, Homo sapiens
tgtcttctctgtct

SEQ ID NO: 6543187 - DNA, 12 bp, Homo sapiens
tgtcttctgctg

SEQ ID NO: 6543188 - DNA, 14 bp, Homo sapiens
tgtcttctgctttg

SEQ ID NO: 6543189 - DNA, 24 bp, Homo sapiens
tgtcttctggacttggtcttgaag

SEQ ID NO: 6543190 - DNA, 19 bp, Homo sapiens
tgtcttctgggcacagtgg

SEQ ID NO: 6543191 - DNA, 14 bp, Homo sapiens
tgtcttctggtctg

SEQ ID NO: 6543192 - DNA, 13 bp, Homo sapiens
tgtcttcttaaaa

SEQ ID NO: 6543193 - DNA, 13 bp, Homo sapiens
tgtcttcttgaaa

SEQ ID NO: 6543194 - DNA, 17 bp, Homo sapiens
tgtcttctttccatccc

SEQ ID NO: 6543195 - DNA, 16 bp, Homo sapiens
tgtcttctttctccat

SEQ ID NO: 6543196 - DNA, 12 bp, Homo sapiens
tgtcttgaaaaa

SEQ ID NO: 6543197 - DNA, 15 bp, Homo sapiens
tgtcttgaaagtggc

SEQ ID NO: 6543198 - DNA, 18 bp, Homo sapiens
tgtcttgactttttaaaa

SEQ ID NO: 6543199 - DNA, 18 bp, Homo sapiens
tgtcttgagaccagcctg

SEQ ID NO: 6543200 - DNA, 22 bp, Homo sapiens
tgtcttgagaccagcctgccag

SEQ ID NO: 6543201 - DNA, 23 bp, Homo sapiens
tgtcttgagaccagcctgccagg

SEQ ID NO: 6543202 - DNA, 17 bp, Homo sapiens
tgtcttgagaggagact

SEQ ID NO: 6543203 - DNA, 14 bp, Homo sapiens
tgtcttgagctcta

SEQ ID NO: 6543204 - DNA, 20 bp, Homo sapiens
tgtcttgataaagtggaatt

SEQ ID NO: 6543205 - DNA, 18 bp, Homo sapiens
tgtcttgatgactgctga

SEQ ID NO: 6543206 - DNA, 14 bp, Homo sapiens
tgtcttgatgtttt

SEQ ID NO: 6543207 - DNA, 13 bp, Homo sapiens
tgtcttgcaactt

SEQ ID NO: 6543208 - DNA, 15 bp, Homo sapiens
tgtcttgcaatggca

SEQ ID NO: 6543209 - DNA, 18 bp, Homo sapiens
tgtcttgcaatggcagcc

SEQ ID NO: 6543210 - DNA, 21 bp, Homo sapiens
tgtcttgcaatggcagccttg

SEQ ID NO: 6543211 - DNA, 22 bp, Homo sapiens
tgtcttgcactggccttctgat

SEQ ID NO: 6543212 - DNA, 13 bp, Homo sapiens
tgtcttgcagtgg

SEQ ID NO: 6543213 - DNA, 12 bp, Homo sapiens
tgtcttgcattt

SEQ ID NO: 6543214 - DNA, 17 bp, Homo sapiens
tgtcttgccttcatttc

SEQ ID NO: 6543215 - DNA, 21 bp, Homo sapiens
tgtcttgcctttttcattatt

SEQ ID NO: 6543216 - DNA, 21 bp, Homo sapiens
tgtcttgcgggtctgtcaggg

SEQ ID NO: 6543217 - DNA, 14 bp, Homo sapiens
tgtcttgctgtcat

SEQ ID NO: 6543218 - DNA, 19 bp, Homo sapiens
tgtcttgctgttgacatat

SEQ ID NO: 6543219 - DNA, 16 bp, Homo sapiens
tgtcttgcttgattga

SEQ ID NO: 6543220 - DNA, 12 bp, Homo sapiens
tgtcttggaagt

SEQ ID NO: 6543221 - DNA, 13 bp, Homo sapiens
tgtcttggacact

SEQ ID NO: 6543222 - DNA, 16 bp, Homo sapiens
tgtcttgggcagagct

SEQ ID NO: 6543223 - DNA, 21 bp, Homo sapiens
tgtcttgggcagagctggctc

SEQ ID NO: 6543224 - DNA, 18 bp, Homo sapiens
tgtcttggggtcccactg

SEQ ID NO: 6543225 - DNA, 22 bp, Homo sapiens
tgtcttggggtcccactgctcg

SEQ ID NO: 6543226 - DNA, 13 bp, Homo sapiens
tgtcttgtacatg

SEQ ID NO: 6543227 - DNA, 16 bp, Homo sapiens
tgtcttgtacatgtgt

SEQ ID NO: 6543228 - DNA, 20 bp, Homo sapiens
tgtcttgtacatgtgtagcc

SEQ ID NO: 6543229 - DNA, 18 bp, Homo sapiens
tgtcttgtacttctgtgt

SEQ ID NO: 6543230 - DNA, 15 bp, Homo sapiens
tgtcttgtcatcttt

SEQ ID NO: 6543231 - DNA, 16 bp, Homo sapiens
tgtcttgtcatctttt

SEQ ID NO: 6543232 - DNA, 19 bp, Homo sapiens
tgtcttgtgtatttctctg

SEQ ID NO: 6543233 - DNA, 17 bp, Homo sapiens
tgtcttgttaatattct

SEQ ID NO: 6543234 - DNA, 18 bp, Homo sapiens
tgtcttgttaatattctt

SEQ ID NO: 6543235 - DNA, 18 bp, Homo sapiens
tgtcttgttatgtacaaa

SEQ ID NO: 6543236 - DNA, 15 bp, Homo sapiens
tgtcttgttcctgtg

SEQ ID NO: 6543237 - DNA, 18 bp, Homo sapiens
tgtcttgttctgtcactc

SEQ ID NO: 6543238 - DNA, 17 bp, Homo sapiens
tgtcttgttctgtccct

SEQ ID NO: 6543239 - DNA, 21 bp, Homo sapiens
tgtcttgttctgtcccttcca

SEQ ID NO: 6543240 - DNA, 14 bp, Homo sapiens
tgtcttgttcttga

SEQ ID NO: 6543241 - DNA, 15 bp, Homo sapiens
tgtcttgttcttgag

SEQ ID NO: 6543242 - DNA, 17 bp, Homo sapiens
tgtcttgttcttgagat

SEQ ID NO: 6543243 - DNA, 11 bp, Homo sapiens
tgtctttaaaa

SEQ ID NO: 6543244 - DNA, 14 bp, Homo sapiens
tgtctttaaaaact

SEQ ID NO: 6543245 - DNA, 15 bp, Homo sapiens
tgtctttaaaatgat

SEQ ID NO: 6543246 - DNA, 14 bp, Homo sapiens
tgtctttaaataga

SEQ ID NO: 6543247 - DNA, 19 bp, Homo sapiens
tgtctttaaatagatacaa

SEQ ID NO: 6543248 - DNA, 14 bp, Homo sapiens
tgtctttaaggaaa

SEQ ID NO: 6543249 - DNA, 12 bp, Homo sapiens
tgtctttactcc

SEQ ID NO: 6543250 - DNA, 15 bp, Homo sapiens
tgtctttagatagcc

SEQ ID NO: 6543251 - DNA, 18 bp, Homo sapiens
tgtctttagatagccctg

SEQ ID NO: 6543252 - DNA, 12 bp, Homo sapiens
tgtctttatatg

SEQ ID NO: 6543253 - DNA, 22 bp, Homo sapiens
tgtctttatttttatcccagga

SEQ ID NO: 6543254 - DNA, 23 bp, Homo sapiens
tgtctttatttttatcccaggaa

SEQ ID NO: 6543255 - DNA, 13 bp, Homo sapiens
tgtctttcaaact

SEQ ID NO: 6543256 - DNA, 20 bp, Homo sapiens
tgtctttcaaactccaaggt

SEQ ID NO: 6543257 - DNA, 18 bp, Homo sapiens
tgtctttcaatgcagttt

SEQ ID NO: 6543258 - DNA, 19 bp, Homo sapiens
tgtctttcaatgcagtttt

SEQ ID NO: 6543259 - DNA, 19 bp, Homo sapiens
tgtctttcagatacatggt

SEQ ID NO: 6543260 - DNA, 20 bp, Homo sapiens
tgtctttcagatacatggtt

SEQ ID NO: 6543261 - DNA, 19 bp, Homo sapiens
tgtctttcagcattaggct

SEQ ID NO: 6543262 - DNA, 17 bp, Homo sapiens
tgtctttcatctcccag

SEQ ID NO: 6543263 - DNA, 20 bp, Homo sapiens
tgtctttccacttctctggg

SEQ ID NO: 6543264 - DNA, 13 bp, Homo sapiens
tgtctttcctaga

SEQ ID NO: 6543265 - DNA, 16 bp, Homo sapiens
tgtctttcctcccttc

SEQ ID NO: 6543266 - DNA, 13 bp, Homo sapiens
tgtctttcctgaa

SEQ ID NO: 6543267 - DNA, 23 bp, Homo sapiens
tgtctttctagccataataaaat

SEQ ID NO: 6543268 - DNA, 17 bp, Homo sapiens
tgtctttctccaaagtt

SEQ ID NO: 6543269 - DNA, 16 bp, Homo sapiens
tgtctttctgcagaaa

SEQ ID NO: 6543270 - DNA, 13 bp, Homo sapiens
tgtctttcttgta

SEQ ID NO: 6543271 - DNA, 12 bp, Homo sapiens
tgtctttctttg

SEQ ID NO: 6543272 - DNA, 21 bp, Homo sapiens
tgtctttctttgtcattcagt

SEQ ID NO: 6543273 - DNA, 22 bp, Homo sapiens
tgtctttctttgtcattcagtt

SEQ ID NO: 6543274 - DNA, 20 bp, Homo sapiens
tgtctttgcggggcctgtct

SEQ ID NO: 6543275 - DNA, 13 bp, Homo sapiens
tgtctttgctgtt

SEQ ID NO: 6543276 - DNA, 21 bp, Homo sapiens
tgtctttgctgtttatatata

SEQ ID NO: 6543277 - DNA, 21 bp, Homo sapiens
tgtctttggaaaaatgtttgt

SEQ ID NO: 6543278 - DNA, 17 bp, Homo sapiens
tgtctttggaccctgag

SEQ ID NO: 6543279 - DNA, 23 bp, Homo sapiens
tgtctttggaccctgaggcccag

SEQ ID NO: 6543280 - DNA, 19 bp, Homo sapiens
tgtctttggataataggaa

SEQ ID NO: 6543281 - DNA, 21 bp, Homo sapiens
tgtctttggataataggaatt

SEQ ID NO: 6543282 - DNA, 13 bp, Homo sapiens
tgtctttgtaata

SEQ ID NO: 6543283 - DNA, 20 bp, Homo sapiens
tgtctttgtaatattttcca

SEQ ID NO: 6543284 - DNA, 15 bp, Homo sapiens
tgtctttgtccctgt

SEQ ID NO: 6543285 - DNA, 16 bp, Homo sapiens
tgtcttttaaaatgca

SEQ ID NO: 6543286 - DNA, 13 bp, Homo sapiens
tgtcttttaggac

SEQ ID NO: 6543287 - DNA, 20 bp, Homo sapiens
tgtcttttcaagtaattttc

SEQ ID NO: 6543288 - DNA, 20 bp, Homo sapiens
tgtcttttcaatcttctact

SEQ ID NO: 6543289 - DNA, 16 bp, Homo sapiens
tgtcttttccactcct

SEQ ID NO: 6543290 - DNA, 19 bp, Homo sapiens
tgtcttttcccatttatct

SEQ ID NO: 6543291 - DNA, 14 bp, Homo sapiens
tgtcttttcccctc

SEQ ID NO: 6543292 - DNA, 13 bp, Homo sapiens
tgtcttttctgct

SEQ ID NO: 6543293 - DNA, 18 bp, Homo sapiens
tgtcttttctgctgagga

SEQ ID NO: 6543294 - DNA, 14 bp, Homo sapiens
tgtcttttgaagaa

SEQ ID NO: 6543295 - DNA, 14 bp, Homo sapiens
tgtcttttgaatat

SEQ ID NO: 6543296 - DNA, 12 bp, Homo sapiens
tgtcttttgaca

SEQ ID NO: 6543297 - DNA, 12 bp, Homo sapiens
tgtcttttgcat

SEQ ID NO: 6543298 - DNA, 13 bp, Homo sapiens
tgtcttttggagg

SEQ ID NO: 6543299 - DNA, 22 bp, Homo sapiens
tgtctttttcatttttttctct

SEQ ID NO: 6543300 - DNA, 14 bp, Homo sapiens
tgtctttttcctat

SEQ ID NO: 6543301 - DNA, 14 bp, Homo sapiens
tgtctttttccttt

SEQ ID NO: 6543302 - DNA, 23 bp, Homo sapiens
tgtctttttctggactgaagcct

SEQ ID NO: 6543303 - DNA, 15 bp, Homo sapiens
tgtctttttgtatct

SEQ ID NO: 6543304 - DNA, 15 bp, Homo sapiens
tgtctttttgttgta

SEQ ID NO: 6543305 - DNA, 12 bp, Homo sapiens
tgtcttttttct

SEQ ID NO: 6543306 - DNA, 18 bp, Homo sapiens
tgtcttttttctctctta

SEQ ID NO: 6543307 - DNA, 16 bp, Homo sapiens
tgtctttttttactta

SEQ ID NO: 6543308 - DNA, 14 bp, Homo sapiens
tgtctttttttgta

SEQ ID NO: 6543309 - DNA, 21 bp, Homo sapiens
tgtcttttttttaatgtgctg

SEQ ID NO: 6543310 - DNA, 18 bp, Homo sapiens
tgtcttttttttcatcct

SEQ ID NO: 6543311 - DNA, 23 bp, Homo sapiens
tgtctttttttttctttttccag

SEQ ID NO: 6543312 - DNA, 23 bp, Homo sapiens
tgtctttttttttttttttaatg

SEQ ID NO: 6543313 - DNA, 16 bp, Homo sapiens
tgtgaaaaaaaatttg

SEQ ID NO: 6543314 - DNA, 17 bp, Homo sapiens
tgtgaaaaaaatgaaat

SEQ ID NO: 6543315 - DNA, 21 bp, Homo sapiens
tgtgaaaaaaatgaaataaag

SEQ ID NO: 6543316 - DNA, 13 bp, Homo sapiens
tgtgaaaaaagaa

SEQ ID NO: 6543317 - DNA, 18 bp, Homo sapiens
tgtgaaaaaggaataaaa

SEQ ID NO: 6543318 - DNA, 12 bp, Homo sapiens
tgtgaaaaatta

SEQ ID NO: 6543319 - DNA, 17 bp, Homo sapiens
tgtgaaaaattaacttt

SEQ ID NO: 6543320 - DNA, 17 bp, Homo sapiens
tgtgaaaacatatttgt

SEQ ID NO: 6543321 - DNA, 21 bp, Homo sapiens
tgtgaaaagaaaaatgagcct

SEQ ID NO: 6543322 - DNA, 18 bp, Homo sapiens
tgtgaaaagcttaataaa

SEQ ID NO: 6543323 - DNA, 14 bp, Homo sapiens
tgtgaaaaggcttt

SEQ ID NO: 6543324 - DNA, 13 bp, Homo sapiens
tgtgaaaagtaaa

SEQ ID NO: 6543325 - DNA, 13 bp, Homo sapiens
tgtgaaaataaag

SEQ ID NO: 6543326 - DNA, 21 bp, Homo sapiens
tgtgaaaataaagcagaagca

SEQ ID NO: 6543327 - DNA, 22 bp, Homo sapiens
tgtgaaaataaagcagaagcaa

SEQ ID NO: 6543328 - DNA, 21 bp, Homo sapiens
tgtgaaaataatagccatcct

SEQ ID NO: 6543329 - DNA, 15 bp, Homo sapiens
tgtgaaaatagtgta

SEQ ID NO: 6543330 - DNA, 21 bp, Homo sapiens
tgtgaaaatagtgtaagaact

SEQ ID NO: 6543331 - DNA, 17 bp, Homo sapiens
tgtgaaaatatacttga

SEQ ID NO: 6543332 - DNA, 18 bp, Homo sapiens
tgtgaaaatatctgctca

SEQ ID NO: 6543333 - DNA, 19 bp, Homo sapiens
tgtgaaaatcatgaaaaga

SEQ ID NO: 6543334 - DNA, 18 bp, Homo sapiens
tgtgaaaatgctttgaaa

SEQ ID NO: 6543335 - DNA, 13 bp, Homo sapiens
tgtgaaaatgggt

SEQ ID NO: 6543336 - DNA, 18 bp, Homo sapiens
tgtgaaaatggtccagga

SEQ ID NO: 6543337 - DNA, 17 bp, Homo sapiens
tgtgaaaatgtgtgtgt

SEQ ID NO: 6543338 - DNA, 23 bp, Homo sapiens
tgtgaaacaatgttgtccaacaa

SEQ ID NO: 6543339 - DNA, 16 bp, Homo sapiens
tgtgaaacagtatcat

SEQ ID NO: 6543340 - DNA, 22 bp, Homo sapiens
tgtgaaacagtgtggatgtaaa

SEQ ID NO: 6543341 - DNA, 15 bp, Homo sapiens
tgtgaaacatggttg

SEQ ID NO: 6543342 - DNA, 20 bp, Homo sapiens
ttgaatatacagagccttga

SEQ ID NO: 6543343 - DNA, 17 bp, Homo sapiens
ttgaatatagcctgcct

SEQ ID NO: 6543344 - DNA, 13 bp, Homo sapiens
ttgaatatattat

SEQ ID NO: 6543345 - DNA, 19 bp, Homo sapiens
ttgaatatattataatctt

SEQ ID NO: 6543346 - DNA, 14 bp, Homo sapiens
ttgaatatcattaa

SEQ ID NO: 6543347 - DNA, 17 bp, Homo sapiens
ttgaatatcccctccca

SEQ ID NO: 6543348 - DNA, 23 bp, Homo sapiens
ttgaatatgattaaaaatatcaa

SEQ ID NO: 6543349 - DNA, 15 bp, Homo sapiens
ttgaatatgccttaa

SEQ ID NO: 6543350 - DNA, 22 bp, Homo sapiens
ttgaatatgccttaatttagaa

SEQ ID NO: 6543351 - DNA, 14 bp, Homo sapiens
ttgaatatgtgcct

SEQ ID NO: 6543352 - DNA, 16 bp, Homo sapiens
ttgaatattaagctaa

SEQ ID NO: 6543353 - DNA, 21 bp, Homo sapiens
ttgaatattaagctaaaaggt

SEQ ID NO: 6543354 - DNA, 13 bp, Homo sapiens
ttgaatattactc

SEQ ID NO: 6543355 - DNA, 12 bp, Homo sapiens
ttgaatattata

SEQ ID NO: 6543356 - DNA, 22 bp, Homo sapiens
ttgaatattggtaattaaaaga

SEQ ID NO: 6543357 - DNA, 15 bp, Homo sapiens
ttgaatatttagcat

SEQ ID NO: 6543358 - DNA, 17 bp, Homo sapiens
ttgaatattttttgaag

SEQ ID NO: 6543359 - DNA, 23 bp, Homo sapiens
ttgaatcaataatatattttctg

SEQ ID NO: 6543360 - DNA, 16 bp, Homo sapiens
ttgaatcaatgtatta

SEQ ID NO: 6543361 - DNA, 17 bp, Homo sapiens
ttgaatcagtataaaca

SEQ ID NO: 6543362 - DNA, 18 bp, Homo sapiens
ttgaatcagtttccaatt

SEQ ID NO: 6543363 - DNA, 21 bp, Homo sapiens
ttgaatcagtttccaattatt

SEQ ID NO: 6543364 - DNA, 23 bp, Homo sapiens
ttgaatcagtttttaaaatattt

SEQ ID NO: 6543365 - DNA, 22 bp, Homo sapiens
ttgaatcatgtagtatcaaata

SEQ ID NO: 6543366 - DNA, 17 bp, Homo sapiens
ttgaatcccacttcagt

SEQ ID NO: 6543367 - DNA, 21 bp, Homo sapiens
ttgaatcctctattaattact

SEQ ID NO: 6543368 - DNA, 14 bp, Homo sapiens
ttgaatcctttgcc

SEQ ID NO: 6543369 - DNA, 20 bp, Homo sapiens
ttgaatctacaaaagtgaac

SEQ ID NO: 6543370 - DNA, 17 bp, Homo sapiens
ttgaatctataaaagaa

SEQ ID NO: 6543371 - DNA, 21 bp, Homo sapiens
ttgaatctattgggattttct

SEQ ID NO: 6543372 - DNA, 15 bp, Homo sapiens
ttgaatctatttaag

SEQ ID NO: 6543373 - DNA, 17 bp, Homo sapiens
ttgaatctatttaagta

SEQ ID NO: 6543374 - DNA, 17 bp, Homo sapiens
ttgaatctatttatctt

SEQ ID NO: 6543375 - DNA, 14 bp, Homo sapiens
ttgaatctatttca

SEQ ID NO: 6543376 - DNA, 15 bp, Homo sapiens
ttgaatctcataatt

SEQ ID NO: 6543377 - DNA, 16 bp, Homo sapiens
ttgaatctctgtatat

SEQ ID NO: 6543378 - DNA, 15 bp, Homo sapiens
ttgaatctgagtgaa

SEQ ID NO: 6543379 - DNA, 14 bp, Homo sapiens
ttgaatctgggact

SEQ ID NO: 6543380 - DNA, 14 bp, Homo sapiens
ttgaatctgggagg

SEQ ID NO: 6543381 - DNA, 18 bp, Homo sapiens
ttgaatctgttactgaaa

SEQ ID NO: 6543382 - DNA, 15 bp, Homo sapiens
ttgaatcttctccct

SEQ ID NO: 6543383 - DNA, 14 bp, Homo sapiens
ttgaatcttgtctc

SEQ ID NO: 6543384 - DNA, 15 bp, Homo sapiens
ttgaatcttgtctca

SEQ ID NO: 6543385 - DNA, 17 bp, Homo sapiens
ttgaatcttgtctcaat

SEQ ID NO: 6543386 - DNA, 22 bp, Homo sapiens
ttgaatcttgtctcaatgctca

SEQ ID NO: 6543387 - DNA, 15 bp, Homo sapiens
ttgaatctttccaat

SEQ ID NO: 6543388 - DNA, 23 bp, Homo sapiens
ttgaatgaaaaatttaagcattg

SEQ ID NO: 6543389 - DNA, 18 bp, Homo sapiens
ttgaatgacaacagaagc

SEQ ID NO: 6543390 - DNA, 22 bp, Homo sapiens
ttgaatgactaagaggaaagta

SEQ ID NO: 6543391 - DNA, 18 bp, Homo sapiens
ttgaatgagacctggaac

SEQ ID NO: 6543392 - DNA, 17 bp, Homo sapiens
ttgaatgataatagctc

SEQ ID NO: 6543393 - DNA, 20 bp, Homo sapiens
ttgaatgatttttctttaca

SEQ ID NO: 6543394 - DNA, 15 bp, Homo sapiens
ttgaatgcaaaccat

SEQ ID NO: 6543395 - DNA, 12 bp, Homo sapiens
ttgaatgcattt

SEQ ID NO: 6543396 - DNA, 13 bp, Homo sapiens
ttgaatgcatttt

SEQ ID NO: 6543397 - DNA, 16 bp, Homo sapiens
ttgaatgcattttgtt

SEQ ID NO: 6543398 - DNA, 23 bp, Homo sapiens
ttgaatgccatagtcaaagagag

SEQ ID NO: 6543399 - DNA, 17 bp, Homo sapiens
ttgaatgctgattcaag

SEQ ID NO: 6543400 - DNA, 14 bp, Homo sapiens
ttgaatgctgccag

SEQ ID NO: 6543401 - DNA, 15 bp, Homo sapiens
ttgaatgctgccagt

SEQ ID NO: 6543402 - DNA, 16 bp, Homo sapiens
ttgaatgcttcctgac

SEQ ID NO: 6543403 - DNA, 17 bp, Homo sapiens
ttgaatgctttttgaat

SEQ ID NO: 6543404 - DNA, 16 bp, Homo sapiens
ttgaatggaagcaaaa

SEQ ID NO: 6543405 - DNA, 20 bp, Homo sapiens
ttgaatggctatgtttttaa

SEQ ID NO: 6543406 - DNA, 15 bp, Homo sapiens
ttgaatggtgcagaa

SEQ ID NO: 6543407 - DNA, 16 bp, Homo sapiens
ttgaatggtgcagaaa

SEQ ID NO: 6543408 - DNA, 16 bp, Homo sapiens
ttgaatggtgttgtat

SEQ ID NO: 6543409 - DNA, 15 bp, Homo sapiens
ttgaatgtaaaacag

SEQ ID NO: 6543410 - DNA, 15 bp, Homo sapiens
ttgaatgtaaccaat

SEQ ID NO: 6543411 - DNA, 14 bp, Homo sapiens
ttgaatgtacaaag

SEQ ID NO: 6543412 - DNA, 16 bp, Homo sapiens
ttgaatgtacaaagat

SEQ ID NO: 6543413 - DNA, 23 bp, Homo sapiens
ttgaatgtaccttatttaaaaga

SEQ ID NO: 6543414 - DNA, 19 bp, Homo sapiens
ttgaatgtcacaaattgat

SEQ ID NO: 6543415 - DNA, 22 bp, Homo sapiens
ttgaatgtccaaaatttatatt

SEQ ID NO: 6543416 - DNA, 19 bp, Homo sapiens
ttgaatgtccccattctat

SEQ ID NO: 6543417 - DNA, 12 bp, Homo sapiens
ttgaatgtcttt

SEQ ID NO: 6543418 - DNA, 19 bp, Homo sapiens
ttgaatgtgagtgtgtatg

SEQ ID NO: 6543419 - DNA, 23 bp, Homo sapiens
ttgaatgtggataaaactgtgta

SEQ ID NO: 6543420 - DNA, 13 bp, Homo sapiens
ttgaatgtgtcag

SEQ ID NO: 6543421 - DNA, 20 bp, Homo sapiens
ttgaatgtgtttcacagttt

SEQ ID NO: 6543422 - DNA, 18 bp, Homo sapiens
ttgaatgttaaataaatt

SEQ ID NO: 6543423 - DNA, 13 bp, Homo sapiens
ttgaatgttaaca

SEQ ID NO: 6543424 - DNA, 18 bp, Homo sapiens
ttgaatgttaagaataac

SEQ ID NO: 6543425 - DNA, 17 bp, Homo sapiens
ttgaatgttaagcagat

SEQ ID NO: 6543426 - DNA, 15 bp, Homo sapiens
ttgaatgttatatca

SEQ ID NO: 6543427 - DNA, 23 bp, Homo sapiens
ttgaatgttatttgttattttca

SEQ ID NO: 6543428 - DNA, 16 bp, Homo sapiens
ttgaattaaaacttct

SEQ ID NO: 6543429 - DNA, 20 bp, Homo sapiens
ttgaattacagagatataaa

SEQ ID NO: 6543430 - DNA, 16 bp, Homo sapiens
ttgaattaggctaaaa

SEQ ID NO: 6543431 - DNA, 12 bp, Homo sapiens
ttgaattatcag

SEQ ID NO: 6543432 - DNA, 18 bp, Homo sapiens
ttgaattatcttggttga

SEQ ID NO: 6543433 - DNA, 14 bp, Homo sapiens
ttgaattatgtgca

SEQ ID NO: 6543434 - DNA, 17 bp, Homo sapiens
ttgaattcatttgctga

SEQ ID NO: 6543435 - DNA, 14 bp, Homo sapiens
ttgaattcgtttct

SEQ ID NO: 6543436 - DNA, 15 bp, Homo sapiens
ttgaattctggaaac

SEQ ID NO: 6543437 - DNA, 23 bp, Homo sapiens
ttgaattctggaggaagaagaca

SEQ ID NO: 6543438 - DNA, 21 bp, Homo sapiens
ttgaattctttagatttttaa

SEQ ID NO: 6543439 - DNA, 11 bp, Homo sapiens
ttgaattgaag

SEQ ID NO: 6543440 - DNA, 17 bp, Homo sapiens
ttgaattgatacctgtt

SEQ ID NO: 6543441 - DNA, 23 bp, Homo sapiens
ttgaattggatacaaggatcaga

SEQ ID NO: 6543442 - DNA, 22 bp, Homo sapiens
ttgaattggcctgaacagatgt

SEQ ID NO: 6543443 - DNA, 18 bp, Homo sapiens
ttgaattggtgaataaaa

SEQ ID NO: 6543444 - DNA, 18 bp, Homo sapiens
ttgaattgtaactgttct

SEQ ID NO: 6543445 - DNA, 14 bp, Homo sapiens
ttgaattgtaagga

SEQ ID NO: 6543446 - DNA, 17 bp, Homo sapiens
ttgaattgtgtcttaat

SEQ ID NO: 6543447 - DNA, 14 bp, Homo sapiens
ttgaatttaaataa

SEQ ID NO: 6543448 - DNA, 16 bp, Homo sapiens
ttgaatttaaataaag

SEQ ID NO: 6543449 - DNA, 14 bp, Homo sapiens
ttgaatttaacaat

SEQ ID NO: 6543450 - DNA, 15 bp, Homo sapiens
ttgaatttaacaatg

SEQ ID NO: 6543451 - DNA, 19 bp, Homo sapiens
ttgaatttaacaatgcgaa

SEQ ID NO: 6543452 - DNA, 20 bp, Homo sapiens
ttgaatttaacaatgcgaat

SEQ ID NO: 6543453 - DNA, 18 bp, Homo sapiens
ttgaatttactggacata

SEQ ID NO: 6543454 - DNA, 21 bp, Homo sapiens
ttgaatttatataaagtattt

SEQ ID NO: 6543455 - DNA, 15 bp, Homo sapiens
ttgaatttattggct

SEQ ID NO: 6543456 - DNA, 22 bp, Homo sapiens
ttgaatttcctatctgtatgtc

SEQ ID NO: 6543457 - DNA, 18 bp, Homo sapiens
ttgaattttcaagcatct

SEQ ID NO: 6543458 - DNA, 13 bp, Homo sapiens
ttgaattttcatt

SEQ ID NO: 6543459 - DNA, 16 bp, Homo sapiens
ttgaattttcatttta

SEQ ID NO: 6543460 - DNA, 17 bp, Homo sapiens
ttgaattttcattttac

SEQ ID NO: 6543461 - DNA, 16 bp, Homo sapiens
ttgaattttcccactg

SEQ ID NO: 6543462 - DNA, 14 bp, Homo sapiens
ttgaattttctgtg

SEQ ID NO: 6543463 - DNA, 15 bp, Homo sapiens
ttgaattttgactta

SEQ ID NO: 6543464 - DNA, 21 bp, Homo sapiens
ttgaattttgtgttagagatt

SEQ ID NO: 6543465 - DNA, 13 bp, Homo sapiens
ttgaatttttcct

SEQ ID NO: 6543466 - DNA, 14 bp, Homo sapiens
ttgaatttttctct

SEQ ID NO: 6543467 - DNA, 18 bp, Homo sapiens
ttgacaaaaatgtttgta

SEQ ID NO: 6543468 - DNA, 19 bp, Homo sapiens
ttgacaaaatgactggctc

SEQ ID NO: 6543469 - DNA, 21 bp, Homo sapiens
ttgacaaaatgttatttccct

SEQ ID NO: 6543470 - DNA, 16 bp, Homo sapiens
ttgacaaaatttgttg

SEQ ID NO: 6543471 - DNA, 17 bp, Homo sapiens
ttgacaaaattttctca

SEQ ID NO: 6543472 - DNA, 22 bp, Homo sapiens
ttgacaaacccggaagatcaga

SEQ ID NO: 6543473 - DNA, 20 bp, Homo sapiens
ttgacaaagtcaagccacat

SEQ ID NO: 6543474 - DNA, 16 bp, Homo sapiens
ttgacaaagtgcctca

SEQ ID NO: 6543475 - DNA, 17 bp, Homo sapiens
ttgacaaatctgtgtat

SEQ ID NO: 6543476 - DNA, 20 bp, Homo sapiens
ttgacaaatctgtgtatatt

SEQ ID NO: 6543477 - DNA, 14 bp, Homo sapiens
ttgacaacacatgt

SEQ ID NO: 6543478 - DNA, 16 bp, Homo sapiens
ttgacaactgaagaga

SEQ ID NO: 6543479 - DNA, 17 bp, Homo sapiens
ttgacaagctaggaaag

SEQ ID NO: 6543480 - DNA, 21 bp, Homo sapiens
ttgacaagctaggaaagagga

SEQ ID NO: 6543481 - DNA, 18 bp, Homo sapiens
ttgacaaggaaaatctat

SEQ ID NO: 6543482 - DNA, 18 bp, Homo sapiens
ttgacaaggtagacatgg

SEQ ID NO: 6543483 - DNA, 12 bp, Homo sapiens
ttgacaataaaa

SEQ ID NO: 6543484 - DNA, 15 bp, Homo sapiens
ttgacaataagaaac

SEQ ID NO: 6543485 - DNA, 16 bp, Homo sapiens
ttgacaatcaaagaaa

SEQ ID NO: 6543486 - DNA, 21 bp, Homo sapiens
ttgacaatgttgtcctcctgt

SEQ ID NO: 6543487 - DNA, 12 bp, Homo sapiens
ttgacaatttgc

SEQ ID NO: 6543488 - DNA, 14 bp, Homo sapiens
ttgacaattttgtc

SEQ ID NO: 6543489 - DNA, 16 bp, Homo sapiens
ttgacaattttgtctt

SEQ ID NO: 6543490 - DNA, 17 bp, Homo sapiens
ttgacaattttgtctta

SEQ ID NO: 6543491 - DNA, 14 bp, Homo sapiens
ttgacacaaagctt

SEQ ID NO: 6543492 - DNA, 14 bp, Homo sapiens
ttgacacacagttg

SEQ ID NO: 6543493 - DNA, 19 bp, Homo sapiens
ttgacacaggtctttccta

SEQ ID NO: 6543494 - DNA, 14 bp, Homo sapiens
ttgacacagtcagc

SEQ ID NO: 6543495 - DNA, 20 bp, Homo sapiens
ttgacacataaaagtaatta

SEQ ID NO: 6543496 - DNA, 18 bp, Homo sapiens
ttgacacatatgaacaca

SEQ ID NO: 6543497 - DNA, 17 bp, Homo sapiens
ttgacaccaaatatttt

SEQ ID NO: 6543498 - DNA, 22 bp, Homo sapiens
ttgacaccaaatattttcaagc

SEQ ID NO: 6543499 - DNA, 13 bp, Homo sapiens
ttgacaccaacca

SEQ ID NO: 6543500 - DNA, 19 bp, Homo sapiens
ttgacaccaaccagacagc

SEQ ID NO: 6543501 - DNA, 21 bp, Homo sapiens
ttgacaccacttagatttaaa

SEQ ID NO: 6543502 - DNA, 22 bp, Homo sapiens
ttgacaccagctgttctgtccc

SEQ ID NO: 6543503 - DNA, 18 bp, Homo sapiens
ttgacacctgtcttgaat

SEQ ID NO: 6543504 - DNA, 14 bp, Homo sapiens
ttgacaccttagag

SEQ ID NO: 6543505 - DNA, 20 bp, Homo sapiens
ttgacacggtgaaatccagg

SEQ ID NO: 6543506 - DNA, 23 bp, Homo sapiens
ttgacactagcccaatgaaatga

SEQ ID NO: 6543507 - DNA, 14 bp, Homo sapiens
ttgacactatatct

SEQ ID NO: 6543508 - DNA, 22 bp, Homo sapiens
ttgacactatatctgtatataa

SEQ ID NO: 6543509 - DNA, 21 bp, Homo sapiens
ttgacactgaaagttttgtaa

SEQ ID NO: 6543510 - DNA, 22 bp, Homo sapiens
ttgacactgctctaacagccct

SEQ ID NO: 6543511 - DNA, 23 bp, Homo sapiens
ttgacactgctctaacagccctc

SEQ ID NO: 6543512 - DNA, 13 bp, Homo sapiens
ttgacactggtat

SEQ ID NO: 6543513 - DNA, 12 bp, Homo sapiens
ttgacactgttt

SEQ ID NO: 6543514 - DNA, 18 bp, Homo sapiens
ttgacactgttttcctta

SEQ ID NO: 6543515 - DNA, 20 bp, Homo sapiens
ttgacacttttaaaaaacaa

SEQ ID NO: 6543516 - DNA, 22 bp, Homo sapiens
ttgacagaaagcagttctgatg

SEQ ID NO: 6543517 - DNA, 17 bp, Homo sapiens
ttgacagaacactgtct

SEQ ID NO: 6543518 - DNA, 17 bp, Homo sapiens
ttgacagaatatgtttc

SEQ ID NO: 6543519 - DNA, 18 bp, Homo sapiens
ttgacagaatggtgccat

SEQ ID NO: 6543520 - DNA, 23 bp, Homo sapiens
ttgacagagagagatactctggg

SEQ ID NO: 6543521 - DNA, 16 bp, Homo sapiens
tgtgaaaccacaggcc

SEQ ID NO: 6543522 - DNA, 14 bp, Homo sapiens
tgtgaaacctgtga

SEQ ID NO: 6543523 - DNA, 18 bp, Homo sapiens
tgtgaaactctaccctga

SEQ ID NO: 6543524 - DNA, 17 bp, Homo sapiens
tgtgaaactctattatg

SEQ ID NO: 6543525 - DNA, 16 bp, Homo sapiens
tgtgaaactgagacca

SEQ ID NO: 6543526 - DNA, 19 bp, Homo sapiens
tgtgaaactggcactgaat

SEQ ID NO: 6543527 - DNA, 23 bp, Homo sapiens
tgtgaaagaagacagcttaatag

SEQ ID NO: 6543528 - DNA, 12 bp, Homo sapiens
tgtgaaagaatg

SEQ ID NO: 6543529 - DNA, 23 bp, Homo sapiens
tgtgaaagatgcatgttactgcc

SEQ ID NO: 6543530 - DNA, 19 bp, Homo sapiens
tgtgaaagccttaagaaga

SEQ ID NO: 6543531 - DNA, 12 bp, Homo sapiens
tgtgaaagctgc

SEQ ID NO: 6543532 - DNA, 17 bp, Homo sapiens
tgtgaaaggaacatttt

SEQ ID NO: 6543533 - DNA, 22 bp, Homo sapiens
tgtgaaaggtgctgatggccct

SEQ ID NO: 6543534 - DNA, 20 bp, Homo sapiens
tgtgaaagtgccaaaataaa

SEQ ID NO: 6543535 - DNA, 17 bp, Homo sapiens
tgtgaaataaaacagga

SEQ ID NO: 6543536 - DNA, 20 bp, Homo sapiens
tgtgaaataatttttaactt

SEQ ID NO: 6543537 - DNA, 14 bp, Homo sapiens
tgtgaaatgtaaca

SEQ ID NO: 6543538 - DNA, 14 bp, Homo sapiens
tgtgaaatgtaact

SEQ ID NO: 6543539 - DNA, 19 bp, Homo sapiens
tgtgaaattcaacctgtgt

SEQ ID NO: 6543540 - DNA, 18 bp, Homo sapiens
tgtgaaattctcagagtg

SEQ ID NO: 6543541 - DNA, 18 bp, Homo sapiens
tgtgaaattgcatacttt

SEQ ID NO: 6543542 - DNA, 14 bp, Homo sapiens
tgtgaaattgtgta

SEQ ID NO: 6543543 - DNA, 17 bp, Homo sapiens
tgtgaaatttaaataat

SEQ ID NO: 6543544 - DNA, 23 bp, Homo sapiens
tgtgaaatttaaataatagacat

SEQ ID NO: 6543545 - DNA, 12 bp, Homo sapiens
tgtgaaatttca

SEQ ID NO: 6543546 - DNA, 13 bp, Homo sapiens
tgtgaaatttcat

SEQ ID NO: 6543547 - DNA, 15 bp, Homo sapiens
tgtgaaatttcatga

SEQ ID NO: 6543548 - DNA, 18 bp, Homo sapiens
tgtgaaatttcatgaaaa

SEQ ID NO: 6543549 - DNA, 14 bp, Homo sapiens
tgtgaaatttgtta

SEQ ID NO: 6543550 - DNA, 17 bp, Homo sapiens
tgtgaaatttttccaca

SEQ ID NO: 6543551 - DNA, 21 bp, Homo sapiens
tgtgaacaaatcaaattgctt

SEQ ID NO: 6543552 - DNA, 15 bp, Homo sapiens
tgtgaacagagagac

SEQ ID NO: 6543553 - DNA, 15 bp, Homo sapiens
tgtgaacagcggctg

SEQ ID NO: 6543554 - DNA, 16 bp, Homo sapiens
tgtgaacagcttgctg

SEQ ID NO: 6543555 - DNA, 23 bp, Homo sapiens
tgtgaacataggtgtgcttccca

SEQ ID NO: 6543556 - DNA, 15 bp, Homo sapiens
tgtgaacatgatagt

SEQ ID NO: 6543557 - DNA, 18 bp, Homo sapiens
tgtgaacatgcctcctcc

SEQ ID NO: 6543558 - DNA, 19 bp, Homo sapiens
tgtgaacatgcctcctcct

SEQ ID NO: 6543559 - DNA, 22 bp, Homo sapiens
tgtgaacatgcctcctcctgcc

SEQ ID NO: 6543560 - DNA, 18 bp, Homo sapiens
tgtgaaccaactgcctta

SEQ ID NO: 6543561 - DNA, 14 bp, Homo sapiens
tgtgaaccaatgca

SEQ ID NO: 6543562 - DNA, 17 bp, Homo sapiens
tgtgaaccaccacaccc

SEQ ID NO: 6543563 - DNA, 22 bp, Homo sapiens
tgtgaaccaccacacccagccc

SEQ ID NO: 6543564 - DNA, 23 bp, Homo sapiens
tgtgaaccaccacacccagccca

SEQ ID NO: 6543565 - DNA, 21 bp, Homo sapiens
tgtgaaccccacgaaggagcc

SEQ ID NO: 6543566 - DNA, 23 bp, Homo sapiens
tgtgaaccctggggcctgactgc

SEQ ID NO: 6543567 - DNA, 17 bp, Homo sapiens
tgtgaacgcatgtggta

SEQ ID NO: 6543568 - DNA, 14 bp, Homo sapiens
tgtgaacgctgtga

SEQ ID NO: 6543569 - DNA, 22 bp, Homo sapiens
tgtgaacgctgtgatgctgtgt

SEQ ID NO: 6543570 - DNA, 14 bp, Homo sapiens
tgtgaactaaactt

SEQ ID NO: 6543571 - DNA, 15 bp, Homo sapiens
tgtgaactaatgaca

SEQ ID NO: 6543572 - DNA, 20 bp, Homo sapiens
tgtgaactattttgaagaaa

SEQ ID NO: 6543573 - DNA, 22 bp, Homo sapiens
tgtgaactcaccctgggagcca

SEQ ID NO: 6543574 - DNA, 14 bp, Homo sapiens
tgtgaactcagcca

SEQ ID NO: 6543575 - DNA, 15 bp, Homo sapiens
tgtgaactcagccaa

SEQ ID NO: 6543576 - DNA, 18 bp, Homo sapiens
tgtgaactcagccaagca

SEQ ID NO: 6543577 - DNA, 19 bp, Homo sapiens
tgtgaactcagccaagcac

SEQ ID NO: 6543578 - DNA, 21 bp, Homo sapiens
tgtgaactcagccaagcacag

SEQ ID NO: 6543579 - DNA, 12 bp, Homo sapiens
tgtgaactcatt

SEQ ID NO: 6543580 - DNA, 16 bp, Homo sapiens
tgtgaactctcccctc

SEQ ID NO: 6543581 - DNA, 14 bp, Homo sapiens
tgtgaactgaaatt

SEQ ID NO: 6543582 - DNA, 19 bp, Homo sapiens
tgtgaactggaccctgttg

SEQ ID NO: 6543583 - DNA, 21 bp, Homo sapiens
tgtgaactggaccctgttgct

SEQ ID NO: 6543584 - DNA, 22 bp, Homo sapiens
tgtgaactggaccctgttgcta

SEQ ID NO: 6543585 - DNA, 21 bp, Homo sapiens
tgtgaacttcacaagaatggt

SEQ ID NO: 6543586 - DNA, 12 bp, Homo sapiens
tgtgaacttgaa

SEQ ID NO: 6543587 - DNA, 12 bp, Homo sapiens
tgtgaacttgta

SEQ ID NO: 6543588 - DNA, 18 bp, Homo sapiens
tgtgaactttattaaata

SEQ ID NO: 6543589 - DNA, 17 bp, Homo sapiens
tgtgaactttctcagca

SEQ ID NO: 6543590 - DNA, 14 bp, Homo sapiens
tgtgaactttgaat

SEQ ID NO: 6543591 - DNA, 10 bp, Homo sapiens
tgtgaagaaa

SEQ ID NO: 6543592 - DNA, 13 bp, Homo sapiens
tgtgaagaaagcc

SEQ ID NO: 6543593 - DNA, 10 bp, Homo sapiens
tgtgaagaat

SEQ ID NO: 6543594 - DNA, 14 bp, Homo sapiens
tgtgaagaatttag

SEQ ID NO: 6543595 - DNA, 20 bp, Homo sapiens
tgtgaagaatttagatctta

SEQ ID NO: 6543596 - DNA, 22 bp, Homo sapiens
tgtgaagaatttagatcttata

SEQ ID NO: 6543597 - DNA, 15 bp, Homo sapiens
tgtgaagacattttt

SEQ ID NO: 6543598 - DNA, 18 bp, Homo sapiens
tgtgaagacccaaaacag

SEQ ID NO: 6543599 - DNA, 23 bp, Homo sapiens
tgtgaagacccagcaggaagcca

SEQ ID NO: 6543600 - DNA, 14 bp, Homo sapiens
tgtgaagagaacca

SEQ ID NO: 6543601 - DNA, 18 bp, Homo sapiens
tgtgaagagaatgtattc

SEQ ID NO: 6543602 - DNA, 20 bp, Homo sapiens
tgtgaagaggtctgattggc

SEQ ID NO: 6543603 - DNA, 22 bp, Homo sapiens
tgtgaagatcacgttccttccc

SEQ ID NO: 6543604 - DNA, 14 bp, Homo sapiens
tgtgaagatgtttg

SEQ ID NO: 6543605 - DNA, 17 bp, Homo sapiens
tgtgaagatgtttgcaa

SEQ ID NO: 6543606 - DNA, 15 bp, Homo sapiens
tgtgaagcatgcttt

SEQ ID NO: 6543607 - DNA, 19 bp, Homo sapiens
tgtgaagcatgctttgctg

SEQ ID NO: 6543608 - DNA, 12 bp, Homo sapiens
tgtgaagcattc

SEQ ID NO: 6543609 - DNA, 13 bp, Homo sapiens
tgtgaagctattt

SEQ ID NO: 6543610 - DNA, 12 bp, Homo sapiens
tgtgaagctgaa

SEQ ID NO: 6543611 - DNA, 22 bp, Homo sapiens
tgtgaagctgaaccccctccag

SEQ ID NO: 6543612 - DNA, 21 bp, Homo sapiens
tgtgaagctggaactgcggga

SEQ ID NO: 6543613 - DNA, 20 bp, Homo sapiens
tgtgaaggacatgagactaa

SEQ ID NO: 6543614 - DNA, 14 bp, Homo sapiens
tgtgaaggaccctt

SEQ ID NO: 6543615 - DNA, 16 bp, Homo sapiens
tgtgaaggaccttcac

SEQ ID NO: 6543616 - DNA, 23 bp, Homo sapiens
tgtgaaggattatggaaaaataa

SEQ ID NO: 6543617 - DNA, 12 bp, Homo sapiens
tgtgaaggccca

SEQ ID NO: 6543618 - DNA, 14 bp, Homo sapiens
tgtgaagggaagga

SEQ ID NO: 6543619 - DNA, 13 bp, Homo sapiens
tgtgaagggtggg

SEQ ID NO: 6543620 - DNA, 20 bp, Homo sapiens
tgtgaagtaacccctcctgg

SEQ ID NO: 6543621 - DNA, 22 bp, Homo sapiens
tgtgaagtaacccctcctggct

SEQ ID NO: 6543622 - DNA, 18 bp, Homo sapiens
tgtgaagtccacttatgt

SEQ ID NO: 6543623 - DNA, 21 bp, Homo sapiens
tgtgaagtccacttatgtaga

SEQ ID NO: 6543624 - DNA, 14 bp, Homo sapiens
tgtgaagtgattga

SEQ ID NO: 6543625 - DNA, 19 bp, Homo sapiens
tgtgaagtgattgacattt

SEQ ID NO: 6543626 - DNA, 18 bp, Homo sapiens
tgtgaagtgttaatacta

SEQ ID NO: 6543627 - DNA, 14 bp, Homo sapiens
tgtgaagttagaat

SEQ ID NO: 6543628 - DNA, 15 bp, Homo sapiens
tgtgaagttagaatt

SEQ ID NO: 6543629 - DNA, 20 bp, Homo sapiens
tgtgaagttagaattccttc

SEQ ID NO: 6543630 - DNA, 21 bp, Homo sapiens
tgtgaagttaggttcttaaaa

SEQ ID NO: 6543631 - DNA, 14 bp, Homo sapiens
tgtgaagttcatct

SEQ ID NO: 6543632 - DNA, 15 bp, Homo sapiens
tgtgaagttcatctt

SEQ ID NO: 6543633 - DNA, 16 bp, Homo sapiens
tgtgaagttcatcttg

SEQ ID NO: 6543634 - DNA, 20 bp, Homo sapiens
tgtgaagtttaattgtctca

SEQ ID NO: 6543635 - DNA, 19 bp, Homo sapiens
tgtgaagtttggagataga

SEQ ID NO: 6543636 - DNA, 16 bp, Homo sapiens
tgtgaataaaaagaaa

SEQ ID NO: 6543637 - DNA, 12 bp, Homo sapiens
tgtgaataaatt

SEQ ID NO: 6543638 - DNA, 14 bp, Homo sapiens
tgtgaataattaca

SEQ ID NO: 6543639 - DNA, 15 bp, Homo sapiens
tgtgaatacaattaa

SEQ ID NO: 6543640 - DNA, 20 bp, Homo sapiens
tgtgaatacaattaaaggtc

SEQ ID NO: 6543641 - DNA, 15 bp, Homo sapiens
tgtgaatagatttta

SEQ ID NO: 6543642 - DNA, 18 bp, Homo sapiens
tgtgaatagcctggccac

SEQ ID NO: 6543643 - DNA, 19 bp, Homo sapiens
tgtgaataggttatatgca

SEQ ID NO: 6543644 - DNA, 18 bp, Homo sapiens
tgtgaatataaatgtgtg

SEQ ID NO: 6543645 - DNA, 22 bp, Homo sapiens
tgtgaatatatttttaaagcaa

SEQ ID NO: 6543646 - DNA, 14 bp, Homo sapiens
tgtgaatatgccag

SEQ ID NO: 6543647 - DNA, 17 bp, Homo sapiens
tgtgaatatggacagtt

SEQ ID NO: 6543648 - DNA, 14 bp, Homo sapiens
tgtgaatatgtgta

SEQ ID NO: 6543649 - DNA, 14 bp, Homo sapiens
tgtgaatattcctt

SEQ ID NO: 6543650 - DNA, 22 bp, Homo sapiens
tgtgaatattgtggctccctgg

SEQ ID NO: 6543651 - DNA, 18 bp, Homo sapiens
tgtgaatccaggaggcag

SEQ ID NO: 6543652 - DNA, 19 bp, Homo sapiens
tgtgaatccatgggtctgg

SEQ ID NO: 6543653 - DNA, 15 bp, Homo sapiens
tgtgaatctatgctg

SEQ ID NO: 6543654 - DNA, 17 bp, Homo sapiens
tgtgaatctatgctggt

SEQ ID NO: 6543655 - DNA, 21 bp, Homo sapiens
tgtgaatctatgctggtgaaa

SEQ ID NO: 6543656 - DNA, 19 bp, Homo sapiens
tgtgaatctgaactgctct

SEQ ID NO: 6543657 - DNA, 16 bp, Homo sapiens
tgtgaatcttaacatt

SEQ ID NO: 6543658 - DNA, 14 bp, Homo sapiens
tgtgaatcttgaat

SEQ ID NO: 6543659 - DNA, 14 bp, Homo sapiens
tgtgaatgaacact

SEQ ID NO: 6543660 - DNA, 14 bp, Homo sapiens
tgtgaatgaagcta

SEQ ID NO: 6543661 - DNA, 23 bp, Homo sapiens
tgtgaatgaatacacaggactta

SEQ ID NO: 6543662 - DNA, 22 bp, Homo sapiens
tgtgaatgattcatgttatatt

SEQ ID NO: 6543663 - DNA, 13 bp, Homo sapiens
tgtgaatgcttct

SEQ ID NO: 6543664 - DNA, 14 bp, Homo sapiens
tgtgaatgcttctg

SEQ ID NO: 6543665 - DNA, 13 bp, Homo sapiens
tgtgaatggaagc

SEQ ID NO: 6543666 - DNA, 13 bp, Homo sapiens
tgtgaatggaggc

SEQ ID NO: 6543667 - DNA, 13 bp, Homo sapiens
tgtgaatggattg

SEQ ID NO: 6543668 - DNA, 19 bp, Homo sapiens
tgtgaatggattggattat

SEQ ID NO: 6543669 - DNA, 16 bp, Homo sapiens
tgtgaatgggaaaaga

SEQ ID NO: 6543670 - DNA, 20 bp, Homo sapiens
tgtgaatggttgcaaagtgt

SEQ ID NO: 6543671 - DNA, 22 bp, Homo sapiens
tgtgaatgtagcttccacctca

SEQ ID NO: 6543672 - DNA, 15 bp, Homo sapiens
tgtgaatgtgactac

SEQ ID NO: 6543673 - DNA, 12 bp, Homo sapiens
tgtgaatgtggg

SEQ ID NO: 6543674 - DNA, 13 bp, Homo sapiens
tgtgaatgttggt

SEQ ID NO: 6543675 - DNA, 20 bp, Homo sapiens
tgtgaatgtttagtgtgctg

SEQ ID NO: 6543676 - DNA, 18 bp, Homo sapiens
tgtgaattaaaaaagctc

SEQ ID NO: 6543677 - DNA, 16 bp, Homo sapiens
tgtgaattaagcccaa

SEQ ID NO: 6543678 - DNA, 16 bp, Homo sapiens
tgtgaattactaactt

SEQ ID NO: 6543679 - DNA, 17 bp, Homo sapiens
tgtgaattactaacttc

SEQ ID NO: 6543680 - DNA, 23 bp, Homo sapiens
tgtgaattaggctgtaactactt

SEQ ID NO: 6543681 - DNA, 15 bp, Homo sapiens
tgtgaattattgaca

SEQ ID NO: 6543682 - DNA, 13 bp, Homo sapiens
tgtgaattcagat

SEQ ID NO: 6543683 - DNA, 14 bp, Homo sapiens
tgtgaattctgtga

SEQ ID NO: 6543684 - DNA, 18 bp, Homo sapiens
tgtgaattctgtgaagaa

SEQ ID NO: 6543685 - DNA, 19 bp, Homo sapiens
tgtgaattctgtgaagaat

SEQ ID NO: 6543686 - DNA, 21 bp, Homo sapiens
tgtgaattgaagtcatcataa

SEQ ID NO: 6543687 - DNA, 18 bp, Homo sapiens
tgtgaattgcatgacttg

SEQ ID NO: 6543688 - DNA, 14 bp, Homo sapiens
tgtgaattgcctgc

SEQ ID NO: 6543689 - DNA, 22 bp, Homo sapiens
tgtgaattgcctgcagagagaa

SEQ ID NO: 6543690 - DNA, 15 bp, Homo sapiens
tgtgaattgcctgcc

SEQ ID NO: 6543691 - DNA, 14 bp, Homo sapiens
tgtgaatttcaact

SEQ ID NO: 6543692 - DNA, 18 bp, Homo sapiens
tgtgaatttgcaacagta

SEQ ID NO: 6543693 - DNA, 16 bp, Homo sapiens
tgtgaatttgccagag

SEQ ID NO: 6543694 - DNA, 17 bp, Homo sapiens
tgtgaatttgccagagg

SEQ ID NO: 6543695 - DNA, 21 bp, Homo sapiens
tgtgaattttaaaatgcaaat

SEQ ID NO: 6543696 - DNA, 22 bp, Homo sapiens
tgtgaattttctaaaagctttc

SEQ ID NO: 6543697 - DNA, 16 bp, Homo sapiens
tgtgaatttttaagct

SEQ ID NO: 6543698 - DNA, 16 bp, Homo sapiens
tgtgaatttttattgt

SEQ ID NO: 6543699 - DNA, 20 bp, Homo sapiens
tgtgaatttttattgttgta

SEQ ID NO: 6543700 - DNA, 21 bp, Homo sapiens
tgtgaatttttgcctatcttt

SEQ ID NO: 6543701 - DNA, 19 bp, Homo sapiens
ttgacagagcctgccccag

SEQ ID NO: 6543702 - DNA, 19 bp, Homo sapiens
ttgacagatcaagctgtga

SEQ ID NO: 6543703 - DNA, 16 bp, Homo sapiens
ttgacagcaacaaagc

SEQ ID NO: 6543704 - DNA, 18 bp, Homo sapiens
ttgacagcaacaaagcat

SEQ ID NO: 6543705 - DNA, 21 bp, Homo sapiens
ttgacagcaattcatggttca

SEQ ID NO: 6543706 - DNA, 17 bp, Homo sapiens
ttgacagctttgctgct

SEQ ID NO: 6543707 - DNA, 19 bp, Homo sapiens
ttgacagctttgctgctga

SEQ ID NO: 6543708 - DNA, 19 bp, Homo sapiens
ttgacaggattattggaaa

SEQ ID NO: 6543709 - DNA, 10 bp, Homo sapiens
ttgacagggc

SEQ ID NO: 6543710 - DNA, 23 bp, Homo sapiens
ttgacagggccttaaaattactt

SEQ ID NO: 6543711 - DNA, 18 bp, Homo sapiens
ttgacaggttccttttaa

SEQ ID NO: 6543712 - DNA, 14 bp, Homo sapiens
ttgacagtatatgt

SEQ ID NO: 6543713 - DNA, 19 bp, Homo sapiens
ttgacagtatatgtcatgc

SEQ ID NO: 6543714 - DNA, 15 bp, Homo sapiens
ttgacagtatatttg

SEQ ID NO: 6543715 - DNA, 18 bp, Homo sapiens
ttgacagtcactcagcca

SEQ ID NO: 6543716 - DNA, 14 bp, Homo sapiens
ttgacagtgaaaca

SEQ ID NO: 6543717 - DNA, 19 bp, Homo sapiens
ttgacagtgttgaaaatgt

SEQ ID NO: 6543718 - DNA, 18 bp, Homo sapiens
ttgacagttacttacaca

SEQ ID NO: 6543719 - DNA, 16 bp, Homo sapiens
ttgacagtttttgaca

SEQ ID NO: 6543720 - DNA, 21 bp, Homo sapiens
ttgacataatgagtaatgcag

SEQ ID NO: 6543721 - DNA, 16 bp, Homo sapiens
ttgacatagcctttgt

SEQ ID NO: 6543722 - DNA, 13 bp, Homo sapiens
ttgacatatttaa

SEQ ID NO: 6543723 - DNA, 13 bp, Homo sapiens
ttgacatcaactg

SEQ ID NO: 6543724 - DNA, 18 bp, Homo sapiens
ttgacatcagccagctgc

SEQ ID NO: 6543725 - DNA, 17 bp, Homo sapiens
ttgacatccaggatggc

SEQ ID NO: 6543726 - DNA, 15 bp, Homo sapiens
ttgacatgaccctct

SEQ ID NO: 6543727 - DNA, 22 bp, Homo sapiens
ttgacatgaccctctgtcccca

SEQ ID NO: 6543728 - DNA, 23 bp, Homo sapiens
ttgacatgagatttataaggttt

SEQ ID NO: 6543729 - DNA, 13 bp, Homo sapiens
ttgacatgtacag

SEQ ID NO: 6543730 - DNA, 18 bp, Homo sapiens
ttgacatgtacagagaac

SEQ ID NO: 6543731 - DNA, 13 bp, Homo sapiens
ttgacatgtagct

SEQ ID NO: 6543732 - DNA, 16 bp, Homo sapiens
ttgacatgtagcttct

SEQ ID NO: 6543733 - DNA, 21 bp, Homo sapiens
ttgacatgtgaagctatttga

SEQ ID NO: 6543734 - DNA, 19 bp, Homo sapiens
ttgacatgtgcaattgtga

SEQ ID NO: 6543735 - DNA, 14 bp, Homo sapiens
ttgacatgtggaaa

SEQ ID NO: 6543736 - DNA, 22 bp, Homo sapiens
ttgacatgtggaaagtgaattt

SEQ ID NO: 6543737 - DNA, 22 bp, Homo sapiens
ttgacattaagaatgttggttt

SEQ ID NO: 6543738 - DNA, 16 bp, Homo sapiens
ttgacattatgtttta

SEQ ID NO: 6543739 - DNA, 15 bp, Homo sapiens
ttgacattctctatt

SEQ ID NO: 6543740 - DNA, 17 bp, Homo sapiens
ttgacattctctattgt

SEQ ID NO: 6543741 - DNA, 14 bp, Homo sapiens
ttgacattctgaat

SEQ ID NO: 6543742 - DNA, 20 bp, Homo sapiens
ttgacattctgaatgcttct

SEQ ID NO: 6543743 - DNA, 14 bp, Homo sapiens
ttgacattgatgtg

SEQ ID NO: 6543744 - DNA, 18 bp, Homo sapiens
ttgacattgtcagaatgt

SEQ ID NO: 6543745 - DNA, 11 bp, Homo sapiens
ttgacatttaa

SEQ ID NO: 6543746 - DNA, 16 bp, Homo sapiens
ttgacatttagaactt

SEQ ID NO: 6543747 - DNA, 14 bp, Homo sapiens
ttgacatttatatt

SEQ ID NO: 6543748 - DNA, 14 bp, Homo sapiens
ttgacattttgtag

SEQ ID NO: 6543749 - DNA, 18 bp, Homo sapiens
ttgaccaacagaaacctt

SEQ ID NO: 6543750 - DNA, 16 bp, Homo sapiens
ttgaccaagaactgca

SEQ ID NO: 6543751 - DNA, 19 bp, Homo sapiens
ttgaccaagatgatcacat

SEQ ID NO: 6543752 - DNA, 22 bp, Homo sapiens
ttgaccaagatgatcacatgga

SEQ ID NO: 6543753 - DNA, 16 bp, Homo sapiens
ttgaccaagcaggaag

SEQ ID NO: 6543754 - DNA, 20 bp, Homo sapiens
ttgaccaagcaggaagctca

SEQ ID NO: 6543755 - DNA, 14 bp, Homo sapiens
ttgaccaccagtta

SEQ ID NO: 6543756 - DNA, 15 bp, Homo sapiens
ttgaccacccacctg

SEQ ID NO: 6543757 - DNA, 18 bp, Homo sapiens
ttgaccactccagagaag

SEQ ID NO: 6543758 - DNA, 21 bp, Homo sapiens
ttgaccactgtctttttctta

SEQ ID NO: 6543759 - DNA, 13 bp, Homo sapiens
ttgaccagaaaat

SEQ ID NO: 6543760 - DNA, 15 bp, Homo sapiens
ttgaccagatctttc

SEQ ID NO: 6543761 - DNA, 17 bp, Homo sapiens
ttgaccagatctttctc

SEQ ID NO: 6543762 - DNA, 21 bp, Homo sapiens
ttgaccagcagatcccagctc

SEQ ID NO: 6543763 - DNA, 21 bp, Homo sapiens
ttgaccagggcagtgaaaatg

SEQ ID NO: 6543764 - DNA, 22 bp, Homo sapiens
ttgaccagggcagtgaaaatga

SEQ ID NO: 6543765 - DNA, 15 bp, Homo sapiens
ttgaccagtttcttt

SEQ ID NO: 6543766 - DNA, 14 bp, Homo sapiens
ttgaccataaatta

SEQ ID NO: 6543767 - DNA, 21 bp, Homo sapiens
ttgacccactcacacttggag

SEQ ID NO: 6543768 - DNA, 18 bp, Homo sapiens
ttgacccaggtggctagc

SEQ ID NO: 6543769 - DNA, 21 bp, Homo sapiens
ttgaccccaatccaacccggg

SEQ ID NO: 6543770 - DNA, 14 bp, Homo sapiens
ttgacccctttccc

SEQ ID NO: 6543771 - DNA, 15 bp, Homo sapiens
ttgacccctttcccc

SEQ ID NO: 6543772 - DNA, 17 bp, Homo sapiens
ttgacccctttccccca

SEQ ID NO: 6543773 - DNA, 20 bp, Homo sapiens
ttgacccctttcccccaccc

SEQ ID NO: 6543774 - DNA, 22 bp, Homo sapiens
ttgaccctcattctttagagat

SEQ ID NO: 6543775 - DNA, 12 bp, Homo sapiens
ttgaccctgcac

SEQ ID NO: 6543776 - DNA, 17 bp, Homo sapiens
ttgaccctgcaccctcc

SEQ ID NO: 6543777 - DNA, 18 bp, Homo sapiens
ttgaccgcaactcacaca

SEQ ID NO: 6543778 - DNA, 22 bp, Homo sapiens
ttgaccgtactctcacatgtgg

SEQ ID NO: 6543779 - DNA, 17 bp, Homo sapiens
ttgaccgtgaggccaga

SEQ ID NO: 6543780 - DNA, 22 bp, Homo sapiens
ttgaccgtgttggtctgtactg

SEQ ID NO: 6543781 - DNA, 17 bp, Homo sapiens
ttgacctcaaaagaaaa

SEQ ID NO: 6543782 - DNA, 22 bp, Homo sapiens
ttgacctcacagtgacccttcc

SEQ ID NO: 6543783 - DNA, 23 bp, Homo sapiens
ttgacctcacagtgacccttccc

SEQ ID NO: 6543784 - DNA, 15 bp, Homo sapiens
ttgacctcagctgca

SEQ ID NO: 6543785 - DNA, 16 bp, Homo sapiens
ttgacctcagctgcac

SEQ ID NO: 6543786 - DNA, 15 bp, Homo sapiens
ttgacctcaggtgat

SEQ ID NO: 6543787 - DNA, 24 bp, Homo sapiens
ttgacctcctccctgttattttca

SEQ ID NO: 6543788 - DNA, 16 bp, Homo sapiens
ttgacctctataaact

SEQ ID NO: 6543789 - DNA, 22 bp, Homo sapiens
ttgacctctcacttttttataa

SEQ ID NO: 6543790 - DNA, 18 bp, Homo sapiens
ttgacctctcagggcctg

SEQ ID NO: 6543791 - DNA, 12 bp, Homo sapiens
ttgacctgaggc

SEQ ID NO: 6543792 - DNA, 21 bp, Homo sapiens
ttgacctgcccgatccagatt

SEQ ID NO: 6543793 - DNA, 21 bp, Homo sapiens
ttgacctgcctcccttcatgc

SEQ ID NO: 6543794 - DNA, 22 bp, Homo sapiens
ttgacctgcctcccttcatgca

SEQ ID NO: 6543795 - DNA, 23 bp, Homo sapiens
ttgacctgcctcccttcatgcat

SEQ ID NO: 6543796 - DNA, 18 bp, Homo sapiens
ttgacctggactgaagtt

SEQ ID NO: 6543797 - DNA, 12 bp, Homo sapiens
ttgacctggagg

SEQ ID NO: 6543798 - DNA, 22 bp, Homo sapiens
ttgacctggatggggcaggcca

SEQ ID NO: 6543799 - DNA, 14 bp, Homo sapiens
ttgaccttaatttc

SEQ ID NO: 6543800 - DNA, 17 bp, Homo sapiens
ttgaccttcccaaggtt

SEQ ID NO: 6543801 - DNA, 16 bp, Homo sapiens
ttgaccttgtattgaa

SEQ ID NO: 6543802 - DNA, 21 bp, Homo sapiens
ttgacctttatttattaaact

SEQ ID NO: 6543803 - DNA, 17 bp, Homo sapiens
ttgacctttgaggtcta

SEQ ID NO: 6543804 - DNA, 21 bp, Homo sapiens
ttgaccttttatgtagtaatt

SEQ ID NO: 6543805 - DNA, 14 bp, Homo sapiens
ttgacgaactggct

SEQ ID NO: 6543806 - DNA, 15 bp, Homo sapiens
ttgacgaactggcta

SEQ ID NO: 6543807 - DNA, 15 bp, Homo sapiens
ttgacgattccttct

SEQ ID NO: 6543808 - DNA, 15 bp, Homo sapiens
ttgacgcatcctgca

SEQ ID NO: 6543809 - DNA, 15 bp, Homo sapiens
ttgacgcttgcttag

SEQ ID NO: 6543810 - DNA, 20 bp, Homo sapiens
ttgacggatgattggattat

SEQ ID NO: 6543811 - DNA, 17 bp, Homo sapiens
ttgacggccttcttggt

SEQ ID NO: 6543812 - DNA, 18 bp, Homo sapiens
ttgacggccttcttggtt

SEQ ID NO: 6543813 - DNA, 18 bp, Homo sapiens
ttgacgggaggcctcagt

SEQ ID NO: 6543814 - DNA, 20 bp, Homo sapiens
ttgacgggaggcctcagttc

SEQ ID NO: 6543815 - DNA, 17 bp, Homo sapiens
ttgacgggccaggccct

SEQ ID NO: 6543816 - DNA, 18 bp, Homo sapiens
ttgacgggccaggccctg

SEQ ID NO: 6543817 - DNA, 20 bp, Homo sapiens
ttgacggggcagtcagattt

SEQ ID NO: 6543818 - DNA, 21 bp, Homo sapiens
ttgacggggcagtcagatttt

SEQ ID NO: 6543819 - DNA, 21 bp, Homo sapiens
ttgacgtcttaggtggcaggg

SEQ ID NO: 6543820 - DNA, 13 bp, Homo sapiens
ttgactaaaatgc

SEQ ID NO: 6543821 - DNA, 19 bp, Homo sapiens
ttgactaaacagcaaaagt

SEQ ID NO: 6543822 - DNA, 14 bp, Homo sapiens
ttgactaaagccat

SEQ ID NO: 6543823 - DNA, 16 bp, Homo sapiens
ttgactaaagccattt

SEQ ID NO: 6543824 - DNA, 22 bp, Homo sapiens
ttgactaaagccatttgtctgt

SEQ ID NO: 6543825 - DNA, 14 bp, Homo sapiens
ttgactaagaaatg

SEQ ID NO: 6543826 - DNA, 15 bp, Homo sapiens
ttgactaattttaca

SEQ ID NO: 6543827 - DNA, 16 bp, Homo sapiens
ttgactactagagctc

SEQ ID NO: 6543828 - DNA, 17 bp, Homo sapiens
ttgactagccatctcaa

SEQ ID NO: 6543829 - DNA, 19 bp, Homo sapiens
ttgactagggattcaggct

SEQ ID NO: 6543830 - DNA, 14 bp, Homo sapiens
ttgactatcacata

SEQ ID NO: 6543831 - DNA, 19 bp, Homo sapiens
ttgactatcacatacaatt

SEQ ID NO: 6543832 - DNA, 20 bp, Homo sapiens
ttgactatcacatacaattt

SEQ ID NO: 6543833 - DNA, 22 bp, Homo sapiens
ttgactatggagtcttgtgaaa

SEQ ID NO: 6543834 - DNA, 13 bp, Homo sapiens
ttgactatttctt

SEQ ID NO: 6543835 - DNA, 19 bp, Homo sapiens
ttgactatttttgttttta

SEQ ID NO: 6543836 - DNA, 21 bp, Homo sapiens
ttgactatttttgtttttatt

SEQ ID NO: 6543837 - DNA, 21 bp, Homo sapiens
ttgactcaagtttttacaaaa

SEQ ID NO: 6543838 - DNA, 14 bp, Homo sapiens
ttgactcaggagcc

SEQ ID NO: 6543839 - DNA, 14 bp, Homo sapiens
ttgactcagtgata

SEQ ID NO: 6543840 - DNA, 14 bp, Homo sapiens
ttgactcagttcca

SEQ ID NO: 6543841 - DNA, 15 bp, Homo sapiens
ttgactcatcttata

SEQ ID NO: 6543842 - DNA, 17 bp, Homo sapiens
ttgactcctttccaata

SEQ ID NO: 6543843 - DNA, 17 bp, Homo sapiens
ttgactctcacactgaa

SEQ ID NO: 6543844 - DNA, 19 bp, Homo sapiens
ttgactctgcctacttctg

SEQ ID NO: 6543845 - DNA, 19 bp, Homo sapiens
ttgactctgggtccttcct

SEQ ID NO: 6543846 - DNA, 20 bp, Homo sapiens
ttgactctgtccaactctgt

SEQ ID NO: 6543847 - DNA, 12 bp, Homo sapiens
ttgactcttccg

SEQ ID NO: 6543848 - DNA, 23 bp, Homo sapiens
ttgactcttccgtgcatcccaga

SEQ ID NO: 6543849 - DNA, 19 bp, Homo sapiens
ttgactcttttatctgagt

SEQ ID NO: 6543850 - DNA, 20 bp, Homo sapiens
ttgactcttttgagtggtaa

SEQ ID NO: 6543851 - DNA, 16 bp, Homo sapiens
ttgactgaaattactt

SEQ ID NO: 6543852 - DNA, 21 bp, Homo sapiens
ttgactgaagcgaacatcttc

SEQ ID NO: 6543853 - DNA, 22 bp, Homo sapiens
ttgactgactgagcaggctgtg

SEQ ID NO: 6543854 - DNA, 21 bp, Homo sapiens
ttgactgatgctgagattctt

SEQ ID NO: 6543855 - DNA, 13 bp, Homo sapiens
ttgactgcagttg

SEQ ID NO: 6543856 - DNA, 18 bp, Homo sapiens
ttgactgcagttgaacag

SEQ ID NO: 6543857 - DNA, 23 bp, Homo sapiens
ttgactgccgcatcatgggagta

SEQ ID NO: 6543858 - DNA, 12 bp, Homo sapiens
ttgactgctgct

SEQ ID NO: 6543859 - DNA, 12 bp, Homo sapiens
ttgactggcttt

SEQ ID NO: 6543860 - DNA, 16 bp, Homo sapiens
ttgactggctttcctc

SEQ ID NO: 6543861 - DNA, 18 bp, Homo sapiens
ttgactggctttcctctc

SEQ ID NO: 6543862 - DNA, 15 bp, Homo sapiens
ttgactgtacagaga

SEQ ID NO: 6543863 - DNA, 16 bp, Homo sapiens
ttgactgtagccacag

SEQ ID NO: 6543864 - DNA, 15 bp, Homo sapiens
ttgactgtcagcaag

SEQ ID NO: 6543865 - DNA, 14 bp, Homo sapiens
ttgactgtgattta

SEQ ID NO: 6543866 - DNA, 15 bp, Homo sapiens
ttgactgtgctagct

SEQ ID NO: 6543867 - DNA, 19 bp, Homo sapiens
ttgactgtggctcttgcct

SEQ ID NO: 6543868 - DNA, 16 bp, Homo sapiens
ttgacttcaaatgtgt

SEQ ID NO: 6543869 - DNA, 23 bp, Homo sapiens
ttgacttcaagatgcctcttcta

SEQ ID NO: 6543870 - DNA, 14 bp, Homo sapiens
ttgacttcagcagg

SEQ ID NO: 6543871 - DNA, 23 bp, Homo sapiens
ttgacttcagctgcctgaaacag

SEQ ID NO: 6543872 - DNA, 15 bp, Homo sapiens
ttgacttctgcccaa

SEQ ID NO: 6543873 - DNA, 16 bp, Homo sapiens
ttgacttcttgcttca

SEQ ID NO: 6543874 - DNA, 19 bp, Homo sapiens
ttgacttgacagaacactg

SEQ ID NO: 6543875 - DNA, 16 bp, Homo sapiens
ttgacttgattagtgc

SEQ ID NO: 6543876 - DNA, 20 bp, Homo sapiens
ttgacttgcaaagacctacc

SEQ ID NO: 6543877 - DNA, 14 bp, Homo sapiens
ttgacttgccactg

SEQ ID NO: 6543878 - DNA, 16 bp, Homo sapiens
ttgacttgccactgcc

SEQ ID NO: 6543879 - DNA, 14 bp, Homo sapiens
tgtgacaaaatgtt

SEQ ID NO: 6543880 - DNA, 14 bp, Homo sapiens
tgtgacaaagaaga

SEQ ID NO: 6543881 - DNA, 14 bp, Homo sapiens
tgtgacaacctttg

SEQ ID NO: 6543882 - DNA, 15 bp, Homo sapiens
tgtgacaacctttgt

SEQ ID NO: 6543883 - DNA, 19 bp, Homo sapiens
tgtgacaacctttgtgtaa

SEQ ID NO: 6543884 - DNA, 23 bp, Homo sapiens
tgtgacaacctttgtgtaataaa

SEQ ID NO: 6543885 - DNA, 22 bp, Homo sapiens
tgtgacacactacaccacacac

SEQ ID NO: 6543886 - DNA, 23 bp, Homo sapiens
tgtgacacactacaccacacaca

SEQ ID NO: 6543887 - DNA, 21 bp, Homo sapiens
tgtgacacagacggaggactg

SEQ ID NO: 6543888 - DNA, 17 bp, Homo sapiens
tgtgacacatatgcacc

SEQ ID NO: 6543889 - DNA, 14 bp, Homo sapiens
tgtgacaccaccac

SEQ ID NO: 6543890 - DNA, 21 bp, Homo sapiens
tgtgacaccaccactgtgtcc

SEQ ID NO: 6543891 - DNA, 23 bp, Homo sapiens
tgtgacaccaccactgtgtccca

SEQ ID NO: 6543892 - DNA, 13 bp, Homo sapiens
tgtgacacccaca

SEQ ID NO: 6543893 - DNA, 23 bp, Homo sapiens
tgtgacacccacaatcccaccta

SEQ ID NO: 6543894 - DNA, 15 bp, Homo sapiens
tgtgacacctggtgc

SEQ ID NO: 6543895 - DNA, 12 bp, Homo sapiens
tgtgacactctc

SEQ ID NO: 6543896 - DNA, 14 bp, Homo sapiens
tgtgacactctcgt

SEQ ID NO: 6543897 - DNA, 21 bp, Homo sapiens
tgtgacacttatctcactgtt

SEQ ID NO: 6543898 - DNA, 14 bp, Homo sapiens
tgtgacagtgcctc

SEQ ID NO: 6543899 - DNA, 15 bp, Homo sapiens
tgtgacagtttccaa

SEQ ID NO: 6543900 - DNA, 15 bp, Homo sapiens
tgtgacatcctgctt

SEQ ID NO: 6543901 - DNA, 19 bp, Homo sapiens
tgtgacatctacctcccga

SEQ ID NO: 6543902 - DNA, 21 bp, Homo sapiens
tgtgacatgcgggctgggcag

SEQ ID NO: 6543903 - DNA, 20 bp, Homo sapiens
tgtgacatggtgcctgagag

SEQ ID NO: 6543904 - DNA, 14 bp, Homo sapiens
tgtgacatgtaaca

SEQ ID NO: 6543905 - DNA, 15 bp, Homo sapiens
tgtgacattccacag

SEQ ID NO: 6543906 - DNA, 16 bp, Homo sapiens
tgtgacattccacaga

SEQ ID NO: 6543907 - DNA, 18 bp, Homo sapiens
tgtgacattccatgacga

SEQ ID NO: 6543908 - DNA, 15 bp, Homo sapiens
tgtgacattcgtgaa

SEQ ID NO: 6543909 - DNA, 17 bp, Homo sapiens
tgtgacatttatatatt

SEQ ID NO: 6543910 - DNA, 18 bp, Homo sapiens
tgtgacatttatatattg

SEQ ID NO: 6543911 - DNA, 16 bp, Homo sapiens
tgtgacatttatgtct

SEQ ID NO: 6543912 - DNA, 22 bp, Homo sapiens
tgtgacatttggagagggggcc

SEQ ID NO: 6543913 - DNA, 15 bp, Homo sapiens
tgtgacatttgtcat

SEQ ID NO: 6543914 - DNA, 17 bp, Homo sapiens
tgtgacattttacatta

SEQ ID NO: 6543915 - DNA, 18 bp, Homo sapiens
tgtgaccaaaagttacat

SEQ ID NO: 6543916 - DNA, 18 bp, Homo sapiens
tgtgaccaaaataccttg

SEQ ID NO: 6543917 - DNA, 15 bp, Homo sapiens
tgtgaccaactgtgt

SEQ ID NO: 6543918 - DNA, 19 bp, Homo sapiens
tgtgaccaatacatttgta

SEQ ID NO: 6543919 - DNA, 16 bp, Homo sapiens
tgtgaccaatgtcttg

SEQ ID NO: 6543920 - DNA, 19 bp, Homo sapiens
tgtgaccactgaattcact

SEQ ID NO: 6543921 - DNA, 19 bp, Homo sapiens
tgtgaccagttttgatatt

SEQ ID NO: 6543922 - DNA, 21 bp, Homo sapiens
tgtgaccatcatttcccaggc

SEQ ID NO: 6543923 - DNA, 14 bp, Homo sapiens
tgtgaccatgttca

SEQ ID NO: 6543924 - DNA, 13 bp, Homo sapiens
tgtgaccattctg

SEQ ID NO: 6543925 - DNA, 14 bp, Homo sapiens
tgtgaccattctgc

SEQ ID NO: 6543926 - DNA, 18 bp, Homo sapiens
tgtgacccaccagtgcct

SEQ ID NO: 6543927 - DNA, 14 bp, Homo sapiens
tgtgacccacttct

SEQ ID NO: 6543928 - DNA, 21 bp, Homo sapiens
tgtgacccagatcctcacaac

SEQ ID NO: 6543929 - DNA, 17 bp, Homo sapiens
tgtgacccagcactgcc

SEQ ID NO: 6543930 - DNA, 16 bp, Homo sapiens
tgtgacccccagctcc

SEQ ID NO: 6543931 - DNA, 20 bp, Homo sapiens
tgtgacccccagctccggcc

SEQ ID NO: 6543932 - DNA, 14 bp, Homo sapiens
tgtgacccctcctg

SEQ ID NO: 6543933 - DNA, 18 bp, Homo sapiens
tgtgacccctcctggggc

SEQ ID NO: 6543934 - DNA, 19 bp, Homo sapiens
tgtgacccctcctggggcc

SEQ ID NO: 6543935 - DNA, 21 bp, Homo sapiens
tgtgacccctcctggggccag

SEQ ID NO: 6543936 - DNA, 23 bp, Homo sapiens
tgtgacccctcctggggccaggc

SEQ ID NO: 6543937 - DNA, 16 bp, Homo sapiens
tgtgacccctttcact

SEQ ID NO: 6543938 - DNA, 18 bp, Homo sapiens
tgtgacccgtgaatgtgc

SEQ ID NO: 6543939 - DNA, 20 bp, Homo sapiens
tgtgaccctgagggctcctc

SEQ ID NO: 6543940 - DNA, 21 bp, Homo sapiens
tgtgaccctgagggctcctcc

SEQ ID NO: 6543941 - DNA, 22 bp, Homo sapiens
tgtgaccctgagggctcctcca

SEQ ID NO: 6543942 - DNA, 12 bp, Homo sapiens
tgtgaccctggg

SEQ ID NO: 6543943 - DNA, 14 bp, Homo sapiens
tgtgaccctgggca

SEQ ID NO: 6543944 - DNA, 16 bp, Homo sapiens
tgtgacctaagaacaa

SEQ ID NO: 6543945 - DNA, 13 bp, Homo sapiens
tgtgacctcacgt

SEQ ID NO: 6543946 - DNA, 20 bp, Homo sapiens
tgtgacctcaggcactagcc

SEQ ID NO: 6543947 - DNA, 21 bp, Homo sapiens
tgtgacctcaggcactagcct

SEQ ID NO: 6543948 - DNA, 15 bp, Homo sapiens
tgtgacctctgacaa

SEQ ID NO: 6543949 - DNA, 15 bp, Homo sapiens
tgtgacctgatttca

SEQ ID NO: 6543950 - DNA, 18 bp, Homo sapiens
tgtgacctgatttcagaa

SEQ ID NO: 6543951 - DNA, 23 bp, Homo sapiens
tgtgacctgatttcagaagagac

SEQ ID NO: 6543952 - DNA, 19 bp, Homo sapiens
tgtgacctgctcctgccca

SEQ ID NO: 6543953 - DNA, 21 bp, Homo sapiens
tgtgacctggtctggtcaggc

SEQ ID NO: 6543954 - DNA, 18 bp, Homo sapiens
tgtgacctgtcagaataa

SEQ ID NO: 6543955 - DNA, 17 bp, Homo sapiens
tgtgaccttaggcccgg

SEQ ID NO: 6543956 - DNA, 18 bp, Homo sapiens
tgtgaccttagtgtttct

SEQ ID NO: 6543957 - DNA, 19 bp, Homo sapiens
tgtgaccttagtgtttctg

SEQ ID NO: 6543958 - DNA, 13 bp, Homo sapiens
tgtgaccttctct

SEQ ID NO: 6543959 - DNA, 16 bp, Homo sapiens
tgtgacgcgcaagtct

SEQ ID NO: 6543960 - DNA, 22 bp, Homo sapiens
tgtgacgggggttggggtgggg

SEQ ID NO: 6543961 - DNA, 16 bp, Homo sapiens
tgtgacgtgcactgtg

SEQ ID NO: 6543962 - DNA, 17 bp, Homo sapiens
tgtgactaaaaatgcat

SEQ ID NO: 6543963 - DNA, 19 bp, Homo sapiens
tgtgactaactatgcaata

SEQ ID NO: 6543964 - DNA, 22 bp, Homo sapiens
tgtgactaagttgcaagatctt

SEQ ID NO: 6543965 - DNA, 18 bp, Homo sapiens
tgtgactaattgtataac

SEQ ID NO: 6543966 - DNA, 22 bp, Homo sapiens
tgtgactaattgtataacaggt

SEQ ID NO: 6543967 - DNA, 23 bp, Homo sapiens
tgtgactaattgtataacaggtt

SEQ ID NO: 6543968 - DNA, 16 bp, Homo sapiens
tgtgactagcgcctgg

SEQ ID NO: 6543969 - DNA, 14 bp, Homo sapiens
tgtgactagtgctg

SEQ ID NO: 6543970 - DNA, 17 bp, Homo sapiens
tgtgactagtgctgaag

SEQ ID NO: 6543971 - DNA, 19 bp, Homo sapiens
tgtgactagtgctgaagct

SEQ ID NO: 6543972 - DNA, 15 bp, Homo sapiens
tgtgactattaaatg

SEQ ID NO: 6543973 - DNA, 16 bp, Homo sapiens
tgtgactattaaatgt

SEQ ID NO: 6543974 - DNA, 18 bp, Homo sapiens
tgtgactattcatggcta

SEQ ID NO: 6543975 - DNA, 18 bp, Homo sapiens
tgtgactcagtgtatttt

SEQ ID NO: 6543976 - DNA, 16 bp, Homo sapiens
tgtgactccaagaggg

SEQ ID NO: 6543977 - DNA, 15 bp, Homo sapiens
tgtgactccagcctg

SEQ ID NO: 6543978 - DNA, 20 bp, Homo sapiens
tgtgactccatatcccggga

SEQ ID NO: 6543979 - DNA, 21 bp, Homo sapiens
tgtgactcgcttagctgaaac

SEQ ID NO: 6543980 - DNA, 16 bp, Homo sapiens
tgtgactcgggagctg

SEQ ID NO: 6543981 - DNA, 16 bp, Homo sapiens
tgtgactctaaattct

SEQ ID NO: 6543982 - DNA, 22 bp, Homo sapiens
tgtgactctaagctcagtgctc

SEQ ID NO: 6543983 - DNA, 16 bp, Homo sapiens
tgtgactctagcaagg

SEQ ID NO: 6543984 - DNA, 13 bp, Homo sapiens
tgtgactcttact

SEQ ID NO: 6543985 - DNA, 14 bp, Homo sapiens
tgtgactctttcca

SEQ ID NO: 6543986 - DNA, 22 bp, Homo sapiens
tgtgactctttcctaaagccaa

SEQ ID NO: 6543987 - DNA, 23 bp, Homo sapiens
tgtgactctttcctaaagccaaa

SEQ ID NO: 6543988 - DNA, 23 bp, Homo sapiens
tgtgactctttttagggccaggc

SEQ ID NO: 6543989 - DNA, 20 bp, Homo sapiens
tgtgactgaaggggcacacc

SEQ ID NO: 6543990 - DNA, 16 bp, Homo sapiens
tgtgactgaatttctt

SEQ ID NO: 6543991 - DNA, 20 bp, Homo sapiens
tgtgactgcatcatatattt

SEQ ID NO: 6543992 - DNA, 15 bp, Homo sapiens
tgtgactggatcttc

SEQ ID NO: 6543993 - DNA, 12 bp, Homo sapiens
tgtgactggcac

SEQ ID NO: 6543994 - DNA, 13 bp, Homo sapiens
tgtgactggtcag

SEQ ID NO: 6543995 - DNA, 13 bp, Homo sapiens
tgtgacttatcta

SEQ ID NO: 6543996 - DNA, 16 bp, Homo sapiens
tgtgacttcactgtat

SEQ ID NO: 6543997 - DNA, 13 bp, Homo sapiens
tgtgacttcccct

SEQ ID NO: 6543998 - DNA, 18 bp, Homo sapiens
tgtgacttccttggaaat

SEQ ID NO: 6543999 - DNA, 20 bp, Homo sapiens
tgtgacttctcccctgccct

SEQ ID NO: 6544000 - DNA, 18 bp, Homo sapiens
tgtgacttggagataata

SEQ ID NO: 6544001 - DNA, 16 bp, Homo sapiens
tgtgacttggccgggc

SEQ ID NO: 6544002 - DNA, 13 bp, Homo sapiens
tgtgactttcagg

SEQ ID NO: 6544003 - DNA, 18 bp, Homo sapiens
tgtgactttcaggctact

SEQ ID NO: 6544004 - DNA, 20 bp, Homo sapiens
tgtgactttgaaaatatata

SEQ ID NO: 6544005 - DNA, 17 bp, Homo sapiens
tgtgactttgctttgag

SEQ ID NO: 6544006 - DNA, 14 bp, Homo sapiens
tgtgacttttaaaa

SEQ ID NO: 6544007 - DNA, 19 bp, Homo sapiens
tgtgacttttctgattaat

SEQ ID NO: 6544008 - DNA, 17 bp, Homo sapiens
tgtgacttttgctttaa

SEQ ID NO: 6544009 - DNA, 22 bp, Homo sapiens
tgtgagaaaaccccttcccatt

SEQ ID NO: 6544010 - DNA, 14 bp, Homo sapiens
tgtgagaaaacgtt

SEQ ID NO: 6544011 - DNA, 12 bp, Homo sapiens
tgtgagaacatt

SEQ ID NO: 6544012 - DNA, 14 bp, Homo sapiens
tgtgagaacattag

SEQ ID NO: 6544013 - DNA, 22 bp, Homo sapiens
tgtgagaactgtgaatatgtgt

SEQ ID NO: 6544014 - DNA, 13 bp, Homo sapiens
tgtgagaagatgg

SEQ ID NO: 6544015 - DNA, 18 bp, Homo sapiens
tgtgagaaggtttattgt

SEQ ID NO: 6544016 - DNA, 22 bp, Homo sapiens
tgtgagaagtgaatgctgggac

SEQ ID NO: 6544017 - DNA, 12 bp, Homo sapiens
tgtgagaagttt

SEQ ID NO: 6544018 - DNA, 12 bp, Homo sapiens
tgtgagaatggc

SEQ ID NO: 6544019 - DNA, 19 bp, Homo sapiens
tgtgagaatggcctggagc

SEQ ID NO: 6544020 - DNA, 16 bp, Homo sapiens
tgtgagacagcaagtt

SEQ ID NO: 6544021 - DNA, 13 bp, Homo sapiens
tgtgagaccccca

SEQ ID NO: 6544022 - DNA, 15 bp, Homo sapiens
tgtgagacccccaca

SEQ ID NO: 6544023 - DNA, 15 bp, Homo sapiens
tgtgagactactaag

SEQ ID NO: 6544024 - DNA, 14 bp, Homo sapiens
tgtgagactcaggt

SEQ ID NO: 6544025 - DNA, 18 bp, Homo sapiens
tgtgagacttaaaacatg

SEQ ID NO: 6544026 - DNA, 15 bp, Homo sapiens
tgtgagacttctgtt

SEQ ID NO: 6544027 - DNA, 22 bp, Homo sapiens
tgtgagagagttgctcctcagg

SEQ ID NO: 6544028 - DNA, 17 bp, Homo sapiens
tgtgagagatggggcgg

SEQ ID NO: 6544029 - DNA, 17 bp, Homo sapiens
tgtgagagcgaggctga

SEQ ID NO: 6544030 - DNA, 13 bp, Homo sapiens
tgtgagagctggt

SEQ ID NO: 6544031 - DNA, 19 bp, Homo sapiens
tgtgagagtgtgagcaggg

SEQ ID NO: 6544032 - DNA, 12 bp, Homo sapiens
tgtgagataaat

SEQ ID NO: 6544033 - DNA, 15 bp, Homo sapiens
tgtgagataaatatc

SEQ ID NO: 6544034 - DNA, 17 bp, Homo sapiens
tgtgagataacttcctt

SEQ ID NO: 6544035 - DNA, 18 bp, Homo sapiens
tgtgagataacttccttc

SEQ ID NO: 6544036 - DNA, 18 bp, Homo sapiens
tgtgagatagttttcatt

SEQ ID NO: 6544037 - DNA, 19 bp, Homo sapiens
tgtgagatagttttcattt

SEQ ID NO: 6544038 - DNA, 15 bp, Homo sapiens
tgtgagatgatttgt

SEQ ID NO: 6544039 - DNA, 19 bp, Homo sapiens
tgtgagatgctagaactcc

SEQ ID NO: 6544040 - DNA, 13 bp, Homo sapiens
tgtgagatggatg

SEQ ID NO: 6544041 - DNA, 16 bp, Homo sapiens
tgtgagatggttccca

SEQ ID NO: 6544042 - DNA, 18 bp, Homo sapiens
tgtgagatgtgtatcagt

SEQ ID NO: 6544043 - DNA, 12 bp, Homo sapiens
tgtgagatttcc

SEQ ID NO: 6544044 - DNA, 22 bp, Homo sapiens
tgtgagattttttattgctagt

SEQ ID NO: 6544045 - DNA, 21 bp, Homo sapiens
tgtgagcaaacagaggaggcc

SEQ ID NO: 6544046 - DNA, 14 bp, Homo sapiens
tgtgagcaagaagt

SEQ ID NO: 6544047 - DNA, 15 bp, Homo sapiens
tgtgagcaagagcca

SEQ ID NO: 6544048 - DNA, 10 bp, Homo sapiens
tgtgagcaca

SEQ ID NO: 6544049 - DNA, 17 bp, Homo sapiens
tgtgagcacaaagaaga

SEQ ID NO: 6544050 - DNA, 19 bp, Homo sapiens
tgtgagcacaaagaagaaa

SEQ ID NO: 6544051 - DNA, 14 bp, Homo sapiens
tgtgagcagaagac

SEQ ID NO: 6544052 - DNA, 20 bp, Homo sapiens
tgtgagcagtggacacgtga

SEQ ID NO: 6544053 - DNA, 16 bp, Homo sapiens
tgtgagcatcctgcaa

SEQ ID NO: 6544054 - DNA, 19 bp, Homo sapiens
tgtgagcatcctggcaggt

SEQ ID NO: 6544055 - DNA, 17 bp, Homo sapiens
tgtgagcatgaaactat

SEQ ID NO: 6544056 - DNA, 19 bp, Homo sapiens
tgtgagccaaagagaaaag

SEQ ID NO: 6544057 - DNA, 16 bp, Homo sapiens
tgtgagccacagcact

SEQ ID NO: 6544058 - DNA, 21 bp, Homo sapiens
tgtgagccacagcactcggcc

SEQ ID NO: 6544059 - DNA, 15 bp, Homo sapiens
ttgactttaaagatg

SEQ ID NO: 6544060 - DNA, 14 bp, Homo sapiens
ttgactttaattta

SEQ ID NO: 6544061 - DNA, 17 bp, Homo sapiens
ttgactttagtgaaagc

SEQ ID NO: 6544062 - DNA, 19 bp, Homo sapiens
ttgactttcaaaatatatt

SEQ ID NO: 6544063 - DNA, 14 bp, Homo sapiens
ttgactttcaggta

SEQ ID NO: 6544064 - DNA, 21 bp, Homo sapiens
ttgactttcaggtactaaata

SEQ ID NO: 6544065 - DNA, 21 bp, Homo sapiens
ttgactttccagaatgacctt

SEQ ID NO: 6544066 - DNA, 19 bp, Homo sapiens
ttgactttccccaccagat

SEQ ID NO: 6544067 - DNA, 12 bp, Homo sapiens
ttgactttgtct

SEQ ID NO: 6544068 - DNA, 18 bp, Homo sapiens
ttgacttttataaagcat

SEQ ID NO: 6544069 - DNA, 19 bp, Homo sapiens
ttgacttttctgtaattca

SEQ ID NO: 6544070 - DNA, 16 bp, Homo sapiens
ttgactttttagatgt

SEQ ID NO: 6544071 - DNA, 16 bp, Homo sapiens
ttgactttttgcattt

SEQ ID NO: 6544072 - DNA, 22 bp, Homo sapiens
ttgagaaaaatagagcaaaatc

SEQ ID NO: 6544073 - DNA, 19 bp, Homo sapiens
ttgagaaaaatatatacta

SEQ ID NO: 6544074 - DNA, 14 bp, Homo sapiens
ttgagaaaatataa

SEQ ID NO: 6544075 - DNA, 17 bp, Homo sapiens
ttgagaaaatataataa

SEQ ID NO: 6544076 - DNA, 20 bp, Homo sapiens
ttgagaaacaaataatttgt

SEQ ID NO: 6544077 - DNA, 18 bp, Homo sapiens
ttgagaaacagttccatt

SEQ ID NO: 6544078 - DNA, 23 bp, Homo sapiens
ttgagaaaccttattgtacctct

SEQ ID NO: 6544079 - DNA, 14 bp, Homo sapiens
ttgagaaagaaata

SEQ ID NO: 6544080 - DNA, 19 bp, Homo sapiens
ttgagaaagagcacttaag

SEQ ID NO: 6544081 - DNA, 21 bp, Homo sapiens
ttgagaaaggattaagataca

SEQ ID NO: 6544082 - DNA, 14 bp, Homo sapiens
ttgagaaagtcaca

SEQ ID NO: 6544083 - DNA, 17 bp, Homo sapiens
ttgagaaagtcagattc

SEQ ID NO: 6544084 - DNA, 15 bp, Homo sapiens
ttgagaacgtaaaga

SEQ ID NO: 6544085 - DNA, 21 bp, Homo sapiens
ttgagaactacctggatttgt

SEQ ID NO: 6544086 - DNA, 22 bp, Homo sapiens
ttgagaactccagctggtgccc

SEQ ID NO: 6544087 - DNA, 23 bp, Homo sapiens
ttgagaactggttttagcattta

SEQ ID NO: 6544088 - DNA, 15 bp, Homo sapiens
ttgagaagaaaacat

SEQ ID NO: 6544089 - DNA, 20 bp, Homo sapiens
ttgagaagaatgtttaatag

SEQ ID NO: 6544090 - DNA, 17 bp, Homo sapiens
ttgagaagataatcatt

SEQ ID NO: 6544091 - DNA, 12 bp, Homo sapiens
ttgagaagctct

SEQ ID NO: 6544092 - DNA, 15 bp, Homo sapiens
ttgagaagctgctca

SEQ ID NO: 6544093 - DNA, 16 bp, Homo sapiens
ttgagaaggagagaaa

SEQ ID NO: 6544094 - DNA, 17 bp, Homo sapiens
ttgagaaggtgcctgcc

SEQ ID NO: 6544095 - DNA, 16 bp, Homo sapiens
ttgagaagttcattgt

SEQ ID NO: 6544096 - DNA, 17 bp, Homo sapiens
ttgagaatcaggttgca

SEQ ID NO: 6544097 - DNA, 15 bp, Homo sapiens
ttgagaatgtgattc

SEQ ID NO: 6544098 - DNA, 13 bp, Homo sapiens
ttgagaattattc

SEQ ID NO: 6544099 - DNA, 13 bp, Homo sapiens
ttgagaattttaa

SEQ ID NO: 6544100 - DNA, 13 bp, Homo sapiens
ttgagacaaaaat

SEQ ID NO: 6544101 - DNA, 23 bp, Homo sapiens
ttgagacaaatcctttctgcccc

SEQ ID NO: 6544102 - DNA, 14 bp, Homo sapiens
ttgagacaatgttt

SEQ ID NO: 6544103 - DNA, 20 bp, Homo sapiens
ttgagacactggtttacact

SEQ ID NO: 6544104 - DNA, 22 bp, Homo sapiens
ttgagacactggtttacacttt

SEQ ID NO: 6544105 - DNA, 21 bp, Homo sapiens
ttgagacactgtcaagattaa

SEQ ID NO: 6544106 - DNA, 23 bp, Homo sapiens
ttgagacactgtcaagattaagt

SEQ ID NO: 6544107 - DNA, 14 bp, Homo sapiens
ttgagacagggtct

SEQ ID NO: 6544108 - DNA, 12 bp, Homo sapiens
ttgagacagttt

SEQ ID NO: 6544109 - DNA, 19 bp, Homo sapiens
ttgagacagtttcttagct

SEQ ID NO: 6544110 - DNA, 13 bp, Homo sapiens
ttgagacattcca

SEQ ID NO: 6544111 - DNA, 15 bp, Homo sapiens
ttgagaccagcctgg

SEQ ID NO: 6544112 - DNA, 16 bp, Homo sapiens
ttgagaccagcctggc

SEQ ID NO: 6544113 - DNA, 19 bp, Homo sapiens
ttgagaccagcctgggcaa

SEQ ID NO: 6544114 - DNA, 22 bp, Homo sapiens
ttgagactcctcagttcttgcc

SEQ ID NO: 6544115 - DNA, 12 bp, Homo sapiens
ttgagactgatc

SEQ ID NO: 6544116 - DNA, 10 bp, Homo sapiens
ttgagactgg

SEQ ID NO: 6544117 - DNA, 16 bp, Homo sapiens
ttgagactgtcctgtg

SEQ ID NO: 6544118 - DNA, 16 bp, Homo sapiens
ttgagacttcaagctt

SEQ ID NO: 6544119 - DNA, 15 bp, Homo sapiens
ttgagagaaacgtga

SEQ ID NO: 6544120 - DNA, 13 bp, Homo sapiens
ttgagagaagcca

SEQ ID NO: 6544121 - DNA, 16 bp, Homo sapiens
ttgagagaatttgtgc

SEQ ID NO: 6544122 - DNA, 22 bp, Homo sapiens
ttgagagacagtaacacaatta

SEQ ID NO: 6544123 - DNA, 16 bp, Homo sapiens
ttgagagaccaggcaa

SEQ ID NO: 6544124 - DNA, 14 bp, Homo sapiens
ttgagagactgcca

SEQ ID NO: 6544125 - DNA, 22 bp, Homo sapiens
ttgagagagatgtgtaattttt

SEQ ID NO: 6544126 - DNA, 23 bp, Homo sapiens
ttgagagagatgtgtaatttttc

SEQ ID NO: 6544127 - DNA, 11 bp, Homo sapiens
ttgagagaggg

SEQ ID NO: 6544128 - DNA, 22 bp, Homo sapiens
ttgagagcctccaggttcctca

SEQ ID NO: 6544129 - DNA, 15 bp, Homo sapiens
ttgagagctttattg

SEQ ID NO: 6544130 - DNA, 16 bp, Homo sapiens
ttgagaggctgaggtg

SEQ ID NO: 6544131 - DNA, 14 bp, Homo sapiens
ttgagaggggctat

SEQ ID NO: 6544132 - DNA, 15 bp, Homo sapiens
ttgagagtgtgacca

SEQ ID NO: 6544133 - DNA, 17 bp, Homo sapiens
ttgagagtgttcctgag

SEQ ID NO: 6544134 - DNA, 15 bp, Homo sapiens
ttgagagttcacaga

SEQ ID NO: 6544135 - DNA, 16 bp, Homo sapiens
ttgagagttcacagaa

SEQ ID NO: 6544136 - DNA, 23 bp, Homo sapiens
ttgagagttcgtgaagagggaag

SEQ ID NO: 6544137 - DNA, 14 bp, Homo sapiens
ttgagagttctaaa

SEQ ID NO: 6544138 - DNA, 21 bp, Homo sapiens
ttgagataatctaaatataaa

SEQ ID NO: 6544139 - DNA, 22 bp, Homo sapiens
ttgagataatctaaatataaac

SEQ ID NO: 6544140 - DNA, 20 bp, Homo sapiens
ttgagatactttttcttttg

SEQ ID NO: 6544141 - DNA, 22 bp, Homo sapiens
ttgagatactttttcttttgta

SEQ ID NO: 6544142 - DNA, 23 bp, Homo sapiens
ttgagatactttttcttttgtaa

SEQ ID NO: 6544143 - DNA, 20 bp, Homo sapiens
ttgagatattaatgcccaga

SEQ ID NO: 6544144 - DNA, 16 bp, Homo sapiens
ttgagatcagcctggg

SEQ ID NO: 6544145 - DNA, 12 bp, Homo sapiens
ttgagatgagtt

SEQ ID NO: 6544146 - DNA, 10 bp, Homo sapiens
ttgagatgcc

SEQ ID NO: 6544147 - DNA, 14 bp, Homo sapiens
ttgagatgcctgtt

SEQ ID NO: 6544148 - DNA, 23 bp, Homo sapiens
ttgagatggagtctcactcttgt

SEQ ID NO: 6544149 - DNA, 18 bp, Homo sapiens
ttgagatggggataaaat

SEQ ID NO: 6544150 - DNA, 22 bp, Homo sapiens
ttgagatggggataaaatgact

SEQ ID NO: 6544151 - DNA, 13 bp, Homo sapiens
ttgagatgtgatg

SEQ ID NO: 6544152 - DNA, 22 bp, Homo sapiens
ttgagatgtgttcctcctgctg

SEQ ID NO: 6544153 - DNA, 23 bp, Homo sapiens
ttgagatgtgttcctcctgctgt

SEQ ID NO: 6544154 - DNA, 12 bp, Homo sapiens
ttgagattagag

SEQ ID NO: 6544155 - DNA, 16 bp, Homo sapiens
ttgagattatatttcc

SEQ ID NO: 6544156 - DNA, 21 bp, Homo sapiens
ttgagattcaagacaagagct

SEQ ID NO: 6544157 - DNA, 12 bp, Homo sapiens
ttgagattctga

SEQ ID NO: 6544158 - DNA, 15 bp, Homo sapiens
ttgagattgccccag

SEQ ID NO: 6544159 - DNA, 15 bp, Homo sapiens
ttgagattgtactgt

SEQ ID NO: 6544160 - DNA, 16 bp, Homo sapiens
ttgagattgtactgtt

SEQ ID NO: 6544161 - DNA, 18 bp, Homo sapiens
ttgagattgtactgttca

SEQ ID NO: 6544162 - DNA, 11 bp, Homo sapiens
ttgagatttct

SEQ ID NO: 6544163 - DNA, 15 bp, Homo sapiens
ttgagatttctttta

SEQ ID NO: 6544164 - DNA, 23 bp, Homo sapiens
ttgagattttccattaactattt

SEQ ID NO: 6544165 - DNA, 21 bp, Homo sapiens
ttgagatttttaagaacttca

SEQ ID NO: 6544166 - DNA, 18 bp, Homo sapiens
ttgagatttttggttttt

SEQ ID NO: 6544167 - DNA, 21 bp, Homo sapiens
ttgagattttttttccgtgtg

SEQ ID NO: 6544168 - DNA, 23 bp, Homo sapiens
ttgagcaaggcaagaagtgggat

SEQ ID NO: 6544169 - DNA, 16 bp, Homo sapiens
ttgagcaagtcccatc

SEQ ID NO: 6544170 - DNA, 13 bp, Homo sapiens
ttgagcaattcat

SEQ ID NO: 6544171 - DNA, 19 bp, Homo sapiens
ttgagcaattcatttcact

SEQ ID NO: 6544172 - DNA, 14 bp, Homo sapiens
ttgagcacaaaatt

SEQ ID NO: 6544173 - DNA, 23 bp, Homo sapiens
ttgagcactggtctctcttggaa

SEQ ID NO: 6544174 - DNA, 18 bp, Homo sapiens
ttgagcagggatcctggt

SEQ ID NO: 6544175 - DNA, 23 bp, Homo sapiens
ttgagcaggtatcaactagggga

SEQ ID NO: 6544176 - DNA, 19 bp, Homo sapiens
ttgagcagtggctggtcca

SEQ ID NO: 6544177 - DNA, 17 bp, Homo sapiens
ttgagcatcaatcttgt

SEQ ID NO: 6544178 - DNA, 14 bp, Homo sapiens
ttgagccagcagac

SEQ ID NO: 6544179 - DNA, 22 bp, Homo sapiens
ttgagccaggcctgggtctgtg

SEQ ID NO: 6544180 - DNA, 15 bp, Homo sapiens
ttgagccaggtggat

SEQ ID NO: 6544181 - DNA, 16 bp, Homo sapiens
ttgagccatgagtgga

SEQ ID NO: 6544182 - DNA, 22 bp, Homo sapiens
ttgagccatttaaagaccaata

SEQ ID NO: 6544183 - DNA, 19 bp, Homo sapiens
ttgagcccacaaagcctta

SEQ ID NO: 6544184 - DNA, 18 bp, Homo sapiens
ttgagcccagaacttcaa

SEQ ID NO: 6544185 - DNA, 13 bp, Homo sapiens
ttgagcccaggag

SEQ ID NO: 6544186 - DNA, 19 bp, Homo sapiens
ttgagccccaagtcctgaa

SEQ ID NO: 6544187 - DNA, 19 bp, Homo sapiens
ttgagccctggaccccagg

SEQ ID NO: 6544188 - DNA, 17 bp, Homo sapiens
ttgagcctaaaaataaa

SEQ ID NO: 6544189 - DNA, 23 bp, Homo sapiens
ttgagcctccatttctggcttct

SEQ ID NO: 6544190 - DNA, 18 bp, Homo sapiens
ttgagcctcccccaaagc

SEQ ID NO: 6544191 - DNA, 14 bp, Homo sapiens
ttgagcctgagcct

SEQ ID NO: 6544192 - DNA, 19 bp, Homo sapiens
ttgagccttattaaaatat

SEQ ID NO: 6544193 - DNA, 16 bp, Homo sapiens
ttgagccttgaacttt

SEQ ID NO: 6544194 - DNA, 22 bp, Homo sapiens
ttgagcctttattggtaaattc

SEQ ID NO: 6544195 - DNA, 20 bp, Homo sapiens
ttgagcgtacgatggaggcc

SEQ ID NO: 6544196 - DNA, 20 bp, Homo sapiens
ttgagcgtgaatctgtatct

SEQ ID NO: 6544197 - DNA, 15 bp, Homo sapiens
ttgagcgtgattctg

SEQ ID NO: 6544198 - DNA, 19 bp, Homo sapiens
ttgagcgtgcgcactgcat

SEQ ID NO: 6544199 - DNA, 18 bp, Homo sapiens
ttgagctagaccaaggtc

SEQ ID NO: 6544200 - DNA, 17 bp, Homo sapiens
ttgagctatgatatgtg

SEQ ID NO: 6544201 - DNA, 22 bp, Homo sapiens
ttgagctatttccttccagcct

SEQ ID NO: 6544202 - DNA, 15 bp, Homo sapiens
ttgagctcagcttcc

SEQ ID NO: 6544203 - DNA, 12 bp, Homo sapiens
ttgagctcaggt

SEQ ID NO: 6544204 - DNA, 22 bp, Homo sapiens
ttgagctcccacttctgccaga

SEQ ID NO: 6544205 - DNA, 13 bp, Homo sapiens
ttgagctcctggg

SEQ ID NO: 6544206 - DNA, 15 bp, Homo sapiens
ttgagctctctgccc

SEQ ID NO: 6544207 - DNA, 17 bp, Homo sapiens
ttgagctctgtaactta

SEQ ID NO: 6544208 - DNA, 18 bp, Homo sapiens
ttgagctctgtaacttac

SEQ ID NO: 6544209 - DNA, 20 bp, Homo sapiens
ttgagctgcctccagcctgg

SEQ ID NO: 6544210 - DNA, 12 bp, Homo sapiens
ttgagctgcctt

SEQ ID NO: 6544211 - DNA, 13 bp, Homo sapiens
ttgagctgccttc

SEQ ID NO: 6544212 - DNA, 15 bp, Homo sapiens
ttgagctgccttccc

SEQ ID NO: 6544213 - DNA, 18 bp, Homo sapiens
ttgagctgctttttttga

SEQ ID NO: 6544214 - DNA, 20 bp, Homo sapiens
ttgagctgctttttttgaaa

SEQ ID NO: 6544215 - DNA, 11 bp, Homo sapiens
ttgagctggcc

SEQ ID NO: 6544216 - DNA, 12 bp, Homo sapiens
ttgagctggcct

SEQ ID NO: 6544217 - DNA, 13 bp, Homo sapiens
ttgagctgtttcc

SEQ ID NO: 6544218 - DNA, 12 bp, Homo sapiens
ttgagctgtttt

SEQ ID NO: 6544219 - DNA, 15 bp, Homo sapiens
ttgagcttaatcttt

SEQ ID NO: 6544220 - DNA, 16 bp, Homo sapiens
ttgagcttaatctttg

SEQ ID NO: 6544221 - DNA, 16 bp, Homo sapiens
ttgagcttcaaaatga

SEQ ID NO: 6544222 - DNA, 16 bp, Homo sapiens
ttgagcttctcctctg

SEQ ID NO: 6544223 - DNA, 17 bp, Homo sapiens
ttgagcttctcctctgc

SEQ ID NO: 6544224 - DNA, 21 bp, Homo sapiens
ttgaggaaaaatatgtgaagg

SEQ ID NO: 6544225 - DNA, 15 bp, Homo sapiens
ttgaggaaaatattg

SEQ ID NO: 6544226 - DNA, 18 bp, Homo sapiens
ttgaggaaacaacagctt

SEQ ID NO: 6544227 - DNA, 15 bp, Homo sapiens
ttgaggaaagcaaga

SEQ ID NO: 6544228 - DNA, 23 bp, Homo sapiens
ttgaggaaagcaagaatcagaga

SEQ ID NO: 6544229 - DNA, 15 bp, Homo sapiens
ttgaggaactgtaca

SEQ ID NO: 6544230 - DNA, 14 bp, Homo sapiens
ttgaggaagttttg

SEQ ID NO: 6544231 - DNA, 18 bp, Homo sapiens
ttgaggaccctcccaggt

SEQ ID NO: 6544232 - DNA, 22 bp, Homo sapiens
ttgaggagaagggggtctctgt

SEQ ID NO: 6544233 - DNA, 23 bp, Homo sapiens
ttgaggagaagggggtctctgtt

SEQ ID NO: 6544234 - DNA, 21 bp, Homo sapiens
ttgaggagcatgttttgtata

SEQ ID NO: 6544235 - DNA, 19 bp, Homo sapiens
ttgaggaggggagcaaggc

SEQ ID NO: 6544236 - DNA, 20 bp, Homo sapiens
ttgaggaggggcacctgcca

SEQ ID NO: 6544237 - DNA, 19 bp, Homo sapiens
ttgaggaggggcaggtaaa

SEQ ID NO: 6544238 - DNA, 19 bp, Homo sapiens
tgtgagccaccgtgcctgg

SEQ ID NO: 6544239 - DNA, 21 bp, Homo sapiens
tgtgagccaccgtgcctggcc

SEQ ID NO: 6544240 - DNA, 15 bp, Homo sapiens
tgtgagccatgcctc

SEQ ID NO: 6544241 - DNA, 16 bp, Homo sapiens
tgtgagccatgcctcc

SEQ ID NO: 6544242 - DNA, 18 bp, Homo sapiens
tgtgagccatgcctccct

SEQ ID NO: 6544243 - DNA, 19 bp, Homo sapiens
tgtgagccatgcctccctg

SEQ ID NO: 6544244 - DNA, 23 bp, Homo sapiens
tgtgagccatgcctccctgggcc

SEQ ID NO: 6544245 - DNA, 14 bp, Homo sapiens
tgtgagcccagctg

SEQ ID NO: 6544246 - DNA, 12 bp, Homo sapiens
tgtgagcccctg

SEQ ID NO: 6544247 - DNA, 17 bp, Homo sapiens
tgtgagcccctggtcct

SEQ ID NO: 6544248 - DNA, 21 bp, Homo sapiens
tgtgagcccctggtcctgagg

SEQ ID NO: 6544249 - DNA, 15 bp, Homo sapiens
tgtgagccctctagg

SEQ ID NO: 6544250 - DNA, 16 bp, Homo sapiens
tgtgagccctctaggg

SEQ ID NO: 6544251 - DNA, 14 bp, Homo sapiens
tgtgagccttggct

SEQ ID NO: 6544252 - DNA, 14 bp, Homo sapiens
tgtgagcgagcaag

SEQ ID NO: 6544253 - DNA, 20 bp, Homo sapiens
tgtgagcgagcctggcaggt

SEQ ID NO: 6544254 - DNA, 18 bp, Homo sapiens
tgtgagcgagtgacagaa

SEQ ID NO: 6544255 - DNA, 22 bp, Homo sapiens
tgtgagcgcttctgcagcctcg

SEQ ID NO: 6544256 - DNA, 18 bp, Homo sapiens
tgtgagcgtgtccacaga

SEQ ID NO: 6544257 - DNA, 20 bp, Homo sapiens
tgtgagctaggagaagggct

SEQ ID NO: 6544258 - DNA, 21 bp, Homo sapiens
tgtgagctaggagaagggctg

SEQ ID NO: 6544259 - DNA, 16 bp, Homo sapiens
tgtgagctatgcaaac

SEQ ID NO: 6544260 - DNA, 16 bp, Homo sapiens
tgtgagctgctgccat

SEQ ID NO: 6544261 - DNA, 18 bp, Homo sapiens
tgtgagctgtaaaaatgt

SEQ ID NO: 6544262 - DNA, 16 bp, Homo sapiens
tgtgagcttacattga

SEQ ID NO: 6544263 - DNA, 14 bp, Homo sapiens
tgtgagcttctaca

SEQ ID NO: 6544264 - DNA, 17 bp, Homo sapiens
tgtgagctttgaagtag

SEQ ID NO: 6544265 - DNA, 12 bp, Homo sapiens
tgtgagcttttt

SEQ ID NO: 6544266 - DNA, 22 bp, Homo sapiens
tgtgagctttttgttccctcat

SEQ ID NO: 6544267 - DNA, 18 bp, Homo sapiens
tgtgagctttttttaaat

SEQ ID NO: 6544268 - DNA, 16 bp, Homo sapiens
tgtgaggaaagtcatt

SEQ ID NO: 6544269 - DNA, 22 bp, Homo sapiens
tgtgaggaaagtcattggcttt

SEQ ID NO: 6544270 - DNA, 13 bp, Homo sapiens
tgtgaggaagccg

SEQ ID NO: 6544271 - DNA, 21 bp, Homo sapiens
tgtgaggaatgctctgtgcca

SEQ ID NO: 6544272 - DNA, 17 bp, Homo sapiens
tgtgaggacagacagaa

SEQ ID NO: 6544273 - DNA, 13 bp, Homo sapiens
tgtgaggagaggg

SEQ ID NO: 6544274 - DNA, 18 bp, Homo sapiens
tgtgaggagctgctggct

SEQ ID NO: 6544275 - DNA, 15 bp, Homo sapiens
tgtgaggaggaaaag

SEQ ID NO: 6544276 - DNA, 13 bp, Homo sapiens
tgtgaggaggggc

SEQ ID NO: 6544277 - DNA, 23 bp, Homo sapiens
tgtgaggatagagacttgcagtt

SEQ ID NO: 6544278 - DNA, 19 bp, Homo sapiens
tgtgaggatgtggatggag

SEQ ID NO: 6544279 - DNA, 22 bp, Homo sapiens
tgtgaggattatgggtcctgca

SEQ ID NO: 6544280 - DNA, 14 bp, Homo sapiens
tgtgaggcaggaga

SEQ ID NO: 6544281 - DNA, 18 bp, Homo sapiens
tgtgaggcaggggcggag

SEQ ID NO: 6544282 - DNA, 14 bp, Homo sapiens
tgtgaggccagggc

SEQ ID NO: 6544283 - DNA, 15 bp, Homo sapiens
tgtgaggccagggca

SEQ ID NO: 6544284 - DNA, 22 bp, Homo sapiens
tgtgaggccagggcagagtgag

SEQ ID NO: 6544285 - DNA, 19 bp, Homo sapiens
tgtgaggccatacttgtga

SEQ ID NO: 6544286 - DNA, 23 bp, Homo sapiens
tgtgaggcccatggttgagaaat

SEQ ID NO: 6544287 - DNA, 14 bp, Homo sapiens
tgtgaggcctggcc

SEQ ID NO: 6544288 - DNA, 15 bp, Homo sapiens
tgtgaggctgggcca

SEQ ID NO: 6544289 - DNA, 21 bp, Homo sapiens
tgtgaggctgggccagcctca

SEQ ID NO: 6544290 - DNA, 18 bp, Homo sapiens
tgtgaggctgtgtctctg

SEQ ID NO: 6544291 - DNA, 17 bp, Homo sapiens
tgtgaggcttgcccagg

SEQ ID NO: 6544292 - DNA, 22 bp, Homo sapiens
tgtgagggacatgctcacctct

SEQ ID NO: 6544293 - DNA, 14 bp, Homo sapiens
tgtgagggagggga

SEQ ID NO: 6544294 - DNA, 17 bp, Homo sapiens
tgtgagggtcctgcagc

SEQ ID NO: 6544295 - DNA, 18 bp, Homo sapiens
tgtgaggtaactgggatc

SEQ ID NO: 6544296 - DNA, 21 bp, Homo sapiens
tgtgaggtgaatgtcttcctt

SEQ ID NO: 6544297 - DNA, 19 bp, Homo sapiens
tgtgagtaaatcagatgtt

SEQ ID NO: 6544298 - DNA, 15 bp, Homo sapiens
tgtgagtaagagctg

SEQ ID NO: 6544299 - DNA, 19 bp, Homo sapiens
tgtgagtaagagctggtgt

SEQ ID NO: 6544300 - DNA, 16 bp, Homo sapiens
tgtgagtaatctgaga

SEQ ID NO: 6544301 - DNA, 19 bp, Homo sapiens
tgtgagtaatctgagaaac

SEQ ID NO: 6544302 - DNA, 18 bp, Homo sapiens
tgtgagtatcagaattga

SEQ ID NO: 6544303 - DNA, 14 bp, Homo sapiens
tgtgagtatgtgtg

SEQ ID NO: 6544304 - DNA, 22 bp, Homo sapiens
tgtgagtattctatgtaaaaat

SEQ ID NO: 6544305 - DNA, 15 bp, Homo sapiens
tgtgagtattctcat

SEQ ID NO: 6544306 - DNA, 23 bp, Homo sapiens
tgtgagtattctcattcttccca

SEQ ID NO: 6544307 - DNA, 21 bp, Homo sapiens
tgtgagtcaatacatagtgct

SEQ ID NO: 6544308 - DNA, 15 bp, Homo sapiens
tgtgagtcagtcagc

SEQ ID NO: 6544309 - DNA, 16 bp, Homo sapiens
tgtgagtcagtcagcg

SEQ ID NO: 6544310 - DNA, 17 bp, Homo sapiens
tgtgagtcattatgtag

SEQ ID NO: 6544311 - DNA, 16 bp, Homo sapiens
tgtgagtcccagagcc

SEQ ID NO: 6544312 - DNA, 19 bp, Homo sapiens
tgtgagtcctgttgaagac

SEQ ID NO: 6544313 - DNA, 21 bp, Homo sapiens
tgtgagtcctgttgaagactt

SEQ ID NO: 6544314 - DNA, 13 bp, Homo sapiens
tgtgagtctggga

SEQ ID NO: 6544315 - DNA, 15 bp, Homo sapiens
tgtgagtctgtcctt

SEQ ID NO: 6544316 - DNA, 18 bp, Homo sapiens
tgtgagtctttggttcta

SEQ ID NO: 6544317 - DNA, 14 bp, Homo sapiens
tgtgagtgcgcctc

SEQ ID NO: 6544318 - DNA, 18 bp, Homo sapiens
tgtgagtgcgtctgaggg

SEQ ID NO: 6544319 - DNA, 14 bp, Homo sapiens
tgtgagtggataat

SEQ ID NO: 6544320 - DNA, 18 bp, Homo sapiens
tgtgagtggataatcagg

SEQ ID NO: 6544321 - DNA, 21 bp, Homo sapiens
tgtgagtggttctgagcaaat

SEQ ID NO: 6544322 - DNA, 20 bp, Homo sapiens
tgtgagtgtaagtgtgagta

SEQ ID NO: 6544323 - DNA, 23 bp, Homo sapiens
tgtgagtgtatgtatacacacac

SEQ ID NO: 6544324 - DNA, 13 bp, Homo sapiens
tgtgagtgtgaat

SEQ ID NO: 6544325 - DNA, 20 bp, Homo sapiens
tgtgagtgtgaatataaatg

SEQ ID NO: 6544326 - DNA, 14 bp, Homo sapiens
tgtgagtgtgatgg

SEQ ID NO: 6544327 - DNA, 19 bp, Homo sapiens
tgtgagtgtgtgtttgtgc

SEQ ID NO: 6544328 - DNA, 22 bp, Homo sapiens
tgtgagtgtgtgtttgtgctga

SEQ ID NO: 6544329 - DNA, 22 bp, Homo sapiens
tgtgagtgtgtttgtgtgcatg

SEQ ID NO: 6544330 - DNA, 14 bp, Homo sapiens
tgtgagtgttagaa

SEQ ID NO: 6544331 - DNA, 14 bp, Homo sapiens
tgtgagttaatttg

SEQ ID NO: 6544332 - DNA, 19 bp, Homo sapiens
tgtgagttaatttgataaa

SEQ ID NO: 6544333 - DNA, 16 bp, Homo sapiens
tgtgagtttcagaaat

SEQ ID NO: 6544334 - DNA, 19 bp, Homo sapiens
tgtgagtttcagaaattct

SEQ ID NO: 6544335 - DNA, 20 bp, Homo sapiens
tgtgagtttggtctggactg

SEQ ID NO: 6544336 - DNA, 21 bp, Homo sapiens
tgtgataatagcatttttgta

SEQ ID NO: 6544337 - DNA, 14 bp, Homo sapiens
tgtgatacagagta

SEQ ID NO: 6544338 - DNA, 16 bp, Homo sapiens
tgtgatacatttctga

SEQ ID NO: 6544339 - DNA, 20 bp, Homo sapiens
tgtgatagagcctttgatct

SEQ ID NO: 6544340 - DNA, 17 bp, Homo sapiens
tgtgatagcactttcta

SEQ ID NO: 6544341 - DNA, 17 bp, Homo sapiens
tgtgatataaacagctt

SEQ ID NO: 6544342 - DNA, 13 bp, Homo sapiens
tgtgatatataag

SEQ ID NO: 6544343 - DNA, 16 bp, Homo sapiens
tgtgatatataagtgt

SEQ ID NO: 6544344 - DNA, 17 bp, Homo sapiens
tgtgatatctgaacaca

SEQ ID NO: 6544345 - DNA, 16 bp, Homo sapiens
tgtgatatggcggcct

SEQ ID NO: 6544346 - DNA, 21 bp, Homo sapiens
tgtgatatgtgtaatatcatt

SEQ ID NO: 6544347 - DNA, 14 bp, Homo sapiens
tgtgatatgtttta

SEQ ID NO: 6544348 - DNA, 15 bp, Homo sapiens
tgtgatatgttttaa

SEQ ID NO: 6544349 - DNA, 16 bp, Homo sapiens
tgtgatatgttttaaa

SEQ ID NO: 6544350 - DNA, 14 bp, Homo sapiens
tgtgatattaacag

SEQ ID NO: 6544351 - DNA, 14 bp, Homo sapiens
tgtgatattctaag

SEQ ID NO: 6544352 - DNA, 15 bp, Homo sapiens
tgtgatattctaaga

SEQ ID NO: 6544353 - DNA, 17 bp, Homo sapiens
tgtgatattctgttgct

SEQ ID NO: 6544354 - DNA, 15 bp, Homo sapiens
tgtgatattgaccat

SEQ ID NO: 6544355 - DNA, 22 bp, Homo sapiens
tgtgatattgaccatgtgatta

SEQ ID NO: 6544356 - DNA, 14 bp, Homo sapiens
tgtgatatttcaga

SEQ ID NO: 6544357 - DNA, 24 bp, Homo sapiens
tgtgatatttcgtgtactgcaaag

SEQ ID NO: 6544358 - DNA, 20 bp, Homo sapiens
tgtgatatttgacagacatc

SEQ ID NO: 6544359 - DNA, 16 bp, Homo sapiens
tgtgatattttacttg

SEQ ID NO: 6544360 - DNA, 17 bp, Homo sapiens
tgtgatcacgcctggct

SEQ ID NO: 6544361 - DNA, 17 bp, Homo sapiens
tgtgatcactgagacag

SEQ ID NO: 6544362 - DNA, 15 bp, Homo sapiens
tgtgatcagaccata

SEQ ID NO: 6544363 - DNA, 20 bp, Homo sapiens
tgtgatcagcattgtgactt

SEQ ID NO: 6544364 - DNA, 22 bp, Homo sapiens
tgtgatcagctttcaaagcatt

SEQ ID NO: 6544365 - DNA, 23 bp, Homo sapiens
tgtgatcagctttcaaagcattt

SEQ ID NO: 6544366 - DNA, 22 bp, Homo sapiens
tgtgatcagtgattttcaaacc

SEQ ID NO: 6544367 - DNA, 19 bp, Homo sapiens
tgtgatcatatatcataaa

SEQ ID NO: 6544368 - DNA, 17 bp, Homo sapiens
tgtgatcatctttgctg

SEQ ID NO: 6544369 - DNA, 22 bp, Homo sapiens
tgtgatccagccctggttctgg

SEQ ID NO: 6544370 - DNA, 24 bp, Homo sapiens
tgtgatccagttgttttccatcat

SEQ ID NO: 6544371 - DNA, 13 bp, Homo sapiens
tgtgatcccagct

SEQ ID NO: 6544372 - DNA, 14 bp, Homo sapiens
tgtgatcccagctc

SEQ ID NO: 6544373 - DNA, 22 bp, Homo sapiens
tgtgatcccagctcactgcagc

SEQ ID NO: 6544374 - DNA, 23 bp, Homo sapiens
tgtgatcccagctcactgcagcc

SEQ ID NO: 6544375 - DNA, 16 bp, Homo sapiens
tgtgatccggtttctt

SEQ ID NO: 6544376 - DNA, 14 bp, Homo sapiens
tgtgatcctgagtc

SEQ ID NO: 6544377 - DNA, 20 bp, Homo sapiens
tgtgatccttggtgctgtgt

SEQ ID NO: 6544378 - DNA, 18 bp, Homo sapiens
tgtgatcctttggggctt

SEQ ID NO: 6544379 - DNA, 22 bp, Homo sapiens
tgtgatcctttggggcttctgt

SEQ ID NO: 6544380 - DNA, 19 bp, Homo sapiens
tgtgatctaagcagttgca

SEQ ID NO: 6544381 - DNA, 22 bp, Homo sapiens
tgtgatctaagcagttgcaatg

SEQ ID NO: 6544382 - DNA, 20 bp, Homo sapiens
tgtgatctatcaatagtcaa

SEQ ID NO: 6544383 - DNA, 13 bp, Homo sapiens
tgtgatctattac

SEQ ID NO: 6544384 - DNA, 20 bp, Homo sapiens
tgtgatctattactctgaca

SEQ ID NO: 6544385 - DNA, 21 bp, Homo sapiens
tgtgatctattactctgacat

SEQ ID NO: 6544386 - DNA, 16 bp, Homo sapiens
tgtgatctcattgttc

SEQ ID NO: 6544387 - DNA, 15 bp, Homo sapiens
tgtgatctgtcttgt

SEQ ID NO: 6544388 - DNA, 17 bp, Homo sapiens
tgtgatctgtcttgtaa

SEQ ID NO: 6544389 - DNA, 16 bp, Homo sapiens
tgtgatcttaaaataa

SEQ ID NO: 6544390 - DNA, 22 bp, Homo sapiens
tgtgatcttaaaataattcata

SEQ ID NO: 6544391 - DNA, 21 bp, Homo sapiens
tgtgatcttaatatatttgaa

SEQ ID NO: 6544392 - DNA, 18 bp, Homo sapiens
tgtgatcttgcattcatt

SEQ ID NO: 6544393 - DNA, 18 bp, Homo sapiens
tgtgatcttgctctatct

SEQ ID NO: 6544394 - DNA, 16 bp, Homo sapiens
tgtgatgaaaaggcag

SEQ ID NO: 6544395 - DNA, 14 bp, Homo sapiens
tgtgatgaaacttt

SEQ ID NO: 6544396 - DNA, 18 bp, Homo sapiens
tgtgatgaacatattcat

SEQ ID NO: 6544397 - DNA, 22 bp, Homo sapiens
tgtgatgaacatattcatgaaa

SEQ ID NO: 6544398 - DNA, 15 bp, Homo sapiens
tgtgatgaactttct

SEQ ID NO: 6544399 - DNA, 21 bp, Homo sapiens
tgtgatgaagctgaggctgct

SEQ ID NO: 6544400 - DNA, 14 bp, Homo sapiens
tgtgatgaatactg

SEQ ID NO: 6544401 - DNA, 16 bp, Homo sapiens
tgtgatgaatactgta

SEQ ID NO: 6544402 - DNA, 18 bp, Homo sapiens
tgtgatgaatactgtatt

SEQ ID NO: 6544403 - DNA, 14 bp, Homo sapiens
tgtgatgaatcaat

SEQ ID NO: 6544404 - DNA, 18 bp, Homo sapiens
tgtgatgacattccctgc

SEQ ID NO: 6544405 - DNA, 18 bp, Homo sapiens
tgtgatgagaggaaatca

SEQ ID NO: 6544406 - DNA, 16 bp, Homo sapiens
tgtgatgaggggaggg

SEQ ID NO: 6544407 - DNA, 19 bp, Homo sapiens
tgtgatgagggtgagaaaa

SEQ ID NO: 6544408 - DNA, 19 bp, Homo sapiens
tgtgatgcatgagctccct

SEQ ID NO: 6544409 - DNA, 14 bp, Homo sapiens
tgtgatgcatttta

SEQ ID NO: 6544410 - DNA, 22 bp, Homo sapiens
tgtgatgccaaagatgtttgaa

SEQ ID NO: 6544411 - DNA, 19 bp, Homo sapiens
tgtgatgccatatcaagtc

SEQ ID NO: 6544412 - DNA, 13 bp, Homo sapiens
tgtgatgctggta

SEQ ID NO: 6544413 - DNA, 23 bp, Homo sapiens
tgtgatgctggtaccactggaat

SEQ ID NO: 6544414 - DNA, 18 bp, Homo sapiens
tgtgatgctgtgtgccca

SEQ ID NO: 6544415 - DNA, 13 bp, Homo sapiens
ttgaggataaatt

SEQ ID NO: 6544416 - DNA, 16 bp, Homo sapiens
ttgaggataaattgcc

SEQ ID NO: 6544417 - DNA, 19 bp, Homo sapiens
ttgaggataaattgccata

SEQ ID NO: 6544418 - DNA, 15 bp, Homo sapiens
ttgaggataactttt

SEQ ID NO: 6544419 - DNA, 22 bp, Homo sapiens
ttgaggatcagggctcctaggc

SEQ ID NO: 6544420 - DNA, 18 bp, Homo sapiens
ttgaggatgcactggcct

SEQ ID NO: 6544421 - DNA, 17 bp, Homo sapiens
ttgaggattagtttaga

SEQ ID NO: 6544422 - DNA, 16 bp, Homo sapiens
ttgaggattttgagta

SEQ ID NO: 6544423 - DNA, 13 bp, Homo sapiens
ttgaggcaagtgt

SEQ ID NO: 6544424 - DNA, 15 bp, Homo sapiens
ttgaggccaaatgag

SEQ ID NO: 6544425 - DNA, 22 bp, Homo sapiens
ttgaggccaagatggctgctgc

SEQ ID NO: 6544426 - DNA, 16 bp, Homo sapiens
ttgaggccaggacttt

SEQ ID NO: 6544427 - DNA, 14 bp, Homo sapiens
ttgaggccaggagt

SEQ ID NO: 6544428 - DNA, 19 bp, Homo sapiens
ttgaggccgcatctttctt

SEQ ID NO: 6544429 - DNA, 18 bp, Homo sapiens
ttgaggcgagcagggcag

SEQ ID NO: 6544430 - DNA, 14 bp, Homo sapiens
ttgaggctgcagtg

SEQ ID NO: 6544431 - DNA, 14 bp, Homo sapiens
ttgaggctttcagt

SEQ ID NO: 6544432 - DNA, 16 bp, Homo sapiens
ttgagggaaagagctt

SEQ ID NO: 6544433 - DNA, 19 bp, Homo sapiens
ttgagggaaggttcttcat

SEQ ID NO: 6544434 - DNA, 22 bp, Homo sapiens
ttgagggacaaatttaaaacaa

SEQ ID NO: 6544435 - DNA, 14 bp, Homo sapiens
ttgagggaccaata

SEQ ID NO: 6544436 - DNA, 20 bp, Homo sapiens
ttgagggacgctttgtctgt

SEQ ID NO: 6544437 - DNA, 21 bp, Homo sapiens
ttgagggacgctttgtctgtc

SEQ ID NO: 6544438 - DNA, 11 bp, Homo sapiens
ttgagggaggg

SEQ ID NO: 6544439 - DNA, 19 bp, Homo sapiens
ttgagggcatttggcttcc

SEQ ID NO: 6544440 - DNA, 17 bp, Homo sapiens
ttgagggccagtgatga

SEQ ID NO: 6544441 - DNA, 20 bp, Homo sapiens
ttgagggccagtgatgatgt

SEQ ID NO: 6544442 - DNA, 19 bp, Homo sapiens
ttgagggcccagagcagga

SEQ ID NO: 6544443 - DNA, 22 bp, Homo sapiens
ttgagggctgatagctctgcct

SEQ ID NO: 6544444 - DNA, 13 bp, Homo sapiens
ttgagggctgcag

SEQ ID NO: 6544445 - DNA, 17 bp, Homo sapiens
ttgaggggaccaggagt

SEQ ID NO: 6544446 - DNA, 19 bp, Homo sapiens
ttgaggggagagggaacgg

SEQ ID NO: 6544447 - DNA, 13 bp, Homo sapiens
ttgaggggagcat

SEQ ID NO: 6544448 - DNA, 13 bp, Homo sapiens
ttgaggggaggag

SEQ ID NO: 6544449 - DNA, 15 bp, Homo sapiens
ttgaggggattaata

SEQ ID NO: 6544450 - DNA, 20 bp, Homo sapiens
ttgaggggattaatatgaaa

SEQ ID NO: 6544451 - DNA, 13 bp, Homo sapiens
ttgaggggccagg

SEQ ID NO: 6544452 - DNA, 20 bp, Homo sapiens
ttgaggggcctgtgtggagg

SEQ ID NO: 6544453 - DNA, 20 bp, Homo sapiens
ttgaggggcttccctctgct

SEQ ID NO: 6544454 - DNA, 13 bp, Homo sapiens
ttgagggtaggag

SEQ ID NO: 6544455 - DNA, 18 bp, Homo sapiens
ttgagggtgggccagcat

SEQ ID NO: 6544456 - DNA, 21 bp, Homo sapiens
ttgaggtaccagttgtattta

SEQ ID NO: 6544457 - DNA, 21 bp, Homo sapiens
ttgaggtagaccaggatttct

SEQ ID NO: 6544458 - DNA, 15 bp, Homo sapiens
ttgaggtagaggaaa

SEQ ID NO: 6544459 - DNA, 21 bp, Homo sapiens
ttgaggtagaggggaaggaaa

SEQ ID NO: 6544460 - DNA, 22 bp, Homo sapiens
ttgaggtcaagtaagaagacat

SEQ ID NO: 6544461 - DNA, 15 bp, Homo sapiens
ttgaggtcagtgttt

SEQ ID NO: 6544462 - DNA, 13 bp, Homo sapiens
ttgaggtccatgg

SEQ ID NO: 6544463 - DNA, 13 bp, Homo sapiens
ttgaggtctcagc

SEQ ID NO: 6544464 - DNA, 20 bp, Homo sapiens
ttgaggtctttctcctcagg

SEQ ID NO: 6544465 - DNA, 17 bp, Homo sapiens
ttgaggtcttttgacat

SEQ ID NO: 6544466 - DNA, 19 bp, Homo sapiens
ttgaggtcttttgacatgt

SEQ ID NO: 6544467 - DNA, 19 bp, Homo sapiens
ttgaggtggaagccctcct

SEQ ID NO: 6544468 - DNA, 19 bp, Homo sapiens
ttgaggtttgaaaagctga

SEQ ID NO: 6544469 - DNA, 20 bp, Homo sapiens
ttgaggtttggaagagtgaa

SEQ ID NO: 6544470 - DNA, 12 bp, Homo sapiens
ttgagtaaaata

SEQ ID NO: 6544471 - DNA, 14 bp, Homo sapiens
ttgagtaaaataaa

SEQ ID NO: 6544472 - DNA, 20 bp, Homo sapiens
ttgagtaatattacatttca

SEQ ID NO: 6544473 - DNA, 14 bp, Homo sapiens
ttgagtaatctgat

SEQ ID NO: 6544474 - DNA, 12 bp, Homo sapiens
ttgagtaatggt

SEQ ID NO: 6544475 - DNA, 16 bp, Homo sapiens
ttgagtaatgtgacta

SEQ ID NO: 6544476 - DNA, 20 bp, Homo sapiens
ttgagtacagaattcaacag

SEQ ID NO: 6544477 - DNA, 14 bp, Homo sapiens
ttgagtacagatac

SEQ ID NO: 6544478 - DNA, 17 bp, Homo sapiens
ttgagtacctactgtgt

SEQ ID NO: 6544479 - DNA, 20 bp, Homo sapiens
ttgagtagacacatttaagg

SEQ ID NO: 6544480 - DNA, 17 bp, Homo sapiens
ttgagtagatattactt

SEQ ID NO: 6544481 - DNA, 19 bp, Homo sapiens
ttgagtagatattacttta

SEQ ID NO: 6544482 - DNA, 15 bp, Homo sapiens
ttgagtaggccctgc

SEQ ID NO: 6544483 - DNA, 15 bp, Homo sapiens
ttgagtatcacttta

SEQ ID NO: 6544484 - DNA, 15 bp, Homo sapiens
ttgagtatcataata

SEQ ID NO: 6544485 - DNA, 20 bp, Homo sapiens
ttgagtattgtttaaaatgt

SEQ ID NO: 6544486 - DNA, 16 bp, Homo sapiens
ttgagtatttgctgtt

SEQ ID NO: 6544487 - DNA, 15 bp, Homo sapiens
ttgagtcacttgtgt

SEQ ID NO: 6544488 - DNA, 20 bp, Homo sapiens
ttgagtcagtgcatttcaag

SEQ ID NO: 6544489 - DNA, 21 bp, Homo sapiens
ttgagtcagtgcatttcaagg

SEQ ID NO: 6544490 - DNA, 18 bp, Homo sapiens
ttgagtcattgacttcat

SEQ ID NO: 6544491 - DNA, 23 bp, Homo sapiens
ttgagtcattgacttcattttat

SEQ ID NO: 6544492 - DNA, 15 bp, Homo sapiens
ttgagtccacgccca

SEQ ID NO: 6544493 - DNA, 13 bp, Homo sapiens
ttgagtccagctt

SEQ ID NO: 6544494 - DNA, 21 bp, Homo sapiens
ttgagtccagctttccttctg

SEQ ID NO: 6544495 - DNA, 13 bp, Homo sapiens
ttgagtccctgct

SEQ ID NO: 6544496 - DNA, 17 bp, Homo sapiens
ttgagtcctacagtgtc

SEQ ID NO: 6544497 - DNA, 20 bp, Homo sapiens
ttgagtcctaggacttaaaa

SEQ ID NO: 6544498 - DNA, 12 bp, Homo sapiens
ttgagtccttgt

SEQ ID NO: 6544499 - DNA, 22 bp, Homo sapiens
ttgagtctcaagggtggcaggt

SEQ ID NO: 6544500 - DNA, 17 bp, Homo sapiens
ttgagtctcttttttat

SEQ ID NO: 6544501 - DNA, 15 bp, Homo sapiens
ttgagtctgttttgt

SEQ ID NO: 6544502 - DNA, 18 bp, Homo sapiens
ttgagtctgttttgtaaa

SEQ ID NO: 6544503 - DNA, 22 bp, Homo sapiens
ttgagtctgtttttttatagtt

SEQ ID NO: 6544504 - DNA, 23 bp, Homo sapiens
ttgagtcttaactgtatttcagt

SEQ ID NO: 6544505 - DNA, 21 bp, Homo sapiens
ttgagtcttcacatttagaat

SEQ ID NO: 6544506 - DNA, 11 bp, Homo sapiens
ttgagtctttt

SEQ ID NO: 6544507 - DNA, 21 bp, Homo sapiens
ttgagtcttttttttttaagt

SEQ ID NO: 6544508 - DNA, 21 bp, Homo sapiens
ttgagtgagaagagcttgcac

SEQ ID NO: 6544509 - DNA, 23 bp, Homo sapiens
ttgagtgatcctcccgccccagc

SEQ ID NO: 6544510 - DNA, 20 bp, Homo sapiens
ttgagtgcaacaagagcaaa

SEQ ID NO: 6544511 - DNA, 16 bp, Homo sapiens
ttgagtgcactaaaca

SEQ ID NO: 6544512 - DNA, 14 bp, Homo sapiens
ttgagtgctctgat

SEQ ID NO: 6544513 - DNA, 15 bp, Homo sapiens
ttgagtgctctgatc

SEQ ID NO: 6544514 - DNA, 16 bp, Homo sapiens
ttgagtgctgggggag

SEQ ID NO: 6544515 - DNA, 21 bp, Homo sapiens
ttgagtgctgtctccatgttt

SEQ ID NO: 6544516 - DNA, 17 bp, Homo sapiens
ttgagtggacagcagct

SEQ ID NO: 6544517 - DNA, 16 bp, Homo sapiens
ttgagtggctgtctta

SEQ ID NO: 6544518 - DNA, 16 bp, Homo sapiens
ttgagtgggccccctc

SEQ ID NO: 6544519 - DNA, 17 bp, Homo sapiens
ttgagtgggccccctct

SEQ ID NO: 6544520 - DNA, 20 bp, Homo sapiens
ttgagtgggccctgcccggg

SEQ ID NO: 6544521 - DNA, 13 bp, Homo sapiens
ttgagtgtactgt

SEQ ID NO: 6544522 - DNA, 14 bp, Homo sapiens
ttgagtgtactgtg

SEQ ID NO: 6544523 - DNA, 19 bp, Homo sapiens
ttgagtgtatacatgtgtg

SEQ ID NO: 6544524 - DNA, 20 bp, Homo sapiens
ttgagtgtatacatgtgtgg

SEQ ID NO: 6544525 - DNA, 15 bp, Homo sapiens
ttgagtgtctgcgcc

SEQ ID NO: 6544526 - DNA, 12 bp, Homo sapiens
ttgagtgtgtgt

SEQ ID NO: 6544527 - DNA, 18 bp, Homo sapiens
ttgagtgtgtgtgtgcat

SEQ ID NO: 6544528 - DNA, 14 bp, Homo sapiens
ttgagtgttctagt

SEQ ID NO: 6544529 - DNA, 18 bp, Homo sapiens
ttgagttaacctttaaga

SEQ ID NO: 6544530 - DNA, 13 bp, Homo sapiens
ttgagttaacttt

SEQ ID NO: 6544531 - DNA, 13 bp, Homo sapiens
ttgagttacatta

SEQ ID NO: 6544532 - DNA, 16 bp, Homo sapiens
ttgagttcaaattttg

SEQ ID NO: 6544533 - DNA, 16 bp, Homo sapiens
ttgagttcaggtagct

SEQ ID NO: 6544534 - DNA, 17 bp, Homo sapiens
ttgagttcatcatgagc

SEQ ID NO: 6544535 - DNA, 18 bp, Homo sapiens
ttgagttcttcctgtaat

SEQ ID NO: 6544536 - DNA, 14 bp, Homo sapiens
ttgagttggacaca

SEQ ID NO: 6544537 - DNA, 17 bp, Homo sapiens
ttgagttggacacactg

SEQ ID NO: 6544538 - DNA, 18 bp, Homo sapiens
ttgagttggacacactgt

SEQ ID NO: 6544539 - DNA, 13 bp, Homo sapiens
ttgagttgggggt

SEQ ID NO: 6544540 - DNA, 21 bp, Homo sapiens
ttgagttgggggtattttcta

SEQ ID NO: 6544541 - DNA, 15 bp, Homo sapiens
ttgagttgtaaagaa

SEQ ID NO: 6544542 - DNA, 23 bp, Homo sapiens
ttgagtttaagtctctgactctt

SEQ ID NO: 6544543 - DNA, 14 bp, Homo sapiens
ttgagtttcagaat

SEQ ID NO: 6544544 - DNA, 18 bp, Homo sapiens
ttgagtttcagctggaaa

SEQ ID NO: 6544545 - DNA, 17 bp, Homo sapiens
ttgagtttcatttttca

SEQ ID NO: 6544546 - DNA, 15 bp, Homo sapiens
ttgagtttgctgtat

SEQ ID NO: 6544547 - DNA, 21 bp, Homo sapiens
ttgagtttgctgttttaaatt

SEQ ID NO: 6544548 - DNA, 19 bp, Homo sapiens
ttgagtttggtccctaaat

SEQ ID NO: 6544549 - DNA, 13 bp, Homo sapiens
ttgagtttgtagg

SEQ ID NO: 6544550 - DNA, 11 bp, Homo sapiens
ttgagtttgtc

SEQ ID NO: 6544551 - DNA, 16 bp, Homo sapiens
ttgagttttatttatt

SEQ ID NO: 6544552 - DNA, 19 bp, Homo sapiens
ttgagttttcagtggggca

SEQ ID NO: 6544553 - DNA, 18 bp, Homo sapiens
ttgagttttcttctgtga

SEQ ID NO: 6544554 - DNA, 17 bp, Homo sapiens
ttgagttttgactgctt

SEQ ID NO: 6544555 - DNA, 15 bp, Homo sapiens
ttgataaaagagttc

SEQ ID NO: 6544556 - DNA, 19 bp, Homo sapiens
ttgataaaatgttcctttt

SEQ ID NO: 6544557 - DNA, 23 bp, Homo sapiens
ttgataaaatgttccttttgaca

SEQ ID NO: 6544558 - DNA, 13 bp, Homo sapiens
ttgataaacataa

SEQ ID NO: 6544559 - DNA, 14 bp, Homo sapiens
ttgataaacataat

SEQ ID NO: 6544560 - DNA, 19 bp, Homo sapiens
ttgataaagtaaaaaagtt

SEQ ID NO: 6544561 - DNA, 20 bp, Homo sapiens
ttgataaagtagtaaaaatt

SEQ ID NO: 6544562 - DNA, 17 bp, Homo sapiens
ttgataaagtttctcag

SEQ ID NO: 6544563 - DNA, 13 bp, Homo sapiens
ttgataaatagtg

SEQ ID NO: 6544564 - DNA, 21 bp, Homo sapiens
ttgataaatcattttatgtca

SEQ ID NO: 6544565 - DNA, 21 bp, Homo sapiens
ttgataacaaaaaataaattt

SEQ ID NO: 6544566 - DNA, 22 bp, Homo sapiens
ttgataacagggattgatttta

SEQ ID NO: 6544567 - DNA, 13 bp, Homo sapiens
ttgataactttgc

SEQ ID NO: 6544568 - DNA, 22 bp, Homo sapiens
ttgataagagggcacacactgt

SEQ ID NO: 6544569 - DNA, 18 bp, Homo sapiens
ttgataagagtgtaacat

SEQ ID NO: 6544570 - DNA, 15 bp, Homo sapiens
ttgataagcacatta

SEQ ID NO: 6544571 - DNA, 16 bp, Homo sapiens
ttgataaggaacattt

SEQ ID NO: 6544572 - DNA, 22 bp, Homo sapiens
ttgataagggactgatgtttgt

SEQ ID NO: 6544573 - DNA, 11 bp, Homo sapiens
ttgataataaa

SEQ ID NO: 6544574 - DNA, 14 bp, Homo sapiens
ttgataataaaatt

SEQ ID NO: 6544575 - DNA, 18 bp, Homo sapiens
ttgataataaaattcatt

SEQ ID NO: 6544576 - DNA, 17 bp, Homo sapiens
ttgataataaattgaaa

SEQ ID NO: 6544577 - DNA, 18 bp, Homo sapiens
ttgataataatattgttt

SEQ ID NO: 6544578 - DNA, 23 bp, Homo sapiens
ttgataatagtaatggttctaga

SEQ ID NO: 6544579 - DNA, 18 bp, Homo sapiens
ttgataatattagtgatt

SEQ ID NO: 6544580 - DNA, 22 bp, Homo sapiens
ttgataatcttcaggtgaacac

SEQ ID NO: 6544581 - DNA, 12 bp, Homo sapiens
ttgataatgaca

SEQ ID NO: 6544582 - DNA, 22 bp, Homo sapiens
ttgataatgacactgtttcctg

SEQ ID NO: 6544583 - DNA, 13 bp, Homo sapiens
ttgataatgtcca

SEQ ID NO: 6544584 - DNA, 15 bp, Homo sapiens
ttgataatgttaaat

SEQ ID NO: 6544585 - DNA, 18 bp, Homo sapiens
ttgataatgttaaatttg

SEQ ID NO: 6544586 - DNA, 21 bp, Homo sapiens
ttgataattcgagcaaacaac

SEQ ID NO: 6544587 - DNA, 14 bp, Homo sapiens
ttgataattcttac

SEQ ID NO: 6544588 - DNA, 22 bp, Homo sapiens
ttgataattcttattttgtgga

SEQ ID NO: 6544589 - DNA, 15 bp, Homo sapiens
ttgataattgcattc

SEQ ID NO: 6544590 - DNA, 16 bp, Homo sapiens
ttgataattttccttt

SEQ ID NO: 6544591 - DNA, 17 bp, Homo sapiens
ttgataattttccttta

SEQ ID NO: 6544592 - DNA, 21 bp, Homo sapiens
ttgatacaaatgtttataact

SEQ ID NO: 6544593 - DNA, 21 bp, Homo sapiens
ttgatacaacaggattttcaa

SEQ ID NO: 6544594 - DNA, 20 bp, Homo sapiens
ttgatacaatattgtgcatg

SEQ ID NO: 6544595 - DNA, 23 bp, Homo sapiens
tgtgatgcttataataaagaaaa

SEQ ID NO: 6544596 - DNA, 17 bp, Homo sapiens
tgtgatggagtgctgtt

SEQ ID NO: 6544597 - DNA, 20 bp, Homo sapiens
tgtgatgggatctgtaagga

SEQ ID NO: 6544598 - DNA, 17 bp, Homo sapiens
tgtgatgggccacaagg

SEQ ID NO: 6544599 - DNA, 19 bp, Homo sapiens
tgtgatggggccctgcctc

SEQ ID NO: 6544600 - DNA, 14 bp, Homo sapiens
tgtgatggggtggg

SEQ ID NO: 6544601 - DNA, 22 bp, Homo sapiens
tgtgatggggtgggcagggctg

SEQ ID NO: 6544602 - DNA, 23 bp, Homo sapiens
tgtgatggttcgttctgtttaca

SEQ ID NO: 6544603 - DNA, 14 bp, Homo sapiens
tgtgatgtcacagt

SEQ ID NO: 6544604 - DNA, 21 bp, Homo sapiens
tgtgatgtcagcggtgcagcg

SEQ ID NO: 6544605 - DNA, 19 bp, Homo sapiens
tgtgatgtcatacagagaa

SEQ ID NO: 6544606 - DNA, 20 bp, Homo sapiens
tgtgatgtcatacagagaag

SEQ ID NO: 6544607 - DNA, 15 bp, Homo sapiens
tgtgatgtgaagcca

SEQ ID NO: 6544608 - DNA, 16 bp, Homo sapiens
tgtgatgtgttgctct

SEQ ID NO: 6544609 - DNA, 17 bp, Homo sapiens
tgtgatgttaactatta

SEQ ID NO: 6544610 - DNA, 14 bp, Homo sapiens
tgtgatgttctaag

SEQ ID NO: 6544611 - DNA, 15 bp, Homo sapiens
tgtgatgttctaagg

SEQ ID NO: 6544612 - DNA, 16 bp, Homo sapiens
tgtgatgttctaaggc

SEQ ID NO: 6544613 - DNA, 18 bp, Homo sapiens
tgtgatgttctaaggctc

SEQ ID NO: 6544614 - DNA, 20 bp, Homo sapiens
tgtgatgttgtcttagcatg

SEQ ID NO: 6544615 - DNA, 21 bp, Homo sapiens
tgtgatgtttaggggcaaaca

SEQ ID NO: 6544616 - DNA, 19 bp, Homo sapiens
tgtgattaactcttagaag

SEQ ID NO: 6544617 - DNA, 14 bp, Homo sapiens
tgtgattaacttat

SEQ ID NO: 6544618 - DNA, 16 bp, Homo sapiens
tgtgattaacttgctt

SEQ ID NO: 6544619 - DNA, 22 bp, Homo sapiens
tgtgattacatagatcagccat

SEQ ID NO: 6544620 - DNA, 14 bp, Homo sapiens
tgtgattacctctc

SEQ ID NO: 6544621 - DNA, 21 bp, Homo sapiens
tgtgattacctgctgcatgaa

SEQ ID NO: 6544622 - DNA, 22 bp, Homo sapiens
tgtgattactctttgctttgta

SEQ ID NO: 6544623 - DNA, 21 bp, Homo sapiens
tgtgattactgcaatcactgt

SEQ ID NO: 6544624 - DNA, 22 bp, Homo sapiens
tgtgattagacagaacacctat

SEQ ID NO: 6544625 - DNA, 23 bp, Homo sapiens
tgtgattagatcacatcttaaat

SEQ ID NO: 6544626 - DNA, 21 bp, Homo sapiens
tgtgattaggtgaagggatgg

SEQ ID NO: 6544627 - DNA, 16 bp, Homo sapiens
tgtgattattctgtat

SEQ ID NO: 6544628 - DNA, 15 bp, Homo sapiens
tgtgattatttttct

SEQ ID NO: 6544629 - DNA, 15 bp, Homo sapiens
tgtgattcaatctgt

SEQ ID NO: 6544630 - DNA, 16 bp, Homo sapiens
tgtgattcaatctgta

SEQ ID NO: 6544631 - DNA, 20 bp, Homo sapiens
tgtgattccccggagctggg

SEQ ID NO: 6544632 - DNA, 19 bp, Homo sapiens
tgtgattcctacccctctt

SEQ ID NO: 6544633 - DNA, 23 bp, Homo sapiens
tgtgattccttttgatggggaga

SEQ ID NO: 6544634 - DNA, 17 bp, Homo sapiens
tgtgattctaatgtctt

SEQ ID NO: 6544635 - DNA, 12 bp, Homo sapiens
tgtgattcttag

SEQ ID NO: 6544636 - DNA, 20 bp, Homo sapiens
tgtgattcttccagatgtga

SEQ ID NO: 6544637 - DNA, 21 bp, Homo sapiens
tgtgattcttccagatgtgat

SEQ ID NO: 6544638 - DNA, 19 bp, Homo sapiens
tgtgattcttctaaagcac

SEQ ID NO: 6544639 - DNA, 15 bp, Homo sapiens
tgtgattctttgata

SEQ ID NO: 6544640 - DNA, 15 bp, Homo sapiens
tgtgattgaatctga

SEQ ID NO: 6544641 - DNA, 16 bp, Homo sapiens
tgtgattgacagcttt

SEQ ID NO: 6544642 - DNA, 22 bp, Homo sapiens
tgtgattgacagctttgctgct

SEQ ID NO: 6544643 - DNA, 16 bp, Homo sapiens
tgtgattgcacgtgcc

SEQ ID NO: 6544644 - DNA, 19 bp, Homo sapiens
tgtgattgcacgtgcctgt

SEQ ID NO: 6544645 - DNA, 21 bp, Homo sapiens
tgtgattggcagcttcaaaac

SEQ ID NO: 6544646 - DNA, 16 bp, Homo sapiens
tgtgattggcaggagg

SEQ ID NO: 6544647 - DNA, 14 bp, Homo sapiens
tgtgattggctgca

SEQ ID NO: 6544648 - DNA, 15 bp, Homo sapiens
tgtgattggctgcag

SEQ ID NO: 6544649 - DNA, 17 bp, Homo sapiens
tgtgattggctgcagga

SEQ ID NO: 6544650 - DNA, 16 bp, Homo sapiens
tgtgattggctggtta

SEQ ID NO: 6544651 - DNA, 20 bp, Homo sapiens
tgtgattgggaataaatatg

SEQ ID NO: 6544652 - DNA, 18 bp, Homo sapiens
tgtgattggtaactagga

SEQ ID NO: 6544653 - DNA, 14 bp, Homo sapiens
tgtgattgtggaat

SEQ ID NO: 6544654 - DNA, 18 bp, Homo sapiens
tgtgatttagaactgtat

SEQ ID NO: 6544655 - DNA, 23 bp, Homo sapiens
tgtgatttagaactgtatgtcag

SEQ ID NO: 6544656 - DNA, 14 bp, Homo sapiens
tgtgatttatgcat

SEQ ID NO: 6544657 - DNA, 15 bp, Homo sapiens
tgtgatttcccgtgg

SEQ ID NO: 6544658 - DNA, 20 bp, Homo sapiens
tgtgatttcccgtggcccca

SEQ ID NO: 6544659 - DNA, 19 bp, Homo sapiens
tgtgatttctttaaaagaa

SEQ ID NO: 6544660 - DNA, 15 bp, Homo sapiens
tgtgatttgactgtt

SEQ ID NO: 6544661 - DNA, 22 bp, Homo sapiens
tgtgatttggaagggaaacttt

SEQ ID NO: 6544662 - DNA, 14 bp, Homo sapiens
tgtgatttgtctct

SEQ ID NO: 6544663 - DNA, 17 bp, Homo sapiens
tgtgatttgtcttccct

SEQ ID NO: 6544664 - DNA, 18 bp, Homo sapiens
tgtgattttaactctgtc

SEQ ID NO: 6544665 - DNA, 24 bp, Homo sapiens
tgtgattttcacctgttataataa

SEQ ID NO: 6544666 - DNA, 20 bp, Homo sapiens
tgtgattttgtaggttattt

SEQ ID NO: 6544667 - DNA, 17 bp, Homo sapiens
tgtgatttttatcacaa

SEQ ID NO: 6544668 - DNA, 17 bp, Homo sapiens
tgtgatttttcttcagg

SEQ ID NO: 6544669 - DNA, 15 bp, Homo sapiens
tgtgatttttgtaat

SEQ ID NO: 6544670 - DNA, 17 bp, Homo sapiens
tgtgatttttgtttgca

SEQ ID NO: 6544671 - DNA, 11 bp, Homo sapiens
tgtgatttttt

SEQ ID NO: 6544672 - DNA, 16 bp, Homo sapiens
tgtgattttttgttct

SEQ ID NO: 6544673 - DNA, 18 bp, Homo sapiens
tgtgattttttgttcttg

SEQ ID NO: 6544674 - DNA, 20 bp, Homo sapiens
tgtgattttttgttcttgtt

SEQ ID NO: 6544675 - DNA, 22 bp, Homo sapiens
tgtgattttttgttcttgttgt

SEQ ID NO: 6544676 - DNA, 17 bp, Homo sapiens
tgtgcaaaaaaattaaa

SEQ ID NO: 6544677 - DNA, 20 bp, Homo sapiens
tgtgcaaaaaaattaaaatg

SEQ ID NO: 6544678 - DNA, 16 bp, Homo sapiens
tgtgcaaaaaggactg

SEQ ID NO: 6544679 - DNA, 13 bp, Homo sapiens
tgtgcaaaaattt

SEQ ID NO: 6544680 - DNA, 14 bp, Homo sapiens
tgtgcaaaagcagg

SEQ ID NO: 6544681 - DNA, 20 bp, Homo sapiens
tgtgcaaaataaaatgagtt

SEQ ID NO: 6544682 - DNA, 14 bp, Homo sapiens
tgtgcaaaatcact

SEQ ID NO: 6544683 - DNA, 14 bp, Homo sapiens
tgtgcaaacatgga

SEQ ID NO: 6544684 - DNA, 17 bp, Homo sapiens
tgtgcaaagcagagtga

SEQ ID NO: 6544685 - DNA, 17 bp, Homo sapiens
tgtgcaaaggataaatt

SEQ ID NO: 6544686 - DNA, 15 bp, Homo sapiens
tgtgcaaattttgca

SEQ ID NO: 6544687 - DNA, 14 bp, Homo sapiens
tgtgcaacagacaa

SEQ ID NO: 6544688 - DNA, 15 bp, Homo sapiens
tgtgcaacataacaa

SEQ ID NO: 6544689 - DNA, 17 bp, Homo sapiens
tgtgcaacctgtggctc

SEQ ID NO: 6544690 - DNA, 18 bp, Homo sapiens
tgtgcaacctgtggctca

SEQ ID NO: 6544691 - DNA, 17 bp, Homo sapiens
tgtgcaacggccagggt

SEQ ID NO: 6544692 - DNA, 15 bp, Homo sapiens
tgtgcaactcttgta

SEQ ID NO: 6544693 - DNA, 16 bp, Homo sapiens
tgtgcaactcttgtat

SEQ ID NO: 6544694 - DNA, 15 bp, Homo sapiens
tgtgcaactggccag

SEQ ID NO: 6544695 - DNA, 19 bp, Homo sapiens
tgtgcaactggccagccaa

SEQ ID NO: 6544696 - DNA, 17 bp, Homo sapiens
tgtgcaagacacccagt

SEQ ID NO: 6544697 - DNA, 23 bp, Homo sapiens
tgtgcaagacacccagtggaacc

SEQ ID NO: 6544698 - DNA, 19 bp, Homo sapiens
tgtgcaaggcagccgtggg

SEQ ID NO: 6544699 - DNA, 17 bp, Homo sapiens
tgtgcaagtatgtgagt

SEQ ID NO: 6544700 - DNA, 21 bp, Homo sapiens
tgtgcaagtcttgtcagaatt

SEQ ID NO: 6544701 - DNA, 15 bp, Homo sapiens
tgtgcaagtgtctgt

SEQ ID NO: 6544702 - DNA, 15 bp, Homo sapiens
tgtgcaataaaataa

SEQ ID NO: 6544703 - DNA, 13 bp, Homo sapiens
tgtgcaatacatt

SEQ ID NO: 6544704 - DNA, 15 bp, Homo sapiens
tgtgcaatacttaga

SEQ ID NO: 6544705 - DNA, 16 bp, Homo sapiens
tgtgcaatagaaatag

SEQ ID NO: 6544706 - DNA, 14 bp, Homo sapiens
tgtgcaataggtga

SEQ ID NO: 6544707 - DNA, 22 bp, Homo sapiens
tgtgcaataggtgagagaatgt

SEQ ID NO: 6544708 - DNA, 18 bp, Homo sapiens
tgtgcaatagtcagagtg

SEQ ID NO: 6544709 - DNA, 22 bp, Homo sapiens
tgtgcaatatgaggggactgca

SEQ ID NO: 6544710 - DNA, 22 bp, Homo sapiens
tgtgcaatggaatataaatatc

SEQ ID NO: 6544711 - DNA, 17 bp, Homo sapiens
tgtgcaattgtgaggga

SEQ ID NO: 6544712 - DNA, 18 bp, Homo sapiens
tgtgcaatttctgtacat

SEQ ID NO: 6544713 - DNA, 21 bp, Homo sapiens
tgtgcacaagtctttccagag

SEQ ID NO: 6544714 - DNA, 19 bp, Homo sapiens
tgtgcacaagtgtgcacag

SEQ ID NO: 6544715 - DNA, 22 bp, Homo sapiens
tgtgcacacacaccacacatac

SEQ ID NO: 6544716 - DNA, 13 bp, Homo sapiens
tgtgcacactaag

SEQ ID NO: 6544717 - DNA, 15 bp, Homo sapiens
tgtgcacactaagaa

SEQ ID NO: 6544718 - DNA, 16 bp, Homo sapiens
tgtgcacactaagaaa

SEQ ID NO: 6544719 - DNA, 18 bp, Homo sapiens
tgtgcacactaagaaatg

SEQ ID NO: 6544720 - DNA, 21 bp, Homo sapiens
tgtgcacatatcaagaagtca

SEQ ID NO: 6544721 - DNA, 15 bp, Homo sapiens
tgtgcacatctgttt

SEQ ID NO: 6544722 - DNA, 21 bp, Homo sapiens
tgtgcaccaccacacccggct

SEQ ID NO: 6544723 - DNA, 18 bp, Homo sapiens
tgtgcacccaacgtgatg

SEQ ID NO: 6544724 - DNA, 14 bp, Homo sapiens
tgtgcacccatggg

SEQ ID NO: 6544725 - DNA, 19 bp, Homo sapiens
tgtgcacccggcctggatg

SEQ ID NO: 6544726 - DNA, 15 bp, Homo sapiens
tgtgcacccgtgcca

SEQ ID NO: 6544727 - DNA, 15 bp, Homo sapiens
tgtgcacctgggctc

SEQ ID NO: 6544728 - DNA, 19 bp, Homo sapiens
tgtgcaccttacattccta

SEQ ID NO: 6544729 - DNA, 22 bp, Homo sapiens
tgtgcaccttaccaactttctg

SEQ ID NO: 6544730 - DNA, 21 bp, Homo sapiens
tgtgcacggcagcttgagcct

SEQ ID NO: 6544731 - DNA, 20 bp, Homo sapiens
tgtgcacgtaaagtacttgt

SEQ ID NO: 6544732 - DNA, 17 bp, Homo sapiens
tgtgcactaaggggccc

SEQ ID NO: 6544733 - DNA, 18 bp, Homo sapiens
tgtgcactagcctgtgat

SEQ ID NO: 6544734 - DNA, 19 bp, Homo sapiens
tgtgcactcacgctcagca

SEQ ID NO: 6544735 - DNA, 16 bp, Homo sapiens
tgtgcactctactctg

SEQ ID NO: 6544736 - DNA, 22 bp, Homo sapiens
tgtgcactgaatcgtttcatgt

SEQ ID NO: 6544737 - DNA, 13 bp, Homo sapiens
tgtgcactgccca

SEQ ID NO: 6544738 - DNA, 13 bp, Homo sapiens
tgtgcactgggca

SEQ ID NO: 6544739 - DNA, 22 bp, Homo sapiens
tgtgcactgggcaggttcctgg

SEQ ID NO: 6544740 - DNA, 14 bp, Homo sapiens
tgtgcagaaaacat

SEQ ID NO: 6544741 - DNA, 16 bp, Homo sapiens
tgtgcagaaaacattg

SEQ ID NO: 6544742 - DNA, 19 bp, Homo sapiens
tgtgcagaaaagctcagag

SEQ ID NO: 6544743 - DNA, 20 bp, Homo sapiens
tgtgcagaaaagctcagagt

SEQ ID NO: 6544744 - DNA, 20 bp, Homo sapiens
tgtgcagaataatggaaaca

SEQ ID NO: 6544745 - DNA, 13 bp, Homo sapiens
tgtgcagaatctc

SEQ ID NO: 6544746 - DNA, 12 bp, Homo sapiens
tgtgcagacaat

SEQ ID NO: 6544747 - DNA, 22 bp, Homo sapiens
tgtgcagacactcaagagccct

SEQ ID NO: 6544748 - DNA, 22 bp, Homo sapiens
tgtgcagactcaataaaatcat

SEQ ID NO: 6544749 - DNA, 13 bp, Homo sapiens
tgtgcagactgat

SEQ ID NO: 6544750 - DNA, 14 bp, Homo sapiens
tgtgcagagcagac

SEQ ID NO: 6544751 - DNA, 17 bp, Homo sapiens
tgtgcagaggaaactta

SEQ ID NO: 6544752 - DNA, 16 bp, Homo sapiens
tgtgcagagtatacaa

SEQ ID NO: 6544753 - DNA, 17 bp, Homo sapiens
tgtgcagatgctgctga

SEQ ID NO: 6544754 - DNA, 22 bp, Homo sapiens
tgtgcagatgctgctgaagaga

SEQ ID NO: 6544755 - DNA, 18 bp, Homo sapiens
tgtgcagcacgtctcaga

SEQ ID NO: 6544756 - DNA, 13 bp, Homo sapiens
tgtgcagcagatt

SEQ ID NO: 6544757 - DNA, 15 bp, Homo sapiens
tgtgcagcagcccag

SEQ ID NO: 6544758 - DNA, 20 bp, Homo sapiens
tgtgcagcagcccagcttcc

SEQ ID NO: 6544759 - DNA, 19 bp, Homo sapiens
tgtgcagcatggaattcct

SEQ ID NO: 6544760 - DNA, 22 bp, Homo sapiens
tgtgcagccccgcctccaggcc

SEQ ID NO: 6544761 - DNA, 19 bp, Homo sapiens
tgtgcagccggggagctga

SEQ ID NO: 6544762 - DNA, 22 bp, Homo sapiens
tgtgcagccggggagctgaggg

SEQ ID NO: 6544763 - DNA, 22 bp, Homo sapiens
tgtgcagcctgtcctgggctgg

SEQ ID NO: 6544764 - DNA, 17 bp, Homo sapiens
tgtgcagcgacccttgg

SEQ ID NO: 6544765 - DNA, 18 bp, Homo sapiens
tgtgcagcgacccttggt

SEQ ID NO: 6544766 - DNA, 20 bp, Homo sapiens
tgtgcagcttcgaggacagg

SEQ ID NO: 6544767 - DNA, 21 bp, Homo sapiens
tgtgcagcttcgaggacagga

SEQ ID NO: 6544768 - DNA, 12 bp, Homo sapiens
tgtgcagctttt

SEQ ID NO: 6544769 - DNA, 20 bp, Homo sapiens
tgtgcaggaagaaaagcccc

SEQ ID NO: 6544770 - DNA, 15 bp, Homo sapiens
tgtgcaggagcctcc

SEQ ID NO: 6544771 - DNA, 19 bp, Homo sapiens
tgtgcaggagcctccctgc

SEQ ID NO: 6544772 - DNA, 19 bp, Homo sapiens
ttgatacagttttcagaaa

SEQ ID NO: 6544773 - DNA, 17 bp, Homo sapiens
ttgatacataataaaaa

SEQ ID NO: 6544774 - DNA, 23 bp, Homo sapiens
ttgatacataataaaaaattatg

SEQ ID NO: 6544775 - DNA, 12 bp, Homo sapiens
ttgatacattta

SEQ ID NO: 6544776 - DNA, 16 bp, Homo sapiens
ttgatacatttatctt

SEQ ID NO: 6544777 - DNA, 19 bp, Homo sapiens
ttgatacatttatcttctg

SEQ ID NO: 6544778 - DNA, 13 bp, Homo sapiens
ttgatacccccct

SEQ ID NO: 6544779 - DNA, 16 bp, Homo sapiens
ttgatacgtgtgtgaa

SEQ ID NO: 6544780 - DNA, 18 bp, Homo sapiens
ttgatacgtgtgtgaagt

SEQ ID NO: 6544781 - DNA, 13 bp, Homo sapiens
ttgatactaccag

SEQ ID NO: 6544782 - DNA, 18 bp, Homo sapiens
ttgatactaccagggtct

SEQ ID NO: 6544783 - DNA, 22 bp, Homo sapiens
ttgatactaccagggtctctca

SEQ ID NO: 6544784 - DNA, 17 bp, Homo sapiens
ttgatactgaatgcata

SEQ ID NO: 6544785 - DNA, 20 bp, Homo sapiens
ttgatactggtcccacttca

SEQ ID NO: 6544786 - DNA, 16 bp, Homo sapiens
ttgatactgttgcacg

SEQ ID NO: 6544787 - DNA, 19 bp, Homo sapiens
ttgatacttgtaacttttt

SEQ ID NO: 6544788 - DNA, 16 bp, Homo sapiens
ttgatacttgttcaaa

SEQ ID NO: 6544789 - DNA, 12 bp, Homo sapiens
ttgatagatgtt

SEQ ID NO: 6544790 - DNA, 18 bp, Homo sapiens
ttgatagatgtttgactt

SEQ ID NO: 6544791 - DNA, 13 bp, Homo sapiens
ttgatagcaaagc

SEQ ID NO: 6544792 - DNA, 21 bp, Homo sapiens
ttgatagcaggtgtaataaga

SEQ ID NO: 6544793 - DNA, 15 bp, Homo sapiens
ttgatagctaaataa

SEQ ID NO: 6544794 - DNA, 16 bp, Homo sapiens
ttgatagctaaataac

SEQ ID NO: 6544795 - DNA, 14 bp, Homo sapiens
ttgatagctttatt

SEQ ID NO: 6544796 - DNA, 22 bp, Homo sapiens
ttgataggaaggaaactggaat

SEQ ID NO: 6544797 - DNA, 19 bp, Homo sapiens
ttgataggagacttgtaca

SEQ ID NO: 6544798 - DNA, 23 bp, Homo sapiens
ttgataggcctagtacaatcttg

SEQ ID NO: 6544799 - DNA, 22 bp, Homo sapiens
ttgatagggtctaccaatacaa

SEQ ID NO: 6544800 - DNA, 16 bp, Homo sapiens
ttgatagtaaatgtcc

SEQ ID NO: 6544801 - DNA, 21 bp, Homo sapiens
ttgatagtagccaaagttaaa

SEQ ID NO: 6544802 - DNA, 16 bp, Homo sapiens
ttgatagtgatgtatt

SEQ ID NO: 6544803 - DNA, 17 bp, Homo sapiens
ttgatagtgatgtattt

SEQ ID NO: 6544804 - DNA, 19 bp, Homo sapiens
ttgatagtgcttcttgtaa

SEQ ID NO: 6544805 - DNA, 14 bp, Homo sapiens
ttgatagtttacaa

SEQ ID NO: 6544806 - DNA, 13 bp, Homo sapiens
ttgatataataat

SEQ ID NO: 6544807 - DNA, 18 bp, Homo sapiens
ttgatataataattactt

SEQ ID NO: 6544808 - DNA, 13 bp, Homo sapiens
ttgatataatctt

SEQ ID NO: 6544809 - DNA, 14 bp, Homo sapiens
ttgatataattact

SEQ ID NO: 6544810 - DNA, 13 bp, Homo sapiens
ttgatatacagac

SEQ ID NO: 6544811 - DNA, 14 bp, Homo sapiens
ttgatatacattgt

SEQ ID NO: 6544812 - DNA, 18 bp, Homo sapiens
ttgatatagaagtataaa

SEQ ID NO: 6544813 - DNA, 20 bp, Homo sapiens
ttgatatagaagtataaaga

SEQ ID NO: 6544814 - DNA, 14 bp, Homo sapiens
ttgatatatattat

SEQ ID NO: 6544815 - DNA, 23 bp, Homo sapiens
ttgatatattctttccatgcagt

SEQ ID NO: 6544816 - DNA, 15 bp, Homo sapiens
ttgatatcacagtct

SEQ ID NO: 6544817 - DNA, 13 bp, Homo sapiens
ttgatatcccaag

SEQ ID NO: 6544818 - DNA, 23 bp, Homo sapiens
ttgatatcctctttgagtgaagc

SEQ ID NO: 6544819 - DNA, 21 bp, Homo sapiens
ttgatatcggtgctatgtgtt

SEQ ID NO: 6544820 - DNA, 22 bp, Homo sapiens
ttgatatctcaatctgcagcca

SEQ ID NO: 6544821 - DNA, 15 bp, Homo sapiens
ttgatatgactgttt

SEQ ID NO: 6544822 - DNA, 22 bp, Homo sapiens
ttgatatgattgtaacatattt

SEQ ID NO: 6544823 - DNA, 20 bp, Homo sapiens
ttgatatgccttttcccaac

SEQ ID NO: 6544824 - DNA, 16 bp, Homo sapiens
ttgatatgggctttct

SEQ ID NO: 6544825 - DNA, 13 bp, Homo sapiens
ttgatatgtaaca

SEQ ID NO: 6544826 - DNA, 15 bp, Homo sapiens
ttgatattatattaa

SEQ ID NO: 6544827 - DNA, 21 bp, Homo sapiens
ttgatattcctacaaagaaaa

SEQ ID NO: 6544828 - DNA, 22 bp, Homo sapiens
ttgatattctaagaaatatctg

SEQ ID NO: 6544829 - DNA, 20 bp, Homo sapiens
ttgatattgtgaacatttgt

SEQ ID NO: 6544830 - DNA, 20 bp, Homo sapiens
ttgatattgtttgctgttgg

SEQ ID NO: 6544831 - DNA, 16 bp, Homo sapiens
ttgatatttaaaagat

SEQ ID NO: 6544832 - DNA, 14 bp, Homo sapiens
ttgatatttaagca

SEQ ID NO: 6544833 - DNA, 19 bp, Homo sapiens
ttgatatttatttcctgct

SEQ ID NO: 6544834 - DNA, 15 bp, Homo sapiens
ttgatatttgtattt

SEQ ID NO: 6544835 - DNA, 15 bp, Homo sapiens
ttgatattttcacag

SEQ ID NO: 6544836 - DNA, 20 bp, Homo sapiens
ttgatattttccctttttaa

SEQ ID NO: 6544837 - DNA, 15 bp, Homo sapiens
ttgatcaaaatcaaa

SEQ ID NO: 6544838 - DNA, 18 bp, Homo sapiens
ttgatcaaaatcaaaagg

SEQ ID NO: 6544839 - DNA, 15 bp, Homo sapiens
ttgatcaaatgtaca

SEQ ID NO: 6544840 - DNA, 17 bp, Homo sapiens
ttgatcaaatgtacatc

SEQ ID NO: 6544841 - DNA, 22 bp, Homo sapiens
ttgatcaacatcttttcttgcc

SEQ ID NO: 6544842 - DNA, 16 bp, Homo sapiens
ttgatcacacagtgtt

SEQ ID NO: 6544843 - DNA, 14 bp, Homo sapiens
ttgatcacactatt

SEQ ID NO: 6544844 - DNA, 12 bp, Homo sapiens
ttgatcagaatc

SEQ ID NO: 6544845 - DNA, 19 bp, Homo sapiens
ttgatcagacattcagaga

SEQ ID NO: 6544846 - DNA, 22 bp, Homo sapiens
ttgatcagatgctgaattgaga

SEQ ID NO: 6544847 - DNA, 19 bp, Homo sapiens
ttgatcagtaagtcacagt

SEQ ID NO: 6544848 - DNA, 17 bp, Homo sapiens
ttgatcagtagtttgca

SEQ ID NO: 6544849 - DNA, 17 bp, Homo sapiens
ttgatcatccctttctc

SEQ ID NO: 6544850 - DNA, 18 bp, Homo sapiens
ttgatcatccctttctcc

SEQ ID NO: 6544851 - DNA, 12 bp, Homo sapiens
ttgatcatgcag

SEQ ID NO: 6544852 - DNA, 17 bp, Homo sapiens
ttgatcatgtacttttt

SEQ ID NO: 6544853 - DNA, 13 bp, Homo sapiens
ttgatcattcata

SEQ ID NO: 6544854 - DNA, 14 bp, Homo sapiens
ttgatcatttctgc

SEQ ID NO: 6544855 - DNA, 18 bp, Homo sapiens
ttgatcattttcccccca

SEQ ID NO: 6544856 - DNA, 19 bp, Homo sapiens
ttgatcattttccccccac

SEQ ID NO: 6544857 - DNA, 19 bp, Homo sapiens
ttgatccagaagagcccat

SEQ ID NO: 6544858 - DNA, 18 bp, Homo sapiens
ttgatccatccagcttgc

SEQ ID NO: 6544859 - DNA, 21 bp, Homo sapiens
ttgatcccaatagaatacctc

SEQ ID NO: 6544860 - DNA, 23 bp, Homo sapiens
ttgatcccacttcactgtgaggg

SEQ ID NO: 6544861 - DNA, 23 bp, Homo sapiens
ttgatcccagaaagtatatactg

SEQ ID NO: 6544862 - DNA, 20 bp, Homo sapiens
ttgatccccacactgcctta

SEQ ID NO: 6544863 - DNA, 12 bp, Homo sapiens
ttgatcccctct

SEQ ID NO: 6544864 - DNA, 21 bp, Homo sapiens
ttgatccctgttacccagaga

SEQ ID NO: 6544865 - DNA, 18 bp, Homo sapiens
ttgatcccttctgttggt

SEQ ID NO: 6544866 - DNA, 23 bp, Homo sapiens
ttgatcctagtgtctttaaatac

SEQ ID NO: 6544867 - DNA, 20 bp, Homo sapiens
ttgatccttaaccaataatg

SEQ ID NO: 6544868 - DNA, 13 bp, Homo sapiens
ttgatccttggaa

SEQ ID NO: 6544869 - DNA, 22 bp, Homo sapiens
ttgatcgcttttaataaactgc

SEQ ID NO: 6544870 - DNA, 23 bp, Homo sapiens
ttgatctaaggcatgctcccagc

SEQ ID NO: 6544871 - DNA, 16 bp, Homo sapiens
ttgatctatctacaaa

SEQ ID NO: 6544872 - DNA, 14 bp, Homo sapiens
ttgatctcacattt

SEQ ID NO: 6544873 - DNA, 18 bp, Homo sapiens
ttgatctccctttcctat

SEQ ID NO: 6544874 - DNA, 19 bp, Homo sapiens
ttgatctcctgacctcatg

SEQ ID NO: 6544875 - DNA, 23 bp, Homo sapiens
ttgatctcctggtagcatgacct

SEQ ID NO: 6544876 - DNA, 24 bp, Homo sapiens
ttgatctcctggtagcatgacctt

SEQ ID NO: 6544877 - DNA, 13 bp, Homo sapiens
ttgatctctcttg

SEQ ID NO: 6544878 - DNA, 18 bp, Homo sapiens
ttgatctgctcagccctg

SEQ ID NO: 6544879 - DNA, 19 bp, Homo sapiens
ttgatctgctcagccctgg

SEQ ID NO: 6544880 - DNA, 21 bp, Homo sapiens
ttgatctgctcagccctggag

SEQ ID NO: 6544881 - DNA, 16 bp, Homo sapiens
ttgatctggaacccag

SEQ ID NO: 6544882 - DNA, 17 bp, Homo sapiens
ttgatctggaacccaga

SEQ ID NO: 6544883 - DNA, 19 bp, Homo sapiens
ttgatctggaacccagact

SEQ ID NO: 6544884 - DNA, 12 bp, Homo sapiens
ttgatctgtgat

SEQ ID NO: 6544885 - DNA, 17 bp, Homo sapiens
ttgatctgtgatttctt

SEQ ID NO: 6544886 - DNA, 19 bp, Homo sapiens
ttgatctgtgatttcttct

SEQ ID NO: 6544887 - DNA, 21 bp, Homo sapiens
ttgatctgtgatttcttctcc

SEQ ID NO: 6544888 - DNA, 13 bp, Homo sapiens
ttgatctgtttta

SEQ ID NO: 6544889 - DNA, 14 bp, Homo sapiens
ttgatcttaaagat

SEQ ID NO: 6544890 - DNA, 17 bp, Homo sapiens
ttgatcttcaacaaatt

SEQ ID NO: 6544891 - DNA, 19 bp, Homo sapiens
ttgatcttcctctgctaaa

SEQ ID NO: 6544892 - DNA, 12 bp, Homo sapiens
ttgatctttgtt

SEQ ID NO: 6544893 - DNA, 15 bp, Homo sapiens
ttgatctttgtttaa

SEQ ID NO: 6544894 - DNA, 18 bp, Homo sapiens
ttgatctttgtttaaatg

SEQ ID NO: 6544895 - DNA, 19 bp, Homo sapiens
ttgatctttttatattctt

SEQ ID NO: 6544896 - DNA, 20 bp, Homo sapiens
ttgatgaaacgtcatgtgtt

SEQ ID NO: 6544897 - DNA, 15 bp, Homo sapiens
ttgatgaaagctgat

SEQ ID NO: 6544898 - DNA, 16 bp, Homo sapiens
ttgatgaaagctgatt

SEQ ID NO: 6544899 - DNA, 14 bp, Homo sapiens
ttgatgaaatcatt

SEQ ID NO: 6544900 - DNA, 13 bp, Homo sapiens
ttgatgaagaagt

SEQ ID NO: 6544901 - DNA, 18 bp, Homo sapiens
ttgatgaagcaaggaaga

SEQ ID NO: 6544902 - DNA, 19 bp, Homo sapiens
ttgatgaagcctgtgccac

SEQ ID NO: 6544903 - DNA, 19 bp, Homo sapiens
ttgatgaataaaatgttta

SEQ ID NO: 6544904 - DNA, 21 bp, Homo sapiens
ttgatgaattcttcctctcct

SEQ ID NO: 6544905 - DNA, 22 bp, Homo sapiens
ttgatgaccaatctctgtgact

SEQ ID NO: 6544906 - DNA, 17 bp, Homo sapiens
ttgatgacccccaacca

SEQ ID NO: 6544907 - DNA, 15 bp, Homo sapiens
ttgatgactgctgat

SEQ ID NO: 6544908 - DNA, 18 bp, Homo sapiens
ttgatgagtgtaacaaga

SEQ ID NO: 6544909 - DNA, 19 bp, Homo sapiens
ttgatgagtgtaacaagaa

SEQ ID NO: 6544910 - DNA, 18 bp, Homo sapiens
ttgatgagttaactgtga

SEQ ID NO: 6544911 - DNA, 18 bp, Homo sapiens
ttgatgatcactgtgaaa

SEQ ID NO: 6544912 - DNA, 16 bp, Homo sapiens
ttgatgatctttgcag

SEQ ID NO: 6544913 - DNA, 21 bp, Homo sapiens
ttgatgatgtctacagaaaat

SEQ ID NO: 6544914 - DNA, 11 bp, Homo sapiens
ttgatgatgtg

SEQ ID NO: 6544915 - DNA, 13 bp, Homo sapiens
ttgatgatgttgt

SEQ ID NO: 6544916 - DNA, 20 bp, Homo sapiens
ttgatgattttcatttcatg

SEQ ID NO: 6544917 - DNA, 14 bp, Homo sapiens
ttgatgattttgta

SEQ ID NO: 6544918 - DNA, 15 bp, Homo sapiens
ttgatgattttgtaa

SEQ ID NO: 6544919 - DNA, 24 bp, Homo sapiens
ttgatgattttgtaattcttatga

SEQ ID NO: 6544920 - DNA, 12 bp, Homo sapiens
ttgatgcaatat

SEQ ID NO: 6544921 - DNA, 17 bp, Homo sapiens
ttgatgcaatccttaca

SEQ ID NO: 6544922 - DNA, 12 bp, Homo sapiens
ttgatgcacaga

SEQ ID NO: 6544923 - DNA, 11 bp, Homo sapiens
ttgatgcactt

SEQ ID NO: 6544924 - DNA, 21 bp, Homo sapiens
ttgatgcagataaaatatttt

SEQ ID NO: 6544925 - DNA, 14 bp, Homo sapiens
ttgatgcagcattt

SEQ ID NO: 6544926 - DNA, 23 bp, Homo sapiens
ttgatgcattaaaagaaaataaa

SEQ ID NO: 6544927 - DNA, 18 bp, Homo sapiens
ttgatgccaaaatgactt

SEQ ID NO: 6544928 - DNA, 19 bp, Homo sapiens
ttgatgccaaaatgacttt

SEQ ID NO: 6544929 - DNA, 18 bp, Homo sapiens
ttgatgccaaagcagaca

SEQ ID NO: 6544930 - DNA, 12 bp, Homo sapiens
ttgatgccagag

SEQ ID NO: 6544931 - DNA, 13 bp, Homo sapiens
ttgatgccagagg

SEQ ID NO: 6544932 - DNA, 14 bp, Homo sapiens
ttgatgccagctgt

SEQ ID NO: 6544933 - DNA, 21 bp, Homo sapiens
ttgatgccagctgtactgagt

SEQ ID NO: 6544934 - DNA, 18 bp, Homo sapiens
ttgatgccatttgtcttt

SEQ ID NO: 6544935 - DNA, 15 bp, Homo sapiens
ttgatgcccaatata

SEQ ID NO: 6544936 - DNA, 12 bp, Homo sapiens
ttgatgcctttt

SEQ ID NO: 6544937 - DNA, 17 bp, Homo sapiens
ttgatgctgacagtcat

SEQ ID NO: 6544938 - DNA, 14 bp, Homo sapiens
ttgatgctgagtca

SEQ ID NO: 6544939 - DNA, 17 bp, Homo sapiens
ttgatgctggagaggtt

SEQ ID NO: 6544940 - DNA, 13 bp, Homo sapiens
ttgatggaaaata

SEQ ID NO: 6544941 - DNA, 23 bp, Homo sapiens
ttgatggaagtgggccagtcctg

SEQ ID NO: 6544942 - DNA, 14 bp, Homo sapiens
ttgatggagaagga

SEQ ID NO: 6544943 - DNA, 18 bp, Homo sapiens
ttgatggagaaggaaaag

SEQ ID NO: 6544944 - DNA, 14 bp, Homo sapiens
ttgatggagatatt

SEQ ID NO: 6544945 - DNA, 20 bp, Homo sapiens
ttgatggctaacttacaaag

SEQ ID NO: 6544946 - DNA, 19 bp, Homo sapiens
ttgatggctatgttttgga

SEQ ID NO: 6544947 - DNA, 14 bp, Homo sapiens
ttgatggggaagga

SEQ ID NO: 6544948 - DNA, 17 bp, Homo sapiens
ttgatggggacatttct

SEQ ID NO: 6544949 - DNA, 20 bp, Homo sapiens
ttgatgggggccaggacacc

SEQ ID NO: 6544950 - DNA, 21 bp, Homo sapiens
ttgatggtaaccataatggaa

SEQ ID NO: 6544951 - DNA, 18 bp, Homo sapiens
tgtgcaggagcggcagat

SEQ ID NO: 6544952 - DNA, 13 bp, Homo sapiens
tgtgcaggcccag

SEQ ID NO: 6544953 - DNA, 19 bp, Homo sapiens
tgtgcaggcctgtccctgg

SEQ ID NO: 6544954 - DNA, 21 bp, Homo sapiens
tgtgcaggcctgtccctggga

SEQ ID NO: 6544955 - DNA, 12 bp, Homo sapiens
tgtgcaggctcc

SEQ ID NO: 6544956 - DNA, 22 bp, Homo sapiens
tgtgcaggctgcagtggctccc

SEQ ID NO: 6544957 - DNA, 17 bp, Homo sapiens
tgtgcagggagggcagt

SEQ ID NO: 6544958 - DNA, 19 bp, Homo sapiens
tgtgcagggatattgcctt

SEQ ID NO: 6544959 - DNA, 20 bp, Homo sapiens
tgtgcagggatattgcctta

SEQ ID NO: 6544960 - DNA, 14 bp, Homo sapiens
tgtgcagggcacag

SEQ ID NO: 6544961 - DNA, 14 bp, Homo sapiens
tgtgcagggctggt

SEQ ID NO: 6544962 - DNA, 17 bp, Homo sapiens
tgtgcagggctggtttg

SEQ ID NO: 6544963 - DNA, 15 bp, Homo sapiens
tgtgcagggtattaa

SEQ ID NO: 6544964 - DNA, 16 bp, Homo sapiens
tgtgcaggtgctgcct

SEQ ID NO: 6544965 - DNA, 14 bp, Homo sapiens
tgtgcagtaacttg

SEQ ID NO: 6544966 - DNA, 19 bp, Homo sapiens
tgtgcagtactttgtgcat

SEQ ID NO: 6544967 - DNA, 20 bp, Homo sapiens
tgtgcagtataattttctaa

SEQ ID NO: 6544968 - DNA, 22 bp, Homo sapiens
tgtgcagtataattttctaatt

SEQ ID NO: 6544969 - DNA, 17 bp, Homo sapiens
tgtgcagtcactggagg

SEQ ID NO: 6544970 - DNA, 21 bp, Homo sapiens
tgtgcagtcccgtggagggta

SEQ ID NO: 6544971 - DNA, 23 bp, Homo sapiens
tgtgcagtcccgtggagggtagg

SEQ ID NO: 6544972 - DNA, 20 bp, Homo sapiens
tgtgcagtgaaggttgctga

SEQ ID NO: 6544973 - DNA, 16 bp, Homo sapiens
tgtgcagtggagctgg

SEQ ID NO: 6544974 - DNA, 17 bp, Homo sapiens
tgtgcagtggagctggc

SEQ ID NO: 6544975 - DNA, 14 bp, Homo sapiens
tgtgcagtgtagcc

SEQ ID NO: 6544976 - DNA, 12 bp, Homo sapiens
tgtgcagtgttg

SEQ ID NO: 6544977 - DNA, 16 bp, Homo sapiens
tgtgcagtgtttttcc

SEQ ID NO: 6544978 - DNA, 13 bp, Homo sapiens
tgtgcagttctag

SEQ ID NO: 6544979 - DNA, 15 bp, Homo sapiens
tgtgcagtttggaat

SEQ ID NO: 6544980 - DNA, 15 bp, Homo sapiens
tgtgcagtttggtat

SEQ ID NO: 6544981 - DNA, 21 bp, Homo sapiens
tgtgcataatgataaaataaa

SEQ ID NO: 6544982 - DNA, 19 bp, Homo sapiens
tgtgcataatgctttggaa

SEQ ID NO: 6544983 - DNA, 20 bp, Homo sapiens
tgtgcataatgctttggaaa

SEQ ID NO: 6544984 - DNA, 16 bp, Homo sapiens
tgtgcatagcgtcctg

SEQ ID NO: 6544985 - DNA, 21 bp, Homo sapiens
tgtgcatagcgtcctgccctg

SEQ ID NO: 6544986 - DNA, 23 bp, Homo sapiens
tgtgcatagcgtcctgccctgcc

SEQ ID NO: 6544987 - DNA, 15 bp, Homo sapiens
tgtgcatagtgctgg

SEQ ID NO: 6544988 - DNA, 17 bp, Homo sapiens
tgtgcatagtgctggga

SEQ ID NO: 6544989 - DNA, 14 bp, Homo sapiens
tgtgcatagtttct

SEQ ID NO: 6544990 - DNA, 15 bp, Homo sapiens
tgtgcatagtttctt

SEQ ID NO: 6544991 - DNA, 23 bp, Homo sapiens
tgtgcatcatgtttctgagacca

SEQ ID NO: 6544992 - DNA, 15 bp, Homo sapiens
tgtgcatctggtgta

SEQ ID NO: 6544993 - DNA, 13 bp, Homo sapiens
tgtgcatctgtgt

SEQ ID NO: 6544994 - DNA, 17 bp, Homo sapiens
tgtgcatgaaagagaaa

SEQ ID NO: 6544995 - DNA, 13 bp, Homo sapiens
tgtgcatgagaat

SEQ ID NO: 6544996 - DNA, 18 bp, Homo sapiens
tgtgcatgagaatgtcat

SEQ ID NO: 6544997 - DNA, 21 bp, Homo sapiens
tgtgcatgagaatgtcatttg

SEQ ID NO: 6544998 - DNA, 23 bp, Homo sapiens
tgtgcatgagaatgtcatttgct

SEQ ID NO: 6544999 - DNA, 17 bp, Homo sapiens
tgtgcatgcaaccagat

SEQ ID NO: 6545000 - DNA, 17 bp, Homo sapiens
tgtgcatgctcaaatga

SEQ ID NO: 6545001 - DNA, 20 bp, Homo sapiens
tgtgcatggaaatgtcctcc

SEQ ID NO: 6545002 - DNA, 13 bp, Homo sapiens
tgtgcatggaact

SEQ ID NO: 6545003 - DNA, 13 bp, Homo sapiens
tgtgcatggaagt

SEQ ID NO: 6545004 - DNA, 22 bp, Homo sapiens
tgtgcatggaggccctcctgtg

SEQ ID NO: 6545005 - DNA, 13 bp, Homo sapiens
tgtgcatgggtga

SEQ ID NO: 6545006 - DNA, 13 bp, Homo sapiens
tgtgcatgtatgt

SEQ ID NO: 6545007 - DNA, 23 bp, Homo sapiens
tgtgcatgtatgtcttggacact

SEQ ID NO: 6545008 - DNA, 20 bp, Homo sapiens
tgtgcatgtgcgtggaagtg

SEQ ID NO: 6545009 - DNA, 18 bp, Homo sapiens
tgtgcatgtgtctttata

SEQ ID NO: 6545010 - DNA, 12 bp, Homo sapiens
tgtgcatgtgtg

SEQ ID NO: 6545011 - DNA, 22 bp, Homo sapiens
tgtgcatgtgtgcgagtgtgtg

SEQ ID NO: 6545012 - DNA, 16 bp, Homo sapiens
tgtgcatgtgtgtata

SEQ ID NO: 6545013 - DNA, 17 bp, Homo sapiens
tgtgcatgtgtgtataa

SEQ ID NO: 6545014 - DNA, 17 bp, Homo sapiens
tgtgcatgtgtgtgtct

SEQ ID NO: 6545015 - DNA, 22 bp, Homo sapiens
tgtgcatgtttactttattaga

SEQ ID NO: 6545016 - DNA, 21 bp, Homo sapiens
tgtgcattaaaattaaatact

SEQ ID NO: 6545017 - DNA, 23 bp, Homo sapiens
tgtgcattaaaattaaatacttt

SEQ ID NO: 6545018 - DNA, 22 bp, Homo sapiens
tgtgcattacaaagttaatatg

SEQ ID NO: 6545019 - DNA, 23 bp, Homo sapiens
tgtgcattatctagatactgtat

SEQ ID NO: 6545020 - DNA, 15 bp, Homo sapiens
tgtgcattctggatt

SEQ ID NO: 6545021 - DNA, 22 bp, Homo sapiens
tgtgcattcttttaaaagacaa

SEQ ID NO: 6545022 - DNA, 13 bp, Homo sapiens
tgtgcatttaatt

SEQ ID NO: 6545023 - DNA, 18 bp, Homo sapiens
tgtgcatttgtgtctgcc

SEQ ID NO: 6545024 - DNA, 21 bp, Homo sapiens
tgtgcattttttttttcattg

SEQ ID NO: 6545025 - DNA, 19 bp, Homo sapiens
tgtgccaaaatgtcaattt

SEQ ID NO: 6545026 - DNA, 18 bp, Homo sapiens
tgtgccaaagatagcaga

SEQ ID NO: 6545027 - DNA, 20 bp, Homo sapiens
tgtgccaaagatagcagaag

SEQ ID NO: 6545028 - DNA, 14 bp, Homo sapiens
tgtgccaacctgtt

SEQ ID NO: 6545029 - DNA, 17 bp, Homo sapiens
tgtgccaacctgttctt

SEQ ID NO: 6545030 - DNA, 10 bp, Homo sapiens
tgtgccaagc

SEQ ID NO: 6545031 - DNA, 12 bp, Homo sapiens
tgtgccaagccc

SEQ ID NO: 6545032 - DNA, 16 bp, Homo sapiens
tgtgccaagccctggc

SEQ ID NO: 6545033 - DNA, 15 bp, Homo sapiens
tgtgccaataaccaa

SEQ ID NO: 6545034 - DNA, 16 bp, Homo sapiens
tgtgccaataaccaag

SEQ ID NO: 6545035 - DNA, 23 bp, Homo sapiens
tgtgccaatcaatagcaccccta

SEQ ID NO: 6545036 - DNA, 17 bp, Homo sapiens
tgtgccacaccccatgc

SEQ ID NO: 6545037 - DNA, 13 bp, Homo sapiens
tgtgccacacgca

SEQ ID NO: 6545038 - DNA, 15 bp, Homo sapiens
tgtgccacagaggcc

SEQ ID NO: 6545039 - DNA, 16 bp, Homo sapiens
tgtgccacagaggccc

SEQ ID NO: 6545040 - DNA, 14 bp, Homo sapiens
tgtgccacaggctg

SEQ ID NO: 6545041 - DNA, 14 bp, Homo sapiens
tgtgccaccacccc

SEQ ID NO: 6545042 - DNA, 13 bp, Homo sapiens
tgtgccaccctct

SEQ ID NO: 6545043 - DNA, 17 bp, Homo sapiens
tgtgccaccctctgcag

SEQ ID NO: 6545044 - DNA, 23 bp, Homo sapiens
tgtgccaccctctgcagggcagc

SEQ ID NO: 6545045 - DNA, 17 bp, Homo sapiens
tgtgccaccctgggctc

SEQ ID NO: 6545046 - DNA, 21 bp, Homo sapiens
tgtgccaccctgggctctgtg

SEQ ID NO: 6545047 - DNA, 13 bp, Homo sapiens
tgtgccacctgca

SEQ ID NO: 6545048 - DNA, 20 bp, Homo sapiens
tgtgccacctgtccggccca

SEQ ID NO: 6545049 - DNA, 21 bp, Homo sapiens
tgtgccacctgtccggcccag

SEQ ID NO: 6545050 - DNA, 22 bp, Homo sapiens
tgtgccacctgtccggcccagt

SEQ ID NO: 6545051 - DNA, 21 bp, Homo sapiens
tgtgccactaaactacattgt

SEQ ID NO: 6545052 - DNA, 18 bp, Homo sapiens
tgtgccactttgactcag

SEQ ID NO: 6545053 - DNA, 22 bp, Homo sapiens
tgtgccactttgactcagaggc

SEQ ID NO: 6545054 - DNA, 22 bp, Homo sapiens
tgtgccagaaagtcccccctcg

SEQ ID NO: 6545055 - DNA, 23 bp, Homo sapiens
tgtgccagaaagtcccccctcgc

SEQ ID NO: 6545056 - DNA, 20 bp, Homo sapiens
tgtgccagagaacccagccc

SEQ ID NO: 6545057 - DNA, 12 bp, Homo sapiens
tgtgccagagcc

SEQ ID NO: 6545058 - DNA, 13 bp, Homo sapiens
tgtgccagagcct

SEQ ID NO: 6545059 - DNA, 15 bp, Homo sapiens
tgtgccagagcctgg

SEQ ID NO: 6545060 - DNA, 17 bp, Homo sapiens
tgtgccagagcctgggg

SEQ ID NO: 6545061 - DNA, 23 bp, Homo sapiens
tgtgccagaggaatcctggcagc

SEQ ID NO: 6545062 - DNA, 16 bp, Homo sapiens
tgtgccagaggccaga

SEQ ID NO: 6545063 - DNA, 13 bp, Homo sapiens
tgtgccagcacct

SEQ ID NO: 6545064 - DNA, 14 bp, Homo sapiens
tgtgccagctcagg

SEQ ID NO: 6545065 - DNA, 18 bp, Homo sapiens
tgtgccagctcaggtgac

SEQ ID NO: 6545066 - DNA, 12 bp, Homo sapiens
tgtgccagctgc

SEQ ID NO: 6545067 - DNA, 17 bp, Homo sapiens
tgtgccagctgcttctg

SEQ ID NO: 6545068 - DNA, 18 bp, Homo sapiens
tgtgccagctgcttctgc

SEQ ID NO: 6545069 - DNA, 19 bp, Homo sapiens
tgtgccagctgcttctgcc

SEQ ID NO: 6545070 - DNA, 18 bp, Homo sapiens
tgtgccaggactgtgact

SEQ ID NO: 6545071 - DNA, 20 bp, Homo sapiens
tgtgccaggactgtgactca

SEQ ID NO: 6545072 - DNA, 12 bp, Homo sapiens
tgtgccaggagt

SEQ ID NO: 6545073 - DNA, 23 bp, Homo sapiens
tgtgccaggctgaattacagtga

SEQ ID NO: 6545074 - DNA, 16 bp, Homo sapiens
tgtgccaggctgggag

SEQ ID NO: 6545075 - DNA, 15 bp, Homo sapiens
tgtgccaggcttgcc

SEQ ID NO: 6545076 - DNA, 21 bp, Homo sapiens
tgtgccaggcttgcctgggct

SEQ ID NO: 6545077 - DNA, 18 bp, Homo sapiens
tgtgccagggcaatgatg

SEQ ID NO: 6545078 - DNA, 18 bp, Homo sapiens
tgtgccatagagtttaac

SEQ ID NO: 6545079 - DNA, 20 bp, Homo sapiens
tgtgccatagagtttaacac

SEQ ID NO: 6545080 - DNA, 20 bp, Homo sapiens
tgtgccatggccccccactc

SEQ ID NO: 6545081 - DNA, 17 bp, Homo sapiens
tgtgccatggtgagaaa

SEQ ID NO: 6545082 - DNA, 15 bp, Homo sapiens
tgtgccatgtataat

SEQ ID NO: 6545083 - DNA, 12 bp, Homo sapiens
tgtgccatgtgc

SEQ ID NO: 6545084 - DNA, 16 bp, Homo sapiens
tgtgccattttctgta

SEQ ID NO: 6545085 - DNA, 14 bp, Homo sapiens
tgtgcccaaaagcc

SEQ ID NO: 6545086 - DNA, 15 bp, Homo sapiens
tgtgcccaaaagcca

SEQ ID NO: 6545087 - DNA, 13 bp, Homo sapiens
tgtgcccacccag

SEQ ID NO: 6545088 - DNA, 14 bp, Homo sapiens
tgtgcccacccagg

SEQ ID NO: 6545089 - DNA, 18 bp, Homo sapiens
tgtgcccacccagggaag

SEQ ID NO: 6545090 - DNA, 18 bp, Homo sapiens
tgtgcccacccagggccc

SEQ ID NO: 6545091 - DNA, 20 bp, Homo sapiens
tgtgcccacccgtgttctcc

SEQ ID NO: 6545092 - DNA, 21 bp, Homo sapiens
tgtgcccacccgtgttctcct

SEQ ID NO: 6545093 - DNA, 22 bp, Homo sapiens
tgtgcccacccgtgttctcctc

SEQ ID NO: 6545094 - DNA, 20 bp, Homo sapiens
tgtgcccacgtgtgcagact

SEQ ID NO: 6545095 - DNA, 18 bp, Homo sapiens
tgtgcccacttcatagat

SEQ ID NO: 6545096 - DNA, 18 bp, Homo sapiens
tgtgcccagaatactgat

SEQ ID NO: 6545097 - DNA, 14 bp, Homo sapiens
tgtgcccagcaggc

SEQ ID NO: 6545098 - DNA, 22 bp, Homo sapiens
tgtgcccagcctccatgtttta

SEQ ID NO: 6545099 - DNA, 13 bp, Homo sapiens
tgtgcccagctca

SEQ ID NO: 6545100 - DNA, 18 bp, Homo sapiens
tgtgcccatcatctctgc

SEQ ID NO: 6545101 - DNA, 21 bp, Homo sapiens
tgtgcccatcatctctgcctt

SEQ ID NO: 6545102 - DNA, 16 bp, Homo sapiens
tgtgcccatttgtcct

SEQ ID NO: 6545103 - DNA, 13 bp, Homo sapiens
tgtgccccaagag

SEQ ID NO: 6545104 - DNA, 19 bp, Homo sapiens
tgtgccccaagaggctagc

SEQ ID NO: 6545105 - DNA, 21 bp, Homo sapiens
tgtgccccactccagcctggg

SEQ ID NO: 6545106 - DNA, 22 bp, Homo sapiens
tgtgccccactccagcctgggg

SEQ ID NO: 6545107 - DNA, 14 bp, Homo sapiens
tgtgccccatgcct

SEQ ID NO: 6545108 - DNA, 13 bp, Homo sapiens
tgtgcccccaccc

SEQ ID NO: 6545109 - DNA, 22 bp, Homo sapiens
tgtgcccccacccccaccctcg

SEQ ID NO: 6545110 - DNA, 17 bp, Homo sapiens
tgtgcccccagcctcag

SEQ ID NO: 6545111 - DNA, 21 bp, Homo sapiens
tgtgcccccatgtaagcaccc

SEQ ID NO: 6545112 - DNA, 15 bp, Homo sapiens
tgtgccccccatcct

SEQ ID NO: 6545113 - DNA, 19 bp, Homo sapiens
tgtgccccccatcctggcc

SEQ ID NO: 6545114 - DNA, 22 bp, Homo sapiens
tgtgccccccatcctggcccat

SEQ ID NO: 6545115 - DNA, 23 bp, Homo sapiens
tgtgccccccatcctggcccatc

SEQ ID NO: 6545116 - DNA, 22 bp, Homo sapiens
tgtgcccccctcctccccgcgc

SEQ ID NO: 6545117 - DNA, 22 bp, Homo sapiens
tgtgccccctcccaccctgcgg

SEQ ID NO: 6545118 - DNA, 13 bp, Homo sapiens
tgtgccccctctg

SEQ ID NO: 6545119 - DNA, 22 bp, Homo sapiens
tgtgccccgcctcccggggtgc

SEQ ID NO: 6545120 - DNA, 22 bp, Homo sapiens
tgtgcccctaaagagcatcctg

SEQ ID NO: 6545121 - DNA, 17 bp, Homo sapiens
tgtgcccctcctgggtg

SEQ ID NO: 6545122 - DNA, 12 bp, Homo sapiens
tgtgcccctgcc

SEQ ID NO: 6545123 - DNA, 14 bp, Homo sapiens
tgtgcccctgccaa

SEQ ID NO: 6545124 - DNA, 23 bp, Homo sapiens
tgtgcccctggcccatctcagcc

SEQ ID NO: 6545125 - DNA, 14 bp, Homo sapiens
tgtgccccttcccc

SEQ ID NO: 6545126 - DNA, 15 bp, Homo sapiens
tgtgccccttcccca

SEQ ID NO: 6545127 - DNA, 18 bp, Homo sapiens
tgtgccccttccccatgc

SEQ ID NO: 6545128 - DNA, 18 bp, Homo sapiens
tgtgccccttccgccact

SEQ ID NO: 6545129 - DNA, 21 bp, Homo sapiens
ttgatggtcagacacaaacaa

SEQ ID NO: 6545130 - DNA, 21 bp, Homo sapiens
ttgatggtgacagctgcaagc

SEQ ID NO: 6545131 - DNA, 21 bp, Homo sapiens
ttgatgtaaaatcttgtcatg

SEQ ID NO: 6545132 - DNA, 18 bp, Homo sapiens
ttgatgtacagaacacaa

SEQ ID NO: 6545133 - DNA, 20 bp, Homo sapiens
ttgatgtacataactcctgt

SEQ ID NO: 6545134 - DNA, 16 bp, Homo sapiens
ttgatgtacatgtgta

SEQ ID NO: 6545135 - DNA, 15 bp, Homo sapiens
ttgatgtacattaca

SEQ ID NO: 6545136 - DNA, 14 bp, Homo sapiens
ttgatgtatatgtt

SEQ ID NO: 6545137 - DNA, 20 bp, Homo sapiens
ttgatgtatctgagttgcca

SEQ ID NO: 6545138 - DNA, 20 bp, Homo sapiens
ttgatgtatggtatctttag

SEQ ID NO: 6545139 - DNA, 12 bp, Homo sapiens
ttgatgtatgtg

SEQ ID NO: 6545140 - DNA, 15 bp, Homo sapiens
ttgatgtatgtgtga

SEQ ID NO: 6545141 - DNA, 19 bp, Homo sapiens
ttgatgtattattatatat

SEQ ID NO: 6545142 - DNA, 16 bp, Homo sapiens
ttgatgtcagccttgc

SEQ ID NO: 6545143 - DNA, 16 bp, Homo sapiens
ttgatgtccccaaagt

SEQ ID NO: 6545144 - DNA, 21 bp, Homo sapiens
ttgatgtcgatgctcactgct

SEQ ID NO: 6545145 - DNA, 17 bp, Homo sapiens
ttgatgtgaagataatt

SEQ ID NO: 6545146 - DNA, 20 bp, Homo sapiens
ttgatgtgcgtgctgtctgt

SEQ ID NO: 6545147 - DNA, 18 bp, Homo sapiens
ttgatgtggccctggctg

SEQ ID NO: 6545148 - DNA, 13 bp, Homo sapiens
ttgatgtgtcttt

SEQ ID NO: 6545149 - DNA, 13 bp, Homo sapiens
ttgatgtgttgtt

SEQ ID NO: 6545150 - DNA, 11 bp, Homo sapiens
ttgatgtgttt

SEQ ID NO: 6545151 - DNA, 15 bp, Homo sapiens
ttgatgttacagatt

SEQ ID NO: 6545152 - DNA, 20 bp, Homo sapiens
ttgatgttcagagtggctca

SEQ ID NO: 6545153 - DNA, 20 bp, Homo sapiens
ttgatgttccacctgccaca

SEQ ID NO: 6545154 - DNA, 14 bp, Homo sapiens
ttgatgttgatgca

SEQ ID NO: 6545155 - DNA, 15 bp, Homo sapiens
ttgatgttgatgcaa

SEQ ID NO: 6545156 - DNA, 16 bp, Homo sapiens
ttgatgtttaagtgtt

SEQ ID NO: 6545157 - DNA, 12 bp, Homo sapiens
ttgatgtttaga

SEQ ID NO: 6545158 - DNA, 14 bp, Homo sapiens
ttgatgtttccaga

SEQ ID NO: 6545159 - DNA, 16 bp, Homo sapiens
ttgatgtttccagaaa

SEQ ID NO: 6545160 - DNA, 17 bp, Homo sapiens
ttgatgtttcctggaag

SEQ ID NO: 6545161 - DNA, 13 bp, Homo sapiens
ttgatgtttcctt

SEQ ID NO: 6545162 - DNA, 18 bp, Homo sapiens
ttgatgtttgtggcctca

SEQ ID NO: 6545163 - DNA, 22 bp, Homo sapiens
ttgatgtttgtggcctcagaat

SEQ ID NO: 6545164 - DNA, 12 bp, Homo sapiens
ttgatgttttct

SEQ ID NO: 6545165 - DNA, 11 bp, Homo sapiens
ttgatgttttt

SEQ ID NO: 6545166 - DNA, 16 bp, Homo sapiens
ttgatgtttttaaagg

SEQ ID NO: 6545167 - DNA, 17 bp, Homo sapiens
ttgattaaaatctcttg

SEQ ID NO: 6545168 - DNA, 21 bp, Homo sapiens
ttgattaaacagcaaagccat

SEQ ID NO: 6545169 - DNA, 14 bp, Homo sapiens
ttgattaaactgta

SEQ ID NO: 6545170 - DNA, 13 bp, Homo sapiens
ttgattaaagatg

SEQ ID NO: 6545171 - DNA, 21 bp, Homo sapiens
ttgattaaattcttgcaaagt

SEQ ID NO: 6545172 - DNA, 14 bp, Homo sapiens
ttgattaacaaata

SEQ ID NO: 6545173 - DNA, 22 bp, Homo sapiens
ttgattaacaatgtattttaat

SEQ ID NO: 6545174 - DNA, 20 bp, Homo sapiens
ttgattaaccttttcaaatt

SEQ ID NO: 6545175 - DNA, 21 bp, Homo sapiens
ttgattaaccttttcaaatta

SEQ ID NO: 6545176 - DNA, 16 bp, Homo sapiens
ttgattaagaaaggaa

SEQ ID NO: 6545177 - DNA, 16 bp, Homo sapiens
ttgattaagattttac

SEQ ID NO: 6545178 - DNA, 14 bp, Homo sapiens
ttgattaaggcagt

SEQ ID NO: 6545179 - DNA, 14 bp, Homo sapiens
ttgattaagtaaat

SEQ ID NO: 6545180 - DNA, 16 bp, Homo sapiens
ttgattaagtatatct

SEQ ID NO: 6545181 - DNA, 19 bp, Homo sapiens
ttgattaatgaagaaagta

SEQ ID NO: 6545182 - DNA, 21 bp, Homo sapiens
ttgattaatgaagaaagtaaa

SEQ ID NO: 6545183 - DNA, 15 bp, Homo sapiens
ttgattaatgtactt

SEQ ID NO: 6545184 - DNA, 16 bp, Homo sapiens
ttgattaatgtttctt

SEQ ID NO: 6545185 - DNA, 14 bp, Homo sapiens
ttgattacagtgca

SEQ ID NO: 6545186 - DNA, 12 bp, Homo sapiens
ttgattacataa

SEQ ID NO: 6545187 - DNA, 23 bp, Homo sapiens
ttgattacataatgttagtagca

SEQ ID NO: 6545188 - DNA, 15 bp, Homo sapiens
ttgattacttccact

SEQ ID NO: 6545189 - DNA, 16 bp, Homo sapiens
ttgattagagaccaga

SEQ ID NO: 6545190 - DNA, 17 bp, Homo sapiens
ttgattagtataatatt

SEQ ID NO: 6545191 - DNA, 21 bp, Homo sapiens
ttgattagtataatatttctt

SEQ ID NO: 6545192 - DNA, 19 bp, Homo sapiens
ttgattagtgtagtgttaa

SEQ ID NO: 6545193 - DNA, 14 bp, Homo sapiens
ttgattatcttcag

SEQ ID NO: 6545194 - DNA, 17 bp, Homo sapiens
ttgattatgtacctttt

SEQ ID NO: 6545195 - DNA, 21 bp, Homo sapiens
ttgattatgtatggatatatt

SEQ ID NO: 6545196 - DNA, 15 bp, Homo sapiens
ttgattattcagtgt

SEQ ID NO: 6545197 - DNA, 17 bp, Homo sapiens
ttgattattcagtgtca

SEQ ID NO: 6545198 - DNA, 12 bp, Homo sapiens
ttgattattctg

SEQ ID NO: 6545199 - DNA, 13 bp, Homo sapiens
ttgattatttcct

SEQ ID NO: 6545200 - DNA, 13 bp, Homo sapiens
ttgattatttgca

SEQ ID NO: 6545201 - DNA, 14 bp, Homo sapiens
ttgattatttgcat

SEQ ID NO: 6545202 - DNA, 20 bp, Homo sapiens
ttgattcagctcattatgaa

SEQ ID NO: 6545203 - DNA, 22 bp, Homo sapiens
ttgattcagctcattatgaaaa

SEQ ID NO: 6545204 - DNA, 13 bp, Homo sapiens
ttgattcataatg

SEQ ID NO: 6545205 - DNA, 12 bp, Homo sapiens
ttgattcatatt

SEQ ID NO: 6545206 - DNA, 14 bp, Homo sapiens
ttgattcatctctg

SEQ ID NO: 6545207 - DNA, 15 bp, Homo sapiens
ttgattcatgttcat

SEQ ID NO: 6545208 - DNA, 13 bp, Homo sapiens
ttgattccaacag

SEQ ID NO: 6545209 - DNA, 16 bp, Homo sapiens
ttgattccattttaag

SEQ ID NO: 6545210 - DNA, 12 bp, Homo sapiens
ttgattcctggt

SEQ ID NO: 6545211 - DNA, 22 bp, Homo sapiens
ttgattcgtatgatcagtactg

SEQ ID NO: 6545212 - DNA, 16 bp, Homo sapiens
ttgattctaaatagcg

SEQ ID NO: 6545213 - DNA, 22 bp, Homo sapiens
ttgattctgtcccccacgtgga

SEQ ID NO: 6545214 - DNA, 12 bp, Homo sapiens
ttgattcttcct

SEQ ID NO: 6545215 - DNA, 14 bp, Homo sapiens
ttgattgaaaaaag

SEQ ID NO: 6545216 - DNA, 19 bp, Homo sapiens
ttgattgaagtattcaatc

SEQ ID NO: 6545217 - DNA, 16 bp, Homo sapiens
ttgattgatgtacaga

SEQ ID NO: 6545218 - DNA, 15 bp, Homo sapiens
ttgattgcgagaatt

SEQ ID NO: 6545219 - DNA, 13 bp, Homo sapiens
ttgattgctaaat

SEQ ID NO: 6545220 - DNA, 20 bp, Homo sapiens
ttgattgctaaatgtaacag

SEQ ID NO: 6545221 - DNA, 23 bp, Homo sapiens
ttgattgctaaatgtaacagtct

SEQ ID NO: 6545222 - DNA, 16 bp, Homo sapiens
ttgattgctttgctgc

SEQ ID NO: 6545223 - DNA, 20 bp, Homo sapiens
ttgattgctttgctgcacag

SEQ ID NO: 6545224 - DNA, 19 bp, Homo sapiens
ttgattgggaaaacatttg

SEQ ID NO: 6545225 - DNA, 22 bp, Homo sapiens
ttgattgggaaaacatttgctg

SEQ ID NO: 6545226 - DNA, 16 bp, Homo sapiens
ttgattgggcacatca

SEQ ID NO: 6545227 - DNA, 17 bp, Homo sapiens
ttgattgggcacatcat

SEQ ID NO: 6545228 - DNA, 17 bp, Homo sapiens
ttgattgtaaaaacaaa

SEQ ID NO: 6545229 - DNA, 12 bp, Homo sapiens
ttgattgtataa

SEQ ID NO: 6545230 - DNA, 15 bp, Homo sapiens
ttgattgtcagctac

SEQ ID NO: 6545231 - DNA, 21 bp, Homo sapiens
ttgattgtcagctactaatga

SEQ ID NO: 6545232 - DNA, 19 bp, Homo sapiens
ttgattgtgttgagtgaag

SEQ ID NO: 6545233 - DNA, 20 bp, Homo sapiens
ttgattgttataaaataaca

SEQ ID NO: 6545234 - DNA, 14 bp, Homo sapiens
ttgattgttcatat

SEQ ID NO: 6545235 - DNA, 20 bp, Homo sapiens
ttgattgttcgggtgtgcaa

SEQ ID NO: 6545236 - DNA, 12 bp, Homo sapiens
ttgattgtttaa

SEQ ID NO: 6545237 - DNA, 18 bp, Homo sapiens
ttgatttaaacacacaga

SEQ ID NO: 6545238 - DNA, 18 bp, Homo sapiens
ttgatttaacttcatttt

SEQ ID NO: 6545239 - DNA, 22 bp, Homo sapiens
ttgatttacagcaagtagataa

SEQ ID NO: 6545240 - DNA, 20 bp, Homo sapiens
ttgatttacctttggaattg

SEQ ID NO: 6545241 - DNA, 20 bp, Homo sapiens
ttgatttataaataacaaaa

SEQ ID NO: 6545242 - DNA, 18 bp, Homo sapiens
ttgatttatatgtgtaat

SEQ ID NO: 6545243 - DNA, 20 bp, Homo sapiens
ttgatttatatgtgtaattt

SEQ ID NO: 6545244 - DNA, 12 bp, Homo sapiens
ttgatttatgca

SEQ ID NO: 6545245 - DNA, 19 bp, Homo sapiens
ttgatttatgcatggaaac

SEQ ID NO: 6545246 - DNA, 15 bp, Homo sapiens
ttgatttatgcttta

SEQ ID NO: 6545247 - DNA, 14 bp, Homo sapiens
ttgatttattaact

SEQ ID NO: 6545248 - DNA, 15 bp, Homo sapiens
ttgatttattaactt

SEQ ID NO: 6545249 - DNA, 17 bp, Homo sapiens
ttgatttattaacttaa

SEQ ID NO: 6545250 - DNA, 22 bp, Homo sapiens
ttgatttattttttaatcattt

SEQ ID NO: 6545251 - DNA, 23 bp, Homo sapiens
ttgatttattttttaatcattta

SEQ ID NO: 6545252 - DNA, 16 bp, Homo sapiens
ttgatttcacatttct

SEQ ID NO: 6545253 - DNA, 19 bp, Homo sapiens
ttgatttcacatttctact

SEQ ID NO: 6545254 - DNA, 15 bp, Homo sapiens
ttgatttccatctta

SEQ ID NO: 6545255 - DNA, 17 bp, Homo sapiens
ttgatttcccttcttct

SEQ ID NO: 6545256 - DNA, 18 bp, Homo sapiens
ttgatttcccttcttctg

SEQ ID NO: 6545257 - DNA, 14 bp, Homo sapiens
ttgatttctaatga

SEQ ID NO: 6545258 - DNA, 13 bp, Homo sapiens
ttgatttgaagaa

SEQ ID NO: 6545259 - DNA, 14 bp, Homo sapiens
ttgatttgaagaac

SEQ ID NO: 6545260 - DNA, 18 bp, Homo sapiens
ttgatttgattgggatga

SEQ ID NO: 6545261 - DNA, 13 bp, Homo sapiens
ttgatttgatttt

SEQ ID NO: 6545262 - DNA, 22 bp, Homo sapiens
ttgatttgcaacactgccaaac

SEQ ID NO: 6545263 - DNA, 16 bp, Homo sapiens
ttgatttgttcttaca

SEQ ID NO: 6545264 - DNA, 18 bp, Homo sapiens
ttgattttaaaaatacat

SEQ ID NO: 6545265 - DNA, 19 bp, Homo sapiens
ttgattttaaaatgtacat

SEQ ID NO: 6545266 - DNA, 14 bp, Homo sapiens
ttgattttaataca

SEQ ID NO: 6545267 - DNA, 15 bp, Homo sapiens
ttgattttaatacat

SEQ ID NO: 6545268 - DNA, 22 bp, Homo sapiens
ttgattttaattactttctgaa

SEQ ID NO: 6545269 - DNA, 14 bp, Homo sapiens
ttgattttaattca

SEQ ID NO: 6545270 - DNA, 19 bp, Homo sapiens
ttgattttaattcaggtga

SEQ ID NO: 6545271 - DNA, 21 bp, Homo sapiens
ttgattttccccctaattctt

SEQ ID NO: 6545272 - DNA, 14 bp, Homo sapiens
ttgattttctggat

SEQ ID NO: 6545273 - DNA, 20 bp, Homo sapiens
ttgatttttacgtttgaaga

SEQ ID NO: 6545274 - DNA, 12 bp, Homo sapiens
ttgatttttatc

SEQ ID NO: 6545275 - DNA, 17 bp, Homo sapiens
ttgatttttctataatc

SEQ ID NO: 6545276 - DNA, 16 bp, Homo sapiens
ttgatttttctcttca

SEQ ID NO: 6545277 - DNA, 14 bp, Homo sapiens
ttgatttttcttct

SEQ ID NO: 6545278 - DNA, 19 bp, Homo sapiens
ttgatttttgtaataaaag

SEQ ID NO: 6545279 - DNA, 16 bp, Homo sapiens
ttgatttttttaaagt

SEQ ID NO: 6545280 - DNA, 19 bp, Homo sapiens
ttgattttttttctctctc

SEQ ID NO: 6545281 - DNA, 23 bp, Homo sapiens
ttgattttttttttcttctaaac

SEQ ID NO: 6545282 - DNA, 19 bp, Homo sapiens
ttgatttttttttttaatc

SEQ ID NO: 6545283 - DNA, 17 bp, Homo sapiens
ttgcaaaaacatagttt

SEQ ID NO: 6545284 - DNA, 15 bp, Homo sapiens
ttgcaaaaactacaa

SEQ ID NO: 6545285 - DNA, 14 bp, Homo sapiens
ttgcaaaacaaaca

SEQ ID NO: 6545286 - DNA, 22 bp, Homo sapiens
ttgcaaaacggatgagttatta

SEQ ID NO: 6545287 - DNA, 14 bp, Homo sapiens
ttgcaaaaggttaa

SEQ ID NO: 6545288 - DNA, 20 bp, Homo sapiens
ttgcaaaaggttaagccata

SEQ ID NO: 6545289 - DNA, 23 bp, Homo sapiens
ttgcaaaatagaagaagaggaag

SEQ ID NO: 6545290 - DNA, 19 bp, Homo sapiens
ttgcaaaatagcatttgtt

SEQ ID NO: 6545291 - DNA, 16 bp, Homo sapiens
ttgcaaaatcagtttt

SEQ ID NO: 6545292 - DNA, 11 bp, Homo sapiens
ttgcaaaattt

SEQ ID NO: 6545293 - DNA, 15 bp, Homo sapiens
ttgcaaaatttccag

SEQ ID NO: 6545294 - DNA, 20 bp, Homo sapiens
ttgcaaacaaaatgatggga

SEQ ID NO: 6545295 - DNA, 21 bp, Homo sapiens
ttgcaaacaattttaatgatg

SEQ ID NO: 6545296 - DNA, 20 bp, Homo sapiens
ttgcaaactatgcatctgag

SEQ ID NO: 6545297 - DNA, 17 bp, Homo sapiens
ttgcaaagaaaattctc

SEQ ID NO: 6545298 - DNA, 16 bp, Homo sapiens
ttgcaaagaccacctc

SEQ ID NO: 6545299 - DNA, 17 bp, Homo sapiens
ttgcaaagaccacctcc

SEQ ID NO: 6545300 - DNA, 22 bp, Homo sapiens
ttgcaaagagacatttcaaaac

SEQ ID NO: 6545301 - DNA, 12 bp, Homo sapiens
ttgcaaagcaac

SEQ ID NO: 6545302 - DNA, 15 bp, Homo sapiens
ttgcaaagcaatgaa

SEQ ID NO: 6545303 - DNA, 18 bp, Homo sapiens
ttgcaaagcctttaaatt

SEQ ID NO: 6545304 - DNA, 12 bp, Homo sapiens
ttgcaaaggaaa

SEQ ID NO: 6545305 - DNA, 13 bp, Homo sapiens
ttgcaaaggactg

SEQ ID NO: 6545306 - DNA, 13 bp, Homo sapiens
ttgcaaagggaca

SEQ ID NO: 6545307 - DNA, 19 bp, Homo sapiens
ttgcaaagggattactaga

SEQ ID NO: 6545308 - DNA, 14 bp, Homo sapiens
ttgcaaagtactgt

SEQ ID NO: 6545309 - DNA, 21 bp, Homo sapiens
ttgcaaagtattgtaaattat

SEQ ID NO: 6545310 - DNA, 16 bp, Homo sapiens
tgtgccccttgacaac

SEQ ID NO: 6545311 - DNA, 23 bp, Homo sapiens
tgtgccccttgacaactggcagg

SEQ ID NO: 6545312 - DNA, 19 bp, Homo sapiens
tgtgcccgcatgtgtgcct

SEQ ID NO: 6545313 - DNA, 15 bp, Homo sapiens
tgtgcccgccctggg

SEQ ID NO: 6545314 - DNA, 23 bp, Homo sapiens
tgtgcccgccctgggctgggccc

SEQ ID NO: 6545315 - DNA, 21 bp, Homo sapiens
tgtgcccgctgcgctgccctg

SEQ ID NO: 6545316 - DNA, 16 bp, Homo sapiens
tgtgccctagggctca

SEQ ID NO: 6545317 - DNA, 18 bp, Homo sapiens
tgtgccctagggctcaga

SEQ ID NO: 6545318 - DNA, 20 bp, Homo sapiens
tgtgccctagggctcagagg

SEQ ID NO: 6545319 - DNA, 13 bp, Homo sapiens
tgtgccctatcac

SEQ ID NO: 6545320 - DNA, 13 bp, Homo sapiens
tgtgccctcaccc

SEQ ID NO: 6545321 - DNA, 15 bp, Homo sapiens
tgtgccctcacccca

SEQ ID NO: 6545322 - DNA, 16 bp, Homo sapiens
tgtgccctcaccccaa

SEQ ID NO: 6545323 - DNA, 12 bp, Homo sapiens
tgtgccctcctg

SEQ ID NO: 6545324 - DNA, 16 bp, Homo sapiens
tgtgccctccttccca

SEQ ID NO: 6545325 - DNA, 14 bp, Homo sapiens
tgtgccctctgggc

SEQ ID NO: 6545326 - DNA, 15 bp, Homo sapiens
tgtgccctctgggct

SEQ ID NO: 6545327 - DNA, 14 bp, Homo sapiens
tgtgccctgaaaat

SEQ ID NO: 6545328 - DNA, 13 bp, Homo sapiens
tgtgccctgcctt

SEQ ID NO: 6545329 - DNA, 15 bp, Homo sapiens
tgtgccctgccttca

SEQ ID NO: 6545330 - DNA, 17 bp, Homo sapiens
tgtgccctgggccaggc

SEQ ID NO: 6545331 - DNA, 20 bp, Homo sapiens
tgtgccctgggccaggcagg

SEQ ID NO: 6545332 - DNA, 21 bp, Homo sapiens
tgtgccctgggccaggcaggc

SEQ ID NO: 6545333 - DNA, 14 bp, Homo sapiens
tgtgccctgtagct

SEQ ID NO: 6545334 - DNA, 13 bp, Homo sapiens
tgtgccctgtgtg

SEQ ID NO: 6545335 - DNA, 15 bp, Homo sapiens
tgtgcccttctctta

SEQ ID NO: 6545336 - DNA, 14 bp, Homo sapiens
tgtgcccttgctgg

SEQ ID NO: 6545337 - DNA, 12 bp, Homo sapiens
tgtgcccttggg

SEQ ID NO: 6545338 - DNA, 16 bp, Homo sapiens
tgtgccgaatgtgcag

SEQ ID NO: 6545339 - DNA, 15 bp, Homo sapiens
tgtgccgacagaagg

SEQ ID NO: 6545340 - DNA, 15 bp, Homo sapiens
tgtgccgcactctgg

SEQ ID NO: 6545341 - DNA, 17 bp, Homo sapiens
tgtgccgctgccacccg

SEQ ID NO: 6545342 - DNA, 17 bp, Homo sapiens
tgtgccgtcgtaggtat

SEQ ID NO: 6545343 - DNA, 19 bp, Homo sapiens
tgtgccgtctttggttcct

SEQ ID NO: 6545344 - DNA, 12 bp, Homo sapiens
tgtgcctaataa

SEQ ID NO: 6545345 - DNA, 16 bp, Homo sapiens
tgtgcctacctggccg

SEQ ID NO: 6545346 - DNA, 18 bp, Homo sapiens
tgtgcctacctggccgca

SEQ ID NO: 6545347 - DNA, 16 bp, Homo sapiens
tgtgcctataatccca

SEQ ID NO: 6545348 - DNA, 20 bp, Homo sapiens
tgtgcctatgagcacaaact

SEQ ID NO: 6545349 - DNA, 16 bp, Homo sapiens
tgtgcctcagagacca

SEQ ID NO: 6545350 - DNA, 11 bp, Homo sapiens
tgtgcctcagc

SEQ ID NO: 6545351 - DNA, 23 bp, Homo sapiens
tgtgcctcccaagctcagagcag

SEQ ID NO: 6545352 - DNA, 15 bp, Homo sapiens
tgtgcctccccccag

SEQ ID NO: 6545353 - DNA, 18 bp, Homo sapiens
tgtgcctccccccagacc

SEQ ID NO: 6545354 - DNA, 21 bp, Homo sapiens
tgtgcctcccccgccacctgt

SEQ ID NO: 6545355 - DNA, 16 bp, Homo sapiens
tgtgcctccctctcct

SEQ ID NO: 6545356 - DNA, 16 bp, Homo sapiens
tgtgcctccctggtga

SEQ ID NO: 6545357 - DNA, 18 bp, Homo sapiens
tgtgcctcccttcccagt

SEQ ID NO: 6545358 - DNA, 13 bp, Homo sapiens
tgtgcctcctccc

SEQ ID NO: 6545359 - DNA, 14 bp, Homo sapiens
tgtgcctcctccct

SEQ ID NO: 6545360 - DNA, 15 bp, Homo sapiens
tgtgcctcctccctc

SEQ ID NO: 6545361 - DNA, 21 bp, Homo sapiens
tgtgcctcctccctccctctc

SEQ ID NO: 6545362 - DNA, 11 bp, Homo sapiens
tgtgcctcctg

SEQ ID NO: 6545363 - DNA, 16 bp, Homo sapiens
tgtgcctcggcctccc

SEQ ID NO: 6545364 - DNA, 16 bp, Homo sapiens
tgtgcctctcatcttt

SEQ ID NO: 6545365 - DNA, 13 bp, Homo sapiens
tgtgcctctctct

SEQ ID NO: 6545366 - DNA, 12 bp, Homo sapiens
tgtgcctctgcg

SEQ ID NO: 6545367 - DNA, 15 bp, Homo sapiens
tgtgcctctgtcctt

SEQ ID NO: 6545368 - DNA, 16 bp, Homo sapiens
tgtgcctctgtcctta

SEQ ID NO: 6545369 - DNA, 18 bp, Homo sapiens
tgtgcctcttgggagacg

SEQ ID NO: 6545370 - DNA, 14 bp, Homo sapiens
tgtgcctgcaccag

SEQ ID NO: 6545371 - DNA, 23 bp, Homo sapiens
tgtgcctgccatgggccagccta

SEQ ID NO: 6545372 - DNA, 12 bp, Homo sapiens
tgtgcctgccct

SEQ ID NO: 6545373 - DNA, 22 bp, Homo sapiens
tgtgcctgccctggagggaggc

SEQ ID NO: 6545374 - DNA, 13 bp, Homo sapiens
tgtgcctgctaga

SEQ ID NO: 6545375 - DNA, 17 bp, Homo sapiens
tgtgcctgctagagcaa

SEQ ID NO: 6545376 - DNA, 19 bp, Homo sapiens
tgtgcctgctagagcaacc

SEQ ID NO: 6545377 - DNA, 19 bp, Homo sapiens
tgtgcctgctcagcagcca

SEQ ID NO: 6545378 - DNA, 21 bp, Homo sapiens
tgtgcctgctgggcactgggc

SEQ ID NO: 6545379 - DNA, 23 bp, Homo sapiens
tgtgcctgcttcagcctcccaca

SEQ ID NO: 6545380 - DNA, 13 bp, Homo sapiens
tgtgcctgcttct

SEQ ID NO: 6545381 - DNA, 13 bp, Homo sapiens
tgtgcctggcctc

SEQ ID NO: 6545382 - DNA, 15 bp, Homo sapiens
tgtgcctggcctctg

SEQ ID NO: 6545383 - DNA, 13 bp, Homo sapiens
tgtgcctggctca

SEQ ID NO: 6545384 - DNA, 16 bp, Homo sapiens
tgtgcctggctccctg

SEQ ID NO: 6545385 - DNA, 17 bp, Homo sapiens
tgtgcctggctccctga

SEQ ID NO: 6545386 - DNA, 18 bp, Homo sapiens
tgtgcctggctccctgat

SEQ ID NO: 6545387 - DNA, 19 bp, Homo sapiens
tgtgcctggctctgattct

SEQ ID NO: 6545388 - DNA, 22 bp, Homo sapiens
tgtgcctggcttctttctctca

SEQ ID NO: 6545389 - DNA, 21 bp, Homo sapiens
tgtgcctgggatcgtgcattt

SEQ ID NO: 6545390 - DNA, 15 bp, Homo sapiens
tgtgcctgggccctg

SEQ ID NO: 6545391 - DNA, 12 bp, Homo sapiens
tgtgcctggggt

SEQ ID NO: 6545392 - DNA, 15 bp, Homo sapiens
tgtgcctggtagaaa

SEQ ID NO: 6545393 - DNA, 18 bp, Homo sapiens
tgtgcctggttcgtgcca

SEQ ID NO: 6545394 - DNA, 18 bp, Homo sapiens
tgtgcctgtcaggctctg

SEQ ID NO: 6545395 - DNA, 16 bp, Homo sapiens
tgtgcctgtctgtcca

SEQ ID NO: 6545396 - DNA, 21 bp, Homo sapiens
tgtgcctgtctgtccaacccc

SEQ ID NO: 6545397 - DNA, 13 bp, Homo sapiens
tgtgcctgtggca

SEQ ID NO: 6545398 - DNA, 14 bp, Homo sapiens
tgtgcctgtggcag

SEQ ID NO: 6545399 - DNA, 13 bp, Homo sapiens
tgtgccttaaatt

SEQ ID NO: 6545400 - DNA, 11 bp, Homo sapiens
tgtgccttaag

SEQ ID NO: 6545401 - DNA, 13 bp, Homo sapiens
tgtgccttaagtt

SEQ ID NO: 6545402 - DNA, 23 bp, Homo sapiens
tgtgccttcgtctttcccatggg

SEQ ID NO: 6545403 - DNA, 15 bp, Homo sapiens
tgtgccttctttgta

SEQ ID NO: 6545404 - DNA, 19 bp, Homo sapiens
tgtgccttgattgattaga

SEQ ID NO: 6545405 - DNA, 16 bp, Homo sapiens
tgtgccttggtctctc

SEQ ID NO: 6545406 - DNA, 20 bp, Homo sapiens
tgtgccttgtcacgccagac

SEQ ID NO: 6545407 - DNA, 15 bp, Homo sapiens
tgtgccttgtttttt

SEQ ID NO: 6545408 - DNA, 13 bp, Homo sapiens
tgtgcctttcact

SEQ ID NO: 6545409 - DNA, 12 bp, Homo sapiens
tgtgcctttcct

SEQ ID NO: 6545410 - DNA, 12 bp, Homo sapiens
tgtgcctttctt

SEQ ID NO: 6545411 - DNA, 13 bp, Homo sapiens
tgtgcctttcttt

SEQ ID NO: 6545412 - DNA, 19 bp, Homo sapiens
tgtgcctttctttgcctct

SEQ ID NO: 6545413 - DNA, 16 bp, Homo sapiens
tgtgcctttgcaaatc

SEQ ID NO: 6545414 - DNA, 16 bp, Homo sapiens
tgtgccttttgccatc

SEQ ID NO: 6545415 - DNA, 14 bp, Homo sapiens
tgtgcgaacacagt

SEQ ID NO: 6545416 - DNA, 13 bp, Homo sapiens
tgtgcgagtctga

SEQ ID NO: 6545417 - DNA, 19 bp, Homo sapiens
tgtgcgcataggcctgctt

SEQ ID NO: 6545418 - DNA, 22 bp, Homo sapiens
tgtgcgcataggcctgctttgt

SEQ ID NO: 6545419 - DNA, 17 bp, Homo sapiens
tgtgcgcctgagtgagt

SEQ ID NO: 6545420 - DNA, 22 bp, Homo sapiens
tgtgcgcctgagtgagtgtgtg

SEQ ID NO: 6545421 - DNA, 22 bp, Homo sapiens
tgtgcgctaaacttttctgata

SEQ ID NO: 6545422 - DNA, 13 bp, Homo sapiens
tgtgcggaattca

SEQ ID NO: 6545423 - DNA, 15 bp, Homo sapiens
tgtgcggagcagcct

SEQ ID NO: 6545424 - DNA, 21 bp, Homo sapiens
tgtgcggagcgggaggcggtg

SEQ ID NO: 6545425 - DNA, 14 bp, Homo sapiens
tgtgcggaggcagg

SEQ ID NO: 6545426 - DNA, 18 bp, Homo sapiens
tgtgcggctccagcccag

SEQ ID NO: 6545427 - DNA, 20 bp, Homo sapiens
tgtgcgtatgcagtgtagat

SEQ ID NO: 6545428 - DNA, 17 bp, Homo sapiens
tgtgcgtcccagctgaa

SEQ ID NO: 6545429 - DNA, 14 bp, Homo sapiens
tgtgcgtctctctt

SEQ ID NO: 6545430 - DNA, 19 bp, Homo sapiens
tgtgcgtctctctttctcc

SEQ ID NO: 6545431 - DNA, 24 bp, Homo sapiens
tgtgcgtctctctttctccctcac

SEQ ID NO: 6545432 - DNA, 15 bp, Homo sapiens
tgtgcgtgaaacaca

SEQ ID NO: 6545433 - DNA, 15 bp, Homo sapiens
tgtgcgtgcatgtgc

SEQ ID NO: 6545434 - DNA, 22 bp, Homo sapiens
tgtgcgtgcgtgttagtgtgtg

SEQ ID NO: 6545435 - DNA, 19 bp, Homo sapiens
tgtgcgtgctgtctgtcct

SEQ ID NO: 6545436 - DNA, 18 bp, Homo sapiens
tgtgcgtggaagtgttcc

SEQ ID NO: 6545437 - DNA, 20 bp, Homo sapiens
tgtgcgtggaagtgttcctg

SEQ ID NO: 6545438 - DNA, 21 bp, Homo sapiens
tgtgcgtggaagtgttcctgt

SEQ ID NO: 6545439 - DNA, 22 bp, Homo sapiens
tgtgcgtggaagtgttcctgtc

SEQ ID NO: 6545440 - DNA, 16 bp, Homo sapiens
tgtgcgtggtccgtgt

SEQ ID NO: 6545441 - DNA, 22 bp, Homo sapiens
tgtgcgtggtggtccctgggta

SEQ ID NO: 6545442 - DNA, 21 bp, Homo sapiens
tgtgcgtgtgtccatgtgtgt

SEQ ID NO: 6545443 - DNA, 15 bp, Homo sapiens
tgtgcgtgttccttt

SEQ ID NO: 6545444 - DNA, 16 bp, Homo sapiens
tgtgctaaaccaagtt

SEQ ID NO: 6545445 - DNA, 14 bp, Homo sapiens
tgtgctaaatatca

SEQ ID NO: 6545446 - DNA, 19 bp, Homo sapiens
tgtgctaatttctgtccag

SEQ ID NO: 6545447 - DNA, 12 bp, Homo sapiens
tgtgctacagaa

SEQ ID NO: 6545448 - DNA, 15 bp, Homo sapiens
tgtgctacagagaaa

SEQ ID NO: 6545449 - DNA, 20 bp, Homo sapiens
tgtgctacagagaaaatcaa

SEQ ID NO: 6545450 - DNA, 14 bp, Homo sapiens
tgtgctacagatga

SEQ ID NO: 6545451 - DNA, 17 bp, Homo sapiens
tgtgctacaggggccag

SEQ ID NO: 6545452 - DNA, 21 bp, Homo sapiens
tgtgctacctctaacaccaca

SEQ ID NO: 6545453 - DNA, 14 bp, Homo sapiens
tgtgctacgtgtga

SEQ ID NO: 6545454 - DNA, 14 bp, Homo sapiens
tgtgctactaacag

SEQ ID NO: 6545455 - DNA, 16 bp, Homo sapiens
tgtgctactaacagat

SEQ ID NO: 6545456 - DNA, 17 bp, Homo sapiens
tgtgctactgattgttt

SEQ ID NO: 6545457 - DNA, 21 bp, Homo sapiens
tgtgctactgtctttggaaaa

SEQ ID NO: 6545458 - DNA, 15 bp, Homo sapiens
tgtgctactttgcct

SEQ ID NO: 6545459 - DNA, 20 bp, Homo sapiens
tgtgctagaaattttcaaga

SEQ ID NO: 6545460 - DNA, 14 bp, Homo sapiens
tgtgctagaagctc

SEQ ID NO: 6545461 - DNA, 14 bp, Homo sapiens
tgtgctagaatact

SEQ ID NO: 6545462 - DNA, 13 bp, Homo sapiens
tgtgctagatgtg

SEQ ID NO: 6545463 - DNA, 20 bp, Homo sapiens
tgtgctagggaaacttcccg

SEQ ID NO: 6545464 - DNA, 17 bp, Homo sapiens
tgtgctaggtctgacca

SEQ ID NO: 6545465 - DNA, 18 bp, Homo sapiens
tgtgctaggtctgaccaa

SEQ ID NO: 6545466 - DNA, 22 bp, Homo sapiens
tgtgctaggtctgaccaaaacc

SEQ ID NO: 6545467 - DNA, 16 bp, Homo sapiens
tgtgctagtcactggc

SEQ ID NO: 6545468 - DNA, 15 bp, Homo sapiens
tgtgctataaatcct

SEQ ID NO: 6545469 - DNA, 18 bp, Homo sapiens
tgtgctatactgcatact

SEQ ID NO: 6545470 - DNA, 18 bp, Homo sapiens
tgtgctatagtatttgat

SEQ ID NO: 6545471 - DNA, 19 bp, Homo sapiens
tgtgctatagtgtatacca

SEQ ID NO: 6545472 - DNA, 14 bp, Homo sapiens
tgtgctatgaattt

SEQ ID NO: 6545473 - DNA, 16 bp, Homo sapiens
tgtgctatggagagga

SEQ ID NO: 6545474 - DNA, 17 bp, Homo sapiens
tgtgctattaatatttg

SEQ ID NO: 6545475 - DNA, 22 bp, Homo sapiens
tgtgctattcgtaagttctgtg

SEQ ID NO: 6545476 - DNA, 17 bp, Homo sapiens
tgtgctattgaactgag

SEQ ID NO: 6545477 - DNA, 15 bp, Homo sapiens
tgtgctatttgtaca

SEQ ID NO: 6545478 - DNA, 16 bp, Homo sapiens
tgtgctatttgtacaa

SEQ ID NO: 6545479 - DNA, 18 bp, Homo sapiens
tgtgctatttgtacaaat

SEQ ID NO: 6545480 - DNA, 21 bp, Homo sapiens
tgtgctcaaattactaatgat

SEQ ID NO: 6545481 - DNA, 17 bp, Homo sapiens
tgtgctcaaccagacag

SEQ ID NO: 6545482 - DNA, 19 bp, Homo sapiens
tgtgctcaaccagacagat

SEQ ID NO: 6545483 - DNA, 18 bp, Homo sapiens
tgtgctcacccattgtct

SEQ ID NO: 6545484 - DNA, 15 bp, Homo sapiens
tgtgctcagaagggc

SEQ ID NO: 6545485 - DNA, 19 bp, Homo sapiens
tgtgctcagcagccccacc

SEQ ID NO: 6545486 - DNA, 13 bp, Homo sapiens
tgtgctcagccaa

SEQ ID NO: 6545487 - DNA, 12 bp, Homo sapiens
tgtgctcagccc

SEQ ID NO: 6545488 - DNA, 16 bp, Homo sapiens
tgtgctcaggagccct

SEQ ID NO: 6545489 - DNA, 17 bp, Homo sapiens
tgtgctcaggagccctg

SEQ ID NO: 6545490 - DNA, 16 bp, Homo sapiens
tgtgctcagtcgccct

SEQ ID NO: 6545491 - DNA, 17 bp, Homo sapiens
tgtgctcagtcgccctg

SEQ ID NO: 6545492 - DNA, 18 bp, Homo sapiens
ttgcaaagttacagatgc

SEQ ID NO: 6545493 - DNA, 19 bp, Homo sapiens
ttgcaaataacttacaaga

SEQ ID NO: 6545494 - DNA, 16 bp, Homo sapiens
ttgcaaatcagtgttt

SEQ ID NO: 6545495 - DNA, 15 bp, Homo sapiens
ttgcaaatcttgaaa

SEQ ID NO: 6545496 - DNA, 17 bp, Homo sapiens
ttgcaaatcttgaaatt

SEQ ID NO: 6545497 - DNA, 18 bp, Homo sapiens
ttgcaaatgagggaagaa

SEQ ID NO: 6545498 - DNA, 15 bp, Homo sapiens
ttgcaaattattcta

SEQ ID NO: 6545499 - DNA, 20 bp, Homo sapiens
ttgcaaattattctagtcaa

SEQ ID NO: 6545500 - DNA, 20 bp, Homo sapiens
ttgcaaattccacccctcct

SEQ ID NO: 6545501 - DNA, 17 bp, Homo sapiens
ttgcaaatttgtaaact

SEQ ID NO: 6545502 - DNA, 13 bp, Homo sapiens
ttgcaacaaaata

SEQ ID NO: 6545503 - DNA, 18 bp, Homo sapiens
ttgcaacaataataaatg

SEQ ID NO: 6545504 - DNA, 14 bp, Homo sapiens
ttgcaacaatgcaa

SEQ ID NO: 6545505 - DNA, 19 bp, Homo sapiens
ttgcaacaggggaggaaaa

SEQ ID NO: 6545506 - DNA, 21 bp, Homo sapiens
ttgcaacaggggaggaaaaaa

SEQ ID NO: 6545507 - DNA, 17 bp, Homo sapiens
ttgcaacatataaagta

SEQ ID NO: 6545508 - DNA, 13 bp, Homo sapiens
ttgcaacatatta

SEQ ID NO: 6545509 - DNA, 12 bp, Homo sapiens
ttgcaaccactg

SEQ ID NO: 6545510 - DNA, 13 bp, Homo sapiens
ttgcaaccaggca

SEQ ID NO: 6545511 - DNA, 14 bp, Homo sapiens
ttgcaaccaggcag

SEQ ID NO: 6545512 - DNA, 17 bp, Homo sapiens
ttgcaaccaggcagctg

SEQ ID NO: 6545513 - DNA, 21 bp, Homo sapiens
ttgcaaccttgtactttacaa

SEQ ID NO: 6545514 - DNA, 14 bp, Homo sapiens
ttgcaacgtttaca

SEQ ID NO: 6545515 - DNA, 16 bp, Homo sapiens
ttgcaactaaggacaa

SEQ ID NO: 6545516 - DNA, 18 bp, Homo sapiens
ttgcaactaaggacaaat

SEQ ID NO: 6545517 - DNA, 20 bp, Homo sapiens
ttgcaactaaggacaaatta

SEQ ID NO: 6545518 - DNA, 20 bp, Homo sapiens
ttgcaactaggtatttctaa

SEQ ID NO: 6545519 - DNA, 23 bp, Homo sapiens
ttgcaacttcagttttatttttg

SEQ ID NO: 6545520 - DNA, 18 bp, Homo sapiens
ttgcaactttgtataaaa

SEQ ID NO: 6545521 - DNA, 21 bp, Homo sapiens
ttgcaagaatgaaatgaatga

SEQ ID NO: 6545522 - DNA, 18 bp, Homo sapiens
ttgcaagactcgaataaa

SEQ ID NO: 6545523 - DNA, 14 bp, Homo sapiens
ttgcaagatgtgaa

SEQ ID NO: 6545524 - DNA, 23 bp, Homo sapiens
ttgcaagatgtgaattattgaca

SEQ ID NO: 6545525 - DNA, 22 bp, Homo sapiens
ttgcaagcaaatcccatttctt

SEQ ID NO: 6545526 - DNA, 17 bp, Homo sapiens
ttgcaagcaacaagcta

SEQ ID NO: 6545527 - DNA, 19 bp, Homo sapiens
ttgcaagcatgcttgtgaa

SEQ ID NO: 6545528 - DNA, 12 bp, Homo sapiens
ttgcaagccata

SEQ ID NO: 6545529 - DNA, 17 bp, Homo sapiens
ttgcaagctccagtagc

SEQ ID NO: 6545530 - DNA, 22 bp, Homo sapiens
ttgcaaggatttttccatgtgt

SEQ ID NO: 6545531 - DNA, 16 bp, Homo sapiens
ttgcaaggcagtctct

SEQ ID NO: 6545532 - DNA, 17 bp, Homo sapiens
ttgcaaggctgatttat

SEQ ID NO: 6545533 - DNA, 19 bp, Homo sapiens
ttgcaagggaatgaatcca

SEQ ID NO: 6545534 - DNA, 21 bp, Homo sapiens
ttgcaaggtcactttgcgtgt

SEQ ID NO: 6545535 - DNA, 19 bp, Homo sapiens
ttgcaaggtgtgatggtct

SEQ ID NO: 6545536 - DNA, 15 bp, Homo sapiens
ttgcaaggttccaca

SEQ ID NO: 6545537 - DNA, 14 bp, Homo sapiens
ttgcaagtgctgga

SEQ ID NO: 6545538 - DNA, 13 bp, Homo sapiens
ttgcaataaaata

SEQ ID NO: 6545539 - DNA, 14 bp, Homo sapiens
ttgcaataaaatag

SEQ ID NO: 6545540 - DNA, 22 bp, Homo sapiens
ttgcaataaaatagtattgaaa

SEQ ID NO: 6545541 - DNA, 14 bp, Homo sapiens
ttgcaataacagct

SEQ ID NO: 6545542 - DNA, 14 bp, Homo sapiens
ttgcaataacttct

SEQ ID NO: 6545543 - DNA, 14 bp, Homo sapiens
ttgcaataatactt

SEQ ID NO: 6545544 - DNA, 21 bp, Homo sapiens
ttgcaatagcagttataacag

SEQ ID NO: 6545545 - DNA, 18 bp, Homo sapiens
ttgcaatcccttaatatc

SEQ ID NO: 6545546 - DNA, 17 bp, Homo sapiens
ttgcaatctaatctgaa

SEQ ID NO: 6545547 - DNA, 13 bp, Homo sapiens
ttgcaatgaagga

SEQ ID NO: 6545548 - DNA, 23 bp, Homo sapiens
ttgcaatgcttttatatggccca

SEQ ID NO: 6545549 - DNA, 16 bp, Homo sapiens
ttgcaatggcagcctt

SEQ ID NO: 6545550 - DNA, 17 bp, Homo sapiens
ttgcaatggcagccttg

SEQ ID NO: 6545551 - DNA, 14 bp, Homo sapiens
ttgcaattattcta

SEQ ID NO: 6545552 - DNA, 13 bp, Homo sapiens
ttgcaattcatgt

SEQ ID NO: 6545553 - DNA, 15 bp, Homo sapiens
ttgcaattcatgtaa

SEQ ID NO: 6545554 - DNA, 18 bp, Homo sapiens
ttgcaattcatgtaacag

SEQ ID NO: 6545555 - DNA, 21 bp, Homo sapiens
ttgcaattgtttaagaatcat

SEQ ID NO: 6545556 - DNA, 23 bp, Homo sapiens
ttgcaatttgagccatttaaaga

SEQ ID NO: 6545557 - DNA, 15 bp, Homo sapiens
ttgcacaaaaagata

SEQ ID NO: 6545558 - DNA, 20 bp, Homo sapiens
ttgcacaaaaagcacaagca

SEQ ID NO: 6545559 - DNA, 24 bp, Homo sapiens
ttgcacaaacttgtgagcatcaga

SEQ ID NO: 6545560 - DNA, 18 bp, Homo sapiens
ttgcacaagttccctgga

SEQ ID NO: 6545561 - DNA, 18 bp, Homo sapiens
ttgcacaatatttctttt

SEQ ID NO: 6545562 - DNA, 20 bp, Homo sapiens
ttgcacaatatttcttttgt

SEQ ID NO: 6545563 - DNA, 21 bp, Homo sapiens
ttgcacaatatttcttttgtt

SEQ ID NO: 6545564 - DNA, 23 bp, Homo sapiens
ttgcacaatcaataaaaatggca

SEQ ID NO: 6545565 - DNA, 15 bp, Homo sapiens
ttgcacaattataaa

SEQ ID NO: 6545566 - DNA, 19 bp, Homo sapiens
ttgcacaatttgagcaatt

SEQ ID NO: 6545567 - DNA, 22 bp, Homo sapiens
ttgcacaatttgagcaattcat

SEQ ID NO: 6545568 - DNA, 16 bp, Homo sapiens
ttgcacacactttcat

SEQ ID NO: 6545569 - DNA, 16 bp, Homo sapiens
ttgcacacagatgtga

SEQ ID NO: 6545570 - DNA, 15 bp, Homo sapiens
ttgcacacatcatct

SEQ ID NO: 6545571 - DNA, 18 bp, Homo sapiens
ttgcacacatcatctgta

SEQ ID NO: 6545572 - DNA, 20 bp, Homo sapiens
ttgcacacatcatctgtaag

SEQ ID NO: 6545573 - DNA, 18 bp, Homo sapiens
ttgcacacattggccgct

SEQ ID NO: 6545574 - DNA, 22 bp, Homo sapiens
ttgcacaccattttgtaaatga

SEQ ID NO: 6545575 - DNA, 19 bp, Homo sapiens
ttgcacacccactcagctc

SEQ ID NO: 6545576 - DNA, 17 bp, Homo sapiens
ttgcacactcccctgca

SEQ ID NO: 6545577 - DNA, 13 bp, Homo sapiens
ttgcacacttgtg

SEQ ID NO: 6545578 - DNA, 21 bp, Homo sapiens
ttgcacagaagtcctgtatgt

SEQ ID NO: 6545579 - DNA, 15 bp, Homo sapiens
ttgcacagcatctca

SEQ ID NO: 6545580 - DNA, 19 bp, Homo sapiens
ttgcacagccaaatttaaa

SEQ ID NO: 6545581 - DNA, 20 bp, Homo sapiens
ttgcacagctggagaaatgg

SEQ ID NO: 6545582 - DNA, 22 bp, Homo sapiens
ttgcacaggccacttgctcaga

SEQ ID NO: 6545583 - DNA, 13 bp, Homo sapiens
ttgcacagggatt

SEQ ID NO: 6545584 - DNA, 20 bp, Homo sapiens
ttgcacaggttttcagcaac

SEQ ID NO: 6545585 - DNA, 22 bp, Homo sapiens
ttgcacagtgatatatttctat

SEQ ID NO: 6545586 - DNA, 15 bp, Homo sapiens
ttgcacatatatttt

SEQ ID NO: 6545587 - DNA, 16 bp, Homo sapiens
ttgcacatatttgaat

SEQ ID NO: 6545588 - DNA, 14 bp, Homo sapiens
ttgcacatcattca

SEQ ID NO: 6545589 - DNA, 16 bp, Homo sapiens
ttgcacatcattcatt

SEQ ID NO: 6545590 - DNA, 17 bp, Homo sapiens
ttgcacatcattcattc

SEQ ID NO: 6545591 - DNA, 20 bp, Homo sapiens
ttgcacatcattcattcact

SEQ ID NO: 6545592 - DNA, 13 bp, Homo sapiens
ttgcacatctctg

SEQ ID NO: 6545593 - DNA, 18 bp, Homo sapiens
ttgcacatgattgtataa

SEQ ID NO: 6545594 - DNA, 19 bp, Homo sapiens
ttgcacatggattcagttt

SEQ ID NO: 6545595 - DNA, 20 bp, Homo sapiens
ttgcacatggattgattaaa

SEQ ID NO: 6545596 - DNA, 22 bp, Homo sapiens
ttgcacatgtaacatagattta

SEQ ID NO: 6545597 - DNA, 13 bp, Homo sapiens
ttgcacatgtctt

SEQ ID NO: 6545598 - DNA, 12 bp, Homo sapiens
ttgcacatgtga

SEQ ID NO: 6545599 - DNA, 16 bp, Homo sapiens
ttgcacatgtttcctc

SEQ ID NO: 6545600 - DNA, 13 bp, Homo sapiens
ttgcacattgttc

SEQ ID NO: 6545601 - DNA, 12 bp, Homo sapiens
ttgcaccaaaga

SEQ ID NO: 6545602 - DNA, 20 bp, Homo sapiens
ttgcaccaaattatcttgat

SEQ ID NO: 6545603 - DNA, 16 bp, Homo sapiens
ttgcaccactgcactc

SEQ ID NO: 6545604 - DNA, 23 bp, Homo sapiens
ttgcaccactgcactccagcttg

SEQ ID NO: 6545605 - DNA, 16 bp, Homo sapiens
ttgcaccagaaatgtt

SEQ ID NO: 6545606 - DNA, 21 bp, Homo sapiens
ttgcaccagttttatccataa

SEQ ID NO: 6545607 - DNA, 22 bp, Homo sapiens
ttgcaccatactccttgcttcc

SEQ ID NO: 6545608 - DNA, 17 bp, Homo sapiens
ttgcaccatgtgaagtg

SEQ ID NO: 6545609 - DNA, 17 bp, Homo sapiens
ttgcaccattctttctt

SEQ ID NO: 6545610 - DNA, 18 bp, Homo sapiens
ttgcaccattctttcttg

SEQ ID NO: 6545611 - DNA, 19 bp, Homo sapiens
ttgcaccccatgctgttga

SEQ ID NO: 6545612 - DNA, 12 bp, Homo sapiens
ttgcacccctcc

SEQ ID NO: 6545613 - DNA, 14 bp, Homo sapiens
ttgcacccctccca

SEQ ID NO: 6545614 - DNA, 15 bp, Homo sapiens
ttgcacccctcccat

SEQ ID NO: 6545615 - DNA, 16 bp, Homo sapiens
ttgcacccctcccatt

SEQ ID NO: 6545616 - DNA, 22 bp, Homo sapiens
ttgcacccctttcctccccata

SEQ ID NO: 6545617 - DNA, 23 bp, Homo sapiens
ttgcacccctttcctccccatac

SEQ ID NO: 6545618 - DNA, 16 bp, Homo sapiens
ttgcacccgcctctcc

SEQ ID NO: 6545619 - DNA, 22 bp, Homo sapiens
ttgcaccctgtagatgttctag

SEQ ID NO: 6545620 - DNA, 16 bp, Homo sapiens
ttgcacctagacactt

SEQ ID NO: 6545621 - DNA, 16 bp, Homo sapiens
ttgcacctatctcagc

SEQ ID NO: 6545622 - DNA, 20 bp, Homo sapiens
ttgcacctatctcagccata

SEQ ID NO: 6545623 - DNA, 21 bp, Homo sapiens
ttgcacctatctcagccatag

SEQ ID NO: 6545624 - DNA, 18 bp, Homo sapiens
ttgcacctgcagccaagc

SEQ ID NO: 6545625 - DNA, 16 bp, Homo sapiens
ttgcacctgtccccac

SEQ ID NO: 6545626 - DNA, 17 bp, Homo sapiens
ttgcacgacgccctctc

SEQ ID NO: 6545627 - DNA, 20 bp, Homo sapiens
ttgcacgacgccctctcccc

SEQ ID NO: 6545628 - DNA, 21 bp, Homo sapiens
ttgcacgacgccctctcccca

SEQ ID NO: 6545629 - DNA, 17 bp, Homo sapiens
ttgcacgcccatgtgtg

SEQ ID NO: 6545630 - DNA, 20 bp, Homo sapiens
ttgcacgcgccctttctacc

SEQ ID NO: 6545631 - DNA, 21 bp, Homo sapiens
ttgcacgtgtgtttttctatt

SEQ ID NO: 6545632 - DNA, 22 bp, Homo sapiens
ttgcacgtgtgtttttctatta

SEQ ID NO: 6545633 - DNA, 22 bp, Homo sapiens
ttgcactaaaagtgatgtgatt

SEQ ID NO: 6545634 - DNA, 17 bp, Homo sapiens
ttgcactaaaatgagga

SEQ ID NO: 6545635 - DNA, 15 bp, Homo sapiens
ttgcactaaagtatg

SEQ ID NO: 6545636 - DNA, 15 bp, Homo sapiens
ttgcactaactgctg

SEQ ID NO: 6545637 - DNA, 16 bp, Homo sapiens
ttgcactaagatattt

SEQ ID NO: 6545638 - DNA, 21 bp, Homo sapiens
ttgcactaggaattctttgca

SEQ ID NO: 6545639 - DNA, 20 bp, Homo sapiens
ttgcactcaaatcttaagaa

SEQ ID NO: 6545640 - DNA, 17 bp, Homo sapiens
ttgcactcatcatattt

SEQ ID NO: 6545641 - DNA, 13 bp, Homo sapiens
ttgcactccagcc

SEQ ID NO: 6545642 - DNA, 17 bp, Homo sapiens
ttgcactccagcctggg

SEQ ID NO: 6545643 - DNA, 19 bp, Homo sapiens
ttgcactctaaaaggttca

SEQ ID NO: 6545644 - DNA, 14 bp, Homo sapiens
ttgcactgaaaacc

SEQ ID NO: 6545645 - DNA, 19 bp, Homo sapiens
ttgcactgaaatggaattc

SEQ ID NO: 6545646 - DNA, 13 bp, Homo sapiens
ttgcactgaacag

SEQ ID NO: 6545647 - DNA, 11 bp, Homo sapiens
ttgcactgaag

SEQ ID NO: 6545648 - DNA, 23 bp, Homo sapiens
ttgcactgaagccggacagctgc

SEQ ID NO: 6545649 - DNA, 20 bp, Homo sapiens
ttgcactgaagttgtctgaa

SEQ ID NO: 6545650 - DNA, 15 bp, Homo sapiens
ttgcactgaagtttt

SEQ ID NO: 6545651 - DNA, 16 bp, Homo sapiens
ttgcactgaatatata

SEQ ID NO: 6545652 - DNA, 17 bp, Homo sapiens
ttgcactgaatatataa

SEQ ID NO: 6545653 - DNA, 23 bp, Homo sapiens
ttgcactgaatatataaacactc

SEQ ID NO: 6545654 - DNA, 21 bp, Homo sapiens
ttgcactgatgtccggagaga

SEQ ID NO: 6545655 - DNA, 21 bp, Homo sapiens
ttgcactgcagttatttacca

SEQ ID NO: 6545656 - DNA, 22 bp, Homo sapiens
ttgcactgccccctgcttggcc

SEQ ID NO: 6545657 - DNA, 23 bp, Homo sapiens
ttgcactgggggaacagatgcta

SEQ ID NO: 6545658 - DNA, 21 bp, Homo sapiens
ttgcactgtatcatttcatgc

SEQ ID NO: 6545659 - DNA, 15 bp, Homo sapiens
ttgcactgtatccaa

SEQ ID NO: 6545660 - DNA, 12 bp, Homo sapiens
ttgcactgtggt

SEQ ID NO: 6545661 - DNA, 22 bp, Homo sapiens
ttgcactgttctgattatgtaa

SEQ ID NO: 6545662 - DNA, 15 bp, Homo sapiens
ttgcacttaatggct

SEQ ID NO: 6545663 - DNA, 22 bp, Homo sapiens
ttgcacttaatggctgttgagg

SEQ ID NO: 6545664 - DNA, 16 bp, Homo sapiens
ttgcacttctgtaaac

SEQ ID NO: 6545665 - DNA, 13 bp, Homo sapiens
ttgcacttctgtt

SEQ ID NO: 6545666 - DNA, 20 bp, Homo sapiens
ttgcacttgtgattatttat

SEQ ID NO: 6545667 - DNA, 19 bp, Homo sapiens
ttgcacttgttatattata

SEQ ID NO: 6545668 - DNA, 13 bp, Homo sapiens
ttgcactttagac

SEQ ID NO: 6545669 - DNA, 21 bp, Homo sapiens
tgtgctcagtcgccctgttct

SEQ ID NO: 6545670 - DNA, 22 bp, Homo sapiens
tgtgctcagtcgccctgttctt

SEQ ID NO: 6545671 - DNA, 22 bp, Homo sapiens
tgtgctcatgcattgcttgtgt

SEQ ID NO: 6545672 - DNA, 17 bp, Homo sapiens
tgtgctcatgtgtgtgg

SEQ ID NO: 6545673 - DNA, 14 bp, Homo sapiens
tgtgctccaaatgt

SEQ ID NO: 6545674 - DNA, 15 bp, Homo sapiens
tgtgctccaaatgtc

SEQ ID NO: 6545675 - DNA, 23 bp, Homo sapiens
tgtgctccaaatgtctactgaag

SEQ ID NO: 6545676 - DNA, 20 bp, Homo sapiens
tgtgctccacactcagaaaa

SEQ ID NO: 6545677 - DNA, 22 bp, Homo sapiens
tgtgctccagcagtgctgggcc

SEQ ID NO: 6545678 - DNA, 15 bp, Homo sapiens
tgtgctccaggcttc

SEQ ID NO: 6545679 - DNA, 17 bp, Homo sapiens
tgtgctccaggcttcct

SEQ ID NO: 6545680 - DNA, 18 bp, Homo sapiens
tgtgctccaggcttcctg

SEQ ID NO: 6545681 - DNA, 22 bp, Homo sapiens
tgtgctccaggcttcctgccct

SEQ ID NO: 6545682 - DNA, 20 bp, Homo sapiens
tgtgctccatagagcagtgc

SEQ ID NO: 6545683 - DNA, 17 bp, Homo sapiens
tgtgctcccctttgcct

SEQ ID NO: 6545684 - DNA, 23 bp, Homo sapiens
tgtgctccgtgcctccaccacca

SEQ ID NO: 6545685 - DNA, 14 bp, Homo sapiens
tgtgctcctgccca

SEQ ID NO: 6545686 - DNA, 15 bp, Homo sapiens
tgtgctcctgcccag

SEQ ID NO: 6545687 - DNA, 13 bp, Homo sapiens
tgtgctcctgtgg

SEQ ID NO: 6545688 - DNA, 14 bp, Homo sapiens
tgtgctcggacaca

SEQ ID NO: 6545689 - DNA, 16 bp, Homo sapiens
tgtgctcgggagtggc

SEQ ID NO: 6545690 - DNA, 15 bp, Homo sapiens
tgtgctctcggcttc

SEQ ID NO: 6545691 - DNA, 12 bp, Homo sapiens
tgtgctctgatc

SEQ ID NO: 6545692 - DNA, 22 bp, Homo sapiens
tgtgctctgatcatccactgtg

SEQ ID NO: 6545693 - DNA, 14 bp, Homo sapiens
tgtgctctgcttca

SEQ ID NO: 6545694 - DNA, 16 bp, Homo sapiens
tgtgctctgttccatt

SEQ ID NO: 6545695 - DNA, 20 bp, Homo sapiens
tgtgctcttatccccagctg

SEQ ID NO: 6545696 - DNA, 15 bp, Homo sapiens
tgtgctcttcctctg

SEQ ID NO: 6545697 - DNA, 13 bp, Homo sapiens
tgtgctctttcct

SEQ ID NO: 6545698 - DNA, 18 bp, Homo sapiens
tgtgctctttcctgccct

SEQ ID NO: 6545699 - DNA, 13 bp, Homo sapiens
tgtgctgaacaca

SEQ ID NO: 6545700 - DNA, 22 bp, Homo sapiens
tgtgctgaacacacaccagttt

SEQ ID NO: 6545701 - DNA, 15 bp, Homo sapiens
tgtgctgagcacaga

SEQ ID NO: 6545702 - DNA, 14 bp, Homo sapiens
tgtgctgagcctgc

SEQ ID NO: 6545703 - DNA, 16 bp, Homo sapiens
tgtgctgagcctgccc

SEQ ID NO: 6545704 - DNA, 16 bp, Homo sapiens
tgtgctgatcctgctg

SEQ ID NO: 6545705 - DNA, 17 bp, Homo sapiens
tgtgctgatcctgctga

SEQ ID NO: 6545706 - DNA, 23 bp, Homo sapiens
tgtgctgatgtagtgaccaagtg

SEQ ID NO: 6545707 - DNA, 18 bp, Homo sapiens
tgtgctgatgtttcctgg

SEQ ID NO: 6545708 - DNA, 21 bp, Homo sapiens
tgtgctgcagacaaaaagaac

SEQ ID NO: 6545709 - DNA, 13 bp, Homo sapiens
tgtgctgcagtgc

SEQ ID NO: 6545710 - DNA, 16 bp, Homo sapiens
tgtgctgccatttgat

SEQ ID NO: 6545711 - DNA, 16 bp, Homo sapiens
tgtgctgccctgaaga

SEQ ID NO: 6545712 - DNA, 15 bp, Homo sapiens
tgtgctgccctgccc

SEQ ID NO: 6545713 - DNA, 20 bp, Homo sapiens
tgtgctgccctgcccacctg

SEQ ID NO: 6545714 - DNA, 13 bp, Homo sapiens
tgtgctgccctgt

SEQ ID NO: 6545715 - DNA, 22 bp, Homo sapiens
tgtgctgccctgttgccgagcc

SEQ ID NO: 6545716 - DNA, 11 bp, Homo sapiens
tgtgctgctgc

SEQ ID NO: 6545717 - DNA, 12 bp, Homo sapiens
tgtgctgctgct

SEQ ID NO: 6545718 - DNA, 21 bp, Homo sapiens
tgtgctgctgggaatggattt

SEQ ID NO: 6545719 - DNA, 18 bp, Homo sapiens
tgtgctgctgtggcatca

SEQ ID NO: 6545720 - DNA, 13 bp, Homo sapiens
tgtgctgcttctc

SEQ ID NO: 6545721 - DNA, 20 bp, Homo sapiens
tgtgctgcttttgagcctca

SEQ ID NO: 6545722 - DNA, 20 bp, Homo sapiens
tgtgctggaccagctggcct

SEQ ID NO: 6545723 - DNA, 18 bp, Homo sapiens
tgtgctggagatgtttta

SEQ ID NO: 6545724 - DNA, 19 bp, Homo sapiens
tgtgctggagccactaact

SEQ ID NO: 6545725 - DNA, 22 bp, Homo sapiens
tgtgctggaggggtggcccaga

SEQ ID NO: 6545726 - DNA, 20 bp, Homo sapiens
tgtgctggatggagcccagg

SEQ ID NO: 6545727 - DNA, 21 bp, Homo sapiens
tgtgctggatggagcccaggc

SEQ ID NO: 6545728 - DNA, 13 bp, Homo sapiens
tgtgctggcttcc

SEQ ID NO: 6545729 - DNA, 15 bp, Homo sapiens
tgtgctggcttccgc

SEQ ID NO: 6545730 - DNA, 10 bp, Homo sapiens
tgtgctggga

SEQ ID NO: 6545731 - DNA, 14 bp, Homo sapiens
tgtgctgggaaatg

SEQ ID NO: 6545732 - DNA, 21 bp, Homo sapiens
tgtgctgggaaatgcagaaat

SEQ ID NO: 6545733 - DNA, 17 bp, Homo sapiens
tgtgctgggaagcccgg

SEQ ID NO: 6545734 - DNA, 24 bp, Homo sapiens
tgtgctgggggaatgagcccagag

SEQ ID NO: 6545735 - DNA, 19 bp, Homo sapiens
tgtgctggggttatctgaa

SEQ ID NO: 6545736 - DNA, 13 bp, Homo sapiens
tgtgctgggtccc

SEQ ID NO: 6545737 - DNA, 21 bp, Homo sapiens
tgtgctgggtgagctcttcca

SEQ ID NO: 6545738 - DNA, 14 bp, Homo sapiens
tgtgctgggtgcct

SEQ ID NO: 6545739 - DNA, 17 bp, Homo sapiens
tgtgctgggtgcctccc

SEQ ID NO: 6545740 - DNA, 21 bp, Homo sapiens
tgtgctggtctctaggcctga

SEQ ID NO: 6545741 - DNA, 20 bp, Homo sapiens
tgtgctggtctttagcccca

SEQ ID NO: 6545742 - DNA, 13 bp, Homo sapiens
tgtgctggttctg

SEQ ID NO: 6545743 - DNA, 22 bp, Homo sapiens
tgtgctgtacattactgtatgt

SEQ ID NO: 6545744 - DNA, 14 bp, Homo sapiens
tgtgctgtatggcc

SEQ ID NO: 6545745 - DNA, 20 bp, Homo sapiens
tgtgctgtatggcccaggca

SEQ ID NO: 6545746 - DNA, 21 bp, Homo sapiens
tgtgctgtatggcccaggcag

SEQ ID NO: 6545747 - DNA, 16 bp, Homo sapiens
tgtgctgtattttgat

SEQ ID NO: 6545748 - DNA, 12 bp, Homo sapiens
tgtgctgtgact

SEQ ID NO: 6545749 - DNA, 17 bp, Homo sapiens
tgtgctgtgcctgctag

SEQ ID NO: 6545750 - DNA, 14 bp, Homo sapiens
tgtgctgtggaagc

SEQ ID NO: 6545751 - DNA, 13 bp, Homo sapiens
tgtgctgtggaga

SEQ ID NO: 6545752 - DNA, 21 bp, Homo sapiens
tgtgctgtggagagaagctga

SEQ ID NO: 6545753 - DNA, 14 bp, Homo sapiens
tgtgctgtgggcag

SEQ ID NO: 6545754 - DNA, 21 bp, Homo sapiens
tgtgctgtgggcagcaccctc

SEQ ID NO: 6545755 - DNA, 13 bp, Homo sapiens
tgtgctgtgtaaa

SEQ ID NO: 6545756 - DNA, 22 bp, Homo sapiens
tgtgctgtgtgagtgagcacac

SEQ ID NO: 6545757 - DNA, 14 bp, Homo sapiens
tgtgctgttgttat

SEQ ID NO: 6545758 - DNA, 16 bp, Homo sapiens
tgtgctgttgttatga

SEQ ID NO: 6545759 - DNA, 18 bp, Homo sapiens
tgtgctgttgtttaaaat

SEQ ID NO: 6545760 - DNA, 18 bp, Homo sapiens
tgtgctgtttcaaagttc

SEQ ID NO: 6545761 - DNA, 14 bp, Homo sapiens
tgtgctgtttgaaa

SEQ ID NO: 6545762 - DNA, 17 bp, Homo sapiens
tgtgctgttttctgtaa

SEQ ID NO: 6545763 - DNA, 18 bp, Homo sapiens
tgtgctgttttctgtaaa

SEQ ID NO: 6545764 - DNA, 16 bp, Homo sapiens
tgtgcttatgtcattt

SEQ ID NO: 6545765 - DNA, 13 bp, Homo sapiens
tgtgcttatgttt

SEQ ID NO: 6545766 - DNA, 23 bp, Homo sapiens
tgtgcttcacacaaagtgaaatt

SEQ ID NO: 6545767 - DNA, 19 bp, Homo sapiens
tgtgcttccctaggctgag

SEQ ID NO: 6545768 - DNA, 14 bp, Homo sapiens
tgtgcttccttggt

SEQ ID NO: 6545769 - DNA, 22 bp, Homo sapiens
tgtgcttccttggttcatgctt

SEQ ID NO: 6545770 - DNA, 13 bp, Homo sapiens
tgtgcttctcagt

SEQ ID NO: 6545771 - DNA, 23 bp, Homo sapiens
tgtgcttctcttctttattgcac

SEQ ID NO: 6545772 - DNA, 15 bp, Homo sapiens
tgtgcttctgccacc

SEQ ID NO: 6545773 - DNA, 21 bp, Homo sapiens
tgtgcttctttctttgggaat

SEQ ID NO: 6545774 - DNA, 14 bp, Homo sapiens
tgtgcttggaacca

SEQ ID NO: 6545775 - DNA, 15 bp, Homo sapiens
tgtgcttggaaccag

SEQ ID NO: 6545776 - DNA, 22 bp, Homo sapiens
tgtgcttggatttgcatattta

SEQ ID NO: 6545777 - DNA, 19 bp, Homo sapiens
tgtgcttgtgacaaactgg

SEQ ID NO: 6545778 - DNA, 18 bp, Homo sapiens
tgtgcttgtgtgtatgtc

SEQ ID NO: 6545779 - DNA, 12 bp, Homo sapiens
tgtgcttgttct

SEQ ID NO: 6545780 - DNA, 14 bp, Homo sapiens
tgtgcttgttcttc

SEQ ID NO: 6545781 - DNA, 16 bp, Homo sapiens
tgtgcttgttcttcct

SEQ ID NO: 6545782 - DNA, 19 bp, Homo sapiens
tgtgcttgttcttcctctt

SEQ ID NO: 6545783 - DNA, 21 bp, Homo sapiens
tgtgcttgttgaatgtcaatc

SEQ ID NO: 6545784 - DNA, 23 bp, Homo sapiens
tgtgcttgtttacagcactactc

SEQ ID NO: 6545785 - DNA, 19 bp, Homo sapiens
tgtgcttgttttataaaat

SEQ ID NO: 6545786 - DNA, 14 bp, Homo sapiens
tgtgctttagcttg

SEQ ID NO: 6545787 - DNA, 12 bp, Homo sapiens
tgtgctttataa

SEQ ID NO: 6545788 - DNA, 13 bp, Homo sapiens
tgtgctttataaa

SEQ ID NO: 6545789 - DNA, 20 bp, Homo sapiens
tgtgctttatgctgaaacag

SEQ ID NO: 6545790 - DNA, 18 bp, Homo sapiens
tgtgctttccagctcacc

SEQ ID NO: 6545791 - DNA, 22 bp, Homo sapiens
tgtgctttccctgaactgggac

SEQ ID NO: 6545792 - DNA, 17 bp, Homo sapiens
tgtgctttctattgtac

SEQ ID NO: 6545793 - DNA, 14 bp, Homo sapiens
tgtgctttctgcat

SEQ ID NO: 6545794 - DNA, 13 bp, Homo sapiens
tgtgctttgaaaa

SEQ ID NO: 6545795 - DNA, 12 bp, Homo sapiens
tgtgctttgaga

SEQ ID NO: 6545796 - DNA, 18 bp, Homo sapiens
tgtgctttgcattttctg

SEQ ID NO: 6545797 - DNA, 13 bp, Homo sapiens
tgtgctttgctct

SEQ ID NO: 6545798 - DNA, 16 bp, Homo sapiens
tgtgctttgctcttgt

SEQ ID NO: 6545799 - DNA, 14 bp, Homo sapiens
tgtgctttgtagct

SEQ ID NO: 6545800 - DNA, 20 bp, Homo sapiens
tgtgcttttgcaaaagaagt

SEQ ID NO: 6545801 - DNA, 17 bp, Homo sapiens
tgtgctttttaagaata

SEQ ID NO: 6545802 - DNA, 22 bp, Homo sapiens
tgtgctttttaagaatattttt

SEQ ID NO: 6545803 - DNA, 18 bp, Homo sapiens
tgtgctttttgcaaaagg

SEQ ID NO: 6545804 - DNA, 15 bp, Homo sapiens
tgtgctttttgtcat

SEQ ID NO: 6545805 - DNA, 17 bp, Homo sapiens
tgtgctttttgtcatgt

SEQ ID NO: 6545806 - DNA, 21 bp, Homo sapiens
tgtgcttttttaaccaaggag

SEQ ID NO: 6545807 - DNA, 17 bp, Homo sapiens
tgtggaaaaaaaaagaa

SEQ ID NO: 6545808 - DNA, 16 bp, Homo sapiens
tgtggaaaaatattta

SEQ ID NO: 6545809 - DNA, 23 bp, Homo sapiens
tgtggaaaagccaagaggctgca

SEQ ID NO: 6545810 - DNA, 17 bp, Homo sapiens
tgtggaaagcctctgct

SEQ ID NO: 6545811 - DNA, 13 bp, Homo sapiens
tgtggaaaggatt

SEQ ID NO: 6545812 - DNA, 21 bp, Homo sapiens
tgtggaaagtcacaggtcaca

SEQ ID NO: 6545813 - DNA, 16 bp, Homo sapiens
tgtggaaatatgcaac

SEQ ID NO: 6545814 - DNA, 16 bp, Homo sapiens
tgtggaacactaaaga

SEQ ID NO: 6545815 - DNA, 17 bp, Homo sapiens
tgtggaacactaaagag

SEQ ID NO: 6545816 - DNA, 19 bp, Homo sapiens
tgtggaacataaaaaggac

SEQ ID NO: 6545817 - DNA, 22 bp, Homo sapiens
tgtggaaccaaagctggcccag

SEQ ID NO: 6545818 - DNA, 17 bp, Homo sapiens
tgtggaactgctgccac

SEQ ID NO: 6545819 - DNA, 17 bp, Homo sapiens
tgtggaagaactgtgat

SEQ ID NO: 6545820 - DNA, 23 bp, Homo sapiens
tgtggaagacacttgctgagtga

SEQ ID NO: 6545821 - DNA, 22 bp, Homo sapiens
tgtggaaggcaagccaggctca

SEQ ID NO: 6545822 - DNA, 23 bp, Homo sapiens
tgtggaaggcacccgccctttcc

SEQ ID NO: 6545823 - DNA, 20 bp, Homo sapiens
tgtggaaggcagggacagag

SEQ ID NO: 6545824 - DNA, 14 bp, Homo sapiens
tgtggaagggacta

SEQ ID NO: 6545825 - DNA, 18 bp, Homo sapiens
tgtggaagggactaggag

SEQ ID NO: 6545826 - DNA, 13 bp, Homo sapiens
tgtggaagtccct

SEQ ID NO: 6545827 - DNA, 20 bp, Homo sapiens
tgtggaagtgtgtgtggcag

SEQ ID NO: 6545828 - DNA, 15 bp, Homo sapiens
tgtggaataatacat

SEQ ID NO: 6545829 - DNA, 19 bp, Homo sapiens
tgtggaataatacatacta

SEQ ID NO: 6545830 - DNA, 17 bp, Homo sapiens
tgtggaatataaatagc

SEQ ID NO: 6545831 - DNA, 23 bp, Homo sapiens
tgtggaatatggcaatagcattg

SEQ ID NO: 6545832 - DNA, 23 bp, Homo sapiens
tgtggaatcaccgggaacgcccc

SEQ ID NO: 6545833 - DNA, 13 bp, Homo sapiens
tgtggaatgagtg

SEQ ID NO: 6545834 - DNA, 22 bp, Homo sapiens
tgtggaatgatgtatataaaat

SEQ ID NO: 6545835 - DNA, 16 bp, Homo sapiens
tgtggaatgcagtcct

SEQ ID NO: 6545836 - DNA, 21 bp, Homo sapiens
tgtggaatggattatagagta

SEQ ID NO: 6545837 - DNA, 22 bp, Homo sapiens
tgtggaatgttgggtctcactc

SEQ ID NO: 6545838 - DNA, 17 bp, Homo sapiens
tgtggaattacataaca

SEQ ID NO: 6545839 - DNA, 17 bp, Homo sapiens
tgtggaatttattggca

SEQ ID NO: 6545840 - DNA, 20 bp, Homo sapiens
tgtggaattttgagaaaaat

SEQ ID NO: 6545841 - DNA, 21 bp, Homo sapiens
tgtggaattttgagaaaaata

SEQ ID NO: 6545842 - DNA, 20 bp, Homo sapiens
tgtggacaatgagtggaata

SEQ ID NO: 6545843 - DNA, 14 bp, Homo sapiens
tgtggacaggatga

SEQ ID NO: 6545844 - DNA, 12 bp, Homo sapiens
tgtggacatatg

SEQ ID NO: 6545845 - DNA, 13 bp, Homo sapiens
tgtggacatatgt

SEQ ID NO: 6545846 - DNA, 15 bp, Homo sapiens
tgtggacatgcaccc

SEQ ID NO: 6545847 - DNA, 22 bp, Homo sapiens
tgtggacatgtgggtggagaag

SEQ ID NO: 6545848 - DNA, 10 bp, Homo sapiens
ttgcactttc

SEQ ID NO: 6545849 - DNA, 21 bp, Homo sapiens
ttgcactttcagactctctct

SEQ ID NO: 6545850 - DNA, 14 bp, Homo sapiens
ttgcactttccttt

SEQ ID NO: 6545851 - DNA, 17 bp, Homo sapiens
ttgcactttcctttcaa

SEQ ID NO: 6545852 - DNA, 21 bp, Homo sapiens
ttgcactttcctttcaataaa

SEQ ID NO: 6545853 - DNA, 22 bp, Homo sapiens
ttgcactttcctttcaataaag

SEQ ID NO: 6545854 - DNA, 16 bp, Homo sapiens
ttgcacttttgaatgt

SEQ ID NO: 6545855 - DNA, 22 bp, Homo sapiens
ttgcactttttcttaatcattt

SEQ ID NO: 6545856 - DNA, 17 bp, Homo sapiens
ttgcagaaaagcacctg

SEQ ID NO: 6545857 - DNA, 12 bp, Homo sapiens
ttgcagaaaatg

SEQ ID NO: 6545858 - DNA, 16 bp, Homo sapiens
ttgcagaaaattctgt

SEQ ID NO: 6545859 - DNA, 17 bp, Homo sapiens
ttgcagaaaattctgtg

SEQ ID NO: 6545860 - DNA, 19 bp, Homo sapiens
ttgcagaaaattctgtgcc

SEQ ID NO: 6545861 - DNA, 21 bp, Homo sapiens
ttgcagaacatgagtgctgat

SEQ ID NO: 6545862 - DNA, 21 bp, Homo sapiens
ttgcagaactaaactcattta

SEQ ID NO: 6545863 - DNA, 16 bp, Homo sapiens
ttgcagaactgccatt

SEQ ID NO: 6545864 - DNA, 16 bp, Homo sapiens
ttgcagaactgtagct

SEQ ID NO: 6545865 - DNA, 18 bp, Homo sapiens
ttgcagaaggaaatgatg

SEQ ID NO: 6545866 - DNA, 17 bp, Homo sapiens
ttgcagaatgaagccat

SEQ ID NO: 6545867 - DNA, 14 bp, Homo sapiens
ttgcagaatgatgc

SEQ ID NO: 6545868 - DNA, 15 bp, Homo sapiens
ttgcagacaggaatc

SEQ ID NO: 6545869 - DNA, 16 bp, Homo sapiens
ttgcagacaggaatct

SEQ ID NO: 6545870 - DNA, 23 bp, Homo sapiens
ttgcagacaggcaagcacctcct

SEQ ID NO: 6545871 - DNA, 12 bp, Homo sapiens
ttgcagacctgg

SEQ ID NO: 6545872 - DNA, 18 bp, Homo sapiens
ttgcagacctgggacttt

SEQ ID NO: 6545873 - DNA, 19 bp, Homo sapiens
ttgcagacctgggacttta

SEQ ID NO: 6545874 - DNA, 19 bp, Homo sapiens
ttgcagactggtgttaatg

SEQ ID NO: 6545875 - DNA, 20 bp, Homo sapiens
ttgcagagaagcatcctcca

SEQ ID NO: 6545876 - DNA, 14 bp, Homo sapiens
ttgcagagacagga

SEQ ID NO: 6545877 - DNA, 18 bp, Homo sapiens
ttgcagaggagcccagtg

SEQ ID NO: 6545878 - DNA, 11 bp, Homo sapiens
ttgcagaggct

SEQ ID NO: 6545879 - DNA, 23 bp, Homo sapiens
ttgcagataaactgatgtttgaa

SEQ ID NO: 6545880 - DNA, 15 bp, Homo sapiens
ttgcagatgccaaaa

SEQ ID NO: 6545881 - DNA, 19 bp, Homo sapiens
ttgcagatggaaagaggtg

SEQ ID NO: 6545882 - DNA, 12 bp, Homo sapiens
ttgcagattcta

SEQ ID NO: 6545883 - DNA, 13 bp, Homo sapiens
ttgcagatttatt

SEQ ID NO: 6545884 - DNA, 16 bp, Homo sapiens
ttgcagatttatttag

SEQ ID NO: 6545885 - DNA, 19 bp, Homo sapiens
ttgcagatttctgccttga

SEQ ID NO: 6545886 - DNA, 17 bp, Homo sapiens
ttgcagcacagctgaga

SEQ ID NO: 6545887 - DNA, 21 bp, Homo sapiens
ttgcagcactgcccatcagtg

SEQ ID NO: 6545888 - DNA, 19 bp, Homo sapiens
ttgcagcagaagccaaatt

SEQ ID NO: 6545889 - DNA, 12 bp, Homo sapiens
ttgcagcagggc

SEQ ID NO: 6545890 - DNA, 14 bp, Homo sapiens
ttgcagcagtgagt

SEQ ID NO: 6545891 - DNA, 16 bp, Homo sapiens
ttgcagcatgagactt

SEQ ID NO: 6545892 - DNA, 17 bp, Homo sapiens
ttgcagcatgagacttt

SEQ ID NO: 6545893 - DNA, 14 bp, Homo sapiens
ttgcagcatttact

SEQ ID NO: 6545894 - DNA, 18 bp, Homo sapiens
ttgcagcatttactatgc

SEQ ID NO: 6545895 - DNA, 17 bp, Homo sapiens
ttgcagcatttttattt

SEQ ID NO: 6545896 - DNA, 23 bp, Homo sapiens
ttgcagccatgaagggatgctag

SEQ ID NO: 6545897 - DNA, 17 bp, Homo sapiens
ttgcagcccaaggacag

SEQ ID NO: 6545898 - DNA, 18 bp, Homo sapiens
ttgcagcccaaggacagt

SEQ ID NO: 6545899 - DNA, 15 bp, Homo sapiens
ttgcagcccttgtga

SEQ ID NO: 6545900 - DNA, 20 bp, Homo sapiens
ttgcagccgcagagaaatgc

SEQ ID NO: 6545901 - DNA, 18 bp, Homo sapiens
ttgcagccggcacagggt

SEQ ID NO: 6545902 - DNA, 18 bp, Homo sapiens
ttgcagcctcaaccaaca

SEQ ID NO: 6545903 - DNA, 21 bp, Homo sapiens
ttgcagcctgaccaaaagtga

SEQ ID NO: 6545904 - DNA, 15 bp, Homo sapiens
ttgcagcctgctcta

SEQ ID NO: 6545905 - DNA, 23 bp, Homo sapiens
ttgcagcctgctctagtgggaca

SEQ ID NO: 6545906 - DNA, 15 bp, Homo sapiens
ttgcagcctggtcac

SEQ ID NO: 6545907 - DNA, 17 bp, Homo sapiens
ttgcagctcactgctgc

SEQ ID NO: 6545908 - DNA, 18 bp, Homo sapiens
ttgcagctcactgctgct

SEQ ID NO: 6545909 - DNA, 14 bp, Homo sapiens
ttgcagctgcccag

SEQ ID NO: 6545910 - DNA, 22 bp, Homo sapiens
ttgcagctgcccagcccctcct

SEQ ID NO: 6545911 - DNA, 13 bp, Homo sapiens
ttgcagctgctgg

SEQ ID NO: 6545912 - DNA, 14 bp, Homo sapiens
ttgcagctggccca

SEQ ID NO: 6545913 - DNA, 17 bp, Homo sapiens
ttgcagctgggagaagg

SEQ ID NO: 6545914 - DNA, 18 bp, Homo sapiens
ttgcagctgggagaaggg

SEQ ID NO: 6545915 - DNA, 14 bp, Homo sapiens
ttgcagctgtcacc

SEQ ID NO: 6545916 - DNA, 17 bp, Homo sapiens
ttgcagctgttttgttg

SEQ ID NO: 6545917 - DNA, 18 bp, Homo sapiens
ttgcagctgttttgttga

SEQ ID NO: 6545918 - DNA, 17 bp, Homo sapiens
ttgcagcttccttccaa

SEQ ID NO: 6545919 - DNA, 19 bp, Homo sapiens
ttgcagcttgtgctgagcc

SEQ ID NO: 6545920 - DNA, 22 bp, Homo sapiens
ttgcagctttaacctgctggga

SEQ ID NO: 6545921 - DNA, 14 bp, Homo sapiens
ttgcaggcaagcct

SEQ ID NO: 6545922 - DNA, 21 bp, Homo sapiens
ttgcaggcatgcatgtgcttg

SEQ ID NO: 6545923 - DNA, 17 bp, Homo sapiens
ttgcaggctctgggctc

SEQ ID NO: 6545924 - DNA, 17 bp, Homo sapiens
ttgcaggctgagtccct

SEQ ID NO: 6545925 - DNA, 21 bp, Homo sapiens
ttgcaggctggctttggaata

SEQ ID NO: 6545926 - DNA, 17 bp, Homo sapiens
ttgcagggcacagatga

SEQ ID NO: 6545927 - DNA, 17 bp, Homo sapiens
ttgcaggggactgggcc

SEQ ID NO: 6545928 - DNA, 23 bp, Homo sapiens
ttgcagggtcctcttctgggcct

SEQ ID NO: 6545929 - DNA, 13 bp, Homo sapiens
ttgcaggtcagcc

SEQ ID NO: 6545930 - DNA, 20 bp, Homo sapiens
ttgcaggtgaccagaatgag

SEQ ID NO: 6545931 - DNA, 15 bp, Homo sapiens
ttgcaggtgcctggc

SEQ ID NO: 6545932 - DNA, 19 bp, Homo sapiens
ttgcaggtgcctggcttgc

SEQ ID NO: 6545933 - DNA, 15 bp, Homo sapiens
ttgcagtaaagtctt

SEQ ID NO: 6545934 - DNA, 13 bp, Homo sapiens
ttgcagtaaagtt

SEQ ID NO: 6545935 - DNA, 13 bp, Homo sapiens
ttgcagtaactgt

SEQ ID NO: 6545936 - DNA, 20 bp, Homo sapiens
ttgcagtaattcaactggaa

SEQ ID NO: 6545937 - DNA, 23 bp, Homo sapiens
ttgcagtaattcaactggaaatt

SEQ ID NO: 6545938 - DNA, 15 bp, Homo sapiens
ttgcagtatatttct

SEQ ID NO: 6545939 - DNA, 17 bp, Homo sapiens
ttgcagtatcagagggt

SEQ ID NO: 6545940 - DNA, 23 bp, Homo sapiens
ttgcagtatcggcactgtacaaa

SEQ ID NO: 6545941 - DNA, 16 bp, Homo sapiens
ttgcagtcactctagt

SEQ ID NO: 6545942 - DNA, 15 bp, Homo sapiens
ttgcagtcactttga

SEQ ID NO: 6545943 - DNA, 14 bp, Homo sapiens
ttgcagtccccagt

SEQ ID NO: 6545944 - DNA, 23 bp, Homo sapiens
ttgcagtcgtgtaattggcccaa

SEQ ID NO: 6545945 - DNA, 17 bp, Homo sapiens
ttgcagtctgtattttc

SEQ ID NO: 6545946 - DNA, 12 bp, Homo sapiens
ttgcagtctttc

SEQ ID NO: 6545947 - DNA, 15 bp, Homo sapiens
ttgcagtgaagatgt

SEQ ID NO: 6545948 - DNA, 16 bp, Homo sapiens
ttgcagtgaagatgtg

SEQ ID NO: 6545949 - DNA, 17 bp, Homo sapiens
ttgcagtgaagatgtgt

SEQ ID NO: 6545950 - DNA, 14 bp, Homo sapiens
ttgcagtgaagtgt

SEQ ID NO: 6545951 - DNA, 16 bp, Homo sapiens
ttgcagtgagctgaga

SEQ ID NO: 6545952 - DNA, 17 bp, Homo sapiens
ttgcagtggggctagga

SEQ ID NO: 6545953 - DNA, 22 bp, Homo sapiens
ttgcagtgtgaatgctgggccc

SEQ ID NO: 6545954 - DNA, 16 bp, Homo sapiens
ttgcagttctgattca

SEQ ID NO: 6545955 - DNA, 14 bp, Homo sapiens
ttgcagttgagagg

SEQ ID NO: 6545956 - DNA, 15 bp, Homo sapiens
ttgcagttgatgtgt

SEQ ID NO: 6545957 - DNA, 15 bp, Homo sapiens
ttgcagtttacagta

SEQ ID NO: 6545958 - DNA, 21 bp, Homo sapiens
ttgcagtttacagtatttcta

SEQ ID NO: 6545959 - DNA, 20 bp, Homo sapiens
ttgcagtttatatatatgct

SEQ ID NO: 6545960 - DNA, 13 bp, Homo sapiens
ttgcagtttatca

SEQ ID NO: 6545961 - DNA, 16 bp, Homo sapiens
ttgcagttttgtaagc

SEQ ID NO: 6545962 - DNA, 21 bp, Homo sapiens
ttgcagtttttataatagatt

SEQ ID NO: 6545963 - DNA, 21 bp, Homo sapiens
ttgcagtttttttatggcatt

SEQ ID NO: 6545964 - DNA, 19 bp, Homo sapiens
ttgcataaacaatccaaat

SEQ ID NO: 6545965 - DNA, 16 bp, Homo sapiens
ttgcataacgtataaa

SEQ ID NO: 6545966 - DNA, 22 bp, Homo sapiens
ttgcataagattaaaggaagga

SEQ ID NO: 6545967 - DNA, 13 bp, Homo sapiens
ttgcataaggttt

SEQ ID NO: 6545968 - DNA, 19 bp, Homo sapiens
ttgcataatactaatttat

SEQ ID NO: 6545969 - DNA, 15 bp, Homo sapiens
ttgcataatgcaatc

SEQ ID NO: 6545970 - DNA, 14 bp, Homo sapiens
ttgcatacaaacaa

SEQ ID NO: 6545971 - DNA, 20 bp, Homo sapiens
ttgcatacaaacaagcatat

SEQ ID NO: 6545972 - DNA, 19 bp, Homo sapiens
ttgcatactattaaacatg

SEQ ID NO: 6545973 - DNA, 16 bp, Homo sapiens
ttgcatactgagccaa

SEQ ID NO: 6545974 - DNA, 16 bp, Homo sapiens
ttgcatactttgtatt

SEQ ID NO: 6545975 - DNA, 21 bp, Homo sapiens
ttgcatactttgtattttgat

SEQ ID NO: 6545976 - DNA, 17 bp, Homo sapiens
ttgcatagaataatgaa

SEQ ID NO: 6545977 - DNA, 17 bp, Homo sapiens
ttgcatagcagctgcta

SEQ ID NO: 6545978 - DNA, 23 bp, Homo sapiens
ttgcatagtaccaatcattttaa

SEQ ID NO: 6545979 - DNA, 17 bp, Homo sapiens
ttgcatataacttatat

SEQ ID NO: 6545980 - DNA, 22 bp, Homo sapiens
ttgcatataacttatattgtaa

SEQ ID NO: 6545981 - DNA, 21 bp, Homo sapiens
ttgcatatagatttagttttg

SEQ ID NO: 6545982 - DNA, 21 bp, Homo sapiens
ttgcatatagttaaactgaga

SEQ ID NO: 6545983 - DNA, 22 bp, Homo sapiens
ttgcatatatttcatgaataca

SEQ ID NO: 6545984 - DNA, 21 bp, Homo sapiens
ttgcatatcacccttccctgc

SEQ ID NO: 6545985 - DNA, 14 bp, Homo sapiens
ttgcatatgtatga

SEQ ID NO: 6545986 - DNA, 13 bp, Homo sapiens
ttgcatattcatt

SEQ ID NO: 6545987 - DNA, 13 bp, Homo sapiens
ttgcatcaatttt

SEQ ID NO: 6545988 - DNA, 20 bp, Homo sapiens
ttgcatcacctctgtaattt

SEQ ID NO: 6545989 - DNA, 19 bp, Homo sapiens
ttgcatcagaaagctttat

SEQ ID NO: 6545990 - DNA, 23 bp, Homo sapiens
ttgcatcagtattaatactaaaa

SEQ ID NO: 6545991 - DNA, 19 bp, Homo sapiens
ttgcatcatagacgagaca

SEQ ID NO: 6545992 - DNA, 22 bp, Homo sapiens
ttgcatcatttaactgaactgt

SEQ ID NO: 6545993 - DNA, 20 bp, Homo sapiens
ttgcatccacttcaggagcc

SEQ ID NO: 6545994 - DNA, 15 bp, Homo sapiens
ttgcatccattgttg

SEQ ID NO: 6545995 - DNA, 21 bp, Homo sapiens
ttgcatccattgttgtgtctg

SEQ ID NO: 6545996 - DNA, 20 bp, Homo sapiens
ttgcatcctatcgatctgga

SEQ ID NO: 6545997 - DNA, 21 bp, Homo sapiens
ttgcatcctatcgatctggaa

SEQ ID NO: 6545998 - DNA, 16 bp, Homo sapiens
ttgcatcctatttggt

SEQ ID NO: 6545999 - DNA, 15 bp, Homo sapiens
ttgcatcctgctggg

SEQ ID NO: 6546000 - DNA, 22 bp, Homo sapiens
ttgcatcgctgtccaagtgttt

SEQ ID NO: 6546001 - DNA, 19 bp, Homo sapiens
ttgcatcgtcccctccccc

SEQ ID NO: 6546002 - DNA, 20 bp, Homo sapiens
ttgcatctaatgaaaaacaa

SEQ ID NO: 6546003 - DNA, 18 bp, Homo sapiens
ttgcatctaggtaatttt

SEQ ID NO: 6546004 - DNA, 17 bp, Homo sapiens
ttgcatctgaaatagga

SEQ ID NO: 6546005 - DNA, 18 bp, Homo sapiens
ttgcatctgggtagctgt

SEQ ID NO: 6546006 - DNA, 13 bp, Homo sapiens
ttgcatctgtata

SEQ ID NO: 6546007 - DNA, 14 bp, Homo sapiens
ttgcatctgtataa

SEQ ID NO: 6546008 - DNA, 19 bp, Homo sapiens
ttgcatctgtataagtaag

SEQ ID NO: 6546009 - DNA, 23 bp, Homo sapiens
ttgcatgaaattgtatctcagtc

SEQ ID NO: 6546010 - DNA, 21 bp, Homo sapiens
ttgcatgaagagaagcaattt

SEQ ID NO: 6546011 - DNA, 18 bp, Homo sapiens
ttgcatgaattactgtat

SEQ ID NO: 6546012 - DNA, 12 bp, Homo sapiens
ttgcatgaggct

SEQ ID NO: 6546013 - DNA, 13 bp, Homo sapiens
ttgcatgatatct

SEQ ID NO: 6546014 - DNA, 14 bp, Homo sapiens
ttgcatgatgtatt

SEQ ID NO: 6546015 - DNA, 15 bp, Homo sapiens
ttgcatgattcttct

SEQ ID NO: 6546016 - DNA, 15 bp, Homo sapiens
ttgcatgcaatttga

SEQ ID NO: 6546017 - DNA, 20 bp, Homo sapiens
ttgcatgcctgggcccaggc

SEQ ID NO: 6546018 - DNA, 17 bp, Homo sapiens
ttgcatgccttttgggt

SEQ ID NO: 6546019 - DNA, 19 bp, Homo sapiens
ttgcatggcatcacctcca

SEQ ID NO: 6546020 - DNA, 19 bp, Homo sapiens
ttgcatggctccagaaatg

SEQ ID NO: 6546021 - DNA, 18 bp, Homo sapiens
ttgcatgggctaatgaag

SEQ ID NO: 6546022 - DNA, 22 bp, Homo sapiens
ttgcatgggctaatgaagatca

SEQ ID NO: 6546023 - DNA, 12 bp, Homo sapiens
ttgcatgtaaaa

SEQ ID NO: 6546024 - DNA, 15 bp, Homo sapiens
ttgcatgtaaaatgc

SEQ ID NO: 6546025 - DNA, 18 bp, Homo sapiens
ttgcatgtaaaatgcagt

SEQ ID NO: 6546026 - DNA, 13 bp, Homo sapiens
tgtggacattgag

SEQ ID NO: 6546027 - DNA, 17 bp, Homo sapiens
tgtggaccactgcatga

SEQ ID NO: 6546028 - DNA, 14 bp, Homo sapiens
tgtggaccgaggaa

SEQ ID NO: 6546029 - DNA, 20 bp, Homo sapiens
tgtggaccggccgcagcccc

SEQ ID NO: 6546030 - DNA, 20 bp, Homo sapiens
tgtggaccgtggacaggccc

SEQ ID NO: 6546031 - DNA, 20 bp, Homo sapiens
tgtggacctcaccagagacc

SEQ ID NO: 6546032 - DNA, 13 bp, Homo sapiens
tgtggaccttccc

SEQ ID NO: 6546033 - DNA, 21 bp, Homo sapiens
tgtggacggggaggctctccc

SEQ ID NO: 6546034 - DNA, 21 bp, Homo sapiens
tgtggacgtcacgctccctga

SEQ ID NO: 6546035 - DNA, 19 bp, Homo sapiens
tgtggactaaaagatataa

SEQ ID NO: 6546036 - DNA, 21 bp, Homo sapiens
tgtggactaaaagatataagt

SEQ ID NO: 6546037 - DNA, 18 bp, Homo sapiens
tgtggactggctgtgccc

SEQ ID NO: 6546038 - DNA, 14 bp, Homo sapiens
tgtggactgtgatg

SEQ ID NO: 6546039 - DNA, 13 bp, Homo sapiens
tgtggactgtgcc

SEQ ID NO: 6546040 - DNA, 23 bp, Homo sapiens
tgtggactgtggcacttgcctgg

SEQ ID NO: 6546041 - DNA, 18 bp, Homo sapiens
tgtggacttattcattcc

SEQ ID NO: 6546042 - DNA, 16 bp, Homo sapiens
tgtggactttgttcac

SEQ ID NO: 6546043 - DNA, 18 bp, Homo sapiens
tgtggacttttccccatt

SEQ ID NO: 6546044 - DNA, 12 bp, Homo sapiens
tgtggacttttt

SEQ ID NO: 6546045 - DNA, 23 bp, Homo sapiens
tgtggagaaattcgttgttccca

SEQ ID NO: 6546046 - DNA, 14 bp, Homo sapiens
tgtggagaacattc

SEQ ID NO: 6546047 - DNA, 20 bp, Homo sapiens
tgtggagaactcagtgccac

SEQ ID NO: 6546048 - DNA, 21 bp, Homo sapiens
tgtggagaagcggctggcagc

SEQ ID NO: 6546049 - DNA, 20 bp, Homo sapiens
tgtggagaaggatagcctca

SEQ ID NO: 6546050 - DNA, 16 bp, Homo sapiens
tgtggagaagtgtgtt

SEQ ID NO: 6546051 - DNA, 14 bp, Homo sapiens
tgtggagaatgtac

SEQ ID NO: 6546052 - DNA, 19 bp, Homo sapiens
tgtggagaatgtacacagt

SEQ ID NO: 6546053 - DNA, 16 bp, Homo sapiens
tgtggagacagccctg

SEQ ID NO: 6546054 - DNA, 19 bp, Homo sapiens
tgtggagaccctgccacag

SEQ ID NO: 6546055 - DNA, 20 bp, Homo sapiens
tgtggagaccctgccacagc

SEQ ID NO: 6546056 - DNA, 23 bp, Homo sapiens
tgtggagactgctcctgagcccc

SEQ ID NO: 6546057 - DNA, 21 bp, Homo sapiens
tgtggagagaagtgagcaagg

SEQ ID NO: 6546058 - DNA, 19 bp, Homo sapiens
tgtggagaggagagaatga

SEQ ID NO: 6546059 - DNA, 19 bp, Homo sapiens
tgtggagagggaatgtgaa

SEQ ID NO: 6546060 - DNA, 23 bp, Homo sapiens
tgtggagaggggtgcacccactc

SEQ ID NO: 6546061 - DNA, 21 bp, Homo sapiens
tgtggagagtgagaataattg

SEQ ID NO: 6546062 - DNA, 19 bp, Homo sapiens
tgtggagagtgcaacagta

SEQ ID NO: 6546063 - DNA, 22 bp, Homo sapiens
tgtggagatcacagccccaccc

SEQ ID NO: 6546064 - DNA, 15 bp, Homo sapiens
tgtggagatggactc

SEQ ID NO: 6546065 - DNA, 19 bp, Homo sapiens
tgtggagcaaaaggcagct

SEQ ID NO: 6546066 - DNA, 15 bp, Homo sapiens
tgtggagcacgtgga

SEQ ID NO: 6546067 - DNA, 18 bp, Homo sapiens
tgtggagcacgtggagat

SEQ ID NO: 6546068 - DNA, 15 bp, Homo sapiens
tgtggagcagcagcc

SEQ ID NO: 6546069 - DNA, 12 bp, Homo sapiens
tgtggagccagg

SEQ ID NO: 6546070 - DNA, 13 bp, Homo sapiens
tgtggagccaggc

SEQ ID NO: 6546071 - DNA, 16 bp, Homo sapiens
tgtggagcccgcaccc

SEQ ID NO: 6546072 - DNA, 16 bp, Homo sapiens
tgtggagccgaggcct

SEQ ID NO: 6546073 - DNA, 18 bp, Homo sapiens
tgtggagctctggggggc

SEQ ID NO: 6546074 - DNA, 19 bp, Homo sapiens
tgtggagctgcttccagtt

SEQ ID NO: 6546075 - DNA, 17 bp, Homo sapiens
tgtggaggaagagccac

SEQ ID NO: 6546076 - DNA, 20 bp, Homo sapiens
tgtggaggaagagccacctg

SEQ ID NO: 6546077 - DNA, 20 bp, Homo sapiens
tgtggaggaaggattgtaaa

SEQ ID NO: 6546078 - DNA, 23 bp, Homo sapiens
tgtggaggagaggggtggaggct

SEQ ID NO: 6546079 - DNA, 20 bp, Homo sapiens
tgtggaggagggagagccct

SEQ ID NO: 6546080 - DNA, 21 bp, Homo sapiens
tgtggaggagggagagccctg

SEQ ID NO: 6546081 - DNA, 19 bp, Homo sapiens
tgtggaggcagtgtcattt

SEQ ID NO: 6546082 - DNA, 19 bp, Homo sapiens
tgtggaggctcctgtggta

SEQ ID NO: 6546083 - DNA, 21 bp, Homo sapiens
tgtggagggagggcagctggc

SEQ ID NO: 6546084 - DNA, 15 bp, Homo sapiens
tgtggaggggagctg

SEQ ID NO: 6546085 - DNA, 13 bp, Homo sapiens
tgtggagggttgc

SEQ ID NO: 6546086 - DNA, 21 bp, Homo sapiens
tgtggaggtacactcttatag

SEQ ID NO: 6546087 - DNA, 15 bp, Homo sapiens
tgtggagtagagttt

SEQ ID NO: 6546088 - DNA, 13 bp, Homo sapiens
tgtggagtggaca

SEQ ID NO: 6546089 - DNA, 13 bp, Homo sapiens
tgtggagtgtgct

SEQ ID NO: 6546090 - DNA, 18 bp, Homo sapiens
tgtggagttattcactct

SEQ ID NO: 6546091 - DNA, 18 bp, Homo sapiens
tgtggagttcaccttgga

SEQ ID NO: 6546092 - DNA, 21 bp, Homo sapiens
tgtggagttcaccttggaagg

SEQ ID NO: 6546093 - DNA, 19 bp, Homo sapiens
tgtggagttcctgctccgt

SEQ ID NO: 6546094 - DNA, 22 bp, Homo sapiens
tgtggagttcctgctccgtgga

SEQ ID NO: 6546095 - DNA, 16 bp, Homo sapiens
tgtggagttggggctg

SEQ ID NO: 6546096 - DNA, 18 bp, Homo sapiens
tgtggataacaaagatat

SEQ ID NO: 6546097 - DNA, 17 bp, Homo sapiens
tgtggatacagtgccca

SEQ ID NO: 6546098 - DNA, 17 bp, Homo sapiens
tgtggatactattaaag

SEQ ID NO: 6546099 - DNA, 22 bp, Homo sapiens
tgtggatatcagttaccaaaca

SEQ ID NO: 6546100 - DNA, 16 bp, Homo sapiens
tgtggatatttattta

SEQ ID NO: 6546101 - DNA, 21 bp, Homo sapiens
tgtggatatttatttaaacaa

SEQ ID NO: 6546102 - DNA, 19 bp, Homo sapiens
tgtggatcaaccatcgctt

SEQ ID NO: 6546103 - DNA, 21 bp, Homo sapiens
tgtggatcttgccacatttct

SEQ ID NO: 6546104 - DNA, 16 bp, Homo sapiens
tgtggatgaaaaaaag

SEQ ID NO: 6546105 - DNA, 23 bp, Homo sapiens
tgtggatgacacaatccctgggg

SEQ ID NO: 6546106 - DNA, 19 bp, Homo sapiens
tgtggatgctccagggcag

SEQ ID NO: 6546107 - DNA, 12 bp, Homo sapiens
tgtggatggcag

SEQ ID NO: 6546108 - DNA, 14 bp, Homo sapiens
tgtggatgtcccta

SEQ ID NO: 6546109 - DNA, 15 bp, Homo sapiens
tgtggatgtcttcct

SEQ ID NO: 6546110 - DNA, 16 bp, Homo sapiens
tgtggatgtggacttt

SEQ ID NO: 6546111 - DNA, 19 bp, Homo sapiens
tgtggatgttttaattcca

SEQ ID NO: 6546112 - DNA, 20 bp, Homo sapiens
tgtggattaatgtcaatgtt

SEQ ID NO: 6546113 - DNA, 15 bp, Homo sapiens
tgtggattcagcttc

SEQ ID NO: 6546114 - DNA, 13 bp, Homo sapiens
tgtggattctata

SEQ ID NO: 6546115 - DNA, 18 bp, Homo sapiens
tgtggattctatatttca

SEQ ID NO: 6546116 - DNA, 17 bp, Homo sapiens
tgtggattctgaggccc

SEQ ID NO: 6546117 - DNA, 18 bp, Homo sapiens
tgtggattgagtaatggg

SEQ ID NO: 6546118 - DNA, 15 bp, Homo sapiens
tgtggatttcagttt

SEQ ID NO: 6546119 - DNA, 21 bp, Homo sapiens
tgtggatttttgtggtagtga

SEQ ID NO: 6546120 - DNA, 16 bp, Homo sapiens
tgtggattttttccta

SEQ ID NO: 6546121 - DNA, 22 bp, Homo sapiens
tgtggattttttccttcaaagt

SEQ ID NO: 6546122 - DNA, 19 bp, Homo sapiens
tgtggcaaaacatatacca

SEQ ID NO: 6546123 - DNA, 19 bp, Homo sapiens
tgtggcaaaatatggtttg

SEQ ID NO: 6546124 - DNA, 21 bp, Homo sapiens
tgtggcaaaccccaaagagag

SEQ ID NO: 6546125 - DNA, 16 bp, Homo sapiens
tgtggcaaagtgctgt

SEQ ID NO: 6546126 - DNA, 19 bp, Homo sapiens
tgtggcaaagtgctgtacc

SEQ ID NO: 6546127 - DNA, 20 bp, Homo sapiens
tgtggcaaagtgctgtaccc

SEQ ID NO: 6546128 - DNA, 22 bp, Homo sapiens
tgtggcaaatgccaggacagct

SEQ ID NO: 6546129 - DNA, 15 bp, Homo sapiens
tgtggcaactaaacc

SEQ ID NO: 6546130 - DNA, 16 bp, Homo sapiens
tgtggcaagcaagagc

SEQ ID NO: 6546131 - DNA, 20 bp, Homo sapiens
tgtggcaagcaagagctctt

SEQ ID NO: 6546132 - DNA, 14 bp, Homo sapiens
tgtggcaagtgaat

SEQ ID NO: 6546133 - DNA, 19 bp, Homo sapiens
tgtggcaattagtgtgaca

SEQ ID NO: 6546134 - DNA, 19 bp, Homo sapiens
tgtggcacagatgcccacg

SEQ ID NO: 6546135 - DNA, 17 bp, Homo sapiens
tgtggcacagccctgag

SEQ ID NO: 6546136 - DNA, 16 bp, Homo sapiens
tgtggcacgcacctgt

SEQ ID NO: 6546137 - DNA, 15 bp, Homo sapiens
tgtggcactgccacc

SEQ ID NO: 6546138 - DNA, 19 bp, Homo sapiens
tgtggcactgcttgaggag

SEQ ID NO: 6546139 - DNA, 20 bp, Homo sapiens
tgtggcactgcttgaggagg

SEQ ID NO: 6546140 - DNA, 16 bp, Homo sapiens
tgtggcacttgcctgg

SEQ ID NO: 6546141 - DNA, 15 bp, Homo sapiens
tgtggcagagagaga

SEQ ID NO: 6546142 - DNA, 19 bp, Homo sapiens
tgtggcagagttacagttc

SEQ ID NO: 6546143 - DNA, 20 bp, Homo sapiens
tgtggcagagttacagttct

SEQ ID NO: 6546144 - DNA, 13 bp, Homo sapiens
tgtggcagcagga

SEQ ID NO: 6546145 - DNA, 22 bp, Homo sapiens
tgtggcagcaggcatggcttcc

SEQ ID NO: 6546146 - DNA, 12 bp, Homo sapiens
tgtggcagccca

SEQ ID NO: 6546147 - DNA, 13 bp, Homo sapiens
tgtggcagcccat

SEQ ID NO: 6546148 - DNA, 22 bp, Homo sapiens
tgtggcagccgtcccaggccac

SEQ ID NO: 6546149 - DNA, 13 bp, Homo sapiens
tgtggcagctgcc

SEQ ID NO: 6546150 - DNA, 21 bp, Homo sapiens
tgtggcagctgcccctggcac

SEQ ID NO: 6546151 - DNA, 12 bp, Homo sapiens
tgtggcagctgg

SEQ ID NO: 6546152 - DNA, 13 bp, Homo sapiens
tgtggcagctggg

SEQ ID NO: 6546153 - DNA, 17 bp, Homo sapiens
tgtggcaggaggctttg

SEQ ID NO: 6546154 - DNA, 23 bp, Homo sapiens
tgtggcaggcagcgccaagcaac

SEQ ID NO: 6546155 - DNA, 14 bp, Homo sapiens
tgtggcaggcctag

SEQ ID NO: 6546156 - DNA, 16 bp, Homo sapiens
tgtggcaggggcagtg

SEQ ID NO: 6546157 - DNA, 19 bp, Homo sapiens
tgtggcaggggcagtggcc

SEQ ID NO: 6546158 - DNA, 21 bp, Homo sapiens
tgtggcagtaaagagaaactt

SEQ ID NO: 6546159 - DNA, 16 bp, Homo sapiens
tgtggcagtggccagg

SEQ ID NO: 6546160 - DNA, 19 bp, Homo sapiens
tgtggcagtggccaggcag

SEQ ID NO: 6546161 - DNA, 16 bp, Homo sapiens
tgtggcagtggttttg

SEQ ID NO: 6546162 - DNA, 17 bp, Homo sapiens
tgtggcatcaggaaagg

SEQ ID NO: 6546163 - DNA, 17 bp, Homo sapiens
tgtggcatctttgcctt

SEQ ID NO: 6546164 - DNA, 21 bp, Homo sapiens
tgtggcatctttgccttgggc

SEQ ID NO: 6546165 - DNA, 12 bp, Homo sapiens
tgtggcatgact

SEQ ID NO: 6546166 - DNA, 14 bp, Homo sapiens
tgtggcattggggg

SEQ ID NO: 6546167 - DNA, 15 bp, Homo sapiens
tgtggcatttccaaa

SEQ ID NO: 6546168 - DNA, 20 bp, Homo sapiens
tgtggcatttccaaacatcc

SEQ ID NO: 6546169 - DNA, 14 bp, Homo sapiens
tgtggcatttggaa

SEQ ID NO: 6546170 - DNA, 13 bp, Homo sapiens
tgtggccaaccag

SEQ ID NO: 6546171 - DNA, 14 bp, Homo sapiens
tgtggccaaccagg

SEQ ID NO: 6546172 - DNA, 18 bp, Homo sapiens
tgtggccaaccaggaccc

SEQ ID NO: 6546173 - DNA, 21 bp, Homo sapiens
tgtggccaaccaggacccagg

SEQ ID NO: 6546174 - DNA, 23 bp, Homo sapiens
tgtggccaagggctccagggcca

SEQ ID NO: 6546175 - DNA, 19 bp, Homo sapiens
tgtggccacaactgctgtg

SEQ ID NO: 6546176 - DNA, 18 bp, Homo sapiens
tgtggccacttatttcac

SEQ ID NO: 6546177 - DNA, 13 bp, Homo sapiens
tgtggccagagct

SEQ ID NO: 6546178 - DNA, 19 bp, Homo sapiens
tgtggccagagctggaagg

SEQ ID NO: 6546179 - DNA, 22 bp, Homo sapiens
tgtggccagagctggaaggcag

SEQ ID NO: 6546180 - DNA, 14 bp, Homo sapiens
tgtggccagcagcc

SEQ ID NO: 6546181 - DNA, 13 bp, Homo sapiens
tgtggccagcctg

SEQ ID NO: 6546182 - DNA, 13 bp, Homo sapiens
tgtggccaggagg

SEQ ID NO: 6546183 - DNA, 16 bp, Homo sapiens
tgtggccatatatgct

SEQ ID NO: 6546184 - DNA, 23 bp, Homo sapiens
tgtggccatatatgctgtatttc

SEQ ID NO: 6546185 - DNA, 15 bp, Homo sapiens
tgtggccatatttat

SEQ ID NO: 6546186 - DNA, 22 bp, Homo sapiens
tgtggccatcactcagccccta

SEQ ID NO: 6546187 - DNA, 21 bp, Homo sapiens
tgtggccatgaccctgcctct

SEQ ID NO: 6546188 - DNA, 17 bp, Homo sapiens
tgtggccatggcctctg

SEQ ID NO: 6546189 - DNA, 22 bp, Homo sapiens
tgtggccatggtccccaagacc

SEQ ID NO: 6546190 - DNA, 23 bp, Homo sapiens
tgtggcccacgggccggccagct

SEQ ID NO: 6546191 - DNA, 15 bp, Homo sapiens
tgtggccccaggtgc

SEQ ID NO: 6546192 - DNA, 18 bp, Homo sapiens
tgtggccccaggtgccac

SEQ ID NO: 6546193 - DNA, 17 bp, Homo sapiens
tgtggcccccgccccct

SEQ ID NO: 6546194 - DNA, 22 bp, Homo sapiens
tgtggcccctcccctgcagacg

SEQ ID NO: 6546195 - DNA, 17 bp, Homo sapiens
tgtggccctgcaagggc

SEQ ID NO: 6546196 - DNA, 23 bp, Homo sapiens
tgtggccctgccatcttcccagc

SEQ ID NO: 6546197 - DNA, 14 bp, Homo sapiens
tgtggccctgccct

SEQ ID NO: 6546198 - DNA, 20 bp, Homo sapiens
tgtggccctgcccttggcac

SEQ ID NO: 6546199 - DNA, 12 bp, Homo sapiens
tgtggccctggc

SEQ ID NO: 6546200 - DNA, 16 bp, Homo sapiens
tgtggccctggccact

SEQ ID NO: 6546201 - DNA, 18 bp, Homo sapiens
tgtggccctggctctgct

SEQ ID NO: 6546202 - DNA, 18 bp, Homo sapiens
tgtggccgactctgcact

SEQ ID NO: 6546203 - DNA, 13 bp, Homo sapiens
ttgcatgtttgaa

SEQ ID NO: 6546204 - DNA, 21 bp, Homo sapiens
ttgcattaaattcacaaactt

SEQ ID NO: 6546205 - DNA, 22 bp, Homo sapiens
ttgcattaaattcacaaacttt

SEQ ID NO: 6546206 - DNA, 18 bp, Homo sapiens
ttgcattacgataaacat

SEQ ID NO: 6546207 - DNA, 11 bp, Homo sapiens
ttgcattagaa

SEQ ID NO: 6546208 - DNA, 14 bp, Homo sapiens
ttgcattatgcaat

SEQ ID NO: 6546209 - DNA, 15 bp, Homo sapiens
ttgcattattcatat

SEQ ID NO: 6546210 - DNA, 17 bp, Homo sapiens
ttgcattcatctctcaa

SEQ ID NO: 6546211 - DNA, 21 bp, Homo sapiens
ttgcattcatctctcaaactt

SEQ ID NO: 6546212 - DNA, 20 bp, Homo sapiens
ttgcattcatggttatgaat

SEQ ID NO: 6546213 - DNA, 13 bp, Homo sapiens
ttgcattcatttt

SEQ ID NO: 6546214 - DNA, 11 bp, Homo sapiens
ttgcattccac

SEQ ID NO: 6546215 - DNA, 16 bp, Homo sapiens
ttgcattccagcgtct

SEQ ID NO: 6546216 - DNA, 18 bp, Homo sapiens
ttgcattccttacttgca

SEQ ID NO: 6546217 - DNA, 22 bp, Homo sapiens
ttgcattccttacttgcactgt

SEQ ID NO: 6546218 - DNA, 20 bp, Homo sapiens
ttgcattctattgccttctt

SEQ ID NO: 6546219 - DNA, 14 bp, Homo sapiens
ttgcattgaatata

SEQ ID NO: 6546220 - DNA, 23 bp, Homo sapiens
ttgcattgaatttagtcattatt

SEQ ID NO: 6546221 - DNA, 22 bp, Homo sapiens
ttgcattgaggaaatattaatt

SEQ ID NO: 6546222 - DNA, 16 bp, Homo sapiens
ttgcattgattgctac

SEQ ID NO: 6546223 - DNA, 20 bp, Homo sapiens
ttgcattggtttgagaaagg

SEQ ID NO: 6546224 - DNA, 15 bp, Homo sapiens
ttgcattgtatgaaa

SEQ ID NO: 6546225 - DNA, 13 bp, Homo sapiens
ttgcattgtctgt

SEQ ID NO: 6546226 - DNA, 23 bp, Homo sapiens
ttgcatttacgcctgtaaatgta

SEQ ID NO: 6546227 - DNA, 20 bp, Homo sapiens
ttgcatttacttttaataaa

SEQ ID NO: 6546228 - DNA, 15 bp, Homo sapiens
ttgcatttagaaatc

SEQ ID NO: 6546229 - DNA, 15 bp, Homo sapiens
ttgcatttagaactt

SEQ ID NO: 6546230 - DNA, 23 bp, Homo sapiens
ttgcatttatttatacagtgcct

SEQ ID NO: 6546231 - DNA, 13 bp, Homo sapiens
ttgcatttcagaa

SEQ ID NO: 6546232 - DNA, 13 bp, Homo sapiens
ttgcatttcatgc

SEQ ID NO: 6546233 - DNA, 20 bp, Homo sapiens
ttgcatttctcttcctaaat

SEQ ID NO: 6546234 - DNA, 13 bp, Homo sapiens
ttgcatttcttgt

SEQ ID NO: 6546235 - DNA, 14 bp, Homo sapiens
ttgcatttctttat

SEQ ID NO: 6546236 - DNA, 15 bp, Homo sapiens
ttgcatttgctcttt

SEQ ID NO: 6546237 - DNA, 15 bp, Homo sapiens
ttgcatttgctgttg

SEQ ID NO: 6546238 - DNA, 21 bp, Homo sapiens
ttgcatttggattggggtccc

SEQ ID NO: 6546239 - DNA, 23 bp, Homo sapiens
ttgcatttgtaaaaatgagactt

SEQ ID NO: 6546240 - DNA, 11 bp, Homo sapiens
ttgcatttgtg

SEQ ID NO: 6546241 - DNA, 17 bp, Homo sapiens
ttgcatttttattaaag

SEQ ID NO: 6546242 - DNA, 14 bp, Homo sapiens
ttgcatttttgtat

SEQ ID NO: 6546243 - DNA, 19 bp, Homo sapiens
ttgcatttttgttttgaaa

SEQ ID NO: 6546244 - DNA, 21 bp, Homo sapiens
ttgcatttttgttttgaaagt

SEQ ID NO: 6546245 - DNA, 15 bp, Homo sapiens
ttgccaaaaaggggt

SEQ ID NO: 6546246 - DNA, 18 bp, Homo sapiens
ttgccaaaaagtgaaata

SEQ ID NO: 6546247 - DNA, 16 bp, Homo sapiens
ttgccaaaaccaagat

SEQ ID NO: 6546248 - DNA, 21 bp, Homo sapiens
ttgccaaaacccagctgcacc

SEQ ID NO: 6546249 - DNA, 22 bp, Homo sapiens
ttgccaaaacccagctgcaccc

SEQ ID NO: 6546250 - DNA, 23 bp, Homo sapiens
ttgccaaaacccagctgcacccc

SEQ ID NO: 6546251 - DNA, 13 bp, Homo sapiens
ttgccaaaataat

SEQ ID NO: 6546252 - DNA, 15 bp, Homo sapiens
ttgccaaaataatgt

SEQ ID NO: 6546253 - DNA, 18 bp, Homo sapiens
ttgccaaaataccagagc

SEQ ID NO: 6546254 - DNA, 20 bp, Homo sapiens
ttgccaaaataccagagcct

SEQ ID NO: 6546255 - DNA, 14 bp, Homo sapiens
ttgccaaaatatat

SEQ ID NO: 6546256 - DNA, 13 bp, Homo sapiens
ttgccaaaatcct

SEQ ID NO: 6546257 - DNA, 13 bp, Homo sapiens
ttgccaaaattca

SEQ ID NO: 6546258 - DNA, 14 bp, Homo sapiens
ttgccaaacattaa

SEQ ID NO: 6546259 - DNA, 21 bp, Homo sapiens
ttgccaaacattaatgttgat

SEQ ID NO: 6546260 - DNA, 14 bp, Homo sapiens
ttgccaaagcactt

SEQ ID NO: 6546261 - DNA, 13 bp, Homo sapiens
ttgccaaagcaga

SEQ ID NO: 6546262 - DNA, 13 bp, Homo sapiens
ttgccaaagctgg

SEQ ID NO: 6546263 - DNA, 21 bp, Homo sapiens
ttgccaaagtacagaatttga

SEQ ID NO: 6546264 - DNA, 22 bp, Homo sapiens
ttgccaaataaagttaaaagta

SEQ ID NO: 6546265 - DNA, 13 bp, Homo sapiens
ttgccaacattgc

SEQ ID NO: 6546266 - DNA, 16 bp, Homo sapiens
ttgccaacattgccta

SEQ ID NO: 6546267 - DNA, 16 bp, Homo sapiens
ttgccaaccctgtgtc

SEQ ID NO: 6546268 - DNA, 23 bp, Homo sapiens
ttgccaacctgtaataaatatga

SEQ ID NO: 6546269 - DNA, 22 bp, Homo sapiens
ttgccaactcaggttcacagca

SEQ ID NO: 6546270 - DNA, 21 bp, Homo sapiens
ttgccaagaaaatgaagggat

SEQ ID NO: 6546271 - DNA, 17 bp, Homo sapiens
ttgccaagaatatagtt

SEQ ID NO: 6546272 - DNA, 15 bp, Homo sapiens
ttgccaagacaaatc

SEQ ID NO: 6546273 - DNA, 16 bp, Homo sapiens
ttgccaagacaaatca

SEQ ID NO: 6546274 - DNA, 17 bp, Homo sapiens
ttgccaagacaaatcaa

SEQ ID NO: 6546275 - DNA, 22 bp, Homo sapiens
ttgccaagacaaatcaacagaa

SEQ ID NO: 6546276 - DNA, 12 bp, Homo sapiens
ttgccaagcccc

SEQ ID NO: 6546277 - DNA, 15 bp, Homo sapiens
ttgccaagctcagga

SEQ ID NO: 6546278 - DNA, 14 bp, Homo sapiens
ttgccaagctgaag

SEQ ID NO: 6546279 - DNA, 17 bp, Homo sapiens
ttgccaaggctctcccc

SEQ ID NO: 6546280 - DNA, 23 bp, Homo sapiens
ttgccaagggcccaaagaaagag

SEQ ID NO: 6546281 - DNA, 13 bp, Homo sapiens
ttgccaagtgcct

SEQ ID NO: 6546282 - DNA, 22 bp, Homo sapiens
ttgccaataaagcttttggaag

SEQ ID NO: 6546283 - DNA, 18 bp, Homo sapiens
ttgccaatagtgtcatcc

SEQ ID NO: 6546284 - DNA, 12 bp, Homo sapiens
ttgccaatatgc

SEQ ID NO: 6546285 - DNA, 21 bp, Homo sapiens
ttgccaatgaggtctgaaatg

SEQ ID NO: 6546286 - DNA, 23 bp, Homo sapiens
ttgccaatggtgtagctgtcctc

SEQ ID NO: 6546287 - DNA, 22 bp, Homo sapiens
ttgccaatttgcacattaaatg

SEQ ID NO: 6546288 - DNA, 23 bp, Homo sapiens
ttgccaatttgcacattaaatga

SEQ ID NO: 6546289 - DNA, 23 bp, Homo sapiens
ttgccacaccaatcagagagcct

SEQ ID NO: 6546290 - DNA, 22 bp, Homo sapiens
ttgccacagatgatacttccaa

SEQ ID NO: 6546291 - DNA, 13 bp, Homo sapiens
ttgccacagcttt

SEQ ID NO: 6546292 - DNA, 18 bp, Homo sapiens
ttgccacaggacacagtc

SEQ ID NO: 6546293 - DNA, 19 bp, Homo sapiens
ttgccacaggcctccctgt

SEQ ID NO: 6546294 - DNA, 15 bp, Homo sapiens
ttgccacataattca

SEQ ID NO: 6546295 - DNA, 24 bp, Homo sapiens
ttgccacatccctatagaccactg

SEQ ID NO: 6546296 - DNA, 12 bp, Homo sapiens
ttgccacatctt

SEQ ID NO: 6546297 - DNA, 23 bp, Homo sapiens
ttgccacatcttgaaaatgccac

SEQ ID NO: 6546298 - DNA, 23 bp, Homo sapiens
ttgccacatggtgtctcccaaca

SEQ ID NO: 6546299 - DNA, 18 bp, Homo sapiens
ttgccacattaaattgat

SEQ ID NO: 6546300 - DNA, 23 bp, Homo sapiens
ttgccaccaccagatgagaagtt

SEQ ID NO: 6546301 - DNA, 18 bp, Homo sapiens
ttgccaccactagagctg

SEQ ID NO: 6546302 - DNA, 13 bp, Homo sapiens
ttgccaccaggag

SEQ ID NO: 6546303 - DNA, 15 bp, Homo sapiens
ttgccaccatacctc

SEQ ID NO: 6546304 - DNA, 14 bp, Homo sapiens
ttgccaccatgtat

SEQ ID NO: 6546305 - DNA, 21 bp, Homo sapiens
ttgccaccatgtattcatcca

SEQ ID NO: 6546306 - DNA, 15 bp, Homo sapiens
ttgccaccccaaccc

SEQ ID NO: 6546307 - DNA, 21 bp, Homo sapiens
ttgccaccccaccctccctgg

SEQ ID NO: 6546308 - DNA, 23 bp, Homo sapiens
ttgccaccccaccctccctggag

SEQ ID NO: 6546309 - DNA, 15 bp, Homo sapiens
ttgccacccccagtt

SEQ ID NO: 6546310 - DNA, 13 bp, Homo sapiens
ttgccaccctcat

SEQ ID NO: 6546311 - DNA, 18 bp, Homo sapiens
ttgccacctctaacagca

SEQ ID NO: 6546312 - DNA, 17 bp, Homo sapiens
ttgccacctctggccaa

SEQ ID NO: 6546313 - DNA, 19 bp, Homo sapiens
ttgccacctctggccaaat

SEQ ID NO: 6546314 - DNA, 15 bp, Homo sapiens
ttgccacggccatga

SEQ ID NO: 6546315 - DNA, 12 bp, Homo sapiens
ttgccactaatt

SEQ ID NO: 6546316 - DNA, 21 bp, Homo sapiens
ttgccactcccctaaactcca

SEQ ID NO: 6546317 - DNA, 14 bp, Homo sapiens
ttgccactgcctct

SEQ ID NO: 6546318 - DNA, 22 bp, Homo sapiens
ttgccacttggccaccaggact

SEQ ID NO: 6546319 - DNA, 17 bp, Homo sapiens
ttgccactttggcttct

SEQ ID NO: 6546320 - DNA, 15 bp, Homo sapiens
ttgccagaaagcata

SEQ ID NO: 6546321 - DNA, 20 bp, Homo sapiens
ttgccagaaagcataaaatt

SEQ ID NO: 6546322 - DNA, 15 bp, Homo sapiens
ttgccagaagttgtg

SEQ ID NO: 6546323 - DNA, 22 bp, Homo sapiens
ttgccagacatgtggtgggaca

SEQ ID NO: 6546324 - DNA, 23 bp, Homo sapiens
ttgccagactctaggttatacaa

SEQ ID NO: 6546325 - DNA, 15 bp, Homo sapiens
ttgccagagaaacta

SEQ ID NO: 6546326 - DNA, 19 bp, Homo sapiens
ttgccagagatccaaaaga

SEQ ID NO: 6546327 - DNA, 15 bp, Homo sapiens
ttgccagagcaggag

SEQ ID NO: 6546328 - DNA, 19 bp, Homo sapiens
ttgccagagcaggagcccc

SEQ ID NO: 6546329 - DNA, 12 bp, Homo sapiens
ttgccagaggcc

SEQ ID NO: 6546330 - DNA, 17 bp, Homo sapiens
ttgccagaggccctgga

SEQ ID NO: 6546331 - DNA, 20 bp, Homo sapiens
ttgccagaggccctggaggg

SEQ ID NO: 6546332 - DNA, 13 bp, Homo sapiens
ttgccagcaaata

SEQ ID NO: 6546333 - DNA, 13 bp, Homo sapiens
ttgccagcacagg

SEQ ID NO: 6546334 - DNA, 14 bp, Homo sapiens
ttgccagcagagcc

SEQ ID NO: 6546335 - DNA, 14 bp, Homo sapiens
ttgccagccaggag

SEQ ID NO: 6546336 - DNA, 16 bp, Homo sapiens
ttgccagcctccttgc

SEQ ID NO: 6546337 - DNA, 22 bp, Homo sapiens
ttgccagctcagcagttcactt

SEQ ID NO: 6546338 - DNA, 17 bp, Homo sapiens
ttgccagctgctgagcc

SEQ ID NO: 6546339 - DNA, 15 bp, Homo sapiens
ttgccagctgctgct

SEQ ID NO: 6546340 - DNA, 19 bp, Homo sapiens
ttgccagcttttcctccct

SEQ ID NO: 6546341 - DNA, 18 bp, Homo sapiens
ttgccaggaatgtttcag

SEQ ID NO: 6546342 - DNA, 12 bp, Homo sapiens
ttgccaggagga

SEQ ID NO: 6546343 - DNA, 21 bp, Homo sapiens
ttgccagggatgggcagccca

SEQ ID NO: 6546344 - DNA, 14 bp, Homo sapiens
ttgccagggctctg

SEQ ID NO: 6546345 - DNA, 16 bp, Homo sapiens
ttgccagggctctggg

SEQ ID NO: 6546346 - DNA, 17 bp, Homo sapiens
ttgccagggctctgggg

SEQ ID NO: 6546347 - DNA, 20 bp, Homo sapiens
ttgccaggtgactgtctggg

SEQ ID NO: 6546348 - DNA, 18 bp, Homo sapiens
ttgccaggttgcagctgc

SEQ ID NO: 6546349 - DNA, 19 bp, Homo sapiens
ttgccagtatataagctgt

SEQ ID NO: 6546350 - DNA, 22 bp, Homo sapiens
ttgccagtatataagctgttta

SEQ ID NO: 6546351 - DNA, 19 bp, Homo sapiens
ttgccagtattatgcatat

SEQ ID NO: 6546352 - DNA, 15 bp, Homo sapiens
ttgccagtcagcaac

SEQ ID NO: 6546353 - DNA, 19 bp, Homo sapiens
ttgccagtgataagagcag

SEQ ID NO: 6546354 - DNA, 23 bp, Homo sapiens
ttgccagtgataagagcagtggg

SEQ ID NO: 6546355 - DNA, 13 bp, Homo sapiens
ttgccagtgtctt

SEQ ID NO: 6546356 - DNA, 15 bp, Homo sapiens
ttgccagtgtctttc

SEQ ID NO: 6546357 - DNA, 17 bp, Homo sapiens
ttgccagttgtcctcct

SEQ ID NO: 6546358 - DNA, 19 bp, Homo sapiens
ttgccagttgtcctccttc

SEQ ID NO: 6546359 - DNA, 18 bp, Homo sapiens
ttgccagttttattttct

SEQ ID NO: 6546360 - DNA, 17 bp, Homo sapiens
ttgccagttttccctgg

SEQ ID NO: 6546361 - DNA, 18 bp, Homo sapiens
ttgccagttttccctgga

SEQ ID NO: 6546362 - DNA, 11 bp, Homo sapiens
ttgccataata

SEQ ID NO: 6546363 - DNA, 18 bp, Homo sapiens
ttgccatactttgtctga

SEQ ID NO: 6546364 - DNA, 22 bp, Homo sapiens
ttgccatactttgtctgaaaaa

SEQ ID NO: 6546365 - DNA, 17 bp, Homo sapiens
ttgccatagagtacact

SEQ ID NO: 6546366 - DNA, 23 bp, Homo sapiens
ttgccatagagtacactgcctgc

SEQ ID NO: 6546367 - DNA, 13 bp, Homo sapiens
ttgccatattgca

SEQ ID NO: 6546368 - DNA, 17 bp, Homo sapiens
ttgccatattgcacatg

SEQ ID NO: 6546369 - DNA, 22 bp, Homo sapiens
ttgccatattgcacatgtctta

SEQ ID NO: 6546370 - DNA, 18 bp, Homo sapiens
ttgccatcacactgttgc

SEQ ID NO: 6546371 - DNA, 20 bp, Homo sapiens
ttgccatcagcaacatcatt

SEQ ID NO: 6546372 - DNA, 13 bp, Homo sapiens
ttgccatccctcc

SEQ ID NO: 6546373 - DNA, 16 bp, Homo sapiens
ttgccatccctccctc

SEQ ID NO: 6546374 - DNA, 22 bp, Homo sapiens
ttgccatccctccctccacctc

SEQ ID NO: 6546375 - DNA, 23 bp, Homo sapiens
ttgccatccttgcacttctgtta

SEQ ID NO: 6546376 - DNA, 15 bp, Homo sapiens
ttgccatctctgctc

SEQ ID NO: 6546377 - DNA, 15 bp, Homo sapiens
ttgccatctgttcat

SEQ ID NO: 6546378 - DNA, 20 bp, Homo sapiens
ttgccatctgttcatttcta

SEQ ID NO: 6546379 - DNA, 18 bp, Homo sapiens
ttgccatgaaggcacctg

SEQ ID NO: 6546380 - DNA, 23 bp, Homo sapiens
ttgccatgacaacttctaattgc

SEQ ID NO: 6546381 - DNA, 16 bp, Homo sapiens
tgtggccgaggacttt

SEQ ID NO: 6546382 - DNA, 17 bp, Homo sapiens
tgtggccgccatctgcg

SEQ ID NO: 6546383 - DNA, 20 bp, Homo sapiens
tgtggccgcctggcaggtgg

SEQ ID NO: 6546384 - DNA, 15 bp, Homo sapiens
tgtggccggcctcct

SEQ ID NO: 6546385 - DNA, 16 bp, Homo sapiens
tgtggccggtgccagc

SEQ ID NO: 6546386 - DNA, 16 bp, Homo sapiens
tgtggccgtctcctcc

SEQ ID NO: 6546387 - DNA, 17 bp, Homo sapiens
tgtggccgtctcctccc

SEQ ID NO: 6546388 - DNA, 15 bp, Homo sapiens
tgtggcctaacctgc

SEQ ID NO: 6546389 - DNA, 11 bp, Homo sapiens
tgtggcctatg

SEQ ID NO: 6546390 - DNA, 16 bp, Homo sapiens
tgtggcctcaccctga

SEQ ID NO: 6546391 - DNA, 20 bp, Homo sapiens
tgtggcctcacttccctggg

SEQ ID NO: 6546392 - DNA, 23 bp, Homo sapiens
tgtggcctcacttccctgggaac

SEQ ID NO: 6546393 - DNA, 11 bp, Homo sapiens
tgtggcctcag

SEQ ID NO: 6546394 - DNA, 15 bp, Homo sapiens
tgtggcctcagccct

SEQ ID NO: 6546395 - DNA, 20 bp, Homo sapiens
tgtggcctcattcagcagaa

SEQ ID NO: 6546396 - DNA, 18 bp, Homo sapiens
tgtggcctccctggctcc

SEQ ID NO: 6546397 - DNA, 23 bp, Homo sapiens
tgtggcctccgtcctgtcactga

SEQ ID NO: 6546398 - DNA, 10 bp, Homo sapiens
tgtggcctga

SEQ ID NO: 6546399 - DNA, 13 bp, Homo sapiens
tgtggcctggatc

SEQ ID NO: 6546400 - DNA, 19 bp, Homo sapiens
tgtggcctggtgggtcagg

SEQ ID NO: 6546401 - DNA, 15 bp, Homo sapiens
tgtggcctgtggcct

SEQ ID NO: 6546402 - DNA, 16 bp, Homo sapiens
tgtggcctgtggcctg

SEQ ID NO: 6546403 - DNA, 13 bp, Homo sapiens
tgtggcctgtgtc

SEQ ID NO: 6546404 - DNA, 16 bp, Homo sapiens
tgtggcctgtgtccag

SEQ ID NO: 6546405 - DNA, 22 bp, Homo sapiens
tgtggcctgtgtccagcagctg

SEQ ID NO: 6546406 - DNA, 23 bp, Homo sapiens
tgtggcctgtgtccagcagctgc

SEQ ID NO: 6546407 - DNA, 20 bp, Homo sapiens
tgtggccttccatttatatg

SEQ ID NO: 6546408 - DNA, 22 bp, Homo sapiens
tgtggccttggcatttcttctt

SEQ ID NO: 6546409 - DNA, 13 bp, Homo sapiens
tgtggccttggcc

SEQ ID NO: 6546410 - DNA, 21 bp, Homo sapiens
tgtggccttggccctgacccc

SEQ ID NO: 6546411 - DNA, 19 bp, Homo sapiens
tgtggcctttatctcaacg

SEQ ID NO: 6546412 - DNA, 21 bp, Homo sapiens
tgtggccttttttataactaa

SEQ ID NO: 6546413 - DNA, 20 bp, Homo sapiens
tgtggcgatatgagagggat

SEQ ID NO: 6546414 - DNA, 19 bp, Homo sapiens
tgtggcgccgtctccaggg

SEQ ID NO: 6546415 - DNA, 23 bp, Homo sapiens
tgtggcgccgtctccaggggctg

SEQ ID NO: 6546416 - DNA, 16 bp, Homo sapiens
tgtggcgggcagtggg

SEQ ID NO: 6546417 - DNA, 15 bp, Homo sapiens
tgtggcgtctccctc

SEQ ID NO: 6546418 - DNA, 20 bp, Homo sapiens
tgtggcgttctgctgcccct

SEQ ID NO: 6546419 - DNA, 17 bp, Homo sapiens
tgtggctaaaaaagctg

SEQ ID NO: 6546420 - DNA, 21 bp, Homo sapiens
tgtggctaaatgcctaataaa

SEQ ID NO: 6546421 - DNA, 16 bp, Homo sapiens
tgtggctagtgacaaa

SEQ ID NO: 6546422 - DNA, 20 bp, Homo sapiens
tgtggctcaacacatgagaa

SEQ ID NO: 6546423 - DNA, 20 bp, Homo sapiens
tgtggctcaggggagcaagc

SEQ ID NO: 6546424 - DNA, 22 bp, Homo sapiens
tgtggctcaggggagcaagctt

SEQ ID NO: 6546425 - DNA, 21 bp, Homo sapiens
tgtggctcagtgccttcctct

SEQ ID NO: 6546426 - DNA, 17 bp, Homo sapiens
tgtggctccaagctcag

SEQ ID NO: 6546427 - DNA, 23 bp, Homo sapiens
tgtggctccaagctcaggtgcct

SEQ ID NO: 6546428 - DNA, 20 bp, Homo sapiens
tgtggctccacacacacaaa

SEQ ID NO: 6546429 - DNA, 13 bp, Homo sapiens
tgtggctcccctc

SEQ ID NO: 6546430 - DNA, 16 bp, Homo sapiens
tgtggctccctcctcc

SEQ ID NO: 6546431 - DNA, 13 bp, Homo sapiens
tgtggctccctct

SEQ ID NO: 6546432 - DNA, 15 bp, Homo sapiens
tgtggctccctctct

SEQ ID NO: 6546433 - DNA, 13 bp, Homo sapiens
tgtggctcccttg

SEQ ID NO: 6546434 - DNA, 15 bp, Homo sapiens
tgtggctcctaccag

SEQ ID NO: 6546435 - DNA, 20 bp, Homo sapiens
tgtggctcctcccagcccat

SEQ ID NO: 6546436 - DNA, 14 bp, Homo sapiens
tgtggctcctgcct

SEQ ID NO: 6546437 - DNA, 15 bp, Homo sapiens
tgtggctcctgcctt

SEQ ID NO: 6546438 - DNA, 22 bp, Homo sapiens
tgtggctcctgggccggctgag

SEQ ID NO: 6546439 - DNA, 19 bp, Homo sapiens
tgtggctcgggtgcccagg

SEQ ID NO: 6546440 - DNA, 12 bp, Homo sapiens
tgtggctctggg

SEQ ID NO: 6546441 - DNA, 18 bp, Homo sapiens
tgtggctctgggtgggcg

SEQ ID NO: 6546442 - DNA, 16 bp, Homo sapiens
tgtggctgaggaggcc

SEQ ID NO: 6546443 - DNA, 22 bp, Homo sapiens
tgtggctgaggaggcctccatc

SEQ ID NO: 6546444 - DNA, 13 bp, Homo sapiens
tgtggctgatgat

SEQ ID NO: 6546445 - DNA, 14 bp, Homo sapiens
tgtggctgctagca

SEQ ID NO: 6546446 - DNA, 20 bp, Homo sapiens
tgtggctgctcccagcctct

SEQ ID NO: 6546447 - DNA, 17 bp, Homo sapiens
tgtggctggctctacct

SEQ ID NO: 6546448 - DNA, 13 bp, Homo sapiens
tgtggctgggacc

SEQ ID NO: 6546449 - DNA, 12 bp, Homo sapiens
tgtggctggggg

SEQ ID NO: 6546450 - DNA, 18 bp, Homo sapiens
tgtggctgggggcaggag

SEQ ID NO: 6546451 - DNA, 13 bp, Homo sapiens
tgtggctgggtgg

SEQ ID NO: 6546452 - DNA, 23 bp, Homo sapiens
tgtggctggtgtccccttcccct

SEQ ID NO: 6546453 - DNA, 20 bp, Homo sapiens
tgtggctgtagatcccaaga

SEQ ID NO: 6546454 - DNA, 17 bp, Homo sapiens
tgtggctgtattcagat

SEQ ID NO: 6546455 - DNA, 23 bp, Homo sapiens
tgtggctgtcaaatccatgtgtc

SEQ ID NO: 6546456 - DNA, 13 bp, Homo sapiens
tgtggctgtgcaa

SEQ ID NO: 6546457 - DNA, 16 bp, Homo sapiens
tgtggcttaaacattt

SEQ ID NO: 6546458 - DNA, 22 bp, Homo sapiens
tgtggcttaccttgattaacat

SEQ ID NO: 6546459 - DNA, 23 bp, Homo sapiens
tgtggcttctctgtctctgtgga

SEQ ID NO: 6546460 - DNA, 19 bp, Homo sapiens
tgtggcttgctagctatgt

SEQ ID NO: 6546461 - DNA, 18 bp, Homo sapiens
tgtggcttggtgagtctg

SEQ ID NO: 6546462 - DNA, 13 bp, Homo sapiens
tgtggctttatga

SEQ ID NO: 6546463 - DNA, 12 bp, Homo sapiens
tgtggctttgtt

SEQ ID NO: 6546464 - DNA, 16 bp, Homo sapiens
tgtgggaaaaaagaaa

SEQ ID NO: 6546465 - DNA, 17 bp, Homo sapiens
tgtgggaaaaaagaaaa

SEQ ID NO: 6546466 - DNA, 17 bp, Homo sapiens
tgtgggaaaaaagaaat

SEQ ID NO: 6546467 - DNA, 19 bp, Homo sapiens
tgtgggaaacctcattgtt

SEQ ID NO: 6546468 - DNA, 18 bp, Homo sapiens
tgtgggaacattattttt

SEQ ID NO: 6546469 - DNA, 23 bp, Homo sapiens
tgtgggaacgagaggggaagagt

SEQ ID NO: 6546470 - DNA, 11 bp, Homo sapiens
tgtgggaagat

SEQ ID NO: 6546471 - DNA, 19 bp, Homo sapiens
tgtgggaatgcggcaagaa

SEQ ID NO: 6546472 - DNA, 15 bp, Homo sapiens
tgtgggaatttaaga

SEQ ID NO: 6546473 - DNA, 17 bp, Homo sapiens
tgtgggacacctgggag

SEQ ID NO: 6546474 - DNA, 21 bp, Homo sapiens
tgtgggaccaggtctgtggaa

SEQ ID NO: 6546475 - DNA, 15 bp, Homo sapiens
tgtgggaccagtccc

SEQ ID NO: 6546476 - DNA, 18 bp, Homo sapiens
tgtgggaccccaggccca

SEQ ID NO: 6546477 - DNA, 18 bp, Homo sapiens
tgtgggaccgcctggccc

SEQ ID NO: 6546478 - DNA, 17 bp, Homo sapiens
tgtgggactagcctggc

SEQ ID NO: 6546479 - DNA, 21 bp, Homo sapiens
tgtgggactccaggccagctc

SEQ ID NO: 6546480 - DNA, 14 bp, Homo sapiens
tgtgggactggccc

SEQ ID NO: 6546481 - DNA, 16 bp, Homo sapiens
tgtgggactggcccac

SEQ ID NO: 6546482 - DNA, 18 bp, Homo sapiens
tgtgggactggcccaccc

SEQ ID NO: 6546483 - DNA, 15 bp, Homo sapiens
tgtgggactgtacac

SEQ ID NO: 6546484 - DNA, 21 bp, Homo sapiens
tgtgggactgtacacacttta

SEQ ID NO: 6546485 - DNA, 16 bp, Homo sapiens
tgtgggagaagggaca

SEQ ID NO: 6546486 - DNA, 16 bp, Homo sapiens
tgtgggagacagcagc

SEQ ID NO: 6546487 - DNA, 19 bp, Homo sapiens
tgtgggagacagcagcctg

SEQ ID NO: 6546488 - DNA, 23 bp, Homo sapiens
tgtgggagaccggcctgccagga

SEQ ID NO: 6546489 - DNA, 12 bp, Homo sapiens
tgtgggagcctc

SEQ ID NO: 6546490 - DNA, 13 bp, Homo sapiens
tgtgggaggaaga

SEQ ID NO: 6546491 - DNA, 15 bp, Homo sapiens
tgtgggagtgtgtaa

SEQ ID NO: 6546492 - DNA, 15 bp, Homo sapiens
tgtgggatgtcctct

SEQ ID NO: 6546493 - DNA, 16 bp, Homo sapiens
tgtgggattatgggtc

SEQ ID NO: 6546494 - DNA, 23 bp, Homo sapiens
tgtgggattatgggtcacaggaa

SEQ ID NO: 6546495 - DNA, 14 bp, Homo sapiens
tgtgggcaaaggca

SEQ ID NO: 6546496 - DNA, 14 bp, Homo sapiens
tgtgggcacccccg

SEQ ID NO: 6546497 - DNA, 14 bp, Homo sapiens
tgtgggcactggcc

SEQ ID NO: 6546498 - DNA, 16 bp, Homo sapiens
tgtgggcactggccca

SEQ ID NO: 6546499 - DNA, 18 bp, Homo sapiens
tgtgggcactggcccagg

SEQ ID NO: 6546500 - DNA, 19 bp, Homo sapiens
tgtgggcagcaccctcccc

SEQ ID NO: 6546501 - DNA, 19 bp, Homo sapiens
tgtgggcaggcaagccctt

SEQ ID NO: 6546502 - DNA, 20 bp, Homo sapiens
tgtgggcaggcaagcccttc

SEQ ID NO: 6546503 - DNA, 14 bp, Homo sapiens
tgtgggcagtcatc

SEQ ID NO: 6546504 - DNA, 19 bp, Homo sapiens
tgtgggcatgagctgctgt

SEQ ID NO: 6546505 - DNA, 14 bp, Homo sapiens
tgtgggcatggccg

SEQ ID NO: 6546506 - DNA, 22 bp, Homo sapiens
tgtgggccaccgtgcctggctg

SEQ ID NO: 6546507 - DNA, 24 bp, Homo sapiens
tgtgggccagccgattcctccagc

SEQ ID NO: 6546508 - DNA, 17 bp, Homo sapiens
tgtgggccctaccctcc

SEQ ID NO: 6546509 - DNA, 19 bp, Homo sapiens
tgtgggcctcaaggacttg

SEQ ID NO: 6546510 - DNA, 21 bp, Homo sapiens
tgtgggcctcaaggacttgaa

SEQ ID NO: 6546511 - DNA, 22 bp, Homo sapiens
tgtgggcctcacctgcccctct

SEQ ID NO: 6546512 - DNA, 15 bp, Homo sapiens
tgtgggcctgggctc

SEQ ID NO: 6546513 - DNA, 18 bp, Homo sapiens
tgtgggcgcccaccctgg

SEQ ID NO: 6546514 - DNA, 19 bp, Homo sapiens
tgtgggcgcccaccctggg

SEQ ID NO: 6546515 - DNA, 13 bp, Homo sapiens
tgtgggcggctcc

SEQ ID NO: 6546516 - DNA, 20 bp, Homo sapiens
tgtgggcggctcctggtgct

SEQ ID NO: 6546517 - DNA, 21 bp, Homo sapiens
tgtgggcgtgagacctgcccc

SEQ ID NO: 6546518 - DNA, 13 bp, Homo sapiens
tgtgggctcacac

SEQ ID NO: 6546519 - DNA, 13 bp, Homo sapiens
tgtgggctcccac

SEQ ID NO: 6546520 - DNA, 14 bp, Homo sapiens
tgtgggctcccacg

SEQ ID NO: 6546521 - DNA, 20 bp, Homo sapiens
tgtgggctcccacgccctcc

SEQ ID NO: 6546522 - DNA, 18 bp, Homo sapiens
tgtgggctgaaggatggg

SEQ ID NO: 6546523 - DNA, 20 bp, Homo sapiens
tgtgggctgcactctgtgcc

SEQ ID NO: 6546524 - DNA, 13 bp, Homo sapiens
tgtgggctgccct

SEQ ID NO: 6546525 - DNA, 19 bp, Homo sapiens
tgtgggctggtgccccaca

SEQ ID NO: 6546526 - DNA, 13 bp, Homo sapiens
tgtgggctgtgag

SEQ ID NO: 6546527 - DNA, 14 bp, Homo sapiens
tgtgggctgtgagt

SEQ ID NO: 6546528 - DNA, 17 bp, Homo sapiens
tgtgggcttcaggtgtt

SEQ ID NO: 6546529 - DNA, 21 bp, Homo sapiens
tgtgggcttcctgctgggact

SEQ ID NO: 6546530 - DNA, 16 bp, Homo sapiens
tgtgggcttgaccagg

SEQ ID NO: 6546531 - DNA, 13 bp, Homo sapiens
tgtggggaaaggg

SEQ ID NO: 6546532 - DNA, 16 bp, Homo sapiens
tgtggggaacatggct

SEQ ID NO: 6546533 - DNA, 17 bp, Homo sapiens
tgtggggaagaggggct

SEQ ID NO: 6546534 - DNA, 14 bp, Homo sapiens
tgtggggacacagc

SEQ ID NO: 6546535 - DNA, 17 bp, Homo sapiens
tgtggggacccaggctc

SEQ ID NO: 6546536 - DNA, 19 bp, Homo sapiens
tgtggggacctcagcctgc

SEQ ID NO: 6546537 - DNA, 13 bp, Homo sapiens
tgtggggactccg

SEQ ID NO: 6546538 - DNA, 13 bp, Homo sapiens
tgtggggaggctg

SEQ ID NO: 6546539 - DNA, 16 bp, Homo sapiens
tgtggggaggctgcac

SEQ ID NO: 6546540 - DNA, 21 bp, Homo sapiens
tgtggggagggcaggtccagc

SEQ ID NO: 6546541 - DNA, 12 bp, Homo sapiens
tgtggggatgtt

SEQ ID NO: 6546542 - DNA, 16 bp, Homo sapiens
tgtggggatttctccc

SEQ ID NO: 6546543 - DNA, 15 bp, Homo sapiens
tgtggggcaagcctg

SEQ ID NO: 6546544 - DNA, 12 bp, Homo sapiens
tgtggggcacag

SEQ ID NO: 6546545 - DNA, 13 bp, Homo sapiens
tgtggggccacac

SEQ ID NO: 6546546 - DNA, 22 bp, Homo sapiens
tgtggggccaggaccatggccg

SEQ ID NO: 6546547 - DNA, 23 bp, Homo sapiens
tgtggggccatgcctcctcagga

SEQ ID NO: 6546548 - DNA, 15 bp, Homo sapiens
tgtggggcccaagca

SEQ ID NO: 6546549 - DNA, 16 bp, Homo sapiens
tgtggggcccaagcat

SEQ ID NO: 6546550 - DNA, 18 bp, Homo sapiens
tgtggggcctcaggctcc

SEQ ID NO: 6546551 - DNA, 16 bp, Homo sapiens
tgtggggcctgggagg

SEQ ID NO: 6546552 - DNA, 17 bp, Homo sapiens
tgtggggctgagctggg

SEQ ID NO: 6546553 - DNA, 13 bp, Homo sapiens
tgtggggctgggc

SEQ ID NO: 6546554 - DNA, 23 bp, Homo sapiens
tgtgggggaagagcacagccctc

SEQ ID NO: 6546555 - DNA, 16 bp, Homo sapiens
tgtgggggactgtaag

SEQ ID NO: 6546556 - DNA, 21 bp, Homo sapiens
tgtgggggaggcgcacagtgt

SEQ ID NO: 6546557 - DNA, 15 bp, Homo sapiens
tgtgggggcttcatc

SEQ ID NO: 6546558 - DNA, 14 bp, Homo sapiens
tgtggggggaagct

SEQ ID NO: 6546559 - DNA, 13 bp, Homo sapiens
tgtggggggaggc

SEQ ID NO: 6546560 - DNA, 19 bp, Homo sapiens
tgtggggggtaatccctgc

SEQ ID NO: 6546561 - DNA, 15 bp, Homo sapiens
ttgccatgaggcctt

SEQ ID NO: 6546562 - DNA, 19 bp, Homo sapiens
ttgccatgaggcctttccc

SEQ ID NO: 6546563 - DNA, 22 bp, Homo sapiens
ttgccatgaggcctttccccag

SEQ ID NO: 6546564 - DNA, 14 bp, Homo sapiens
ttgccatgctgcta

SEQ ID NO: 6546565 - DNA, 21 bp, Homo sapiens
ttgccatgggcttcactgtat

SEQ ID NO: 6546566 - DNA, 16 bp, Homo sapiens
ttgccatgtagacccc

SEQ ID NO: 6546567 - DNA, 14 bp, Homo sapiens
ttgccatgtgtttt

SEQ ID NO: 6546568 - DNA, 14 bp, Homo sapiens
ttgccatgttgcca

SEQ ID NO: 6546569 - DNA, 19 bp, Homo sapiens
ttgccatgttggccaggct

SEQ ID NO: 6546570 - DNA, 21 bp, Homo sapiens
ttgccatgttggccaggctgg

SEQ ID NO: 6546571 - DNA, 19 bp, Homo sapiens
ttgccattatagcgcctgt

SEQ ID NO: 6546572 - DNA, 20 bp, Homo sapiens
ttgccattatagcgcctgta

SEQ ID NO: 6546573 - DNA, 21 bp, Homo sapiens
ttgccattatagcgcctgtat

SEQ ID NO: 6546574 - DNA, 20 bp, Homo sapiens
ttgccattctcttgcattgt

SEQ ID NO: 6546575 - DNA, 21 bp, Homo sapiens
ttgccattctcttgcattgtg

SEQ ID NO: 6546576 - DNA, 24 bp, Homo sapiens
ttgccatttcttcccaaggccagt

SEQ ID NO: 6546577 - DNA, 16 bp, Homo sapiens
ttgccatttctttata

SEQ ID NO: 6546578 - DNA, 21 bp, Homo sapiens
ttgccatttctttatatggaa

SEQ ID NO: 6546579 - DNA, 19 bp, Homo sapiens
ttgccatttgtatactttt

SEQ ID NO: 6546580 - DNA, 21 bp, Homo sapiens
ttgccattttattaaacattt

SEQ ID NO: 6546581 - DNA, 19 bp, Homo sapiens
ttgccatttttattagaaa

SEQ ID NO: 6546582 - DNA, 17 bp, Homo sapiens
ttgcccaaatctgccta

SEQ ID NO: 6546583 - DNA, 20 bp, Homo sapiens
ttgcccaacaccagcccctg

SEQ ID NO: 6546584 - DNA, 16 bp, Homo sapiens
ttgcccaacctcagca

SEQ ID NO: 6546585 - DNA, 16 bp, Homo sapiens
ttgcccaactcccagc

SEQ ID NO: 6546586 - DNA, 19 bp, Homo sapiens
ttgcccaagtcacacagct

SEQ ID NO: 6546587 - DNA, 18 bp, Homo sapiens
ttgcccacacacactcct

SEQ ID NO: 6546588 - DNA, 21 bp, Homo sapiens
ttgcccacacacactccttcc

SEQ ID NO: 6546589 - DNA, 15 bp, Homo sapiens
ttgcccacacacttt

SEQ ID NO: 6546590 - DNA, 19 bp, Homo sapiens
ttgcccacacctgcctctg

SEQ ID NO: 6546591 - DNA, 15 bp, Homo sapiens
ttgcccacaggtgcg

SEQ ID NO: 6546592 - DNA, 23 bp, Homo sapiens
ttgcccacgctggagtgcagtga

SEQ ID NO: 6546593 - DNA, 17 bp, Homo sapiens
ttgcccactcctgctct

SEQ ID NO: 6546594 - DNA, 16 bp, Homo sapiens
ttgcccacttctgtgt

SEQ ID NO: 6546595 - DNA, 17 bp, Homo sapiens
ttgcccacttctgtgta

SEQ ID NO: 6546596 - DNA, 18 bp, Homo sapiens
ttgcccagagatgcctcc

SEQ ID NO: 6546597 - DNA, 17 bp, Homo sapiens
ttgcccagagcacttta

SEQ ID NO: 6546598 - DNA, 15 bp, Homo sapiens
ttgcccagcagctca

SEQ ID NO: 6546599 - DNA, 15 bp, Homo sapiens
ttgcccagcctggat

SEQ ID NO: 6546600 - DNA, 10 bp, Homo sapiens
ttgcccagct

SEQ ID NO: 6546601 - DNA, 13 bp, Homo sapiens
ttgcccaggcagg

SEQ ID NO: 6546602 - DNA, 16 bp, Homo sapiens
ttgcccaggcaggtct

SEQ ID NO: 6546603 - DNA, 15 bp, Homo sapiens
ttgcccaggcctccc

SEQ ID NO: 6546604 - DNA, 16 bp, Homo sapiens
ttgcccaggcctcccc

SEQ ID NO: 6546605 - DNA, 14 bp, Homo sapiens
ttgcccaggctgga

SEQ ID NO: 6546606 - DNA, 17 bp, Homo sapiens
ttgcccaggctggagtg

SEQ ID NO: 6546607 - DNA, 20 bp, Homo sapiens
ttgcccaggctggagtgcaa

SEQ ID NO: 6546608 - DNA, 18 bp, Homo sapiens
ttgcccaggctggtctca

SEQ ID NO: 6546609 - DNA, 19 bp, Homo sapiens
ttgcccagggctcagcctg

SEQ ID NO: 6546610 - DNA, 20 bp, Homo sapiens
ttgcccagggtcctgtgcct

SEQ ID NO: 6546611 - DNA, 22 bp, Homo sapiens
ttgcccaggtgagggaaggaga

SEQ ID NO: 6546612 - DNA, 20 bp, Homo sapiens
ttgcccagtacatttaaatt

SEQ ID NO: 6546613 - DNA, 11 bp, Homo sapiens
ttgcccagtcc

SEQ ID NO: 6546614 - DNA, 16 bp, Homo sapiens
ttgcccagtgagccct

SEQ ID NO: 6546615 - DNA, 18 bp, Homo sapiens
ttgcccagtgagccctgc

SEQ ID NO: 6546616 - DNA, 14 bp, Homo sapiens
ttgcccatccatct

SEQ ID NO: 6546617 - DNA, 13 bp, Homo sapiens
ttgcccatcctga

SEQ ID NO: 6546618 - DNA, 15 bp, Homo sapiens
ttgcccatgatataa

SEQ ID NO: 6546619 - DNA, 14 bp, Homo sapiens
ttgcccatgggata

SEQ ID NO: 6546620 - DNA, 21 bp, Homo sapiens
ttgcccattctctaagcctgg

SEQ ID NO: 6546621 - DNA, 15 bp, Homo sapiens
ttgcccatttacact

SEQ ID NO: 6546622 - DNA, 17 bp, Homo sapiens
ttgcccatttatattca

SEQ ID NO: 6546623 - DNA, 15 bp, Homo sapiens
ttgccccaaccccca

SEQ ID NO: 6546624 - DNA, 21 bp, Homo sapiens
ttgccccaacccccagcaccc

SEQ ID NO: 6546625 - DNA, 12 bp, Homo sapiens
ttgccccaagat

SEQ ID NO: 6546626 - DNA, 13 bp, Homo sapiens
ttgccccacagtt

SEQ ID NO: 6546627 - DNA, 17 bp, Homo sapiens
ttgccccacagttgtgt

SEQ ID NO: 6546628 - DNA, 20 bp, Homo sapiens
ttgccccacagttgtgttca

SEQ ID NO: 6546629 - DNA, 13 bp, Homo sapiens
ttgccccacctcc

SEQ ID NO: 6546630 - DNA, 16 bp, Homo sapiens
ttgccccacctccccc

SEQ ID NO: 6546631 - DNA, 15 bp, Homo sapiens
ttgccccactctgcc

SEQ ID NO: 6546632 - DNA, 17 bp, Homo sapiens
ttgccccagacctggaa

SEQ ID NO: 6546633 - DNA, 19 bp, Homo sapiens
ttgccccagacctggaaga

SEQ ID NO: 6546634 - DNA, 14 bp, Homo sapiens
ttgccccagagccc

SEQ ID NO: 6546635 - DNA, 16 bp, Homo sapiens
ttgccccaggccaggt

SEQ ID NO: 6546636 - DNA, 15 bp, Homo sapiens
ttgccccaggccctg

SEQ ID NO: 6546637 - DNA, 14 bp, Homo sapiens
ttgccccatcactg

SEQ ID NO: 6546638 - DNA, 21 bp, Homo sapiens
ttgcccccaaacccccattct

SEQ ID NO: 6546639 - DNA, 13 bp, Homo sapiens
ttgcccccacctc

SEQ ID NO: 6546640 - DNA, 14 bp, Homo sapiens
ttgcccccacctct

SEQ ID NO: 6546641 - DNA, 18 bp, Homo sapiens
ttgcccccacctctggtc

SEQ ID NO: 6546642 - DNA, 15 bp, Homo sapiens
ttgcccccagggcac

SEQ ID NO: 6546643 - DNA, 13 bp, Homo sapiens
ttgcccccatccc

SEQ ID NO: 6546644 - DNA, 13 bp, Homo sapiens
ttgcccccatggg

SEQ ID NO: 6546645 - DNA, 20 bp, Homo sapiens
ttgcccccatggggtccttg

SEQ ID NO: 6546646 - DNA, 23 bp, Homo sapiens
ttgcccccatggggtccttggag

SEQ ID NO: 6546647 - DNA, 17 bp, Homo sapiens
ttgcccccattcccagc

SEQ ID NO: 6546648 - DNA, 13 bp, Homo sapiens
ttgcccccatttc

SEQ ID NO: 6546649 - DNA, 12 bp, Homo sapiens
ttgccccccacc

SEQ ID NO: 6546650 - DNA, 13 bp, Homo sapiens
ttgccccccaccc

SEQ ID NO: 6546651 - DNA, 16 bp, Homo sapiens
ttgccccccaccccag

SEQ ID NO: 6546652 - DNA, 22 bp, Homo sapiens
ttgccccctgcccgtgtacata

SEQ ID NO: 6546653 - DNA, 23 bp, Homo sapiens
ttgccccgactccgcttcccctg

SEQ ID NO: 6546654 - DNA, 14 bp, Homo sapiens
ttgcccctctgcct

SEQ ID NO: 6546655 - DNA, 13 bp, Homo sapiens
ttgcccctgagac

SEQ ID NO: 6546656 - DNA, 12 bp, Homo sapiens
ttgcccctgctc

SEQ ID NO: 6546657 - DNA, 15 bp, Homo sapiens
ttgcccctgctctgt

SEQ ID NO: 6546658 - DNA, 13 bp, Homo sapiens
ttgcccctggcaa

SEQ ID NO: 6546659 - DNA, 19 bp, Homo sapiens
ttgcccctggctttgcctc

SEQ ID NO: 6546660 - DNA, 18 bp, Homo sapiens
ttgccccttccccatctc

SEQ ID NO: 6546661 - DNA, 16 bp, Homo sapiens
ttgcccctttcagtat

SEQ ID NO: 6546662 - DNA, 20 bp, Homo sapiens
ttgcccgaaactaagccagg

SEQ ID NO: 6546663 - DNA, 21 bp, Homo sapiens
ttgcccgcacccctccctgct

SEQ ID NO: 6546664 - DNA, 15 bp, Homo sapiens
ttgcccgccagccag

SEQ ID NO: 6546665 - DNA, 23 bp, Homo sapiens
ttgcccgccctccacccactagg

SEQ ID NO: 6546666 - DNA, 17 bp, Homo sapiens
ttgcccgcgctcaggag

SEQ ID NO: 6546667 - DNA, 17 bp, Homo sapiens
ttgcccggattctggga

SEQ ID NO: 6546668 - DNA, 17 bp, Homo sapiens
ttgcccgtcgtgtgctg

SEQ ID NO: 6546669 - DNA, 15 bp, Homo sapiens
ttgccctaagcagaa

SEQ ID NO: 6546670 - DNA, 15 bp, Homo sapiens
ttgccctagcccaga

SEQ ID NO: 6546671 - DNA, 16 bp, Homo sapiens
ttgccctatgctgtgc

SEQ ID NO: 6546672 - DNA, 15 bp, Homo sapiens
ttgccctccgcctgg

SEQ ID NO: 6546673 - DNA, 18 bp, Homo sapiens
ttgccctccgcctgggat

SEQ ID NO: 6546674 - DNA, 14 bp, Homo sapiens
ttgccctcctgggc

SEQ ID NO: 6546675 - DNA, 12 bp, Homo sapiens
ttgccctgacct

SEQ ID NO: 6546676 - DNA, 13 bp, Homo sapiens
ttgccctgacctc

SEQ ID NO: 6546677 - DNA, 21 bp, Homo sapiens
ttgccctgacctcccagccct

SEQ ID NO: 6546678 - DNA, 15 bp, Homo sapiens
ttgccctgaggggcc

SEQ ID NO: 6546679 - DNA, 12 bp, Homo sapiens
ttgccctgccag

SEQ ID NO: 6546680 - DNA, 19 bp, Homo sapiens
ttgccctgcgtcccttctc

SEQ ID NO: 6546681 - DNA, 18 bp, Homo sapiens
ttgccctgctgccctccc

SEQ ID NO: 6546682 - DNA, 20 bp, Homo sapiens
ttgccctggagcctcagcag

SEQ ID NO: 6546683 - DNA, 22 bp, Homo sapiens
ttgccctggagcctcagcagca

SEQ ID NO: 6546684 - DNA, 20 bp, Homo sapiens
ttgccctgtggattccagca

SEQ ID NO: 6546685 - DNA, 15 bp, Homo sapiens
ttgccctgtttcctg

SEQ ID NO: 6546686 - DNA, 20 bp, Homo sapiens
ttgccctgtttcctgctgct

SEQ ID NO: 6546687 - DNA, 20 bp, Homo sapiens
ttgcccttcaggacccttct

SEQ ID NO: 6546688 - DNA, 17 bp, Homo sapiens
ttgcccttccctgtccc

SEQ ID NO: 6546689 - DNA, 12 bp, Homo sapiens
ttgcccttcctc

SEQ ID NO: 6546690 - DNA, 13 bp, Homo sapiens
ttgcccttcctcc

SEQ ID NO: 6546691 - DNA, 16 bp, Homo sapiens
ttgcccttcctgaccc

SEQ ID NO: 6546692 - DNA, 15 bp, Homo sapiens
ttgcccttgccctga

SEQ ID NO: 6546693 - DNA, 17 bp, Homo sapiens
ttgcccttgccctgacc

SEQ ID NO: 6546694 - DNA, 13 bp, Homo sapiens
ttgccctttccat

SEQ ID NO: 6546695 - DNA, 12 bp, Homo sapiens
ttgcccttttcc

SEQ ID NO: 6546696 - DNA, 16 bp, Homo sapiens
ttgccgcacatgaaac

SEQ ID NO: 6546697 - DNA, 18 bp, Homo sapiens
ttgccgcgtcgccctccc

SEQ ID NO: 6546698 - DNA, 14 bp, Homo sapiens
ttgccgctcccctt

SEQ ID NO: 6546699 - DNA, 16 bp, Homo sapiens
ttgccgctgggagagc

SEQ ID NO: 6546700 - DNA, 15 bp, Homo sapiens
ttgccgctgtataaa

SEQ ID NO: 6546701 - DNA, 15 bp, Homo sapiens
ttgccgggcctggac

SEQ ID NO: 6546702 - DNA, 13 bp, Homo sapiens
ttgccgtctacct

SEQ ID NO: 6546703 - DNA, 15 bp, Homo sapiens
ttgccgtctacctga

SEQ ID NO: 6546704 - DNA, 15 bp, Homo sapiens
ttgccgtctaggatt

SEQ ID NO: 6546705 - DNA, 18 bp, Homo sapiens
ttgccgtggcatcttaaa

SEQ ID NO: 6546706 - DNA, 21 bp, Homo sapiens
ttgccgttgccaagaactgaa

SEQ ID NO: 6546707 - DNA, 18 bp, Homo sapiens
ttgcctaaaatttctgag

SEQ ID NO: 6546708 - DNA, 17 bp, Homo sapiens
ttgcctaaatccaaaga

SEQ ID NO: 6546709 - DNA, 20 bp, Homo sapiens
ttgcctaaatccaaagaaaa

SEQ ID NO: 6546710 - DNA, 14 bp, Homo sapiens
ttgcctaaatccat

SEQ ID NO: 6546711 - DNA, 22 bp, Homo sapiens
ttgcctaaatccatttggaaat

SEQ ID NO: 6546712 - DNA, 22 bp, Homo sapiens
ttgcctaagaataaacatttgt

SEQ ID NO: 6546713 - DNA, 16 bp, Homo sapiens
ttgcctaagtattaaa

SEQ ID NO: 6546714 - DNA, 23 bp, Homo sapiens
ttgcctaagtattaaaacattgg

SEQ ID NO: 6546715 - DNA, 22 bp, Homo sapiens
ttgcctaatacattaaagcagt

SEQ ID NO: 6546716 - DNA, 20 bp, Homo sapiens
ttgcctaatatgatgactgt

SEQ ID NO: 6546717 - DNA, 19 bp, Homo sapiens
ttgcctacaataaaaagaa

SEQ ID NO: 6546718 - DNA, 17 bp, Homo sapiens
ttgcctactatgccaga

SEQ ID NO: 6546719 - DNA, 22 bp, Homo sapiens
ttgcctagaaatatctttctct

SEQ ID NO: 6546720 - DNA, 19 bp, Homo sapiens
ttgcctataatacttgcaa

SEQ ID NO: 6546721 - DNA, 22 bp, Homo sapiens
ttgcctataatacttgcaacta

SEQ ID NO: 6546722 - DNA, 16 bp, Homo sapiens
ttgcctatcctgctgt

SEQ ID NO: 6546723 - DNA, 14 bp, Homo sapiens
ttgcctatctttaa

SEQ ID NO: 6546724 - DNA, 12 bp, Homo sapiens
ttgcctatgata

SEQ ID NO: 6546725 - DNA, 23 bp, Homo sapiens
ttgcctatgatactgtctctcca

SEQ ID NO: 6546726 - DNA, 16 bp, Homo sapiens
ttgcctatttccccct

SEQ ID NO: 6546727 - DNA, 21 bp, Homo sapiens
ttgcctcaacagcaggaggca

SEQ ID NO: 6546728 - DNA, 20 bp, Homo sapiens
ttgcctcagtagatactaaa

SEQ ID NO: 6546729 - DNA, 20 bp, Homo sapiens
ttgcctcatggccagcgccc

SEQ ID NO: 6546730 - DNA, 21 bp, Homo sapiens
ttgcctccacctctccttgga

SEQ ID NO: 6546731 - DNA, 23 bp, Homo sapiens
ttgcctccactcaccacaagctg

SEQ ID NO: 6546732 - DNA, 14 bp, Homo sapiens
ttgcctccatcttt

SEQ ID NO: 6546733 - DNA, 18 bp, Homo sapiens
ttgcctccatctttttct

SEQ ID NO: 6546734 - DNA, 21 bp, Homo sapiens
ttgcctccatctttttcttgg

SEQ ID NO: 6546735 - DNA, 22 bp, Homo sapiens
ttgcctccatctttttcttggg

SEQ ID NO: 6546736 - DNA, 23 bp, Homo sapiens
ttgcctccatctttttcttgggt

SEQ ID NO: 6546737 - DNA, 12 bp, Homo sapiens
ttgcctcccagg

SEQ ID NO: 6546738 - DNA, 17 bp, Homo sapiens
ttgcctccccatttccc

SEQ ID NO: 6546739 - DNA, 15 bp, Homo sapiens
ttgcctcccttcctc

SEQ ID NO: 6546740 - DNA, 16 bp, Homo sapiens
ttgcctcccttcctcc

SEQ ID NO: 6546741 - DNA, 18 bp, Homo sapiens
tgtgggggtctgggaggc

SEQ ID NO: 6546742 - DNA, 19 bp, Homo sapiens
tgtggggtgcagctgggtg

SEQ ID NO: 6546743 - DNA, 22 bp, Homo sapiens
tgtggggtgcagctgggtgggg

SEQ ID NO: 6546744 - DNA, 20 bp, Homo sapiens
tgtggggtggacctgggaca

SEQ ID NO: 6546745 - DNA, 17 bp, Homo sapiens
tgtggggtggagcactg

SEQ ID NO: 6546746 - DNA, 13 bp, Homo sapiens
tgtgggtaagagg

SEQ ID NO: 6546747 - DNA, 14 bp, Homo sapiens
tgtgggtaagagga

SEQ ID NO: 6546748 - DNA, 15 bp, Homo sapiens
tgtgggtacatgtga

SEQ ID NO: 6546749 - DNA, 15 bp, Homo sapiens
tgtgggtacctgtat

SEQ ID NO: 6546750 - DNA, 15 bp, Homo sapiens
tgtgggtatttcttg

SEQ ID NO: 6546751 - DNA, 22 bp, Homo sapiens
tgtgggtatttcttggcatgca

SEQ ID NO: 6546752 - DNA, 16 bp, Homo sapiens
tgtgggtccctaagca

SEQ ID NO: 6546753 - DNA, 14 bp, Homo sapiens
tgtgggtctctgaa

SEQ ID NO: 6546754 - DNA, 14 bp, Homo sapiens
tgtgggtctctgga

SEQ ID NO: 6546755 - DNA, 16 bp, Homo sapiens
tgtgggtctgtgtgtg

SEQ ID NO: 6546756 - DNA, 20 bp, Homo sapiens
tgtgggtctgtgtgtgtgta

SEQ ID NO: 6546757 - DNA, 14 bp, Homo sapiens
tgtgggtgaccagg

SEQ ID NO: 6546758 - DNA, 20 bp, Homo sapiens
tgtgggtgatcagaaggctg

SEQ ID NO: 6546759 - DNA, 14 bp, Homo sapiens
tgtgggtgccagtc

SEQ ID NO: 6546760 - DNA, 14 bp, Homo sapiens
tgtgggtgccctgt

SEQ ID NO: 6546761 - DNA, 20 bp, Homo sapiens
tgtgggtggagaagggaggg

SEQ ID NO: 6546762 - DNA, 22 bp, Homo sapiens
tgtgggtggatataaatatata

SEQ ID NO: 6546763 - DNA, 23 bp, Homo sapiens
tgtgggtgggagtgtgtctgctg

SEQ ID NO: 6546764 - DNA, 12 bp, Homo sapiens
tgtgggtgggga

SEQ ID NO: 6546765 - DNA, 22 bp, Homo sapiens
tgtgggtggggaggccctgcct

SEQ ID NO: 6546766 - DNA, 13 bp, Homo sapiens
tgtgggtggggcc

SEQ ID NO: 6546767 - DNA, 16 bp, Homo sapiens
tgtgggtggggcttct

SEQ ID NO: 6546768 - DNA, 12 bp, Homo sapiens
tgtgggtgtagc

SEQ ID NO: 6546769 - DNA, 15 bp, Homo sapiens
tgtgggtgtagccag

SEQ ID NO: 6546770 - DNA, 17 bp, Homo sapiens
tgtgggtgtcagtgtca

SEQ ID NO: 6546771 - DNA, 14 bp, Homo sapiens
tgtgggtgtcctgc

SEQ ID NO: 6546772 - DNA, 21 bp, Homo sapiens
tgtgggtgtcctgcctgtctg

SEQ ID NO: 6546773 - DNA, 23 bp, Homo sapiens
tgtgggtgtcctgcctgtctgcc

SEQ ID NO: 6546774 - DNA, 22 bp, Homo sapiens
tgtgggtgttaatttttgatac

SEQ ID NO: 6546775 - DNA, 16 bp, Homo sapiens
tgtgggttatcctcct

SEQ ID NO: 6546776 - DNA, 16 bp, Homo sapiens
tgtgggttccacagac

SEQ ID NO: 6546777 - DNA, 23 bp, Homo sapiens
tgtgggtttctaaagctgccagc

SEQ ID NO: 6546778 - DNA, 21 bp, Homo sapiens
tgtgggtttgggtgcctcctg

SEQ ID NO: 6546779 - DNA, 18 bp, Homo sapiens
tgtgggtttggttagagg

SEQ ID NO: 6546780 - DNA, 15 bp, Homo sapiens
tgtgggtttttattt

SEQ ID NO: 6546781 - DNA, 14 bp, Homo sapiens
tgtggtaatctaca

SEQ ID NO: 6546782 - DNA, 17 bp, Homo sapiens
tgtggtaatctacacca

SEQ ID NO: 6546783 - DNA, 14 bp, Homo sapiens
tgtggtacagagaa

SEQ ID NO: 6546784 - DNA, 16 bp, Homo sapiens
tgtggtacagagaagc

SEQ ID NO: 6546785 - DNA, 23 bp, Homo sapiens
tgtggtacagagaagccagcttg

SEQ ID NO: 6546786 - DNA, 19 bp, Homo sapiens
tgtggtacatggtgtttgt

SEQ ID NO: 6546787 - DNA, 16 bp, Homo sapiens
tgtggtaccctggcag

SEQ ID NO: 6546788 - DNA, 13 bp, Homo sapiens
tgtggtagaaaca

SEQ ID NO: 6546789 - DNA, 15 bp, Homo sapiens
tgtggtagctccagc

SEQ ID NO: 6546790 - DNA, 23 bp, Homo sapiens
tgtggtaggccttttaacatttt

SEQ ID NO: 6546791 - DNA, 17 bp, Homo sapiens
tgtggtaggggcaggga

SEQ ID NO: 6546792 - DNA, 14 bp, Homo sapiens
tgtggtatgagggg

SEQ ID NO: 6546793 - DNA, 18 bp, Homo sapiens
tgtggtatgtagcccggc

SEQ ID NO: 6546794 - DNA, 17 bp, Homo sapiens
tgtggtattttggcatt

SEQ ID NO: 6546795 - DNA, 16 bp, Homo sapiens
tgtggtcaacatttct

SEQ ID NO: 6546796 - DNA, 22 bp, Homo sapiens
tgtggtcaacatttctcatgtt

SEQ ID NO: 6546797 - DNA, 16 bp, Homo sapiens
tgtggtcaaggctaca

SEQ ID NO: 6546798 - DNA, 23 bp, Homo sapiens
tgtggtcacagcggaggtgtgga

SEQ ID NO: 6546799 - DNA, 16 bp, Homo sapiens
tgtggtcagcggtatg

SEQ ID NO: 6546800 - DNA, 12 bp, Homo sapiens
tgtggtcaggcc

SEQ ID NO: 6546801 - DNA, 18 bp, Homo sapiens
tgtggtcaggcccagcct

SEQ ID NO: 6546802 - DNA, 19 bp, Homo sapiens
tgtggtcaggcccagcctc

SEQ ID NO: 6546803 - DNA, 14 bp, Homo sapiens
tgtggtcccaccca

SEQ ID NO: 6546804 - DNA, 14 bp, Homo sapiens
tgtggtcctagaag

SEQ ID NO: 6546805 - DNA, 20 bp, Homo sapiens
tgtggtcgtcaactttcctc

SEQ ID NO: 6546806 - DNA, 21 bp, Homo sapiens
tgtggtcgtcatgctgtccgt

SEQ ID NO: 6546807 - DNA, 21 bp, Homo sapiens
tgtggtctaaagtgtttagct

SEQ ID NO: 6546808 - DNA, 21 bp, Homo sapiens
tgtggtctataaaataaactt

SEQ ID NO: 6546809 - DNA, 13 bp, Homo sapiens
tgtggtctcagga

SEQ ID NO: 6546810 - DNA, 14 bp, Homo sapiens
tgtggtctcaggat

SEQ ID NO: 6546811 - DNA, 13 bp, Homo sapiens
tgtggtctccact

SEQ ID NO: 6546812 - DNA, 17 bp, Homo sapiens
tgtggtctccttggaaa

SEQ ID NO: 6546813 - DNA, 18 bp, Homo sapiens
tgtggtctcgatgctgct

SEQ ID NO: 6546814 - DNA, 20 bp, Homo sapiens
tgtggtctctgccccagcct

SEQ ID NO: 6546815 - DNA, 19 bp, Homo sapiens
tgtggtctggtgttccagc

SEQ ID NO: 6546816 - DNA, 13 bp, Homo sapiens
tgtggtctgtgtg

SEQ ID NO: 6546817 - DNA, 16 bp, Homo sapiens
tgtggtctgtgtgtga

SEQ ID NO: 6546818 - DNA, 20 bp, Homo sapiens
tgtggtgaagtgtggctggt

SEQ ID NO: 6546819 - DNA, 22 bp, Homo sapiens
tgtggtgacttctgctgctggc

SEQ ID NO: 6546820 - DNA, 20 bp, Homo sapiens
tgtggtgagggagaacctct

SEQ ID NO: 6546821 - DNA, 12 bp, Homo sapiens
tgtggtgagggg

SEQ ID NO: 6546822 - DNA, 22 bp, Homo sapiens
tgtggtgaggtcctgtcctggc

SEQ ID NO: 6546823 - DNA, 20 bp, Homo sapiens
tgtggtgatcgcacaaggac

SEQ ID NO: 6546824 - DNA, 15 bp, Homo sapiens
tgtggtgatgatgtg

SEQ ID NO: 6546825 - DNA, 23 bp, Homo sapiens
tgtggtgatgtacgctgcgtgcc

SEQ ID NO: 6546826 - DNA, 16 bp, Homo sapiens
tgtggtgcagtaacca

SEQ ID NO: 6546827 - DNA, 23 bp, Homo sapiens
tgtggtggcacgcatctgtagtt

SEQ ID NO: 6546828 - DNA, 13 bp, Homo sapiens
tgtggtggctgct

SEQ ID NO: 6546829 - DNA, 16 bp, Homo sapiens
tgtggtggctgctcca

SEQ ID NO: 6546830 - DNA, 17 bp, Homo sapiens
tgtggtggctgtctctg

SEQ ID NO: 6546831 - DNA, 13 bp, Homo sapiens
tgtggtgggaggg

SEQ ID NO: 6546832 - DNA, 16 bp, Homo sapiens
tgtggtgggcgctggg

SEQ ID NO: 6546833 - DNA, 14 bp, Homo sapiens
tgtggtggggagag

SEQ ID NO: 6546834 - DNA, 22 bp, Homo sapiens
tgtggtgggttctttggaagga

SEQ ID NO: 6546835 - DNA, 21 bp, Homo sapiens
tgtggtggtacatgcctgtaa

SEQ ID NO: 6546836 - DNA, 18 bp, Homo sapiens
tgtggtggttcattccac

SEQ ID NO: 6546837 - DNA, 15 bp, Homo sapiens
tgtggtggtttctat

SEQ ID NO: 6546838 - DNA, 20 bp, Homo sapiens
tgtggtgtaaagctggccct

SEQ ID NO: 6546839 - DNA, 21 bp, Homo sapiens
tgtggtgtaaagctggccctg

SEQ ID NO: 6546840 - DNA, 13 bp, Homo sapiens
tgtggtgtaattt

SEQ ID NO: 6546841 - DNA, 18 bp, Homo sapiens
tgtggtgtcgtctgtgaa

SEQ ID NO: 6546842 - DNA, 19 bp, Homo sapiens
tgtggtgtcgtctgtgaat

SEQ ID NO: 6546843 - DNA, 14 bp, Homo sapiens
tgtggtgtctgtgt

SEQ ID NO: 6546844 - DNA, 20 bp, Homo sapiens
tgtggtgtgaccatgttcat

SEQ ID NO: 6546845 - DNA, 13 bp, Homo sapiens
tgtggtgtgccat

SEQ ID NO: 6546846 - DNA, 15 bp, Homo sapiens
tgtggtgtgtgtgct

SEQ ID NO: 6546847 - DNA, 21 bp, Homo sapiens
tgtggtgtgtttgcttggaaa

SEQ ID NO: 6546848 - DNA, 14 bp, Homo sapiens
tgtggtgtttcctg

SEQ ID NO: 6546849 - DNA, 21 bp, Homo sapiens
tgtggttaatccaatcaattt

SEQ ID NO: 6546850 - DNA, 21 bp, Homo sapiens
tgtggttacagtgcagacagg

SEQ ID NO: 6546851 - DNA, 20 bp, Homo sapiens
tgtggttataacttaatgaa

SEQ ID NO: 6546852 - DNA, 24 bp, Homo sapiens
tgtggttattttctccatgtctgt

SEQ ID NO: 6546853 - DNA, 20 bp, Homo sapiens
tgtggttatttttatacagt

SEQ ID NO: 6546854 - DNA, 21 bp, Homo sapiens
tgtggttcagtgccttcctct

SEQ ID NO: 6546855 - DNA, 18 bp, Homo sapiens
tgtggttcctaagcctgt

SEQ ID NO: 6546856 - DNA, 23 bp, Homo sapiens
tgtggttcctaagcctgttgctg

SEQ ID NO: 6546857 - DNA, 13 bp, Homo sapiens
tgtggttcctctg

SEQ ID NO: 6546858 - DNA, 22 bp, Homo sapiens
tgtggttctataataagttttg

SEQ ID NO: 6546859 - DNA, 14 bp, Homo sapiens
tgtggttctatttt

SEQ ID NO: 6546860 - DNA, 19 bp, Homo sapiens
tgtggttgaaaaccacagt

SEQ ID NO: 6546861 - DNA, 19 bp, Homo sapiens
tgtggttgaggggcctgga

SEQ ID NO: 6546862 - DNA, 15 bp, Homo sapiens
tgtggttgcagcctg

SEQ ID NO: 6546863 - DNA, 19 bp, Homo sapiens
tgtggttgcagtctttccc

SEQ ID NO: 6546864 - DNA, 13 bp, Homo sapiens
tgtggttgcatgt

SEQ ID NO: 6546865 - DNA, 20 bp, Homo sapiens
tgtggttgggggtgggaggt

SEQ ID NO: 6546866 - DNA, 17 bp, Homo sapiens
tgtggttgtggatggga

SEQ ID NO: 6546867 - DNA, 14 bp, Homo sapiens
tgtggtttatgtca

SEQ ID NO: 6546868 - DNA, 21 bp, Homo sapiens
tgtggtttcagatgtgcaata

SEQ ID NO: 6546869 - DNA, 17 bp, Homo sapiens
tgtggtttcatgttagt

SEQ ID NO: 6546870 - DNA, 14 bp, Homo sapiens
tgtggtttcccctt

SEQ ID NO: 6546871 - DNA, 18 bp, Homo sapiens
tgtggtttccctgcccct

SEQ ID NO: 6546872 - DNA, 20 bp, Homo sapiens
tgtggtttccctgcccctgt

SEQ ID NO: 6546873 - DNA, 22 bp, Homo sapiens
tgtggtttgcattgtctccttc

SEQ ID NO: 6546874 - DNA, 17 bp, Homo sapiens
tgtggttttatggagac

SEQ ID NO: 6546875 - DNA, 22 bp, Homo sapiens
tgtggttttcccctccctgggt

SEQ ID NO: 6546876 - DNA, 23 bp, Homo sapiens
tgtggttttcccctccctgggtt

SEQ ID NO: 6546877 - DNA, 18 bp, Homo sapiens
tgtggttttcgagattat

SEQ ID NO: 6546878 - DNA, 15 bp, Homo sapiens
tgtggttttctgttt

SEQ ID NO: 6546879 - DNA, 20 bp, Homo sapiens
tgtggtttttgatgcctttt

SEQ ID NO: 6546880 - DNA, 17 bp, Homo sapiens
tgtgtaaaaaatggaaa

SEQ ID NO: 6546881 - DNA, 23 bp, Homo sapiens
tgtgtaaaaaatggaaaaaaaca

SEQ ID NO: 6546882 - DNA, 19 bp, Homo sapiens
tgtgtaaaattaatgtaat

SEQ ID NO: 6546883 - DNA, 20 bp, Homo sapiens
tgtgtaaacaaaatgaagct

SEQ ID NO: 6546884 - DNA, 20 bp, Homo sapiens
tgtgtaaagactgagcagaa

SEQ ID NO: 6546885 - DNA, 18 bp, Homo sapiens
tgtgtaaagacttgagaa

SEQ ID NO: 6546886 - DNA, 15 bp, Homo sapiens
tgtgtaaagatttat

SEQ ID NO: 6546887 - DNA, 17 bp, Homo sapiens
tgtgtaaataatttgca

SEQ ID NO: 6546888 - DNA, 22 bp, Homo sapiens
tgtgtaaatatgtacatttgtc

SEQ ID NO: 6546889 - DNA, 20 bp, Homo sapiens
tgtgtaaatggagcttgtac

SEQ ID NO: 6546890 - DNA, 17 bp, Homo sapiens
tgtgtaaatgttatgac

SEQ ID NO: 6546891 - DNA, 14 bp, Homo sapiens
tgtgtaaatttctc

SEQ ID NO: 6546892 - DNA, 14 bp, Homo sapiens
tgtgtaaatttgta

SEQ ID NO: 6546893 - DNA, 12 bp, Homo sapiens
tgtgtaacacag

SEQ ID NO: 6546894 - DNA, 13 bp, Homo sapiens
tgtgtaacactgt

SEQ ID NO: 6546895 - DNA, 14 bp, Homo sapiens
tgtgtaacagctcc

SEQ ID NO: 6546896 - DNA, 21 bp, Homo sapiens
tgtgtaacagggtcacaagaa

SEQ ID NO: 6546897 - DNA, 20 bp, Homo sapiens
tgtgtaacagttagccactg

SEQ ID NO: 6546898 - DNA, 15 bp, Homo sapiens
tgtgtaacatccaag

SEQ ID NO: 6546899 - DNA, 18 bp, Homo sapiens
tgtgtaacatccaagcca

SEQ ID NO: 6546900 - DNA, 20 bp, Homo sapiens
tgtgtaaccagcagtcacag

SEQ ID NO: 6546901 - DNA, 21 bp, Homo sapiens
tgtgtaaccagcagtcacagg

SEQ ID NO: 6546902 - DNA, 15 bp, Homo sapiens
tgtgtaaccatttta

SEQ ID NO: 6546903 - DNA, 18 bp, Homo sapiens
tgtgtaactgcccaaagc

SEQ ID NO: 6546904 - DNA, 21 bp, Homo sapiens
tgtgtaactgcccaaagcagc

SEQ ID NO: 6546905 - DNA, 21 bp, Homo sapiens
tgtgtaactgttctttgcagt

SEQ ID NO: 6546906 - DNA, 16 bp, Homo sapiens
tgtgtaactttaaaca

SEQ ID NO: 6546907 - DNA, 19 bp, Homo sapiens
tgtgtaactttaaacatct

SEQ ID NO: 6546908 - DNA, 14 bp, Homo sapiens
tgtgtaagagaatg

SEQ ID NO: 6546909 - DNA, 22 bp, Homo sapiens
tgtgtaaggaaaaataaaagtg

SEQ ID NO: 6546910 - DNA, 23 bp, Homo sapiens
tgtgtaaggagtataccatgaga

SEQ ID NO: 6546911 - DNA, 13 bp, Homo sapiens
tgtgtaagtagat

SEQ ID NO: 6546912 - DNA, 12 bp, Homo sapiens
tgtgtaataaaa

SEQ ID NO: 6546913 - DNA, 22 bp, Homo sapiens
tgtgtaataaaaatttgtttaa

SEQ ID NO: 6546914 - DNA, 15 bp, Homo sapiens
tgtgtaataaagtgt

SEQ ID NO: 6546915 - DNA, 15 bp, Homo sapiens
tgtgtaataagaaag

SEQ ID NO: 6546916 - DNA, 16 bp, Homo sapiens
tgtgtaatagaaaact

SEQ ID NO: 6546917 - DNA, 20 bp, Homo sapiens
tgtgtaatatcatttcataa

SEQ ID NO: 6546918 - DNA, 14 bp, Homo sapiens
tgtgtaatatgaaa

SEQ ID NO: 6546919 - DNA, 12 bp, Homo sapiens
ttgcctcctccc

SEQ ID NO: 6546920 - DNA, 17 bp, Homo sapiens
ttgcctcctctctccct

SEQ ID NO: 6546921 - DNA, 19 bp, Homo sapiens
ttgcctcctgttctgccca

SEQ ID NO: 6546922 - DNA, 18 bp, Homo sapiens
ttgcctccttttttctta

SEQ ID NO: 6546923 - DNA, 18 bp, Homo sapiens
ttgcctcggctcctgctg

SEQ ID NO: 6546924 - DNA, 14 bp, Homo sapiens
ttgcctctctcagg

SEQ ID NO: 6546925 - DNA, 18 bp, Homo sapiens
ttgcctctctgccagccg

SEQ ID NO: 6546926 - DNA, 11 bp, Homo sapiens
ttgcctctctt

SEQ ID NO: 6546927 - DNA, 14 bp, Homo sapiens
ttgcctctgcacgt

SEQ ID NO: 6546928 - DNA, 21 bp, Homo sapiens
ttgcctctgcacgtgcacaca

SEQ ID NO: 6546929 - DNA, 16 bp, Homo sapiens
ttgcctctgccctgga

SEQ ID NO: 6546930 - DNA, 17 bp, Homo sapiens
ttgcctctgccctggat

SEQ ID NO: 6546931 - DNA, 13 bp, Homo sapiens
ttgcctctgtcca

SEQ ID NO: 6546932 - DNA, 17 bp, Homo sapiens
ttgcctctgtccccttc

SEQ ID NO: 6546933 - DNA, 19 bp, Homo sapiens
ttgcctctgtccccttctc

SEQ ID NO: 6546934 - DNA, 16 bp, Homo sapiens
ttgcctctgtcctccc

SEQ ID NO: 6546935 - DNA, 17 bp, Homo sapiens
ttgcctctgtcctccca

SEQ ID NO: 6546936 - DNA, 21 bp, Homo sapiens
ttgcctctgtcctcccatccc

SEQ ID NO: 6546937 - DNA, 12 bp, Homo sapiens
ttgcctctgtgc

SEQ ID NO: 6546938 - DNA, 19 bp, Homo sapiens
ttgcctcttccagtcttcc

SEQ ID NO: 6546939 - DNA, 23 bp, Homo sapiens
ttgcctcttctacttgtaaaatg

SEQ ID NO: 6546940 - DNA, 21 bp, Homo sapiens
ttgcctcttctttgtgccttt

SEQ ID NO: 6546941 - DNA, 17 bp, Homo sapiens
ttgcctctttctccagc

SEQ ID NO: 6546942 - DNA, 22 bp, Homo sapiens
ttgcctgaacatccttccttcc

SEQ ID NO: 6546943 - DNA, 17 bp, Homo sapiens
ttgcctgaactccagag

SEQ ID NO: 6546944 - DNA, 19 bp, Homo sapiens
ttgcctgaactcctgccat

SEQ ID NO: 6546945 - DNA, 13 bp, Homo sapiens
ttgcctgaagctt

SEQ ID NO: 6546946 - DNA, 13 bp, Homo sapiens
ttgcctgacaatt

SEQ ID NO: 6546947 - DNA, 21 bp, Homo sapiens
ttgcctgacaattgcaaatca

SEQ ID NO: 6546948 - DNA, 22 bp, Homo sapiens
ttgcctgagaagaagtggctgc

SEQ ID NO: 6546949 - DNA, 17 bp, Homo sapiens
ttgcctgaggctcaaga

SEQ ID NO: 6546950 - DNA, 13 bp, Homo sapiens
ttgcctgcagggc

SEQ ID NO: 6546951 - DNA, 12 bp, Homo sapiens
ttgcctgcagtt

SEQ ID NO: 6546952 - DNA, 17 bp, Homo sapiens
ttgcctgccactgtgtg

SEQ ID NO: 6546953 - DNA, 18 bp, Homo sapiens
ttgcctgccactgtgtga

SEQ ID NO: 6546954 - DNA, 13 bp, Homo sapiens
ttgcctgccatgg

SEQ ID NO: 6546955 - DNA, 15 bp, Homo sapiens
ttgcctgccctcctg

SEQ ID NO: 6546956 - DNA, 11 bp, Homo sapiens
ttgcctgcctc

SEQ ID NO: 6546957 - DNA, 17 bp, Homo sapiens
ttgcctgcctcctaggc

SEQ ID NO: 6546958 - DNA, 22 bp, Homo sapiens
ttgcctgcctgcctgtggagac

SEQ ID NO: 6546959 - DNA, 22 bp, Homo sapiens
ttgcctgcctggaaacagcctg

SEQ ID NO: 6546960 - DNA, 19 bp, Homo sapiens
ttgcctgcctgggcctccc

SEQ ID NO: 6546961 - DNA, 19 bp, Homo sapiens
ttgcctgcctgtgctattt

SEQ ID NO: 6546962 - DNA, 15 bp, Homo sapiens
ttgcctgcctttcca

SEQ ID NO: 6546963 - DNA, 23 bp, Homo sapiens
ttgcctgcctttccatccatggc

SEQ ID NO: 6546964 - DNA, 19 bp, Homo sapiens
ttgcctgcggtcaaggcca

SEQ ID NO: 6546965 - DNA, 22 bp, Homo sapiens
ttgcctgcgttttggaagctct

SEQ ID NO: 6546966 - DNA, 20 bp, Homo sapiens
ttgcctggattgggagccat

SEQ ID NO: 6546967 - DNA, 21 bp, Homo sapiens
ttgcctggattgggagccatt

SEQ ID NO: 6546968 - DNA, 11 bp, Homo sapiens
ttgcctggcct

SEQ ID NO: 6546969 - DNA, 21 bp, Homo sapiens
ttgcctggctgtggaggcctg

SEQ ID NO: 6546970 - DNA, 18 bp, Homo sapiens
ttgcctgggacggctgag

SEQ ID NO: 6546971 - DNA, 17 bp, Homo sapiens
ttgcctgggcagtgccc

SEQ ID NO: 6546972 - DNA, 12 bp, Homo sapiens
ttgcctgggctg

SEQ ID NO: 6546973 - DNA, 18 bp, Homo sapiens
ttgcctgggctgggcagc

SEQ ID NO: 6546974 - DNA, 21 bp, Homo sapiens
ttgcctgggctgggcagcctt

SEQ ID NO: 6546975 - DNA, 20 bp, Homo sapiens
ttgcctggggccacatagct

SEQ ID NO: 6546976 - DNA, 14 bp, Homo sapiens
ttgcctgtaacaag

SEQ ID NO: 6546977 - DNA, 21 bp, Homo sapiens
ttgcctgtagtctcagctact

SEQ ID NO: 6546978 - DNA, 22 bp, Homo sapiens
ttgcctgtctaaagccttaact

SEQ ID NO: 6546979 - DNA, 17 bp, Homo sapiens
ttgcctgtctgtttgct

SEQ ID NO: 6546980 - DNA, 14 bp, Homo sapiens
ttgcctgtgtgagc

SEQ ID NO: 6546981 - DNA, 16 bp, Homo sapiens
ttgcctgttcagttac

SEQ ID NO: 6546982 - DNA, 19 bp, Homo sapiens
ttgcctgttggctgctgcg

SEQ ID NO: 6546983 - DNA, 14 bp, Homo sapiens
ttgcctgtttcttc

SEQ ID NO: 6546984 - DNA, 15 bp, Homo sapiens
ttgccttaagtttcc

SEQ ID NO: 6546985 - DNA, 17 bp, Homo sapiens
ttgccttattaaagttc

SEQ ID NO: 6546986 - DNA, 15 bp, Homo sapiens
ttgccttatttgtct

SEQ ID NO: 6546987 - DNA, 22 bp, Homo sapiens
ttgccttccagaaaacaaaact

SEQ ID NO: 6546988 - DNA, 23 bp, Homo sapiens
ttgccttcccccctcagcaaggg

SEQ ID NO: 6546989 - DNA, 22 bp, Homo sapiens
ttgccttcctaagcctgtggct

SEQ ID NO: 6546990 - DNA, 20 bp, Homo sapiens
ttgccttcctttctccagga

SEQ ID NO: 6546991 - DNA, 17 bp, Homo sapiens
ttgccttctcaccagct

SEQ ID NO: 6546992 - DNA, 16 bp, Homo sapiens
ttgccttctttgaaga

SEQ ID NO: 6546993 - DNA, 17 bp, Homo sapiens
ttgccttctttgaagaa

SEQ ID NO: 6546994 - DNA, 21 bp, Homo sapiens
ttgccttgaaccacttccctc

SEQ ID NO: 6546995 - DNA, 16 bp, Homo sapiens
ttgccttgacaaactt

SEQ ID NO: 6546996 - DNA, 14 bp, Homo sapiens
ttgccttgagttta

SEQ ID NO: 6546997 - DNA, 19 bp, Homo sapiens
ttgccttgcagaactgcca

SEQ ID NO: 6546998 - DNA, 20 bp, Homo sapiens
ttgccttgcagaactgccat

SEQ ID NO: 6546999 - DNA, 15 bp, Homo sapiens
ttgccttgcatttgt

SEQ ID NO: 6547000 - DNA, 16 bp, Homo sapiens
ttgccttgctgtttgt

SEQ ID NO: 6547001 - DNA, 14 bp, Homo sapiens
ttgccttgcttctc

SEQ ID NO: 6547002 - DNA, 15 bp, Homo sapiens
ttgccttgggccttt

SEQ ID NO: 6547003 - DNA, 20 bp, Homo sapiens
ttgccttgggctgctcctca

SEQ ID NO: 6547004 - DNA, 22 bp, Homo sapiens
ttgcctttaatattttgtaata

SEQ ID NO: 6547005 - DNA, 23 bp, Homo sapiens
ttgcctttaggcaggaagtcagg

SEQ ID NO: 6547006 - DNA, 18 bp, Homo sapiens
ttgcctttaggggtgtgt

SEQ ID NO: 6547007 - DNA, 18 bp, Homo sapiens
ttgcctttatctctgagg

SEQ ID NO: 6547008 - DNA, 20 bp, Homo sapiens
ttgcctttatctctgaggct

SEQ ID NO: 6547009 - DNA, 18 bp, Homo sapiens
ttgcctttcgaggcctga

SEQ ID NO: 6547010 - DNA, 13 bp, Homo sapiens
ttgcctttctcga

SEQ ID NO: 6547011 - DNA, 12 bp, Homo sapiens
ttgcctttctgt

SEQ ID NO: 6547012 - DNA, 19 bp, Homo sapiens
ttgcctttctgtgtttatt

SEQ ID NO: 6547013 - DNA, 14 bp, Homo sapiens
ttgcctttgaagag

SEQ ID NO: 6547014 - DNA, 18 bp, Homo sapiens
ttgcctttgaagggtatg

SEQ ID NO: 6547015 - DNA, 17 bp, Homo sapiens
ttgcctttgaatgttaa

SEQ ID NO: 6547016 - DNA, 18 bp, Homo sapiens
ttgccttttatgtaaatt

SEQ ID NO: 6547017 - DNA, 21 bp, Homo sapiens
ttgccttttatgtaaattttt

SEQ ID NO: 6547018 - DNA, 19 bp, Homo sapiens
ttgccttttgcaaccagga

SEQ ID NO: 6547019 - DNA, 14 bp, Homo sapiens
ttgcctttttcatt

SEQ ID NO: 6547020 - DNA, 20 bp, Homo sapiens
ttgcctttttcattttccaa

SEQ ID NO: 6547021 - DNA, 20 bp, Homo sapiens
ttgcgaccaccaacacacag

SEQ ID NO: 6547022 - DNA, 19 bp, Homo sapiens
ttgcgaccttaatttaact

SEQ ID NO: 6547023 - DNA, 20 bp, Homo sapiens
ttgcgacggagagaaaaaag

SEQ ID NO: 6547024 - DNA, 22 bp, Homo sapiens
ttgcgacggagagaaaaaagaa

SEQ ID NO: 6547025 - DNA, 14 bp, Homo sapiens
ttgcgagagatgtg

SEQ ID NO: 6547026 - DNA, 19 bp, Homo sapiens
ttgcgagagatgtgtgttg

SEQ ID NO: 6547027 - DNA, 14 bp, Homo sapiens
ttgcgagtccaagg

SEQ ID NO: 6547028 - DNA, 13 bp, Homo sapiens
ttgcgatttcaca

SEQ ID NO: 6547029 - DNA, 15 bp, Homo sapiens
ttgcgcagccctacc

SEQ ID NO: 6547030 - DNA, 16 bp, Homo sapiens
ttgcgcctaatgtgtt

SEQ ID NO: 6547031 - DNA, 19 bp, Homo sapiens
ttgcgcctcagccctcagt

SEQ ID NO: 6547032 - DNA, 22 bp, Homo sapiens
ttgcgcctcggtatctggcttc

SEQ ID NO: 6547033 - DNA, 12 bp, Homo sapiens
ttgcgctcaggg

SEQ ID NO: 6547034 - DNA, 23 bp, Homo sapiens
ttgcgctcaggggctccatgctg

SEQ ID NO: 6547035 - DNA, 20 bp, Homo sapiens
ttgcgctctcaagaccagag

SEQ ID NO: 6547036 - DNA, 22 bp, Homo sapiens
ttgcgctctcaagaccagagac

SEQ ID NO: 6547037 - DNA, 15 bp, Homo sapiens
ttgcgctctgggttt

SEQ ID NO: 6547038 - DNA, 17 bp, Homo sapiens
ttgcggcaaaaggaaag

SEQ ID NO: 6547039 - DNA, 14 bp, Homo sapiens
ttgcggccccagga

SEQ ID NO: 6547040 - DNA, 13 bp, Homo sapiens
ttgcggggcctgt

SEQ ID NO: 6547041 - DNA, 21 bp, Homo sapiens
ttgcggggcctgtctcagtga

SEQ ID NO: 6547042 - DNA, 14 bp, Homo sapiens
ttgcggggggaggg

SEQ ID NO: 6547043 - DNA, 15 bp, Homo sapiens
ttgcgtacacagaga

SEQ ID NO: 6547044 - DNA, 16 bp, Homo sapiens
ttgcgtatgtctgtta

SEQ ID NO: 6547045 - DNA, 15 bp, Homo sapiens
ttgcgtcctgcagag

SEQ ID NO: 6547046 - DNA, 16 bp, Homo sapiens
ttgcgtctgaggcctg

SEQ ID NO: 6547047 - DNA, 18 bp, Homo sapiens
ttgcgtgcccggggcagc

SEQ ID NO: 6547048 - DNA, 17 bp, Homo sapiens
ttgcgtggatcaagctt

SEQ ID NO: 6547049 - DNA, 16 bp, Homo sapiens
ttgcgtgtctgtttcc

SEQ ID NO: 6547050 - DNA, 13 bp, Homo sapiens
ttgctaaaaaata

SEQ ID NO: 6547051 - DNA, 21 bp, Homo sapiens
ttgctaaaacagcttcctgtt

SEQ ID NO: 6547052 - DNA, 13 bp, Homo sapiens
ttgctaaactgat

SEQ ID NO: 6547053 - DNA, 14 bp, Homo sapiens
ttgctaaagcactt

SEQ ID NO: 6547054 - DNA, 23 bp, Homo sapiens
ttgctaaagcactttgcacttaa

SEQ ID NO: 6547055 - DNA, 22 bp, Homo sapiens
ttgctaaaggaaaaaaccatcc

SEQ ID NO: 6547056 - DNA, 20 bp, Homo sapiens
ttgctaaatacaacactgat

SEQ ID NO: 6547057 - DNA, 16 bp, Homo sapiens
ttgctaaatatttctt

SEQ ID NO: 6547058 - DNA, 16 bp, Homo sapiens
ttgctaaattataaaa

SEQ ID NO: 6547059 - DNA, 13 bp, Homo sapiens
ttgctaacagcaa

SEQ ID NO: 6547060 - DNA, 21 bp, Homo sapiens
ttgctaactgaactttgaaga

SEQ ID NO: 6547061 - DNA, 14 bp, Homo sapiens
ttgctaactgggtt

SEQ ID NO: 6547062 - DNA, 16 bp, Homo sapiens
ttgctaactgggttaa

SEQ ID NO: 6547063 - DNA, 21 bp, Homo sapiens
ttgctaactgggttaaatatt

SEQ ID NO: 6547064 - DNA, 16 bp, Homo sapiens
ttgctaagaaatgtta

SEQ ID NO: 6547065 - DNA, 20 bp, Homo sapiens
ttgctaagatgctctatctt

SEQ ID NO: 6547066 - DNA, 16 bp, Homo sapiens
ttgctaagcattccaa

SEQ ID NO: 6547067 - DNA, 21 bp, Homo sapiens
ttgctaagccccagcaagcaa

SEQ ID NO: 6547068 - DNA, 13 bp, Homo sapiens
ttgctaaggcagc

SEQ ID NO: 6547069 - DNA, 18 bp, Homo sapiens
ttgctaagggaaataaca

SEQ ID NO: 6547070 - DNA, 20 bp, Homo sapiens
ttgctaagggaaataacagt

SEQ ID NO: 6547071 - DNA, 20 bp, Homo sapiens
ttgctaataaacactggctc

SEQ ID NO: 6547072 - DNA, 22 bp, Homo sapiens
ttgctaataaacactggctctg

SEQ ID NO: 6547073 - DNA, 16 bp, Homo sapiens
ttgctaatcagtgtct

SEQ ID NO: 6547074 - DNA, 22 bp, Homo sapiens
ttgctaatgaattttaaaagca

SEQ ID NO: 6547075 - DNA, 14 bp, Homo sapiens
ttgctaatgttgct

SEQ ID NO: 6547076 - DNA, 16 bp, Homo sapiens
ttgctaattaaaaagt

SEQ ID NO: 6547077 - DNA, 20 bp, Homo sapiens
ttgctaattaactgaaacat

SEQ ID NO: 6547078 - DNA, 17 bp, Homo sapiens
ttgctaattaataaaaa

SEQ ID NO: 6547079 - DNA, 15 bp, Homo sapiens
ttgctaatttttatt

SEQ ID NO: 6547080 - DNA, 23 bp, Homo sapiens
ttgctacaaatttatgcatttca

SEQ ID NO: 6547081 - DNA, 14 bp, Homo sapiens
ttgctacaataaat

SEQ ID NO: 6547082 - DNA, 14 bp, Homo sapiens
ttgctacacacaca

SEQ ID NO: 6547083 - DNA, 18 bp, Homo sapiens
ttgctacaccccttttcc

SEQ ID NO: 6547084 - DNA, 21 bp, Homo sapiens
ttgctacaccccttttccagt

SEQ ID NO: 6547085 - DNA, 13 bp, Homo sapiens
ttgctacattttc

SEQ ID NO: 6547086 - DNA, 16 bp, Homo sapiens
ttgctaccacagactt

SEQ ID NO: 6547087 - DNA, 23 bp, Homo sapiens
ttgctaccacagacttgcactga

SEQ ID NO: 6547088 - DNA, 23 bp, Homo sapiens
ttgctaccacggcctcctttccg

SEQ ID NO: 6547089 - DNA, 16 bp, Homo sapiens
ttgctaccagtattta

SEQ ID NO: 6547090 - DNA, 17 bp, Homo sapiens
ttgctacctcagtcagt

SEQ ID NO: 6547091 - DNA, 16 bp, Homo sapiens
ttgctacctcagtgct

SEQ ID NO: 6547092 - DNA, 17 bp, Homo sapiens
ttgctacctcagtgctc

SEQ ID NO: 6547093 - DNA, 17 bp, Homo sapiens
ttgctacgattccactg

SEQ ID NO: 6547094 - DNA, 13 bp, Homo sapiens
ttgctacgtgcct

SEQ ID NO: 6547095 - DNA, 15 bp, Homo sapiens
ttgctacgtgcctcc

SEQ ID NO: 6547096 - DNA, 18 bp, Homo sapiens
ttgctactataatcaaat

SEQ ID NO: 6547097 - DNA, 14 bp, Homo sapiens
ttgctactttattt

SEQ ID NO: 6547098 - DNA, 13 bp, Homo sapiens
tgtgtaatattac

SEQ ID NO: 6547099 - DNA, 22 bp, Homo sapiens
tgtgtaatcatttcttgggccc

SEQ ID NO: 6547100 - DNA, 18 bp, Homo sapiens
tgtgtaatgactgagatt

SEQ ID NO: 6547101 - DNA, 10 bp, Homo sapiens
tgtgtaatta

SEQ ID NO: 6547102 - DNA, 12 bp, Homo sapiens
tgtgtaattatg

SEQ ID NO: 6547103 - DNA, 19 bp, Homo sapiens
tgtgtaatttaaaattgtg

SEQ ID NO: 6547104 - DNA, 16 bp, Homo sapiens
tgtgtaattttgttct

SEQ ID NO: 6547105 - DNA, 19 bp, Homo sapiens
tgtgtacaaagaaataaca

SEQ ID NO: 6547106 - DNA, 20 bp, Homo sapiens
tgtgtacaaagtagagaagt

SEQ ID NO: 6547107 - DNA, 22 bp, Homo sapiens
tgtgtacaaagtagagaagtat

SEQ ID NO: 6547108 - DNA, 19 bp, Homo sapiens
tgtgtacaaatacatgtgt

SEQ ID NO: 6547109 - DNA, 17 bp, Homo sapiens
tgtgtacaatgtacaca

SEQ ID NO: 6547110 - DNA, 14 bp, Homo sapiens
tgtgtacaatgtga

SEQ ID NO: 6547111 - DNA, 16 bp, Homo sapiens
tgtgtacaattttagt

SEQ ID NO: 6547112 - DNA, 15 bp, Homo sapiens
tgtgtacacaaagga

SEQ ID NO: 6547113 - DNA, 17 bp, Homo sapiens
tgtgtacacctctggat

SEQ ID NO: 6547114 - DNA, 21 bp, Homo sapiens
tgtgtacagaattctgctacc

SEQ ID NO: 6547115 - DNA, 23 bp, Homo sapiens
tgtgtacagaattctgctacctc

SEQ ID NO: 6547116 - DNA, 18 bp, Homo sapiens
tgtgtacagatgaatgat

SEQ ID NO: 6547117 - DNA, 10 bp, Homo sapiens
tgtgtacagg

SEQ ID NO: 6547118 - DNA, 14 bp, Homo sapiens
tgtgtacagtatgt

SEQ ID NO: 6547119 - DNA, 21 bp, Homo sapiens
tgtgtacagtgaattgtcttt

SEQ ID NO: 6547120 - DNA, 23 bp, Homo sapiens
tgtgtacagtgaattgtctttta

SEQ ID NO: 6547121 - DNA, 15 bp, Homo sapiens
tgtgtacataactga

SEQ ID NO: 6547122 - DNA, 17 bp, Homo sapiens
tgtgtacataactgaaa

SEQ ID NO: 6547123 - DNA, 14 bp, Homo sapiens
tgtgtacatatatg

SEQ ID NO: 6547124 - DNA, 17 bp, Homo sapiens
tgtgtacatatatgtat

SEQ ID NO: 6547125 - DNA, 23 bp, Homo sapiens
tgtgtacatatatgtataatata

SEQ ID NO: 6547126 - DNA, 24 bp, Homo sapiens
tgtgtacatcccatgtaacagaaa

SEQ ID NO: 6547127 - DNA, 12 bp, Homo sapiens
tgtgtacatgta

SEQ ID NO: 6547128 - DNA, 13 bp, Homo sapiens
tgtgtaccacacc

SEQ ID NO: 6547129 - DNA, 21 bp, Homo sapiens
tgtgtaccacaccctgcctgc

SEQ ID NO: 6547130 - DNA, 22 bp, Homo sapiens
tgtgtaccacaccctgcctgct

SEQ ID NO: 6547131 - DNA, 17 bp, Homo sapiens
tgtgtaccacttcctga

SEQ ID NO: 6547132 - DNA, 19 bp, Homo sapiens
tgtgtaccacttcctgagg

SEQ ID NO: 6547133 - DNA, 15 bp, Homo sapiens
tgtgtacccaaacgt

SEQ ID NO: 6547134 - DNA, 23 bp, Homo sapiens
tgtgtacccactcctcactgccc

SEQ ID NO: 6547135 - DNA, 17 bp, Homo sapiens
tgtgtacctcactgtcc

SEQ ID NO: 6547136 - DNA, 22 bp, Homo sapiens
tgtgtacctctagaatcccagc

SEQ ID NO: 6547137 - DNA, 18 bp, Homo sapiens
tgtgtacctgtggctgtg

SEQ ID NO: 6547138 - DNA, 19 bp, Homo sapiens
tgtgtacgtgcatgctgta

SEQ ID NO: 6547139 - DNA, 14 bp, Homo sapiens
tgtgtactctggcc

SEQ ID NO: 6547140 - DNA, 23 bp, Homo sapiens
tgtgtactctttatttctagcag

SEQ ID NO: 6547141 - DNA, 17 bp, Homo sapiens
tgtgtactgataaaata

SEQ ID NO: 6547142 - DNA, 21 bp, Homo sapiens
tgtgtactgattcaagaacaa

SEQ ID NO: 6547143 - DNA, 19 bp, Homo sapiens
tgtgtactgtatagacagt

SEQ ID NO: 6547144 - DNA, 21 bp, Homo sapiens
tgtgtactgtatagacagttt

SEQ ID NO: 6547145 - DNA, 12 bp, Homo sapiens
tgtgtactttta

SEQ ID NO: 6547146 - DNA, 10 bp, Homo sapiens
tgtgtagaaa

SEQ ID NO: 6547147 - DNA, 17 bp, Homo sapiens
tgtgtagaagtccacag

SEQ ID NO: 6547148 - DNA, 18 bp, Homo sapiens
tgtgtagacgatatactc

SEQ ID NO: 6547149 - DNA, 16 bp, Homo sapiens
tgtgtagagttaagaa

SEQ ID NO: 6547150 - DNA, 18 bp, Homo sapiens
tgtgtagatattatgtat

SEQ ID NO: 6547151 - DNA, 15 bp, Homo sapiens
tgtgtagatttgaaa

SEQ ID NO: 6547152 - DNA, 16 bp, Homo sapiens
tgtgtagatttgaaaa

SEQ ID NO: 6547153 - DNA, 17 bp, Homo sapiens
tgtgtagatttgaaaat

SEQ ID NO: 6547154 - DNA, 23 bp, Homo sapiens
tgtgtagcaattgacagagaata

SEQ ID NO: 6547155 - DNA, 23 bp, Homo sapiens
tgtgtagcctgtgcatgtatgtc

SEQ ID NO: 6547156 - DNA, 12 bp, Homo sapiens
tgtgtagccttt

SEQ ID NO: 6547157 - DNA, 19 bp, Homo sapiens
tgtgtagctgtgacctgct

SEQ ID NO: 6547158 - DNA, 14 bp, Homo sapiens
tgtgtagctttgct

SEQ ID NO: 6547159 - DNA, 22 bp, Homo sapiens
tgtgtaggaaatctgaagcctt

SEQ ID NO: 6547160 - DNA, 14 bp, Homo sapiens
tgtgtaggaagagg

SEQ ID NO: 6547161 - DNA, 12 bp, Homo sapiens
tgtgtagggcgg

SEQ ID NO: 6547162 - DNA, 19 bp, Homo sapiens
tgtgtaggtgaacagtcac

SEQ ID NO: 6547163 - DNA, 21 bp, Homo sapiens
tgtgtagtagctcgtgtgctt

SEQ ID NO: 6547164 - DNA, 14 bp, Homo sapiens
tgtgtagtatcttg

SEQ ID NO: 6547165 - DNA, 16 bp, Homo sapiens
tgtgtagtcaataaaa

SEQ ID NO: 6547166 - DNA, 23 bp, Homo sapiens
tgtgtagtctctctagtagttaa

SEQ ID NO: 6547167 - DNA, 14 bp, Homo sapiens
tgtgtagttcatgt

SEQ ID NO: 6547168 - DNA, 23 bp, Homo sapiens
tgtgtataaaacattaattgcta

SEQ ID NO: 6547169 - DNA, 13 bp, Homo sapiens
tgtgtataaacaa

SEQ ID NO: 6547170 - DNA, 21 bp, Homo sapiens
tgtgtataaacaagaaaaata

SEQ ID NO: 6547171 - DNA, 16 bp, Homo sapiens
tgtgtataaattgtct

SEQ ID NO: 6547172 - DNA, 17 bp, Homo sapiens
tgtgtataagtgcacac

SEQ ID NO: 6547173 - DNA, 15 bp, Homo sapiens
tgtgtataatgtgct

SEQ ID NO: 6547174 - DNA, 17 bp, Homo sapiens
tgtgtataatttacctc

SEQ ID NO: 6547175 - DNA, 22 bp, Homo sapiens
tgtgtatacacttaaacttgca

SEQ ID NO: 6547176 - DNA, 12 bp, Homo sapiens
tgtgtatacata

SEQ ID NO: 6547177 - DNA, 19 bp, Homo sapiens
tgtgtatacatatgtatgt

SEQ ID NO: 6547178 - DNA, 15 bp, Homo sapiens
tgtgtatacatgcca

SEQ ID NO: 6547179 - DNA, 15 bp, Homo sapiens
tgtgtatactgtaat

SEQ ID NO: 6547180 - DNA, 22 bp, Homo sapiens
tgtgtatactgtaatcgtgcta

SEQ ID NO: 6547181 - DNA, 22 bp, Homo sapiens
tgtgtataggaatttgtatttt

SEQ ID NO: 6547182 - DNA, 15 bp, Homo sapiens
tgtgtatatagtttt

SEQ ID NO: 6547183 - DNA, 14 bp, Homo sapiens
tgtgtatatataca

SEQ ID NO: 6547184 - DNA, 15 bp, Homo sapiens
tgtgtatatatacat

SEQ ID NO: 6547185 - DNA, 22 bp, Homo sapiens
tgtgtatatattatatatacat

SEQ ID NO: 6547186 - DNA, 19 bp, Homo sapiens
tgtgtatatctcttggaaa

SEQ ID NO: 6547187 - DNA, 14 bp, Homo sapiens
tgtgtatatgtatt

SEQ ID NO: 6547188 - DNA, 16 bp, Homo sapiens
tgtgtatatgtattta

SEQ ID NO: 6547189 - DNA, 12 bp, Homo sapiens
tgtgtatatgtt

SEQ ID NO: 6547190 - DNA, 21 bp, Homo sapiens
tgtgtatattccttttaaaga

SEQ ID NO: 6547191 - DNA, 19 bp, Homo sapiens
tgtgtatattggtgtatat

SEQ ID NO: 6547192 - DNA, 20 bp, Homo sapiens
tgtgtatattgtaacgttaa

SEQ ID NO: 6547193 - DNA, 15 bp, Homo sapiens
tgtgtatatttgatt

SEQ ID NO: 6547194 - DNA, 14 bp, Homo sapiens
tgtgtatatttgct

SEQ ID NO: 6547195 - DNA, 15 bp, Homo sapiens
tgtgtatatttgctt

SEQ ID NO: 6547196 - DNA, 18 bp, Homo sapiens
tgtgtatattttaatgaa

SEQ ID NO: 6547197 - DNA, 20 bp, Homo sapiens
tgtgtatatttttgtatgtc

SEQ ID NO: 6547198 - DNA, 20 bp, Homo sapiens
tgtgtatcaccctcagctgg

SEQ ID NO: 6547199 - DNA, 16 bp, Homo sapiens
tgtgtatccattatca

SEQ ID NO: 6547200 - DNA, 21 bp, Homo sapiens
tgtgtatccattatcatgtgt

SEQ ID NO: 6547201 - DNA, 23 bp, Homo sapiens
tgtgtatcttgattaatgtactt

SEQ ID NO: 6547202 - DNA, 21 bp, Homo sapiens
tgtgtatgagaagtactttgt

SEQ ID NO: 6547203 - DNA, 12 bp, Homo sapiens
tgtgtatgagac

SEQ ID NO: 6547204 - DNA, 23 bp, Homo sapiens
tgtgtatgagactgtgtttctag

SEQ ID NO: 6547205 - DNA, 19 bp, Homo sapiens
tgtgtatgcacatgaactt

SEQ ID NO: 6547206 - DNA, 13 bp, Homo sapiens
tgtgtatgctgct

SEQ ID NO: 6547207 - DNA, 15 bp, Homo sapiens
tgtgtatgctgcttt

SEQ ID NO: 6547208 - DNA, 14 bp, Homo sapiens
tgtgtatgggcaaa

SEQ ID NO: 6547209 - DNA, 22 bp, Homo sapiens
tgtgtatgggggaaggcgctgg

SEQ ID NO: 6547210 - DNA, 23 bp, Homo sapiens
tgtgtatggtgacctctccggcc

SEQ ID NO: 6547211 - DNA, 16 bp, Homo sapiens
tgtgtatgtacatata

SEQ ID NO: 6547212 - DNA, 19 bp, Homo sapiens
tgtgtatgtcagtggtttc

SEQ ID NO: 6547213 - DNA, 17 bp, Homo sapiens
tgtgtatgtctatgtgt

SEQ ID NO: 6547214 - DNA, 14 bp, Homo sapiens
tgtgtatgtgcgtg

SEQ ID NO: 6547215 - DNA, 14 bp, Homo sapiens
tgtgtatgtggggg

SEQ ID NO: 6547216 - DNA, 16 bp, Homo sapiens
tgtgtatgtgtgtgag

SEQ ID NO: 6547217 - DNA, 19 bp, Homo sapiens
tgtgtatgtttcttagccc

SEQ ID NO: 6547218 - DNA, 13 bp, Homo sapiens
tgtgtatgtttta

SEQ ID NO: 6547219 - DNA, 19 bp, Homo sapiens
tgtgtattaaaaaaaacaa

SEQ ID NO: 6547220 - DNA, 23 bp, Homo sapiens
tgtgtattatgtgcctaattttc

SEQ ID NO: 6547221 - DNA, 17 bp, Homo sapiens
tgtgtattcagaggcag

SEQ ID NO: 6547222 - DNA, 19 bp, Homo sapiens
tgtgtattcatactgacat

SEQ ID NO: 6547223 - DNA, 14 bp, Homo sapiens
tgtgtattgaagaa

SEQ ID NO: 6547224 - DNA, 17 bp, Homo sapiens
tgtgtattgatgcaata

SEQ ID NO: 6547225 - DNA, 21 bp, Homo sapiens
tgtgtattgatgcaatataag

SEQ ID NO: 6547226 - DNA, 13 bp, Homo sapiens
tgtgtattgttgt

SEQ ID NO: 6547227 - DNA, 20 bp, Homo sapiens
tgtgtattgttgtaaaatgt

SEQ ID NO: 6547228 - DNA, 20 bp, Homo sapiens
tgtgtatttaacagggaggg

SEQ ID NO: 6547229 - DNA, 15 bp, Homo sapiens
tgtgtatttacgctt

SEQ ID NO: 6547230 - DNA, 14 bp, Homo sapiens
tgtgtatttatata

SEQ ID NO: 6547231 - DNA, 19 bp, Homo sapiens
tgtgtatttatttaaaact

SEQ ID NO: 6547232 - DNA, 19 bp, Homo sapiens
tgtgtatttccagtgcaat

SEQ ID NO: 6547233 - DNA, 15 bp, Homo sapiens
tgtgtatttctaaga

SEQ ID NO: 6547234 - DNA, 14 bp, Homo sapiens
tgtgtatttctctg

SEQ ID NO: 6547235 - DNA, 18 bp, Homo sapiens
tgtgtatttctctgtgaa

SEQ ID NO: 6547236 - DNA, 15 bp, Homo sapiens
tgtgtatttgctaat

SEQ ID NO: 6547237 - DNA, 17 bp, Homo sapiens
tgtgtcaaaactggttt

SEQ ID NO: 6547238 - DNA, 14 bp, Homo sapiens
tgtgtcacaaagct

SEQ ID NO: 6547239 - DNA, 15 bp, Homo sapiens
tgtgtcacactgagc

SEQ ID NO: 6547240 - DNA, 18 bp, Homo sapiens
tgtgtcaccatcaggcca

SEQ ID NO: 6547241 - DNA, 23 bp, Homo sapiens
tgtgtcactgcatggcttctgaa

SEQ ID NO: 6547242 - DNA, 15 bp, Homo sapiens
tgtgtcactggctgc

SEQ ID NO: 6547243 - DNA, 17 bp, Homo sapiens
tgtgtcactggctgcct

SEQ ID NO: 6547244 - DNA, 16 bp, Homo sapiens
tgtgtcacttgtgctt

SEQ ID NO: 6547245 - DNA, 17 bp, Homo sapiens
tgtgtcagaaacatgaa

SEQ ID NO: 6547246 - DNA, 21 bp, Homo sapiens
tgtgtcagaaacatgaaatgc

SEQ ID NO: 6547247 - DNA, 14 bp, Homo sapiens
tgtgtcagaatctc

SEQ ID NO: 6547248 - DNA, 16 bp, Homo sapiens
tgtgtcagagacagac

SEQ ID NO: 6547249 - DNA, 22 bp, Homo sapiens
tgtgtcagagcccagcccagga

SEQ ID NO: 6547250 - DNA, 12 bp, Homo sapiens
tgtgtcagagtg

SEQ ID NO: 6547251 - DNA, 19 bp, Homo sapiens
tgtgtcagcatctttgccc

SEQ ID NO: 6547252 - DNA, 14 bp, Homo sapiens
tgtgtcagcatgca

SEQ ID NO: 6547253 - DNA, 14 bp, Homo sapiens
tgtgtcagctgagg

SEQ ID NO: 6547254 - DNA, 16 bp, Homo sapiens
tgtgtcagctggtagc

SEQ ID NO: 6547255 - DNA, 16 bp, Homo sapiens
tgtgtcaggccctctg

SEQ ID NO: 6547256 - DNA, 13 bp, Homo sapiens
tgtgtcagggatg

SEQ ID NO: 6547257 - DNA, 20 bp, Homo sapiens
tgtgtcagggatgagttgag

SEQ ID NO: 6547258 - DNA, 17 bp, Homo sapiens
tgtgtcaggtggggcag

SEQ ID NO: 6547259 - DNA, 20 bp, Homo sapiens
tgtgtcaggtggggcagctt

SEQ ID NO: 6547260 - DNA, 22 bp, Homo sapiens
tgtgtcagtggggctctctgag

SEQ ID NO: 6547261 - DNA, 18 bp, Homo sapiens
tgtgtcagtttatgtttt

SEQ ID NO: 6547262 - DNA, 15 bp, Homo sapiens
tgtgtcagtttttcc

SEQ ID NO: 6547263 - DNA, 16 bp, Homo sapiens
tgtgtcataccagaaa

SEQ ID NO: 6547264 - DNA, 21 bp, Homo sapiens
tgtgtcataccagaaagctct

SEQ ID NO: 6547265 - DNA, 22 bp, Homo sapiens
tgtgtcatgaagaatgtttctg

SEQ ID NO: 6547266 - DNA, 17 bp, Homo sapiens
tgtgtcatggtgatgca

SEQ ID NO: 6547267 - DNA, 20 bp, Homo sapiens
tgtgtcatggtgatgcaagt

SEQ ID NO: 6547268 - DNA, 18 bp, Homo sapiens
tgtgtcatttattcaagt

SEQ ID NO: 6547269 - DNA, 18 bp, Homo sapiens
tgtgtcatttctatattc

SEQ ID NO: 6547270 - DNA, 17 bp, Homo sapiens
tgtgtccaaaaccgcca

SEQ ID NO: 6547271 - DNA, 21 bp, Homo sapiens
tgtgtccaaaaccgccagctc

SEQ ID NO: 6547272 - DNA, 19 bp, Homo sapiens
tgtgtccaagtgtgtgtgc

SEQ ID NO: 6547273 - DNA, 17 bp, Homo sapiens
tgtgtccacacatacat

SEQ ID NO: 6547274 - DNA, 17 bp, Homo sapiens
tgtgtccacgactgtct

SEQ ID NO: 6547275 - DNA, 18 bp, Homo sapiens
tgtgtccacgactgtctc

SEQ ID NO: 6547276 - DNA, 16 bp, Homo sapiens
ttgctagaaaagacat

SEQ ID NO: 6547277 - DNA, 19 bp, Homo sapiens
ttgctagaatgggaagggt

SEQ ID NO: 6547278 - DNA, 16 bp, Homo sapiens
ttgctagacagccagg

SEQ ID NO: 6547279 - DNA, 19 bp, Homo sapiens
ttgctagagcatcatcctt

SEQ ID NO: 6547280 - DNA, 19 bp, Homo sapiens
ttgctagcaacaacttact

SEQ ID NO: 6547281 - DNA, 20 bp, Homo sapiens
ttgctagcaacaacttacta

SEQ ID NO: 6547282 - DNA, 18 bp, Homo sapiens
ttgctagcagtaaaagat

SEQ ID NO: 6547283 - DNA, 18 bp, Homo sapiens
ttgctagctagccagcca

SEQ ID NO: 6547284 - DNA, 19 bp, Homo sapiens
ttgctagctagccagccaa

SEQ ID NO: 6547285 - DNA, 19 bp, Homo sapiens
ttgctagctatgtgacctt

SEQ ID NO: 6547286 - DNA, 20 bp, Homo sapiens
ttgctaggacgcaataaatt

SEQ ID NO: 6547287 - DNA, 18 bp, Homo sapiens
ttgctaggagccccagct

SEQ ID NO: 6547288 - DNA, 15 bp, Homo sapiens
ttgctagggagaggg

SEQ ID NO: 6547289 - DNA, 16 bp, Homo sapiens
ttgctaggtataaaaa

SEQ ID NO: 6547290 - DNA, 21 bp, Homo sapiens
ttgctagtattcgctgtgttc

SEQ ID NO: 6547291 - DNA, 17 bp, Homo sapiens
ttgctagtatttgaatt

SEQ ID NO: 6547292 - DNA, 20 bp, Homo sapiens
ttgctagtctagtttccttt

SEQ ID NO: 6547293 - DNA, 20 bp, Homo sapiens
ttgctataaatagatttagt

SEQ ID NO: 6547294 - DNA, 22 bp, Homo sapiens
ttgctataagaaaagtgaaagt

SEQ ID NO: 6547295 - DNA, 15 bp, Homo sapiens
ttgctataatcatta

SEQ ID NO: 6547296 - DNA, 15 bp, Homo sapiens
ttgctatagtgacat

SEQ ID NO: 6547297 - DNA, 16 bp, Homo sapiens
ttgctatagtgacatg

SEQ ID NO: 6547298 - DNA, 22 bp, Homo sapiens
ttgctatagtgacatgcagtta

SEQ ID NO: 6547299 - DNA, 19 bp, Homo sapiens
ttgctatagttatacatca

SEQ ID NO: 6547300 - DNA, 20 bp, Homo sapiens
ttgctatagttatacatcaa

SEQ ID NO: 6547301 - DNA, 22 bp, Homo sapiens
ttgctatattcctttttctatg

SEQ ID NO: 6547302 - DNA, 16 bp, Homo sapiens
ttgctatatttgctaa

SEQ ID NO: 6547303 - DNA, 17 bp, Homo sapiens
ttgctatatttgctaat

SEQ ID NO: 6547304 - DNA, 21 bp, Homo sapiens
ttgctatcaaaataaattgaa

SEQ ID NO: 6547305 - DNA, 18 bp, Homo sapiens
ttgctatcaacaataaaa

SEQ ID NO: 6547306 - DNA, 22 bp, Homo sapiens
ttgctatcaacaataaaatttt

SEQ ID NO: 6547307 - DNA, 21 bp, Homo sapiens
ttgctatcgccctcctttccc

SEQ ID NO: 6547308 - DNA, 20 bp, Homo sapiens
ttgctatcggggaagccaga

SEQ ID NO: 6547309 - DNA, 14 bp, Homo sapiens
ttgctatctctatt

SEQ ID NO: 6547310 - DNA, 18 bp, Homo sapiens
ttgctatctgaactaatt

SEQ ID NO: 6547311 - DNA, 23 bp, Homo sapiens
ttgctatctggaggccttccagc

SEQ ID NO: 6547312 - DNA, 13 bp, Homo sapiens
ttgctatcttaat

SEQ ID NO: 6547313 - DNA, 18 bp, Homo sapiens
ttgctatcttaattttgg

SEQ ID NO: 6547314 - DNA, 23 bp, Homo sapiens
ttgctatggcaggataagaaagc

SEQ ID NO: 6547315 - DNA, 14 bp, Homo sapiens
ttgctatgtaaggg

SEQ ID NO: 6547316 - DNA, 15 bp, Homo sapiens
ttgctatgttactat

SEQ ID NO: 6547317 - DNA, 19 bp, Homo sapiens
ttgctatgttactattttc

SEQ ID NO: 6547318 - DNA, 17 bp, Homo sapiens
ttgctatgttgcccaag

SEQ ID NO: 6547319 - DNA, 13 bp, Homo sapiens
ttgctattctgtc

SEQ ID NO: 6547320 - DNA, 19 bp, Homo sapiens
ttgctattctgtccctagg

SEQ ID NO: 6547321 - DNA, 12 bp, Homo sapiens
ttgctattgtaa

SEQ ID NO: 6547322 - DNA, 16 bp, Homo sapiens
ttgctattgtttatag

SEQ ID NO: 6547323 - DNA, 15 bp, Homo sapiens
ttgctatttatattc

SEQ ID NO: 6547324 - DNA, 17 bp, Homo sapiens
ttgctatttcaataaca

SEQ ID NO: 6547325 - DNA, 15 bp, Homo sapiens
ttgctatttgcttta

SEQ ID NO: 6547326 - DNA, 15 bp, Homo sapiens
ttgctattttatttg

SEQ ID NO: 6547327 - DNA, 19 bp, Homo sapiens
ttgctattttatttgtatt

SEQ ID NO: 6547328 - DNA, 20 bp, Homo sapiens
ttgctattttatttgtattc

SEQ ID NO: 6547329 - DNA, 18 bp, Homo sapiens
ttgctcaaaaaatgagct

SEQ ID NO: 6547330 - DNA, 14 bp, Homo sapiens
ttgctcaaaatctg

SEQ ID NO: 6547331 - DNA, 18 bp, Homo sapiens
ttgctcaaaattgcttct

SEQ ID NO: 6547332 - DNA, 19 bp, Homo sapiens
ttgctcaaatctattcaga

SEQ ID NO: 6547333 - DNA, 19 bp, Homo sapiens
ttgctcaataaaggtcata

SEQ ID NO: 6547334 - DNA, 20 bp, Homo sapiens
ttgctcacactacttgagaa

SEQ ID NO: 6547335 - DNA, 20 bp, Homo sapiens
ttgctcacagttattacata

SEQ ID NO: 6547336 - DNA, 20 bp, Homo sapiens
ttgctcaccaagctgttcca

SEQ ID NO: 6547337 - DNA, 14 bp, Homo sapiens
ttgctcacccagga

SEQ ID NO: 6547338 - DNA, 20 bp, Homo sapiens
ttgctcaccgactcacctgc

SEQ ID NO: 6547339 - DNA, 23 bp, Homo sapiens
ttgctcaccgactcacctgcgca

SEQ ID NO: 6547340 - DNA, 22 bp, Homo sapiens
ttgctcactcactcactccaag

SEQ ID NO: 6547341 - DNA, 13 bp, Homo sapiens
ttgctcactccct

SEQ ID NO: 6547342 - DNA, 14 bp, Homo sapiens
ttgctcactcccta

SEQ ID NO: 6547343 - DNA, 21 bp, Homo sapiens
ttgctcagacgagacacccta

SEQ ID NO: 6547344 - DNA, 17 bp, Homo sapiens
ttgctcagagaaggaaa

SEQ ID NO: 6547345 - DNA, 23 bp, Homo sapiens
ttgctcagagaaggaaaagactg

SEQ ID NO: 6547346 - DNA, 21 bp, Homo sapiens
ttgctcagagtgaagagtgaa

SEQ ID NO: 6547347 - DNA, 18 bp, Homo sapiens
ttgctcagatagatctgt

SEQ ID NO: 6547348 - DNA, 13 bp, Homo sapiens
ttgctcagctcct

SEQ ID NO: 6547349 - DNA, 16 bp, Homo sapiens
ttgctcaggctggtct

SEQ ID NO: 6547350 - DNA, 16 bp, Homo sapiens
ttgctcagtgcctcct

SEQ ID NO: 6547351 - DNA, 15 bp, Homo sapiens
ttgctcagtgtccag

SEQ ID NO: 6547352 - DNA, 16 bp, Homo sapiens
ttgctcataagtaaat

SEQ ID NO: 6547353 - DNA, 23 bp, Homo sapiens
ttgctcatgcatagtcccagcta

SEQ ID NO: 6547354 - DNA, 15 bp, Homo sapiens
ttgctcattcttgag

SEQ ID NO: 6547355 - DNA, 20 bp, Homo sapiens
ttgctcattcttgaggagca

SEQ ID NO: 6547356 - DNA, 12 bp, Homo sapiens
ttgctccacccc

SEQ ID NO: 6547357 - DNA, 12 bp, Homo sapiens
ttgctccagagc

SEQ ID NO: 6547358 - DNA, 22 bp, Homo sapiens
ttgctccagtaaaatcttgcct

SEQ ID NO: 6547359 - DNA, 13 bp, Homo sapiens
ttgctccattcac

SEQ ID NO: 6547360 - DNA, 16 bp, Homo sapiens
ttgctccattcctgag

SEQ ID NO: 6547361 - DNA, 20 bp, Homo sapiens
ttgctccattttcttgtcaa

SEQ ID NO: 6547362 - DNA, 17 bp, Homo sapiens
ttgctcccaacccattc

SEQ ID NO: 6547363 - DNA, 22 bp, Homo sapiens
ttgctcccaggagggctttgtg

SEQ ID NO: 6547364 - DNA, 13 bp, Homo sapiens
ttgctcccagttt

SEQ ID NO: 6547365 - DNA, 21 bp, Homo sapiens
ttgctcccctgatagaagatt

SEQ ID NO: 6547366 - DNA, 16 bp, Homo sapiens
ttgctccctccccgct

SEQ ID NO: 6547367 - DNA, 13 bp, Homo sapiens
ttgctccctctcc

SEQ ID NO: 6547368 - DNA, 16 bp, Homo sapiens
ttgctccctctgttag

SEQ ID NO: 6547369 - DNA, 15 bp, Homo sapiens
ttgctccgctcccac

SEQ ID NO: 6547370 - DNA, 17 bp, Homo sapiens
ttgctcctaatgttgaa

SEQ ID NO: 6547371 - DNA, 20 bp, Homo sapiens
ttgctcctacccctgtcctg

SEQ ID NO: 6547372 - DNA, 15 bp, Homo sapiens
ttgctcctagcagac

SEQ ID NO: 6547373 - DNA, 17 bp, Homo sapiens
ttgctcctagcagacag

SEQ ID NO: 6547374 - DNA, 20 bp, Homo sapiens
ttgctcctggaacctggcag

SEQ ID NO: 6547375 - DNA, 14 bp, Homo sapiens
ttgctcctggcctt

SEQ ID NO: 6547376 - DNA, 18 bp, Homo sapiens
ttgctcctggccttgctg

SEQ ID NO: 6547377 - DNA, 14 bp, Homo sapiens
ttgctcctttccat

SEQ ID NO: 6547378 - DNA, 16 bp, Homo sapiens
ttgctcctttccatca

SEQ ID NO: 6547379 - DNA, 19 bp, Homo sapiens
ttgctcctttccatcagct

SEQ ID NO: 6547380 - DNA, 21 bp, Homo sapiens
ttgctcgaagactgtgacatc

SEQ ID NO: 6547381 - DNA, 21 bp, Homo sapiens
ttgctcgcgcggccgtggcct

SEQ ID NO: 6547382 - DNA, 16 bp, Homo sapiens
ttgctcgtcacagtgt

SEQ ID NO: 6547383 - DNA, 22 bp, Homo sapiens
ttgctctaaaatatttatgaag

SEQ ID NO: 6547384 - DNA, 21 bp, Homo sapiens
ttgctctaattcttttcaaaa

SEQ ID NO: 6547385 - DNA, 14 bp, Homo sapiens
ttgctctacctggc

SEQ ID NO: 6547386 - DNA, 16 bp, Homo sapiens
ttgctctacctggccg

SEQ ID NO: 6547387 - DNA, 19 bp, Homo sapiens
ttgctctatgctttccaaa

SEQ ID NO: 6547388 - DNA, 15 bp, Homo sapiens
ttgctctatgggaaa

SEQ ID NO: 6547389 - DNA, 16 bp, Homo sapiens
ttgctctccattcttt

SEQ ID NO: 6547390 - DNA, 21 bp, Homo sapiens
ttgctctcccctgccctgctg

SEQ ID NO: 6547391 - DNA, 20 bp, Homo sapiens
ttgctctcccggttcttcca

SEQ ID NO: 6547392 - DNA, 21 bp, Homo sapiens
ttgctctcccggttcttccag

SEQ ID NO: 6547393 - DNA, 23 bp, Homo sapiens
ttgctctccctcccttctttcct

SEQ ID NO: 6547394 - DNA, 18 bp, Homo sapiens
ttgctctccctcttctca

SEQ ID NO: 6547395 - DNA, 17 bp, Homo sapiens
ttgctctctctccctgc

SEQ ID NO: 6547396 - DNA, 20 bp, Homo sapiens
ttgctctctggccttttcct

SEQ ID NO: 6547397 - DNA, 13 bp, Homo sapiens
ttgctctctgggc

SEQ ID NO: 6547398 - DNA, 17 bp, Homo sapiens
ttgctctctgtgaccct

SEQ ID NO: 6547399 - DNA, 20 bp, Homo sapiens
ttgctctctgtgtctgagag

SEQ ID NO: 6547400 - DNA, 16 bp, Homo sapiens
ttgctctctgttcaag

SEQ ID NO: 6547401 - DNA, 16 bp, Homo sapiens
ttgctctctgttctct

SEQ ID NO: 6547402 - DNA, 21 bp, Homo sapiens
ttgctctctgttctcttgctt

SEQ ID NO: 6547403 - DNA, 19 bp, Homo sapiens
ttgctctcttcaataaacc

SEQ ID NO: 6547404 - DNA, 21 bp, Homo sapiens
ttgctctcttttattctgtgc

SEQ ID NO: 6547405 - DNA, 16 bp, Homo sapiens
ttgctctgacctcctc

SEQ ID NO: 6547406 - DNA, 22 bp, Homo sapiens
ttgctctgacctcctctgggcc

SEQ ID NO: 6547407 - DNA, 11 bp, Homo sapiens
ttgctctgagg

SEQ ID NO: 6547408 - DNA, 15 bp, Homo sapiens
ttgctctgcaggcac

SEQ ID NO: 6547409 - DNA, 16 bp, Homo sapiens
ttgctctggagcagcc

SEQ ID NO: 6547410 - DNA, 23 bp, Homo sapiens
ttgctctgtaatctcgtttcaaa

SEQ ID NO: 6547411 - DNA, 13 bp, Homo sapiens
ttgctctgtatgt

SEQ ID NO: 6547412 - DNA, 20 bp, Homo sapiens
ttgctctgtcccccaggctg

SEQ ID NO: 6547413 - DNA, 20 bp, Homo sapiens
ttgctctgtctcccaggctg

SEQ ID NO: 6547414 - DNA, 18 bp, Homo sapiens
ttgctctgtgtatatctc

SEQ ID NO: 6547415 - DNA, 23 bp, Homo sapiens
ttgctctgtgtatatctcttgga

SEQ ID NO: 6547416 - DNA, 24 bp, Homo sapiens
ttgctctgtgtatatctcttggaa

SEQ ID NO: 6547417 - DNA, 20 bp, Homo sapiens
ttgctctgtttgtggggtga

SEQ ID NO: 6547418 - DNA, 13 bp, Homo sapiens
ttgctcttaaaaa

SEQ ID NO: 6547419 - DNA, 21 bp, Homo sapiens
ttgctcttaagtaccagaagc

SEQ ID NO: 6547420 - DNA, 19 bp, Homo sapiens
ttgctcttcataataaacc

SEQ ID NO: 6547421 - DNA, 12 bp, Homo sapiens
ttgctcttctcc

SEQ ID NO: 6547422 - DNA, 13 bp, Homo sapiens
ttgctcttctcct

SEQ ID NO: 6547423 - DNA, 12 bp, Homo sapiens
ttgctcttctga

SEQ ID NO: 6547424 - DNA, 17 bp, Homo sapiens
ttgctcttctttctgag

SEQ ID NO: 6547425 - DNA, 14 bp, Homo sapiens
ttgctcttgatgcc

SEQ ID NO: 6547426 - DNA, 16 bp, Homo sapiens
ttgctcttggggaagg

SEQ ID NO: 6547427 - DNA, 15 bp, Homo sapiens
ttgctcttgtagccc

SEQ ID NO: 6547428 - DNA, 16 bp, Homo sapiens
ttgctctttagatgca

SEQ ID NO: 6547429 - DNA, 13 bp, Homo sapiens
ttgctctttcacc

SEQ ID NO: 6547430 - DNA, 16 bp, Homo sapiens
ttgctcttttaagcag

SEQ ID NO: 6547431 - DNA, 18 bp, Homo sapiens
ttgctcttttaagcagtc

SEQ ID NO: 6547432 - DNA, 17 bp, Homo sapiens
ttgctgaaaaatgggca

SEQ ID NO: 6547433 - DNA, 14 bp, Homo sapiens
ttgctgaaactgtg

SEQ ID NO: 6547434 - DNA, 18 bp, Homo sapiens
ttgctgaaagatatgtat

SEQ ID NO: 6547435 - DNA, 20 bp, Homo sapiens
ttgctgaaagatatgtatat

SEQ ID NO: 6547436 - DNA, 14 bp, Homo sapiens
ttgctgaaagatct

SEQ ID NO: 6547437 - DNA, 16 bp, Homo sapiens
ttgctgaaattttata

SEQ ID NO: 6547438 - DNA, 16 bp, Homo sapiens
ttgctgaacacacaca

SEQ ID NO: 6547439 - DNA, 17 bp, Homo sapiens
ttgctgaacattggaga

SEQ ID NO: 6547440 - DNA, 11 bp, Homo sapiens
ttgctgaactc

SEQ ID NO: 6547441 - DNA, 16 bp, Homo sapiens
ttgctgaagtctcccc

SEQ ID NO: 6547442 - DNA, 15 bp, Homo sapiens
ttgctgaatatgcaa

SEQ ID NO: 6547443 - DNA, 17 bp, Homo sapiens
ttgctgaatcccatcag

SEQ ID NO: 6547444 - DNA, 18 bp, Homo sapiens
ttgctgaatgtcattatt

SEQ ID NO: 6547445 - DNA, 14 bp, Homo sapiens
ttgctgaattctaa

SEQ ID NO: 6547446 - DNA, 14 bp, Homo sapiens
ttgctgaatttcag

SEQ ID NO: 6547447 - DNA, 23 bp, Homo sapiens
ttgctgacaaccattaaagtcag

SEQ ID NO: 6547448 - DNA, 14 bp, Homo sapiens
ttgctgacagagcc

SEQ ID NO: 6547449 - DNA, 15 bp, Homo sapiens
ttgctgacagagccc

SEQ ID NO: 6547450 - DNA, 20 bp, Homo sapiens
ttgctgaccagctggagtga

SEQ ID NO: 6547451 - DNA, 15 bp, Homo sapiens
ttgctgaccccaggt

SEQ ID NO: 6547452 - DNA, 23 bp, Homo sapiens
ttgctgactactactctgccaat

SEQ ID NO: 6547453 - DNA, 16 bp, Homo sapiens
ttgctgagaaatgggg

SEQ ID NO: 6547454 - DNA, 13 bp, Homo sapiens
tgtgtccagcagc

SEQ ID NO: 6547455 - DNA, 14 bp, Homo sapiens
tgtgtccagcagct

SEQ ID NO: 6547456 - DNA, 16 bp, Homo sapiens
tgtgtccatgtgtgtg

SEQ ID NO: 6547457 - DNA, 15 bp, Homo sapiens
tgtgtccatttcaag

SEQ ID NO: 6547458 - DNA, 22 bp, Homo sapiens
tgtgtcccaaaatcccctcagc

SEQ ID NO: 6547459 - DNA, 17 bp, Homo sapiens
tgtgtcccagatgctgt

SEQ ID NO: 6547460 - DNA, 15 bp, Homo sapiens
tgtgtcccagccacg

SEQ ID NO: 6547461 - DNA, 22 bp, Homo sapiens
tgtgtcccagccacgcagggcc

SEQ ID NO: 6547462 - DNA, 13 bp, Homo sapiens
tgtgtcccaggca

SEQ ID NO: 6547463 - DNA, 11 bp, Homo sapiens
tgtgtcccagt

SEQ ID NO: 6547464 - DNA, 21 bp, Homo sapiens
tgtgtcccagtgtctggccca

SEQ ID NO: 6547465 - DNA, 19 bp, Homo sapiens
tgtgtcccatgatccctgt

SEQ ID NO: 6547466 - DNA, 15 bp, Homo sapiens
tgtgtcccccccagg

SEQ ID NO: 6547467 - DNA, 16 bp, Homo sapiens
tgtgtcccccccaggc

SEQ ID NO: 6547468 - DNA, 19 bp, Homo sapiens
tgtgtcccccctgtggtct

SEQ ID NO: 6547469 - DNA, 16 bp, Homo sapiens
tgtgtccccctctgtc

SEQ ID NO: 6547470 - DNA, 21 bp, Homo sapiens
tgtgtccccctctgtccaggc

SEQ ID NO: 6547471 - DNA, 14 bp, Homo sapiens
tgtgtcccctcact

SEQ ID NO: 6547472 - DNA, 15 bp, Homo sapiens
tgtgtcccctcactc

SEQ ID NO: 6547473 - DNA, 17 bp, Homo sapiens
tgtgtcccctcactctg

SEQ ID NO: 6547474 - DNA, 16 bp, Homo sapiens
tgtgtcccctgacctg

SEQ ID NO: 6547475 - DNA, 16 bp, Homo sapiens
tgtgtccctctctctg

SEQ ID NO: 6547476 - DNA, 17 bp, Homo sapiens
tgtgtccctgctggggt

SEQ ID NO: 6547477 - DNA, 20 bp, Homo sapiens
tgtgtccctggaaccttcta

SEQ ID NO: 6547478 - DNA, 14 bp, Homo sapiens
tgtgtccctggaca

SEQ ID NO: 6547479 - DNA, 21 bp, Homo sapiens
tgtgtccctggacacagctct

SEQ ID NO: 6547480 - DNA, 21 bp, Homo sapiens
tgtgtccctggcgctgtgcta

SEQ ID NO: 6547481 - DNA, 15 bp, Homo sapiens
tgtgtccggcccagt

SEQ ID NO: 6547482 - DNA, 23 bp, Homo sapiens
tgtgtccgtgaaagttgtgatct

SEQ ID NO: 6547483 - DNA, 22 bp, Homo sapiens
tgtgtcctcaagaagaaagtgt

SEQ ID NO: 6547484 - DNA, 16 bp, Homo sapiens
tgtgtcctccaccatg

SEQ ID NO: 6547485 - DNA, 18 bp, Homo sapiens
tgtgtcctccaggagctt

SEQ ID NO: 6547486 - DNA, 15 bp, Homo sapiens
tgtgtcctcctgctc

SEQ ID NO: 6547487 - DNA, 16 bp, Homo sapiens
tgtgtcctcctgctct

SEQ ID NO: 6547488 - DNA, 20 bp, Homo sapiens
tgtgtcctcctgctctgctt

SEQ ID NO: 6547489 - DNA, 23 bp, Homo sapiens
tgtgtcctcctgctctgcttcct

SEQ ID NO: 6547490 - DNA, 14 bp, Homo sapiens
tgtgtcctctcccc

SEQ ID NO: 6547491 - DNA, 21 bp, Homo sapiens
tgtgtcctctcccctctgccc

SEQ ID NO: 6547492 - DNA, 18 bp, Homo sapiens
tgtgtcctctgcctgggc

SEQ ID NO: 6547493 - DNA, 20 bp, Homo sapiens
tgtgtcctgaaacgctcctt

SEQ ID NO: 6547494 - DNA, 14 bp, Homo sapiens
tgtgtcctgacact

SEQ ID NO: 6547495 - DNA, 22 bp, Homo sapiens
tgtgtcctggtaattcctctcc

SEQ ID NO: 6547496 - DNA, 14 bp, Homo sapiens
tgtgtcctggttcc

SEQ ID NO: 6547497 - DNA, 19 bp, Homo sapiens
tgtgtcctgtgtaaattag

SEQ ID NO: 6547498 - DNA, 16 bp, Homo sapiens
tgtgtccttccctgca

SEQ ID NO: 6547499 - DNA, 18 bp, Homo sapiens
tgtgtccttgaactgagg

SEQ ID NO: 6547500 - DNA, 14 bp, Homo sapiens
tgtgtccttgcacc

SEQ ID NO: 6547501 - DNA, 16 bp, Homo sapiens
tgtgtcctttaaaaaa

SEQ ID NO: 6547502 - DNA, 22 bp, Homo sapiens
tgtgtcgcctctcactctggca

SEQ ID NO: 6547503 - DNA, 15 bp, Homo sapiens
tgtgtctaagattct

SEQ ID NO: 6547504 - DNA, 13 bp, Homo sapiens
tgtgtctacagag

SEQ ID NO: 6547505 - DNA, 14 bp, Homo sapiens
tgtgtctacagaga

SEQ ID NO: 6547506 - DNA, 19 bp, Homo sapiens
tgtgtctaggcaggacctg

SEQ ID NO: 6547507 - DNA, 15 bp, Homo sapiens
tgtgtctaggcaggc

SEQ ID NO: 6547508 - DNA, 13 bp, Homo sapiens
tgtgtctaggctg

SEQ ID NO: 6547509 - DNA, 21 bp, Homo sapiens
tgtgtctaggctggaagagcc

SEQ ID NO: 6547510 - DNA, 14 bp, Homo sapiens
tgtgtctatttctg

SEQ ID NO: 6547511 - DNA, 20 bp, Homo sapiens
tgtgtctcaggaaaacagct

SEQ ID NO: 6547512 - DNA, 14 bp, Homo sapiens
tgtgtctcatgcca

SEQ ID NO: 6547513 - DNA, 23 bp, Homo sapiens
tgtgtctcatgccagcagcacgt

SEQ ID NO: 6547514 - DNA, 15 bp, Homo sapiens
tgtgtctcccagaac

SEQ ID NO: 6547515 - DNA, 13 bp, Homo sapiens
tgtgtctcctgca

SEQ ID NO: 6547516 - DNA, 15 bp, Homo sapiens
tgtgtctctgctttc

SEQ ID NO: 6547517 - DNA, 16 bp, Homo sapiens
tgtgtctcttggtcct

SEQ ID NO: 6547518 - DNA, 20 bp, Homo sapiens
tgtgtctcttggtcctgctg

SEQ ID NO: 6547519 - DNA, 17 bp, Homo sapiens
tgtgtctgaatcatgtc

SEQ ID NO: 6547520 - DNA, 12 bp, Homo sapiens
tgtgtctgagcc

SEQ ID NO: 6547521 - DNA, 21 bp, Homo sapiens
tgtgtctgagcccaacccttc

SEQ ID NO: 6547522 - DNA, 20 bp, Homo sapiens
tgtgtctgcattgttattgt

SEQ ID NO: 6547523 - DNA, 15 bp, Homo sapiens
tgtgtctgccaaaca

SEQ ID NO: 6547524 - DNA, 18 bp, Homo sapiens
tgtgtctgccaaacacat

SEQ ID NO: 6547525 - DNA, 21 bp, Homo sapiens
tgtgtctgccaaacacattta

SEQ ID NO: 6547526 - DNA, 16 bp, Homo sapiens
tgtgtctgccacatta

SEQ ID NO: 6547527 - DNA, 22 bp, Homo sapiens
tgtgtctgctgagtaaggaaca

SEQ ID NO: 6547528 - DNA, 12 bp, Homo sapiens
tgtgtctgctgt

SEQ ID NO: 6547529 - DNA, 15 bp, Homo sapiens
tgtgtctggagcctg

SEQ ID NO: 6547530 - DNA, 18 bp, Homo sapiens
tgtgtctggagcctgcag

SEQ ID NO: 6547531 - DNA, 13 bp, Homo sapiens
tgtgtctggtaac

SEQ ID NO: 6547532 - DNA, 13 bp, Homo sapiens
tgtgtctggtgca

SEQ ID NO: 6547533 - DNA, 14 bp, Homo sapiens
tgtgtctgtacacg

SEQ ID NO: 6547534 - DNA, 14 bp, Homo sapiens
tgtgtctgtattca

SEQ ID NO: 6547535 - DNA, 23 bp, Homo sapiens
tgtgtctgtcacaggctgggtca

SEQ ID NO: 6547536 - DNA, 19 bp, Homo sapiens
tgtgtctgtctttgtggga

SEQ ID NO: 6547537 - DNA, 20 bp, Homo sapiens
tgtgtctgtgtggtatattt

SEQ ID NO: 6547538 - DNA, 12 bp, Homo sapiens
tgtgtctgtgtt

SEQ ID NO: 6547539 - DNA, 15 bp, Homo sapiens
tgtgtctgtgttgct

SEQ ID NO: 6547540 - DNA, 15 bp, Homo sapiens
tgtgtctgttttact

SEQ ID NO: 6547541 - DNA, 21 bp, Homo sapiens
tgtgtcttatgaggaattgga

SEQ ID NO: 6547542 - DNA, 17 bp, Homo sapiens
tgtgtcttcaatttgta

SEQ ID NO: 6547543 - DNA, 20 bp, Homo sapiens
tgtgtcttgcaatggcagcc

SEQ ID NO: 6547544 - DNA, 21 bp, Homo sapiens
tgtgtcttgcaatggcagcct

SEQ ID NO: 6547545 - DNA, 19 bp, Homo sapiens
tgtgtctttaaatgctgct

SEQ ID NO: 6547546 - DNA, 22 bp, Homo sapiens
tgtgtctttcacagctcctccc

SEQ ID NO: 6547547 - DNA, 22 bp, Homo sapiens
tgtgtctttccagaaggtcacg

SEQ ID NO: 6547548 - DNA, 17 bp, Homo sapiens
tgtgtcttttgttctct

SEQ ID NO: 6547549 - DNA, 18 bp, Homo sapiens
tgtgtcttttgttctctc

SEQ ID NO: 6547550 - DNA, 18 bp, Homo sapiens
tgtgtctttttcgccaaa

SEQ ID NO: 6547551 - DNA, 15 bp, Homo sapiens
tgtgtgaaaatactg

SEQ ID NO: 6547552 - DNA, 22 bp, Homo sapiens
tgtgtgaaacaatgttgtccaa

SEQ ID NO: 6547553 - DNA, 23 bp, Homo sapiens
tgtgtgaaacaatgttgtccaac

SEQ ID NO: 6547554 - DNA, 20 bp, Homo sapiens
tgtgtgaaaggtacttcaaa

SEQ ID NO: 6547555 - DNA, 23 bp, Homo sapiens
tgtgtgaaatctttcaagttgca

SEQ ID NO: 6547556 - DNA, 20 bp, Homo sapiens
tgtgtgaaccactgtgtact

SEQ ID NO: 6547557 - DNA, 20 bp, Homo sapiens
tgtgtgaactgctttcaagt

SEQ ID NO: 6547558 - DNA, 15 bp, Homo sapiens
tgtgtgaactgggca

SEQ ID NO: 6547559 - DNA, 23 bp, Homo sapiens
tgtgtgaagatcacgttccttcc

SEQ ID NO: 6547560 - DNA, 22 bp, Homo sapiens
tgtgtgaagcttaagggtcata

SEQ ID NO: 6547561 - DNA, 15 bp, Homo sapiens
tgtgtgaaggcagag

SEQ ID NO: 6547562 - DNA, 21 bp, Homo sapiens
tgtgtgaaggtaactaagaag

SEQ ID NO: 6547563 - DNA, 19 bp, Homo sapiens
tgtgtgaagtgagaactcc

SEQ ID NO: 6547564 - DNA, 17 bp, Homo sapiens
tgtgtgaagtgagtgag

SEQ ID NO: 6547565 - DNA, 17 bp, Homo sapiens
tgtgtgaagttacacaa

SEQ ID NO: 6547566 - DNA, 16 bp, Homo sapiens
tgtgtgaatgaacact

SEQ ID NO: 6547567 - DNA, 18 bp, Homo sapiens
tgtgtgaatgaacactct

SEQ ID NO: 6547568 - DNA, 22 bp, Homo sapiens
tgtgtgaatgaacactcttttg

SEQ ID NO: 6547569 - DNA, 12 bp, Homo sapiens
tgtgtgaatgtg

SEQ ID NO: 6547570 - DNA, 13 bp, Homo sapiens
tgtgtgaatgtgg

SEQ ID NO: 6547571 - DNA, 19 bp, Homo sapiens
tgtgtgaatttttctaaac

SEQ ID NO: 6547572 - DNA, 14 bp, Homo sapiens
tgtgtgacaattct

SEQ ID NO: 6547573 - DNA, 20 bp, Homo sapiens
tgtgtgacaccaccactgtg

SEQ ID NO: 6547574 - DNA, 23 bp, Homo sapiens
tgtgtgacaccaccactgtgtcc

SEQ ID NO: 6547575 - DNA, 18 bp, Homo sapiens
tgtgtgacatcacagggc

SEQ ID NO: 6547576 - DNA, 12 bp, Homo sapiens
tgtgtgaccaac

SEQ ID NO: 6547577 - DNA, 17 bp, Homo sapiens
tgtgtgaccaactgtgt

SEQ ID NO: 6547578 - DNA, 20 bp, Homo sapiens
tgtgtgaccaactgtgttgt

SEQ ID NO: 6547579 - DNA, 22 bp, Homo sapiens
tgtgtgacccctcctggggcca

SEQ ID NO: 6547580 - DNA, 16 bp, Homo sapiens
tgtgtgagactactaa

SEQ ID NO: 6547581 - DNA, 20 bp, Homo sapiens
tgtgtgagacttaaaacatg

SEQ ID NO: 6547582 - DNA, 21 bp, Homo sapiens
tgtgtgagacttaaaacatgg

SEQ ID NO: 6547583 - DNA, 14 bp, Homo sapiens
tgtgtgagcagtgg

SEQ ID NO: 6547584 - DNA, 13 bp, Homo sapiens
tgtgtgagcatct

SEQ ID NO: 6547585 - DNA, 16 bp, Homo sapiens
tgtgtgagcatctctg

SEQ ID NO: 6547586 - DNA, 17 bp, Homo sapiens
tgtgtgaggagctgctg

SEQ ID NO: 6547587 - DNA, 17 bp, Homo sapiens
tgtgtgaggctgtgtct

SEQ ID NO: 6547588 - DNA, 18 bp, Homo sapiens
tgtgtgaggctgtgtctc

SEQ ID NO: 6547589 - DNA, 17 bp, Homo sapiens
tgtgtgagtgtgaatat

SEQ ID NO: 6547590 - DNA, 12 bp, Homo sapiens
tgtgtgataaat

SEQ ID NO: 6547591 - DNA, 15 bp, Homo sapiens
tgtgtgatatttcag

SEQ ID NO: 6547592 - DNA, 18 bp, Homo sapiens
tgtgtgatatttcagaaa

SEQ ID NO: 6547593 - DNA, 18 bp, Homo sapiens
tgtgtgatccagccctgg

SEQ ID NO: 6547594 - DNA, 17 bp, Homo sapiens
tgtgtgatgaactttct

SEQ ID NO: 6547595 - DNA, 14 bp, Homo sapiens
tgtgtgatgctgac

SEQ ID NO: 6547596 - DNA, 17 bp, Homo sapiens
tgtgtgatgtgacattt

SEQ ID NO: 6547597 - DNA, 23 bp, Homo sapiens
tgtgtgattgcacgtgcctgtgg

SEQ ID NO: 6547598 - DNA, 10 bp, Homo sapiens
tgtgtgattt

SEQ ID NO: 6547599 - DNA, 15 bp, Homo sapiens
tgtgtgatttcctaa

SEQ ID NO: 6547600 - DNA, 18 bp, Homo sapiens
tgtgtgcaactaactgac

SEQ ID NO: 6547601 - DNA, 13 bp, Homo sapiens
tgtgtgcaatgtt

SEQ ID NO: 6547602 - DNA, 16 bp, Homo sapiens
tgtgtgcaatgttccg

SEQ ID NO: 6547603 - DNA, 20 bp, Homo sapiens
tgtgtgcacacgtgtgtatg

SEQ ID NO: 6547604 - DNA, 22 bp, Homo sapiens
tgtgtgcacacgtgtgtatgag

SEQ ID NO: 6547605 - DNA, 23 bp, Homo sapiens
tgtgtgcacatctacatgccatg

SEQ ID NO: 6547606 - DNA, 22 bp, Homo sapiens
tgtgtgcaccttaccaactttc

SEQ ID NO: 6547607 - DNA, 20 bp, Homo sapiens
tgtgtgcagagcagacaggc

SEQ ID NO: 6547608 - DNA, 22 bp, Homo sapiens
tgtgtgcagagtatacaagtgt

SEQ ID NO: 6547609 - DNA, 16 bp, Homo sapiens
tgtgtgcaggagcctc

SEQ ID NO: 6547610 - DNA, 17 bp, Homo sapiens
tgtgtgcagtggagctg

SEQ ID NO: 6547611 - DNA, 15 bp, Homo sapiens
tgtgtgcatatttgt

SEQ ID NO: 6547612 - DNA, 15 bp, Homo sapiens
tgtgtgcatcaggct

SEQ ID NO: 6547613 - DNA, 15 bp, Homo sapiens
tgtgtgcatggaagt

SEQ ID NO: 6547614 - DNA, 20 bp, Homo sapiens
tgtgtgcatggaagtaatta

SEQ ID NO: 6547615 - DNA, 12 bp, Homo sapiens
tgtgtgcatgta

SEQ ID NO: 6547616 - DNA, 15 bp, Homo sapiens
tgtgtgcatgtatgt

SEQ ID NO: 6547617 - DNA, 20 bp, Homo sapiens
tgtgtgcatgtgtgtgctca

SEQ ID NO: 6547618 - DNA, 16 bp, Homo sapiens
tgtgtgccaagccctg

SEQ ID NO: 6547619 - DNA, 17 bp, Homo sapiens
tgtgtgccaagccctgg

SEQ ID NO: 6547620 - DNA, 16 bp, Homo sapiens
tgtgtgccatattctg

SEQ ID NO: 6547621 - DNA, 18 bp, Homo sapiens
tgtgtgccatattctggt

SEQ ID NO: 6547622 - DNA, 13 bp, Homo sapiens
tgtgtgcccagca

SEQ ID NO: 6547623 - DNA, 21 bp, Homo sapiens
tgtgtgcccagcacctggagg

SEQ ID NO: 6547624 - DNA, 14 bp, Homo sapiens
tgtgtgcccagctt

SEQ ID NO: 6547625 - DNA, 20 bp, Homo sapiens
tgtgtgccccactccagcct

SEQ ID NO: 6547626 - DNA, 19 bp, Homo sapiens
tgtgtgccctagggctcag

SEQ ID NO: 6547627 - DNA, 14 bp, Homo sapiens
tgtgtgccctggac

SEQ ID NO: 6547628 - DNA, 13 bp, Homo sapiens
tgtgtgccctggg

SEQ ID NO: 6547629 - DNA, 15 bp, Homo sapiens
tgtgtgccctgggcc

SEQ ID NO: 6547630 - DNA, 21 bp, Homo sapiens
tgtgtgccctgggccaggcag

SEQ ID NO: 6547631 - DNA, 15 bp, Homo sapiens
tgtgtgcctagtgat

SEQ ID NO: 6547632 - DNA, 17 bp, Homo sapiens
tgtgtgcctctagctga

SEQ ID NO: 6547633 - DNA, 15 bp, Homo sapiens
ttgctgagaagcaaa

SEQ ID NO: 6547634 - DNA, 11 bp, Homo sapiens
ttgctgagagc

SEQ ID NO: 6547635 - DNA, 14 bp, Homo sapiens
ttgctgagccagct

SEQ ID NO: 6547636 - DNA, 19 bp, Homo sapiens
ttgctgagccagctgcaga

SEQ ID NO: 6547637 - DNA, 11 bp, Homo sapiens
ttgctgagggg

SEQ ID NO: 6547638 - DNA, 14 bp, Homo sapiens
ttgctgagtgaagg

SEQ ID NO: 6547639 - DNA, 18 bp, Homo sapiens
ttgctgatccccaacctg

SEQ ID NO: 6547640 - DNA, 22 bp, Homo sapiens
ttgctgatggcccctccagcac

SEQ ID NO: 6547641 - DNA, 23 bp, Homo sapiens
ttgctgatggcccctccagcaca

SEQ ID NO: 6547642 - DNA, 20 bp, Homo sapiens
ttgctgatggcttgacatgt

SEQ ID NO: 6547643 - DNA, 18 bp, Homo sapiens
ttgctgatggtgcaatga

SEQ ID NO: 6547644 - DNA, 16 bp, Homo sapiens
ttgctgatgtttataa

SEQ ID NO: 6547645 - DNA, 23 bp, Homo sapiens
ttgctgatttgcacacattggcc

SEQ ID NO: 6547646 - DNA, 19 bp, Homo sapiens
ttgctgattttaatggatt

SEQ ID NO: 6547647 - DNA, 14 bp, Homo sapiens
ttgctgattttgac

SEQ ID NO: 6547648 - DNA, 20 bp, Homo sapiens
ttgctgattttgaccttgta

SEQ ID NO: 6547649 - DNA, 13 bp, Homo sapiens
ttgctgcaaacct

SEQ ID NO: 6547650 - DNA, 22 bp, Homo sapiens
ttgctgcacaaacatgaaaatt

SEQ ID NO: 6547651 - DNA, 19 bp, Homo sapiens
ttgctgcacagcaggacct

SEQ ID NO: 6547652 - DNA, 16 bp, Homo sapiens
ttgctgcaggccctcc

SEQ ID NO: 6547653 - DNA, 18 bp, Homo sapiens
ttgctgcagtatgaaaat

SEQ ID NO: 6547654 - DNA, 18 bp, Homo sapiens
ttgctgcataaaattcta

SEQ ID NO: 6547655 - DNA, 15 bp, Homo sapiens
ttgctgcatatttga

SEQ ID NO: 6547656 - DNA, 22 bp, Homo sapiens
ttgctgcatgggttaattgaga

SEQ ID NO: 6547657 - DNA, 13 bp, Homo sapiens
ttgctgcatttta

SEQ ID NO: 6547658 - DNA, 17 bp, Homo sapiens
ttgctgcattttaagca

SEQ ID NO: 6547659 - DNA, 15 bp, Homo sapiens
ttgctgcattttaca

SEQ ID NO: 6547660 - DNA, 11 bp, Homo sapiens
ttgctgccaaa

SEQ ID NO: 6547661 - DNA, 18 bp, Homo sapiens
ttgctgccaaaaccacat

SEQ ID NO: 6547662 - DNA, 21 bp, Homo sapiens
ttgctgccaaccataccttcc

SEQ ID NO: 6547663 - DNA, 20 bp, Homo sapiens
ttgctgccaagtcctgcctt

SEQ ID NO: 6547664 - DNA, 21 bp, Homo sapiens
ttgctgccaagtcctgccttt

SEQ ID NO: 6547665 - DNA, 11 bp, Homo sapiens
ttgctgccaga

SEQ ID NO: 6547666 - DNA, 19 bp, Homo sapiens
ttgctgccagagaagtctg

SEQ ID NO: 6547667 - DNA, 17 bp, Homo sapiens
ttgctgccatcgtaaac

SEQ ID NO: 6547668 - DNA, 20 bp, Homo sapiens
ttgctgccattacagaggta

SEQ ID NO: 6547669 - DNA, 16 bp, Homo sapiens
ttgctgcctcagagca

SEQ ID NO: 6547670 - DNA, 22 bp, Homo sapiens
ttgctgccttctgtctcttgca

SEQ ID NO: 6547671 - DNA, 22 bp, Homo sapiens
ttgctgcgcaccaatgcccagc

SEQ ID NO: 6547672 - DNA, 16 bp, Homo sapiens
ttgctgctaatatttt

SEQ ID NO: 6547673 - DNA, 20 bp, Homo sapiens
ttgctgctaatattttcctc

SEQ ID NO: 6547674 - DNA, 23 bp, Homo sapiens
ttgctgctaccgccctgggctgg

SEQ ID NO: 6547675 - DNA, 13 bp, Homo sapiens
ttgctgctagaac

SEQ ID NO: 6547676 - DNA, 22 bp, Homo sapiens
ttgctgctataattctatactg

SEQ ID NO: 6547677 - DNA, 20 bp, Homo sapiens
ttgctgctattttactgtct

SEQ ID NO: 6547678 - DNA, 12 bp, Homo sapiens
ttgctgctctgc

SEQ ID NO: 6547679 - DNA, 13 bp, Homo sapiens
ttgctgctgaagg

SEQ ID NO: 6547680 - DNA, 21 bp, Homo sapiens
ttgctgctgatttaaacacat

SEQ ID NO: 6547681 - DNA, 12 bp, Homo sapiens
ttgctgctgcct

SEQ ID NO: 6547682 - DNA, 15 bp, Homo sapiens
ttgctgctgctgctc

SEQ ID NO: 6547683 - DNA, 13 bp, Homo sapiens
ttgctgctggctc

SEQ ID NO: 6547684 - DNA, 20 bp, Homo sapiens
ttgctgctggctcccatctc

SEQ ID NO: 6547685 - DNA, 22 bp, Homo sapiens
ttgctgctgtgcgtggaaaaag

SEQ ID NO: 6547686 - DNA, 12 bp, Homo sapiens
ttgctgcttgga

SEQ ID NO: 6547687 - DNA, 12 bp, Homo sapiens
ttgctgctttgt

SEQ ID NO: 6547688 - DNA, 11 bp, Homo sapiens
ttgctggaaaa

SEQ ID NO: 6547689 - DNA, 15 bp, Homo sapiens
ttgctggaaaactgc

SEQ ID NO: 6547690 - DNA, 18 bp, Homo sapiens
ttgctggaaaactgccac

SEQ ID NO: 6547691 - DNA, 21 bp, Homo sapiens
ttgctggaaaactgccacaag

SEQ ID NO: 6547692 - DNA, 23 bp, Homo sapiens
ttgctggaaaatctgtaaaaaag

SEQ ID NO: 6547693 - DNA, 14 bp, Homo sapiens
ttgctggaaagagc

SEQ ID NO: 6547694 - DNA, 19 bp, Homo sapiens
ttgctggaacacaggggcc

SEQ ID NO: 6547695 - DNA, 20 bp, Homo sapiens
ttgctggaacacaggggcct

SEQ ID NO: 6547696 - DNA, 11 bp, Homo sapiens
ttgctggaaga

SEQ ID NO: 6547697 - DNA, 21 bp, Homo sapiens
ttgctggaataagttcaaatt

SEQ ID NO: 6547698 - DNA, 15 bp, Homo sapiens
ttgctggacctgaat

SEQ ID NO: 6547699 - DNA, 21 bp, Homo sapiens
ttgctggacggggactgggga

SEQ ID NO: 6547700 - DNA, 12 bp, Homo sapiens
ttgctggagact

SEQ ID NO: 6547701 - DNA, 19 bp, Homo sapiens
ttgctggagtcctgttctc

SEQ ID NO: 6547702 - DNA, 15 bp, Homo sapiens
ttgctggatgctgct

SEQ ID NO: 6547703 - DNA, 16 bp, Homo sapiens
ttgctggcaaagacag

SEQ ID NO: 6547704 - DNA, 15 bp, Homo sapiens
ttgctggcaatgagt

SEQ ID NO: 6547705 - DNA, 16 bp, Homo sapiens
ttgctggcagggcctg

SEQ ID NO: 6547706 - DNA, 15 bp, Homo sapiens
ttgctggcatttgct

SEQ ID NO: 6547707 - DNA, 23 bp, Homo sapiens
ttgctggccccagccctgctggg

SEQ ID NO: 6547708 - DNA, 15 bp, Homo sapiens
ttgctggctctgaga

SEQ ID NO: 6547709 - DNA, 19 bp, Homo sapiens
ttgctggctctgagaatca

SEQ ID NO: 6547710 - DNA, 11 bp, Homo sapiens
ttgctggctgc

SEQ ID NO: 6547711 - DNA, 12 bp, Homo sapiens
ttgctggctgga

SEQ ID NO: 6547712 - DNA, 16 bp, Homo sapiens
ttgctgggaacacagc

SEQ ID NO: 6547713 - DNA, 22 bp, Homo sapiens
ttgctgggagctgaaaaatcac

SEQ ID NO: 6547714 - DNA, 16 bp, Homo sapiens
ttgctgggaggactgg

SEQ ID NO: 6547715 - DNA, 17 bp, Homo sapiens
ttgctgggaggactgga

SEQ ID NO: 6547716 - DNA, 16 bp, Homo sapiens
ttgctgggccagggaa

SEQ ID NO: 6547717 - DNA, 22 bp, Homo sapiens
ttgctgggcctcattctagcac

SEQ ID NO: 6547718 - DNA, 17 bp, Homo sapiens
ttgctgggccttttgtt

SEQ ID NO: 6547719 - DNA, 23 bp, Homo sapiens
ttgctggggacggggggccccag

SEQ ID NO: 6547720 - DNA, 12 bp, Homo sapiens
ttgctggggatt

SEQ ID NO: 6547721 - DNA, 18 bp, Homo sapiens
ttgctggggtccagggct

SEQ ID NO: 6547722 - DNA, 23 bp, Homo sapiens
ttgctggtagagacccccaggcc

SEQ ID NO: 6547723 - DNA, 14 bp, Homo sapiens
ttgctggtcctgca

SEQ ID NO: 6547724 - DNA, 18 bp, Homo sapiens
ttgctggtcttctcagtt

SEQ ID NO: 6547725 - DNA, 19 bp, Homo sapiens
ttgctggtgcctgccacct

SEQ ID NO: 6547726 - DNA, 20 bp, Homo sapiens
ttgctggtgtagtcttttta

SEQ ID NO: 6547727 - DNA, 13 bp, Homo sapiens
ttgctggttggat

SEQ ID NO: 6547728 - DNA, 17 bp, Homo sapiens
ttgctggtttgaaagat

SEQ ID NO: 6547729 - DNA, 18 bp, Homo sapiens
ttgctgtaagatgtctgt

SEQ ID NO: 6547730 - DNA, 19 bp, Homo sapiens
ttgctgtaagatgtctgtt

SEQ ID NO: 6547731 - DNA, 23 bp, Homo sapiens
ttgctgtaagcacctgggctgag

SEQ ID NO: 6547732 - DNA, 16 bp, Homo sapiens
ttgctgtaatgttaat

SEQ ID NO: 6547733 - DNA, 17 bp, Homo sapiens
ttgctgtactcttgctg

SEQ ID NO: 6547734 - DNA, 19 bp, Homo sapiens
ttgctgtactcttgctgat

SEQ ID NO: 6547735 - DNA, 20 bp, Homo sapiens
ttgctgtagaagatggcact

SEQ ID NO: 6547736 - DNA, 15 bp, Homo sapiens
ttgctgtagagactt

SEQ ID NO: 6547737 - DNA, 16 bp, Homo sapiens
ttgctgtataagttat

SEQ ID NO: 6547738 - DNA, 17 bp, Homo sapiens
ttgctgtattgccccca

SEQ ID NO: 6547739 - DNA, 18 bp, Homo sapiens
ttgctgtattgcccccat

SEQ ID NO: 6547740 - DNA, 13 bp, Homo sapiens
ttgctgtcactgt

SEQ ID NO: 6547741 - DNA, 17 bp, Homo sapiens
ttgctgtcatgtgaatc

SEQ ID NO: 6547742 - DNA, 13 bp, Homo sapiens
ttgctgtccaatt

SEQ ID NO: 6547743 - DNA, 22 bp, Homo sapiens
ttgctgtccaatttctattaaa

SEQ ID NO: 6547744 - DNA, 17 bp, Homo sapiens
ttgctgtccaggcagct

SEQ ID NO: 6547745 - DNA, 16 bp, Homo sapiens
ttgctgtcccttttcc

SEQ ID NO: 6547746 - DNA, 18 bp, Homo sapiens
ttgctgtcccttttcctt

SEQ ID NO: 6547747 - DNA, 15 bp, Homo sapiens
ttgctgtcctaggcc

SEQ ID NO: 6547748 - DNA, 17 bp, Homo sapiens
ttgctgtctatgattgt

SEQ ID NO: 6547749 - DNA, 11 bp, Homo sapiens
ttgctgtctct

SEQ ID NO: 6547750 - DNA, 12 bp, Homo sapiens
ttgctgtctctg

SEQ ID NO: 6547751 - DNA, 13 bp, Homo sapiens
ttgctgtctctta

SEQ ID NO: 6547752 - DNA, 15 bp, Homo sapiens
ttgctgtctgaaaaa

SEQ ID NO: 6547753 - DNA, 18 bp, Homo sapiens
ttgctgtctgcagccttg

SEQ ID NO: 6547754 - DNA, 15 bp, Homo sapiens
ttgctgtctttctct

SEQ ID NO: 6547755 - DNA, 20 bp, Homo sapiens
ttgctgtgaattagctcact

SEQ ID NO: 6547756 - DNA, 15 bp, Homo sapiens
ttgctgtgaggctgt

SEQ ID NO: 6547757 - DNA, 17 bp, Homo sapiens
ttgctgtgaggctgtcc

SEQ ID NO: 6547758 - DNA, 15 bp, Homo sapiens
ttgctgtgccaggag

SEQ ID NO: 6547759 - DNA, 14 bp, Homo sapiens
ttgctgtgccgtgt

SEQ ID NO: 6547760 - DNA, 18 bp, Homo sapiens
ttgctgtgctgtacatta

SEQ ID NO: 6547761 - DNA, 12 bp, Homo sapiens
ttgctgtggcct

SEQ ID NO: 6547762 - DNA, 23 bp, Homo sapiens
ttgctgtgggaacgagaggggaa

SEQ ID NO: 6547763 - DNA, 17 bp, Homo sapiens
ttgctgtgtagttccct

SEQ ID NO: 6547764 - DNA, 21 bp, Homo sapiens
ttgctgtgtagttccctctgc

SEQ ID NO: 6547765 - DNA, 20 bp, Homo sapiens
ttgctgtgtcataccaggcc

SEQ ID NO: 6547766 - DNA, 14 bp, Homo sapiens
ttgctgtgtctcac

SEQ ID NO: 6547767 - DNA, 19 bp, Homo sapiens
ttgctgtgtgtcccaggca

SEQ ID NO: 6547768 - DNA, 17 bp, Homo sapiens
ttgctgtgtttaatttg

SEQ ID NO: 6547769 - DNA, 13 bp, Homo sapiens
ttgctgttaactg

SEQ ID NO: 6547770 - DNA, 14 bp, Homo sapiens
ttgctgttactgct

SEQ ID NO: 6547771 - DNA, 21 bp, Homo sapiens
ttgctgttattatatttgaca

SEQ ID NO: 6547772 - DNA, 23 bp, Homo sapiens
ttgctgttattatatttgacatg

SEQ ID NO: 6547773 - DNA, 14 bp, Homo sapiens
ttgctgttcagtgc

SEQ ID NO: 6547774 - DNA, 15 bp, Homo sapiens
ttgctgttgaaagca

SEQ ID NO: 6547775 - DNA, 21 bp, Homo sapiens
ttgctgttgatgaggcctctt

SEQ ID NO: 6547776 - DNA, 15 bp, Homo sapiens
ttgctgttgctgttg

SEQ ID NO: 6547777 - DNA, 19 bp, Homo sapiens
ttgctgttgtccaactatt

SEQ ID NO: 6547778 - DNA, 19 bp, Homo sapiens
ttgctgttgtccctctgct

SEQ ID NO: 6547779 - DNA, 19 bp, Homo sapiens
ttgctgttgttccttcaca

SEQ ID NO: 6547780 - DNA, 19 bp, Homo sapiens
ttgctgttgtttctaaaca

SEQ ID NO: 6547781 - DNA, 17 bp, Homo sapiens
ttgctgtttaccgccca

SEQ ID NO: 6547782 - DNA, 14 bp, Homo sapiens
ttgctgtttactcc

SEQ ID NO: 6547783 - DNA, 17 bp, Homo sapiens
ttgctgtttatatatat

SEQ ID NO: 6547784 - DNA, 20 bp, Homo sapiens
ttgctgtttattttttttgg

SEQ ID NO: 6547785 - DNA, 13 bp, Homo sapiens
ttgctgtttcctt

SEQ ID NO: 6547786 - DNA, 14 bp, Homo sapiens
ttgctgttttcctc

SEQ ID NO: 6547787 - DNA, 19 bp, Homo sapiens
ttgctgttttcctcccttc

SEQ ID NO: 6547788 - DNA, 20 bp, Homo sapiens
ttgctgttttcctcccttct

SEQ ID NO: 6547789 - DNA, 16 bp, Homo sapiens
ttgcttaaaagaaagt

SEQ ID NO: 6547790 - DNA, 14 bp, Homo sapiens
ttgcttaaaagaca

SEQ ID NO: 6547791 - DNA, 14 bp, Homo sapiens
ttgcttaaaatttt

SEQ ID NO: 6547792 - DNA, 22 bp, Homo sapiens
ttgcttaaaattttacttttgt

SEQ ID NO: 6547793 - DNA, 14 bp, Homo sapiens
ttgcttaaacaaaa

SEQ ID NO: 6547794 - DNA, 18 bp, Homo sapiens
ttgcttaaaccacttaaa

SEQ ID NO: 6547795 - DNA, 21 bp, Homo sapiens
ttgcttaaactaatgaacaaa

SEQ ID NO: 6547796 - DNA, 14 bp, Homo sapiens
ttgcttaaatgtga

SEQ ID NO: 6547797 - DNA, 20 bp, Homo sapiens
ttgcttaaatgtgaattact

SEQ ID NO: 6547798 - DNA, 24 bp, Homo sapiens
ttgcttaaatgtgaattactaact

SEQ ID NO: 6547799 - DNA, 20 bp, Homo sapiens
ttgcttaaattgtgggcaaa

SEQ ID NO: 6547800 - DNA, 17 bp, Homo sapiens
ttgcttaatctagagct

SEQ ID NO: 6547801 - DNA, 17 bp, Homo sapiens
ttgcttaattgtgaaca

SEQ ID NO: 6547802 - DNA, 18 bp, Homo sapiens
ttgcttaatttctgcctt

SEQ ID NO: 6547803 - DNA, 13 bp, Homo sapiens
ttgcttacaattt

SEQ ID NO: 6547804 - DNA, 22 bp, Homo sapiens
ttgcttacaatttttttaattt

SEQ ID NO: 6547805 - DNA, 13 bp, Homo sapiens
ttgcttacatcct

SEQ ID NO: 6547806 - DNA, 13 bp, Homo sapiens
ttgcttacatttt

SEQ ID NO: 6547807 - DNA, 18 bp, Homo sapiens
ttgcttacatttttacaa

SEQ ID NO: 6547808 - DNA, 19 bp, Homo sapiens
ttgcttaccaaaagctcag

SEQ ID NO: 6547809 - DNA, 18 bp, Homo sapiens
ttgcttactgatattatc

SEQ ID NO: 6547810 - DNA, 13 bp, Homo sapiens
ttgcttactggtg

SEQ ID NO: 6547811 - DNA, 17 bp, Homo sapiens
ttgcttacttttactgt

SEQ ID NO: 6547812 - DNA, 21 bp, Homo sapiens
ttgcttagagtgcccagcaga

SEQ ID NO: 6547813 - DNA, 16 bp, Homo sapiens
tgtgtgcctgtggcag

SEQ ID NO: 6547814 - DNA, 13 bp, Homo sapiens
tgtgtgccttctg

SEQ ID NO: 6547815 - DNA, 14 bp, Homo sapiens
tgtgtgccttgttc

SEQ ID NO: 6547816 - DNA, 15 bp, Homo sapiens
tgtgtgcgtgtatat

SEQ ID NO: 6547817 - DNA, 17 bp, Homo sapiens
tgtgtgcgtgtatatgt

SEQ ID NO: 6547818 - DNA, 15 bp, Homo sapiens
tgtgtgcgtgtcagt

SEQ ID NO: 6547819 - DNA, 21 bp, Homo sapiens
tgtgtgcgtgtttgggttttt

SEQ ID NO: 6547820 - DNA, 18 bp, Homo sapiens
tgtgtgctactaacagat

SEQ ID NO: 6547821 - DNA, 12 bp, Homo sapiens
tgtgtgctcagc

SEQ ID NO: 6547822 - DNA, 19 bp, Homo sapiens
tgtgtgctcagcagcccca

SEQ ID NO: 6547823 - DNA, 18 bp, Homo sapiens
tgtgtgctgactgaacat

SEQ ID NO: 6547824 - DNA, 20 bp, Homo sapiens
tgtgtgcttcacacaaagtg

SEQ ID NO: 6547825 - DNA, 19 bp, Homo sapiens
tgtgtgcttgaatgtgagt

SEQ ID NO: 6547826 - DNA, 20 bp, Homo sapiens
tgtgtgctttttttgtgtgt

SEQ ID NO: 6547827 - DNA, 17 bp, Homo sapiens
tgtgtggaagaaggaaa

SEQ ID NO: 6547828 - DNA, 20 bp, Homo sapiens
tgtgtggacccccaccctgc

SEQ ID NO: 6547829 - DNA, 21 bp, Homo sapiens
tgtgtggacggcgctgcctca

SEQ ID NO: 6547830 - DNA, 19 bp, Homo sapiens
tgtgtggagaactcagtgc

SEQ ID NO: 6547831 - DNA, 20 bp, Homo sapiens
tgtgtggagaactcagtgcc

SEQ ID NO: 6547832 - DNA, 22 bp, Homo sapiens
tgtgtggagctcgctaaagtca

SEQ ID NO: 6547833 - DNA, 14 bp, Homo sapiens
tgtgtggattcttt

SEQ ID NO: 6547834 - DNA, 16 bp, Homo sapiens
tgtgtggcaaacattt

SEQ ID NO: 6547835 - DNA, 19 bp, Homo sapiens
tgtgtggcagggggccccg

SEQ ID NO: 6547836 - DNA, 17 bp, Homo sapiens
tgtgtggccaaccagga

SEQ ID NO: 6547837 - DNA, 23 bp, Homo sapiens
tgtgtggccaaccaggacccagg

SEQ ID NO: 6547838 - DNA, 14 bp, Homo sapiens
tgtgtggccctgga

SEQ ID NO: 6547839 - DNA, 20 bp, Homo sapiens
tgtgtggccgcctggcaggt

SEQ ID NO: 6547840 - DNA, 15 bp, Homo sapiens
tgtgtggccggcctc

SEQ ID NO: 6547841 - DNA, 16 bp, Homo sapiens
tgtgtggccggcctcc

SEQ ID NO: 6547842 - DNA, 19 bp, Homo sapiens
tgtgtggccggcctcctcc

SEQ ID NO: 6547843 - DNA, 20 bp, Homo sapiens
tgtgtggccggcctcctcct

SEQ ID NO: 6547844 - DNA, 11 bp, Homo sapiens
tgtgtggcctg

SEQ ID NO: 6547845 - DNA, 11 bp, Homo sapiens
tgtgtggctgt

SEQ ID NO: 6547846 - DNA, 14 bp, Homo sapiens
tgtgtgggactgta

SEQ ID NO: 6547847 - DNA, 17 bp, Homo sapiens
tgtgtgggactgtacac

SEQ ID NO: 6547848 - DNA, 14 bp, Homo sapiens
tgtgtgggagtgtg

SEQ ID NO: 6547849 - DNA, 15 bp, Homo sapiens
tgtgtgggagtgtgt

SEQ ID NO: 6547850 - DNA, 14 bp, Homo sapiens
tgtgtgggcagggt

SEQ ID NO: 6547851 - DNA, 19 bp, Homo sapiens
tgtgtgggccaccgtgcct

SEQ ID NO: 6547852 - DNA, 15 bp, Homo sapiens
tgtgtgggcccaagg

SEQ ID NO: 6547853 - DNA, 17 bp, Homo sapiens
tgtgtgggcccaaggcc

SEQ ID NO: 6547854 - DNA, 20 bp, Homo sapiens
tgtgtgggggtactagaagc

SEQ ID NO: 6547855 - DNA, 21 bp, Homo sapiens
tgtgtgggtaaatgcttttaa

SEQ ID NO: 6547856 - DNA, 22 bp, Homo sapiens
tgtgtgggtggatataaatata

SEQ ID NO: 6547857 - DNA, 23 bp, Homo sapiens
tgtgtgggtggatataaatatat

SEQ ID NO: 6547858 - DNA, 19 bp, Homo sapiens
tgtgtgggtgtatgtatgt

SEQ ID NO: 6547859 - DNA, 16 bp, Homo sapiens
tgtgtgggtgtgtgcg

SEQ ID NO: 6547860 - DNA, 18 bp, Homo sapiens
tgtgtgggtttactctgt

SEQ ID NO: 6547861 - DNA, 21 bp, Homo sapiens
tgtgtgggtttactctgtgct

SEQ ID NO: 6547862 - DNA, 14 bp, Homo sapiens
tgtgtggtagaaac

SEQ ID NO: 6547863 - DNA, 15 bp, Homo sapiens
tgtgtggtagaaaca

SEQ ID NO: 6547864 - DNA, 16 bp, Homo sapiens
tgtgtggtagaaacaa

SEQ ID NO: 6547865 - DNA, 23 bp, Homo sapiens
tgtgtggtcaacatttctcatgt

SEQ ID NO: 6547866 - DNA, 14 bp, Homo sapiens
tgtgtggtcagtgg

SEQ ID NO: 6547867 - DNA, 19 bp, Homo sapiens
tgtgtggtctctgccccag

SEQ ID NO: 6547868 - DNA, 14 bp, Homo sapiens
tgtgtggtggcctc

SEQ ID NO: 6547869 - DNA, 22 bp, Homo sapiens
tgtgtggtgtcgtctgtgaatg

SEQ ID NO: 6547870 - DNA, 16 bp, Homo sapiens
tgtgtggtgtgtgtgc

SEQ ID NO: 6547871 - DNA, 16 bp, Homo sapiens
tgtgtggttggaaaac

SEQ ID NO: 6547872 - DNA, 22 bp, Homo sapiens
tgtgtggtttagtgtaaaaatg

SEQ ID NO: 6547873 - DNA, 17 bp, Homo sapiens
tgtgtgtaagattttta

SEQ ID NO: 6547874 - DNA, 10 bp, Homo sapiens
tgtgtgtact

SEQ ID NO: 6547875 - DNA, 17 bp, Homo sapiens
tgtgtgtatactgtaat

SEQ ID NO: 6547876 - DNA, 22 bp, Homo sapiens
tgtgtgtatatatgtgtatata

SEQ ID NO: 6547877 - DNA, 22 bp, Homo sapiens
tgtgtgtatgatacgtgtataa

SEQ ID NO: 6547878 - DNA, 13 bp, Homo sapiens
tgtgtgtatgcta

SEQ ID NO: 6547879 - DNA, 11 bp, Homo sapiens
tgtgtgtatgt

SEQ ID NO: 6547880 - DNA, 18 bp, Homo sapiens
tgtgtgtatgtatacaca

SEQ ID NO: 6547881 - DNA, 12 bp, Homo sapiens
tgtgtgtatgtg

SEQ ID NO: 6547882 - DNA, 13 bp, Homo sapiens
tgtgtgtatttgc

SEQ ID NO: 6547883 - DNA, 16 bp, Homo sapiens
tgtgtgtatttgtatt

SEQ ID NO: 6547884 - DNA, 20 bp, Homo sapiens
tgtgtgtatttgtattaata

SEQ ID NO: 6547885 - DNA, 17 bp, Homo sapiens
tgtgtgtcagttttcat

SEQ ID NO: 6547886 - DNA, 22 bp, Homo sapiens
tgtgtgtccacgactgtctcca

SEQ ID NO: 6547887 - DNA, 22 bp, Homo sapiens
tgtgtgtccagcacctttgtaa

SEQ ID NO: 6547888 - DNA, 12 bp, Homo sapiens
tgtgtgtctcac

SEQ ID NO: 6547889 - DNA, 16 bp, Homo sapiens
tgtgtgtctcacccct

SEQ ID NO: 6547890 - DNA, 13 bp, Homo sapiens
tgtgtgtctgtct

SEQ ID NO: 6547891 - DNA, 21 bp, Homo sapiens
tgtgtgtctgtctttgtggga

SEQ ID NO: 6547892 - DNA, 20 bp, Homo sapiens
tgtgtgtgaatgaacactct

SEQ ID NO: 6547893 - DNA, 15 bp, Homo sapiens
tgtgtgtgaattcct

SEQ ID NO: 6547894 - DNA, 23 bp, Homo sapiens
tgtgtgtgacccctcctggggcc

SEQ ID NO: 6547895 - DNA, 13 bp, Homo sapiens
tgtgtgtgatgtg

SEQ ID NO: 6547896 - DNA, 12 bp, Homo sapiens
tgtgtgtgcaag

SEQ ID NO: 6547897 - DNA, 13 bp, Homo sapiens
tgtgtgtgcatgt

SEQ ID NO: 6547898 - DNA, 14 bp, Homo sapiens
tgtgtgtgccctgg

SEQ ID NO: 6547899 - DNA, 18 bp, Homo sapiens
tgtgtgtgcgtgtatatg

SEQ ID NO: 6547900 - DNA, 21 bp, Homo sapiens
tgtgtgtggaaggcacccgcc

SEQ ID NO: 6547901 - DNA, 14 bp, Homo sapiens
tgtgtgtggacagc

SEQ ID NO: 6547902 - DNA, 17 bp, Homo sapiens
tgtgtgtgggtgtgtgc

SEQ ID NO: 6547903 - DNA, 9 bp, Homo sapiens
tgtgtgtgt

SEQ ID NO: 6547904 - DNA, 13 bp, Homo sapiens
tgtgtgtgtatgt

SEQ ID NO: 6547905 - DNA, 14 bp, Homo sapiens
tgtgtgtgtcagct

SEQ ID NO: 6547906 - DNA, 13 bp, Homo sapiens
tgtgtgtgtctct

SEQ ID NO: 6547907 - DNA, 13 bp, Homo sapiens
tgtgtgtgtgaat

SEQ ID NO: 6547908 - DNA, 14 bp, Homo sapiens
tgtgtgtgtgggtg

SEQ ID NO: 6547909 - DNA, 16 bp, Homo sapiens
tgtgtgtgtgtatgtg

SEQ ID NO: 6547910 - DNA, 12 bp, Homo sapiens
tgtgtgtgtgtg

SEQ ID NO: 6547911 - DNA, 16 bp, Homo sapiens
tgtgtgtgtgtgtgcg

SEQ ID NO: 6547912 - DNA, 15 bp, Homo sapiens
tgtgtgtgtgtttta

SEQ ID NO: 6547913 - DNA, 13 bp, Homo sapiens
tgtgtgtgttctt

SEQ ID NO: 6547914 - DNA, 12 bp, Homo sapiens
tgtgtgtgtttt

SEQ ID NO: 6547915 - DNA, 14 bp, Homo sapiens
tgtgtgttcacctt

SEQ ID NO: 6547916 - DNA, 12 bp, Homo sapiens
tgtgtgttcctg

SEQ ID NO: 6547917 - DNA, 14 bp, Homo sapiens
tgtgtgttcctgct

SEQ ID NO: 6547918 - DNA, 13 bp, Homo sapiens
tgtgtgttctgta

SEQ ID NO: 6547919 - DNA, 19 bp, Homo sapiens
tgtgtgttcttcaagccag

SEQ ID NO: 6547920 - DNA, 19 bp, Homo sapiens
tgtgtgttcttttgataca

SEQ ID NO: 6547921 - DNA, 16 bp, Homo sapiens
tgtgtgttgatactgt

SEQ ID NO: 6547922 - DNA, 19 bp, Homo sapiens
tgtgtgttgatactgttgc

SEQ ID NO: 6547923 - DNA, 20 bp, Homo sapiens
tgtgtgttgatactgttgca

SEQ ID NO: 6547924 - DNA, 19 bp, Homo sapiens
tgtgtgttgccacaggaca

SEQ ID NO: 6547925 - DNA, 16 bp, Homo sapiens
tgtgtgttgtcagcct

SEQ ID NO: 6547926 - DNA, 21 bp, Homo sapiens
tgtgtgttgtcagcctgtgct

SEQ ID NO: 6547927 - DNA, 15 bp, Homo sapiens
tgtgtgtttaaataa

SEQ ID NO: 6547928 - DNA, 12 bp, Homo sapiens
tgtgtgtttagg

SEQ ID NO: 6547929 - DNA, 12 bp, Homo sapiens
tgtgtgtttcaa

SEQ ID NO: 6547930 - DNA, 10 bp, Homo sapiens
tgtgtgtttg

SEQ ID NO: 6547931 - DNA, 16 bp, Homo sapiens
tgtgtgtttgtgctga

SEQ ID NO: 6547932 - DNA, 18 bp, Homo sapiens
tgtgtgtttgtgtgtttc

SEQ ID NO: 6547933 - DNA, 19 bp, Homo sapiens
tgtgtgttttcccaaagca

SEQ ID NO: 6547934 - DNA, 18 bp, Homo sapiens
tgtgtgttttctcctaga

SEQ ID NO: 6547935 - DNA, 14 bp, Homo sapiens
tgtgttaaaaggaa

SEQ ID NO: 6547936 - DNA, 14 bp, Homo sapiens
tgtgttaaagtact

SEQ ID NO: 6547937 - DNA, 23 bp, Homo sapiens
tgtgttaaagtacttgaaatgta

SEQ ID NO: 6547938 - DNA, 19 bp, Homo sapiens
tgtgttaagtatgtgtaaa

SEQ ID NO: 6547939 - DNA, 17 bp, Homo sapiens
tgtgttaattctttctc

SEQ ID NO: 6547940 - DNA, 13 bp, Homo sapiens
tgtgttaatttaa

SEQ ID NO: 6547941 - DNA, 17 bp, Homo sapiens
tgtgttacaataagtgt

SEQ ID NO: 6547942 - DNA, 23 bp, Homo sapiens
tgtgttactaaaaaaaagatgaa

SEQ ID NO: 6547943 - DNA, 14 bp, Homo sapiens
tgtgttactgcttt

SEQ ID NO: 6547944 - DNA, 20 bp, Homo sapiens
tgtgttactgctttgcaaag

SEQ ID NO: 6547945 - DNA, 15 bp, Homo sapiens
tgtgttacttgaagt

SEQ ID NO: 6547946 - DNA, 19 bp, Homo sapiens
tgtgttacttgaagtaact

SEQ ID NO: 6547947 - DNA, 20 bp, Homo sapiens
tgtgttacttgaagtaacta

SEQ ID NO: 6547948 - DNA, 14 bp, Homo sapiens
tgtgttagaaaagt

SEQ ID NO: 6547949 - DNA, 16 bp, Homo sapiens
tgtgttagcctcttgc

SEQ ID NO: 6547950 - DNA, 17 bp, Homo sapiens
tgtgttagttcccaaca

SEQ ID NO: 6547951 - DNA, 22 bp, Homo sapiens
tgtgttatagacggtgctcact

SEQ ID NO: 6547952 - DNA, 23 bp, Homo sapiens
tgtgttatcggacattctaatgc

SEQ ID NO: 6547953 - DNA, 17 bp, Homo sapiens
tgtgttatctacctcaa

SEQ ID NO: 6547954 - DNA, 14 bp, Homo sapiens
tgtgttatgaagca

SEQ ID NO: 6547955 - DNA, 13 bp, Homo sapiens
tgtgttcaatatc

SEQ ID NO: 6547956 - DNA, 20 bp, Homo sapiens
tgtgttcaatatttagaaaa

SEQ ID NO: 6547957 - DNA, 13 bp, Homo sapiens
tgtgttcaatctg

SEQ ID NO: 6547958 - DNA, 13 bp, Homo sapiens
tgtgttcagaaga

SEQ ID NO: 6547959 - DNA, 23 bp, Homo sapiens
tgtgttcagaagaatcttcctgg

SEQ ID NO: 6547960 - DNA, 19 bp, Homo sapiens
tgtgttcagctctttccaa

SEQ ID NO: 6547961 - DNA, 14 bp, Homo sapiens
tgtgttcatgctga

SEQ ID NO: 6547962 - DNA, 23 bp, Homo sapiens
tgtgttcatgctgaatccacctc

SEQ ID NO: 6547963 - DNA, 18 bp, Homo sapiens
tgtgttcattaatgttta

SEQ ID NO: 6547964 - DNA, 22 bp, Homo sapiens
tgtgttcattctgcattgagaa

SEQ ID NO: 6547965 - DNA, 16 bp, Homo sapiens
tgtgttccaagtttcc

SEQ ID NO: 6547966 - DNA, 19 bp, Homo sapiens
tgtgttcccatttcagctg

SEQ ID NO: 6547967 - DNA, 13 bp, Homo sapiens
tgtgttccctcat

SEQ ID NO: 6547968 - DNA, 21 bp, Homo sapiens
tgtgttccctttgtctttcaa

SEQ ID NO: 6547969 - DNA, 16 bp, Homo sapiens
tgtgttcctccatttt

SEQ ID NO: 6547970 - DNA, 18 bp, Homo sapiens
tgtgttcctccattttct

SEQ ID NO: 6547971 - DNA, 13 bp, Homo sapiens
tgtgttcctcctg

SEQ ID NO: 6547972 - DNA, 15 bp, Homo sapiens
tgtgttcctggcaat

SEQ ID NO: 6547973 - DNA, 24 bp, Homo sapiens
tgtgttcctggcaatagtgtgttc

SEQ ID NO: 6547974 - DNA, 15 bp, Homo sapiens
tgtgttcctggctga

SEQ ID NO: 6547975 - DNA, 16 bp, Homo sapiens
tgtgttccttctgtga

SEQ ID NO: 6547976 - DNA, 21 bp, Homo sapiens
tgtgttcgtggagccacaggc

SEQ ID NO: 6547977 - DNA, 23 bp, Homo sapiens
tgtgttctaatccaagggccagt

SEQ ID NO: 6547978 - DNA, 16 bp, Homo sapiens
tgtgttctagtcattg

SEQ ID NO: 6547979 - DNA, 17 bp, Homo sapiens
tgtgttctcaacacaca

SEQ ID NO: 6547980 - DNA, 15 bp, Homo sapiens
tgtgttctgatgagg

SEQ ID NO: 6547981 - DNA, 20 bp, Homo sapiens
tgtgttctgatgaggcattt

SEQ ID NO: 6547982 - DNA, 13 bp, Homo sapiens
tgtgttctgggct

SEQ ID NO: 6547983 - DNA, 23 bp, Homo sapiens
tgtgttctgggctggggccacct

SEQ ID NO: 6547984 - DNA, 19 bp, Homo sapiens
tgtgttctgtttgttaaaa

SEQ ID NO: 6547985 - DNA, 18 bp, Homo sapiens
tgtgttcttaaaatattg

SEQ ID NO: 6547986 - DNA, 19 bp, Homo sapiens
tgtgttcttaaaatattgt

SEQ ID NO: 6547987 - DNA, 18 bp, Homo sapiens
tgtgttcttcaagccagc

SEQ ID NO: 6547988 - DNA, 15 bp, Homo sapiens
tgtgttcttctaggc

SEQ ID NO: 6547989 - DNA, 12 bp, Homo sapiens
tgtgttctttat

SEQ ID NO: 6547990 - DNA, 13 bp, Homo sapiens
tgtgttctttccc

SEQ ID NO: 6547991 - DNA, 21 bp, Homo sapiens
tgtgttctttgttccactgga

SEQ ID NO: 6547992 - DNA, 22 bp, Homo sapiens
tgtgttcttttctcctttacca

SEQ ID NO: 6547993 - DNA, 13 bp, Homo sapiens
tgtgttgaaaacc

SEQ ID NO: 6547994 - DNA, 14 bp, Homo sapiens
ttgcttagtaaaat

SEQ ID NO: 6547995 - DNA, 15 bp, Homo sapiens
ttgcttagtaaaatt

SEQ ID NO: 6547996 - DNA, 20 bp, Homo sapiens
ttgcttagtatctaataatg

SEQ ID NO: 6547997 - DNA, 22 bp, Homo sapiens
ttgcttagtcacttatttcata

SEQ ID NO: 6547998 - DNA, 19 bp, Homo sapiens
ttgcttataaactgggaag

SEQ ID NO: 6547999 - DNA, 13 bp, Homo sapiens
ttgcttatgacat

SEQ ID NO: 6548000 - DNA, 15 bp, Homo sapiens
ttgcttattcttgag

SEQ ID NO: 6548001 - DNA, 15 bp, Homo sapiens
ttgcttattgttcca

SEQ ID NO: 6548002 - DNA, 20 bp, Homo sapiens
ttgcttattgttccaagaca

SEQ ID NO: 6548003 - DNA, 23 bp, Homo sapiens
ttgcttattgttccaagacattg

SEQ ID NO: 6548004 - DNA, 13 bp, Homo sapiens
ttgcttatttaat

SEQ ID NO: 6548005 - DNA, 13 bp, Homo sapiens
ttgcttattttat

SEQ ID NO: 6548006 - DNA, 18 bp, Homo sapiens
ttgcttcaaactgagaca

SEQ ID NO: 6548007 - DNA, 15 bp, Homo sapiens
ttgcttcaagtgttt

SEQ ID NO: 6548008 - DNA, 14 bp, Homo sapiens
ttgcttcaattaaa

SEQ ID NO: 6548009 - DNA, 13 bp, Homo sapiens
ttgcttcagtgga

SEQ ID NO: 6548010 - DNA, 14 bp, Homo sapiens
ttgcttcataaatg

SEQ ID NO: 6548011 - DNA, 15 bp, Homo sapiens
ttgcttcatctggag

SEQ ID NO: 6548012 - DNA, 19 bp, Homo sapiens
ttgcttcatgtgtcccaga

SEQ ID NO: 6548013 - DNA, 20 bp, Homo sapiens
ttgcttcatgtgtcccagaa

SEQ ID NO: 6548014 - DNA, 22 bp, Homo sapiens
ttgcttccaagcccttccctct

SEQ ID NO: 6548015 - DNA, 16 bp, Homo sapiens
ttgcttccaggtggca

SEQ ID NO: 6548016 - DNA, 14 bp, Homo sapiens
ttgcttcccatctg

SEQ ID NO: 6548017 - DNA, 21 bp, Homo sapiens
ttgcttcctcttcttcttttc

SEQ ID NO: 6548018 - DNA, 18 bp, Homo sapiens
ttgcttcctgtgtaacat

SEQ ID NO: 6548019 - DNA, 20 bp, Homo sapiens
ttgcttcctgtgtaacatct

SEQ ID NO: 6548020 - DNA, 21 bp, Homo sapiens
ttgcttcctgtgtaacatctg

SEQ ID NO: 6548021 - DNA, 16 bp, Homo sapiens
ttgcttctaaatgccc

SEQ ID NO: 6548022 - DNA, 16 bp, Homo sapiens
ttgcttctactttcat

SEQ ID NO: 6548023 - DNA, 19 bp, Homo sapiens
ttgcttctcccatttcctg

SEQ ID NO: 6548024 - DNA, 11 bp, Homo sapiens
ttgcttctctc

SEQ ID NO: 6548025 - DNA, 13 bp, Homo sapiens
ttgcttctctgcc

SEQ ID NO: 6548026 - DNA, 12 bp, Homo sapiens
ttgcttctgaat

SEQ ID NO: 6548027 - DNA, 13 bp, Homo sapiens
ttgcttctgcagc

SEQ ID NO: 6548028 - DNA, 14 bp, Homo sapiens
ttgcttctgtagta

SEQ ID NO: 6548029 - DNA, 13 bp, Homo sapiens
ttgcttctgtgta

SEQ ID NO: 6548030 - DNA, 22 bp, Homo sapiens
ttgcttgaaagaaaatatgcat

SEQ ID NO: 6548031 - DNA, 20 bp, Homo sapiens
ttgcttgaaattactgtgta

SEQ ID NO: 6548032 - DNA, 13 bp, Homo sapiens
ttgcttgaacaca

SEQ ID NO: 6548033 - DNA, 15 bp, Homo sapiens
ttgcttgaacacagt

SEQ ID NO: 6548034 - DNA, 13 bp, Homo sapiens
ttgcttgaatgct

SEQ ID NO: 6548035 - DNA, 13 bp, Homo sapiens
ttgcttgagccca

SEQ ID NO: 6548036 - DNA, 17 bp, Homo sapiens
ttgcttgagcccaggag

SEQ ID NO: 6548037 - DNA, 16 bp, Homo sapiens
ttgcttgccaaagtac

SEQ ID NO: 6548038 - DNA, 16 bp, Homo sapiens
ttgcttgcctgcaggg

SEQ ID NO: 6548039 - DNA, 19 bp, Homo sapiens
ttgcttgcctgcagggcca

SEQ ID NO: 6548040 - DNA, 17 bp, Homo sapiens
ttgcttgcgtgctggga

SEQ ID NO: 6548041 - DNA, 19 bp, Homo sapiens
ttgcttggaaattccttgc

SEQ ID NO: 6548042 - DNA, 17 bp, Homo sapiens
ttgcttggactacctat

SEQ ID NO: 6548043 - DNA, 16 bp, Homo sapiens
ttgcttggcagagagg

SEQ ID NO: 6548044 - DNA, 16 bp, Homo sapiens
ttgcttgtcctgctca

SEQ ID NO: 6548045 - DNA, 14 bp, Homo sapiens
ttgcttgtcttctg

SEQ ID NO: 6548046 - DNA, 23 bp, Homo sapiens
ttgcttgtgaatcttaacatttt

SEQ ID NO: 6548047 - DNA, 19 bp, Homo sapiens
ttgcttgttatattaagca

SEQ ID NO: 6548048 - DNA, 13 bp, Homo sapiens
ttgcttgttctct

SEQ ID NO: 6548049 - DNA, 19 bp, Homo sapiens
ttgctttaacctgaacctt

SEQ ID NO: 6548050 - DNA, 17 bp, Homo sapiens
ttgctttaatataaatg

SEQ ID NO: 6548051 - DNA, 13 bp, Homo sapiens
ttgctttaatgag

SEQ ID NO: 6548052 - DNA, 23 bp, Homo sapiens
ttgctttaatgtgtattgaagaa

SEQ ID NO: 6548053 - DNA, 21 bp, Homo sapiens
ttgctttaattccatgaatgt

SEQ ID NO: 6548054 - DNA, 16 bp, Homo sapiens
ttgctttaattgttaa

SEQ ID NO: 6548055 - DNA, 12 bp, Homo sapiens
ttgctttaattt

SEQ ID NO: 6548056 - DNA, 16 bp, Homo sapiens
ttgctttaccttttca

SEQ ID NO: 6548057 - DNA, 22 bp, Homo sapiens
ttgctttactgtcaaaataatt

SEQ ID NO: 6548058 - DNA, 16 bp, Homo sapiens
ttgctttagaaaacat

SEQ ID NO: 6548059 - DNA, 21 bp, Homo sapiens
ttgctttatactgagcttttg

SEQ ID NO: 6548060 - DNA, 18 bp, Homo sapiens
ttgctttatccagcagtc

SEQ ID NO: 6548061 - DNA, 21 bp, Homo sapiens
ttgctttatccagcagtcaat

SEQ ID NO: 6548062 - DNA, 16 bp, Homo sapiens
ttgctttatttttcat

SEQ ID NO: 6548063 - DNA, 20 bp, Homo sapiens
ttgctttatttttcattacc

SEQ ID NO: 6548064 - DNA, 23 bp, Homo sapiens
ttgctttcaattgacaaatgatg

SEQ ID NO: 6548065 - DNA, 11 bp, Homo sapiens
ttgctttcctt

SEQ ID NO: 6548066 - DNA, 13 bp, Homo sapiens
ttgctttcctttc

SEQ ID NO: 6548067 - DNA, 13 bp, Homo sapiens
ttgctttctatat

SEQ ID NO: 6548068 - DNA, 14 bp, Homo sapiens
ttgctttctgaaat

SEQ ID NO: 6548069 - DNA, 16 bp, Homo sapiens
ttgctttctgaaattc

SEQ ID NO: 6548070 - DNA, 12 bp, Homo sapiens
ttgctttctggt

SEQ ID NO: 6548071 - DNA, 14 bp, Homo sapiens
ttgctttgaaaaag

SEQ ID NO: 6548072 - DNA, 15 bp, Homo sapiens
ttgctttgaaaatat

SEQ ID NO: 6548073 - DNA, 16 bp, Homo sapiens
ttgctttgaagcagtt

SEQ ID NO: 6548074 - DNA, 22 bp, Homo sapiens
ttgctttgaagcagttgtgtca

SEQ ID NO: 6548075 - DNA, 23 bp, Homo sapiens
ttgctttgacttaggtgtgaaga

SEQ ID NO: 6548076 - DNA, 19 bp, Homo sapiens
ttgctttgagactcctcag

SEQ ID NO: 6548077 - DNA, 21 bp, Homo sapiens
ttgctttgagactcctcagca

SEQ ID NO: 6548078 - DNA, 17 bp, Homo sapiens
ttgctttgagcccacag

SEQ ID NO: 6548079 - DNA, 15 bp, Homo sapiens
ttgctttgctgtctg

SEQ ID NO: 6548080 - DNA, 13 bp, Homo sapiens
ttgctttgctgtt

SEQ ID NO: 6548081 - DNA, 17 bp, Homo sapiens
ttgctttggaagtttta

SEQ ID NO: 6548082 - DNA, 20 bp, Homo sapiens
ttgctttgggctttgcaggc

SEQ ID NO: 6548083 - DNA, 21 bp, Homo sapiens
ttgctttggggggtgtgctga

SEQ ID NO: 6548084 - DNA, 18 bp, Homo sapiens
ttgctttgtagtttgctt

SEQ ID NO: 6548085 - DNA, 20 bp, Homo sapiens
ttgctttgtattgtatatta

SEQ ID NO: 6548086 - DNA, 15 bp, Homo sapiens
ttgctttgtgatttt

SEQ ID NO: 6548087 - DNA, 20 bp, Homo sapiens
ttgctttgtgatttttgtaa

SEQ ID NO: 6548088 - DNA, 12 bp, Homo sapiens
ttgctttgttac

SEQ ID NO: 6548089 - DNA, 17 bp, Homo sapiens
ttgcttttaaaactact

SEQ ID NO: 6548090 - DNA, 13 bp, Homo sapiens
ttgcttttaaaat

SEQ ID NO: 6548091 - DNA, 22 bp, Homo sapiens
ttgcttttacggtgatattgtg

SEQ ID NO: 6548092 - DNA, 13 bp, Homo sapiens
ttgcttttagaaa

SEQ ID NO: 6548093 - DNA, 13 bp, Homo sapiens
ttgcttttatcca

SEQ ID NO: 6548094 - DNA, 13 bp, Homo sapiens
ttgcttttatgac

SEQ ID NO: 6548095 - DNA, 15 bp, Homo sapiens
ttgcttttattttga

SEQ ID NO: 6548096 - DNA, 12 bp, Homo sapiens
ttgcttttcatg

SEQ ID NO: 6548097 - DNA, 18 bp, Homo sapiens
ttgcttttcatgcaaact

SEQ ID NO: 6548098 - DNA, 22 bp, Homo sapiens
ttgcttttcatgcaaactcttt

SEQ ID NO: 6548099 - DNA, 15 bp, Homo sapiens
ttgcttttccctctt

SEQ ID NO: 6548100 - DNA, 21 bp, Homo sapiens
ttgcttttgaaggaatacaat

SEQ ID NO: 6548101 - DNA, 19 bp, Homo sapiens
ttgcttttgcctctgccca

SEQ ID NO: 6548102 - DNA, 19 bp, Homo sapiens
ttgcttttgtttttttcct

SEQ ID NO: 6548103 - DNA, 13 bp, Homo sapiens
ttgctttttgccc

SEQ ID NO: 6548104 - DNA, 17 bp, Homo sapiens
ttgctttttgctgtgta

SEQ ID NO: 6548105 - DNA, 14 bp, Homo sapiens
ttgcttttttatgg

SEQ ID NO: 6548106 - DNA, 19 bp, Homo sapiens
ttgcttttttgtattggtt

SEQ ID NO: 6548107 - DNA, 15 bp, Homo sapiens
ttggaaaaaatttgt

SEQ ID NO: 6548108 - DNA, 14 bp, Homo sapiens
ttggaaaaagaaaa

SEQ ID NO: 6548109 - DNA, 13 bp, Homo sapiens
ttggaaaaatggg

SEQ ID NO: 6548110 - DNA, 16 bp, Homo sapiens
ttggaaaaatgtcact

SEQ ID NO: 6548111 - DNA, 18 bp, Homo sapiens
ttggaaaaatgtcactga

SEQ ID NO: 6548112 - DNA, 18 bp, Homo sapiens
ttggaaaacaaaagtttt

SEQ ID NO: 6548113 - DNA, 18 bp, Homo sapiens
ttggaaaactaattaatt

SEQ ID NO: 6548114 - DNA, 12 bp, Homo sapiens
ttggaaaataaa

SEQ ID NO: 6548115 - DNA, 15 bp, Homo sapiens
ttggaaaataaatca

SEQ ID NO: 6548116 - DNA, 23 bp, Homo sapiens
ttggaaaatatttttttcctttg

SEQ ID NO: 6548117 - DNA, 21 bp, Homo sapiens
ttggaaaatgacattttacta

SEQ ID NO: 6548118 - DNA, 15 bp, Homo sapiens
ttggaaaatgcattg

SEQ ID NO: 6548119 - DNA, 10 bp, Homo sapiens
ttggaaaatt

SEQ ID NO: 6548120 - DNA, 15 bp, Homo sapiens
ttggaaacactaaat

SEQ ID NO: 6548121 - DNA, 16 bp, Homo sapiens
ttggaaaccatgcact

SEQ ID NO: 6548122 - DNA, 17 bp, Homo sapiens
ttggaaacctgccctgc

SEQ ID NO: 6548123 - DNA, 20 bp, Homo sapiens
ttggaaacctgccctgcctg

SEQ ID NO: 6548124 - DNA, 14 bp, Homo sapiens
ttggaaactaataa

SEQ ID NO: 6548125 - DNA, 22 bp, Homo sapiens
ttggaaactaataaaatatttt

SEQ ID NO: 6548126 - DNA, 16 bp, Homo sapiens
ttggaaactgctaaat

SEQ ID NO: 6548127 - DNA, 11 bp, Homo sapiens
ttggaaagaac

SEQ ID NO: 6548128 - DNA, 13 bp, Homo sapiens
ttggaaagaacat

SEQ ID NO: 6548129 - DNA, 21 bp, Homo sapiens
ttggaaagacaggaagaccaa

SEQ ID NO: 6548130 - DNA, 19 bp, Homo sapiens
ttggaaagaggttctgcac

SEQ ID NO: 6548131 - DNA, 23 bp, Homo sapiens
ttggaaagagtaggaagactttg

SEQ ID NO: 6548132 - DNA, 13 bp, Homo sapiens
ttggaaagcaggt

SEQ ID NO: 6548133 - DNA, 20 bp, Homo sapiens
ttggaaagcatcacctcagg

SEQ ID NO: 6548134 - DNA, 14 bp, Homo sapiens
ttggaaaggaccag

SEQ ID NO: 6548135 - DNA, 21 bp, Homo sapiens
ttggaaagtacactctgctgt

SEQ ID NO: 6548136 - DNA, 18 bp, Homo sapiens
ttggaaagttcagccaga

SEQ ID NO: 6548137 - DNA, 16 bp, Homo sapiens
ttggaaataaaccatt

SEQ ID NO: 6548138 - DNA, 20 bp, Homo sapiens
ttggaaataaaccattggac

SEQ ID NO: 6548139 - DNA, 15 bp, Homo sapiens
ttggaaataactgga

SEQ ID NO: 6548140 - DNA, 23 bp, Homo sapiens
ttggaaatagaaatttccagaga

SEQ ID NO: 6548141 - DNA, 19 bp, Homo sapiens
ttggaaataggcaattaga

SEQ ID NO: 6548142 - DNA, 16 bp, Homo sapiens
ttggaaatcaaatgta

SEQ ID NO: 6548143 - DNA, 22 bp, Homo sapiens
ttggaaatcctagtttcctctc

SEQ ID NO: 6548144 - DNA, 14 bp, Homo sapiens
ttggaaatcctcta

SEQ ID NO: 6548145 - DNA, 22 bp, Homo sapiens
ttggaaatggcatgcaaaagca

SEQ ID NO: 6548146 - DNA, 20 bp, Homo sapiens
ttggaaatggggagctggcc

SEQ ID NO: 6548147 - DNA, 23 bp, Homo sapiens
ttggaaatgtacttttggataag

SEQ ID NO: 6548148 - DNA, 11 bp, Homo sapiens
ttggaaattcc

SEQ ID NO: 6548149 - DNA, 15 bp, Homo sapiens
ttggaaatttagcat

SEQ ID NO: 6548150 - DNA, 17 bp, Homo sapiens
ttggaaatttagcattg

SEQ ID NO: 6548151 - DNA, 14 bp, Homo sapiens
ttggaaattttagt

SEQ ID NO: 6548152 - DNA, 19 bp, Homo sapiens
ttggaacaaatgcttttcc

SEQ ID NO: 6548153 - DNA, 15 bp, Homo sapiens
ttggaacaacatgtt

SEQ ID NO: 6548154 - DNA, 16 bp, Homo sapiens
ttggaacaccctggat

SEQ ID NO: 6548155 - DNA, 18 bp, Homo sapiens
ttggaacaccctggatgc

SEQ ID NO: 6548156 - DNA, 16 bp, Homo sapiens
ttggaacagtgacaat

SEQ ID NO: 6548157 - DNA, 20 bp, Homo sapiens
ttggaaccaaagtctaaact

SEQ ID NO: 6548158 - DNA, 14 bp, Homo sapiens
ttggaaccagactc

SEQ ID NO: 6548159 - DNA, 22 bp, Homo sapiens
ttggaaccgtgtccagcacaga

SEQ ID NO: 6548160 - DNA, 13 bp, Homo sapiens
ttggaactatgaa

SEQ ID NO: 6548161 - DNA, 14 bp, Homo sapiens
ttggaactctactc

SEQ ID NO: 6548162 - DNA, 13 bp, Homo sapiens
ttggaactgcaat

SEQ ID NO: 6548163 - DNA, 15 bp, Homo sapiens
ttggaactgctgcca

SEQ ID NO: 6548164 - DNA, 15 bp, Homo sapiens
ttggaacttacaaag

SEQ ID NO: 6548165 - DNA, 16 bp, Homo sapiens
ttggaacttacaaagg

SEQ ID NO: 6548166 - DNA, 22 bp, Homo sapiens
ttggaacttgcctgcctttcca

SEQ ID NO: 6548167 - DNA, 12 bp, Homo sapiens
ttggaacttttc

SEQ ID NO: 6548168 - DNA, 22 bp, Homo sapiens
ttggaagaaaaaaatcttctcc

SEQ ID NO: 6548169 - DNA, 22 bp, Homo sapiens
ttggaagaagaaccaggcatgg

SEQ ID NO: 6548170 - DNA, 18 bp, Homo sapiens
ttggaagaaggggcaggt

SEQ ID NO: 6548171 - DNA, 23 bp, Homo sapiens
ttggaagacttgggttgatctct

SEQ ID NO: 6548172 - DNA, 13 bp, Homo sapiens
ttggaagagaaag

SEQ ID NO: 6548173 - DNA, 19 bp, Homo sapiens
ttggaagagaggcacctgc

SEQ ID NO: 6548174 - DNA, 21 bp, Homo sapiens
ttggaagagcagcacctcctc

SEQ ID NO: 6548175 - DNA, 14 bp, Homo sapiens
tgtgttgaaaacca

SEQ ID NO: 6548176 - DNA, 16 bp, Homo sapiens
tgtgttgaaaaccaaa

SEQ ID NO: 6548177 - DNA, 12 bp, Homo sapiens
tgtgttgaaata

SEQ ID NO: 6548178 - DNA, 13 bp, Homo sapiens
tgtgttgaacaca

SEQ ID NO: 6548179 - DNA, 17 bp, Homo sapiens
tgtgttgaagagcagct

SEQ ID NO: 6548180 - DNA, 17 bp, Homo sapiens
tgtgttgacactgtttt

SEQ ID NO: 6548181 - DNA, 16 bp, Homo sapiens
tgtgttgactgctgct

SEQ ID NO: 6548182 - DNA, 16 bp, Homo sapiens
tgtgttgatactgttg

SEQ ID NO: 6548183 - DNA, 19 bp, Homo sapiens
tgtgttgatactgttgcac

SEQ ID NO: 6548184 - DNA, 23 bp, Homo sapiens
tgtgttgatactgttgcacgtgt

SEQ ID NO: 6548185 - DNA, 18 bp, Homo sapiens
tgtgttgatttctttcct

SEQ ID NO: 6548186 - DNA, 19 bp, Homo sapiens
tgtgttgcaaattattcta

SEQ ID NO: 6548187 - DNA, 17 bp, Homo sapiens
tgtgttgcactgaacag

SEQ ID NO: 6548188 - DNA, 24 bp, Homo sapiens
tgtgttgcattattcatttagtga

SEQ ID NO: 6548189 - DNA, 16 bp, Homo sapiens
tgtgttgccaagctcc

SEQ ID NO: 6548190 - DNA, 18 bp, Homo sapiens
tgtgttgccatgtgtgct

SEQ ID NO: 6548191 - DNA, 23 bp, Homo sapiens
tgtgttgcccaggctggtcttga

SEQ ID NO: 6548192 - DNA, 17 bp, Homo sapiens
tgtgttgcctcctacct

SEQ ID NO: 6548193 - DNA, 18 bp, Homo sapiens
tgtgttgctaaaaaaagt

SEQ ID NO: 6548194 - DNA, 13 bp, Homo sapiens
tgtgttgcttcaa

SEQ ID NO: 6548195 - DNA, 15 bp, Homo sapiens
tgtgttgctttctga

SEQ ID NO: 6548196 - DNA, 21 bp, Homo sapiens
tgtgttggacaaatgtgaaga

SEQ ID NO: 6548197 - DNA, 15 bp, Homo sapiens
tgtgttggacagaga

SEQ ID NO: 6548198 - DNA, 19 bp, Homo sapiens
tgtgttggacagagaaggg

SEQ ID NO: 6548199 - DNA, 12 bp, Homo sapiens
tgtgttgtatta

SEQ ID NO: 6548200 - DNA, 19 bp, Homo sapiens
tgtgttgtattaacaaaag

SEQ ID NO: 6548201 - DNA, 13 bp, Homo sapiens
tgtgttgtctcta

SEQ ID NO: 6548202 - DNA, 14 bp, Homo sapiens
tgtgttgtctgtgc

SEQ ID NO: 6548203 - DNA, 15 bp, Homo sapiens
tgtgttgtctgtgca

SEQ ID NO: 6548204 - DNA, 21 bp, Homo sapiens
tgtgttgtgtgagcgtggcct

SEQ ID NO: 6548205 - DNA, 14 bp, Homo sapiens
tgtgttgtgtgtgg

SEQ ID NO: 6548206 - DNA, 13 bp, Homo sapiens
tgtgttgttgctt

SEQ ID NO: 6548207 - DNA, 21 bp, Homo sapiens
tgtgttgttgcttcttgtgaa

SEQ ID NO: 6548208 - DNA, 14 bp, Homo sapiens
tgtgttgttgcttt

SEQ ID NO: 6548209 - DNA, 14 bp, Homo sapiens
tgtgttgtttgaaa

SEQ ID NO: 6548210 - DNA, 14 bp, Homo sapiens
tgtgtttaaataaa

SEQ ID NO: 6548211 - DNA, 21 bp, Homo sapiens
tgtgtttaagcaccatggcct

SEQ ID NO: 6548212 - DNA, 14 bp, Homo sapiens
tgtgtttacagaca

SEQ ID NO: 6548213 - DNA, 16 bp, Homo sapiens
tgtgtttacagacaga

SEQ ID NO: 6548214 - DNA, 17 bp, Homo sapiens
tgtgtttacagagatgt

SEQ ID NO: 6548215 - DNA, 13 bp, Homo sapiens
tgtgtttactttt

SEQ ID NO: 6548216 - DNA, 15 bp, Homo sapiens
tgtgtttagaagcct

SEQ ID NO: 6548217 - DNA, 17 bp, Homo sapiens
tgtgtttagaattgaag

SEQ ID NO: 6548218 - DNA, 18 bp, Homo sapiens
tgtgtttagaattgaagg

SEQ ID NO: 6548219 - DNA, 14 bp, Homo sapiens
tgtgtttagatttt

SEQ ID NO: 6548220 - DNA, 15 bp, Homo sapiens
tgtgtttatgcattt

SEQ ID NO: 6548221 - DNA, 12 bp, Homo sapiens
tgtgtttattca

SEQ ID NO: 6548222 - DNA, 17 bp, Homo sapiens
tgtgtttattcatccag

SEQ ID NO: 6548223 - DNA, 14 bp, Homo sapiens
tgtgtttatttcac

SEQ ID NO: 6548224 - DNA, 22 bp, Homo sapiens
tgtgtttcaaaaccatgcctgg

SEQ ID NO: 6548225 - DNA, 13 bp, Homo sapiens
tgtgtttcacttt

SEQ ID NO: 6548226 - DNA, 16 bp, Homo sapiens
tgtgtttcaggacagc

SEQ ID NO: 6548227 - DNA, 18 bp, Homo sapiens
tgtgtttcatgttctgtg

SEQ ID NO: 6548228 - DNA, 20 bp, Homo sapiens
tgtgtttcatgttctgtgtc

SEQ ID NO: 6548229 - DNA, 19 bp, Homo sapiens
tgtgtttcattacttgaat

SEQ ID NO: 6548230 - DNA, 14 bp, Homo sapiens
tgtgtttccctaga

SEQ ID NO: 6548231 - DNA, 20 bp, Homo sapiens
tgtgtttcgcattaagcaca

SEQ ID NO: 6548232 - DNA, 15 bp, Homo sapiens
tgtgtttctaaaact

SEQ ID NO: 6548233 - DNA, 21 bp, Homo sapiens
tgtgtttctcctgagctagga

SEQ ID NO: 6548234 - DNA, 14 bp, Homo sapiens
tgtgtttctgtgct

SEQ ID NO: 6548235 - DNA, 15 bp, Homo sapiens
tgtgtttctgtgctc

SEQ ID NO: 6548236 - DNA, 17 bp, Homo sapiens
tgtgtttcttgcctcat

SEQ ID NO: 6548237 - DNA, 13 bp, Homo sapiens
tgtgtttcttgct

SEQ ID NO: 6548238 - DNA, 13 bp, Homo sapiens
tgtgtttgaaaca

SEQ ID NO: 6548239 - DNA, 20 bp, Homo sapiens
tgtgtttgaaacactcgtgt

SEQ ID NO: 6548240 - DNA, 16 bp, Homo sapiens
tgtgtttgaaatcatc

SEQ ID NO: 6548241 - DNA, 13 bp, Homo sapiens
tgtgtttgaagca

SEQ ID NO: 6548242 - DNA, 18 bp, Homo sapiens
tgtgtttgaattgatttt

SEQ ID NO: 6548243 - DNA, 13 bp, Homo sapiens
tgtgtttgacatg

SEQ ID NO: 6548244 - DNA, 17 bp, Homo sapiens
tgtgtttgacatgtgaa

SEQ ID NO: 6548245 - DNA, 12 bp, Homo sapiens
tgtgtttgagaa

SEQ ID NO: 6548246 - DNA, 15 bp, Homo sapiens
tgtgtttgctcccat

SEQ ID NO: 6548247 - DNA, 16 bp, Homo sapiens
tgtgtttgctcccctt

SEQ ID NO: 6548248 - DNA, 21 bp, Homo sapiens
tgtgtttggatacatctgctg

SEQ ID NO: 6548249 - DNA, 22 bp, Homo sapiens
tgtgtttggatacatctgctgt

SEQ ID NO: 6548250 - DNA, 17 bp, Homo sapiens
tgtgtttggcttggcct

SEQ ID NO: 6548251 - DNA, 17 bp, Homo sapiens
tgtgtttggttcaattt

SEQ ID NO: 6548252 - DNA, 18 bp, Homo sapiens
tgtgtttggtttacattt

SEQ ID NO: 6548253 - DNA, 23 bp, Homo sapiens
tgtgtttggtttacatttaaagc

SEQ ID NO: 6548254 - DNA, 17 bp, Homo sapiens
tgtgtttgtatgtctgt

SEQ ID NO: 6548255 - DNA, 17 bp, Homo sapiens
tgtgtttgtcattagcc

SEQ ID NO: 6548256 - DNA, 14 bp, Homo sapiens
tgtgtttgtgagca

SEQ ID NO: 6548257 - DNA, 11 bp, Homo sapiens
tgtgtttgtgt

SEQ ID NO: 6548258 - DNA, 15 bp, Homo sapiens
tgtgtttgtgtattt

SEQ ID NO: 6548259 - DNA, 13 bp, Homo sapiens
tgtgtttgtgtga

SEQ ID NO: 6548260 - DNA, 14 bp, Homo sapiens
tgtgtttgttccta

SEQ ID NO: 6548261 - DNA, 20 bp, Homo sapiens
tgtgtttgttctttttattg

SEQ ID NO: 6548262 - DNA, 18 bp, Homo sapiens
tgtgttttaaaaaaactg

SEQ ID NO: 6548263 - DNA, 13 bp, Homo sapiens
tgtgttttaacac

SEQ ID NO: 6548264 - DNA, 21 bp, Homo sapiens
tgtgttttaacaccaacactg

SEQ ID NO: 6548265 - DNA, 21 bp, Homo sapiens
tgtgttttaattttctttatg

SEQ ID NO: 6548266 - DNA, 14 bp, Homo sapiens
tgtgttttcagtct

SEQ ID NO: 6548267 - DNA, 20 bp, Homo sapiens
tgtgttttcctttgtcttaa

SEQ ID NO: 6548268 - DNA, 13 bp, Homo sapiens
tgtgttttctgaa

SEQ ID NO: 6548269 - DNA, 14 bp, Homo sapiens
tgtgttttctgaat

SEQ ID NO: 6548270 - DNA, 16 bp, Homo sapiens
tgtgttttctgtagac

SEQ ID NO: 6548271 - DNA, 18 bp, Homo sapiens
tgtgttttcttgtaaatg

SEQ ID NO: 6548272 - DNA, 15 bp, Homo sapiens
tgtgttttctttggt

SEQ ID NO: 6548273 - DNA, 13 bp, Homo sapiens
tgtgttttgcaag

SEQ ID NO: 6548274 - DNA, 23 bp, Homo sapiens
tgtgttttgcacgtcttgctatt

SEQ ID NO: 6548275 - DNA, 13 bp, Homo sapiens
tgtgttttgcttt

SEQ ID NO: 6548276 - DNA, 18 bp, Homo sapiens
tgtgttttggtatgcact

SEQ ID NO: 6548277 - DNA, 13 bp, Homo sapiens
tgtgttttgtcct

SEQ ID NO: 6548278 - DNA, 18 bp, Homo sapiens
tgtgttttgtctgagcct

SEQ ID NO: 6548279 - DNA, 16 bp, Homo sapiens
tgtgttttgtcttttt

SEQ ID NO: 6548280 - DNA, 19 bp, Homo sapiens
tgtgttttgttttgattta

SEQ ID NO: 6548281 - DNA, 16 bp, Homo sapiens
tgtgtttttcagttat

SEQ ID NO: 6548282 - DNA, 15 bp, Homo sapiens
tgtgtttttcataaa

SEQ ID NO: 6548283 - DNA, 20 bp, Homo sapiens
tgtgtttttccaaaacttga

SEQ ID NO: 6548284 - DNA, 16 bp, Homo sapiens
tgtgtttttctatata

SEQ ID NO: 6548285 - DNA, 15 bp, Homo sapiens
tgtgtttttctatta

SEQ ID NO: 6548286 - DNA, 17 bp, Homo sapiens
tgtgtttttctattaaa

SEQ ID NO: 6548287 - DNA, 19 bp, Homo sapiens
tgtgtttttctattaaaag

SEQ ID NO: 6548288 - DNA, 14 bp, Homo sapiens
tgtgtttttctcca

SEQ ID NO: 6548289 - DNA, 18 bp, Homo sapiens
tgtgtttttctttttcca

SEQ ID NO: 6548290 - DNA, 13 bp, Homo sapiens
tgtgtttttgaaa

SEQ ID NO: 6548291 - DNA, 18 bp, Homo sapiens
tgtgtttttgcactgtct

SEQ ID NO: 6548292 - DNA, 16 bp, Homo sapiens
tgtgtttttgggaaga

SEQ ID NO: 6548293 - DNA, 18 bp, Homo sapiens
tgtgtttttgggatgtct

SEQ ID NO: 6548294 - DNA, 17 bp, Homo sapiens
tgtgttttttaagatag

SEQ ID NO: 6548295 - DNA, 22 bp, Homo sapiens
tgttaaaaaaataagaagaatg

SEQ ID NO: 6548296 - DNA, 20 bp, Homo sapiens
tgttaaaaaagaaatctgtt

SEQ ID NO: 6548297 - DNA, 16 bp, Homo sapiens
tgttaaaaataaatcc

SEQ ID NO: 6548298 - DNA, 19 bp, Homo sapiens
tgttaaaaatagcagtatt

SEQ ID NO: 6548299 - DNA, 17 bp, Homo sapiens
tgttaaaacaaattaaa

SEQ ID NO: 6548300 - DNA, 14 bp, Homo sapiens
tgttaaaacataaa

SEQ ID NO: 6548301 - DNA, 18 bp, Homo sapiens
tgttaaaacataaacaca

SEQ ID NO: 6548302 - DNA, 16 bp, Homo sapiens
tgttaaaacatcaaaa

SEQ ID NO: 6548303 - DNA, 19 bp, Homo sapiens
tgttaaaactggcatctga

SEQ ID NO: 6548304 - DNA, 21 bp, Homo sapiens
tgttaaaagaaaataaattac

SEQ ID NO: 6548305 - DNA, 24 bp, Homo sapiens
tgttaaaaggaaaaataacaacta

SEQ ID NO: 6548306 - DNA, 14 bp, Homo sapiens
tgttaaaatacata

SEQ ID NO: 6548307 - DNA, 18 bp, Homo sapiens
tgttaaaatacataactt

SEQ ID NO: 6548308 - DNA, 19 bp, Homo sapiens
tgttaaaatacataacttc

SEQ ID NO: 6548309 - DNA, 22 bp, Homo sapiens
tgttaaaatacataacttcagt

SEQ ID NO: 6548310 - DNA, 17 bp, Homo sapiens
tgttaaaatagacaact

SEQ ID NO: 6548311 - DNA, 20 bp, Homo sapiens
tgttaaaatggggataataa

SEQ ID NO: 6548312 - DNA, 15 bp, Homo sapiens
tgttaaaatgtacac

SEQ ID NO: 6548313 - DNA, 17 bp, Homo sapiens
tgttaaaatgtacactg

SEQ ID NO: 6548314 - DNA, 18 bp, Homo sapiens
tgttaaaatgtacactgg

SEQ ID NO: 6548315 - DNA, 15 bp, Homo sapiens
tgttaaaatgtattc

SEQ ID NO: 6548316 - DNA, 22 bp, Homo sapiens
tgttaaaattatacctgttgct

SEQ ID NO: 6548317 - DNA, 21 bp, Homo sapiens
tgttaaaattatcaatatcta

SEQ ID NO: 6548318 - DNA, 23 bp, Homo sapiens
tgttaaaattatcaatatctaat

SEQ ID NO: 6548319 - DNA, 20 bp, Homo sapiens
tgttaaaattatgaatctga

SEQ ID NO: 6548320 - DNA, 14 bp, Homo sapiens
tgttaaacaaatga

SEQ ID NO: 6548321 - DNA, 20 bp, Homo sapiens
tgttaaacaactctttaaag

SEQ ID NO: 6548322 - DNA, 12 bp, Homo sapiens
tgttaaacagta

SEQ ID NO: 6548323 - DNA, 18 bp, Homo sapiens
tgttaaactagcatatct

SEQ ID NO: 6548324 - DNA, 19 bp, Homo sapiens
tgttaaactagcatatctg

SEQ ID NO: 6548325 - DNA, 22 bp, Homo sapiens
tgttaaactctgttgtaagtaa

SEQ ID NO: 6548326 - DNA, 20 bp, Homo sapiens
tgttaaactgttagcactgt

SEQ ID NO: 6548327 - DNA, 21 bp, Homo sapiens
tgttaaactgttagcactgtt

SEQ ID NO: 6548328 - DNA, 22 bp, Homo sapiens
tgttaaactgttagcactgttg

SEQ ID NO: 6548329 - DNA, 12 bp, Homo sapiens
tgttaaagactt

SEQ ID NO: 6548330 - DNA, 16 bp, Homo sapiens
tgttaaagagaatgag

SEQ ID NO: 6548331 - DNA, 15 bp, Homo sapiens
tgttaaagagataaa

SEQ ID NO: 6548332 - DNA, 21 bp, Homo sapiens
tgttaaagagataaagaataa

SEQ ID NO: 6548333 - DNA, 16 bp, Homo sapiens
tgttaaagagcactgg

SEQ ID NO: 6548334 - DNA, 21 bp, Homo sapiens
tgttaaagaggcgtcttgtat

SEQ ID NO: 6548335 - DNA, 12 bp, Homo sapiens
tgttaaagatat

SEQ ID NO: 6548336 - DNA, 13 bp, Homo sapiens
tgttaaagatgta

SEQ ID NO: 6548337 - DNA, 14 bp, Homo sapiens
tgttaaagatgtag

SEQ ID NO: 6548338 - DNA, 14 bp, Homo sapiens
tgttaaagcatttc

SEQ ID NO: 6548339 - DNA, 13 bp, Homo sapiens
tgttaaagccaga

SEQ ID NO: 6548340 - DNA, 19 bp, Homo sapiens
tgttaaagctggaacattt

SEQ ID NO: 6548341 - DNA, 23 bp, Homo sapiens
tgttaaataatatggctatgctt

SEQ ID NO: 6548342 - DNA, 18 bp, Homo sapiens
tgttaaatacaggaaaca

SEQ ID NO: 6548343 - DNA, 14 bp, Homo sapiens
tgttaaatactgtg

SEQ ID NO: 6548344 - DNA, 22 bp, Homo sapiens
tgttaaatatcagtagaaactc

SEQ ID NO: 6548345 - DNA, 20 bp, Homo sapiens
tgttaaatatttgtccttaa

SEQ ID NO: 6548346 - DNA, 19 bp, Homo sapiens
tgttaaatctacaaacttt

SEQ ID NO: 6548347 - DNA, 22 bp, Homo sapiens
tgttaaatgacttgattgtact

SEQ ID NO: 6548348 - DNA, 19 bp, Homo sapiens
tgttaaatgtatacaccaa

SEQ ID NO: 6548349 - DNA, 17 bp, Homo sapiens
tgttaaattcaatgctt

SEQ ID NO: 6548350 - DNA, 18 bp, Homo sapiens
tgttaaattgctgtgtat

SEQ ID NO: 6548351 - DNA, 16 bp, Homo sapiens
tgttaaatttgtaagt

SEQ ID NO: 6548352 - DNA, 13 bp, Homo sapiens
tgttaaattttct

SEQ ID NO: 6548353 - DNA, 22 bp, Homo sapiens
tgttaaattttctctaaactgt

SEQ ID NO: 6548354 - DNA, 23 bp, Homo sapiens
tgttaacaatggcaggttttaca

SEQ ID NO: 6548355 - DNA, 14 bp, Homo sapiens
ttggaagaggaaaa

SEQ ID NO: 6548356 - DNA, 16 bp, Homo sapiens
ttggaagatgcagaag

SEQ ID NO: 6548357 - DNA, 17 bp, Homo sapiens
ttggaagatgcagaagc

SEQ ID NO: 6548358 - DNA, 22 bp, Homo sapiens
ttggaagatggcataacctgtc

SEQ ID NO: 6548359 - DNA, 15 bp, Homo sapiens
ttggaagattcagct

SEQ ID NO: 6548360 - DNA, 15 bp, Homo sapiens
ttggaagcaacgtgt

SEQ ID NO: 6548361 - DNA, 19 bp, Homo sapiens
ttggaagcctgagcagggc

SEQ ID NO: 6548362 - DNA, 21 bp, Homo sapiens
ttggaagctagctcccctcct

SEQ ID NO: 6548363 - DNA, 19 bp, Homo sapiens
ttggaagctccgctttcta

SEQ ID NO: 6548364 - DNA, 19 bp, Homo sapiens
ttggaagctttgagttgac

SEQ ID NO: 6548365 - DNA, 19 bp, Homo sapiens
ttggaaggagacacagatg

SEQ ID NO: 6548366 - DNA, 21 bp, Homo sapiens
ttggaaggagacacagatgtt

SEQ ID NO: 6548367 - DNA, 13 bp, Homo sapiens
ttggaaggggcct

SEQ ID NO: 6548368 - DNA, 20 bp, Homo sapiens
ttggaaggtagagcccactg

SEQ ID NO: 6548369 - DNA, 21 bp, Homo sapiens
ttggaaggtcttttgagggct

SEQ ID NO: 6548370 - DNA, 15 bp, Homo sapiens
ttggaagtctgcgcc

SEQ ID NO: 6548371 - DNA, 15 bp, Homo sapiens
ttggaagtgaaatta

SEQ ID NO: 6548372 - DNA, 20 bp, Homo sapiens
ttggaagtgtgtggaaggca

SEQ ID NO: 6548373 - DNA, 20 bp, Homo sapiens
ttggaagtttagctctgaga

SEQ ID NO: 6548374 - DNA, 13 bp, Homo sapiens
ttggaagtttcat

SEQ ID NO: 6548375 - DNA, 17 bp, Homo sapiens
ttggaatattaaaaaac

SEQ ID NO: 6548376 - DNA, 23 bp, Homo sapiens
ttggaatattgtccattgtccaa

SEQ ID NO: 6548377 - DNA, 13 bp, Homo sapiens
ttggaatatttga

SEQ ID NO: 6548378 - DNA, 18 bp, Homo sapiens
ttggaatattttatcctg

SEQ ID NO: 6548379 - DNA, 14 bp, Homo sapiens
ttggaatcaaggta

SEQ ID NO: 6548380 - DNA, 20 bp, Homo sapiens
ttggaatcctccttaattta

SEQ ID NO: 6548381 - DNA, 16 bp, Homo sapiens
ttggaatcttttataa

SEQ ID NO: 6548382 - DNA, 19 bp, Homo sapiens
ttggaatgaaattcctcct

SEQ ID NO: 6548383 - DNA, 14 bp, Homo sapiens
ttggaatgaacaat

SEQ ID NO: 6548384 - DNA, 22 bp, Homo sapiens
ttggaatgcacagggcaattga

SEQ ID NO: 6548385 - DNA, 18 bp, Homo sapiens
ttggaatgggcagctcat

SEQ ID NO: 6548386 - DNA, 17 bp, Homo sapiens
ttggaatgttctcagat

SEQ ID NO: 6548387 - DNA, 16 bp, Homo sapiens
ttggaatgttgttaaa

SEQ ID NO: 6548388 - DNA, 18 bp, Homo sapiens
ttggaattctactggaaa

SEQ ID NO: 6548389 - DNA, 15 bp, Homo sapiens
ttggaattgacattc

SEQ ID NO: 6548390 - DNA, 17 bp, Homo sapiens
ttggaattggaattact

SEQ ID NO: 6548391 - DNA, 17 bp, Homo sapiens
ttggaatttctggcctc

SEQ ID NO: 6548392 - DNA, 14 bp, Homo sapiens
ttggaatttgctta

SEQ ID NO: 6548393 - DNA, 21 bp, Homo sapiens
ttggaatttgtaacctcagct

SEQ ID NO: 6548394 - DNA, 22 bp, Homo sapiens
ttggaatttgtaacctcagctc

SEQ ID NO: 6548395 - DNA, 14 bp, Homo sapiens
ttggaattttcttt

SEQ ID NO: 6548396 - DNA, 22 bp, Homo sapiens
ttggaattttctttcatacatt

SEQ ID NO: 6548397 - DNA, 15 bp, Homo sapiens
ttggaattttgtaaa

SEQ ID NO: 6548398 - DNA, 23 bp, Homo sapiens
ttggaattttgtaaaaagaaatt

SEQ ID NO: 6548399 - DNA, 17 bp, Homo sapiens
ttggaatttttttttcc

SEQ ID NO: 6548400 - DNA, 24 bp, Homo sapiens
ttggaatttttttttcctggaatt

SEQ ID NO: 6548401 - DNA, 13 bp, Homo sapiens
ttggacaaaatgg

SEQ ID NO: 6548402 - DNA, 14 bp, Homo sapiens
ttggacaaatcaca

SEQ ID NO: 6548403 - DNA, 21 bp, Homo sapiens
ttggacaaatgtgaagatgca

SEQ ID NO: 6548404 - DNA, 22 bp, Homo sapiens
ttggacaaatgtgaagatgcat

SEQ ID NO: 6548405 - DNA, 16 bp, Homo sapiens
ttggacaactgcatgg

SEQ ID NO: 6548406 - DNA, 19 bp, Homo sapiens
ttggacaagcttctgagac

SEQ ID NO: 6548407 - DNA, 15 bp, Homo sapiens
ttggacacacacagc

SEQ ID NO: 6548408 - DNA, 17 bp, Homo sapiens
ttggacacacacagctt

SEQ ID NO: 6548409 - DNA, 17 bp, Homo sapiens
ttggacaccctgtcaga

SEQ ID NO: 6548410 - DNA, 19 bp, Homo sapiens
ttggacacctttaggttct

SEQ ID NO: 6548411 - DNA, 17 bp, Homo sapiens
ttggacagaaaatgcaa

SEQ ID NO: 6548412 - DNA, 13 bp, Homo sapiens
ttggacagaccca

SEQ ID NO: 6548413 - DNA, 22 bp, Homo sapiens
ttggacagacccacccccagcc

SEQ ID NO: 6548414 - DNA, 14 bp, Homo sapiens
ttggacagcaaaac

SEQ ID NO: 6548415 - DNA, 16 bp, Homo sapiens
ttggacagctgcttgt

SEQ ID NO: 6548416 - DNA, 12 bp, Homo sapiens
ttggacagtggc

SEQ ID NO: 6548417 - DNA, 14 bp, Homo sapiens
ttggacagtggcct

SEQ ID NO: 6548418 - DNA, 22 bp, Homo sapiens
ttggacataactgacttagttc

SEQ ID NO: 6548419 - DNA, 22 bp, Homo sapiens
ttggacatcagtgtttgttgga

SEQ ID NO: 6548420 - DNA, 22 bp, Homo sapiens
ttggacatctctctggcttctg

SEQ ID NO: 6548421 - DNA, 17 bp, Homo sapiens
ttggacatttatgtaca

SEQ ID NO: 6548422 - DNA, 18 bp, Homo sapiens
ttggacattttatgtctt

SEQ ID NO: 6548423 - DNA, 19 bp, Homo sapiens
ttggacattttatgtcttt

SEQ ID NO: 6548424 - DNA, 20 bp, Homo sapiens
ttggacattttatgtctttc

SEQ ID NO: 6548425 - DNA, 18 bp, Homo sapiens
ttggacattttcttcaga

SEQ ID NO: 6548426 - DNA, 12 bp, Homo sapiens
ttggaccagggc

SEQ ID NO: 6548427 - DNA, 15 bp, Homo sapiens
ttggacccaaggaaa

SEQ ID NO: 6548428 - DNA, 14 bp, Homo sapiens
ttggacccagggcc

SEQ ID NO: 6548429 - DNA, 19 bp, Homo sapiens
ttggaccccagctgggagg

SEQ ID NO: 6548430 - DNA, 16 bp, Homo sapiens
ttggacccgctctgga

SEQ ID NO: 6548431 - DNA, 18 bp, Homo sapiens
ttggaccctgaggcccag

SEQ ID NO: 6548432 - DNA, 18 bp, Homo sapiens
ttggaccctggtgacctc

SEQ ID NO: 6548433 - DNA, 13 bp, Homo sapiens
ttggacccttcca

SEQ ID NO: 6548434 - DNA, 14 bp, Homo sapiens
ttggacccttccat

SEQ ID NO: 6548435 - DNA, 17 bp, Homo sapiens
ttggacccttggaaaac

SEQ ID NO: 6548436 - DNA, 23 bp, Homo sapiens
ttggacctaaatggcctcatgtg

SEQ ID NO: 6548437 - DNA, 20 bp, Homo sapiens
ttggacctcattttattaaa

SEQ ID NO: 6548438 - DNA, 17 bp, Homo sapiens
ttggacctcgtgcttta

SEQ ID NO: 6548439 - DNA, 14 bp, Homo sapiens
ttggacctctgctc

SEQ ID NO: 6548440 - DNA, 15 bp, Homo sapiens
ttggacctctgctct

SEQ ID NO: 6548441 - DNA, 21 bp, Homo sapiens
ttggacctgcagttggcctca

SEQ ID NO: 6548442 - DNA, 11 bp, Homo sapiens
ttggacctgcc

SEQ ID NO: 6548443 - DNA, 20 bp, Homo sapiens
ttggacctggctaatggagt

SEQ ID NO: 6548444 - DNA, 16 bp, Homo sapiens
ttggacgcacacagct

SEQ ID NO: 6548445 - DNA, 17 bp, Homo sapiens
ttggacgcacacagctt

SEQ ID NO: 6548446 - DNA, 17 bp, Homo sapiens
ttggacggctgggcaca

SEQ ID NO: 6548447 - DNA, 22 bp, Homo sapiens
ttggacgggatgacctccagaa

SEQ ID NO: 6548448 - DNA, 22 bp, Homo sapiens
ttggacggggacacggcctctg

SEQ ID NO: 6548449 - DNA, 22 bp, Homo sapiens
ttggacgtttactagactttga

SEQ ID NO: 6548450 - DNA, 17 bp, Homo sapiens
ttggactaaatgcctag

SEQ ID NO: 6548451 - DNA, 13 bp, Homo sapiens
ttggactacacaa

SEQ ID NO: 6548452 - DNA, 13 bp, Homo sapiens
ttggactacttgt

SEQ ID NO: 6548453 - DNA, 15 bp, Homo sapiens
ttggactagccagaa

SEQ ID NO: 6548454 - DNA, 12 bp, Homo sapiens
ttggactatgga

SEQ ID NO: 6548455 - DNA, 13 bp, Homo sapiens
ttggactccaggc

SEQ ID NO: 6548456 - DNA, 15 bp, Homo sapiens
ttggactccaggcct

SEQ ID NO: 6548457 - DNA, 22 bp, Homo sapiens
ttggactccaggcctgaccagg

SEQ ID NO: 6548458 - DNA, 13 bp, Homo sapiens
ttggactccctcc

SEQ ID NO: 6548459 - DNA, 13 bp, Homo sapiens
ttggactcctccc

SEQ ID NO: 6548460 - DNA, 15 bp, Homo sapiens
ttggactctcaggga

SEQ ID NO: 6548461 - DNA, 18 bp, Homo sapiens
ttggactctctgtggtcc

SEQ ID NO: 6548462 - DNA, 14 bp, Homo sapiens
ttggactctgagct

SEQ ID NO: 6548463 - DNA, 16 bp, Homo sapiens
ttggactcttgctctt

SEQ ID NO: 6548464 - DNA, 17 bp, Homo sapiens
ttggactgagatttctt

SEQ ID NO: 6548465 - DNA, 22 bp, Homo sapiens
ttggactggaggtacaaataat

SEQ ID NO: 6548466 - DNA, 16 bp, Homo sapiens
ttggactgtggcctca

SEQ ID NO: 6548467 - DNA, 22 bp, Homo sapiens
ttggactgttcaagcaaaaaag

SEQ ID NO: 6548468 - DNA, 14 bp, Homo sapiens
ttggactgttttca

SEQ ID NO: 6548469 - DNA, 20 bp, Homo sapiens
ttggactgttttcaataaca

SEQ ID NO: 6548470 - DNA, 20 bp, Homo sapiens
ttggacttcaaagcaagctg

SEQ ID NO: 6548471 - DNA, 12 bp, Homo sapiens
ttggacttctga

SEQ ID NO: 6548472 - DNA, 16 bp, Homo sapiens
ttggacttgtcccggg

SEQ ID NO: 6548473 - DNA, 23 bp, Homo sapiens
ttggactttcaaaattaaatctg

SEQ ID NO: 6548474 - DNA, 18 bp, Homo sapiens
ttggacttttcgttaaca

SEQ ID NO: 6548475 - DNA, 20 bp, Homo sapiens
ttggagaaaagcacttaaag

SEQ ID NO: 6548476 - DNA, 17 bp, Homo sapiens
ttggagaaaataacaag

SEQ ID NO: 6548477 - DNA, 18 bp, Homo sapiens
ttggagaaaatgaagaaa

SEQ ID NO: 6548478 - DNA, 13 bp, Homo sapiens
ttggagaaagaaa

SEQ ID NO: 6548479 - DNA, 18 bp, Homo sapiens
ttggagaaatgaaaacag

SEQ ID NO: 6548480 - DNA, 16 bp, Homo sapiens
ttggagaaatgtcata

SEQ ID NO: 6548481 - DNA, 15 bp, Homo sapiens
ttggagaaattattt

SEQ ID NO: 6548482 - DNA, 18 bp, Homo sapiens
ttggagaactcatttcaa

SEQ ID NO: 6548483 - DNA, 15 bp, Homo sapiens
ttggagaagaactga

SEQ ID NO: 6548484 - DNA, 20 bp, Homo sapiens
ttggagaagcccgtgtgaga

SEQ ID NO: 6548485 - DNA, 16 bp, Homo sapiens
ttggagaagtctcagc

SEQ ID NO: 6548486 - DNA, 14 bp, Homo sapiens
ttggagaatactgc

SEQ ID NO: 6548487 - DNA, 21 bp, Homo sapiens
ttggagaatactttgcttcat

SEQ ID NO: 6548488 - DNA, 15 bp, Homo sapiens
ttggagaatatcaaa

SEQ ID NO: 6548489 - DNA, 13 bp, Homo sapiens
ttggagaatttag

SEQ ID NO: 6548490 - DNA, 18 bp, Homo sapiens
ttggagaatttaggtttt

SEQ ID NO: 6548491 - DNA, 18 bp, Homo sapiens
ttggagacacaactattt

SEQ ID NO: 6548492 - DNA, 20 bp, Homo sapiens
ttggagacagcaattgtaga

SEQ ID NO: 6548493 - DNA, 12 bp, Homo sapiens
ttggagagcaaa

SEQ ID NO: 6548494 - DNA, 19 bp, Homo sapiens
ttggagagcaaaggcccat

SEQ ID NO: 6548495 - DNA, 23 bp, Homo sapiens
ttggagagcaaaggcccatgccc

SEQ ID NO: 6548496 - DNA, 13 bp, Homo sapiens
ttggagagcagct

SEQ ID NO: 6548497 - DNA, 13 bp, Homo sapiens
ttggagaggagag

SEQ ID NO: 6548498 - DNA, 15 bp, Homo sapiens
ttggagaggaggtgt

SEQ ID NO: 6548499 - DNA, 13 bp, Homo sapiens
ttggagagggaag

SEQ ID NO: 6548500 - DNA, 17 bp, Homo sapiens
ttggagagggggccgga

SEQ ID NO: 6548501 - DNA, 17 bp, Homo sapiens
ttggagagtaaaaactg

SEQ ID NO: 6548502 - DNA, 16 bp, Homo sapiens
ttggagagtttcctga

SEQ ID NO: 6548503 - DNA, 21 bp, Homo sapiens
ttggagagtttcctgaaacaa

SEQ ID NO: 6548504 - DNA, 22 bp, Homo sapiens
ttggagagtttgcctgttctat

SEQ ID NO: 6548505 - DNA, 19 bp, Homo sapiens
ttggagatgtctctgtgtg

SEQ ID NO: 6548506 - DNA, 23 bp, Homo sapiens
ttggagattactaactgtggaca

SEQ ID NO: 6548507 - DNA, 15 bp, Homo sapiens
ttggagatttttcat

SEQ ID NO: 6548508 - DNA, 15 bp, Homo sapiens
ttggagcaaaccatt

SEQ ID NO: 6548509 - DNA, 15 bp, Homo sapiens
ttggagcacaaaatt

SEQ ID NO: 6548510 - DNA, 12 bp, Homo sapiens
ttggagcagcag

SEQ ID NO: 6548511 - DNA, 14 bp, Homo sapiens
ttggagcagcaggc

SEQ ID NO: 6548512 - DNA, 22 bp, Homo sapiens
ttggagcaggcaaaaaagggac

SEQ ID NO: 6548513 - DNA, 20 bp, Homo sapiens
ttggagccccaggggacaag

SEQ ID NO: 6548514 - DNA, 16 bp, Homo sapiens
ttggagccccctggcg

SEQ ID NO: 6548515 - DNA, 16 bp, Homo sapiens
ttggagccgggaaagc

SEQ ID NO: 6548516 - DNA, 17 bp, Homo sapiens
ttggagcctaaagagaa

SEQ ID NO: 6548517 - DNA, 11 bp, Homo sapiens
ttggagcctgc

SEQ ID NO: 6548518 - DNA, 14 bp, Homo sapiens
ttggagcctgcagg

SEQ ID NO: 6548519 - DNA, 13 bp, Homo sapiens
ttggagccttcca

SEQ ID NO: 6548520 - DNA, 14 bp, Homo sapiens
ttggagccttccac

SEQ ID NO: 6548521 - DNA, 16 bp, Homo sapiens
ttggagctgaagacct

SEQ ID NO: 6548522 - DNA, 11 bp, Homo sapiens
ttggagctgag

SEQ ID NO: 6548523 - DNA, 12 bp, Homo sapiens
ttggagctgaga

SEQ ID NO: 6548524 - DNA, 19 bp, Homo sapiens
ttggagctgagatgagccc

SEQ ID NO: 6548525 - DNA, 20 bp, Homo sapiens
ttggagctgagatgagcccc

SEQ ID NO: 6548526 - DNA, 14 bp, Homo sapiens
ttggagctgagcct

SEQ ID NO: 6548527 - DNA, 17 bp, Homo sapiens
ttggagctgtcctccag

SEQ ID NO: 6548528 - DNA, 20 bp, Homo sapiens
ttggagctgtcctccagagg

SEQ ID NO: 6548529 - DNA, 22 bp, Homo sapiens
ttggagctgttccattgggtcc

SEQ ID NO: 6548530 - DNA, 15 bp, Homo sapiens
ttggagcttacatag

SEQ ID NO: 6548531 - DNA, 16 bp, Homo sapiens
ttggagctttggaata

SEQ ID NO: 6548532 - DNA, 17 bp, Homo sapiens
ttggaggaaatgtgctc

SEQ ID NO: 6548533 - DNA, 16 bp, Homo sapiens
ttggaggagagagcct

SEQ ID NO: 6548534 - DNA, 17 bp, Homo sapiens
ttggaggagagagcctt

SEQ ID NO: 6548535 - DNA, 14 bp, Homo sapiens
tgttaacactgtaa

SEQ ID NO: 6548536 - DNA, 13 bp, Homo sapiens
tgttaacagaagg

SEQ ID NO: 6548537 - DNA, 22 bp, Homo sapiens
tgttaacagagcaaatttgaat

SEQ ID NO: 6548538 - DNA, 16 bp, Homo sapiens
tgttaacaggtatttt

SEQ ID NO: 6548539 - DNA, 16 bp, Homo sapiens
tgttaacagtatttta

SEQ ID NO: 6548540 - DNA, 18 bp, Homo sapiens
tgttaacatggaatttaa

SEQ ID NO: 6548541 - DNA, 21 bp, Homo sapiens
tgttaacatggacatgatctt

SEQ ID NO: 6548542 - DNA, 20 bp, Homo sapiens
tgttaacattccaagactct

SEQ ID NO: 6548543 - DNA, 17 bp, Homo sapiens
tgttaacatttttggta

SEQ ID NO: 6548544 - DNA, 20 bp, Homo sapiens
tgttaaccgtttcaggacca

SEQ ID NO: 6548545 - DNA, 16 bp, Homo sapiens
tgttaacctaggcagt

SEQ ID NO: 6548546 - DNA, 20 bp, Homo sapiens
tgttaaccttaaatacactg

SEQ ID NO: 6548547 - DNA, 14 bp, Homo sapiens
tgttaactacatat

SEQ ID NO: 6548548 - DNA, 19 bp, Homo sapiens
tgttaactacatattgtct

SEQ ID NO: 6548549 - DNA, 14 bp, Homo sapiens
tgttaactatgaca

SEQ ID NO: 6548550 - DNA, 22 bp, Homo sapiens
tgttaactgaagatattccaac

SEQ ID NO: 6548551 - DNA, 12 bp, Homo sapiens
tgttaactgaat

SEQ ID NO: 6548552 - DNA, 14 bp, Homo sapiens
tgttaactgaatac

SEQ ID NO: 6548553 - DNA, 20 bp, Homo sapiens
tgttaactgccaagcttgga

SEQ ID NO: 6548554 - DNA, 12 bp, Homo sapiens
tgttaactgtac

SEQ ID NO: 6548555 - DNA, 18 bp, Homo sapiens
tgttaactgttaactatg

SEQ ID NO: 6548556 - DNA, 19 bp, Homo sapiens
tgttaactgttcttggaaa

SEQ ID NO: 6548557 - DNA, 20 bp, Homo sapiens
tgttaacttatgtctcttgt

SEQ ID NO: 6548558 - DNA, 18 bp, Homo sapiens
tgttaactttcaaatcca

SEQ ID NO: 6548559 - DNA, 19 bp, Homo sapiens
tgttaagaaaaactacagc

SEQ ID NO: 6548560 - DNA, 20 bp, Homo sapiens
tgttaagaaaggatataaaa

SEQ ID NO: 6548561 - DNA, 21 bp, Homo sapiens
tgttaagaaaggatataaaag

SEQ ID NO: 6548562 - DNA, 15 bp, Homo sapiens
tgttaagaattgacc

SEQ ID NO: 6548563 - DNA, 17 bp, Homo sapiens
tgttaagacttgacagt

SEQ ID NO: 6548564 - DNA, 16 bp, Homo sapiens
tgttaagagataattc

SEQ ID NO: 6548565 - DNA, 20 bp, Homo sapiens
tgttaagataattgtacttt

SEQ ID NO: 6548566 - DNA, 23 bp, Homo sapiens
tgttaagataattgtactttgaa

SEQ ID NO: 6548567 - DNA, 18 bp, Homo sapiens
tgttaagcagctaaattt

SEQ ID NO: 6548568 - DNA, 15 bp, Homo sapiens
tgttaagcatttatt

SEQ ID NO: 6548569 - DNA, 12 bp, Homo sapiens
tgttaagctcag

SEQ ID NO: 6548570 - DNA, 13 bp, Homo sapiens
tgttaagctctgc

SEQ ID NO: 6548571 - DNA, 15 bp, Homo sapiens
tgttaagcttctatt

SEQ ID NO: 6548572 - DNA, 16 bp, Homo sapiens
tgttaaggaaactctt

SEQ ID NO: 6548573 - DNA, 23 bp, Homo sapiens
tgttaaggaaactcttatctcag

SEQ ID NO: 6548574 - DNA, 20 bp, Homo sapiens
tgttaaggacccttttaagc

SEQ ID NO: 6548575 - DNA, 17 bp, Homo sapiens
tgttaaggcaacattcc

SEQ ID NO: 6548576 - DNA, 17 bp, Homo sapiens
tgttaagggaagctgat

SEQ ID NO: 6548577 - DNA, 22 bp, Homo sapiens
tgttaaggtggattgaggccag

SEQ ID NO: 6548578 - DNA, 17 bp, Homo sapiens
tgttaaggttgaacttt

SEQ ID NO: 6548579 - DNA, 15 bp, Homo sapiens
tgttaagtatgtgta

SEQ ID NO: 6548580 - DNA, 17 bp, Homo sapiens
tgttaagtattttcata

SEQ ID NO: 6548581 - DNA, 22 bp, Homo sapiens
tgttaagtcctccctgactttt

SEQ ID NO: 6548582 - DNA, 23 bp, Homo sapiens
tgttaagtgccattactactgta

SEQ ID NO: 6548583 - DNA, 20 bp, Homo sapiens
tgttaagtgcttttaaactg

SEQ ID NO: 6548584 - DNA, 13 bp, Homo sapiens
tgttaagtgtaaa

SEQ ID NO: 6548585 - DNA, 17 bp, Homo sapiens
tgttaagtttttaatct

SEQ ID NO: 6548586 - DNA, 13 bp, Homo sapiens
tgttaataaaggt

SEQ ID NO: 6548587 - DNA, 15 bp, Homo sapiens
tgttaataaaggttt

SEQ ID NO: 6548588 - DNA, 13 bp, Homo sapiens
tgttaataaatgg

SEQ ID NO: 6548589 - DNA, 14 bp, Homo sapiens
tgttaataataaga

SEQ ID NO: 6548590 - DNA, 16 bp, Homo sapiens
tgttaataataagata

SEQ ID NO: 6548591 - DNA, 19 bp, Homo sapiens
tgttaatacacagtacttt

SEQ ID NO: 6548592 - DNA, 20 bp, Homo sapiens
tgttaatacatcacatctta

SEQ ID NO: 6548593 - DNA, 14 bp, Homo sapiens
tgttaatactgaga

SEQ ID NO: 6548594 - DNA, 16 bp, Homo sapiens
tgttaatactgagaaa

SEQ ID NO: 6548595 - DNA, 13 bp, Homo sapiens
tgttaatagtact

SEQ ID NO: 6548596 - DNA, 17 bp, Homo sapiens
tgttaatataactgtct

SEQ ID NO: 6548597 - DNA, 19 bp, Homo sapiens
tgttaatataatttaacag

SEQ ID NO: 6548598 - DNA, 18 bp, Homo sapiens
tgttaatatcactcatta

SEQ ID NO: 6548599 - DNA, 21 bp, Homo sapiens
tgttaatattaatttatattt

SEQ ID NO: 6548600 - DNA, 23 bp, Homo sapiens
tgttaatattaatttatatttgt

SEQ ID NO: 6548601 - DNA, 13 bp, Homo sapiens
tgttaatatttta

SEQ ID NO: 6548602 - DNA, 19 bp, Homo sapiens
tgttaatattttatgtgta

SEQ ID NO: 6548603 - DNA, 12 bp, Homo sapiens
tgttaatcaatt

SEQ ID NO: 6548604 - DNA, 14 bp, Homo sapiens
tgttaatccagaga

SEQ ID NO: 6548605 - DNA, 18 bp, Homo sapiens
tgttaatctgatgtataa

SEQ ID NO: 6548606 - DNA, 19 bp, Homo sapiens
tgttaatctgatgtataat

SEQ ID NO: 6548607 - DNA, 20 bp, Homo sapiens
tgttaatctgatgtataatg

SEQ ID NO: 6548608 - DNA, 22 bp, Homo sapiens
tgttaatctgatgtataatgta

SEQ ID NO: 6548609 - DNA, 23 bp, Homo sapiens
tgttaatctgatgtataatgtaa

SEQ ID NO: 6548610 - DNA, 17 bp, Homo sapiens
tgttaatcttaatgtat

SEQ ID NO: 6548611 - DNA, 22 bp, Homo sapiens
tgttaatcttaatgtatatcgt

SEQ ID NO: 6548612 - DNA, 23 bp, Homo sapiens
tgttaatcttaggggagagcttt

SEQ ID NO: 6548613 - DNA, 14 bp, Homo sapiens
tgttaatgaaaatg

SEQ ID NO: 6548614 - DNA, 17 bp, Homo sapiens
tgttaatgaaaatgtca

SEQ ID NO: 6548615 - DNA, 13 bp, Homo sapiens
tgttaatgactct

SEQ ID NO: 6548616 - DNA, 21 bp, Homo sapiens
tgttaatgagaaaatggcttt

SEQ ID NO: 6548617 - DNA, 20 bp, Homo sapiens
tgttaatgattcttgtgtca

SEQ ID NO: 6548618 - DNA, 23 bp, Homo sapiens
tgttaatgcattgttgtaaagta

SEQ ID NO: 6548619 - DNA, 21 bp, Homo sapiens
tgttaatgctctatgtttgta

SEQ ID NO: 6548620 - DNA, 22 bp, Homo sapiens
tgttaatggtagcattcttctt

SEQ ID NO: 6548621 - DNA, 17 bp, Homo sapiens
tgttaatggtttgaata

SEQ ID NO: 6548622 - DNA, 14 bp, Homo sapiens
tgttaatgtatact

SEQ ID NO: 6548623 - DNA, 13 bp, Homo sapiens
tgttaatgtcatt

SEQ ID NO: 6548624 - DNA, 18 bp, Homo sapiens
tgttaattaaatatttct

SEQ ID NO: 6548625 - DNA, 17 bp, Homo sapiens
tgttaattataaacagc

SEQ ID NO: 6548626 - DNA, 21 bp, Homo sapiens
tgttaattataaacagcaggg

SEQ ID NO: 6548627 - DNA, 15 bp, Homo sapiens
tgttaattcttattt

SEQ ID NO: 6548628 - DNA, 18 bp, Homo sapiens
tgttaattgattaaaatc

SEQ ID NO: 6548629 - DNA, 20 bp, Homo sapiens
tgttaattgcgtagaggcta

SEQ ID NO: 6548630 - DNA, 17 bp, Homo sapiens
tgttaatttagaaaact

SEQ ID NO: 6548631 - DNA, 23 bp, Homo sapiens
tgttaatttataatgtatttgaa

SEQ ID NO: 6548632 - DNA, 23 bp, Homo sapiens
tgttaatttattttaatgtaaat

SEQ ID NO: 6548633 - DNA, 21 bp, Homo sapiens
tgttaatttattttgctccct

SEQ ID NO: 6548634 - DNA, 23 bp, Homo sapiens
tgttaatttattttgctccctct

SEQ ID NO: 6548635 - DNA, 23 bp, Homo sapiens
tgttaatttcttgcaatttgaag

SEQ ID NO: 6548636 - DNA, 16 bp, Homo sapiens
tgttaatttgttatgt

SEQ ID NO: 6548637 - DNA, 17 bp, Homo sapiens
tgttaatttgttatgta

SEQ ID NO: 6548638 - DNA, 21 bp, Homo sapiens
tgttaattttaccttgtttga

SEQ ID NO: 6548639 - DNA, 15 bp, Homo sapiens
tgttaattttcctca

SEQ ID NO: 6548640 - DNA, 18 bp, Homo sapiens
tgttaattttgctaactg

SEQ ID NO: 6548641 - DNA, 19 bp, Homo sapiens
tgttaattttgctaactgg

SEQ ID NO: 6548642 - DNA, 20 bp, Homo sapiens
tgttaattttgctaactggg

SEQ ID NO: 6548643 - DNA, 23 bp, Homo sapiens
tgttaattttgctaactgggtta

SEQ ID NO: 6548644 - DNA, 21 bp, Homo sapiens
tgttaattttttggtacaaaa

SEQ ID NO: 6548645 - DNA, 13 bp, Homo sapiens
tgttacaaaaaaa

SEQ ID NO: 6548646 - DNA, 21 bp, Homo sapiens
tgttacaaaatgtaactgtta

SEQ ID NO: 6548647 - DNA, 18 bp, Homo sapiens
tgttacaaattgtagaag

SEQ ID NO: 6548648 - DNA, 10 bp, Homo sapiens
tgttacaagt

SEQ ID NO: 6548649 - DNA, 17 bp, Homo sapiens
tgttacaagtgttctta

SEQ ID NO: 6548650 - DNA, 17 bp, Homo sapiens
tgttacaagtttgctaa

SEQ ID NO: 6548651 - DNA, 18 bp, Homo sapiens
tgttacaagtttgctaaa

SEQ ID NO: 6548652 - DNA, 15 bp, Homo sapiens
tgttacacaatatgt

SEQ ID NO: 6548653 - DNA, 17 bp, Homo sapiens
tgttacacaatatgtgt

SEQ ID NO: 6548654 - DNA, 22 bp, Homo sapiens
tgttacacaatggtttttaaat

SEQ ID NO: 6548655 - DNA, 20 bp, Homo sapiens
tgttacacagcccaagagga

SEQ ID NO: 6548656 - DNA, 21 bp, Homo sapiens
tgttacactaatttgaataaa

SEQ ID NO: 6548657 - DNA, 19 bp, Homo sapiens
tgttacagaggacatacca

SEQ ID NO: 6548658 - DNA, 13 bp, Homo sapiens
tgttacaggcttg

SEQ ID NO: 6548659 - DNA, 16 bp, Homo sapiens
tgttacaggtgtacta

SEQ ID NO: 6548660 - DNA, 14 bp, Homo sapiens
tgttacagtaatgt

SEQ ID NO: 6548661 - DNA, 17 bp, Homo sapiens
tgttacataacaagaaa

SEQ ID NO: 6548662 - DNA, 22 bp, Homo sapiens
tgttacataacaagaaaatcaa

SEQ ID NO: 6548663 - DNA, 19 bp, Homo sapiens
tgttacataagataaatgt

SEQ ID NO: 6548664 - DNA, 19 bp, Homo sapiens
tgttacataaggatgactt

SEQ ID NO: 6548665 - DNA, 13 bp, Homo sapiens
tgttacatagtgt

SEQ ID NO: 6548666 - DNA, 22 bp, Homo sapiens
tgttacatgtaatatatttcag

SEQ ID NO: 6548667 - DNA, 15 bp, Homo sapiens
tgttacatgtagaaa

SEQ ID NO: 6548668 - DNA, 12 bp, Homo sapiens
tgttacatgtat

SEQ ID NO: 6548669 - DNA, 17 bp, Homo sapiens
tgttacattaaagccct

SEQ ID NO: 6548670 - DNA, 22 bp, Homo sapiens
tgttacattgtcaaagcttgcc

SEQ ID NO: 6548671 - DNA, 13 bp, Homo sapiens
tgttacattttta

SEQ ID NO: 6548672 - DNA, 22 bp, Homo sapiens
tgttacatttttaagtgctgca

SEQ ID NO: 6548673 - DNA, 22 bp, Homo sapiens
tgttaccaaagcaatatttccc

SEQ ID NO: 6548674 - DNA, 14 bp, Homo sapiens
tgttaccagacttc

SEQ ID NO: 6548675 - DNA, 16 bp, Homo sapiens
tgttaccagacttcaa

SEQ ID NO: 6548676 - DNA, 21 bp, Homo sapiens
tgttaccagagcctctttgct

SEQ ID NO: 6548677 - DNA, 18 bp, Homo sapiens
tgttaccatactgtctct

SEQ ID NO: 6548678 - DNA, 23 bp, Homo sapiens
tgttaccatactgtctctggagt

SEQ ID NO: 6548679 - DNA, 16 bp, Homo sapiens
tgttaccatgaagata

SEQ ID NO: 6548680 - DNA, 14 bp, Homo sapiens
tgttaccattcaca

SEQ ID NO: 6548681 - DNA, 15 bp, Homo sapiens
tgttaccattcacaa

SEQ ID NO: 6548682 - DNA, 18 bp, Homo sapiens
tgttaccattggaaattt

SEQ ID NO: 6548683 - DNA, 23 bp, Homo sapiens
tgttaccccaagcgccctggccc

SEQ ID NO: 6548684 - DNA, 18 bp, Homo sapiens
tgttaccctcctgtaaat

SEQ ID NO: 6548685 - DNA, 17 bp, Homo sapiens
tgttaccgcctgtctct

SEQ ID NO: 6548686 - DNA, 19 bp, Homo sapiens
tgttacctaacaatgtttt

SEQ ID NO: 6548687 - DNA, 14 bp, Homo sapiens
tgttacctctgaat

SEQ ID NO: 6548688 - DNA, 23 bp, Homo sapiens
tgttacctgaaaacactgtgcac

SEQ ID NO: 6548689 - DNA, 21 bp, Homo sapiens
tgttacctgatcaatgacaga

SEQ ID NO: 6548690 - DNA, 16 bp, Homo sapiens
tgttacctgtcatttt

SEQ ID NO: 6548691 - DNA, 18 bp, Homo sapiens
tgttacctgtcattttgc

SEQ ID NO: 6548692 - DNA, 15 bp, Homo sapiens
tgttacctgtgtgct

SEQ ID NO: 6548693 - DNA, 14 bp, Homo sapiens
tgttaccttaaaac

SEQ ID NO: 6548694 - DNA, 22 bp, Homo sapiens
tgttaccttttaaaatagtaat

SEQ ID NO: 6548695 - DNA, 21 bp, Homo sapiens
tgttacgatatttcgtttggt

SEQ ID NO: 6548696 - DNA, 21 bp, Homo sapiens
tgttacggcatcacacttata

SEQ ID NO: 6548697 - DNA, 19 bp, Homo sapiens
tgttacgtttgaagtctga

SEQ ID NO: 6548698 - DNA, 17 bp, Homo sapiens
tgttactaaagaaaata

SEQ ID NO: 6548699 - DNA, 17 bp, Homo sapiens
tgttactaaattttcta

SEQ ID NO: 6548700 - DNA, 18 bp, Homo sapiens
tgttactaactaaactct

SEQ ID NO: 6548701 - DNA, 23 bp, Homo sapiens
tgttactaccttattttccccga

SEQ ID NO: 6548702 - DNA, 21 bp, Homo sapiens
tgttactagagttagatatgt

SEQ ID NO: 6548703 - DNA, 22 bp, Homo sapiens
tgttactagagttagatatgtg

SEQ ID NO: 6548704 - DNA, 12 bp, Homo sapiens
tgttactagcct

SEQ ID NO: 6548705 - DNA, 14 bp, Homo sapiens
tgttactagcctct

SEQ ID NO: 6548706 - DNA, 15 bp, Homo sapiens
tgttactagcctctc

SEQ ID NO: 6548707 - DNA, 15 bp, Homo sapiens
tgttactatctgctt

SEQ ID NO: 6548708 - DNA, 21 bp, Homo sapiens
tgttactatggtaacactttg

SEQ ID NO: 6548709 - DNA, 18 bp, Homo sapiens
tgttactattttctacaa

SEQ ID NO: 6548710 - DNA, 20 bp, Homo sapiens
tgttactattttctacaatt

SEQ ID NO: 6548711 - DNA, 18 bp, Homo sapiens
ttggaggagagagccttg

SEQ ID NO: 6548712 - DNA, 21 bp, Homo sapiens
ttggaggcaatcctaccttgc

SEQ ID NO: 6548713 - DNA, 18 bp, Homo sapiens
ttggaggcccctgggctc

SEQ ID NO: 6548714 - DNA, 13 bp, Homo sapiens
ttggaggcctcac

SEQ ID NO: 6548715 - DNA, 15 bp, Homo sapiens
ttggaggcctcaccc

SEQ ID NO: 6548716 - DNA, 20 bp, Homo sapiens
ttggaggccttccctggcct

SEQ ID NO: 6548717 - DNA, 17 bp, Homo sapiens
ttggaggcctttcatcc

SEQ ID NO: 6548718 - DNA, 12 bp, Homo sapiens
ttggaggctgca

SEQ ID NO: 6548719 - DNA, 17 bp, Homo sapiens
ttggagggaaagccagc

SEQ ID NO: 6548720 - DNA, 18 bp, Homo sapiens
ttggagggaaagccagcc

SEQ ID NO: 6548721 - DNA, 21 bp, Homo sapiens
ttggagggaaagccagcctgg

SEQ ID NO: 6548722 - DNA, 15 bp, Homo sapiens
ttggagggaagggag

SEQ ID NO: 6548723 - DNA, 15 bp, Homo sapiens
ttggagggatcattt

SEQ ID NO: 6548724 - DNA, 20 bp, Homo sapiens
ttggaggggaaatggggaaa

SEQ ID NO: 6548725 - DNA, 20 bp, Homo sapiens
ttggagggtctgggggcagc

SEQ ID NO: 6548726 - DNA, 16 bp, Homo sapiens
ttggaggtcacagctg

SEQ ID NO: 6548727 - DNA, 20 bp, Homo sapiens
ttggaggtcacagctggatc

SEQ ID NO: 6548728 - DNA, 18 bp, Homo sapiens
ttggaggtgcttaagcag

SEQ ID NO: 6548729 - DNA, 19 bp, Homo sapiens
ttggaggtgcttgatctat

SEQ ID NO: 6548730 - DNA, 12 bp, Homo sapiens
ttggagtaattg

SEQ ID NO: 6548731 - DNA, 17 bp, Homo sapiens
ttggagtagaatgtagt

SEQ ID NO: 6548732 - DNA, 23 bp, Homo sapiens
ttggagtcaaaaggcaaatcatt

SEQ ID NO: 6548733 - DNA, 15 bp, Homo sapiens
ttggagtcactgcca

SEQ ID NO: 6548734 - DNA, 15 bp, Homo sapiens
ttggagtcttccaaa

SEQ ID NO: 6548735 - DNA, 14 bp, Homo sapiens
ttggagtgagccag

SEQ ID NO: 6548736 - DNA, 15 bp, Homo sapiens
ttggagtgcatttga

SEQ ID NO: 6548737 - DNA, 14 bp, Homo sapiens
ttggagtgccacgt

SEQ ID NO: 6548738 - DNA, 23 bp, Homo sapiens
ttggagtgccacgtggccgctgc

SEQ ID NO: 6548739 - DNA, 13 bp, Homo sapiens
ttggagtgctctt

SEQ ID NO: 6548740 - DNA, 18 bp, Homo sapiens
ttggagtgctcttcccac

SEQ ID NO: 6548741 - DNA, 23 bp, Homo sapiens
ttggagtgctcttcccactccag

SEQ ID NO: 6548742 - DNA, 16 bp, Homo sapiens
ttggagtggaggcatt

SEQ ID NO: 6548743 - DNA, 21 bp, Homo sapiens
ttggagtgggttggcttgctg

SEQ ID NO: 6548744 - DNA, 19 bp, Homo sapiens
ttggagtgttccccttcca

SEQ ID NO: 6548745 - DNA, 22 bp, Homo sapiens
ttggagtgttccccttccactg

SEQ ID NO: 6548746 - DNA, 19 bp, Homo sapiens
ttggagttcattcatatta

SEQ ID NO: 6548747 - DNA, 22 bp, Homo sapiens
ttggagttcattcatattacaa

SEQ ID NO: 6548748 - DNA, 17 bp, Homo sapiens
ttggagttggagtagaa

SEQ ID NO: 6548749 - DNA, 15 bp, Homo sapiens
ttggagtttaggaat

SEQ ID NO: 6548750 - DNA, 15 bp, Homo sapiens
ttggagtttttctga

SEQ ID NO: 6548751 - DNA, 19 bp, Homo sapiens
ttggataaatcatttcagt

SEQ ID NO: 6548752 - DNA, 22 bp, Homo sapiens
ttggataacaccaccattcaca

SEQ ID NO: 6548753 - DNA, 22 bp, Homo sapiens
ttggataagtagggctaagcca

SEQ ID NO: 6548754 - DNA, 17 bp, Homo sapiens
ttggataataaaaattg

SEQ ID NO: 6548755 - DNA, 21 bp, Homo sapiens
ttggataataactagatctcc

SEQ ID NO: 6548756 - DNA, 15 bp, Homo sapiens
ttggataataaggaa

SEQ ID NO: 6548757 - DNA, 15 bp, Homo sapiens
ttggatacagctgct

SEQ ID NO: 6548758 - DNA, 19 bp, Homo sapiens
ttggatacatctgctgtgt

SEQ ID NO: 6548759 - DNA, 22 bp, Homo sapiens
ttggatacatctgctgtgtgga

SEQ ID NO: 6548760 - DNA, 23 bp, Homo sapiens
ttggatacatctgctgtgtggaa

SEQ ID NO: 6548761 - DNA, 16 bp, Homo sapiens
ttggataccccattaa

SEQ ID NO: 6548762 - DNA, 17 bp, Homo sapiens
ttggatagtcagctgta

SEQ ID NO: 6548763 - DNA, 15 bp, Homo sapiens
ttggatagtctccta

SEQ ID NO: 6548764 - DNA, 20 bp, Homo sapiens
ttggatatattattgtaagt

SEQ ID NO: 6548765 - DNA, 13 bp, Homo sapiens
ttggatccaagga

SEQ ID NO: 6548766 - DNA, 18 bp, Homo sapiens
ttggatcctactcaacaa

SEQ ID NO: 6548767 - DNA, 13 bp, Homo sapiens
ttggatcctgtgt

SEQ ID NO: 6548768 - DNA, 22 bp, Homo sapiens
ttggatcgtggaagaagggcca

SEQ ID NO: 6548769 - DNA, 17 bp, Homo sapiens
ttggatctatcacctgt

SEQ ID NO: 6548770 - DNA, 22 bp, Homo sapiens
ttggatctatcacctgtcatca

SEQ ID NO: 6548771 - DNA, 13 bp, Homo sapiens
ttggatctattta

SEQ ID NO: 6548772 - DNA, 13 bp, Homo sapiens
ttggatctggggt

SEQ ID NO: 6548773 - DNA, 19 bp, Homo sapiens
ttggatcttcaatggcttt

SEQ ID NO: 6548774 - DNA, 18 bp, Homo sapiens
ttggatgagttttgggaa

SEQ ID NO: 6548775 - DNA, 13 bp, Homo sapiens
ttggatgatacag

SEQ ID NO: 6548776 - DNA, 20 bp, Homo sapiens
ttggatgatacagtgttttt

SEQ ID NO: 6548777 - DNA, 23 bp, Homo sapiens
ttggatgattttttaagcagact

SEQ ID NO: 6548778 - DNA, 21 bp, Homo sapiens
ttggatgcatgagctattgct

SEQ ID NO: 6548779 - DNA, 16 bp, Homo sapiens
ttggatgcatttctat

SEQ ID NO: 6548780 - DNA, 14 bp, Homo sapiens
ttggatgggagtgg

SEQ ID NO: 6548781 - DNA, 21 bp, Homo sapiens
ttggatgggagtgggcacctc

SEQ ID NO: 6548782 - DNA, 18 bp, Homo sapiens
ttggatggtgaagtcaca

SEQ ID NO: 6548783 - DNA, 19 bp, Homo sapiens
ttggatggtgaagtcacat

SEQ ID NO: 6548784 - DNA, 22 bp, Homo sapiens
ttggatggtgttacatattata

SEQ ID NO: 6548785 - DNA, 15 bp, Homo sapiens
ttggatgtaatttag

SEQ ID NO: 6548786 - DNA, 11 bp, Homo sapiens
ttggatgtggg

SEQ ID NO: 6548787 - DNA, 14 bp, Homo sapiens
ttggatgttgctat

SEQ ID NO: 6548788 - DNA, 18 bp, Homo sapiens
ttggatgtttttagttct

SEQ ID NO: 6548789 - DNA, 23 bp, Homo sapiens
ttggattaaatacatatggatgt

SEQ ID NO: 6548790 - DNA, 15 bp, Homo sapiens
ttggattaaattagt

SEQ ID NO: 6548791 - DNA, 16 bp, Homo sapiens
ttggattagtgaacta

SEQ ID NO: 6548792 - DNA, 18 bp, Homo sapiens
ttggattatttaataaca

SEQ ID NO: 6548793 - DNA, 12 bp, Homo sapiens
ttggattatttt

SEQ ID NO: 6548794 - DNA, 15 bp, Homo sapiens
ttggattcaatttta

SEQ ID NO: 6548795 - DNA, 22 bp, Homo sapiens
ttggattcccttaaacaaaagt

SEQ ID NO: 6548796 - DNA, 20 bp, Homo sapiens
ttggattcctcacagccttg

SEQ ID NO: 6548797 - DNA, 17 bp, Homo sapiens
ttggattctaaatacat

SEQ ID NO: 6548798 - DNA, 17 bp, Homo sapiens
ttggattctgagagctg

SEQ ID NO: 6548799 - DNA, 22 bp, Homo sapiens
ttggattctttaaatatatatt

SEQ ID NO: 6548800 - DNA, 20 bp, Homo sapiens
ttggattggtaccagagcct

SEQ ID NO: 6548801 - DNA, 14 bp, Homo sapiens
ttggattgtccccg

SEQ ID NO: 6548802 - DNA, 15 bp, Homo sapiens
ttggatttctgtgaa

SEQ ID NO: 6548803 - DNA, 20 bp, Homo sapiens
ttggatttgaacttgctctt

SEQ ID NO: 6548804 - DNA, 14 bp, Homo sapiens
ttggatttgacatt

SEQ ID NO: 6548805 - DNA, 17 bp, Homo sapiens
ttggatttgcatttttg

SEQ ID NO: 6548806 - DNA, 13 bp, Homo sapiens
ttggatttgctgt

SEQ ID NO: 6548807 - DNA, 17 bp, Homo sapiens
ttggatttgtccaaaca

SEQ ID NO: 6548808 - DNA, 18 bp, Homo sapiens
ttggatttgtccaaacag

SEQ ID NO: 6548809 - DNA, 22 bp, Homo sapiens
ttggatttgtccaaacaggtgc

SEQ ID NO: 6548810 - DNA, 23 bp, Homo sapiens
ttggatttgtccaaacaggtgct

SEQ ID NO: 6548811 - DNA, 19 bp, Homo sapiens
ttggatttgtgtgtatgtg

SEQ ID NO: 6548812 - DNA, 14 bp, Homo sapiens
ttggatttgtttaa

SEQ ID NO: 6548813 - DNA, 18 bp, Homo sapiens
ttggattttatgttgaca

SEQ ID NO: 6548814 - DNA, 12 bp, Homo sapiens
ttggattttcac

SEQ ID NO: 6548815 - DNA, 17 bp, Homo sapiens
ttggcaaaaaggcagga

SEQ ID NO: 6548816 - DNA, 21 bp, Homo sapiens
ttggcaaacgagactttctcc

SEQ ID NO: 6548817 - DNA, 17 bp, Homo sapiens
ttggcaaacgggcttga

SEQ ID NO: 6548818 - DNA, 20 bp, Homo sapiens
ttggcaaactctccaccaca

SEQ ID NO: 6548819 - DNA, 21 bp, Homo sapiens
ttggcaaaggtccctgagctc

SEQ ID NO: 6548820 - DNA, 14 bp, Homo sapiens
ttggcaactttctt

SEQ ID NO: 6548821 - DNA, 15 bp, Homo sapiens
ttggcaagaacttgt

SEQ ID NO: 6548822 - DNA, 16 bp, Homo sapiens
ttggcaagaacttgtt

SEQ ID NO: 6548823 - DNA, 18 bp, Homo sapiens
ttggcaagaacttgttta

SEQ ID NO: 6548824 - DNA, 20 bp, Homo sapiens
ttggcaataaattttgaaaa

SEQ ID NO: 6548825 - DNA, 16 bp, Homo sapiens
ttggcaatattcctta

SEQ ID NO: 6548826 - DNA, 21 bp, Homo sapiens
ttggcaatgactcaaagtctg

SEQ ID NO: 6548827 - DNA, 15 bp, Homo sapiens
ttggcaatgctaatt

SEQ ID NO: 6548828 - DNA, 16 bp, Homo sapiens
ttggcaattcttcttc

SEQ ID NO: 6548829 - DNA, 20 bp, Homo sapiens
ttggcaatttcctggccctc

SEQ ID NO: 6548830 - DNA, 14 bp, Homo sapiens
ttggcaattttgtg

SEQ ID NO: 6548831 - DNA, 20 bp, Homo sapiens
ttggcacaatgtatacttca

SEQ ID NO: 6548832 - DNA, 15 bp, Homo sapiens
ttggcacagaaacac

SEQ ID NO: 6548833 - DNA, 23 bp, Homo sapiens
ttggcacagaaacacaatatttt

SEQ ID NO: 6548834 - DNA, 14 bp, Homo sapiens
ttggcacagaacag

SEQ ID NO: 6548835 - DNA, 20 bp, Homo sapiens
ttggcacatgccacctggca

SEQ ID NO: 6548836 - DNA, 17 bp, Homo sapiens
ttggcaccaataaagga

SEQ ID NO: 6548837 - DNA, 21 bp, Homo sapiens
ttggcaccaataaaggaggaa

SEQ ID NO: 6548838 - DNA, 18 bp, Homo sapiens
ttggcaccaccagggtgg

SEQ ID NO: 6548839 - DNA, 22 bp, Homo sapiens
ttggcaccccagctaccccttc

SEQ ID NO: 6548840 - DNA, 18 bp, Homo sapiens
ttggcacccccatgctgc

SEQ ID NO: 6548841 - DNA, 21 bp, Homo sapiens
ttggcacccccatgctgcctt

SEQ ID NO: 6548842 - DNA, 12 bp, Homo sapiens
ttggcacctgca

SEQ ID NO: 6548843 - DNA, 16 bp, Homo sapiens
ttggcaccttccccct

SEQ ID NO: 6548844 - DNA, 14 bp, Homo sapiens
ttggcactcacaga

SEQ ID NO: 6548845 - DNA, 15 bp, Homo sapiens
ttggcactgatgggc

SEQ ID NO: 6548846 - DNA, 22 bp, Homo sapiens
ttggcactgatgggcactggaa

SEQ ID NO: 6548847 - DNA, 22 bp, Homo sapiens
ttggcacttataggtaacgtga

SEQ ID NO: 6548848 - DNA, 18 bp, Homo sapiens
ttggcacttattgaatat

SEQ ID NO: 6548849 - DNA, 19 bp, Homo sapiens
ttggcacttgtatttaatt

SEQ ID NO: 6548850 - DNA, 16 bp, Homo sapiens
ttggcagaaaggatgt

SEQ ID NO: 6548851 - DNA, 18 bp, Homo sapiens
ttggcagagaaggcctct

SEQ ID NO: 6548852 - DNA, 23 bp, Homo sapiens
ttggcagagaccataagagaaac

SEQ ID NO: 6548853 - DNA, 13 bp, Homo sapiens
ttggcagagagat

SEQ ID NO: 6548854 - DNA, 22 bp, Homo sapiens
ttggcagatgcagctcttcctg

SEQ ID NO: 6548855 - DNA, 23 bp, Homo sapiens
ttggcagcacagctactcagatc

SEQ ID NO: 6548856 - DNA, 15 bp, Homo sapiens
ttggcagcacctgtc

SEQ ID NO: 6548857 - DNA, 14 bp, Homo sapiens
ttggcagcagattt

SEQ ID NO: 6548858 - DNA, 17 bp, Homo sapiens
ttggcagcccctgtttt

SEQ ID NO: 6548859 - DNA, 23 bp, Homo sapiens
ttggcagcccctgttttctgctg

SEQ ID NO: 6548860 - DNA, 13 bp, Homo sapiens
ttggcagccttgt

SEQ ID NO: 6548861 - DNA, 11 bp, Homo sapiens
ttggcagctga

SEQ ID NO: 6548862 - DNA, 19 bp, Homo sapiens
ttggcagcttaacattgac

SEQ ID NO: 6548863 - DNA, 16 bp, Homo sapiens
ttggcagcttcaaaac

SEQ ID NO: 6548864 - DNA, 17 bp, Homo sapiens
ttggcagcttcaaaaca

SEQ ID NO: 6548865 - DNA, 16 bp, Homo sapiens
ttggcaggagctcctg

SEQ ID NO: 6548866 - DNA, 17 bp, Homo sapiens
ttggcaggataagaaaa

SEQ ID NO: 6548867 - DNA, 22 bp, Homo sapiens
ttggcaggatcggcttcctcag

SEQ ID NO: 6548868 - DNA, 14 bp, Homo sapiens
ttggcaggcccact

SEQ ID NO: 6548869 - DNA, 15 bp, Homo sapiens
ttggcaggctgaggt

SEQ ID NO: 6548870 - DNA, 12 bp, Homo sapiens
ttggcaggctgg

SEQ ID NO: 6548871 - DNA, 21 bp, Homo sapiens
ttggcaggggtggaggagagc

SEQ ID NO: 6548872 - DNA, 20 bp, Homo sapiens
ttggcaggtaggaatattat

SEQ ID NO: 6548873 - DNA, 20 bp, Homo sapiens
ttggcagtgagtgagcctgg

SEQ ID NO: 6548874 - DNA, 12 bp, Homo sapiens
ttggcagtgttt

SEQ ID NO: 6548875 - DNA, 19 bp, Homo sapiens
ttggcagtgttttgagaac

SEQ ID NO: 6548876 - DNA, 17 bp, Homo sapiens
ttggcagttcctggcat

SEQ ID NO: 6548877 - DNA, 23 bp, Homo sapiens
ttggcataacataaatctgtgaa

SEQ ID NO: 6548878 - DNA, 16 bp, Homo sapiens
ttggcataatttgtct

SEQ ID NO: 6548879 - DNA, 21 bp, Homo sapiens
ttggcatcacagggcagagcc

SEQ ID NO: 6548880 - DNA, 15 bp, Homo sapiens
ttggcatcgaccaca

SEQ ID NO: 6548881 - DNA, 16 bp, Homo sapiens
ttggcatctgcaaagg

SEQ ID NO: 6548882 - DNA, 15 bp, Homo sapiens
ttggcatctgctttt

SEQ ID NO: 6548883 - DNA, 20 bp, Homo sapiens
ttggcatggaaatttaaagc

SEQ ID NO: 6548884 - DNA, 19 bp, Homo sapiens
ttggcatggatttctgtct

SEQ ID NO: 6548885 - DNA, 14 bp, Homo sapiens
ttggcatggcttta

SEQ ID NO: 6548886 - DNA, 23 bp, Homo sapiens
ttggcatggtggcacgtgcctgt

SEQ ID NO: 6548887 - DNA, 18 bp, Homo sapiens
ttggcatggttgttgcat

SEQ ID NO: 6548888 - DNA, 16 bp, Homo sapiens
ttggcatgtgtatgtt

SEQ ID NO: 6548889 - DNA, 22 bp, Homo sapiens
tgttactattttctacaattaa

SEQ ID NO: 6548890 - DNA, 20 bp, Homo sapiens
tgttactcagtgttagagaa

SEQ ID NO: 6548891 - DNA, 14 bp, Homo sapiens
tgttactcatcttt

SEQ ID NO: 6548892 - DNA, 17 bp, Homo sapiens
tgttactccaaaaagaa

SEQ ID NO: 6548893 - DNA, 24 bp, Homo sapiens
tgttactccattactgtgatttct

SEQ ID NO: 6548894 - DNA, 18 bp, Homo sapiens
tgttactccctgttattt

SEQ ID NO: 6548895 - DNA, 18 bp, Homo sapiens
tgttactccctgttttag

SEQ ID NO: 6548896 - DNA, 22 bp, Homo sapiens
tgttactctcttgcaccaaatt

SEQ ID NO: 6548897 - DNA, 15 bp, Homo sapiens
tgttactctggttct

SEQ ID NO: 6548898 - DNA, 15 bp, Homo sapiens
tgttactctgtccca

SEQ ID NO: 6548899 - DNA, 19 bp, Homo sapiens
tgttactcttaattttaaa

SEQ ID NO: 6548900 - DNA, 15 bp, Homo sapiens
tgttactgaagttat

SEQ ID NO: 6548901 - DNA, 17 bp, Homo sapiens
tgttactgactcctcag

SEQ ID NO: 6548902 - DNA, 17 bp, Homo sapiens
tgttactgagatgtctt

SEQ ID NO: 6548903 - DNA, 15 bp, Homo sapiens
tgttactgagatgtt

SEQ ID NO: 6548904 - DNA, 14 bp, Homo sapiens
tgttactgatcatg

SEQ ID NO: 6548905 - DNA, 21 bp, Homo sapiens
tgttactgattctcctgtcag

SEQ ID NO: 6548906 - DNA, 19 bp, Homo sapiens
tgttactgccttaataaaa

SEQ ID NO: 6548907 - DNA, 17 bp, Homo sapiens
tgttactgctgattctt

SEQ ID NO: 6548908 - DNA, 14 bp, Homo sapiens
tgttactgcttcat

SEQ ID NO: 6548909 - DNA, 13 bp, Homo sapiens
tgttactgcttct

SEQ ID NO: 6548910 - DNA, 19 bp, Homo sapiens
tgttactgcttctctttgt

SEQ ID NO: 6548911 - DNA, 16 bp, Homo sapiens
tgttactgctttgcaa

SEQ ID NO: 6548912 - DNA, 18 bp, Homo sapiens
tgttactgctttgcaaag

SEQ ID NO: 6548913 - DNA, 16 bp, Homo sapiens
tgttactggaaaaatt

SEQ ID NO: 6548914 - DNA, 20 bp, Homo sapiens
tgttactggataaattgttt

SEQ ID NO: 6548915 - DNA, 14 bp, Homo sapiens
tgttactgtatcct

SEQ ID NO: 6548916 - DNA, 15 bp, Homo sapiens
tgttactgtcttcag

SEQ ID NO: 6548917 - DNA, 12 bp, Homo sapiens
tgttactgttct

SEQ ID NO: 6548918 - DNA, 16 bp, Homo sapiens
tgttactgttcttgct

SEQ ID NO: 6548919 - DNA, 18 bp, Homo sapiens
tgttactgttcttgctgc

SEQ ID NO: 6548920 - DNA, 19 bp, Homo sapiens
tgttactgttcttgctgct

SEQ ID NO: 6548921 - DNA, 24 bp, Homo sapiens
tgttactgttcttgctgctagaac

SEQ ID NO: 6548922 - DNA, 18 bp, Homo sapiens
tgttacttaaacatcatt

SEQ ID NO: 6548923 - DNA, 21 bp, Homo sapiens
tgttacttaaacatcattgga

SEQ ID NO: 6548924 - DNA, 12 bp, Homo sapiens
tgttacttaaat

SEQ ID NO: 6548925 - DNA, 15 bp, Homo sapiens
tgttacttaaatagc

SEQ ID NO: 6548926 - DNA, 14 bp, Homo sapiens
tgttacttacctaa

SEQ ID NO: 6548927 - DNA, 18 bp, Homo sapiens
tgttacttacctaaacag

SEQ ID NO: 6548928 - DNA, 17 bp, Homo sapiens
tgttacttatgtagaaa

SEQ ID NO: 6548929 - DNA, 15 bp, Homo sapiens
tgttacttctctaat

SEQ ID NO: 6548930 - DNA, 16 bp, Homo sapiens
tgttacttctctgagt

SEQ ID NO: 6548931 - DNA, 14 bp, Homo sapiens
tgttacttgaagta

SEQ ID NO: 6548932 - DNA, 20 bp, Homo sapiens
tgttacttgaagtaactata

SEQ ID NO: 6548933 - DNA, 13 bp, Homo sapiens
tgttacttgagaa

SEQ ID NO: 6548934 - DNA, 14 bp, Homo sapiens
tgttacttgcaggt

SEQ ID NO: 6548935 - DNA, 19 bp, Homo sapiens
tgttacttgctttgagttg

SEQ ID NO: 6548936 - DNA, 23 bp, Homo sapiens
tgttactttaaaaatcagttttg

SEQ ID NO: 6548937 - DNA, 17 bp, Homo sapiens
tgttactttacttttgc

SEQ ID NO: 6548938 - DNA, 19 bp, Homo sapiens
tgttactttcactttttta

SEQ ID NO: 6548939 - DNA, 15 bp, Homo sapiens
tgttactttgaatag

SEQ ID NO: 6548940 - DNA, 13 bp, Homo sapiens
tgttactttggaa

SEQ ID NO: 6548941 - DNA, 23 bp, Homo sapiens
tgttactttggcaatttcctggc

SEQ ID NO: 6548942 - DNA, 12 bp, Homo sapiens
tgttagaaaagt

SEQ ID NO: 6548943 - DNA, 19 bp, Homo sapiens
tgttagaaaatggacactg

SEQ ID NO: 6548944 - DNA, 13 bp, Homo sapiens
tgttagaacacta

SEQ ID NO: 6548945 - DNA, 14 bp, Homo sapiens
tgttagaacactat

SEQ ID NO: 6548946 - DNA, 19 bp, Homo sapiens
tgttagaacactattttca

SEQ ID NO: 6548947 - DNA, 23 bp, Homo sapiens
tgttagaacactattttcagaat

SEQ ID NO: 6548948 - DNA, 16 bp, Homo sapiens
tgttagaatatgttga

SEQ ID NO: 6548949 - DNA, 13 bp, Homo sapiens
tgttagaatgtaa

SEQ ID NO: 6548950 - DNA, 17 bp, Homo sapiens
tgttagacttgtgtgca

SEQ ID NO: 6548951 - DNA, 13 bp, Homo sapiens
tgttagagacttt

SEQ ID NO: 6548952 - DNA, 21 bp, Homo sapiens
tgttagaggttttaaagtgat

SEQ ID NO: 6548953 - DNA, 16 bp, Homo sapiens
tgttagatattgctac

SEQ ID NO: 6548954 - DNA, 12 bp, Homo sapiens
tgttagatgctg

SEQ ID NO: 6548955 - DNA, 22 bp, Homo sapiens
tgttagatgctgaatatctgtt

SEQ ID NO: 6548956 - DNA, 17 bp, Homo sapiens
tgttagatgtttgttga

SEQ ID NO: 6548957 - DNA, 15 bp, Homo sapiens
tgttagcaaagatta

SEQ ID NO: 6548958 - DNA, 17 bp, Homo sapiens
tgttagcacattgataa

SEQ ID NO: 6548959 - DNA, 22 bp, Homo sapiens
tgttagcactgatagtcctttt

SEQ ID NO: 6548960 - DNA, 12 bp, Homo sapiens
tgttagcactgt

SEQ ID NO: 6548961 - DNA, 13 bp, Homo sapiens
tgttagcactgtt

SEQ ID NO: 6548962 - DNA, 14 bp, Homo sapiens
tgttagcactgttg

SEQ ID NO: 6548963 - DNA, 15 bp, Homo sapiens
tgttagcactgttga

SEQ ID NO: 6548964 - DNA, 20 bp, Homo sapiens
tgttagcactgttgatgtat

SEQ ID NO: 6548965 - DNA, 21 bp, Homo sapiens
tgttagcatgctggtgagcca

SEQ ID NO: 6548966 - DNA, 18 bp, Homo sapiens
tgttagccacggaaacat

SEQ ID NO: 6548967 - DNA, 21 bp, Homo sapiens
tgttagcccaaggttaaaaag

SEQ ID NO: 6548968 - DNA, 20 bp, Homo sapiens
tgttagcctgcaaacaacat

SEQ ID NO: 6548969 - DNA, 13 bp, Homo sapiens
tgttagccttaga

SEQ ID NO: 6548970 - DNA, 21 bp, Homo sapiens
tgttagccttttttccccaga

SEQ ID NO: 6548971 - DNA, 19 bp, Homo sapiens
tgttagctacacagtgcag

SEQ ID NO: 6548972 - DNA, 24 bp, Homo sapiens
tgttagctcagaggagaggagcaa

SEQ ID NO: 6548973 - DNA, 18 bp, Homo sapiens
tgttagctccaaagcatt

SEQ ID NO: 6548974 - DNA, 17 bp, Homo sapiens
tgttagctcctcactgt

SEQ ID NO: 6548975 - DNA, 18 bp, Homo sapiens
tgttagctcctcactgtg

SEQ ID NO: 6548976 - DNA, 14 bp, Homo sapiens
tgttagctgttatt

SEQ ID NO: 6548977 - DNA, 20 bp, Homo sapiens
tgttagctttccaaggaagc

SEQ ID NO: 6548978 - DNA, 20 bp, Homo sapiens
tgttagctttttaaaacatt

SEQ ID NO: 6548979 - DNA, 23 bp, Homo sapiens
tgttaggaacagcagtgttctca

SEQ ID NO: 6548980 - DNA, 20 bp, Homo sapiens
tgttaggatcaatgataaat

SEQ ID NO: 6548981 - DNA, 16 bp, Homo sapiens
tgttaggcctggcaca

SEQ ID NO: 6548982 - DNA, 21 bp, Homo sapiens
tgttaggcctggcacagtgtc

SEQ ID NO: 6548983 - DNA, 18 bp, Homo sapiens
tgttaggcttttctgcct

SEQ ID NO: 6548984 - DNA, 21 bp, Homo sapiens
tgttagggacatttccaagct

SEQ ID NO: 6548985 - DNA, 19 bp, Homo sapiens
tgttagggctgcttttctt

SEQ ID NO: 6548986 - DNA, 12 bp, Homo sapiens
tgttaggggaaa

SEQ ID NO: 6548987 - DNA, 21 bp, Homo sapiens
tgttagggtcagccattttta

SEQ ID NO: 6548988 - DNA, 19 bp, Homo sapiens
tgttagggttatgttttta

SEQ ID NO: 6548989 - DNA, 18 bp, Homo sapiens
tgttaggtccattttcta

SEQ ID NO: 6548990 - DNA, 19 bp, Homo sapiens
tgttaggtctcatgcccac

SEQ ID NO: 6548991 - DNA, 21 bp, Homo sapiens
tgttaggttttctatgtgact

SEQ ID NO: 6548992 - DNA, 13 bp, Homo sapiens
tgttagtaaagga

SEQ ID NO: 6548993 - DNA, 13 bp, Homo sapiens
tgttagtaacatg

SEQ ID NO: 6548994 - DNA, 18 bp, Homo sapiens
tgttagtaatggcagagc

SEQ ID NO: 6548995 - DNA, 20 bp, Homo sapiens
tgttagtagaaattttacaa

SEQ ID NO: 6548996 - DNA, 19 bp, Homo sapiens
tgttagtataagcttttca

SEQ ID NO: 6548997 - DNA, 20 bp, Homo sapiens
tgttagtatgaggcatttgt

SEQ ID NO: 6548998 - DNA, 21 bp, Homo sapiens
tgttagtcttaccgaataagg

SEQ ID NO: 6548999 - DNA, 17 bp, Homo sapiens
tgttagtgctggtcaga

SEQ ID NO: 6549000 - DNA, 13 bp, Homo sapiens
tgttagtggaaaa

SEQ ID NO: 6549001 - DNA, 17 bp, Homo sapiens
tgttagtgggaagagct

SEQ ID NO: 6549002 - DNA, 18 bp, Homo sapiens
tgttagtgggaagagctg

SEQ ID NO: 6549003 - DNA, 19 bp, Homo sapiens
tgttagtgggaagagctgg

SEQ ID NO: 6549004 - DNA, 16 bp, Homo sapiens
tgttagtgtgtgtgca

SEQ ID NO: 6549005 - DNA, 17 bp, Homo sapiens
tgttagtgtgtgtgcat

SEQ ID NO: 6549006 - DNA, 14 bp, Homo sapiens
tgttagttataaaa

SEQ ID NO: 6549007 - DNA, 21 bp, Homo sapiens
tgttagttattttaggagaca

SEQ ID NO: 6549008 - DNA, 14 bp, Homo sapiens
tgttagttcctgta

SEQ ID NO: 6549009 - DNA, 20 bp, Homo sapiens
tgttagttctagctctattt

SEQ ID NO: 6549010 - DNA, 15 bp, Homo sapiens
tgttagtttacaata

SEQ ID NO: 6549011 - DNA, 21 bp, Homo sapiens
tgttagtttagtgtgtgtgca

SEQ ID NO: 6549012 - DNA, 23 bp, Homo sapiens
tgttagtttctgagttttaccaa

SEQ ID NO: 6549013 - DNA, 17 bp, Homo sapiens
tgttataaaatctgtat

SEQ ID NO: 6549014 - DNA, 13 bp, Homo sapiens
tgttataaagaca

SEQ ID NO: 6549015 - DNA, 12 bp, Homo sapiens
tgttataaagta

SEQ ID NO: 6549016 - DNA, 15 bp, Homo sapiens
tgttataaataaaat

SEQ ID NO: 6549017 - DNA, 23 bp, Homo sapiens
tgttataaatttatcaactgtca

SEQ ID NO: 6549018 - DNA, 15 bp, Homo sapiens
tgttataaattttgt

SEQ ID NO: 6549019 - DNA, 14 bp, Homo sapiens
tgttataactctgc

SEQ ID NO: 6549020 - DNA, 17 bp, Homo sapiens
tgttataactctgcact

SEQ ID NO: 6549021 - DNA, 12 bp, Homo sapiens
tgttataatctt

SEQ ID NO: 6549022 - DNA, 13 bp, Homo sapiens
tgttataattaga

SEQ ID NO: 6549023 - DNA, 20 bp, Homo sapiens
tgttatacatcaatatgtat

SEQ ID NO: 6549024 - DNA, 13 bp, Homo sapiens
tgttatacttcaa

SEQ ID NO: 6549025 - DNA, 20 bp, Homo sapiens
tgttatagattgtcttaatg

SEQ ID NO: 6549026 - DNA, 18 bp, Homo sapiens
tgttatagatttagctat

SEQ ID NO: 6549027 - DNA, 16 bp, Homo sapiens
tgttatataatcatta

SEQ ID NO: 6549028 - DNA, 15 bp, Homo sapiens
tgttatatataaata

SEQ ID NO: 6549029 - DNA, 13 bp, Homo sapiens
tgttatatataat

SEQ ID NO: 6549030 - DNA, 21 bp, Homo sapiens
tgttatatatctcttttggtc

SEQ ID NO: 6549031 - DNA, 15 bp, Homo sapiens
tgttatattaaagaa

SEQ ID NO: 6549032 - DNA, 20 bp, Homo sapiens
tgttatattccaaggaaaat

SEQ ID NO: 6549033 - DNA, 17 bp, Homo sapiens
tgttatattgcttcctg

SEQ ID NO: 6549034 - DNA, 13 bp, Homo sapiens
tgttatatttcat

SEQ ID NO: 6549035 - DNA, 18 bp, Homo sapiens
tgttatatttttcttaaa

SEQ ID NO: 6549036 - DNA, 13 bp, Homo sapiens
tgttatcaaaata

SEQ ID NO: 6549037 - DNA, 17 bp, Homo sapiens
tgttatcaaccaactgc

SEQ ID NO: 6549038 - DNA, 21 bp, Homo sapiens
tgttatcaccttccaaacaaa

SEQ ID NO: 6549039 - DNA, 19 bp, Homo sapiens
tgttatcagctgggcagtg

SEQ ID NO: 6549040 - DNA, 23 bp, Homo sapiens
tgttatcagctgggcagtgccag

SEQ ID NO: 6549041 - DNA, 18 bp, Homo sapiens
tgttatcagtaatgctaa

SEQ ID NO: 6549042 - DNA, 22 bp, Homo sapiens
tgttatcagtacaattctttgt

SEQ ID NO: 6549043 - DNA, 21 bp, Homo sapiens
tgttatcatattggtgctgag

SEQ ID NO: 6549044 - DNA, 16 bp, Homo sapiens
tgttatcatcctccct

SEQ ID NO: 6549045 - DNA, 20 bp, Homo sapiens
tgttatcattcttataacat

SEQ ID NO: 6549046 - DNA, 14 bp, Homo sapiens
tgttatccacaagc

SEQ ID NO: 6549047 - DNA, 21 bp, Homo sapiens
tgttatcccaagaccctgccc

SEQ ID NO: 6549048 - DNA, 16 bp, Homo sapiens
tgttatccttgttcct

SEQ ID NO: 6549049 - DNA, 18 bp, Homo sapiens
tgttatcggattactgaa

SEQ ID NO: 6549050 - DNA, 16 bp, Homo sapiens
tgttatcttctcaagt

SEQ ID NO: 6549051 - DNA, 23 bp, Homo sapiens
tgttatcttctcaagttctaaga

SEQ ID NO: 6549052 - DNA, 15 bp, Homo sapiens
tgttatcttgtgtat

SEQ ID NO: 6549053 - DNA, 19 bp, Homo sapiens
tgttatcttgtgtatggat

SEQ ID NO: 6549054 - DNA, 13 bp, Homo sapiens
tgttatgaaaacc

SEQ ID NO: 6549055 - DNA, 13 bp, Homo sapiens
tgttatgaacagc

SEQ ID NO: 6549056 - DNA, 14 bp, Homo sapiens
tgttatgaacagct

SEQ ID NO: 6549057 - DNA, 15 bp, Homo sapiens
tgttatgaacagctg

SEQ ID NO: 6549058 - DNA, 16 bp, Homo sapiens
tgttatgaacagctgt

SEQ ID NO: 6549059 - DNA, 24 bp, Homo sapiens
tgttatgaacagctgtgtctgcca

SEQ ID NO: 6549060 - DNA, 13 bp, Homo sapiens
tgttatgaacatc

SEQ ID NO: 6549061 - DNA, 17 bp, Homo sapiens
tgttatgactccagaat

SEQ ID NO: 6549062 - DNA, 13 bp, Homo sapiens
tgttatgactcct

SEQ ID NO: 6549063 - DNA, 21 bp, Homo sapiens
tgttatgaggatataatgtgt

SEQ ID NO: 6549064 - DNA, 19 bp, Homo sapiens
tgttatgataaaaaatttt

SEQ ID NO: 6549065 - DNA, 15 bp, Homo sapiens
tgttatgatattgtt

SEQ ID NO: 6549066 - DNA, 15 bp, Homo sapiens
tgttatgatctactc

SEQ ID NO: 6549067 - DNA, 16 bp, Homo sapiens
tgttatgatgtgctta

SEQ ID NO: 6549068 - DNA, 13 bp, Homo sapiens
ttggcattatctc

SEQ ID NO: 6549069 - DNA, 23 bp, Homo sapiens
ttggcattcaaccacgcaggaag

SEQ ID NO: 6549070 - DNA, 13 bp, Homo sapiens
ttggcattcccca

SEQ ID NO: 6549071 - DNA, 16 bp, Homo sapiens
ttggcattgatcttaa

SEQ ID NO: 6549072 - DNA, 14 bp, Homo sapiens
ttggcattgctgca

SEQ ID NO: 6549073 - DNA, 15 bp, Homo sapiens
ttggcattgctgcat

SEQ ID NO: 6549074 - DNA, 11 bp, Homo sapiens
ttggcatttct

SEQ ID NO: 6549075 - DNA, 14 bp, Homo sapiens
ttggcatttctata

SEQ ID NO: 6549076 - DNA, 18 bp, Homo sapiens
ttggcatttgctggcctg

SEQ ID NO: 6549077 - DNA, 21 bp, Homo sapiens
ttggcatttgttatcctcttg

SEQ ID NO: 6549078 - DNA, 20 bp, Homo sapiens
ttggcattttggctcagagt

SEQ ID NO: 6549079 - DNA, 20 bp, Homo sapiens
ttggccaaacatcagacctg

SEQ ID NO: 6549080 - DNA, 20 bp, Homo sapiens
ttggccaccaggtgcctttc

SEQ ID NO: 6549081 - DNA, 17 bp, Homo sapiens
ttggccacggcctggga

SEQ ID NO: 6549082 - DNA, 14 bp, Homo sapiens
ttggccactccgag

SEQ ID NO: 6549083 - DNA, 20 bp, Homo sapiens
ttggccactgggtctcactc

SEQ ID NO: 6549084 - DNA, 23 bp, Homo sapiens
ttggccagaggaaatctgaatgt

SEQ ID NO: 6549085 - DNA, 20 bp, Homo sapiens
ttggccagagggcccctcac

SEQ ID NO: 6549086 - DNA, 22 bp, Homo sapiens
ttggccaggaggttcccccgac

SEQ ID NO: 6549087 - DNA, 12 bp, Homo sapiens
ttggccaggctg

SEQ ID NO: 6549088 - DNA, 15 bp, Homo sapiens
ttggccaggctggtt

SEQ ID NO: 6549089 - DNA, 14 bp, Homo sapiens
ttggccagggaggc

SEQ ID NO: 6549090 - DNA, 17 bp, Homo sapiens
ttggccagtgagaagct

SEQ ID NO: 6549091 - DNA, 20 bp, Homo sapiens
ttggccagtgagaagctgag

SEQ ID NO: 6549092 - DNA, 18 bp, Homo sapiens
ttggccatatttacctca

SEQ ID NO: 6549093 - DNA, 19 bp, Homo sapiens
ttggccatatttacctcag

SEQ ID NO: 6549094 - DNA, 16 bp, Homo sapiens
ttggccatctctggat

SEQ ID NO: 6549095 - DNA, 20 bp, Homo sapiens
ttggccatgatgtccttgga

SEQ ID NO: 6549096 - DNA, 13 bp, Homo sapiens
ttggccatgcaga

SEQ ID NO: 6549097 - DNA, 19 bp, Homo sapiens
ttggccatgcagaaagcat

SEQ ID NO: 6549098 - DNA, 23 bp, Homo sapiens
ttggccatgtattatgaaaaaga

SEQ ID NO: 6549099 - DNA, 21 bp, Homo sapiens
ttggccatttatgctgacatg

SEQ ID NO: 6549100 - DNA, 11 bp, Homo sapiens
ttggcccagag

SEQ ID NO: 6549101 - DNA, 12 bp, Homo sapiens
ttggcccagaga

SEQ ID NO: 6549102 - DNA, 11 bp, Homo sapiens
ttggcccagca

SEQ ID NO: 6549103 - DNA, 12 bp, Homo sapiens
ttggcccaggaa

SEQ ID NO: 6549104 - DNA, 23 bp, Homo sapiens
ttggcccaggagctctgcgccag

SEQ ID NO: 6549105 - DNA, 22 bp, Homo sapiens
ttggcccaggagtttggccaga

SEQ ID NO: 6549106 - DNA, 20 bp, Homo sapiens
ttggcccaggattattgtca

SEQ ID NO: 6549107 - DNA, 16 bp, Homo sapiens
ttggccccactttgaa

SEQ ID NO: 6549108 - DNA, 17 bp, Homo sapiens
ttggccccactttgaag

SEQ ID NO: 6549109 - DNA, 20 bp, Homo sapiens
ttggccccactttgaagggc

SEQ ID NO: 6549110 - DNA, 23 bp, Homo sapiens
ttggcccccaaagatagacaggt

SEQ ID NO: 6549111 - DNA, 19 bp, Homo sapiens
ttggcccccgagctggggg

SEQ ID NO: 6549112 - DNA, 19 bp, Homo sapiens
ttggcccccttcaggagcc

SEQ ID NO: 6549113 - DNA, 22 bp, Homo sapiens
ttggcccccttcaggagcctgg

SEQ ID NO: 6549114 - DNA, 18 bp, Homo sapiens
ttggccctcagtgggctc

SEQ ID NO: 6549115 - DNA, 17 bp, Homo sapiens
ttggccctcctcagctc

SEQ ID NO: 6549116 - DNA, 20 bp, Homo sapiens
ttggccctcctcagctccct

SEQ ID NO: 6549117 - DNA, 21 bp, Homo sapiens
ttggccctcttgcgggcctgg

SEQ ID NO: 6549118 - DNA, 12 bp, Homo sapiens
ttggccctgccc

SEQ ID NO: 6549119 - DNA, 19 bp, Homo sapiens
ttggccctgcccctccccc

SEQ ID NO: 6549120 - DNA, 15 bp, Homo sapiens
ttggccctggagcca

SEQ ID NO: 6549121 - DNA, 22 bp, Homo sapiens
ttggccctggagccagggcaga

SEQ ID NO: 6549122 - DNA, 14 bp, Homo sapiens
ttggccctttcctt

SEQ ID NO: 6549123 - DNA, 14 bp, Homo sapiens
ttggccgagctcct

SEQ ID NO: 6549124 - DNA, 16 bp, Homo sapiens
ttggccgagctcctgg

SEQ ID NO: 6549125 - DNA, 20 bp, Homo sapiens
ttggccgagtcagcacgtag

SEQ ID NO: 6549126 - DNA, 16 bp, Homo sapiens
ttggccgatgagctgg

SEQ ID NO: 6549127 - DNA, 19 bp, Homo sapiens
ttggccgattagaaggcag

SEQ ID NO: 6549128 - DNA, 23 bp, Homo sapiens
ttggccgtggccatcagggtggg

SEQ ID NO: 6549129 - DNA, 15 bp, Homo sapiens
ttggcctacattctt

SEQ ID NO: 6549130 - DNA, 13 bp, Homo sapiens
ttggcctatttca

SEQ ID NO: 6549131 - DNA, 13 bp, Homo sapiens
ttggcctcagagg

SEQ ID NO: 6549132 - DNA, 12 bp, Homo sapiens
ttggcctcagca

SEQ ID NO: 6549133 - DNA, 13 bp, Homo sapiens
ttggcctcagcag

SEQ ID NO: 6549134 - DNA, 16 bp, Homo sapiens
ttggcctcagctggct

SEQ ID NO: 6549135 - DNA, 19 bp, Homo sapiens
ttggcctcagggccaggaa

SEQ ID NO: 6549136 - DNA, 17 bp, Homo sapiens
ttggcctccatttctgt

SEQ ID NO: 6549137 - DNA, 18 bp, Homo sapiens
ttggcctcccaaaagact

SEQ ID NO: 6549138 - DNA, 17 bp, Homo sapiens
ttggcctcccctgctga

SEQ ID NO: 6549139 - DNA, 19 bp, Homo sapiens
ttggcctccggcctcccct

SEQ ID NO: 6549140 - DNA, 16 bp, Homo sapiens
ttggcctcctgcaaag

SEQ ID NO: 6549141 - DNA, 16 bp, Homo sapiens
ttggcctcgcctgggc

SEQ ID NO: 6549142 - DNA, 14 bp, Homo sapiens
ttggcctctctgta

SEQ ID NO: 6549143 - DNA, 22 bp, Homo sapiens
ttggcctctgcaaaggaaatac

SEQ ID NO: 6549144 - DNA, 13 bp, Homo sapiens
ttggcctctgccc

SEQ ID NO: 6549145 - DNA, 20 bp, Homo sapiens
ttggcctcttgtagtcttgg

SEQ ID NO: 6549146 - DNA, 21 bp, Homo sapiens
ttggcctgcctcccagccctg

SEQ ID NO: 6549147 - DNA, 12 bp, Homo sapiens
ttggcctggaga

SEQ ID NO: 6549148 - DNA, 16 bp, Homo sapiens
ttggcctggaggtggg

SEQ ID NO: 6549149 - DNA, 12 bp, Homo sapiens
ttggcctgggcc

SEQ ID NO: 6549150 - DNA, 12 bp, Homo sapiens
ttggcctggggg

SEQ ID NO: 6549151 - DNA, 22 bp, Homo sapiens
ttggcctggggtgcatctcctc

SEQ ID NO: 6549152 - DNA, 19 bp, Homo sapiens
ttggcctgtagagttgctg

SEQ ID NO: 6549153 - DNA, 17 bp, Homo sapiens
ttggcctgtcagagctt

SEQ ID NO: 6549154 - DNA, 23 bp, Homo sapiens
ttggcctgtccacctgtgctgct

SEQ ID NO: 6549155 - DNA, 22 bp, Homo sapiens
ttggcctgtctcatccccaggg

SEQ ID NO: 6549156 - DNA, 23 bp, Homo sapiens
ttggcctgtctttggattgttaa

SEQ ID NO: 6549157 - DNA, 16 bp, Homo sapiens
ttggcctgtgggcctc

SEQ ID NO: 6549158 - DNA, 12 bp, Homo sapiens
ttggcctgtgtc

SEQ ID NO: 6549159 - DNA, 18 bp, Homo sapiens
ttggccttaactggccct

SEQ ID NO: 6549160 - DNA, 21 bp, Homo sapiens
ttggccttcgattttaaatat

SEQ ID NO: 6549161 - DNA, 14 bp, Homo sapiens
ttggccttgcagct

SEQ ID NO: 6549162 - DNA, 13 bp, Homo sapiens
ttggccttgggcc

SEQ ID NO: 6549163 - DNA, 21 bp, Homo sapiens
ttggccttggggccagactgg

SEQ ID NO: 6549164 - DNA, 13 bp, Homo sapiens
ttggcctttcctt

SEQ ID NO: 6549165 - DNA, 14 bp, Homo sapiens
ttggcctttccttg

SEQ ID NO: 6549166 - DNA, 15 bp, Homo sapiens
ttggcctttgtaaga

SEQ ID NO: 6549167 - DNA, 21 bp, Homo sapiens
ttggccttttgtacaaagatt

SEQ ID NO: 6549168 - DNA, 21 bp, Homo sapiens
ttggcgccccatgggccctca

SEQ ID NO: 6549169 - DNA, 17 bp, Homo sapiens
ttggcgctctcagcttt

SEQ ID NO: 6549170 - DNA, 23 bp, Homo sapiens
ttggcgctgcccctggcagcccc

SEQ ID NO: 6549171 - DNA, 20 bp, Homo sapiens
ttggcgggcagcccagcctc

SEQ ID NO: 6549172 - DNA, 19 bp, Homo sapiens
ttggcgtagcagagttaaa

SEQ ID NO: 6549173 - DNA, 18 bp, Homo sapiens
ttggcgtaggctacagag

SEQ ID NO: 6549174 - DNA, 21 bp, Homo sapiens
ttggcgtaggctacagagaag

SEQ ID NO: 6549175 - DNA, 23 bp, Homo sapiens
ttggcgtaggctacagagaagcc

SEQ ID NO: 6549176 - DNA, 21 bp, Homo sapiens
ttggctacgttttggttctat

SEQ ID NO: 6549177 - DNA, 16 bp, Homo sapiens
ttggctagaagaaagt

SEQ ID NO: 6549178 - DNA, 18 bp, Homo sapiens
ttggctagaggttcaaag

SEQ ID NO: 6549179 - DNA, 22 bp, Homo sapiens
ttggctaggacccctccatgtg

SEQ ID NO: 6549180 - DNA, 20 bp, Homo sapiens
ttggctatgatggtgacatg

SEQ ID NO: 6549181 - DNA, 19 bp, Homo sapiens
ttggctattgaagatgctg

SEQ ID NO: 6549182 - DNA, 17 bp, Homo sapiens
ttggctatttaaaactt

SEQ ID NO: 6549183 - DNA, 17 bp, Homo sapiens
ttggctatttctgtgtc

SEQ ID NO: 6549184 - DNA, 22 bp, Homo sapiens
ttggctatttgaaatactaaaa

SEQ ID NO: 6549185 - DNA, 14 bp, Homo sapiens
ttggctcaatcctc

SEQ ID NO: 6549186 - DNA, 17 bp, Homo sapiens
ttggctcactgcagcct

SEQ ID NO: 6549187 - DNA, 14 bp, Homo sapiens
ttggctcagagtcc

SEQ ID NO: 6549188 - DNA, 12 bp, Homo sapiens
ttggctcaggca

SEQ ID NO: 6549189 - DNA, 20 bp, Homo sapiens
ttggctcaggcagacaagag

SEQ ID NO: 6549190 - DNA, 21 bp, Homo sapiens
ttggctcccaagtcacaccca

SEQ ID NO: 6549191 - DNA, 22 bp, Homo sapiens
ttggctcccatcttttgttact

SEQ ID NO: 6549192 - DNA, 14 bp, Homo sapiens
ttggctcctgagaa

SEQ ID NO: 6549193 - DNA, 22 bp, Homo sapiens
ttggctcctgcccactgatagc

SEQ ID NO: 6549194 - DNA, 19 bp, Homo sapiens
ttggctcctttcccacagt

SEQ ID NO: 6549195 - DNA, 18 bp, Homo sapiens
ttggctcgggacttcaaa

SEQ ID NO: 6549196 - DNA, 16 bp, Homo sapiens
ttggctctcccacccc

SEQ ID NO: 6549197 - DNA, 19 bp, Homo sapiens
ttggctctcctctggctag

SEQ ID NO: 6549198 - DNA, 13 bp, Homo sapiens
ttggctctgccag

SEQ ID NO: 6549199 - DNA, 19 bp, Homo sapiens
ttggctctgccagtcctgt

SEQ ID NO: 6549200 - DNA, 23 bp, Homo sapiens
ttggctctgccagtcctgtcctt

SEQ ID NO: 6549201 - DNA, 14 bp, Homo sapiens
ttggctctggagac

SEQ ID NO: 6549202 - DNA, 17 bp, Homo sapiens
ttggctctggagacagc

SEQ ID NO: 6549203 - DNA, 16 bp, Homo sapiens
ttggctctgttgctgt

SEQ ID NO: 6549204 - DNA, 19 bp, Homo sapiens
ttggctgaaattctcctgg

SEQ ID NO: 6549205 - DNA, 22 bp, Homo sapiens
ttggctgaaattctcctggagg

SEQ ID NO: 6549206 - DNA, 15 bp, Homo sapiens
ttggctgaaattctt

SEQ ID NO: 6549207 - DNA, 16 bp, Homo sapiens
ttggctgaattaaaat

SEQ ID NO: 6549208 - DNA, 14 bp, Homo sapiens
ttggctgacccctc

SEQ ID NO: 6549209 - DNA, 18 bp, Homo sapiens
ttggctgacccctctggt

SEQ ID NO: 6549210 - DNA, 21 bp, Homo sapiens
ttggctgacccctctggtgtg

SEQ ID NO: 6549211 - DNA, 22 bp, Homo sapiens
ttggctgacccctctggtgtgt

SEQ ID NO: 6549212 - DNA, 18 bp, Homo sapiens
ttggctgacttcatctgg

SEQ ID NO: 6549213 - DNA, 16 bp, Homo sapiens
ttggctgagccccctc

SEQ ID NO: 6549214 - DNA, 12 bp, Homo sapiens
ttggctgagggg

SEQ ID NO: 6549215 - DNA, 19 bp, Homo sapiens
ttggctgagtactggaata

SEQ ID NO: 6549216 - DNA, 14 bp, Homo sapiens
ttggctgcagggag

SEQ ID NO: 6549217 - DNA, 19 bp, Homo sapiens
ttggctgccccacaggcca

SEQ ID NO: 6549218 - DNA, 24 bp, Homo sapiens
ttggctgccccattccagctctcc

SEQ ID NO: 6549219 - DNA, 17 bp, Homo sapiens
ttggctgccgtctggcc

SEQ ID NO: 6549220 - DNA, 19 bp, Homo sapiens
ttggctgcgctaaccccca

SEQ ID NO: 6549221 - DNA, 12 bp, Homo sapiens
ttggctgctcag

SEQ ID NO: 6549222 - DNA, 13 bp, Homo sapiens
ttggctgctgcca

SEQ ID NO: 6549223 - DNA, 21 bp, Homo sapiens
ttggctgctgcggctgtgggc

SEQ ID NO: 6549224 - DNA, 20 bp, Homo sapiens
ttggctgcttaaactggaaa

SEQ ID NO: 6549225 - DNA, 15 bp, Homo sapiens
ttggctgcttcctgt

SEQ ID NO: 6549226 - DNA, 16 bp, Homo sapiens
ttggctgcttggcctt

SEQ ID NO: 6549227 - DNA, 12 bp, Homo sapiens
ttggctggaccc

SEQ ID NO: 6549228 - DNA, 20 bp, Homo sapiens
ttggctggatgaaattttct

SEQ ID NO: 6549229 - DNA, 23 bp, Homo sapiens
ttggctggatgaaattttctaga

SEQ ID NO: 6549230 - DNA, 11 bp, Homo sapiens
ttggctgggcc

SEQ ID NO: 6549231 - DNA, 16 bp, Homo sapiens
ttggctggtagcagca

SEQ ID NO: 6549232 - DNA, 23 bp, Homo sapiens
ttggctggtagcagcaggctcag

SEQ ID NO: 6549233 - DNA, 20 bp, Homo sapiens
ttggctggtgtggtacagag

SEQ ID NO: 6549234 - DNA, 23 bp, Homo sapiens
ttggctggtgtggtacagagaag

SEQ ID NO: 6549235 - DNA, 17 bp, Homo sapiens
ttggctggttaatggga

SEQ ID NO: 6549236 - DNA, 20 bp, Homo sapiens
ttggctggttaattccataa

SEQ ID NO: 6549237 - DNA, 18 bp, Homo sapiens
ttggctgtaatgtaacag

SEQ ID NO: 6549238 - DNA, 15 bp, Homo sapiens
ttggctgtaatttaa

SEQ ID NO: 6549239 - DNA, 15 bp, Homo sapiens
ttggctgtctgacca

SEQ ID NO: 6549240 - DNA, 19 bp, Homo sapiens
ttggctgtgacctcttcaa

SEQ ID NO: 6549241 - DNA, 22 bp, Homo sapiens
ttggctgtgctgtattttgata

SEQ ID NO: 6549242 - DNA, 14 bp, Homo sapiens
ttggctgtgtctaa

SEQ ID NO: 6549243 - DNA, 21 bp, Homo sapiens
ttggctgtgtctaaactgcat

SEQ ID NO: 6549244 - DNA, 22 bp, Homo sapiens
ttggctgttttccctctgctgc

SEQ ID NO: 6549245 - DNA, 22 bp, Homo sapiens
ttggcttaaagcatcctcctcc

SEQ ID NO: 6549246 - DNA, 22 bp, Homo sapiens
tgttatgatgtgcttaacaggg

SEQ ID NO: 6549247 - DNA, 16 bp, Homo sapiens
tgttatgcactgtggt

SEQ ID NO: 6549248 - DNA, 19 bp, Homo sapiens
tgttatgcactgtggtttc

SEQ ID NO: 6549249 - DNA, 20 bp, Homo sapiens
tgttatgccaaacagttgta

SEQ ID NO: 6549250 - DNA, 21 bp, Homo sapiens
tgttatgcctgttgcaggcaa

SEQ ID NO: 6549251 - DNA, 23 bp, Homo sapiens
tgttatgcctgttgcaggcaaat

SEQ ID NO: 6549252 - DNA, 15 bp, Homo sapiens
tgttatgccttgcta

SEQ ID NO: 6549253 - DNA, 12 bp, Homo sapiens
tgttatgctgtt

SEQ ID NO: 6549254 - DNA, 16 bp, Homo sapiens
tgttatgctgtttcct

SEQ ID NO: 6549255 - DNA, 20 bp, Homo sapiens
tgttatgctgtttcctagct

SEQ ID NO: 6549256 - DNA, 15 bp, Homo sapiens
tgttatggtagaaaa

SEQ ID NO: 6549257 - DNA, 17 bp, Homo sapiens
tgttatggtagaaaaat

SEQ ID NO: 6549258 - DNA, 13 bp, Homo sapiens
tgttatgtaaaac

SEQ ID NO: 6549259 - DNA, 18 bp, Homo sapiens
tgttatgtaaaactcgct

SEQ ID NO: 6549260 - DNA, 16 bp, Homo sapiens
tgttatgtacaaacta

SEQ ID NO: 6549261 - DNA, 17 bp, Homo sapiens
tgttatgtagataacaa

SEQ ID NO: 6549262 - DNA, 17 bp, Homo sapiens
tgttatgtatatagatg

SEQ ID NO: 6549263 - DNA, 19 bp, Homo sapiens
tgttatgtatatagatgtg

SEQ ID NO: 6549264 - DNA, 12 bp, Homo sapiens
tgttatgtatga

SEQ ID NO: 6549265 - DNA, 14 bp, Homo sapiens
tgttatgtattcct

SEQ ID NO: 6549266 - DNA, 12 bp, Homo sapiens
tgttatgtattt

SEQ ID NO: 6549267 - DNA, 14 bp, Homo sapiens
tgttatgtatttcc

SEQ ID NO: 6549268 - DNA, 22 bp, Homo sapiens
tgttatgtcaaactgtcttggc

SEQ ID NO: 6549269 - DNA, 17 bp, Homo sapiens
tgttatgtccagaaatt

SEQ ID NO: 6549270 - DNA, 21 bp, Homo sapiens
tgttatgttttcgaaaatcaa

SEQ ID NO: 6549271 - DNA, 20 bp, Homo sapiens
tgttattaaacgtatgcatg

SEQ ID NO: 6549272 - DNA, 14 bp, Homo sapiens
tgttattaaatgta

SEQ ID NO: 6549273 - DNA, 20 bp, Homo sapiens
tgttattacatccttgtggc

SEQ ID NO: 6549274 - DNA, 17 bp, Homo sapiens
tgttattactgttccca

SEQ ID NO: 6549275 - DNA, 21 bp, Homo sapiens
tgttattagagattacctcct

SEQ ID NO: 6549276 - DNA, 14 bp, Homo sapiens
tgttattagatgtt

SEQ ID NO: 6549277 - DNA, 20 bp, Homo sapiens
tgttattatagagcagaaat

SEQ ID NO: 6549278 - DNA, 12 bp, Homo sapiens
tgttattatata

SEQ ID NO: 6549279 - DNA, 19 bp, Homo sapiens
tgttattatatttgacatg

SEQ ID NO: 6549280 - DNA, 15 bp, Homo sapiens
tgttattatcctgca

SEQ ID NO: 6549281 - DNA, 16 bp, Homo sapiens
tgttattattcattat

SEQ ID NO: 6549282 - DNA, 14 bp, Homo sapiens
tgttattattggct

SEQ ID NO: 6549283 - DNA, 19 bp, Homo sapiens
tgttattattggcttgcac

SEQ ID NO: 6549284 - DNA, 19 bp, Homo sapiens
tgttattcaataactattg

SEQ ID NO: 6549285 - DNA, 13 bp, Homo sapiens
tgttattccatca

SEQ ID NO: 6549286 - DNA, 14 bp, Homo sapiens
tgttattccatcaa

SEQ ID NO: 6549287 - DNA, 19 bp, Homo sapiens
tgttattccatcaataaat

SEQ ID NO: 6549288 - DNA, 20 bp, Homo sapiens
tgttattccatcaataaatg

SEQ ID NO: 6549289 - DNA, 22 bp, Homo sapiens
tgttattccatcaataaatgct

SEQ ID NO: 6549290 - DNA, 13 bp, Homo sapiens
tgttattcctagt

SEQ ID NO: 6549291 - DNA, 17 bp, Homo sapiens
tgttattcgtgaatagt

SEQ ID NO: 6549292 - DNA, 13 bp, Homo sapiens
tgttattctttgc

SEQ ID NO: 6549293 - DNA, 16 bp, Homo sapiens
tgttattcttttccag

SEQ ID NO: 6549294 - DNA, 18 bp, Homo sapiens
tgttattcttttccagaa

SEQ ID NO: 6549295 - DNA, 23 bp, Homo sapiens
tgttattgaaaaaaattggcatt

SEQ ID NO: 6549296 - DNA, 15 bp, Homo sapiens
tgttattgaagtgtt

SEQ ID NO: 6549297 - DNA, 23 bp, Homo sapiens
tgttattggaattttctttcata

SEQ ID NO: 6549298 - DNA, 21 bp, Homo sapiens
tgttattgggcaagtgattga

SEQ ID NO: 6549299 - DNA, 22 bp, Homo sapiens
tgttattgggcaagtgattgaa

SEQ ID NO: 6549300 - DNA, 14 bp, Homo sapiens
tgttattgtattta

SEQ ID NO: 6549301 - DNA, 13 bp, Homo sapiens
tgttattgtgaat

SEQ ID NO: 6549302 - DNA, 14 bp, Homo sapiens
tgttattgtggaag

SEQ ID NO: 6549303 - DNA, 16 bp, Homo sapiens
tgttattgttgaacat

SEQ ID NO: 6549304 - DNA, 19 bp, Homo sapiens
tgttatttacactggtcta

SEQ ID NO: 6549305 - DNA, 14 bp, Homo sapiens
tgttatttatatat

SEQ ID NO: 6549306 - DNA, 22 bp, Homo sapiens
tgttatttatccctcattcatc

SEQ ID NO: 6549307 - DNA, 15 bp, Homo sapiens
tgttatttatgatgt

SEQ ID NO: 6549308 - DNA, 18 bp, Homo sapiens
tgttatttattctttatt

SEQ ID NO: 6549309 - DNA, 13 bp, Homo sapiens
tgttatttattga

SEQ ID NO: 6549310 - DNA, 18 bp, Homo sapiens
tgttatttctatgaaaat

SEQ ID NO: 6549311 - DNA, 13 bp, Homo sapiens
tgttatttctcag

SEQ ID NO: 6549312 - DNA, 17 bp, Homo sapiens
tgttatttctcagactt

SEQ ID NO: 6549313 - DNA, 15 bp, Homo sapiens
tgttatttctgcaaa

SEQ ID NO: 6549314 - DNA, 14 bp, Homo sapiens
tgttatttcttccc

SEQ ID NO: 6549315 - DNA, 15 bp, Homo sapiens
tgttatttcttccct

SEQ ID NO: 6549316 - DNA, 17 bp, Homo sapiens
tgttatttgatgactga

SEQ ID NO: 6549317 - DNA, 12 bp, Homo sapiens
tgttatttggaa

SEQ ID NO: 6549318 - DNA, 16 bp, Homo sapiens
tgttatttggaatttt

SEQ ID NO: 6549319 - DNA, 17 bp, Homo sapiens
tgttatttgtaatagat

SEQ ID NO: 6549320 - DNA, 17 bp, Homo sapiens
tgttatttgtacagttc

SEQ ID NO: 6549321 - DNA, 16 bp, Homo sapiens
tgttattttcagtgat

SEQ ID NO: 6549322 - DNA, 19 bp, Homo sapiens
tgttattttccttctgaag

SEQ ID NO: 6549323 - DNA, 17 bp, Homo sapiens
tgttattttcttctaag

SEQ ID NO: 6549324 - DNA, 14 bp, Homo sapiens
tgttattttgcaac

SEQ ID NO: 6549325 - DNA, 20 bp, Homo sapiens
tgttatttttaagcttttat

SEQ ID NO: 6549326 - DNA, 22 bp, Homo sapiens
tgttatttttacagcaaaagat

SEQ ID NO: 6549327 - DNA, 22 bp, Homo sapiens
tgttatttttatatcagcctga

SEQ ID NO: 6549328 - DNA, 17 bp, Homo sapiens
tgttatttttgtatttt

SEQ ID NO: 6549329 - DNA, 16 bp, Homo sapiens
tgttatttttgtttct

SEQ ID NO: 6549330 - DNA, 18 bp, Homo sapiens
tgttattttttaattatt

SEQ ID NO: 6549331 - DNA, 20 bp, Homo sapiens
tgttattttttatttccaca

SEQ ID NO: 6549332 - DNA, 14 bp, Homo sapiens
tgttattttttcag

SEQ ID NO: 6549333 - DNA, 22 bp, Homo sapiens
tgttatttttttttttttcaca

SEQ ID NO: 6549334 - DNA, 13 bp, Homo sapiens
tgttcaaaatact

SEQ ID NO: 6549335 - DNA, 14 bp, Homo sapiens
tgttcaaaatacta

SEQ ID NO: 6549336 - DNA, 18 bp, Homo sapiens
tgttcaaaatgttaataa

SEQ ID NO: 6549337 - DNA, 22 bp, Homo sapiens
tgttcaaacaatatcatatcat

SEQ ID NO: 6549338 - DNA, 14 bp, Homo sapiens
tgttcaaacattta

SEQ ID NO: 6549339 - DNA, 20 bp, Homo sapiens
tgttcaaacccagtcttgtg

SEQ ID NO: 6549340 - DNA, 18 bp, Homo sapiens
tgttcaaactactgtaca

SEQ ID NO: 6549341 - DNA, 22 bp, Homo sapiens
tgttcaaagccacattatttct

SEQ ID NO: 6549342 - DNA, 12 bp, Homo sapiens
tgttcaaattca

SEQ ID NO: 6549343 - DNA, 14 bp, Homo sapiens
tgttcaaattcacg

SEQ ID NO: 6549344 - DNA, 15 bp, Homo sapiens
tgttcaaattctgat

SEQ ID NO: 6549345 - DNA, 19 bp, Homo sapiens
tgttcaaattctgattatt

SEQ ID NO: 6549346 - DNA, 22 bp, Homo sapiens
tgttcaacaatcagtcatcatg

SEQ ID NO: 6549347 - DNA, 15 bp, Homo sapiens
tgttcaactatttta

SEQ ID NO: 6549348 - DNA, 23 bp, Homo sapiens
tgttcaagaccagcctgaccaac

SEQ ID NO: 6549349 - DNA, 16 bp, Homo sapiens
tgttcaagcttttcct

SEQ ID NO: 6549350 - DNA, 19 bp, Homo sapiens
tgttcaagcttttcctttc

SEQ ID NO: 6549351 - DNA, 17 bp, Homo sapiens
tgttcaagtatctaact

SEQ ID NO: 6549352 - DNA, 18 bp, Homo sapiens
tgttcaagtatctaactc

SEQ ID NO: 6549353 - DNA, 16 bp, Homo sapiens
tgttcaagtcattcca

SEQ ID NO: 6549354 - DNA, 15 bp, Homo sapiens
tgttcaatattttct

SEQ ID NO: 6549355 - DNA, 15 bp, Homo sapiens
tgttcaatctgtgaa

SEQ ID NO: 6549356 - DNA, 14 bp, Homo sapiens
tgttcaatctgtgt

SEQ ID NO: 6549357 - DNA, 21 bp, Homo sapiens
tgttcaatctgtgtaagaaaa

SEQ ID NO: 6549358 - DNA, 23 bp, Homo sapiens
tgttcaatgattatttgtattta

SEQ ID NO: 6549359 - DNA, 21 bp, Homo sapiens
tgttcaatggttctgaaataa

SEQ ID NO: 6549360 - DNA, 19 bp, Homo sapiens
tgttcacaaactacctctg

SEQ ID NO: 6549361 - DNA, 17 bp, Homo sapiens
tgttcacaaactgtgaa

SEQ ID NO: 6549362 - DNA, 14 bp, Homo sapiens
tgttcacaacctgg

SEQ ID NO: 6549363 - DNA, 22 bp, Homo sapiens
tgttcacaccattctcctgcct

SEQ ID NO: 6549364 - DNA, 16 bp, Homo sapiens
tgttcacagcttttct

SEQ ID NO: 6549365 - DNA, 22 bp, Homo sapiens
tgttcacatccagttgtctaaa

SEQ ID NO: 6549366 - DNA, 13 bp, Homo sapiens
tgttcacattttt

SEQ ID NO: 6549367 - DNA, 14 bp, Homo sapiens
tgttcaccagagaa

SEQ ID NO: 6549368 - DNA, 22 bp, Homo sapiens
tgttcaccattataatgaattt

SEQ ID NO: 6549369 - DNA, 18 bp, Homo sapiens
tgttcaccttatgtatta

SEQ ID NO: 6549370 - DNA, 19 bp, Homo sapiens
tgttcaccttctgtgcatc

SEQ ID NO: 6549371 - DNA, 18 bp, Homo sapiens
tgttcacggtgacacagg

SEQ ID NO: 6549372 - DNA, 22 bp, Homo sapiens
tgttcacggtgacacaggtcag

SEQ ID NO: 6549373 - DNA, 23 bp, Homo sapiens
tgttcacggtgacacaggtcagg

SEQ ID NO: 6549374 - DNA, 18 bp, Homo sapiens
tgttcacgtgactcctca

SEQ ID NO: 6549375 - DNA, 22 bp, Homo sapiens
tgttcacgtgttttccatccca

SEQ ID NO: 6549376 - DNA, 22 bp, Homo sapiens
tgttcactccgggtcaagttgt

SEQ ID NO: 6549377 - DNA, 15 bp, Homo sapiens
tgttcactgaagacg

SEQ ID NO: 6549378 - DNA, 14 bp, Homo sapiens
tgttcactgcagca

SEQ ID NO: 6549379 - DNA, 20 bp, Homo sapiens
tgttcactgctccttgctgc

SEQ ID NO: 6549380 - DNA, 13 bp, Homo sapiens
tgttcactgtccc

SEQ ID NO: 6549381 - DNA, 13 bp, Homo sapiens
tgttcacttaaat

SEQ ID NO: 6549382 - DNA, 23 bp, Homo sapiens
tgttcacttcgaaattctgagtt

SEQ ID NO: 6549383 - DNA, 19 bp, Homo sapiens
tgttcactttaaagcaatt

SEQ ID NO: 6549384 - DNA, 19 bp, Homo sapiens
tgttcacttttcctccctc

SEQ ID NO: 6549385 - DNA, 17 bp, Homo sapiens
tgttcacttttgacaaa

SEQ ID NO: 6549386 - DNA, 15 bp, Homo sapiens
tgttcagaaaaaagg

SEQ ID NO: 6549387 - DNA, 16 bp, Homo sapiens
tgttcagaaagcaata

SEQ ID NO: 6549388 - DNA, 20 bp, Homo sapiens
tgttcagaacttcatctgcc

SEQ ID NO: 6549389 - DNA, 13 bp, Homo sapiens
tgttcagaagaat

SEQ ID NO: 6549390 - DNA, 22 bp, Homo sapiens
tgttcagaaggttgctctagat

SEQ ID NO: 6549391 - DNA, 21 bp, Homo sapiens
tgttcagaagttgttagtgat

SEQ ID NO: 6549392 - DNA, 22 bp, Homo sapiens
tgttcagaattcatgaaattat

SEQ ID NO: 6549393 - DNA, 12 bp, Homo sapiens
tgttcagaggca

SEQ ID NO: 6549394 - DNA, 17 bp, Homo sapiens
tgttcagatgtgcattt

SEQ ID NO: 6549395 - DNA, 16 bp, Homo sapiens
tgttcagattaaaaaa

SEQ ID NO: 6549396 - DNA, 17 bp, Homo sapiens
tgttcagcactgtccct

SEQ ID NO: 6549397 - DNA, 18 bp, Homo sapiens
tgttcagcgttttgcaag

SEQ ID NO: 6549398 - DNA, 12 bp, Homo sapiens
tgttcagctccc

SEQ ID NO: 6549399 - DNA, 19 bp, Homo sapiens
tgttcagctcccccaggct

SEQ ID NO: 6549400 - DNA, 20 bp, Homo sapiens
tgttcagctcccccaggctg

SEQ ID NO: 6549401 - DNA, 22 bp, Homo sapiens
tgttcagctcccccaggctgtt

SEQ ID NO: 6549402 - DNA, 18 bp, Homo sapiens
tgttcagctctttccaaa

SEQ ID NO: 6549403 - DNA, 19 bp, Homo sapiens
tgttcagctctttccaaat

SEQ ID NO: 6549404 - DNA, 21 bp, Homo sapiens
tgttcagcttcagacttttat

SEQ ID NO: 6549405 - DNA, 13 bp, Homo sapiens
tgttcaggcattc

SEQ ID NO: 6549406 - DNA, 13 bp, Homo sapiens
tgttcagtaataa

SEQ ID NO: 6549407 - DNA, 15 bp, Homo sapiens
tgttcagtgagatat

SEQ ID NO: 6549408 - DNA, 15 bp, Homo sapiens
tgttcagtgtaaata

SEQ ID NO: 6549409 - DNA, 15 bp, Homo sapiens
tgttcagtgtaattt

SEQ ID NO: 6549410 - DNA, 13 bp, Homo sapiens
tgttcagtgttga

SEQ ID NO: 6549411 - DNA, 14 bp, Homo sapiens
tgttcagtgttgac

SEQ ID NO: 6549412 - DNA, 18 bp, Homo sapiens
tgttcagtgttgacatag

SEQ ID NO: 6549413 - DNA, 19 bp, Homo sapiens
tgttcagtgttgacatagc

SEQ ID NO: 6549414 - DNA, 16 bp, Homo sapiens
tgttcagttacagaaa

SEQ ID NO: 6549415 - DNA, 17 bp, Homo sapiens
tgttcagttccagcttt

SEQ ID NO: 6549416 - DNA, 14 bp, Homo sapiens
tgttcataataaaa

SEQ ID NO: 6549417 - DNA, 23 bp, Homo sapiens
tgttcatacatatttttgtagca

SEQ ID NO: 6549418 - DNA, 16 bp, Homo sapiens
tgttcatactttggct

SEQ ID NO: 6549419 - DNA, 20 bp, Homo sapiens
tgttcatagatattggaaga

SEQ ID NO: 6549420 - DNA, 19 bp, Homo sapiens
tgttcatagcccagtagac

SEQ ID NO: 6549421 - DNA, 17 bp, Homo sapiens
tgttcatatagccaggg

SEQ ID NO: 6549422 - DNA, 22 bp, Homo sapiens
tgttcatatagtcaatgtaaaa

SEQ ID NO: 6549423 - DNA, 14 bp, Homo sapiens
tgttcatctctttg

SEQ ID NO: 6549424 - DNA, 15 bp, Homo sapiens
tgttcatctctttgt

SEQ ID NO: 6549425 - DNA, 14 bp, Homo sapiens
ttggcttaaatata

SEQ ID NO: 6549426 - DNA, 15 bp, Homo sapiens
ttggcttaaatatag

SEQ ID NO: 6549427 - DNA, 12 bp, Homo sapiens
ttggcttacatt

SEQ ID NO: 6549428 - DNA, 15 bp, Homo sapiens
ttggcttacatttga

SEQ ID NO: 6549429 - DNA, 14 bp, Homo sapiens
ttggcttactgaaa

SEQ ID NO: 6549430 - DNA, 17 bp, Homo sapiens
ttggcttactgaaagac

SEQ ID NO: 6549431 - DNA, 15 bp, Homo sapiens
ttggcttataaacac

SEQ ID NO: 6549432 - DNA, 13 bp, Homo sapiens
ttggcttatgaaa

SEQ ID NO: 6549433 - DNA, 14 bp, Homo sapiens
ttggcttatgaaaa

SEQ ID NO: 6549434 - DNA, 16 bp, Homo sapiens
ttggcttcatttcaat

SEQ ID NO: 6549435 - DNA, 18 bp, Homo sapiens
ttggcttccagaaggcag

SEQ ID NO: 6549436 - DNA, 14 bp, Homo sapiens
ttggcttcccctcc

SEQ ID NO: 6549437 - DNA, 15 bp, Homo sapiens
ttggcttcctctgct

SEQ ID NO: 6549438 - DNA, 17 bp, Homo sapiens
ttggcttcctttcttgg

SEQ ID NO: 6549439 - DNA, 22 bp, Homo sapiens
ttggcttcctttcttggttcat

SEQ ID NO: 6549440 - DNA, 19 bp, Homo sapiens
ttggcttctcaatagagtg

SEQ ID NO: 6549441 - DNA, 17 bp, Homo sapiens
ttggcttctccctgggg

SEQ ID NO: 6549442 - DNA, 15 bp, Homo sapiens
ttggcttctcctgtg

SEQ ID NO: 6549443 - DNA, 17 bp, Homo sapiens
ttggcttctcctgtgac

SEQ ID NO: 6549444 - DNA, 22 bp, Homo sapiens
ttggcttctgatttttctcttt

SEQ ID NO: 6549445 - DNA, 22 bp, Homo sapiens
ttggcttcttaaaaactgtgta

SEQ ID NO: 6549446 - DNA, 23 bp, Homo sapiens
ttggcttcttaaaaactgtgtat

SEQ ID NO: 6549447 - DNA, 15 bp, Homo sapiens
ttggcttgctgttta

SEQ ID NO: 6549448 - DNA, 15 bp, Homo sapiens
ttggcttgcttatgt

SEQ ID NO: 6549449 - DNA, 14 bp, Homo sapiens
ttggcttgtgttat

SEQ ID NO: 6549450 - DNA, 17 bp, Homo sapiens
ttggctttaaacaccct

SEQ ID NO: 6549451 - DNA, 22 bp, Homo sapiens
ttggctttatcctctttagagt

SEQ ID NO: 6549452 - DNA, 17 bp, Homo sapiens
ttggctttatgcacatt

SEQ ID NO: 6549453 - DNA, 16 bp, Homo sapiens
ttggctttcctgtttc

SEQ ID NO: 6549454 - DNA, 18 bp, Homo sapiens
ttggctttctccctcacc

SEQ ID NO: 6549455 - DNA, 14 bp, Homo sapiens
ttggctttgcccac

SEQ ID NO: 6549456 - DNA, 21 bp, Homo sapiens
ttggctttgcccacccctcac

SEQ ID NO: 6549457 - DNA, 20 bp, Homo sapiens
ttggcttttgcttggcagag

SEQ ID NO: 6549458 - DNA, 23 bp, Homo sapiens
ttggctttttaaattttccatta

SEQ ID NO: 6549459 - DNA, 20 bp, Homo sapiens
ttgggaaaaaaacttggcac

SEQ ID NO: 6549460 - DNA, 12 bp, Homo sapiens
ttgggaaaacat

SEQ ID NO: 6549461 - DNA, 13 bp, Homo sapiens
ttgggaaaacatg

SEQ ID NO: 6549462 - DNA, 21 bp, Homo sapiens
ttgggaaaaggtgtaaaacag

SEQ ID NO: 6549463 - DNA, 20 bp, Homo sapiens
ttgggaaaatatcactttgt

SEQ ID NO: 6549464 - DNA, 17 bp, Homo sapiens
ttgggaaacttgtcact

SEQ ID NO: 6549465 - DNA, 20 bp, Homo sapiens
ttgggaaagaagttgctaag

SEQ ID NO: 6549466 - DNA, 12 bp, Homo sapiens
ttgggaaagaga

SEQ ID NO: 6549467 - DNA, 14 bp, Homo sapiens
ttgggaaagagaca

SEQ ID NO: 6549468 - DNA, 12 bp, Homo sapiens
ttgggaaagata

SEQ ID NO: 6549469 - DNA, 13 bp, Homo sapiens
ttgggaaagccca

SEQ ID NO: 6549470 - DNA, 16 bp, Homo sapiens
ttgggaaaggcagggc

SEQ ID NO: 6549471 - DNA, 16 bp, Homo sapiens
ttgggaaatacaagaa

SEQ ID NO: 6549472 - DNA, 22 bp, Homo sapiens
ttgggaaattaaatccaataaa

SEQ ID NO: 6549473 - DNA, 23 bp, Homo sapiens
ttgggaacataaaaactactgaa

SEQ ID NO: 6549474 - DNA, 15 bp, Homo sapiens
ttgggaactcatcaa

SEQ ID NO: 6549475 - DNA, 22 bp, Homo sapiens
ttgggaactgaaatccttgaga

SEQ ID NO: 6549476 - DNA, 18 bp, Homo sapiens
ttgggaagacgttttctt

SEQ ID NO: 6549477 - DNA, 18 bp, Homo sapiens
ttgggaagagcttagaaa

SEQ ID NO: 6549478 - DNA, 19 bp, Homo sapiens
ttgggaagcagtttcagat

SEQ ID NO: 6549479 - DNA, 22 bp, Homo sapiens
ttgggaagcagtttcagataaa

SEQ ID NO: 6549480 - DNA, 15 bp, Homo sapiens
ttgggaagccaggaa

SEQ ID NO: 6549481 - DNA, 23 bp, Homo sapiens
ttgggaaggacacagcagtattg

SEQ ID NO: 6549482 - DNA, 19 bp, Homo sapiens
ttgggaaggggtcctgcag

SEQ ID NO: 6549483 - DNA, 15 bp, Homo sapiens
ttgggaataaatatg

SEQ ID NO: 6549484 - DNA, 19 bp, Homo sapiens
ttgggaatatccatgtact

SEQ ID NO: 6549485 - DNA, 19 bp, Homo sapiens
ttgggaatatttgaatctt

SEQ ID NO: 6549486 - DNA, 20 bp, Homo sapiens
ttgggaatgaaattaacaca

SEQ ID NO: 6549487 - DNA, 20 bp, Homo sapiens
ttgggaatggtgcccttgga

SEQ ID NO: 6549488 - DNA, 19 bp, Homo sapiens
ttgggacaacagtgctttg

SEQ ID NO: 6549489 - DNA, 14 bp, Homo sapiens
ttgggacaccaggg

SEQ ID NO: 6549490 - DNA, 12 bp, Homo sapiens
ttgggacagcca

SEQ ID NO: 6549491 - DNA, 19 bp, Homo sapiens
ttgggacagccattttcca

SEQ ID NO: 6549492 - DNA, 19 bp, Homo sapiens
ttgggaccaaaactgccta

SEQ ID NO: 6549493 - DNA, 17 bp, Homo sapiens
ttgggaccagaagtgtt

SEQ ID NO: 6549494 - DNA, 20 bp, Homo sapiens
ttgggaccagaagtgtttca

SEQ ID NO: 6549495 - DNA, 17 bp, Homo sapiens
ttgggaccctccagtgc

SEQ ID NO: 6549496 - DNA, 20 bp, Homo sapiens
ttgggacggaagtggcctga

SEQ ID NO: 6549497 - DNA, 23 bp, Homo sapiens
ttgggactagatcacaactgaag

SEQ ID NO: 6549498 - DNA, 17 bp, Homo sapiens
ttgggactgagtgctga

SEQ ID NO: 6549499 - DNA, 22 bp, Homo sapiens
ttgggactgctaaataaaattt

SEQ ID NO: 6549500 - DNA, 13 bp, Homo sapiens
ttgggactgtctt

SEQ ID NO: 6549501 - DNA, 13 bp, Homo sapiens
ttgggagaaagca

SEQ ID NO: 6549502 - DNA, 19 bp, Homo sapiens
ttgggagacaattagcaga

SEQ ID NO: 6549503 - DNA, 15 bp, Homo sapiens
ttgggagagggcgca

SEQ ID NO: 6549504 - DNA, 16 bp, Homo sapiens
ttgggagagggcgcag

SEQ ID NO: 6549505 - DNA, 12 bp, Homo sapiens
ttgggagagtgc

SEQ ID NO: 6549506 - DNA, 19 bp, Homo sapiens
ttgggagcaatctggaaaa

SEQ ID NO: 6549507 - DNA, 12 bp, Homo sapiens
ttgggagccact

SEQ ID NO: 6549508 - DNA, 14 bp, Homo sapiens
ttgggagccaggac

SEQ ID NO: 6549509 - DNA, 15 bp, Homo sapiens
ttgggagccaggact

SEQ ID NO: 6549510 - DNA, 21 bp, Homo sapiens
ttgggagccaggactcccaga

SEQ ID NO: 6549511 - DNA, 14 bp, Homo sapiens
ttgggagcctctgg

SEQ ID NO: 6549512 - DNA, 19 bp, Homo sapiens
ttgggagcctgtggccagc

SEQ ID NO: 6549513 - DNA, 14 bp, Homo sapiens
ttgggagctctgct

SEQ ID NO: 6549514 - DNA, 18 bp, Homo sapiens
ttgggaggaaacctgaga

SEQ ID NO: 6549515 - DNA, 23 bp, Homo sapiens
ttgggaggaagcagaataaagca

SEQ ID NO: 6549516 - DNA, 22 bp, Homo sapiens
ttgggaggagggggcccggctg

SEQ ID NO: 6549517 - DNA, 21 bp, Homo sapiens
ttgggaggatttgatgtaagt

SEQ ID NO: 6549518 - DNA, 13 bp, Homo sapiens
ttgggaggcaggt

SEQ ID NO: 6549519 - DNA, 16 bp, Homo sapiens
ttgggaggccaaggca

SEQ ID NO: 6549520 - DNA, 17 bp, Homo sapiens
ttgggaggctgtggaga

SEQ ID NO: 6549521 - DNA, 16 bp, Homo sapiens
ttgggaggggccggag

SEQ ID NO: 6549522 - DNA, 17 bp, Homo sapiens
ttgggaggtccaaggtc

SEQ ID NO: 6549523 - DNA, 20 bp, Homo sapiens
ttgggagtatgttgtcataa

SEQ ID NO: 6549524 - DNA, 12 bp, Homo sapiens
ttgggagtccag

SEQ ID NO: 6549525 - DNA, 13 bp, Homo sapiens
ttgggagttttta

SEQ ID NO: 6549526 - DNA, 17 bp, Homo sapiens
ttgggataaagcaaggg

SEQ ID NO: 6549527 - DNA, 21 bp, Homo sapiens
ttgggatactgcttattttat

SEQ ID NO: 6549528 - DNA, 16 bp, Homo sapiens
ttgggatcaataggaa

SEQ ID NO: 6549529 - DNA, 15 bp, Homo sapiens
ttgggatcagcctcc

SEQ ID NO: 6549530 - DNA, 17 bp, Homo sapiens
ttgggatcagcctccgc

SEQ ID NO: 6549531 - DNA, 14 bp, Homo sapiens
ttgggatccttcag

SEQ ID NO: 6549532 - DNA, 18 bp, Homo sapiens
ttgggatgatgcctcatg

SEQ ID NO: 6549533 - DNA, 21 bp, Homo sapiens
ttgggatgctatttcagccaa

SEQ ID NO: 6549534 - DNA, 13 bp, Homo sapiens
ttgggatgggcac

SEQ ID NO: 6549535 - DNA, 13 bp, Homo sapiens
ttgggattaatat

SEQ ID NO: 6549536 - DNA, 20 bp, Homo sapiens
ttgggattcctcccctggaa

SEQ ID NO: 6549537 - DNA, 16 bp, Homo sapiens
ttgggattgggggctg

SEQ ID NO: 6549538 - DNA, 14 bp, Homo sapiens
ttgggattgggggg

SEQ ID NO: 6549539 - DNA, 22 bp, Homo sapiens
ttgggatttatatctatagtag

SEQ ID NO: 6549540 - DNA, 16 bp, Homo sapiens
ttgggattttagaaca

SEQ ID NO: 6549541 - DNA, 17 bp, Homo sapiens
ttgggcacagtccagac

SEQ ID NO: 6549542 - DNA, 20 bp, Homo sapiens
ttgggcacatcatttcaaga

SEQ ID NO: 6549543 - DNA, 20 bp, Homo sapiens
ttgggcacgggagagcgcca

SEQ ID NO: 6549544 - DNA, 19 bp, Homo sapiens
ttgggcagaagggagaagg

SEQ ID NO: 6549545 - DNA, 19 bp, Homo sapiens
ttgggcagaatgaattcga

SEQ ID NO: 6549546 - DNA, 15 bp, Homo sapiens
ttgggcagagaggct

SEQ ID NO: 6549547 - DNA, 12 bp, Homo sapiens
ttgggcagagct

SEQ ID NO: 6549548 - DNA, 22 bp, Homo sapiens
ttgggcagagctggctctgagc

SEQ ID NO: 6549549 - DNA, 11 bp, Homo sapiens
ttgggcagcca

SEQ ID NO: 6549550 - DNA, 14 bp, Homo sapiens
ttgggcagccagga

SEQ ID NO: 6549551 - DNA, 23 bp, Homo sapiens
ttgggcagccaggagtgcccccg

SEQ ID NO: 6549552 - DNA, 18 bp, Homo sapiens
ttgggcagcgcccttcct

SEQ ID NO: 6549553 - DNA, 11 bp, Homo sapiens
ttgggcagggt

SEQ ID NO: 6549554 - DNA, 21 bp, Homo sapiens
ttgggcagtctttcttgaaat

SEQ ID NO: 6549555 - DNA, 17 bp, Homo sapiens
ttgggcagtggagaggg

SEQ ID NO: 6549556 - DNA, 14 bp, Homo sapiens
ttgggcagttggcc

SEQ ID NO: 6549557 - DNA, 19 bp, Homo sapiens
ttgggcatcagaaaacagg

SEQ ID NO: 6549558 - DNA, 16 bp, Homo sapiens
ttgggcatccacccag

SEQ ID NO: 6549559 - DNA, 20 bp, Homo sapiens
ttgggcatccacccagtgct

SEQ ID NO: 6549560 - DNA, 21 bp, Homo sapiens
ttgggcatccacccagtgctg

SEQ ID NO: 6549561 - DNA, 20 bp, Homo sapiens
ttgggcatttatattccact

SEQ ID NO: 6549562 - DNA, 22 bp, Homo sapiens
ttgggccaaatccgctctcttc

SEQ ID NO: 6549563 - DNA, 15 bp, Homo sapiens
ttgggccactgccct

SEQ ID NO: 6549564 - DNA, 14 bp, Homo sapiens
ttgggccagaagta

SEQ ID NO: 6549565 - DNA, 17 bp, Homo sapiens
ttgggccagacatgcca

SEQ ID NO: 6549566 - DNA, 18 bp, Homo sapiens
ttgggccagcttttcaaa

SEQ ID NO: 6549567 - DNA, 16 bp, Homo sapiens
ttgggccatactggcc

SEQ ID NO: 6549568 - DNA, 22 bp, Homo sapiens
ttgggcccaagaactgcagata

SEQ ID NO: 6549569 - DNA, 20 bp, Homo sapiens
ttgggcccacacctccttcc

SEQ ID NO: 6549570 - DNA, 12 bp, Homo sapiens
ttgggcccagct

SEQ ID NO: 6549571 - DNA, 16 bp, Homo sapiens
ttgggcccagctgggc

SEQ ID NO: 6549572 - DNA, 18 bp, Homo sapiens
ttgggcccagctgggctc

SEQ ID NO: 6549573 - DNA, 22 bp, Homo sapiens
ttgggccccagaccccagggca

SEQ ID NO: 6549574 - DNA, 15 bp, Homo sapiens
ttgggccccagggaa

SEQ ID NO: 6549575 - DNA, 16 bp, Homo sapiens
ttgggcccccagcctg

SEQ ID NO: 6549576 - DNA, 11 bp, Homo sapiens
ttgggccctgc

SEQ ID NO: 6549577 - DNA, 21 bp, Homo sapiens
ttgggccctgcattggcctgg

SEQ ID NO: 6549578 - DNA, 22 bp, Homo sapiens
ttgggccgaatcccccagggaa

SEQ ID NO: 6549579 - DNA, 19 bp, Homo sapiens
ttgggcctcaggctctgca

SEQ ID NO: 6549580 - DNA, 17 bp, Homo sapiens
ttgggcctccatgcccc

SEQ ID NO: 6549581 - DNA, 22 bp, Homo sapiens
ttgggcctccccccagcccctc

SEQ ID NO: 6549582 - DNA, 20 bp, Homo sapiens
ttgggcctctcctgccctct

SEQ ID NO: 6549583 - DNA, 13 bp, Homo sapiens
ttgggcctgacct

SEQ ID NO: 6549584 - DNA, 21 bp, Homo sapiens
ttgggcctgacctccagtcct

SEQ ID NO: 6549585 - DNA, 19 bp, Homo sapiens
ttgggcctgctccagacct

SEQ ID NO: 6549586 - DNA, 14 bp, Homo sapiens
ttgggcctggccag

SEQ ID NO: 6549587 - DNA, 15 bp, Homo sapiens
ttgggcctgggcctc

SEQ ID NO: 6549588 - DNA, 17 bp, Homo sapiens
ttgggcctgggcctctg

SEQ ID NO: 6549589 - DNA, 15 bp, Homo sapiens
ttgggcctgttcctt

SEQ ID NO: 6549590 - DNA, 20 bp, Homo sapiens
ttgggcgccgtgctgggcag

SEQ ID NO: 6549591 - DNA, 21 bp, Homo sapiens
ttgggcgctcggtctccaccc

SEQ ID NO: 6549592 - DNA, 16 bp, Homo sapiens
ttgggcggctgagagc

SEQ ID NO: 6549593 - DNA, 21 bp, Homo sapiens
ttgggcggctgagagccccag

SEQ ID NO: 6549594 - DNA, 22 bp, Homo sapiens
ttgggcgtctcccccagagtgc

SEQ ID NO: 6549595 - DNA, 17 bp, Homo sapiens
ttgggctactggcagct

SEQ ID NO: 6549596 - DNA, 16 bp, Homo sapiens
ttgggctataaaatat

SEQ ID NO: 6549597 - DNA, 12 bp, Homo sapiens
ttgggctcagag

SEQ ID NO: 6549598 - DNA, 21 bp, Homo sapiens
ttgggctcagggttggccatt

SEQ ID NO: 6549599 - DNA, 12 bp, Homo sapiens
ttgggctcccaa

SEQ ID NO: 6549600 - DNA, 21 bp, Homo sapiens
ttgggctcctggctgccaggc

SEQ ID NO: 6549601 - DNA, 15 bp, Homo sapiens
ttgggctcctttttc

SEQ ID NO: 6549602 - DNA, 16 bp, Homo sapiens
ttgggctcctttttct

SEQ ID NO: 6549603 - DNA, 19 bp, Homo sapiens
ttgggctctagaattccag

SEQ ID NO: 6549604 - DNA, 20 bp, Homo sapiens
tgttcatgaaagattcaatg

SEQ ID NO: 6549605 - DNA, 18 bp, Homo sapiens
tgttcatgaaggtcctag

SEQ ID NO: 6549606 - DNA, 16 bp, Homo sapiens
tgttcatgagtggatg

SEQ ID NO: 6549607 - DNA, 20 bp, Homo sapiens
tgttcatgatagaaagaata

SEQ ID NO: 6549608 - DNA, 16 bp, Homo sapiens
tgttcatgatagtgtg

SEQ ID NO: 6549609 - DNA, 19 bp, Homo sapiens
tgttcatgatagtgtgatt

SEQ ID NO: 6549610 - DNA, 15 bp, Homo sapiens
tgttcatgctccaag

SEQ ID NO: 6549611 - DNA, 14 bp, Homo sapiens
tgttcatgctgaat

SEQ ID NO: 6549612 - DNA, 21 bp, Homo sapiens
tgttcatgctgaatccacctc

SEQ ID NO: 6549613 - DNA, 22 bp, Homo sapiens
tgttcatggggtttttgccctg

SEQ ID NO: 6549614 - DNA, 14 bp, Homo sapiens
tgttcatgtgcctc

SEQ ID NO: 6549615 - DNA, 17 bp, Homo sapiens
tgttcatgtttggtgca

SEQ ID NO: 6549616 - DNA, 14 bp, Homo sapiens
tgttcatgttttgc

SEQ ID NO: 6549617 - DNA, 18 bp, Homo sapiens
tgttcatgttttgctaat

SEQ ID NO: 6549618 - DNA, 19 bp, Homo sapiens
tgttcatgttttgctaatg

SEQ ID NO: 6549619 - DNA, 22 bp, Homo sapiens
tgttcattaaagcatgaatggt

SEQ ID NO: 6549620 - DNA, 19 bp, Homo sapiens
tgttcattataatctcaaa

SEQ ID NO: 6549621 - DNA, 16 bp, Homo sapiens
tgttcattcaagctat

SEQ ID NO: 6549622 - DNA, 16 bp, Homo sapiens
tgttcattcctccagg

SEQ ID NO: 6549623 - DNA, 19 bp, Homo sapiens
tgttcattctgcattgaga

SEQ ID NO: 6549624 - DNA, 15 bp, Homo sapiens
tgttcattctgtgac

SEQ ID NO: 6549625 - DNA, 14 bp, Homo sapiens
tgttcattcttgtt

SEQ ID NO: 6549626 - DNA, 13 bp, Homo sapiens
tgttcattgtaat

SEQ ID NO: 6549627 - DNA, 14 bp, Homo sapiens
tgttcattgtaatg

SEQ ID NO: 6549628 - DNA, 22 bp, Homo sapiens
tgttcatttagattgaaaactt

SEQ ID NO: 6549629 - DNA, 17 bp, Homo sapiens
tgttcatttctgtctcc

SEQ ID NO: 6549630 - DNA, 22 bp, Homo sapiens
tgttcatttgaaacctttttct

SEQ ID NO: 6549631 - DNA, 12 bp, Homo sapiens
tgttcattttga

SEQ ID NO: 6549632 - DNA, 14 bp, Homo sapiens
tgttcattttgaaa

SEQ ID NO: 6549633 - DNA, 19 bp, Homo sapiens
tgttcattttgaaaatatg

SEQ ID NO: 6549634 - DNA, 18 bp, Homo sapiens
tgttcattttgagctgaa

SEQ ID NO: 6549635 - DNA, 20 bp, Homo sapiens
tgttcatttttaaagcctgg

SEQ ID NO: 6549636 - DNA, 21 bp, Homo sapiens
tgttccaaaccctcctgggaa

SEQ ID NO: 6549637 - DNA, 13 bp, Homo sapiens
tgttccaaagcca

SEQ ID NO: 6549638 - DNA, 15 bp, Homo sapiens
tgttccaaagccagt

SEQ ID NO: 6549639 - DNA, 17 bp, Homo sapiens
tgttccaaatgaatgtt

SEQ ID NO: 6549640 - DNA, 20 bp, Homo sapiens
tgttccaaattcagtttcat

SEQ ID NO: 6549641 - DNA, 20 bp, Homo sapiens
tgttccaaatttgctttaca

SEQ ID NO: 6549642 - DNA, 19 bp, Homo sapiens
tgttccaacctcctgctct

SEQ ID NO: 6549643 - DNA, 22 bp, Homo sapiens
tgttccaacctcctgctctggg

SEQ ID NO: 6549644 - DNA, 23 bp, Homo sapiens
tgttccaacctcctgctctggga

SEQ ID NO: 6549645 - DNA, 15 bp, Homo sapiens
tgttccaagacattg

SEQ ID NO: 6549646 - DNA, 20 bp, Homo sapiens
tgttccaagacattgtcaat

SEQ ID NO: 6549647 - DNA, 21 bp, Homo sapiens
tgttccaagacattgtcaata

SEQ ID NO: 6549648 - DNA, 10 bp, Homo sapiens
tgttccaagt

SEQ ID NO: 6549649 - DNA, 17 bp, Homo sapiens
tgttccaagtttccaaa

SEQ ID NO: 6549650 - DNA, 17 bp, Homo sapiens
tgttccaatttcacgct

SEQ ID NO: 6549651 - DNA, 18 bp, Homo sapiens
tgttccaatttcacgctt

SEQ ID NO: 6549652 - DNA, 16 bp, Homo sapiens
tgttccacaaaacatt

SEQ ID NO: 6549653 - DNA, 20 bp, Homo sapiens
tgttccacagtgactgggcc

SEQ ID NO: 6549654 - DNA, 16 bp, Homo sapiens
tgttccaccaaataca

SEQ ID NO: 6549655 - DNA, 18 bp, Homo sapiens
tgttccaccattgctgga

SEQ ID NO: 6549656 - DNA, 21 bp, Homo sapiens
tgttccaccattgctggaaaa

SEQ ID NO: 6549657 - DNA, 16 bp, Homo sapiens
tgttccacttgtttgc

SEQ ID NO: 6549658 - DNA, 12 bp, Homo sapiens
tgttccagacat

SEQ ID NO: 6549659 - DNA, 22 bp, Homo sapiens
tgttccagactcaggttccaga

SEQ ID NO: 6549660 - DNA, 18 bp, Homo sapiens
tgttccagattcaatcga

SEQ ID NO: 6549661 - DNA, 14 bp, Homo sapiens
tgttccagcagttt

SEQ ID NO: 6549662 - DNA, 20 bp, Homo sapiens
tgttccagccaaagcatgcc

SEQ ID NO: 6549663 - DNA, 21 bp, Homo sapiens
tgttccagccaaagcatgccg

SEQ ID NO: 6549664 - DNA, 14 bp, Homo sapiens
tgttccagctcttt

SEQ ID NO: 6549665 - DNA, 17 bp, Homo sapiens
tgttccagctgcctggg

SEQ ID NO: 6549666 - DNA, 18 bp, Homo sapiens
tgttccaggcatccatct

SEQ ID NO: 6549667 - DNA, 18 bp, Homo sapiens
tgttccaggccctccagt

SEQ ID NO: 6549668 - DNA, 18 bp, Homo sapiens
tgttccagtaatctaata

SEQ ID NO: 6549669 - DNA, 19 bp, Homo sapiens
tgttccataataaacttct

SEQ ID NO: 6549670 - DNA, 17 bp, Homo sapiens
tgttccatcctgtacaa

SEQ ID NO: 6549671 - DNA, 14 bp, Homo sapiens
tgttccatgcctgg

SEQ ID NO: 6549672 - DNA, 15 bp, Homo sapiens
tgttccattaaacga

SEQ ID NO: 6549673 - DNA, 14 bp, Homo sapiens
tgttccattgcctc

SEQ ID NO: 6549674 - DNA, 16 bp, Homo sapiens
tgttccattttatgca

SEQ ID NO: 6549675 - DNA, 22 bp, Homo sapiens
tgttcccaagagcatcatgcct

SEQ ID NO: 6549676 - DNA, 22 bp, Homo sapiens
tgttcccacaatggctgggagg

SEQ ID NO: 6549677 - DNA, 20 bp, Homo sapiens
tgttcccaccaggctgctca

SEQ ID NO: 6549678 - DNA, 18 bp, Homo sapiens
tgttcccactgaaatgga

SEQ ID NO: 6549679 - DNA, 18 bp, Homo sapiens
tgttcccagaaccttgat

SEQ ID NO: 6549680 - DNA, 14 bp, Homo sapiens
tgttcccagaggca

SEQ ID NO: 6549681 - DNA, 16 bp, Homo sapiens
tgttcccagcccctgc

SEQ ID NO: 6549682 - DNA, 18 bp, Homo sapiens
tgttcccagcccctgcag

SEQ ID NO: 6549683 - DNA, 21 bp, Homo sapiens
tgttcccatccctgaaacatt

SEQ ID NO: 6549684 - DNA, 14 bp, Homo sapiens
tgttcccatgtcta

SEQ ID NO: 6549685 - DNA, 16 bp, Homo sapiens
tgttcccattcttgca

SEQ ID NO: 6549686 - DNA, 21 bp, Homo sapiens
tgttccccaaatggccatttt

SEQ ID NO: 6549687 - DNA, 20 bp, Homo sapiens
tgttccccacaggtcctcca

SEQ ID NO: 6549688 - DNA, 12 bp, Homo sapiens
tgttccccaccc

SEQ ID NO: 6549689 - DNA, 14 bp, Homo sapiens
tgttccccacccag

SEQ ID NO: 6549690 - DNA, 18 bp, Homo sapiens
tgttccccaccgccctgc

SEQ ID NO: 6549691 - DNA, 23 bp, Homo sapiens
tgttccccaccgctgagaggctg

SEQ ID NO: 6549692 - DNA, 13 bp, Homo sapiens
tgttccccactgg

SEQ ID NO: 6549693 - DNA, 17 bp, Homo sapiens
tgttccccactggagca

SEQ ID NO: 6549694 - DNA, 14 bp, Homo sapiens
tgttccccagagaa

SEQ ID NO: 6549695 - DNA, 18 bp, Homo sapiens
tgttcccccgctggcagc

SEQ ID NO: 6549696 - DNA, 19 bp, Homo sapiens
tgttcccccgctggcagcc

SEQ ID NO: 6549697 - DNA, 17 bp, Homo sapiens
tgttcccctaagtggat

SEQ ID NO: 6549698 - DNA, 18 bp, Homo sapiens
tgttcccctaagtggatt

SEQ ID NO: 6549699 - DNA, 14 bp, Homo sapiens
tgttcccctcactg

SEQ ID NO: 6549700 - DNA, 12 bp, Homo sapiens
tgttcccctcct

SEQ ID NO: 6549701 - DNA, 15 bp, Homo sapiens
tgttcccctcctcca

SEQ ID NO: 6549702 - DNA, 23 bp, Homo sapiens
tgttcccctcctccactctcccc

SEQ ID NO: 6549703 - DNA, 14 bp, Homo sapiens
tgttcccctctccc

SEQ ID NO: 6549704 - DNA, 16 bp, Homo sapiens
tgttcccctctccctt

SEQ ID NO: 6549705 - DNA, 17 bp, Homo sapiens
tgttcccctctcccttc

SEQ ID NO: 6549706 - DNA, 23 bp, Homo sapiens
tgttcccctctcccttccctcct

SEQ ID NO: 6549707 - DNA, 12 bp, Homo sapiens
tgttcccctctt

SEQ ID NO: 6549708 - DNA, 20 bp, Homo sapiens
tgttcccctcttgtctcccc

SEQ ID NO: 6549709 - DNA, 18 bp, Homo sapiens
tgttcccctgtcctgtga

SEQ ID NO: 6549710 - DNA, 21 bp, Homo sapiens
tgttccccttccactgagggc

SEQ ID NO: 6549711 - DNA, 21 bp, Homo sapiens
tgttcccgatggtctctctcc

SEQ ID NO: 6549712 - DNA, 21 bp, Homo sapiens
tgttcccgattcacgtttttc

SEQ ID NO: 6549713 - DNA, 17 bp, Homo sapiens
tgttcccgtgcctggga

SEQ ID NO: 6549714 - DNA, 17 bp, Homo sapiens
tgttccctcattctgca

SEQ ID NO: 6549715 - DNA, 19 bp, Homo sapiens
tgttccctcctggtcctgg

SEQ ID NO: 6549716 - DNA, 14 bp, Homo sapiens
tgttccctctgctc

SEQ ID NO: 6549717 - DNA, 15 bp, Homo sapiens
tgttccctgaggacc

SEQ ID NO: 6549718 - DNA, 17 bp, Homo sapiens
tgttccctgcaccctgg

SEQ ID NO: 6549719 - DNA, 21 bp, Homo sapiens
tgttccctgctgggtgggaat

SEQ ID NO: 6549720 - DNA, 14 bp, Homo sapiens
tgttccctgttctg

SEQ ID NO: 6549721 - DNA, 20 bp, Homo sapiens
tgttcccttcctctgtgcca

SEQ ID NO: 6549722 - DNA, 22 bp, Homo sapiens
tgttcccttcctcttcctgccc

SEQ ID NO: 6549723 - DNA, 23 bp, Homo sapiens
tgttcccttcctcttcctgccct

SEQ ID NO: 6549724 - DNA, 22 bp, Homo sapiens
tgttcccttcctgccctgtggc

SEQ ID NO: 6549725 - DNA, 16 bp, Homo sapiens
tgttcccttgaccatt

SEQ ID NO: 6549726 - DNA, 22 bp, Homo sapiens
tgttcccttgaccattggctgc

SEQ ID NO: 6549727 - DNA, 17 bp, Homo sapiens
tgttccctttttcataa

SEQ ID NO: 6549728 - DNA, 15 bp, Homo sapiens
tgttccgttcatctg

SEQ ID NO: 6549729 - DNA, 20 bp, Homo sapiens
tgttcctaagttcttagata

SEQ ID NO: 6549730 - DNA, 14 bp, Homo sapiens
tgttcctagtgaaa

SEQ ID NO: 6549731 - DNA, 18 bp, Homo sapiens
tgttcctatggaaacatt

SEQ ID NO: 6549732 - DNA, 23 bp, Homo sapiens
tgttcctcaaatcagtgataatt

SEQ ID NO: 6549733 - DNA, 16 bp, Homo sapiens
tgttcctccattttct

SEQ ID NO: 6549734 - DNA, 22 bp, Homo sapiens
tgttcctccattttcttatcca

SEQ ID NO: 6549735 - DNA, 16 bp, Homo sapiens
tgttcctcccaagagg

SEQ ID NO: 6549736 - DNA, 15 bp, Homo sapiens
tgttcctccctccca

SEQ ID NO: 6549737 - DNA, 12 bp, Homo sapiens
tgttcctcctgc

SEQ ID NO: 6549738 - DNA, 14 bp, Homo sapiens
tgttcctcctgctg

SEQ ID NO: 6549739 - DNA, 10 bp, Homo sapiens
tgttcctcta

SEQ ID NO: 6549740 - DNA, 22 bp, Homo sapiens
tgttcctctagtagtatattta

SEQ ID NO: 6549741 - DNA, 21 bp, Homo sapiens
tgttcctctatactttgttct

SEQ ID NO: 6549742 - DNA, 13 bp, Homo sapiens
tgttcctgaaatg

SEQ ID NO: 6549743 - DNA, 14 bp, Homo sapiens
tgttcctgaaatgt

SEQ ID NO: 6549744 - DNA, 12 bp, Homo sapiens
tgttcctgaagc

SEQ ID NO: 6549745 - DNA, 17 bp, Homo sapiens
tgttcctgaagctgctg

SEQ ID NO: 6549746 - DNA, 19 bp, Homo sapiens
tgttcctgaagctgctgtg

SEQ ID NO: 6549747 - DNA, 17 bp, Homo sapiens
tgttcctgactgttctc

SEQ ID NO: 6549748 - DNA, 18 bp, Homo sapiens
tgttcctgactgttctct

SEQ ID NO: 6549749 - DNA, 16 bp, Homo sapiens
tgttcctgatgtgcca

SEQ ID NO: 6549750 - DNA, 21 bp, Homo sapiens
tgttcctgcagccccagaaga

SEQ ID NO: 6549751 - DNA, 23 bp, Homo sapiens
tgttcctgcagccccagaagaaa

SEQ ID NO: 6549752 - DNA, 12 bp, Homo sapiens
tgttcctgcctt

SEQ ID NO: 6549753 - DNA, 15 bp, Homo sapiens
tgttcctgccttctc

SEQ ID NO: 6549754 - DNA, 18 bp, Homo sapiens
tgttcctgctcttcccag

SEQ ID NO: 6549755 - DNA, 13 bp, Homo sapiens
tgttcctgctgct

SEQ ID NO: 6549756 - DNA, 16 bp, Homo sapiens
tgttcctgctgctgtc

SEQ ID NO: 6549757 - DNA, 14 bp, Homo sapiens
tgttcctggaagca

SEQ ID NO: 6549758 - DNA, 23 bp, Homo sapiens
tgttcctggaggtcagcatttga

SEQ ID NO: 6549759 - DNA, 21 bp, Homo sapiens
tgttcctggagttttgatttg

SEQ ID NO: 6549760 - DNA, 10 bp, Homo sapiens
tgttcctggc

SEQ ID NO: 6549761 - DNA, 13 bp, Homo sapiens
tgttcctggctga

SEQ ID NO: 6549762 - DNA, 11 bp, Homo sapiens
tgttcctggga

SEQ ID NO: 6549763 - DNA, 21 bp, Homo sapiens
tgttcctgggatgtttaatca

SEQ ID NO: 6549764 - DNA, 14 bp, Homo sapiens
tgttcctgtctcaa

SEQ ID NO: 6549765 - DNA, 19 bp, Homo sapiens
tgttcctgtctcaatagct

SEQ ID NO: 6549766 - DNA, 10 bp, Homo sapiens
tgttcctgtg

SEQ ID NO: 6549767 - DNA, 16 bp, Homo sapiens
tgttcctgtgttcttc

SEQ ID NO: 6549768 - DNA, 12 bp, Homo sapiens
tgttcctgttta

SEQ ID NO: 6549769 - DNA, 19 bp, Homo sapiens
tgttccttaagtcagaaca

SEQ ID NO: 6549770 - DNA, 17 bp, Homo sapiens
tgttccttatttctctc

SEQ ID NO: 6549771 - DNA, 19 bp, Homo sapiens
tgttccttatttctctctc

SEQ ID NO: 6549772 - DNA, 23 bp, Homo sapiens
tgttccttatttctctctcctgg

SEQ ID NO: 6549773 - DNA, 17 bp, Homo sapiens
tgttccttcacatttaa

SEQ ID NO: 6549774 - DNA, 22 bp, Homo sapiens
tgttccttccagtgtcatttct

SEQ ID NO: 6549775 - DNA, 19 bp, Homo sapiens
tgttccttccgcttggagc

SEQ ID NO: 6549776 - DNA, 18 bp, Homo sapiens
tgttccttcctccactgc

SEQ ID NO: 6549777 - DNA, 16 bp, Homo sapiens
tgttccttcctgcaga

SEQ ID NO: 6549778 - DNA, 21 bp, Homo sapiens
tgttccttcctgcagacctgg

SEQ ID NO: 6549779 - DNA, 22 bp, Homo sapiens
tgttccttctctgtctgcctct

SEQ ID NO: 6549780 - DNA, 19 bp, Homo sapiens
tgttccttctgcttctccc

SEQ ID NO: 6549781 - DNA, 12 bp, Homo sapiens
tgttccttctgt

SEQ ID NO: 6549782 - DNA, 17 bp, Homo sapiens
tgttccttgtactctta

SEQ ID NO: 6549783 - DNA, 12 bp, Homo sapiens
ttgggctctgcg

SEQ ID NO: 6549784 - DNA, 13 bp, Homo sapiens
ttgggctctgctg

SEQ ID NO: 6549785 - DNA, 22 bp, Homo sapiens
ttgggctgacacctaccatgct

SEQ ID NO: 6549786 - DNA, 23 bp, Homo sapiens
ttgggctgacacctaccatgctg

SEQ ID NO: 6549787 - DNA, 19 bp, Homo sapiens
ttgggctgagtgcagccaa

SEQ ID NO: 6549788 - DNA, 22 bp, Homo sapiens
ttgggctgagtgcagccaaagg

SEQ ID NO: 6549789 - DNA, 23 bp, Homo sapiens
ttgggctgagtgcagccaaaggg

SEQ ID NO: 6549790 - DNA, 19 bp, Homo sapiens
ttgggctggaacagattca

SEQ ID NO: 6549791 - DNA, 19 bp, Homo sapiens
ttgggctggataaatatgt

SEQ ID NO: 6549792 - DNA, 15 bp, Homo sapiens
ttgggctggcaccca

SEQ ID NO: 6549793 - DNA, 16 bp, Homo sapiens
ttgggctggcacccac

SEQ ID NO: 6549794 - DNA, 23 bp, Homo sapiens
ttgggctggcgggccctggagct

SEQ ID NO: 6549795 - DNA, 18 bp, Homo sapiens
ttgggctgggggactggg

SEQ ID NO: 6549796 - DNA, 14 bp, Homo sapiens
ttgggctggtcaga

SEQ ID NO: 6549797 - DNA, 13 bp, Homo sapiens
ttgggctgtgcct

SEQ ID NO: 6549798 - DNA, 14 bp, Homo sapiens
ttgggctgtgcctg

SEQ ID NO: 6549799 - DNA, 22 bp, Homo sapiens
ttgggctgtgcggatctctgga

SEQ ID NO: 6549800 - DNA, 14 bp, Homo sapiens
ttgggcttcttcct

SEQ ID NO: 6549801 - DNA, 18 bp, Homo sapiens
ttgggcttgctattctgt

SEQ ID NO: 6549802 - DNA, 19 bp, Homo sapiens
ttgggctttgcaggctctg

SEQ ID NO: 6549803 - DNA, 20 bp, Homo sapiens
ttgggctttgcaggctctgg

SEQ ID NO: 6549804 - DNA, 17 bp, Homo sapiens
ttggggaaaaaagcaca

SEQ ID NO: 6549805 - DNA, 17 bp, Homo sapiens
ttggggaaaaattcttg

SEQ ID NO: 6549806 - DNA, 20 bp, Homo sapiens
ttggggaaaaattcttggtt

SEQ ID NO: 6549807 - DNA, 19 bp, Homo sapiens
ttggggaaacagcatctcc

SEQ ID NO: 6549808 - DNA, 20 bp, Homo sapiens
ttggggaaacctagagaaga

SEQ ID NO: 6549809 - DNA, 17 bp, Homo sapiens
ttggggaactcaaagga

SEQ ID NO: 6549810 - DNA, 14 bp, Homo sapiens
ttggggaagaaaaa

SEQ ID NO: 6549811 - DNA, 11 bp, Homo sapiens
ttggggaagag

SEQ ID NO: 6549812 - DNA, 18 bp, Homo sapiens
ttggggaagggcctgccc

SEQ ID NO: 6549813 - DNA, 18 bp, Homo sapiens
ttggggacagttggcaga

SEQ ID NO: 6549814 - DNA, 19 bp, Homo sapiens
ttggggaccacagaggctg

SEQ ID NO: 6549815 - DNA, 16 bp, Homo sapiens
ttggggagatttgcca

SEQ ID NO: 6549816 - DNA, 13 bp, Homo sapiens
ttggggagcagag

SEQ ID NO: 6549817 - DNA, 23 bp, Homo sapiens
ttggggagggaggggaaatgtaa

SEQ ID NO: 6549818 - DNA, 15 bp, Homo sapiens
ttggggaggtgttca

SEQ ID NO: 6549819 - DNA, 15 bp, Homo sapiens
ttggggattgagttg

SEQ ID NO: 6549820 - DNA, 19 bp, Homo sapiens
ttggggattgccactaagt

SEQ ID NO: 6549821 - DNA, 15 bp, Homo sapiens
ttggggattttcaaa

SEQ ID NO: 6549822 - DNA, 22 bp, Homo sapiens
ttggggcaacattgttcacctt

SEQ ID NO: 6549823 - DNA, 16 bp, Homo sapiens
ttggggcatttgtaaa

SEQ ID NO: 6549824 - DNA, 18 bp, Homo sapiens
ttggggcatttgtgggac

SEQ ID NO: 6549825 - DNA, 21 bp, Homo sapiens
ttggggccctcttgccagcct

SEQ ID NO: 6549826 - DNA, 13 bp, Homo sapiens
ttggggcctggct

SEQ ID NO: 6549827 - DNA, 14 bp, Homo sapiens
ttggggcctggctt

SEQ ID NO: 6549828 - DNA, 15 bp, Homo sapiens
ttggggcctggcttg

SEQ ID NO: 6549829 - DNA, 17 bp, Homo sapiens
ttggggcgaggcagagg

SEQ ID NO: 6549830 - DNA, 21 bp, Homo sapiens
ttggggcgaggcagaggacag

SEQ ID NO: 6549831 - DNA, 23 bp, Homo sapiens
ttggggcggcccacgccagctgg

SEQ ID NO: 6549832 - DNA, 14 bp, Homo sapiens
ttggggctcccagc

SEQ ID NO: 6549833 - DNA, 22 bp, Homo sapiens
ttggggctcccagccaggccct

SEQ ID NO: 6549834 - DNA, 14 bp, Homo sapiens
ttggggctggcccc

SEQ ID NO: 6549835 - DNA, 16 bp, Homo sapiens
ttggggcttgactttt

SEQ ID NO: 6549836 - DNA, 21 bp, Homo sapiens
ttggggctttacatactttat

SEQ ID NO: 6549837 - DNA, 16 bp, Homo sapiens
ttgggggaaatgttgt

SEQ ID NO: 6549838 - DNA, 22 bp, Homo sapiens
ttgggggaaatgttgtgggggt

SEQ ID NO: 6549839 - DNA, 16 bp, Homo sapiens
ttgggggaatgcacct

SEQ ID NO: 6549840 - DNA, 21 bp, Homo sapiens
ttgggggaatgcacctcccca

SEQ ID NO: 6549841 - DNA, 16 bp, Homo sapiens
ttgggggacagccttc

SEQ ID NO: 6549842 - DNA, 17 bp, Homo sapiens
ttgggggacagccttca

SEQ ID NO: 6549843 - DNA, 21 bp, Homo sapiens
ttgggggacagggctggccca

SEQ ID NO: 6549844 - DNA, 23 bp, Homo sapiens
ttgggggacagggctggcccagc

SEQ ID NO: 6549845 - DNA, 23 bp, Homo sapiens
ttgggggacatgctaaataacta

SEQ ID NO: 6549846 - DNA, 20 bp, Homo sapiens
ttgggggacgcccagccccc

SEQ ID NO: 6549847 - DNA, 23 bp, Homo sapiens
ttgggggaggggagactttgatg

SEQ ID NO: 6549848 - DNA, 16 bp, Homo sapiens
ttgggggattcaaatg

SEQ ID NO: 6549849 - DNA, 13 bp, Homo sapiens
ttgggggcaccat

SEQ ID NO: 6549850 - DNA, 18 bp, Homo sapiens
ttgggggcactcagccac

SEQ ID NO: 6549851 - DNA, 12 bp, Homo sapiens
ttgggggcagac

SEQ ID NO: 6549852 - DNA, 21 bp, Homo sapiens
ttgggggcaggtcaggaccag

SEQ ID NO: 6549853 - DNA, 16 bp, Homo sapiens
ttgggggctggtgcca

SEQ ID NO: 6549854 - DNA, 20 bp, Homo sapiens
ttggggggagagacacagat

SEQ ID NO: 6549855 - DNA, 23 bp, Homo sapiens
ttggggggagggggtgtctgcac

SEQ ID NO: 6549856 - DNA, 13 bp, Homo sapiens
ttggggggccggg

SEQ ID NO: 6549857 - DNA, 18 bp, Homo sapiens
ttgggggggaccctgcct

SEQ ID NO: 6549858 - DNA, 19 bp, Homo sapiens
ttgggggggcgtgagaccc

SEQ ID NO: 6549859 - DNA, 23 bp, Homo sapiens
ttggggggggcccgcctggcaga

SEQ ID NO: 6549860 - DNA, 16 bp, Homo sapiens
ttgggggtaaaaaata

SEQ ID NO: 6549861 - DNA, 18 bp, Homo sapiens
ttgggggtgtggctctgc

SEQ ID NO: 6549862 - DNA, 17 bp, Homo sapiens
ttgggggttcaggcccg

SEQ ID NO: 6549863 - DNA, 19 bp, Homo sapiens
ttggggtactcttgatgtg

SEQ ID NO: 6549864 - DNA, 23 bp, Homo sapiens
ttggggtcaagaaacagccagca

SEQ ID NO: 6549865 - DNA, 15 bp, Homo sapiens
ttggggtcccaggga

SEQ ID NO: 6549866 - DNA, 13 bp, Homo sapiens
ttggggtctcttt

SEQ ID NO: 6549867 - DNA, 14 bp, Homo sapiens
ttggggtctgaccc

SEQ ID NO: 6549868 - DNA, 15 bp, Homo sapiens
ttggggtctgacccc

SEQ ID NO: 6549869 - DNA, 22 bp, Homo sapiens
ttggggtgataaggggccttgc

SEQ ID NO: 6549870 - DNA, 15 bp, Homo sapiens
ttggggtgggagggc

SEQ ID NO: 6549871 - DNA, 18 bp, Homo sapiens
ttggggtgggtataaaag

SEQ ID NO: 6549872 - DNA, 18 bp, Homo sapiens
ttggggtggttgaggcta

SEQ ID NO: 6549873 - DNA, 19 bp, Homo sapiens
ttggggtgtggggtggggt

SEQ ID NO: 6549874 - DNA, 22 bp, Homo sapiens
ttggggttcccccagacagagc

SEQ ID NO: 6549875 - DNA, 20 bp, Homo sapiens
ttggggttcctctgtacagc

SEQ ID NO: 6549876 - DNA, 19 bp, Homo sapiens
ttggggttcggcctgtgtc

SEQ ID NO: 6549877 - DNA, 16 bp, Homo sapiens
ttggggttgtgttgtc

SEQ ID NO: 6549878 - DNA, 17 bp, Homo sapiens
ttggggtttgatttgct

SEQ ID NO: 6549879 - DNA, 20 bp, Homo sapiens
ttggggttttttttttctga

SEQ ID NO: 6549880 - DNA, 20 bp, Homo sapiens
ttgggtacatggcccgcagt

SEQ ID NO: 6549881 - DNA, 18 bp, Homo sapiens
ttgggtacctattttcat

SEQ ID NO: 6549882 - DNA, 14 bp, Homo sapiens
ttgggtagaaaaat

SEQ ID NO: 6549883 - DNA, 21 bp, Homo sapiens
ttgggtatcctgcccagtgtt

SEQ ID NO: 6549884 - DNA, 19 bp, Homo sapiens
ttgggtcacccctccagga

SEQ ID NO: 6549885 - DNA, 23 bp, Homo sapiens
ttgggtcagagaaaatgagaaag

SEQ ID NO: 6549886 - DNA, 21 bp, Homo sapiens
ttgggtcattgacctctcagg

SEQ ID NO: 6549887 - DNA, 23 bp, Homo sapiens
ttgggtcattgacctctcagggc

SEQ ID NO: 6549888 - DNA, 17 bp, Homo sapiens
ttgggtcatttttaact

SEQ ID NO: 6549889 - DNA, 22 bp, Homo sapiens
ttgggtcctgcaatctccaggg

SEQ ID NO: 6549890 - DNA, 15 bp, Homo sapiens
ttgggtcctgggcag

SEQ ID NO: 6549891 - DNA, 16 bp, Homo sapiens
ttgggtcctgggcagg

SEQ ID NO: 6549892 - DNA, 19 bp, Homo sapiens
ttgggtcctgggcaggtgg

SEQ ID NO: 6549893 - DNA, 17 bp, Homo sapiens
ttgggtctgaaaggaaa

SEQ ID NO: 6549894 - DNA, 13 bp, Homo sapiens
ttgggtctgtgtc

SEQ ID NO: 6549895 - DNA, 14 bp, Homo sapiens
ttgggtctgtgtca

SEQ ID NO: 6549896 - DNA, 15 bp, Homo sapiens
ttgggtgaatcttga

SEQ ID NO: 6549897 - DNA, 15 bp, Homo sapiens
ttgggtgatcattca

SEQ ID NO: 6549898 - DNA, 17 bp, Homo sapiens
ttgggtgcctcctgcag

SEQ ID NO: 6549899 - DNA, 22 bp, Homo sapiens
ttgggtgcggtttgctcagccc

SEQ ID NO: 6549900 - DNA, 15 bp, Homo sapiens
ttgggtggagaagcc

SEQ ID NO: 6549901 - DNA, 16 bp, Homo sapiens
ttgggtggagaagcca

SEQ ID NO: 6549902 - DNA, 18 bp, Homo sapiens
ttgggtggagaagccatt

SEQ ID NO: 6549903 - DNA, 19 bp, Homo sapiens
ttgggtggagaagccattg

SEQ ID NO: 6549904 - DNA, 23 bp, Homo sapiens
ttgggtggcaacatttggggaga

SEQ ID NO: 6549905 - DNA, 19 bp, Homo sapiens
ttgggtggccccctctcct

SEQ ID NO: 6549906 - DNA, 18 bp, Homo sapiens
ttgggtgggggctgtggc

SEQ ID NO: 6549907 - DNA, 19 bp, Homo sapiens
ttgggtgggggctgtggcc

SEQ ID NO: 6549908 - DNA, 21 bp, Homo sapiens
ttgggtggggggcattgagta

SEQ ID NO: 6549909 - DNA, 17 bp, Homo sapiens
ttgggtggggggcttca

SEQ ID NO: 6549910 - DNA, 22 bp, Homo sapiens
ttgggtggggggcttcatacac

SEQ ID NO: 6549911 - DNA, 15 bp, Homo sapiens
ttgggtggtttgtga

SEQ ID NO: 6549912 - DNA, 16 bp, Homo sapiens
ttgggtggtttttatt

SEQ ID NO: 6549913 - DNA, 20 bp, Homo sapiens
ttgggtgtagatttctgaca

SEQ ID NO: 6549914 - DNA, 15 bp, Homo sapiens
ttgggtgtattgtgc

SEQ ID NO: 6549915 - DNA, 20 bp, Homo sapiens
ttgggtgtttttcatgtttt

SEQ ID NO: 6549916 - DNA, 16 bp, Homo sapiens
ttgggttaagtatgag

SEQ ID NO: 6549917 - DNA, 12 bp, Homo sapiens
ttgggttagacc

SEQ ID NO: 6549918 - DNA, 13 bp, Homo sapiens
ttgggttcacagc

SEQ ID NO: 6549919 - DNA, 15 bp, Homo sapiens
ttgggttcaggcctg

SEQ ID NO: 6549920 - DNA, 17 bp, Homo sapiens
ttgggttctctgctgtc

SEQ ID NO: 6549921 - DNA, 10 bp, Homo sapiens
ttgggttgac

SEQ ID NO: 6549922 - DNA, 17 bp, Homo sapiens
ttgggtttatttggaaa

SEQ ID NO: 6549923 - DNA, 20 bp, Homo sapiens
ttgggtttgccttaattctt

SEQ ID NO: 6549924 - DNA, 14 bp, Homo sapiens
ttgggtttggccag

SEQ ID NO: 6549925 - DNA, 15 bp, Homo sapiens
ttgggtttggccagg

SEQ ID NO: 6549926 - DNA, 19 bp, Homo sapiens
ttgggtttggccagggagg

SEQ ID NO: 6549927 - DNA, 15 bp, Homo sapiens
ttgggtttggggcca

SEQ ID NO: 6549928 - DNA, 14 bp, Homo sapiens
ttgggtttttaact

SEQ ID NO: 6549929 - DNA, 12 bp, Homo sapiens
ttgggtttttat

SEQ ID NO: 6549930 - DNA, 17 bp, Homo sapiens
ttggtaaaaacagcagc

SEQ ID NO: 6549931 - DNA, 14 bp, Homo sapiens
ttggtaaaaatgct

SEQ ID NO: 6549932 - DNA, 18 bp, Homo sapiens
ttggtaaaaatgctgctc

SEQ ID NO: 6549933 - DNA, 21 bp, Homo sapiens
ttggtaaaacagtttcatcta

SEQ ID NO: 6549934 - DNA, 19 bp, Homo sapiens
ttggtaaaactcactgtga

SEQ ID NO: 6549935 - DNA, 20 bp, Homo sapiens
ttggtaaaactcactgtgat

SEQ ID NO: 6549936 - DNA, 14 bp, Homo sapiens
ttggtaaatgtttc

SEQ ID NO: 6549937 - DNA, 23 bp, Homo sapiens
ttggtaacgaatttaaaatgtag

SEQ ID NO: 6549938 - DNA, 12 bp, Homo sapiens
ttggtaactttt

SEQ ID NO: 6549939 - DNA, 18 bp, Homo sapiens
ttggtaagagacagaatg

SEQ ID NO: 6549940 - DNA, 14 bp, Homo sapiens
ttggtaagagggag

SEQ ID NO: 6549941 - DNA, 23 bp, Homo sapiens
ttggtaagggaagtttagatgag

SEQ ID NO: 6549942 - DNA, 20 bp, Homo sapiens
ttggtaaggggaattgagga

SEQ ID NO: 6549943 - DNA, 19 bp, Homo sapiens
ttggtaatgatgattcaat

SEQ ID NO: 6549944 - DNA, 23 bp, Homo sapiens
ttggtaatgatgattcaatcatt

SEQ ID NO: 6549945 - DNA, 12 bp, Homo sapiens
ttggtaatgtgt

SEQ ID NO: 6549946 - DNA, 14 bp, Homo sapiens
ttggtaattaaaag

SEQ ID NO: 6549947 - DNA, 13 bp, Homo sapiens
ttggtacacatgt

SEQ ID NO: 6549948 - DNA, 16 bp, Homo sapiens
ttggtacacatgtgtt

SEQ ID NO: 6549949 - DNA, 22 bp, Homo sapiens
ttggtacagttcataattcacc

SEQ ID NO: 6549950 - DNA, 23 bp, Homo sapiens
ttggtacagttcataattcacca

SEQ ID NO: 6549951 - DNA, 19 bp, Homo sapiens
ttggtaccagataactttt

SEQ ID NO: 6549952 - DNA, 23 bp, Homo sapiens
ttggtacctctcatttgggcacc

SEQ ID NO: 6549953 - DNA, 14 bp, Homo sapiens
ttggtacctttcta

SEQ ID NO: 6549954 - DNA, 17 bp, Homo sapiens
ttggtagagccctcaga

SEQ ID NO: 6549955 - DNA, 15 bp, Homo sapiens
ttggtagagtttatt

SEQ ID NO: 6549956 - DNA, 16 bp, Homo sapiens
ttggtagatgacaaat

SEQ ID NO: 6549957 - DNA, 21 bp, Homo sapiens
ttggtagggtgagtgtttcca

SEQ ID NO: 6549958 - DNA, 14 bp, Homo sapiens
ttggtaggtaaatc

SEQ ID NO: 6549959 - DNA, 13 bp, Homo sapiens
ttggtagtttctg

SEQ ID NO: 6549960 - DNA, 16 bp, Homo sapiens
ttggtataatgtttaa

SEQ ID NO: 6549961 - DNA, 18 bp, Homo sapiens
tgttccttgtactcttag

SEQ ID NO: 6549962 - DNA, 22 bp, Homo sapiens
tgttcctttatttaggaaacac

SEQ ID NO: 6549963 - DNA, 17 bp, Homo sapiens
tgttcctttctctgggc

SEQ ID NO: 6549964 - DNA, 19 bp, Homo sapiens
tgttcctttctctgggctt

SEQ ID NO: 6549965 - DNA, 16 bp, Homo sapiens
tgttcctttgaagaat

SEQ ID NO: 6549966 - DNA, 22 bp, Homo sapiens
tgttcctttgaagaattgtagt

SEQ ID NO: 6549967 - DNA, 20 bp, Homo sapiens
tgttcctttttaaatgtgaa

SEQ ID NO: 6549968 - DNA, 21 bp, Homo sapiens
tgttcctttttaaatgtgaat

SEQ ID NO: 6549969 - DNA, 20 bp, Homo sapiens
tgttcctttttaggtacagt

SEQ ID NO: 6549970 - DNA, 16 bp, Homo sapiens
tgttcctttttgtaaa

SEQ ID NO: 6549971 - DNA, 22 bp, Homo sapiens
tgttccttttttcaatatgcaa

SEQ ID NO: 6549972 - DNA, 17 bp, Homo sapiens
tgttcgaagttcatttt

SEQ ID NO: 6549973 - DNA, 22 bp, Homo sapiens
tgttcgcatggtcacacactga

SEQ ID NO: 6549974 - DNA, 15 bp, Homo sapiens
tgttcgcgtgtgtgg

SEQ ID NO: 6549975 - DNA, 23 bp, Homo sapiens
tgttcgcgtgtgtgggtggatat

SEQ ID NO: 6549976 - DNA, 13 bp, Homo sapiens
tgttcgctggctg

SEQ ID NO: 6549977 - DNA, 19 bp, Homo sapiens
tgttcgcttggctccatgc

SEQ ID NO: 6549978 - DNA, 20 bp, Homo sapiens
tgttcggaaggggttcctca

SEQ ID NO: 6549979 - DNA, 19 bp, Homo sapiens
tgttcgggccaaggacctg

SEQ ID NO: 6549980 - DNA, 15 bp, Homo sapiens
tgttcgggggagcag

SEQ ID NO: 6549981 - DNA, 14 bp, Homo sapiens
tgttcgtattacaa

SEQ ID NO: 6549982 - DNA, 20 bp, Homo sapiens
tgttcgtattacaagagaaa

SEQ ID NO: 6549983 - DNA, 17 bp, Homo sapiens
tgttcgttgcacagctg

SEQ ID NO: 6549984 - DNA, 18 bp, Homo sapiens
tgttcgttgcacagctgt

SEQ ID NO: 6549985 - DNA, 20 bp, Homo sapiens
tgttcgttgcacagctgttt

SEQ ID NO: 6549986 - DNA, 17 bp, Homo sapiens
tgttctaaaatgaaata

SEQ ID NO: 6549987 - DNA, 19 bp, Homo sapiens
tgttctaaagctctgacat

SEQ ID NO: 6549988 - DNA, 19 bp, Homo sapiens
tgttctaaaggctgttaaa

SEQ ID NO: 6549989 - DNA, 22 bp, Homo sapiens
tgttctaaatatcccttggaca

SEQ ID NO: 6549990 - DNA, 14 bp, Homo sapiens
tgttctaagatgtg

SEQ ID NO: 6549991 - DNA, 15 bp, Homo sapiens
tgttctaaggctctg

SEQ ID NO: 6549992 - DNA, 19 bp, Homo sapiens
tgttctaaggctctgagag

SEQ ID NO: 6549993 - DNA, 23 bp, Homo sapiens
tgttctaaggctctgagagtcta

SEQ ID NO: 6549994 - DNA, 14 bp, Homo sapiens
tgttctaagtttct

SEQ ID NO: 6549995 - DNA, 22 bp, Homo sapiens
tgttctaagtttctaagattct

SEQ ID NO: 6549996 - DNA, 13 bp, Homo sapiens
tgttctacatggc

SEQ ID NO: 6549997 - DNA, 15 bp, Homo sapiens
tgttctactttgttc

SEQ ID NO: 6549998 - DNA, 22 bp, Homo sapiens
tgttctagacttccccatcccg

SEQ ID NO: 6549999 - DNA, 19 bp, Homo sapiens
tgttctagattatgtcttt

SEQ ID NO: 6550000 - DNA, 20 bp, Homo sapiens
tgttctagcaagatagtctt

SEQ ID NO: 6550001 - DNA, 15 bp, Homo sapiens
tgttctagtactgta

SEQ ID NO: 6550002 - DNA, 19 bp, Homo sapiens
tgttctagttagcaggaaa

SEQ ID NO: 6550003 - DNA, 19 bp, Homo sapiens
tgttctatagagcctggcg

SEQ ID NO: 6550004 - DNA, 17 bp, Homo sapiens
tgttctatataattttt

SEQ ID NO: 6550005 - DNA, 14 bp, Homo sapiens
tgttctatccaaac

SEQ ID NO: 6550006 - DNA, 18 bp, Homo sapiens
tgttctatccaaacatgt

SEQ ID NO: 6550007 - DNA, 13 bp, Homo sapiens
tgttctatgcaaa

SEQ ID NO: 6550008 - DNA, 18 bp, Homo sapiens
tgttctatgcttcctcgt

SEQ ID NO: 6550009 - DNA, 14 bp, Homo sapiens
tgttctatggacca

SEQ ID NO: 6550010 - DNA, 18 bp, Homo sapiens
tgttctatggaccaaatg

SEQ ID NO: 6550011 - DNA, 16 bp, Homo sapiens
tgttctatttttcaat

SEQ ID NO: 6550012 - DNA, 20 bp, Homo sapiens
tgttctcaaagcagaagtgg

SEQ ID NO: 6550013 - DNA, 24 bp, Homo sapiens
tgttctcaacatactgtaatcaaa

SEQ ID NO: 6550014 - DNA, 18 bp, Homo sapiens
tgttctcacagtgacacc

SEQ ID NO: 6550015 - DNA, 12 bp, Homo sapiens
tgttctcagagc

SEQ ID NO: 6550016 - DNA, 14 bp, Homo sapiens
tgttctcagagctc

SEQ ID NO: 6550017 - DNA, 21 bp, Homo sapiens
tgttctcagagctccacagaa

SEQ ID NO: 6550018 - DNA, 21 bp, Homo sapiens
tgttctcagctccgtcatctg

SEQ ID NO: 6550019 - DNA, 18 bp, Homo sapiens
tgttctcattcctgttct

SEQ ID NO: 6550020 - DNA, 23 bp, Homo sapiens
tgttctcattcctgttctttctt

SEQ ID NO: 6550021 - DNA, 19 bp, Homo sapiens
tgttctccactgacacaaa

SEQ ID NO: 6550022 - DNA, 19 bp, Homo sapiens
tgttctccattttcaagct

SEQ ID NO: 6550023 - DNA, 21 bp, Homo sapiens
tgttctccgggtgtggcctca

SEQ ID NO: 6550024 - DNA, 22 bp, Homo sapiens
tgttctcctagactgaccctga

SEQ ID NO: 6550025 - DNA, 16 bp, Homo sapiens
tgttctcctccaaatg

SEQ ID NO: 6550026 - DNA, 22 bp, Homo sapiens
tgttctcctgctgctccctcag

SEQ ID NO: 6550027 - DNA, 22 bp, Homo sapiens
tgttctcgaactcctgacctca

SEQ ID NO: 6550028 - DNA, 16 bp, Homo sapiens
tgttctcgttgcccta

SEQ ID NO: 6550029 - DNA, 20 bp, Homo sapiens
tgttctcgttgccctaattc

SEQ ID NO: 6550030 - DNA, 15 bp, Homo sapiens
tgttctctatcattt

SEQ ID NO: 6550031 - DNA, 13 bp, Homo sapiens
tgttctctcccct

SEQ ID NO: 6550032 - DNA, 21 bp, Homo sapiens
tgttctctccccttgcactgg

SEQ ID NO: 6550033 - DNA, 12 bp, Homo sapiens
tgttctctcttg

SEQ ID NO: 6550034 - DNA, 11 bp, Homo sapiens
tgttctctgaa

SEQ ID NO: 6550035 - DNA, 13 bp, Homo sapiens
tgttctctgagga

SEQ ID NO: 6550036 - DNA, 16 bp, Homo sapiens
tgttctctgaggacac

SEQ ID NO: 6550037 - DNA, 12 bp, Homo sapiens
tgttctctgctg

SEQ ID NO: 6550038 - DNA, 13 bp, Homo sapiens
tgttctctgctga

SEQ ID NO: 6550039 - DNA, 15 bp, Homo sapiens
tgttctctgctgagg

SEQ ID NO: 6550040 - DNA, 17 bp, Homo sapiens
tgttctctgctgagggc

SEQ ID NO: 6550041 - DNA, 19 bp, Homo sapiens
tgttctctgctgagggcca

SEQ ID NO: 6550042 - DNA, 15 bp, Homo sapiens
tgttctctgcttttc

SEQ ID NO: 6550043 - DNA, 14 bp, Homo sapiens
tgttctctgggaga

SEQ ID NO: 6550044 - DNA, 16 bp, Homo sapiens
tgttctctgggagaaa

SEQ ID NO: 6550045 - DNA, 16 bp, Homo sapiens
tgttctcttcccaggc

SEQ ID NO: 6550046 - DNA, 19 bp, Homo sapiens
tgttctcttcccaggcctt

SEQ ID NO: 6550047 - DNA, 23 bp, Homo sapiens
tgttctcttgggaactgaactca

SEQ ID NO: 6550048 - DNA, 14 bp, Homo sapiens
tgttctctttgctg

SEQ ID NO: 6550049 - DNA, 22 bp, Homo sapiens
tgttctctttgctgacactgtg

SEQ ID NO: 6550050 - DNA, 21 bp, Homo sapiens
tgttctgaaggtgcccaggag

SEQ ID NO: 6550051 - DNA, 15 bp, Homo sapiens
tgttctgacagttgt

SEQ ID NO: 6550052 - DNA, 13 bp, Homo sapiens
tgttctgacatta

SEQ ID NO: 6550053 - DNA, 15 bp, Homo sapiens
tgttctgacattaac

SEQ ID NO: 6550054 - DNA, 15 bp, Homo sapiens
tgttctgaccctgct

SEQ ID NO: 6550055 - DNA, 18 bp, Homo sapiens
tgttctgaccctgcttca

SEQ ID NO: 6550056 - DNA, 16 bp, Homo sapiens
tgttctgagaactgac

SEQ ID NO: 6550057 - DNA, 22 bp, Homo sapiens
tgttctgagaactgactttctc

SEQ ID NO: 6550058 - DNA, 21 bp, Homo sapiens
tgttctgagattcaatattga

SEQ ID NO: 6550059 - DNA, 18 bp, Homo sapiens
tgttctgagctataacat

SEQ ID NO: 6550060 - DNA, 15 bp, Homo sapiens
tgttctgataatgaa

SEQ ID NO: 6550061 - DNA, 20 bp, Homo sapiens
tgttctgatgaggcatttta

SEQ ID NO: 6550062 - DNA, 16 bp, Homo sapiens
tgttctgattagaaat

SEQ ID NO: 6550063 - DNA, 19 bp, Homo sapiens
tgttctgattagaaatgac

SEQ ID NO: 6550064 - DNA, 12 bp, Homo sapiens
tgttctgcaaag

SEQ ID NO: 6550065 - DNA, 14 bp, Homo sapiens
tgttctgcaactcc

SEQ ID NO: 6550066 - DNA, 23 bp, Homo sapiens
tgttctgcaagaattaaaactga

SEQ ID NO: 6550067 - DNA, 16 bp, Homo sapiens
tgttctgcactgaaaa

SEQ ID NO: 6550068 - DNA, 16 bp, Homo sapiens
tgttctgcatggattc

SEQ ID NO: 6550069 - DNA, 16 bp, Homo sapiens
tgttctgcccccagcc

SEQ ID NO: 6550070 - DNA, 11 bp, Homo sapiens
tgttctgcctc

SEQ ID NO: 6550071 - DNA, 15 bp, Homo sapiens
tgttctgcctctccc

SEQ ID NO: 6550072 - DNA, 19 bp, Homo sapiens
tgttctgcgctgtgtacaa

SEQ ID NO: 6550073 - DNA, 20 bp, Homo sapiens
tgttctgctaaatttcaaat

SEQ ID NO: 6550074 - DNA, 22 bp, Homo sapiens
tgttctgctccataccttttct

SEQ ID NO: 6550075 - DNA, 12 bp, Homo sapiens
tgttctgctcct

SEQ ID NO: 6550076 - DNA, 23 bp, Homo sapiens
tgttctgctcctgcttttctgtc

SEQ ID NO: 6550077 - DNA, 24 bp, Homo sapiens
tgttctgctcctgcttttctgtcc

SEQ ID NO: 6550078 - DNA, 14 bp, Homo sapiens
tgttctgctgttct

SEQ ID NO: 6550079 - DNA, 22 bp, Homo sapiens
tgttctgctttatcttttcata

SEQ ID NO: 6550080 - DNA, 16 bp, Homo sapiens
tgttctggacctcccc

SEQ ID NO: 6550081 - DNA, 20 bp, Homo sapiens
tgttctggacctccccctct

SEQ ID NO: 6550082 - DNA, 15 bp, Homo sapiens
tgttctggagctgct

SEQ ID NO: 6550083 - DNA, 16 bp, Homo sapiens
tgttctggcctcagac

SEQ ID NO: 6550084 - DNA, 14 bp, Homo sapiens
tgttctgggacaca

SEQ ID NO: 6550085 - DNA, 19 bp, Homo sapiens
tgttctgggactccaggtc

SEQ ID NO: 6550086 - DNA, 22 bp, Homo sapiens
tgttctgggagttgctgttaat

SEQ ID NO: 6550087 - DNA, 12 bp, Homo sapiens
tgttctgggctc

SEQ ID NO: 6550088 - DNA, 15 bp, Homo sapiens
tgttctgggctcttt

SEQ ID NO: 6550089 - DNA, 21 bp, Homo sapiens
tgttctggggggacccagtgc

SEQ ID NO: 6550090 - DNA, 23 bp, Homo sapiens
tgttctggggggacccagtgcag

SEQ ID NO: 6550091 - DNA, 16 bp, Homo sapiens
tgttctggtatacatt

SEQ ID NO: 6550092 - DNA, 14 bp, Homo sapiens
tgttctggtggccc

SEQ ID NO: 6550093 - DNA, 23 bp, Homo sapiens
tgttctggtggccccagctgtga

SEQ ID NO: 6550094 - DNA, 22 bp, Homo sapiens
tgttctgtagattcatgcaagt

SEQ ID NO: 6550095 - DNA, 17 bp, Homo sapiens
tgttctgtagctttctg

SEQ ID NO: 6550096 - DNA, 18 bp, Homo sapiens
tgttctgtccagtttcca

SEQ ID NO: 6550097 - DNA, 16 bp, Homo sapiens
tgttctgtcccttgcc

SEQ ID NO: 6550098 - DNA, 14 bp, Homo sapiens
tgttctgtcttccc

SEQ ID NO: 6550099 - DNA, 18 bp, Homo sapiens
tgttctgtgatataagtg

SEQ ID NO: 6550100 - DNA, 21 bp, Homo sapiens
tgttctgtggaaagtgtaaag

SEQ ID NO: 6550101 - DNA, 22 bp, Homo sapiens
tgttctgtggaaagtgtaaagc

SEQ ID NO: 6550102 - DNA, 19 bp, Homo sapiens
tgttctgtggtcacagtga

SEQ ID NO: 6550103 - DNA, 19 bp, Homo sapiens
tgttctgtggttcctctgc

SEQ ID NO: 6550104 - DNA, 12 bp, Homo sapiens
tgttctgtgtac

SEQ ID NO: 6550105 - DNA, 20 bp, Homo sapiens
tgttctgtgtcacgtgaccc

SEQ ID NO: 6550106 - DNA, 12 bp, Homo sapiens
tgttctgtgtcc

SEQ ID NO: 6550107 - DNA, 14 bp, Homo sapiens
tgttctgtgtccct

SEQ ID NO: 6550108 - DNA, 17 bp, Homo sapiens
tgttctgtgtctgctgt

SEQ ID NO: 6550109 - DNA, 22 bp, Homo sapiens
tgttctgtgtgggtctggggag

SEQ ID NO: 6550110 - DNA, 19 bp, Homo sapiens
tgttctgttaactgaatac

SEQ ID NO: 6550111 - DNA, 23 bp, Homo sapiens
tgttctgttaactgaataccact

SEQ ID NO: 6550112 - DNA, 15 bp, Homo sapiens
tgttctgttacaaaa

SEQ ID NO: 6550113 - DNA, 19 bp, Homo sapiens
tgttctgttacaaaatgta

SEQ ID NO: 6550114 - DNA, 22 bp, Homo sapiens
tgttctgttacaaaatgtaact

SEQ ID NO: 6550115 - DNA, 23 bp, Homo sapiens
tgttctgttacaaaatgtaactg

SEQ ID NO: 6550116 - DNA, 16 bp, Homo sapiens
tgttctgttcatttcc

SEQ ID NO: 6550117 - DNA, 16 bp, Homo sapiens
tgttctgttctggggg

SEQ ID NO: 6550118 - DNA, 14 bp, Homo sapiens
tgttctgttgtaaa

SEQ ID NO: 6550119 - DNA, 14 bp, Homo sapiens
tgttctgttgtctg

SEQ ID NO: 6550120 - DNA, 10 bp, Homo sapiens
tgttctgttt

SEQ ID NO: 6550121 - DNA, 13 bp, Homo sapiens
tgttctgtttaat

SEQ ID NO: 6550122 - DNA, 22 bp, Homo sapiens
tgttctgtttggcacttgtatt

SEQ ID NO: 6550123 - DNA, 14 bp, Homo sapiens
tgttctgtttgtgt

SEQ ID NO: 6550124 - DNA, 14 bp, Homo sapiens
tgttctgtttgtta

SEQ ID NO: 6550125 - DNA, 11 bp, Homo sapiens
tgttcttaaaa

SEQ ID NO: 6550126 - DNA, 19 bp, Homo sapiens
tgttcttaaaaaaataaaa

SEQ ID NO: 6550127 - DNA, 20 bp, Homo sapiens
tgttcttaaaaatgcattta

SEQ ID NO: 6550128 - DNA, 16 bp, Homo sapiens
tgttcttaagacgtga

SEQ ID NO: 6550129 - DNA, 14 bp, Homo sapiens
tgttcttaattctt

SEQ ID NO: 6550130 - DNA, 16 bp, Homo sapiens
tgttcttaattcttag

SEQ ID NO: 6550131 - DNA, 17 bp, Homo sapiens
tgttcttaattgcactc

SEQ ID NO: 6550132 - DNA, 14 bp, Homo sapiens
tgttcttacaaatg

SEQ ID NO: 6550133 - DNA, 20 bp, Homo sapiens
tgttcttacaaatgtgaaac

SEQ ID NO: 6550134 - DNA, 14 bp, Homo sapiens
tgttcttacacata

SEQ ID NO: 6550135 - DNA, 16 bp, Homo sapiens
tgttcttacacataca

SEQ ID NO: 6550136 - DNA, 21 bp, Homo sapiens
tgttcttactgtaactacttc

SEQ ID NO: 6550137 - DNA, 14 bp, Homo sapiens
tgttcttagagtgt

SEQ ID NO: 6550138 - DNA, 20 bp, Homo sapiens
tgttcttagagtgtagctgt

SEQ ID NO: 6550139 - DNA, 12 bp, Homo sapiens
ttggtatatttt

SEQ ID NO: 6550140 - DNA, 17 bp, Homo sapiens
ttggtatcaagaaagtc

SEQ ID NO: 6550141 - DNA, 13 bp, Homo sapiens
ttggtatctcagg

SEQ ID NO: 6550142 - DNA, 18 bp, Homo sapiens
ttggtatctgttctttaa

SEQ ID NO: 6550143 - DNA, 14 bp, Homo sapiens
ttggtatgaaacaa

SEQ ID NO: 6550144 - DNA, 22 bp, Homo sapiens
ttggtatggagttggcagacag

SEQ ID NO: 6550145 - DNA, 18 bp, Homo sapiens
ttggtatgtgccaggctt

SEQ ID NO: 6550146 - DNA, 21 bp, Homo sapiens
ttggtattatataattcaagg

SEQ ID NO: 6550147 - DNA, 17 bp, Homo sapiens
ttggtattgtcttaaat

SEQ ID NO: 6550148 - DNA, 17 bp, Homo sapiens
ttggtatttactgcaat

SEQ ID NO: 6550149 - DNA, 23 bp, Homo sapiens
ttggtatttatctattgtaagat

SEQ ID NO: 6550150 - DNA, 15 bp, Homo sapiens
ttggtatttgtttaa

SEQ ID NO: 6550151 - DNA, 18 bp, Homo sapiens
ttggtatttgtttaatac

SEQ ID NO: 6550152 - DNA, 20 bp, Homo sapiens
ttggtatttgtttgtagctt

SEQ ID NO: 6550153 - DNA, 17 bp, Homo sapiens
ttggtcaagaaaggagg

SEQ ID NO: 6550154 - DNA, 13 bp, Homo sapiens
ttggtcaaggcca

SEQ ID NO: 6550155 - DNA, 20 bp, Homo sapiens
ttggtcaaggccacctctgc

SEQ ID NO: 6550156 - DNA, 22 bp, Homo sapiens
ttggtcaaggccacctctgcct

SEQ ID NO: 6550157 - DNA, 23 bp, Homo sapiens
ttggtcaaggccacctctgcctc

SEQ ID NO: 6550158 - DNA, 23 bp, Homo sapiens
ttggtcacaagtaggagacacag

SEQ ID NO: 6550159 - DNA, 14 bp, Homo sapiens
ttggtcacccagac

SEQ ID NO: 6550160 - DNA, 16 bp, Homo sapiens
ttggtcagaatgcagt

SEQ ID NO: 6550161 - DNA, 13 bp, Homo sapiens
ttggtcagaggag

SEQ ID NO: 6550162 - DNA, 15 bp, Homo sapiens
ttggtcagcttttgt

SEQ ID NO: 6550163 - DNA, 21 bp, Homo sapiens
ttggtcatatcaaacattaaa

SEQ ID NO: 6550164 - DNA, 19 bp, Homo sapiens
ttggtcatggtagattttt

SEQ ID NO: 6550165 - DNA, 19 bp, Homo sapiens
ttggtcatgtgggtcttcc

SEQ ID NO: 6550166 - DNA, 22 bp, Homo sapiens
ttggtcattcctaatgcattag

SEQ ID NO: 6550167 - DNA, 13 bp, Homo sapiens
ttggtcatttggc

SEQ ID NO: 6550168 - DNA, 20 bp, Homo sapiens
ttggtcatttggcagcccct

SEQ ID NO: 6550169 - DNA, 13 bp, Homo sapiens
ttggtccaaaaaa

SEQ ID NO: 6550170 - DNA, 14 bp, Homo sapiens
ttggtccaaaaaaa

SEQ ID NO: 6550171 - DNA, 16 bp, Homo sapiens
ttggtccaaaaaaagg

SEQ ID NO: 6550172 - DNA, 22 bp, Homo sapiens
ttggtccaaaaaaaggaaaaat

SEQ ID NO: 6550173 - DNA, 23 bp, Homo sapiens
ttggtccaaattctttattcttc

SEQ ID NO: 6550174 - DNA, 15 bp, Homo sapiens
ttggtccaagattcc

SEQ ID NO: 6550175 - DNA, 20 bp, Homo sapiens
ttggtccagattgaaaagtg

SEQ ID NO: 6550176 - DNA, 15 bp, Homo sapiens
ttggtccaggaaatg

SEQ ID NO: 6550177 - DNA, 14 bp, Homo sapiens
ttggtccccagcat

SEQ ID NO: 6550178 - DNA, 20 bp, Homo sapiens
ttggtcccctccctcgtggg

SEQ ID NO: 6550179 - DNA, 13 bp, Homo sapiens
ttggtccctgggg

SEQ ID NO: 6550180 - DNA, 21 bp, Homo sapiens
ttggtcctaagtccctgcccc

SEQ ID NO: 6550181 - DNA, 19 bp, Homo sapiens
ttggtcctacctattatcc

SEQ ID NO: 6550182 - DNA, 13 bp, Homo sapiens
ttggtcctgtcac

SEQ ID NO: 6550183 - DNA, 19 bp, Homo sapiens
ttggtcctgtcaccctggc

SEQ ID NO: 6550184 - DNA, 22 bp, Homo sapiens
ttggtcctgttaaccctccacc

SEQ ID NO: 6550185 - DNA, 19 bp, Homo sapiens
ttggtccttctttcctctt

SEQ ID NO: 6550186 - DNA, 13 bp, Homo sapiens
ttggtctattttc

SEQ ID NO: 6550187 - DNA, 16 bp, Homo sapiens
ttggtctcactacttg

SEQ ID NO: 6550188 - DNA, 23 bp, Homo sapiens
ttggtctcctggatgggcctttg

SEQ ID NO: 6550189 - DNA, 19 bp, Homo sapiens
ttggtctctcccagctctg

SEQ ID NO: 6550190 - DNA, 20 bp, Homo sapiens
ttggtctgacccactgcttt

SEQ ID NO: 6550191 - DNA, 18 bp, Homo sapiens
ttggtctgccttctgctg

SEQ ID NO: 6550192 - DNA, 13 bp, Homo sapiens
ttggtctggactg

SEQ ID NO: 6550193 - DNA, 17 bp, Homo sapiens
ttggtctgtacaaataa

SEQ ID NO: 6550194 - DNA, 14 bp, Homo sapiens
ttggtctgtactga

SEQ ID NO: 6550195 - DNA, 15 bp, Homo sapiens
ttggtctgtgagatg

SEQ ID NO: 6550196 - DNA, 18 bp, Homo sapiens
ttggtcttactttgtgca

SEQ ID NO: 6550197 - DNA, 17 bp, Homo sapiens
ttggtcttactttgtta

SEQ ID NO: 6550198 - DNA, 18 bp, Homo sapiens
ttggtcttagctttacat

SEQ ID NO: 6550199 - DNA, 20 bp, Homo sapiens
ttggtcttagctttacattt

SEQ ID NO: 6550200 - DNA, 18 bp, Homo sapiens
ttggtcttctactgcctt

SEQ ID NO: 6550201 - DNA, 12 bp, Homo sapiens
ttggtcttgccc

SEQ ID NO: 6550202 - DNA, 21 bp, Homo sapiens
ttggtgaaaataagaaagaat

SEQ ID NO: 6550203 - DNA, 22 bp, Homo sapiens
ttggtgaaataataaaatgcaa

SEQ ID NO: 6550204 - DNA, 19 bp, Homo sapiens
ttggtgaaggatccaggaa

SEQ ID NO: 6550205 - DNA, 14 bp, Homo sapiens
ttggtgaagtaaat

SEQ ID NO: 6550206 - DNA, 12 bp, Homo sapiens
ttggtgaataac

SEQ ID NO: 6550207 - DNA, 15 bp, Homo sapiens
ttggtgacaatgtca

SEQ ID NO: 6550208 - DNA, 20 bp, Homo sapiens
ttggtgaccagtttcttaaa

SEQ ID NO: 6550209 - DNA, 20 bp, Homo sapiens
ttggtgacttgtctgcctcc

SEQ ID NO: 6550210 - DNA, 21 bp, Homo sapiens
ttggtgagaaacctgtatctt

SEQ ID NO: 6550211 - DNA, 22 bp, Homo sapiens
ttggtgagaaagggattgctga

SEQ ID NO: 6550212 - DNA, 14 bp, Homo sapiens
ttggtgagaacctg

SEQ ID NO: 6550213 - DNA, 18 bp, Homo sapiens
ttggtgagcagagcggga

SEQ ID NO: 6550214 - DNA, 14 bp, Homo sapiens
ttggtgataagtgg

SEQ ID NO: 6550215 - DNA, 18 bp, Homo sapiens
ttggtgatactgtcaagc

SEQ ID NO: 6550216 - DNA, 16 bp, Homo sapiens
ttggtgatgagactta

SEQ ID NO: 6550217 - DNA, 19 bp, Homo sapiens
ttggtgatggaaaaagcgc

SEQ ID NO: 6550218 - DNA, 20 bp, Homo sapiens
ttggtgattaaggtcctgct

SEQ ID NO: 6550219 - DNA, 16 bp, Homo sapiens
ttggtgattttagatt

SEQ ID NO: 6550220 - DNA, 19 bp, Homo sapiens
ttggtgcaattaactctgg

SEQ ID NO: 6550221 - DNA, 16 bp, Homo sapiens
ttggtgcacagcacaa

SEQ ID NO: 6550222 - DNA, 15 bp, Homo sapiens
ttggtgcacagtgat

SEQ ID NO: 6550223 - DNA, 22 bp, Homo sapiens
ttggtgcatagaactgggtaaa

SEQ ID NO: 6550224 - DNA, 20 bp, Homo sapiens
ttggtgcatgtctgttcttc

SEQ ID NO: 6550225 - DNA, 12 bp, Homo sapiens
ttggtgcattcg

SEQ ID NO: 6550226 - DNA, 18 bp, Homo sapiens
ttggtgccgatgttgaac

SEQ ID NO: 6550227 - DNA, 21 bp, Homo sapiens
ttggtgcctttcctgttcagc

SEQ ID NO: 6550228 - DNA, 21 bp, Homo sapiens
ttggtgcggtaggtgctggcc

SEQ ID NO: 6550229 - DNA, 15 bp, Homo sapiens
ttggtgctatttgaa

SEQ ID NO: 6550230 - DNA, 19 bp, Homo sapiens
ttggtgctctgaatttctt

SEQ ID NO: 6550231 - DNA, 14 bp, Homo sapiens
ttggtgctgatgga

SEQ ID NO: 6550232 - DNA, 13 bp, Homo sapiens
ttggtgctggttt

SEQ ID NO: 6550233 - DNA, 16 bp, Homo sapiens
ttggtgctttgcattt

SEQ ID NO: 6550234 - DNA, 19 bp, Homo sapiens
ttggtgctttttataaaaa

SEQ ID NO: 6550235 - DNA, 17 bp, Homo sapiens
ttggtggaatctttagc

SEQ ID NO: 6550236 - DNA, 20 bp, Homo sapiens
ttggtggaattcctctttaa

SEQ ID NO: 6550237 - DNA, 17 bp, Homo sapiens
ttggtggagcagccaga

SEQ ID NO: 6550238 - DNA, 19 bp, Homo sapiens
ttggtggagcagccagagc

SEQ ID NO: 6550239 - DNA, 18 bp, Homo sapiens
ttggtggatgggccctgc

SEQ ID NO: 6550240 - DNA, 14 bp, Homo sapiens
ttggtggccaggct

SEQ ID NO: 6550241 - DNA, 17 bp, Homo sapiens
ttggtggccaggctggt

SEQ ID NO: 6550242 - DNA, 23 bp, Homo sapiens
ttggtggccgcaaccacttgcta

SEQ ID NO: 6550243 - DNA, 18 bp, Homo sapiens
ttggtggcctaatttaca

SEQ ID NO: 6550244 - DNA, 13 bp, Homo sapiens
ttggtgggagggt

SEQ ID NO: 6550245 - DNA, 15 bp, Homo sapiens
ttggtggggccaggc

SEQ ID NO: 6550246 - DNA, 21 bp, Homo sapiens
ttggtggggctcgtggccttc

SEQ ID NO: 6550247 - DNA, 21 bp, Homo sapiens
ttggtgggggagcctctggaa

SEQ ID NO: 6550248 - DNA, 23 bp, Homo sapiens
ttggtggggggtccagtctgtga

SEQ ID NO: 6550249 - DNA, 15 bp, Homo sapiens
ttggtggggtggcac

SEQ ID NO: 6550250 - DNA, 22 bp, Homo sapiens
ttggtggggtggcacctgtttc

SEQ ID NO: 6550251 - DNA, 16 bp, Homo sapiens
ttggtgtaacttaaat

SEQ ID NO: 6550252 - DNA, 15 bp, Homo sapiens
ttggtgtaatttgaa

SEQ ID NO: 6550253 - DNA, 12 bp, Homo sapiens
ttggtgtactgt

SEQ ID NO: 6550254 - DNA, 17 bp, Homo sapiens
ttggtgtatatcatgaa

SEQ ID NO: 6550255 - DNA, 18 bp, Homo sapiens
ttggtgtattatcatttt

SEQ ID NO: 6550256 - DNA, 17 bp, Homo sapiens
ttggtgtcattattcca

SEQ ID NO: 6550257 - DNA, 18 bp, Homo sapiens
ttggtgtcgggcatgaca

SEQ ID NO: 6550258 - DNA, 20 bp, Homo sapiens
ttggtgtctgatgtgtgccc

SEQ ID NO: 6550259 - DNA, 21 bp, Homo sapiens
ttggtgtgaatgctgtacctt

SEQ ID NO: 6550260 - DNA, 13 bp, Homo sapiens
ttggtgtgccctg

SEQ ID NO: 6550261 - DNA, 17 bp, Homo sapiens
ttggtgtgccctgtgtg

SEQ ID NO: 6550262 - DNA, 21 bp, Homo sapiens
ttggtgtggcccatggctgtt

SEQ ID NO: 6550263 - DNA, 18 bp, Homo sapiens
ttggtgtggctgtattca

SEQ ID NO: 6550264 - DNA, 16 bp, Homo sapiens
ttggtgtgtggagatg

SEQ ID NO: 6550265 - DNA, 19 bp, Homo sapiens
ttggtgtgttcctgtggga

SEQ ID NO: 6550266 - DNA, 23 bp, Homo sapiens
ttggtgtgttcgtggagccacag

SEQ ID NO: 6550267 - DNA, 16 bp, Homo sapiens
ttggtgtgttttgctc

SEQ ID NO: 6550268 - DNA, 17 bp, Homo sapiens
ttggtgttcctggaagc

SEQ ID NO: 6550269 - DNA, 19 bp, Homo sapiens
ttggtgttcctggaagcag

SEQ ID NO: 6550270 - DNA, 22 bp, Homo sapiens
ttggtgttcgtttccatcatgt

SEQ ID NO: 6550271 - DNA, 13 bp, Homo sapiens
ttggtgttcttcc

SEQ ID NO: 6550272 - DNA, 13 bp, Homo sapiens
ttggtgttggctg

SEQ ID NO: 6550273 - DNA, 18 bp, Homo sapiens
ttggtgtttgactgtaat

SEQ ID NO: 6550274 - DNA, 17 bp, Homo sapiens
ttggttaaaaaaaagaa

SEQ ID NO: 6550275 - DNA, 12 bp, Homo sapiens
ttggttaaataa

SEQ ID NO: 6550276 - DNA, 22 bp, Homo sapiens
ttggttaacaataaagtgacaa

SEQ ID NO: 6550277 - DNA, 18 bp, Homo sapiens
ttggttaagtctgtttta

SEQ ID NO: 6550278 - DNA, 12 bp, Homo sapiens
ttggttaatatg

SEQ ID NO: 6550279 - DNA, 22 bp, Homo sapiens
ttggttaatcacttaacctgct

SEQ ID NO: 6550280 - DNA, 16 bp, Homo sapiens
ttggttaatcagtgtt

SEQ ID NO: 6550281 - DNA, 21 bp, Homo sapiens
ttggttaatgaaaaatctgaa

SEQ ID NO: 6550282 - DNA, 17 bp, Homo sapiens
ttggttagaacctccta

SEQ ID NO: 6550283 - DNA, 22 bp, Homo sapiens
ttggttagacgccttccaggtc

SEQ ID NO: 6550284 - DNA, 20 bp, Homo sapiens
ttggttagaggaaggctgaa

SEQ ID NO: 6550285 - DNA, 14 bp, Homo sapiens
ttggttatacatga

SEQ ID NO: 6550286 - DNA, 23 bp, Homo sapiens
ttggttatacatgacactgaaat

SEQ ID NO: 6550287 - DNA, 19 bp, Homo sapiens
ttggttatggttatgttca

SEQ ID NO: 6550288 - DNA, 15 bp, Homo sapiens
ttggttatttctaaa

SEQ ID NO: 6550289 - DNA, 16 bp, Homo sapiens
ttggttatttctaaac

SEQ ID NO: 6550290 - DNA, 14 bp, Homo sapiens
ttggttcatgcctg

SEQ ID NO: 6550291 - DNA, 15 bp, Homo sapiens
ttggttcatgcctgg

SEQ ID NO: 6550292 - DNA, 16 bp, Homo sapiens
ttggttcatgcctggg

SEQ ID NO: 6550293 - DNA, 12 bp, Homo sapiens
ttggttcatgtg

SEQ ID NO: 6550294 - DNA, 14 bp, Homo sapiens
ttggttcattaatt

SEQ ID NO: 6550295 - DNA, 17 bp, Homo sapiens
ttggttcctgcccccgc

SEQ ID NO: 6550296 - DNA, 16 bp, Homo sapiens
ttggttcctgggatgg

SEQ ID NO: 6550297 - DNA, 18 bp, Homo sapiens
ttggttcgatacctggag

SEQ ID NO: 6550298 - DNA, 14 bp, Homo sapiens
ttggttctaaggac

SEQ ID NO: 6550299 - DNA, 15 bp, Homo sapiens
ttggttctaatagaa

SEQ ID NO: 6550300 - DNA, 19 bp, Homo sapiens
ttggttctaatagaactca

SEQ ID NO: 6550301 - DNA, 18 bp, Homo sapiens
ttggttctagcgcagttt

SEQ ID NO: 6550302 - DNA, 20 bp, Homo sapiens
ttggttctagcgcagttttt

SEQ ID NO: 6550303 - DNA, 19 bp, Homo sapiens
ttggttctctccaggaagg

SEQ ID NO: 6550304 - DNA, 23 bp, Homo sapiens
ttggttctgaagccatgtagcca

SEQ ID NO: 6550305 - DNA, 20 bp, Homo sapiens
ttggttctggactaaaacta

SEQ ID NO: 6550306 - DNA, 13 bp, Homo sapiens
ttggttctggcca

SEQ ID NO: 6550307 - DNA, 15 bp, Homo sapiens
ttggttctgtgaaca

SEQ ID NO: 6550308 - DNA, 12 bp, Homo sapiens
ttggttcttccc

SEQ ID NO: 6550309 - DNA, 16 bp, Homo sapiens
ttggttcttctctttt

SEQ ID NO: 6550310 - DNA, 22 bp, Homo sapiens
ttggttgaaaagattccatttt

SEQ ID NO: 6550311 - DNA, 20 bp, Homo sapiens
ttggttgaaaataaaaagat

SEQ ID NO: 6550312 - DNA, 16 bp, Homo sapiens
ttggttgattgtttaa

SEQ ID NO: 6550313 - DNA, 17 bp, Homo sapiens
ttggttgggatgacttg

SEQ ID NO: 6550314 - DNA, 15 bp, Homo sapiens
ttggttggggtgggg

SEQ ID NO: 6550315 - DNA, 18 bp, Homo sapiens
ttggttggtgtgaagaaa

SEQ ID NO: 6550316 - DNA, 16 bp, Homo sapiens
ttggttggtttttaca

SEQ ID NO: 6550317 - DNA, 20 bp, Homo sapiens
tgttcttagctcaatgagca

SEQ ID NO: 6550318 - DNA, 14 bp, Homo sapiens
tgttcttaggttta

SEQ ID NO: 6550319 - DNA, 19 bp, Homo sapiens
tgttcttaggtttactgtg

SEQ ID NO: 6550320 - DNA, 20 bp, Homo sapiens
tgttcttagtgacacacact

SEQ ID NO: 6550321 - DNA, 23 bp, Homo sapiens
tgttcttatagaataaaagctgt

SEQ ID NO: 6550322 - DNA, 21 bp, Homo sapiens
tgttcttatggggtgagaata

SEQ ID NO: 6550323 - DNA, 20 bp, Homo sapiens
tgttcttcacttctgggaaa

SEQ ID NO: 6550324 - DNA, 16 bp, Homo sapiens
tgttcttcagtccttt

SEQ ID NO: 6550325 - DNA, 21 bp, Homo sapiens
tgttcttcagtcctttgtctt

SEQ ID NO: 6550326 - DNA, 18 bp, Homo sapiens
tgttcttcagtgtaatgt

SEQ ID NO: 6550327 - DNA, 11 bp, Homo sapiens
tgttcttccag

SEQ ID NO: 6550328 - DNA, 16 bp, Homo sapiens
tgttcttccagtgagg

SEQ ID NO: 6550329 - DNA, 15 bp, Homo sapiens
tgttcttcctcagcc

SEQ ID NO: 6550330 - DNA, 17 bp, Homo sapiens
tgttcttcctcagccag

SEQ ID NO: 6550331 - DNA, 13 bp, Homo sapiens
tgttcttcctcca

SEQ ID NO: 6550332 - DNA, 14 bp, Homo sapiens
tgttcttcttctct

SEQ ID NO: 6550333 - DNA, 15 bp, Homo sapiens
tgttcttgaagctgg

SEQ ID NO: 6550334 - DNA, 13 bp, Homo sapiens
tgttcttgaattt

SEQ ID NO: 6550335 - DNA, 14 bp, Homo sapiens
tgttcttgagcagc

SEQ ID NO: 6550336 - DNA, 23 bp, Homo sapiens
tgttcttgaggtctcttttctct

SEQ ID NO: 6550337 - DNA, 22 bp, Homo sapiens
tgttcttgatggagattaagat

SEQ ID NO: 6550338 - DNA, 13 bp, Homo sapiens
tgttcttgctgct

SEQ ID NO: 6550339 - DNA, 20 bp, Homo sapiens
tgttcttgctgctagaactt

SEQ ID NO: 6550340 - DNA, 15 bp, Homo sapiens
tgttcttggtctccc

SEQ ID NO: 6550341 - DNA, 22 bp, Homo sapiens
tgttcttggtgtttgactgtaa

SEQ ID NO: 6550342 - DNA, 15 bp, Homo sapiens
tgttcttggttcctg

SEQ ID NO: 6550343 - DNA, 18 bp, Homo sapiens
tgttcttggttcctgttt

SEQ ID NO: 6550344 - DNA, 20 bp, Homo sapiens
tgttcttggttcctgtttga

SEQ ID NO: 6550345 - DNA, 23 bp, Homo sapiens
tgttcttggttcctgtttgaaac

SEQ ID NO: 6550346 - DNA, 22 bp, Homo sapiens
tgttcttggtttgtaaattaac

SEQ ID NO: 6550347 - DNA, 17 bp, Homo sapiens
tgttcttgtaaaactgt

SEQ ID NO: 6550348 - DNA, 19 bp, Homo sapiens
tgttcttgtaaaactgtga

SEQ ID NO: 6550349 - DNA, 20 bp, Homo sapiens
tgttcttgtaaaactgtgac

SEQ ID NO: 6550350 - DNA, 16 bp, Homo sapiens
tgttcttgtcatcagt

SEQ ID NO: 6550351 - DNA, 18 bp, Homo sapiens
tgttctttaaccctcact

SEQ ID NO: 6550352 - DNA, 12 bp, Homo sapiens
tgttctttagtt

SEQ ID NO: 6550353 - DNA, 13 bp, Homo sapiens
tgttctttataac

SEQ ID NO: 6550354 - DNA, 14 bp, Homo sapiens
tgttctttatatac

SEQ ID NO: 6550355 - DNA, 24 bp, Homo sapiens
tgttctttcacccatcctaggaac

SEQ ID NO: 6550356 - DNA, 15 bp, Homo sapiens
tgttctttcagaaag

SEQ ID NO: 6550357 - DNA, 20 bp, Homo sapiens
tgttctttccaaagtacact

SEQ ID NO: 6550358 - DNA, 18 bp, Homo sapiens
tgttctttccccaggggc

SEQ ID NO: 6550359 - DNA, 15 bp, Homo sapiens
tgttctttccggcca

SEQ ID NO: 6550360 - DNA, 15 bp, Homo sapiens
tgttctttcctcaca

SEQ ID NO: 6550361 - DNA, 22 bp, Homo sapiens
tgttctttctggctatgcattt

SEQ ID NO: 6550362 - DNA, 20 bp, Homo sapiens
tgttctttggaaatacacag

SEQ ID NO: 6550363 - DNA, 12 bp, Homo sapiens
tgttcttttcaa

SEQ ID NO: 6550364 - DNA, 21 bp, Homo sapiens
tgttcttttcccccaaagtgg

SEQ ID NO: 6550365 - DNA, 16 bp, Homo sapiens
tgttcttttctattta

SEQ ID NO: 6550366 - DNA, 14 bp, Homo sapiens
tgttcttttctggt

SEQ ID NO: 6550367 - DNA, 12 bp, Homo sapiens
tgttcttttgat

SEQ ID NO: 6550368 - DNA, 17 bp, Homo sapiens
tgttcttttgatacatt

SEQ ID NO: 6550369 - DNA, 19 bp, Homo sapiens
tgttcttttgatacattta

SEQ ID NO: 6550370 - DNA, 14 bp, Homo sapiens
tgttcttttgcaat

SEQ ID NO: 6550371 - DNA, 16 bp, Homo sapiens
tgttcttttgtcccag

SEQ ID NO: 6550372 - DNA, 15 bp, Homo sapiens
tgttcttttgtttca

SEQ ID NO: 6550373 - DNA, 17 bp, Homo sapiens
tgttcttttgtttcatt

SEQ ID NO: 6550374 - DNA, 19 bp, Homo sapiens
tgttctttttaaaaagttg

SEQ ID NO: 6550375 - DNA, 13 bp, Homo sapiens
tgttctttttaga

SEQ ID NO: 6550376 - DNA, 17 bp, Homo sapiens
tgttctttttattgaat

SEQ ID NO: 6550377 - DNA, 13 bp, Homo sapiens
tgttgaaaaaatt

SEQ ID NO: 6550378 - DNA, 15 bp, Homo sapiens
tgttgaaaaaattta

SEQ ID NO: 6550379 - DNA, 16 bp, Homo sapiens
tgttgaaaaagaaaac

SEQ ID NO: 6550380 - DNA, 18 bp, Homo sapiens
tgttgaaaaccaaaatga

SEQ ID NO: 6550381 - DNA, 14 bp, Homo sapiens
tgttgaaaatgttc

SEQ ID NO: 6550382 - DNA, 17 bp, Homo sapiens
tgttgaaaatgttcaga

SEQ ID NO: 6550383 - DNA, 18 bp, Homo sapiens
tgttgaaagcaaaaatgc

SEQ ID NO: 6550384 - DNA, 19 bp, Homo sapiens
tgttgaaagctgaaaagca

SEQ ID NO: 6550385 - DNA, 22 bp, Homo sapiens
tgttgaaagctgaaaagcatac

SEQ ID NO: 6550386 - DNA, 24 bp, Homo sapiens
tgttgaaaggtaatttgagagaaa

SEQ ID NO: 6550387 - DNA, 23 bp, Homo sapiens
tgttgaaaggttttttttcagtt

SEQ ID NO: 6550388 - DNA, 14 bp, Homo sapiens
tgttgaaagtaaaa

SEQ ID NO: 6550389 - DNA, 14 bp, Homo sapiens
tgttgaaatagctt

SEQ ID NO: 6550390 - DNA, 22 bp, Homo sapiens
tgttgaaattatgtatgtttac

SEQ ID NO: 6550391 - DNA, 21 bp, Homo sapiens
tgttgaaattttgcaaatata

SEQ ID NO: 6550392 - DNA, 18 bp, Homo sapiens
tgttgaacaaaataaatt

SEQ ID NO: 6550393 - DNA, 23 bp, Homo sapiens
tgttgaactaatatatgaaataa

SEQ ID NO: 6550394 - DNA, 12 bp, Homo sapiens
tgttgaactttt

SEQ ID NO: 6550395 - DNA, 22 bp, Homo sapiens
tgttgaagaaattataaagata

SEQ ID NO: 6550396 - DNA, 16 bp, Homo sapiens
tgttgaagaagagttt

SEQ ID NO: 6550397 - DNA, 21 bp, Homo sapiens
tgttgaagaagagtttgcaaa

SEQ ID NO: 6550398 - DNA, 18 bp, Homo sapiens
tgttgaagaatacagtta

SEQ ID NO: 6550399 - DNA, 20 bp, Homo sapiens
tgttgaagacttcctctcta

SEQ ID NO: 6550400 - DNA, 20 bp, Homo sapiens
tgttgaagatttgaggactt

SEQ ID NO: 6550401 - DNA, 16 bp, Homo sapiens
tgttgaaggactacag

SEQ ID NO: 6550402 - DNA, 17 bp, Homo sapiens
tgttgaagggaggtggc

SEQ ID NO: 6550403 - DNA, 17 bp, Homo sapiens
tgttgaagtctcaggag

SEQ ID NO: 6550404 - DNA, 21 bp, Homo sapiens
tgttgaataatacgtgtgtac

SEQ ID NO: 6550405 - DNA, 19 bp, Homo sapiens
tgttgaatgcctgtcccag

SEQ ID NO: 6550406 - DNA, 21 bp, Homo sapiens
tgttgaatgcttaaagcaagg

SEQ ID NO: 6550407 - DNA, 14 bp, Homo sapiens
tgttgaatgtattc

SEQ ID NO: 6550408 - DNA, 18 bp, Homo sapiens
tgttgaattcttttgcca

SEQ ID NO: 6550409 - DNA, 14 bp, Homo sapiens
tgttgaattttatt

SEQ ID NO: 6550410 - DNA, 15 bp, Homo sapiens
tgttgacaaatgaca

SEQ ID NO: 6550411 - DNA, 20 bp, Homo sapiens
tgttgacaaatgacagatct

SEQ ID NO: 6550412 - DNA, 18 bp, Homo sapiens
tgttgacaactgtgactg

SEQ ID NO: 6550413 - DNA, 22 bp, Homo sapiens
tgttgacacaccagttttgagt

SEQ ID NO: 6550414 - DNA, 16 bp, Homo sapiens
tgttgacacaggtctt

SEQ ID NO: 6550415 - DNA, 17 bp, Homo sapiens
tgttgacacatatgaac

SEQ ID NO: 6550416 - DNA, 19 bp, Homo sapiens
tgttgacactgttttcctt

SEQ ID NO: 6550417 - DNA, 17 bp, Homo sapiens
tgttgacagtgaggaaa

SEQ ID NO: 6550418 - DNA, 17 bp, Homo sapiens
tgttgacagttcatatg

SEQ ID NO: 6550419 - DNA, 16 bp, Homo sapiens
tgttgacagttctgaa

SEQ ID NO: 6550420 - DNA, 16 bp, Homo sapiens
tgttgacatagccttt

SEQ ID NO: 6550421 - DNA, 19 bp, Homo sapiens
tgttgacatagcctttgtg

SEQ ID NO: 6550422 - DNA, 18 bp, Homo sapiens
tgttgacatatttaatgt

SEQ ID NO: 6550423 - DNA, 19 bp, Homo sapiens
tgttgacatatttaatgtt

SEQ ID NO: 6550424 - DNA, 23 bp, Homo sapiens
tgttgacatatttaatgttttaa

SEQ ID NO: 6550425 - DNA, 18 bp, Homo sapiens
tgttgacattaagaatgt

SEQ ID NO: 6550426 - DNA, 12 bp, Homo sapiens
tgttgacattag

SEQ ID NO: 6550427 - DNA, 14 bp, Homo sapiens
tgttgacattagtc

SEQ ID NO: 6550428 - DNA, 23 bp, Homo sapiens
tgttgacattcggggtgatcctg

SEQ ID NO: 6550429 - DNA, 14 bp, Homo sapiens
tgttgacattctga

SEQ ID NO: 6550430 - DNA, 18 bp, Homo sapiens
tgttgacattctgaatgc

SEQ ID NO: 6550431 - DNA, 22 bp, Homo sapiens
tgttgacattttctttttaaat

SEQ ID NO: 6550432 - DNA, 18 bp, Homo sapiens
tgttgaccactccagaga

SEQ ID NO: 6550433 - DNA, 19 bp, Homo sapiens
tgttgaccactccagagaa

SEQ ID NO: 6550434 - DNA, 18 bp, Homo sapiens
tgttgaccaggctggagt

SEQ ID NO: 6550435 - DNA, 16 bp, Homo sapiens
tgttgaccggctgccg

SEQ ID NO: 6550436 - DNA, 17 bp, Homo sapiens
tgttgaccggctgccgt

SEQ ID NO: 6550437 - DNA, 13 bp, Homo sapiens
tgttgacctgccc

SEQ ID NO: 6550438 - DNA, 14 bp, Homo sapiens
tgttgacctgcccg

SEQ ID NO: 6550439 - DNA, 17 bp, Homo sapiens
tgttgacctgtgcacct

SEQ ID NO: 6550440 - DNA, 14 bp, Homo sapiens
tgttgaccttccca

SEQ ID NO: 6550441 - DNA, 19 bp, Homo sapiens
tgttgactctagtactgtg

SEQ ID NO: 6550442 - DNA, 16 bp, Homo sapiens
tgttgactgctgctcc

SEQ ID NO: 6550443 - DNA, 20 bp, Homo sapiens
tgttgactgctgctccccac

SEQ ID NO: 6550444 - DNA, 21 bp, Homo sapiens
tgttgacttattttctctgtg

SEQ ID NO: 6550445 - DNA, 22 bp, Homo sapiens
tgttgagaagcgtttttaacct

SEQ ID NO: 6550446 - DNA, 18 bp, Homo sapiens
tgttgagaattgtgctca

SEQ ID NO: 6550447 - DNA, 13 bp, Homo sapiens
tgttgagacagag

SEQ ID NO: 6550448 - DNA, 13 bp, Homo sapiens
tgttgagacccag

SEQ ID NO: 6550449 - DNA, 17 bp, Homo sapiens
tgttgagacctcagctt

SEQ ID NO: 6550450 - DNA, 22 bp, Homo sapiens
tgttgagagggggatgcccctg

SEQ ID NO: 6550451 - DNA, 20 bp, Homo sapiens
tgttgagcatgacagcctgc

SEQ ID NO: 6550452 - DNA, 17 bp, Homo sapiens
tgttgagccaggcctgg

SEQ ID NO: 6550453 - DNA, 20 bp, Homo sapiens
tgttgagccccagtgctgga

SEQ ID NO: 6550454 - DNA, 18 bp, Homo sapiens
tgttgagccttttccctc

SEQ ID NO: 6550455 - DNA, 19 bp, Homo sapiens
tgttgagcgtattcttgaa

SEQ ID NO: 6550456 - DNA, 20 bp, Homo sapiens
tgttgaggcgagcagggcag

SEQ ID NO: 6550457 - DNA, 22 bp, Homo sapiens
tgttgaggcttatatttgtgta

SEQ ID NO: 6550458 - DNA, 23 bp, Homo sapiens
tgttgaggtggtctgaatgttct

SEQ ID NO: 6550459 - DNA, 13 bp, Homo sapiens
tgttgagtgttca

SEQ ID NO: 6550460 - DNA, 14 bp, Homo sapiens
tgttgagtgttcat

SEQ ID NO: 6550461 - DNA, 18 bp, Homo sapiens
tgttgagttggacacact

SEQ ID NO: 6550462 - DNA, 19 bp, Homo sapiens
tgttgagttggacacactg

SEQ ID NO: 6550463 - DNA, 19 bp, Homo sapiens
tgttgataaaaatactgac

SEQ ID NO: 6550464 - DNA, 22 bp, Homo sapiens
tgttgataaaccaaaaacattt

SEQ ID NO: 6550465 - DNA, 19 bp, Homo sapiens
tgttgataaatggatatta

SEQ ID NO: 6550466 - DNA, 19 bp, Homo sapiens
tgttgataaattccactgg

SEQ ID NO: 6550467 - DNA, 14 bp, Homo sapiens
tgttgataatatat

SEQ ID NO: 6550468 - DNA, 14 bp, Homo sapiens
tgttgataatttca

SEQ ID NO: 6550469 - DNA, 18 bp, Homo sapiens
tgttgatacaaaccactg

SEQ ID NO: 6550470 - DNA, 22 bp, Homo sapiens
tgttgatacacaggtgagaaag

SEQ ID NO: 6550471 - DNA, 21 bp, Homo sapiens
tgttgatacctctgctgggat

SEQ ID NO: 6550472 - DNA, 14 bp, Homo sapiens
tgttgatactgttg

SEQ ID NO: 6550473 - DNA, 18 bp, Homo sapiens
tgttgatattgtttgctg

SEQ ID NO: 6550474 - DNA, 17 bp, Homo sapiens
tgttgatattttccctt

SEQ ID NO: 6550475 - DNA, 19 bp, Homo sapiens
tgttgatcatgtacttttt

SEQ ID NO: 6550476 - DNA, 20 bp, Homo sapiens
tgttgatcatgtacttttta

SEQ ID NO: 6550477 - DNA, 19 bp, Homo sapiens
tgttgatccatccagcttg

SEQ ID NO: 6550478 - DNA, 12 bp, Homo sapiens
tgttgatcccaa

SEQ ID NO: 6550479 - DNA, 16 bp, Homo sapiens
tgttgatcccaagaca

SEQ ID NO: 6550480 - DNA, 21 bp, Homo sapiens
tgttgatctatgggaaatcta

SEQ ID NO: 6550481 - DNA, 21 bp, Homo sapiens
tgttgatctgcatatttctgt

SEQ ID NO: 6550482 - DNA, 17 bp, Homo sapiens
tgttgatggcaaaaaaa

SEQ ID NO: 6550483 - DNA, 23 bp, Homo sapiens
tgttgatgggatgattgaagaaa

SEQ ID NO: 6550484 - DNA, 16 bp, Homo sapiens
tgttgattaaagatga

SEQ ID NO: 6550485 - DNA, 23 bp, Homo sapiens
tgttgattacataatcaaagcta

SEQ ID NO: 6550486 - DNA, 16 bp, Homo sapiens
tgttgattattagcca

SEQ ID NO: 6550487 - DNA, 15 bp, Homo sapiens
tgttgattccactga

SEQ ID NO: 6550488 - DNA, 22 bp, Homo sapiens
tgttgattctttcaatccacag

SEQ ID NO: 6550489 - DNA, 16 bp, Homo sapiens
tgttgattgctaaatg

SEQ ID NO: 6550490 - DNA, 19 bp, Homo sapiens
tgttgattgctaaatgtaa

SEQ ID NO: 6550491 - DNA, 14 bp, Homo sapiens
tgttgatttctagt

SEQ ID NO: 6550492 - DNA, 19 bp, Homo sapiens
tgttgatttctagttattt

SEQ ID NO: 6550493 - DNA, 18 bp, Homo sapiens
tgttgattttctgttgta

SEQ ID NO: 6550494 - DNA, 13 bp, Homo sapiens
ttggttgtatata

SEQ ID NO: 6550495 - DNA, 12 bp, Homo sapiens
ttggttgtattc

SEQ ID NO: 6550496 - DNA, 13 bp, Homo sapiens
ttggttgtattct

SEQ ID NO: 6550497 - DNA, 18 bp, Homo sapiens
ttggttgtcaatattaaa

SEQ ID NO: 6550498 - DNA, 16 bp, Homo sapiens
ttggttgtttaacact

SEQ ID NO: 6550499 - DNA, 12 bp, Homo sapiens
ttggtttaaaaa

SEQ ID NO: 6550500 - DNA, 14 bp, Homo sapiens
ttggtttaaacttt

SEQ ID NO: 6550501 - DNA, 20 bp, Homo sapiens
ttggtttacatttaaagcat

SEQ ID NO: 6550502 - DNA, 15 bp, Homo sapiens
ttggtttactttcaa

SEQ ID NO: 6550503 - DNA, 23 bp, Homo sapiens
ttggtttattccctccagggtct

SEQ ID NO: 6550504 - DNA, 18 bp, Homo sapiens
ttggtttatttttgtaat

SEQ ID NO: 6550505 - DNA, 19 bp, Homo sapiens
ttggtttatttttgtaatg

SEQ ID NO: 6550506 - DNA, 17 bp, Homo sapiens
ttggtttcaccttccct

SEQ ID NO: 6550507 - DNA, 16 bp, Homo sapiens
ttggtttctcttctcc

SEQ ID NO: 6550508 - DNA, 13 bp, Homo sapiens
ttggtttctggat

SEQ ID NO: 6550509 - DNA, 11 bp, Homo sapiens
ttggtttgaca

SEQ ID NO: 6550510 - DNA, 16 bp, Homo sapiens
ttggtttgcacataaa

SEQ ID NO: 6550511 - DNA, 14 bp, Homo sapiens
ttggtttgccttcc

SEQ ID NO: 6550512 - DNA, 19 bp, Homo sapiens
ttggtttgccttttatgta

SEQ ID NO: 6550513 - DNA, 12 bp, Homo sapiens
ttggtttgcttt

SEQ ID NO: 6550514 - DNA, 16 bp, Homo sapiens
ttggtttggggagaaa

SEQ ID NO: 6550515 - DNA, 12 bp, Homo sapiens
ttggtttgtatg

SEQ ID NO: 6550516 - DNA, 16 bp, Homo sapiens
ttggtttgtatgagat

SEQ ID NO: 6550517 - DNA, 17 bp, Homo sapiens
ttggtttgtatgagatg

SEQ ID NO: 6550518 - DNA, 13 bp, Homo sapiens
ttggttttaaaag

SEQ ID NO: 6550519 - DNA, 16 bp, Homo sapiens
ttggttttaaaagcac

SEQ ID NO: 6550520 - DNA, 16 bp, Homo sapiens
ttggttttaaaatact

SEQ ID NO: 6550521 - DNA, 16 bp, Homo sapiens
ttggttttacacagga

SEQ ID NO: 6550522 - DNA, 12 bp, Homo sapiens
ttggttttatga

SEQ ID NO: 6550523 - DNA, 13 bp, Homo sapiens
ttggttttcttct

SEQ ID NO: 6550524 - DNA, 14 bp, Homo sapiens
ttggttttgaaatg

SEQ ID NO: 6550525 - DNA, 19 bp, Homo sapiens
ttggttttgcatgtctgca

SEQ ID NO: 6550526 - DNA, 16 bp, Homo sapiens
ttggttttgctacata

SEQ ID NO: 6550527 - DNA, 18 bp, Homo sapiens
ttggtttttaaaacccag

SEQ ID NO: 6550528 - DNA, 15 bp, Homo sapiens
ttggtttttatattt

SEQ ID NO: 6550529 - DNA, 19 bp, Homo sapiens
ttggtttttatttctcctt

SEQ ID NO: 6550530 - DNA, 14 bp, Homo sapiens
ttggtttttcctca

SEQ ID NO: 6550531 - DNA, 22 bp, Homo sapiens
ttggtttttgtcttgcattttt

SEQ ID NO: 6550532 - DNA, 18 bp, Homo sapiens
ttgtaaaaaaaaaaaaca

SEQ ID NO: 6550533 - DNA, 15 bp, Homo sapiens
ttgtaaaaaaaaatg

SEQ ID NO: 6550534 - DNA, 20 bp, Homo sapiens
ttgtaaaaaaaaatgccttt

SEQ ID NO: 6550535 - DNA, 22 bp, Homo sapiens
ttgtaaaaaaaaatgcctttga

SEQ ID NO: 6550536 - DNA, 23 bp, Homo sapiens
ttgtaaaaaaaaatgcctttgag

SEQ ID NO: 6550537 - DNA, 15 bp, Homo sapiens
ttgtaaaaaaagcaa

SEQ ID NO: 6550538 - DNA, 18 bp, Homo sapiens
ttgtaaaaaaagcaaaaa

SEQ ID NO: 6550539 - DNA, 12 bp, Homo sapiens
ttgtaaaaaagg

SEQ ID NO: 6550540 - DNA, 14 bp, Homo sapiens
ttgtaaaaacaaaa

SEQ ID NO: 6550541 - DNA, 20 bp, Homo sapiens
ttgtaaaaacagcattgctt

SEQ ID NO: 6550542 - DNA, 16 bp, Homo sapiens
ttgtaaaaatactgtt

SEQ ID NO: 6550543 - DNA, 19 bp, Homo sapiens
ttgtaaaaatactgtttca

SEQ ID NO: 6550544 - DNA, 21 bp, Homo sapiens
ttgtaaaaatagcaaaatatt

SEQ ID NO: 6550545 - DNA, 14 bp, Homo sapiens
ttgtaaaaatatac

SEQ ID NO: 6550546 - DNA, 12 bp, Homo sapiens
ttgtaaaaatga

SEQ ID NO: 6550547 - DNA, 23 bp, Homo sapiens
ttgtaaaaatgagactttttcag

SEQ ID NO: 6550548 - DNA, 23 bp, Homo sapiens
ttgtaaaaatgagtcatttgttt

SEQ ID NO: 6550549 - DNA, 19 bp, Homo sapiens
ttgtaaaaatgtctttcat

SEQ ID NO: 6550550 - DNA, 18 bp, Homo sapiens
ttgtaaaacaaaatttga

SEQ ID NO: 6550551 - DNA, 12 bp, Homo sapiens
ttgtaaaacaat

SEQ ID NO: 6550552 - DNA, 13 bp, Homo sapiens
ttgtaaaacaatg

SEQ ID NO: 6550553 - DNA, 14 bp, Homo sapiens
ttgtaaaacaggta

SEQ ID NO: 6550554 - DNA, 15 bp, Homo sapiens
ttgtaaaacaggtag

SEQ ID NO: 6550555 - DNA, 14 bp, Homo sapiens
ttgtaaaactgtga

SEQ ID NO: 6550556 - DNA, 17 bp, Homo sapiens
ttgtaaaactgtgacat

SEQ ID NO: 6550557 - DNA, 17 bp, Homo sapiens
ttgtaaaactgttattt

SEQ ID NO: 6550558 - DNA, 17 bp, Homo sapiens
ttgtaaaacttctgctc

SEQ ID NO: 6550559 - DNA, 18 bp, Homo sapiens
ttgtaaaacttctgctcg

SEQ ID NO: 6550560 - DNA, 19 bp, Homo sapiens
ttgtaaaacttctgctcgt

SEQ ID NO: 6550561 - DNA, 20 bp, Homo sapiens
ttgtaaaagcaacatcagct

SEQ ID NO: 6550562 - DNA, 13 bp, Homo sapiens
ttgtaaaatatag

SEQ ID NO: 6550563 - DNA, 20 bp, Homo sapiens
ttgtaaaatatagctgtaca

SEQ ID NO: 6550564 - DNA, 13 bp, Homo sapiens
ttgtaaaatcaaa

SEQ ID NO: 6550565 - DNA, 15 bp, Homo sapiens
ttgtaaaatgacaat

SEQ ID NO: 6550566 - DNA, 20 bp, Homo sapiens
ttgtaaaatgacaatcatgt

SEQ ID NO: 6550567 - DNA, 22 bp, Homo sapiens
ttgtaaaatgacaatcatgtgt

SEQ ID NO: 6550568 - DNA, 12 bp, Homo sapiens
ttgtaaaatggt

SEQ ID NO: 6550569 - DNA, 14 bp, Homo sapiens
ttgtaaaatgtcaa

SEQ ID NO: 6550570 - DNA, 15 bp, Homo sapiens
ttgtaaaattccatg

SEQ ID NO: 6550571 - DNA, 16 bp, Homo sapiens
ttgtaaaattccatgg

SEQ ID NO: 6550572 - DNA, 16 bp, Homo sapiens
ttgtaaacaaactctt

SEQ ID NO: 6550573 - DNA, 23 bp, Homo sapiens
ttgtaaacaaactgtgtaactgc

SEQ ID NO: 6550574 - DNA, 20 bp, Homo sapiens
ttgtaaacacagtgtggtta

SEQ ID NO: 6550575 - DNA, 17 bp, Homo sapiens
ttgtaaacagaaggaga

SEQ ID NO: 6550576 - DNA, 14 bp, Homo sapiens
ttgtaaacatgtgt

SEQ ID NO: 6550577 - DNA, 20 bp, Homo sapiens
ttgtaaacattagttctatt

SEQ ID NO: 6550578 - DNA, 12 bp, Homo sapiens
ttgtaaaccatt

SEQ ID NO: 6550579 - DNA, 13 bp, Homo sapiens
ttgtaaaccattg

SEQ ID NO: 6550580 - DNA, 16 bp, Homo sapiens
ttgtaaacctggaggg

SEQ ID NO: 6550581 - DNA, 17 bp, Homo sapiens
ttgtaaacgtcttttta

SEQ ID NO: 6550582 - DNA, 16 bp, Homo sapiens
ttgtaaactcaaaata

SEQ ID NO: 6550583 - DNA, 22 bp, Homo sapiens
ttgtaaactgtatcaaatctgt

SEQ ID NO: 6550584 - DNA, 13 bp, Homo sapiens
ttgtaaacttctg

SEQ ID NO: 6550585 - DNA, 15 bp, Homo sapiens
ttgtaaactttgaaa

SEQ ID NO: 6550586 - DNA, 19 bp, Homo sapiens
ttgtaaactttgaaatata

SEQ ID NO: 6550587 - DNA, 14 bp, Homo sapiens
ttgtaaagagtgga

SEQ ID NO: 6550588 - DNA, 17 bp, Homo sapiens
ttgtaaaggtaggtgca

SEQ ID NO: 6550589 - DNA, 17 bp, Homo sapiens
ttgtaaaggtgatgaat

SEQ ID NO: 6550590 - DNA, 22 bp, Homo sapiens
ttgtaaagtcggtgattatatt

SEQ ID NO: 6550591 - DNA, 21 bp, Homo sapiens
ttgtaaagttaattcattaaa

SEQ ID NO: 6550592 - DNA, 21 bp, Homo sapiens
ttgtaaagttggttggataag

SEQ ID NO: 6550593 - DNA, 14 bp, Homo sapiens
ttgtaaagtttcta

SEQ ID NO: 6550594 - DNA, 11 bp, Homo sapiens
ttgtaaataaa

SEQ ID NO: 6550595 - DNA, 14 bp, Homo sapiens
ttgtaaataaaagt

SEQ ID NO: 6550596 - DNA, 21 bp, Homo sapiens
ttgtaaataaaagtatttaat

SEQ ID NO: 6550597 - DNA, 18 bp, Homo sapiens
ttgtaaataaaggaacca

SEQ ID NO: 6550598 - DNA, 21 bp, Homo sapiens
ttgtaaataaattttgtgcaa

SEQ ID NO: 6550599 - DNA, 21 bp, Homo sapiens
ttgtaaataagagatttggag

SEQ ID NO: 6550600 - DNA, 20 bp, Homo sapiens
ttgtaaataagtgaaaataa

SEQ ID NO: 6550601 - DNA, 22 bp, Homo sapiens
ttgtaaatacaagttctattta

SEQ ID NO: 6550602 - DNA, 14 bp, Homo sapiens
ttgtaaatacaatt

SEQ ID NO: 6550603 - DNA, 16 bp, Homo sapiens
ttgtaaatacaattca

SEQ ID NO: 6550604 - DNA, 13 bp, Homo sapiens
ttgtaaatacacc

SEQ ID NO: 6550605 - DNA, 19 bp, Homo sapiens
ttgtaaatactccattatt

SEQ ID NO: 6550606 - DNA, 18 bp, Homo sapiens
ttgtaaataggattttta

SEQ ID NO: 6550607 - DNA, 17 bp, Homo sapiens
ttgtaaatagtatttga

SEQ ID NO: 6550608 - DNA, 14 bp, Homo sapiens
ttgtaaatattaaa

SEQ ID NO: 6550609 - DNA, 13 bp, Homo sapiens
ttgtaaatattct

SEQ ID NO: 6550610 - DNA, 14 bp, Homo sapiens
ttgtaaatattctt

SEQ ID NO: 6550611 - DNA, 16 bp, Homo sapiens
ttgtaaatattcttgt

SEQ ID NO: 6550612 - DNA, 22 bp, Homo sapiens
ttgtaaatattgctaaaagcat

SEQ ID NO: 6550613 - DNA, 19 bp, Homo sapiens
ttgtaaatatttatgtaaa

SEQ ID NO: 6550614 - DNA, 14 bp, Homo sapiens
ttgtaaatctgtac

SEQ ID NO: 6550615 - DNA, 12 bp, Homo sapiens
ttgtaaatcttt

SEQ ID NO: 6550616 - DNA, 17 bp, Homo sapiens
ttgtaaatctttgtgaa

SEQ ID NO: 6550617 - DNA, 22 bp, Homo sapiens
ttgtaaatgaaacttaagaatt

SEQ ID NO: 6550618 - DNA, 22 bp, Homo sapiens
ttgtaaatgaccaagaaaaaga

SEQ ID NO: 6550619 - DNA, 18 bp, Homo sapiens
ttgtaaatgagacacata

SEQ ID NO: 6550620 - DNA, 12 bp, Homo sapiens
ttgtaaatgcct

SEQ ID NO: 6550621 - DNA, 13 bp, Homo sapiens
ttgtaaatgcctc

SEQ ID NO: 6550622 - DNA, 20 bp, Homo sapiens
ttgtaaatgctattatactg

SEQ ID NO: 6550623 - DNA, 19 bp, Homo sapiens
ttgtaaatgtactggtaat

SEQ ID NO: 6550624 - DNA, 14 bp, Homo sapiens
ttgtaaatgtgctt

SEQ ID NO: 6550625 - DNA, 16 bp, Homo sapiens
ttgtaaatgtggtaaa

SEQ ID NO: 6550626 - DNA, 20 bp, Homo sapiens
ttgtaaatgtgttggacaaa

SEQ ID NO: 6550627 - DNA, 13 bp, Homo sapiens
ttgtaaatgttat

SEQ ID NO: 6550628 - DNA, 17 bp, Homo sapiens
ttgtaaatgttatttct

SEQ ID NO: 6550629 - DNA, 21 bp, Homo sapiens
ttgtaaattaaacataaaaca

SEQ ID NO: 6550630 - DNA, 23 bp, Homo sapiens
ttgtaaattaacttttataaact

SEQ ID NO: 6550631 - DNA, 16 bp, Homo sapiens
ttgtaaattaatcttt

SEQ ID NO: 6550632 - DNA, 12 bp, Homo sapiens
ttgtaaattata

SEQ ID NO: 6550633 - DNA, 20 bp, Homo sapiens
ttgtaaattatatttgtgct

SEQ ID NO: 6550634 - DNA, 23 bp, Homo sapiens
ttgtaaattattaatttatgcag

SEQ ID NO: 6550635 - DNA, 17 bp, Homo sapiens
ttgtaaattattgatga

SEQ ID NO: 6550636 - DNA, 21 bp, Homo sapiens
ttgtaaattattgatgatttt

SEQ ID NO: 6550637 - DNA, 13 bp, Homo sapiens
ttgtaaattggca

SEQ ID NO: 6550638 - DNA, 14 bp, Homo sapiens
ttgtaaattggcat

SEQ ID NO: 6550639 - DNA, 18 bp, Homo sapiens
ttgtaaattggcatggaa

SEQ ID NO: 6550640 - DNA, 13 bp, Homo sapiens
ttgtaaattgtca

SEQ ID NO: 6550641 - DNA, 12 bp, Homo sapiens
ttgtaaatttta

SEQ ID NO: 6550642 - DNA, 15 bp, Homo sapiens
ttgtaacaagaaaat

SEQ ID NO: 6550643 - DNA, 23 bp, Homo sapiens
ttgtaacatatttcttgagtaat

SEQ ID NO: 6550644 - DNA, 21 bp, Homo sapiens
ttgtaacattctatttcaact

SEQ ID NO: 6550645 - DNA, 18 bp, Homo sapiens
ttgtaacattgtaaagta

SEQ ID NO: 6550646 - DNA, 19 bp, Homo sapiens
ttgtaacattgtaaagtat

SEQ ID NO: 6550647 - DNA, 17 bp, Homo sapiens
ttgtaaccagtgcagaa

SEQ ID NO: 6550648 - DNA, 23 bp, Homo sapiens
ttgtaaccatttctcactagtgt

SEQ ID NO: 6550649 - DNA, 16 bp, Homo sapiens
ttgtaacccagatttt

SEQ ID NO: 6550650 - DNA, 15 bp, Homo sapiens
ttgtaacgttgctgt

SEQ ID NO: 6550651 - DNA, 21 bp, Homo sapiens
ttgtaacgttgctgtgggaac

SEQ ID NO: 6550652 - DNA, 17 bp, Homo sapiens
ttgtaactaaaataatt

SEQ ID NO: 6550653 - DNA, 16 bp, Homo sapiens
ttgtaactaatagatt

SEQ ID NO: 6550654 - DNA, 12 bp, Homo sapiens
ttgtaactacaa

SEQ ID NO: 6550655 - DNA, 14 bp, Homo sapiens
ttgtaactccacca

SEQ ID NO: 6550656 - DNA, 13 bp, Homo sapiens
ttgtaactctttg

SEQ ID NO: 6550657 - DNA, 17 bp, Homo sapiens
ttgtaactctttggcta

SEQ ID NO: 6550658 - DNA, 21 bp, Homo sapiens
ttgtaactgtttagatgaatg

SEQ ID NO: 6550659 - DNA, 17 bp, Homo sapiens
ttgtaacttatattgaa

SEQ ID NO: 6550660 - DNA, 18 bp, Homo sapiens
ttgtaacttatattgaag

SEQ ID NO: 6550661 - DNA, 13 bp, Homo sapiens
ttgtaacttatgt

SEQ ID NO: 6550662 - DNA, 17 bp, Homo sapiens
ttgtaacttggatgtag

SEQ ID NO: 6550663 - DNA, 13 bp, Homo sapiens
ttgtaacttgttg

SEQ ID NO: 6550664 - DNA, 13 bp, Homo sapiens
ttgtaactttgca

SEQ ID NO: 6550665 - DNA, 17 bp, Homo sapiens
ttgtaactttttacatt

SEQ ID NO: 6550666 - DNA, 18 bp, Homo sapiens
ttgtaactttttacatta

SEQ ID NO: 6550667 - DNA, 13 bp, Homo sapiens
ttgtaagaaaagc

SEQ ID NO: 6550668 - DNA, 21 bp, Homo sapiens
ttgtaagaaataacactgtga

SEQ ID NO: 6550669 - DNA, 18 bp, Homo sapiens
ttgtaagacaaaggtttt

SEQ ID NO: 6550670 - DNA, 22 bp, Homo sapiens
ttgtaagacaaaggttttcctc

SEQ ID NO: 6550671 - DNA, 19 bp, Homo sapiens
ttgtaagacaatccatgta

SEQ ID NO: 6550672 - DNA, 18 bp, Homo sapiens
ttgtaagacattagtttg

SEQ ID NO: 6550673 - DNA, 16 bp, Homo sapiens
ttgtaagacatttgta

SEQ ID NO: 6550674 - DNA, 13 bp, Homo sapiens
ttgtaagatgctg

SEQ ID NO: 6550675 - DNA, 20 bp, Homo sapiens
ttgtaagatggataatgtgt

SEQ ID NO: 6550676 - DNA, 12 bp, Homo sapiens
tgttgattttta

SEQ ID NO: 6550677 - DNA, 14 bp, Homo sapiens
tgttgcaaagcttc

SEQ ID NO: 6550678 - DNA, 15 bp, Homo sapiens
tgttgcaaaggaaat

SEQ ID NO: 6550679 - DNA, 12 bp, Homo sapiens
tgttgcaaaggg

SEQ ID NO: 6550680 - DNA, 22 bp, Homo sapiens
tgttgcaaatcactctgcaatg

SEQ ID NO: 6550681 - DNA, 16 bp, Homo sapiens
tgttgcaagatgtgaa

SEQ ID NO: 6550682 - DNA, 17 bp, Homo sapiens
tgttgcaagatgtgaat

SEQ ID NO: 6550683 - DNA, 19 bp, Homo sapiens
tgttgcaagtactgctgta

SEQ ID NO: 6550684 - DNA, 21 bp, Homo sapiens
tgttgcaatgtgaaaaatctg

SEQ ID NO: 6550685 - DNA, 15 bp, Homo sapiens
tgttgcacagtccct

SEQ ID NO: 6550686 - DNA, 16 bp, Homo sapiens
tgttgcacatcattca

SEQ ID NO: 6550687 - DNA, 20 bp, Homo sapiens
tgttgcaccaattaagtgtt

SEQ ID NO: 6550688 - DNA, 14 bp, Homo sapiens
tgttgcacccagcc

SEQ ID NO: 6550689 - DNA, 20 bp, Homo sapiens
tgttgcactcaagttgttta

SEQ ID NO: 6550690 - DNA, 16 bp, Homo sapiens
tgttgcactgaaaacc

SEQ ID NO: 6550691 - DNA, 15 bp, Homo sapiens
tgttgcactgaagtt

SEQ ID NO: 6550692 - DNA, 19 bp, Homo sapiens
tgttgcactgaagtttgat

SEQ ID NO: 6550693 - DNA, 22 bp, Homo sapiens
tgttgcactgaagtttgataaa

SEQ ID NO: 6550694 - DNA, 17 bp, Homo sapiens
tgttgcactgccccctg

SEQ ID NO: 6550695 - DNA, 24 bp, Homo sapiens
tgttgcacttttgaatgtccaaaa

SEQ ID NO: 6550696 - DNA, 14 bp, Homo sapiens
tgttgcagatgggt

SEQ ID NO: 6550697 - DNA, 16 bp, Homo sapiens
tgttgcaggcaaatgt

SEQ ID NO: 6550698 - DNA, 17 bp, Homo sapiens
tgttgcagtggcctggc

SEQ ID NO: 6550699 - DNA, 16 bp, Homo sapiens
tgttgcatagaattca

SEQ ID NO: 6550700 - DNA, 17 bp, Homo sapiens
tgttgcatatagttaaa

SEQ ID NO: 6550701 - DNA, 21 bp, Homo sapiens
tgttgcatatagttaaactga

SEQ ID NO: 6550702 - DNA, 17 bp, Homo sapiens
tgttgcatgatgtattt

SEQ ID NO: 6550703 - DNA, 14 bp, Homo sapiens
tgttgcatggatgt

SEQ ID NO: 6550704 - DNA, 20 bp, Homo sapiens
tgttgcatgggctaatgaag

SEQ ID NO: 6550705 - DNA, 14 bp, Homo sapiens
tgttgcatgtttga

SEQ ID NO: 6550706 - DNA, 18 bp, Homo sapiens
tgttgcattaattgtgct

SEQ ID NO: 6550707 - DNA, 20 bp, Homo sapiens
tgttgcattattcatttagt

SEQ ID NO: 6550708 - DNA, 18 bp, Homo sapiens
tgttgcatttccagctgt

SEQ ID NO: 6550709 - DNA, 20 bp, Homo sapiens
tgttgcatttccagctgtgc

SEQ ID NO: 6550710 - DNA, 20 bp, Homo sapiens
tgttgccaaatatgtcctgg

SEQ ID NO: 6550711 - DNA, 17 bp, Homo sapiens
tgttgccaactaagccc

SEQ ID NO: 6550712 - DNA, 16 bp, Homo sapiens
tgttgccaagagcccg

SEQ ID NO: 6550713 - DNA, 17 bp, Homo sapiens
tgttgccacactttcac

SEQ ID NO: 6550714 - DNA, 15 bp, Homo sapiens
tgttgccacaggaca

SEQ ID NO: 6550715 - DNA, 14 bp, Homo sapiens
tgttgccaggcagg

SEQ ID NO: 6550716 - DNA, 12 bp, Homo sapiens
tgttgccagtgc

SEQ ID NO: 6550717 - DNA, 13 bp, Homo sapiens
tgttgccagtgct

SEQ ID NO: 6550718 - DNA, 19 bp, Homo sapiens
tgttgccatgtgcaccttg

SEQ ID NO: 6550719 - DNA, 14 bp, Homo sapiens
tgttgccatgtgtt

SEQ ID NO: 6550720 - DNA, 15 bp, Homo sapiens
tgttgcccaagctgg

SEQ ID NO: 6550721 - DNA, 22 bp, Homo sapiens
tgttgcccagaatttcatactt

SEQ ID NO: 6550722 - DNA, 19 bp, Homo sapiens
tgttgcccaggcaggtctt

SEQ ID NO: 6550723 - DNA, 14 bp, Homo sapiens
tgttgcccaggctg

SEQ ID NO: 6550724 - DNA, 19 bp, Homo sapiens
tgttgcccaggctggagtg

SEQ ID NO: 6550725 - DNA, 20 bp, Homo sapiens
tgttgcccaggctggtcttg

SEQ ID NO: 6550726 - DNA, 11 bp, Homo sapiens
tgttgccccag

SEQ ID NO: 6550727 - DNA, 19 bp, Homo sapiens
tgttgccccattcctaaga

SEQ ID NO: 6550728 - DNA, 21 bp, Homo sapiens
tgttgcccgccctccacccac

SEQ ID NO: 6550729 - DNA, 16 bp, Homo sapiens
tgttgccctcgtgccc

SEQ ID NO: 6550730 - DNA, 12 bp, Homo sapiens
tgttgccctggg

SEQ ID NO: 6550731 - DNA, 14 bp, Homo sapiens
tgttgccgagccca

SEQ ID NO: 6550732 - DNA, 12 bp, Homo sapiens
tgttgcctcctc

SEQ ID NO: 6550733 - DNA, 13 bp, Homo sapiens
tgttgcctcctct

SEQ ID NO: 6550734 - DNA, 15 bp, Homo sapiens
tgttgcctcctctct

SEQ ID NO: 6550735 - DNA, 17 bp, Homo sapiens
tgttgcctcctctctcc

SEQ ID NO: 6550736 - DNA, 22 bp, Homo sapiens
tgttgcctcctctctccctgcc

SEQ ID NO: 6550737 - DNA, 16 bp, Homo sapiens
tgttgcctctctttga

SEQ ID NO: 6550738 - DNA, 14 bp, Homo sapiens
tgttgcctcttgca

SEQ ID NO: 6550739 - DNA, 15 bp, Homo sapiens
tgttgccttatttct

SEQ ID NO: 6550740 - DNA, 19 bp, Homo sapiens
tgttgccttgcataatggt

SEQ ID NO: 6550741 - DNA, 18 bp, Homo sapiens
tgttgcctttatggtttc

SEQ ID NO: 6550742 - DNA, 17 bp, Homo sapiens
tgttgcctttgctctta

SEQ ID NO: 6550743 - DNA, 14 bp, Homo sapiens
tgttgccttttcac

SEQ ID NO: 6550744 - DNA, 15 bp, Homo sapiens
tgttgcgctcccgca

SEQ ID NO: 6550745 - DNA, 16 bp, Homo sapiens
tgttgcgtttttcctt

SEQ ID NO: 6550746 - DNA, 14 bp, Homo sapiens
tgttgctaacagca

SEQ ID NO: 6550747 - DNA, 12 bp, Homo sapiens
tgttgctaagcc

SEQ ID NO: 6550748 - DNA, 22 bp, Homo sapiens
tgttgctaagccccagcaagca

SEQ ID NO: 6550749 - DNA, 19 bp, Homo sapiens
tgttgctacatcagagtgt

SEQ ID NO: 6550750 - DNA, 13 bp, Homo sapiens
tgttgctagggag

SEQ ID NO: 6550751 - DNA, 15 bp, Homo sapiens
tgttgctagggagag

SEQ ID NO: 6550752 - DNA, 18 bp, Homo sapiens
tgttgctagggagaggga

SEQ ID NO: 6550753 - DNA, 15 bp, Homo sapiens
tgttgctatagtgac

SEQ ID NO: 6550754 - DNA, 18 bp, Homo sapiens
tgttgctatagtgacatg

SEQ ID NO: 6550755 - DNA, 16 bp, Homo sapiens
tgttgctatcctgcag

SEQ ID NO: 6550756 - DNA, 20 bp, Homo sapiens
tgttgctcagagtgaagagt

SEQ ID NO: 6550757 - DNA, 23 bp, Homo sapiens
tgttgctcagcaaggggctctgc

SEQ ID NO: 6550758 - DNA, 13 bp, Homo sapiens
tgttgctcagctc

SEQ ID NO: 6550759 - DNA, 15 bp, Homo sapiens
tgttgctctaggaag

SEQ ID NO: 6550760 - DNA, 17 bp, Homo sapiens
tgttgctctaggaagac

SEQ ID NO: 6550761 - DNA, 17 bp, Homo sapiens
tgttgctctctgtgtct

SEQ ID NO: 6550762 - DNA, 21 bp, Homo sapiens
tgttgctctctgtgtctgaga

SEQ ID NO: 6550763 - DNA, 13 bp, Homo sapiens
tgttgctcttgga

SEQ ID NO: 6550764 - DNA, 15 bp, Homo sapiens
tgttgctcttggaaa

SEQ ID NO: 6550765 - DNA, 11 bp, Homo sapiens
tgttgctgaat

SEQ ID NO: 6550766 - DNA, 14 bp, Homo sapiens
tgttgctgaatagg

SEQ ID NO: 6550767 - DNA, 21 bp, Homo sapiens
tgttgctgagttcctgtgggt

SEQ ID NO: 6550768 - DNA, 14 bp, Homo sapiens
tgttgctgatttta

SEQ ID NO: 6550769 - DNA, 16 bp, Homo sapiens
tgttgctgctgctgct

SEQ ID NO: 6550770 - DNA, 13 bp, Homo sapiens
tgttgctgctgtt

SEQ ID NO: 6550771 - DNA, 12 bp, Homo sapiens
tgttgctggact

SEQ ID NO: 6550772 - DNA, 15 bp, Homo sapiens
tgttgctggaggggc

SEQ ID NO: 6550773 - DNA, 16 bp, Homo sapiens
tgttgctgttcacagc

SEQ ID NO: 6550774 - DNA, 23 bp, Homo sapiens
tgttgctgttcacagcttttctt

SEQ ID NO: 6550775 - DNA, 19 bp, Homo sapiens
tgttgcttaatctagagct

SEQ ID NO: 6550776 - DNA, 19 bp, Homo sapiens
tgttgcttaattgtgaaca

SEQ ID NO: 6550777 - DNA, 20 bp, Homo sapiens
tgttgcttagtcacttattt

SEQ ID NO: 6550778 - DNA, 20 bp, Homo sapiens
tgttgcttatgttgttttgt

SEQ ID NO: 6550779 - DNA, 20 bp, Homo sapiens
tgttgcttcaaactgagaca

SEQ ID NO: 6550780 - DNA, 14 bp, Homo sapiens
tgttgcttcaaatt

SEQ ID NO: 6550781 - DNA, 19 bp, Homo sapiens
tgttgcttcagtaaaagga

SEQ ID NO: 6550782 - DNA, 14 bp, Homo sapiens
tgttgcttctcagg

SEQ ID NO: 6550783 - DNA, 16 bp, Homo sapiens
tgttgcttctcaggct

SEQ ID NO: 6550784 - DNA, 16 bp, Homo sapiens
tgttgcttctgaatca

SEQ ID NO: 6550785 - DNA, 20 bp, Homo sapiens
tgttgcttctgaatcactgt

SEQ ID NO: 6550786 - DNA, 18 bp, Homo sapiens
tgttgctttcttcctgca

SEQ ID NO: 6550787 - DNA, 12 bp, Homo sapiens
tgttgctttgtt

SEQ ID NO: 6550788 - DNA, 10 bp, Homo sapiens
tgttgctttt

SEQ ID NO: 6550789 - DNA, 21 bp, Homo sapiens
tgttgcttttgtgaacttttt

SEQ ID NO: 6550790 - DNA, 14 bp, Homo sapiens
tgttggaaaaaatt

SEQ ID NO: 6550791 - DNA, 15 bp, Homo sapiens
tgttggaaaaaattt

SEQ ID NO: 6550792 - DNA, 14 bp, Homo sapiens
tgttggaaaacata

SEQ ID NO: 6550793 - DNA, 22 bp, Homo sapiens
tgttggaaaatgtgtctctgct

SEQ ID NO: 6550794 - DNA, 22 bp, Homo sapiens
tgttggaagaaaagaatcacag

SEQ ID NO: 6550795 - DNA, 19 bp, Homo sapiens
tgttggacaaatgtgaaga

SEQ ID NO: 6550796 - DNA, 22 bp, Homo sapiens
tgttggacaaatgtgaagatgc

SEQ ID NO: 6550797 - DNA, 21 bp, Homo sapiens
tgttggacaagcttctgagac

SEQ ID NO: 6550798 - DNA, 22 bp, Homo sapiens
tgttggacaagcttctgagacg

SEQ ID NO: 6550799 - DNA, 13 bp, Homo sapiens
tgttggactctga

SEQ ID NO: 6550800 - DNA, 16 bp, Homo sapiens
tgttggactctgagct

SEQ ID NO: 6550801 - DNA, 17 bp, Homo sapiens
tgttggagaagaactga

SEQ ID NO: 6550802 - DNA, 20 bp, Homo sapiens
tgttggagaagaactgaaat

SEQ ID NO: 6550803 - DNA, 17 bp, Homo sapiens
tgttggagcaaaccatt

SEQ ID NO: 6550804 - DNA, 22 bp, Homo sapiens
tgttggaggaccccgagggctg

SEQ ID NO: 6550805 - DNA, 13 bp, Homo sapiens
tgttggaggggca

SEQ ID NO: 6550806 - DNA, 20 bp, Homo sapiens
tgttggataaatcagtggtt

SEQ ID NO: 6550807 - DNA, 11 bp, Homo sapiens
tgttggataag

SEQ ID NO: 6550808 - DNA, 23 bp, Homo sapiens
tgttggataataactagatctcc

SEQ ID NO: 6550809 - DNA, 14 bp, Homo sapiens
tgttggatcttcaa

SEQ ID NO: 6550810 - DNA, 21 bp, Homo sapiens
tgttggatcttcaatggcttt

SEQ ID NO: 6550811 - DNA, 23 bp, Homo sapiens
tgttggatttataaatgctattt

SEQ ID NO: 6550812 - DNA, 20 bp, Homo sapiens
tgttggatttttgtcttgtg

SEQ ID NO: 6550813 - DNA, 23 bp, Homo sapiens
tgttggcaaacgagactttctcc

SEQ ID NO: 6550814 - DNA, 15 bp, Homo sapiens
tgttggcaaatcact

SEQ ID NO: 6550815 - DNA, 18 bp, Homo sapiens
tgttggcacatcctatgc

SEQ ID NO: 6550816 - DNA, 18 bp, Homo sapiens
tgttggcacatgcctgta

SEQ ID NO: 6550817 - DNA, 22 bp, Homo sapiens
tgttggcactcacagacctgga

SEQ ID NO: 6550818 - DNA, 22 bp, Homo sapiens
tgttggcacttataggtaacgt

SEQ ID NO: 6550819 - DNA, 15 bp, Homo sapiens
tgttggcaggcccac

SEQ ID NO: 6550820 - DNA, 18 bp, Homo sapiens
tgttggcaggctggccag

SEQ ID NO: 6550821 - DNA, 18 bp, Homo sapiens
tgttggcagtgtttgtat

SEQ ID NO: 6550822 - DNA, 17 bp, Homo sapiens
tgttggcatagctctgg

SEQ ID NO: 6550823 - DNA, 15 bp, Homo sapiens
tgttggcattaacaa

SEQ ID NO: 6550824 - DNA, 13 bp, Homo sapiens
tgttggccaggct

SEQ ID NO: 6550825 - DNA, 16 bp, Homo sapiens
tgttggccaggctggt

SEQ ID NO: 6550826 - DNA, 13 bp, Homo sapiens
tgttggcccctct

SEQ ID NO: 6550827 - DNA, 14 bp, Homo sapiens
tgttggcccttcca

SEQ ID NO: 6550828 - DNA, 17 bp, Homo sapiens
tgttggcccttccagtg

SEQ ID NO: 6550829 - DNA, 18 bp, Homo sapiens
tgttggcccttccagtgg

SEQ ID NO: 6550830 - DNA, 17 bp, Homo sapiens
tgttggcctccggcctc

SEQ ID NO: 6550831 - DNA, 20 bp, Homo sapiens
tgttggcctccggcctcccc

SEQ ID NO: 6550832 - DNA, 16 bp, Homo sapiens
tgttggcctcttcagg

SEQ ID NO: 6550833 - DNA, 23 bp, Homo sapiens
tgttggcgtggggcctttgtcag

SEQ ID NO: 6550834 - DNA, 18 bp, Homo sapiens
tgttggcgtgtcccagca

SEQ ID NO: 6550835 - DNA, 22 bp, Homo sapiens
tgttggctacacagacccctcc

SEQ ID NO: 6550836 - DNA, 15 bp, Homo sapiens
tgttggctatttgaa

SEQ ID NO: 6550837 - DNA, 16 bp, Homo sapiens
tgttggctatttgaaa

SEQ ID NO: 6550838 - DNA, 14 bp, Homo sapiens
tgttggctcagaaa

SEQ ID NO: 6550839 - DNA, 14 bp, Homo sapiens
tgttggctttgttt

SEQ ID NO: 6550840 - DNA, 13 bp, Homo sapiens
tgttgggaaaaag

SEQ ID NO: 6550841 - DNA, 19 bp, Homo sapiens
tgttgggaaacttggctcg

SEQ ID NO: 6550842 - DNA, 13 bp, Homo sapiens
tgttgggaaagga

SEQ ID NO: 6550843 - DNA, 19 bp, Homo sapiens
tgttgggaagctatttcct

SEQ ID NO: 6550844 - DNA, 17 bp, Homo sapiens
tgttgggacctgctgct

SEQ ID NO: 6550845 - DNA, 19 bp, Homo sapiens
tgttgggactgctaaataa

SEQ ID NO: 6550846 - DNA, 15 bp, Homo sapiens
tgttgggagaaagca

SEQ ID NO: 6550847 - DNA, 20 bp, Homo sapiens
tgttgggaggggaagggctg

SEQ ID NO: 6550848 - DNA, 18 bp, Homo sapiens
tgttgggagtgaggatgt

SEQ ID NO: 6550849 - DNA, 18 bp, Homo sapiens
tgttgggatactgcaggg

SEQ ID NO: 6550850 - DNA, 18 bp, Homo sapiens
tgttgggatcgcattgca

SEQ ID NO: 6550851 - DNA, 16 bp, Homo sapiens
tgttgggccaggagcc

SEQ ID NO: 6550852 - DNA, 12 bp, Homo sapiens
tgttgggcccca

SEQ ID NO: 6550853 - DNA, 13 bp, Homo sapiens
tgttggggctggg

SEQ ID NO: 6550854 - DNA, 23 bp, Homo sapiens
tgttggggggccccacggagagt

SEQ ID NO: 6550855 - DNA, 20 bp, Homo sapiens
tgttgggtttgagacagaca

SEQ ID NO: 6550856 - DNA, 16 bp, Homo sapiens
tgttggtaactaatgt

SEQ ID NO: 6550857 - DNA, 11 bp, Homo sapiens
ttgtaagattt

SEQ ID NO: 6550858 - DNA, 18 bp, Homo sapiens
ttgtaagcaattctaagt

SEQ ID NO: 6550859 - DNA, 14 bp, Homo sapiens
ttgtaagccagagt

SEQ ID NO: 6550860 - DNA, 16 bp, Homo sapiens
ttgtaagccagagtca

SEQ ID NO: 6550861 - DNA, 16 bp, Homo sapiens
ttgtaagcgtatggct

SEQ ID NO: 6550862 - DNA, 17 bp, Homo sapiens
ttgtaagcgtatggctt

SEQ ID NO: 6550863 - DNA, 18 bp, Homo sapiens
ttgtaagcgtatggcttt

SEQ ID NO: 6550864 - DNA, 14 bp, Homo sapiens
ttgtaaggaatgat

SEQ ID NO: 6550865 - DNA, 16 bp, Homo sapiens
ttgtaaggacttgtgc

SEQ ID NO: 6550866 - DNA, 22 bp, Homo sapiens
ttgtaaggatataaaaagtaca

SEQ ID NO: 6550867 - DNA, 21 bp, Homo sapiens
ttgtaaggatgattttaatat

SEQ ID NO: 6550868 - DNA, 14 bp, Homo sapiens
ttgtaaggctttga

SEQ ID NO: 6550869 - DNA, 16 bp, Homo sapiens
ttgtaaggggaagagg

SEQ ID NO: 6550870 - DNA, 23 bp, Homo sapiens
ttgtaaggggaagagggaaatgt

SEQ ID NO: 6550871 - DNA, 16 bp, Homo sapiens
ttgtaaggtattgcaa

SEQ ID NO: 6550872 - DNA, 15 bp, Homo sapiens
ttgtaagtaagtaag

SEQ ID NO: 6550873 - DNA, 20 bp, Homo sapiens
ttgtaagtaagtaagaaaga

SEQ ID NO: 6550874 - DNA, 13 bp, Homo sapiens
ttgtaagtataag

SEQ ID NO: 6550875 - DNA, 14 bp, Homo sapiens
ttgtaagtatgtga

SEQ ID NO: 6550876 - DNA, 15 bp, Homo sapiens
ttgtaagtcagtgtt

SEQ ID NO: 6550877 - DNA, 18 bp, Homo sapiens
ttgtaagtgtaaaaaatg

SEQ ID NO: 6550878 - DNA, 19 bp, Homo sapiens
ttgtaagtgtaaaaaatgt

SEQ ID NO: 6550879 - DNA, 20 bp, Homo sapiens
ttgtaagtgtaaaaaatgtc

SEQ ID NO: 6550880 - DNA, 18 bp, Homo sapiens
ttgtaagttgtacaaatg

SEQ ID NO: 6550881 - DNA, 14 bp, Homo sapiens
ttgtaagtttatgt

SEQ ID NO: 6550882 - DNA, 17 bp, Homo sapiens
ttgtaagtttcaggtga

SEQ ID NO: 6550883 - DNA, 22 bp, Homo sapiens
ttgtaagtttcaggtgacatgt

SEQ ID NO: 6550884 - DNA, 12 bp, Homo sapiens
ttgtaataaaac

SEQ ID NO: 6550885 - DNA, 21 bp, Homo sapiens
ttgtaataaaactatttgtat

SEQ ID NO: 6550886 - DNA, 12 bp, Homo sapiens
ttgtaataaact

SEQ ID NO: 6550887 - DNA, 18 bp, Homo sapiens
ttgtaataaagtatataa

SEQ ID NO: 6550888 - DNA, 22 bp, Homo sapiens
ttgtaataacatttaatttaga

SEQ ID NO: 6550889 - DNA, 20 bp, Homo sapiens
ttgtaataagcaatcaaggt

SEQ ID NO: 6550890 - DNA, 15 bp, Homo sapiens
ttgtaatacacatat

SEQ ID NO: 6550891 - DNA, 13 bp, Homo sapiens
ttgtaatataaga

SEQ ID NO: 6550892 - DNA, 13 bp, Homo sapiens
ttgtaatataatg

SEQ ID NO: 6550893 - DNA, 14 bp, Homo sapiens
ttgtaatatatcct

SEQ ID NO: 6550894 - DNA, 16 bp, Homo sapiens
ttgtaatatatcctgt

SEQ ID NO: 6550895 - DNA, 14 bp, Homo sapiens
ttgtaatatcagtt

SEQ ID NO: 6550896 - DNA, 15 bp, Homo sapiens
ttgtaatatgacaga

SEQ ID NO: 6550897 - DNA, 17 bp, Homo sapiens
ttgtaatatgacagata

SEQ ID NO: 6550898 - DNA, 23 bp, Homo sapiens
ttgtaatatgacagataacctaa

SEQ ID NO: 6550899 - DNA, 20 bp, Homo sapiens
ttgtaatatgagaatgtatt

SEQ ID NO: 6550900 - DNA, 12 bp, Homo sapiens
ttgtaatatgat

SEQ ID NO: 6550901 - DNA, 14 bp, Homo sapiens
ttgtaatatgtaaa

SEQ ID NO: 6550902 - DNA, 21 bp, Homo sapiens
ttgtaatatgtatattaagaa

SEQ ID NO: 6550903 - DNA, 15 bp, Homo sapiens
ttgtaatattctgtt

SEQ ID NO: 6550904 - DNA, 18 bp, Homo sapiens
ttgtaatattctgttttg

SEQ ID NO: 6550905 - DNA, 22 bp, Homo sapiens
ttgtaatatttcttcaagtgag

SEQ ID NO: 6550906 - DNA, 20 bp, Homo sapiens
ttgtaatatttgaattttta

SEQ ID NO: 6550907 - DNA, 18 bp, Homo sapiens
ttgtaatattttgtatta

SEQ ID NO: 6550908 - DNA, 15 bp, Homo sapiens
ttgtaatcgttatgt

SEQ ID NO: 6550909 - DNA, 23 bp, Homo sapiens
ttgtaatctgaagtatggtatta

SEQ ID NO: 6550910 - DNA, 22 bp, Homo sapiens
ttgtaatgaattcctagaatta

SEQ ID NO: 6550911 - DNA, 12 bp, Homo sapiens
ttgtaatgcact

SEQ ID NO: 6550912 - DNA, 21 bp, Homo sapiens
ttgtaatgctgcacttcctgt

SEQ ID NO: 6550913 - DNA, 15 bp, Homo sapiens
ttgtaatgctgtaca

SEQ ID NO: 6550914 - DNA, 22 bp, Homo sapiens
ttgtaatggattcttttcatca

SEQ ID NO: 6550915 - DNA, 21 bp, Homo sapiens
ttgtaatggtgcttattaaga

SEQ ID NO: 6550916 - DNA, 22 bp, Homo sapiens
ttgtaatggtgcttattaagac

SEQ ID NO: 6550917 - DNA, 15 bp, Homo sapiens
ttgtaatgtaactgc

SEQ ID NO: 6550918 - DNA, 14 bp, Homo sapiens
ttgtaatgtatctt

SEQ ID NO: 6550919 - DNA, 15 bp, Homo sapiens
ttgtaatgtatctta

SEQ ID NO: 6550920 - DNA, 18 bp, Homo sapiens
ttgtaatgtatcttattt

SEQ ID NO: 6550921 - DNA, 15 bp, Homo sapiens
ttgtaatgtcttgag

SEQ ID NO: 6550922 - DNA, 19 bp, Homo sapiens
ttgtaatgtgaaaagtatc

SEQ ID NO: 6550923 - DNA, 17 bp, Homo sapiens
ttgtaatgtgtgaaaaa

SEQ ID NO: 6550924 - DNA, 12 bp, Homo sapiens
ttgtaatgttgt

SEQ ID NO: 6550925 - DNA, 19 bp, Homo sapiens
ttgtaatgttgtgaataat

SEQ ID NO: 6550926 - DNA, 21 bp, Homo sapiens
ttgtaatgttgtgaataatta

SEQ ID NO: 6550927 - DNA, 16 bp, Homo sapiens
ttgtaattagtaataa

SEQ ID NO: 6550928 - DNA, 16 bp, Homo sapiens
ttgtaattatgtaaat

SEQ ID NO: 6550929 - DNA, 17 bp, Homo sapiens
ttgtaattatgtaaata

SEQ ID NO: 6550930 - DNA, 14 bp, Homo sapiens
ttgtaattattgtg

SEQ ID NO: 6550931 - DNA, 14 bp, Homo sapiens
ttgtaattctaaat

SEQ ID NO: 6550932 - DNA, 18 bp, Homo sapiens
ttgtaattcttatgacta

SEQ ID NO: 6550933 - DNA, 18 bp, Homo sapiens
ttgtaattgcttacattt

SEQ ID NO: 6550934 - DNA, 12 bp, Homo sapiens
ttgtaattgtgt

SEQ ID NO: 6550935 - DNA, 13 bp, Homo sapiens
ttgtaattgtgta

SEQ ID NO: 6550936 - DNA, 23 bp, Homo sapiens
ttgtaattgtgtaaaaaatggaa

SEQ ID NO: 6550937 - DNA, 22 bp, Homo sapiens
ttgtaatttaaacaggcccagc

SEQ ID NO: 6550938 - DNA, 12 bp, Homo sapiens
ttgtaatttgaa

SEQ ID NO: 6550939 - DNA, 14 bp, Homo sapiens
ttgtaatttgaatt

SEQ ID NO: 6550940 - DNA, 16 bp, Homo sapiens
ttgtaatttgaattgg

SEQ ID NO: 6550941 - DNA, 20 bp, Homo sapiens
ttgtaatttgggaacataaa

SEQ ID NO: 6550942 - DNA, 13 bp, Homo sapiens
ttgtaattttaca

SEQ ID NO: 6550943 - DNA, 19 bp, Homo sapiens
ttgtaattttcttgatgac

SEQ ID NO: 6550944 - DNA, 22 bp, Homo sapiens
ttgtaattttcttgatgactgg

SEQ ID NO: 6550945 - DNA, 13 bp, Homo sapiens
ttgtaattttgaa

SEQ ID NO: 6550946 - DNA, 16 bp, Homo sapiens
ttgtaattttgttcct

SEQ ID NO: 6550947 - DNA, 19 bp, Homo sapiens
ttgtaatttttggggaaaa

SEQ ID NO: 6550948 - DNA, 22 bp, Homo sapiens
ttgtaatttttttgaaaaaagt

SEQ ID NO: 6550949 - DNA, 19 bp, Homo sapiens
ttgtacaaaaaagttataa

SEQ ID NO: 6550950 - DNA, 12 bp, Homo sapiens
ttgtacaaaaga

SEQ ID NO: 6550951 - DNA, 13 bp, Homo sapiens
ttgtacaaaagaa

SEQ ID NO: 6550952 - DNA, 12 bp, Homo sapiens
ttgtacaaaata

SEQ ID NO: 6550953 - DNA, 23 bp, Homo sapiens
ttgtacaaaataaacaaataaca

SEQ ID NO: 6550954 - DNA, 20 bp, Homo sapiens
ttgtacaaaattaagcaaat

SEQ ID NO: 6550955 - DNA, 20 bp, Homo sapiens
ttgtacaaagtaaaaataaa

SEQ ID NO: 6550956 - DNA, 13 bp, Homo sapiens
ttgtacaaagtat

SEQ ID NO: 6550957 - DNA, 15 bp, Homo sapiens
ttgtacaaagtatta

SEQ ID NO: 6550958 - DNA, 20 bp, Homo sapiens
ttgtacaaagtattaagcat

SEQ ID NO: 6550959 - DNA, 22 bp, Homo sapiens
ttgtacaaagtattaagcatat

SEQ ID NO: 6550960 - DNA, 18 bp, Homo sapiens
ttgtacaaagttttcctt

SEQ ID NO: 6550961 - DNA, 16 bp, Homo sapiens
ttgtacaaataaacct

SEQ ID NO: 6550962 - DNA, 14 bp, Homo sapiens
ttgtacaaataaag

SEQ ID NO: 6550963 - DNA, 11 bp, Homo sapiens
ttgtacaaatg

SEQ ID NO: 6550964 - DNA, 20 bp, Homo sapiens
ttgtacaaatgtaagcaaag

SEQ ID NO: 6550965 - DNA, 17 bp, Homo sapiens
ttgtacaaatgtatttt

SEQ ID NO: 6550966 - DNA, 18 bp, Homo sapiens
ttgtacaaggtaattgtt

SEQ ID NO: 6550967 - DNA, 20 bp, Homo sapiens
ttgtacaaggtatttacaca

SEQ ID NO: 6550968 - DNA, 14 bp, Homo sapiens
ttgtacaatcatgt

SEQ ID NO: 6550969 - DNA, 13 bp, Homo sapiens
ttgtacaatggtt

SEQ ID NO: 6550970 - DNA, 15 bp, Homo sapiens
ttgtacaatggttta

SEQ ID NO: 6550971 - DNA, 22 bp, Homo sapiens
ttgtacaatggtttattcccaa

SEQ ID NO: 6550972 - DNA, 22 bp, Homo sapiens
ttgtacacaacacctaaaacca

SEQ ID NO: 6550973 - DNA, 19 bp, Homo sapiens
ttgtacacaccttatattt

SEQ ID NO: 6550974 - DNA, 13 bp, Homo sapiens
ttgtacacagtct

SEQ ID NO: 6550975 - DNA, 23 bp, Homo sapiens
ttgtacacccatgaaagaaaact

SEQ ID NO: 6550976 - DNA, 18 bp, Homo sapiens
ttgtacacgctgatgaga

SEQ ID NO: 6550977 - DNA, 15 bp, Homo sapiens
ttgtacactgctgta

SEQ ID NO: 6550978 - DNA, 13 bp, Homo sapiens
ttgtacacttaag

SEQ ID NO: 6550979 - DNA, 15 bp, Homo sapiens
ttgtacacttttttg

SEQ ID NO: 6550980 - DNA, 22 bp, Homo sapiens
ttgtacagaatatttctattga

SEQ ID NO: 6550981 - DNA, 13 bp, Homo sapiens
ttgtacagaattt

SEQ ID NO: 6550982 - DNA, 18 bp, Homo sapiens
ttgtacagaattttggaa

SEQ ID NO: 6550983 - DNA, 21 bp, Homo sapiens
ttgtacagacgtatgcttatt

SEQ ID NO: 6550984 - DNA, 14 bp, Homo sapiens
ttgtacagactgtt

SEQ ID NO: 6550985 - DNA, 14 bp, Homo sapiens
ttgtacagccttat

SEQ ID NO: 6550986 - DNA, 17 bp, Homo sapiens
ttgtacaggactgtaaa

SEQ ID NO: 6550987 - DNA, 23 bp, Homo sapiens
ttgtacaggactgtaaagatttg

SEQ ID NO: 6550988 - DNA, 18 bp, Homo sapiens
ttgtacagtgtctgtgcc

SEQ ID NO: 6550989 - DNA, 15 bp, Homo sapiens
ttgtacagtttgctg

SEQ ID NO: 6550990 - DNA, 20 bp, Homo sapiens
ttgtacagtttgctgtacta

SEQ ID NO: 6550991 - DNA, 20 bp, Homo sapiens
ttgtacagtttgtttacaca

SEQ ID NO: 6550992 - DNA, 13 bp, Homo sapiens
ttgtacagttttt

SEQ ID NO: 6550993 - DNA, 13 bp, Homo sapiens
ttgtacataaaca

SEQ ID NO: 6550994 - DNA, 22 bp, Homo sapiens
ttgtacatacagaggtaactat

SEQ ID NO: 6550995 - DNA, 19 bp, Homo sapiens
ttgtacatacgatttaagg

SEQ ID NO: 6550996 - DNA, 22 bp, Homo sapiens
ttgtacatacgatttaaggtat

SEQ ID NO: 6550997 - DNA, 16 bp, Homo sapiens
ttgtacatatcaaata

SEQ ID NO: 6550998 - DNA, 22 bp, Homo sapiens
ttgtacatatcaaatagatatt

SEQ ID NO: 6550999 - DNA, 19 bp, Homo sapiens
ttgtacatatcctttggtc

SEQ ID NO: 6551000 - DNA, 17 bp, Homo sapiens
ttgtacatatggaaatc

SEQ ID NO: 6551001 - DNA, 17 bp, Homo sapiens
ttgtacatattatcatc

SEQ ID NO: 6551002 - DNA, 15 bp, Homo sapiens
ttgtacatatttgtg

SEQ ID NO: 6551003 - DNA, 16 bp, Homo sapiens
ttgtacatctggctta

SEQ ID NO: 6551004 - DNA, 13 bp, Homo sapiens
ttgtacatgaaat

SEQ ID NO: 6551005 - DNA, 22 bp, Homo sapiens
ttgtacatgaaatttttgtaaa

SEQ ID NO: 6551006 - DNA, 18 bp, Homo sapiens
ttgtacatgataagacat

SEQ ID NO: 6551007 - DNA, 21 bp, Homo sapiens
ttgtacatgtgtagcctgtgc

SEQ ID NO: 6551008 - DNA, 17 bp, Homo sapiens
ttgtacatttatgattt

SEQ ID NO: 6551009 - DNA, 23 bp, Homo sapiens
ttgtacatttatgatttaataaa

SEQ ID NO: 6551010 - DNA, 17 bp, Homo sapiens
ttgtacatttggaacag

SEQ ID NO: 6551011 - DNA, 12 bp, Homo sapiens
ttgtacattttt

SEQ ID NO: 6551012 - DNA, 23 bp, Homo sapiens
ttgtacatttttaaattcttact

SEQ ID NO: 6551013 - DNA, 21 bp, Homo sapiens
ttgtaccacagtttcttctgt

SEQ ID NO: 6551014 - DNA, 13 bp, Homo sapiens
ttgtaccactgct

SEQ ID NO: 6551015 - DNA, 17 bp, Homo sapiens
ttgtaccactgctaata

SEQ ID NO: 6551016 - DNA, 16 bp, Homo sapiens
ttgtaccatatgtagc

SEQ ID NO: 6551017 - DNA, 12 bp, Homo sapiens
ttgtaccatatt

SEQ ID NO: 6551018 - DNA, 18 bp, Homo sapiens
ttgtaccatattgctctt

SEQ ID NO: 6551019 - DNA, 17 bp, Homo sapiens
ttgtaccatcattttat

SEQ ID NO: 6551020 - DNA, 20 bp, Homo sapiens
ttgtaccatggttgtgcaca

SEQ ID NO: 6551021 - DNA, 15 bp, Homo sapiens
ttgtaccattttcta

SEQ ID NO: 6551022 - DNA, 11 bp, Homo sapiens
ttgtaccccat

SEQ ID NO: 6551023 - DNA, 15 bp, Homo sapiens
ttgtaccccatccct

SEQ ID NO: 6551024 - DNA, 16 bp, Homo sapiens
ttgtaccccatccctt

SEQ ID NO: 6551025 - DNA, 19 bp, Homo sapiens
ttgtaccccatcccttcct

SEQ ID NO: 6551026 - DNA, 19 bp, Homo sapiens
ttgtacccttgttattatc

SEQ ID NO: 6551027 - DNA, 14 bp, Homo sapiens
ttgtacctctggct

SEQ ID NO: 6551028 - DNA, 13 bp, Homo sapiens
ttgtacctggtga

SEQ ID NO: 6551029 - DNA, 21 bp, Homo sapiens
ttgtacctgtaggactctcat

SEQ ID NO: 6551030 - DNA, 22 bp, Homo sapiens
ttgtaccttattgatctttgcc

SEQ ID NO: 6551031 - DNA, 23 bp, Homo sapiens
ttgtaccttttttgttttttcaa

SEQ ID NO: 6551032 - DNA, 16 bp, Homo sapiens
ttgtacgaagagtatt

SEQ ID NO: 6551033 - DNA, 19 bp, Homo sapiens
ttgtacgaagagtattttt

SEQ ID NO: 6551034 - DNA, 17 bp, Homo sapiens
ttgtacgtatgaatgat

SEQ ID NO: 6551035 - DNA, 13 bp, Homo sapiens
ttgtacgtgggag

SEQ ID NO: 6551036 - DNA, 15 bp, Homo sapiens
ttgtacgtgttatta

SEQ ID NO: 6551037 - DNA, 21 bp, Homo sapiens
tgttggtaattattttggtac

SEQ ID NO: 6551038 - DNA, 15 bp, Homo sapiens
tgttggtattttcag

SEQ ID NO: 6551039 - DNA, 13 bp, Homo sapiens
tgttggtcagagg

SEQ ID NO: 6551040 - DNA, 16 bp, Homo sapiens
tgttggtccactgtgt

SEQ ID NO: 6551041 - DNA, 14 bp, Homo sapiens
tgttggtctgtact

SEQ ID NO: 6551042 - DNA, 15 bp, Homo sapiens
tgttggtctgtactg

SEQ ID NO: 6551043 - DNA, 23 bp, Homo sapiens
tgttggtgaattttcaaggcctt

SEQ ID NO: 6551044 - DNA, 11 bp, Homo sapiens
tgttggtgcaa

SEQ ID NO: 6551045 - DNA, 14 bp, Homo sapiens
tgttggtgcacagc

SEQ ID NO: 6551046 - DNA, 23 bp, Homo sapiens
tgttggtgcgaaagtaaaaacac

SEQ ID NO: 6551047 - DNA, 15 bp, Homo sapiens
tgttggtgctttgca

SEQ ID NO: 6551048 - DNA, 20 bp, Homo sapiens
tgttggtgtggagttttcat

SEQ ID NO: 6551049 - DNA, 19 bp, Homo sapiens
tgttggtgttcggagctct

SEQ ID NO: 6551050 - DNA, 14 bp, Homo sapiens
tgttggttcaaact

SEQ ID NO: 6551051 - DNA, 14 bp, Homo sapiens
tgttggttttgact

SEQ ID NO: 6551052 - DNA, 22 bp, Homo sapiens
tgttggttttttataaagtcta

SEQ ID NO: 6551053 - DNA, 14 bp, Homo sapiens
tgttgtaaaaagaa

SEQ ID NO: 6551054 - DNA, 23 bp, Homo sapiens
tgttgtaaaacaaaatttgacta

SEQ ID NO: 6551055 - DNA, 14 bp, Homo sapiens
tgttgtaaagagtg

SEQ ID NO: 6551056 - DNA, 17 bp, Homo sapiens
tgttgtaaatgaccaag

SEQ ID NO: 6551057 - DNA, 21 bp, Homo sapiens
tgttgtaaatgaccaagaaaa

SEQ ID NO: 6551058 - DNA, 15 bp, Homo sapiens
tgttgtaagaattct

SEQ ID NO: 6551059 - DNA, 18 bp, Homo sapiens
tgttgtaagaattctgat

SEQ ID NO: 6551060 - DNA, 14 bp, Homo sapiens
tgttgtaagcaaca

SEQ ID NO: 6551061 - DNA, 16 bp, Homo sapiens
tgttgtaatagtccat

SEQ ID NO: 6551062 - DNA, 15 bp, Homo sapiens
tgttgtaatattttg

SEQ ID NO: 6551063 - DNA, 22 bp, Homo sapiens
tgttgtaatattttgctgctga

SEQ ID NO: 6551064 - DNA, 15 bp, Homo sapiens
tgttgtaattcttca

SEQ ID NO: 6551065 - DNA, 19 bp, Homo sapiens
tgttgtaattcttcagttg

SEQ ID NO: 6551066 - DNA, 15 bp, Homo sapiens
tgttgtacaagctca

SEQ ID NO: 6551067 - DNA, 15 bp, Homo sapiens
tgttgtacaatcaaa

SEQ ID NO: 6551068 - DNA, 18 bp, Homo sapiens
tgttgtacaatcaaaaca

SEQ ID NO: 6551069 - DNA, 23 bp, Homo sapiens
tgttgtacaattaagttacaatt

SEQ ID NO: 6551070 - DNA, 16 bp, Homo sapiens
tgttgtacaattactg

SEQ ID NO: 6551071 - DNA, 17 bp, Homo sapiens
tgttgtacaattactgt

SEQ ID NO: 6551072 - DNA, 16 bp, Homo sapiens
tgttgtacatttatga

SEQ ID NO: 6551073 - DNA, 18 bp, Homo sapiens
tgttgtacatttatgatt

SEQ ID NO: 6551074 - DNA, 22 bp, Homo sapiens
tgttgtacatttcaccatggcc

SEQ ID NO: 6551075 - DNA, 19 bp, Homo sapiens
tgttgtaccatatgtagca

SEQ ID NO: 6551076 - DNA, 14 bp, Homo sapiens
tgttgtagagaaaa

SEQ ID NO: 6551077 - DNA, 15 bp, Homo sapiens
tgttgtagatgctaa

SEQ ID NO: 6551078 - DNA, 22 bp, Homo sapiens
tgttgtagattgattgtattgt

SEQ ID NO: 6551079 - DNA, 17 bp, Homo sapiens
tgttgtagtaagagctt

SEQ ID NO: 6551080 - DNA, 17 bp, Homo sapiens
tgttgtatatcactaaa

SEQ ID NO: 6551081 - DNA, 21 bp, Homo sapiens
tgttgtatatcactaaaagca

SEQ ID NO: 6551082 - DNA, 15 bp, Homo sapiens
tgttgtatgccttta

SEQ ID NO: 6551083 - DNA, 14 bp, Homo sapiens
tgttgtattaacaa

SEQ ID NO: 6551084 - DNA, 15 bp, Homo sapiens
tgttgtattaactgg

SEQ ID NO: 6551085 - DNA, 16 bp, Homo sapiens
tgttgtattcctgcct

SEQ ID NO: 6551086 - DNA, 14 bp, Homo sapiens
tgttgtatttaatt

SEQ ID NO: 6551087 - DNA, 22 bp, Homo sapiens
tgttgtatttatggattaaaaa

SEQ ID NO: 6551088 - DNA, 15 bp, Homo sapiens
tgttgtatttctata

SEQ ID NO: 6551089 - DNA, 13 bp, Homo sapiens
tgttgtcaaagag

SEQ ID NO: 6551090 - DNA, 11 bp, Homo sapiens
tgttgtcaaga

SEQ ID NO: 6551091 - DNA, 16 bp, Homo sapiens
tgttgtcaagaatagc

SEQ ID NO: 6551092 - DNA, 15 bp, Homo sapiens
tgttgtcaagtataa

SEQ ID NO: 6551093 - DNA, 19 bp, Homo sapiens
tgttgtcacatctcaggga

SEQ ID NO: 6551094 - DNA, 21 bp, Homo sapiens
tgttgtcagcaggcaggctgg

SEQ ID NO: 6551095 - DNA, 16 bp, Homo sapiens
tgttgtcagcctgtgc

SEQ ID NO: 6551096 - DNA, 23 bp, Homo sapiens
tgttgtcagcctgtgctgtggca

SEQ ID NO: 6551097 - DNA, 15 bp, Homo sapiens
tgttgtcataacatt

SEQ ID NO: 6551098 - DNA, 19 bp, Homo sapiens
tgttgtcataacatttaaa

SEQ ID NO: 6551099 - DNA, 20 bp, Homo sapiens
tgttgtcataacatttaaag

SEQ ID NO: 6551100 - DNA, 14 bp, Homo sapiens
tgttgtcatgtgta

SEQ ID NO: 6551101 - DNA, 16 bp, Homo sapiens
tgttgtcatgtgtatg

SEQ ID NO: 6551102 - DNA, 14 bp, Homo sapiens
tgttgtcattgctg

SEQ ID NO: 6551103 - DNA, 13 bp, Homo sapiens
tgttgtcattgtc

SEQ ID NO: 6551104 - DNA, 14 bp, Homo sapiens
tgttgtcattgtcc

SEQ ID NO: 6551105 - DNA, 21 bp, Homo sapiens
tgttgtcattgtccagctggg

SEQ ID NO: 6551106 - DNA, 12 bp, Homo sapiens
tgttgtccaaca

SEQ ID NO: 6551107 - DNA, 22 bp, Homo sapiens
tgttgtccaacaataaacagga

SEQ ID NO: 6551108 - DNA, 17 bp, Homo sapiens
tgttgtccaactattta

SEQ ID NO: 6551109 - DNA, 22 bp, Homo sapiens
tgttgtcctcccaggaaccaaa

SEQ ID NO: 6551110 - DNA, 18 bp, Homo sapiens
tgttgtcctcctgttcat

SEQ ID NO: 6551111 - DNA, 16 bp, Homo sapiens
tgttgtcctgtgtcat

SEQ ID NO: 6551112 - DNA, 14 bp, Homo sapiens
tgttgtccttgccc

SEQ ID NO: 6551113 - DNA, 18 bp, Homo sapiens
tgttgtccttgccccact

SEQ ID NO: 6551114 - DNA, 17 bp, Homo sapiens
tgttgtctaagaaattg

SEQ ID NO: 6551115 - DNA, 16 bp, Homo sapiens
tgttgtctgcaactct

SEQ ID NO: 6551116 - DNA, 17 bp, Homo sapiens
tgttgtctgtttgttct

SEQ ID NO: 6551117 - DNA, 15 bp, Homo sapiens
tgttgtcttcagcag

SEQ ID NO: 6551118 - DNA, 12 bp, Homo sapiens
tgttgtcttgaa

SEQ ID NO: 6551119 - DNA, 22 bp, Homo sapiens
tgttgtgaagctaatgtcacaa

SEQ ID NO: 6551120 - DNA, 15 bp, Homo sapiens
tgttgtgaataatta

SEQ ID NO: 6551121 - DNA, 21 bp, Homo sapiens
tgttgtgactgctgccatttt

SEQ ID NO: 6551122 - DNA, 14 bp, Homo sapiens
tgttgtgagaatgg

SEQ ID NO: 6551123 - DNA, 15 bp, Homo sapiens
tgttgtgagaatggc

SEQ ID NO: 6551124 - DNA, 22 bp, Homo sapiens
tgttgtgagaatggcctggagc

SEQ ID NO: 6551125 - DNA, 13 bp, Homo sapiens
tgttgtgagcttt

SEQ ID NO: 6551126 - DNA, 13 bp, Homo sapiens
tgttgtgatgtct

SEQ ID NO: 6551127 - DNA, 14 bp, Homo sapiens
tgttgtgatgtctt

SEQ ID NO: 6551128 - DNA, 12 bp, Homo sapiens
tgttgtgattaa

SEQ ID NO: 6551129 - DNA, 20 bp, Homo sapiens
tgttgtgattttgtacagaa

SEQ ID NO: 6551130 - DNA, 19 bp, Homo sapiens
tgttgtgcactagtgcaat

SEQ ID NO: 6551131 - DNA, 18 bp, Homo sapiens
tgttgtgcagtgtgcctg

SEQ ID NO: 6551132 - DNA, 23 bp, Homo sapiens
tgttgtgcagtgtgcctgtcact

SEQ ID NO: 6551133 - DNA, 16 bp, Homo sapiens
tgttgtgcctccctgg

SEQ ID NO: 6551134 - DNA, 13 bp, Homo sapiens
tgttgtgctttta

SEQ ID NO: 6551135 - DNA, 16 bp, Homo sapiens
tgttgtggaagcatgt

SEQ ID NO: 6551136 - DNA, 22 bp, Homo sapiens
tgttgtgggcgctgcttccagg

SEQ ID NO: 6551137 - DNA, 14 bp, Homo sapiens
tgttgtgggcttcc

SEQ ID NO: 6551138 - DNA, 23 bp, Homo sapiens
tgttgtgggcttcctgctgggac

SEQ ID NO: 6551139 - DNA, 18 bp, Homo sapiens
tgttgtggggatggtgat

SEQ ID NO: 6551140 - DNA, 21 bp, Homo sapiens
tgttgtgggttctatgtttac

SEQ ID NO: 6551141 - DNA, 21 bp, Homo sapiens
tgttgtgtacgtggagaggga

SEQ ID NO: 6551142 - DNA, 12 bp, Homo sapiens
tgttgtgtataa

SEQ ID NO: 6551143 - DNA, 18 bp, Homo sapiens
tgttgtgtataatttacc

SEQ ID NO: 6551144 - DNA, 13 bp, Homo sapiens
tgttgtgtctgga

SEQ ID NO: 6551145 - DNA, 22 bp, Homo sapiens
tgttgtgtctgtgccctccaaa

SEQ ID NO: 6551146 - DNA, 12 bp, Homo sapiens
tgttgtgtgtgc

SEQ ID NO: 6551147 - DNA, 15 bp, Homo sapiens
tgttgtgtgtgcagg

SEQ ID NO: 6551148 - DNA, 16 bp, Homo sapiens
tgttgtgtgttgcact

SEQ ID NO: 6551149 - DNA, 18 bp, Homo sapiens
tgttgtgttacaataagt

SEQ ID NO: 6551150 - DNA, 14 bp, Homo sapiens
tgttgtgttcctgg

SEQ ID NO: 6551151 - DNA, 15 bp, Homo sapiens
tgttgtgttcctggc

SEQ ID NO: 6551152 - DNA, 14 bp, Homo sapiens
tgttgtgtttctgt

SEQ ID NO: 6551153 - DNA, 16 bp, Homo sapiens
tgttgtgtttgtagtc

SEQ ID NO: 6551154 - DNA, 15 bp, Homo sapiens
tgttgttaaacacgt

SEQ ID NO: 6551155 - DNA, 14 bp, Homo sapiens
tgttgttaaatgct

SEQ ID NO: 6551156 - DNA, 21 bp, Homo sapiens
tgttgttaatgaaaatgtcag

SEQ ID NO: 6551157 - DNA, 13 bp, Homo sapiens
tgttgttaatttt

SEQ ID NO: 6551158 - DNA, 15 bp, Homo sapiens
tgttgttatgatgtg

SEQ ID NO: 6551159 - DNA, 22 bp, Homo sapiens
tgttgttcaagcttttcctttc

SEQ ID NO: 6551160 - DNA, 17 bp, Homo sapiens
tgttgttcagaagttgt

SEQ ID NO: 6551161 - DNA, 13 bp, Homo sapiens
tgttgttccaaat

SEQ ID NO: 6551162 - DNA, 15 bp, Homo sapiens
tgttgttccatttta

SEQ ID NO: 6551163 - DNA, 21 bp, Homo sapiens
tgttgttcccacacacaaacc

SEQ ID NO: 6551164 - DNA, 19 bp, Homo sapiens
tgttgttcctctatacttt

SEQ ID NO: 6551165 - DNA, 15 bp, Homo sapiens
tgttgttccttttga

SEQ ID NO: 6551166 - DNA, 22 bp, Homo sapiens
tgttgttctaaaggctgttaaa

SEQ ID NO: 6551167 - DNA, 13 bp, Homo sapiens
tgttgttctgcct

SEQ ID NO: 6551168 - DNA, 11 bp, Homo sapiens
tgttgttctgt

SEQ ID NO: 6551169 - DNA, 22 bp, Homo sapiens
tgttgttctgttaactgaatac

SEQ ID NO: 6551170 - DNA, 18 bp, Homo sapiens
tgttgttgaactaatata

SEQ ID NO: 6551171 - DNA, 21 bp, Homo sapiens
tgttgttgcagggaagtctta

SEQ ID NO: 6551172 - DNA, 20 bp, Homo sapiens
tgttgttgcttcttgtgaag

SEQ ID NO: 6551173 - DNA, 18 bp, Homo sapiens
tgttgttggcaagctgca

SEQ ID NO: 6551174 - DNA, 20 bp, Homo sapiens
tgttgtttaaaataaaagta

SEQ ID NO: 6551175 - DNA, 13 bp, Homo sapiens
tgttgtttaagtg

SEQ ID NO: 6551176 - DNA, 13 bp, Homo sapiens
tgttgtttacctg

SEQ ID NO: 6551177 - DNA, 15 bp, Homo sapiens
tgttgtttataataa

SEQ ID NO: 6551178 - DNA, 18 bp, Homo sapiens
tgttgtttatatgaaaac

SEQ ID NO: 6551179 - DNA, 11 bp, Homo sapiens
tgttgtttcca

SEQ ID NO: 6551180 - DNA, 13 bp, Homo sapiens
tgttgtttccata

SEQ ID NO: 6551181 - DNA, 14 bp, Homo sapiens
tgttgtttccatag

SEQ ID NO: 6551182 - DNA, 15 bp, Homo sapiens
tgttgtttccatagc

SEQ ID NO: 6551183 - DNA, 16 bp, Homo sapiens
tgttgtttcttaaata

SEQ ID NO: 6551184 - DNA, 20 bp, Homo sapiens
tgttgtttcttaatttggaa

SEQ ID NO: 6551185 - DNA, 16 bp, Homo sapiens
tgttgtttcttttatg

SEQ ID NO: 6551186 - DNA, 17 bp, Homo sapiens
tgttgtttgaaaatatt

SEQ ID NO: 6551187 - DNA, 11 bp, Homo sapiens
tgttgtttgat

SEQ ID NO: 6551188 - DNA, 13 bp, Homo sapiens
tgttgtttgtaaa

SEQ ID NO: 6551189 - DNA, 15 bp, Homo sapiens
tgttgtttgtaaata

SEQ ID NO: 6551190 - DNA, 14 bp, Homo sapiens
tgttgtttgtttag

SEQ ID NO: 6551191 - DNA, 12 bp, Homo sapiens
tgttgttttata

SEQ ID NO: 6551192 - DNA, 16 bp, Homo sapiens
tgttgttttctggggg

SEQ ID NO: 6551193 - DNA, 16 bp, Homo sapiens
tgttgttttgtacaga

SEQ ID NO: 6551194 - DNA, 13 bp, Homo sapiens
tgttgttttgtgt

SEQ ID NO: 6551195 - DNA, 23 bp, Homo sapiens
tgttgtttttaaaaagaaaatca

SEQ ID NO: 6551196 - DNA, 16 bp, Homo sapiens
tgttgtttttgataat

SEQ ID NO: 6551197 - DNA, 22 bp, Homo sapiens
tgttgttttttcatagtgcctt

SEQ ID NO: 6551198 - DNA, 20 bp, Homo sapiens
tgtttaaaaaaagtatatat

SEQ ID NO: 6551199 - DNA, 18 bp, Homo sapiens
tgtttaaaaaaccacatg

SEQ ID NO: 6551200 - DNA, 16 bp, Homo sapiens
tgtttaaaaaagttta

SEQ ID NO: 6551201 - DNA, 17 bp, Homo sapiens
tgtttaaaaaagtttaa

SEQ ID NO: 6551202 - DNA, 18 bp, Homo sapiens
tgtttaaaaaagtttaaa

SEQ ID NO: 6551203 - DNA, 21 bp, Homo sapiens
tgtttaaaaaagtttaaaatg

SEQ ID NO: 6551204 - DNA, 17 bp, Homo sapiens
tgtttaaaaagtaagtt

SEQ ID NO: 6551205 - DNA, 12 bp, Homo sapiens
tgtttaaaacac

SEQ ID NO: 6551206 - DNA, 22 bp, Homo sapiens
tgtttaaaactcagaatataac

SEQ ID NO: 6551207 - DNA, 18 bp, Homo sapiens
tgtttaaaagcaaatact

SEQ ID NO: 6551208 - DNA, 14 bp, Homo sapiens
tgtttaaaataaaa

SEQ ID NO: 6551209 - DNA, 19 bp, Homo sapiens
tgtttaaaataaaatgaaa

SEQ ID NO: 6551210 - DNA, 22 bp, Homo sapiens
tgtttaaaataaaatgaaaatt

SEQ ID NO: 6551211 - DNA, 14 bp, Homo sapiens
tgtttaaaatcatt

SEQ ID NO: 6551212 - DNA, 14 bp, Homo sapiens
tgtttaaaattcag

SEQ ID NO: 6551213 - DNA, 15 bp, Homo sapiens
tgtttaaaattcagt

SEQ ID NO: 6551214 - DNA, 17 bp, Homo sapiens
tgtttaaaattcagttt

SEQ ID NO: 6551215 - DNA, 14 bp, Homo sapiens
tgtttaaaattctc

SEQ ID NO: 6551216 - DNA, 13 bp, Homo sapiens
tgtttaaaatttc

SEQ ID NO: 6551217 - DNA, 23 bp, Homo sapiens
tgtttaaagaagctctccaggcc

SEQ ID NO: 6551218 - DNA, 17 bp, Homo sapiens
tgtttaaagagaggtta

SEQ ID NO: 6551219 - DNA, 16 bp, Homo sapiens
ttgtacgttaattaaa

SEQ ID NO: 6551220 - DNA, 15 bp, Homo sapiens
ttgtacgttatatat

SEQ ID NO: 6551221 - DNA, 17 bp, Homo sapiens
ttgtacgttcttctatt

SEQ ID NO: 6551222 - DNA, 16 bp, Homo sapiens
ttgtactatttaactg

SEQ ID NO: 6551223 - DNA, 18 bp, Homo sapiens
ttgtactcaaagcccaga

SEQ ID NO: 6551224 - DNA, 14 bp, Homo sapiens
ttgtactcaatttt

SEQ ID NO: 6551225 - DNA, 13 bp, Homo sapiens
ttgtactccagcc

SEQ ID NO: 6551226 - DNA, 21 bp, Homo sapiens
ttgtactgcatcttagtttac

SEQ ID NO: 6551227 - DNA, 19 bp, Homo sapiens
ttgtactggttagattcat

SEQ ID NO: 6551228 - DNA, 14 bp, Homo sapiens
ttgtactgtaaaga

SEQ ID NO: 6551229 - DNA, 15 bp, Homo sapiens
ttgtactgtagttca

SEQ ID NO: 6551230 - DNA, 17 bp, Homo sapiens
ttgtactgttgctttaa

SEQ ID NO: 6551231 - DNA, 23 bp, Homo sapiens
ttgtacttaaatggtaataagca

SEQ ID NO: 6551232 - DNA, 22 bp, Homo sapiens
ttgtacttagccagttcaaagt

SEQ ID NO: 6551233 - DNA, 13 bp, Homo sapiens
ttgtacttcttat

SEQ ID NO: 6551234 - DNA, 13 bp, Homo sapiens
ttgtacttgattt

SEQ ID NO: 6551235 - DNA, 19 bp, Homo sapiens
ttgtacttggagtaattgc

SEQ ID NO: 6551236 - DNA, 15 bp, Homo sapiens
ttgtactttaaaaat

SEQ ID NO: 6551237 - DNA, 19 bp, Homo sapiens
ttgtactttatcatgaatg

SEQ ID NO: 6551238 - DNA, 22 bp, Homo sapiens
ttgtacttttagtagagacagt

SEQ ID NO: 6551239 - DNA, 21 bp, Homo sapiens
ttgtacttttctggttccaaa

SEQ ID NO: 6551240 - DNA, 22 bp, Homo sapiens
ttgtacttttctggttccaaac

SEQ ID NO: 6551241 - DNA, 20 bp, Homo sapiens
ttgtagaaaaatccctccac

SEQ ID NO: 6551242 - DNA, 21 bp, Homo sapiens
ttgtagaaagctaatacaaaa

SEQ ID NO: 6551243 - DNA, 14 bp, Homo sapiens
ttgtagaaatctgt

SEQ ID NO: 6551244 - DNA, 18 bp, Homo sapiens
ttgtagaaattaaacata

SEQ ID NO: 6551245 - DNA, 15 bp, Homo sapiens
ttgtagaaattctta

SEQ ID NO: 6551246 - DNA, 19 bp, Homo sapiens
ttgtagaactcactctggg

SEQ ID NO: 6551247 - DNA, 12 bp, Homo sapiens
ttgtagaacttg

SEQ ID NO: 6551248 - DNA, 19 bp, Homo sapiens
ttgtagaagaaaatttaat

SEQ ID NO: 6551249 - DNA, 23 bp, Homo sapiens
ttgtagaaggagccttgttggtg

SEQ ID NO: 6551250 - DNA, 22 bp, Homo sapiens
ttgtagaagtaggaagtgaaaa

SEQ ID NO: 6551251 - DNA, 22 bp, Homo sapiens
ttgtagaagtcacattcctgaa

SEQ ID NO: 6551252 - DNA, 18 bp, Homo sapiens
ttgtagaataaatggttt

SEQ ID NO: 6551253 - DNA, 17 bp, Homo sapiens
ttgtagaatgtattgta

SEQ ID NO: 6551254 - DNA, 14 bp, Homo sapiens
ttgtagaattgtta

SEQ ID NO: 6551255 - DNA, 22 bp, Homo sapiens
ttgtagactatggaatgtcagt

SEQ ID NO: 6551256 - DNA, 16 bp, Homo sapiens
ttgtagactcttgctc

SEQ ID NO: 6551257 - DNA, 23 bp, Homo sapiens
ttgtagacttcctttataatatt

SEQ ID NO: 6551258 - DNA, 14 bp, Homo sapiens
ttgtagagccaggg

SEQ ID NO: 6551259 - DNA, 19 bp, Homo sapiens
ttgtagagtggcccagaat

SEQ ID NO: 6551260 - DNA, 21 bp, Homo sapiens
ttgtagagtggcccagaattg

SEQ ID NO: 6551261 - DNA, 20 bp, Homo sapiens
ttgtagatacaatcagctgc

SEQ ID NO: 6551262 - DNA, 17 bp, Homo sapiens
ttgtagatatatatttc

SEQ ID NO: 6551263 - DNA, 12 bp, Homo sapiens
ttgtagatgaaa

SEQ ID NO: 6551264 - DNA, 20 bp, Homo sapiens
ttgtagatgaacatctctgt

SEQ ID NO: 6551265 - DNA, 15 bp, Homo sapiens
ttgtagatgaacttg

SEQ ID NO: 6551266 - DNA, 22 bp, Homo sapiens
ttgtagatgttagggtataagt

SEQ ID NO: 6551267 - DNA, 22 bp, Homo sapiens
ttgtagattaggtcttgctgga

SEQ ID NO: 6551268 - DNA, 15 bp, Homo sapiens
ttgtagatttgattt

SEQ ID NO: 6551269 - DNA, 14 bp, Homo sapiens
ttgtagcactgaca

SEQ ID NO: 6551270 - DNA, 17 bp, Homo sapiens
ttgtagcactgacagat

SEQ ID NO: 6551271 - DNA, 18 bp, Homo sapiens
ttgtagcactgacagatt

SEQ ID NO: 6551272 - DNA, 18 bp, Homo sapiens
ttgtagcagctatatatt

SEQ ID NO: 6551273 - DNA, 19 bp, Homo sapiens
ttgtagcaggtttcactat

SEQ ID NO: 6551274 - DNA, 15 bp, Homo sapiens
ttgtagcataactgt

SEQ ID NO: 6551275 - DNA, 16 bp, Homo sapiens
ttgtagcatcctggaa

SEQ ID NO: 6551276 - DNA, 13 bp, Homo sapiens
ttgtagcatgtga

SEQ ID NO: 6551277 - DNA, 14 bp, Homo sapiens
ttgtagcattttcc

SEQ ID NO: 6551278 - DNA, 16 bp, Homo sapiens
ttgtagcattttcctg

SEQ ID NO: 6551279 - DNA, 15 bp, Homo sapiens
ttgtagccagccggg

SEQ ID NO: 6551280 - DNA, 12 bp, Homo sapiens
ttgtagccctgg

SEQ ID NO: 6551281 - DNA, 14 bp, Homo sapiens
ttgtagcctctctt

SEQ ID NO: 6551282 - DNA, 16 bp, Homo sapiens
ttgtagcctctctttg

SEQ ID NO: 6551283 - DNA, 21 bp, Homo sapiens
ttgtagctaaaaataaaacat

SEQ ID NO: 6551284 - DNA, 17 bp, Homo sapiens
ttgtagctaacagtgaa

SEQ ID NO: 6551285 - DNA, 14 bp, Homo sapiens
ttgtagctagaata

SEQ ID NO: 6551286 - DNA, 15 bp, Homo sapiens
ttgtagctagtttaa

SEQ ID NO: 6551287 - DNA, 20 bp, Homo sapiens
ttgtagctagtttaaaatta

SEQ ID NO: 6551288 - DNA, 21 bp, Homo sapiens
ttgtagctagtttaaaattat

SEQ ID NO: 6551289 - DNA, 21 bp, Homo sapiens
ttgtagctcttagtcctccct

SEQ ID NO: 6551290 - DNA, 14 bp, Homo sapiens
ttgtagctggggct

SEQ ID NO: 6551291 - DNA, 15 bp, Homo sapiens
ttgtagctgtcatgg

SEQ ID NO: 6551292 - DNA, 14 bp, Homo sapiens
ttgtagctttcctg

SEQ ID NO: 6551293 - DNA, 15 bp, Homo sapiens
ttgtaggaagcattt

SEQ ID NO: 6551294 - DNA, 20 bp, Homo sapiens
ttgtaggaagcattttttat

SEQ ID NO: 6551295 - DNA, 16 bp, Homo sapiens
ttgtaggaatctgcct

SEQ ID NO: 6551296 - DNA, 20 bp, Homo sapiens
ttgtaggaatctgccttcca

SEQ ID NO: 6551297 - DNA, 14 bp, Homo sapiens
ttgtaggactaaat

SEQ ID NO: 6551298 - DNA, 16 bp, Homo sapiens
ttgtagggatgccttt

SEQ ID NO: 6551299 - DNA, 21 bp, Homo sapiens
ttgtaggggaggggctccttt

SEQ ID NO: 6551300 - DNA, 13 bp, Homo sapiens
ttgtagggtttct

SEQ ID NO: 6551301 - DNA, 16 bp, Homo sapiens
ttgtaggtacttttgg

SEQ ID NO: 6551302 - DNA, 22 bp, Homo sapiens
ttgtaggtacttttggaatcta

SEQ ID NO: 6551303 - DNA, 15 bp, Homo sapiens
ttgtaggtatactat

SEQ ID NO: 6551304 - DNA, 20 bp, Homo sapiens
ttgtaggtatgtctgtgcca

SEQ ID NO: 6551305 - DNA, 21 bp, Homo sapiens
ttgtaggtatgtctgtgccat

SEQ ID NO: 6551306 - DNA, 19 bp, Homo sapiens
ttgtaggtcaatgaaatat

SEQ ID NO: 6551307 - DNA, 19 bp, Homo sapiens
ttgtaggttattttatatt

SEQ ID NO: 6551308 - DNA, 18 bp, Homo sapiens
ttgtaggtttctctgcct

SEQ ID NO: 6551309 - DNA, 22 bp, Homo sapiens
ttgtagtagcgttttttaaatg

SEQ ID NO: 6551310 - DNA, 18 bp, Homo sapiens
ttgtagtatttagtatat

SEQ ID NO: 6551311 - DNA, 19 bp, Homo sapiens
ttgtagtccatttaaatgc

SEQ ID NO: 6551312 - DNA, 19 bp, Homo sapiens
ttgtagtgccactgttgtt

SEQ ID NO: 6551313 - DNA, 17 bp, Homo sapiens
ttgtagtgctttgagag

SEQ ID NO: 6551314 - DNA, 23 bp, Homo sapiens
ttgtagtgctttgagagagaaag

SEQ ID NO: 6551315 - DNA, 19 bp, Homo sapiens
ttgtagttctgtgtacttt

SEQ ID NO: 6551316 - DNA, 15 bp, Homo sapiens
ttgtagttctttaaa

SEQ ID NO: 6551317 - DNA, 21 bp, Homo sapiens
ttgtagttgcattaataatag

SEQ ID NO: 6551318 - DNA, 13 bp, Homo sapiens
ttgtagtttacct

SEQ ID NO: 6551319 - DNA, 16 bp, Homo sapiens
ttgtagtttgcccaga

SEQ ID NO: 6551320 - DNA, 21 bp, Homo sapiens
ttgtataaaaaggaaattagt

SEQ ID NO: 6551321 - DNA, 14 bp, Homo sapiens
ttgtataaaacagt

SEQ ID NO: 6551322 - DNA, 16 bp, Homo sapiens
ttgtataaaacagtgt

SEQ ID NO: 6551323 - DNA, 17 bp, Homo sapiens
ttgtataaaagttgtac

SEQ ID NO: 6551324 - DNA, 19 bp, Homo sapiens
ttgtataaaagttgtactg

SEQ ID NO: 6551325 - DNA, 11 bp, Homo sapiens
ttgtataaaat

SEQ ID NO: 6551326 - DNA, 15 bp, Homo sapiens
ttgtataaaataatt

SEQ ID NO: 6551327 - DNA, 16 bp, Homo sapiens
ttgtataaaataattt

SEQ ID NO: 6551328 - DNA, 12 bp, Homo sapiens
ttgtataaaatc

SEQ ID NO: 6551329 - DNA, 23 bp, Homo sapiens
ttgtataaaatccatagatttat

SEQ ID NO: 6551330 - DNA, 21 bp, Homo sapiens
ttgtataaaatctgaattttg

SEQ ID NO: 6551331 - DNA, 20 bp, Homo sapiens
ttgtataaataaatattttt

SEQ ID NO: 6551332 - DNA, 22 bp, Homo sapiens
ttgtataaatgacaaagtgttg

SEQ ID NO: 6551333 - DNA, 13 bp, Homo sapiens
ttgtataaatgta

SEQ ID NO: 6551334 - DNA, 19 bp, Homo sapiens
ttgtataaatgtatataca

SEQ ID NO: 6551335 - DNA, 11 bp, Homo sapiens
ttgtataaatt

SEQ ID NO: 6551336 - DNA, 19 bp, Homo sapiens
ttgtataaatttatttact

SEQ ID NO: 6551337 - DNA, 14 bp, Homo sapiens
ttgtataacaggtt

SEQ ID NO: 6551338 - DNA, 17 bp, Homo sapiens
ttgtataacaggttatt

SEQ ID NO: 6551339 - DNA, 15 bp, Homo sapiens
ttgtataacatcact

SEQ ID NO: 6551340 - DNA, 21 bp, Homo sapiens
ttgtataagattagaatgaaa

SEQ ID NO: 6551341 - DNA, 20 bp, Homo sapiens
ttgtataaggagctttgctc

SEQ ID NO: 6551342 - DNA, 16 bp, Homo sapiens
ttgtataagtcaagca

SEQ ID NO: 6551343 - DNA, 24 bp, Homo sapiens
ttgtataagtcaagcacatgtaat

SEQ ID NO: 6551344 - DNA, 18 bp, Homo sapiens
ttgtataagtccatgaat

SEQ ID NO: 6551345 - DNA, 14 bp, Homo sapiens
ttgtataatttcga

SEQ ID NO: 6551346 - DNA, 22 bp, Homo sapiens
ttgtataatttcgagatttgta

SEQ ID NO: 6551347 - DNA, 18 bp, Homo sapiens
ttgtatacatcctgggta

SEQ ID NO: 6551348 - DNA, 19 bp, Homo sapiens
ttgtatacatcctgggtaa

SEQ ID NO: 6551349 - DNA, 22 bp, Homo sapiens
ttgtataccaatgtgttttctg

SEQ ID NO: 6551350 - DNA, 23 bp, Homo sapiens
ttgtataccatgatgcatggagt

SEQ ID NO: 6551351 - DNA, 17 bp, Homo sapiens
ttgtataccctgaagaa

SEQ ID NO: 6551352 - DNA, 20 bp, Homo sapiens
ttgtatactttaaataattt

SEQ ID NO: 6551353 - DNA, 22 bp, Homo sapiens
ttgtatactttaaataatttaa

SEQ ID NO: 6551354 - DNA, 16 bp, Homo sapiens
ttgtatagaccaaagc

SEQ ID NO: 6551355 - DNA, 21 bp, Homo sapiens
ttgtatagctgaaattccagt

SEQ ID NO: 6551356 - DNA, 13 bp, Homo sapiens
ttgtatagttaac

SEQ ID NO: 6551357 - DNA, 22 bp, Homo sapiens
ttgtatagttatgtaaataatt

SEQ ID NO: 6551358 - DNA, 15 bp, Homo sapiens
ttgtatagttgcttg

SEQ ID NO: 6551359 - DNA, 12 bp, Homo sapiens
ttgtatataaag

SEQ ID NO: 6551360 - DNA, 19 bp, Homo sapiens
ttgtatatacagttatttt

SEQ ID NO: 6551361 - DNA, 13 bp, Homo sapiens
ttgtatatacata

SEQ ID NO: 6551362 - DNA, 14 bp, Homo sapiens
ttgtatatacatat

SEQ ID NO: 6551363 - DNA, 15 bp, Homo sapiens
ttgtatatatatgtg

SEQ ID NO: 6551364 - DNA, 16 bp, Homo sapiens
ttgtatatatatgtga

SEQ ID NO: 6551365 - DNA, 11 bp, Homo sapiens
ttgtatatatc

SEQ ID NO: 6551366 - DNA, 15 bp, Homo sapiens
ttgtatatatgtgtg

SEQ ID NO: 6551367 - DNA, 16 bp, Homo sapiens
ttgtatatatgtgtgt

SEQ ID NO: 6551368 - DNA, 21 bp, Homo sapiens
ttgtatatatgtgtgtttaaa

SEQ ID NO: 6551369 - DNA, 16 bp, Homo sapiens
ttgtatatcactaaaa

SEQ ID NO: 6551370 - DNA, 18 bp, Homo sapiens
ttgtatatggtattgtga

SEQ ID NO: 6551371 - DNA, 14 bp, Homo sapiens
ttgtatattaaaat

SEQ ID NO: 6551372 - DNA, 15 bp, Homo sapiens
ttgtatattacaatg

SEQ ID NO: 6551373 - DNA, 16 bp, Homo sapiens
ttgtatattacaatga

SEQ ID NO: 6551374 - DNA, 21 bp, Homo sapiens
ttgtatattatggaagatttt

SEQ ID NO: 6551375 - DNA, 13 bp, Homo sapiens
ttgtatattcact

SEQ ID NO: 6551376 - DNA, 15 bp, Homo sapiens
ttgtatattctggaa

SEQ ID NO: 6551377 - DNA, 22 bp, Homo sapiens
ttgtatattggttttatgatga

SEQ ID NO: 6551378 - DNA, 14 bp, Homo sapiens
ttgtatattgtaat

SEQ ID NO: 6551379 - DNA, 21 bp, Homo sapiens
ttgtatattgtggatgtgttc

SEQ ID NO: 6551380 - DNA, 13 bp, Homo sapiens
ttgtatatttgta

SEQ ID NO: 6551381 - DNA, 15 bp, Homo sapiens
ttgtatcagaggcct

SEQ ID NO: 6551382 - DNA, 22 bp, Homo sapiens
ttgtatcagaggcctataatga

SEQ ID NO: 6551383 - DNA, 16 bp, Homo sapiens
ttgtatcagtaccatt

SEQ ID NO: 6551384 - DNA, 19 bp, Homo sapiens
ttgtatcatttgaacaact

SEQ ID NO: 6551385 - DNA, 15 bp, Homo sapiens
ttgtatccagtgatg

SEQ ID NO: 6551386 - DNA, 22 bp, Homo sapiens
ttgtatcggagggaaacagaag

SEQ ID NO: 6551387 - DNA, 20 bp, Homo sapiens
ttgtatcgtatagctgtatt

SEQ ID NO: 6551388 - DNA, 20 bp, Homo sapiens
ttgtatctacagtaatgaaa

SEQ ID NO: 6551389 - DNA, 16 bp, Homo sapiens
ttgtatctacattaaa

SEQ ID NO: 6551390 - DNA, 17 bp, Homo sapiens
ttgtatctacattaaaa

SEQ ID NO: 6551391 - DNA, 22 bp, Homo sapiens
ttgtatctacattaaaatgaca

SEQ ID NO: 6551392 - DNA, 17 bp, Homo sapiens
ttgtatctagtgcagct

SEQ ID NO: 6551393 - DNA, 21 bp, Homo sapiens
ttgtatctagtgcagctgatt

SEQ ID NO: 6551394 - DNA, 16 bp, Homo sapiens
ttgtatctcatactgt

SEQ ID NO: 6551395 - DNA, 20 bp, Homo sapiens
ttgtatctctgaagcatgtt

SEQ ID NO: 6551396 - DNA, 14 bp, Homo sapiens
ttgtatctcttttg

SEQ ID NO: 6551397 - DNA, 16 bp, Homo sapiens
tgtttaaagtatatgt

SEQ ID NO: 6551398 - DNA, 23 bp, Homo sapiens
tgtttaaagttcaacatgttatt

SEQ ID NO: 6551399 - DNA, 23 bp, Homo sapiens
tgtttaaataaaatttaatttca

SEQ ID NO: 6551400 - DNA, 22 bp, Homo sapiens
tgtttaaatataaatgtttaaa

SEQ ID NO: 6551401 - DNA, 21 bp, Homo sapiens
tgtttaaatcatgtatgttat

SEQ ID NO: 6551402 - DNA, 13 bp, Homo sapiens
tgtttaaatgcca

SEQ ID NO: 6551403 - DNA, 15 bp, Homo sapiens
tgtttaaatgccaaa

SEQ ID NO: 6551404 - DNA, 17 bp, Homo sapiens
tgtttaaatgccaaaat

SEQ ID NO: 6551405 - DNA, 13 bp, Homo sapiens
tgtttaaatgctg

SEQ ID NO: 6551406 - DNA, 16 bp, Homo sapiens
tgtttaaatgctgtgt

SEQ ID NO: 6551407 - DNA, 19 bp, Homo sapiens
tgtttaaatgctgtgtaca

SEQ ID NO: 6551408 - DNA, 21 bp, Homo sapiens
tgtttaaattgtaaattttag

SEQ ID NO: 6551409 - DNA, 18 bp, Homo sapiens
tgtttaacaacatggctt

SEQ ID NO: 6551410 - DNA, 22 bp, Homo sapiens
tgtttaacacttctgtatgcat

SEQ ID NO: 6551411 - DNA, 13 bp, Homo sapiens
tgtttaacacttt

SEQ ID NO: 6551412 - DNA, 17 bp, Homo sapiens
tgtttaacattcacagc

SEQ ID NO: 6551413 - DNA, 18 bp, Homo sapiens
tgtttaacccaaaagatt

SEQ ID NO: 6551414 - DNA, 18 bp, Homo sapiens
tgtttaagaatcatggat

SEQ ID NO: 6551415 - DNA, 20 bp, Homo sapiens
tgtttaagaatcatggattt

SEQ ID NO: 6551416 - DNA, 17 bp, Homo sapiens
tgtttaagacacttccg

SEQ ID NO: 6551417 - DNA, 18 bp, Homo sapiens
tgtttaagacacttccgt

SEQ ID NO: 6551418 - DNA, 20 bp, Homo sapiens
tgtttaagatatatttccaa

SEQ ID NO: 6551419 - DNA, 20 bp, Homo sapiens
tgtttaagatttaatttgcc

SEQ ID NO: 6551420 - DNA, 21 bp, Homo sapiens
tgtttaagatttaatttgcca

SEQ ID NO: 6551421 - DNA, 23 bp, Homo sapiens
tgtttaagatttaatttgccaaa

SEQ ID NO: 6551422 - DNA, 13 bp, Homo sapiens
tgtttaagcagaa

SEQ ID NO: 6551423 - DNA, 14 bp, Homo sapiens
tgtttaagctgagc

SEQ ID NO: 6551424 - DNA, 23 bp, Homo sapiens
tgtttaagtcattttttacttga

SEQ ID NO: 6551425 - DNA, 12 bp, Homo sapiens
tgtttaataaag

SEQ ID NO: 6551426 - DNA, 15 bp, Homo sapiens
tgtttaataaaggct

SEQ ID NO: 6551427 - DNA, 14 bp, Homo sapiens
tgtttaataatatg

SEQ ID NO: 6551428 - DNA, 19 bp, Homo sapiens
tgtttaataatatgtacaa

SEQ ID NO: 6551429 - DNA, 20 bp, Homo sapiens
tgtttaataatatgtacaaa

SEQ ID NO: 6551430 - DNA, 21 bp, Homo sapiens
tgtttaataatatgtacaaat

SEQ ID NO: 6551431 - DNA, 19 bp, Homo sapiens
tgtttaataccctgtacat

SEQ ID NO: 6551432 - DNA, 21 bp, Homo sapiens
tgtttaatcatagttactgtg

SEQ ID NO: 6551433 - DNA, 20 bp, Homo sapiens
tgtttaatcatataaataga

SEQ ID NO: 6551434 - DNA, 23 bp, Homo sapiens
tgtttaatcatataaatagaatg

SEQ ID NO: 6551435 - DNA, 15 bp, Homo sapiens
tgtttaatctacatt

SEQ ID NO: 6551436 - DNA, 13 bp, Homo sapiens
tgtttaatctttt

SEQ ID NO: 6551437 - DNA, 20 bp, Homo sapiens
tgtttaatgggtatgctcag

SEQ ID NO: 6551438 - DNA, 15 bp, Homo sapiens
tgtttaatggtagtt

SEQ ID NO: 6551439 - DNA, 14 bp, Homo sapiens
tgtttaatggtgaa

SEQ ID NO: 6551440 - DNA, 15 bp, Homo sapiens
tgtttaatgttaatt

SEQ ID NO: 6551441 - DNA, 19 bp, Homo sapiens
tgtttaatgttctgtgata

SEQ ID NO: 6551442 - DNA, 20 bp, Homo sapiens
tgtttaattcattaatctgt

SEQ ID NO: 6551443 - DNA, 23 bp, Homo sapiens
tgtttaattcattaatctgtttg

SEQ ID NO: 6551444 - DNA, 18 bp, Homo sapiens
tgtttaattcctggaaaa

SEQ ID NO: 6551445 - DNA, 15 bp, Homo sapiens
tgtttaattgtaggt

SEQ ID NO: 6551446 - DNA, 19 bp, Homo sapiens
tgtttaattgtataaaaca

SEQ ID NO: 6551447 - DNA, 17 bp, Homo sapiens
tgtttaatttcttcaaa

SEQ ID NO: 6551448 - DNA, 20 bp, Homo sapiens
tgtttaatttcttcaaaatg

SEQ ID NO: 6551449 - DNA, 21 bp, Homo sapiens
tgtttacaaaaatttctgtaa

SEQ ID NO: 6551450 - DNA, 23 bp, Homo sapiens
tgtttacaaacatggaaaacaga

SEQ ID NO: 6551451 - DNA, 16 bp, Homo sapiens
tgtttacaacacagta

SEQ ID NO: 6551452 - DNA, 18 bp, Homo sapiens
tgtttacaacacagtagt

SEQ ID NO: 6551453 - DNA, 16 bp, Homo sapiens
tgtttacaacatcacc

SEQ ID NO: 6551454 - DNA, 16 bp, Homo sapiens
tgtttacaataaagaa

SEQ ID NO: 6551455 - DNA, 13 bp, Homo sapiens
tgtttacacaatt

SEQ ID NO: 6551456 - DNA, 16 bp, Homo sapiens
tgtttacactctttgt

SEQ ID NO: 6551457 - DNA, 18 bp, Homo sapiens
tgtttacactctttgtaa

SEQ ID NO: 6551458 - DNA, 19 bp, Homo sapiens
tgtttacactctttgtaag

SEQ ID NO: 6551459 - DNA, 15 bp, Homo sapiens
tgtttacagacagaa

SEQ ID NO: 6551460 - DNA, 14 bp, Homo sapiens
tgtttacagaggac

SEQ ID NO: 6551461 - DNA, 20 bp, Homo sapiens
tgtttacagcactactctgt

SEQ ID NO: 6551462 - DNA, 21 bp, Homo sapiens
tgtttacagcactactctgtg

SEQ ID NO: 6551463 - DNA, 23 bp, Homo sapiens
tgtttacagcactactctgtgcc

SEQ ID NO: 6551464 - DNA, 23 bp, Homo sapiens
tgtttacaggatattccaaaata

SEQ ID NO: 6551465 - DNA, 21 bp, Homo sapiens
tgtttacagggagcctcctgc

SEQ ID NO: 6551466 - DNA, 18 bp, Homo sapiens
tgtttacaggtttgaatt

SEQ ID NO: 6551467 - DNA, 22 bp, Homo sapiens
tgtttacagtatgatgaaaata

SEQ ID NO: 6551468 - DNA, 12 bp, Homo sapiens
tgtttacagtga

SEQ ID NO: 6551469 - DNA, 15 bp, Homo sapiens
tgtttacagtgagga

SEQ ID NO: 6551470 - DNA, 23 bp, Homo sapiens
tgtttacagtgaggactcggcca

SEQ ID NO: 6551471 - DNA, 22 bp, Homo sapiens
tgtttacatcaaagcttcttca

SEQ ID NO: 6551472 - DNA, 14 bp, Homo sapiens
tgtttacatcagtt

SEQ ID NO: 6551473 - DNA, 21 bp, Homo sapiens
tgtttacatcagttttaacga

SEQ ID NO: 6551474 - DNA, 12 bp, Homo sapiens
tgtttacatgag

SEQ ID NO: 6551475 - DNA, 16 bp, Homo sapiens
tgtttacatgcttatt

SEQ ID NO: 6551476 - DNA, 22 bp, Homo sapiens
tgtttacatgcttattccatga

SEQ ID NO: 6551477 - DNA, 20 bp, Homo sapiens
tgtttacattttatggtgcc

SEQ ID NO: 6551478 - DNA, 21 bp, Homo sapiens
tgtttaccaaggaaagaacaa

SEQ ID NO: 6551479 - DNA, 22 bp, Homo sapiens
tgtttaccaaggaaagaacaaa

SEQ ID NO: 6551480 - DNA, 15 bp, Homo sapiens
tgtttaccctccctg

SEQ ID NO: 6551481 - DNA, 22 bp, Homo sapiens
tgtttaccctccctgtcccctg

SEQ ID NO: 6551482 - DNA, 17 bp, Homo sapiens
tgtttacctcactggtg

SEQ ID NO: 6551483 - DNA, 23 bp, Homo sapiens
tgtttacctcactggtgcattta

SEQ ID NO: 6551484 - DNA, 14 bp, Homo sapiens
tgtttacctggtgc

SEQ ID NO: 6551485 - DNA, 16 bp, Homo sapiens
tgtttacctttctctc

SEQ ID NO: 6551486 - DNA, 22 bp, Homo sapiens
tgtttactatatagaatttcct

SEQ ID NO: 6551487 - DNA, 16 bp, Homo sapiens
tgtttactcacattgt

SEQ ID NO: 6551488 - DNA, 16 bp, Homo sapiens
tgtttactctcttcat

SEQ ID NO: 6551489 - DNA, 19 bp, Homo sapiens
tgtttactgacatggtgct

SEQ ID NO: 6551490 - DNA, 12 bp, Homo sapiens
tgtttactgctt

SEQ ID NO: 6551491 - DNA, 19 bp, Homo sapiens
tgtttactgcttttcatta

SEQ ID NO: 6551492 - DNA, 12 bp, Homo sapiens
tgtttactgtaa

SEQ ID NO: 6551493 - DNA, 13 bp, Homo sapiens
tgtttactgtaaa

SEQ ID NO: 6551494 - DNA, 15 bp, Homo sapiens
tgtttactgtaaatt

SEQ ID NO: 6551495 - DNA, 14 bp, Homo sapiens
tgtttactgtatca

SEQ ID NO: 6551496 - DNA, 23 bp, Homo sapiens
tgtttacttaaagatttatcaaa

SEQ ID NO: 6551497 - DNA, 19 bp, Homo sapiens
tgtttacttgaatagtatt

SEQ ID NO: 6551498 - DNA, 15 bp, Homo sapiens
tgtttacttgtaaat

SEQ ID NO: 6551499 - DNA, 20 bp, Homo sapiens
tgtttactttttggctggag

SEQ ID NO: 6551500 - DNA, 22 bp, Homo sapiens
tgtttagaaaaaaaactgaaga

SEQ ID NO: 6551501 - DNA, 19 bp, Homo sapiens
tgtttagaactactgataa

SEQ ID NO: 6551502 - DNA, 13 bp, Homo sapiens
tgtttagaagcct

SEQ ID NO: 6551503 - DNA, 15 bp, Homo sapiens
tgtttagaattgaag

SEQ ID NO: 6551504 - DNA, 14 bp, Homo sapiens
tgtttagagagcct

SEQ ID NO: 6551505 - DNA, 20 bp, Homo sapiens
tgtttagagtaaataaactg

SEQ ID NO: 6551506 - DNA, 16 bp, Homo sapiens
tgtttagagttgcaat

SEQ ID NO: 6551507 - DNA, 17 bp, Homo sapiens
tgtttagagttgcaatc

SEQ ID NO: 6551508 - DNA, 21 bp, Homo sapiens
tgtttagatgaggctcagaga

SEQ ID NO: 6551509 - DNA, 11 bp, Homo sapiens
tgtttagatgt

SEQ ID NO: 6551510 - DNA, 23 bp, Homo sapiens
tgtttagattgtattaactatct

SEQ ID NO: 6551511 - DNA, 12 bp, Homo sapiens
tgtttagatttg

SEQ ID NO: 6551512 - DNA, 17 bp, Homo sapiens
tgtttagattttgtgtt

SEQ ID NO: 6551513 - DNA, 13 bp, Homo sapiens
tgtttagcagaac

SEQ ID NO: 6551514 - DNA, 22 bp, Homo sapiens
tgtttagcagcagcctttaatg

SEQ ID NO: 6551515 - DNA, 14 bp, Homo sapiens
tgtttagcattaaa

SEQ ID NO: 6551516 - DNA, 19 bp, Homo sapiens
tgtttagcattaaaaataa

SEQ ID NO: 6551517 - DNA, 15 bp, Homo sapiens
tgtttagctatttaa

SEQ ID NO: 6551518 - DNA, 16 bp, Homo sapiens
tgtttagctatttaat

SEQ ID NO: 6551519 - DNA, 21 bp, Homo sapiens
tgtttaggaaatttatacaaa

SEQ ID NO: 6551520 - DNA, 24 bp, Homo sapiens
tgtttaggaagaagtggtactagt

SEQ ID NO: 6551521 - DNA, 18 bp, Homo sapiens
tgtttaggcctcatttct

SEQ ID NO: 6551522 - DNA, 17 bp, Homo sapiens
tgtttaggggtgaagga

SEQ ID NO: 6551523 - DNA, 21 bp, Homo sapiens
tgtttagtaaatacatcactg

SEQ ID NO: 6551524 - DNA, 14 bp, Homo sapiens
tgtttagtaatcat

SEQ ID NO: 6551525 - DNA, 16 bp, Homo sapiens
tgtttagtagcagtga

SEQ ID NO: 6551526 - DNA, 23 bp, Homo sapiens
tgtttagtctcgctaaagttata

SEQ ID NO: 6551527 - DNA, 16 bp, Homo sapiens
tgtttagttcagcaaa

SEQ ID NO: 6551528 - DNA, 17 bp, Homo sapiens
tgtttagttgcaaggat

SEQ ID NO: 6551529 - DNA, 19 bp, Homo sapiens
tgtttagttttacatttta

SEQ ID NO: 6551530 - DNA, 12 bp, Homo sapiens
tgtttataaaaa

SEQ ID NO: 6551531 - DNA, 17 bp, Homo sapiens
tgtttataaatgttctg

SEQ ID NO: 6551532 - DNA, 21 bp, Homo sapiens
tgtttataaatgttctggtat

SEQ ID NO: 6551533 - DNA, 21 bp, Homo sapiens
tgtttataactctagggatat

SEQ ID NO: 6551534 - DNA, 18 bp, Homo sapiens
tgtttataagctgggcat

SEQ ID NO: 6551535 - DNA, 16 bp, Homo sapiens
tgtttataatgttatc

SEQ ID NO: 6551536 - DNA, 15 bp, Homo sapiens
tgtttataattgttt

SEQ ID NO: 6551537 - DNA, 18 bp, Homo sapiens
tgtttataattgtttata

SEQ ID NO: 6551538 - DNA, 15 bp, Homo sapiens
tgtttatacacacag

SEQ ID NO: 6551539 - DNA, 14 bp, Homo sapiens
tgtttatacagagt

SEQ ID NO: 6551540 - DNA, 22 bp, Homo sapiens
tgtttatactgtatttctaaga

SEQ ID NO: 6551541 - DNA, 15 bp, Homo sapiens
tgtttatacttgaga

SEQ ID NO: 6551542 - DNA, 22 bp, Homo sapiens
tgtttataggaaataaatctaa

SEQ ID NO: 6551543 - DNA, 15 bp, Homo sapiens
tgtttatataatttt

SEQ ID NO: 6551544 - DNA, 16 bp, Homo sapiens
tgtttatatcactgtc

SEQ ID NO: 6551545 - DNA, 17 bp, Homo sapiens
tgtttatatcactgtct

SEQ ID NO: 6551546 - DNA, 22 bp, Homo sapiens
tgtttatatctgcaaaaaacct

SEQ ID NO: 6551547 - DNA, 14 bp, Homo sapiens
tgtttatatgccca

SEQ ID NO: 6551548 - DNA, 10 bp, Homo sapiens
tgtttatatt

SEQ ID NO: 6551549 - DNA, 22 bp, Homo sapiens
tgtttatattgtttttatatat

SEQ ID NO: 6551550 - DNA, 18 bp, Homo sapiens
tgtttatatttaattttt

SEQ ID NO: 6551551 - DNA, 16 bp, Homo sapiens
tgtttatcaaagagca

SEQ ID NO: 6551552 - DNA, 18 bp, Homo sapiens
tgtttatcagatacatca

SEQ ID NO: 6551553 - DNA, 19 bp, Homo sapiens
tgtttatcagatacatcac

SEQ ID NO: 6551554 - DNA, 20 bp, Homo sapiens
tgtttatcccttaagaatga

SEQ ID NO: 6551555 - DNA, 15 bp, Homo sapiens
tgtttatcctttcat

SEQ ID NO: 6551556 - DNA, 17 bp, Homo sapiens
tgtttatcctttcatat

SEQ ID NO: 6551557 - DNA, 21 bp, Homo sapiens
tgtttatcctttcatatagtt

SEQ ID NO: 6551558 - DNA, 21 bp, Homo sapiens
tgtttatgaaaataaatagct

SEQ ID NO: 6551559 - DNA, 21 bp, Homo sapiens
tgtttatgaagaaagatacta

SEQ ID NO: 6551560 - DNA, 18 bp, Homo sapiens
tgtttatgaattataaat

SEQ ID NO: 6551561 - DNA, 16 bp, Homo sapiens
tgtttatgagccagac

SEQ ID NO: 6551562 - DNA, 21 bp, Homo sapiens
tgtttatgagccagacaaatg

SEQ ID NO: 6551563 - DNA, 19 bp, Homo sapiens
tgtttatgatatttcttgc

SEQ ID NO: 6551564 - DNA, 12 bp, Homo sapiens
tgtttatgcatt

SEQ ID NO: 6551565 - DNA, 13 bp, Homo sapiens
tgtttatgcattt

SEQ ID NO: 6551566 - DNA, 17 bp, Homo sapiens
tgtttatgcatttcaat

SEQ ID NO: 6551567 - DNA, 17 bp, Homo sapiens
tgtttatgccaaatgtt

SEQ ID NO: 6551568 - DNA, 21 bp, Homo sapiens
tgtttatgccaaatgttaact

SEQ ID NO: 6551569 - DNA, 23 bp, Homo sapiens
tgtttatggaaataccaggacca

SEQ ID NO: 6551570 - DNA, 18 bp, Homo sapiens
tgtttatggaaatattaa

SEQ ID NO: 6551571 - DNA, 17 bp, Homo sapiens
tgtttatggcatttagt

SEQ ID NO: 6551572 - DNA, 13 bp, Homo sapiens
tgtttatggcctc

SEQ ID NO: 6551573 - DNA, 24 bp, Homo sapiens
tgtttatggcctcagctgcctcac

SEQ ID NO: 6551574 - DNA, 21 bp, Homo sapiens
ttgtatctgcaggcagacacg

SEQ ID NO: 6551575 - DNA, 15 bp, Homo sapiens
ttgtatctgtctttc

SEQ ID NO: 6551576 - DNA, 14 bp, Homo sapiens
ttgtatcttaaatt

SEQ ID NO: 6551577 - DNA, 23 bp, Homo sapiens
ttgtatcttcctttcttgtcttt

SEQ ID NO: 6551578 - DNA, 20 bp, Homo sapiens
ttgtatctttatgctgtatt

SEQ ID NO: 6551579 - DNA, 14 bp, Homo sapiens
ttgtatcttttatc

SEQ ID NO: 6551580 - DNA, 12 bp, Homo sapiens
ttgtatgaaaac

SEQ ID NO: 6551581 - DNA, 16 bp, Homo sapiens
ttgtatgaaactaaag

SEQ ID NO: 6551582 - DNA, 22 bp, Homo sapiens
ttgtatgaaagatggctgtgcc

SEQ ID NO: 6551583 - DNA, 22 bp, Homo sapiens
ttgtatgaaatatatgtgaaag

SEQ ID NO: 6551584 - DNA, 17 bp, Homo sapiens
ttgtatgaactctttaa

SEQ ID NO: 6551585 - DNA, 18 bp, Homo sapiens
ttgtatgaagtactttta

SEQ ID NO: 6551586 - DNA, 19 bp, Homo sapiens
ttgtatgaataaaaggctg

SEQ ID NO: 6551587 - DNA, 23 bp, Homo sapiens
ttgtatgagatggttaaaaaggc

SEQ ID NO: 6551588 - DNA, 23 bp, Homo sapiens
ttgtatgaggtcctcaggtcagc

SEQ ID NO: 6551589 - DNA, 19 bp, Homo sapiens
ttgtatgatctgtgccttt

SEQ ID NO: 6551590 - DNA, 13 bp, Homo sapiens
ttgtatgatgtat

SEQ ID NO: 6551591 - DNA, 13 bp, Homo sapiens
ttgtatgatgtgt

SEQ ID NO: 6551592 - DNA, 21 bp, Homo sapiens
ttgtatgattccaatctctgt

SEQ ID NO: 6551593 - DNA, 19 bp, Homo sapiens
ttgtatgcaagcagtttca

SEQ ID NO: 6551594 - DNA, 21 bp, Homo sapiens
ttgtatgcctttaaatctgtg

SEQ ID NO: 6551595 - DNA, 22 bp, Homo sapiens
ttgtatgcctttaaatctgtga

SEQ ID NO: 6551596 - DNA, 23 bp, Homo sapiens
ttgtatgcctttaaatctgtgat

SEQ ID NO: 6551597 - DNA, 15 bp, Homo sapiens
ttgtatgctgaattt

SEQ ID NO: 6551598 - DNA, 22 bp, Homo sapiens
ttgtatggctctcaagtgaaag

SEQ ID NO: 6551599 - DNA, 12 bp, Homo sapiens
ttgtatgtaagt

SEQ ID NO: 6551600 - DNA, 13 bp, Homo sapiens
ttgtatgtactgt

SEQ ID NO: 6551601 - DNA, 14 bp, Homo sapiens
ttgtatgtatgtgt

SEQ ID NO: 6551602 - DNA, 15 bp, Homo sapiens
ttgtatgtatgtgta

SEQ ID NO: 6551603 - DNA, 14 bp, Homo sapiens
ttgtatgtattaaa

SEQ ID NO: 6551604 - DNA, 15 bp, Homo sapiens
ttgtatgtattaaac

SEQ ID NO: 6551605 - DNA, 13 bp, Homo sapiens
ttgtatgtctgtg

SEQ ID NO: 6551606 - DNA, 15 bp, Homo sapiens
ttgtatgtctgtgta

SEQ ID NO: 6551607 - DNA, 12 bp, Homo sapiens
ttgtatgtgaac

SEQ ID NO: 6551608 - DNA, 13 bp, Homo sapiens
ttgtatgtgaaca

SEQ ID NO: 6551609 - DNA, 21 bp, Homo sapiens
ttgtatgtggaagtatacctg

SEQ ID NO: 6551610 - DNA, 17 bp, Homo sapiens
ttgtatgtgtgtagaca

SEQ ID NO: 6551611 - DNA, 12 bp, Homo sapiens
ttgtatgttaaa

SEQ ID NO: 6551612 - DNA, 16 bp, Homo sapiens
ttgtatgttgaggatc

SEQ ID NO: 6551613 - DNA, 17 bp, Homo sapiens
ttgtatgttgaggatct

SEQ ID NO: 6551614 - DNA, 20 bp, Homo sapiens
ttgtatgtttttctgtataa

SEQ ID NO: 6551615 - DNA, 15 bp, Homo sapiens
ttgtattaaactctt

SEQ ID NO: 6551616 - DNA, 14 bp, Homo sapiens
ttgtattaactggg

SEQ ID NO: 6551617 - DNA, 14 bp, Homo sapiens
ttgtattaataaag

SEQ ID NO: 6551618 - DNA, 18 bp, Homo sapiens
ttgtattaataaagcatt

SEQ ID NO: 6551619 - DNA, 19 bp, Homo sapiens
ttgtattaataaagcattc

SEQ ID NO: 6551620 - DNA, 21 bp, Homo sapiens
ttgtattaataaagcattctt

SEQ ID NO: 6551621 - DNA, 16 bp, Homo sapiens
ttgtattaatttctga

SEQ ID NO: 6551622 - DNA, 15 bp, Homo sapiens
ttgtattaccaaagc

SEQ ID NO: 6551623 - DNA, 17 bp, Homo sapiens
ttgtattagatgttctc

SEQ ID NO: 6551624 - DNA, 20 bp, Homo sapiens
ttgtattatagtactgcttt

SEQ ID NO: 6551625 - DNA, 18 bp, Homo sapiens
ttgtattatcatatatgc

SEQ ID NO: 6551626 - DNA, 21 bp, Homo sapiens
ttgtattatcatatatgcttt

SEQ ID NO: 6551627 - DNA, 17 bp, Homo sapiens
ttgtattattacaaata

SEQ ID NO: 6551628 - DNA, 21 bp, Homo sapiens
ttgtattattacaaatattgt

SEQ ID NO: 6551629 - DNA, 17 bp, Homo sapiens
ttgtattatttttgtag

SEQ ID NO: 6551630 - DNA, 14 bp, Homo sapiens
ttgtattcagagtt

SEQ ID NO: 6551631 - DNA, 12 bp, Homo sapiens
ttgtattcatgt

SEQ ID NO: 6551632 - DNA, 15 bp, Homo sapiens
ttgtattctctgagc

SEQ ID NO: 6551633 - DNA, 20 bp, Homo sapiens
ttgtattctctgagctgtgc

SEQ ID NO: 6551634 - DNA, 22 bp, Homo sapiens
ttgtattctctgcaattttact

SEQ ID NO: 6551635 - DNA, 22 bp, Homo sapiens
ttgtattcttcatgaaatgtgt

SEQ ID NO: 6551636 - DNA, 17 bp, Homo sapiens
ttgtattctttgatgtt

SEQ ID NO: 6551637 - DNA, 22 bp, Homo sapiens
ttgtattcttttccaagctcct

SEQ ID NO: 6551638 - DNA, 17 bp, Homo sapiens
ttgtattgaaaacactt

SEQ ID NO: 6551639 - DNA, 13 bp, Homo sapiens
ttgtattgacttt

SEQ ID NO: 6551640 - DNA, 20 bp, Homo sapiens
ttgtattgagggccagtgat

SEQ ID NO: 6551641 - DNA, 15 bp, Homo sapiens
ttgtattgctgtcct

SEQ ID NO: 6551642 - DNA, 12 bp, Homo sapiens
ttgtattgcttc

SEQ ID NO: 6551643 - DNA, 13 bp, Homo sapiens
ttgtattgtaaaa

SEQ ID NO: 6551644 - DNA, 19 bp, Homo sapiens
ttgtattgtatattacaat

SEQ ID NO: 6551645 - DNA, 15 bp, Homo sapiens
ttgtattgtttcaat

SEQ ID NO: 6551646 - DNA, 16 bp, Homo sapiens
ttgtatttaaaaacat

SEQ ID NO: 6551647 - DNA, 22 bp, Homo sapiens
ttgtatttaaaacatttcatgt

SEQ ID NO: 6551648 - DNA, 23 bp, Homo sapiens
ttgtatttaaaacatttcatgta

SEQ ID NO: 6551649 - DNA, 13 bp, Homo sapiens
ttgtatttaacag

SEQ ID NO: 6551650 - DNA, 18 bp, Homo sapiens
ttgtatttaacagaaatt

SEQ ID NO: 6551651 - DNA, 22 bp, Homo sapiens
ttgtatttaacagaaattgtat

SEQ ID NO: 6551652 - DNA, 14 bp, Homo sapiens
ttgtatttaagaca

SEQ ID NO: 6551653 - DNA, 15 bp, Homo sapiens
ttgtatttaagacat

SEQ ID NO: 6551654 - DNA, 21 bp, Homo sapiens
ttgtatttaagacataaacaa

SEQ ID NO: 6551655 - DNA, 15 bp, Homo sapiens
ttgtatttaattctt

SEQ ID NO: 6551656 - DNA, 18 bp, Homo sapiens
ttgtatttagtagttatt

SEQ ID NO: 6551657 - DNA, 16 bp, Homo sapiens
ttgtatttattcaata

SEQ ID NO: 6551658 - DNA, 20 bp, Homo sapiens
ttgtatttattcaataaagt

SEQ ID NO: 6551659 - DNA, 17 bp, Homo sapiens
ttgtatttatttccaga

SEQ ID NO: 6551660 - DNA, 14 bp, Homo sapiens
ttgtatttcaaata

SEQ ID NO: 6551661 - DNA, 10 bp, Homo sapiens
ttgtatttct

SEQ ID NO: 6551662 - DNA, 12 bp, Homo sapiens
ttgtatttcttt

SEQ ID NO: 6551663 - DNA, 20 bp, Homo sapiens
ttgtatttggaatatttgaa

SEQ ID NO: 6551664 - DNA, 22 bp, Homo sapiens
ttgtatttggaatatttgaata

SEQ ID NO: 6551665 - DNA, 18 bp, Homo sapiens
ttgtattttaaaacataa

SEQ ID NO: 6551666 - DNA, 21 bp, Homo sapiens
ttgtattttaaatgttttaca

SEQ ID NO: 6551667 - DNA, 14 bp, Homo sapiens
ttgtattttaactc

SEQ ID NO: 6551668 - DNA, 17 bp, Homo sapiens
ttgtattttaataaaga

SEQ ID NO: 6551669 - DNA, 20 bp, Homo sapiens
ttgtattttatttttttctc

SEQ ID NO: 6551670 - DNA, 18 bp, Homo sapiens
ttgtattttcatgaaaat

SEQ ID NO: 6551671 - DNA, 18 bp, Homo sapiens
ttgtattttcttaatata

SEQ ID NO: 6551672 - DNA, 18 bp, Homo sapiens
ttgtattttcttcccatt

SEQ ID NO: 6551673 - DNA, 20 bp, Homo sapiens
ttgtattttgacaaaaatgt

SEQ ID NO: 6551674 - DNA, 14 bp, Homo sapiens
ttgtatttttaatg

SEQ ID NO: 6551675 - DNA, 15 bp, Homo sapiens
ttgtatttttaatgg

SEQ ID NO: 6551676 - DNA, 20 bp, Homo sapiens
ttgtatttttagtagagaca

SEQ ID NO: 6551677 - DNA, 15 bp, Homo sapiens
ttgtatttttccaga

SEQ ID NO: 6551678 - DNA, 20 bp, Homo sapiens
ttgtattttttaaaacacta

SEQ ID NO: 6551679 - DNA, 20 bp, Homo sapiens
ttgtattttttcctgtaaga

SEQ ID NO: 6551680 - DNA, 22 bp, Homo sapiens
ttgtattttttgttgaaagtaa

SEQ ID NO: 6551681 - DNA, 15 bp, Homo sapiens
ttgtatttttttcca

SEQ ID NO: 6551682 - DNA, 15 bp, Homo sapiens
ttgtcaaaaaccaga

SEQ ID NO: 6551683 - DNA, 22 bp, Homo sapiens
ttgtcaaaataaagattctcac

SEQ ID NO: 6551684 - DNA, 14 bp, Homo sapiens
ttgtcaaaattaat

SEQ ID NO: 6551685 - DNA, 19 bp, Homo sapiens
ttgtcaaaattaatatgat

SEQ ID NO: 6551686 - DNA, 13 bp, Homo sapiens
ttgtcaaagagag

SEQ ID NO: 6551687 - DNA, 22 bp, Homo sapiens
ttgtcaaagtggtgagaggcat

SEQ ID NO: 6551688 - DNA, 22 bp, Homo sapiens
ttgtcaaatagcaaggccaggg

SEQ ID NO: 6551689 - DNA, 23 bp, Homo sapiens
ttgtcaaatgcccactctccatc

SEQ ID NO: 6551690 - DNA, 15 bp, Homo sapiens
ttgtcaacaaaaaga

SEQ ID NO: 6551691 - DNA, 20 bp, Homo sapiens
ttgtcaacacaaagacacag

SEQ ID NO: 6551692 - DNA, 20 bp, Homo sapiens
ttgtcaacactatataaata

SEQ ID NO: 6551693 - DNA, 21 bp, Homo sapiens
ttgtcaacactatataaataa

SEQ ID NO: 6551694 - DNA, 14 bp, Homo sapiens
ttgtcaacattgtg

SEQ ID NO: 6551695 - DNA, 16 bp, Homo sapiens
ttgtcaaccagtgcaa

SEQ ID NO: 6551696 - DNA, 22 bp, Homo sapiens
ttgtcaagaggataaattttag

SEQ ID NO: 6551697 - DNA, 20 bp, Homo sapiens
ttgtcaagtctctgctggcc

SEQ ID NO: 6551698 - DNA, 20 bp, Homo sapiens
ttgtcaataaaatccataca

SEQ ID NO: 6551699 - DNA, 22 bp, Homo sapiens
ttgtcaataaggagcatcagcc

SEQ ID NO: 6551700 - DNA, 19 bp, Homo sapiens
ttgtcaatagtattaacta

SEQ ID NO: 6551701 - DNA, 17 bp, Homo sapiens
ttgtcaatggaagaaac

SEQ ID NO: 6551702 - DNA, 19 bp, Homo sapiens
ttgtcaatttatgaatata

SEQ ID NO: 6551703 - DNA, 22 bp, Homo sapiens
ttgtcacaacaattaaatatac

SEQ ID NO: 6551704 - DNA, 18 bp, Homo sapiens
ttgtcacacactttggct

SEQ ID NO: 6551705 - DNA, 22 bp, Homo sapiens
ttgtcacagtcttgtgaacttt

SEQ ID NO: 6551706 - DNA, 16 bp, Homo sapiens
ttgtcacatcagataa

SEQ ID NO: 6551707 - DNA, 14 bp, Homo sapiens
ttgtcaccagatct

SEQ ID NO: 6551708 - DNA, 19 bp, Homo sapiens
ttgtcaccaggcaaccagg

SEQ ID NO: 6551709 - DNA, 16 bp, Homo sapiens
ttgtcacctctgttaa

SEQ ID NO: 6551710 - DNA, 13 bp, Homo sapiens
ttgtcacgccaga

SEQ ID NO: 6551711 - DNA, 16 bp, Homo sapiens
ttgtcactacaaaaat

SEQ ID NO: 6551712 - DNA, 20 bp, Homo sapiens
ttgtcactagcagctgcagt

SEQ ID NO: 6551713 - DNA, 19 bp, Homo sapiens
ttgtcactccaaaccttac

SEQ ID NO: 6551714 - DNA, 16 bp, Homo sapiens
ttgtcactgacacaaa

SEQ ID NO: 6551715 - DNA, 21 bp, Homo sapiens
ttgtcactggaacctccctgg

SEQ ID NO: 6551716 - DNA, 23 bp, Homo sapiens
ttgtcactgtcttcacaacctcc

SEQ ID NO: 6551717 - DNA, 13 bp, Homo sapiens
ttgtcacttctgc

SEQ ID NO: 6551718 - DNA, 17 bp, Homo sapiens
ttgtcacttgccacatg

SEQ ID NO: 6551719 - DNA, 20 bp, Homo sapiens
ttgtcacttgccacatggtg

SEQ ID NO: 6551720 - DNA, 16 bp, Homo sapiens
ttgtcacttttccttt

SEQ ID NO: 6551721 - DNA, 14 bp, Homo sapiens
ttgtcactttttat

SEQ ID NO: 6551722 - DNA, 14 bp, Homo sapiens
ttgtcactttttct

SEQ ID NO: 6551723 - DNA, 23 bp, Homo sapiens
ttgtcagaatggaatccatctgt

SEQ ID NO: 6551724 - DNA, 12 bp, Homo sapiens
ttgtcagaatgt

SEQ ID NO: 6551725 - DNA, 15 bp, Homo sapiens
ttgtcagaatgttgt

SEQ ID NO: 6551726 - DNA, 13 bp, Homo sapiens
ttgtcagacataa

SEQ ID NO: 6551727 - DNA, 12 bp, Homo sapiens
ttgtcagacttt

SEQ ID NO: 6551728 - DNA, 20 bp, Homo sapiens
ttgtcagactttaaagaata

SEQ ID NO: 6551729 - DNA, 18 bp, Homo sapiens
ttgtcagcaagaggagga

SEQ ID NO: 6551730 - DNA, 12 bp, Homo sapiens
ttgtcagcaggc

SEQ ID NO: 6551731 - DNA, 15 bp, Homo sapiens
ttgtcagcatctgac

SEQ ID NO: 6551732 - DNA, 17 bp, Homo sapiens
ttgtcagcatctgacca

SEQ ID NO: 6551733 - DNA, 20 bp, Homo sapiens
ttgtcagcatctgaccatct

SEQ ID NO: 6551734 - DNA, 21 bp, Homo sapiens
ttgtcagccatcgtcctggga

SEQ ID NO: 6551735 - DNA, 16 bp, Homo sapiens
ttgtcagcctgtgctg

SEQ ID NO: 6551736 - DNA, 17 bp, Homo sapiens
ttgtcagcctgtgctgt

SEQ ID NO: 6551737 - DNA, 12 bp, Homo sapiens
ttgtcagctact

SEQ ID NO: 6551738 - DNA, 23 bp, Homo sapiens
ttgtcagctttggattgctgggg

SEQ ID NO: 6551739 - DNA, 16 bp, Homo sapiens
ttgtcaggtgggagat

SEQ ID NO: 6551740 - DNA, 16 bp, Homo sapiens
ttgtcagtatggcttt

SEQ ID NO: 6551741 - DNA, 15 bp, Homo sapiens
ttgtcagtgtagaca

SEQ ID NO: 6551742 - DNA, 21 bp, Homo sapiens
ttgtcagtgtagacacaggtc

SEQ ID NO: 6551743 - DNA, 17 bp, Homo sapiens
ttgtcagttttgttcac

SEQ ID NO: 6551744 - DNA, 21 bp, Homo sapiens
ttgtcataaaatgctatttta

SEQ ID NO: 6551745 - DNA, 22 bp, Homo sapiens
ttgtcataaaatgctattttaa

SEQ ID NO: 6551746 - DNA, 12 bp, Homo sapiens
ttgtcataacat

SEQ ID NO: 6551747 - DNA, 19 bp, Homo sapiens
ttgtcataacatttaaaga

SEQ ID NO: 6551748 - DNA, 23 bp, Homo sapiens
ttgtcataacatttaaagagatt

SEQ ID NO: 6551749 - DNA, 23 bp, Homo sapiens
ttgtcatataaacctgatgttga

SEQ ID NO: 6551750 - DNA, 17 bp, Homo sapiens
ttgtcatatattcatgt

SEQ ID NO: 6551751 - DNA, 21 bp, Homo sapiens
ttgtcatatattcatgtaata

SEQ ID NO: 6551752 - DNA, 15 bp, Homo sapiens
tgtttatgtaatttc

SEQ ID NO: 6551753 - DNA, 16 bp, Homo sapiens
tgtttatgtaatttca

SEQ ID NO: 6551754 - DNA, 17 bp, Homo sapiens
tgtttatgtaatttcag

SEQ ID NO: 6551755 - DNA, 17 bp, Homo sapiens
tgtttatgtactgtaaa

SEQ ID NO: 6551756 - DNA, 22 bp, Homo sapiens
tgtttatgtactgtaaacagtt

SEQ ID NO: 6551757 - DNA, 18 bp, Homo sapiens
tgtttatgtgttatgaac

SEQ ID NO: 6551758 - DNA, 22 bp, Homo sapiens
tgtttatgttgtttataataaa

SEQ ID NO: 6551759 - DNA, 19 bp, Homo sapiens
tgtttattaaaattctgaa

SEQ ID NO: 6551760 - DNA, 16 bp, Homo sapiens
tgtttattaaatgctt

SEQ ID NO: 6551761 - DNA, 13 bp, Homo sapiens
tgtttattaacaa

SEQ ID NO: 6551762 - DNA, 18 bp, Homo sapiens
tgtttattaactactgaa

SEQ ID NO: 6551763 - DNA, 22 bp, Homo sapiens
tgtttattacaatttttaataa

SEQ ID NO: 6551764 - DNA, 18 bp, Homo sapiens
tgtttattacagtataat

SEQ ID NO: 6551765 - DNA, 18 bp, Homo sapiens
tgtttattacttccatga

SEQ ID NO: 6551766 - DNA, 21 bp, Homo sapiens
tgtttattacttccatgaatt

SEQ ID NO: 6551767 - DNA, 18 bp, Homo sapiens
tgtttattcaaactgaaa

SEQ ID NO: 6551768 - DNA, 18 bp, Homo sapiens
tgtttattccaaagagtg

SEQ ID NO: 6551769 - DNA, 17 bp, Homo sapiens
tgtttattccttctgta

SEQ ID NO: 6551770 - DNA, 16 bp, Homo sapiens
tgtttattcttccaga

SEQ ID NO: 6551771 - DNA, 14 bp, Homo sapiens
tgtttattcttgat

SEQ ID NO: 6551772 - DNA, 21 bp, Homo sapiens
tgtttattgaagaactggcat

SEQ ID NO: 6551773 - DNA, 20 bp, Homo sapiens
tgtttattgaattcatttca

SEQ ID NO: 6551774 - DNA, 23 bp, Homo sapiens
tgtttattgaattcatttcactg

SEQ ID NO: 6551775 - DNA, 12 bp, Homo sapiens
tgtttattgcaa

SEQ ID NO: 6551776 - DNA, 23 bp, Homo sapiens
tgtttattgccattatagcgcct

SEQ ID NO: 6551777 - DNA, 14 bp, Homo sapiens
tgtttattgtcaaa

SEQ ID NO: 6551778 - DNA, 17 bp, Homo sapiens
tgtttattgtcaaagtg

SEQ ID NO: 6551779 - DNA, 16 bp, Homo sapiens
tgtttatttaaggatg

SEQ ID NO: 6551780 - DNA, 20 bp, Homo sapiens
tgtttatttaaggatggatg

SEQ ID NO: 6551781 - DNA, 22 bp, Homo sapiens
tgtttatttaaggatggatggc

SEQ ID NO: 6551782 - DNA, 13 bp, Homo sapiens
tgtttatttagaa

SEQ ID NO: 6551783 - DNA, 22 bp, Homo sapiens
tgtttattttctacgtttcttt

SEQ ID NO: 6551784 - DNA, 17 bp, Homo sapiens
tgtttatttttaaattt

SEQ ID NO: 6551785 - DNA, 20 bp, Homo sapiens
tgtttatttttaaattttct

SEQ ID NO: 6551786 - DNA, 14 bp, Homo sapiens
tgtttatttttata

SEQ ID NO: 6551787 - DNA, 19 bp, Homo sapiens
tgtttatttttcatattgt

SEQ ID NO: 6551788 - DNA, 19 bp, Homo sapiens
tgtttcaaaaaattatatg

SEQ ID NO: 6551789 - DNA, 20 bp, Homo sapiens
tgtttcaaaatagacaagtt

SEQ ID NO: 6551790 - DNA, 19 bp, Homo sapiens
tgtttcaaacacaaatgca

SEQ ID NO: 6551791 - DNA, 21 bp, Homo sapiens
tgtttcaaacatatataacaa

SEQ ID NO: 6551792 - DNA, 18 bp, Homo sapiens
tgtttcaaactgtaaaaa

SEQ ID NO: 6551793 - DNA, 13 bp, Homo sapiens
tgtttcaaagcac

SEQ ID NO: 6551794 - DNA, 12 bp, Homo sapiens
tgtttcaaatgg

SEQ ID NO: 6551795 - DNA, 13 bp, Homo sapiens
tgtttcaaatgga

SEQ ID NO: 6551796 - DNA, 15 bp, Homo sapiens
tgtttcaacagaggg

SEQ ID NO: 6551797 - DNA, 15 bp, Homo sapiens
tgtttcaactttctt

SEQ ID NO: 6551798 - DNA, 20 bp, Homo sapiens
tgtttcaactttcttatctg

SEQ ID NO: 6551799 - DNA, 10 bp, Homo sapiens
tgtttcaaga

SEQ ID NO: 6551800 - DNA, 19 bp, Homo sapiens
tgtttcaaggcactctaga

SEQ ID NO: 6551801 - DNA, 17 bp, Homo sapiens
tgtttcaagtggggctc

SEQ ID NO: 6551802 - DNA, 21 bp, Homo sapiens
tgtttcaagtggggctcgcca

SEQ ID NO: 6551803 - DNA, 15 bp, Homo sapiens
tgtttcaatcactgt

SEQ ID NO: 6551804 - DNA, 15 bp, Homo sapiens
tgtttcaattctgta

SEQ ID NO: 6551805 - DNA, 19 bp, Homo sapiens
tgtttcaattctgtaatta

SEQ ID NO: 6551806 - DNA, 22 bp, Homo sapiens
tgtttcaattctgtaattacat

SEQ ID NO: 6551807 - DNA, 23 bp, Homo sapiens
tgtttcaattctgtaattacata

SEQ ID NO: 6551808 - DNA, 16 bp, Homo sapiens
tgtttcacaaggtctt

SEQ ID NO: 6551809 - DNA, 23 bp, Homo sapiens
tgtttcacaccggaaggttttta

SEQ ID NO: 6551810 - DNA, 21 bp, Homo sapiens
tgtttcacagagtgtgctgct

SEQ ID NO: 6551811 - DNA, 22 bp, Homo sapiens
tgtttcacagagtgtgctgcta

SEQ ID NO: 6551812 - DNA, 15 bp, Homo sapiens
tgtttcaccagtttc

SEQ ID NO: 6551813 - DNA, 17 bp, Homo sapiens
tgtttcaccctgtccct

SEQ ID NO: 6551814 - DNA, 18 bp, Homo sapiens
tgtttcacgaagtttgtt

SEQ ID NO: 6551815 - DNA, 17 bp, Homo sapiens
tgtttcactactcagca

SEQ ID NO: 6551816 - DNA, 14 bp, Homo sapiens
tgtttcactccacc

SEQ ID NO: 6551817 - DNA, 22 bp, Homo sapiens
tgtttcactgaaatgtttggat

SEQ ID NO: 6551818 - DNA, 19 bp, Homo sapiens
tgtttcactggaaaggaaa

SEQ ID NO: 6551819 - DNA, 19 bp, Homo sapiens
tgtttcagaaaacataata

SEQ ID NO: 6551820 - DNA, 15 bp, Homo sapiens
tgtttcagacccccc

SEQ ID NO: 6551821 - DNA, 21 bp, Homo sapiens
tgtttcagagcataaaaccta

SEQ ID NO: 6551822 - DNA, 18 bp, Homo sapiens
tgtttcagataaatttca

SEQ ID NO: 6551823 - DNA, 21 bp, Homo sapiens
tgtttcagctaagggaagaca

SEQ ID NO: 6551824 - DNA, 24 bp, Homo sapiens
tgtttcagctaagggaagacattt

SEQ ID NO: 6551825 - DNA, 17 bp, Homo sapiens
tgtttcagctgcagttg

SEQ ID NO: 6551826 - DNA, 10 bp, Homo sapiens
tgtttcagtg

SEQ ID NO: 6551827 - DNA, 22 bp, Homo sapiens
tgtttcagtgaagatgctgtaa

SEQ ID NO: 6551828 - DNA, 20 bp, Homo sapiens
tgtttcagtgccatttgtta

SEQ ID NO: 6551829 - DNA, 23 bp, Homo sapiens
tgtttcataatgcagaagtattc

SEQ ID NO: 6551830 - DNA, 22 bp, Homo sapiens
tgtttcatacagctattaaaat

SEQ ID NO: 6551831 - DNA, 13 bp, Homo sapiens
tgtttcatcaatg

SEQ ID NO: 6551832 - DNA, 18 bp, Homo sapiens
tgtttcatccttcccact

SEQ ID NO: 6551833 - DNA, 14 bp, Homo sapiens
tgtttcatctaagt

SEQ ID NO: 6551834 - DNA, 14 bp, Homo sapiens
tgtttcatctggtt

SEQ ID NO: 6551835 - DNA, 19 bp, Homo sapiens
tgtttcatgaagaaaaaat

SEQ ID NO: 6551836 - DNA, 14 bp, Homo sapiens
tgtttcatgttctg

SEQ ID NO: 6551837 - DNA, 16 bp, Homo sapiens
tgtttcatgttctgtg

SEQ ID NO: 6551838 - DNA, 19 bp, Homo sapiens
tgtttcatgttctgtgtca

SEQ ID NO: 6551839 - DNA, 21 bp, Homo sapiens
tgtttcatgttttgtgactat

SEQ ID NO: 6551840 - DNA, 22 bp, Homo sapiens
tgtttcatgttttgtgactata

SEQ ID NO: 6551841 - DNA, 16 bp, Homo sapiens
tgtttcattaactgtg

SEQ ID NO: 6551842 - DNA, 12 bp, Homo sapiens
tgtttcattatg

SEQ ID NO: 6551843 - DNA, 14 bp, Homo sapiens
tgtttcatttgtgt

SEQ ID NO: 6551844 - DNA, 16 bp, Homo sapiens
tgtttcatttgtgtca

SEQ ID NO: 6551845 - DNA, 15 bp, Homo sapiens
tgtttcattttactg

SEQ ID NO: 6551846 - DNA, 21 bp, Homo sapiens
tgtttccaaatccctttcatg

SEQ ID NO: 6551847 - DNA, 16 bp, Homo sapiens
tgtttccaacttgtct

SEQ ID NO: 6551848 - DNA, 22 bp, Homo sapiens
tgtttccaatgtttagcaaata

SEQ ID NO: 6551849 - DNA, 11 bp, Homo sapiens
tgtttccagaa

SEQ ID NO: 6551850 - DNA, 15 bp, Homo sapiens
tgtttccagaaaata

SEQ ID NO: 6551851 - DNA, 17 bp, Homo sapiens
tgtttccagaaaatata

SEQ ID NO: 6551852 - DNA, 20 bp, Homo sapiens
tgtttccagaaaatataaat

SEQ ID NO: 6551853 - DNA, 23 bp, Homo sapiens
tgtttccagaaaatataaatgca

SEQ ID NO: 6551854 - DNA, 21 bp, Homo sapiens
tgtttccagcagaagacaaaa

SEQ ID NO: 6551855 - DNA, 15 bp, Homo sapiens
tgtttccagcattcc

SEQ ID NO: 6551856 - DNA, 20 bp, Homo sapiens
tgtttccagcattcccaggt

SEQ ID NO: 6551857 - DNA, 19 bp, Homo sapiens
tgtttccagctgccaagtg

SEQ ID NO: 6551858 - DNA, 12 bp, Homo sapiens
tgtttccaggca

SEQ ID NO: 6551859 - DNA, 23 bp, Homo sapiens
tgtttccaggcatgaccctggag

SEQ ID NO: 6551860 - DNA, 14 bp, Homo sapiens
tgtttccagggtct

SEQ ID NO: 6551861 - DNA, 19 bp, Homo sapiens
tgtttccatattttatagg

SEQ ID NO: 6551862 - DNA, 13 bp, Homo sapiens
tgtttccatggtt

SEQ ID NO: 6551863 - DNA, 16 bp, Homo sapiens
tgtttccatgttatgt

SEQ ID NO: 6551864 - DNA, 20 bp, Homo sapiens
tgtttccatgttatgtttct

SEQ ID NO: 6551865 - DNA, 21 bp, Homo sapiens
tgtttccccatctctgtctgg

SEQ ID NO: 6551866 - DNA, 15 bp, Homo sapiens
tgtttcccccactcc

SEQ ID NO: 6551867 - DNA, 17 bp, Homo sapiens
tgtttcccctcagaaca

SEQ ID NO: 6551868 - DNA, 19 bp, Homo sapiens
tgtttcccgtaaggctgta

SEQ ID NO: 6551869 - DNA, 23 bp, Homo sapiens
tgtttcccgtaaggctgtacata

SEQ ID NO: 6551870 - DNA, 15 bp, Homo sapiens
tgtttccctctcctt

SEQ ID NO: 6551871 - DNA, 16 bp, Homo sapiens
tgtttccctctgtgtt

SEQ ID NO: 6551872 - DNA, 20 bp, Homo sapiens
tgtttccctctgtgttagag

SEQ ID NO: 6551873 - DNA, 12 bp, Homo sapiens
tgtttccctgct

SEQ ID NO: 6551874 - DNA, 17 bp, Homo sapiens
tgtttccctgctggcca

SEQ ID NO: 6551875 - DNA, 14 bp, Homo sapiens
tgtttcccttcctc

SEQ ID NO: 6551876 - DNA, 18 bp, Homo sapiens
tgtttcccttgctttgtt

SEQ ID NO: 6551877 - DNA, 19 bp, Homo sapiens
tgtttcccttgctttgttt

SEQ ID NO: 6551878 - DNA, 15 bp, Homo sapiens
tgtttcctaaatcag

SEQ ID NO: 6551879 - DNA, 16 bp, Homo sapiens
tgtttcctagctgtgt

SEQ ID NO: 6551880 - DNA, 16 bp, Homo sapiens
tgtttcctattaatct

SEQ ID NO: 6551881 - DNA, 17 bp, Homo sapiens
tgtttcctcatctatgg

SEQ ID NO: 6551882 - DNA, 19 bp, Homo sapiens
tgtttcctccttgtcactg

SEQ ID NO: 6551883 - DNA, 13 bp, Homo sapiens
tgtttcctctaaa

SEQ ID NO: 6551884 - DNA, 15 bp, Homo sapiens
tgtttcctcttccaa

SEQ ID NO: 6551885 - DNA, 14 bp, Homo sapiens
tgtttcctgacaga

SEQ ID NO: 6551886 - DNA, 21 bp, Homo sapiens
tgtttcctgacattgtctcct

SEQ ID NO: 6551887 - DNA, 16 bp, Homo sapiens
tgtttcctgcaggcca

SEQ ID NO: 6551888 - DNA, 14 bp, Homo sapiens
tgtttcctggcaat

SEQ ID NO: 6551889 - DNA, 20 bp, Homo sapiens
tgtttcctggcactgcttcc

SEQ ID NO: 6551890 - DNA, 13 bp, Homo sapiens
tgtttcctggcct

SEQ ID NO: 6551891 - DNA, 20 bp, Homo sapiens
tgtttcctggcctcagagct

SEQ ID NO: 6551892 - DNA, 21 bp, Homo sapiens
tgtttcctggcctcagagctt

SEQ ID NO: 6551893 - DNA, 22 bp, Homo sapiens
tgtttcctggcctcagagcttc

SEQ ID NO: 6551894 - DNA, 23 bp, Homo sapiens
tgtttcctgtgcccatcatctct

SEQ ID NO: 6551895 - DNA, 23 bp, Homo sapiens
tgtttccttgcctgctttctcca

SEQ ID NO: 6551896 - DNA, 21 bp, Homo sapiens
tgtttccttgttggtcagagg

SEQ ID NO: 6551897 - DNA, 20 bp, Homo sapiens
tgtttccttttcaggagatg

SEQ ID NO: 6551898 - DNA, 16 bp, Homo sapiens
tgtttccttttttccc

SEQ ID NO: 6551899 - DNA, 18 bp, Homo sapiens
tgtttcgagtaaacttga

SEQ ID NO: 6551900 - DNA, 23 bp, Homo sapiens
tgtttcgcgggtaactggggttg

SEQ ID NO: 6551901 - DNA, 21 bp, Homo sapiens
tgtttcgctgatatatgtgtt

SEQ ID NO: 6551902 - DNA, 22 bp, Homo sapiens
tgtttcggagacgggaccgggc

SEQ ID NO: 6551903 - DNA, 20 bp, Homo sapiens
tgtttcgtgaagtatactgt

SEQ ID NO: 6551904 - DNA, 15 bp, Homo sapiens
tgtttctaaaactat

SEQ ID NO: 6551905 - DNA, 21 bp, Homo sapiens
tgtttctaacaattttcagac

SEQ ID NO: 6551906 - DNA, 14 bp, Homo sapiens
tgtttctaagagca

SEQ ID NO: 6551907 - DNA, 18 bp, Homo sapiens
tgtttctacctatatgca

SEQ ID NO: 6551908 - DNA, 17 bp, Homo sapiens
tgtttctactttgatat

SEQ ID NO: 6551909 - DNA, 14 bp, Homo sapiens
tgtttctagaacag

SEQ ID NO: 6551910 - DNA, 18 bp, Homo sapiens
tgtttctagctaaataaa

SEQ ID NO: 6551911 - DNA, 16 bp, Homo sapiens
tgtttctagttgagga

SEQ ID NO: 6551912 - DNA, 16 bp, Homo sapiens
tgtttctataaatgac

SEQ ID NO: 6551913 - DNA, 12 bp, Homo sapiens
tgtttctcaaaa

SEQ ID NO: 6551914 - DNA, 14 bp, Homo sapiens
tgtttctcatttta

SEQ ID NO: 6551915 - DNA, 21 bp, Homo sapiens
tgtttctccacaacagcctgg

SEQ ID NO: 6551916 - DNA, 22 bp, Homo sapiens
tgtttctccacaacagcctggg

SEQ ID NO: 6551917 - DNA, 15 bp, Homo sapiens
tgtttctccccctgg

SEQ ID NO: 6551918 - DNA, 16 bp, Homo sapiens
tgtttctccccctggg

SEQ ID NO: 6551919 - DNA, 17 bp, Homo sapiens
tgtttctccccctgggc

SEQ ID NO: 6551920 - DNA, 15 bp, Homo sapiens
tgtttctccctctca

SEQ ID NO: 6551921 - DNA, 23 bp, Homo sapiens
tgtttctcgtgctgcatccctgt

SEQ ID NO: 6551922 - DNA, 17 bp, Homo sapiens
tgtttctctaaggaatt

SEQ ID NO: 6551923 - DNA, 14 bp, Homo sapiens
tgtttctctgctgt

SEQ ID NO: 6551924 - DNA, 18 bp, Homo sapiens
tgtttctcttgagctggc

SEQ ID NO: 6551925 - DNA, 19 bp, Homo sapiens
tgtttctgaaaagaaataa

SEQ ID NO: 6551926 - DNA, 23 bp, Homo sapiens
tgtttctgaaaagaaataataat

SEQ ID NO: 6551927 - DNA, 16 bp, Homo sapiens
tgtttctgacccactg

SEQ ID NO: 6551928 - DNA, 12 bp, Homo sapiens
tgtttctgactc

SEQ ID NO: 6551929 - DNA, 21 bp, Homo sapiens
ttgtcatatcactaaataaac

SEQ ID NO: 6551930 - DNA, 23 bp, Homo sapiens
ttgtcatatcagcacatattttc

SEQ ID NO: 6551931 - DNA, 16 bp, Homo sapiens
ttgtcatcaaacataa

SEQ ID NO: 6551932 - DNA, 21 bp, Homo sapiens
ttgtcatcattgtatatatgt

SEQ ID NO: 6551933 - DNA, 16 bp, Homo sapiens
ttgtcatcctcccttg

SEQ ID NO: 6551934 - DNA, 15 bp, Homo sapiens
ttgtcatgaactgta

SEQ ID NO: 6551935 - DNA, 22 bp, Homo sapiens
ttgtcatggaaaatgtcctgtg

SEQ ID NO: 6551936 - DNA, 23 bp, Homo sapiens
ttgtcatggaaaatgtcctgtgg

SEQ ID NO: 6551937 - DNA, 21 bp, Homo sapiens
ttgtcatggggatcaattttc

SEQ ID NO: 6551938 - DNA, 16 bp, Homo sapiens
ttgtcatggtgaaatt

SEQ ID NO: 6551939 - DNA, 18 bp, Homo sapiens
ttgtcatgtaccatcaat

SEQ ID NO: 6551940 - DNA, 16 bp, Homo sapiens
ttgtcatgtagctgtt

SEQ ID NO: 6551941 - DNA, 22 bp, Homo sapiens
ttgtcatgtgtataaaaataaa

SEQ ID NO: 6551942 - DNA, 13 bp, Homo sapiens
ttgtcatgttact

SEQ ID NO: 6551943 - DNA, 18 bp, Homo sapiens
ttgtcatgttatgcagtg

SEQ ID NO: 6551944 - DNA, 21 bp, Homo sapiens
ttgtcatgttatgcagtgaac

SEQ ID NO: 6551945 - DNA, 15 bp, Homo sapiens
ttgtcattaaaattg

SEQ ID NO: 6551946 - DNA, 12 bp, Homo sapiens
ttgtcattaaag

SEQ ID NO: 6551947 - DNA, 16 bp, Homo sapiens
ttgtcattacaaatct

SEQ ID NO: 6551948 - DNA, 15 bp, Homo sapiens
ttgtcattagcctga

SEQ ID NO: 6551949 - DNA, 18 bp, Homo sapiens
ttgtcattatgatttcat

SEQ ID NO: 6551950 - DNA, 20 bp, Homo sapiens
ttgtcattcaagcctgtgaa

SEQ ID NO: 6551951 - DNA, 21 bp, Homo sapiens
ttgtcattcagttctaggcct

SEQ ID NO: 6551952 - DNA, 14 bp, Homo sapiens
ttgtcattctcatc

SEQ ID NO: 6551953 - DNA, 14 bp, Homo sapiens
ttgtcattgctgtt

SEQ ID NO: 6551954 - DNA, 17 bp, Homo sapiens
ttgtcattgtccagctg

SEQ ID NO: 6551955 - DNA, 13 bp, Homo sapiens
ttgtcattttcat

SEQ ID NO: 6551956 - DNA, 14 bp, Homo sapiens
ttgtcattttcatt

SEQ ID NO: 6551957 - DNA, 13 bp, Homo sapiens
ttgtcattttgaa

SEQ ID NO: 6551958 - DNA, 21 bp, Homo sapiens
ttgtccaaagctgaaaatgtg

SEQ ID NO: 6551959 - DNA, 18 bp, Homo sapiens
ttgtccaatggctgtaaa

SEQ ID NO: 6551960 - DNA, 21 bp, Homo sapiens
ttgtccaattaatgaagttga

SEQ ID NO: 6551961 - DNA, 21 bp, Homo sapiens
ttgtccaattgtataactttg

SEQ ID NO: 6551962 - DNA, 14 bp, Homo sapiens
ttgtccacaaatgt

SEQ ID NO: 6551963 - DNA, 16 bp, Homo sapiens
ttgtccacaaatgtcc

SEQ ID NO: 6551964 - DNA, 22 bp, Homo sapiens
ttgtccacagtctcccattctc

SEQ ID NO: 6551965 - DNA, 18 bp, Homo sapiens
ttgtccaccattccttta

SEQ ID NO: 6551966 - DNA, 22 bp, Homo sapiens
ttgtccacccacttagtccact

SEQ ID NO: 6551967 - DNA, 22 bp, Homo sapiens
ttgtccaccttctgccaaggcc

SEQ ID NO: 6551968 - DNA, 13 bp, Homo sapiens
ttgtccagagaca

SEQ ID NO: 6551969 - DNA, 22 bp, Homo sapiens
ttgtccagagataaaaatcata

SEQ ID NO: 6551970 - DNA, 16 bp, Homo sapiens
ttgtccagagctgctt

SEQ ID NO: 6551971 - DNA, 17 bp, Homo sapiens
ttgtccaggaaagaaac

SEQ ID NO: 6551972 - DNA, 19 bp, Homo sapiens
ttgtccaggaactgcctgg

SEQ ID NO: 6551973 - DNA, 18 bp, Homo sapiens
ttgtccatcagattctgt

SEQ ID NO: 6551974 - DNA, 21 bp, Homo sapiens
ttgtccatgcctacagataat

SEQ ID NO: 6551975 - DNA, 20 bp, Homo sapiens
ttgtccatgtgcttccctag

SEQ ID NO: 6551976 - DNA, 18 bp, Homo sapiens
ttgtccattattcatttt

SEQ ID NO: 6551977 - DNA, 23 bp, Homo sapiens
ttgtccattgcgttattttcttt

SEQ ID NO: 6551978 - DNA, 19 bp, Homo sapiens
ttgtccattgtaaatctga

SEQ ID NO: 6551979 - DNA, 15 bp, Homo sapiens
ttgtcccaagtgcca

SEQ ID NO: 6551980 - DNA, 13 bp, Homo sapiens
ttgtcccacagct

SEQ ID NO: 6551981 - DNA, 19 bp, Homo sapiens
ttgtcccactatctgggtg

SEQ ID NO: 6551982 - DNA, 18 bp, Homo sapiens
ttgtcccagcctggggct

SEQ ID NO: 6551983 - DNA, 13 bp, Homo sapiens
ttgtcccatctct

SEQ ID NO: 6551984 - DNA, 16 bp, Homo sapiens
ttgtcccatctgccct

SEQ ID NO: 6551985 - DNA, 18 bp, Homo sapiens
ttgtcccatctgccctcc

SEQ ID NO: 6551986 - DNA, 19 bp, Homo sapiens
ttgtcccatttccttggag

SEQ ID NO: 6551987 - DNA, 12 bp, Homo sapiens
ttgtccccacac

SEQ ID NO: 6551988 - DNA, 15 bp, Homo sapiens
ttgtccccacactcc

SEQ ID NO: 6551989 - DNA, 20 bp, Homo sapiens
ttgtccccaccgcagacagg

SEQ ID NO: 6551990 - DNA, 16 bp, Homo sapiens
ttgtcccccaacttga

SEQ ID NO: 6551991 - DNA, 16 bp, Homo sapiens
ttgtccccgacccttg

SEQ ID NO: 6551992 - DNA, 16 bp, Homo sapiens
ttgtccccgctggctc

SEQ ID NO: 6551993 - DNA, 17 bp, Homo sapiens
ttgtccccgctggctca

SEQ ID NO: 6551994 - DNA, 15 bp, Homo sapiens
ttgtccccgtggtct

SEQ ID NO: 6551995 - DNA, 13 bp, Homo sapiens
ttgtcccctgctt

SEQ ID NO: 6551996 - DNA, 17 bp, Homo sapiens
ttgtcccggataggcta

SEQ ID NO: 6551997 - DNA, 19 bp, Homo sapiens
ttgtcccggatttttgtta

SEQ ID NO: 6551998 - DNA, 13 bp, Homo sapiens
ttgtccctctcac

SEQ ID NO: 6551999 - DNA, 16 bp, Homo sapiens
ttgtccctctgcccca

SEQ ID NO: 6552000 - DNA, 17 bp, Homo sapiens
ttgtccctctttggaac

SEQ ID NO: 6552001 - DNA, 18 bp, Homo sapiens
ttgtccctgaagagaagg

SEQ ID NO: 6552002 - DNA, 14 bp, Homo sapiens
ttgtccctggggca

SEQ ID NO: 6552003 - DNA, 17 bp, Homo sapiens
ttgtccctggggcactc

SEQ ID NO: 6552004 - DNA, 19 bp, Homo sapiens
ttgtccctggggcactccc

SEQ ID NO: 6552005 - DNA, 22 bp, Homo sapiens
ttgtccctggggcactccccca

SEQ ID NO: 6552006 - DNA, 23 bp, Homo sapiens
ttgtccctgtgttgtcccatctg

SEQ ID NO: 6552007 - DNA, 15 bp, Homo sapiens
ttgtcccttggcaca

SEQ ID NO: 6552008 - DNA, 21 bp, Homo sapiens
ttgtccggtggaaggccttct

SEQ ID NO: 6552009 - DNA, 15 bp, Homo sapiens
ttgtccggtttactt

SEQ ID NO: 6552010 - DNA, 17 bp, Homo sapiens
ttgtccggtttacttta

SEQ ID NO: 6552011 - DNA, 18 bp, Homo sapiens
ttgtcctaagaacaatgc

SEQ ID NO: 6552012 - DNA, 15 bp, Homo sapiens
ttgtcctaagagatt

SEQ ID NO: 6552013 - DNA, 16 bp, Homo sapiens
ttgtcctatgggagtc

SEQ ID NO: 6552014 - DNA, 20 bp, Homo sapiens
ttgtcctattagtgttatat

SEQ ID NO: 6552015 - DNA, 19 bp, Homo sapiens
ttgtcctcagcttgggctt

SEQ ID NO: 6552016 - DNA, 17 bp, Homo sapiens
ttgtcctcagtccattt

SEQ ID NO: 6552017 - DNA, 20 bp, Homo sapiens
ttgtcctctcagagcctcag

SEQ ID NO: 6552018 - DNA, 12 bp, Homo sapiens
ttgtcctctccc

SEQ ID NO: 6552019 - DNA, 13 bp, Homo sapiens
ttgtcctctcccg

SEQ ID NO: 6552020 - DNA, 18 bp, Homo sapiens
ttgtcctcttctgctctt

SEQ ID NO: 6552021 - DNA, 23 bp, Homo sapiens
ttgtcctgatgcttttgtctaat

SEQ ID NO: 6552022 - DNA, 11 bp, Homo sapiens
ttgtcctgcag

SEQ ID NO: 6552023 - DNA, 13 bp, Homo sapiens
ttgtcctgcagag

SEQ ID NO: 6552024 - DNA, 17 bp, Homo sapiens
ttgtcctgcagtgctca

SEQ ID NO: 6552025 - DNA, 14 bp, Homo sapiens
ttgtcctgccagct

SEQ ID NO: 6552026 - DNA, 12 bp, Homo sapiens
ttgtcctggccc

SEQ ID NO: 6552027 - DNA, 11 bp, Homo sapiens
ttgtcctgtgt

SEQ ID NO: 6552028 - DNA, 16 bp, Homo sapiens
ttgtccttagcctgga

SEQ ID NO: 6552029 - DNA, 14 bp, Homo sapiens
ttgtccttgaagct

SEQ ID NO: 6552030 - DNA, 22 bp, Homo sapiens
ttgtccttgaagcttgtatctg

SEQ ID NO: 6552031 - DNA, 15 bp, Homo sapiens
ttgtccttgcacctg

SEQ ID NO: 6552032 - DNA, 23 bp, Homo sapiens
ttgtccttgccccactcctctcc

SEQ ID NO: 6552033 - DNA, 16 bp, Homo sapiens
ttgtccttgtgtatcc

SEQ ID NO: 6552034 - DNA, 23 bp, Homo sapiens
ttgtccttgtgtatcctgacagc

SEQ ID NO: 6552035 - DNA, 16 bp, Homo sapiens
ttgtcctttaatattt

SEQ ID NO: 6552036 - DNA, 15 bp, Homo sapiens
ttgtcctttatattt

SEQ ID NO: 6552037 - DNA, 17 bp, Homo sapiens
ttgtcctttatgtattc

SEQ ID NO: 6552038 - DNA, 15 bp, Homo sapiens
ttgtcctttgagaaa

SEQ ID NO: 6552039 - DNA, 20 bp, Homo sapiens
ttgtcctttgaggccccaac

SEQ ID NO: 6552040 - DNA, 17 bp, Homo sapiens
ttgtccttttatttctc

SEQ ID NO: 6552041 - DNA, 16 bp, Homo sapiens
ttgtccttttgtcttc

SEQ ID NO: 6552042 - DNA, 22 bp, Homo sapiens
ttgtcgaaaagagtcttccaat

SEQ ID NO: 6552043 - DNA, 23 bp, Homo sapiens
ttgtcgaaaagagtcttccaatt

SEQ ID NO: 6552044 - DNA, 20 bp, Homo sapiens
ttgtcgcgcgtctcccatcc

SEQ ID NO: 6552045 - DNA, 14 bp, Homo sapiens
ttgtcgctcatgtg

SEQ ID NO: 6552046 - DNA, 22 bp, Homo sapiens
ttgtcgctgaacctgtctcctc

SEQ ID NO: 6552047 - DNA, 19 bp, Homo sapiens
ttgtcgctttctcagtgtg

SEQ ID NO: 6552048 - DNA, 20 bp, Homo sapiens
ttgtcgggcaccagccagcg

SEQ ID NO: 6552049 - DNA, 13 bp, Homo sapiens
ttgtcgtttttat

SEQ ID NO: 6552050 - DNA, 11 bp, Homo sapiens
ttgtctaaaat

SEQ ID NO: 6552051 - DNA, 22 bp, Homo sapiens
ttgtctaaaatgcctcagtgta

SEQ ID NO: 6552052 - DNA, 15 bp, Homo sapiens
ttgtctaaaatgtca

SEQ ID NO: 6552053 - DNA, 16 bp, Homo sapiens
ttgtctaaaatgtcag

SEQ ID NO: 6552054 - DNA, 13 bp, Homo sapiens
ttgtctaaacaag

SEQ ID NO: 6552055 - DNA, 15 bp, Homo sapiens
ttgtctaactcagaa

SEQ ID NO: 6552056 - DNA, 16 bp, Homo sapiens
ttgtctaagaaacatt

SEQ ID NO: 6552057 - DNA, 17 bp, Homo sapiens
ttgtctaagaaacattg

SEQ ID NO: 6552058 - DNA, 18 bp, Homo sapiens
ttgtctaagaaacattgg

SEQ ID NO: 6552059 - DNA, 20 bp, Homo sapiens
ttgtctaagtagggccaggg

SEQ ID NO: 6552060 - DNA, 20 bp, Homo sapiens
ttgtctagaggtgagaccaa

SEQ ID NO: 6552061 - DNA, 18 bp, Homo sapiens
ttgtctagtcattgtcat

SEQ ID NO: 6552062 - DNA, 15 bp, Homo sapiens
ttgtctataaagcat

SEQ ID NO: 6552063 - DNA, 20 bp, Homo sapiens
ttgtctatagttgtcagtat

SEQ ID NO: 6552064 - DNA, 22 bp, Homo sapiens
ttgtctatgaagttgctgttta

SEQ ID NO: 6552065 - DNA, 17 bp, Homo sapiens
ttgtctattctgagcct

SEQ ID NO: 6552066 - DNA, 18 bp, Homo sapiens
ttgtctatttgtctctta

SEQ ID NO: 6552067 - DNA, 16 bp, Homo sapiens
ttgtctattttaaaat

SEQ ID NO: 6552068 - DNA, 17 bp, Homo sapiens
ttgtctatttttgtctt

SEQ ID NO: 6552069 - DNA, 18 bp, Homo sapiens
ttgtctatttttgtctta

SEQ ID NO: 6552070 - DNA, 19 bp, Homo sapiens
ttgtctcaaagcatcaaat

SEQ ID NO: 6552071 - DNA, 16 bp, Homo sapiens
ttgtctcaatgctcat

SEQ ID NO: 6552072 - DNA, 17 bp, Homo sapiens
ttgtctcaatgctcata

SEQ ID NO: 6552073 - DNA, 18 bp, Homo sapiens
ttgtctcacgattccagt

SEQ ID NO: 6552074 - DNA, 19 bp, Homo sapiens
ttgtctcacgattccagtg

SEQ ID NO: 6552075 - DNA, 20 bp, Homo sapiens
ttgtctcagattttattatg

SEQ ID NO: 6552076 - DNA, 16 bp, Homo sapiens
ttgtctcattttgtat

SEQ ID NO: 6552077 - DNA, 18 bp, Homo sapiens
ttgtctccaaagaagata

SEQ ID NO: 6552078 - DNA, 15 bp, Homo sapiens
ttgtctccatgtgta

SEQ ID NO: 6552079 - DNA, 21 bp, Homo sapiens
ttgtctcccgccccccacact

SEQ ID NO: 6552080 - DNA, 15 bp, Homo sapiens
ttgtctccctggccc

SEQ ID NO: 6552081 - DNA, 19 bp, Homo sapiens
ttgtctccctggccctcaa

SEQ ID NO: 6552082 - DNA, 20 bp, Homo sapiens
ttgtctccctggttgcctct

SEQ ID NO: 6552083 - DNA, 17 bp, Homo sapiens
ttgtctcctactcctga

SEQ ID NO: 6552084 - DNA, 18 bp, Homo sapiens
ttgtctcctttccactgc

SEQ ID NO: 6552085 - DNA, 14 bp, Homo sapiens
ttgtctcctttctg

SEQ ID NO: 6552086 - DNA, 17 bp, Homo sapiens
ttgtctcctttctgact

SEQ ID NO: 6552087 - DNA, 18 bp, Homo sapiens
ttgtctcctttctgactg

SEQ ID NO: 6552088 - DNA, 17 bp, Homo sapiens
ttgtctcgtttgtgatt

SEQ ID NO: 6552089 - DNA, 19 bp, Homo sapiens
ttgtctctatgccagctca

SEQ ID NO: 6552090 - DNA, 13 bp, Homo sapiens
ttgtctctcctgg

SEQ ID NO: 6552091 - DNA, 12 bp, Homo sapiens
ttgtctctcctt

SEQ ID NO: 6552092 - DNA, 13 bp, Homo sapiens
ttgtctctccttt

SEQ ID NO: 6552093 - DNA, 14 bp, Homo sapiens
ttgtctctcctttt

SEQ ID NO: 6552094 - DNA, 21 bp, Homo sapiens
ttgtctctccttttcttttgt

SEQ ID NO: 6552095 - DNA, 21 bp, Homo sapiens
ttgtctctgatgcagcttata

SEQ ID NO: 6552096 - DNA, 12 bp, Homo sapiens
ttgtctctgggc

SEQ ID NO: 6552097 - DNA, 11 bp, Homo sapiens
ttgtctctgta

SEQ ID NO: 6552098 - DNA, 23 bp, Homo sapiens
ttgtctctgttttacaagttgga

SEQ ID NO: 6552099 - DNA, 20 bp, Homo sapiens
ttgtctcttcctctgcagga

SEQ ID NO: 6552100 - DNA, 18 bp, Homo sapiens
ttgtctcttgcctgccac

SEQ ID NO: 6552101 - DNA, 18 bp, Homo sapiens
ttgtctgaacccaggcag

SEQ ID NO: 6552102 - DNA, 23 bp, Homo sapiens
ttgtctgaacccaggcagctggc

SEQ ID NO: 6552103 - DNA, 13 bp, Homo sapiens
ttgtctgaaggat

SEQ ID NO: 6552104 - DNA, 15 bp, Homo sapiens
ttgtctgaaggattt

SEQ ID NO: 6552105 - DNA, 17 bp, Homo sapiens
ttgtctgacacatgctc

SEQ ID NO: 6552106 - DNA, 14 bp, Homo sapiens
ttgtctgattgaaa

SEQ ID NO: 6552107 - DNA, 16 bp, Homo sapiens
ttgtctgatttcttag

SEQ ID NO: 6552108 - DNA, 22 bp, Homo sapiens
tgtttctgagacggagtctcag

SEQ ID NO: 6552109 - DNA, 23 bp, Homo sapiens
tgtttctgcagcccttgggcagt

SEQ ID NO: 6552110 - DNA, 21 bp, Homo sapiens
tgtttctgcagtagtctctgt

SEQ ID NO: 6552111 - DNA, 22 bp, Homo sapiens
tgtttctgcagtagtctctgtg

SEQ ID NO: 6552112 - DNA, 19 bp, Homo sapiens
tgtttctgcagtattctgt

SEQ ID NO: 6552113 - DNA, 20 bp, Homo sapiens
tgtttctgcagtattctgta

SEQ ID NO: 6552114 - DNA, 23 bp, Homo sapiens
tgtttctggaagactgctcccgg

SEQ ID NO: 6552115 - DNA, 24 bp, Homo sapiens
tgtttctggaagactgctcccggc

SEQ ID NO: 6552116 - DNA, 18 bp, Homo sapiens
tgtttctggacattctct

SEQ ID NO: 6552117 - DNA, 23 bp, Homo sapiens
tgtttctggacattctctttgat

SEQ ID NO: 6552118 - DNA, 23 bp, Homo sapiens
tgtttctggacccttataaaatc

SEQ ID NO: 6552119 - DNA, 12 bp, Homo sapiens
tgtttctggagt

SEQ ID NO: 6552120 - DNA, 19 bp, Homo sapiens
tgtttctggagtcacatca

SEQ ID NO: 6552121 - DNA, 17 bp, Homo sapiens
tgtttctggatttcata

SEQ ID NO: 6552122 - DNA, 15 bp, Homo sapiens
tgtttctgtaacaaa

SEQ ID NO: 6552123 - DNA, 16 bp, Homo sapiens
tgtttctgtaacaaat

SEQ ID NO: 6552124 - DNA, 17 bp, Homo sapiens
tgtttctgtaacaaatt

SEQ ID NO: 6552125 - DNA, 21 bp, Homo sapiens
tgtttctgtaacaaattggga

SEQ ID NO: 6552126 - DNA, 22 bp, Homo sapiens
tgtttctgtactttttggcata

SEQ ID NO: 6552127 - DNA, 13 bp, Homo sapiens
tgtttctgtcaag

SEQ ID NO: 6552128 - DNA, 14 bp, Homo sapiens
tgtttctgtcagga

SEQ ID NO: 6552129 - DNA, 12 bp, Homo sapiens
tgtttctgtcct

SEQ ID NO: 6552130 - DNA, 18 bp, Homo sapiens
tgtttctgtcctgtaact

SEQ ID NO: 6552131 - DNA, 20 bp, Homo sapiens
tgtttctgtcctgtaactgt

SEQ ID NO: 6552132 - DNA, 23 bp, Homo sapiens
tgtttctgtgaaattctcagagt

SEQ ID NO: 6552133 - DNA, 13 bp, Homo sapiens
tgtttctgtgctc

SEQ ID NO: 6552134 - DNA, 14 bp, Homo sapiens
tgtttctgtgggcg

SEQ ID NO: 6552135 - DNA, 14 bp, Homo sapiens
tgtttctgttctgg

SEQ ID NO: 6552136 - DNA, 15 bp, Homo sapiens
tgtttctgtttagtc

SEQ ID NO: 6552137 - DNA, 19 bp, Homo sapiens
tgtttctgtttataatgaa

SEQ ID NO: 6552138 - DNA, 13 bp, Homo sapiens
tgtttctgtttct

SEQ ID NO: 6552139 - DNA, 22 bp, Homo sapiens
tgtttcttaactataaatatgt

SEQ ID NO: 6552140 - DNA, 16 bp, Homo sapiens
tgtttcttaatttgga

SEQ ID NO: 6552141 - DNA, 22 bp, Homo sapiens
tgtttcttagagccaagtgtct

SEQ ID NO: 6552142 - DNA, 19 bp, Homo sapiens
tgtttcttattctctgttt

SEQ ID NO: 6552143 - DNA, 19 bp, Homo sapiens
tgtttcttccaaagcacat

SEQ ID NO: 6552144 - DNA, 12 bp, Homo sapiens
tgtttcttctca

SEQ ID NO: 6552145 - DNA, 22 bp, Homo sapiens
tgtttcttctccaattctgaaa

SEQ ID NO: 6552146 - DNA, 14 bp, Homo sapiens
tgtttcttctggct

SEQ ID NO: 6552147 - DNA, 17 bp, Homo sapiens
tgtttcttctgtcttta

SEQ ID NO: 6552148 - DNA, 23 bp, Homo sapiens
tgtttcttctttcttttaagcag

SEQ ID NO: 6552149 - DNA, 16 bp, Homo sapiens
tgtttcttgacaagct

SEQ ID NO: 6552150 - DNA, 19 bp, Homo sapiens
tgtttcttgccttttgtta

SEQ ID NO: 6552151 - DNA, 12 bp, Homo sapiens
tgtttcttgctc

SEQ ID NO: 6552152 - DNA, 14 bp, Homo sapiens
tgtttcttgcttgt

SEQ ID NO: 6552153 - DNA, 17 bp, Homo sapiens
tgtttcttgcttgtacc

SEQ ID NO: 6552154 - DNA, 18 bp, Homo sapiens
tgtttcttgttcatccaa

SEQ ID NO: 6552155 - DNA, 14 bp, Homo sapiens
tgtttcttgtttat

SEQ ID NO: 6552156 - DNA, 17 bp, Homo sapiens
tgtttcttgtttattga

SEQ ID NO: 6552157 - DNA, 21 bp, Homo sapiens
tgtttctttaaatttcaaatg

SEQ ID NO: 6552158 - DNA, 22 bp, Homo sapiens
tgtttctttaaatttcaaatgt

SEQ ID NO: 6552159 - DNA, 13 bp, Homo sapiens
tgtttctttctga

SEQ ID NO: 6552160 - DNA, 20 bp, Homo sapiens
tgtttctttcttcctcttct

SEQ ID NO: 6552161 - DNA, 16 bp, Homo sapiens
tgtttctttgaatttt

SEQ ID NO: 6552162 - DNA, 18 bp, Homo sapiens
tgtttctttgaattttca

SEQ ID NO: 6552163 - DNA, 19 bp, Homo sapiens
tgtttctttgaattttcat

SEQ ID NO: 6552164 - DNA, 12 bp, Homo sapiens
tgtttctttgat

SEQ ID NO: 6552165 - DNA, 19 bp, Homo sapiens
tgtttctttgtaatgaaaa

SEQ ID NO: 6552166 - DNA, 17 bp, Homo sapiens
tgtttcttttaagtata

SEQ ID NO: 6552167 - DNA, 15 bp, Homo sapiens
tgtttcttttcacat

SEQ ID NO: 6552168 - DNA, 20 bp, Homo sapiens
tgtttcttttgcttaggaaa

SEQ ID NO: 6552169 - DNA, 13 bp, Homo sapiens
tgtttcttttgta

SEQ ID NO: 6552170 - DNA, 23 bp, Homo sapiens
tgtttctttttacagcattgtct

SEQ ID NO: 6552171 - DNA, 16 bp, Homo sapiens
tgtttgaaaacaaaaa

SEQ ID NO: 6552172 - DNA, 15 bp, Homo sapiens
tgtttgaaaactgac

SEQ ID NO: 6552173 - DNA, 18 bp, Homo sapiens
tgtttgaaacaaagaagg

SEQ ID NO: 6552174 - DNA, 18 bp, Homo sapiens
tgtttgaaatatcatgtt

SEQ ID NO: 6552175 - DNA, 22 bp, Homo sapiens
tgtttgaaatatggaactgtaa

SEQ ID NO: 6552176 - DNA, 15 bp, Homo sapiens
tgtttgaacccagga

SEQ ID NO: 6552177 - DNA, 16 bp, Homo sapiens
tgtttgaacccaggag

SEQ ID NO: 6552178 - DNA, 18 bp, Homo sapiens
tgtttgaactgccaagaa

SEQ ID NO: 6552179 - DNA, 19 bp, Homo sapiens
tgtttgaagattatatgaa

SEQ ID NO: 6552180 - DNA, 18 bp, Homo sapiens
tgtttgaagtctgctcat

SEQ ID NO: 6552181 - DNA, 22 bp, Homo sapiens
tgtttgaattcctcctctattt

SEQ ID NO: 6552182 - DNA, 16 bp, Homo sapiens
tgtttgaattgatttt

SEQ ID NO: 6552183 - DNA, 20 bp, Homo sapiens
tgtttgaattttcaaaggct

SEQ ID NO: 6552184 - DNA, 22 bp, Homo sapiens
tgtttgacaaagaaacccaagt

SEQ ID NO: 6552185 - DNA, 22 bp, Homo sapiens
tgtttgacaaagttactgattc

SEQ ID NO: 6552186 - DNA, 21 bp, Homo sapiens
tgtttgacaataatctcacaa

SEQ ID NO: 6552187 - DNA, 14 bp, Homo sapiens
tgtttgacacctct

SEQ ID NO: 6552188 - DNA, 18 bp, Homo sapiens
tgtttgaccccagtttct

SEQ ID NO: 6552189 - DNA, 21 bp, Homo sapiens
tgtttgaccttcagagccagc

SEQ ID NO: 6552190 - DNA, 18 bp, Homo sapiens
tgtttgactgtaatgtaa

SEQ ID NO: 6552191 - DNA, 14 bp, Homo sapiens
tgtttgactttaaa

SEQ ID NO: 6552192 - DNA, 20 bp, Homo sapiens
tgtttgactttaaagatgat

SEQ ID NO: 6552193 - DNA, 14 bp, Homo sapiens
tgtttgagaaatta

SEQ ID NO: 6552194 - DNA, 11 bp, Homo sapiens
tgtttgagaac

SEQ ID NO: 6552195 - DNA, 17 bp, Homo sapiens
tgtttgagatgtgatgc

SEQ ID NO: 6552196 - DNA, 18 bp, Homo sapiens
tgtttgagattctcaaag

SEQ ID NO: 6552197 - DNA, 12 bp, Homo sapiens
tgtttgagcgca

SEQ ID NO: 6552198 - DNA, 23 bp, Homo sapiens
tgtttgagctcagacccccactc

SEQ ID NO: 6552199 - DNA, 15 bp, Homo sapiens
tgtttgaggaaagca

SEQ ID NO: 6552200 - DNA, 21 bp, Homo sapiens
tgtttgaggcaaattaactgt

SEQ ID NO: 6552201 - DNA, 17 bp, Homo sapiens
tgtttgatatttgtgta

SEQ ID NO: 6552202 - DNA, 13 bp, Homo sapiens
tgtttgatgcatt

SEQ ID NO: 6552203 - DNA, 16 bp, Homo sapiens
tgtttgatgcattaaa

SEQ ID NO: 6552204 - DNA, 20 bp, Homo sapiens
tgtttgatgtatgtgtgaaa

SEQ ID NO: 6552205 - DNA, 18 bp, Homo sapiens
tgtttgatgtgtatgtgt

SEQ ID NO: 6552206 - DNA, 17 bp, Homo sapiens
tgtttgattcagacagc

SEQ ID NO: 6552207 - DNA, 14 bp, Homo sapiens
tgtttgattccatt

SEQ ID NO: 6552208 - DNA, 11 bp, Homo sapiens
tgtttgatttc

SEQ ID NO: 6552209 - DNA, 20 bp, Homo sapiens
tgtttgcaactggtatatat

SEQ ID NO: 6552210 - DNA, 21 bp, Homo sapiens
tgtttgcaactggtatatatt

SEQ ID NO: 6552211 - DNA, 23 bp, Homo sapiens
tgtttgcacgttatggtgtttct

SEQ ID NO: 6552212 - DNA, 12 bp, Homo sapiens
tgtttgcactgt

SEQ ID NO: 6552213 - DNA, 16 bp, Homo sapiens
tgtttgcactgtgtgc

SEQ ID NO: 6552214 - DNA, 17 bp, Homo sapiens
tgtttgcagcctgctct

SEQ ID NO: 6552215 - DNA, 14 bp, Homo sapiens
tgtttgcagctgtg

SEQ ID NO: 6552216 - DNA, 14 bp, Homo sapiens
tgtttgcatataag

SEQ ID NO: 6552217 - DNA, 14 bp, Homo sapiens
tgtttgcatcattt

SEQ ID NO: 6552218 - DNA, 15 bp, Homo sapiens
tgtttgcatctgaaa

SEQ ID NO: 6552219 - DNA, 15 bp, Homo sapiens
tgtttgcatgagaaa

SEQ ID NO: 6552220 - DNA, 13 bp, Homo sapiens
tgtttgcatgcgc

SEQ ID NO: 6552221 - DNA, 15 bp, Homo sapiens
tgtttgccaagctga

SEQ ID NO: 6552222 - DNA, 18 bp, Homo sapiens
tgtttgccaggacatgca

SEQ ID NO: 6552223 - DNA, 20 bp, Homo sapiens
tgtttgccctgttcaaagta

SEQ ID NO: 6552224 - DNA, 18 bp, Homo sapiens
tgtttgccctttggccag

SEQ ID NO: 6552225 - DNA, 10 bp, Homo sapiens
tgtttgcctc

SEQ ID NO: 6552226 - DNA, 19 bp, Homo sapiens
tgtttgcctttaggcagga

SEQ ID NO: 6552227 - DNA, 22 bp, Homo sapiens
tgtttgcctttaggcaggaagt

SEQ ID NO: 6552228 - DNA, 22 bp, Homo sapiens
tgtttgcgcttgaccatgttgc

SEQ ID NO: 6552229 - DNA, 14 bp, Homo sapiens
tgtttgctaattaa

SEQ ID NO: 6552230 - DNA, 20 bp, Homo sapiens
tgtttgctatgactacattt

SEQ ID NO: 6552231 - DNA, 17 bp, Homo sapiens
tgtttgctcagaacaca

SEQ ID NO: 6552232 - DNA, 23 bp, Homo sapiens
tgtttgctccccttccccttcct

SEQ ID NO: 6552233 - DNA, 17 bp, Homo sapiens
tgtttgctctaaattaa

SEQ ID NO: 6552234 - DNA, 17 bp, Homo sapiens
tgtttgctgatccccaa

SEQ ID NO: 6552235 - DNA, 14 bp, Homo sapiens
tgtttgctgcagag

SEQ ID NO: 6552236 - DNA, 15 bp, Homo sapiens
tgtttgctgttgggt

SEQ ID NO: 6552237 - DNA, 14 bp, Homo sapiens
tgtttgcttaaaat

SEQ ID NO: 6552238 - DNA, 16 bp, Homo sapiens
tgtttgcttaaaatat

SEQ ID NO: 6552239 - DNA, 17 bp, Homo sapiens
tgtttgcttaaacaaag

SEQ ID NO: 6552240 - DNA, 13 bp, Homo sapiens
tgtttgcttaatt

SEQ ID NO: 6552241 - DNA, 15 bp, Homo sapiens
tgtttgcttcaactg

SEQ ID NO: 6552242 - DNA, 18 bp, Homo sapiens
tgtttgcttcataaatga

SEQ ID NO: 6552243 - DNA, 12 bp, Homo sapiens
tgtttgcttctt

SEQ ID NO: 6552244 - DNA, 16 bp, Homo sapiens
tgtttgcttcttgcca

SEQ ID NO: 6552245 - DNA, 22 bp, Homo sapiens
tgtttgcttcttgccatcactg

SEQ ID NO: 6552246 - DNA, 19 bp, Homo sapiens
tgtttgcttggaaattcct

SEQ ID NO: 6552247 - DNA, 13 bp, Homo sapiens
tgtttgcttggtg

SEQ ID NO: 6552248 - DNA, 12 bp, Homo sapiens
tgtttgctttct

SEQ ID NO: 6552249 - DNA, 22 bp, Homo sapiens
tgtttgctttctgatcaaggcc

SEQ ID NO: 6552250 - DNA, 16 bp, Homo sapiens
tgtttggaaaagacag

SEQ ID NO: 6552251 - DNA, 14 bp, Homo sapiens
tgtttggaaaccac

SEQ ID NO: 6552252 - DNA, 22 bp, Homo sapiens
tgtttggaaatggggagctggc

SEQ ID NO: 6552253 - DNA, 23 bp, Homo sapiens
tgtttggaaatggggagctggcc

SEQ ID NO: 6552254 - DNA, 24 bp, Homo sapiens
tgtttggaaatggggagctggcct

SEQ ID NO: 6552255 - DNA, 20 bp, Homo sapiens
tgtttggactgttttcaata

SEQ ID NO: 6552256 - DNA, 15 bp, Homo sapiens
tgtttggagacattc

SEQ ID NO: 6552257 - DNA, 15 bp, Homo sapiens
tgtttggaggagcaa

SEQ ID NO: 6552258 - DNA, 18 bp, Homo sapiens
tgtttggagttaaaatgt

SEQ ID NO: 6552259 - DNA, 18 bp, Homo sapiens
tgtttggatacatctgct

SEQ ID NO: 6552260 - DNA, 16 bp, Homo sapiens
tgtttggattcctcac

SEQ ID NO: 6552261 - DNA, 22 bp, Homo sapiens
tgtttggatttcctttatactg

SEQ ID NO: 6552262 - DNA, 22 bp, Homo sapiens
tgtttggatttttaattaaaaa

SEQ ID NO: 6552263 - DNA, 17 bp, Homo sapiens
tgtttggcaatgcactg

SEQ ID NO: 6552264 - DNA, 15 bp, Homo sapiens
tgtttggcacttgta

SEQ ID NO: 6552265 - DNA, 16 bp, Homo sapiens
tgtttggcacttgtat

SEQ ID NO: 6552266 - DNA, 11 bp, Homo sapiens
tgtttggctgg

SEQ ID NO: 6552267 - DNA, 20 bp, Homo sapiens
tgtttggcttataaacacat

SEQ ID NO: 6552268 - DNA, 14 bp, Homo sapiens
tgtttggctttcag

SEQ ID NO: 6552269 - DNA, 15 bp, Homo sapiens
tgtttgggagactgt

SEQ ID NO: 6552270 - DNA, 16 bp, Homo sapiens
tgtttgggccactgcc

SEQ ID NO: 6552271 - DNA, 21 bp, Homo sapiens
tgtttggggaagttcaagtga

SEQ ID NO: 6552272 - DNA, 15 bp, Homo sapiens
tgtttggggatgaga

SEQ ID NO: 6552273 - DNA, 22 bp, Homo sapiens
tgtttgggggaaaaaaaagaaa

SEQ ID NO: 6552274 - DNA, 19 bp, Homo sapiens
tgtttgggggacgtttctc

SEQ ID NO: 6552275 - DNA, 21 bp, Homo sapiens
tgtttgggggacgtttctcat

SEQ ID NO: 6552276 - DNA, 23 bp, Homo sapiens
tgtttggggtgtttcaaaagtgg

SEQ ID NO: 6552277 - DNA, 21 bp, Homo sapiens
tgtttgggtcttttatacatg

SEQ ID NO: 6552278 - DNA, 23 bp, Homo sapiens
tgtttgggtggtttgtgagcctt

SEQ ID NO: 6552279 - DNA, 14 bp, Homo sapiens
tgtttggtaaatgt

SEQ ID NO: 6552280 - DNA, 19 bp, Homo sapiens
tgtttggtaacgaatttaa

SEQ ID NO: 6552281 - DNA, 21 bp, Homo sapiens
tgtttggtataaattaatttg

SEQ ID NO: 6552282 - DNA, 17 bp, Homo sapiens
tgtttggtattgtattt

SEQ ID NO: 6552283 - DNA, 23 bp, Homo sapiens
tgtttggtgtaggtaaatctagt

SEQ ID NO: 6552284 - DNA, 14 bp, Homo sapiens
tgtttggttatagt

SEQ ID NO: 6552285 - DNA, 18 bp, Homo sapiens
tgtttggttgtaaatgct

SEQ ID NO: 6552286 - DNA, 20 bp, Homo sapiens
ttgtctgccgtgagagccca

SEQ ID NO: 6552287 - DNA, 13 bp, Homo sapiens
ttgtctgcgcctg

SEQ ID NO: 6552288 - DNA, 20 bp, Homo sapiens
ttgtctgcgcctgaaaaggg

SEQ ID NO: 6552289 - DNA, 11 bp, Homo sapiens
ttgtctgctgc

SEQ ID NO: 6552290 - DNA, 15 bp, Homo sapiens
ttgtctggaagaaag

SEQ ID NO: 6552291 - DNA, 23 bp, Homo sapiens
ttgtctggataccagatatttga

SEQ ID NO: 6552292 - DNA, 21 bp, Homo sapiens
ttgtctggctgtggcccctcc

SEQ ID NO: 6552293 - DNA, 23 bp, Homo sapiens
ttgtctggggccgaggggccagg

SEQ ID NO: 6552294 - DNA, 17 bp, Homo sapiens
ttgtctggttaaaaaat

SEQ ID NO: 6552295 - DNA, 12 bp, Homo sapiens
ttgtctgtaaaa

SEQ ID NO: 6552296 - DNA, 12 bp, Homo sapiens
ttgtctgtacat

SEQ ID NO: 6552297 - DNA, 20 bp, Homo sapiens
ttgtctgtacatactggcct

SEQ ID NO: 6552298 - DNA, 11 bp, Homo sapiens
ttgtctgtcct

SEQ ID NO: 6552299 - DNA, 11 bp, Homo sapiens
ttgtctgtctc

SEQ ID NO: 6552300 - DNA, 19 bp, Homo sapiens
ttgtctgtgatctctgctg

SEQ ID NO: 6552301 - DNA, 21 bp, Homo sapiens
ttgtctgtgatctctgctggg

SEQ ID NO: 6552302 - DNA, 14 bp, Homo sapiens
ttgtctgtgcagct

SEQ ID NO: 6552303 - DNA, 21 bp, Homo sapiens
ttgtctgtgtatttctatttt

SEQ ID NO: 6552304 - DNA, 15 bp, Homo sapiens
ttgtctgtgtgctgt

SEQ ID NO: 6552305 - DNA, 22 bp, Homo sapiens
ttgtcttaaaaagtggaaaaat

SEQ ID NO: 6552306 - DNA, 13 bp, Homo sapiens
ttgtcttaaataa

SEQ ID NO: 6552307 - DNA, 17 bp, Homo sapiens
ttgtcttaagtgtttct

SEQ ID NO: 6552308 - DNA, 19 bp, Homo sapiens
ttgtcttaagtgtttctca

SEQ ID NO: 6552309 - DNA, 21 bp, Homo sapiens
ttgtcttaccacagtgtttta

SEQ ID NO: 6552310 - DNA, 22 bp, Homo sapiens
ttgtcttaccacagtgttttat

SEQ ID NO: 6552311 - DNA, 13 bp, Homo sapiens
ttgtcttatatat

SEQ ID NO: 6552312 - DNA, 18 bp, Homo sapiens
ttgtcttatgtgaaaaat

SEQ ID NO: 6552313 - DNA, 23 bp, Homo sapiens
ttgtcttattcctaattcctgta

SEQ ID NO: 6552314 - DNA, 16 bp, Homo sapiens
ttgtcttattcttaag

SEQ ID NO: 6552315 - DNA, 12 bp, Homo sapiens
ttgtcttattga

SEQ ID NO: 6552316 - DNA, 18 bp, Homo sapiens
ttgtcttcagcagtcaat

SEQ ID NO: 6552317 - DNA, 17 bp, Homo sapiens
ttgtcttccaaccccag

SEQ ID NO: 6552318 - DNA, 18 bp, Homo sapiens
ttgtcttccaaccccagc

SEQ ID NO: 6552319 - DNA, 19 bp, Homo sapiens
ttgtcttccaaccccagct

SEQ ID NO: 6552320 - DNA, 22 bp, Homo sapiens
ttgtcttccaaccccagctggc

SEQ ID NO: 6552321 - DNA, 12 bp, Homo sapiens
ttgtcttccccc

SEQ ID NO: 6552322 - DNA, 13 bp, Homo sapiens
ttgtcttcccccc

SEQ ID NO: 6552323 - DNA, 21 bp, Homo sapiens
ttgtcttcccccctctcctcc

SEQ ID NO: 6552324 - DNA, 23 bp, Homo sapiens
ttgtcttcccccctctcctccca

SEQ ID NO: 6552325 - DNA, 11 bp, Homo sapiens
ttgtcttccct

SEQ ID NO: 6552326 - DNA, 15 bp, Homo sapiens
ttgtcttcccttctt

SEQ ID NO: 6552327 - DNA, 18 bp, Homo sapiens
ttgtcttcgctggctcct

SEQ ID NO: 6552328 - DNA, 16 bp, Homo sapiens
ttgtcttctccccagg

SEQ ID NO: 6552329 - DNA, 22 bp, Homo sapiens
ttgtcttgaaaaaaaatagatg

SEQ ID NO: 6552330 - DNA, 16 bp, Homo sapiens
ttgtcttgaaaactgt

SEQ ID NO: 6552331 - DNA, 22 bp, Homo sapiens
ttgtcttgaaacctttctactt

SEQ ID NO: 6552332 - DNA, 13 bp, Homo sapiens
ttgtcttgaaaga

SEQ ID NO: 6552333 - DNA, 18 bp, Homo sapiens
ttgtcttgccttattaaa

SEQ ID NO: 6552334 - DNA, 16 bp, Homo sapiens
ttgtcttgtaattgtg

SEQ ID NO: 6552335 - DNA, 13 bp, Homo sapiens
ttgtcttgtactt

SEQ ID NO: 6552336 - DNA, 13 bp, Homo sapiens
ttgtcttgtggag

SEQ ID NO: 6552337 - DNA, 18 bp, Homo sapiens
ttgtcttgtgtatttcag

SEQ ID NO: 6552338 - DNA, 19 bp, Homo sapiens
ttgtcttgttatgtacaaa

SEQ ID NO: 6552339 - DNA, 21 bp, Homo sapiens
ttgtcttgttctgtcccttcc

SEQ ID NO: 6552340 - DNA, 22 bp, Homo sapiens
ttgtcttgttctgtcccttcca

SEQ ID NO: 6552341 - DNA, 14 bp, Homo sapiens
ttgtctttaaagtt

SEQ ID NO: 6552342 - DNA, 14 bp, Homo sapiens
ttgtctttaactgt

SEQ ID NO: 6552343 - DNA, 14 bp, Homo sapiens
ttgtctttaatata

SEQ ID NO: 6552344 - DNA, 19 bp, Homo sapiens
ttgtctttagtgccggctg

SEQ ID NO: 6552345 - DNA, 23 bp, Homo sapiens
ttgtctttattagattttcctcc

SEQ ID NO: 6552346 - DNA, 12 bp, Homo sapiens
ttgtctttattt

SEQ ID NO: 6552347 - DNA, 13 bp, Homo sapiens
ttgtctttcatgg

SEQ ID NO: 6552348 - DNA, 13 bp, Homo sapiens
ttgtctttcctta

SEQ ID NO: 6552349 - DNA, 15 bp, Homo sapiens
ttgtctttctttgct

SEQ ID NO: 6552350 - DNA, 12 bp, Homo sapiens
ttgtctttgctg

SEQ ID NO: 6552351 - DNA, 14 bp, Homo sapiens
ttgtctttgctgta

SEQ ID NO: 6552352 - DNA, 19 bp, Homo sapiens
ttgtctttgctgtactctt

SEQ ID NO: 6552353 - DNA, 18 bp, Homo sapiens
ttgtctttggaaaattca

SEQ ID NO: 6552354 - DNA, 15 bp, Homo sapiens
ttgtctttggaccct

SEQ ID NO: 6552355 - DNA, 18 bp, Homo sapiens
ttgtcttttcaaaatatt

SEQ ID NO: 6552356 - DNA, 20 bp, Homo sapiens
ttgtcttttcagaagcaagc

SEQ ID NO: 6552357 - DNA, 19 bp, Homo sapiens
ttgtcttttgacatccagc

SEQ ID NO: 6552358 - DNA, 14 bp, Homo sapiens
ttgtcttttgtaaa

SEQ ID NO: 6552359 - DNA, 13 bp, Homo sapiens
ttgtctttttaga

SEQ ID NO: 6552360 - DNA, 19 bp, Homo sapiens
ttgtctttttagatgccca

SEQ ID NO: 6552361 - DNA, 12 bp, Homo sapiens
ttgtctttttat

SEQ ID NO: 6552362 - DNA, 22 bp, Homo sapiens
ttgtctttttcctactccgttc

SEQ ID NO: 6552363 - DNA, 16 bp, Homo sapiens
ttgtctttttccttta

SEQ ID NO: 6552364 - DNA, 19 bp, Homo sapiens
ttgtcttttttttcctttg

SEQ ID NO: 6552365 - DNA, 22 bp, Homo sapiens
ttgtgaaaaaaatgaaataaag

SEQ ID NO: 6552366 - DNA, 19 bp, Homo sapiens
ttgtgaaagaggtcccaag

SEQ ID NO: 6552367 - DNA, 11 bp, Homo sapiens
ttgtgaaagca

SEQ ID NO: 6552368 - DNA, 20 bp, Homo sapiens
ttgtgaaaggaaagaggctc

SEQ ID NO: 6552369 - DNA, 20 bp, Homo sapiens
ttgtgaaagtggcaagctct

SEQ ID NO: 6552370 - DNA, 17 bp, Homo sapiens
ttgtgaaatcagtatca

SEQ ID NO: 6552371 - DNA, 21 bp, Homo sapiens
ttgtgaaatcagtatcagaat

SEQ ID NO: 6552372 - DNA, 13 bp, Homo sapiens
ttgtgaaatgtaa

SEQ ID NO: 6552373 - DNA, 15 bp, Homo sapiens
ttgtgaaatgtaaca

SEQ ID NO: 6552374 - DNA, 15 bp, Homo sapiens
ttgtgaaatgtctgt

SEQ ID NO: 6552375 - DNA, 13 bp, Homo sapiens
ttgtgaaattatt

SEQ ID NO: 6552376 - DNA, 20 bp, Homo sapiens
ttgtgaaattcaacctgtgt

SEQ ID NO: 6552377 - DNA, 13 bp, Homo sapiens
ttgtgaaattgtg

SEQ ID NO: 6552378 - DNA, 14 bp, Homo sapiens
ttgtgaaatttcat

SEQ ID NO: 6552379 - DNA, 14 bp, Homo sapiens
ttgtgaaatttgtt

SEQ ID NO: 6552380 - DNA, 23 bp, Homo sapiens
ttgtgaaatttgttaatatatat

SEQ ID NO: 6552381 - DNA, 17 bp, Homo sapiens
ttgtgaaatttttcata

SEQ ID NO: 6552382 - DNA, 19 bp, Homo sapiens
ttgtgaaatttttcatatt

SEQ ID NO: 6552383 - DNA, 19 bp, Homo sapiens
ttgtgaacaagtccctgta

SEQ ID NO: 6552384 - DNA, 15 bp, Homo sapiens
ttgtgaacagaagtc

SEQ ID NO: 6552385 - DNA, 22 bp, Homo sapiens
ttgtgaacatgatagttaaact

SEQ ID NO: 6552386 - DNA, 23 bp, Homo sapiens
ttgtgaactcagccaagcacagt

SEQ ID NO: 6552387 - DNA, 15 bp, Homo sapiens
ttgtgaactgctgga

SEQ ID NO: 6552388 - DNA, 14 bp, Homo sapiens
ttgtgaactggaag

SEQ ID NO: 6552389 - DNA, 14 bp, Homo sapiens
ttgtgaactgtctt

SEQ ID NO: 6552390 - DNA, 22 bp, Homo sapiens
ttgtgaagaaacatttatcttt

SEQ ID NO: 6552391 - DNA, 22 bp, Homo sapiens
ttgtgaagaactattttattct

SEQ ID NO: 6552392 - DNA, 11 bp, Homo sapiens
ttgtgaagaat

SEQ ID NO: 6552393 - DNA, 11 bp, Homo sapiens
ttgtgaagagg

SEQ ID NO: 6552394 - DNA, 22 bp, Homo sapiens
ttgtgaaggaaaaacatgctta

SEQ ID NO: 6552395 - DNA, 18 bp, Homo sapiens
ttgtgaaggattatggaa

SEQ ID NO: 6552396 - DNA, 22 bp, Homo sapiens
ttgtgaaggcaggggaatgtat

SEQ ID NO: 6552397 - DNA, 14 bp, Homo sapiens
ttgtgaaggccatg

SEQ ID NO: 6552398 - DNA, 20 bp, Homo sapiens
ttgtgaagtgattgacattt

SEQ ID NO: 6552399 - DNA, 21 bp, Homo sapiens
ttgtgaagttaggttcttaaa

SEQ ID NO: 6552400 - DNA, 14 bp, Homo sapiens
ttgtgaataaagag

SEQ ID NO: 6552401 - DNA, 13 bp, Homo sapiens
ttgtgaataatta

SEQ ID NO: 6552402 - DNA, 14 bp, Homo sapiens
ttgtgaataattac

SEQ ID NO: 6552403 - DNA, 15 bp, Homo sapiens
ttgtgaatgcttctc

SEQ ID NO: 6552404 - DNA, 13 bp, Homo sapiens
ttgtgaatggatt

SEQ ID NO: 6552405 - DNA, 21 bp, Homo sapiens
ttgtgaatggattggattatt

SEQ ID NO: 6552406 - DNA, 21 bp, Homo sapiens
ttgtgaatgtatttttctgtt

SEQ ID NO: 6552407 - DNA, 16 bp, Homo sapiens
ttgtgaatgttgtcct

SEQ ID NO: 6552408 - DNA, 18 bp, Homo sapiens
ttgtgaattgataataaa

SEQ ID NO: 6552409 - DNA, 16 bp, Homo sapiens
ttgtgacaagaataat

SEQ ID NO: 6552410 - DNA, 23 bp, Homo sapiens
ttgtgacagctctttttgtgaag

SEQ ID NO: 6552411 - DNA, 17 bp, Homo sapiens
ttgtgacaggaaagccc

SEQ ID NO: 6552412 - DNA, 22 bp, Homo sapiens
ttgtgacaggaaagccctcccc

SEQ ID NO: 6552413 - DNA, 21 bp, Homo sapiens
ttgtgacagggcgggggtggc

SEQ ID NO: 6552414 - DNA, 19 bp, Homo sapiens
ttgtgacagtcactgcatt

SEQ ID NO: 6552415 - DNA, 13 bp, Homo sapiens
ttgtgacattaaa

SEQ ID NO: 6552416 - DNA, 16 bp, Homo sapiens
ttgtgaccaagttata

SEQ ID NO: 6552417 - DNA, 18 bp, Homo sapiens
ttgtgaccaatacatttg

SEQ ID NO: 6552418 - DNA, 21 bp, Homo sapiens
ttgtgaccaatacatttgtat

SEQ ID NO: 6552419 - DNA, 12 bp, Homo sapiens
ttgtgaccacag

SEQ ID NO: 6552420 - DNA, 19 bp, Homo sapiens
ttgtgactaagttgcaaga

SEQ ID NO: 6552421 - DNA, 14 bp, Homo sapiens
ttgtgactaattgt

SEQ ID NO: 6552422 - DNA, 15 bp, Homo sapiens
ttgtgactatataga

SEQ ID NO: 6552423 - DNA, 22 bp, Homo sapiens
ttgtgactatatagagatgttt

SEQ ID NO: 6552424 - DNA, 20 bp, Homo sapiens
ttgtgactcagcagaggcag

SEQ ID NO: 6552425 - DNA, 12 bp, Homo sapiens
ttgtgactggca

SEQ ID NO: 6552426 - DNA, 17 bp, Homo sapiens
ttgtgacttcactgtat

SEQ ID NO: 6552427 - DNA, 18 bp, Homo sapiens
ttgtgacttcactgtata

SEQ ID NO: 6552428 - DNA, 23 bp, Homo sapiens
ttgtgacttcttcttctttgttt

SEQ ID NO: 6552429 - DNA, 11 bp, Homo sapiens
ttgtgactttt

SEQ ID NO: 6552430 - DNA, 20 bp, Homo sapiens
ttgtgacttttagacagtgg

SEQ ID NO: 6552431 - DNA, 17 bp, Homo sapiens
ttgtgacttttgcttta

SEQ ID NO: 6552432 - DNA, 9 bp, Homo sapiens
ttgtgagaa

SEQ ID NO: 6552433 - DNA, 21 bp, Homo sapiens
ttgtgagaaacatctcaataa

SEQ ID NO: 6552434 - DNA, 19 bp, Homo sapiens
ttgtgagaagatgggggct

SEQ ID NO: 6552435 - DNA, 13 bp, Homo sapiens
ttgtgagaatggc

SEQ ID NO: 6552436 - DNA, 15 bp, Homo sapiens
ttgtgagaattactg

SEQ ID NO: 6552437 - DNA, 11 bp, Homo sapiens
ttgtgagagcg

SEQ ID NO: 6552438 - DNA, 20 bp, Homo sapiens
ttgtgagagtggctttctac

SEQ ID NO: 6552439 - DNA, 12 bp, Homo sapiens
ttgtgagatggg

SEQ ID NO: 6552440 - DNA, 16 bp, Homo sapiens
ttgtgagccctctagg

SEQ ID NO: 6552441 - DNA, 20 bp, Homo sapiens
ttgtgagccttgctgccaag

SEQ ID NO: 6552442 - DNA, 21 bp, Homo sapiens
ttgtgagccttgctgccaagt

SEQ ID NO: 6552443 - DNA, 15 bp, Homo sapiens
ttgtgagctttttgt

SEQ ID NO: 6552444 - DNA, 19 bp, Homo sapiens
ttgtgagctttttgttccc

SEQ ID NO: 6552445 - DNA, 16 bp, Homo sapiens
ttgtgagggacatgct

SEQ ID NO: 6552446 - DNA, 14 bp, Homo sapiens
ttgtgagggagaga

SEQ ID NO: 6552447 - DNA, 20 bp, Homo sapiens
ttgtgagtaaatcagatgtt

SEQ ID NO: 6552448 - DNA, 18 bp, Homo sapiens
ttgtgagtgtgtgcacag

SEQ ID NO: 6552449 - DNA, 16 bp, Homo sapiens
ttgtgagttaatttga

SEQ ID NO: 6552450 - DNA, 22 bp, Homo sapiens
ttgtgagtttaccttgtatact

SEQ ID NO: 6552451 - DNA, 21 bp, Homo sapiens
ttgtgagtttgtttctttgaa

SEQ ID NO: 6552452 - DNA, 22 bp, Homo sapiens
ttgtgagtttgtttctttgaat

SEQ ID NO: 6552453 - DNA, 22 bp, Homo sapiens
ttgtgataagttctagttgctt

SEQ ID NO: 6552454 - DNA, 16 bp, Homo sapiens
ttgtgataatagcatt

SEQ ID NO: 6552455 - DNA, 20 bp, Homo sapiens
ttgtgataatagcatttttg

SEQ ID NO: 6552456 - DNA, 20 bp, Homo sapiens
ttgtgatacaatgctgtgcc

SEQ ID NO: 6552457 - DNA, 16 bp, Homo sapiens
ttgtgatatatgtatt

SEQ ID NO: 6552458 - DNA, 21 bp, Homo sapiens
ttgtgatatgcacaatgtaga

SEQ ID NO: 6552459 - DNA, 17 bp, Homo sapiens
ttgtgatatggagccct

SEQ ID NO: 6552460 - DNA, 17 bp, Homo sapiens
ttgtgatcagcattgtg

SEQ ID NO: 6552461 - DNA, 15 bp, Homo sapiens
ttgtgatcttgctct

SEQ ID NO: 6552462 - DNA, 20 bp, Homo sapiens
ttgtgatgaatctacatttg

SEQ ID NO: 6552463 - DNA, 20 bp, Homo sapiens
ttgtgatggaggggagaggg

SEQ ID NO: 6552464 - DNA, 17 bp, Homo sapiens
ttgtgatgtgcacgtaa

SEQ ID NO: 6552465 - DNA, 22 bp, Homo sapiens
ttgtgatgtttgctcagaggaa

SEQ ID NO: 6552466 - DNA, 14 bp, Homo sapiens
tgtttggtttacat

SEQ ID NO: 6552467 - DNA, 13 bp, Homo sapiens
tgtttggttttac

SEQ ID NO: 6552468 - DNA, 14 bp, Homo sapiens
tgtttggttttaca

SEQ ID NO: 6552469 - DNA, 18 bp, Homo sapiens
tgtttgtaaataagagat

SEQ ID NO: 6552470 - DNA, 19 bp, Homo sapiens
tgtttgtaaataagagatt

SEQ ID NO: 6552471 - DNA, 16 bp, Homo sapiens
tgtttgtaaatgcctc

SEQ ID NO: 6552472 - DNA, 22 bp, Homo sapiens
tgtttgtaaatgcctcttaaat

SEQ ID NO: 6552473 - DNA, 15 bp, Homo sapiens
tgtttgtaaattaat

SEQ ID NO: 6552474 - DNA, 13 bp, Homo sapiens
tgtttgtaagatt

SEQ ID NO: 6552475 - DNA, 14 bp, Homo sapiens
tgtttgtaagcaat

SEQ ID NO: 6552476 - DNA, 17 bp, Homo sapiens
tgtttgtaagtgaagtg

SEQ ID NO: 6552477 - DNA, 23 bp, Homo sapiens
tgtttgtaatcattatctcactt

SEQ ID NO: 6552478 - DNA, 14 bp, Homo sapiens
tgtttgtacaaact

SEQ ID NO: 6552479 - DNA, 14 bp, Homo sapiens
tgtttgtacagtaa

SEQ ID NO: 6552480 - DNA, 20 bp, Homo sapiens
tgtttgtactggttcattgt

SEQ ID NO: 6552481 - DNA, 18 bp, Homo sapiens
tgtttgtagccaatacat

SEQ ID NO: 6552482 - DNA, 23 bp, Homo sapiens
tgtttgtagccaatacatggtgt

SEQ ID NO: 6552483 - DNA, 16 bp, Homo sapiens
tgtttgtagctttcct

SEQ ID NO: 6552484 - DNA, 13 bp, Homo sapiens
tgtttgtatgaaa

SEQ ID NO: 6552485 - DNA, 14 bp, Homo sapiens
tgtttgtatgaaat

SEQ ID NO: 6552486 - DNA, 15 bp, Homo sapiens
tgtttgtatgtctgt

SEQ ID NO: 6552487 - DNA, 15 bp, Homo sapiens
tgtttgtattcatgt

SEQ ID NO: 6552488 - DNA, 16 bp, Homo sapiens
tgtttgtattgtaaaa

SEQ ID NO: 6552489 - DNA, 15 bp, Homo sapiens
tgtttgtatttggaa

SEQ ID NO: 6552490 - DNA, 21 bp, Homo sapiens
tgtttgtattttttatttaca

SEQ ID NO: 6552491 - DNA, 22 bp, Homo sapiens
tgtttgtattttttatttacat

SEQ ID NO: 6552492 - DNA, 23 bp, Homo sapiens
tgtttgtattttttatttacatt

SEQ ID NO: 6552493 - DNA, 19 bp, Homo sapiens
tgtttgtatttttttccaa

SEQ ID NO: 6552494 - DNA, 16 bp, Homo sapiens
tgtttgtcagatatga

SEQ ID NO: 6552495 - DNA, 16 bp, Homo sapiens
tgtttgtcatggtgaa

SEQ ID NO: 6552496 - DNA, 13 bp, Homo sapiens
tgtttgtccagtt

SEQ ID NO: 6552497 - DNA, 14 bp, Homo sapiens
tgtttgtcctgggt

SEQ ID NO: 6552498 - DNA, 16 bp, Homo sapiens
tgtttgtcctgggttc

SEQ ID NO: 6552499 - DNA, 15 bp, Homo sapiens
tgtttgtctctcctt

SEQ ID NO: 6552500 - DNA, 18 bp, Homo sapiens
tgtttgtctctccttttc

SEQ ID NO: 6552501 - DNA, 15 bp, Homo sapiens
tgtttgtctcttctg

SEQ ID NO: 6552502 - DNA, 16 bp, Homo sapiens
tgtttgtctgaacaaa

SEQ ID NO: 6552503 - DNA, 15 bp, Homo sapiens
tgtttgtctggattg

SEQ ID NO: 6552504 - DNA, 19 bp, Homo sapiens
tgtttgtctgtcttcatag

SEQ ID NO: 6552505 - DNA, 16 bp, Homo sapiens
tgtttgtcttctcccc

SEQ ID NO: 6552506 - DNA, 15 bp, Homo sapiens
tgtttgtgagtatgt

SEQ ID NO: 6552507 - DNA, 17 bp, Homo sapiens
tgtttgtgatggtctct

SEQ ID NO: 6552508 - DNA, 15 bp, Homo sapiens
tgtttgtgcaaacat

SEQ ID NO: 6552509 - DNA, 17 bp, Homo sapiens
tgtttgtgcaaacataa

SEQ ID NO: 6552510 - DNA, 13 bp, Homo sapiens
tgtttgtgcatcc

SEQ ID NO: 6552511 - DNA, 18 bp, Homo sapiens
tgtttgtgctctgttcca

SEQ ID NO: 6552512 - DNA, 14 bp, Homo sapiens
tgtttgtgctgtgg

SEQ ID NO: 6552513 - DNA, 13 bp, Homo sapiens
tgtttgtgcttca

SEQ ID NO: 6552514 - DNA, 16 bp, Homo sapiens
tgtttgtggaatggat

SEQ ID NO: 6552515 - DNA, 17 bp, Homo sapiens
tgtttgtggaatggatt

SEQ ID NO: 6552516 - DNA, 13 bp, Homo sapiens
tgtttgtggcctc

SEQ ID NO: 6552517 - DNA, 14 bp, Homo sapiens
tgtttgtggcctca

SEQ ID NO: 6552518 - DNA, 18 bp, Homo sapiens
tgtttgtgtccataagag

SEQ ID NO: 6552519 - DNA, 14 bp, Homo sapiens
tgtttgtgtctgac

SEQ ID NO: 6552520 - DNA, 13 bp, Homo sapiens
tgtttgtgtctgt

SEQ ID NO: 6552521 - DNA, 16 bp, Homo sapiens
tgtttgttactgtcat

SEQ ID NO: 6552522 - DNA, 18 bp, Homo sapiens
tgtttgttactgtcattc

SEQ ID NO: 6552523 - DNA, 12 bp, Homo sapiens
tgtttgttatgg

SEQ ID NO: 6552524 - DNA, 16 bp, Homo sapiens
tgtttgttcacactcc

SEQ ID NO: 6552525 - DNA, 21 bp, Homo sapiens
tgtttgttcacatatgattct

SEQ ID NO: 6552526 - DNA, 15 bp, Homo sapiens
tgtttgttcatctgt

SEQ ID NO: 6552527 - DNA, 15 bp, Homo sapiens
tgtttgttctcttat

SEQ ID NO: 6552528 - DNA, 16 bp, Homo sapiens
tgtttgttgacagctt

SEQ ID NO: 6552529 - DNA, 23 bp, Homo sapiens
tgtttgttgccccattcctaaga

SEQ ID NO: 6552530 - DNA, 16 bp, Homo sapiens
tgtttgttgctggctt

SEQ ID NO: 6552531 - DNA, 17 bp, Homo sapiens
tgtttgttgctggcttg

SEQ ID NO: 6552532 - DNA, 23 bp, Homo sapiens
tgtttgttggatccgtttgacca

SEQ ID NO: 6552533 - DNA, 11 bp, Homo sapiens
tgtttgttggt

SEQ ID NO: 6552534 - DNA, 15 bp, Homo sapiens
tgtttgttgtagatt

SEQ ID NO: 6552535 - DNA, 11 bp, Homo sapiens
tgtttgtttaa

SEQ ID NO: 6552536 - DNA, 16 bp, Homo sapiens
tgtttgtttaagctga

SEQ ID NO: 6552537 - DNA, 13 bp, Homo sapiens
tgtttgtttaatt

SEQ ID NO: 6552538 - DNA, 12 bp, Homo sapiens
tgtttgtttagt

SEQ ID NO: 6552539 - DNA, 21 bp, Homo sapiens
tgtttgtttatatcactgtct

SEQ ID NO: 6552540 - DNA, 15 bp, Homo sapiens
tgtttgtttcaagaa

SEQ ID NO: 6552541 - DNA, 17 bp, Homo sapiens
tgtttgtttcctttgtt

SEQ ID NO: 6552542 - DNA, 23 bp, Homo sapiens
tgtttgtttcttcttttccttta

SEQ ID NO: 6552543 - DNA, 15 bp, Homo sapiens
tgtttgtttctttgt

SEQ ID NO: 6552544 - DNA, 16 bp, Homo sapiens
tgtttgtttgtctgtt

SEQ ID NO: 6552545 - DNA, 14 bp, Homo sapiens
tgtttgttttggat

SEQ ID NO: 6552546 - DNA, 18 bp, Homo sapiens
tgttttaaaaaaatttga

SEQ ID NO: 6552547 - DNA, 17 bp, Homo sapiens
tgttttaaaaacctgtt

SEQ ID NO: 6552548 - DNA, 18 bp, Homo sapiens
tgttttaaaacgtgtaaa

SEQ ID NO: 6552549 - DNA, 20 bp, Homo sapiens
tgttttaaaacgtgtaaatg

SEQ ID NO: 6552550 - DNA, 19 bp, Homo sapiens
tgttttaaaagtttgtcct

SEQ ID NO: 6552551 - DNA, 14 bp, Homo sapiens
tgttttaaaataag

SEQ ID NO: 6552552 - DNA, 23 bp, Homo sapiens
tgttttaaaataagttaaaggca

SEQ ID NO: 6552553 - DNA, 23 bp, Homo sapiens
tgttttaaaatgagaaatctaaa

SEQ ID NO: 6552554 - DNA, 23 bp, Homo sapiens
tgttttaaaatgtgaggcaataa

SEQ ID NO: 6552555 - DNA, 12 bp, Homo sapiens
tgttttaaaatt

SEQ ID NO: 6552556 - DNA, 18 bp, Homo sapiens
tgttttaaaattatatag

SEQ ID NO: 6552557 - DNA, 22 bp, Homo sapiens
tgttttaaaggaataaacttga

SEQ ID NO: 6552558 - DNA, 18 bp, Homo sapiens
tgttttaaatatagaatt

SEQ ID NO: 6552559 - DNA, 23 bp, Homo sapiens
tgttttaaatgtacagacatatt

SEQ ID NO: 6552560 - DNA, 12 bp, Homo sapiens
tgttttaaatta

SEQ ID NO: 6552561 - DNA, 14 bp, Homo sapiens
tgttttaacaaaaa

SEQ ID NO: 6552562 - DNA, 13 bp, Homo sapiens
tgttttaacagat

SEQ ID NO: 6552563 - DNA, 11 bp, Homo sapiens
tgttttaactt

SEQ ID NO: 6552564 - DNA, 23 bp, Homo sapiens
tgttttaagaaatgtagttgatg

SEQ ID NO: 6552565 - DNA, 19 bp, Homo sapiens
tgttttaagactgaatgtt

SEQ ID NO: 6552566 - DNA, 23 bp, Homo sapiens
tgttttaagactgaatgttttat

SEQ ID NO: 6552567 - DNA, 16 bp, Homo sapiens
tgttttaagaggcagg

SEQ ID NO: 6552568 - DNA, 23 bp, Homo sapiens
tgttttaagcaaatgcattctat

SEQ ID NO: 6552569 - DNA, 18 bp, Homo sapiens
tgttttaaggaagaaaaa

SEQ ID NO: 6552570 - DNA, 22 bp, Homo sapiens
tgttttaaggatgcttgtacat

SEQ ID NO: 6552571 - DNA, 18 bp, Homo sapiens
tgttttaagtactacaca

SEQ ID NO: 6552572 - DNA, 20 bp, Homo sapiens
tgttttaataaaagatttac

SEQ ID NO: 6552573 - DNA, 21 bp, Homo sapiens
tgttttaataaacgtttgaaa

SEQ ID NO: 6552574 - DNA, 18 bp, Homo sapiens
tgttttaatctgaaattc

SEQ ID NO: 6552575 - DNA, 16 bp, Homo sapiens
tgttttaattccatga

SEQ ID NO: 6552576 - DNA, 22 bp, Homo sapiens
tgttttaatttaaacacctcct

SEQ ID NO: 6552577 - DNA, 22 bp, Homo sapiens
tgttttaatttatactggcatg

SEQ ID NO: 6552578 - DNA, 17 bp, Homo sapiens
tgttttacaaagaaaca

SEQ ID NO: 6552579 - DNA, 20 bp, Homo sapiens
tgttttacaaagaaacaaaa

SEQ ID NO: 6552580 - DNA, 11 bp, Homo sapiens
tgttttacaac

SEQ ID NO: 6552581 - DNA, 12 bp, Homo sapiens
tgttttacaact

SEQ ID NO: 6552582 - DNA, 13 bp, Homo sapiens
tgttttacaatag

SEQ ID NO: 6552583 - DNA, 22 bp, Homo sapiens
tgttttacaatagttctgtggg

SEQ ID NO: 6552584 - DNA, 16 bp, Homo sapiens
tgttttacaatgattt

SEQ ID NO: 6552585 - DNA, 17 bp, Homo sapiens
tgttttacagtatatct

SEQ ID NO: 6552586 - DNA, 16 bp, Homo sapiens
tgttttaccagctccc

SEQ ID NO: 6552587 - DNA, 21 bp, Homo sapiens
tgttttacctgttctgaaatg

SEQ ID NO: 6552588 - DNA, 14 bp, Homo sapiens
tgttttacgtgcaa

SEQ ID NO: 6552589 - DNA, 16 bp, Homo sapiens
tgttttactaaagaaa

SEQ ID NO: 6552590 - DNA, 16 bp, Homo sapiens
tgttttactgctttta

SEQ ID NO: 6552591 - DNA, 20 bp, Homo sapiens
tgttttactgtcagattaaa

SEQ ID NO: 6552592 - DNA, 22 bp, Homo sapiens
tgttttactgtcagattaaatt

SEQ ID NO: 6552593 - DNA, 15 bp, Homo sapiens
tgttttactgtgaaa

SEQ ID NO: 6552594 - DNA, 20 bp, Homo sapiens
tgttttacttttttaacatg

SEQ ID NO: 6552595 - DNA, 16 bp, Homo sapiens
tgttttagaagttaaa

SEQ ID NO: 6552596 - DNA, 19 bp, Homo sapiens
tgttttagaatgatgcaca

SEQ ID NO: 6552597 - DNA, 20 bp, Homo sapiens
tgttttagacaaatactcat

SEQ ID NO: 6552598 - DNA, 21 bp, Homo sapiens
tgttttagacaaatactcatg

SEQ ID NO: 6552599 - DNA, 23 bp, Homo sapiens
tgttttagacaaatactcatgtg

SEQ ID NO: 6552600 - DNA, 24 bp, Homo sapiens
tgttttagacaaatactcatgtgt

SEQ ID NO: 6552601 - DNA, 18 bp, Homo sapiens
tgttttagagtaagaaat

SEQ ID NO: 6552602 - DNA, 17 bp, Homo sapiens
tgttttagatgttacta

SEQ ID NO: 6552603 - DNA, 12 bp, Homo sapiens
tgttttagcatt

SEQ ID NO: 6552604 - DNA, 16 bp, Homo sapiens
tgttttagctgaggga

SEQ ID NO: 6552605 - DNA, 23 bp, Homo sapiens
tgttttagggagtggttcctgtg

SEQ ID NO: 6552606 - DNA, 23 bp, Homo sapiens
tgttttaggttaaaaaaaggcat

SEQ ID NO: 6552607 - DNA, 20 bp, Homo sapiens
tgttttagtcattaatgtgt

SEQ ID NO: 6552608 - DNA, 21 bp, Homo sapiens
tgttttagtgtttatgtttaa

SEQ ID NO: 6552609 - DNA, 17 bp, Homo sapiens
tgttttagttaaatttc

SEQ ID NO: 6552610 - DNA, 17 bp, Homo sapiens
tgttttagtttctgaac

SEQ ID NO: 6552611 - DNA, 18 bp, Homo sapiens
tgttttagtttctgaact

SEQ ID NO: 6552612 - DNA, 13 bp, Homo sapiens
tgttttataaaat

SEQ ID NO: 6552613 - DNA, 12 bp, Homo sapiens
tgttttataaat

SEQ ID NO: 6552614 - DNA, 14 bp, Homo sapiens
tgttttataaatgg

SEQ ID NO: 6552615 - DNA, 22 bp, Homo sapiens
tgttttataagttcacaaaatg

SEQ ID NO: 6552616 - DNA, 16 bp, Homo sapiens
tgttttataattagtc

SEQ ID NO: 6552617 - DNA, 20 bp, Homo sapiens
tgttttataattttgtgaag

SEQ ID NO: 6552618 - DNA, 11 bp, Homo sapiens
tgttttatata

SEQ ID NO: 6552619 - DNA, 17 bp, Homo sapiens
tgttttatatagcaaga

SEQ ID NO: 6552620 - DNA, 16 bp, Homo sapiens
tgttttatatgattaa

SEQ ID NO: 6552621 - DNA, 12 bp, Homo sapiens
tgttttatcatg

SEQ ID NO: 6552622 - DNA, 23 bp, Homo sapiens
tgttttatcatgacatgttatat

SEQ ID NO: 6552623 - DNA, 12 bp, Homo sapiens
tgttttatcctt

SEQ ID NO: 6552624 - DNA, 16 bp, Homo sapiens
tgttttatccttacaa

SEQ ID NO: 6552625 - DNA, 23 bp, Homo sapiens
tgttttatctccatactttggat

SEQ ID NO: 6552626 - DNA, 15 bp, Homo sapiens
tgttttatctcctgt

SEQ ID NO: 6552627 - DNA, 16 bp, Homo sapiens
tgttttatctctgtga

SEQ ID NO: 6552628 - DNA, 20 bp, Homo sapiens
tgttttatggcctaaattta

SEQ ID NO: 6552629 - DNA, 18 bp, Homo sapiens
tgttttatgtcatactct

SEQ ID NO: 6552630 - DNA, 21 bp, Homo sapiens
tgttttatgtcatactctgtg

SEQ ID NO: 6552631 - DNA, 14 bp, Homo sapiens
tgttttatgttgat

SEQ ID NO: 6552632 - DNA, 15 bp, Homo sapiens
tgttttattactgtt

SEQ ID NO: 6552633 - DNA, 21 bp, Homo sapiens
tgttttattgactgtctttcc

SEQ ID NO: 6552634 - DNA, 22 bp, Homo sapiens
tgttttattgactgtctttcct

SEQ ID NO: 6552635 - DNA, 21 bp, Homo sapiens
tgttttatttaacctctaaat

SEQ ID NO: 6552636 - DNA, 15 bp, Homo sapiens
tgttttatttatgaa

SEQ ID NO: 6552637 - DNA, 19 bp, Homo sapiens
tgttttatttatgaagttt

SEQ ID NO: 6552638 - DNA, 18 bp, Homo sapiens
tgttttatttcattggtt

SEQ ID NO: 6552639 - DNA, 14 bp, Homo sapiens
tgttttattttcaa

SEQ ID NO: 6552640 - DNA, 15 bp, Homo sapiens
tgttttattttcaaa

SEQ ID NO: 6552641 - DNA, 21 bp, Homo sapiens
tgttttcaacctagaaacctt

SEQ ID NO: 6552642 - DNA, 22 bp, Homo sapiens
tgttttcaaggaagaaaacgga

SEQ ID NO: 6552643 - DNA, 22 bp, Homo sapiens
tgttttcaatctcgtatagaag

SEQ ID NO: 6552644 - DNA, 17 bp, Homo sapiens
tgttttcaatgaattaa

SEQ ID NO: 6552645 - DNA, 23 bp, Homo sapiens
ttgtgattatttcactttagatg

SEQ ID NO: 6552646 - DNA, 16 bp, Homo sapiens
ttgtgattggcctgta

SEQ ID NO: 6552647 - DNA, 14 bp, Homo sapiens
ttgtgatttcttta

SEQ ID NO: 6552648 - DNA, 16 bp, Homo sapiens
ttgtgatttgactgtt

SEQ ID NO: 6552649 - DNA, 10 bp, Homo sapiens
ttgtgatttt

SEQ ID NO: 6552650 - DNA, 12 bp, Homo sapiens
ttgtgatttttg

SEQ ID NO: 6552651 - DNA, 17 bp, Homo sapiens
ttgtgatttttgtaatt

SEQ ID NO: 6552652 - DNA, 18 bp, Homo sapiens
ttgtgcaaaagcaggctt

SEQ ID NO: 6552653 - DNA, 14 bp, Homo sapiens
ttgtgcaaaatatt

SEQ ID NO: 6552654 - DNA, 19 bp, Homo sapiens
ttgtgcaatagtcagagtg

SEQ ID NO: 6552655 - DNA, 18 bp, Homo sapiens
ttgtgcaatgtaaatatt

SEQ ID NO: 6552656 - DNA, 19 bp, Homo sapiens
ttgtgcaatgtgtataaac

SEQ ID NO: 6552657 - DNA, 15 bp, Homo sapiens
ttgtgcaattgtctt

SEQ ID NO: 6552658 - DNA, 15 bp, Homo sapiens
ttgtgcacaggcaga

SEQ ID NO: 6552659 - DNA, 14 bp, Homo sapiens
ttgtgcacatttaa

SEQ ID NO: 6552660 - DNA, 21 bp, Homo sapiens
ttgtgcaccctctatcccaat

SEQ ID NO: 6552661 - DNA, 23 bp, Homo sapiens
ttgtgcacttagtagtttttaca

SEQ ID NO: 6552662 - DNA, 16 bp, Homo sapiens
ttgtgcagaaaacatt

SEQ ID NO: 6552663 - DNA, 23 bp, Homo sapiens
ttgtgcagctgacttttctgacc

SEQ ID NO: 6552664 - DNA, 20 bp, Homo sapiens
ttgtgcagtaacttgggagt

SEQ ID NO: 6552665 - DNA, 16 bp, Homo sapiens
ttgtgcagtcatcaga

SEQ ID NO: 6552666 - DNA, 17 bp, Homo sapiens
ttgtgcataaatttcca

SEQ ID NO: 6552667 - DNA, 21 bp, Homo sapiens
ttgtgcatgcaaaaatgaatt

SEQ ID NO: 6552668 - DNA, 22 bp, Homo sapiens
ttgtgcatgctagtgttgtatt

SEQ ID NO: 6552669 - DNA, 14 bp, Homo sapiens
ttgtgcattctgga

SEQ ID NO: 6552670 - DNA, 13 bp, Homo sapiens
ttgtgcattcttt

SEQ ID NO: 6552671 - DNA, 23 bp, Homo sapiens
ttgtgcattggataacaccacca

SEQ ID NO: 6552672 - DNA, 13 bp, Homo sapiens
ttgtgcattgtgg

SEQ ID NO: 6552673 - DNA, 19 bp, Homo sapiens
ttgtgcatttgtaaatgct

SEQ ID NO: 6552674 - DNA, 10 bp, Homo sapiens
ttgtgccaaa

SEQ ID NO: 6552675 - DNA, 18 bp, Homo sapiens
ttgtgccaaacaaaatga

SEQ ID NO: 6552676 - DNA, 23 bp, Homo sapiens
ttgtgccaaacctactaggccat

SEQ ID NO: 6552677 - DNA, 16 bp, Homo sapiens
ttgtgccaaagatagc

SEQ ID NO: 6552678 - DNA, 22 bp, Homo sapiens
ttgtgccaactgccaggctgcc

SEQ ID NO: 6552679 - DNA, 13 bp, Homo sapiens
ttgtgccaagcct

SEQ ID NO: 6552680 - DNA, 15 bp, Homo sapiens
ttgtgccaagccttc

SEQ ID NO: 6552681 - DNA, 22 bp, Homo sapiens
ttgtgccaatatgtattgtaaa

SEQ ID NO: 6552682 - DNA, 20 bp, Homo sapiens
ttgtgccacacgcatgggca

SEQ ID NO: 6552683 - DNA, 13 bp, Homo sapiens
ttgtgcccactta

SEQ ID NO: 6552684 - DNA, 15 bp, Homo sapiens
ttgtgcccctaaaga

SEQ ID NO: 6552685 - DNA, 23 bp, Homo sapiens
ttgtgcccctaaagagcatcctg

SEQ ID NO: 6552686 - DNA, 16 bp, Homo sapiens
ttgtgccccttcactc

SEQ ID NO: 6552687 - DNA, 15 bp, Homo sapiens
ttgtgccctgtagct

SEQ ID NO: 6552688 - DNA, 17 bp, Homo sapiens
ttgtgcccttgtatagt

SEQ ID NO: 6552689 - DNA, 15 bp, Homo sapiens
ttgtgccgtaattat

SEQ ID NO: 6552690 - DNA, 18 bp, Homo sapiens
ttgtgcctcatttattta

SEQ ID NO: 6552691 - DNA, 11 bp, Homo sapiens
ttgtgcctccc

SEQ ID NO: 6552692 - DNA, 16 bp, Homo sapiens
ttgtgcctcccttccc

SEQ ID NO: 6552693 - DNA, 14 bp, Homo sapiens
ttgtgcctctgccc

SEQ ID NO: 6552694 - DNA, 18 bp, Homo sapiens
ttgtgcctcttgggagac

SEQ ID NO: 6552695 - DNA, 22 bp, Homo sapiens
ttgtgcctgttgtgaagctaat

SEQ ID NO: 6552696 - DNA, 16 bp, Homo sapiens
ttgtgccttactaaat

SEQ ID NO: 6552697 - DNA, 17 bp, Homo sapiens
ttgtgccttgtaaataa

SEQ ID NO: 6552698 - DNA, 10 bp, Homo sapiens
ttgtgccttt

SEQ ID NO: 6552699 - DNA, 20 bp, Homo sapiens
ttgtgcctttcacagcttct

SEQ ID NO: 6552700 - DNA, 17 bp, Homo sapiens
ttgtgctaatttctgtc

SEQ ID NO: 6552701 - DNA, 23 bp, Homo sapiens
ttgtgctacatgacgacaaagct

SEQ ID NO: 6552702 - DNA, 16 bp, Homo sapiens
ttgtgctagaaatttt

SEQ ID NO: 6552703 - DNA, 15 bp, Homo sapiens
ttgtgctatattttt

SEQ ID NO: 6552704 - DNA, 13 bp, Homo sapiens
ttgtgctatttaa

SEQ ID NO: 6552705 - DNA, 16 bp, Homo sapiens
ttgtgctcataaattg

SEQ ID NO: 6552706 - DNA, 14 bp, Homo sapiens
ttgtgctcatgtgt

SEQ ID NO: 6552707 - DNA, 23 bp, Homo sapiens
ttgtgctcctcttgattcctggt

SEQ ID NO: 6552708 - DNA, 12 bp, Homo sapiens
ttgtgctcggga

SEQ ID NO: 6552709 - DNA, 17 bp, Homo sapiens
ttgtgctcgggatcaaa

SEQ ID NO: 6552710 - DNA, 14 bp, Homo sapiens
ttgtgctctttcct

SEQ ID NO: 6552711 - DNA, 16 bp, Homo sapiens
ttgtgctctttcctgc

SEQ ID NO: 6552712 - DNA, 11 bp, Homo sapiens
ttgtgctgcca

SEQ ID NO: 6552713 - DNA, 20 bp, Homo sapiens
ttgtgctgggtcccagcctg

SEQ ID NO: 6552714 - DNA, 15 bp, Homo sapiens
ttgtgctgtgggcag

SEQ ID NO: 6552715 - DNA, 17 bp, Homo sapiens
ttgtgctgtgggcagca

SEQ ID NO: 6552716 - DNA, 22 bp, Homo sapiens
ttgtgctgtgggcagcaccctc

SEQ ID NO: 6552717 - DNA, 16 bp, Homo sapiens
ttgtgcttaaattatt

SEQ ID NO: 6552718 - DNA, 16 bp, Homo sapiens
ttgtgcttctccccag

SEQ ID NO: 6552719 - DNA, 18 bp, Homo sapiens
ttgtgcttctccccagaa

SEQ ID NO: 6552720 - DNA, 23 bp, Homo sapiens
ttgtgcttctttctttgggaata

SEQ ID NO: 6552721 - DNA, 14 bp, Homo sapiens
ttgtgcttgtttac

SEQ ID NO: 6552722 - DNA, 15 bp, Homo sapiens
ttgtgctttaaaaat

SEQ ID NO: 6552723 - DNA, 22 bp, Homo sapiens
ttgtgctttataccccatttga

SEQ ID NO: 6552724 - DNA, 14 bp, Homo sapiens
ttgtgctttctagc

SEQ ID NO: 6552725 - DNA, 16 bp, Homo sapiens
ttgtgctttctagcaa

SEQ ID NO: 6552726 - DNA, 20 bp, Homo sapiens
ttgtgcttttagtaaaaaca

SEQ ID NO: 6552727 - DNA, 21 bp, Homo sapiens
ttgtggaaaatgaaaattagg

SEQ ID NO: 6552728 - DNA, 15 bp, Homo sapiens
ttgtggaaacagctg

SEQ ID NO: 6552729 - DNA, 21 bp, Homo sapiens
ttgtggaaagtagctgctagt

SEQ ID NO: 6552730 - DNA, 22 bp, Homo sapiens
ttgtggaaagtagctgctagtg

SEQ ID NO: 6552731 - DNA, 15 bp, Homo sapiens
ttgtggaagacactt

SEQ ID NO: 6552732 - DNA, 15 bp, Homo sapiens
ttgtggaatggattt

SEQ ID NO: 6552733 - DNA, 15 bp, Homo sapiens
ttgtggacatttaag

SEQ ID NO: 6552734 - DNA, 17 bp, Homo sapiens
ttgtggaccaattattg

SEQ ID NO: 6552735 - DNA, 22 bp, Homo sapiens
ttgtggactaaaagatataagt

SEQ ID NO: 6552736 - DNA, 13 bp, Homo sapiens
ttgtggactgagc

SEQ ID NO: 6552737 - DNA, 14 bp, Homo sapiens
ttgtggactggctg

SEQ ID NO: 6552738 - DNA, 15 bp, Homo sapiens
ttgtggagaaaaaga

SEQ ID NO: 6552739 - DNA, 19 bp, Homo sapiens
ttgtggagatcacagcccc

SEQ ID NO: 6552740 - DNA, 22 bp, Homo sapiens
ttgtggagattttttttttaat

SEQ ID NO: 6552741 - DNA, 14 bp, Homo sapiens
ttgtggagccccac

SEQ ID NO: 6552742 - DNA, 22 bp, Homo sapiens
ttgtggagcgccagctctgccc

SEQ ID NO: 6552743 - DNA, 23 bp, Homo sapiens
ttgtggaggagggagagccctgt

SEQ ID NO: 6552744 - DNA, 18 bp, Homo sapiens
ttgtggataacaaagata

SEQ ID NO: 6552745 - DNA, 15 bp, Homo sapiens
ttgtggataagaaaa

SEQ ID NO: 6552746 - DNA, 21 bp, Homo sapiens
ttgtggatagagcagcctgct

SEQ ID NO: 6552747 - DNA, 16 bp, Homo sapiens
ttgtggatatagttat

SEQ ID NO: 6552748 - DNA, 16 bp, Homo sapiens
ttgtggatatatttaa

SEQ ID NO: 6552749 - DNA, 15 bp, Homo sapiens
ttgtggatgctccag

SEQ ID NO: 6552750 - DNA, 19 bp, Homo sapiens
ttgtggatgggaggctcct

SEQ ID NO: 6552751 - DNA, 14 bp, Homo sapiens
ttgtggattaatgt

SEQ ID NO: 6552752 - DNA, 21 bp, Homo sapiens
ttgtggatttaacagaaatgt

SEQ ID NO: 6552753 - DNA, 22 bp, Homo sapiens
ttgtggcaagtgaatttgcctg

SEQ ID NO: 6552754 - DNA, 19 bp, Homo sapiens
ttgtggcacagatgcccac

SEQ ID NO: 6552755 - DNA, 14 bp, Homo sapiens
ttgtggcacattct

SEQ ID NO: 6552756 - DNA, 15 bp, Homo sapiens
ttgtggcacctcaac

SEQ ID NO: 6552757 - DNA, 19 bp, Homo sapiens
ttgtggcagcttccctgaa

SEQ ID NO: 6552758 - DNA, 15 bp, Homo sapiens
ttgtggcagtgctga

SEQ ID NO: 6552759 - DNA, 19 bp, Homo sapiens
ttgtggccaaggagctgct

SEQ ID NO: 6552760 - DNA, 20 bp, Homo sapiens
ttgtggccaaggagctgcta

SEQ ID NO: 6552761 - DNA, 16 bp, Homo sapiens
ttgtggcccaagcctg

SEQ ID NO: 6552762 - DNA, 21 bp, Homo sapiens
ttgtggcccagataaggcttt

SEQ ID NO: 6552763 - DNA, 12 bp, Homo sapiens
ttgtggcctcag

SEQ ID NO: 6552764 - DNA, 13 bp, Homo sapiens
ttgtggcctggga

SEQ ID NO: 6552765 - DNA, 15 bp, Homo sapiens
ttgtggcgtctccct

SEQ ID NO: 6552766 - DNA, 14 bp, Homo sapiens
ttgtggctttatga

SEQ ID NO: 6552767 - DNA, 12 bp, Homo sapiens
ttgtgggaataa

SEQ ID NO: 6552768 - DNA, 13 bp, Homo sapiens
ttgtgggaataaa

SEQ ID NO: 6552769 - DNA, 16 bp, Homo sapiens
ttgtgggaatttaaga

SEQ ID NO: 6552770 - DNA, 20 bp, Homo sapiens
ttgtgggacttattacaatt

SEQ ID NO: 6552771 - DNA, 15 bp, Homo sapiens
ttgtgggagacagca

SEQ ID NO: 6552772 - DNA, 13 bp, Homo sapiens
ttgtgggataatg

SEQ ID NO: 6552773 - DNA, 18 bp, Homo sapiens
ttgtgggataatgggaga

SEQ ID NO: 6552774 - DNA, 17 bp, Homo sapiens
ttgtgggcactgtgcca

SEQ ID NO: 6552775 - DNA, 16 bp, Homo sapiens
ttgtgggcataaactg

SEQ ID NO: 6552776 - DNA, 20 bp, Homo sapiens
ttgtgggcctgggctcctgg

SEQ ID NO: 6552777 - DNA, 20 bp, Homo sapiens
ttgtggggacccaggctccg

SEQ ID NO: 6552778 - DNA, 19 bp, Homo sapiens
ttgtggggatgaacttttt

SEQ ID NO: 6552779 - DNA, 19 bp, Homo sapiens
ttgtggggcacagatgcct

SEQ ID NO: 6552780 - DNA, 19 bp, Homo sapiens
ttgtggggcctcaggctcc

SEQ ID NO: 6552781 - DNA, 19 bp, Homo sapiens
ttgtgggggactgtaagtt

SEQ ID NO: 6552782 - DNA, 17 bp, Homo sapiens
ttgtgggtttctctgtg

SEQ ID NO: 6552783 - DNA, 18 bp, Homo sapiens
ttgtggtaacttctttga

SEQ ID NO: 6552784 - DNA, 14 bp, Homo sapiens
ttgtggtagaaatt

SEQ ID NO: 6552785 - DNA, 18 bp, Homo sapiens
ttgtggtcacatgcttta

SEQ ID NO: 6552786 - DNA, 15 bp, Homo sapiens
ttgtggtccaaatag

SEQ ID NO: 6552787 - DNA, 21 bp, Homo sapiens
ttgtggtctcgatgctgctgg

SEQ ID NO: 6552788 - DNA, 22 bp, Homo sapiens
ttgtggtgatcgcacaaggaca

SEQ ID NO: 6552789 - DNA, 22 bp, Homo sapiens
ttgtggtggtgctaaaggaggc

SEQ ID NO: 6552790 - DNA, 17 bp, Homo sapiens
ttgtggtgtaaagctgg

SEQ ID NO: 6552791 - DNA, 23 bp, Homo sapiens
ttgtggtgtgaccatgttcatta

SEQ ID NO: 6552792 - DNA, 14 bp, Homo sapiens
ttgtggtgttcctg

SEQ ID NO: 6552793 - DNA, 17 bp, Homo sapiens
ttgtggtgttcctgaag

SEQ ID NO: 6552794 - DNA, 18 bp, Homo sapiens
ttgtggttaaaaacctgc

SEQ ID NO: 6552795 - DNA, 19 bp, Homo sapiens
ttgtggttatttttataca

SEQ ID NO: 6552796 - DNA, 14 bp, Homo sapiens
ttgtggttggttgt

SEQ ID NO: 6552797 - DNA, 14 bp, Homo sapiens
ttgtggtttaaata

SEQ ID NO: 6552798 - DNA, 20 bp, Homo sapiens
ttgtggtttatatatttaaa

SEQ ID NO: 6552799 - DNA, 14 bp, Homo sapiens
ttgtggtttatgtc

SEQ ID NO: 6552800 - DNA, 14 bp, Homo sapiens
ttgtggtttggaat

SEQ ID NO: 6552801 - DNA, 15 bp, Homo sapiens
ttgtggttttgggaa

SEQ ID NO: 6552802 - DNA, 19 bp, Homo sapiens
ttgtgtaaaaaatggaaaa

SEQ ID NO: 6552803 - DNA, 21 bp, Homo sapiens
ttgtgtaaaaaatggaaaaaa

SEQ ID NO: 6552804 - DNA, 19 bp, Homo sapiens
ttgtgtaaatacaattttg

SEQ ID NO: 6552805 - DNA, 22 bp, Homo sapiens
ttgtgtaacaattttaatgcta

SEQ ID NO: 6552806 - DNA, 14 bp, Homo sapiens
ttgtgtaagaaata

SEQ ID NO: 6552807 - DNA, 18 bp, Homo sapiens
ttgtgtaagaatcactgc

SEQ ID NO: 6552808 - DNA, 23 bp, Homo sapiens
ttgtgtaataaaaatttgtttaa

SEQ ID NO: 6552809 - DNA, 16 bp, Homo sapiens
ttgtgtaataaagtgt

SEQ ID NO: 6552810 - DNA, 19 bp, Homo sapiens
ttgtgtaatagaaaactga

SEQ ID NO: 6552811 - DNA, 21 bp, Homo sapiens
ttgtgtaatagaaaactgaaa

SEQ ID NO: 6552812 - DNA, 18 bp, Homo sapiens
ttgtgtaatattacttta

SEQ ID NO: 6552813 - DNA, 14 bp, Homo sapiens
ttgtgtaatctaag

SEQ ID NO: 6552814 - DNA, 21 bp, Homo sapiens
ttgtgtaatctaagtatatgt

SEQ ID NO: 6552815 - DNA, 19 bp, Homo sapiens
ttgtgtaatttaagtgaca

SEQ ID NO: 6552816 - DNA, 23 bp, Homo sapiens
ttgtgtacaaagtagagaagtat

SEQ ID NO: 6552817 - DNA, 23 bp, Homo sapiens
ttgtgtacagacttgttgtgact

SEQ ID NO: 6552818 - DNA, 17 bp, Homo sapiens
ttgtgtacagtatgtgt

SEQ ID NO: 6552819 - DNA, 18 bp, Homo sapiens
ttgtgtacagtatgtgtc

SEQ ID NO: 6552820 - DNA, 17 bp, Homo sapiens
ttgtgtacatagagcaa

SEQ ID NO: 6552821 - DNA, 13 bp, Homo sapiens
ttgtgtacttgac

SEQ ID NO: 6552822 - DNA, 14 bp, Homo sapiens
ttgtgtagattgtg

SEQ ID NO: 6552823 - DNA, 18 bp, Homo sapiens
ttgtgtagattgtgtaaa

SEQ ID NO: 6552824 - DNA, 22 bp, Homo sapiens
tgttttcaatgaattaagaaag

SEQ ID NO: 6552825 - DNA, 18 bp, Homo sapiens
tgttttcaattttaaaca

SEQ ID NO: 6552826 - DNA, 15 bp, Homo sapiens
tgttttcacttgtat

SEQ ID NO: 6552827 - DNA, 13 bp, Homo sapiens
tgttttcaggtgt

SEQ ID NO: 6552828 - DNA, 17 bp, Homo sapiens
tgttttcagtgtacatg

SEQ ID NO: 6552829 - DNA, 16 bp, Homo sapiens
tgttttcatcatttca

SEQ ID NO: 6552830 - DNA, 19 bp, Homo sapiens
tgttttcatgtaaataaat

SEQ ID NO: 6552831 - DNA, 19 bp, Homo sapiens
tgttttcattatctcaaaa

SEQ ID NO: 6552832 - DNA, 14 bp, Homo sapiens
tgttttcattctgg

SEQ ID NO: 6552833 - DNA, 15 bp, Homo sapiens
tgttttcattctggt

SEQ ID NO: 6552834 - DNA, 18 bp, Homo sapiens
tgttttcatttacaggaa

SEQ ID NO: 6552835 - DNA, 16 bp, Homo sapiens
tgttttcattttactg

SEQ ID NO: 6552836 - DNA, 21 bp, Homo sapiens
tgttttccaatattttaataa

SEQ ID NO: 6552837 - DNA, 19 bp, Homo sapiens
tgttttccacataaatttt

SEQ ID NO: 6552838 - DNA, 17 bp, Homo sapiens
tgttttccactgtgcta

SEQ ID NO: 6552839 - DNA, 14 bp, Homo sapiens
tgttttccatccca

SEQ ID NO: 6552840 - DNA, 23 bp, Homo sapiens
tgttttccatgatttagcaagca

SEQ ID NO: 6552841 - DNA, 18 bp, Homo sapiens
tgttttccattgtttgaa

SEQ ID NO: 6552842 - DNA, 20 bp, Homo sapiens
tgttttcccaagtgtaatta

SEQ ID NO: 6552843 - DNA, 16 bp, Homo sapiens
tgttttcccacgagga

SEQ ID NO: 6552844 - DNA, 21 bp, Homo sapiens
tgttttcccatttaaaaatat

SEQ ID NO: 6552845 - DNA, 20 bp, Homo sapiens
tgttttcccctaattttcca

SEQ ID NO: 6552846 - DNA, 17 bp, Homo sapiens
tgttttccctctgctgc

SEQ ID NO: 6552847 - DNA, 16 bp, Homo sapiens
tgttttccctgacctc

SEQ ID NO: 6552848 - DNA, 21 bp, Homo sapiens
tgttttccctggctaacagtc

SEQ ID NO: 6552849 - DNA, 21 bp, Homo sapiens
tgttttcccttaacttttcct

SEQ ID NO: 6552850 - DNA, 14 bp, Homo sapiens
tgttttcctccctt

SEQ ID NO: 6552851 - DNA, 19 bp, Homo sapiens
tgttttcctgctttacaaa

SEQ ID NO: 6552852 - DNA, 16 bp, Homo sapiens
tgttttcggcagcctt

SEQ ID NO: 6552853 - DNA, 21 bp, Homo sapiens
tgttttcgttgttgttaacaa

SEQ ID NO: 6552854 - DNA, 16 bp, Homo sapiens
tgttttctaagatgtt

SEQ ID NO: 6552855 - DNA, 17 bp, Homo sapiens
tgttttctaagatgttc

SEQ ID NO: 6552856 - DNA, 13 bp, Homo sapiens
tgttttctagtgt

SEQ ID NO: 6552857 - DNA, 18 bp, Homo sapiens
tgttttctagtgtatcaa

SEQ ID NO: 6552858 - DNA, 20 bp, Homo sapiens
tgttttctagtgtatcaaaa

SEQ ID NO: 6552859 - DNA, 14 bp, Homo sapiens
tgttttctccctct

SEQ ID NO: 6552860 - DNA, 16 bp, Homo sapiens
tgttttctccctctca

SEQ ID NO: 6552861 - DNA, 15 bp, Homo sapiens
tgttttctctctgtt

SEQ ID NO: 6552862 - DNA, 17 bp, Homo sapiens
tgttttctctgaacaca

SEQ ID NO: 6552863 - DNA, 16 bp, Homo sapiens
tgttttctgactaatt

SEQ ID NO: 6552864 - DNA, 18 bp, Homo sapiens
tgttttctgctgtttaca

SEQ ID NO: 6552865 - DNA, 19 bp, Homo sapiens
tgttttctgctgtttacaa

SEQ ID NO: 6552866 - DNA, 15 bp, Homo sapiens
tgttttctgtaaatt

SEQ ID NO: 6552867 - DNA, 18 bp, Homo sapiens
tgttttcttcatttctct

SEQ ID NO: 6552868 - DNA, 14 bp, Homo sapiens
tgttttcttgattt

SEQ ID NO: 6552869 - DNA, 11 bp, Homo sapiens
tgttttcttgg

SEQ ID NO: 6552870 - DNA, 17 bp, Homo sapiens
tgttttcttgtctgtgt

SEQ ID NO: 6552871 - DNA, 23 bp, Homo sapiens
tgttttcttgtgttgttttctct

SEQ ID NO: 6552872 - DNA, 21 bp, Homo sapiens
tgttttctttaaagatgtaat

SEQ ID NO: 6552873 - DNA, 14 bp, Homo sapiens
tgttttctttgagg

SEQ ID NO: 6552874 - DNA, 16 bp, Homo sapiens
tgttttctttgtttct

SEQ ID NO: 6552875 - DNA, 15 bp, Homo sapiens
tgttttctttttctg

SEQ ID NO: 6552876 - DNA, 16 bp, Homo sapiens
tgttttgaaactagaa

SEQ ID NO: 6552877 - DNA, 17 bp, Homo sapiens
tgttttgaaactcagta

SEQ ID NO: 6552878 - DNA, 11 bp, Homo sapiens
tgttttgaaag

SEQ ID NO: 6552879 - DNA, 12 bp, Homo sapiens
tgttttgaaagt

SEQ ID NO: 6552880 - DNA, 19 bp, Homo sapiens
tgttttgaaagtttaacaa

SEQ ID NO: 6552881 - DNA, 15 bp, Homo sapiens
tgttttgaaatgata

SEQ ID NO: 6552882 - DNA, 13 bp, Homo sapiens
tgttttgaataaa

SEQ ID NO: 6552883 - DNA, 19 bp, Homo sapiens
tgttttgaatctcataatt

SEQ ID NO: 6552884 - DNA, 22 bp, Homo sapiens
tgttttgaatggtgttgtatgc

SEQ ID NO: 6552885 - DNA, 17 bp, Homo sapiens
tgttttgaatgtggata

SEQ ID NO: 6552886 - DNA, 17 bp, Homo sapiens
tgttttgacttgaataa

SEQ ID NO: 6552887 - DNA, 13 bp, Homo sapiens
tgttttgagaaaa

SEQ ID NO: 6552888 - DNA, 12 bp, Homo sapiens
tgttttgagaac

SEQ ID NO: 6552889 - DNA, 16 bp, Homo sapiens
tgttttgagctttcca

SEQ ID NO: 6552890 - DNA, 16 bp, Homo sapiens
tgttttgagtcagtgc

SEQ ID NO: 6552891 - DNA, 22 bp, Homo sapiens
tgttttgatgccatttgtcttt

SEQ ID NO: 6552892 - DNA, 12 bp, Homo sapiens
tgttttgcaaag

SEQ ID NO: 6552893 - DNA, 14 bp, Homo sapiens
tgttttgcaagcca

SEQ ID NO: 6552894 - DNA, 21 bp, Homo sapiens
tgttttgcaagggaatgaatc

SEQ ID NO: 6552895 - DNA, 15 bp, Homo sapiens
tgttttgcaagtgct

SEQ ID NO: 6552896 - DNA, 18 bp, Homo sapiens
tgttttgcacagccaaat

SEQ ID NO: 6552897 - DNA, 22 bp, Homo sapiens
tgttttgcacgtcttgctattt

SEQ ID NO: 6552898 - DNA, 12 bp, Homo sapiens
tgttttgcactt

SEQ ID NO: 6552899 - DNA, 12 bp, Homo sapiens
tgttttgcattc

SEQ ID NO: 6552900 - DNA, 15 bp, Homo sapiens
tgttttgccgtggct

SEQ ID NO: 6552901 - DNA, 14 bp, Homo sapiens
tgttttgctaaagg

SEQ ID NO: 6552902 - DNA, 17 bp, Homo sapiens
tgttttgcttcccctcc

SEQ ID NO: 6552903 - DNA, 18 bp, Homo sapiens
tgttttgcttttccatat

SEQ ID NO: 6552904 - DNA, 19 bp, Homo sapiens
tgttttgcttttgctcgat

SEQ ID NO: 6552905 - DNA, 21 bp, Homo sapiens
tgttttgctttttaaactgat

SEQ ID NO: 6552906 - DNA, 16 bp, Homo sapiens
tgttttgctttttctg

SEQ ID NO: 6552907 - DNA, 13 bp, Homo sapiens
tgttttggaataa

SEQ ID NO: 6552908 - DNA, 23 bp, Homo sapiens
tgttttggaattcaatgggtaaa

SEQ ID NO: 6552909 - DNA, 19 bp, Homo sapiens
tgttttggactccatctct

SEQ ID NO: 6552910 - DNA, 16 bp, Homo sapiens
tgttttggactctctg

SEQ ID NO: 6552911 - DNA, 13 bp, Homo sapiens
tgttttggagaaa

SEQ ID NO: 6552912 - DNA, 21 bp, Homo sapiens
tgttttggatgaatgcagtat

SEQ ID NO: 6552913 - DNA, 11 bp, Homo sapiens
tgttttggatt

SEQ ID NO: 6552914 - DNA, 14 bp, Homo sapiens
tgttttggattctt

SEQ ID NO: 6552915 - DNA, 15 bp, Homo sapiens
tgttttggattcttt

SEQ ID NO: 6552916 - DNA, 22 bp, Homo sapiens
tgttttggattctttaaatata

SEQ ID NO: 6552917 - DNA, 21 bp, Homo sapiens
tgttttggatttggagagaaa

SEQ ID NO: 6552918 - DNA, 23 bp, Homo sapiens
tgttttgggcctccatgccccag

SEQ ID NO: 6552919 - DNA, 20 bp, Homo sapiens
tgttttggggatgagagggt

SEQ ID NO: 6552920 - DNA, 13 bp, Homo sapiens
tgttttggggttt

SEQ ID NO: 6552921 - DNA, 21 bp, Homo sapiens
tgttttggggttttgttttgt

SEQ ID NO: 6552922 - DNA, 16 bp, Homo sapiens
tgttttgggtgaatct

SEQ ID NO: 6552923 - DNA, 21 bp, Homo sapiens
tgttttggtagattaaatata

SEQ ID NO: 6552924 - DNA, 16 bp, Homo sapiens
tgttttggtatctgtt

SEQ ID NO: 6552925 - DNA, 22 bp, Homo sapiens
tgttttggtatctgttctttaa

SEQ ID NO: 6552926 - DNA, 20 bp, Homo sapiens
tgttttggtcccctccctcg

SEQ ID NO: 6552927 - DNA, 22 bp, Homo sapiens
tgttttggtcccctccctcgtg

SEQ ID NO: 6552928 - DNA, 18 bp, Homo sapiens
tgttttggtgcctgcctc

SEQ ID NO: 6552929 - DNA, 15 bp, Homo sapiens
tgttttggtttgcta

SEQ ID NO: 6552930 - DNA, 16 bp, Homo sapiens
tgttttgtaaactttg

SEQ ID NO: 6552931 - DNA, 19 bp, Homo sapiens
tgttttgtaaactttgaaa

SEQ ID NO: 6552932 - DNA, 22 bp, Homo sapiens
tgttttgtaaactttgaaatat

SEQ ID NO: 6552933 - DNA, 15 bp, Homo sapiens
tgttttgtacaatta

SEQ ID NO: 6552934 - DNA, 10 bp, Homo sapiens
tgttttgtag

SEQ ID NO: 6552935 - DNA, 12 bp, Homo sapiens
tgttttgtagca

SEQ ID NO: 6552936 - DNA, 16 bp, Homo sapiens
tgttttgtatacaaat

SEQ ID NO: 6552937 - DNA, 19 bp, Homo sapiens
tgttttgtatatgctgcat

SEQ ID NO: 6552938 - DNA, 19 bp, Homo sapiens
tgttttgtcagacttccaa

SEQ ID NO: 6552939 - DNA, 18 bp, Homo sapiens
tgttttgtcccatttcct

SEQ ID NO: 6552940 - DNA, 16 bp, Homo sapiens
tgttttgtctgagcct

SEQ ID NO: 6552941 - DNA, 17 bp, Homo sapiens
tgttttgtgaattttct

SEQ ID NO: 6552942 - DNA, 12 bp, Homo sapiens
tgttttgtggat

SEQ ID NO: 6552943 - DNA, 13 bp, Homo sapiens
tgttttgtggata

SEQ ID NO: 6552944 - DNA, 14 bp, Homo sapiens
tgttttgtggataa

SEQ ID NO: 6552945 - DNA, 13 bp, Homo sapiens
tgttttgtgtata

SEQ ID NO: 6552946 - DNA, 14 bp, Homo sapiens
tgttttgtgttgtt

SEQ ID NO: 6552947 - DNA, 15 bp, Homo sapiens
tgttttgttaatata

SEQ ID NO: 6552948 - DNA, 13 bp, Homo sapiens
tgttttgttgaca

SEQ ID NO: 6552949 - DNA, 21 bp, Homo sapiens
tgttttgttgacattctgaat

SEQ ID NO: 6552950 - DNA, 20 bp, Homo sapiens
tgttttgttgcactgaagtt

SEQ ID NO: 6552951 - DNA, 20 bp, Homo sapiens
tgttttgttggtttttaaag

SEQ ID NO: 6552952 - DNA, 14 bp, Homo sapiens
tgttttgtttcttg

SEQ ID NO: 6552953 - DNA, 17 bp, Homo sapiens
tgttttgtttggagaca

SEQ ID NO: 6552954 - DNA, 16 bp, Homo sapiens
tgttttgtttgtctct

SEQ ID NO: 6552955 - DNA, 13 bp, Homo sapiens
tgttttgttttat

SEQ ID NO: 6552956 - DNA, 17 bp, Homo sapiens
tgttttgtttttttcct

SEQ ID NO: 6552957 - DNA, 20 bp, Homo sapiens
tgttttgtttttttcctttt

SEQ ID NO: 6552958 - DNA, 17 bp, Homo sapiens
tgttttgtttttttgag

SEQ ID NO: 6552959 - DNA, 10 bp, Homo sapiens
tgtttttaaa

SEQ ID NO: 6552960 - DNA, 17 bp, Homo sapiens
tgtttttaaaaatcata

SEQ ID NO: 6552961 - DNA, 16 bp, Homo sapiens
tgtttttaaaaccact

SEQ ID NO: 6552962 - DNA, 22 bp, Homo sapiens
tgtttttaaaatagaatgatag

SEQ ID NO: 6552963 - DNA, 19 bp, Homo sapiens
tgtttttaaaatcttatta

SEQ ID NO: 6552964 - DNA, 15 bp, Homo sapiens
tgtttttaaattttg

SEQ ID NO: 6552965 - DNA, 12 bp, Homo sapiens
tgtttttaagat

SEQ ID NO: 6552966 - DNA, 17 bp, Homo sapiens
tgtttttaagtcctgta

SEQ ID NO: 6552967 - DNA, 13 bp, Homo sapiens
tgtttttaatgct

SEQ ID NO: 6552968 - DNA, 18 bp, Homo sapiens
tgtttttacaaatgttaa

SEQ ID NO: 6552969 - DNA, 21 bp, Homo sapiens
tgtttttaggctgttccttgt

SEQ ID NO: 6552970 - DNA, 16 bp, Homo sapiens
tgtttttataaaaaca

SEQ ID NO: 6552971 - DNA, 20 bp, Homo sapiens
tgtttttataaaaacattga

SEQ ID NO: 6552972 - DNA, 22 bp, Homo sapiens
tgtttttatatattataagttg

SEQ ID NO: 6552973 - DNA, 20 bp, Homo sapiens
tgtttttatgaagaaaaaat

SEQ ID NO: 6552974 - DNA, 16 bp, Homo sapiens
tgtttttattctgtat

SEQ ID NO: 6552975 - DNA, 22 bp, Homo sapiens
tgtttttatttcaattgtttat

SEQ ID NO: 6552976 - DNA, 23 bp, Homo sapiens
tgtttttatttcaattgtttata

SEQ ID NO: 6552977 - DNA, 14 bp, Homo sapiens
tgtttttatttctt

SEQ ID NO: 6552978 - DNA, 19 bp, Homo sapiens
tgtttttcaatgtgttctt

SEQ ID NO: 6552979 - DNA, 12 bp, Homo sapiens
tgtttttcagtt

SEQ ID NO: 6552980 - DNA, 19 bp, Homo sapiens
tgtttttcagttcaaagtc

SEQ ID NO: 6552981 - DNA, 19 bp, Homo sapiens
tgtttttcatccattccta

SEQ ID NO: 6552982 - DNA, 13 bp, Homo sapiens
tgtttttcatgtt

SEQ ID NO: 6552983 - DNA, 14 bp, Homo sapiens
tgtttttcattcat

SEQ ID NO: 6552984 - DNA, 21 bp, Homo sapiens
tgtttttcccgtataataaaa

SEQ ID NO: 6552985 - DNA, 13 bp, Homo sapiens
tgtttttcccttt

SEQ ID NO: 6552986 - DNA, 18 bp, Homo sapiens
tgtttttcctgtgtatta

SEQ ID NO: 6552987 - DNA, 20 bp, Homo sapiens
tgtttttccttgtatttaaa

SEQ ID NO: 6552988 - DNA, 15 bp, Homo sapiens
tgtttttcctttctt

SEQ ID NO: 6552989 - DNA, 13 bp, Homo sapiens
tgtttttctaaag

SEQ ID NO: 6552990 - DNA, 15 bp, Homo sapiens
tgtttttctattaaa

SEQ ID NO: 6552991 - DNA, 17 bp, Homo sapiens
tgtttttctattaaaag

SEQ ID NO: 6552992 - DNA, 19 bp, Homo sapiens
tgtttttctattaaaagac

SEQ ID NO: 6552993 - DNA, 20 bp, Homo sapiens
tgtttttctattaaaagact

SEQ ID NO: 6552994 - DNA, 11 bp, Homo sapiens
tgtttttctca

SEQ ID NO: 6552995 - DNA, 12 bp, Homo sapiens
tgtttttctcaa

SEQ ID NO: 6552996 - DNA, 14 bp, Homo sapiens
tgtttttctcaaat

SEQ ID NO: 6552997 - DNA, 16 bp, Homo sapiens
tgtttttctcaaataa

SEQ ID NO: 6552998 - DNA, 17 bp, Homo sapiens
tgtttttctctaatgct

SEQ ID NO: 6552999 - DNA, 16 bp, Homo sapiens
tgtttttctctctgga

SEQ ID NO: 6553000 - DNA, 19 bp, Homo sapiens
tgtttttctgctttagact

SEQ ID NO: 6553001 - DNA, 12 bp, Homo sapiens
tgtttttctggg

SEQ ID NO: 6553002 - DNA, 22 bp, Homo sapiens
tgtttttctgtgtgtcagtttt

SEQ ID NO: 6553003 - DNA, 14 bp, Homo sapiens
tgtttttctgtgtt

SEQ ID NO: 6553004 - DNA, 13 bp, Homo sapiens
tgtttttctttta

SEQ ID NO: 6553005 - DNA, 20 bp, Homo sapiens
ttgtgtagccccttttcttt

SEQ ID NO: 6553006 - DNA, 13 bp, Homo sapiens
ttgtgtagccttt

SEQ ID NO: 6553007 - DNA, 15 bp, Homo sapiens
ttgtgtataagttgt

SEQ ID NO: 6553008 - DNA, 15 bp, Homo sapiens
ttgtgtataatttac

SEQ ID NO: 6553009 - DNA, 17 bp, Homo sapiens
ttgtgtatatatcttat

SEQ ID NO: 6553010 - DNA, 19 bp, Homo sapiens
ttgtgtatatgttggttta

SEQ ID NO: 6553011 - DNA, 20 bp, Homo sapiens
ttgtgtatccattatcatgt

SEQ ID NO: 6553012 - DNA, 23 bp, Homo sapiens
ttgtgtatccattatcatgtgta

SEQ ID NO: 6553013 - DNA, 20 bp, Homo sapiens
ttgtgtatcgtaaccagcca

SEQ ID NO: 6553014 - DNA, 21 bp, Homo sapiens
ttgtgtatcgtaaccagccag

SEQ ID NO: 6553015 - DNA, 21 bp, Homo sapiens
ttgtgtatcttcgtaacttca

SEQ ID NO: 6553016 - DNA, 22 bp, Homo sapiens
ttgtgtatcttcgtaacttcat

SEQ ID NO: 6553017 - DNA, 19 bp, Homo sapiens
ttgtgtatcttgattaatg

SEQ ID NO: 6553018 - DNA, 22 bp, Homo sapiens
ttgtgtatgggtagcactacta

SEQ ID NO: 6553019 - DNA, 11 bp, Homo sapiens
ttgtgtatgta

SEQ ID NO: 6553020 - DNA, 18 bp, Homo sapiens
ttgtgtatttctctgtga

SEQ ID NO: 6553021 - DNA, 19 bp, Homo sapiens
ttgtgtatttctctgtgaa

SEQ ID NO: 6553022 - DNA, 21 bp, Homo sapiens
ttgtgtatttctctgtgaatc

SEQ ID NO: 6553023 - DNA, 17 bp, Homo sapiens
ttgtgtattttctttgg

SEQ ID NO: 6553024 - DNA, 21 bp, Homo sapiens
ttgtgtcaatgggcaatgaca

SEQ ID NO: 6553025 - DNA, 17 bp, Homo sapiens
ttgtgtcactgtacagt

SEQ ID NO: 6553026 - DNA, 19 bp, Homo sapiens
ttgtgtcagagctgggagt

SEQ ID NO: 6553027 - DNA, 19 bp, Homo sapiens
ttgtgtcataaattacaca

SEQ ID NO: 6553028 - DNA, 13 bp, Homo sapiens
ttgtgtcatacca

SEQ ID NO: 6553029 - DNA, 16 bp, Homo sapiens
ttgtgtcatattttaa

SEQ ID NO: 6553030 - DNA, 19 bp, Homo sapiens
ttgtgtcatgtttaagaaa

SEQ ID NO: 6553031 - DNA, 18 bp, Homo sapiens
ttgtgtcccattccccca

SEQ ID NO: 6553032 - DNA, 16 bp, Homo sapiens
ttgtgtccctaatgtg

SEQ ID NO: 6553033 - DNA, 17 bp, Homo sapiens
ttgtgtctatgatgttg

SEQ ID NO: 6553034 - DNA, 21 bp, Homo sapiens
ttgtgtctcccgtgcatgctc

SEQ ID NO: 6553035 - DNA, 13 bp, Homo sapiens
ttgtgtctgcagg

SEQ ID NO: 6553036 - DNA, 17 bp, Homo sapiens
ttgtgtctgcaggattg

SEQ ID NO: 6553037 - DNA, 17 bp, Homo sapiens
ttgtgtctggtgcagaa

SEQ ID NO: 6553038 - DNA, 15 bp, Homo sapiens
ttgtgtcttaatctc

SEQ ID NO: 6553039 - DNA, 18 bp, Homo sapiens
ttgtgtcttttgcatgat

SEQ ID NO: 6553040 - DNA, 19 bp, Homo sapiens
ttgtgtgaaaaaagaaaat

SEQ ID NO: 6553041 - DNA, 23 bp, Homo sapiens
ttgtgtgaaaggtacttcaaatc

SEQ ID NO: 6553042 - DNA, 15 bp, Homo sapiens
ttgtgtgaaattgca

SEQ ID NO: 6553043 - DNA, 16 bp, Homo sapiens
ttgtgtgaacttggaa

SEQ ID NO: 6553044 - DNA, 18 bp, Homo sapiens
ttgtgtgatccagccctg

SEQ ID NO: 6553045 - DNA, 20 bp, Homo sapiens
ttgtgtgatccagccctggt

SEQ ID NO: 6553046 - DNA, 13 bp, Homo sapiens
ttgtgtgattgaa

SEQ ID NO: 6553047 - DNA, 20 bp, Homo sapiens
ttgtgtgatttcctaaacat

SEQ ID NO: 6553048 - DNA, 14 bp, Homo sapiens
ttgtgtgcgctgcc

SEQ ID NO: 6553049 - DNA, 16 bp, Homo sapiens
ttgtgtgcgctgcctg

SEQ ID NO: 6553050 - DNA, 17 bp, Homo sapiens
ttgtgtgcgctgcctgg

SEQ ID NO: 6553051 - DNA, 21 bp, Homo sapiens
ttgtgtgcggagtcattttgt

SEQ ID NO: 6553052 - DNA, 15 bp, Homo sapiens
ttgtgtgcttctgct

SEQ ID NO: 6553053 - DNA, 16 bp, Homo sapiens
ttgtgtggatatttat

SEQ ID NO: 6553054 - DNA, 16 bp, Homo sapiens
ttgtgtggattcttta

SEQ ID NO: 6553055 - DNA, 13 bp, Homo sapiens
ttgtgtggctcct

SEQ ID NO: 6553056 - DNA, 17 bp, Homo sapiens
ttgtgtgggttcaaatt

SEQ ID NO: 6553057 - DNA, 19 bp, Homo sapiens
ttgtgtggtctggttcctg

SEQ ID NO: 6553058 - DNA, 22 bp, Homo sapiens
ttgtgtgtaccacaccctgcct

SEQ ID NO: 6553059 - DNA, 22 bp, Homo sapiens
ttgtgtgtatgcacatgaactt

SEQ ID NO: 6553060 - DNA, 12 bp, Homo sapiens
ttgtgtgtatgt

SEQ ID NO: 6553061 - DNA, 14 bp, Homo sapiens
ttgtgtgtatttgc

SEQ ID NO: 6553062 - DNA, 20 bp, Homo sapiens
ttgtgtgtcacaaagctaaa

SEQ ID NO: 6553063 - DNA, 15 bp, Homo sapiens
ttgtgtgtcatgcca

SEQ ID NO: 6553064 - DNA, 16 bp, Homo sapiens
ttgtgtgtccccttgc

SEQ ID NO: 6553065 - DNA, 13 bp, Homo sapiens
ttgtgtgtcttaa

SEQ ID NO: 6553066 - DNA, 16 bp, Homo sapiens
ttgtgtgtgccctggg

SEQ ID NO: 6553067 - DNA, 13 bp, Homo sapiens
ttgtgtgtgggag

SEQ ID NO: 6553068 - DNA, 16 bp, Homo sapiens
ttgtgtgtgggagtgt

SEQ ID NO: 6553069 - DNA, 12 bp, Homo sapiens
ttgtgtgtgtgc

SEQ ID NO: 6553070 - DNA, 20 bp, Homo sapiens
ttgtgtgtgttctgtcccca

SEQ ID NO: 6553071 - DNA, 16 bp, Homo sapiens
ttgtgtgttatttaaa

SEQ ID NO: 6553072 - DNA, 22 bp, Homo sapiens
ttgtgtgttccaagtttccaaa

SEQ ID NO: 6553073 - DNA, 22 bp, Homo sapiens
ttgtgtgttgcactcaagttgt

SEQ ID NO: 6553074 - DNA, 12 bp, Homo sapiens
ttgtgtgtttca

SEQ ID NO: 6553075 - DNA, 19 bp, Homo sapiens
ttgtgttaacttgcctcca

SEQ ID NO: 6553076 - DNA, 19 bp, Homo sapiens
ttgtgttaattctttctca

SEQ ID NO: 6553077 - DNA, 19 bp, Homo sapiens
ttgtgttacaataagtgtt

SEQ ID NO: 6553078 - DNA, 19 bp, Homo sapiens
ttgtgttactaatttgtat

SEQ ID NO: 6553079 - DNA, 19 bp, Homo sapiens
ttgtgttactgcagtgacc

SEQ ID NO: 6553080 - DNA, 16 bp, Homo sapiens
ttgtgttcagaagaat

SEQ ID NO: 6553081 - DNA, 17 bp, Homo sapiens
ttgtgttcagttccagc

SEQ ID NO: 6553082 - DNA, 20 bp, Homo sapiens
ttgtgttcctacagacactt

SEQ ID NO: 6553083 - DNA, 17 bp, Homo sapiens
ttgtgttcctatggaaa

SEQ ID NO: 6553084 - DNA, 18 bp, Homo sapiens
ttgtgttcctatggaaac

SEQ ID NO: 6553085 - DNA, 18 bp, Homo sapiens
ttgtgttcctctttgcat

SEQ ID NO: 6553086 - DNA, 15 bp, Homo sapiens
ttgtgttcctggctg

SEQ ID NO: 6553087 - DNA, 11 bp, Homo sapiens
ttgtgttcctt

SEQ ID NO: 6553088 - DNA, 16 bp, Homo sapiens
ttgtgttcctttttat

SEQ ID NO: 6553089 - DNA, 16 bp, Homo sapiens
ttgtgttctgagtgaa

SEQ ID NO: 6553090 - DNA, 13 bp, Homo sapiens
ttgtgttctgtag

SEQ ID NO: 6553091 - DNA, 14 bp, Homo sapiens
ttgtgttctgtaga

SEQ ID NO: 6553092 - DNA, 22 bp, Homo sapiens
ttgtgttctgtttgttaaaact

SEQ ID NO: 6553093 - DNA, 15 bp, Homo sapiens
ttgtgttctgttttg

SEQ ID NO: 6553094 - DNA, 11 bp, Homo sapiens
ttgtgttctta

SEQ ID NO: 6553095 - DNA, 13 bp, Homo sapiens
ttgtgttcttaaa

SEQ ID NO: 6553096 - DNA, 12 bp, Homo sapiens
ttgtgttgaaga

SEQ ID NO: 6553097 - DNA, 18 bp, Homo sapiens
ttgtgttgaagagcagct

SEQ ID NO: 6553098 - DNA, 20 bp, Homo sapiens
ttgtgttgaagaggttttaa

SEQ ID NO: 6553099 - DNA, 13 bp, Homo sapiens
ttgtgttgacatt

SEQ ID NO: 6553100 - DNA, 22 bp, Homo sapiens
ttgtgttgactttataaatttc

SEQ ID NO: 6553101 - DNA, 22 bp, Homo sapiens
ttgtgttgccttagcacttctt

SEQ ID NO: 6553102 - DNA, 13 bp, Homo sapiens
ttgtgttgctttc

SEQ ID NO: 6553103 - DNA, 15 bp, Homo sapiens
ttgtgttggtattta

SEQ ID NO: 6553104 - DNA, 18 bp, Homo sapiens
ttgtgttggtatttactg

SEQ ID NO: 6553105 - DNA, 13 bp, Homo sapiens
ttgtgttgtaatt

SEQ ID NO: 6553106 - DNA, 13 bp, Homo sapiens
ttgtgttgtacaa

SEQ ID NO: 6553107 - DNA, 18 bp, Homo sapiens
ttgtgttgtcactaaact

SEQ ID NO: 6553108 - DNA, 15 bp, Homo sapiens
ttgtgttgttttctc

SEQ ID NO: 6553109 - DNA, 23 bp, Homo sapiens
ttgtgttgttttctctgatcaca

SEQ ID NO: 6553110 - DNA, 23 bp, Homo sapiens
ttgtgttgttttttgttcaatgt

SEQ ID NO: 6553111 - DNA, 22 bp, Homo sapiens
ttgtgtttaactgtgaacaaat

SEQ ID NO: 6553112 - DNA, 18 bp, Homo sapiens
ttgtgtttacattttatg

SEQ ID NO: 6553113 - DNA, 18 bp, Homo sapiens
ttgtgtttagctaccttt

SEQ ID NO: 6553114 - DNA, 12 bp, Homo sapiens
ttgtgtttagga

SEQ ID NO: 6553115 - DNA, 21 bp, Homo sapiens
ttgtgtttatatataagccaa

SEQ ID NO: 6553116 - DNA, 21 bp, Homo sapiens
ttgtgtttcacaaaattaagt

SEQ ID NO: 6553117 - DNA, 19 bp, Homo sapiens
ttgtgtttctttagttttt

SEQ ID NO: 6553118 - DNA, 16 bp, Homo sapiens
ttgtgtttgcttggtg

SEQ ID NO: 6553119 - DNA, 17 bp, Homo sapiens
ttgtgtttggtttacat

SEQ ID NO: 6553120 - DNA, 18 bp, Homo sapiens
ttgtgtttggtttacatt

SEQ ID NO: 6553121 - DNA, 12 bp, Homo sapiens
ttgtgtttgtat

SEQ ID NO: 6553122 - DNA, 20 bp, Homo sapiens
ttgtgtttgtcattagcctg

SEQ ID NO: 6553123 - DNA, 13 bp, Homo sapiens
ttgtgttttaaca

SEQ ID NO: 6553124 - DNA, 21 bp, Homo sapiens
ttgtgttttcctaaacacact

SEQ ID NO: 6553125 - DNA, 16 bp, Homo sapiens
ttgtgttttcttgtaa

SEQ ID NO: 6553126 - DNA, 15 bp, Homo sapiens
ttgtgttttgtccaa

SEQ ID NO: 6553127 - DNA, 22 bp, Homo sapiens
ttgttaaaaacatgtgaaagat

SEQ ID NO: 6553128 - DNA, 15 bp, Homo sapiens
ttgttaaaaatgtca

SEQ ID NO: 6553129 - DNA, 21 bp, Homo sapiens
ttgttaaaacacaaaatgaat

SEQ ID NO: 6553130 - DNA, 18 bp, Homo sapiens
ttgttaaaaccttactta

SEQ ID NO: 6553131 - DNA, 16 bp, Homo sapiens
ttgttaaaatctactt

SEQ ID NO: 6553132 - DNA, 18 bp, Homo sapiens
ttgttaaaatctactttt

SEQ ID NO: 6553133 - DNA, 16 bp, Homo sapiens
ttgttaaaattatgaa

SEQ ID NO: 6553134 - DNA, 22 bp, Homo sapiens
ttgttaaaattatgaatctgat

SEQ ID NO: 6553135 - DNA, 15 bp, Homo sapiens
ttgttaaacaaatga

SEQ ID NO: 6553136 - DNA, 16 bp, Homo sapiens
ttgttaaagagcactg

SEQ ID NO: 6553137 - DNA, 12 bp, Homo sapiens
ttgttaaagctg

SEQ ID NO: 6553138 - DNA, 22 bp, Homo sapiens
ttgttaaagctggaacatttga

SEQ ID NO: 6553139 - DNA, 17 bp, Homo sapiens
ttgttaaaggcaatggt

SEQ ID NO: 6553140 - DNA, 16 bp, Homo sapiens
ttgttaaatacacatt

SEQ ID NO: 6553141 - DNA, 15 bp, Homo sapiens
ttgttaaatgctatg

SEQ ID NO: 6553142 - DNA, 23 bp, Homo sapiens
ttgttaaatgctatggaaataca

SEQ ID NO: 6553143 - DNA, 18 bp, Homo sapiens
ttgttaaattacattttt

SEQ ID NO: 6553144 - DNA, 20 bp, Homo sapiens
ttgttaacagacactgtaaa

SEQ ID NO: 6553145 - DNA, 23 bp, Homo sapiens
ttgttaacagacactgtaaaata

SEQ ID NO: 6553146 - DNA, 14 bp, Homo sapiens
ttgttaacagcaac

SEQ ID NO: 6553147 - DNA, 22 bp, Homo sapiens
ttgttaactcttgtctattttt

SEQ ID NO: 6553148 - DNA, 23 bp, Homo sapiens
ttgttaacttcaggtaaaaactt

SEQ ID NO: 6553149 - DNA, 14 bp, Homo sapiens
ttgttaactttggg

SEQ ID NO: 6553150 - DNA, 18 bp, Homo sapiens
ttgttaagctcaggattt

SEQ ID NO: 6553151 - DNA, 17 bp, Homo sapiens
ttgttaagggcattttt

SEQ ID NO: 6553152 - DNA, 22 bp, Homo sapiens
ttgttaagtatcagctacaatt

SEQ ID NO: 6553153 - DNA, 17 bp, Homo sapiens
ttgttaagtccttggct

SEQ ID NO: 6553154 - DNA, 19 bp, Homo sapiens
ttgttaataaaagtacatg

SEQ ID NO: 6553155 - DNA, 18 bp, Homo sapiens
ttgttaatataatttaac

SEQ ID NO: 6553156 - DNA, 17 bp, Homo sapiens
ttgttaatattcatttt

SEQ ID NO: 6553157 - DNA, 14 bp, Homo sapiens
ttgttaatattctt

SEQ ID NO: 6553158 - DNA, 19 bp, Homo sapiens
ttgttaatgaaaatgtcag

SEQ ID NO: 6553159 - DNA, 12 bp, Homo sapiens
ttgttaatgcat

SEQ ID NO: 6553160 - DNA, 15 bp, Homo sapiens
ttgttaatgcattgt

SEQ ID NO: 6553161 - DNA, 21 bp, Homo sapiens
ttgttaatgcattgttgtaaa

SEQ ID NO: 6553162 - DNA, 20 bp, Homo sapiens
ttgttaatgctctatgtttg

SEQ ID NO: 6553163 - DNA, 21 bp, Homo sapiens
ttgttaatgctctatgtttgt

SEQ ID NO: 6553164 - DNA, 17 bp, Homo sapiens
ttgttaatggtgcaaat

SEQ ID NO: 6553165 - DNA, 16 bp, Homo sapiens
ttgttaatgttctgaa

SEQ ID NO: 6553166 - DNA, 21 bp, Homo sapiens
ttgttaatgttgggatttata

SEQ ID NO: 6553167 - DNA, 17 bp, Homo sapiens
ttgttaattcctatgaa

SEQ ID NO: 6553168 - DNA, 19 bp, Homo sapiens
ttgttaatttatctgttgt

SEQ ID NO: 6553169 - DNA, 16 bp, Homo sapiens
ttgttaattttcctca

SEQ ID NO: 6553170 - DNA, 15 bp, Homo sapiens
ttgttacaagtgttc

SEQ ID NO: 6553171 - DNA, 17 bp, Homo sapiens
ttgttacaggtgtacta

SEQ ID NO: 6553172 - DNA, 14 bp, Homo sapiens
ttgttacattttta

SEQ ID NO: 6553173 - DNA, 21 bp, Homo sapiens
ttgttaccaaatacacatttc

SEQ ID NO: 6553174 - DNA, 17 bp, Homo sapiens
ttgttaccatgaagata

SEQ ID NO: 6553175 - DNA, 23 bp, Homo sapiens
ttgttacctccaacagaactaaa

SEQ ID NO: 6553176 - DNA, 22 bp, Homo sapiens
ttgttacctgtcattttgcact

SEQ ID NO: 6553177 - DNA, 12 bp, Homo sapiens
ttgttaccttta

SEQ ID NO: 6553178 - DNA, 19 bp, Homo sapiens
ttgttaccttttacagaat

SEQ ID NO: 6553179 - DNA, 22 bp, Homo sapiens
ttgttactcatcgggcccaggg

SEQ ID NO: 6553180 - DNA, 22 bp, Homo sapiens
ttgttactctggttctttgttt

SEQ ID NO: 6553181 - DNA, 15 bp, Homo sapiens
ttgttactcttggga

SEQ ID NO: 6553182 - DNA, 18 bp, Homo sapiens
ttgttactgattcaatta

SEQ ID NO: 6553183 - DNA, 19 bp, Homo sapiens
tgtttttctttttccacaa

SEQ ID NO: 6553184 - DNA, 19 bp, Homo sapiens
tgtttttgaaacccacagt

SEQ ID NO: 6553185 - DNA, 14 bp, Homo sapiens
tgtttttgaagaag

SEQ ID NO: 6553186 - DNA, 13 bp, Homo sapiens
tgtttttgaattt

SEQ ID NO: 6553187 - DNA, 16 bp, Homo sapiens
tgtttttgcacatgtt

SEQ ID NO: 6553188 - DNA, 13 bp, Homo sapiens
tgtttttgcatga

SEQ ID NO: 6553189 - DNA, 14 bp, Homo sapiens
tgtttttgcatttt

SEQ ID NO: 6553190 - DNA, 13 bp, Homo sapiens
tgtttttgccaaa

SEQ ID NO: 6553191 - DNA, 18 bp, Homo sapiens
tgtttttgccactgattt

SEQ ID NO: 6553192 - DNA, 11 bp, Homo sapiens
tgtttttgcta

SEQ ID NO: 6553193 - DNA, 20 bp, Homo sapiens
tgtttttgcttgttatatta

SEQ ID NO: 6553194 - DNA, 14 bp, Homo sapiens
tgtttttgggaaga

SEQ ID NO: 6553195 - DNA, 18 bp, Homo sapiens
tgtttttgggatgtctta

SEQ ID NO: 6553196 - DNA, 14 bp, Homo sapiens
tgtttttggtttct

SEQ ID NO: 6553197 - DNA, 23 bp, Homo sapiens
tgtttttggtttcttattcaaag

SEQ ID NO: 6553198 - DNA, 15 bp, Homo sapiens
tgtttttgtaaagtg

SEQ ID NO: 6553199 - DNA, 11 bp, Homo sapiens
tgtttttgtag

SEQ ID NO: 6553200 - DNA, 14 bp, Homo sapiens
tgtttttgtattta

SEQ ID NO: 6553201 - DNA, 20 bp, Homo sapiens
tgtttttgtcaactgcttgt

SEQ ID NO: 6553202 - DNA, 13 bp, Homo sapiens
tgtttttgttgtg

SEQ ID NO: 6553203 - DNA, 9 bp, Homo sapiens
tgtttttta

SEQ ID NO: 6553204 - DNA, 14 bp, Homo sapiens
tgttttttaaaaaa

SEQ ID NO: 6553205 - DNA, 18 bp, Homo sapiens
tgttttttaaaaaagcct

SEQ ID NO: 6553206 - DNA, 14 bp, Homo sapiens
tgttttttaaagca

SEQ ID NO: 6553207 - DNA, 12 bp, Homo sapiens
tgttttttaaga

SEQ ID NO: 6553208 - DNA, 11 bp, Homo sapiens
tgttttttaat

SEQ ID NO: 6553209 - DNA, 15 bp, Homo sapiens
tgttttttatgaagt

SEQ ID NO: 6553210 - DNA, 17 bp, Homo sapiens
tgttttttatgaagtgc

SEQ ID NO: 6553211 - DNA, 13 bp, Homo sapiens
tgttttttatgtt

SEQ ID NO: 6553212 - DNA, 13 bp, Homo sapiens
tgttttttcaaaa

SEQ ID NO: 6553213 - DNA, 23 bp, Homo sapiens
tgttttttcaaaatagaaaagtt

SEQ ID NO: 6553214 - DNA, 14 bp, Homo sapiens
tgttttttcatgtg

SEQ ID NO: 6553215 - DNA, 21 bp, Homo sapiens
tgttttttcattgtgttttct

SEQ ID NO: 6553216 - DNA, 14 bp, Homo sapiens
tgttttttcatttg

SEQ ID NO: 6553217 - DNA, 17 bp, Homo sapiens
tgttttttcatttgtaa

SEQ ID NO: 6553218 - DNA, 18 bp, Homo sapiens
tgttttttcatttgtaaa

SEQ ID NO: 6553219 - DNA, 19 bp, Homo sapiens
tgttttttcatttgtaaaa

SEQ ID NO: 6553220 - DNA, 14 bp, Homo sapiens
tgttttttctgtaa

SEQ ID NO: 6553221 - DNA, 14 bp, Homo sapiens
tgttttttctttaa

SEQ ID NO: 6553222 - DNA, 16 bp, Homo sapiens
tgttttttctttataa

SEQ ID NO: 6553223 - DNA, 22 bp, Homo sapiens
tgttttttctttttttttaagt

SEQ ID NO: 6553224 - DNA, 16 bp, Homo sapiens
tgttttttgaaaacat

SEQ ID NO: 6553225 - DNA, 13 bp, Homo sapiens
tgttttttgaagt

SEQ ID NO: 6553226 - DNA, 18 bp, Homo sapiens
tgttttttgccacagctt

SEQ ID NO: 6553227 - DNA, 16 bp, Homo sapiens
tgttttttggtctttt

SEQ ID NO: 6553228 - DNA, 11 bp, Homo sapiens
tgttttttgta

SEQ ID NO: 6553229 - DNA, 12 bp, Homo sapiens
tgttttttgtaa

SEQ ID NO: 6553230 - DNA, 15 bp, Homo sapiens
tgttttttgtaacta

SEQ ID NO: 6553231 - DNA, 21 bp, Homo sapiens
tgttttttgtaactacaaagc

SEQ ID NO: 6553232 - DNA, 16 bp, Homo sapiens
tgttttttgttcaatg

SEQ ID NO: 6553233 - DNA, 23 bp, Homo sapiens
tgttttttgttcaatgttccatt

SEQ ID NO: 6553234 - DNA, 18 bp, Homo sapiens
tgttttttgttttcatta

SEQ ID NO: 6553235 - DNA, 21 bp, Homo sapiens
tgtttttttaaatattatgct

SEQ ID NO: 6553236 - DNA, 19 bp, Homo sapiens
tgtttttttaactgcattt

SEQ ID NO: 6553237 - DNA, 23 bp, Homo sapiens
tgtttttttaatttctaagaagt

SEQ ID NO: 6553238 - DNA, 21 bp, Homo sapiens
tgtttttttagggtttctgat

SEQ ID NO: 6553239 - DNA, 12 bp, Homo sapiens
tgtttttttcct

SEQ ID NO: 6553240 - DNA, 21 bp, Homo sapiens
tgtttttttcctcatgtaaca

SEQ ID NO: 6553241 - DNA, 17 bp, Homo sapiens
tgtttttttctaaaaag

SEQ ID NO: 6553242 - DNA, 21 bp, Homo sapiens
tgtttttttctcctgcaaatt

SEQ ID NO: 6553243 - DNA, 16 bp, Homo sapiens
tgtttttttgttatta

SEQ ID NO: 6553244 - DNA, 20 bp, Homo sapiens
tgttttttttaagggcatgt

SEQ ID NO: 6553245 - DNA, 17 bp, Homo sapiens
tgttttttttcagccac

SEQ ID NO: 6553246 - DNA, 14 bp, Homo sapiens
tgttttttttcctt

SEQ ID NO: 6553247 - DNA, 21 bp, Homo sapiens
tgttttttttgactaaagcta

SEQ ID NO: 6553248 - DNA, 18 bp, Homo sapiens
tgttttttttttccactt

SEQ ID NO: 6553249 - DNA, 19 bp, Homo sapiens
tgttttttttttccactta

SEQ ID NO: 6553250 - DNA, 20 bp, Homo sapiens
tgttttttttttgtgtgtgc

SEQ ID NO: 6553251 - DNA, 16 bp, Homo sapiens
tgtttttttttttaag

SEQ ID NO: 6553252 - DNA, 22 bp, Homo sapiens
tgttttttttttttgtatttct

SEQ ID NO: 6553253 - DNA, 21 bp, Homo sapiens
tgtttttttttttttacatgt

SEQ ID NO: 6553254 - DNA, 21 bp, Homo sapiens
tgttttttttttttttgctta

SEQ ID NO: 6553255 - DNA, 19 bp, Homo sapiens
ttaaaaaaaaaaaaaagct

SEQ ID NO: 6553256 - DNA, 15 bp, Homo sapiens
ttaaaaaaaaaaaat

SEQ ID NO: 6553257 - DNA, 15 bp, Homo sapiens
ttaaaaaaaaaaaca

SEQ ID NO: 6553258 - DNA, 16 bp, Homo sapiens
ttaaaaaaaaaagtca

SEQ ID NO: 6553259 - DNA, 13 bp, Homo sapiens
ttaaaaaaaaaat

SEQ ID NO: 6553260 - DNA, 19 bp, Homo sapiens
ttaaaaaaaaaatcagtgt

SEQ ID NO: 6553261 - DNA, 14 bp, Homo sapiens
ttaaaaaaaaacat

SEQ ID NO: 6553262 - DNA, 22 bp, Homo sapiens
ttaaaaaaaaacctgagcccca

SEQ ID NO: 6553263 - DNA, 13 bp, Homo sapiens
ttaaaaaaaaaga

SEQ ID NO: 6553264 - DNA, 20 bp, Homo sapiens
ttaaaaaaaaagttggtatt

SEQ ID NO: 6553265 - DNA, 19 bp, Homo sapiens
ttaaaaaaaaatactcttt

SEQ ID NO: 6553266 - DNA, 19 bp, Homo sapiens
ttaaaaaaaacaaaaagaa

SEQ ID NO: 6553267 - DNA, 23 bp, Homo sapiens
ttaaaaaaaacaaaaagaacaaa

SEQ ID NO: 6553268 - DNA, 14 bp, Homo sapiens
ttaaaaaaaactca

SEQ ID NO: 6553269 - DNA, 14 bp, Homo sapiens
ttaaaaaaaataat

SEQ ID NO: 6553270 - DNA, 13 bp, Homo sapiens
ttaaaaaaaatgt

SEQ ID NO: 6553271 - DNA, 15 bp, Homo sapiens
ttaaaaaaaatgtga

SEQ ID NO: 6553272 - DNA, 18 bp, Homo sapiens
ttaaaaaaaatgtgaaat

SEQ ID NO: 6553273 - DNA, 12 bp, Homo sapiens
ttaaaaaaacaa

SEQ ID NO: 6553274 - DNA, 15 bp, Homo sapiens
ttaaaaaaacaaata

SEQ ID NO: 6553275 - DNA, 16 bp, Homo sapiens
ttaaaaaaacaaatgt

SEQ ID NO: 6553276 - DNA, 22 bp, Homo sapiens
ttaaaaaaacaaattggacagc

SEQ ID NO: 6553277 - DNA, 11 bp, Homo sapiens
ttaaaaaaact

SEQ ID NO: 6553278 - DNA, 15 bp, Homo sapiens
ttaaaaaaactgaag

SEQ ID NO: 6553279 - DNA, 13 bp, Homo sapiens
ttaaaaaaagaaa

SEQ ID NO: 6553280 - DNA, 18 bp, Homo sapiens
ttaaaaaaagctaaatta

SEQ ID NO: 6553281 - DNA, 13 bp, Homo sapiens
ttaaaaaaaggaa

SEQ ID NO: 6553282 - DNA, 19 bp, Homo sapiens
ttaaaaaaaggaaaactca

SEQ ID NO: 6553283 - DNA, 22 bp, Homo sapiens
ttaaaaaaagtatatattctac

SEQ ID NO: 6553284 - DNA, 12 bp, Homo sapiens
ttaaaaaaataa

SEQ ID NO: 6553285 - DNA, 23 bp, Homo sapiens
ttaaaaaaataaaacattttaaa

SEQ ID NO: 6553286 - DNA, 15 bp, Homo sapiens
ttaaaaaaataacat

SEQ ID NO: 6553287 - DNA, 19 bp, Homo sapiens
ttaaaaaaataatataaat

SEQ ID NO: 6553288 - DNA, 23 bp, Homo sapiens
ttaaaaaaatcacactctaagtt

SEQ ID NO: 6553289 - DNA, 23 bp, Homo sapiens
ttaaaaaaatcccatttatgcaa

SEQ ID NO: 6553290 - DNA, 14 bp, Homo sapiens
ttaaaaaaatgaca

SEQ ID NO: 6553291 - DNA, 18 bp, Homo sapiens
ttaaaaaaattactgtga

SEQ ID NO: 6553292 - DNA, 16 bp, Homo sapiens
ttaaaaaaatttaagt

SEQ ID NO: 6553293 - DNA, 12 bp, Homo sapiens
ttaaaaaacaaa

SEQ ID NO: 6553294 - DNA, 12 bp, Homo sapiens
ttaaaaaacaac

SEQ ID NO: 6553295 - DNA, 12 bp, Homo sapiens
ttaaaaaacaat

SEQ ID NO: 6553296 - DNA, 22 bp, Homo sapiens
ttaaaaaacaattggttgtata

SEQ ID NO: 6553297 - DNA, 22 bp, Homo sapiens
ttaaaaaacagcttgttctaga

SEQ ID NO: 6553298 - DNA, 17 bp, Homo sapiens
ttaaaaaactattttat

SEQ ID NO: 6553299 - DNA, 23 bp, Homo sapiens
ttaaaaaactctttggtgcacaa

SEQ ID NO: 6553300 - DNA, 22 bp, Homo sapiens
ttaaaaaactttctactcattt

SEQ ID NO: 6553301 - DNA, 11 bp, Homo sapiens
ttaaaaaagaa

SEQ ID NO: 6553302 - DNA, 19 bp, Homo sapiens
ttaaaaaagaaagatttta

SEQ ID NO: 6553303 - DNA, 22 bp, Homo sapiens
ttaaaaaagaaatctgtttcaa

SEQ ID NO: 6553304 - DNA, 19 bp, Homo sapiens
ttaaaaaagaaattatctt

SEQ ID NO: 6553305 - DNA, 21 bp, Homo sapiens
ttaaaaaagaaattatcttta

SEQ ID NO: 6553306 - DNA, 22 bp, Homo sapiens
ttaaaaaagactgaacatgttt

SEQ ID NO: 6553307 - DNA, 13 bp, Homo sapiens
ttaaaaaagagac

SEQ ID NO: 6553308 - DNA, 18 bp, Homo sapiens
ttaaaaaagcaaggcaca

SEQ ID NO: 6553309 - DNA, 21 bp, Homo sapiens
ttaaaaaagcctggtttttct

SEQ ID NO: 6553310 - DNA, 12 bp, Homo sapiens
ttaaaaaagctt

SEQ ID NO: 6553311 - DNA, 22 bp, Homo sapiens
ttaaaaaagttgtaatagagaa

SEQ ID NO: 6553312 - DNA, 15 bp, Homo sapiens
ttaaaaaagtttaaa

SEQ ID NO: 6553313 - DNA, 20 bp, Homo sapiens
ttaaaaaataaaaaaataca

SEQ ID NO: 6553314 - DNA, 21 bp, Homo sapiens
ttaaaaaataaaaaaatacag

SEQ ID NO: 6553315 - DNA, 23 bp, Homo sapiens
ttaaaaaataaaaaaatacagta

SEQ ID NO: 6553316 - DNA, 18 bp, Homo sapiens
ttaaaaaataaatataat

SEQ ID NO: 6553317 - DNA, 13 bp, Homo sapiens
ttaaaaaataaca

SEQ ID NO: 6553318 - DNA, 14 bp, Homo sapiens
ttaaaaaataacat

SEQ ID NO: 6553319 - DNA, 23 bp, Homo sapiens
ttaaaaaataggtggtagatatt

SEQ ID NO: 6553320 - DNA, 14 bp, Homo sapiens
ttaaaaaatagttg

SEQ ID NO: 6553321 - DNA, 15 bp, Homo sapiens
ttaaaaaatatttat

SEQ ID NO: 6553322 - DNA, 12 bp, Homo sapiens
ttaaaaaatcaa

SEQ ID NO: 6553323 - DNA, 19 bp, Homo sapiens
ttaaaaaatcaatcaatgg

SEQ ID NO: 6553324 - DNA, 16 bp, Homo sapiens
ttaaaaaatgaaaata

SEQ ID NO: 6553325 - DNA, 13 bp, Homo sapiens
ttaaaaaatgtga

SEQ ID NO: 6553326 - DNA, 16 bp, Homo sapiens
ttaaaaaatttttgaa

SEQ ID NO: 6553327 - DNA, 20 bp, Homo sapiens
ttaaaaaattttttgattaa

SEQ ID NO: 6553328 - DNA, 13 bp, Homo sapiens
ttaaaaacaaaaa

SEQ ID NO: 6553329 - DNA, 16 bp, Homo sapiens
ttaaaaacaaaaggca

SEQ ID NO: 6553330 - DNA, 18 bp, Homo sapiens
ttaaaaacaaatgagttt

SEQ ID NO: 6553331 - DNA, 14 bp, Homo sapiens
ttaaaaacaggaaa

SEQ ID NO: 6553332 - DNA, 19 bp, Homo sapiens
ttaaaaacataacataaat

SEQ ID NO: 6553333 - DNA, 15 bp, Homo sapiens
ttaaaaacatagaaa

SEQ ID NO: 6553334 - DNA, 20 bp, Homo sapiens
ttaaaaacatagaaaaatga

SEQ ID NO: 6553335 - DNA, 14 bp, Homo sapiens
ttaaaaacatgaat

SEQ ID NO: 6553336 - DNA, 15 bp, Homo sapiens
ttaaaaacatgacca

SEQ ID NO: 6553337 - DNA, 19 bp, Homo sapiens
ttaaaaacatgagaaatgt

SEQ ID NO: 6553338 - DNA, 22 bp, Homo sapiens
ttaaaaacattccccaattatc

SEQ ID NO: 6553339 - DNA, 19 bp, Homo sapiens
ttaaaaacatttttttaag

SEQ ID NO: 6553340 - DNA, 18 bp, Homo sapiens
ttaaaaacctattttgaa

SEQ ID NO: 6553341 - DNA, 15 bp, Homo sapiens
ttaaaaacctttttg

SEQ ID NO: 6553342 - DNA, 18 bp, Homo sapiens
ttaaaaactcttcagtgc

SEQ ID NO: 6553343 - DNA, 23 bp, Homo sapiens
ttaaaaactgtgtatcattaaaa

SEQ ID NO: 6553344 - DNA, 10 bp, Homo sapiens
ttaaaaactt

SEQ ID NO: 6553345 - DNA, 18 bp, Homo sapiens
ttaaaaactttaaagata

SEQ ID NO: 6553346 - DNA, 17 bp, Homo sapiens
ttaaaaagaaatccagt

SEQ ID NO: 6553347 - DNA, 15 bp, Homo sapiens
ttaaaaagaagtttc

SEQ ID NO: 6553348 - DNA, 16 bp, Homo sapiens
ttaaaaagaatgacgt

SEQ ID NO: 6553349 - DNA, 16 bp, Homo sapiens
ttaaaaagacactttt

SEQ ID NO: 6553350 - DNA, 21 bp, Homo sapiens
ttaaaaagacacttttaccga

SEQ ID NO: 6553351 - DNA, 12 bp, Homo sapiens
ttaaaaagcaaa

SEQ ID NO: 6553352 - DNA, 19 bp, Homo sapiens
ttaaaaagcagtttttgaa

SEQ ID NO: 6553353 - DNA, 18 bp, Homo sapiens
ttaaaaagcatgttgtga

SEQ ID NO: 6553354 - DNA, 17 bp, Homo sapiens
ttaaaaagctaatgaca

SEQ ID NO: 6553355 - DNA, 21 bp, Homo sapiens
ttaaaaaggaaatttgtttgt

SEQ ID NO: 6553356 - DNA, 12 bp, Homo sapiens
ttaaaaaggaac

SEQ ID NO: 6553357 - DNA, 19 bp, Homo sapiens
ttaaaaaggaactgcagca

SEQ ID NO: 6553358 - DNA, 18 bp, Homo sapiens
ttaaaaaggaattttgta

SEQ ID NO: 6553359 - DNA, 13 bp, Homo sapiens
ttaaaaaggcctt

SEQ ID NO: 6553360 - DNA, 16 bp, Homo sapiens
ttaaaaaggcctttgg

SEQ ID NO: 6553361 - DNA, 22 bp, Homo sapiens
ttaaaaagggagaaagaaaact

SEQ ID NO: 6553362 - DNA, 23 bp, Homo sapiens
ttaaaaagggcagggcatctcct

SEQ ID NO: 6553363 - DNA, 17 bp, Homo sapiens
ttaaaaagggtaacttg

SEQ ID NO: 6553364 - DNA, 14 bp, Homo sapiens
ttgttactgcatca

SEQ ID NO: 6553365 - DNA, 15 bp, Homo sapiens
ttgttactgttctga

SEQ ID NO: 6553366 - DNA, 20 bp, Homo sapiens
ttgttactgttcttgctgct

SEQ ID NO: 6553367 - DNA, 23 bp, Homo sapiens
ttgttactgttcttgctgctaga

SEQ ID NO: 6553368 - DNA, 24 bp, Homo sapiens
ttgttactgttcttgctgctagaa

SEQ ID NO: 6553369 - DNA, 20 bp, Homo sapiens
ttgttacttctctaattctt

SEQ ID NO: 6553370 - DNA, 22 bp, Homo sapiens
ttgttagaaaacaaaattttat

SEQ ID NO: 6553371 - DNA, 12 bp, Homo sapiens
ttgttagaaagt

SEQ ID NO: 6553372 - DNA, 13 bp, Homo sapiens
ttgttagagagaa

SEQ ID NO: 6553373 - DNA, 16 bp, Homo sapiens
ttgttagatagctgca

SEQ ID NO: 6553374 - DNA, 16 bp, Homo sapiens
ttgttagcaaatgaca

SEQ ID NO: 6553375 - DNA, 22 bp, Homo sapiens
ttgttagcattttcaatgtgat

SEQ ID NO: 6553376 - DNA, 20 bp, Homo sapiens
ttgttagcttccttaagtat

SEQ ID NO: 6553377 - DNA, 19 bp, Homo sapiens
ttgttaggaaaaaattgaa

SEQ ID NO: 6553378 - DNA, 20 bp, Homo sapiens
ttgttaggccaaagacaaat

SEQ ID NO: 6553379 - DNA, 17 bp, Homo sapiens
ttgttaggctgtaaaga

SEQ ID NO: 6553380 - DNA, 13 bp, Homo sapiens
ttgttaggggtgg

SEQ ID NO: 6553381 - DNA, 22 bp, Homo sapiens
ttgttaggggtgggggagaatg

SEQ ID NO: 6553382 - DNA, 22 bp, Homo sapiens
ttgttaggttttctatgtgact

SEQ ID NO: 6553383 - DNA, 21 bp, Homo sapiens
ttgttagtatgaggcatttgt

SEQ ID NO: 6553384 - DNA, 17 bp, Homo sapiens
ttgttagtgatttgcta

SEQ ID NO: 6553385 - DNA, 15 bp, Homo sapiens
ttgttagtggacttg

SEQ ID NO: 6553386 - DNA, 16 bp, Homo sapiens
ttgttagtttacaata

SEQ ID NO: 6553387 - DNA, 18 bp, Homo sapiens
ttgttagtttacaatatt

SEQ ID NO: 6553388 - DNA, 16 bp, Homo sapiens
ttgttagtttagtgtg

SEQ ID NO: 6553389 - DNA, 17 bp, Homo sapiens
ttgttagtttagtgtgt

SEQ ID NO: 6553390 - DNA, 14 bp, Homo sapiens
ttgttatacattta

SEQ ID NO: 6553391 - DNA, 13 bp, Homo sapiens
ttgttatacttca

SEQ ID NO: 6553392 - DNA, 18 bp, Homo sapiens
ttgttatagttcatagtt

SEQ ID NO: 6553393 - DNA, 14 bp, Homo sapiens
ttgttatatataat

SEQ ID NO: 6553394 - DNA, 19 bp, Homo sapiens
ttgttatattataattgga

SEQ ID NO: 6553395 - DNA, 18 bp, Homo sapiens
ttgttatcatttaagatt

SEQ ID NO: 6553396 - DNA, 13 bp, Homo sapiens
ttgttatgacagt

SEQ ID NO: 6553397 - DNA, 17 bp, Homo sapiens
ttgttatgatgtgctta

SEQ ID NO: 6553398 - DNA, 18 bp, Homo sapiens
ttgttatgccttgctatt

SEQ ID NO: 6553399 - DNA, 14 bp, Homo sapiens
ttgttatggcttaa

SEQ ID NO: 6553400 - DNA, 19 bp, Homo sapiens
ttgttatggcttaatgaca

SEQ ID NO: 6553401 - DNA, 14 bp, Homo sapiens
ttgttatgtacaaa

SEQ ID NO: 6553402 - DNA, 13 bp, Homo sapiens
ttgttatgtatat

SEQ ID NO: 6553403 - DNA, 14 bp, Homo sapiens
ttgttattaaatgt

SEQ ID NO: 6553404 - DNA, 15 bp, Homo sapiens
ttgttattataacat

SEQ ID NO: 6553405 - DNA, 14 bp, Homo sapiens
ttgttattccatca

SEQ ID NO: 6553406 - DNA, 15 bp, Homo sapiens
ttgttattgaagtgt

SEQ ID NO: 6553407 - DNA, 23 bp, Homo sapiens
ttgttattgggcaagtgattgaa

SEQ ID NO: 6553408 - DNA, 17 bp, Homo sapiens
ttgttattgtggaagat

SEQ ID NO: 6553409 - DNA, 13 bp, Homo sapiens
ttgttatttcaat

SEQ ID NO: 6553410 - DNA, 23 bp, Homo sapiens
ttgttatttgaaaacatgtttat

SEQ ID NO: 6553411 - DNA, 15 bp, Homo sapiens
ttgttattttgcaac

SEQ ID NO: 6553412 - DNA, 22 bp, Homo sapiens
ttgttattttgcaacctcgctg

SEQ ID NO: 6553413 - DNA, 15 bp, Homo sapiens
ttgttattttggaaa

SEQ ID NO: 6553414 - DNA, 14 bp, Homo sapiens
ttgttattttttca

SEQ ID NO: 6553415 - DNA, 15 bp, Homo sapiens
ttgttcaaatgcatt

SEQ ID NO: 6553416 - DNA, 14 bp, Homo sapiens
ttgttcaactccct

SEQ ID NO: 6553417 - DNA, 18 bp, Homo sapiens
ttgttcaagcttttcctt

SEQ ID NO: 6553418 - DNA, 18 bp, Homo sapiens
ttgttcaagtatctaact

SEQ ID NO: 6553419 - DNA, 19 bp, Homo sapiens
ttgttcaataataaatatt

SEQ ID NO: 6553420 - DNA, 20 bp, Homo sapiens
ttgttcaataataaatattt

SEQ ID NO: 6553421 - DNA, 13 bp, Homo sapiens
ttgttcaattaga

SEQ ID NO: 6553422 - DNA, 15 bp, Homo sapiens
ttgttcaattagaat

SEQ ID NO: 6553423 - DNA, 20 bp, Homo sapiens
ttgttcacctctgtacagac

SEQ ID NO: 6553424 - DNA, 18 bp, Homo sapiens
ttgttcaccttctgtgca

SEQ ID NO: 6553425 - DNA, 15 bp, Homo sapiens
ttgttcacctttgta

SEQ ID NO: 6553426 - DNA, 18 bp, Homo sapiens
ttgttcacttaaattctt

SEQ ID NO: 6553427 - DNA, 16 bp, Homo sapiens
ttgttcagaagttgtt

SEQ ID NO: 6553428 - DNA, 23 bp, Homo sapiens
ttgttcagatctcatagatgacc

SEQ ID NO: 6553429 - DNA, 23 bp, Homo sapiens
ttgttcaggaaaaggttgaataa

SEQ ID NO: 6553430 - DNA, 20 bp, Homo sapiens
ttgttcagggagaagatcat

SEQ ID NO: 6553431 - DNA, 17 bp, Homo sapiens
ttgttcagtcctctgca

SEQ ID NO: 6553432 - DNA, 13 bp, Homo sapiens
ttgttcatacata

SEQ ID NO: 6553433 - DNA, 16 bp, Homo sapiens
ttgttcatacatattt

SEQ ID NO: 6553434 - DNA, 20 bp, Homo sapiens
ttgttcatatcaagaaattg

SEQ ID NO: 6553435 - DNA, 13 bp, Homo sapiens
ttgttcatattca

SEQ ID NO: 6553436 - DNA, 13 bp, Homo sapiens
ttgttcatcattg

SEQ ID NO: 6553437 - DNA, 15 bp, Homo sapiens
ttgttcatctgtaac

SEQ ID NO: 6553438 - DNA, 15 bp, Homo sapiens
ttgttcatgggacat

SEQ ID NO: 6553439 - DNA, 13 bp, Homo sapiens
ttgttcatgtttg

SEQ ID NO: 6553440 - DNA, 12 bp, Homo sapiens
ttgttcatttag

SEQ ID NO: 6553441 - DNA, 17 bp, Homo sapiens
ttgttcatttctgtctc

SEQ ID NO: 6553442 - DNA, 12 bp, Homo sapiens
ttgttcatttgg

SEQ ID NO: 6553443 - DNA, 19 bp, Homo sapiens
ttgttcattttgagctgaa

SEQ ID NO: 6553444 - DNA, 22 bp, Homo sapiens
ttgttccaaatgtgtataattt

SEQ ID NO: 6553445 - DNA, 21 bp, Homo sapiens
ttgttccaagacattgtcaat

SEQ ID NO: 6553446 - DNA, 14 bp, Homo sapiens
ttgttccacattct

SEQ ID NO: 6553447 - DNA, 14 bp, Homo sapiens
ttgttccactggaa

SEQ ID NO: 6553448 - DNA, 19 bp, Homo sapiens
ttgttccacttgtttgcac

SEQ ID NO: 6553449 - DNA, 22 bp, Homo sapiens
ttgttccacttgtttgcactgt

SEQ ID NO: 6553450 - DNA, 13 bp, Homo sapiens
ttgttccagattc

SEQ ID NO: 6553451 - DNA, 17 bp, Homo sapiens
ttgttccattttatgca

SEQ ID NO: 6553452 - DNA, 11 bp, Homo sapiens
ttgttcccagt

SEQ ID NO: 6553453 - DNA, 21 bp, Homo sapiens
ttgttcccatcctcttctttt

SEQ ID NO: 6553454 - DNA, 18 bp, Homo sapiens
ttgttcccctaagtggat

SEQ ID NO: 6553455 - DNA, 14 bp, Homo sapiens
ttgttcccctcctc

SEQ ID NO: 6553456 - DNA, 13 bp, Homo sapiens
ttgttcccttcct

SEQ ID NO: 6553457 - DNA, 20 bp, Homo sapiens
ttgttcctaagttcttagat

SEQ ID NO: 6553458 - DNA, 19 bp, Homo sapiens
ttgttcctctatactttgt

SEQ ID NO: 6553459 - DNA, 21 bp, Homo sapiens
ttgttcctctatactttgttc

SEQ ID NO: 6553460 - DNA, 11 bp, Homo sapiens
ttgttcctgga

SEQ ID NO: 6553461 - DNA, 17 bp, Homo sapiens
ttgttccttcacattta

SEQ ID NO: 6553462 - DNA, 15 bp, Homo sapiens
ttgttccttcctgcg

SEQ ID NO: 6553463 - DNA, 23 bp, Homo sapiens
ttgttccttgcttttatagttgt

SEQ ID NO: 6553464 - DNA, 19 bp, Homo sapiens
ttgttcctttaacctttgc

SEQ ID NO: 6553465 - DNA, 13 bp, Homo sapiens
ttgttcctttctg

SEQ ID NO: 6553466 - DNA, 14 bp, Homo sapiens
ttgttcctttttct

SEQ ID NO: 6553467 - DNA, 22 bp, Homo sapiens
ttgttcgccgcgtggaatgtga

SEQ ID NO: 6553468 - DNA, 17 bp, Homo sapiens
ttgttcgggtgtgcaat

SEQ ID NO: 6553469 - DNA, 15 bp, Homo sapiens
ttgttctagacttcc

SEQ ID NO: 6553470 - DNA, 21 bp, Homo sapiens
ttgttctagacttccccatcc

SEQ ID NO: 6553471 - DNA, 20 bp, Homo sapiens
ttgttctagttagcaggaaa

SEQ ID NO: 6553472 - DNA, 22 bp, Homo sapiens
ttgttctagttagcaggaaata

SEQ ID NO: 6553473 - DNA, 15 bp, Homo sapiens
ttgttctagttttca

SEQ ID NO: 6553474 - DNA, 19 bp, Homo sapiens
ttgttctatttttcaatca

SEQ ID NO: 6553475 - DNA, 12 bp, Homo sapiens
ttgttctcaggg

SEQ ID NO: 6553476 - DNA, 13 bp, Homo sapiens
ttgttctcagggg

SEQ ID NO: 6553477 - DNA, 22 bp, Homo sapiens
ttgttctccgggtgtggcctca

SEQ ID NO: 6553478 - DNA, 15 bp, Homo sapiens
ttgttctctgggaga

SEQ ID NO: 6553479 - DNA, 13 bp, Homo sapiens
ttgttctcttctg

SEQ ID NO: 6553480 - DNA, 17 bp, Homo sapiens
ttgttctcttctgcgta

SEQ ID NO: 6553481 - DNA, 13 bp, Homo sapiens
ttgttctgggtga

SEQ ID NO: 6553482 - DNA, 16 bp, Homo sapiens
ttgttctgtcccttcc

SEQ ID NO: 6553483 - DNA, 21 bp, Homo sapiens
ttgttctgtcccttccacttc

SEQ ID NO: 6553484 - DNA, 13 bp, Homo sapiens
ttgttctgttcct

SEQ ID NO: 6553485 - DNA, 19 bp, Homo sapiens
ttgttctgttttgtgagaa

SEQ ID NO: 6553486 - DNA, 13 bp, Homo sapiens
ttgttcttaaaaa

SEQ ID NO: 6553487 - DNA, 15 bp, Homo sapiens
ttgttcttacacata

SEQ ID NO: 6553488 - DNA, 12 bp, Homo sapiens
ttgttcttacag

SEQ ID NO: 6553489 - DNA, 14 bp, Homo sapiens
ttgttcttatgaac

SEQ ID NO: 6553490 - DNA, 18 bp, Homo sapiens
ttgttcttccaaagcaga

SEQ ID NO: 6553491 - DNA, 14 bp, Homo sapiens
ttgttcttcttaaa

SEQ ID NO: 6553492 - DNA, 21 bp, Homo sapiens
ttgttcttgatagtagccaaa

SEQ ID NO: 6553493 - DNA, 11 bp, Homo sapiens
ttgttcttggt

SEQ ID NO: 6553494 - DNA, 22 bp, Homo sapiens
ttgttcttgttgtacccttgtt

SEQ ID NO: 6553495 - DNA, 15 bp, Homo sapiens
ttgttcttgttttta

SEQ ID NO: 6553496 - DNA, 14 bp, Homo sapiens
ttgttctttaaaat

SEQ ID NO: 6553497 - DNA, 14 bp, Homo sapiens
ttgttctttaaagt

SEQ ID NO: 6553498 - DNA, 14 bp, Homo sapiens
ttgttctttatttg

SEQ ID NO: 6553499 - DNA, 14 bp, Homo sapiens
ttgttctttcagaa

SEQ ID NO: 6553500 - DNA, 12 bp, Homo sapiens
ttgttctttgcc

SEQ ID NO: 6553501 - DNA, 16 bp, Homo sapiens
ttgttctttgtttcca

SEQ ID NO: 6553502 - DNA, 17 bp, Homo sapiens
ttgttctttgtttccag

SEQ ID NO: 6553503 - DNA, 12 bp, Homo sapiens
ttgttcttttcc

SEQ ID NO: 6553504 - DNA, 16 bp, Homo sapiens
ttgttcttttgtttca

SEQ ID NO: 6553505 - DNA, 16 bp, Homo sapiens
ttgttgaaaaagtttg

SEQ ID NO: 6553506 - DNA, 18 bp, Homo sapiens
ttgttgaaaaatgttgct

SEQ ID NO: 6553507 - DNA, 14 bp, Homo sapiens
ttgttgaaactaaa

SEQ ID NO: 6553508 - DNA, 13 bp, Homo sapiens
ttgttgaaatctt

SEQ ID NO: 6553509 - DNA, 14 bp, Homo sapiens
ttgttgaaatcttt

SEQ ID NO: 6553510 - DNA, 19 bp, Homo sapiens
ttgttgaaatcttttttat

SEQ ID NO: 6553511 - DNA, 12 bp, Homo sapiens
ttgttgaaattt

SEQ ID NO: 6553512 - DNA, 19 bp, Homo sapiens
ttgttgaacatacttcaaa

SEQ ID NO: 6553513 - DNA, 18 bp, Homo sapiens
ttgttgaactgttagaat

SEQ ID NO: 6553514 - DNA, 14 bp, Homo sapiens
ttgttgaatgtatt

SEQ ID NO: 6553515 - DNA, 15 bp, Homo sapiens
ttgttgaatgtattc

SEQ ID NO: 6553516 - DNA, 16 bp, Homo sapiens
ttgttgacaaaatttt

SEQ ID NO: 6553517 - DNA, 17 bp, Homo sapiens
ttgttgacattctgaat

SEQ ID NO: 6553518 - DNA, 22 bp, Homo sapiens
ttgttgagggcatttggcttcc

SEQ ID NO: 6553519 - DNA, 22 bp, Homo sapiens
ttgttgaggtggtctgaatgtt

SEQ ID NO: 6553520 - DNA, 20 bp, Homo sapiens
ttgttgataaattccactgg

SEQ ID NO: 6553521 - DNA, 20 bp, Homo sapiens
ttgttgatacctctgctggg

SEQ ID NO: 6553522 - DNA, 22 bp, Homo sapiens
ttgttgatattttcccttttta

SEQ ID NO: 6553523 - DNA, 23 bp, Homo sapiens
ttgttgatccccacactgcctta

SEQ ID NO: 6553524 - DNA, 21 bp, Homo sapiens
ttgttgatgctcacatatgat

SEQ ID NO: 6553525 - DNA, 13 bp, Homo sapiens
ttgttgattaatt

SEQ ID NO: 6553526 - DNA, 15 bp, Homo sapiens
ttgttgattaatttg

SEQ ID NO: 6553527 - DNA, 11 bp, Homo sapiens
ttgttgcactg

SEQ ID NO: 6553528 - DNA, 14 bp, Homo sapiens
ttgttgcactgaag

SEQ ID NO: 6553529 - DNA, 15 bp, Homo sapiens
ttgttgcactgaagt

SEQ ID NO: 6553530 - DNA, 17 bp, Homo sapiens
ttgttgcactgaagttt

SEQ ID NO: 6553531 - DNA, 22 bp, Homo sapiens
ttgttgccaggttgcagctgct

SEQ ID NO: 6553532 - DNA, 20 bp, Homo sapiens
ttgttgccatgtgcaccttg

SEQ ID NO: 6553533 - DNA, 13 bp, Homo sapiens
ttgttgcccaggc

SEQ ID NO: 6553534 - DNA, 16 bp, Homo sapiens
ttgttgcccaggctgg

SEQ ID NO: 6553535 - DNA, 23 bp, Homo sapiens
ttgttgcctacctagctgcatct

SEQ ID NO: 6553536 - DNA, 23 bp, Homo sapiens
ttgttgccttatcttgaaaagaa

SEQ ID NO: 6553537 - DNA, 23 bp, Homo sapiens
ttgttgctgaaaactctatgtcc

SEQ ID NO: 6553538 - DNA, 22 bp, Homo sapiens
ttgttgctgattttgaccttgt

SEQ ID NO: 6553539 - DNA, 20 bp, Homo sapiens
ttgttgctggcttgttgtaa

SEQ ID NO: 6553540 - DNA, 11 bp, Homo sapiens
ttgttgctttt

SEQ ID NO: 6553541 - DNA, 22 bp, Homo sapiens
ttgttggagtgaagcatttaaa

SEQ ID NO: 6553542 - DNA, 20 bp, Homo sapiens
ttgttggagtgtaaaccaaa

SEQ ID NO: 6553543 - DNA, 15 bp, Homo sapiens
ttgttggatcttcaa

SEQ ID NO: 6553544 - DNA, 20 bp, Homo sapiens
ttgttggatcttcaatggct

SEQ ID NO: 6553545 - DNA, 16 bp, Homo sapiens
ttaaaaaggtttacag

SEQ ID NO: 6553546 - DNA, 20 bp, Homo sapiens
ttaaaaagtaataaaattca

SEQ ID NO: 6553547 - DNA, 16 bp, Homo sapiens
ttaaaaagtactcttt

SEQ ID NO: 6553548 - DNA, 21 bp, Homo sapiens
ttaaaaagtattgccaaacat

SEQ ID NO: 6553549 - DNA, 23 bp, Homo sapiens
ttaaaaagtattgccaaacatta

SEQ ID NO: 6553550 - DNA, 23 bp, Homo sapiens
ttaaaaagtccataccttatata

SEQ ID NO: 6553551 - DNA, 17 bp, Homo sapiens
ttaaaaagtctgcatta

SEQ ID NO: 6553552 - DNA, 22 bp, Homo sapiens
ttaaaaagtctgcattacattc

SEQ ID NO: 6553553 - DNA, 14 bp, Homo sapiens
ttaaaaagtcttca

SEQ ID NO: 6553554 - DNA, 14 bp, Homo sapiens
ttaaaaagtgctat

SEQ ID NO: 6553555 - DNA, 22 bp, Homo sapiens
ttaaaaagttatataaaggcaa

SEQ ID NO: 6553556 - DNA, 17 bp, Homo sapiens
ttaaaaagttgttcaac

SEQ ID NO: 6553557 - DNA, 11 bp, Homo sapiens
ttaaaaagttt

SEQ ID NO: 6553558 - DNA, 15 bp, Homo sapiens
ttaaaaataaagcaa

SEQ ID NO: 6553559 - DNA, 19 bp, Homo sapiens
ttaaaaataaagctactga

SEQ ID NO: 6553560 - DNA, 16 bp, Homo sapiens
ttaaaaataaatccca

SEQ ID NO: 6553561 - DNA, 17 bp, Homo sapiens
ttaaaaatacaattatt

SEQ ID NO: 6553562 - DNA, 15 bp, Homo sapiens
ttaaaaatacacatg

SEQ ID NO: 6553563 - DNA, 12 bp, Homo sapiens
ttaaaaatacat

SEQ ID NO: 6553564 - DNA, 16 bp, Homo sapiens
ttaaaaatataaaact

SEQ ID NO: 6553565 - DNA, 18 bp, Homo sapiens
ttaaaaatatcaaattaa

SEQ ID NO: 6553566 - DNA, 23 bp, Homo sapiens
ttaaaaatatggaacttctaata

SEQ ID NO: 6553567 - DNA, 14 bp, Homo sapiens
ttaaaaatatgtga

SEQ ID NO: 6553568 - DNA, 16 bp, Homo sapiens
ttaaaaatatttcaga

SEQ ID NO: 6553569 - DNA, 15 bp, Homo sapiens
ttaaaaatcaacttt

SEQ ID NO: 6553570 - DNA, 20 bp, Homo sapiens
ttaaaaatcatcttataatt

SEQ ID NO: 6553571 - DNA, 22 bp, Homo sapiens
ttaaaaatctttcagaatacaa

SEQ ID NO: 6553572 - DNA, 14 bp, Homo sapiens
ttaaaaatgaaaat

SEQ ID NO: 6553573 - DNA, 15 bp, Homo sapiens
ttaaaaatgcaaatc

SEQ ID NO: 6553574 - DNA, 17 bp, Homo sapiens
ttaaaaatggaactgtg

SEQ ID NO: 6553575 - DNA, 17 bp, Homo sapiens
ttaaaaatggtatcaaa

SEQ ID NO: 6553576 - DNA, 14 bp, Homo sapiens
ttaaaaatgtaaat

SEQ ID NO: 6553577 - DNA, 17 bp, Homo sapiens
ttaaaaatgtaaatatt

SEQ ID NO: 6553578 - DNA, 20 bp, Homo sapiens
ttaaaaatgtagaaattctt

SEQ ID NO: 6553579 - DNA, 23 bp, Homo sapiens
ttaaaaatgtagaaattcttcat

SEQ ID NO: 6553580 - DNA, 14 bp, Homo sapiens
ttaaaaatgtataa

SEQ ID NO: 6553581 - DNA, 14 bp, Homo sapiens
ttaaaaatgtgtca

SEQ ID NO: 6553582 - DNA, 14 bp, Homo sapiens
ttaaaaatgttagt

SEQ ID NO: 6553583 - DNA, 12 bp, Homo sapiens
ttaaaaatgttt

SEQ ID NO: 6553584 - DNA, 16 bp, Homo sapiens
ttaaaaattaattctt

SEQ ID NO: 6553585 - DNA, 13 bp, Homo sapiens
ttaaaaattactt

SEQ ID NO: 6553586 - DNA, 13 bp, Homo sapiens
ttaaaaattatag

SEQ ID NO: 6553587 - DNA, 20 bp, Homo sapiens
ttaaaaattatctttaaaac

SEQ ID NO: 6553588 - DNA, 17 bp, Homo sapiens
ttaaaaattattatata

SEQ ID NO: 6553589 - DNA, 19 bp, Homo sapiens
ttaaaaattattatatatt

SEQ ID NO: 6553590 - DNA, 17 bp, Homo sapiens
ttaaaaattcagcaaag

SEQ ID NO: 6553591 - DNA, 20 bp, Homo sapiens
ttaaaaattcttgaaagaat

SEQ ID NO: 6553592 - DNA, 11 bp, Homo sapiens
ttaaaaattgg

SEQ ID NO: 6553593 - DNA, 20 bp, Homo sapiens
ttaaaaattgtcttcatgta

SEQ ID NO: 6553594 - DNA, 14 bp, Homo sapiens
ttaaaaattgttat

SEQ ID NO: 6553595 - DNA, 13 bp, Homo sapiens
ttaaaaattgttt

SEQ ID NO: 6553596 - DNA, 14 bp, Homo sapiens
ttaaaaatttataa

SEQ ID NO: 6553597 - DNA, 16 bp, Homo sapiens
ttaaaaatttataaca

SEQ ID NO: 6553598 - DNA, 12 bp, Homo sapiens
ttaaaacaaaac

SEQ ID NO: 6553599 - DNA, 18 bp, Homo sapiens
ttaaaacaaaacaaaaca

SEQ ID NO: 6553600 - DNA, 15 bp, Homo sapiens
ttaaaacaaattaaa

SEQ ID NO: 6553601 - DNA, 18 bp, Homo sapiens
ttaaaacaaattaaaaac

SEQ ID NO: 6553602 - DNA, 10 bp, Homo sapiens
ttaaaacaag

SEQ ID NO: 6553603 - DNA, 11 bp, Homo sapiens
ttaaaacaaga

SEQ ID NO: 6553604 - DNA, 12 bp, Homo sapiens
ttaaaacaagct

SEQ ID NO: 6553605 - DNA, 14 bp, Homo sapiens
ttaaaacaagctga

SEQ ID NO: 6553606 - DNA, 16 bp, Homo sapiens
ttaaaacaagctgata

SEQ ID NO: 6553607 - DNA, 21 bp, Homo sapiens
ttaaaacaattttttttttcc

SEQ ID NO: 6553608 - DNA, 20 bp, Homo sapiens
ttaaaacacagtattgtaga

SEQ ID NO: 6553609 - DNA, 22 bp, Homo sapiens
ttaaaacacagtattgtagaaa

SEQ ID NO: 6553610 - DNA, 12 bp, Homo sapiens
ttaaaacacatg

SEQ ID NO: 6553611 - DNA, 19 bp, Homo sapiens
ttaaaacacgttttaagga

SEQ ID NO: 6553612 - DNA, 23 bp, Homo sapiens
ttaaaacacgttttaaggactga

SEQ ID NO: 6553613 - DNA, 14 bp, Homo sapiens
ttaaaacacttctg

SEQ ID NO: 6553614 - DNA, 16 bp, Homo sapiens
ttaaaacagaaaaggt

SEQ ID NO: 6553615 - DNA, 21 bp, Homo sapiens
ttaaaacagacactggcatgg

SEQ ID NO: 6553616 - DNA, 15 bp, Homo sapiens
ttaaaacagcctggg

SEQ ID NO: 6553617 - DNA, 13 bp, Homo sapiens
ttaaaacagctgt

SEQ ID NO: 6553618 - DNA, 15 bp, Homo sapiens
ttaaaacaggcaaag

SEQ ID NO: 6553619 - DNA, 18 bp, Homo sapiens
ttaaaacataaacacatt

SEQ ID NO: 6553620 - DNA, 13 bp, Homo sapiens
ttaaaacatatgg

SEQ ID NO: 6553621 - DNA, 13 bp, Homo sapiens
ttaaaacatattt

SEQ ID NO: 6553622 - DNA, 18 bp, Homo sapiens
ttaaaacatatttcattt

SEQ ID NO: 6553623 - DNA, 14 bp, Homo sapiens
ttaaaacatcaaaa

SEQ ID NO: 6553624 - DNA, 23 bp, Homo sapiens
ttaaaacatcattcctttttatt

SEQ ID NO: 6553625 - DNA, 13 bp, Homo sapiens
ttaaaacatctct

SEQ ID NO: 6553626 - DNA, 18 bp, Homo sapiens
ttaaaacatggtgcctat

SEQ ID NO: 6553627 - DNA, 13 bp, Homo sapiens
ttaaaacatgtaa

SEQ ID NO: 6553628 - DNA, 12 bp, Homo sapiens
ttaaaacatttc

SEQ ID NO: 6553629 - DNA, 12 bp, Homo sapiens
ttaaaacatttt

SEQ ID NO: 6553630 - DNA, 14 bp, Homo sapiens
ttaaaaccaaagag

SEQ ID NO: 6553631 - DNA, 12 bp, Homo sapiens
ttaaaaccacta

SEQ ID NO: 6553632 - DNA, 16 bp, Homo sapiens
ttaaaaccagttaccc

SEQ ID NO: 6553633 - DNA, 18 bp, Homo sapiens
ttaaaaccataaaataaa

SEQ ID NO: 6553634 - DNA, 13 bp, Homo sapiens
ttaaaaccatgca

SEQ ID NO: 6553635 - DNA, 19 bp, Homo sapiens
ttaaaaccatgcagcttca

SEQ ID NO: 6553636 - DNA, 23 bp, Homo sapiens
ttaaaaccatgcagcttcatcaa

SEQ ID NO: 6553637 - DNA, 20 bp, Homo sapiens
ttaaaaccattaccttaaaa

SEQ ID NO: 6553638 - DNA, 22 bp, Homo sapiens
ttaaaaccattgtcctaagaac

SEQ ID NO: 6553639 - DNA, 12 bp, Homo sapiens
ttaaaacccaaa

SEQ ID NO: 6553640 - DNA, 17 bp, Homo sapiens
ttaaaacccaaacttcc

SEQ ID NO: 6553641 - DNA, 20 bp, Homo sapiens
ttaaaacctagaacttcaaa

SEQ ID NO: 6553642 - DNA, 21 bp, Homo sapiens
ttaaaacctgcgacagcttgt

SEQ ID NO: 6553643 - DNA, 18 bp, Homo sapiens
ttaaaacctgcttttcaa

SEQ ID NO: 6553644 - DNA, 21 bp, Homo sapiens
ttaaaacctgcttttcaatgt

SEQ ID NO: 6553645 - DNA, 23 bp, Homo sapiens
ttaaaacctggaccttttctgga

SEQ ID NO: 6553646 - DNA, 23 bp, Homo sapiens
ttaaaacctgggtatgttcctaa

SEQ ID NO: 6553647 - DNA, 13 bp, Homo sapiens
ttaaaactaaatt

SEQ ID NO: 6553648 - DNA, 19 bp, Homo sapiens
ttaaaactaatgagtatga

SEQ ID NO: 6553649 - DNA, 21 bp, Homo sapiens
ttaaaactaggcatttgtaaa

SEQ ID NO: 6553650 - DNA, 17 bp, Homo sapiens
ttaaaactaggtaatgt

SEQ ID NO: 6553651 - DNA, 15 bp, Homo sapiens
ttaaaactataacat

SEQ ID NO: 6553652 - DNA, 14 bp, Homo sapiens
ttaaaactcagcct

SEQ ID NO: 6553653 - DNA, 18 bp, Homo sapiens
ttaaaactcatcacataa

SEQ ID NO: 6553654 - DNA, 13 bp, Homo sapiens
ttaaaactctggt

SEQ ID NO: 6553655 - DNA, 22 bp, Homo sapiens
ttaaaactgaacttgaagctaa

SEQ ID NO: 6553656 - DNA, 14 bp, Homo sapiens
ttaaaactgaagtc

SEQ ID NO: 6553657 - DNA, 16 bp, Homo sapiens
ttaaaactgaagtctg

SEQ ID NO: 6553658 - DNA, 18 bp, Homo sapiens
ttaaaactgaagtctgaa

SEQ ID NO: 6553659 - DNA, 20 bp, Homo sapiens
ttaaaactgaagtctgaaat

SEQ ID NO: 6553660 - DNA, 22 bp, Homo sapiens
ttaaaactgagtccatgaaaat

SEQ ID NO: 6553661 - DNA, 20 bp, Homo sapiens
ttaaaactgcagttttcaga

SEQ ID NO: 6553662 - DNA, 14 bp, Homo sapiens
ttaaaactgcattt

SEQ ID NO: 6553663 - DNA, 19 bp, Homo sapiens
ttaaaactgctcatttcat

SEQ ID NO: 6553664 - DNA, 21 bp, Homo sapiens
ttaaaactgctcatttcatga

SEQ ID NO: 6553665 - DNA, 16 bp, Homo sapiens
ttaaaactggacctgt

SEQ ID NO: 6553666 - DNA, 19 bp, Homo sapiens
ttaaaactggatggaaata

SEQ ID NO: 6553667 - DNA, 16 bp, Homo sapiens
ttaaaactgtaccttt

SEQ ID NO: 6553668 - DNA, 15 bp, Homo sapiens
ttaaaactgtattta

SEQ ID NO: 6553669 - DNA, 14 bp, Homo sapiens
ttaaaactgttatt

SEQ ID NO: 6553670 - DNA, 10 bp, Homo sapiens
ttaaaagaaa

SEQ ID NO: 6553671 - DNA, 16 bp, Homo sapiens
ttaaaagaaaaaatga

SEQ ID NO: 6553672 - DNA, 21 bp, Homo sapiens
ttaaaagaaagggttctgtaa

SEQ ID NO: 6553673 - DNA, 23 bp, Homo sapiens
ttaaaagaaagggttctgtaaaa

SEQ ID NO: 6553674 - DNA, 20 bp, Homo sapiens
ttaaaagaaatatacagttt

SEQ ID NO: 6553675 - DNA, 21 bp, Homo sapiens
ttaaaagaaatatacagtttg

SEQ ID NO: 6553676 - DNA, 16 bp, Homo sapiens
ttaaaagaaatttatt

SEQ ID NO: 6553677 - DNA, 12 bp, Homo sapiens
ttaaaagaacat

SEQ ID NO: 6553678 - DNA, 17 bp, Homo sapiens
ttaaaagaagactggaa

SEQ ID NO: 6553679 - DNA, 12 bp, Homo sapiens
ttaaaagaatat

SEQ ID NO: 6553680 - DNA, 21 bp, Homo sapiens
ttaaaagaatattttaacttc

SEQ ID NO: 6553681 - DNA, 22 bp, Homo sapiens
ttaaaagaatattttaacttcc

SEQ ID NO: 6553682 - DNA, 12 bp, Homo sapiens
ttaaaagaatga

SEQ ID NO: 6553683 - DNA, 20 bp, Homo sapiens
ttaaaagaatgagtgaagta

SEQ ID NO: 6553684 - DNA, 19 bp, Homo sapiens
ttaaaagaatgattatgaa

SEQ ID NO: 6553685 - DNA, 13 bp, Homo sapiens
ttaaaagaatggg

SEQ ID NO: 6553686 - DNA, 21 bp, Homo sapiens
ttaaaagaatgggcagttaca

SEQ ID NO: 6553687 - DNA, 14 bp, Homo sapiens
ttaaaagacaaaca

SEQ ID NO: 6553688 - DNA, 14 bp, Homo sapiens
ttaaaagacactgt

SEQ ID NO: 6553689 - DNA, 11 bp, Homo sapiens
ttaaaagacag

SEQ ID NO: 6553690 - DNA, 14 bp, Homo sapiens
ttaaaagacatttt

SEQ ID NO: 6553691 - DNA, 12 bp, Homo sapiens
ttaaaagactca

SEQ ID NO: 6553692 - DNA, 15 bp, Homo sapiens
ttaaaagactttgat

SEQ ID NO: 6553693 - DNA, 14 bp, Homo sapiens
ttaaaagatacagt

SEQ ID NO: 6553694 - DNA, 17 bp, Homo sapiens
ttaaaagatacagttac

SEQ ID NO: 6553695 - DNA, 15 bp, Homo sapiens
ttaaaagatcatagt

SEQ ID NO: 6553696 - DNA, 20 bp, Homo sapiens
ttaaaagatgcttttaacag

SEQ ID NO: 6553697 - DNA, 22 bp, Homo sapiens
ttaaaagatgcttttaacagag

SEQ ID NO: 6553698 - DNA, 24 bp, Homo sapiens
ttaaaagatggtgaactgtgagta

SEQ ID NO: 6553699 - DNA, 23 bp, Homo sapiens
ttaaaagattatctcagaaagta

SEQ ID NO: 6553700 - DNA, 21 bp, Homo sapiens
ttaaaagattcatttttaatc

SEQ ID NO: 6553701 - DNA, 18 bp, Homo sapiens
ttaaaagcaaatcatttg

SEQ ID NO: 6553702 - DNA, 19 bp, Homo sapiens
ttaaaagcatatataaaac

SEQ ID NO: 6553703 - DNA, 14 bp, Homo sapiens
ttaaaagcatgaaa

SEQ ID NO: 6553704 - DNA, 17 bp, Homo sapiens
ttaaaagcatgaaacat

SEQ ID NO: 6553705 - DNA, 14 bp, Homo sapiens
ttaaaagcattttt

SEQ ID NO: 6553706 - DNA, 19 bp, Homo sapiens
ttaaaagcatttttattat

SEQ ID NO: 6553707 - DNA, 17 bp, Homo sapiens
ttaaaagccacatagag

SEQ ID NO: 6553708 - DNA, 12 bp, Homo sapiens
ttaaaagccatg

SEQ ID NO: 6553709 - DNA, 13 bp, Homo sapiens
ttaaaagcctgct

SEQ ID NO: 6553710 - DNA, 19 bp, Homo sapiens
ttaaaagctatcttcatgt

SEQ ID NO: 6553711 - DNA, 14 bp, Homo sapiens
ttaaaagctttaga

SEQ ID NO: 6553712 - DNA, 15 bp, Homo sapiens
ttaaaagctttagat

SEQ ID NO: 6553713 - DNA, 16 bp, Homo sapiens
ttaaaagctttagatt

SEQ ID NO: 6553714 - DNA, 18 bp, Homo sapiens
ttaaaaggaaaaataaca

SEQ ID NO: 6553715 - DNA, 16 bp, Homo sapiens
ttaaaaggatgtataa

SEQ ID NO: 6553716 - DNA, 20 bp, Homo sapiens
ttaaaaggatttttatcttt

SEQ ID NO: 6553717 - DNA, 11 bp, Homo sapiens
ttaaaaggcaa

SEQ ID NO: 6553718 - DNA, 23 bp, Homo sapiens
ttaaaagggattacccaagcaaa

SEQ ID NO: 6553719 - DNA, 14 bp, Homo sapiens
ttaaaaggggccca

SEQ ID NO: 6553720 - DNA, 19 bp, Homo sapiens
ttaaaaggtactggtacta

SEQ ID NO: 6553721 - DNA, 19 bp, Homo sapiens
ttaaaaggtataattaaac

SEQ ID NO: 6553722 - DNA, 18 bp, Homo sapiens
ttaaaaggttgactcaag

SEQ ID NO: 6553723 - DNA, 13 bp, Homo sapiens
ttaaaagtaaaat

SEQ ID NO: 6553724 - DNA, 17 bp, Homo sapiens
ttaaaagtaataaagag

SEQ ID NO: 6553725 - DNA, 12 bp, Homo sapiens
ttaaaagtactt

SEQ ID NO: 6553726 - DNA, 20 bp, Homo sapiens
ttaaaagtactttaaaaagg

SEQ ID NO: 6553727 - DNA, 16 bp, Homo sapiens
ttgttggcaagctgca

SEQ ID NO: 6553728 - DNA, 16 bp, Homo sapiens
ttgttggcactcaaca

SEQ ID NO: 6553729 - DNA, 12 bp, Homo sapiens
ttgttggcctcc

SEQ ID NO: 6553730 - DNA, 12 bp, Homo sapiens
ttgttgggaaag

SEQ ID NO: 6553731 - DNA, 19 bp, Homo sapiens
ttgttgggattcctgaccc

SEQ ID NO: 6553732 - DNA, 21 bp, Homo sapiens
ttgttgggattcctgacccag

SEQ ID NO: 6553733 - DNA, 16 bp, Homo sapiens
ttgttggggctttaca

SEQ ID NO: 6553734 - DNA, 14 bp, Homo sapiens
ttgttggtaccttt

SEQ ID NO: 6553735 - DNA, 15 bp, Homo sapiens
ttgttggtacctttc

SEQ ID NO: 6553736 - DNA, 16 bp, Homo sapiens
ttgttggtcacatgga

SEQ ID NO: 6553737 - DNA, 20 bp, Homo sapiens
ttgttggttggttttcttct

SEQ ID NO: 6553738 - DNA, 18 bp, Homo sapiens
ttgttgtagagaaaacat

SEQ ID NO: 6553739 - DNA, 16 bp, Homo sapiens
ttgttgtcctcccagg

SEQ ID NO: 6553740 - DNA, 12 bp, Homo sapiens
ttgttgtctaca

SEQ ID NO: 6553741 - DNA, 14 bp, Homo sapiens
ttgttgtcttcact

SEQ ID NO: 6553742 - DNA, 12 bp, Homo sapiens
ttgttgtgactt

SEQ ID NO: 6553743 - DNA, 23 bp, Homo sapiens
ttgttgtgagaatggcctggagc

SEQ ID NO: 6553744 - DNA, 14 bp, Homo sapiens
ttgttgtgctttta

SEQ ID NO: 6553745 - DNA, 22 bp, Homo sapiens
ttgttgtggctcttatttctga

SEQ ID NO: 6553746 - DNA, 11 bp, Homo sapiens
ttgttgtgtat

SEQ ID NO: 6553747 - DNA, 15 bp, Homo sapiens
ttgttgtgtgtgcag

SEQ ID NO: 6553748 - DNA, 14 bp, Homo sapiens
ttgttgtgttctgt

SEQ ID NO: 6553749 - DNA, 21 bp, Homo sapiens
ttgttgttaatgaaaatgtca

SEQ ID NO: 6553750 - DNA, 14 bp, Homo sapiens
ttgttgttcccctt

SEQ ID NO: 6553751 - DNA, 14 bp, Homo sapiens
ttgttgttcctcta

SEQ ID NO: 6553752 - DNA, 18 bp, Homo sapiens
ttgttgttcctctatact

SEQ ID NO: 6553753 - DNA, 22 bp, Homo sapiens
ttgttgttcctctatactttgt

SEQ ID NO: 6553754 - DNA, 13 bp, Homo sapiens
ttgttgttctgtt

SEQ ID NO: 6553755 - DNA, 9 bp, Homo sapiens
ttgttgttg

SEQ ID NO: 6553756 - DNA, 16 bp, Homo sapiens
ttgttgttgctgctgt

SEQ ID NO: 6553757 - DNA, 23 bp, Homo sapiens
ttgttgtttgccatactttgtct

SEQ ID NO: 6553758 - DNA, 15 bp, Homo sapiens
ttgttgtttgctttg

SEQ ID NO: 6553759 - DNA, 19 bp, Homo sapiens
ttgttgtttggattcctca

SEQ ID NO: 6553760 - DNA, 15 bp, Homo sapiens
ttgttgtttgtatgt

SEQ ID NO: 6553761 - DNA, 20 bp, Homo sapiens
ttgttgttttaacctcccct

SEQ ID NO: 6553762 - DNA, 13 bp, Homo sapiens
ttgttgttttata

SEQ ID NO: 6553763 - DNA, 21 bp, Homo sapiens
ttgttgtttttaaaaagaaaa

SEQ ID NO: 6553764 - DNA, 16 bp, Homo sapiens
ttgttgtttttaagat

SEQ ID NO: 6553765 - DNA, 20 bp, Homo sapiens
ttgtttaaaaacaggaaaaa

SEQ ID NO: 6553766 - DNA, 18 bp, Homo sapiens
ttgtttaaaaatacacat

SEQ ID NO: 6553767 - DNA, 23 bp, Homo sapiens
ttgtttaaaactcagaatataac

SEQ ID NO: 6553768 - DNA, 14 bp, Homo sapiens
ttgtttaaaatcat

SEQ ID NO: 6553769 - DNA, 18 bp, Homo sapiens
ttgtttaaagaataaagt

SEQ ID NO: 6553770 - DNA, 17 bp, Homo sapiens
ttgtttaaagcaactgt

SEQ ID NO: 6553771 - DNA, 15 bp, Homo sapiens
ttgtttaaatataaa

SEQ ID NO: 6553772 - DNA, 14 bp, Homo sapiens
ttgtttaacaaaag

SEQ ID NO: 6553773 - DNA, 16 bp, Homo sapiens
ttgtttaataaaggct

SEQ ID NO: 6553774 - DNA, 12 bp, Homo sapiens
ttgtttaatcta

SEQ ID NO: 6553775 - DNA, 12 bp, Homo sapiens
ttgtttaatggt

SEQ ID NO: 6553776 - DNA, 16 bp, Homo sapiens
ttgtttaatgtgaact

SEQ ID NO: 6553777 - DNA, 20 bp, Homo sapiens
ttgtttaatgtgaacttgta

SEQ ID NO: 6553778 - DNA, 14 bp, Homo sapiens
ttgtttaatgttaa

SEQ ID NO: 6553779 - DNA, 22 bp, Homo sapiens
ttgtttaatttttatttcttcc

SEQ ID NO: 6553780 - DNA, 20 bp, Homo sapiens
ttgtttacaacacagtagtg

SEQ ID NO: 6553781 - DNA, 13 bp, Homo sapiens
ttgtttacaataa

SEQ ID NO: 6553782 - DNA, 18 bp, Homo sapiens
ttgtttacaggatattcc

SEQ ID NO: 6553783 - DNA, 18 bp, Homo sapiens
ttgtttacttaaagattt

SEQ ID NO: 6553784 - DNA, 13 bp, Homo sapiens
ttgtttagaaaaa

SEQ ID NO: 6553785 - DNA, 14 bp, Homo sapiens
ttgtttagaaacag

SEQ ID NO: 6553786 - DNA, 15 bp, Homo sapiens
ttgtttagaaacaga

SEQ ID NO: 6553787 - DNA, 23 bp, Homo sapiens
ttgtttagtctttatactgcaaa

SEQ ID NO: 6553788 - DNA, 9 bp, Homo sapiens
ttgtttata

SEQ ID NO: 6553789 - DNA, 16 bp, Homo sapiens
ttgtttataataaaaa

SEQ ID NO: 6553790 - DNA, 14 bp, Homo sapiens
ttgtttataatgtt

SEQ ID NO: 6553791 - DNA, 16 bp, Homo sapiens
ttgtttatacacaact

SEQ ID NO: 6553792 - DNA, 17 bp, Homo sapiens
ttgtttatatcactgtc

SEQ ID NO: 6553793 - DNA, 14 bp, Homo sapiens
ttgtttatcaactt

SEQ ID NO: 6553794 - DNA, 18 bp, Homo sapiens
ttgtttatgatatttctt

SEQ ID NO: 6553795 - DNA, 12 bp, Homo sapiens
ttgtttatgtaa

SEQ ID NO: 6553796 - DNA, 18 bp, Homo sapiens
ttgtttattaaatagtta

SEQ ID NO: 6553797 - DNA, 19 bp, Homo sapiens
ttgtttattagttttgcat

SEQ ID NO: 6553798 - DNA, 23 bp, Homo sapiens
ttgtttattgaattcatttcact

SEQ ID NO: 6553799 - DNA, 13 bp, Homo sapiens
ttgtttatttgca

SEQ ID NO: 6553800 - DNA, 14 bp, Homo sapiens
ttgtttatttgcaa

SEQ ID NO: 6553801 - DNA, 14 bp, Homo sapiens
ttgtttcaagaacc

SEQ ID NO: 6553802 - DNA, 23 bp, Homo sapiens
ttgtttcaatgaggtgtccaact

SEQ ID NO: 6553803 - DNA, 11 bp, Homo sapiens
ttgtttcagaa

SEQ ID NO: 6553804 - DNA, 12 bp, Homo sapiens
ttgtttcatcta

SEQ ID NO: 6553805 - DNA, 14 bp, Homo sapiens
ttgtttcatctatt

SEQ ID NO: 6553806 - DNA, 16 bp, Homo sapiens
ttgtttcattaagttg

SEQ ID NO: 6553807 - DNA, 15 bp, Homo sapiens
ttgtttcattgattt

SEQ ID NO: 6553808 - DNA, 21 bp, Homo sapiens
ttgtttccaaagctgaagatc

SEQ ID NO: 6553809 - DNA, 22 bp, Homo sapiens
ttgtttccaaagtgcatgtcac

SEQ ID NO: 6553810 - DNA, 16 bp, Homo sapiens
ttgtttcctcttccaa

SEQ ID NO: 6553811 - DNA, 23 bp, Homo sapiens
ttgtttcctgtgcccatcatctc

SEQ ID NO: 6553812 - DNA, 15 bp, Homo sapiens
ttgtttcctttcact

SEQ ID NO: 6553813 - DNA, 22 bp, Homo sapiens
ttgtttcgctctttgagaaata

SEQ ID NO: 6553814 - DNA, 17 bp, Homo sapiens
ttgtttctacctcccag

SEQ ID NO: 6553815 - DNA, 22 bp, Homo sapiens
ttgtttctagactataaatgtt

SEQ ID NO: 6553816 - DNA, 18 bp, Homo sapiens
ttgtttctataaatgact

SEQ ID NO: 6553817 - DNA, 12 bp, Homo sapiens
ttgtttctatac

SEQ ID NO: 6553818 - DNA, 13 bp, Homo sapiens
ttgtttctatact

SEQ ID NO: 6553819 - DNA, 16 bp, Homo sapiens
ttgtttctatactgtt

SEQ ID NO: 6553820 - DNA, 23 bp, Homo sapiens
ttgtttctcctctgaagcatttg

SEQ ID NO: 6553821 - DNA, 21 bp, Homo sapiens
ttgtttctgacccactgatct

SEQ ID NO: 6553822 - DNA, 13 bp, Homo sapiens
ttgtttctgcatc

SEQ ID NO: 6553823 - DNA, 16 bp, Homo sapiens
ttgtttctgcatcttt

SEQ ID NO: 6553824 - DNA, 12 bp, Homo sapiens
ttgtttctgttt

SEQ ID NO: 6553825 - DNA, 13 bp, Homo sapiens
ttgtttctgttta

SEQ ID NO: 6553826 - DNA, 12 bp, Homo sapiens
ttgtttcttaaa

SEQ ID NO: 6553827 - DNA, 15 bp, Homo sapiens
ttgtttcttaaataa

SEQ ID NO: 6553828 - DNA, 12 bp, Homo sapiens
ttgtttcttcca

SEQ ID NO: 6553829 - DNA, 19 bp, Homo sapiens
ttgtttcttccaaagcaca

SEQ ID NO: 6553830 - DNA, 18 bp, Homo sapiens
ttgtttcttctgtcttta

SEQ ID NO: 6553831 - DNA, 16 bp, Homo sapiens
ttgtttcttcttttcc

SEQ ID NO: 6553832 - DNA, 18 bp, Homo sapiens
ttgtttcttcttttcctt

SEQ ID NO: 6553833 - DNA, 15 bp, Homo sapiens
ttgtttctttctagt

SEQ ID NO: 6553834 - DNA, 13 bp, Homo sapiens
ttgtttctttctg

SEQ ID NO: 6553835 - DNA, 13 bp, Homo sapiens
ttgtttcttttaa

SEQ ID NO: 6553836 - DNA, 14 bp, Homo sapiens
ttgtttcttttttc

SEQ ID NO: 6553837 - DNA, 13 bp, Homo sapiens
ttgtttgaaatgt

SEQ ID NO: 6553838 - DNA, 13 bp, Homo sapiens
ttgtttgaatgtt

SEQ ID NO: 6553839 - DNA, 19 bp, Homo sapiens
ttgtttgaccccagtttct

SEQ ID NO: 6553840 - DNA, 22 bp, Homo sapiens
ttgtttgaccccagtttcttct

SEQ ID NO: 6553841 - DNA, 20 bp, Homo sapiens
ttgtttgagcgcagagtaaa

SEQ ID NO: 6553842 - DNA, 18 bp, Homo sapiens
ttgtttgaggcaaatcta

SEQ ID NO: 6553843 - DNA, 21 bp, Homo sapiens
ttgtttgaggcaaattaactg

SEQ ID NO: 6553844 - DNA, 22 bp, Homo sapiens
ttgtttgatctacttcatagct

SEQ ID NO: 6553845 - DNA, 14 bp, Homo sapiens
ttgtttgatttcaa

SEQ ID NO: 6553846 - DNA, 16 bp, Homo sapiens
ttgtttgcatcattta

SEQ ID NO: 6553847 - DNA, 16 bp, Homo sapiens
ttgtttgctatcttaa

SEQ ID NO: 6553848 - DNA, 12 bp, Homo sapiens
ttgtttgctatg

SEQ ID NO: 6553849 - DNA, 14 bp, Homo sapiens
ttgtttgctgctat

SEQ ID NO: 6553850 - DNA, 14 bp, Homo sapiens
ttgtttgctgcttt

SEQ ID NO: 6553851 - DNA, 13 bp, Homo sapiens
ttgtttgcttatt

SEQ ID NO: 6553852 - DNA, 11 bp, Homo sapiens
ttgtttgcttc

SEQ ID NO: 6553853 - DNA, 12 bp, Homo sapiens
ttgtttgctttg

SEQ ID NO: 6553854 - DNA, 21 bp, Homo sapiens
ttgtttggaccaaaaaccagt

SEQ ID NO: 6553855 - DNA, 21 bp, Homo sapiens
ttgtttggactgttttcaata

SEQ ID NO: 6553856 - DNA, 23 bp, Homo sapiens
ttgtttggatcaaaatctgtaga

SEQ ID NO: 6553857 - DNA, 15 bp, Homo sapiens
ttgtttggatttcct

SEQ ID NO: 6553858 - DNA, 17 bp, Homo sapiens
ttgtttggcaaggaaag

SEQ ID NO: 6553859 - DNA, 14 bp, Homo sapiens
ttgtttgggagagt

SEQ ID NO: 6553860 - DNA, 20 bp, Homo sapiens
ttgtttggggatgagaaagg

SEQ ID NO: 6553861 - DNA, 16 bp, Homo sapiens
ttgtttgggtatcctg

SEQ ID NO: 6553862 - DNA, 19 bp, Homo sapiens
ttgtttgggtggtttgtga

SEQ ID NO: 6553863 - DNA, 16 bp, Homo sapiens
ttgtttggtattgtat

SEQ ID NO: 6553864 - DNA, 17 bp, Homo sapiens
ttgtttggttggtttta

SEQ ID NO: 6553865 - DNA, 18 bp, Homo sapiens
ttgtttgtaaaagagctg

SEQ ID NO: 6553866 - DNA, 13 bp, Homo sapiens
ttgtttgtaaata

SEQ ID NO: 6553867 - DNA, 12 bp, Homo sapiens
ttgtttgtaatc

SEQ ID NO: 6553868 - DNA, 19 bp, Homo sapiens
ttgtttgtactggttcatt

SEQ ID NO: 6553869 - DNA, 14 bp, Homo sapiens
ttgtttgtagcttt

SEQ ID NO: 6553870 - DNA, 18 bp, Homo sapiens
ttgtttgtagctttcctg

SEQ ID NO: 6553871 - DNA, 22 bp, Homo sapiens
ttgtttgtatgtataattcaaa

SEQ ID NO: 6553872 - DNA, 16 bp, Homo sapiens
ttgtttgtattgtaaa

SEQ ID NO: 6553873 - DNA, 15 bp, Homo sapiens
ttgtttgtcacaagt

SEQ ID NO: 6553874 - DNA, 19 bp, Homo sapiens
ttgtttgtctctccttttc

SEQ ID NO: 6553875 - DNA, 20 bp, Homo sapiens
ttgtttgtctgtttttactc

SEQ ID NO: 6553876 - DNA, 13 bp, Homo sapiens
ttgtttgtttagt

SEQ ID NO: 6553877 - DNA, 12 bp, Homo sapiens
ttgtttgtttca

SEQ ID NO: 6553878 - DNA, 21 bp, Homo sapiens
ttgtttgtttctccccctggg

SEQ ID NO: 6553879 - DNA, 13 bp, Homo sapiens
ttgtttgtttgag

SEQ ID NO: 6553880 - DNA, 12 bp, Homo sapiens
ttgtttgtttta

SEQ ID NO: 6553881 - DNA, 14 bp, Homo sapiens
ttgtttgttttaga

SEQ ID NO: 6553882 - DNA, 14 bp, Homo sapiens
ttgtttgttttgga

SEQ ID NO: 6553883 - DNA, 20 bp, Homo sapiens
ttgttttaagattgtaattc

SEQ ID NO: 6553884 - DNA, 16 bp, Homo sapiens
ttgttttaagcaaatg

SEQ ID NO: 6553885 - DNA, 16 bp, Homo sapiens
ttgttttaaggaagaa

SEQ ID NO: 6553886 - DNA, 14 bp, Homo sapiens
ttgttttaatttta

SEQ ID NO: 6553887 - DNA, 12 bp, Homo sapiens
ttgttttacaat

SEQ ID NO: 6553888 - DNA, 16 bp, Homo sapiens
ttgttttagaaccagc

SEQ ID NO: 6553889 - DNA, 16 bp, Homo sapiens
ttgttttagatccaaa

SEQ ID NO: 6553890 - DNA, 15 bp, Homo sapiens
ttgttttatgttcta

SEQ ID NO: 6553891 - DNA, 14 bp, Homo sapiens
ttgttttcacttgt

SEQ ID NO: 6553892 - DNA, 14 bp, Homo sapiens
ttgttttccactgt

SEQ ID NO: 6553893 - DNA, 13 bp, Homo sapiens
ttgttttctactt

SEQ ID NO: 6553894 - DNA, 13 bp, Homo sapiens
ttgttttcttaaa

SEQ ID NO: 6553895 - DNA, 18 bp, Homo sapiens
ttgttttcttctgtatgt

SEQ ID NO: 6553896 - DNA, 23 bp, Homo sapiens
ttgttttcttcttcagtgaagca

SEQ ID NO: 6553897 - DNA, 22 bp, Homo sapiens
ttgttttctttctttaaatgtt

SEQ ID NO: 6553898 - DNA, 14 bp, Homo sapiens
ttgttttgaaacta

SEQ ID NO: 6553899 - DNA, 16 bp, Homo sapiens
ttgttttgaaagttta

SEQ ID NO: 6553900 - DNA, 24 bp, Homo sapiens
ttgttttgagctttccatgttgct

SEQ ID NO: 6553901 - DNA, 21 bp, Homo sapiens
ttgttttgatgataaaaggag

SEQ ID NO: 6553902 - DNA, 13 bp, Homo sapiens
ttgttttgcactg

SEQ ID NO: 6553903 - DNA, 15 bp, Homo sapiens
ttgttttgcactttt

SEQ ID NO: 6553904 - DNA, 13 bp, Homo sapiens
ttgttttgccagt

SEQ ID NO: 6553905 - DNA, 13 bp, Homo sapiens
ttgttttgctgct

SEQ ID NO: 6553906 - DNA, 13 bp, Homo sapiens
ttgttttgctttt

SEQ ID NO: 6553907 - DNA, 15 bp, Homo sapiens
ttgttttggctgctc

SEQ ID NO: 6553908 - DNA, 18 bp, Homo sapiens
ttgttttgggtgaatctt

SEQ ID NO: 6553909 - DNA, 15 bp, Homo sapiens
ttgttttgtgacttt

SEQ ID NO: 6553910 - DNA, 16 bp, Homo sapiens
ttgttttgtgcagaga

SEQ ID NO: 6553911 - DNA, 16 bp, Homo sapiens
ttaaaagtatctttaa

SEQ ID NO: 6553912 - DNA, 14 bp, Homo sapiens
ttaaaagtattcat

SEQ ID NO: 6553913 - DNA, 15 bp, Homo sapiens
ttaaaagtattcata

SEQ ID NO: 6553914 - DNA, 18 bp, Homo sapiens
ttaaaagtgtattttatt

SEQ ID NO: 6553915 - DNA, 21 bp, Homo sapiens
ttaaaagtgtgtaaatgctta

SEQ ID NO: 6553916 - DNA, 22 bp, Homo sapiens
ttaaaagttgggaaaagtgtta

SEQ ID NO: 6553917 - DNA, 20 bp, Homo sapiens
ttaaaagttgttaccaaata

SEQ ID NO: 6553918 - DNA, 17 bp, Homo sapiens
ttaaaagtttcaatgtg

SEQ ID NO: 6553919 - DNA, 22 bp, Homo sapiens
ttaaaagtttcaatgtgattct

SEQ ID NO: 6553920 - DNA, 20 bp, Homo sapiens
ttaaaataaaaattctgaat

SEQ ID NO: 6553921 - DNA, 15 bp, Homo sapiens
ttaaaataaaacaag

SEQ ID NO: 6553922 - DNA, 16 bp, Homo sapiens
ttaaaataaaacaagc

SEQ ID NO: 6553923 - DNA, 20 bp, Homo sapiens
ttaaaataaaacaagcctta

SEQ ID NO: 6553924 - DNA, 20 bp, Homo sapiens
ttaaaataaaatgaaaattg

SEQ ID NO: 6553925 - DNA, 19 bp, Homo sapiens
ttaaaataaaattttttac

SEQ ID NO: 6553926 - DNA, 21 bp, Homo sapiens
ttaaaataaaattttttactt

SEQ ID NO: 6553927 - DNA, 21 bp, Homo sapiens
ttaaaataaacattttgtcca

SEQ ID NO: 6553928 - DNA, 15 bp, Homo sapiens
ttaaaataaaccaaa

SEQ ID NO: 6553929 - DNA, 16 bp, Homo sapiens
ttaaaataaaccaaat

SEQ ID NO: 6553930 - DNA, 16 bp, Homo sapiens
ttaaaataaactgtaa

SEQ ID NO: 6553931 - DNA, 18 bp, Homo sapiens
ttaaaataaactgtaaac

SEQ ID NO: 6553932 - DNA, 19 bp, Homo sapiens
ttaaaataaactgtaaact

SEQ ID NO: 6553933 - DNA, 16 bp, Homo sapiens
ttaaaataaactttct

SEQ ID NO: 6553934 - DNA, 22 bp, Homo sapiens
ttaaaataaagttaaactgatt

SEQ ID NO: 6553935 - DNA, 12 bp, Homo sapiens
ttaaaataaata

SEQ ID NO: 6553936 - DNA, 13 bp, Homo sapiens
ttaaaataaataa

SEQ ID NO: 6553937 - DNA, 14 bp, Homo sapiens
ttaaaataaattct

SEQ ID NO: 6553938 - DNA, 20 bp, Homo sapiens
ttaaaataagcactgtgcta

SEQ ID NO: 6553939 - DNA, 15 bp, Homo sapiens
ttaaaataagtgaat

SEQ ID NO: 6553940 - DNA, 16 bp, Homo sapiens
ttaaaataattaaata

SEQ ID NO: 6553941 - DNA, 19 bp, Homo sapiens
ttaaaataattatatgaag

SEQ ID NO: 6553942 - DNA, 20 bp, Homo sapiens
ttaaaataatttatcaaaaa

SEQ ID NO: 6553943 - DNA, 21 bp, Homo sapiens
ttaaaataatttatcaaaaaa

SEQ ID NO: 6553944 - DNA, 15 bp, Homo sapiens
ttaaaatacaagact

SEQ ID NO: 6553945 - DNA, 17 bp, Homo sapiens
ttaaaatacaagactgc

SEQ ID NO: 6553946 - DNA, 15 bp, Homo sapiens
ttaaaatacatgaat

SEQ ID NO: 6553947 - DNA, 22 bp, Homo sapiens
ttaaaatactcagtgctaaaca

SEQ ID NO: 6553948 - DNA, 16 bp, Homo sapiens
ttaaaatactgtagat

SEQ ID NO: 6553949 - DNA, 15 bp, Homo sapiens
ttaaaatacttgttt

SEQ ID NO: 6553950 - DNA, 15 bp, Homo sapiens
ttaaaatagaaataa

SEQ ID NO: 6553951 - DNA, 19 bp, Homo sapiens
ttaaaatagcaaaagaaga

SEQ ID NO: 6553952 - DNA, 21 bp, Homo sapiens
ttaaaatagcaaaagaagaag

SEQ ID NO: 6553953 - DNA, 17 bp, Homo sapiens
ttaaaatagcatactgt

SEQ ID NO: 6553954 - DNA, 20 bp, Homo sapiens
ttaaaatagcatactgtgta

SEQ ID NO: 6553955 - DNA, 18 bp, Homo sapiens
ttaaaataggggatattt

SEQ ID NO: 6553956 - DNA, 13 bp, Homo sapiens
ttaaaatagtttt

SEQ ID NO: 6553957 - DNA, 12 bp, Homo sapiens
ttaaaatataat

SEQ ID NO: 6553958 - DNA, 16 bp, Homo sapiens
ttaaaatatacttaaa

SEQ ID NO: 6553959 - DNA, 22 bp, Homo sapiens
ttaaaatatagatgtgttttat

SEQ ID NO: 6553960 - DNA, 21 bp, Homo sapiens
ttaaaatatatagtgaaaaat

SEQ ID NO: 6553961 - DNA, 13 bp, Homo sapiens
ttaaaatatatat

SEQ ID NO: 6553962 - DNA, 20 bp, Homo sapiens
ttaaaatatatatgttgatt

SEQ ID NO: 6553963 - DNA, 22 bp, Homo sapiens
ttaaaatatatgttctgcaaga

SEQ ID NO: 6553964 - DNA, 12 bp, Homo sapiens
ttaaaatatatt

SEQ ID NO: 6553965 - DNA, 18 bp, Homo sapiens
ttaaaatatcttcctttg

SEQ ID NO: 6553966 - DNA, 15 bp, Homo sapiens
ttaaaatatgcacta

SEQ ID NO: 6553967 - DNA, 21 bp, Homo sapiens
ttaaaatattatttgatatct

SEQ ID NO: 6553968 - DNA, 14 bp, Homo sapiens
ttaaaatattgtgt

SEQ ID NO: 6553969 - DNA, 18 bp, Homo sapiens
ttaaaatatttaactttt

SEQ ID NO: 6553970 - DNA, 18 bp, Homo sapiens
ttaaaatatttagtctaa

SEQ ID NO: 6553971 - DNA, 17 bp, Homo sapiens
ttaaaatattttcttaa

SEQ ID NO: 6553972 - DNA, 18 bp, Homo sapiens
ttaaaatcaaatgtaaat

SEQ ID NO: 6553973 - DNA, 13 bp, Homo sapiens
ttaaaatcaactt

SEQ ID NO: 6553974 - DNA, 19 bp, Homo sapiens
ttaaaatcaacttttgaaa

SEQ ID NO: 6553975 - DNA, 20 bp, Homo sapiens
ttaaaatcactaacattata

SEQ ID NO: 6553976 - DNA, 23 bp, Homo sapiens
ttaaaatcactaacattatattg

SEQ ID NO: 6553977 - DNA, 18 bp, Homo sapiens
ttaaaatcactgtcaata

SEQ ID NO: 6553978 - DNA, 21 bp, Homo sapiens
ttaaaatcataacattgattt

SEQ ID NO: 6553979 - DNA, 16 bp, Homo sapiens
ttaaaatcatgatcct

SEQ ID NO: 6553980 - DNA, 15 bp, Homo sapiens
ttaaaatccagactt

SEQ ID NO: 6553981 - DNA, 13 bp, Homo sapiens
ttaaaatccagta

SEQ ID NO: 6553982 - DNA, 14 bp, Homo sapiens
ttaaaatccagtat

SEQ ID NO: 6553983 - DNA, 16 bp, Homo sapiens
ttaaaatcccaaatct

SEQ ID NO: 6553984 - DNA, 17 bp, Homo sapiens
ttaaaatctattctgtg

SEQ ID NO: 6553985 - DNA, 19 bp, Homo sapiens
ttaaaatctattctgtgtt

SEQ ID NO: 6553986 - DNA, 17 bp, Homo sapiens
ttaaaatctctaataga

SEQ ID NO: 6553987 - DNA, 18 bp, Homo sapiens
ttaaaatctgagggaaat

SEQ ID NO: 6553988 - DNA, 22 bp, Homo sapiens
ttaaaatctgagggaaatgttt

SEQ ID NO: 6553989 - DNA, 14 bp, Homo sapiens
ttaaaatctgattt

SEQ ID NO: 6553990 - DNA, 17 bp, Homo sapiens
ttaaaatctgatttaat

SEQ ID NO: 6553991 - DNA, 14 bp, Homo sapiens
ttaaaatctggaaa

SEQ ID NO: 6553992 - DNA, 15 bp, Homo sapiens
ttaaaatctggaaat

SEQ ID NO: 6553993 - DNA, 17 bp, Homo sapiens
ttaaaatctggaaatct

SEQ ID NO: 6553994 - DNA, 15 bp, Homo sapiens
ttaaaatcttattaa

SEQ ID NO: 6553995 - DNA, 17 bp, Homo sapiens
ttaaaatgaaatgcatt

SEQ ID NO: 6553996 - DNA, 19 bp, Homo sapiens
ttaaaatgaaatgcatttt

SEQ ID NO: 6553997 - DNA, 16 bp, Homo sapiens
ttaaaatgaagcaatt

SEQ ID NO: 6553998 - DNA, 19 bp, Homo sapiens
ttaaaatgaagcaatttat

SEQ ID NO: 6553999 - DNA, 21 bp, Homo sapiens
ttaaaatgaataatttattat

SEQ ID NO: 6554000 - DNA, 15 bp, Homo sapiens
ttaaaatgaatctta

SEQ ID NO: 6554001 - DNA, 17 bp, Homo sapiens
ttaaaatgacaaacatg

SEQ ID NO: 6554002 - DNA, 18 bp, Homo sapiens
ttaaaatgacaaagccat

SEQ ID NO: 6554003 - DNA, 12 bp, Homo sapiens
ttaaaatgcaag

SEQ ID NO: 6554004 - DNA, 23 bp, Homo sapiens
ttaaaatgcaatatttgtaaggc

SEQ ID NO: 6554005 - DNA, 21 bp, Homo sapiens
ttaaaatgcatatttctatgt

SEQ ID NO: 6554006 - DNA, 21 bp, Homo sapiens
ttaaaatgcattgaaagaatt

SEQ ID NO: 6554007 - DNA, 14 bp, Homo sapiens
ttaaaatgcgaaat

SEQ ID NO: 6554008 - DNA, 17 bp, Homo sapiens
ttaaaatgctgttttgt

SEQ ID NO: 6554009 - DNA, 11 bp, Homo sapiens
ttaaaatggaa

SEQ ID NO: 6554010 - DNA, 12 bp, Homo sapiens
ttaaaatggact

SEQ ID NO: 6554011 - DNA, 19 bp, Homo sapiens
ttaaaatggtatgccaact

SEQ ID NO: 6554012 - DNA, 23 bp, Homo sapiens
ttaaaatggtttttgcctaaaat

SEQ ID NO: 6554013 - DNA, 17 bp, Homo sapiens
ttaaaatgtaaactctt

SEQ ID NO: 6554014 - DNA, 19 bp, Homo sapiens
ttaaaatgtaaactcttca

SEQ ID NO: 6554015 - DNA, 21 bp, Homo sapiens
ttaaaatgtaatttaaatgaa

SEQ ID NO: 6554016 - DNA, 13 bp, Homo sapiens
ttaaaatgtacac

SEQ ID NO: 6554017 - DNA, 16 bp, Homo sapiens
ttaaaatgtacactgg

SEQ ID NO: 6554018 - DNA, 15 bp, Homo sapiens
ttaaaatgtacatgt

SEQ ID NO: 6554019 - DNA, 16 bp, Homo sapiens
ttaaaatgtagaagaa

SEQ ID NO: 6554020 - DNA, 21 bp, Homo sapiens
ttaaaatgtagttttaaataa

SEQ ID NO: 6554021 - DNA, 22 bp, Homo sapiens
ttaaaatgtagttttaaataaa

SEQ ID NO: 6554022 - DNA, 21 bp, Homo sapiens
ttaaaatgtcccagtgtcagt

SEQ ID NO: 6554023 - DNA, 17 bp, Homo sapiens
ttaaaatgtcttggtct

SEQ ID NO: 6554024 - DNA, 11 bp, Homo sapiens
ttaaaatgtga

SEQ ID NO: 6554025 - DNA, 20 bp, Homo sapiens
ttaaaatgtgaggcaataag

SEQ ID NO: 6554026 - DNA, 12 bp, Homo sapiens
ttaaaatgtgat

SEQ ID NO: 6554027 - DNA, 14 bp, Homo sapiens
ttaaaatgtgattt

SEQ ID NO: 6554028 - DNA, 22 bp, Homo sapiens
ttaaaatgtgtttttcagttat

SEQ ID NO: 6554029 - DNA, 18 bp, Homo sapiens
ttaaaatgtttaggaaat

SEQ ID NO: 6554030 - DNA, 12 bp, Homo sapiens
ttaaaattaaat

SEQ ID NO: 6554031 - DNA, 13 bp, Homo sapiens
ttaaaattacaga

SEQ ID NO: 6554032 - DNA, 14 bp, Homo sapiens
ttaaaattagtctt

SEQ ID NO: 6554033 - DNA, 23 bp, Homo sapiens
ttaaaattatcaatatctaatat

SEQ ID NO: 6554034 - DNA, 16 bp, Homo sapiens
ttaaaattatgaatct

SEQ ID NO: 6554035 - DNA, 12 bp, Homo sapiens
ttaaaattcaaa

SEQ ID NO: 6554036 - DNA, 15 bp, Homo sapiens
ttaaaattcagtttt

SEQ ID NO: 6554037 - DNA, 17 bp, Homo sapiens
ttaaaattccattatct

SEQ ID NO: 6554038 - DNA, 23 bp, Homo sapiens
ttaaaattctcttccaaccattt

SEQ ID NO: 6554039 - DNA, 14 bp, Homo sapiens
ttaaaattctgaat

SEQ ID NO: 6554040 - DNA, 18 bp, Homo sapiens
ttaaaattctgaattttg

SEQ ID NO: 6554041 - DNA, 16 bp, Homo sapiens
ttaaaattctgagtga

SEQ ID NO: 6554042 - DNA, 14 bp, Homo sapiens
ttaaaattctgatg

SEQ ID NO: 6554043 - DNA, 23 bp, Homo sapiens
ttaaaattgatttttctcttcat

SEQ ID NO: 6554044 - DNA, 18 bp, Homo sapiens
ttaaaattgccattttat

SEQ ID NO: 6554045 - DNA, 18 bp, Homo sapiens
ttaaaattgctaacgttt

SEQ ID NO: 6554046 - DNA, 14 bp, Homo sapiens
ttaaaattggcacc

SEQ ID NO: 6554047 - DNA, 20 bp, Homo sapiens
ttaaaattggtaattgaatg

SEQ ID NO: 6554048 - DNA, 21 bp, Homo sapiens
ttaaaattgtcacctctgtta

SEQ ID NO: 6554049 - DNA, 17 bp, Homo sapiens
ttaaaattgtgttctta

SEQ ID NO: 6554050 - DNA, 16 bp, Homo sapiens
ttaaaattgttaccac

SEQ ID NO: 6554051 - DNA, 15 bp, Homo sapiens
ttaaaatttaacatc

SEQ ID NO: 6554052 - DNA, 15 bp, Homo sapiens
ttaaaatttattgct

SEQ ID NO: 6554053 - DNA, 17 bp, Homo sapiens
ttaaaatttgaaacatt

SEQ ID NO: 6554054 - DNA, 18 bp, Homo sapiens
ttaaaatttgaaacattg

SEQ ID NO: 6554055 - DNA, 14 bp, Homo sapiens
ttaaaatttgtaga

SEQ ID NO: 6554056 - DNA, 15 bp, Homo sapiens
ttaaaatttgtctta

SEQ ID NO: 6554057 - DNA, 19 bp, Homo sapiens
ttaaaattttcattctgaa

SEQ ID NO: 6554058 - DNA, 12 bp, Homo sapiens
ttaaaattttgg

SEQ ID NO: 6554059 - DNA, 16 bp, Homo sapiens
ttaaaattttgtatgt

SEQ ID NO: 6554060 - DNA, 22 bp, Homo sapiens
ttaaaatttttcttaagacaga

SEQ ID NO: 6554061 - DNA, 18 bp, Homo sapiens
ttaaaatttttttagaaa

SEQ ID NO: 6554062 - DNA, 19 bp, Homo sapiens
ttaaacaaaaacaaagaaa

SEQ ID NO: 6554063 - DNA, 14 bp, Homo sapiens
ttaaacaaaatgaa

SEQ ID NO: 6554064 - DNA, 21 bp, Homo sapiens
ttaaacaaaatgtagacaaag

SEQ ID NO: 6554065 - DNA, 23 bp, Homo sapiens
ttaaacaaaatttatgtcatttt

SEQ ID NO: 6554066 - DNA, 18 bp, Homo sapiens
ttaaacaaaatttcacag

SEQ ID NO: 6554067 - DNA, 16 bp, Homo sapiens
ttaaacaaagcagtat

SEQ ID NO: 6554068 - DNA, 14 bp, Homo sapiens
ttaaacaaagtttc

SEQ ID NO: 6554069 - DNA, 13 bp, Homo sapiens
ttaaacaaatgtg

SEQ ID NO: 6554070 - DNA, 22 bp, Homo sapiens
ttaaacaatctttcatgtcttg

SEQ ID NO: 6554071 - DNA, 13 bp, Homo sapiens
ttaaacaatgtat

SEQ ID NO: 6554072 - DNA, 14 bp, Homo sapiens
ttaaacaatgtata

SEQ ID NO: 6554073 - DNA, 15 bp, Homo sapiens
ttaaacaattcttgt

SEQ ID NO: 6554074 - DNA, 16 bp, Homo sapiens
ttaaacaatttatttt

SEQ ID NO: 6554075 - DNA, 18 bp, Homo sapiens
ttaaacaatttattttat

SEQ ID NO: 6554076 - DNA, 23 bp, Homo sapiens
ttaaacacacagatacacacaca

SEQ ID NO: 6554077 - DNA, 20 bp, Homo sapiens
ttaaacacagggaaagcatt

SEQ ID NO: 6554078 - DNA, 14 bp, Homo sapiens
ttaaacacccctca

SEQ ID NO: 6554079 - DNA, 13 bp, Homo sapiens
ttaaacacctcct

SEQ ID NO: 6554080 - DNA, 14 bp, Homo sapiens
ttaaacacctgaca

SEQ ID NO: 6554081 - DNA, 12 bp, Homo sapiens
ttaaacagatga

SEQ ID NO: 6554082 - DNA, 17 bp, Homo sapiens
ttaaacagcaaagccat

SEQ ID NO: 6554083 - DNA, 14 bp, Homo sapiens
ttaaacagcagtgt

SEQ ID NO: 6554084 - DNA, 16 bp, Homo sapiens
ttaaacaggcccagca

SEQ ID NO: 6554085 - DNA, 18 bp, Homo sapiens
ttaaacagggtctcactc

SEQ ID NO: 6554086 - DNA, 16 bp, Homo sapiens
ttaaacagtatttcat

SEQ ID NO: 6554087 - DNA, 22 bp, Homo sapiens
ttaaacagtgaacttgtctggc

SEQ ID NO: 6554088 - DNA, 19 bp, Homo sapiens
ttaaacagttgcacagcat

SEQ ID NO: 6554089 - DNA, 23 bp, Homo sapiens
ttaaacagttgcacagcatctca

SEQ ID NO: 6554090 - DNA, 15 bp, Homo sapiens
ttgttttgtgtttca

SEQ ID NO: 6554091 - DNA, 15 bp, Homo sapiens
ttgttttgttaacaa

SEQ ID NO: 6554092 - DNA, 19 bp, Homo sapiens
ttgttttgttaacaatggc

SEQ ID NO: 6554093 - DNA, 14 bp, Homo sapiens
ttgttttgttttaa

SEQ ID NO: 6554094 - DNA, 18 bp, Homo sapiens
ttgtttttaaactgtaca

SEQ ID NO: 6554095 - DNA, 19 bp, Homo sapiens
ttgtttttaaactgtacag

SEQ ID NO: 6554096 - DNA, 22 bp, Homo sapiens
ttgtttttaacaactaatcaag

SEQ ID NO: 6554097 - DNA, 19 bp, Homo sapiens
ttgtttttaagtttgcact

SEQ ID NO: 6554098 - DNA, 19 bp, Homo sapiens
ttgtttttaatttgaatca

SEQ ID NO: 6554099 - DNA, 18 bp, Homo sapiens
ttgtttttattttcaaga

SEQ ID NO: 6554100 - DNA, 13 bp, Homo sapiens
ttgtttttcattc

SEQ ID NO: 6554101 - DNA, 15 bp, Homo sapiens
ttgtttttccatgtg

SEQ ID NO: 6554102 - DNA, 18 bp, Homo sapiens
ttgtttttccatgtgttt

SEQ ID NO: 6554103 - DNA, 13 bp, Homo sapiens
ttgtttttccttg

SEQ ID NO: 6554104 - DNA, 19 bp, Homo sapiens
ttgtttttcgtttttttgg

SEQ ID NO: 6554105 - DNA, 14 bp, Homo sapiens
ttgtttttcttcag

SEQ ID NO: 6554106 - DNA, 16 bp, Homo sapiens
ttgtttttcttcagca

SEQ ID NO: 6554107 - DNA, 20 bp, Homo sapiens
ttgtttttcttcagcattta

SEQ ID NO: 6554108 - DNA, 22 bp, Homo sapiens
ttgtttttgagtactgtactat

SEQ ID NO: 6554109 - DNA, 18 bp, Homo sapiens
ttgtttttgagttttctt

SEQ ID NO: 6554110 - DNA, 17 bp, Homo sapiens
ttgtttttgcatgaaat

SEQ ID NO: 6554111 - DNA, 13 bp, Homo sapiens
ttgtttttgcttt

SEQ ID NO: 6554112 - DNA, 15 bp, Homo sapiens
ttgtttttgctttct

SEQ ID NO: 6554113 - DNA, 17 bp, Homo sapiens
ttgtttttggaaagaaa

SEQ ID NO: 6554114 - DNA, 21 bp, Homo sapiens
ttgtttttgtatttattaatt

SEQ ID NO: 6554115 - DNA, 15 bp, Homo sapiens
ttgttttttaaagca

SEQ ID NO: 6554116 - DNA, 15 bp, Homo sapiens
ttgttttttaaatga

SEQ ID NO: 6554117 - DNA, 14 bp, Homo sapiens
ttgttttttagttc

SEQ ID NO: 6554118 - DNA, 19 bp, Homo sapiens
ttgttttttcatagtgcct

SEQ ID NO: 6554119 - DNA, 17 bp, Homo sapiens
ttgttttttcattgtgt

SEQ ID NO: 6554120 - DNA, 19 bp, Homo sapiens
ttgttttttccccttgcct

SEQ ID NO: 6554121 - DNA, 12 bp, Homo sapiens
ttgttttttgaa

SEQ ID NO: 6554122 - DNA, 15 bp, Homo sapiens
ttgtttttttcctca

SEQ ID NO: 6554123 - DNA, 22 bp, Homo sapiens
ttgtttttttcctttttcctcc

SEQ ID NO: 6554124 - DNA, 16 bp, Homo sapiens
ttgtttttttcttttc

SEQ ID NO: 6554125 - DNA, 18 bp, Homo sapiens
ttgttttttttttccact

SEQ ID NO: 6554126 - DNA, 17 bp, Homo sapiens
tttaaaaaaaaaattgg

SEQ ID NO: 6554127 - DNA, 20 bp, Homo sapiens
tttaaaaaaaaacattcaaa

SEQ ID NO: 6554128 - DNA, 18 bp, Homo sapiens
tttaaaaaaaaagtcaga

SEQ ID NO: 6554129 - DNA, 18 bp, Homo sapiens
tttaaaaaaaaatcttgt

SEQ ID NO: 6554130 - DNA, 15 bp, Homo sapiens
tttaaaaaaaagaaa

SEQ ID NO: 6554131 - DNA, 16 bp, Homo sapiens
tttaaaaaaacaaata

SEQ ID NO: 6554132 - DNA, 17 bp, Homo sapiens
tttaaaaaaacaaataa

SEQ ID NO: 6554133 - DNA, 15 bp, Homo sapiens
tttaaaaaaactgaa

SEQ ID NO: 6554134 - DNA, 16 bp, Homo sapiens
tttaaaaaaactgaag

SEQ ID NO: 6554135 - DNA, 19 bp, Homo sapiens
tttaaaaaaagctaaatta

SEQ ID NO: 6554136 - DNA, 22 bp, Homo sapiens
tttaaaaaaagtatatattcta

SEQ ID NO: 6554137 - DNA, 15 bp, Homo sapiens
tttaaaaaaataaaa

SEQ ID NO: 6554138 - DNA, 18 bp, Homo sapiens
tttaaaaaaataaaacag

SEQ ID NO: 6554139 - DNA, 21 bp, Homo sapiens
tttaaaaaaataaaacagtat

SEQ ID NO: 6554140 - DNA, 23 bp, Homo sapiens
tttaaaaaaataacatctgaaaa

SEQ ID NO: 6554141 - DNA, 17 bp, Homo sapiens
tttaaaaaaatcacaaa

SEQ ID NO: 6554142 - DNA, 17 bp, Homo sapiens
tttaaaaaaatttaagt

SEQ ID NO: 6554143 - DNA, 15 bp, Homo sapiens
tttaaaaaaatttga

SEQ ID NO: 6554144 - DNA, 16 bp, Homo sapiens
tttaaaaaacaaaaag

SEQ ID NO: 6554145 - DNA, 11 bp, Homo sapiens
tttaaaaaact

SEQ ID NO: 6554146 - DNA, 21 bp, Homo sapiens
tttaaaaaactaaaaactaga

SEQ ID NO: 6554147 - DNA, 19 bp, Homo sapiens
tttaaaaaactattttatg

SEQ ID NO: 6554148 - DNA, 12 bp, Homo sapiens
tttaaaaaagaa

SEQ ID NO: 6554149 - DNA, 15 bp, Homo sapiens
tttaaaaaagactga

SEQ ID NO: 6554150 - DNA, 22 bp, Homo sapiens
tttaaaaaagactgaacatgtt

SEQ ID NO: 6554151 - DNA, 20 bp, Homo sapiens
tttaaaaaagcattatcctt

SEQ ID NO: 6554152 - DNA, 22 bp, Homo sapiens
tttaaaaaagcctggtttttct

SEQ ID NO: 6554153 - DNA, 17 bp, Homo sapiens
tttaaaaaagcttaaaa

SEQ ID NO: 6554154 - DNA, 23 bp, Homo sapiens
tttaaaaaagcttaaaactttga

SEQ ID NO: 6554155 - DNA, 14 bp, Homo sapiens
tttaaaaaagttta

SEQ ID NO: 6554156 - DNA, 17 bp, Homo sapiens
tttaaaaaataaatata

SEQ ID NO: 6554157 - DNA, 18 bp, Homo sapiens
tttaaaaaataaatataa

SEQ ID NO: 6554158 - DNA, 21 bp, Homo sapiens
tttaaaaaataacatattctt

SEQ ID NO: 6554159 - DNA, 22 bp, Homo sapiens
tttaaaaaataacttcattgtt

SEQ ID NO: 6554160 - DNA, 20 bp, Homo sapiens
tttaaaaaatacagtattat

SEQ ID NO: 6554161 - DNA, 24 bp, Homo sapiens
tttaaaaaataccattgaaatcag

SEQ ID NO: 6554162 - DNA, 19 bp, Homo sapiens
tttaaaaaatagcagcttt

SEQ ID NO: 6554163 - DNA, 14 bp, Homo sapiens
tttaaaaaatatat

SEQ ID NO: 6554164 - DNA, 15 bp, Homo sapiens
tttaaaaaatatata

SEQ ID NO: 6554165 - DNA, 19 bp, Homo sapiens
tttaaaaaatatttattaa

SEQ ID NO: 6554166 - DNA, 18 bp, Homo sapiens
tttaaaaaatgttttctg

SEQ ID NO: 6554167 - DNA, 20 bp, Homo sapiens
tttaaaaaattaaaaatgaa

SEQ ID NO: 6554168 - DNA, 22 bp, Homo sapiens
tttaaaaaattaaaaatgaaaa

SEQ ID NO: 6554169 - DNA, 21 bp, Homo sapiens
tttaaaaaattaatctgggcc

SEQ ID NO: 6554170 - DNA, 16 bp, Homo sapiens
tttaaaaaattatgga

SEQ ID NO: 6554171 - DNA, 19 bp, Homo sapiens
tttaaaaaattatggaata

SEQ ID NO: 6554172 - DNA, 20 bp, Homo sapiens
tttaaaaaattatggaatat

SEQ ID NO: 6554173 - DNA, 22 bp, Homo sapiens
tttaaaaaattatggaatatca

SEQ ID NO: 6554174 - DNA, 16 bp, Homo sapiens
tttaaaaacaggaaaa

SEQ ID NO: 6554175 - DNA, 19 bp, Homo sapiens
tttaaaaacattttttata

SEQ ID NO: 6554176 - DNA, 14 bp, Homo sapiens
tttaaaaactattt

SEQ ID NO: 6554177 - DNA, 14 bp, Homo sapiens
tttaaaaactcttc

SEQ ID NO: 6554178 - DNA, 14 bp, Homo sapiens
tttaaaaactgttt

SEQ ID NO: 6554179 - DNA, 15 bp, Homo sapiens
tttaaaaagaaatta

SEQ ID NO: 6554180 - DNA, 20 bp, Homo sapiens
tttaaaaagaaattgaggtt

SEQ ID NO: 6554181 - DNA, 16 bp, Homo sapiens
tttaaaaagaagaaaa

SEQ ID NO: 6554182 - DNA, 18 bp, Homo sapiens
tttaaaaagcaaatcttt

SEQ ID NO: 6554183 - DNA, 13 bp, Homo sapiens
tttaaaaagctca

SEQ ID NO: 6554184 - DNA, 20 bp, Homo sapiens
tttaaaaaggaaatttgttt

SEQ ID NO: 6554185 - DNA, 14 bp, Homo sapiens
tttaaaaaggcctt

SEQ ID NO: 6554186 - DNA, 17 bp, Homo sapiens
tttaaaaaggcctttgg

SEQ ID NO: 6554187 - DNA, 22 bp, Homo sapiens
tttaaaaagtaagttaataatg

SEQ ID NO: 6554188 - DNA, 23 bp, Homo sapiens
tttaaaaagtaagttaataatgt

SEQ ID NO: 6554189 - DNA, 13 bp, Homo sapiens
tttaaaaagtatt

SEQ ID NO: 6554190 - DNA, 13 bp, Homo sapiens
tttaaaaagtgtt

SEQ ID NO: 6554191 - DNA, 18 bp, Homo sapiens
tttaaaaagttatataaa

SEQ ID NO: 6554192 - DNA, 16 bp, Homo sapiens
tttaaaaataaaagct

SEQ ID NO: 6554193 - DNA, 18 bp, Homo sapiens
tttaaaaataaaagctat

SEQ ID NO: 6554194 - DNA, 15 bp, Homo sapiens
tttaaaaataaagga

SEQ ID NO: 6554195 - DNA, 18 bp, Homo sapiens
tttaaaaataagtcaaca

SEQ ID NO: 6554196 - DNA, 21 bp, Homo sapiens
tttaaaaataagtcaacagta

SEQ ID NO: 6554197 - DNA, 12 bp, Homo sapiens
tttaaaaataca

SEQ ID NO: 6554198 - DNA, 21 bp, Homo sapiens
tttaaaaatacaattattgta

SEQ ID NO: 6554199 - DNA, 15 bp, Homo sapiens
tttaaaaatacacat

SEQ ID NO: 6554200 - DNA, 17 bp, Homo sapiens
tttaaaaatacacatgg

SEQ ID NO: 6554201 - DNA, 20 bp, Homo sapiens
tttaaaaatagaatacattt

SEQ ID NO: 6554202 - DNA, 13 bp, Homo sapiens
tttaaaaatattc

SEQ ID NO: 6554203 - DNA, 13 bp, Homo sapiens
tttaaaaatcaac

SEQ ID NO: 6554204 - DNA, 15 bp, Homo sapiens
tttaaaaatctgcca

SEQ ID NO: 6554205 - DNA, 19 bp, Homo sapiens
tttaaaaatctttcagaat

SEQ ID NO: 6554206 - DNA, 12 bp, Homo sapiens
tttaaaaatgaa

SEQ ID NO: 6554207 - DNA, 14 bp, Homo sapiens
tttaaaaatgaaat

SEQ ID NO: 6554208 - DNA, 19 bp, Homo sapiens
tttaaaaatgatctgtagt

SEQ ID NO: 6554209 - DNA, 17 bp, Homo sapiens
tttaaaaatgatgataa

SEQ ID NO: 6554210 - DNA, 20 bp, Homo sapiens
tttaaaaatgcaatatctga

SEQ ID NO: 6554211 - DNA, 19 bp, Homo sapiens
tttaaaaatgcatgataat

SEQ ID NO: 6554212 - DNA, 20 bp, Homo sapiens
tttaaaaatggtatcaaaat

SEQ ID NO: 6554213 - DNA, 11 bp, Homo sapiens
tttaaaaatgt

SEQ ID NO: 6554214 - DNA, 12 bp, Homo sapiens
tttaaaaatgta

SEQ ID NO: 6554215 - DNA, 13 bp, Homo sapiens
tttaaaaatgtat

SEQ ID NO: 6554216 - DNA, 13 bp, Homo sapiens
tttaaaaatgttt

SEQ ID NO: 6554217 - DNA, 15 bp, Homo sapiens
tttaaaaattcactt

SEQ ID NO: 6554218 - DNA, 22 bp, Homo sapiens
tttaaaaattcacttctatata

SEQ ID NO: 6554219 - DNA, 18 bp, Homo sapiens
tttaaaaattgaaaaaag

SEQ ID NO: 6554220 - DNA, 13 bp, Homo sapiens
tttaaaaattggc

SEQ ID NO: 6554221 - DNA, 15 bp, Homo sapiens
tttaaaaattgttat

SEQ ID NO: 6554222 - DNA, 19 bp, Homo sapiens
tttaaaacaagctgatagt

SEQ ID NO: 6554223 - DNA, 15 bp, Homo sapiens
tttaaaacagtattt

SEQ ID NO: 6554224 - DNA, 21 bp, Homo sapiens
tttaaaacataggaaagtaga

SEQ ID NO: 6554225 - DNA, 14 bp, Homo sapiens
tttaaaacatggca

SEQ ID NO: 6554226 - DNA, 16 bp, Homo sapiens
tttaaaacatttcatg

SEQ ID NO: 6554227 - DNA, 17 bp, Homo sapiens
tttaaaaccagttaccc

SEQ ID NO: 6554228 - DNA, 14 bp, Homo sapiens
tttaaaaccatgca

SEQ ID NO: 6554229 - DNA, 22 bp, Homo sapiens
tttaaaacgcgtctgcctgggc

SEQ ID NO: 6554230 - DNA, 22 bp, Homo sapiens
tttaaaacgtgtaaatgaagat

SEQ ID NO: 6554231 - DNA, 19 bp, Homo sapiens
tttaaaacgttttctcttc

SEQ ID NO: 6554232 - DNA, 13 bp, Homo sapiens
tttaaaactactt

SEQ ID NO: 6554233 - DNA, 12 bp, Homo sapiens
tttaaaactctg

SEQ ID NO: 6554234 - DNA, 13 bp, Homo sapiens
tttaaaactctgg

SEQ ID NO: 6554235 - DNA, 16 bp, Homo sapiens
tttaaaactggacctg

SEQ ID NO: 6554236 - DNA, 15 bp, Homo sapiens
tttaaaactgttatt

SEQ ID NO: 6554237 - DNA, 22 bp, Homo sapiens
tttaaaactgttggaatggatt

SEQ ID NO: 6554238 - DNA, 13 bp, Homo sapiens
tttaaaagaaaaa

SEQ ID NO: 6554239 - DNA, 14 bp, Homo sapiens
tttaaaagaatgat

SEQ ID NO: 6554240 - DNA, 18 bp, Homo sapiens
tttaaaagaatgggcagt

SEQ ID NO: 6554241 - DNA, 19 bp, Homo sapiens
tttaaaagacacacttgtc

SEQ ID NO: 6554242 - DNA, 12 bp, Homo sapiens
tttaaaagactt

SEQ ID NO: 6554243 - DNA, 15 bp, Homo sapiens
tttaaaagagaaaaa

SEQ ID NO: 6554244 - DNA, 16 bp, Homo sapiens
tttaaaagagaaaaac

SEQ ID NO: 6554245 - DNA, 21 bp, Homo sapiens
tttaaaagagagagagagaaa

SEQ ID NO: 6554246 - DNA, 23 bp, Homo sapiens
tttaaaagaggaaattaaataat

SEQ ID NO: 6554247 - DNA, 15 bp, Homo sapiens
tttaaaagataaaca

SEQ ID NO: 6554248 - DNA, 13 bp, Homo sapiens
tttaaaagataca

SEQ ID NO: 6554249 - DNA, 19 bp, Homo sapiens
tttaaaagatccatttaaa

SEQ ID NO: 6554250 - DNA, 13 bp, Homo sapiens
tttaaaagatctt

SEQ ID NO: 6554251 - DNA, 18 bp, Homo sapiens
tttaaaagatgcaatgta

SEQ ID NO: 6554252 - DNA, 17 bp, Homo sapiens
tttaaaagatgctttta

SEQ ID NO: 6554253 - DNA, 16 bp, Homo sapiens
tttaaaagattcattt

SEQ ID NO: 6554254 - DNA, 12 bp, Homo sapiens
tttaaaagattt

SEQ ID NO: 6554255 - DNA, 19 bp, Homo sapiens
tttaaaagcaaaactgcaa

SEQ ID NO: 6554256 - DNA, 13 bp, Homo sapiens
tttaaaagcacga

SEQ ID NO: 6554257 - DNA, 15 bp, Homo sapiens
tttaaaagcagagca

SEQ ID NO: 6554258 - DNA, 18 bp, Homo sapiens
tttaaaagcatgaaacat

SEQ ID NO: 6554259 - DNA, 17 bp, Homo sapiens
tttaaaaggaaagaaaa

SEQ ID NO: 6554260 - DNA, 17 bp, Homo sapiens
tttaaaaggcaactcaa

SEQ ID NO: 6554261 - DNA, 10 bp, Homo sapiens
tttaaaaggg

SEQ ID NO: 6554262 - DNA, 21 bp, Homo sapiens
tttaaaaggtattttgaatac

SEQ ID NO: 6554263 - DNA, 23 bp, Homo sapiens
tttaaaagtaaaatgtctttcca

SEQ ID NO: 6554264 - DNA, 20 bp, Homo sapiens
tttaaaagtatataataaaa

SEQ ID NO: 6554265 - DNA, 16 bp, Homo sapiens
tttaaaagtatcttta

SEQ ID NO: 6554266 - DNA, 17 bp, Homo sapiens
tttaaaagtatctttaa

SEQ ID NO: 6554267 - DNA, 15 bp, Homo sapiens
tttaaaagtcacata

SEQ ID NO: 6554268 - DNA, 19 bp, Homo sapiens
tttaaaagtcacataaaat

SEQ ID NO: 6554269 - DNA, 12 bp, Homo sapiens
tttaaaagtcta

SEQ ID NO: 6554270 - DNA, 13 bp, Homo sapiens
ttaaacataaata

SEQ ID NO: 6554271 - DNA, 19 bp, Homo sapiens
ttaaacataagctaaatca

SEQ ID NO: 6554272 - DNA, 12 bp, Homo sapiens
ttaaacataata

SEQ ID NO: 6554273 - DNA, 18 bp, Homo sapiens
ttaaacatacataataca

SEQ ID NO: 6554274 - DNA, 22 bp, Homo sapiens
ttaaacatatccaagtttgaat

SEQ ID NO: 6554275 - DNA, 17 bp, Homo sapiens
ttaaacatattcaagga

SEQ ID NO: 6554276 - DNA, 21 bp, Homo sapiens
ttaaacatcattggataaatt

SEQ ID NO: 6554277 - DNA, 21 bp, Homo sapiens
ttaaacatgaaactgaataag

SEQ ID NO: 6554278 - DNA, 17 bp, Homo sapiens
ttaaacatgaatttaat

SEQ ID NO: 6554279 - DNA, 16 bp, Homo sapiens
ttaaacatgattatct

SEQ ID NO: 6554280 - DNA, 22 bp, Homo sapiens
ttaaacatgctgtacatacttt

SEQ ID NO: 6554281 - DNA, 23 bp, Homo sapiens
ttaaacatgctgtacatactttt

SEQ ID NO: 6554282 - DNA, 18 bp, Homo sapiens
ttaaacatgtaaatacaa

SEQ ID NO: 6554283 - DNA, 21 bp, Homo sapiens
ttaaacattaaaaatggaact

SEQ ID NO: 6554284 - DNA, 15 bp, Homo sapiens
ttaaacattgaagta

SEQ ID NO: 6554285 - DNA, 22 bp, Homo sapiens
ttaaacattggttcttgtatta

SEQ ID NO: 6554286 - DNA, 11 bp, Homo sapiens
ttaaacatttt

SEQ ID NO: 6554287 - DNA, 20 bp, Homo sapiens
ttaaaccaaacggaactctt

SEQ ID NO: 6554288 - DNA, 23 bp, Homo sapiens
ttaaaccaacctttaaaattgtc

SEQ ID NO: 6554289 - DNA, 16 bp, Homo sapiens
ttaaaccaatgaagaa

SEQ ID NO: 6554290 - DNA, 21 bp, Homo sapiens
ttaaaccacacacacaaggtg

SEQ ID NO: 6554291 - DNA, 14 bp, Homo sapiens
ttaaaccacttaaa

SEQ ID NO: 6554292 - DNA, 20 bp, Homo sapiens
ttaaaccagcagaaaagtgc

SEQ ID NO: 6554293 - DNA, 17 bp, Homo sapiens
ttaaaccatgggataaa

SEQ ID NO: 6554294 - DNA, 23 bp, Homo sapiens
ttaaaccatgggataaatgccat

SEQ ID NO: 6554295 - DNA, 23 bp, Homo sapiens
ttaaacccacaagctgcctctga

SEQ ID NO: 6554296 - DNA, 18 bp, Homo sapiens
ttaaacccacataaacac

SEQ ID NO: 6554297 - DNA, 15 bp, Homo sapiens
ttaaacccatacaat

SEQ ID NO: 6554298 - DNA, 21 bp, Homo sapiens
ttaaacccatacaatgtatgt

SEQ ID NO: 6554299 - DNA, 16 bp, Homo sapiens
ttaaacccattttagt

SEQ ID NO: 6554300 - DNA, 20 bp, Homo sapiens
ttaaaccctggatcagtcct

SEQ ID NO: 6554301 - DNA, 19 bp, Homo sapiens
ttaaaccctttagtgcttt

SEQ ID NO: 6554302 - DNA, 17 bp, Homo sapiens
ttaaaccgccaaggctg

SEQ ID NO: 6554303 - DNA, 14 bp, Homo sapiens
ttaaacctatactc

SEQ ID NO: 6554304 - DNA, 23 bp, Homo sapiens
ttaaacctggaatctacaagcca

SEQ ID NO: 6554305 - DNA, 20 bp, Homo sapiens
ttaaacctgtgctttcatgt

SEQ ID NO: 6554306 - DNA, 13 bp, Homo sapiens
ttaaacctgttcc

SEQ ID NO: 6554307 - DNA, 15 bp, Homo sapiens
ttaaacctgttcctg

SEQ ID NO: 6554308 - DNA, 15 bp, Homo sapiens
ttaaacctttaatga

SEQ ID NO: 6554309 - DNA, 14 bp, Homo sapiens
ttaaaccttttatt

SEQ ID NO: 6554310 - DNA, 19 bp, Homo sapiens
ttaaacgaagagttccctt

SEQ ID NO: 6554311 - DNA, 16 bp, Homo sapiens
ttaaacgagataatgt

SEQ ID NO: 6554312 - DNA, 15 bp, Homo sapiens
ttaaacgattagtga

SEQ ID NO: 6554313 - DNA, 22 bp, Homo sapiens
ttaaacgatttttaaaatgtac

SEQ ID NO: 6554314 - DNA, 16 bp, Homo sapiens
ttaaacgcctccttca

SEQ ID NO: 6554315 - DNA, 22 bp, Homo sapiens
ttaaacgcgtgatgaagacaga

SEQ ID NO: 6554316 - DNA, 23 bp, Homo sapiens
ttaaacgctctaggtacgatgac

SEQ ID NO: 6554317 - DNA, 17 bp, Homo sapiens
ttaaacgcttcttatgt

SEQ ID NO: 6554318 - DNA, 13 bp, Homo sapiens
ttaaacggattat

SEQ ID NO: 6554319 - DNA, 14 bp, Homo sapiens
ttaaacggattatt

SEQ ID NO: 6554320 - DNA, 15 bp, Homo sapiens
ttaaacggattattt

SEQ ID NO: 6554321 - DNA, 17 bp, Homo sapiens
ttaaacgtagcatgtgg

SEQ ID NO: 6554322 - DNA, 20 bp, Homo sapiens
ttaaacgtagcatgtggcat

SEQ ID NO: 6554323 - DNA, 16 bp, Homo sapiens
ttaaacgtatgcatgt

SEQ ID NO: 6554324 - DNA, 17 bp, Homo sapiens
ttaaacgtcacagcagt

SEQ ID NO: 6554325 - DNA, 19 bp, Homo sapiens
ttaaacgtgatttttaaat

SEQ ID NO: 6554326 - DNA, 14 bp, Homo sapiens
ttaaacgtgcagac

SEQ ID NO: 6554327 - DNA, 16 bp, Homo sapiens
ttaaacgtgtaaattg

SEQ ID NO: 6554328 - DNA, 18 bp, Homo sapiens
ttaaactaaccttttatc

SEQ ID NO: 6554329 - DNA, 20 bp, Homo sapiens
ttaaactaaggccctcttga

SEQ ID NO: 6554330 - DNA, 15 bp, Homo sapiens
ttaaactacaggtag

SEQ ID NO: 6554331 - DNA, 22 bp, Homo sapiens
ttaaactacattaggttgtgaa

SEQ ID NO: 6554332 - DNA, 23 bp, Homo sapiens
ttaaactacattaggttgtgaat

SEQ ID NO: 6554333 - DNA, 21 bp, Homo sapiens
ttaaactaccactttttttaa

SEQ ID NO: 6554334 - DNA, 18 bp, Homo sapiens
ttaaactacctcaaaaca

SEQ ID NO: 6554335 - DNA, 18 bp, Homo sapiens
ttaaactactatttttct

SEQ ID NO: 6554336 - DNA, 16 bp, Homo sapiens
ttaaactagatgacct

SEQ ID NO: 6554337 - DNA, 20 bp, Homo sapiens
ttaaactagatgacctcatt

SEQ ID NO: 6554338 - DNA, 23 bp, Homo sapiens
ttaaactagatgacctcattaac

SEQ ID NO: 6554339 - DNA, 22 bp, Homo sapiens
ttaaactaggagaaccaaatct

SEQ ID NO: 6554340 - DNA, 16 bp, Homo sapiens
ttaaactagtttaagg

SEQ ID NO: 6554341 - DNA, 16 bp, Homo sapiens
ttaaactataggtaat

SEQ ID NO: 6554342 - DNA, 14 bp, Homo sapiens
ttaaactatcttgt

SEQ ID NO: 6554343 - DNA, 16 bp, Homo sapiens
ttaaactatgttccta

SEQ ID NO: 6554344 - DNA, 14 bp, Homo sapiens
ttaaactcagggac

SEQ ID NO: 6554345 - DNA, 20 bp, Homo sapiens
ttaaactcgactaaaacaag

SEQ ID NO: 6554346 - DNA, 20 bp, Homo sapiens
ttaaactctgaatttatctt

SEQ ID NO: 6554347 - DNA, 18 bp, Homo sapiens
ttaaactctgccagaaaa

SEQ ID NO: 6554348 - DNA, 16 bp, Homo sapiens
ttaaactctggacact

SEQ ID NO: 6554349 - DNA, 22 bp, Homo sapiens
ttaaactctgttgcaagtgcaa

SEQ ID NO: 6554350 - DNA, 19 bp, Homo sapiens
ttaaactctgttgtaagta

SEQ ID NO: 6554351 - DNA, 13 bp, Homo sapiens
ttaaactcttaga

SEQ ID NO: 6554352 - DNA, 20 bp, Homo sapiens
ttaaactcttgaatatgtgc

SEQ ID NO: 6554353 - DNA, 16 bp, Homo sapiens
ttaaactgaaagcttt

SEQ ID NO: 6554354 - DNA, 22 bp, Homo sapiens
ttaaactgaaagctttaatgtt

SEQ ID NO: 6554355 - DNA, 16 bp, Homo sapiens
ttaaactgatgtatag

SEQ ID NO: 6554356 - DNA, 20 bp, Homo sapiens
ttaaactgatgtatagcttt

SEQ ID NO: 6554357 - DNA, 18 bp, Homo sapiens
ttaaactgggaaatgaga

SEQ ID NO: 6554358 - DNA, 12 bp, Homo sapiens
ttaaactgtaca

SEQ ID NO: 6554359 - DNA, 18 bp, Homo sapiens
ttaaactgtacagaattt

SEQ ID NO: 6554360 - DNA, 15 bp, Homo sapiens
ttaaactgtacagtg

SEQ ID NO: 6554361 - DNA, 13 bp, Homo sapiens
ttaaactgtattt

SEQ ID NO: 6554362 - DNA, 11 bp, Homo sapiens
ttaaactgtga

SEQ ID NO: 6554363 - DNA, 13 bp, Homo sapiens
ttaaactgtgagc

SEQ ID NO: 6554364 - DNA, 19 bp, Homo sapiens
ttaaactgttagcactgtt

SEQ ID NO: 6554365 - DNA, 20 bp, Homo sapiens
ttaaactgttagcactgttg

SEQ ID NO: 6554366 - DNA, 18 bp, Homo sapiens
ttaaactgttctgtgtgg

SEQ ID NO: 6554367 - DNA, 20 bp, Homo sapiens
ttaaacttaatctaaatgga

SEQ ID NO: 6554368 - DNA, 22 bp, Homo sapiens
ttaaacttaatctaaatggaac

SEQ ID NO: 6554369 - DNA, 11 bp, Homo sapiens
ttaaacttcca

SEQ ID NO: 6554370 - DNA, 13 bp, Homo sapiens
ttaaacttccaaa

SEQ ID NO: 6554371 - DNA, 16 bp, Homo sapiens
ttaaacttccaaagaa

SEQ ID NO: 6554372 - DNA, 17 bp, Homo sapiens
ttaaacttccaaagaaa

SEQ ID NO: 6554373 - DNA, 18 bp, Homo sapiens
ttaaacttccaaagaaag

SEQ ID NO: 6554374 - DNA, 12 bp, Homo sapiens
ttaaacttgaaa

SEQ ID NO: 6554375 - DNA, 15 bp, Homo sapiens
ttaaacttgacccag

SEQ ID NO: 6554376 - DNA, 22 bp, Homo sapiens
ttaaacttggaagggggagaca

SEQ ID NO: 6554377 - DNA, 16 bp, Homo sapiens
ttaaacttgtcagaat

SEQ ID NO: 6554378 - DNA, 14 bp, Homo sapiens
ttaaacttgtgaat

SEQ ID NO: 6554379 - DNA, 15 bp, Homo sapiens
ttaaacttgtgaatg

SEQ ID NO: 6554380 - DNA, 17 bp, Homo sapiens
ttaaacttgtgaatgct

SEQ ID NO: 6554381 - DNA, 13 bp, Homo sapiens
ttaaactttcaat

SEQ ID NO: 6554382 - DNA, 18 bp, Homo sapiens
ttaaactttcaatatttt

SEQ ID NO: 6554383 - DNA, 19 bp, Homo sapiens
ttaaactttcccttggctg

SEQ ID NO: 6554384 - DNA, 19 bp, Homo sapiens
ttaaactttgtcacttctg

SEQ ID NO: 6554385 - DNA, 21 bp, Homo sapiens
ttaaactttgtcacttctgct

SEQ ID NO: 6554386 - DNA, 17 bp, Homo sapiens
ttaaacttttaattcat

SEQ ID NO: 6554387 - DNA, 13 bp, Homo sapiens
ttaaactttttaa

SEQ ID NO: 6554388 - DNA, 17 bp, Homo sapiens
ttaaactttttaaaata

SEQ ID NO: 6554389 - DNA, 15 bp, Homo sapiens
ttaaacttttttaac

SEQ ID NO: 6554390 - DNA, 16 bp, Homo sapiens
ttaaactttttttgtc

SEQ ID NO: 6554391 - DNA, 16 bp, Homo sapiens
ttaaagaaaaaaatgt

SEQ ID NO: 6554392 - DNA, 22 bp, Homo sapiens
ttaaagaaaaaaattgaaatgt

SEQ ID NO: 6554393 - DNA, 20 bp, Homo sapiens
ttaaagaaaaaccacagata

SEQ ID NO: 6554394 - DNA, 13 bp, Homo sapiens
ttaaagaaaaata

SEQ ID NO: 6554395 - DNA, 17 bp, Homo sapiens
ttaaagaaaagatgaaa

SEQ ID NO: 6554396 - DNA, 18 bp, Homo sapiens
ttaaagaaaatgtgtctg

SEQ ID NO: 6554397 - DNA, 13 bp, Homo sapiens
ttaaagaaaattg

SEQ ID NO: 6554398 - DNA, 19 bp, Homo sapiens
ttaaagaaaattgcatgaa

SEQ ID NO: 6554399 - DNA, 15 bp, Homo sapiens
ttaaagaaaattgcc

SEQ ID NO: 6554400 - DNA, 23 bp, Homo sapiens
ttaaagaaaattgccaaaatata

SEQ ID NO: 6554401 - DNA, 14 bp, Homo sapiens
ttaaagaaacacta

SEQ ID NO: 6554402 - DNA, 16 bp, Homo sapiens
ttaaagaaacagcttt

SEQ ID NO: 6554403 - DNA, 16 bp, Homo sapiens
ttaaagaaaggaaaag

SEQ ID NO: 6554404 - DNA, 17 bp, Homo sapiens
ttaaagaaaggaaaaga

SEQ ID NO: 6554405 - DNA, 12 bp, Homo sapiens
ttaaagaaaggc

SEQ ID NO: 6554406 - DNA, 11 bp, Homo sapiens
ttaaagaaagt

SEQ ID NO: 6554407 - DNA, 18 bp, Homo sapiens
ttaaagaaatttaatgtt

SEQ ID NO: 6554408 - DNA, 20 bp, Homo sapiens
ttaaagaaatttaatgtttc

SEQ ID NO: 6554409 - DNA, 19 bp, Homo sapiens
ttaaagaacagctaacaat

SEQ ID NO: 6554410 - DNA, 13 bp, Homo sapiens
ttaaagaagacat

SEQ ID NO: 6554411 - DNA, 12 bp, Homo sapiens
ttaaagaagacc

SEQ ID NO: 6554412 - DNA, 16 bp, Homo sapiens
ttaaagaagagtgact

SEQ ID NO: 6554413 - DNA, 14 bp, Homo sapiens
ttaaagaagctgca

SEQ ID NO: 6554414 - DNA, 14 bp, Homo sapiens
ttaaagaagtattt

SEQ ID NO: 6554415 - DNA, 22 bp, Homo sapiens
ttaaagaagtcataaacagcat

SEQ ID NO: 6554416 - DNA, 20 bp, Homo sapiens
ttaaagaagtccatgtgata

SEQ ID NO: 6554417 - DNA, 12 bp, Homo sapiens
ttaaagaataaa

SEQ ID NO: 6554418 - DNA, 21 bp, Homo sapiens
ttaaagaataaagtccaaagt

SEQ ID NO: 6554419 - DNA, 19 bp, Homo sapiens
ttaaagaatgttagtaaag

SEQ ID NO: 6554420 - DNA, 21 bp, Homo sapiens
ttaaagaatgttagtaaagga

SEQ ID NO: 6554421 - DNA, 19 bp, Homo sapiens
ttaaagaatttaaaaaagt

SEQ ID NO: 6554422 - DNA, 9 bp, Homo sapiens
ttaaagaca

SEQ ID NO: 6554423 - DNA, 21 bp, Homo sapiens
ttaaagacaaagacaaattct

SEQ ID NO: 6554424 - DNA, 14 bp, Homo sapiens
ttaaagacaaagca

SEQ ID NO: 6554425 - DNA, 18 bp, Homo sapiens
ttaaagacaggagacaaa

SEQ ID NO: 6554426 - DNA, 17 bp, Homo sapiens
ttaaagacagggtcttg

SEQ ID NO: 6554427 - DNA, 13 bp, Homo sapiens
ttaaagacattta

SEQ ID NO: 6554428 - DNA, 17 bp, Homo sapiens
ttaaagacatttaaaat

SEQ ID NO: 6554429 - DNA, 19 bp, Homo sapiens
ttaaagacatttaaaatag

SEQ ID NO: 6554430 - DNA, 19 bp, Homo sapiens
ttaaagaccaataaacttc

SEQ ID NO: 6554431 - DNA, 17 bp, Homo sapiens
ttaaagacccaacttgc

SEQ ID NO: 6554432 - DNA, 20 bp, Homo sapiens
ttaaagaccctcctattcta

SEQ ID NO: 6554433 - DNA, 16 bp, Homo sapiens
ttaaagactacctggg

SEQ ID NO: 6554434 - DNA, 11 bp, Homo sapiens
ttaaagactta

SEQ ID NO: 6554435 - DNA, 23 bp, Homo sapiens
ttaaagacttgatgaataaacac

SEQ ID NO: 6554436 - DNA, 14 bp, Homo sapiens
ttaaagacttttat

SEQ ID NO: 6554437 - DNA, 21 bp, Homo sapiens
ttaaagagaaaaatggcctgc

SEQ ID NO: 6554438 - DNA, 15 bp, Homo sapiens
ttaaagagacaaata

SEQ ID NO: 6554439 - DNA, 16 bp, Homo sapiens
ttaaagagacaaatag

SEQ ID NO: 6554440 - DNA, 13 bp, Homo sapiens
ttaaagagaggtt

SEQ ID NO: 6554441 - DNA, 14 bp, Homo sapiens
ttaaagagaggtta

SEQ ID NO: 6554442 - DNA, 13 bp, Homo sapiens
ttaaagagataaa

SEQ ID NO: 6554443 - DNA, 17 bp, Homo sapiens
ttaaagagcacaggttc

SEQ ID NO: 6554444 - DNA, 21 bp, Homo sapiens
ttaaagagcaggatagctctt

SEQ ID NO: 6554445 - DNA, 23 bp, Homo sapiens
ttaaagagcatggaaaaatactg

SEQ ID NO: 6554446 - DNA, 21 bp, Homo sapiens
ttaaagaggagaaggaaaaca

SEQ ID NO: 6554447 - DNA, 17 bp, Homo sapiens
ttaaagaggagcctttc

SEQ ID NO: 6554448 - DNA, 21 bp, Homo sapiens
ttaaagaggcgtcttgtattt

SEQ ID NO: 6554449 - DNA, 23 bp, Homo sapiens
tttaaaagtgccattaacaaatg

SEQ ID NO: 6554450 - DNA, 22 bp, Homo sapiens
tttaaaagttgtgcatgtatgt

SEQ ID NO: 6554451 - DNA, 14 bp, Homo sapiens
tttaaaataaaaat

SEQ ID NO: 6554452 - DNA, 19 bp, Homo sapiens
tttaaaataaaatttttta

SEQ ID NO: 6554453 - DNA, 19 bp, Homo sapiens
tttaaaataaactgtaaac

SEQ ID NO: 6554454 - DNA, 15 bp, Homo sapiens
tttaaaataaataaa

SEQ ID NO: 6554455 - DNA, 18 bp, Homo sapiens
tttaaaataagctttctc

SEQ ID NO: 6554456 - DNA, 12 bp, Homo sapiens
tttaaaatataa

SEQ ID NO: 6554457 - DNA, 13 bp, Homo sapiens
tttaaaatatatg

SEQ ID NO: 6554458 - DNA, 14 bp, Homo sapiens
tttaaaatatatgt

SEQ ID NO: 6554459 - DNA, 19 bp, Homo sapiens
tttaaaatatcctgtaact

SEQ ID NO: 6554460 - DNA, 16 bp, Homo sapiens
tttaaaatatttatct

SEQ ID NO: 6554461 - DNA, 20 bp, Homo sapiens
tttaaaatatttgaatgaaa

SEQ ID NO: 6554462 - DNA, 18 bp, Homo sapiens
tttaaaatcactaacatt

SEQ ID NO: 6554463 - DNA, 20 bp, Homo sapiens
tttaaaatcactaacattat

SEQ ID NO: 6554464 - DNA, 22 bp, Homo sapiens
tttaaaatcagctattttgtga

SEQ ID NO: 6554465 - DNA, 16 bp, Homo sapiens
tttaaaatcatttctg

SEQ ID NO: 6554466 - DNA, 12 bp, Homo sapiens
tttaaaatctat

SEQ ID NO: 6554467 - DNA, 12 bp, Homo sapiens
tttaaaatctga

SEQ ID NO: 6554468 - DNA, 21 bp, Homo sapiens
tttaaaatctgagggaaatgt

SEQ ID NO: 6554469 - DNA, 16 bp, Homo sapiens
tttaaaatcttattaa

SEQ ID NO: 6554470 - DNA, 22 bp, Homo sapiens
tttaaaatcttattaaagtttc

SEQ ID NO: 6554471 - DNA, 12 bp, Homo sapiens
tttaaaatgaag

SEQ ID NO: 6554472 - DNA, 16 bp, Homo sapiens
tttaaaatgagaaatc

SEQ ID NO: 6554473 - DNA, 12 bp, Homo sapiens
tttaaaatgatt

SEQ ID NO: 6554474 - DNA, 19 bp, Homo sapiens
tttaaaatgcagattcata

SEQ ID NO: 6554475 - DNA, 23 bp, Homo sapiens
tttaaaatgccaagcaagggaca

SEQ ID NO: 6554476 - DNA, 21 bp, Homo sapiens
tttaaaatgcgaaattattgg

SEQ ID NO: 6554477 - DNA, 14 bp, Homo sapiens
tttaaaatgctgct

SEQ ID NO: 6554478 - DNA, 14 bp, Homo sapiens
tttaaaatggcatt

SEQ ID NO: 6554479 - DNA, 19 bp, Homo sapiens
tttaaaatggcatttagca

SEQ ID NO: 6554480 - DNA, 20 bp, Homo sapiens
tttaaaatgtaaactcttca

SEQ ID NO: 6554481 - DNA, 20 bp, Homo sapiens
tttaaaatgtacatgtatta

SEQ ID NO: 6554482 - DNA, 21 bp, Homo sapiens
tttaaaatgtagaaacttaaa

SEQ ID NO: 6554483 - DNA, 18 bp, Homo sapiens
tttaaaatgtagaagaaa

SEQ ID NO: 6554484 - DNA, 12 bp, Homo sapiens
tttaaaatgtct

SEQ ID NO: 6554485 - DNA, 13 bp, Homo sapiens
tttaaaatgtgtg

SEQ ID NO: 6554486 - DNA, 19 bp, Homo sapiens
tttaaaatgttttctttgt

SEQ ID NO: 6554487 - DNA, 23 bp, Homo sapiens
tttaaaattaaaaaaaagaagag

SEQ ID NO: 6554488 - DNA, 16 bp, Homo sapiens
tttaaaattaatcttg

SEQ ID NO: 6554489 - DNA, 16 bp, Homo sapiens
tttaaaattacaacta

SEQ ID NO: 6554490 - DNA, 23 bp, Homo sapiens
tttaaaattattaaaaattatag

SEQ ID NO: 6554491 - DNA, 12 bp, Homo sapiens
tttaaaattcat

SEQ ID NO: 6554492 - DNA, 19 bp, Homo sapiens
tttaaaattctcttccaac

SEQ ID NO: 6554493 - DNA, 15 bp, Homo sapiens
tttaaaattggcacc

SEQ ID NO: 6554494 - DNA, 23 bp, Homo sapiens
tttaaaattgtcacctctgttaa

SEQ ID NO: 6554495 - DNA, 16 bp, Homo sapiens
tttaaaattgtgatgt

SEQ ID NO: 6554496 - DNA, 15 bp, Homo sapiens
tttaaaatttagagt

SEQ ID NO: 6554497 - DNA, 20 bp, Homo sapiens
tttaaaatttatattgtaaa

SEQ ID NO: 6554498 - DNA, 12 bp, Homo sapiens
tttaaaatttgt

SEQ ID NO: 6554499 - DNA, 16 bp, Homo sapiens
tttaaaattttggaat

SEQ ID NO: 6554500 - DNA, 17 bp, Homo sapiens
tttaaaattttgtatgt

SEQ ID NO: 6554501 - DNA, 18 bp, Homo sapiens
tttaaaatttttttagaa

SEQ ID NO: 6554502 - DNA, 19 bp, Homo sapiens
tttaaaatttttttagaaa

SEQ ID NO: 6554503 - DNA, 16 bp, Homo sapiens
tttaaacaaaatttca

SEQ ID NO: 6554504 - DNA, 17 bp, Homo sapiens
tttaaacaaacattgtg

SEQ ID NO: 6554505 - DNA, 23 bp, Homo sapiens
tttaaacaaacattgtgttgaca

SEQ ID NO: 6554506 - DNA, 16 bp, Homo sapiens
tttaaacaaatgtgta

SEQ ID NO: 6554507 - DNA, 23 bp, Homo sapiens
tttaaacaatctttcatgtcttg

SEQ ID NO: 6554508 - DNA, 22 bp, Homo sapiens
tttaaacactcttcagagaaat

SEQ ID NO: 6554509 - DNA, 20 bp, Homo sapiens
tttaaacagatattccctct

SEQ ID NO: 6554510 - DNA, 16 bp, Homo sapiens
tttaaacatagaaagt

SEQ ID NO: 6554511 - DNA, 13 bp, Homo sapiens
tttaaacatatcc

SEQ ID NO: 6554512 - DNA, 20 bp, Homo sapiens
tttaaacatggttacaatca

SEQ ID NO: 6554513 - DNA, 23 bp, Homo sapiens
tttaaacattaaaaatggaactg

SEQ ID NO: 6554514 - DNA, 15 bp, Homo sapiens
tttaaacattatttt

SEQ ID NO: 6554515 - DNA, 20 bp, Homo sapiens
tttaaacatttgttcctgga

SEQ ID NO: 6554516 - DNA, 12 bp, Homo sapiens
tttaaacatttt

SEQ ID NO: 6554517 - DNA, 14 bp, Homo sapiens
tttaaaccactaat

SEQ ID NO: 6554518 - DNA, 13 bp, Homo sapiens
tttaaaccagcag

SEQ ID NO: 6554519 - DNA, 16 bp, Homo sapiens
tttaaaccagcagaaa

SEQ ID NO: 6554520 - DNA, 18 bp, Homo sapiens
tttaaaccagcagaaaag

SEQ ID NO: 6554521 - DNA, 19 bp, Homo sapiens
tttaaaccagcagaaaagt

SEQ ID NO: 6554522 - DNA, 21 bp, Homo sapiens
tttaaacccattttagtcact

SEQ ID NO: 6554523 - DNA, 17 bp, Homo sapiens
tttaaaccgctaaaaga

SEQ ID NO: 6554524 - DNA, 21 bp, Homo sapiens
tttaaaccgctaaaagaaact

SEQ ID NO: 6554525 - DNA, 16 bp, Homo sapiens
tttaaacctttttctt

SEQ ID NO: 6554526 - DNA, 18 bp, Homo sapiens
tttaaacgaagagacaga

SEQ ID NO: 6554527 - DNA, 19 bp, Homo sapiens
tttaaactaaccttttatc

SEQ ID NO: 6554528 - DNA, 16 bp, Homo sapiens
tttaaactacaggtag

SEQ ID NO: 6554529 - DNA, 19 bp, Homo sapiens
tttaaactacatcttgaaa

SEQ ID NO: 6554530 - DNA, 15 bp, Homo sapiens
tttaaactacattag

SEQ ID NO: 6554531 - DNA, 20 bp, Homo sapiens
tttaaactactatttttctt

SEQ ID NO: 6554532 - DNA, 13 bp, Homo sapiens
tttaaactactga

SEQ ID NO: 6554533 - DNA, 12 bp, Homo sapiens
tttaaactagat

SEQ ID NO: 6554534 - DNA, 15 bp, Homo sapiens
tttaaactataagca

SEQ ID NO: 6554535 - DNA, 13 bp, Homo sapiens
tttaaactctttt

SEQ ID NO: 6554536 - DNA, 16 bp, Homo sapiens
tttaaactctttttgg

SEQ ID NO: 6554537 - DNA, 16 bp, Homo sapiens
tttaaactgatgtata

SEQ ID NO: 6554538 - DNA, 21 bp, Homo sapiens
tttaaactgatgtatagcttt

SEQ ID NO: 6554539 - DNA, 15 bp, Homo sapiens
tttaaactgtacagt

SEQ ID NO: 6554540 - DNA, 16 bp, Homo sapiens
tttaaactgtacagtg

SEQ ID NO: 6554541 - DNA, 18 bp, Homo sapiens
tttaaacttcagttttac

SEQ ID NO: 6554542 - DNA, 18 bp, Homo sapiens
tttaaacttcttaactgg

SEQ ID NO: 6554543 - DNA, 16 bp, Homo sapiens
tttaaactttcaatat

SEQ ID NO: 6554544 - DNA, 14 bp, Homo sapiens
tttaaactttttaa

SEQ ID NO: 6554545 - DNA, 17 bp, Homo sapiens
tttaaactttttaaaat

SEQ ID NO: 6554546 - DNA, 17 bp, Homo sapiens
tttaaagaaaaaaatgt

SEQ ID NO: 6554547 - DNA, 18 bp, Homo sapiens
tttaaagaaaaaaatgtc

SEQ ID NO: 6554548 - DNA, 13 bp, Homo sapiens
tttaaagaaaagt

SEQ ID NO: 6554549 - DNA, 18 bp, Homo sapiens
tttaaagaaacactaaat

SEQ ID NO: 6554550 - DNA, 17 bp, Homo sapiens
tttaaagaaactgattt

SEQ ID NO: 6554551 - DNA, 11 bp, Homo sapiens
tttaaagaaat

SEQ ID NO: 6554552 - DNA, 13 bp, Homo sapiens
tttaaagaaattt

SEQ ID NO: 6554553 - DNA, 17 bp, Homo sapiens
tttaaagaagaaaaaaa

SEQ ID NO: 6554554 - DNA, 18 bp, Homo sapiens
tttaaagaagaaacgtct

SEQ ID NO: 6554555 - DNA, 19 bp, Homo sapiens
tttaaagaagtaaatttgt

SEQ ID NO: 6554556 - DNA, 20 bp, Homo sapiens
tttaaagaagtaaatttgtc

SEQ ID NO: 6554557 - DNA, 13 bp, Homo sapiens
tttaaagaataaa

SEQ ID NO: 6554558 - DNA, 14 bp, Homo sapiens
tttaaagaataaag

SEQ ID NO: 6554559 - DNA, 18 bp, Homo sapiens
tttaaagaatatgacttt

SEQ ID NO: 6554560 - DNA, 23 bp, Homo sapiens
tttaaagaatcattatttattaa

SEQ ID NO: 6554561 - DNA, 15 bp, Homo sapiens
tttaaagaatccaag

SEQ ID NO: 6554562 - DNA, 20 bp, Homo sapiens
tttaaagaatccaagacaaa

SEQ ID NO: 6554563 - DNA, 22 bp, Homo sapiens
tttaaagacaaagacattattt

SEQ ID NO: 6554564 - DNA, 11 bp, Homo sapiens
tttaaagacag

SEQ ID NO: 6554565 - DNA, 15 bp, Homo sapiens
tttaaagacctgaca

SEQ ID NO: 6554566 - DNA, 12 bp, Homo sapiens
tttaaagactta

SEQ ID NO: 6554567 - DNA, 17 bp, Homo sapiens
tttaaagagaatgtaga

SEQ ID NO: 6554568 - DNA, 15 bp, Homo sapiens
tttaaagagaggtta

SEQ ID NO: 6554569 - DNA, 13 bp, Homo sapiens
tttaaagagtcta

SEQ ID NO: 6554570 - DNA, 16 bp, Homo sapiens
tttaaagagtctagat

SEQ ID NO: 6554571 - DNA, 15 bp, Homo sapiens
tttaaagatttgttt

SEQ ID NO: 6554572 - DNA, 20 bp, Homo sapiens
tttaaagcaactgtctattt

SEQ ID NO: 6554573 - DNA, 23 bp, Homo sapiens
tttaaagcaactgtctatttctg

SEQ ID NO: 6554574 - DNA, 18 bp, Homo sapiens
tttaaagcaatcttggca

SEQ ID NO: 6554575 - DNA, 16 bp, Homo sapiens
tttaaagcaggttctt

SEQ ID NO: 6554576 - DNA, 19 bp, Homo sapiens
tttaaagcaggttcttgtt

SEQ ID NO: 6554577 - DNA, 18 bp, Homo sapiens
tttaaagccattctgatt

SEQ ID NO: 6554578 - DNA, 15 bp, Homo sapiens
tttaaagccttctgg

SEQ ID NO: 6554579 - DNA, 17 bp, Homo sapiens
tttaaagcgtttgcaca

SEQ ID NO: 6554580 - DNA, 12 bp, Homo sapiens
tttaaaggaaaa

SEQ ID NO: 6554581 - DNA, 17 bp, Homo sapiens
tttaaaggaaaaaatgt

SEQ ID NO: 6554582 - DNA, 16 bp, Homo sapiens
tttaaaggaaacacta

SEQ ID NO: 6554583 - DNA, 19 bp, Homo sapiens
tttaaaggacaaacagtga

SEQ ID NO: 6554584 - DNA, 18 bp, Homo sapiens
tttaaaggcattagagtc

SEQ ID NO: 6554585 - DNA, 23 bp, Homo sapiens
tttaaaggtggattttgtttaaa

SEQ ID NO: 6554586 - DNA, 22 bp, Homo sapiens
tttaaaggtttttaaattgttt

SEQ ID NO: 6554587 - DNA, 13 bp, Homo sapiens
tttaaagtaaact

SEQ ID NO: 6554588 - DNA, 15 bp, Homo sapiens
tttaaagtactgagc

SEQ ID NO: 6554589 - DNA, 12 bp, Homo sapiens
tttaaagtactt

SEQ ID NO: 6554590 - DNA, 16 bp, Homo sapiens
tttaaagtagattaga

SEQ ID NO: 6554591 - DNA, 23 bp, Homo sapiens
tttaaagtatgaatctatgccaa

SEQ ID NO: 6554592 - DNA, 21 bp, Homo sapiens
tttaaagtatgcattattaaa

SEQ ID NO: 6554593 - DNA, 17 bp, Homo sapiens
tttaaagtattctccat

SEQ ID NO: 6554594 - DNA, 20 bp, Homo sapiens
tttaaagtatttataaaaat

SEQ ID NO: 6554595 - DNA, 15 bp, Homo sapiens
tttaaagtattttct

SEQ ID NO: 6554596 - DNA, 18 bp, Homo sapiens
tttaaagtctcagtttct

SEQ ID NO: 6554597 - DNA, 22 bp, Homo sapiens
tttaaagtcttctttcatgtaa

SEQ ID NO: 6554598 - DNA, 15 bp, Homo sapiens
tttaaagtcttgctg

SEQ ID NO: 6554599 - DNA, 18 bp, Homo sapiens
tttaaagtgattaaacgt

SEQ ID NO: 6554600 - DNA, 14 bp, Homo sapiens
tttaaagtgcaaaa

SEQ ID NO: 6554601 - DNA, 20 bp, Homo sapiens
tttaaagtgccttatcaaat

SEQ ID NO: 6554602 - DNA, 18 bp, Homo sapiens
tttaaagtgtaataatat

SEQ ID NO: 6554603 - DNA, 20 bp, Homo sapiens
tttaaagtgtacattttata

SEQ ID NO: 6554604 - DNA, 19 bp, Homo sapiens
tttaaagtgtttctgttat

SEQ ID NO: 6554605 - DNA, 22 bp, Homo sapiens
tttaaagttagtatcttttgat

SEQ ID NO: 6554606 - DNA, 14 bp, Homo sapiens
tttaaagttatctt

SEQ ID NO: 6554607 - DNA, 15 bp, Homo sapiens
tttaaagttcaaact

SEQ ID NO: 6554608 - DNA, 15 bp, Homo sapiens
tttaaagttccctat

SEQ ID NO: 6554609 - DNA, 13 bp, Homo sapiens
tttaaagttctgt

SEQ ID NO: 6554610 - DNA, 21 bp, Homo sapiens
tttaaagttcttattttagta

SEQ ID NO: 6554611 - DNA, 20 bp, Homo sapiens
tttaaagttgcacatgattg

SEQ ID NO: 6554612 - DNA, 21 bp, Homo sapiens
tttaaagtttgttcacttaaa

SEQ ID NO: 6554613 - DNA, 23 bp, Homo sapiens
tttaaataaaaattactgtgtta

SEQ ID NO: 6554614 - DNA, 15 bp, Homo sapiens
tttaaataaaagcac

SEQ ID NO: 6554615 - DNA, 19 bp, Homo sapiens
tttaaataaaagcacaagt

SEQ ID NO: 6554616 - DNA, 19 bp, Homo sapiens
tttaaataaaagtgatcaa

SEQ ID NO: 6554617 - DNA, 14 bp, Homo sapiens
tttaaataaaatca

SEQ ID NO: 6554618 - DNA, 14 bp, Homo sapiens
tttaaataaaccta

SEQ ID NO: 6554619 - DNA, 23 bp, Homo sapiens
tttaaataaactttttttcaatg

SEQ ID NO: 6554620 - DNA, 16 bp, Homo sapiens
tttaaataaagaacaa

SEQ ID NO: 6554621 - DNA, 13 bp, Homo sapiens
tttaaataaagtt

SEQ ID NO: 6554622 - DNA, 16 bp, Homo sapiens
tttaaataaagtttgg

SEQ ID NO: 6554623 - DNA, 22 bp, Homo sapiens
tttaaataaatagatgttctgt

SEQ ID NO: 6554624 - DNA, 17 bp, Homo sapiens
tttaaataacctctggc

SEQ ID NO: 6554625 - DNA, 20 bp, Homo sapiens
tttaaataacctctggccct

SEQ ID NO: 6554626 - DNA, 17 bp, Homo sapiens
tttaaataatagacata

SEQ ID NO: 6554627 - DNA, 16 bp, Homo sapiens
tttaaataatttaact

SEQ ID NO: 6554628 - DNA, 23 bp, Homo sapiens
ttaaagaggcgtcttgtattttc

SEQ ID NO: 6554629 - DNA, 20 bp, Homo sapiens
ttaaagaggctgtgtggcca

SEQ ID NO: 6554630 - DNA, 17 bp, Homo sapiens
ttaaagagtcctccttc

SEQ ID NO: 6554631 - DNA, 12 bp, Homo sapiens
ttaaagagtcta

SEQ ID NO: 6554632 - DNA, 15 bp, Homo sapiens
ttaaagagtctagat

SEQ ID NO: 6554633 - DNA, 23 bp, Homo sapiens
ttaaagagtctagattcaaaggt

SEQ ID NO: 6554634 - DNA, 12 bp, Homo sapiens
ttaaagatacca

SEQ ID NO: 6554635 - DNA, 21 bp, Homo sapiens
ttaaagatgattgttcttttg

SEQ ID NO: 6554636 - DNA, 15 bp, Homo sapiens
ttaaagatgccatag

SEQ ID NO: 6554637 - DNA, 18 bp, Homo sapiens
ttaaagatgccatagcat

SEQ ID NO: 6554638 - DNA, 20 bp, Homo sapiens
ttaaagatgccatagcataa

SEQ ID NO: 6554639 - DNA, 17 bp, Homo sapiens
ttaaagatgctatggaa

SEQ ID NO: 6554640 - DNA, 21 bp, Homo sapiens
ttaaagatgctgtcggcacca

SEQ ID NO: 6554641 - DNA, 24 bp, Homo sapiens
ttaaagatttcttttcattattct

SEQ ID NO: 6554642 - DNA, 11 bp, Homo sapiens
ttaaagcaaaa

SEQ ID NO: 6554643 - DNA, 16 bp, Homo sapiens
ttaaagcaaaatagta

SEQ ID NO: 6554644 - DNA, 15 bp, Homo sapiens
ttaaagcaaaccagc

SEQ ID NO: 6554645 - DNA, 14 bp, Homo sapiens
ttaaagcaaaggag

SEQ ID NO: 6554646 - DNA, 18 bp, Homo sapiens
ttaaagcaacattttatt

SEQ ID NO: 6554647 - DNA, 19 bp, Homo sapiens
ttaaagcaacattttattt

SEQ ID NO: 6554648 - DNA, 23 bp, Homo sapiens
ttaaagcaactgtctatttctgc

SEQ ID NO: 6554649 - DNA, 22 bp, Homo sapiens
ttaaagcaagcaacacagagga

SEQ ID NO: 6554650 - DNA, 22 bp, Homo sapiens
ttaaagcaataagttcattaaa

SEQ ID NO: 6554651 - DNA, 17 bp, Homo sapiens
ttaaagcacacttttcc

SEQ ID NO: 6554652 - DNA, 21 bp, Homo sapiens
ttaaagcacatgccagggaaa

SEQ ID NO: 6554653 - DNA, 12 bp, Homo sapiens
ttaaagcagcaa

SEQ ID NO: 6554654 - DNA, 20 bp, Homo sapiens
ttaaagcaggttcttgttgg

SEQ ID NO: 6554655 - DNA, 15 bp, Homo sapiens
ttaaagcatctgtaa

SEQ ID NO: 6554656 - DNA, 21 bp, Homo sapiens
ttaaagcattgctgttatgtc

SEQ ID NO: 6554657 - DNA, 19 bp, Homo sapiens
ttaaagccaaatgtaaata

SEQ ID NO: 6554658 - DNA, 17 bp, Homo sapiens
ttaaagcccccttctcc

SEQ ID NO: 6554659 - DNA, 13 bp, Homo sapiens
ttaaagcctcctc

SEQ ID NO: 6554660 - DNA, 15 bp, Homo sapiens
ttaaagcctggcttc

SEQ ID NO: 6554661 - DNA, 22 bp, Homo sapiens
ttaaagcctgttccataggaag

SEQ ID NO: 6554662 - DNA, 14 bp, Homo sapiens
ttaaagccttaagc

SEQ ID NO: 6554663 - DNA, 22 bp, Homo sapiens
ttaaagcctttagtatcagtgt

SEQ ID NO: 6554664 - DNA, 21 bp, Homo sapiens
ttaaagcgtagacatatattt

SEQ ID NO: 6554665 - DNA, 15 bp, Homo sapiens
ttaaagctaaactga

SEQ ID NO: 6554666 - DNA, 19 bp, Homo sapiens
ttaaagctaaagtatctgt

SEQ ID NO: 6554667 - DNA, 22 bp, Homo sapiens
ttaaagctcatgcatttcaagc

SEQ ID NO: 6554668 - DNA, 20 bp, Homo sapiens
ttaaagctcttcatttctgg

SEQ ID NO: 6554669 - DNA, 14 bp, Homo sapiens
ttaaagctgagaga

SEQ ID NO: 6554670 - DNA, 22 bp, Homo sapiens
ttaaagctgagagaccctggcc

SEQ ID NO: 6554671 - DNA, 11 bp, Homo sapiens
ttaaagctgta

SEQ ID NO: 6554672 - DNA, 13 bp, Homo sapiens
ttaaagctgtaca

SEQ ID NO: 6554673 - DNA, 14 bp, Homo sapiens
ttaaagctgtttct

SEQ ID NO: 6554674 - DNA, 21 bp, Homo sapiens
ttaaagctgtttctaaacagt

SEQ ID NO: 6554675 - DNA, 16 bp, Homo sapiens
ttaaagcttaaactga

SEQ ID NO: 6554676 - DNA, 17 bp, Homo sapiens
ttaaagcttaaactgaa

SEQ ID NO: 6554677 - DNA, 16 bp, Homo sapiens
ttaaagcttatttccc

SEQ ID NO: 6554678 - DNA, 20 bp, Homo sapiens
ttaaagcttatttttatgtg

SEQ ID NO: 6554679 - DNA, 23 bp, Homo sapiens
ttaaagcttccctctcagctgct

SEQ ID NO: 6554680 - DNA, 20 bp, Homo sapiens
ttaaagcttgatttgatctt

SEQ ID NO: 6554681 - DNA, 12 bp, Homo sapiens
ttaaagcttggt

SEQ ID NO: 6554682 - DNA, 15 bp, Homo sapiens
ttaaagcttttgatg

SEQ ID NO: 6554683 - DNA, 17 bp, Homo sapiens
ttaaagcttttgatgtg

SEQ ID NO: 6554684 - DNA, 14 bp, Homo sapiens
ttaaaggaaaagca

SEQ ID NO: 6554685 - DNA, 23 bp, Homo sapiens
ttaaaggaaaagtcaacatcttc

SEQ ID NO: 6554686 - DNA, 17 bp, Homo sapiens
ttaaaggaaagttctat

SEQ ID NO: 6554687 - DNA, 22 bp, Homo sapiens
ttaaaggaaggttctggtgtga

SEQ ID NO: 6554688 - DNA, 19 bp, Homo sapiens
ttaaaggaccctatatgtg

SEQ ID NO: 6554689 - DNA, 17 bp, Homo sapiens
ttaaaggatgttggtgt

SEQ ID NO: 6554690 - DNA, 18 bp, Homo sapiens
ttaaaggcaccatctaat

SEQ ID NO: 6554691 - DNA, 15 bp, Homo sapiens
ttaaaggcagtccag

SEQ ID NO: 6554692 - DNA, 22 bp, Homo sapiens
ttaaaggccagaggctatggaa

SEQ ID NO: 6554693 - DNA, 16 bp, Homo sapiens
ttaaaggcccagcccc

SEQ ID NO: 6554694 - DNA, 20 bp, Homo sapiens
ttaaaggcccagcccctaga

SEQ ID NO: 6554695 - DNA, 17 bp, Homo sapiens
ttaaaggctaccttatt

SEQ ID NO: 6554696 - DNA, 16 bp, Homo sapiens
ttaaaggcttctctct

SEQ ID NO: 6554697 - DNA, 22 bp, Homo sapiens
ttaaagggaagaaaacactgtt

SEQ ID NO: 6554698 - DNA, 16 bp, Homo sapiens
ttaaagggacagtttg

SEQ ID NO: 6554699 - DNA, 12 bp, Homo sapiens
ttaaagggcaga

SEQ ID NO: 6554700 - DNA, 16 bp, Homo sapiens
ttaaagggcagatatt

SEQ ID NO: 6554701 - DNA, 17 bp, Homo sapiens
ttaaagggcccaatgaa

SEQ ID NO: 6554702 - DNA, 22 bp, Homo sapiens
ttaaagggtagcctacaaatgt

SEQ ID NO: 6554703 - DNA, 20 bp, Homo sapiens
ttaaagggtgcccatttgtg

SEQ ID NO: 6554704 - DNA, 19 bp, Homo sapiens
ttaaagggtgtacttatat

SEQ ID NO: 6554705 - DNA, 15 bp, Homo sapiens
ttaaagggtttgaga

SEQ ID NO: 6554706 - DNA, 21 bp, Homo sapiens
ttaaaggtacaatcaaaggat

SEQ ID NO: 6554707 - DNA, 18 bp, Homo sapiens
ttaaaggtagagatgtgt

SEQ ID NO: 6554708 - DNA, 17 bp, Homo sapiens
ttaaaggtcctgccctc

SEQ ID NO: 6554709 - DNA, 21 bp, Homo sapiens
ttaaaggtctcccacaagact

SEQ ID NO: 6554710 - DNA, 15 bp, Homo sapiens
ttaaaggtggaaaat

SEQ ID NO: 6554711 - DNA, 16 bp, Homo sapiens
ttaaaggtttttgaaa

SEQ ID NO: 6554712 - DNA, 20 bp, Homo sapiens
ttaaagtaaacttgtgtatt

SEQ ID NO: 6554713 - DNA, 12 bp, Homo sapiens
ttaaagtaaatt

SEQ ID NO: 6554714 - DNA, 15 bp, Homo sapiens
ttaaagtaaattatt

SEQ ID NO: 6554715 - DNA, 16 bp, Homo sapiens
ttaaagtaacatttaa

SEQ ID NO: 6554716 - DNA, 14 bp, Homo sapiens
ttaaagtactttct

SEQ ID NO: 6554717 - DNA, 12 bp, Homo sapiens
ttaaagtagttc

SEQ ID NO: 6554718 - DNA, 16 bp, Homo sapiens
ttaaagtataaagtaa

SEQ ID NO: 6554719 - DNA, 13 bp, Homo sapiens
ttaaagtatatat

SEQ ID NO: 6554720 - DNA, 16 bp, Homo sapiens
ttaaagtatctacctg

SEQ ID NO: 6554721 - DNA, 23 bp, Homo sapiens
ttaaagtatgcattattaaattg

SEQ ID NO: 6554722 - DNA, 12 bp, Homo sapiens
ttaaagtatttt

SEQ ID NO: 6554723 - DNA, 20 bp, Homo sapiens
ttaaagtcacacatttctat

SEQ ID NO: 6554724 - DNA, 21 bp, Homo sapiens
ttaaagtctacactgcctttg

SEQ ID NO: 6554725 - DNA, 14 bp, Homo sapiens
ttaaagtctgagaa

SEQ ID NO: 6554726 - DNA, 17 bp, Homo sapiens
ttaaagtgagtactgtt

SEQ ID NO: 6554727 - DNA, 14 bp, Homo sapiens
ttaaagtgcagtca

SEQ ID NO: 6554728 - DNA, 16 bp, Homo sapiens
ttaaagtgcagtcatt

SEQ ID NO: 6554729 - DNA, 17 bp, Homo sapiens
ttaaagtgcagtcattt

SEQ ID NO: 6554730 - DNA, 18 bp, Homo sapiens
ttaaagtgcagtcatttg

SEQ ID NO: 6554731 - DNA, 13 bp, Homo sapiens
ttaaagtgccagt

SEQ ID NO: 6554732 - DNA, 14 bp, Homo sapiens
ttaaagtgccttca

SEQ ID NO: 6554733 - DNA, 17 bp, Homo sapiens
ttaaagtggtctgaact

SEQ ID NO: 6554734 - DNA, 18 bp, Homo sapiens
ttaaagtgtattataaca

SEQ ID NO: 6554735 - DNA, 19 bp, Homo sapiens
ttaaagtgtattataacag

SEQ ID NO: 6554736 - DNA, 22 bp, Homo sapiens
ttaaagtgtccattgacatgta

SEQ ID NO: 6554737 - DNA, 17 bp, Homo sapiens
ttaaagtgtttcagcta

SEQ ID NO: 6554738 - DNA, 22 bp, Homo sapiens
ttaaagtgtttcagctaaggga

SEQ ID NO: 6554739 - DNA, 14 bp, Homo sapiens
ttaaagttcattgc

SEQ ID NO: 6554740 - DNA, 19 bp, Homo sapiens
ttaaagttctaggcatact

SEQ ID NO: 6554741 - DNA, 18 bp, Homo sapiens
ttaaagttcttattttag

SEQ ID NO: 6554742 - DNA, 18 bp, Homo sapiens
ttaaagttgattttgaac

SEQ ID NO: 6554743 - DNA, 21 bp, Homo sapiens
ttaaagttggtattaataaaa

SEQ ID NO: 6554744 - DNA, 14 bp, Homo sapiens
ttaaagttgtaaca

SEQ ID NO: 6554745 - DNA, 20 bp, Homo sapiens
ttaaagttgtataaaaacat

SEQ ID NO: 6554746 - DNA, 16 bp, Homo sapiens
ttaaagttgtttccca

SEQ ID NO: 6554747 - DNA, 14 bp, Homo sapiens
ttaaagtttaaagt

SEQ ID NO: 6554748 - DNA, 13 bp, Homo sapiens
ttaaagtttaatg

SEQ ID NO: 6554749 - DNA, 12 bp, Homo sapiens
ttaaagtttcaa

SEQ ID NO: 6554750 - DNA, 14 bp, Homo sapiens
ttaaagtttcaaaa

SEQ ID NO: 6554751 - DNA, 18 bp, Homo sapiens
ttaaagtttcaaaaatct

SEQ ID NO: 6554752 - DNA, 20 bp, Homo sapiens
ttaaagtttcaaaaatctga

SEQ ID NO: 6554753 - DNA, 21 bp, Homo sapiens
ttaaagtttcaaaaatctgaa

SEQ ID NO: 6554754 - DNA, 16 bp, Homo sapiens
ttaaagtttcattagt

SEQ ID NO: 6554755 - DNA, 15 bp, Homo sapiens
ttaaagttttcaaat

SEQ ID NO: 6554756 - DNA, 20 bp, Homo sapiens
ttaaataaaaataatagact

SEQ ID NO: 6554757 - DNA, 12 bp, Homo sapiens
ttaaataaaact

SEQ ID NO: 6554758 - DNA, 12 bp, Homo sapiens
ttaaataaaaga

SEQ ID NO: 6554759 - DNA, 20 bp, Homo sapiens
ttaaataaaagaaatgcaca

SEQ ID NO: 6554760 - DNA, 18 bp, Homo sapiens
ttaaataaaagaggtcca

SEQ ID NO: 6554761 - DNA, 13 bp, Homo sapiens
ttaaataaaagtg

SEQ ID NO: 6554762 - DNA, 14 bp, Homo sapiens
ttaaataaaagtga

SEQ ID NO: 6554763 - DNA, 20 bp, Homo sapiens
ttaaataaaagtgatcaata

SEQ ID NO: 6554764 - DNA, 16 bp, Homo sapiens
ttaaataaacacagtc

SEQ ID NO: 6554765 - DNA, 12 bp, Homo sapiens
ttaaataaactg

SEQ ID NO: 6554766 - DNA, 14 bp, Homo sapiens
ttaaataaactgtt

SEQ ID NO: 6554767 - DNA, 15 bp, Homo sapiens
ttaaataaactgttt

SEQ ID NO: 6554768 - DNA, 15 bp, Homo sapiens
ttaaataaacttttt

SEQ ID NO: 6554769 - DNA, 21 bp, Homo sapiens
ttaaataaactttttttcaat

SEQ ID NO: 6554770 - DNA, 23 bp, Homo sapiens
ttaaataaactttttttcaatgt

SEQ ID NO: 6554771 - DNA, 22 bp, Homo sapiens
ttaaataaatcaagaatcattg

SEQ ID NO: 6554772 - DNA, 21 bp, Homo sapiens
ttaaataaatgtcattaaaat

SEQ ID NO: 6554773 - DNA, 13 bp, Homo sapiens
ttaaataaattaa

SEQ ID NO: 6554774 - DNA, 20 bp, Homo sapiens
ttaaataaattgtgaaaaaa

SEQ ID NO: 6554775 - DNA, 22 bp, Homo sapiens
ttaaataaatttgacttttctg

SEQ ID NO: 6554776 - DNA, 21 bp, Homo sapiens
ttaaataacctctggcccttg

SEQ ID NO: 6554777 - DNA, 17 bp, Homo sapiens
ttaaataagaaactttt

SEQ ID NO: 6554778 - DNA, 11 bp, Homo sapiens
ttaaataagat

SEQ ID NO: 6554779 - DNA, 22 bp, Homo sapiens
ttaaataaggttggagatgtca

SEQ ID NO: 6554780 - DNA, 24 bp, Homo sapiens
ttaaataatatggctatgcttaaa

SEQ ID NO: 6554781 - DNA, 14 bp, Homo sapiens
ttaaataatcctct

SEQ ID NO: 6554782 - DNA, 20 bp, Homo sapiens
ttaaataatgcttcagatat

SEQ ID NO: 6554783 - DNA, 15 bp, Homo sapiens
ttaaataatgtgaaa

SEQ ID NO: 6554784 - DNA, 15 bp, Homo sapiens
ttaaataatgttcat

SEQ ID NO: 6554785 - DNA, 21 bp, Homo sapiens
ttaaataatttaactaccctt

SEQ ID NO: 6554786 - DNA, 16 bp, Homo sapiens
ttaaatacagacacta

SEQ ID NO: 6554787 - DNA, 20 bp, Homo sapiens
ttaaatacagacactaagtt

SEQ ID NO: 6554788 - DNA, 21 bp, Homo sapiens
ttaaatacagataattcattt

SEQ ID NO: 6554789 - DNA, 20 bp, Homo sapiens
ttaaatacaggaaacagttg

SEQ ID NO: 6554790 - DNA, 21 bp, Homo sapiens
ttaaatactgtgcagaataat

SEQ ID NO: 6554791 - DNA, 22 bp, Homo sapiens
ttaaatactgtgcagaataatg

SEQ ID NO: 6554792 - DNA, 20 bp, Homo sapiens
ttaaatagataaccaatttt

SEQ ID NO: 6554793 - DNA, 15 bp, Homo sapiens
ttaaatagcatctgc

SEQ ID NO: 6554794 - DNA, 17 bp, Homo sapiens
ttaaatagcctaaatga

SEQ ID NO: 6554795 - DNA, 14 bp, Homo sapiens
ttaaatagggaata

SEQ ID NO: 6554796 - DNA, 18 bp, Homo sapiens
ttaaatagttatataatt

SEQ ID NO: 6554797 - DNA, 19 bp, Homo sapiens
ttaaatagtttacttcact

SEQ ID NO: 6554798 - DNA, 21 bp, Homo sapiens
ttaaatagtttacttcacttt

SEQ ID NO: 6554799 - DNA, 23 bp, Homo sapiens
ttaaatataaaatacataaaaga

SEQ ID NO: 6554800 - DNA, 12 bp, Homo sapiens
ttaaatataaat

SEQ ID NO: 6554801 - DNA, 16 bp, Homo sapiens
ttaaatataaatagct

SEQ ID NO: 6554802 - DNA, 19 bp, Homo sapiens
ttaaatataaatgtttgtc

SEQ ID NO: 6554803 - DNA, 15 bp, Homo sapiens
ttaaatataatatgc

SEQ ID NO: 6554804 - DNA, 20 bp, Homo sapiens
ttaaatatacttagatcctg

SEQ ID NO: 6554805 - DNA, 14 bp, Homo sapiens
ttaaatatagatta

SEQ ID NO: 6554806 - DNA, 20 bp, Homo sapiens
tttaaatacagtcttccatt

SEQ ID NO: 6554807 - DNA, 14 bp, Homo sapiens
tttaaataccagta

SEQ ID NO: 6554808 - DNA, 20 bp, Homo sapiens
tttaaatactccctttttga

SEQ ID NO: 6554809 - DNA, 21 bp, Homo sapiens
tttaaatagcattatcttatc

SEQ ID NO: 6554810 - DNA, 13 bp, Homo sapiens
tttaaatagccta

SEQ ID NO: 6554811 - DNA, 20 bp, Homo sapiens
tttaaatagtttacttcact

SEQ ID NO: 6554812 - DNA, 15 bp, Homo sapiens
tttaaatataattct

SEQ ID NO: 6554813 - DNA, 21 bp, Homo sapiens
tttaaatataattctgtaaat

SEQ ID NO: 6554814 - DNA, 21 bp, Homo sapiens
tttaaatatatattattctca

SEQ ID NO: 6554815 - DNA, 16 bp, Homo sapiens
tttaaatatatatttt

SEQ ID NO: 6554816 - DNA, 21 bp, Homo sapiens
tttaaatatatgctaagtctt

SEQ ID NO: 6554817 - DNA, 16 bp, Homo sapiens
tttaaatatcattctt

SEQ ID NO: 6554818 - DNA, 23 bp, Homo sapiens
tttaaatatctgaacatttacta

SEQ ID NO: 6554819 - DNA, 14 bp, Homo sapiens
tttaaatatgaaca

SEQ ID NO: 6554820 - DNA, 16 bp, Homo sapiens
tttaaatatgaacaaa

SEQ ID NO: 6554821 - DNA, 15 bp, Homo sapiens
tttaaatattaagca

SEQ ID NO: 6554822 - DNA, 18 bp, Homo sapiens
tttaaatcaaaaactttt

SEQ ID NO: 6554823 - DNA, 21 bp, Homo sapiens
tttaaatcaaaaacttttcat

SEQ ID NO: 6554824 - DNA, 14 bp, Homo sapiens
tttaaatcaaaagc

SEQ ID NO: 6554825 - DNA, 17 bp, Homo sapiens
tttaaatcaaaagctgc

SEQ ID NO: 6554826 - DNA, 13 bp, Homo sapiens
tttaaatcaagga

SEQ ID NO: 6554827 - DNA, 22 bp, Homo sapiens
tttaaatcaagtcccaaattca

SEQ ID NO: 6554828 - DNA, 16 bp, Homo sapiens
tttaaatcagatacct

SEQ ID NO: 6554829 - DNA, 19 bp, Homo sapiens
tttaaatcagatttgtaat

SEQ ID NO: 6554830 - DNA, 11 bp, Homo sapiens
tttaaatcatc

SEQ ID NO: 6554831 - DNA, 16 bp, Homo sapiens
tttaaatcatgtatgt

SEQ ID NO: 6554832 - DNA, 13 bp, Homo sapiens
tttaaatcatttc

SEQ ID NO: 6554833 - DNA, 19 bp, Homo sapiens
tttaaatcctgaagagcat

SEQ ID NO: 6554834 - DNA, 17 bp, Homo sapiens
tttaaatcctgttgaaa

SEQ ID NO: 6554835 - DNA, 20 bp, Homo sapiens
tttaaatcctgttgaaaagc

SEQ ID NO: 6554836 - DNA, 14 bp, Homo sapiens
tttaaatccttaat

SEQ ID NO: 6554837 - DNA, 22 bp, Homo sapiens
tttaaatctaaatctatttatt

SEQ ID NO: 6554838 - DNA, 13 bp, Homo sapiens
tttaaatgaaaat

SEQ ID NO: 6554839 - DNA, 16 bp, Homo sapiens
tttaaatgaaaatgta

SEQ ID NO: 6554840 - DNA, 12 bp, Homo sapiens
tttaaatgaaag

SEQ ID NO: 6554841 - DNA, 22 bp, Homo sapiens
tttaaatgaattaaatattgaa

SEQ ID NO: 6554842 - DNA, 23 bp, Homo sapiens
tttaaatgaattaaatattgaaa

SEQ ID NO: 6554843 - DNA, 18 bp, Homo sapiens
tttaaatgacagtaatat

SEQ ID NO: 6554844 - DNA, 22 bp, Homo sapiens
tttaaatgacatttttgataaa

SEQ ID NO: 6554845 - DNA, 17 bp, Homo sapiens
tttaaatgatcatgaaa

SEQ ID NO: 6554846 - DNA, 12 bp, Homo sapiens
tttaaatgattc

SEQ ID NO: 6554847 - DNA, 17 bp, Homo sapiens
tttaaatgattccaaat

SEQ ID NO: 6554848 - DNA, 19 bp, Homo sapiens
tttaaatgattccaaataa

SEQ ID NO: 6554849 - DNA, 14 bp, Homo sapiens
tttaaatgctgctt

SEQ ID NO: 6554850 - DNA, 20 bp, Homo sapiens
tttaaatgctgtatgtcatt

SEQ ID NO: 6554851 - DNA, 23 bp, Homo sapiens
tttaaatgctgtatgtcattaaa

SEQ ID NO: 6554852 - DNA, 17 bp, Homo sapiens
tttaaatggaattttct

SEQ ID NO: 6554853 - DNA, 18 bp, Homo sapiens
tttaaatgtaaagatatt

SEQ ID NO: 6554854 - DNA, 12 bp, Homo sapiens
tttaaatgtata

SEQ ID NO: 6554855 - DNA, 14 bp, Homo sapiens
tttaaatgtatact

SEQ ID NO: 6554856 - DNA, 16 bp, Homo sapiens
tttaaatgtattttac

SEQ ID NO: 6554857 - DNA, 18 bp, Homo sapiens
tttaaatgtcagttgaaa

SEQ ID NO: 6554858 - DNA, 15 bp, Homo sapiens
tttaaatgtctaatg

SEQ ID NO: 6554859 - DNA, 16 bp, Homo sapiens
tttaaatgtctaatgt

SEQ ID NO: 6554860 - DNA, 18 bp, Homo sapiens
tttaaatgtctaatgtat

SEQ ID NO: 6554861 - DNA, 13 bp, Homo sapiens
tttaaatgtctat

SEQ ID NO: 6554862 - DNA, 11 bp, Homo sapiens
tttaaatgtga

SEQ ID NO: 6554863 - DNA, 17 bp, Homo sapiens
tttaaatgtgaattttt

SEQ ID NO: 6554864 - DNA, 23 bp, Homo sapiens
tttaaatgtgcttcattgtttga

SEQ ID NO: 6554865 - DNA, 14 bp, Homo sapiens
tttaaatgtgtaca

SEQ ID NO: 6554866 - DNA, 23 bp, Homo sapiens
tttaaatgtgtacaatgtacaca

SEQ ID NO: 6554867 - DNA, 17 bp, Homo sapiens
tttaaatgtgtatttct

SEQ ID NO: 6554868 - DNA, 18 bp, Homo sapiens
tttaaatgttgaaatctt

SEQ ID NO: 6554869 - DNA, 12 bp, Homo sapiens
tttaaatgttta

SEQ ID NO: 6554870 - DNA, 14 bp, Homo sapiens
tttaaatgtttact

SEQ ID NO: 6554871 - DNA, 14 bp, Homo sapiens
tttaaatgtttttt

SEQ ID NO: 6554872 - DNA, 19 bp, Homo sapiens
tttaaattacctttacata

SEQ ID NO: 6554873 - DNA, 19 bp, Homo sapiens
tttaaattatactgtagct

SEQ ID NO: 6554874 - DNA, 12 bp, Homo sapiens
tttaaattatat

SEQ ID NO: 6554875 - DNA, 12 bp, Homo sapiens
tttaaattatga

SEQ ID NO: 6554876 - DNA, 17 bp, Homo sapiens
tttaaattatgtataaa

SEQ ID NO: 6554877 - DNA, 22 bp, Homo sapiens
tttaaattatgtttttattaag

SEQ ID NO: 6554878 - DNA, 19 bp, Homo sapiens
tttaaattctttttcaaaa

SEQ ID NO: 6554879 - DNA, 21 bp, Homo sapiens
tttaaattggagaaaagcact

SEQ ID NO: 6554880 - DNA, 20 bp, Homo sapiens
tttaaattggtcatggtaga

SEQ ID NO: 6554881 - DNA, 14 bp, Homo sapiens
tttaaattgttcct

SEQ ID NO: 6554882 - DNA, 14 bp, Homo sapiens
tttaaatttaagta

SEQ ID NO: 6554883 - DNA, 18 bp, Homo sapiens
tttaaatttacagaatat

SEQ ID NO: 6554884 - DNA, 21 bp, Homo sapiens
tttaaatttcttttattaata

SEQ ID NO: 6554885 - DNA, 14 bp, Homo sapiens
tttaaatttgttat

SEQ ID NO: 6554886 - DNA, 20 bp, Homo sapiens
tttaaattttaaaaagcagc

SEQ ID NO: 6554887 - DNA, 22 bp, Homo sapiens
tttaaattttaccctttagact

SEQ ID NO: 6554888 - DNA, 14 bp, Homo sapiens
tttaaattttcacc

SEQ ID NO: 6554889 - DNA, 21 bp, Homo sapiens
tttaaattttccattaatttc

SEQ ID NO: 6554890 - DNA, 21 bp, Homo sapiens
tttaaattttctccagtccct

SEQ ID NO: 6554891 - DNA, 13 bp, Homo sapiens
tttaaattttctt

SEQ ID NO: 6554892 - DNA, 21 bp, Homo sapiens
tttaaattttcttcagttggt

SEQ ID NO: 6554893 - DNA, 16 bp, Homo sapiens
tttaaattttcttttt

SEQ ID NO: 6554894 - DNA, 20 bp, Homo sapiens
tttaaatttttgtgaaccaa

SEQ ID NO: 6554895 - DNA, 18 bp, Homo sapiens
tttaaatttttttcctta

SEQ ID NO: 6554896 - DNA, 14 bp, Homo sapiens
tttaacaaaaaagg

SEQ ID NO: 6554897 - DNA, 19 bp, Homo sapiens
tttaacaaaaaaggaaaat

SEQ ID NO: 6554898 - DNA, 19 bp, Homo sapiens
tttaacaaaaagtgcttca

SEQ ID NO: 6554899 - DNA, 19 bp, Homo sapiens
tttaacaaaacaagaaaga

SEQ ID NO: 6554900 - DNA, 19 bp, Homo sapiens
tttaacaaaagatttgttt

SEQ ID NO: 6554901 - DNA, 12 bp, Homo sapiens
tttaacaaaatt

SEQ ID NO: 6554902 - DNA, 14 bp, Homo sapiens
tttaacaaatctaa

SEQ ID NO: 6554903 - DNA, 22 bp, Homo sapiens
tttaacaaatctaatctcttat

SEQ ID NO: 6554904 - DNA, 20 bp, Homo sapiens
tttaacaaatgactgtatct

SEQ ID NO: 6554905 - DNA, 14 bp, Homo sapiens
tttaacaacatgtt

SEQ ID NO: 6554906 - DNA, 19 bp, Homo sapiens
tttaacaactaatcaagag

SEQ ID NO: 6554907 - DNA, 23 bp, Homo sapiens
tttaacaactatgatttggaaaa

SEQ ID NO: 6554908 - DNA, 12 bp, Homo sapiens
tttaacaagaag

SEQ ID NO: 6554909 - DNA, 23 bp, Homo sapiens
tttaacaataactactgtgttcc

SEQ ID NO: 6554910 - DNA, 21 bp, Homo sapiens
tttaacaatccattcacaagc

SEQ ID NO: 6554911 - DNA, 14 bp, Homo sapiens
tttaacaatgacaa

SEQ ID NO: 6554912 - DNA, 14 bp, Homo sapiens
tttaacaatgcgaa

SEQ ID NO: 6554913 - DNA, 19 bp, Homo sapiens
tttaacacaagtcctgtga

SEQ ID NO: 6554914 - DNA, 14 bp, Homo sapiens
tttaacacataact

SEQ ID NO: 6554915 - DNA, 21 bp, Homo sapiens
tttaacaccaacactgtaaca

SEQ ID NO: 6554916 - DNA, 21 bp, Homo sapiens
tttaacactttgtattactta

SEQ ID NO: 6554917 - DNA, 22 bp, Homo sapiens
tttaacagaaaaatgaaattta

SEQ ID NO: 6554918 - DNA, 16 bp, Homo sapiens
tttaacagaaattgta

SEQ ID NO: 6554919 - DNA, 14 bp, Homo sapiens
tttaacagatattt

SEQ ID NO: 6554920 - DNA, 17 bp, Homo sapiens
tttaacagcatgacaaa

SEQ ID NO: 6554921 - DNA, 14 bp, Homo sapiens
tttaacagggtctc

SEQ ID NO: 6554922 - DNA, 16 bp, Homo sapiens
tttaacagtcatttaa

SEQ ID NO: 6554923 - DNA, 22 bp, Homo sapiens
tttaacataaaggttattttct

SEQ ID NO: 6554924 - DNA, 13 bp, Homo sapiens
tttaacataagct

SEQ ID NO: 6554925 - DNA, 17 bp, Homo sapiens
tttaacataagctattt

SEQ ID NO: 6554926 - DNA, 23 bp, Homo sapiens
tttaacatagtaacgtgttactg

SEQ ID NO: 6554927 - DNA, 21 bp, Homo sapiens
tttaacatagtcctgttacta

SEQ ID NO: 6554928 - DNA, 22 bp, Homo sapiens
tttaacatcactacaaaaagaa

SEQ ID NO: 6554929 - DNA, 16 bp, Homo sapiens
tttaacatctttgttt

SEQ ID NO: 6554930 - DNA, 14 bp, Homo sapiens
tttaacatgtgtta

SEQ ID NO: 6554931 - DNA, 16 bp, Homo sapiens
tttaacatgtgttaaa

SEQ ID NO: 6554932 - DNA, 15 bp, Homo sapiens
tttaacattctcaat

SEQ ID NO: 6554933 - DNA, 16 bp, Homo sapiens
tttaacattctcaatc

SEQ ID NO: 6554934 - DNA, 18 bp, Homo sapiens
tttaacattgattggata

SEQ ID NO: 6554935 - DNA, 20 bp, Homo sapiens
tttaacatttgatgtctaga

SEQ ID NO: 6554936 - DNA, 11 bp, Homo sapiens
tttaacatttt

SEQ ID NO: 6554937 - DNA, 20 bp, Homo sapiens
tttaacattttacagtaaat

SEQ ID NO: 6554938 - DNA, 13 bp, Homo sapiens
tttaacattttgt

SEQ ID NO: 6554939 - DNA, 18 bp, Homo sapiens
tttaaccaaggaggggcc

SEQ ID NO: 6554940 - DNA, 22 bp, Homo sapiens
tttaaccaagttgtttattcca

SEQ ID NO: 6554941 - DNA, 18 bp, Homo sapiens
tttaaccacattaattaa

SEQ ID NO: 6554942 - DNA, 23 bp, Homo sapiens
tttaaccaggggtcctaaccact

SEQ ID NO: 6554943 - DNA, 21 bp, Homo sapiens
tttaaccataaatcaattcat

SEQ ID NO: 6554944 - DNA, 20 bp, Homo sapiens
tttaaccatggcagggtgct

SEQ ID NO: 6554945 - DNA, 19 bp, Homo sapiens
tttaaccattccataatca

SEQ ID NO: 6554946 - DNA, 17 bp, Homo sapiens
tttaaccattttaacct

SEQ ID NO: 6554947 - DNA, 21 bp, Homo sapiens
tttaaccattttaacctagat

SEQ ID NO: 6554948 - DNA, 18 bp, Homo sapiens
tttaaccccgtcaacaaa

SEQ ID NO: 6554949 - DNA, 18 bp, Homo sapiens
tttaaccctaatctttca

SEQ ID NO: 6554950 - DNA, 13 bp, Homo sapiens
tttaaccctcaca

SEQ ID NO: 6554951 - DNA, 12 bp, Homo sapiens
tttaaccctgcc

SEQ ID NO: 6554952 - DNA, 23 bp, Homo sapiens
tttaaccggtaagagtttcagtt

SEQ ID NO: 6554953 - DNA, 20 bp, Homo sapiens
tttaaccgtttttcaagaaa

SEQ ID NO: 6554954 - DNA, 21 bp, Homo sapiens
tttaacctaatatcacttaaa

SEQ ID NO: 6554955 - DNA, 23 bp, Homo sapiens
tttaacctagatgtttaacaaat

SEQ ID NO: 6554956 - DNA, 18 bp, Homo sapiens
tttaacctatgataatta

SEQ ID NO: 6554957 - DNA, 13 bp, Homo sapiens
tttaacctcccct

SEQ ID NO: 6554958 - DNA, 14 bp, Homo sapiens
tttaacctctaaat

SEQ ID NO: 6554959 - DNA, 18 bp, Homo sapiens
tttaacctgttatttcta

SEQ ID NO: 6554960 - DNA, 21 bp, Homo sapiens
tttaacctgtttatataattt

SEQ ID NO: 6554961 - DNA, 14 bp, Homo sapiens
tttaaccttaaaat

SEQ ID NO: 6554962 - DNA, 16 bp, Homo sapiens
tttaacctttgataga

SEQ ID NO: 6554963 - DNA, 22 bp, Homo sapiens
tttaacgaatgaagatgtctaa

SEQ ID NO: 6554964 - DNA, 23 bp, Homo sapiens
tttaacgaggatttccctgaagc

SEQ ID NO: 6554965 - DNA, 14 bp, Homo sapiens
tttaacgctgccta

SEQ ID NO: 6554966 - DNA, 18 bp, Homo sapiens
tttaacgtatgtatttca

SEQ ID NO: 6554967 - DNA, 21 bp, Homo sapiens
tttaacgtgggattcagagaa

SEQ ID NO: 6554968 - DNA, 13 bp, Homo sapiens
tttaactaattta

SEQ ID NO: 6554969 - DNA, 16 bp, Homo sapiens
tttaactaatttaaac

SEQ ID NO: 6554970 - DNA, 19 bp, Homo sapiens
tttaactaatttaaaccag

SEQ ID NO: 6554971 - DNA, 22 bp, Homo sapiens
tttaactaatttaaaccagcag

SEQ ID NO: 6554972 - DNA, 12 bp, Homo sapiens
tttaactacaaa

SEQ ID NO: 6554973 - DNA, 17 bp, Homo sapiens
tttaactacatctgcct

SEQ ID NO: 6554974 - DNA, 14 bp, Homo sapiens
tttaactaccctta

SEQ ID NO: 6554975 - DNA, 18 bp, Homo sapiens
tttaactacccttaatta

SEQ ID NO: 6554976 - DNA, 21 bp, Homo sapiens
tttaactactaagaataaata

SEQ ID NO: 6554977 - DNA, 22 bp, Homo sapiens
tttaactactttactaaattaa

SEQ ID NO: 6554978 - DNA, 15 bp, Homo sapiens
tttaactagaattta

SEQ ID NO: 6554979 - DNA, 17 bp, Homo sapiens
tttaactagaatttatt

SEQ ID NO: 6554980 - DNA, 22 bp, Homo sapiens
tttaactatcttctctatattt

SEQ ID NO: 6554981 - DNA, 18 bp, Homo sapiens
tttaactatgtaataatg

SEQ ID NO: 6554982 - DNA, 12 bp, Homo sapiens
tttaactcagat

SEQ ID NO: 6554983 - DNA, 15 bp, Homo sapiens
tttaactcagatcac

SEQ ID NO: 6554984 - DNA, 13 bp, Homo sapiens
ttaaatatatatt

SEQ ID NO: 6554985 - DNA, 16 bp, Homo sapiens
ttaaatatatattatt

SEQ ID NO: 6554986 - DNA, 20 bp, Homo sapiens
ttaaatatatctttgtaaat

SEQ ID NO: 6554987 - DNA, 18 bp, Homo sapiens
ttaaatatatgtatgtaa

SEQ ID NO: 6554988 - DNA, 22 bp, Homo sapiens
ttaaatatatgtatgtaaaaat

SEQ ID NO: 6554989 - DNA, 17 bp, Homo sapiens
ttaaatatcaatcattt

SEQ ID NO: 6554990 - DNA, 18 bp, Homo sapiens
ttaaatatcattctttgt

SEQ ID NO: 6554991 - DNA, 20 bp, Homo sapiens
ttaaatatccatttatcttt

SEQ ID NO: 6554992 - DNA, 22 bp, Homo sapiens
ttaaatatctgaacatttacta

SEQ ID NO: 6554993 - DNA, 14 bp, Homo sapiens
ttaaatatctttta

SEQ ID NO: 6554994 - DNA, 17 bp, Homo sapiens
ttaaatatcttttatgt

SEQ ID NO: 6554995 - DNA, 12 bp, Homo sapiens
ttaaatatgaat

SEQ ID NO: 6554996 - DNA, 16 bp, Homo sapiens
ttaaatatgatttgca

SEQ ID NO: 6554997 - DNA, 19 bp, Homo sapiens
ttaaatatgatttgcattt

SEQ ID NO: 6554998 - DNA, 22 bp, Homo sapiens
ttaaatattaactcaaaagttg

SEQ ID NO: 6554999 - DNA, 20 bp, Homo sapiens
ttaaatattgaataagtatt

SEQ ID NO: 6555000 - DNA, 24 bp, Homo sapiens
ttaaatattgtaatatgacagata

SEQ ID NO: 6555001 - DNA, 17 bp, Homo sapiens
ttaaatatttaacatag

SEQ ID NO: 6555002 - DNA, 13 bp, Homo sapiens
ttaaatatttagt

SEQ ID NO: 6555003 - DNA, 17 bp, Homo sapiens
ttaaatatttattttct

SEQ ID NO: 6555004 - DNA, 15 bp, Homo sapiens
ttaaatatttcttaa

SEQ ID NO: 6555005 - DNA, 13 bp, Homo sapiens
ttaaatattttct

SEQ ID NO: 6555006 - DNA, 18 bp, Homo sapiens
ttaaatattttctatttt

SEQ ID NO: 6555007 - DNA, 14 bp, Homo sapiens
ttaaatattttgct

SEQ ID NO: 6555008 - DNA, 16 bp, Homo sapiens
ttaaatattttgctaa

SEQ ID NO: 6555009 - DNA, 21 bp, Homo sapiens
ttaaatattttgctaactggt

SEQ ID NO: 6555010 - DNA, 22 bp, Homo sapiens
ttaaatcactgaggcattttta

SEQ ID NO: 6555011 - DNA, 16 bp, Homo sapiens
ttaaatcagaataaat

SEQ ID NO: 6555012 - DNA, 13 bp, Homo sapiens
ttaaatcagaatc

SEQ ID NO: 6555013 - DNA, 19 bp, Homo sapiens
ttaaatcagactagagaat

SEQ ID NO: 6555014 - DNA, 22 bp, Homo sapiens
ttaaatcagttctcaatttcat

SEQ ID NO: 6555015 - DNA, 22 bp, Homo sapiens
ttaaatcagtttattaaatctg

SEQ ID NO: 6555016 - DNA, 16 bp, Homo sapiens
ttaaatcagttttgtg

SEQ ID NO: 6555017 - DNA, 14 bp, Homo sapiens
ttaaatcatgtatg

SEQ ID NO: 6555018 - DNA, 17 bp, Homo sapiens
ttaaatcattagagctt

SEQ ID NO: 6555019 - DNA, 23 bp, Homo sapiens
ttaaatcattagagcttaaattg

SEQ ID NO: 6555020 - DNA, 22 bp, Homo sapiens
ttaaatcattcattcaatagat

SEQ ID NO: 6555021 - DNA, 19 bp, Homo sapiens
ttaaatcatttggttaaat

SEQ ID NO: 6555022 - DNA, 19 bp, Homo sapiens
ttaaatcattttaacttct

SEQ ID NO: 6555023 - DNA, 14 bp, Homo sapiens
ttaaatcattttca

SEQ ID NO: 6555024 - DNA, 22 bp, Homo sapiens
ttaaatccaactttcacagtga

SEQ ID NO: 6555025 - DNA, 12 bp, Homo sapiens
ttaaatccagtt

SEQ ID NO: 6555026 - DNA, 22 bp, Homo sapiens
ttaaatcccaaatcctatttaa

SEQ ID NO: 6555027 - DNA, 14 bp, Homo sapiens
ttaaatcctgttga

SEQ ID NO: 6555028 - DNA, 19 bp, Homo sapiens
ttaaatccttttacctttt

SEQ ID NO: 6555029 - DNA, 17 bp, Homo sapiens
ttaaatccttttcccat

SEQ ID NO: 6555030 - DNA, 16 bp, Homo sapiens
ttaaatctacaaactt

SEQ ID NO: 6555031 - DNA, 19 bp, Homo sapiens
ttaaatctacaaactttta

SEQ ID NO: 6555032 - DNA, 15 bp, Homo sapiens
ttaaatctagacatt

SEQ ID NO: 6555033 - DNA, 19 bp, Homo sapiens
ttaaatctagacattcttt

SEQ ID NO: 6555034 - DNA, 21 bp, Homo sapiens
ttaaatctatgaagtatataa

SEQ ID NO: 6555035 - DNA, 21 bp, Homo sapiens
ttaaatctgaaggttctggta

SEQ ID NO: 6555036 - DNA, 17 bp, Homo sapiens
ttaaatctgaattttaa

SEQ ID NO: 6555037 - DNA, 22 bp, Homo sapiens
ttaaatctgaattttaaaacat

SEQ ID NO: 6555038 - DNA, 21 bp, Homo sapiens
ttaaatctgcctttgtttcta

SEQ ID NO: 6555039 - DNA, 17 bp, Homo sapiens
ttaaatctgctttagtt

SEQ ID NO: 6555040 - DNA, 16 bp, Homo sapiens
ttaaatctgtccctga

SEQ ID NO: 6555041 - DNA, 15 bp, Homo sapiens
ttaaatcttaaaagt

SEQ ID NO: 6555042 - DNA, 19 bp, Homo sapiens
ttaaatcttaaacaatgta

SEQ ID NO: 6555043 - DNA, 24 bp, Homo sapiens
ttaaatcttaaacaatgtataaag

SEQ ID NO: 6555044 - DNA, 12 bp, Homo sapiens
ttaaatctttgt

SEQ ID NO: 6555045 - DNA, 15 bp, Homo sapiens
ttaaatctttgttaa

SEQ ID NO: 6555046 - DNA, 21 bp, Homo sapiens
ttaaatctttgttaaaatata

SEQ ID NO: 6555047 - DNA, 15 bp, Homo sapiens
ttaaatgaaaatgta

SEQ ID NO: 6555048 - DNA, 23 bp, Homo sapiens
ttaaatgaaaggagtttaaaaac

SEQ ID NO: 6555049 - DNA, 13 bp, Homo sapiens
ttaaatgaaatac

SEQ ID NO: 6555050 - DNA, 18 bp, Homo sapiens
ttaaatgaactactgcta

SEQ ID NO: 6555051 - DNA, 16 bp, Homo sapiens
ttaaatgaacttatgt

SEQ ID NO: 6555052 - DNA, 21 bp, Homo sapiens
ttaaatgaagtgattctaaga

SEQ ID NO: 6555053 - DNA, 21 bp, Homo sapiens
ttaaatgacactcatataatt

SEQ ID NO: 6555054 - DNA, 18 bp, Homo sapiens
ttaaatgactcttccctc

SEQ ID NO: 6555055 - DNA, 16 bp, Homo sapiens
ttaaatgacttagaaa

SEQ ID NO: 6555056 - DNA, 21 bp, Homo sapiens
ttaaatgacttgattgtactt

SEQ ID NO: 6555057 - DNA, 12 bp, Homo sapiens
ttaaatgacttt

SEQ ID NO: 6555058 - DNA, 12 bp, Homo sapiens
ttaaatgagaag

SEQ ID NO: 6555059 - DNA, 16 bp, Homo sapiens
ttaaatgaggattatt

SEQ ID NO: 6555060 - DNA, 21 bp, Homo sapiens
ttaaatgagggtttctgatct

SEQ ID NO: 6555061 - DNA, 13 bp, Homo sapiens
ttaaatgatattt

SEQ ID NO: 6555062 - DNA, 16 bp, Homo sapiens
ttaaatgatatttagg

SEQ ID NO: 6555063 - DNA, 13 bp, Homo sapiens
ttaaatgattcca

SEQ ID NO: 6555064 - DNA, 16 bp, Homo sapiens
ttaaatgcaaaaatat

SEQ ID NO: 6555065 - DNA, 17 bp, Homo sapiens
ttaaatgcaacagtttt

SEQ ID NO: 6555066 - DNA, 20 bp, Homo sapiens
ttaaatgcaaccatttgaaa

SEQ ID NO: 6555067 - DNA, 16 bp, Homo sapiens
ttaaatgcacctggaa

SEQ ID NO: 6555068 - DNA, 20 bp, Homo sapiens
ttaaatgcagttacaaatta

SEQ ID NO: 6555069 - DNA, 19 bp, Homo sapiens
ttaaatgcatgtcttaaat

SEQ ID NO: 6555070 - DNA, 13 bp, Homo sapiens
ttaaatgccaaaa

SEQ ID NO: 6555071 - DNA, 20 bp, Homo sapiens
ttaaatgccaaaatgtactt

SEQ ID NO: 6555072 - DNA, 22 bp, Homo sapiens
ttaaatgccacaagacataatt

SEQ ID NO: 6555073 - DNA, 17 bp, Homo sapiens
ttaaatgcccagcccct

SEQ ID NO: 6555074 - DNA, 17 bp, Homo sapiens
ttaaatgccttgtataa

SEQ ID NO: 6555075 - DNA, 21 bp, Homo sapiens
ttaaatgctatggaaatacat

SEQ ID NO: 6555076 - DNA, 23 bp, Homo sapiens
ttaaatgctatggaaatacattt

SEQ ID NO: 6555077 - DNA, 12 bp, Homo sapiens
ttaaatgctgct

SEQ ID NO: 6555078 - DNA, 19 bp, Homo sapiens
ttaaatggaaactgaaact

SEQ ID NO: 6555079 - DNA, 17 bp, Homo sapiens
ttaaatggcacctgtat

SEQ ID NO: 6555080 - DNA, 23 bp, Homo sapiens
ttaaatgggctactttgtccttt

SEQ ID NO: 6555081 - DNA, 13 bp, Homo sapiens
ttaaatgtaaaga

SEQ ID NO: 6555082 - DNA, 16 bp, Homo sapiens
ttaaatgtaaataatc

SEQ ID NO: 6555083 - DNA, 17 bp, Homo sapiens
ttaaatgtaagttgaga

SEQ ID NO: 6555084 - DNA, 16 bp, Homo sapiens
ttaaatgtacagacat

SEQ ID NO: 6555085 - DNA, 18 bp, Homo sapiens
ttaaatgtagacagatat

SEQ ID NO: 6555086 - DNA, 14 bp, Homo sapiens
ttaaatgtatacta

SEQ ID NO: 6555087 - DNA, 20 bp, Homo sapiens
ttaaatgtatatgtcattta

SEQ ID NO: 6555088 - DNA, 21 bp, Homo sapiens
ttaaatgtatcacattgaaga

SEQ ID NO: 6555089 - DNA, 16 bp, Homo sapiens
ttaaatgtattttaca

SEQ ID NO: 6555090 - DNA, 18 bp, Homo sapiens
ttaaatgtctaatgtatt

SEQ ID NO: 6555091 - DNA, 17 bp, Homo sapiens
ttaaatgtctataaatg

SEQ ID NO: 6555092 - DNA, 19 bp, Homo sapiens
ttaaatgtcttatatagca

SEQ ID NO: 6555093 - DNA, 18 bp, Homo sapiens
ttaaatgtgaattactaa

SEQ ID NO: 6555094 - DNA, 21 bp, Homo sapiens
ttaaatgtgaattactaactt

SEQ ID NO: 6555095 - DNA, 22 bp, Homo sapiens
ttaaatgtgaattactaacttc

SEQ ID NO: 6555096 - DNA, 13 bp, Homo sapiens
ttaaatgtggaat

SEQ ID NO: 6555097 - DNA, 23 bp, Homo sapiens
ttaaatgtggaatgatgtatata

SEQ ID NO: 6555098 - DNA, 17 bp, Homo sapiens
ttaaatgtgtacaatgt

SEQ ID NO: 6555099 - DNA, 23 bp, Homo sapiens
ttaaatgtgtgtaaaaaagtgtt

SEQ ID NO: 6555100 - DNA, 16 bp, Homo sapiens
ttaaatgttatgacta

SEQ ID NO: 6555101 - DNA, 13 bp, Homo sapiens
ttaaatgttcatg

SEQ ID NO: 6555102 - DNA, 15 bp, Homo sapiens
ttaaatgttcatgtc

SEQ ID NO: 6555103 - DNA, 17 bp, Homo sapiens
ttaaatgttgaaatctt

SEQ ID NO: 6555104 - DNA, 20 bp, Homo sapiens
ttaaatgttgaaatcttaaa

SEQ ID NO: 6555105 - DNA, 14 bp, Homo sapiens
ttaaatgtttatat

SEQ ID NO: 6555106 - DNA, 14 bp, Homo sapiens
ttaaatgtttgttg

SEQ ID NO: 6555107 - DNA, 11 bp, Homo sapiens
ttaaatgtttt

SEQ ID NO: 6555108 - DNA, 17 bp, Homo sapiens
ttaaatgttttataagt

SEQ ID NO: 6555109 - DNA, 16 bp, Homo sapiens
ttaaatgttttcattg

SEQ ID NO: 6555110 - DNA, 14 bp, Homo sapiens
ttaaatgttttgta

SEQ ID NO: 6555111 - DNA, 21 bp, Homo sapiens
ttaaatgtttttttttaaaga

SEQ ID NO: 6555112 - DNA, 12 bp, Homo sapiens
ttaaattaaaca

SEQ ID NO: 6555113 - DNA, 14 bp, Homo sapiens
ttaaattaaacaat

SEQ ID NO: 6555114 - DNA, 17 bp, Homo sapiens
ttaaattacaattttat

SEQ ID NO: 6555115 - DNA, 18 bp, Homo sapiens
ttaaattacaattttatc

SEQ ID NO: 6555116 - DNA, 15 bp, Homo sapiens
ttaaattacagcttt

SEQ ID NO: 6555117 - DNA, 16 bp, Homo sapiens
ttaaattacatttgta

SEQ ID NO: 6555118 - DNA, 18 bp, Homo sapiens
ttaaattacatttgtaat

SEQ ID NO: 6555119 - DNA, 18 bp, Homo sapiens
ttaaattacctttacata

SEQ ID NO: 6555120 - DNA, 22 bp, Homo sapiens
ttaaattacctttacatatata

SEQ ID NO: 6555121 - DNA, 15 bp, Homo sapiens
ttaaattagaaaata

SEQ ID NO: 6555122 - DNA, 21 bp, Homo sapiens
ttaaattataacttaaaatat

SEQ ID NO: 6555123 - DNA, 14 bp, Homo sapiens
ttaaattataagga

SEQ ID NO: 6555124 - DNA, 15 bp, Homo sapiens
ttaaattataaggac

SEQ ID NO: 6555125 - DNA, 19 bp, Homo sapiens
ttaaattataaggactgca

SEQ ID NO: 6555126 - DNA, 18 bp, Homo sapiens
ttaaattataccaaagat

SEQ ID NO: 6555127 - DNA, 12 bp, Homo sapiens
ttaaattatatg

SEQ ID NO: 6555128 - DNA, 13 bp, Homo sapiens
ttaaattatatga

SEQ ID NO: 6555129 - DNA, 16 bp, Homo sapiens
ttaaattattgcttaa

SEQ ID NO: 6555130 - DNA, 22 bp, Homo sapiens
ttaaattcccgttttgtcactt

SEQ ID NO: 6555131 - DNA, 17 bp, Homo sapiens
ttaaattctcaaagttt

SEQ ID NO: 6555132 - DNA, 18 bp, Homo sapiens
ttaaattctcaaagtttt

SEQ ID NO: 6555133 - DNA, 13 bp, Homo sapiens
ttaaattctgaat

SEQ ID NO: 6555134 - DNA, 15 bp, Homo sapiens
ttaaattctgaatgc

SEQ ID NO: 6555135 - DNA, 17 bp, Homo sapiens
ttaaattcttcaagaaa

SEQ ID NO: 6555136 - DNA, 22 bp, Homo sapiens
ttaaattcttcaagaaagaatt

SEQ ID NO: 6555137 - DNA, 23 bp, Homo sapiens
ttaaattcttcaagaaagaattc

SEQ ID NO: 6555138 - DNA, 19 bp, Homo sapiens
ttaaattgcacgtgcaata

SEQ ID NO: 6555139 - DNA, 22 bp, Homo sapiens
ttaaattgcctttgtaatatga

SEQ ID NO: 6555140 - DNA, 21 bp, Homo sapiens
ttaaattgctcacagttatta

SEQ ID NO: 6555141 - DNA, 16 bp, Homo sapiens
ttaaattgctgtgtat

SEQ ID NO: 6555142 - DNA, 21 bp, Homo sapiens
ttaaattgctttctatatctt

SEQ ID NO: 6555143 - DNA, 14 bp, Homo sapiens
ttaaattggagaaa

SEQ ID NO: 6555144 - DNA, 17 bp, Homo sapiens
ttaaattggagaaaagc

SEQ ID NO: 6555145 - DNA, 22 bp, Homo sapiens
ttaaattggagaaaagcactta

SEQ ID NO: 6555146 - DNA, 23 bp, Homo sapiens
ttaaattggagaaaagcacttaa

SEQ ID NO: 6555147 - DNA, 17 bp, Homo sapiens
ttaaattggcttgttta

SEQ ID NO: 6555148 - DNA, 23 bp, Homo sapiens
ttaaattgggcttcaatcactgt

SEQ ID NO: 6555149 - DNA, 17 bp, Homo sapiens
ttaaattgtgtacactt

SEQ ID NO: 6555150 - DNA, 15 bp, Homo sapiens
ttaaatttaaagata

SEQ ID NO: 6555151 - DNA, 18 bp, Homo sapiens
ttaaatttaaagatattg

SEQ ID NO: 6555152 - DNA, 15 bp, Homo sapiens
ttaaatttacagaat

SEQ ID NO: 6555153 - DNA, 18 bp, Homo sapiens
ttaaatttacagaatatt

SEQ ID NO: 6555154 - DNA, 18 bp, Homo sapiens
ttaaatttaggtaaataa

SEQ ID NO: 6555155 - DNA, 23 bp, Homo sapiens
ttaaatttagtgctcagaatcca

SEQ ID NO: 6555156 - DNA, 19 bp, Homo sapiens
ttaaatttcaaatgcagaa

SEQ ID NO: 6555157 - DNA, 18 bp, Homo sapiens
ttaaatttcttatgtgac

SEQ ID NO: 6555158 - DNA, 19 bp, Homo sapiens
ttaaatttcttatgtgaca

SEQ ID NO: 6555159 - DNA, 22 bp, Homo sapiens
ttaaatttcttggcaaatttta

SEQ ID NO: 6555160 - DNA, 23 bp, Homo sapiens
ttaaatttcttggcaaattttaa

SEQ ID NO: 6555161 - DNA, 19 bp, Homo sapiens
tttaactcaggactccagc

SEQ ID NO: 6555162 - DNA, 20 bp, Homo sapiens
tttaactcccattaccatgt

SEQ ID NO: 6555163 - DNA, 22 bp, Homo sapiens
tttaactccctttttacacttt

SEQ ID NO: 6555164 - DNA, 21 bp, Homo sapiens
tttaactctactgtgtaatat

SEQ ID NO: 6555165 - DNA, 12 bp, Homo sapiens
tttaactctgcg

SEQ ID NO: 6555166 - DNA, 22 bp, Homo sapiens
tttaactctgcggatagcattt

SEQ ID NO: 6555167 - DNA, 19 bp, Homo sapiens
tttaactctggattttgaa

SEQ ID NO: 6555168 - DNA, 18 bp, Homo sapiens
tttaactctgtaagaaac

SEQ ID NO: 6555169 - DNA, 13 bp, Homo sapiens
tttaactctgtct

SEQ ID NO: 6555170 - DNA, 17 bp, Homo sapiens
tttaactctgtcttcac

SEQ ID NO: 6555171 - DNA, 12 bp, Homo sapiens
tttaactcttaa

SEQ ID NO: 6555172 - DNA, 19 bp, Homo sapiens
tttaactcttaactgaaga

SEQ ID NO: 6555173 - DNA, 15 bp, Homo sapiens
tttaactgaaaatgt

SEQ ID NO: 6555174 - DNA, 16 bp, Homo sapiens
tttaactgaaaatgta

SEQ ID NO: 6555175 - DNA, 19 bp, Homo sapiens
tttaactgaaaatgtaaat

SEQ ID NO: 6555176 - DNA, 19 bp, Homo sapiens
tttaactgacaagccatct

SEQ ID NO: 6555177 - DNA, 11 bp, Homo sapiens
tttaactgact

SEQ ID NO: 6555178 - DNA, 13 bp, Homo sapiens
tttaactgagggc

SEQ ID NO: 6555179 - DNA, 19 bp, Homo sapiens
tttaactgagggctgatct

SEQ ID NO: 6555180 - DNA, 21 bp, Homo sapiens
tttaactgatttaacactttt

SEQ ID NO: 6555181 - DNA, 19 bp, Homo sapiens
tttaactgcagttgacttt

SEQ ID NO: 6555182 - DNA, 21 bp, Homo sapiens
tttaactgccgtaatttaact

SEQ ID NO: 6555183 - DNA, 21 bp, Homo sapiens
tttaactggaaggctgctttc

SEQ ID NO: 6555184 - DNA, 14 bp, Homo sapiens
tttaactggagctc

SEQ ID NO: 6555185 - DNA, 15 bp, Homo sapiens
tttaactggagctcc

SEQ ID NO: 6555186 - DNA, 13 bp, Homo sapiens
tttaactggcatg

SEQ ID NO: 6555187 - DNA, 18 bp, Homo sapiens
tttaactggcatgtcatt

SEQ ID NO: 6555188 - DNA, 13 bp, Homo sapiens
tttaactggtgaa

SEQ ID NO: 6555189 - DNA, 18 bp, Homo sapiens
tttaactggtgaagagaa

SEQ ID NO: 6555190 - DNA, 22 bp, Homo sapiens
tttaactggtgcactttgtaaa

SEQ ID NO: 6555191 - DNA, 12 bp, Homo sapiens
tttaactgtgat

SEQ ID NO: 6555192 - DNA, 13 bp, Homo sapiens
tttaactgtgata

SEQ ID NO: 6555193 - DNA, 15 bp, Homo sapiens
tttaactgtgcatgt

SEQ ID NO: 6555194 - DNA, 17 bp, Homo sapiens
tttaacttatgtatgtg

SEQ ID NO: 6555195 - DNA, 15 bp, Homo sapiens
tttaacttattgcta

SEQ ID NO: 6555196 - DNA, 14 bp, Homo sapiens
tttaacttattgtt

SEQ ID NO: 6555197 - DNA, 17 bp, Homo sapiens
tttaacttgaaaagatt

SEQ ID NO: 6555198 - DNA, 19 bp, Homo sapiens
tttaacttgagggtaataa

SEQ ID NO: 6555199 - DNA, 15 bp, Homo sapiens
tttaacttgtaataa

SEQ ID NO: 6555200 - DNA, 21 bp, Homo sapiens
tttaacttgtctttttgttat

SEQ ID NO: 6555201 - DNA, 21 bp, Homo sapiens
tttaactttaccaaatgaaat

SEQ ID NO: 6555202 - DNA, 19 bp, Homo sapiens
tttaactttatcacattat

SEQ ID NO: 6555203 - DNA, 15 bp, Homo sapiens
tttaactttgtgggg

SEQ ID NO: 6555204 - DNA, 12 bp, Homo sapiens
tttaactttgtt

SEQ ID NO: 6555205 - DNA, 12 bp, Homo sapiens
tttaacttttaa

SEQ ID NO: 6555206 - DNA, 17 bp, Homo sapiens
tttaacttttaaagaat

SEQ ID NO: 6555207 - DNA, 17 bp, Homo sapiens
tttaacttttaatttaa

SEQ ID NO: 6555208 - DNA, 17 bp, Homo sapiens
tttaacttttggaatca

SEQ ID NO: 6555209 - DNA, 11 bp, Homo sapiens
tttaacttttt

SEQ ID NO: 6555210 - DNA, 19 bp, Homo sapiens
tttaactttttttcttcta

SEQ ID NO: 6555211 - DNA, 17 bp, Homo sapiens
tttaacttttttttctc

SEQ ID NO: 6555212 - DNA, 18 bp, Homo sapiens
tttaagaaaaaataaaag

SEQ ID NO: 6555213 - DNA, 18 bp, Homo sapiens
tttaagaaaaaggatgca

SEQ ID NO: 6555214 - DNA, 13 bp, Homo sapiens
tttaagaaaaatt

SEQ ID NO: 6555215 - DNA, 20 bp, Homo sapiens
tttaagaaaaattcacaagc

SEQ ID NO: 6555216 - DNA, 19 bp, Homo sapiens
tttaagaaaacaccatgga

SEQ ID NO: 6555217 - DNA, 18 bp, Homo sapiens
tttaagaaaagcactttt

SEQ ID NO: 6555218 - DNA, 20 bp, Homo sapiens
tttaagaaaagcacttttgt

SEQ ID NO: 6555219 - DNA, 19 bp, Homo sapiens
tttaagaaaagccctgaga

SEQ ID NO: 6555220 - DNA, 12 bp, Homo sapiens
tttaagaaaagt

SEQ ID NO: 6555221 - DNA, 17 bp, Homo sapiens
tttaagaaaagtatttt

SEQ ID NO: 6555222 - DNA, 19 bp, Homo sapiens
tttaagaaaagtattttga

SEQ ID NO: 6555223 - DNA, 12 bp, Homo sapiens
tttaagaaaata

SEQ ID NO: 6555224 - DNA, 20 bp, Homo sapiens
tttaagaaaatacaataaac

SEQ ID NO: 6555225 - DNA, 22 bp, Homo sapiens
tttaagaaaatacaataaacta

SEQ ID NO: 6555226 - DNA, 23 bp, Homo sapiens
tttaagaaagagaatgaactgtg

SEQ ID NO: 6555227 - DNA, 20 bp, Homo sapiens
tttaagaaagggaaagctgt

SEQ ID NO: 6555228 - DNA, 16 bp, Homo sapiens
tttaagaaatgagaaa

SEQ ID NO: 6555229 - DNA, 18 bp, Homo sapiens
tttaagaaatgagaaatt

SEQ ID NO: 6555230 - DNA, 21 bp, Homo sapiens
tttaagaaatgagaaattgtg

SEQ ID NO: 6555231 - DNA, 17 bp, Homo sapiens
tttaagaagaaagattt

SEQ ID NO: 6555232 - DNA, 19 bp, Homo sapiens
tttaagaatagttctaaaa

SEQ ID NO: 6555233 - DNA, 20 bp, Homo sapiens
tttaagaatagttctaaaat

SEQ ID NO: 6555234 - DNA, 18 bp, Homo sapiens
tttaagaatatttttaga

SEQ ID NO: 6555235 - DNA, 13 bp, Homo sapiens
tttaagaatcatg

SEQ ID NO: 6555236 - DNA, 14 bp, Homo sapiens
tttaagaatcatgg

SEQ ID NO: 6555237 - DNA, 14 bp, Homo sapiens
tttaagaatgaaca

SEQ ID NO: 6555238 - DNA, 12 bp, Homo sapiens
tttaagaatggt

SEQ ID NO: 6555239 - DNA, 21 bp, Homo sapiens
tttaagaatggtctcagtgtt

SEQ ID NO: 6555240 - DNA, 12 bp, Homo sapiens
tttaagaattct

SEQ ID NO: 6555241 - DNA, 15 bp, Homo sapiens
tttaagaattctgta

SEQ ID NO: 6555242 - DNA, 20 bp, Homo sapiens
tttaagaattgagtaatggt

SEQ ID NO: 6555243 - DNA, 15 bp, Homo sapiens
tttaagacacttttt

SEQ ID NO: 6555244 - DNA, 11 bp, Homo sapiens
tttaagacata

SEQ ID NO: 6555245 - DNA, 15 bp, Homo sapiens
tttaagacataaaca

SEQ ID NO: 6555246 - DNA, 17 bp, Homo sapiens
tttaagacataaacaaa

SEQ ID NO: 6555247 - DNA, 16 bp, Homo sapiens
tttaagaccagcctgg

SEQ ID NO: 6555248 - DNA, 20 bp, Homo sapiens
tttaagacgaaacatttgtt

SEQ ID NO: 6555249 - DNA, 23 bp, Homo sapiens
tttaagactctcgcatcttccca

SEQ ID NO: 6555250 - DNA, 21 bp, Homo sapiens
tttaagactgataattttaca

SEQ ID NO: 6555251 - DNA, 14 bp, Homo sapiens
tttaagactgtaat

SEQ ID NO: 6555252 - DNA, 22 bp, Homo sapiens
tttaagacttagttatttctgc

SEQ ID NO: 6555253 - DNA, 12 bp, Homo sapiens
tttaagagaaat

SEQ ID NO: 6555254 - DNA, 18 bp, Homo sapiens
tttaagagaacaagcaaa

SEQ ID NO: 6555255 - DNA, 12 bp, Homo sapiens
tttaagagacag

SEQ ID NO: 6555256 - DNA, 14 bp, Homo sapiens
tttaagagacagcc

SEQ ID NO: 6555257 - DNA, 11 bp, Homo sapiens
tttaagagact

SEQ ID NO: 6555258 - DNA, 12 bp, Homo sapiens
tttaagagactc

SEQ ID NO: 6555259 - DNA, 14 bp, Homo sapiens
tttaagagactctt

SEQ ID NO: 6555260 - DNA, 20 bp, Homo sapiens
tttaagagactctttatttt

SEQ ID NO: 6555261 - DNA, 14 bp, Homo sapiens
tttaagagagaaat

SEQ ID NO: 6555262 - DNA, 21 bp, Homo sapiens
tttaagagagaaatctgaaaa

SEQ ID NO: 6555263 - DNA, 23 bp, Homo sapiens
tttaagaggaagaagaagaaagg

SEQ ID NO: 6555264 - DNA, 18 bp, Homo sapiens
tttaagaggaatttataa

SEQ ID NO: 6555265 - DNA, 22 bp, Homo sapiens
tttaagaggaatttataacaaa

SEQ ID NO: 6555266 - DNA, 15 bp, Homo sapiens
tttaagataaattat

SEQ ID NO: 6555267 - DNA, 20 bp, Homo sapiens
tttaagataatagtttacat

SEQ ID NO: 6555268 - DNA, 19 bp, Homo sapiens
tttaagatatatacatgga

SEQ ID NO: 6555269 - DNA, 19 bp, Homo sapiens
tttaagatatccatctttt

SEQ ID NO: 6555270 - DNA, 23 bp, Homo sapiens
tttaagatatccatctttttctt

SEQ ID NO: 6555271 - DNA, 17 bp, Homo sapiens
tttaagatgtacattta

SEQ ID NO: 6555272 - DNA, 22 bp, Homo sapiens
tttaagatgtacatttaataat

SEQ ID NO: 6555273 - DNA, 12 bp, Homo sapiens
tttaagatgtga

SEQ ID NO: 6555274 - DNA, 14 bp, Homo sapiens
tttaagatgtgaaa

SEQ ID NO: 6555275 - DNA, 17 bp, Homo sapiens
tttaagattccttttct

SEQ ID NO: 6555276 - DNA, 11 bp, Homo sapiens
tttaagattta

SEQ ID NO: 6555277 - DNA, 15 bp, Homo sapiens
tttaagatttctcta

SEQ ID NO: 6555278 - DNA, 18 bp, Homo sapiens
tttaagatttttctcaaa

SEQ ID NO: 6555279 - DNA, 14 bp, Homo sapiens
tttaagcaaatgca

SEQ ID NO: 6555280 - DNA, 23 bp, Homo sapiens
tttaagcaaatgcattctatcgt

SEQ ID NO: 6555281 - DNA, 19 bp, Homo sapiens
tttaagcaacaaaactatg

SEQ ID NO: 6555282 - DNA, 14 bp, Homo sapiens
tttaagcaacactt

SEQ ID NO: 6555283 - DNA, 17 bp, Homo sapiens
tttaagcaagttaagtg

SEQ ID NO: 6555284 - DNA, 13 bp, Homo sapiens
tttaagcaattca

SEQ ID NO: 6555285 - DNA, 21 bp, Homo sapiens
tttaagcacaaaaaatttaag

SEQ ID NO: 6555286 - DNA, 20 bp, Homo sapiens
tttaagcactacataaactg

SEQ ID NO: 6555287 - DNA, 13 bp, Homo sapiens
tttaagcagctct

SEQ ID NO: 6555288 - DNA, 15 bp, Homo sapiens
tttaagcagctctaa

SEQ ID NO: 6555289 - DNA, 20 bp, Homo sapiens
tttaagcagctcttgctaat

SEQ ID NO: 6555290 - DNA, 21 bp, Homo sapiens
tttaagcaggaatgcaatata

SEQ ID NO: 6555291 - DNA, 14 bp, Homo sapiens
tttaagcataatta

SEQ ID NO: 6555292 - DNA, 22 bp, Homo sapiens
tttaagcatgagtggccttaat

SEQ ID NO: 6555293 - DNA, 16 bp, Homo sapiens
tttaagcattactctt

SEQ ID NO: 6555294 - DNA, 13 bp, Homo sapiens
tttaagcattgtt

SEQ ID NO: 6555295 - DNA, 21 bp, Homo sapiens
tttaagcattgtttgcttatt

SEQ ID NO: 6555296 - DNA, 17 bp, Homo sapiens
tttaagcatttgtatat

SEQ ID NO: 6555297 - DNA, 18 bp, Homo sapiens
tttaagcatttgtatatt

SEQ ID NO: 6555298 - DNA, 21 bp, Homo sapiens
tttaagcattttactgtctgt

SEQ ID NO: 6555299 - DNA, 16 bp, Homo sapiens
tttaagccaaaatgca

SEQ ID NO: 6555300 - DNA, 18 bp, Homo sapiens
tttaagccaaagaaacaa

SEQ ID NO: 6555301 - DNA, 20 bp, Homo sapiens
tttaagccaataaataatat

SEQ ID NO: 6555302 - DNA, 22 bp, Homo sapiens
tttaagccacaaagtttgtggt

SEQ ID NO: 6555303 - DNA, 14 bp, Homo sapiens
tttaagccccctct

SEQ ID NO: 6555304 - DNA, 14 bp, Homo sapiens
tttaagccctgctc

SEQ ID NO: 6555305 - DNA, 13 bp, Homo sapiens
tttaagccgcaga

SEQ ID NO: 6555306 - DNA, 17 bp, Homo sapiens
tttaagcctgcattctt

SEQ ID NO: 6555307 - DNA, 16 bp, Homo sapiens
tttaagccttacaaag

SEQ ID NO: 6555308 - DNA, 19 bp, Homo sapiens
tttaagccttacaaaggga

SEQ ID NO: 6555309 - DNA, 14 bp, Homo sapiens
tttaagccttgaca

SEQ ID NO: 6555310 - DNA, 14 bp, Homo sapiens
tttaagcctttgaa

SEQ ID NO: 6555311 - DNA, 23 bp, Homo sapiens
tttaagcctttgttgaactgtta

SEQ ID NO: 6555312 - DNA, 17 bp, Homo sapiens
tttaagccttttgtgta

SEQ ID NO: 6555313 - DNA, 19 bp, Homo sapiens
tttaagcgaggcagaatgg

SEQ ID NO: 6555314 - DNA, 20 bp, Homo sapiens
tttaagctaggaaaagaaat

SEQ ID NO: 6555315 - DNA, 22 bp, Homo sapiens
tttaagctaggaaaagaaatct

SEQ ID NO: 6555316 - DNA, 23 bp, Homo sapiens
tttaagctaggaaaagaaatcta

SEQ ID NO: 6555317 - DNA, 18 bp, Homo sapiens
tttaagctccagacatac

SEQ ID NO: 6555318 - DNA, 17 bp, Homo sapiens
tttaagctccagcttta

SEQ ID NO: 6555319 - DNA, 20 bp, Homo sapiens
tttaagctccatgtgcatat

SEQ ID NO: 6555320 - DNA, 19 bp, Homo sapiens
tttaagctctgagctgtca

SEQ ID NO: 6555321 - DNA, 15 bp, Homo sapiens
tttaagctctgcccc

SEQ ID NO: 6555322 - DNA, 16 bp, Homo sapiens
tttaagctctgcccct

SEQ ID NO: 6555323 - DNA, 21 bp, Homo sapiens
tttaagctgttactgtcttca

SEQ ID NO: 6555324 - DNA, 16 bp, Homo sapiens
tttaagcttaacattt

SEQ ID NO: 6555325 - DNA, 14 bp, Homo sapiens
tttaaggaaaacta

SEQ ID NO: 6555326 - DNA, 12 bp, Homo sapiens
tttaaggaaaca

SEQ ID NO: 6555327 - DNA, 15 bp, Homo sapiens
tttaaggaaaggcaa

SEQ ID NO: 6555328 - DNA, 12 bp, Homo sapiens
tttaaggaatat

SEQ ID NO: 6555329 - DNA, 21 bp, Homo sapiens
tttaaggagatgtaagagctt

SEQ ID NO: 6555330 - DNA, 22 bp, Homo sapiens
tttaaggagattgggagacaat

SEQ ID NO: 6555331 - DNA, 22 bp, Homo sapiens
tttaaggatgcttgtacataat

SEQ ID NO: 6555332 - DNA, 12 bp, Homo sapiens
tttaaggatgga

SEQ ID NO: 6555333 - DNA, 20 bp, Homo sapiens
tttaaggatggatggcaccc

SEQ ID NO: 6555334 - DNA, 15 bp, Homo sapiens
tttaaggattctgca

SEQ ID NO: 6555335 - DNA, 12 bp, Homo sapiens
tttaaggcaaaa

SEQ ID NO: 6555336 - DNA, 20 bp, Homo sapiens
tttaaggctgtgtgaatttt

SEQ ID NO: 6555337 - DNA, 22 bp, Homo sapiens
tttaaggcttcaatttattgca

SEQ ID NO: 6555338 - DNA, 19 bp, Homo sapiens
tttaagggcatgccttgtg

SEQ ID NO: 6555339 - DNA, 21 bp, Homo sapiens
tttaagggccctttttcaata

SEQ ID NO: 6555340 - DNA, 23 bp, Homo sapiens
tttaaggggatctaaaaaaatgt

SEQ ID NO: 6555341 - DNA, 15 bp, Homo sapiens
ttaaatttgtaagtt

SEQ ID NO: 6555342 - DNA, 17 bp, Homo sapiens
ttaaatttgtaagtttc

SEQ ID NO: 6555343 - DNA, 14 bp, Homo sapiens
ttaaatttgttctt

SEQ ID NO: 6555344 - DNA, 17 bp, Homo sapiens
ttaaatttgttctttgt

SEQ ID NO: 6555345 - DNA, 20 bp, Homo sapiens
ttaaatttgttctttgttta

SEQ ID NO: 6555346 - DNA, 18 bp, Homo sapiens
ttaaattttaaagcctga

SEQ ID NO: 6555347 - DNA, 17 bp, Homo sapiens
ttaaattttaaggtaga

SEQ ID NO: 6555348 - DNA, 16 bp, Homo sapiens
ttaaattttacccttt

SEQ ID NO: 6555349 - DNA, 20 bp, Homo sapiens
ttaaattttaccctttagac

SEQ ID NO: 6555350 - DNA, 22 bp, Homo sapiens
ttaaattttatttttattactt

SEQ ID NO: 6555351 - DNA, 17 bp, Homo sapiens
ttaaattttcagaaagc

SEQ ID NO: 6555352 - DNA, 19 bp, Homo sapiens
ttaaattttctctaaactg

SEQ ID NO: 6555353 - DNA, 15 bp, Homo sapiens
ttaaattttgagttc

SEQ ID NO: 6555354 - DNA, 20 bp, Homo sapiens
ttaaattttgagttctacat

SEQ ID NO: 6555355 - DNA, 12 bp, Homo sapiens
ttaaattttgta

SEQ ID NO: 6555356 - DNA, 19 bp, Homo sapiens
ttaaattttgtaggatttt

SEQ ID NO: 6555357 - DNA, 19 bp, Homo sapiens
ttaaattttgtatgccaat

SEQ ID NO: 6555358 - DNA, 16 bp, Homo sapiens
ttaaattttgtgtctc

SEQ ID NO: 6555359 - DNA, 18 bp, Homo sapiens
ttaaatttttgtcatttt

SEQ ID NO: 6555360 - DNA, 14 bp, Homo sapiens
ttaaattttttggc

SEQ ID NO: 6555361 - DNA, 18 bp, Homo sapiens
ttaaattttttgttgaca

SEQ ID NO: 6555362 - DNA, 22 bp, Homo sapiens
ttaaatttttttgtatgaaaac

SEQ ID NO: 6555363 - DNA, 22 bp, Homo sapiens
ttaacaaaaaaggaaaatgaac

SEQ ID NO: 6555364 - DNA, 18 bp, Homo sapiens
ttaacaaaacaagaaaga

SEQ ID NO: 6555365 - DNA, 18 bp, Homo sapiens
ttaacaaaagatttgttt

SEQ ID NO: 6555366 - DNA, 14 bp, Homo sapiens
ttaacaaacaggat

SEQ ID NO: 6555367 - DNA, 19 bp, Homo sapiens
ttaacaaaccaacatcttt

SEQ ID NO: 6555368 - DNA, 17 bp, Homo sapiens
ttaacaaactaaaaata

SEQ ID NO: 6555369 - DNA, 11 bp, Homo sapiens
ttaacaaataa

SEQ ID NO: 6555370 - DNA, 12 bp, Homo sapiens
ttaacaaataaa

SEQ ID NO: 6555371 - DNA, 12 bp, Homo sapiens
ttaacaaataca

SEQ ID NO: 6555372 - DNA, 20 bp, Homo sapiens
ttaacaaatctaatctctta

SEQ ID NO: 6555373 - DNA, 10 bp, Homo sapiens
ttaacaaatg

SEQ ID NO: 6555374 - DNA, 20 bp, Homo sapiens
ttaacaaatgctattaaagt

SEQ ID NO: 6555375 - DNA, 13 bp, Homo sapiens
ttaacaaattgca

SEQ ID NO: 6555376 - DNA, 19 bp, Homo sapiens
ttaacaaattgcatttgtg

SEQ ID NO: 6555377 - DNA, 22 bp, Homo sapiens
ttaacaacaataacactgtctc

SEQ ID NO: 6555378 - DNA, 20 bp, Homo sapiens
ttaacaactgactaaccatt

SEQ ID NO: 6555379 - DNA, 16 bp, Homo sapiens
ttaacaactgtgaata

SEQ ID NO: 6555380 - DNA, 14 bp, Homo sapiens
ttaacaacttgtct

SEQ ID NO: 6555381 - DNA, 14 bp, Homo sapiens
ttaacaagaacttt

SEQ ID NO: 6555382 - DNA, 16 bp, Homo sapiens
ttaacaagaagatgaa

SEQ ID NO: 6555383 - DNA, 19 bp, Homo sapiens
ttaacaagaggggaaaaca

SEQ ID NO: 6555384 - DNA, 17 bp, Homo sapiens
ttaacaagatgtttcat

SEQ ID NO: 6555385 - DNA, 19 bp, Homo sapiens
ttaacaagctcccaggccg

SEQ ID NO: 6555386 - DNA, 21 bp, Homo sapiens
ttaacaaggaatgcctgtgcc

SEQ ID NO: 6555387 - DNA, 21 bp, Homo sapiens
ttaacaataactactgtgttc

SEQ ID NO: 6555388 - DNA, 13 bp, Homo sapiens
ttaacaatgacaa

SEQ ID NO: 6555389 - DNA, 12 bp, Homo sapiens
ttaacaatgcaa

SEQ ID NO: 6555390 - DNA, 15 bp, Homo sapiens
ttaacaatgcctatt

SEQ ID NO: 6555391 - DNA, 19 bp, Homo sapiens
ttaacaatgcctattgtaa

SEQ ID NO: 6555392 - DNA, 13 bp, Homo sapiens
ttaacaatgtatt

SEQ ID NO: 6555393 - DNA, 21 bp, Homo sapiens
ttaacaatgtattttaataac

SEQ ID NO: 6555394 - DNA, 18 bp, Homo sapiens
ttaacaattgtcttaaaa

SEQ ID NO: 6555395 - DNA, 20 bp, Homo sapiens
ttaacacaatgtgaatttct

SEQ ID NO: 6555396 - DNA, 13 bp, Homo sapiens
ttaacacactgaa

SEQ ID NO: 6555397 - DNA, 20 bp, Homo sapiens
ttaacacagatcaagtgaac

SEQ ID NO: 6555398 - DNA, 19 bp, Homo sapiens
ttaacacagtgtttcaatt

SEQ ID NO: 6555399 - DNA, 13 bp, Homo sapiens
ttaacacattctt

SEQ ID NO: 6555400 - DNA, 20 bp, Homo sapiens
ttaacacctgatctggccca

SEQ ID NO: 6555401 - DNA, 16 bp, Homo sapiens
ttaacacctgatgtgt

SEQ ID NO: 6555402 - DNA, 17 bp, Homo sapiens
ttaacacctgatgtgta

SEQ ID NO: 6555403 - DNA, 19 bp, Homo sapiens
ttaacacctgatgtgtaca

SEQ ID NO: 6555404 - DNA, 20 bp, Homo sapiens
ttaacacctgatgtgtacat

SEQ ID NO: 6555405 - DNA, 18 bp, Homo sapiens
ttaacacctttaaagtgt

SEQ ID NO: 6555406 - DNA, 20 bp, Homo sapiens
ttaacacgctgcctggtctg

SEQ ID NO: 6555407 - DNA, 16 bp, Homo sapiens
ttaacactcatttcca

SEQ ID NO: 6555408 - DNA, 19 bp, Homo sapiens
ttaacactgagtgaaatat

SEQ ID NO: 6555409 - DNA, 18 bp, Homo sapiens
ttaacactggttaaatta

SEQ ID NO: 6555410 - DNA, 20 bp, Homo sapiens
ttaacactggttaaattaac

SEQ ID NO: 6555411 - DNA, 15 bp, Homo sapiens
ttaacacttaaattt

SEQ ID NO: 6555412 - DNA, 17 bp, Homo sapiens
ttaacagaaactttcaa

SEQ ID NO: 6555413 - DNA, 16 bp, Homo sapiens
ttaacagaaatgtaca

SEQ ID NO: 6555414 - DNA, 17 bp, Homo sapiens
ttaacagaaatgtttct

SEQ ID NO: 6555415 - DNA, 20 bp, Homo sapiens
ttaacagaagggagggcaga

SEQ ID NO: 6555416 - DNA, 12 bp, Homo sapiens
ttaacagaagtt

SEQ ID NO: 6555417 - DNA, 18 bp, Homo sapiens
ttaacagaagttgtgaaa

SEQ ID NO: 6555418 - DNA, 19 bp, Homo sapiens
ttaacagagctaagaaata

SEQ ID NO: 6555419 - DNA, 13 bp, Homo sapiens
ttaacagagtctg

SEQ ID NO: 6555420 - DNA, 18 bp, Homo sapiens
ttaacagagttttctgtt

SEQ ID NO: 6555421 - DNA, 18 bp, Homo sapiens
ttaacagatatttaaatt

SEQ ID NO: 6555422 - DNA, 22 bp, Homo sapiens
ttaacagatatttaaatttagt

SEQ ID NO: 6555423 - DNA, 12 bp, Homo sapiens
ttaacagcatga

SEQ ID NO: 6555424 - DNA, 14 bp, Homo sapiens
ttaacagcatgaca

SEQ ID NO: 6555425 - DNA, 20 bp, Homo sapiens
ttaacagcatgacaaaaatt

SEQ ID NO: 6555426 - DNA, 14 bp, Homo sapiens
ttaacagctttctc

SEQ ID NO: 6555427 - DNA, 18 bp, Homo sapiens
ttaacaggcaaacatttt

SEQ ID NO: 6555428 - DNA, 23 bp, Homo sapiens
ttaacaggcaaacattttctctt

SEQ ID NO: 6555429 - DNA, 21 bp, Homo sapiens
ttaacaggtctttgaaatatg

SEQ ID NO: 6555430 - DNA, 18 bp, Homo sapiens
ttaacaggttttcttcta

SEQ ID NO: 6555431 - DNA, 20 bp, Homo sapiens
ttaacaggttttcttctaat

SEQ ID NO: 6555432 - DNA, 13 bp, Homo sapiens
ttaacagtaaata

SEQ ID NO: 6555433 - DNA, 16 bp, Homo sapiens
ttaacagtaaatatac

SEQ ID NO: 6555434 - DNA, 17 bp, Homo sapiens
ttaacagtaaatataca

SEQ ID NO: 6555435 - DNA, 15 bp, Homo sapiens
ttaacagtacctgtg

SEQ ID NO: 6555436 - DNA, 18 bp, Homo sapiens
ttaacagtatttctcttt

SEQ ID NO: 6555437 - DNA, 22 bp, Homo sapiens
ttaacagtatttctcttttatt

SEQ ID NO: 6555438 - DNA, 17 bp, Homo sapiens
ttaacagtattttaaga

SEQ ID NO: 6555439 - DNA, 23 bp, Homo sapiens
ttaacagtggagctgaattttct

SEQ ID NO: 6555440 - DNA, 22 bp, Homo sapiens
ttaacagttcctttcaaaggag

SEQ ID NO: 6555441 - DNA, 13 bp, Homo sapiens
ttaacagttgtat

SEQ ID NO: 6555442 - DNA, 16 bp, Homo sapiens
ttaacagttttccatg

SEQ ID NO: 6555443 - DNA, 19 bp, Homo sapiens
ttaacagttttccatgaaa

SEQ ID NO: 6555444 - DNA, 21 bp, Homo sapiens
ttaacagttttccatgaaaac

SEQ ID NO: 6555445 - DNA, 21 bp, Homo sapiens
ttaacataaaggttattttct

SEQ ID NO: 6555446 - DNA, 11 bp, Homo sapiens
ttaacataatg

SEQ ID NO: 6555447 - DNA, 23 bp, Homo sapiens
ttaacataatggttgtgaaatgt

SEQ ID NO: 6555448 - DNA, 12 bp, Homo sapiens
ttaacataccta

SEQ ID NO: 6555449 - DNA, 13 bp, Homo sapiens
ttaacataggttt

SEQ ID NO: 6555450 - DNA, 22 bp, Homo sapiens
ttaacatagtaagttcagcact

SEQ ID NO: 6555451 - DNA, 23 bp, Homo sapiens
ttaacatagtaagttcagcactt

SEQ ID NO: 6555452 - DNA, 15 bp, Homo sapiens
ttaacatagtcctgt

SEQ ID NO: 6555453 - DNA, 18 bp, Homo sapiens
ttaacatataatatatgt

SEQ ID NO: 6555454 - DNA, 13 bp, Homo sapiens
ttaacatatatat

SEQ ID NO: 6555455 - DNA, 16 bp, Homo sapiens
ttaacatattatttca

SEQ ID NO: 6555456 - DNA, 20 bp, Homo sapiens
ttaacatcactacaaaaaga

SEQ ID NO: 6555457 - DNA, 22 bp, Homo sapiens
ttaacatcagaactgaaataaa

SEQ ID NO: 6555458 - DNA, 19 bp, Homo sapiens
ttaacatcagtgtctgttt

SEQ ID NO: 6555459 - DNA, 17 bp, Homo sapiens
ttaacatctattataaa

SEQ ID NO: 6555460 - DNA, 22 bp, Homo sapiens
ttaacatctgcagtgttctgtg

SEQ ID NO: 6555461 - DNA, 16 bp, Homo sapiens
ttaacatgatgtacta

SEQ ID NO: 6555462 - DNA, 17 bp, Homo sapiens
ttaacatgcaataacaa

SEQ ID NO: 6555463 - DNA, 18 bp, Homo sapiens
ttaacatgcaataacaag

SEQ ID NO: 6555464 - DNA, 22 bp, Homo sapiens
ttaacatggaatttaatttatg

SEQ ID NO: 6555465 - DNA, 12 bp, Homo sapiens
ttaacatgttaa

SEQ ID NO: 6555466 - DNA, 19 bp, Homo sapiens
ttaacattagatgtcatga

SEQ ID NO: 6555467 - DNA, 19 bp, Homo sapiens
ttaacattccaagactcta

SEQ ID NO: 6555468 - DNA, 11 bp, Homo sapiens
ttaacattcct

SEQ ID NO: 6555469 - DNA, 14 bp, Homo sapiens
ttaacattgaccaa

SEQ ID NO: 6555470 - DNA, 13 bp, Homo sapiens
ttaacattgattg

SEQ ID NO: 6555471 - DNA, 14 bp, Homo sapiens
ttaacatttcatgt

SEQ ID NO: 6555472 - DNA, 12 bp, Homo sapiens
ttaacatttgcc

SEQ ID NO: 6555473 - DNA, 13 bp, Homo sapiens
ttaacatttgcct

SEQ ID NO: 6555474 - DNA, 15 bp, Homo sapiens
ttaacattttggaaa

SEQ ID NO: 6555475 - DNA, 18 bp, Homo sapiens
ttaaccaaaggtgaagga

SEQ ID NO: 6555476 - DNA, 16 bp, Homo sapiens
ttaaccaaataaaaca

SEQ ID NO: 6555477 - DNA, 20 bp, Homo sapiens
ttaaccaaattaacctttca

SEQ ID NO: 6555478 - DNA, 20 bp, Homo sapiens
ttaaccaagtcgctcctagg

SEQ ID NO: 6555479 - DNA, 22 bp, Homo sapiens
ttaaccaccgcatatgcatgcc

SEQ ID NO: 6555480 - DNA, 17 bp, Homo sapiens
ttaaccactctacagac

SEQ ID NO: 6555481 - DNA, 18 bp, Homo sapiens
ttaaccactctacagact

SEQ ID NO: 6555482 - DNA, 17 bp, Homo sapiens
ttaaccacttcagctga

SEQ ID NO: 6555483 - DNA, 17 bp, Homo sapiens
ttaaccacttgcctctt

SEQ ID NO: 6555484 - DNA, 13 bp, Homo sapiens
ttaaccagatcta

SEQ ID NO: 6555485 - DNA, 22 bp, Homo sapiens
ttaaccagatctagtcaatcaa

SEQ ID NO: 6555486 - DNA, 21 bp, Homo sapiens
ttaaccagtctgaagtttcat

SEQ ID NO: 6555487 - DNA, 22 bp, Homo sapiens
ttaaccagtctgaagtttcatt

SEQ ID NO: 6555488 - DNA, 16 bp, Homo sapiens
ttaaccagttgtggtg

SEQ ID NO: 6555489 - DNA, 14 bp, Homo sapiens
ttaaccataaatca

SEQ ID NO: 6555490 - DNA, 13 bp, Homo sapiens
ttaaccattgtct

SEQ ID NO: 6555491 - DNA, 14 bp, Homo sapiens
ttaaccatttaata

SEQ ID NO: 6555492 - DNA, 22 bp, Homo sapiens
ttaaccatttaataaagaaata

SEQ ID NO: 6555493 - DNA, 16 bp, Homo sapiens
ttaacccaatggagac

SEQ ID NO: 6555494 - DNA, 13 bp, Homo sapiens
ttaacccagtgtt

SEQ ID NO: 6555495 - DNA, 16 bp, Homo sapiens
ttaacccattattcct

SEQ ID NO: 6555496 - DNA, 15 bp, Homo sapiens
ttaaccccaaaggtg

SEQ ID NO: 6555497 - DNA, 21 bp, Homo sapiens
ttaacccccatttttgtaata

SEQ ID NO: 6555498 - DNA, 18 bp, Homo sapiens
ttaacccccctgtacaca

SEQ ID NO: 6555499 - DNA, 17 bp, Homo sapiens
ttaaccccgtcaacaaa

SEQ ID NO: 6555500 - DNA, 15 bp, Homo sapiens
ttaaccctaatcttt

SEQ ID NO: 6555501 - DNA, 14 bp, Homo sapiens
ttaaccctgaacaa

SEQ ID NO: 6555502 - DNA, 20 bp, Homo sapiens
ttaaccgaagaactaataaa

SEQ ID NO: 6555503 - DNA, 16 bp, Homo sapiens
ttaaccgtttttcaag

SEQ ID NO: 6555504 - DNA, 17 bp, Homo sapiens
ttaacctaatatcactt

SEQ ID NO: 6555505 - DNA, 23 bp, Homo sapiens
ttaacctacttgtaaacttgaaa

SEQ ID NO: 6555506 - DNA, 17 bp, Homo sapiens
ttaacctagatgtttaa

SEQ ID NO: 6555507 - DNA, 20 bp, Homo sapiens
ttaacctatgatattttctg

SEQ ID NO: 6555508 - DNA, 14 bp, Homo sapiens
ttaacctatttcca

SEQ ID NO: 6555509 - DNA, 15 bp, Homo sapiens
ttaacctcagtgtca

SEQ ID NO: 6555510 - DNA, 19 bp, Homo sapiens
ttaacctcagtgtcattta

SEQ ID NO: 6555511 - DNA, 19 bp, Homo sapiens
ttaacctctctaagccaca

SEQ ID NO: 6555512 - DNA, 12 bp, Homo sapiens
ttaacctctgca

SEQ ID NO: 6555513 - DNA, 20 bp, Homo sapiens
ttaacctgcatgcagcaaca

SEQ ID NO: 6555514 - DNA, 14 bp, Homo sapiens
ttaacctgggacca

SEQ ID NO: 6555515 - DNA, 13 bp, Homo sapiens
ttaacctggtgct

SEQ ID NO: 6555516 - DNA, 16 bp, Homo sapiens
ttaacctgttatttct

SEQ ID NO: 6555517 - DNA, 18 bp, Homo sapiens
ttaacctgtttatataat

SEQ ID NO: 6555518 - DNA, 21 bp, Homo sapiens
ttaaccttaaaattgatatta

SEQ ID NO: 6555519 - DNA, 18 bp, Homo sapiens
ttaaccttaaatacactg

SEQ ID NO: 6555520 - DNA, 20 bp, Homo sapiens
tttaagggtttgtggaaaat

SEQ ID NO: 6555521 - DNA, 19 bp, Homo sapiens
tttaaggtctaatcagtga

SEQ ID NO: 6555522 - DNA, 17 bp, Homo sapiens
tttaaggtctgtttgct

SEQ ID NO: 6555523 - DNA, 14 bp, Homo sapiens
tttaaggttaatta

SEQ ID NO: 6555524 - DNA, 16 bp, Homo sapiens
tttaaggttgaaaaga

SEQ ID NO: 6555525 - DNA, 17 bp, Homo sapiens
tttaaggtttcaacaaa

SEQ ID NO: 6555526 - DNA, 17 bp, Homo sapiens
tttaagtaaaaaagaaa

SEQ ID NO: 6555527 - DNA, 15 bp, Homo sapiens
tttaagtaactttaa

SEQ ID NO: 6555528 - DNA, 14 bp, Homo sapiens
tttaagtaagtaag

SEQ ID NO: 6555529 - DNA, 16 bp, Homo sapiens
tttaagtaatgtggaa

SEQ ID NO: 6555530 - DNA, 17 bp, Homo sapiens
tttaagtactatctttg

SEQ ID NO: 6555531 - DNA, 23 bp, Homo sapiens
tttaagtagaaaagttgcagatg

SEQ ID NO: 6555532 - DNA, 21 bp, Homo sapiens
tttaagtatatagtatattta

SEQ ID NO: 6555533 - DNA, 14 bp, Homo sapiens
tttaagtatgagtt

SEQ ID NO: 6555534 - DNA, 16 bp, Homo sapiens
tttaagtatggaatat

SEQ ID NO: 6555535 - DNA, 16 bp, Homo sapiens
tttaagtattcaagaa

SEQ ID NO: 6555536 - DNA, 19 bp, Homo sapiens
tttaagtattgtttcctga

SEQ ID NO: 6555537 - DNA, 13 bp, Homo sapiens
tttaagtatttat

SEQ ID NO: 6555538 - DNA, 23 bp, Homo sapiens
tttaagtcagaagcccattaaaa

SEQ ID NO: 6555539 - DNA, 13 bp, Homo sapiens
tttaagtcatttt

SEQ ID NO: 6555540 - DNA, 18 bp, Homo sapiens
tttaagtcattttttact

SEQ ID NO: 6555541 - DNA, 23 bp, Homo sapiens
tttaagtcattttttacttgaat

SEQ ID NO: 6555542 - DNA, 15 bp, Homo sapiens
tttaagtccctgtca

SEQ ID NO: 6555543 - DNA, 22 bp, Homo sapiens
tttaagtcgggaaattctgctg

SEQ ID NO: 6555544 - DNA, 14 bp, Homo sapiens
tttaagtgaaattt

SEQ ID NO: 6555545 - DNA, 20 bp, Homo sapiens
tttaagtgaatacattaacg

SEQ ID NO: 6555546 - DNA, 17 bp, Homo sapiens
tttaagtgcaacatttc

SEQ ID NO: 6555547 - DNA, 17 bp, Homo sapiens
tttaagtggactgtatt

SEQ ID NO: 6555548 - DNA, 18 bp, Homo sapiens
tttaagtggactgtattt

SEQ ID NO: 6555549 - DNA, 20 bp, Homo sapiens
tttaagtggggttgataaca

SEQ ID NO: 6555550 - DNA, 19 bp, Homo sapiens
tttaagtgggtttttatga

SEQ ID NO: 6555551 - DNA, 22 bp, Homo sapiens
tttaagtgtaactggcagtttt

SEQ ID NO: 6555552 - DNA, 14 bp, Homo sapiens
tttaagtgtgctgg

SEQ ID NO: 6555553 - DNA, 19 bp, Homo sapiens
tttaagtgttctgtggctg

SEQ ID NO: 6555554 - DNA, 18 bp, Homo sapiens
tttaagttacacattttt

SEQ ID NO: 6555555 - DNA, 23 bp, Homo sapiens
tttaagttctggatgcatttctc

SEQ ID NO: 6555556 - DNA, 20 bp, Homo sapiens
tttaagttggctagagcttc

SEQ ID NO: 6555557 - DNA, 12 bp, Homo sapiens
tttaagttgtaa

SEQ ID NO: 6555558 - DNA, 15 bp, Homo sapiens
tttaagttgtaaacg

SEQ ID NO: 6555559 - DNA, 19 bp, Homo sapiens
tttaagttgtaaacgtctt

SEQ ID NO: 6555560 - DNA, 18 bp, Homo sapiens
tttaagttgtcaaagaag

SEQ ID NO: 6555561 - DNA, 14 bp, Homo sapiens
tttaagttgtttgc

SEQ ID NO: 6555562 - DNA, 13 bp, Homo sapiens
tttaagtttgaaa

SEQ ID NO: 6555563 - DNA, 14 bp, Homo sapiens
tttaagtttgcact

SEQ ID NO: 6555564 - DNA, 18 bp, Homo sapiens
tttaagtttgcactcaaa

SEQ ID NO: 6555565 - DNA, 20 bp, Homo sapiens
tttaagttttatttaacttt

SEQ ID NO: 6555566 - DNA, 18 bp, Homo sapiens
tttaagttttgacaagct

SEQ ID NO: 6555567 - DNA, 20 bp, Homo sapiens
tttaagttttttatagagat

SEQ ID NO: 6555568 - DNA, 16 bp, Homo sapiens
tttaataaaaaggaaa

SEQ ID NO: 6555569 - DNA, 20 bp, Homo sapiens
tttaataaaacaacaacaaa

SEQ ID NO: 6555570 - DNA, 17 bp, Homo sapiens
tttaataaaataattct

SEQ ID NO: 6555571 - DNA, 22 bp, Homo sapiens
tttaataaacactcttgaaaaa

SEQ ID NO: 6555572 - DNA, 20 bp, Homo sapiens
tttaataaactactctttga

SEQ ID NO: 6555573 - DNA, 23 bp, Homo sapiens
tttaataaagaaatatttaccta

SEQ ID NO: 6555574 - DNA, 19 bp, Homo sapiens
tttaataaagcgaaaaact

SEQ ID NO: 6555575 - DNA, 12 bp, Homo sapiens
tttaataaagct

SEQ ID NO: 6555576 - DNA, 13 bp, Homo sapiens
tttaataaagctt

SEQ ID NO: 6555577 - DNA, 20 bp, Homo sapiens
tttaataaagtatattgaaa

SEQ ID NO: 6555578 - DNA, 20 bp, Homo sapiens
tttaataaagtatgaatatt

SEQ ID NO: 6555579 - DNA, 22 bp, Homo sapiens
tttaataacaaggagatttctt

SEQ ID NO: 6555580 - DNA, 14 bp, Homo sapiens
tttaataacaattg

SEQ ID NO: 6555581 - DNA, 13 bp, Homo sapiens
tttaataagaaca

SEQ ID NO: 6555582 - DNA, 13 bp, Homo sapiens
tttaataaggaaa

SEQ ID NO: 6555583 - DNA, 13 bp, Homo sapiens
tttaataataaaa

SEQ ID NO: 6555584 - DNA, 19 bp, Homo sapiens
tttaataatatgtacaaat

SEQ ID NO: 6555585 - DNA, 23 bp, Homo sapiens
tttaataatatgtacaaataata

SEQ ID NO: 6555586 - DNA, 22 bp, Homo sapiens
tttaataatgtatgtacagctg

SEQ ID NO: 6555587 - DNA, 14 bp, Homo sapiens
tttaataatgtttc

SEQ ID NO: 6555588 - DNA, 19 bp, Homo sapiens
tttaataatgtttcaaaca

SEQ ID NO: 6555589 - DNA, 15 bp, Homo sapiens
tttaataattagaaa

SEQ ID NO: 6555590 - DNA, 14 bp, Homo sapiens
tttaataattatat

SEQ ID NO: 6555591 - DNA, 15 bp, Homo sapiens
tttaataatttcatc

SEQ ID NO: 6555592 - DNA, 20 bp, Homo sapiens
tttaatacagctcagtaaat

SEQ ID NO: 6555593 - DNA, 17 bp, Homo sapiens
tttaatacaggaaattg

SEQ ID NO: 6555594 - DNA, 17 bp, Homo sapiens
tttaatacctttggaaa

SEQ ID NO: 6555595 - DNA, 15 bp, Homo sapiens
tttaatacttttcca

SEQ ID NO: 6555596 - DNA, 15 bp, Homo sapiens
tttaatagcctgtca

SEQ ID NO: 6555597 - DNA, 21 bp, Homo sapiens
tttaatagcgtcataactaga

SEQ ID NO: 6555598 - DNA, 21 bp, Homo sapiens
tttaataggtttggacaaaat

SEQ ID NO: 6555599 - DNA, 22 bp, Homo sapiens
tttaatagtatatctaatggct

SEQ ID NO: 6555600 - DNA, 12 bp, Homo sapiens
tttaatagtgtt

SEQ ID NO: 6555601 - DNA, 17 bp, Homo sapiens
tttaatagtgttaatca

SEQ ID NO: 6555602 - DNA, 16 bp, Homo sapiens
tttaatagtttctaaa

SEQ ID NO: 6555603 - DNA, 22 bp, Homo sapiens
tttaatataaaagatatatata

SEQ ID NO: 6555604 - DNA, 22 bp, Homo sapiens
tttaatataaagttttatatat

SEQ ID NO: 6555605 - DNA, 23 bp, Homo sapiens
tttaatataaagttttatatatt

SEQ ID NO: 6555606 - DNA, 20 bp, Homo sapiens
tttaatatactaaccatttc

SEQ ID NO: 6555607 - DNA, 22 bp, Homo sapiens
tttaatatactccttaaaaatg

SEQ ID NO: 6555608 - DNA, 15 bp, Homo sapiens
tttaatatagctatt

SEQ ID NO: 6555609 - DNA, 19 bp, Homo sapiens
tttaatatataatttaatg

SEQ ID NO: 6555610 - DNA, 23 bp, Homo sapiens
tttaatatctgagaagtgtatat

SEQ ID NO: 6555611 - DNA, 17 bp, Homo sapiens
tttaatatgagcttcaa

SEQ ID NO: 6555612 - DNA, 12 bp, Homo sapiens
tttaatatgcat

SEQ ID NO: 6555613 - DNA, 13 bp, Homo sapiens
tttaatatgtatt

SEQ ID NO: 6555614 - DNA, 13 bp, Homo sapiens
tttaatatgttga

SEQ ID NO: 6555615 - DNA, 14 bp, Homo sapiens
tttaatattaaagc

SEQ ID NO: 6555616 - DNA, 15 bp, Homo sapiens
tttaatattaaagcc

SEQ ID NO: 6555617 - DNA, 24 bp, Homo sapiens
tttaatattacctaatgaaagtga

SEQ ID NO: 6555618 - DNA, 14 bp, Homo sapiens
tttaatattactgt

SEQ ID NO: 6555619 - DNA, 17 bp, Homo sapiens
tttaatattactgtctt

SEQ ID NO: 6555620 - DNA, 18 bp, Homo sapiens
tttaatattgatgtcagt

SEQ ID NO: 6555621 - DNA, 13 bp, Homo sapiens
tttaatatttaaa

SEQ ID NO: 6555622 - DNA, 18 bp, Homo sapiens
tttaatatttaaacagca

SEQ ID NO: 6555623 - DNA, 17 bp, Homo sapiens
tttaatatttatagagt

SEQ ID NO: 6555624 - DNA, 18 bp, Homo sapiens
tttaatatttatgtttaa

SEQ ID NO: 6555625 - DNA, 18 bp, Homo sapiens
tttaatatttttcaaaat

SEQ ID NO: 6555626 - DNA, 12 bp, Homo sapiens
tttaatcaatgt

SEQ ID NO: 6555627 - DNA, 21 bp, Homo sapiens
tttaatcaatgtgacatgttg

SEQ ID NO: 6555628 - DNA, 14 bp, Homo sapiens
tttaatcagtgaag

SEQ ID NO: 6555629 - DNA, 14 bp, Homo sapiens
tttaatcatgaaat

SEQ ID NO: 6555630 - DNA, 18 bp, Homo sapiens
tttaatcatgagcctgtt

SEQ ID NO: 6555631 - DNA, 21 bp, Homo sapiens
tttaatcatgagcctgtttat

SEQ ID NO: 6555632 - DNA, 12 bp, Homo sapiens
tttaatccagtt

SEQ ID NO: 6555633 - DNA, 13 bp, Homo sapiens
tttaatccatttt

SEQ ID NO: 6555634 - DNA, 22 bp, Homo sapiens
tttaatccccagtaaaattgcc

SEQ ID NO: 6555635 - DNA, 20 bp, Homo sapiens
tttaatcctgtaccaaatct

SEQ ID NO: 6555636 - DNA, 21 bp, Homo sapiens
tttaatccttctagtttccca

SEQ ID NO: 6555637 - DNA, 15 bp, Homo sapiens
tttaatcgtttttgt

SEQ ID NO: 6555638 - DNA, 17 bp, Homo sapiens
tttaatcgtttttgttt

SEQ ID NO: 6555639 - DNA, 16 bp, Homo sapiens
tttaatctaaaatgat

SEQ ID NO: 6555640 - DNA, 15 bp, Homo sapiens
tttaatctaaattta

SEQ ID NO: 6555641 - DNA, 16 bp, Homo sapiens
tttaatctactgcatt

SEQ ID NO: 6555642 - DNA, 18 bp, Homo sapiens
tttaatctactgcattta

SEQ ID NO: 6555643 - DNA, 19 bp, Homo sapiens
tttaatctctctctctttt

SEQ ID NO: 6555644 - DNA, 17 bp, Homo sapiens
tttaatcttagctttta

SEQ ID NO: 6555645 - DNA, 13 bp, Homo sapiens
tttaatcttatct

SEQ ID NO: 6555646 - DNA, 13 bp, Homo sapiens
tttaatcttttat

SEQ ID NO: 6555647 - DNA, 18 bp, Homo sapiens
tttaatcttttatgattg

SEQ ID NO: 6555648 - DNA, 19 bp, Homo sapiens
tttaatctttttgtttttc

SEQ ID NO: 6555649 - DNA, 21 bp, Homo sapiens
tttaatgaaagactgtacaaa

SEQ ID NO: 6555650 - DNA, 16 bp, Homo sapiens
tttaatgaacaaatgg

SEQ ID NO: 6555651 - DNA, 22 bp, Homo sapiens
tttaatgaagacccagtgtaaa

SEQ ID NO: 6555652 - DNA, 16 bp, Homo sapiens
tttaatgaagatctaa

SEQ ID NO: 6555653 - DNA, 21 bp, Homo sapiens
tttaatgaatttaaggcaaaa

SEQ ID NO: 6555654 - DNA, 12 bp, Homo sapiens
tttaatgacttt

SEQ ID NO: 6555655 - DNA, 17 bp, Homo sapiens
tttaatgactttttata

SEQ ID NO: 6555656 - DNA, 13 bp, Homo sapiens
tttaatgagaaaa

SEQ ID NO: 6555657 - DNA, 15 bp, Homo sapiens
tttaatgagaaaaaa

SEQ ID NO: 6555658 - DNA, 21 bp, Homo sapiens
tttaatgagaatagaaacgta

SEQ ID NO: 6555659 - DNA, 16 bp, Homo sapiens
tttaatgattgtttaa

SEQ ID NO: 6555660 - DNA, 20 bp, Homo sapiens
tttaatgcagaaaaggaaga

SEQ ID NO: 6555661 - DNA, 19 bp, Homo sapiens
tttaatgcattaaacctgt

SEQ ID NO: 6555662 - DNA, 23 bp, Homo sapiens
tttaatgccgatatactctagat

SEQ ID NO: 6555663 - DNA, 12 bp, Homo sapiens
tttaatgccttc

SEQ ID NO: 6555664 - DNA, 13 bp, Homo sapiens
tttaatgccttcc

SEQ ID NO: 6555665 - DNA, 13 bp, Homo sapiens
tttaatgctgcct

SEQ ID NO: 6555666 - DNA, 13 bp, Homo sapiens
tttaatgcttaag

SEQ ID NO: 6555667 - DNA, 18 bp, Homo sapiens
tttaatgcttaagatttg

SEQ ID NO: 6555668 - DNA, 21 bp, Homo sapiens
tttaatggacatgagataatg

SEQ ID NO: 6555669 - DNA, 17 bp, Homo sapiens
tttaatggatatttctc

SEQ ID NO: 6555670 - DNA, 18 bp, Homo sapiens
tttaatggatgtataata

SEQ ID NO: 6555671 - DNA, 17 bp, Homo sapiens
tttaatggcagcagaaa

SEQ ID NO: 6555672 - DNA, 22 bp, Homo sapiens
tttaatggccggctggaaatgc

SEQ ID NO: 6555673 - DNA, 15 bp, Homo sapiens
tttaatgggatttca

SEQ ID NO: 6555674 - DNA, 18 bp, Homo sapiens
tttaatggggtctgtaaa

SEQ ID NO: 6555675 - DNA, 19 bp, Homo sapiens
tttaatggggtgcacctgt

SEQ ID NO: 6555676 - DNA, 14 bp, Homo sapiens
tttaatgtaaaatt

SEQ ID NO: 6555677 - DNA, 14 bp, Homo sapiens
tttaatgtacaagt

SEQ ID NO: 6555678 - DNA, 13 bp, Homo sapiens
tttaatgtagaac

SEQ ID NO: 6555679 - DNA, 22 bp, Homo sapiens
tttaatgtatatttgctgcaaa

SEQ ID NO: 6555680 - DNA, 15 bp, Homo sapiens
tttaatgtatctatt

SEQ ID NO: 6555681 - DNA, 18 bp, Homo sapiens
tttaatgtatctatttgt

SEQ ID NO: 6555682 - DNA, 13 bp, Homo sapiens
tttaatgtatctt

SEQ ID NO: 6555683 - DNA, 15 bp, Homo sapiens
tttaatgtatcttaa

SEQ ID NO: 6555684 - DNA, 19 bp, Homo sapiens
tttaatgtctcctttgctc

SEQ ID NO: 6555685 - DNA, 16 bp, Homo sapiens
tttaatgtgaacttgt

SEQ ID NO: 6555686 - DNA, 13 bp, Homo sapiens
tttaatgtgaatt

SEQ ID NO: 6555687 - DNA, 21 bp, Homo sapiens
tttaatgtgatgatgtaattg

SEQ ID NO: 6555688 - DNA, 20 bp, Homo sapiens
tttaatgtgctgtgtaaagt

SEQ ID NO: 6555689 - DNA, 19 bp, Homo sapiens
tttaatgtggcaagtttgc

SEQ ID NO: 6555690 - DNA, 17 bp, Homo sapiens
tttaatgtgtattgaag

SEQ ID NO: 6555691 - DNA, 23 bp, Homo sapiens
tttaatgttgaacaaaataaatt

SEQ ID NO: 6555692 - DNA, 21 bp, Homo sapiens
tttaatgtttaaaacatcatt

SEQ ID NO: 6555693 - DNA, 17 bp, Homo sapiens
tttaatgtttattattt

SEQ ID NO: 6555694 - DNA, 21 bp, Homo sapiens
tttaatgtttctgatttctga

SEQ ID NO: 6555695 - DNA, 12 bp, Homo sapiens
tttaatgtttga

SEQ ID NO: 6555696 - DNA, 17 bp, Homo sapiens
tttaatgtttgtaagca

SEQ ID NO: 6555697 - DNA, 17 bp, Homo sapiens
tttaatgttttctgctg

SEQ ID NO: 6555698 - DNA, 18 bp, Homo sapiens
tttaatgtttttttgtag

SEQ ID NO: 6555699 - DNA, 18 bp, Homo sapiens
ttaaccttgccttagaaa

SEQ ID NO: 6555700 - DNA, 21 bp, Homo sapiens
ttaaccttgtataaattattc

SEQ ID NO: 6555701 - DNA, 16 bp, Homo sapiens
ttaacctttaagtctt

SEQ ID NO: 6555702 - DNA, 14 bp, Homo sapiens
ttaacggtgctaaa

SEQ ID NO: 6555703 - DNA, 15 bp, Homo sapiens
ttaacggtgctaaaa

SEQ ID NO: 6555704 - DNA, 20 bp, Homo sapiens
ttaacgtgggattcagagaa

SEQ ID NO: 6555705 - DNA, 14 bp, Homo sapiens
ttaacgtttctcat

SEQ ID NO: 6555706 - DNA, 17 bp, Homo sapiens
ttaactaaattttaaag

SEQ ID NO: 6555707 - DNA, 22 bp, Homo sapiens
ttaactaatatttgtctgtgtg

SEQ ID NO: 6555708 - DNA, 23 bp, Homo sapiens
ttaactaatctattgggttcatt

SEQ ID NO: 6555709 - DNA, 15 bp, Homo sapiens
ttaactaatttaaac

SEQ ID NO: 6555710 - DNA, 16 bp, Homo sapiens
ttaactaatttaaacc

SEQ ID NO: 6555711 - DNA, 23 bp, Homo sapiens
ttaactaatttaaaccagcagaa

SEQ ID NO: 6555712 - DNA, 17 bp, Homo sapiens
ttaactacatctgcctc

SEQ ID NO: 6555713 - DNA, 20 bp, Homo sapiens
ttaactacccttaattactt

SEQ ID NO: 6555714 - DNA, 21 bp, Homo sapiens
ttaactacccttaattactta

SEQ ID NO: 6555715 - DNA, 18 bp, Homo sapiens
ttaactactatattgatt

SEQ ID NO: 6555716 - DNA, 21 bp, Homo sapiens
ttaactactttactaaattaa

SEQ ID NO: 6555717 - DNA, 20 bp, Homo sapiens
ttaactagatacagaataat

SEQ ID NO: 6555718 - DNA, 15 bp, Homo sapiens
ttaactataaatatg

SEQ ID NO: 6555719 - DNA, 18 bp, Homo sapiens
ttaactataacaatcact

SEQ ID NO: 6555720 - DNA, 17 bp, Homo sapiens
ttaactatcaccagtgc

SEQ ID NO: 6555721 - DNA, 21 bp, Homo sapiens
ttaactatgacagatatattt

SEQ ID NO: 6555722 - DNA, 14 bp, Homo sapiens
ttaactatgtaata

SEQ ID NO: 6555723 - DNA, 15 bp, Homo sapiens
ttaactatgtgatgt

SEQ ID NO: 6555724 - DNA, 16 bp, Homo sapiens
ttaactatgtgatgtt

SEQ ID NO: 6555725 - DNA, 12 bp, Homo sapiens
ttaactatttca

SEQ ID NO: 6555726 - DNA, 15 bp, Homo sapiens
ttaactcaaaagttg

SEQ ID NO: 6555727 - DNA, 12 bp, Homo sapiens
ttaactcagcca

SEQ ID NO: 6555728 - DNA, 18 bp, Homo sapiens
ttaactcaggatgccaag

SEQ ID NO: 6555729 - DNA, 23 bp, Homo sapiens
ttaactcatctgttatcctgcta

SEQ ID NO: 6555730 - DNA, 12 bp, Homo sapiens
ttaactccctcc

SEQ ID NO: 6555731 - DNA, 20 bp, Homo sapiens
ttaactccctttttacactt

SEQ ID NO: 6555732 - DNA, 23 bp, Homo sapiens
ttaactccctttttacactttat

SEQ ID NO: 6555733 - DNA, 16 bp, Homo sapiens
ttaactcgttgcagtc

SEQ ID NO: 6555734 - DNA, 17 bp, Homo sapiens
ttaactctctttatgtc

SEQ ID NO: 6555735 - DNA, 14 bp, Homo sapiens
ttaactctggattt

SEQ ID NO: 6555736 - DNA, 18 bp, Homo sapiens
ttaactctggattttgaa

SEQ ID NO: 6555737 - DNA, 21 bp, Homo sapiens
ttaactctgtaaaagtgtctg

SEQ ID NO: 6555738 - DNA, 19 bp, Homo sapiens
ttaactgaaaatgtaaatt

SEQ ID NO: 6555739 - DNA, 13 bp, Homo sapiens
ttaactgaagaaa

SEQ ID NO: 6555740 - DNA, 19 bp, Homo sapiens
ttaactgaagatgttgaga

SEQ ID NO: 6555741 - DNA, 14 bp, Homo sapiens
ttaactgaagcaaa

SEQ ID NO: 6555742 - DNA, 20 bp, Homo sapiens
ttaactgaagcaaataccaa

SEQ ID NO: 6555743 - DNA, 16 bp, Homo sapiens
ttaactgaataccact

SEQ ID NO: 6555744 - DNA, 13 bp, Homo sapiens
ttaactgacatgg

SEQ ID NO: 6555745 - DNA, 21 bp, Homo sapiens
ttaactgagggctgatcttta

SEQ ID NO: 6555746 - DNA, 14 bp, Homo sapiens
ttaactgcactcat

SEQ ID NO: 6555747 - DNA, 18 bp, Homo sapiens
ttaactgccaaaacaaga

SEQ ID NO: 6555748 - DNA, 21 bp, Homo sapiens
ttaactgccaatccttaaata

SEQ ID NO: 6555749 - DNA, 19 bp, Homo sapiens
ttaactgccgtaatttaac

SEQ ID NO: 6555750 - DNA, 12 bp, Homo sapiens
ttaactgccttt

SEQ ID NO: 6555751 - DNA, 13 bp, Homo sapiens
ttaactggccctc

SEQ ID NO: 6555752 - DNA, 23 bp, Homo sapiens
ttaactgggtacccaaaacacat

SEQ ID NO: 6555753 - DNA, 22 bp, Homo sapiens
ttaactggtaagcgatttgaaa

SEQ ID NO: 6555754 - DNA, 22 bp, Homo sapiens
ttaactggtgcactttgtaaat

SEQ ID NO: 6555755 - DNA, 15 bp, Homo sapiens
ttaactgtaaacttg

SEQ ID NO: 6555756 - DNA, 14 bp, Homo sapiens
ttaactgtgaataa

SEQ ID NO: 6555757 - DNA, 13 bp, Homo sapiens
ttaactgtggata

SEQ ID NO: 6555758 - DNA, 18 bp, Homo sapiens
ttaactgttcttggaaaa

SEQ ID NO: 6555759 - DNA, 15 bp, Homo sapiens
ttaacttaaaagaac

SEQ ID NO: 6555760 - DNA, 21 bp, Homo sapiens
ttaacttaaaagaacatagga

SEQ ID NO: 6555761 - DNA, 13 bp, Homo sapiens
ttaacttaaatag

SEQ ID NO: 6555762 - DNA, 20 bp, Homo sapiens
ttaacttaacccagatttta

SEQ ID NO: 6555763 - DNA, 15 bp, Homo sapiens
ttaacttaactgaag

SEQ ID NO: 6555764 - DNA, 15 bp, Homo sapiens
ttaacttaatggcac

SEQ ID NO: 6555765 - DNA, 23 bp, Homo sapiens
ttaacttaatggcacaaagtctt

SEQ ID NO: 6555766 - DNA, 20 bp, Homo sapiens
ttaacttacatgactttctt

SEQ ID NO: 6555767 - DNA, 13 bp, Homo sapiens
ttaacttacattt

SEQ ID NO: 6555768 - DNA, 21 bp, Homo sapiens
ttaacttacatttgtacttta

SEQ ID NO: 6555769 - DNA, 20 bp, Homo sapiens
ttaacttagtgtttagcatt

SEQ ID NO: 6555770 - DNA, 15 bp, Homo sapiens
ttaacttatctccag

SEQ ID NO: 6555771 - DNA, 15 bp, Homo sapiens
ttaacttattgctag

SEQ ID NO: 6555772 - DNA, 16 bp, Homo sapiens
ttaacttccactttgt

SEQ ID NO: 6555773 - DNA, 18 bp, Homo sapiens
ttaacttccactttgtat

SEQ ID NO: 6555774 - DNA, 13 bp, Homo sapiens
ttaacttctgaaa

SEQ ID NO: 6555775 - DNA, 17 bp, Homo sapiens
ttaacttcttgcttctt

SEQ ID NO: 6555776 - DNA, 14 bp, Homo sapiens
ttaacttgaatttg

SEQ ID NO: 6555777 - DNA, 22 bp, Homo sapiens
ttaacttgcctccatctttttc

SEQ ID NO: 6555778 - DNA, 16 bp, Homo sapiens
ttaacttggtcagagc

SEQ ID NO: 6555779 - DNA, 18 bp, Homo sapiens
ttaacttggtcagagcca

SEQ ID NO: 6555780 - DNA, 13 bp, Homo sapiens
ttaacttgtatat

SEQ ID NO: 6555781 - DNA, 21 bp, Homo sapiens
ttaacttgtattttcttaata

SEQ ID NO: 6555782 - DNA, 22 bp, Homo sapiens
ttaacttgtcaaaaaacaaaaa

SEQ ID NO: 6555783 - DNA, 20 bp, Homo sapiens
ttaacttgtctttttgttat

SEQ ID NO: 6555784 - DNA, 19 bp, Homo sapiens
ttaactttaaaactgtatt

SEQ ID NO: 6555785 - DNA, 18 bp, Homo sapiens
ttaactttatcacattat

SEQ ID NO: 6555786 - DNA, 14 bp, Homo sapiens
ttaactttgtttta

SEQ ID NO: 6555787 - DNA, 16 bp, Homo sapiens
ttaacttttataaact

SEQ ID NO: 6555788 - DNA, 22 bp, Homo sapiens
ttaacttttccttgtatgttct

SEQ ID NO: 6555789 - DNA, 13 bp, Homo sapiens
ttaacttttgtaa

SEQ ID NO: 6555790 - DNA, 17 bp, Homo sapiens
ttaactttttatttcta

SEQ ID NO: 6555791 - DNA, 20 bp, Homo sapiens
ttaactttttatttctaaat

SEQ ID NO: 6555792 - DNA, 18 bp, Homo sapiens
ttaactttttttcttcta

SEQ ID NO: 6555793 - DNA, 15 bp, Homo sapiens
ttaagaaaaaaataa

SEQ ID NO: 6555794 - DNA, 22 bp, Homo sapiens
ttaagaaaaacaataaagatac

SEQ ID NO: 6555795 - DNA, 20 bp, Homo sapiens
ttaagaaaaacatgtcatgt

SEQ ID NO: 6555796 - DNA, 19 bp, Homo sapiens
ttaagaaaaaggatgcaca

SEQ ID NO: 6555797 - DNA, 20 bp, Homo sapiens
ttaagaaaaaggatgcacag

SEQ ID NO: 6555798 - DNA, 16 bp, Homo sapiens
ttaagaaaagtatttt

SEQ ID NO: 6555799 - DNA, 17 bp, Homo sapiens
ttaagaaaagtattttg

SEQ ID NO: 6555800 - DNA, 18 bp, Homo sapiens
ttaagaaaagtattttga

SEQ ID NO: 6555801 - DNA, 23 bp, Homo sapiens
ttaagaaaagtattttgaagttt

SEQ ID NO: 6555802 - DNA, 17 bp, Homo sapiens
ttaagaaaatacaataa

SEQ ID NO: 6555803 - DNA, 12 bp, Homo sapiens
ttaagaaacact

SEQ ID NO: 6555804 - DNA, 14 bp, Homo sapiens
ttaagaaacactga

SEQ ID NO: 6555805 - DNA, 21 bp, Homo sapiens
ttaagaaagattaaatatatc

SEQ ID NO: 6555806 - DNA, 15 bp, Homo sapiens
ttaagaaagcactta

SEQ ID NO: 6555807 - DNA, 23 bp, Homo sapiens
ttaagaaagcacttaaacagaag

SEQ ID NO: 6555808 - DNA, 16 bp, Homo sapiens
ttaagaaaggaagcaa

SEQ ID NO: 6555809 - DNA, 14 bp, Homo sapiens
ttaagaaaggaagt

SEQ ID NO: 6555810 - DNA, 19 bp, Homo sapiens
ttaagaaaggatataaaag

SEQ ID NO: 6555811 - DNA, 21 bp, Homo sapiens
ttaagaaagtaatttaatttg

SEQ ID NO: 6555812 - DNA, 11 bp, Homo sapiens
ttaagaaatac

SEQ ID NO: 6555813 - DNA, 17 bp, Homo sapiens
ttaagaaatctggccca

SEQ ID NO: 6555814 - DNA, 21 bp, Homo sapiens
ttaagaaatctggcccagggt

SEQ ID NO: 6555815 - DNA, 14 bp, Homo sapiens
ttaagaaatgagaa

SEQ ID NO: 6555816 - DNA, 19 bp, Homo sapiens
ttaagaaatgtataaactt

SEQ ID NO: 6555817 - DNA, 20 bp, Homo sapiens
ttaagaaattccatacttct

SEQ ID NO: 6555818 - DNA, 12 bp, Homo sapiens
ttaagaacattt

SEQ ID NO: 6555819 - DNA, 18 bp, Homo sapiens
ttaagaaccaaactccta

SEQ ID NO: 6555820 - DNA, 17 bp, Homo sapiens
ttaagaaccttattttg

SEQ ID NO: 6555821 - DNA, 16 bp, Homo sapiens
ttaagaactgctgttt

SEQ ID NO: 6555822 - DNA, 16 bp, Homo sapiens
ttaagaacttcatttt

SEQ ID NO: 6555823 - DNA, 16 bp, Homo sapiens
ttaagaagaaagattt

SEQ ID NO: 6555824 - DNA, 22 bp, Homo sapiens
ttaagaagactgcattatattt

SEQ ID NO: 6555825 - DNA, 21 bp, Homo sapiens
ttaagaagccctgcagagcac

SEQ ID NO: 6555826 - DNA, 19 bp, Homo sapiens
ttaagaataattgaacaat

SEQ ID NO: 6555827 - DNA, 22 bp, Homo sapiens
ttaagaatacacaggatatttt

SEQ ID NO: 6555828 - DNA, 17 bp, Homo sapiens
ttaagaatagtctctgg

SEQ ID NO: 6555829 - DNA, 19 bp, Homo sapiens
ttaagaatagtctctgggt

SEQ ID NO: 6555830 - DNA, 20 bp, Homo sapiens
ttaagaatatgtttccttgt

SEQ ID NO: 6555831 - DNA, 15 bp, Homo sapiens
ttaagaatcatggat

SEQ ID NO: 6555832 - DNA, 20 bp, Homo sapiens
ttaagaatcttagataactt

SEQ ID NO: 6555833 - DNA, 11 bp, Homo sapiens
ttaagaatgaa

SEQ ID NO: 6555834 - DNA, 14 bp, Homo sapiens
ttaagaatgaaata

SEQ ID NO: 6555835 - DNA, 20 bp, Homo sapiens
ttaagaatgaaatactgttt

SEQ ID NO: 6555836 - DNA, 22 bp, Homo sapiens
ttaagaatgaaatactgtttga

SEQ ID NO: 6555837 - DNA, 18 bp, Homo sapiens
ttaagaatgagtttctta

SEQ ID NO: 6555838 - DNA, 23 bp, Homo sapiens
ttaagaatgagtttcttagactt

SEQ ID NO: 6555839 - DNA, 23 bp, Homo sapiens
ttaagaatgcagattcctgggcc

SEQ ID NO: 6555840 - DNA, 17 bp, Homo sapiens
ttaagaatggaagaaaa

SEQ ID NO: 6555841 - DNA, 22 bp, Homo sapiens
ttaagaattcaaatttgtaata

SEQ ID NO: 6555842 - DNA, 16 bp, Homo sapiens
ttaagaattgaagata

SEQ ID NO: 6555843 - DNA, 20 bp, Homo sapiens
ttaagaatttaccagaaata

SEQ ID NO: 6555844 - DNA, 16 bp, Homo sapiens
ttaagaatttcacaag

SEQ ID NO: 6555845 - DNA, 15 bp, Homo sapiens
ttaagacaaaaagcc

SEQ ID NO: 6555846 - DNA, 19 bp, Homo sapiens
ttaagacaaaaagccttga

SEQ ID NO: 6555847 - DNA, 16 bp, Homo sapiens
ttaagacaacaggcat

SEQ ID NO: 6555848 - DNA, 16 bp, Homo sapiens
ttaagacacacctctg

SEQ ID NO: 6555849 - DNA, 20 bp, Homo sapiens
ttaagacactgaaaaatcta

SEQ ID NO: 6555850 - DNA, 14 bp, Homo sapiens
ttaagacactgtga

SEQ ID NO: 6555851 - DNA, 15 bp, Homo sapiens
ttaagacactgtgag

SEQ ID NO: 6555852 - DNA, 22 bp, Homo sapiens
ttaagacagtgtacaaaactgt

SEQ ID NO: 6555853 - DNA, 16 bp, Homo sapiens
ttaagacatgatttcc

SEQ ID NO: 6555854 - DNA, 23 bp, Homo sapiens
ttaagacatttttggaaggggac

SEQ ID NO: 6555855 - DNA, 12 bp, Homo sapiens
ttaagaccaaag

SEQ ID NO: 6555856 - DNA, 13 bp, Homo sapiens
ttaagaccaaaga

SEQ ID NO: 6555857 - DNA, 18 bp, Homo sapiens
ttaagacctactgttcta

SEQ ID NO: 6555858 - DNA, 22 bp, Homo sapiens
ttaagacctactgttctaaagc

SEQ ID NO: 6555859 - DNA, 19 bp, Homo sapiens
ttaagacgaaacatttgtt

SEQ ID NO: 6555860 - DNA, 15 bp, Homo sapiens
ttaagacggaagtaa

SEQ ID NO: 6555861 - DNA, 17 bp, Homo sapiens
ttaagactgaatgtttt

SEQ ID NO: 6555862 - DNA, 18 bp, Homo sapiens
ttaagactgattttaata

SEQ ID NO: 6555863 - DNA, 16 bp, Homo sapiens
ttaagacttaatgaga

SEQ ID NO: 6555864 - DNA, 23 bp, Homo sapiens
ttaagacttaatgagactttaaa

SEQ ID NO: 6555865 - DNA, 17 bp, Homo sapiens
ttaagacttgacagtgg

SEQ ID NO: 6555866 - DNA, 10 bp, Homo sapiens
ttaagacttt

SEQ ID NO: 6555867 - DNA, 15 bp, Homo sapiens
ttaagagaaacttta

SEQ ID NO: 6555868 - DNA, 12 bp, Homo sapiens
ttaagagaaatg

SEQ ID NO: 6555869 - DNA, 15 bp, Homo sapiens
ttaagagaatgaatt

SEQ ID NO: 6555870 - DNA, 19 bp, Homo sapiens
ttaagagacagagaatctt

SEQ ID NO: 6555871 - DNA, 20 bp, Homo sapiens
ttaagagactctttattttt

SEQ ID NO: 6555872 - DNA, 18 bp, Homo sapiens
ttaagagattttatgttt

SEQ ID NO: 6555873 - DNA, 13 bp, Homo sapiens
ttaagagctattt

SEQ ID NO: 6555874 - DNA, 16 bp, Homo sapiens
ttaagagctattttag

SEQ ID NO: 6555875 - DNA, 21 bp, Homo sapiens
ttaagagctattttagaaagc

SEQ ID NO: 6555876 - DNA, 17 bp, Homo sapiens
ttaagagcttgatctgt

SEQ ID NO: 6555877 - DNA, 20 bp, Homo sapiens
tttaattaaaaactagtagt

SEQ ID NO: 6555878 - DNA, 16 bp, Homo sapiens
tttaattaaaaacttt

SEQ ID NO: 6555879 - DNA, 13 bp, Homo sapiens
tttaattaaataa

SEQ ID NO: 6555880 - DNA, 22 bp, Homo sapiens
tttaattaataatatgtactaa

SEQ ID NO: 6555881 - DNA, 22 bp, Homo sapiens
tttaattaattgggccagcttt

SEQ ID NO: 6555882 - DNA, 16 bp, Homo sapiens
tttaattactgttttc

SEQ ID NO: 6555883 - DNA, 19 bp, Homo sapiens
tttaattaggttaactatg

SEQ ID NO: 6555884 - DNA, 22 bp, Homo sapiens
tttaattagtgctaagtgtgaa

SEQ ID NO: 6555885 - DNA, 23 bp, Homo sapiens
tttaattataaaaaattaactta

SEQ ID NO: 6555886 - DNA, 17 bp, Homo sapiens
tttaattatctgcattt

SEQ ID NO: 6555887 - DNA, 11 bp, Homo sapiens
tttaattatta

SEQ ID NO: 6555888 - DNA, 14 bp, Homo sapiens
tttaattattattc

SEQ ID NO: 6555889 - DNA, 13 bp, Homo sapiens
tttaattattgtt

SEQ ID NO: 6555890 - DNA, 13 bp, Homo sapiens
tttaattatttaa

SEQ ID NO: 6555891 - DNA, 14 bp, Homo sapiens
tttaattatttaaa

SEQ ID NO: 6555892 - DNA, 22 bp, Homo sapiens
tttaattatttaaatgtactta

SEQ ID NO: 6555893 - DNA, 15 bp, Homo sapiens
tttaattattttaaa

SEQ ID NO: 6555894 - DNA, 12 bp, Homo sapiens
tttaattcaaag

SEQ ID NO: 6555895 - DNA, 19 bp, Homo sapiens
tttaattcaagaaatgaca

SEQ ID NO: 6555896 - DNA, 16 bp, Homo sapiens
tttaattcacgtgctt

SEQ ID NO: 6555897 - DNA, 14 bp, Homo sapiens
tttaattcagtaca

SEQ ID NO: 6555898 - DNA, 16 bp, Homo sapiens
tttaattcagtacaac

SEQ ID NO: 6555899 - DNA, 12 bp, Homo sapiens
tttaattcataa

SEQ ID NO: 6555900 - DNA, 17 bp, Homo sapiens
tttaattcataattaga

SEQ ID NO: 6555901 - DNA, 14 bp, Homo sapiens
tttaattctagtat

SEQ ID NO: 6555902 - DNA, 14 bp, Homo sapiens
tttaattctcattt

SEQ ID NO: 6555903 - DNA, 11 bp, Homo sapiens
tttaattctct

SEQ ID NO: 6555904 - DNA, 20 bp, Homo sapiens
tttaattctgtcttgttcat

SEQ ID NO: 6555905 - DNA, 21 bp, Homo sapiens
tttaattctgtcttgttcatt

SEQ ID NO: 6555906 - DNA, 22 bp, Homo sapiens
tttaattcttatttctgtgtta

SEQ ID NO: 6555907 - DNA, 21 bp, Homo sapiens
tttaattgaaagggacaagta

SEQ ID NO: 6555908 - DNA, 16 bp, Homo sapiens
tttaattgaaattaac

SEQ ID NO: 6555909 - DNA, 14 bp, Homo sapiens
tttaattgaagaac

SEQ ID NO: 6555910 - DNA, 15 bp, Homo sapiens
tttaattgaaggaaa

SEQ ID NO: 6555911 - DNA, 16 bp, Homo sapiens
tttaattgaaggaaag

SEQ ID NO: 6555912 - DNA, 12 bp, Homo sapiens
tttaattgcttt

SEQ ID NO: 6555913 - DNA, 15 bp, Homo sapiens
tttaattgctttgaa

SEQ ID NO: 6555914 - DNA, 20 bp, Homo sapiens
tttaattgtaattgtctcaa

SEQ ID NO: 6555915 - DNA, 13 bp, Homo sapiens
tttaattgtagtt

SEQ ID NO: 6555916 - DNA, 21 bp, Homo sapiens
tttaattgtataaaacagtgt

SEQ ID NO: 6555917 - DNA, 21 bp, Homo sapiens
tttaattgtataagtcaagca

SEQ ID NO: 6555918 - DNA, 14 bp, Homo sapiens
tttaattgtgatat

SEQ ID NO: 6555919 - DNA, 14 bp, Homo sapiens
tttaattgttactc

SEQ ID NO: 6555920 - DNA, 24 bp, Homo sapiens
tttaattgttgtttctttctagtg

SEQ ID NO: 6555921 - DNA, 17 bp, Homo sapiens
tttaatttaacaaacta

SEQ ID NO: 6555922 - DNA, 22 bp, Homo sapiens
tttaatttagtaaaccaatcct

SEQ ID NO: 6555923 - DNA, 20 bp, Homo sapiens
tttaatttataggcagatct

SEQ ID NO: 6555924 - DNA, 14 bp, Homo sapiens
tttaatttatgtaa

SEQ ID NO: 6555925 - DNA, 21 bp, Homo sapiens
tttaatttattaattgctttg

SEQ ID NO: 6555926 - DNA, 16 bp, Homo sapiens
tttaatttatttatta

SEQ ID NO: 6555927 - DNA, 15 bp, Homo sapiens
tttaatttcataaat

SEQ ID NO: 6555928 - DNA, 17 bp, Homo sapiens
tttaatttcatgtatat

SEQ ID NO: 6555929 - DNA, 18 bp, Homo sapiens
tttaatttcctgtgagga

SEQ ID NO: 6555930 - DNA, 23 bp, Homo sapiens
tttaatttctaagaagttacttt

SEQ ID NO: 6555931 - DNA, 22 bp, Homo sapiens
tttaatttctgaagaagttaat

SEQ ID NO: 6555932 - DNA, 20 bp, Homo sapiens
tttaatttctgtcagaatgc

SEQ ID NO: 6555933 - DNA, 13 bp, Homo sapiens
tttaatttcttca

SEQ ID NO: 6555934 - DNA, 22 bp, Homo sapiens
tttaatttgaaggtagaatgtt

SEQ ID NO: 6555935 - DNA, 14 bp, Homo sapiens
tttaatttgaatca

SEQ ID NO: 6555936 - DNA, 20 bp, Homo sapiens
tttaatttgaatcagagaaa

SEQ ID NO: 6555937 - DNA, 11 bp, Homo sapiens
tttaatttgat

SEQ ID NO: 6555938 - DNA, 18 bp, Homo sapiens
tttaatttgatgaaagct

SEQ ID NO: 6555939 - DNA, 18 bp, Homo sapiens
tttaatttgggcatctct

SEQ ID NO: 6555940 - DNA, 17 bp, Homo sapiens
tttaatttgtaaaactt

SEQ ID NO: 6555941 - DNA, 19 bp, Homo sapiens
tttaattttagagaaactt

SEQ ID NO: 6555942 - DNA, 17 bp, Homo sapiens
tttaattttcagttcta

SEQ ID NO: 6555943 - DNA, 16 bp, Homo sapiens
tttaattttcttgttt

SEQ ID NO: 6555944 - DNA, 19 bp, Homo sapiens
tttaattttgatatacatt

SEQ ID NO: 6555945 - DNA, 15 bp, Homo sapiens
tttaattttggaatt

SEQ ID NO: 6555946 - DNA, 11 bp, Homo sapiens
tttaattttgt

SEQ ID NO: 6555947 - DNA, 14 bp, Homo sapiens
tttaattttgtaaa

SEQ ID NO: 6555948 - DNA, 19 bp, Homo sapiens
tttaattttgtcagattca

SEQ ID NO: 6555949 - DNA, 19 bp, Homo sapiens
tttaatttttaaaagactt

SEQ ID NO: 6555950 - DNA, 17 bp, Homo sapiens
tttaattttttaaataa

SEQ ID NO: 6555951 - DNA, 19 bp, Homo sapiens
tttaatttttttgagacag

SEQ ID NO: 6555952 - DNA, 16 bp, Homo sapiens
tttacaaaaatataaa

SEQ ID NO: 6555953 - DNA, 13 bp, Homo sapiens
tttacaaaacata

SEQ ID NO: 6555954 - DNA, 21 bp, Homo sapiens
tttacaaaagaaataccttga

SEQ ID NO: 6555955 - DNA, 20 bp, Homo sapiens
tttacaaaatacaaaaaagt

SEQ ID NO: 6555956 - DNA, 14 bp, Homo sapiens
tttacaaaatacta

SEQ ID NO: 6555957 - DNA, 15 bp, Homo sapiens
tttacaaacaagata

SEQ ID NO: 6555958 - DNA, 19 bp, Homo sapiens
tttacaaacagatgaaaaa

SEQ ID NO: 6555959 - DNA, 22 bp, Homo sapiens
tttacaaacatggaaaacagag

SEQ ID NO: 6555960 - DNA, 14 bp, Homo sapiens
tttacaaactgaag

SEQ ID NO: 6555961 - DNA, 12 bp, Homo sapiens
tttacaaagaaa

SEQ ID NO: 6555962 - DNA, 21 bp, Homo sapiens
tttacaaagaaacaaaatata

SEQ ID NO: 6555963 - DNA, 21 bp, Homo sapiens
tttacaaatgttaaaatgtgt

SEQ ID NO: 6555964 - DNA, 19 bp, Homo sapiens
tttacaacactttaatggg

SEQ ID NO: 6555965 - DNA, 22 bp, Homo sapiens
tttacaactccaacttctatgt

SEQ ID NO: 6555966 - DNA, 14 bp, Homo sapiens
tttacaactcctga

SEQ ID NO: 6555967 - DNA, 16 bp, Homo sapiens
tttacaactcctgatt

SEQ ID NO: 6555968 - DNA, 12 bp, Homo sapiens
tttacaagaaaa

SEQ ID NO: 6555969 - DNA, 22 bp, Homo sapiens
tttacaagaaaacaatggggct

SEQ ID NO: 6555970 - DNA, 15 bp, Homo sapiens
tttacaagaaataaa

SEQ ID NO: 6555971 - DNA, 21 bp, Homo sapiens
tttacaagaagtttattctca

SEQ ID NO: 6555972 - DNA, 18 bp, Homo sapiens
tttacaagagaagaaagt

SEQ ID NO: 6555973 - DNA, 21 bp, Homo sapiens
tttacaagcccccccttccac

SEQ ID NO: 6555974 - DNA, 16 bp, Homo sapiens
tttacaagtaacaaaa

SEQ ID NO: 6555975 - DNA, 21 bp, Homo sapiens
tttacaagtgtatatcagaaa

SEQ ID NO: 6555976 - DNA, 17 bp, Homo sapiens
tttacaataaatattct

SEQ ID NO: 6555977 - DNA, 23 bp, Homo sapiens
tttacaatgatgccgaacattag

SEQ ID NO: 6555978 - DNA, 18 bp, Homo sapiens
tttacaatgatttgtaaa

SEQ ID NO: 6555979 - DNA, 13 bp, Homo sapiens
tttacaatgtatt

SEQ ID NO: 6555980 - DNA, 15 bp, Homo sapiens
tttacaatgtcatat

SEQ ID NO: 6555981 - DNA, 16 bp, Homo sapiens
tttacaatgtgaatag

SEQ ID NO: 6555982 - DNA, 19 bp, Homo sapiens
tttacaatttacaaagtgt

SEQ ID NO: 6555983 - DNA, 19 bp, Homo sapiens
tttacacaatagaattata

SEQ ID NO: 6555984 - DNA, 21 bp, Homo sapiens
tttacacacgtgcaatttgtt

SEQ ID NO: 6555985 - DNA, 19 bp, Homo sapiens
tttacacactgtacacata

SEQ ID NO: 6555986 - DNA, 21 bp, Homo sapiens
tttacacactgtacacataag

SEQ ID NO: 6555987 - DNA, 18 bp, Homo sapiens
tttacacagagaaataca

SEQ ID NO: 6555988 - DNA, 13 bp, Homo sapiens
tttacacagcaat

SEQ ID NO: 6555989 - DNA, 13 bp, Homo sapiens
tttacacaggaag

SEQ ID NO: 6555990 - DNA, 21 bp, Homo sapiens
tttacacaggtttagttgact

SEQ ID NO: 6555991 - DNA, 14 bp, Homo sapiens
tttacaccacactt

SEQ ID NO: 6555992 - DNA, 15 bp, Homo sapiens
tttacaccacacttt

SEQ ID NO: 6555993 - DNA, 18 bp, Homo sapiens
tttacaccacactttcaa

SEQ ID NO: 6555994 - DNA, 19 bp, Homo sapiens
tttacaccacactttcaaa

SEQ ID NO: 6555995 - DNA, 16 bp, Homo sapiens
tttacacgcttttgtg

SEQ ID NO: 6555996 - DNA, 18 bp, Homo sapiens
tttacacgtatctcttgg

SEQ ID NO: 6555997 - DNA, 13 bp, Homo sapiens
tttacacgtctat

SEQ ID NO: 6555998 - DNA, 16 bp, Homo sapiens
tttacactctttgtaa

SEQ ID NO: 6555999 - DNA, 19 bp, Homo sapiens
tttacactggatgtttctc

SEQ ID NO: 6556000 - DNA, 11 bp, Homo sapiens
tttacagaaaa

SEQ ID NO: 6556001 - DNA, 15 bp, Homo sapiens
tttacagaataaaag

SEQ ID NO: 6556002 - DNA, 17 bp, Homo sapiens
tttacagaatgcattaa

SEQ ID NO: 6556003 - DNA, 22 bp, Homo sapiens
tttacagacagaagagaaggaa

SEQ ID NO: 6556004 - DNA, 23 bp, Homo sapiens
tttacagagaggatacatttaat

SEQ ID NO: 6556005 - DNA, 21 bp, Homo sapiens
tttacagagatgtctcttata

SEQ ID NO: 6556006 - DNA, 22 bp, Homo sapiens
tttacagatccagaatttatta

SEQ ID NO: 6556007 - DNA, 18 bp, Homo sapiens
tttacagatgtagatata

SEQ ID NO: 6556008 - DNA, 15 bp, Homo sapiens
tttacagatttctca

SEQ ID NO: 6556009 - DNA, 16 bp, Homo sapiens
tttacagcactactct

SEQ ID NO: 6556010 - DNA, 16 bp, Homo sapiens
tttacagcattgtctt

SEQ ID NO: 6556011 - DNA, 17 bp, Homo sapiens
tttacagcattgtcttt

SEQ ID NO: 6556012 - DNA, 20 bp, Homo sapiens
tttacagctctgactttaca

SEQ ID NO: 6556013 - DNA, 23 bp, Homo sapiens
tttacagctcttggcattttcct

SEQ ID NO: 6556014 - DNA, 16 bp, Homo sapiens
tttacagctgcctttc

SEQ ID NO: 6556015 - DNA, 14 bp, Homo sapiens
tttacagctgtgct

SEQ ID NO: 6556016 - DNA, 15 bp, Homo sapiens
tttacagctgtgctc

SEQ ID NO: 6556017 - DNA, 18 bp, Homo sapiens
tttacagctttacacaca

SEQ ID NO: 6556018 - DNA, 14 bp, Homo sapiens
tttacaggaaaaaa

SEQ ID NO: 6556019 - DNA, 21 bp, Homo sapiens
tttacaggaggttgtggatgc

SEQ ID NO: 6556020 - DNA, 18 bp, Homo sapiens
tttacaggatattccaaa

SEQ ID NO: 6556021 - DNA, 22 bp, Homo sapiens
tttacagggagcctcctgccca

SEQ ID NO: 6556022 - DNA, 19 bp, Homo sapiens
tttacagtaaataaattgt

SEQ ID NO: 6556023 - DNA, 16 bp, Homo sapiens
tttacagtaaatgtta

SEQ ID NO: 6556024 - DNA, 18 bp, Homo sapiens
tttacagtagttaacctt

SEQ ID NO: 6556025 - DNA, 14 bp, Homo sapiens
tttacagtatatct

SEQ ID NO: 6556026 - DNA, 16 bp, Homo sapiens
tttacagtatccaaaa

SEQ ID NO: 6556027 - DNA, 12 bp, Homo sapiens
tttacagtattt

SEQ ID NO: 6556028 - DNA, 18 bp, Homo sapiens
tttacagtctatttgaga

SEQ ID NO: 6556029 - DNA, 19 bp, Homo sapiens
tttacagtctctttcttcc

SEQ ID NO: 6556030 - DNA, 23 bp, Homo sapiens
tttacagtgaaaatgtaagctgt

SEQ ID NO: 6556031 - DNA, 20 bp, Homo sapiens
tttacagtgaagaaagcctg

SEQ ID NO: 6556032 - DNA, 19 bp, Homo sapiens
tttacagtgaccttttctt

SEQ ID NO: 6556033 - DNA, 15 bp, Homo sapiens
tttacagtgatagaa

SEQ ID NO: 6556034 - DNA, 16 bp, Homo sapiens
tttacagtgtatttaa

SEQ ID NO: 6556035 - DNA, 19 bp, Homo sapiens
tttacagtgtttctggctt

SEQ ID NO: 6556036 - DNA, 14 bp, Homo sapiens
tttacagttactgc

SEQ ID NO: 6556037 - DNA, 15 bp, Homo sapiens
tttacagttactttt

SEQ ID NO: 6556038 - DNA, 21 bp, Homo sapiens
tttacagttagggttttgcaa

SEQ ID NO: 6556039 - DNA, 14 bp, Homo sapiens
tttacagtttgtgt

SEQ ID NO: 6556040 - DNA, 21 bp, Homo sapiens
tttacagtttttttctttgtg

SEQ ID NO: 6556041 - DNA, 16 bp, Homo sapiens
tttacataagaaatgt

SEQ ID NO: 6556042 - DNA, 21 bp, Homo sapiens
tttacatacactgtatgttat

SEQ ID NO: 6556043 - DNA, 14 bp, Homo sapiens
tttacatactttat

SEQ ID NO: 6556044 - DNA, 19 bp, Homo sapiens
tttacatataaaatgtaat

SEQ ID NO: 6556045 - DNA, 18 bp, Homo sapiens
tttacatatagctttgca

SEQ ID NO: 6556046 - DNA, 15 bp, Homo sapiens
tttacatatctgttt

SEQ ID NO: 6556047 - DNA, 23 bp, Homo sapiens
tttacatatgattgtatttgtgt

SEQ ID NO: 6556048 - DNA, 16 bp, Homo sapiens
tttacatatttacctg

SEQ ID NO: 6556049 - DNA, 14 bp, Homo sapiens
tttacatcaataat

SEQ ID NO: 6556050 - DNA, 18 bp, Homo sapiens
tttacatgaattgcattt

SEQ ID NO: 6556051 - DNA, 21 bp, Homo sapiens
tttacatgacagatattttat

SEQ ID NO: 6556052 - DNA, 22 bp, Homo sapiens
tttacatgacagatattttatc

SEQ ID NO: 6556053 - DNA, 14 bp, Homo sapiens
tttacatgcttatt

SEQ ID NO: 6556054 - DNA, 18 bp, Homo sapiens
tttacatgcttattccat

SEQ ID NO: 6556055 - DNA, 20 bp, Homo sapiens
tttacatggcgccctgcctc

SEQ ID NO: 6556056 - DNA, 16 bp, Homo sapiens
ttaagaggaagaagaa

SEQ ID NO: 6556057 - DNA, 22 bp, Homo sapiens
ttaagaggaagaagaagaaagg

SEQ ID NO: 6556058 - DNA, 20 bp, Homo sapiens
ttaagaggcagaaaattgca

SEQ ID NO: 6556059 - DNA, 22 bp, Homo sapiens
ttaagagtacaagctcttgttt

SEQ ID NO: 6556060 - DNA, 20 bp, Homo sapiens
ttaagagtagcaagttctag

SEQ ID NO: 6556061 - DNA, 14 bp, Homo sapiens
ttaagagtccaaga

SEQ ID NO: 6556062 - DNA, 19 bp, Homo sapiens
ttaagagtccaagaatcca

SEQ ID NO: 6556063 - DNA, 15 bp, Homo sapiens
ttaagataatattta

SEQ ID NO: 6556064 - DNA, 20 bp, Homo sapiens
ttaagataattgtactttga

SEQ ID NO: 6556065 - DNA, 23 bp, Homo sapiens
ttaagataattgtactttgaaaa

SEQ ID NO: 6556066 - DNA, 15 bp, Homo sapiens
ttaagatacaaatta

SEQ ID NO: 6556067 - DNA, 18 bp, Homo sapiens
ttaagatacactcctgct

SEQ ID NO: 6556068 - DNA, 21 bp, Homo sapiens
ttaagatacactcctgctgtg

SEQ ID NO: 6556069 - DNA, 19 bp, Homo sapiens
ttaagatagacttattctt

SEQ ID NO: 6556070 - DNA, 14 bp, Homo sapiens
ttaagatatgatgt

SEQ ID NO: 6556071 - DNA, 15 bp, Homo sapiens
ttaagatccagaaat

SEQ ID NO: 6556072 - DNA, 16 bp, Homo sapiens
ttaagatcctaaactc

SEQ ID NO: 6556073 - DNA, 20 bp, Homo sapiens
ttaagatcctaaactctcta

SEQ ID NO: 6556074 - DNA, 17 bp, Homo sapiens
ttaagatggattctcag

SEQ ID NO: 6556075 - DNA, 21 bp, Homo sapiens
ttaagatggattctcagatat

SEQ ID NO: 6556076 - DNA, 23 bp, Homo sapiens
ttaagatggattctcagatattt

SEQ ID NO: 6556077 - DNA, 12 bp, Homo sapiens
ttaagatgtgaa

SEQ ID NO: 6556078 - DNA, 13 bp, Homo sapiens
ttaagatgtgaaa

SEQ ID NO: 6556079 - DNA, 22 bp, Homo sapiens
ttaagatgtttattaatagaat

SEQ ID NO: 6556080 - DNA, 14 bp, Homo sapiens
ttaagattataatt

SEQ ID NO: 6556081 - DNA, 15 bp, Homo sapiens
ttaagattataattg

SEQ ID NO: 6556082 - DNA, 12 bp, Homo sapiens
ttaagattcagt

SEQ ID NO: 6556083 - DNA, 15 bp, Homo sapiens
ttaagattcagtttt

SEQ ID NO: 6556084 - DNA, 19 bp, Homo sapiens
ttaagattccttttcttgt

SEQ ID NO: 6556085 - DNA, 22 bp, Homo sapiens
ttaagattgaagctaaaacact

SEQ ID NO: 6556086 - DNA, 15 bp, Homo sapiens
ttaagatttaatttg

SEQ ID NO: 6556087 - DNA, 19 bp, Homo sapiens
ttaagatttaatttgccaa

SEQ ID NO: 6556088 - DNA, 15 bp, Homo sapiens
ttaagattttacaaa

SEQ ID NO: 6556089 - DNA, 18 bp, Homo sapiens
ttaagattttacaaaaga

SEQ ID NO: 6556090 - DNA, 17 bp, Homo sapiens
ttaagatttttctcaaa

SEQ ID NO: 6556091 - DNA, 21 bp, Homo sapiens
ttaagatttttctcaaagttt

SEQ ID NO: 6556092 - DNA, 19 bp, Homo sapiens
ttaagcaaaggctccctcg

SEQ ID NO: 6556093 - DNA, 15 bp, Homo sapiens
ttaagcaaatactta

SEQ ID NO: 6556094 - DNA, 13 bp, Homo sapiens
ttaagcaaatgca

SEQ ID NO: 6556095 - DNA, 14 bp, Homo sapiens
ttaagcaaatgcat

SEQ ID NO: 6556096 - DNA, 15 bp, Homo sapiens
ttaagcaaatgcatt

SEQ ID NO: 6556097 - DNA, 19 bp, Homo sapiens
ttaagcaacaatggatatt

SEQ ID NO: 6556098 - DNA, 19 bp, Homo sapiens
ttaagcaacatctttttaa

SEQ ID NO: 6556099 - DNA, 19 bp, Homo sapiens
ttaagcaaccttaaagcaa

SEQ ID NO: 6556100 - DNA, 22 bp, Homo sapiens
ttaagcaactggaaaagtgttc

SEQ ID NO: 6556101 - DNA, 21 bp, Homo sapiens
ttaagcaaggtgtccctgcct

SEQ ID NO: 6556102 - DNA, 22 bp, Homo sapiens
ttaagcaaggtgtccctgcctt

SEQ ID NO: 6556103 - DNA, 16 bp, Homo sapiens
ttaagcaataaaactg

SEQ ID NO: 6556104 - DNA, 22 bp, Homo sapiens
ttaagcacaaaaaatttaagag

SEQ ID NO: 6556105 - DNA, 21 bp, Homo sapiens
ttaagcacattattgtagaga

SEQ ID NO: 6556106 - DNA, 15 bp, Homo sapiens
ttaagcactcttaaa

SEQ ID NO: 6556107 - DNA, 12 bp, Homo sapiens
ttaagcactttg

SEQ ID NO: 6556108 - DNA, 13 bp, Homo sapiens
ttaagcactttga

SEQ ID NO: 6556109 - DNA, 14 bp, Homo sapiens
ttaagcactttgaa

SEQ ID NO: 6556110 - DNA, 17 bp, Homo sapiens
ttaagcagaacaaatgt

SEQ ID NO: 6556111 - DNA, 18 bp, Homo sapiens
ttaagcagaacaaatgtg

SEQ ID NO: 6556112 - DNA, 19 bp, Homo sapiens
ttaagcagaacaaatgtgt

SEQ ID NO: 6556113 - DNA, 19 bp, Homo sapiens
ttaagcagagcagaacttt

SEQ ID NO: 6556114 - DNA, 22 bp, Homo sapiens
ttaagcagagcagaactttttt

SEQ ID NO: 6556115 - DNA, 15 bp, Homo sapiens
ttaagcagcatggaa

SEQ ID NO: 6556116 - DNA, 19 bp, Homo sapiens
ttaagcagcatggaaaaat

SEQ ID NO: 6556117 - DNA, 13 bp, Homo sapiens
ttaagcagccttt

SEQ ID NO: 6556118 - DNA, 13 bp, Homo sapiens
ttaagcagctctt

SEQ ID NO: 6556119 - DNA, 17 bp, Homo sapiens
ttaagcagctcttgcta

SEQ ID NO: 6556120 - DNA, 18 bp, Homo sapiens
ttaagcagctcttgctaa

SEQ ID NO: 6556121 - DNA, 16 bp, Homo sapiens
ttaagcagcttgaatg

SEQ ID NO: 6556122 - DNA, 18 bp, Homo sapiens
ttaagcagtaaaaactgt

SEQ ID NO: 6556123 - DNA, 19 bp, Homo sapiens
ttaagcagtacaaatgttt

SEQ ID NO: 6556124 - DNA, 16 bp, Homo sapiens
ttaagcagtacatctt

SEQ ID NO: 6556125 - DNA, 19 bp, Homo sapiens
ttaagcagtacatcttgtg

SEQ ID NO: 6556126 - DNA, 15 bp, Homo sapiens
ttaagcatatatttt

SEQ ID NO: 6556127 - DNA, 22 bp, Homo sapiens
ttaagcatatgtgttacttcaa

SEQ ID NO: 6556128 - DNA, 17 bp, Homo sapiens
ttaagcatgacagaaaa

SEQ ID NO: 6556129 - DNA, 18 bp, Homo sapiens
ttaagcatgagtggcctt

SEQ ID NO: 6556130 - DNA, 15 bp, Homo sapiens
ttaagcatgcttcta

SEQ ID NO: 6556131 - DNA, 18 bp, Homo sapiens
ttaagcattaccactcag

SEQ ID NO: 6556132 - DNA, 21 bp, Homo sapiens
ttaagcattactcttgtaaga

SEQ ID NO: 6556133 - DNA, 20 bp, Homo sapiens
ttaagcattgggtgggtaaa

SEQ ID NO: 6556134 - DNA, 19 bp, Homo sapiens
ttaagcattgtttgcttat

SEQ ID NO: 6556135 - DNA, 23 bp, Homo sapiens
ttaagcattgtttgcttattgtt

SEQ ID NO: 6556136 - DNA, 14 bp, Homo sapiens
ttaagcatttattt

SEQ ID NO: 6556137 - DNA, 23 bp, Homo sapiens
ttaagcatttgcgtatgtaaaca

SEQ ID NO: 6556138 - DNA, 13 bp, Homo sapiens
ttaagcatttgta

SEQ ID NO: 6556139 - DNA, 16 bp, Homo sapiens
ttaagcatttgtatat

SEQ ID NO: 6556140 - DNA, 18 bp, Homo sapiens
ttaagcatttgtatatta

SEQ ID NO: 6556141 - DNA, 22 bp, Homo sapiens
ttaagcattttgaaacaaagta

SEQ ID NO: 6556142 - DNA, 21 bp, Homo sapiens
ttaagccaaactcaggcccag

SEQ ID NO: 6556143 - DNA, 16 bp, Homo sapiens
ttaagccaaagaaaca

SEQ ID NO: 6556144 - DNA, 22 bp, Homo sapiens
ttaagccaatatttactcatca

SEQ ID NO: 6556145 - DNA, 15 bp, Homo sapiens
ttaagccactgcctc

SEQ ID NO: 6556146 - DNA, 21 bp, Homo sapiens
ttaagccacttaaaatgttca

SEQ ID NO: 6556147 - DNA, 17 bp, Homo sapiens
ttaagccaggaaacatg

SEQ ID NO: 6556148 - DNA, 13 bp, Homo sapiens
ttaagcccaatct

SEQ ID NO: 6556149 - DNA, 13 bp, Homo sapiens
ttaagcccaggag

SEQ ID NO: 6556150 - DNA, 13 bp, Homo sapiens
ttaagccccctct

SEQ ID NO: 6556151 - DNA, 13 bp, Homo sapiens
ttaagccctgagg

SEQ ID NO: 6556152 - DNA, 19 bp, Homo sapiens
ttaagccctgctctttctc

SEQ ID NO: 6556153 - DNA, 22 bp, Homo sapiens
ttaagccctgctctttctctga

SEQ ID NO: 6556154 - DNA, 20 bp, Homo sapiens
ttaagcctaaagattttgat

SEQ ID NO: 6556155 - DNA, 19 bp, Homo sapiens
ttaagcctcatatttaaag

SEQ ID NO: 6556156 - DNA, 21 bp, Homo sapiens
ttaagcctcatatttaaagac

SEQ ID NO: 6556157 - DNA, 22 bp, Homo sapiens
ttaagcctcatatttaaagaca

SEQ ID NO: 6556158 - DNA, 15 bp, Homo sapiens
ttaagcctgaagagc

SEQ ID NO: 6556159 - DNA, 17 bp, Homo sapiens
ttaagcctgaagagctt

SEQ ID NO: 6556160 - DNA, 19 bp, Homo sapiens
ttaagccttacaaagggaa

SEQ ID NO: 6556161 - DNA, 17 bp, Homo sapiens
ttaagcctttgttgaac

SEQ ID NO: 6556162 - DNA, 14 bp, Homo sapiens
ttaagcgttcatat

SEQ ID NO: 6556163 - DNA, 19 bp, Homo sapiens
ttaagctaggaaaagaaat

SEQ ID NO: 6556164 - DNA, 22 bp, Homo sapiens
ttaagctaggaaaagaaatcta

SEQ ID NO: 6556165 - DNA, 15 bp, Homo sapiens
ttaagctatcagcaa

SEQ ID NO: 6556166 - DNA, 13 bp, Homo sapiens
ttaagctccagct

SEQ ID NO: 6556167 - DNA, 19 bp, Homo sapiens
ttaagctccatgtgcatat

SEQ ID NO: 6556168 - DNA, 16 bp, Homo sapiens
ttaagctctgagctgt

SEQ ID NO: 6556169 - DNA, 18 bp, Homo sapiens
ttaagctctgagctgtca

SEQ ID NO: 6556170 - DNA, 13 bp, Homo sapiens
ttaagctctgccc

SEQ ID NO: 6556171 - DNA, 17 bp, Homo sapiens
ttaagctgttactgtct

SEQ ID NO: 6556172 - DNA, 12 bp, Homo sapiens
ttaagcttattt

SEQ ID NO: 6556173 - DNA, 14 bp, Homo sapiens
ttaagcttctattt

SEQ ID NO: 6556174 - DNA, 20 bp, Homo sapiens
ttaagcttgaagattaggta

SEQ ID NO: 6556175 - DNA, 17 bp, Homo sapiens
ttaagctttaaatgaca

SEQ ID NO: 6556176 - DNA, 14 bp, Homo sapiens
ttaaggaaaattag

SEQ ID NO: 6556177 - DNA, 19 bp, Homo sapiens
ttaaggaaactttttaatt

SEQ ID NO: 6556178 - DNA, 17 bp, Homo sapiens
ttaaggaagaaaaatca

SEQ ID NO: 6556179 - DNA, 21 bp, Homo sapiens
ttaaggaagacaatgtgaaaa

SEQ ID NO: 6556180 - DNA, 22 bp, Homo sapiens
ttaaggaagagagaattctgtt

SEQ ID NO: 6556181 - DNA, 14 bp, Homo sapiens
ttaaggaatttgat

SEQ ID NO: 6556182 - DNA, 13 bp, Homo sapiens
ttaaggacagtgt

SEQ ID NO: 6556183 - DNA, 18 bp, Homo sapiens
ttaaggagaatcatgttt

SEQ ID NO: 6556184 - DNA, 15 bp, Homo sapiens
ttaaggagaggagag

SEQ ID NO: 6556185 - DNA, 12 bp, Homo sapiens
ttaaggagctgg

SEQ ID NO: 6556186 - DNA, 18 bp, Homo sapiens
ttaaggagggagaaagga

SEQ ID NO: 6556187 - DNA, 20 bp, Homo sapiens
ttaaggagggagaaaggaga

SEQ ID NO: 6556188 - DNA, 19 bp, Homo sapiens
ttaaggatgcttgtacata

SEQ ID NO: 6556189 - DNA, 14 bp, Homo sapiens
ttaaggatggatgg

SEQ ID NO: 6556190 - DNA, 16 bp, Homo sapiens
ttaaggatggatggca

SEQ ID NO: 6556191 - DNA, 17 bp, Homo sapiens
ttaaggatggatggcac

SEQ ID NO: 6556192 - DNA, 18 bp, Homo sapiens
ttaaggatggatggcacc

SEQ ID NO: 6556193 - DNA, 17 bp, Homo sapiens
ttaaggattctgcagaa

SEQ ID NO: 6556194 - DNA, 15 bp, Homo sapiens
ttaaggattttatgc

SEQ ID NO: 6556195 - DNA, 20 bp, Homo sapiens
ttaaggattttatgctttaa

SEQ ID NO: 6556196 - DNA, 13 bp, Homo sapiens
ttaaggcaaaaaa

SEQ ID NO: 6556197 - DNA, 15 bp, Homo sapiens
ttaaggcaaataaag

SEQ ID NO: 6556198 - DNA, 22 bp, Homo sapiens
ttaaggcaactgaacaaaaaaa

SEQ ID NO: 6556199 - DNA, 17 bp, Homo sapiens
ttaaggcacagtgggag

SEQ ID NO: 6556200 - DNA, 23 bp, Homo sapiens
ttaaggcagtatgatatcatgct

SEQ ID NO: 6556201 - DNA, 17 bp, Homo sapiens
ttaaggcatacttttaa

SEQ ID NO: 6556202 - DNA, 15 bp, Homo sapiens
ttaaggcatttgttt

SEQ ID NO: 6556203 - DNA, 15 bp, Homo sapiens
ttaaggccacatcca

SEQ ID NO: 6556204 - DNA, 22 bp, Homo sapiens
ttaaggcgtggcttctgcagga

SEQ ID NO: 6556205 - DNA, 18 bp, Homo sapiens
ttaagggaagaattccag

SEQ ID NO: 6556206 - DNA, 15 bp, Homo sapiens
ttaagggacatgtat

SEQ ID NO: 6556207 - DNA, 17 bp, Homo sapiens
ttaagggacatttctat

SEQ ID NO: 6556208 - DNA, 17 bp, Homo sapiens
ttaagggacgggggtgg

SEQ ID NO: 6556209 - DNA, 22 bp, Homo sapiens
ttaagggatgttgcaaagggat

SEQ ID NO: 6556210 - DNA, 16 bp, Homo sapiens
ttaagggcatgccttg

SEQ ID NO: 6556211 - DNA, 19 bp, Homo sapiens
ttaagggcatgttgggata

SEQ ID NO: 6556212 - DNA, 16 bp, Homo sapiens
ttaagggcctgctgga

SEQ ID NO: 6556213 - DNA, 15 bp, Homo sapiens
ttaaggggaagataa

SEQ ID NO: 6556214 - DNA, 16 bp, Homo sapiens
ttaaggggatctaaaa

SEQ ID NO: 6556215 - DNA, 22 bp, Homo sapiens
ttaaggggggcagggagtgatg

SEQ ID NO: 6556216 - DNA, 23 bp, Homo sapiens
ttaaggggtgggtcagaacatgt

SEQ ID NO: 6556217 - DNA, 18 bp, Homo sapiens
ttaagggtaggatgttgc

SEQ ID NO: 6556218 - DNA, 15 bp, Homo sapiens
ttaagggttaagaaa

SEQ ID NO: 6556219 - DNA, 20 bp, Homo sapiens
ttaaggtaactactgctaat

SEQ ID NO: 6556220 - DNA, 13 bp, Homo sapiens
ttaaggtacactg

SEQ ID NO: 6556221 - DNA, 14 bp, Homo sapiens
ttaaggtacatcat

SEQ ID NO: 6556222 - DNA, 15 bp, Homo sapiens
ttaaggtacatcatt

SEQ ID NO: 6556223 - DNA, 21 bp, Homo sapiens
ttaaggtacatcattattgta

SEQ ID NO: 6556224 - DNA, 24 bp, Homo sapiens
ttaaggtatttcgaaactgccaag

SEQ ID NO: 6556225 - DNA, 19 bp, Homo sapiens
ttaaggtctaatcagtgat

SEQ ID NO: 6556226 - DNA, 20 bp, Homo sapiens
ttaaggtctaatcagtgatt

SEQ ID NO: 6556227 - DNA, 14 bp, Homo sapiens
ttaaggtctccaaa

SEQ ID NO: 6556228 - DNA, 22 bp, Homo sapiens
ttaaggtctgggagtgttctgt

SEQ ID NO: 6556229 - DNA, 20 bp, Homo sapiens
ttaaggtgagcataaatcaa

SEQ ID NO: 6556230 - DNA, 17 bp, Homo sapiens
ttaaggtgggaaaaaaa

SEQ ID NO: 6556231 - DNA, 17 bp, Homo sapiens
ttaaggtgtttgaaaat

SEQ ID NO: 6556232 - DNA, 22 bp, Homo sapiens
ttaaggtgtttgaaaatagttt

SEQ ID NO: 6556233 - DNA, 14 bp, Homo sapiens
ttaaggttgaactt

SEQ ID NO: 6556234 - DNA, 21 bp, Homo sapiens
tttacatggcgccctgcctcc

SEQ ID NO: 6556235 - DNA, 16 bp, Homo sapiens
tttacatggctggagc

SEQ ID NO: 6556236 - DNA, 19 bp, Homo sapiens
tttacatggggttttcaat

SEQ ID NO: 6556237 - DNA, 20 bp, Homo sapiens
tttacatgtatggttactaa

SEQ ID NO: 6556238 - DNA, 22 bp, Homo sapiens
tttacatgtatggttactaaaa

SEQ ID NO: 6556239 - DNA, 20 bp, Homo sapiens
tttacatgtcatttgactgt

SEQ ID NO: 6556240 - DNA, 19 bp, Homo sapiens
tttacatgtgtagcctatg

SEQ ID NO: 6556241 - DNA, 18 bp, Homo sapiens
tttacattacaaatttct

SEQ ID NO: 6556242 - DNA, 16 bp, Homo sapiens
tttacattacagaata

SEQ ID NO: 6556243 - DNA, 14 bp, Homo sapiens
tttacattatgcaa

SEQ ID NO: 6556244 - DNA, 14 bp, Homo sapiens
tttacattctagtt

SEQ ID NO: 6556245 - DNA, 20 bp, Homo sapiens
tttacattctgtctgttttt

SEQ ID NO: 6556246 - DNA, 18 bp, Homo sapiens
tttacattgtgacaaaca

SEQ ID NO: 6556247 - DNA, 18 bp, Homo sapiens
tttacattgtgactgtgt

SEQ ID NO: 6556248 - DNA, 23 bp, Homo sapiens
tttacattgtgactgtgtttgca

SEQ ID NO: 6556249 - DNA, 16 bp, Homo sapiens
tttacattgttgagct

SEQ ID NO: 6556250 - DNA, 12 bp, Homo sapiens
tttacatttaaa

SEQ ID NO: 6556251 - DNA, 16 bp, Homo sapiens
tttacatttactgaaa

SEQ ID NO: 6556252 - DNA, 17 bp, Homo sapiens
tttacatttattccttc

SEQ ID NO: 6556253 - DNA, 12 bp, Homo sapiens
tttacatttcta

SEQ ID NO: 6556254 - DNA, 15 bp, Homo sapiens
tttacattttagggt

SEQ ID NO: 6556255 - DNA, 13 bp, Homo sapiens
tttacattttatg

SEQ ID NO: 6556256 - DNA, 18 bp, Homo sapiens
tttacattttatttatta

SEQ ID NO: 6556257 - DNA, 18 bp, Homo sapiens
tttacattttcagtacca

SEQ ID NO: 6556258 - DNA, 14 bp, Homo sapiens
tttaccaaaaattt

SEQ ID NO: 6556259 - DNA, 23 bp, Homo sapiens
tttaccaaaggtttttaaagtaa

SEQ ID NO: 6556260 - DNA, 22 bp, Homo sapiens
tttaccaaatgaaatgccaaag

SEQ ID NO: 6556261 - DNA, 17 bp, Homo sapiens
tttaccaaattgcttga

SEQ ID NO: 6556262 - DNA, 18 bp, Homo sapiens
tttaccaacatgtatctg

SEQ ID NO: 6556263 - DNA, 20 bp, Homo sapiens
tttaccaagttatataaaga

SEQ ID NO: 6556264 - DNA, 12 bp, Homo sapiens
tttaccaagttt

SEQ ID NO: 6556265 - DNA, 13 bp, Homo sapiens
tttaccaccccca

SEQ ID NO: 6556266 - DNA, 15 bp, Homo sapiens
tttaccacccccaca

SEQ ID NO: 6556267 - DNA, 18 bp, Homo sapiens
tttaccacccccacacct

SEQ ID NO: 6556268 - DNA, 15 bp, Homo sapiens
tttaccagaaatatt

SEQ ID NO: 6556269 - DNA, 14 bp, Homo sapiens
tttaccagctttta

SEQ ID NO: 6556270 - DNA, 19 bp, Homo sapiens
tttaccagcttttaaccat

SEQ ID NO: 6556271 - DNA, 18 bp, Homo sapiens
tttaccagggatgtagat

SEQ ID NO: 6556272 - DNA, 19 bp, Homo sapiens
tttaccagttaattactca

SEQ ID NO: 6556273 - DNA, 15 bp, Homo sapiens
tttaccataatctta

SEQ ID NO: 6556274 - DNA, 16 bp, Homo sapiens
tttaccatatgtttat

SEQ ID NO: 6556275 - DNA, 20 bp, Homo sapiens
tttaccatcaaacaaatcat

SEQ ID NO: 6556276 - DNA, 13 bp, Homo sapiens
tttaccattagca

SEQ ID NO: 6556277 - DNA, 20 bp, Homo sapiens
tttaccattagcataatttt

SEQ ID NO: 6556278 - DNA, 16 bp, Homo sapiens
tttaccatttgtaata

SEQ ID NO: 6556279 - DNA, 18 bp, Homo sapiens
tttacccaaaaactaaat

SEQ ID NO: 6556280 - DNA, 23 bp, Homo sapiens
tttacccagaatgtcagattcct

SEQ ID NO: 6556281 - DNA, 23 bp, Homo sapiens
tttacccagcatgactttcctta

SEQ ID NO: 6556282 - DNA, 22 bp, Homo sapiens
tttacccagtgggacagaggag

SEQ ID NO: 6556283 - DNA, 14 bp, Homo sapiens
tttacccatatccc

SEQ ID NO: 6556284 - DNA, 16 bp, Homo sapiens
tttaccccatccctgt

SEQ ID NO: 6556285 - DNA, 15 bp, Homo sapiens
tttacccctgcacag

SEQ ID NO: 6556286 - DNA, 18 bp, Homo sapiens
tttaccctatatctataa

SEQ ID NO: 6556287 - DNA, 21 bp, Homo sapiens
tttaccctcctctatttcttt

SEQ ID NO: 6556288 - DNA, 13 bp, Homo sapiens
tttaccctcttgg

SEQ ID NO: 6556289 - DNA, 14 bp, Homo sapiens
tttaccctggcccc

SEQ ID NO: 6556290 - DNA, 19 bp, Homo sapiens
tttaccctgtgtcagagcc

SEQ ID NO: 6556291 - DNA, 13 bp, Homo sapiens
tttacccttcagg

SEQ ID NO: 6556292 - DNA, 13 bp, Homo sapiens
tttacccttggct

SEQ ID NO: 6556293 - DNA, 22 bp, Homo sapiens
tttaccctttggccccactttg

SEQ ID NO: 6556294 - DNA, 13 bp, Homo sapiens
tttacccttttcc

SEQ ID NO: 6556295 - DNA, 16 bp, Homo sapiens
tttaccgttcacttcc

SEQ ID NO: 6556296 - DNA, 21 bp, Homo sapiens
tttacctactgtgtcttggaa

SEQ ID NO: 6556297 - DNA, 13 bp, Homo sapiens
tttacctagaaga

SEQ ID NO: 6556298 - DNA, 22 bp, Homo sapiens
tttacctagtgcaaaaactgta

SEQ ID NO: 6556299 - DNA, 13 bp, Homo sapiens
tttacctataaaa

SEQ ID NO: 6556300 - DNA, 21 bp, Homo sapiens
tttacctatggaagtggttct

SEQ ID NO: 6556301 - DNA, 15 bp, Homo sapiens
tttacctatgtaaca

SEQ ID NO: 6556302 - DNA, 15 bp, Homo sapiens
tttacctattctgaa

SEQ ID NO: 6556303 - DNA, 18 bp, Homo sapiens
tttacctattctgaaaaa

SEQ ID NO: 6556304 - DNA, 22 bp, Homo sapiens
tttacctattctgaaaaagaca

SEQ ID NO: 6556305 - DNA, 19 bp, Homo sapiens
tttacctcgttctgctcag

SEQ ID NO: 6556306 - DNA, 16 bp, Homo sapiens
tttacctctctctggg

SEQ ID NO: 6556307 - DNA, 16 bp, Homo sapiens
tttacctgcaggctcc

SEQ ID NO: 6556308 - DNA, 18 bp, Homo sapiens
tttacctgtatttaagat

SEQ ID NO: 6556309 - DNA, 19 bp, Homo sapiens
tttacctgtatttaagatt

SEQ ID NO: 6556310 - DNA, 18 bp, Homo sapiens
tttaccttcaaactttag

SEQ ID NO: 6556311 - DNA, 22 bp, Homo sapiens
tttaccttcatttcatcctgtt

SEQ ID NO: 6556312 - DNA, 13 bp, Homo sapiens
tttaccttgaaaa

SEQ ID NO: 6556313 - DNA, 13 bp, Homo sapiens
tttaccttgtata

SEQ ID NO: 6556314 - DNA, 17 bp, Homo sapiens
tttaccttgtcattttg

SEQ ID NO: 6556315 - DNA, 12 bp, Homo sapiens
tttaccttttaa

SEQ ID NO: 6556316 - DNA, 18 bp, Homo sapiens
tttaccttttatgcaaaa

SEQ ID NO: 6556317 - DNA, 19 bp, Homo sapiens
tttaccttttctataagtt

SEQ ID NO: 6556318 - DNA, 17 bp, Homo sapiens
tttaccttttctgttgt

SEQ ID NO: 6556319 - DNA, 22 bp, Homo sapiens
tttacctttttgcttattttac

SEQ ID NO: 6556320 - DNA, 21 bp, Homo sapiens
tttaccttttttatacataaa

SEQ ID NO: 6556321 - DNA, 14 bp, Homo sapiens
tttacgcaaggaag

SEQ ID NO: 6556322 - DNA, 17 bp, Homo sapiens
tttacgtaaaaagatat

SEQ ID NO: 6556323 - DNA, 18 bp, Homo sapiens
tttacgtctgggagaaat

SEQ ID NO: 6556324 - DNA, 14 bp, Homo sapiens
tttacgtgcaaaca

SEQ ID NO: 6556325 - DNA, 17 bp, Homo sapiens
tttacgttcatcacctg

SEQ ID NO: 6556326 - DNA, 12 bp, Homo sapiens
tttacgttgtgt

SEQ ID NO: 6556327 - DNA, 15 bp, Homo sapiens
tttactaaagagaca

SEQ ID NO: 6556328 - DNA, 16 bp, Homo sapiens
tttactaacagtaact

SEQ ID NO: 6556329 - DNA, 17 bp, Homo sapiens
tttactaacagtaactg

SEQ ID NO: 6556330 - DNA, 14 bp, Homo sapiens
tttactaactaaat

SEQ ID NO: 6556331 - DNA, 19 bp, Homo sapiens
tttactaactaaataccat

SEQ ID NO: 6556332 - DNA, 14 bp, Homo sapiens
tttactaagacata

SEQ ID NO: 6556333 - DNA, 20 bp, Homo sapiens
tttactaagccacaagaaat

SEQ ID NO: 6556334 - DNA, 22 bp, Homo sapiens
tttactaagccacaagaaattt

SEQ ID NO: 6556335 - DNA, 14 bp, Homo sapiens
tttactaatagaca

SEQ ID NO: 6556336 - DNA, 17 bp, Homo sapiens
tttactaatagacaatt

SEQ ID NO: 6556337 - DNA, 13 bp, Homo sapiens
tttactaatatat

SEQ ID NO: 6556338 - DNA, 12 bp, Homo sapiens
tttactaatgat

SEQ ID NO: 6556339 - DNA, 21 bp, Homo sapiens
tttactacaatatgtacattt

SEQ ID NO: 6556340 - DNA, 21 bp, Homo sapiens
tttactacagctatgaagaaa

SEQ ID NO: 6556341 - DNA, 12 bp, Homo sapiens
tttactactgtg

SEQ ID NO: 6556342 - DNA, 15 bp, Homo sapiens
tttactactgtggaa

SEQ ID NO: 6556343 - DNA, 18 bp, Homo sapiens
tttactactgtggaaaga

SEQ ID NO: 6556344 - DNA, 22 bp, Homo sapiens
tttactacttctctctgtattt

SEQ ID NO: 6556345 - DNA, 12 bp, Homo sapiens
tttactagaaat

SEQ ID NO: 6556346 - DNA, 23 bp, Homo sapiens
tttactagaaatgggaatcatgg

SEQ ID NO: 6556347 - DNA, 19 bp, Homo sapiens
tttactagactgaggagcc

SEQ ID NO: 6556348 - DNA, 20 bp, Homo sapiens
tttactatcacacatgaata

SEQ ID NO: 6556349 - DNA, 18 bp, Homo sapiens
tttactatcttttcatct

SEQ ID NO: 6556350 - DNA, 17 bp, Homo sapiens
tttactatgccacagat

SEQ ID NO: 6556351 - DNA, 18 bp, Homo sapiens
tttactatgtaaatgctt

SEQ ID NO: 6556352 - DNA, 17 bp, Homo sapiens
tttactattaacatgat

SEQ ID NO: 6556353 - DNA, 19 bp, Homo sapiens
tttactattaacatgatgt

SEQ ID NO: 6556354 - DNA, 24 bp, Homo sapiens
tttactatttcaatacttacatat

SEQ ID NO: 6556355 - DNA, 13 bp, Homo sapiens
tttactattttac

SEQ ID NO: 6556356 - DNA, 22 bp, Homo sapiens
tttactcacattctgttgttca

SEQ ID NO: 6556357 - DNA, 16 bp, Homo sapiens
tttactcagaatagct

SEQ ID NO: 6556358 - DNA, 19 bp, Homo sapiens
tttactcaggctttctatt

SEQ ID NO: 6556359 - DNA, 21 bp, Homo sapiens
tttactcatcctccaggaact

SEQ ID NO: 6556360 - DNA, 13 bp, Homo sapiens
tttactcattatc

SEQ ID NO: 6556361 - DNA, 17 bp, Homo sapiens
tttactcattgaaatgt

SEQ ID NO: 6556362 - DNA, 13 bp, Homo sapiens
tttactccagtgg

SEQ ID NO: 6556363 - DNA, 13 bp, Homo sapiens
tttactccccttg

SEQ ID NO: 6556364 - DNA, 19 bp, Homo sapiens
tttactcccttcctggcct

SEQ ID NO: 6556365 - DNA, 11 bp, Homo sapiens
tttactcctgg

SEQ ID NO: 6556366 - DNA, 21 bp, Homo sapiens
tttactctatgccccaaatat

SEQ ID NO: 6556367 - DNA, 17 bp, Homo sapiens
tttactctcttcatccg

SEQ ID NO: 6556368 - DNA, 12 bp, Homo sapiens
tttactctgtgt

SEQ ID NO: 6556369 - DNA, 21 bp, Homo sapiens
tttactctgttgaatatttag

SEQ ID NO: 6556370 - DNA, 13 bp, Homo sapiens
tttactcttaaat

SEQ ID NO: 6556371 - DNA, 15 bp, Homo sapiens
tttactcttaaatca

SEQ ID NO: 6556372 - DNA, 12 bp, Homo sapiens
tttactctttca

SEQ ID NO: 6556373 - DNA, 13 bp, Homo sapiens
tttactctttcat

SEQ ID NO: 6556374 - DNA, 14 bp, Homo sapiens
tttactctttgaaa

SEQ ID NO: 6556375 - DNA, 17 bp, Homo sapiens
tttactctttttctaaa

SEQ ID NO: 6556376 - DNA, 12 bp, Homo sapiens
tttactgaatgt

SEQ ID NO: 6556377 - DNA, 18 bp, Homo sapiens
tttactgaatgttagaag

SEQ ID NO: 6556378 - DNA, 22 bp, Homo sapiens
tttactgacacttcctgtcctt

SEQ ID NO: 6556379 - DNA, 14 bp, Homo sapiens
tttactgacagaaa

SEQ ID NO: 6556380 - DNA, 18 bp, Homo sapiens
tttactgaccctggggct

SEQ ID NO: 6556381 - DNA, 13 bp, Homo sapiens
tttactgagactt

SEQ ID NO: 6556382 - DNA, 15 bp, Homo sapiens
tttactgatactaca

SEQ ID NO: 6556383 - DNA, 18 bp, Homo sapiens
tttactgatgagagaatg

SEQ ID NO: 6556384 - DNA, 16 bp, Homo sapiens
tttactgcagctttgt

SEQ ID NO: 6556385 - DNA, 21 bp, Homo sapiens
tttactgcattttcacaacat

SEQ ID NO: 6556386 - DNA, 17 bp, Homo sapiens
tttactgcctgaataaa

SEQ ID NO: 6556387 - DNA, 22 bp, Homo sapiens
tttactgcctgaataaagagcc

SEQ ID NO: 6556388 - DNA, 13 bp, Homo sapiens
tttactgcctgta

SEQ ID NO: 6556389 - DNA, 22 bp, Homo sapiens
tttactgctccttccatctgcc

SEQ ID NO: 6556390 - DNA, 16 bp, Homo sapiens
tttactgctctagaaa

SEQ ID NO: 6556391 - DNA, 15 bp, Homo sapiens
tttactgctctgaga

SEQ ID NO: 6556392 - DNA, 19 bp, Homo sapiens
tttactgctttctgaatgt

SEQ ID NO: 6556393 - DNA, 19 bp, Homo sapiens
tttactgcttttcattagc

SEQ ID NO: 6556394 - DNA, 19 bp, Homo sapiens
tttactggccatacaaaat

SEQ ID NO: 6556395 - DNA, 19 bp, Homo sapiens
tttactggttgcatggaaa

SEQ ID NO: 6556396 - DNA, 17 bp, Homo sapiens
tttactgtctatatata

SEQ ID NO: 6556397 - DNA, 19 bp, Homo sapiens
tttactgtctgtaagagaa

SEQ ID NO: 6556398 - DNA, 21 bp, Homo sapiens
tttactgtcttaattaagtaa

SEQ ID NO: 6556399 - DNA, 21 bp, Homo sapiens
tttactgtgaaaaaaaatttg

SEQ ID NO: 6556400 - DNA, 17 bp, Homo sapiens
tttactgtgaaactggc

SEQ ID NO: 6556401 - DNA, 17 bp, Homo sapiens
tttactgtgaagagaat

SEQ ID NO: 6556402 - DNA, 19 bp, Homo sapiens
tttactgtgtatctcaata

SEQ ID NO: 6556403 - DNA, 22 bp, Homo sapiens
tttactgttacaatattaggtg

SEQ ID NO: 6556404 - DNA, 19 bp, Homo sapiens
tttactgttatcctattta

SEQ ID NO: 6556405 - DNA, 17 bp, Homo sapiens
tttactgttatttaatt

SEQ ID NO: 6556406 - DNA, 14 bp, Homo sapiens
tttactgttgtaca

SEQ ID NO: 6556407 - DNA, 18 bp, Homo sapiens
tttactgttttaattgta

SEQ ID NO: 6556408 - DNA, 20 bp, Homo sapiens
tttactgttttaattgtagt

SEQ ID NO: 6556409 - DNA, 14 bp, Homo sapiens
tttacttaaagatt

SEQ ID NO: 6556410 - DNA, 15 bp, Homo sapiens
tttacttaaagattt

SEQ ID NO: 6556411 - DNA, 16 bp, Homo sapiens
tttacttaaagattta

SEQ ID NO: 6556412 - DNA, 14 bp, Homo sapiens
tttacttaagactt

SEQ ID NO: 6556413 - DNA, 20 bp, Homo sapiens
tttacttaagtgttcatttt

SEQ ID NO: 6556414 - DNA, 18 bp, Homo sapiens
ttaaggtttgcaaattaa

SEQ ID NO: 6556415 - DNA, 18 bp, Homo sapiens
ttaaggtttgttttcatt

SEQ ID NO: 6556416 - DNA, 15 bp, Homo sapiens
ttaagtaaaaaatat

SEQ ID NO: 6556417 - DNA, 17 bp, Homo sapiens
ttaagtaaaatgtcata

SEQ ID NO: 6556418 - DNA, 19 bp, Homo sapiens
ttaagtaaactaatgagtt

SEQ ID NO: 6556419 - DNA, 15 bp, Homo sapiens
ttaagtaacgtgctc

SEQ ID NO: 6556420 - DNA, 16 bp, Homo sapiens
ttaagtaacgtgctca

SEQ ID NO: 6556421 - DNA, 18 bp, Homo sapiens
ttaagtaaggaattttat

SEQ ID NO: 6556422 - DNA, 23 bp, Homo sapiens
ttaagtaaggacaaagaaggaaa

SEQ ID NO: 6556423 - DNA, 15 bp, Homo sapiens
ttaagtaatgtggaa

SEQ ID NO: 6556424 - DNA, 14 bp, Homo sapiens
ttaagtaattgcca

SEQ ID NO: 6556425 - DNA, 22 bp, Homo sapiens
ttaagtaattgcctacaataaa

SEQ ID NO: 6556426 - DNA, 16 bp, Homo sapiens
ttaagtaatttcatgc

SEQ ID NO: 6556427 - DNA, 22 bp, Homo sapiens
ttaagtaatttccccactctga

SEQ ID NO: 6556428 - DNA, 17 bp, Homo sapiens
ttaagtactatctttgt

SEQ ID NO: 6556429 - DNA, 17 bp, Homo sapiens
ttaagtactatgtatca

SEQ ID NO: 6556430 - DNA, 16 bp, Homo sapiens
ttaagtagaacaaaaa

SEQ ID NO: 6556431 - DNA, 12 bp, Homo sapiens
ttaagtagattt

SEQ ID NO: 6556432 - DNA, 14 bp, Homo sapiens
ttaagtatatatat

SEQ ID NO: 6556433 - DNA, 16 bp, Homo sapiens
ttaagtatatttgtaa

SEQ ID NO: 6556434 - DNA, 18 bp, Homo sapiens
ttaagtatatttgtaaaa

SEQ ID NO: 6556435 - DNA, 14 bp, Homo sapiens
ttaagtatcagaaa

SEQ ID NO: 6556436 - DNA, 14 bp, Homo sapiens
ttaagtatcttttt

SEQ ID NO: 6556437 - DNA, 23 bp, Homo sapiens
ttaagtattgattctgcttgaga

SEQ ID NO: 6556438 - DNA, 15 bp, Homo sapiens
ttaagtattgcatct

SEQ ID NO: 6556439 - DNA, 19 bp, Homo sapiens
ttaagtatttatatattta

SEQ ID NO: 6556440 - DNA, 18 bp, Homo sapiens
ttaagtcataatgaataa

SEQ ID NO: 6556441 - DNA, 16 bp, Homo sapiens
ttaagtcatcattact

SEQ ID NO: 6556442 - DNA, 17 bp, Homo sapiens
ttaagtcattttgtaat

SEQ ID NO: 6556443 - DNA, 19 bp, Homo sapiens
ttaagtcattttttacttg

SEQ ID NO: 6556444 - DNA, 22 bp, Homo sapiens
ttaagtcattttttacttgaat

SEQ ID NO: 6556445 - DNA, 22 bp, Homo sapiens
ttaagtccagctcatttcagtt

SEQ ID NO: 6556446 - DNA, 22 bp, Homo sapiens
ttaagtcccagtatacctcatt

SEQ ID NO: 6556447 - DNA, 17 bp, Homo sapiens
ttaagtctcagtacact

SEQ ID NO: 6556448 - DNA, 19 bp, Homo sapiens
ttaagtctcgaatgtaatt

SEQ ID NO: 6556449 - DNA, 23 bp, Homo sapiens
ttaagtctctgactcttgccttt

SEQ ID NO: 6556450 - DNA, 19 bp, Homo sapiens
ttaagtctgggatgtagaa

SEQ ID NO: 6556451 - DNA, 22 bp, Homo sapiens
ttaagtctgggatgtagaactt

SEQ ID NO: 6556452 - DNA, 15 bp, Homo sapiens
ttaagtctgttttat

SEQ ID NO: 6556453 - DNA, 21 bp, Homo sapiens
ttaagtctgttttatgacttc

SEQ ID NO: 6556454 - DNA, 15 bp, Homo sapiens
ttaagtcttactgtt

SEQ ID NO: 6556455 - DNA, 16 bp, Homo sapiens
ttaagtcttcaaattt

SEQ ID NO: 6556456 - DNA, 18 bp, Homo sapiens
ttaagtctttattaactt

SEQ ID NO: 6556457 - DNA, 12 bp, Homo sapiens
ttaagtgaaatt

SEQ ID NO: 6556458 - DNA, 15 bp, Homo sapiens
ttaagtgaaatttat

SEQ ID NO: 6556459 - DNA, 12 bp, Homo sapiens
ttaagtgacaca

SEQ ID NO: 6556460 - DNA, 18 bp, Homo sapiens
ttaagtgacacagacatt

SEQ ID NO: 6556461 - DNA, 20 bp, Homo sapiens
ttaagtgaggaaatcaaagt

SEQ ID NO: 6556462 - DNA, 22 bp, Homo sapiens
ttaagtgagtcctgttcttcct

SEQ ID NO: 6556463 - DNA, 16 bp, Homo sapiens
ttaagtgatgaacatt

SEQ ID NO: 6556464 - DNA, 24 bp, Homo sapiens
ttaagtgcaacatttctgtatact

SEQ ID NO: 6556465 - DNA, 23 bp, Homo sapiens
ttaagtgccattactactgtaca

SEQ ID NO: 6556466 - DNA, 19 bp, Homo sapiens
ttaagtgcgtgtgtagagt

SEQ ID NO: 6556467 - DNA, 14 bp, Homo sapiens
ttaagtgctgcagc

SEQ ID NO: 6556468 - DNA, 14 bp, Homo sapiens
ttaagtgctgcatt

SEQ ID NO: 6556469 - DNA, 16 bp, Homo sapiens
ttaagtgctgcattta

SEQ ID NO: 6556470 - DNA, 19 bp, Homo sapiens
ttaagtgctgcatttaaaa

SEQ ID NO: 6556471 - DNA, 12 bp, Homo sapiens
ttaagtgcttac

SEQ ID NO: 6556472 - DNA, 21 bp, Homo sapiens
ttaagtgcttgaggccaaatg

SEQ ID NO: 6556473 - DNA, 16 bp, Homo sapiens
ttaagtgctttgtaat

SEQ ID NO: 6556474 - DNA, 19 bp, Homo sapiens
ttaagtggactgtatttcg

SEQ ID NO: 6556475 - DNA, 16 bp, Homo sapiens
ttaagtggatctgttt

SEQ ID NO: 6556476 - DNA, 16 bp, Homo sapiens
ttaagtgggctcctga

SEQ ID NO: 6556477 - DNA, 17 bp, Homo sapiens
ttaagtgggctcctgac

SEQ ID NO: 6556478 - DNA, 20 bp, Homo sapiens
ttaagtggtctagtcaagga

SEQ ID NO: 6556479 - DNA, 16 bp, Homo sapiens
ttaagtgtcatttctt

SEQ ID NO: 6556480 - DNA, 22 bp, Homo sapiens
ttaagtgtgcagccatagtttg

SEQ ID NO: 6556481 - DNA, 13 bp, Homo sapiens
ttaagtgtgtata

SEQ ID NO: 6556482 - DNA, 13 bp, Homo sapiens
ttaagtgttcatt

SEQ ID NO: 6556483 - DNA, 16 bp, Homo sapiens
ttaagtgttctgtggc

SEQ ID NO: 6556484 - DNA, 22 bp, Homo sapiens
ttaagtgttgtacaattactgt

SEQ ID NO: 6556485 - DNA, 18 bp, Homo sapiens
ttaagtgtttaaaagcaa

SEQ ID NO: 6556486 - DNA, 13 bp, Homo sapiens
ttaagtgtttctc

SEQ ID NO: 6556487 - DNA, 23 bp, Homo sapiens
ttaagtgtttctcaaaagaggtt

SEQ ID NO: 6556488 - DNA, 16 bp, Homo sapiens
ttaagtgtttgaaaac

SEQ ID NO: 6556489 - DNA, 18 bp, Homo sapiens
ttaagttaatgaaataaa

SEQ ID NO: 6556490 - DNA, 23 bp, Homo sapiens
ttaagttaatgaaataaaatttg

SEQ ID NO: 6556491 - DNA, 22 bp, Homo sapiens
ttaagttacacatttttcagat

SEQ ID NO: 6556492 - DNA, 14 bp, Homo sapiens
ttaagttagagaat

SEQ ID NO: 6556493 - DNA, 19 bp, Homo sapiens
ttaagttagagaatatatt

SEQ ID NO: 6556494 - DNA, 13 bp, Homo sapiens
ttaagttcacttt

SEQ ID NO: 6556495 - DNA, 13 bp, Homo sapiens
ttaagttccagca

SEQ ID NO: 6556496 - DNA, 22 bp, Homo sapiens
ttaagttctggatgcatttctc

SEQ ID NO: 6556497 - DNA, 12 bp, Homo sapiens
ttaagttcttat

SEQ ID NO: 6556498 - DNA, 21 bp, Homo sapiens
ttaagttctttgatttgtacc

SEQ ID NO: 6556499 - DNA, 21 bp, Homo sapiens
ttaagttgagatagttttcat

SEQ ID NO: 6556500 - DNA, 19 bp, Homo sapiens
ttaagttggctagagcttc

SEQ ID NO: 6556501 - DNA, 19 bp, Homo sapiens
ttaagttgtaaacgtcttt

SEQ ID NO: 6556502 - DNA, 23 bp, Homo sapiens
ttaagttgtaaacgtctttttaa

SEQ ID NO: 6556503 - DNA, 13 bp, Homo sapiens
ttaagttgtcaaa

SEQ ID NO: 6556504 - DNA, 18 bp, Homo sapiens
ttaagttgtcaaagaagc

SEQ ID NO: 6556505 - DNA, 13 bp, Homo sapiens
ttaagttgttgaa

SEQ ID NO: 6556506 - DNA, 11 bp, Homo sapiens
ttaagtttaga

SEQ ID NO: 6556507 - DNA, 23 bp, Homo sapiens
ttaagtttagaaattacaagttt

SEQ ID NO: 6556508 - DNA, 16 bp, Homo sapiens
ttaagtttcaaactta

SEQ ID NO: 6556509 - DNA, 22 bp, Homo sapiens
ttaagtttcaaacttactattt

SEQ ID NO: 6556510 - DNA, 20 bp, Homo sapiens
ttaagtttccttccagccca

SEQ ID NO: 6556511 - DNA, 15 bp, Homo sapiens
ttaagtttctcagct

SEQ ID NO: 6556512 - DNA, 19 bp, Homo sapiens
ttaagtttgcagatttatt

SEQ ID NO: 6556513 - DNA, 16 bp, Homo sapiens
ttaagtttgtgaatgt

SEQ ID NO: 6556514 - DNA, 18 bp, Homo sapiens
ttaagttttatttaactt

SEQ ID NO: 6556515 - DNA, 20 bp, Homo sapiens
ttaagttttgacaagctggc

SEQ ID NO: 6556516 - DNA, 17 bp, Homo sapiens
ttaagtttttttcctct

SEQ ID NO: 6556517 - DNA, 21 bp, Homo sapiens
ttaataaaaagctttttcctc

SEQ ID NO: 6556518 - DNA, 14 bp, Homo sapiens
ttaataaaaaggaa

SEQ ID NO: 6556519 - DNA, 17 bp, Homo sapiens
ttaataaaaaggaaata

SEQ ID NO: 6556520 - DNA, 14 bp, Homo sapiens
ttaataaaaaggca

SEQ ID NO: 6556521 - DNA, 15 bp, Homo sapiens
ttaataaaaatacac

SEQ ID NO: 6556522 - DNA, 17 bp, Homo sapiens
ttaataaaaatgacaga

SEQ ID NO: 6556523 - DNA, 18 bp, Homo sapiens
ttaataaaacactatttt

SEQ ID NO: 6556524 - DNA, 12 bp, Homo sapiens
ttaataaaactg

SEQ ID NO: 6556525 - DNA, 16 bp, Homo sapiens
ttaataaaactgcaca

SEQ ID NO: 6556526 - DNA, 18 bp, Homo sapiens
ttaataaaactgcgagga

SEQ ID NO: 6556527 - DNA, 20 bp, Homo sapiens
ttaataaaactgcgaggaca

SEQ ID NO: 6556528 - DNA, 20 bp, Homo sapiens
ttaataaaagaaaattacaa

SEQ ID NO: 6556529 - DNA, 15 bp, Homo sapiens
ttaataaaagaacat

SEQ ID NO: 6556530 - DNA, 14 bp, Homo sapiens
ttaataaaataatt

SEQ ID NO: 6556531 - DNA, 16 bp, Homo sapiens
ttaataaaataattct

SEQ ID NO: 6556532 - DNA, 21 bp, Homo sapiens
ttaataaaatattcgaaattc

SEQ ID NO: 6556533 - DNA, 13 bp, Homo sapiens
ttaataaaattga

SEQ ID NO: 6556534 - DNA, 17 bp, Homo sapiens
ttaataaacactcttga

SEQ ID NO: 6556535 - DNA, 23 bp, Homo sapiens
ttaataaacgtccacagagtata

SEQ ID NO: 6556536 - DNA, 16 bp, Homo sapiens
ttaataaacgtttgaa

SEQ ID NO: 6556537 - DNA, 19 bp, Homo sapiens
ttaataaacgtttgaaatt

SEQ ID NO: 6556538 - DNA, 19 bp, Homo sapiens
ttaataaactactctttga

SEQ ID NO: 6556539 - DNA, 14 bp, Homo sapiens
ttaataaactgcaa

SEQ ID NO: 6556540 - DNA, 13 bp, Homo sapiens
ttaataaagaaat

SEQ ID NO: 6556541 - DNA, 14 bp, Homo sapiens
ttaataaagaaata

SEQ ID NO: 6556542 - DNA, 15 bp, Homo sapiens
ttaataaagaaatat

SEQ ID NO: 6556543 - DNA, 16 bp, Homo sapiens
ttaataaagaaatatt

SEQ ID NO: 6556544 - DNA, 19 bp, Homo sapiens
ttaataaagaaatatttac

SEQ ID NO: 6556545 - DNA, 21 bp, Homo sapiens
ttaataaagaaatatttacct

SEQ ID NO: 6556546 - DNA, 14 bp, Homo sapiens
ttaataaagatgag

SEQ ID NO: 6556547 - DNA, 15 bp, Homo sapiens
ttaataaagatgagt

SEQ ID NO: 6556548 - DNA, 17 bp, Homo sapiens
ttaataaagatgattga

SEQ ID NO: 6556549 - DNA, 12 bp, Homo sapiens
ttaataaagcat

SEQ ID NO: 6556550 - DNA, 13 bp, Homo sapiens
ttaataaagcttt

SEQ ID NO: 6556551 - DNA, 21 bp, Homo sapiens
ttaataaaggccacaggagac

SEQ ID NO: 6556552 - DNA, 21 bp, Homo sapiens
ttaataaaggtcttaaataat

SEQ ID NO: 6556553 - DNA, 13 bp, Homo sapiens
ttaataaagtata

SEQ ID NO: 6556554 - DNA, 18 bp, Homo sapiens
ttaataaatattgtattt

SEQ ID NO: 6556555 - DNA, 20 bp, Homo sapiens
ttaataaattatttattatt

SEQ ID NO: 6556556 - DNA, 18 bp, Homo sapiens
ttaataaattggtaatat

SEQ ID NO: 6556557 - DNA, 13 bp, Homo sapiens
ttaataaattttc

SEQ ID NO: 6556558 - DNA, 17 bp, Homo sapiens
ttaataaattttccatt

SEQ ID NO: 6556559 - DNA, 23 bp, Homo sapiens
ttaataacaatatatagaattgt

SEQ ID NO: 6556560 - DNA, 16 bp, Homo sapiens
ttaataacagaaatac

SEQ ID NO: 6556561 - DNA, 17 bp, Homo sapiens
ttaataacattacctta

SEQ ID NO: 6556562 - DNA, 20 bp, Homo sapiens
ttaataacattaccttactg

SEQ ID NO: 6556563 - DNA, 18 bp, Homo sapiens
ttaataactttctctgtg

SEQ ID NO: 6556564 - DNA, 23 bp, Homo sapiens
ttaataagagtaaaaatatgtga

SEQ ID NO: 6556565 - DNA, 14 bp, Homo sapiens
ttaataataaattc

SEQ ID NO: 6556566 - DNA, 23 bp, Homo sapiens
ttaataataagataatgatgagt

SEQ ID NO: 6556567 - DNA, 13 bp, Homo sapiens
ttaataataatct

SEQ ID NO: 6556568 - DNA, 16 bp, Homo sapiens
ttaataataatctagg

SEQ ID NO: 6556569 - DNA, 23 bp, Homo sapiens
ttaataataatgccaatgaacat

SEQ ID NO: 6556570 - DNA, 16 bp, Homo sapiens
ttaataatatacttgt

SEQ ID NO: 6556571 - DNA, 20 bp, Homo sapiens
ttaataatggttactcattt

SEQ ID NO: 6556572 - DNA, 21 bp, Homo sapiens
ttaataatggttactcatttt

SEQ ID NO: 6556573 - DNA, 22 bp, Homo sapiens
ttaataatgtattgtaatcttt

SEQ ID NO: 6556574 - DNA, 16 bp, Homo sapiens
ttaataatgtttcaaa

SEQ ID NO: 6556575 - DNA, 21 bp, Homo sapiens
ttaatacaagtaatattatta

SEQ ID NO: 6556576 - DNA, 13 bp, Homo sapiens
ttaatacagataa

SEQ ID NO: 6556577 - DNA, 22 bp, Homo sapiens
ttaatacagattgaaaggacct

SEQ ID NO: 6556578 - DNA, 17 bp, Homo sapiens
ttaatacagctcagtaa

SEQ ID NO: 6556579 - DNA, 14 bp, Homo sapiens
ttaatacaggactt

SEQ ID NO: 6556580 - DNA, 22 bp, Homo sapiens
ttaatacagtttatttttaaag

SEQ ID NO: 6556581 - DNA, 20 bp, Homo sapiens
ttaatacatcacatcttatt

SEQ ID NO: 6556582 - DNA, 15 bp, Homo sapiens
ttaatacatcatttt

SEQ ID NO: 6556583 - DNA, 15 bp, Homo sapiens
ttaataccaccaaca

SEQ ID NO: 6556584 - DNA, 16 bp, Homo sapiens
ttaatacccatgcttt

SEQ ID NO: 6556585 - DNA, 16 bp, Homo sapiens
ttaataccctgtacat

SEQ ID NO: 6556586 - DNA, 14 bp, Homo sapiens
ttaatacctttaaa

SEQ ID NO: 6556587 - DNA, 20 bp, Homo sapiens
ttaatacctttaaatatcat

SEQ ID NO: 6556588 - DNA, 21 bp, Homo sapiens
ttaatacctttaaatatcatt

SEQ ID NO: 6556589 - DNA, 21 bp, Homo sapiens
ttaatacctttggaaaaatct

SEQ ID NO: 6556590 - DNA, 15 bp, Homo sapiens
ttaatactaaaatat

SEQ ID NO: 6556591 - DNA, 15 bp, Homo sapiens
ttaatactaccttga

SEQ ID NO: 6556592 - DNA, 21 bp, Homo sapiens
tttacttactgctatctacta

SEQ ID NO: 6556593 - DNA, 16 bp, Homo sapiens
tttacttatcttatgc

SEQ ID NO: 6556594 - DNA, 15 bp, Homo sapiens
tttacttcactttca

SEQ ID NO: 6556595 - DNA, 17 bp, Homo sapiens
tttacttctaatcttaa

SEQ ID NO: 6556596 - DNA, 20 bp, Homo sapiens
tttacttctcgaattgaagc

SEQ ID NO: 6556597 - DNA, 13 bp, Homo sapiens
tttacttctggcc

SEQ ID NO: 6556598 - DNA, 13 bp, Homo sapiens
tttacttcttata

SEQ ID NO: 6556599 - DNA, 19 bp, Homo sapiens
tttacttcttatacatttg

SEQ ID NO: 6556600 - DNA, 12 bp, Homo sapiens
tttacttgaaag

SEQ ID NO: 6556601 - DNA, 16 bp, Homo sapiens
tttacttggaaataat

SEQ ID NO: 6556602 - DNA, 18 bp, Homo sapiens
tttacttggtgaggagga

SEQ ID NO: 6556603 - DNA, 22 bp, Homo sapiens
tttacttgtagaaatctgtaat

SEQ ID NO: 6556604 - DNA, 13 bp, Homo sapiens
tttacttgtctgt

SEQ ID NO: 6556605 - DNA, 23 bp, Homo sapiens
tttacttgttcatttctgtctcc

SEQ ID NO: 6556606 - DNA, 15 bp, Homo sapiens
tttacttgtttcaga

SEQ ID NO: 6556607 - DNA, 16 bp, Homo sapiens
tttactttaaacttgt

SEQ ID NO: 6556608 - DNA, 18 bp, Homo sapiens
tttactttagaagcctgc

SEQ ID NO: 6556609 - DNA, 22 bp, Homo sapiens
tttactttattaatatgagtta

SEQ ID NO: 6556610 - DNA, 17 bp, Homo sapiens
tttactttcccttgctt

SEQ ID NO: 6556611 - DNA, 14 bp, Homo sapiens
tttactttgccaac

SEQ ID NO: 6556612 - DNA, 15 bp, Homo sapiens
tttactttgtgcaat

SEQ ID NO: 6556613 - DNA, 18 bp, Homo sapiens
tttacttttaaacagtga

SEQ ID NO: 6556614 - DNA, 18 bp, Homo sapiens
tttacttttcacactgtc

SEQ ID NO: 6556615 - DNA, 13 bp, Homo sapiens
tttacttttgttt

SEQ ID NO: 6556616 - DNA, 17 bp, Homo sapiens
tttactttttatttgca

SEQ ID NO: 6556617 - DNA, 23 bp, Homo sapiens
tttacttttttaaaattgtgttc

SEQ ID NO: 6556618 - DNA, 20 bp, Homo sapiens
tttacttttttacactgagt

SEQ ID NO: 6556619 - DNA, 15 bp, Homo sapiens
tttagaaaaaaaact

SEQ ID NO: 6556620 - DNA, 21 bp, Homo sapiens
tttagaaaaaaaactgaagat

SEQ ID NO: 6556621 - DNA, 23 bp, Homo sapiens
tttagaaaaacatttaaactttt

SEQ ID NO: 6556622 - DNA, 19 bp, Homo sapiens
tttagaaaaagaacatgca

SEQ ID NO: 6556623 - DNA, 19 bp, Homo sapiens
tttagaaaacccaagtttt

SEQ ID NO: 6556624 - DNA, 15 bp, Homo sapiens
tttagaaaactttaa

SEQ ID NO: 6556625 - DNA, 22 bp, Homo sapiens
tttagaaacagtgcaacactgg

SEQ ID NO: 6556626 - DNA, 21 bp, Homo sapiens
tttagaaacctcattggccag

SEQ ID NO: 6556627 - DNA, 12 bp, Homo sapiens
tttagaaactga

SEQ ID NO: 6556628 - DNA, 18 bp, Homo sapiens
tttagaaactgatttctt

SEQ ID NO: 6556629 - DNA, 19 bp, Homo sapiens
tttagaaacttatcttaca

SEQ ID NO: 6556630 - DNA, 15 bp, Homo sapiens
tttagaaagaaaatt

SEQ ID NO: 6556631 - DNA, 13 bp, Homo sapiens
tttagaaagaaat

SEQ ID NO: 6556632 - DNA, 20 bp, Homo sapiens
tttagaaatactgcaagaaa

SEQ ID NO: 6556633 - DNA, 22 bp, Homo sapiens
tttagaaatactgcaagaaaat

SEQ ID NO: 6556634 - DNA, 11 bp, Homo sapiens
tttagaaatat

SEQ ID NO: 6556635 - DNA, 16 bp, Homo sapiens
tttagaaatatccttt

SEQ ID NO: 6556636 - DNA, 11 bp, Homo sapiens
tttagaaatga

SEQ ID NO: 6556637 - DNA, 15 bp, Homo sapiens
tttagaaatgatttc

SEQ ID NO: 6556638 - DNA, 14 bp, Homo sapiens
tttagaaatgcata

SEQ ID NO: 6556639 - DNA, 17 bp, Homo sapiens
tttagaacaacataaaa

SEQ ID NO: 6556640 - DNA, 15 bp, Homo sapiens
tttagaacagaaaac

SEQ ID NO: 6556641 - DNA, 18 bp, Homo sapiens
tttagaacagaaaacaac

SEQ ID NO: 6556642 - DNA, 16 bp, Homo sapiens
tttagaacagcattgt

SEQ ID NO: 6556643 - DNA, 14 bp, Homo sapiens
tttagaacaggaga

SEQ ID NO: 6556644 - DNA, 14 bp, Homo sapiens
tttagaacaggttt

SEQ ID NO: 6556645 - DNA, 17 bp, Homo sapiens
tttagaaccgtaggttt

SEQ ID NO: 6556646 - DNA, 19 bp, Homo sapiens
tttagaacctaacttttat

SEQ ID NO: 6556647 - DNA, 18 bp, Homo sapiens
tttagaacctgcatttaa

SEQ ID NO: 6556648 - DNA, 20 bp, Homo sapiens
tttagaacgagcctggaagc

SEQ ID NO: 6556649 - DNA, 21 bp, Homo sapiens
tttagaagcaaagatttcagt

SEQ ID NO: 6556650 - DNA, 11 bp, Homo sapiens
tttagaagcag

SEQ ID NO: 6556651 - DNA, 14 bp, Homo sapiens
tttagaagccaact

SEQ ID NO: 6556652 - DNA, 23 bp, Homo sapiens
tttagaagcctgacaactcattt

SEQ ID NO: 6556653 - DNA, 14 bp, Homo sapiens
tttagaagtagaat

SEQ ID NO: 6556654 - DNA, 15 bp, Homo sapiens
tttagaagtgtcatg

SEQ ID NO: 6556655 - DNA, 23 bp, Homo sapiens
tttagaataaattcccaacttct

SEQ ID NO: 6556656 - DNA, 21 bp, Homo sapiens
tttagaataagaatttgcata

SEQ ID NO: 6556657 - DNA, 14 bp, Homo sapiens
tttagaatatatta

SEQ ID NO: 6556658 - DNA, 17 bp, Homo sapiens
tttagaatatgccttgt

SEQ ID NO: 6556659 - DNA, 19 bp, Homo sapiens
tttagaatcaagtctgtga

SEQ ID NO: 6556660 - DNA, 16 bp, Homo sapiens
tttagaatcagaataa

SEQ ID NO: 6556661 - DNA, 14 bp, Homo sapiens
tttagaatcccagc

SEQ ID NO: 6556662 - DNA, 16 bp, Homo sapiens
tttagaatctagaaat

SEQ ID NO: 6556663 - DNA, 22 bp, Homo sapiens
tttagaatgatgcacatttcat

SEQ ID NO: 6556664 - DNA, 21 bp, Homo sapiens
tttagaatggaggaagaacaa

SEQ ID NO: 6556665 - DNA, 23 bp, Homo sapiens
tttagaatggttgagttacatta

SEQ ID NO: 6556666 - DNA, 21 bp, Homo sapiens
tttagaatgttgaaaagtaat

SEQ ID NO: 6556667 - DNA, 11 bp, Homo sapiens
tttagaattga

SEQ ID NO: 6556668 - DNA, 13 bp, Homo sapiens
tttagaattgaag

SEQ ID NO: 6556669 - DNA, 15 bp, Homo sapiens
tttagaattgaaggt

SEQ ID NO: 6556670 - DNA, 17 bp, Homo sapiens
tttagaatttgaaagga

SEQ ID NO: 6556671 - DNA, 23 bp, Homo sapiens
tttagacaaagccttaagcaaat

SEQ ID NO: 6556672 - DNA, 18 bp, Homo sapiens
tttagacaaatactcatg

SEQ ID NO: 6556673 - DNA, 23 bp, Homo sapiens
tttagacaaatactcatgtgtat

SEQ ID NO: 6556674 - DNA, 21 bp, Homo sapiens
tttagacaaccatagaactgt

SEQ ID NO: 6556675 - DNA, 14 bp, Homo sapiens
tttagacaactaga

SEQ ID NO: 6556676 - DNA, 15 bp, Homo sapiens
tttagacaactagat

SEQ ID NO: 6556677 - DNA, 19 bp, Homo sapiens
tttagacaccttcattttg

SEQ ID NO: 6556678 - DNA, 14 bp, Homo sapiens
tttagacactggct

SEQ ID NO: 6556679 - DNA, 16 bp, Homo sapiens
tttagacagtctcact

SEQ ID NO: 6556680 - DNA, 15 bp, Homo sapiens
tttagaccatttatc

SEQ ID NO: 6556681 - DNA, 22 bp, Homo sapiens
tttagaccctattgctgcttga

SEQ ID NO: 6556682 - DNA, 19 bp, Homo sapiens
tttagacctcatctccaag

SEQ ID NO: 6556683 - DNA, 19 bp, Homo sapiens
tttagactaagggcaggaa

SEQ ID NO: 6556684 - DNA, 21 bp, Homo sapiens
tttagacttgaaaagagacag

SEQ ID NO: 6556685 - DNA, 22 bp, Homo sapiens
tttagacttgaaaagagacagg

SEQ ID NO: 6556686 - DNA, 21 bp, Homo sapiens
tttagacttggattctttcca

SEQ ID NO: 6556687 - DNA, 15 bp, Homo sapiens
tttagactttaaaat

SEQ ID NO: 6556688 - DNA, 15 bp, Homo sapiens
tttagactttaacat

SEQ ID NO: 6556689 - DNA, 20 bp, Homo sapiens
tttagagaactgaaaagaga

SEQ ID NO: 6556690 - DNA, 18 bp, Homo sapiens
tttagagaactgtggccg

SEQ ID NO: 6556691 - DNA, 21 bp, Homo sapiens
tttagagaatgtgtttcaaaa

SEQ ID NO: 6556692 - DNA, 14 bp, Homo sapiens
tttagagataaata

SEQ ID NO: 6556693 - DNA, 18 bp, Homo sapiens
tttagagataattgcttg

SEQ ID NO: 6556694 - DNA, 21 bp, Homo sapiens
tttagagcattaaaataacta

SEQ ID NO: 6556695 - DNA, 16 bp, Homo sapiens
tttagagccctcccta

SEQ ID NO: 6556696 - DNA, 19 bp, Homo sapiens
tttagagcgtttggttaaa

SEQ ID NO: 6556697 - DNA, 16 bp, Homo sapiens
tttagagcttccaaat

SEQ ID NO: 6556698 - DNA, 18 bp, Homo sapiens
tttagaggaacccaagat

SEQ ID NO: 6556699 - DNA, 21 bp, Homo sapiens
tttagagtatgcaagaagaat

SEQ ID NO: 6556700 - DNA, 18 bp, Homo sapiens
tttagagtgtaggtgaaa

SEQ ID NO: 6556701 - DNA, 16 bp, Homo sapiens
tttagagttagactgt

SEQ ID NO: 6556702 - DNA, 18 bp, Homo sapiens
tttagagttgatactaca

SEQ ID NO: 6556703 - DNA, 15 bp, Homo sapiens
tttagataatacacc

SEQ ID NO: 6556704 - DNA, 16 bp, Homo sapiens
tttagataatttgaaa

SEQ ID NO: 6556705 - DNA, 22 bp, Homo sapiens
tttagatatattctctaataaa

SEQ ID NO: 6556706 - DNA, 15 bp, Homo sapiens
tttagatatctagac

SEQ ID NO: 6556707 - DNA, 18 bp, Homo sapiens
tttagatattcatacttt

SEQ ID NO: 6556708 - DNA, 15 bp, Homo sapiens
tttagatattttcca

SEQ ID NO: 6556709 - DNA, 24 bp, Homo sapiens
tttagatcaaggcaaaaatatcag

SEQ ID NO: 6556710 - DNA, 21 bp, Homo sapiens
tttagatcccatgtcacctca

SEQ ID NO: 6556711 - DNA, 22 bp, Homo sapiens
tttagatcccatgtcacctcag

SEQ ID NO: 6556712 - DNA, 17 bp, Homo sapiens
tttagatctcctgtatt

SEQ ID NO: 6556713 - DNA, 15 bp, Homo sapiens
tttagatctctgaag

SEQ ID NO: 6556714 - DNA, 18 bp, Homo sapiens
tttagatgaatgtcagtt

SEQ ID NO: 6556715 - DNA, 17 bp, Homo sapiens
tttagatgagtgaaata

SEQ ID NO: 6556716 - DNA, 21 bp, Homo sapiens
tttagatggtggcacattcct

SEQ ID NO: 6556717 - DNA, 20 bp, Homo sapiens
tttagatggttacactgtta

SEQ ID NO: 6556718 - DNA, 17 bp, Homo sapiens
tttagatgtaattttgt

SEQ ID NO: 6556719 - DNA, 19 bp, Homo sapiens
tttagatgtgctgctttga

SEQ ID NO: 6556720 - DNA, 18 bp, Homo sapiens
tttagatgtgtatacaga

SEQ ID NO: 6556721 - DNA, 14 bp, Homo sapiens
tttagattatttta

SEQ ID NO: 6556722 - DNA, 19 bp, Homo sapiens
tttagattgaaatttatga

SEQ ID NO: 6556723 - DNA, 14 bp, Homo sapiens
tttagattgagtaa

SEQ ID NO: 6556724 - DNA, 17 bp, Homo sapiens
tttagattggttctgtt

SEQ ID NO: 6556725 - DNA, 22 bp, Homo sapiens
tttagattttcttttttatctt

SEQ ID NO: 6556726 - DNA, 16 bp, Homo sapiens
tttagatttttaaaag

SEQ ID NO: 6556727 - DNA, 23 bp, Homo sapiens
tttagatttttaaattggagaaa

SEQ ID NO: 6556728 - DNA, 22 bp, Homo sapiens
tttagcaaactgatgctgagga

SEQ ID NO: 6556729 - DNA, 22 bp, Homo sapiens
tttagcaaatcagtatattttc

SEQ ID NO: 6556730 - DNA, 19 bp, Homo sapiens
tttagcaatgctgtgaata

SEQ ID NO: 6556731 - DNA, 23 bp, Homo sapiens
tttagcaatttaatattttgcac

SEQ ID NO: 6556732 - DNA, 18 bp, Homo sapiens
tttagcacaatttatatt

SEQ ID NO: 6556733 - DNA, 19 bp, Homo sapiens
tttagcacagtatttaaca

SEQ ID NO: 6556734 - DNA, 21 bp, Homo sapiens
tttagcacatcactgagaaga

SEQ ID NO: 6556735 - DNA, 12 bp, Homo sapiens
tttagcagaaat

SEQ ID NO: 6556736 - DNA, 22 bp, Homo sapiens
tttagcagcagcctttaatgca

SEQ ID NO: 6556737 - DNA, 23 bp, Homo sapiens
tttagcagtccaaagaacaagaa

SEQ ID NO: 6556738 - DNA, 16 bp, Homo sapiens
tttagcagtccatttt

SEQ ID NO: 6556739 - DNA, 12 bp, Homo sapiens
tttagcagtggc

SEQ ID NO: 6556740 - DNA, 18 bp, Homo sapiens
tttagcagtggctggtgc

SEQ ID NO: 6556741 - DNA, 20 bp, Homo sapiens
tttagcagtggctggtgccc

SEQ ID NO: 6556742 - DNA, 15 bp, Homo sapiens
tttagcagttctgca

SEQ ID NO: 6556743 - DNA, 23 bp, Homo sapiens
tttagcagttctgcaaatagaaa

SEQ ID NO: 6556744 - DNA, 16 bp, Homo sapiens
tttagcagtttcctca

SEQ ID NO: 6556745 - DNA, 21 bp, Homo sapiens
tttagcagtttcctcagtgat

SEQ ID NO: 6556746 - DNA, 23 bp, Homo sapiens
tttagcatgacaagccccaggca

SEQ ID NO: 6556747 - DNA, 14 bp, Homo sapiens
tttagcatgttgtt

SEQ ID NO: 6556748 - DNA, 13 bp, Homo sapiens
tttagcattaaaa

SEQ ID NO: 6556749 - DNA, 19 bp, Homo sapiens
tttagcattttaattctct

SEQ ID NO: 6556750 - DNA, 18 bp, Homo sapiens
tttagccaaacccttgtc

SEQ ID NO: 6556751 - DNA, 11 bp, Homo sapiens
tttagccagat

SEQ ID NO: 6556752 - DNA, 15 bp, Homo sapiens
tttagcccttctagg

SEQ ID NO: 6556753 - DNA, 22 bp, Homo sapiens
tttagcctgtgtcattgcccca

SEQ ID NO: 6556754 - DNA, 15 bp, Homo sapiens
tttagcggtttgcaa

SEQ ID NO: 6556755 - DNA, 13 bp, Homo sapiens
tttagctacagct

SEQ ID NO: 6556756 - DNA, 19 bp, Homo sapiens
tttagctacctttttatat

SEQ ID NO: 6556757 - DNA, 23 bp, Homo sapiens
tttagctagaatccacacatata

SEQ ID NO: 6556758 - DNA, 21 bp, Homo sapiens
tttagctaggatttgaacact

SEQ ID NO: 6556759 - DNA, 14 bp, Homo sapiens
tttagctatgtgga

SEQ ID NO: 6556760 - DNA, 14 bp, Homo sapiens
tttagctattactg

SEQ ID NO: 6556761 - DNA, 20 bp, Homo sapiens
tttagctcaaacgtggcttt

SEQ ID NO: 6556762 - DNA, 12 bp, Homo sapiens
tttagctctgag

SEQ ID NO: 6556763 - DNA, 22 bp, Homo sapiens
tttagctggtgtcagcccctct

SEQ ID NO: 6556764 - DNA, 16 bp, Homo sapiens
tttagctgtgttatta

SEQ ID NO: 6556765 - DNA, 16 bp, Homo sapiens
tttagcttacctgggc

SEQ ID NO: 6556766 - DNA, 22 bp, Homo sapiens
tttagctttacatattcctttg

SEQ ID NO: 6556767 - DNA, 15 bp, Homo sapiens
tttagctttgtgttt

SEQ ID NO: 6556768 - DNA, 22 bp, Homo sapiens
tttaggaaaatgagaggagaac

SEQ ID NO: 6556769 - DNA, 17 bp, Homo sapiens
ttaatactaccttgaaa

SEQ ID NO: 6556770 - DNA, 21 bp, Homo sapiens
ttaatactcaaatgagtaaca

SEQ ID NO: 6556771 - DNA, 15 bp, Homo sapiens
ttaatactcacctcc

SEQ ID NO: 6556772 - DNA, 16 bp, Homo sapiens
ttaatactcacctcct

SEQ ID NO: 6556773 - DNA, 14 bp, Homo sapiens
ttaatactctattt

SEQ ID NO: 6556774 - DNA, 16 bp, Homo sapiens
ttaatactgagaaaaa

SEQ ID NO: 6556775 - DNA, 18 bp, Homo sapiens
ttaatactgtattgctgt

SEQ ID NO: 6556776 - DNA, 20 bp, Homo sapiens
ttaatactgttattctttgc

SEQ ID NO: 6556777 - DNA, 17 bp, Homo sapiens
ttaatacttgaactgtt

SEQ ID NO: 6556778 - DNA, 14 bp, Homo sapiens
ttaatacttttcca

SEQ ID NO: 6556779 - DNA, 21 bp, Homo sapiens
ttaatacttttccacagattt

SEQ ID NO: 6556780 - DNA, 14 bp, Homo sapiens
ttaatagaaaatat

SEQ ID NO: 6556781 - DNA, 23 bp, Homo sapiens
ttaatagaacacagagtgtgttt

SEQ ID NO: 6556782 - DNA, 15 bp, Homo sapiens
ttaatagagatgaat

SEQ ID NO: 6556783 - DNA, 17 bp, Homo sapiens
ttaatagatcttagggt

SEQ ID NO: 6556784 - DNA, 14 bp, Homo sapiens
ttaatagattattt

SEQ ID NO: 6556785 - DNA, 16 bp, Homo sapiens
ttaatagattatttca

SEQ ID NO: 6556786 - DNA, 21 bp, Homo sapiens
ttaatagatttaccctttata

SEQ ID NO: 6556787 - DNA, 12 bp, Homo sapiens
ttaatagcacta

SEQ ID NO: 6556788 - DNA, 20 bp, Homo sapiens
ttaatagcgtcataactaga

SEQ ID NO: 6556789 - DNA, 13 bp, Homo sapiens
ttaatagctgtga

SEQ ID NO: 6556790 - DNA, 18 bp, Homo sapiens
ttaatagcttttattgta

SEQ ID NO: 6556791 - DNA, 22 bp, Homo sapiens
ttaataggatgaatgggaaagt

SEQ ID NO: 6556792 - DNA, 22 bp, Homo sapiens
ttaatagggtgagcttgagagt

SEQ ID NO: 6556793 - DNA, 16 bp, Homo sapiens
ttaataggtttggaca

SEQ ID NO: 6556794 - DNA, 17 bp, Homo sapiens
ttaatagtaatttgtaa

SEQ ID NO: 6556795 - DNA, 16 bp, Homo sapiens
ttaatagtatatctaa

SEQ ID NO: 6556796 - DNA, 23 bp, Homo sapiens
ttaatagtcatcacatttctatg

SEQ ID NO: 6556797 - DNA, 15 bp, Homo sapiens
ttaatagtcattcca

SEQ ID NO: 6556798 - DNA, 14 bp, Homo sapiens
ttaatagtgctttt

SEQ ID NO: 6556799 - DNA, 13 bp, Homo sapiens
ttaatagtgtcat

SEQ ID NO: 6556800 - DNA, 14 bp, Homo sapiens
ttaatagtgttaat

SEQ ID NO: 6556801 - DNA, 16 bp, Homo sapiens
ttaatagtgttaatca

SEQ ID NO: 6556802 - DNA, 14 bp, Homo sapiens
ttaatagtttctaa

SEQ ID NO: 6556803 - DNA, 19 bp, Homo sapiens
ttaatagtttgtctatttt

SEQ ID NO: 6556804 - DNA, 22 bp, Homo sapiens
ttaatataaagtagtcctgtga

SEQ ID NO: 6556805 - DNA, 22 bp, Homo sapiens
ttaatataaagttttatatatt

SEQ ID NO: 6556806 - DNA, 23 bp, Homo sapiens
ttaatataaagttttatatatta

SEQ ID NO: 6556807 - DNA, 19 bp, Homo sapiens
ttaatataagtttctttag

SEQ ID NO: 6556808 - DNA, 17 bp, Homo sapiens
ttaatataatttaacag

SEQ ID NO: 6556809 - DNA, 21 bp, Homo sapiens
ttaatatactaaccatttctt

SEQ ID NO: 6556810 - DNA, 17 bp, Homo sapiens
ttaatatactcagggat

SEQ ID NO: 6556811 - DNA, 23 bp, Homo sapiens
ttaatatactcagggattccttc

SEQ ID NO: 6556812 - DNA, 15 bp, Homo sapiens
ttaatatagctattt

SEQ ID NO: 6556813 - DNA, 17 bp, Homo sapiens
ttaatatagctattttt

SEQ ID NO: 6556814 - DNA, 23 bp, Homo sapiens
ttaatatataatttaatgtaaat

SEQ ID NO: 6556815 - DNA, 13 bp, Homo sapiens
ttaatatatataa

SEQ ID NO: 6556816 - DNA, 22 bp, Homo sapiens
ttaatatatataatacttaaaa

SEQ ID NO: 6556817 - DNA, 19 bp, Homo sapiens
ttaatatatcccagaaatt

SEQ ID NO: 6556818 - DNA, 19 bp, Homo sapiens
ttaatatatgtattattta

SEQ ID NO: 6556819 - DNA, 16 bp, Homo sapiens
ttaatatattaaaatt

SEQ ID NO: 6556820 - DNA, 18 bp, Homo sapiens
ttaatatatttgaaaaaa

SEQ ID NO: 6556821 - DNA, 22 bp, Homo sapiens
ttaatatcaaaagaaaattgat

SEQ ID NO: 6556822 - DNA, 18 bp, Homo sapiens
ttaatatcaactctgaag

SEQ ID NO: 6556823 - DNA, 21 bp, Homo sapiens
ttaatatcactaatttcttct

SEQ ID NO: 6556824 - DNA, 17 bp, Homo sapiens
ttaatatcactcattaa

SEQ ID NO: 6556825 - DNA, 15 bp, Homo sapiens
ttaatatcatcagta

SEQ ID NO: 6556826 - DNA, 18 bp, Homo sapiens
ttaatatcatcagtattg

SEQ ID NO: 6556827 - DNA, 19 bp, Homo sapiens
ttaatatccctacatgtat

SEQ ID NO: 6556828 - DNA, 20 bp, Homo sapiens
ttaatatccctacatgtatt

SEQ ID NO: 6556829 - DNA, 17 bp, Homo sapiens
ttaatatccctggagtt

SEQ ID NO: 6556830 - DNA, 19 bp, Homo sapiens
ttaatatcctaaacatcat

SEQ ID NO: 6556831 - DNA, 13 bp, Homo sapiens
ttaatatctcctg

SEQ ID NO: 6556832 - DNA, 16 bp, Homo sapiens
ttaatatctcctggaa

SEQ ID NO: 6556833 - DNA, 17 bp, Homo sapiens
ttaatatctcctggaac

SEQ ID NO: 6556834 - DNA, 14 bp, Homo sapiens
ttaatatctggcac

SEQ ID NO: 6556835 - DNA, 14 bp, Homo sapiens
ttaatatctttctg

SEQ ID NO: 6556836 - DNA, 16 bp, Homo sapiens
ttaatatctttctgca

SEQ ID NO: 6556837 - DNA, 14 bp, Homo sapiens
ttaatatgaaaact

SEQ ID NO: 6556838 - DNA, 15 bp, Homo sapiens
ttaatatgaaaactt

SEQ ID NO: 6556839 - DNA, 17 bp, Homo sapiens
ttaatatgaaaacttat

SEQ ID NO: 6556840 - DNA, 14 bp, Homo sapiens
ttaatatgaaattt

SEQ ID NO: 6556841 - DNA, 19 bp, Homo sapiens
ttaatatgagcttcaatat

SEQ ID NO: 6556842 - DNA, 12 bp, Homo sapiens
ttaatatgagtt

SEQ ID NO: 6556843 - DNA, 22 bp, Homo sapiens
ttaatatgattctagtacataa

SEQ ID NO: 6556844 - DNA, 18 bp, Homo sapiens
ttaatatgctacagtact

SEQ ID NO: 6556845 - DNA, 19 bp, Homo sapiens
ttaatatgctgcaacaaaa

SEQ ID NO: 6556846 - DNA, 20 bp, Homo sapiens
ttaatatgcttaaaataagc

SEQ ID NO: 6556847 - DNA, 18 bp, Homo sapiens
ttaatatggcttcaccaa

SEQ ID NO: 6556848 - DNA, 16 bp, Homo sapiens
ttaatatggggatgca

SEQ ID NO: 6556849 - DNA, 22 bp, Homo sapiens
ttaatatggggatgcagcatta

SEQ ID NO: 6556850 - DNA, 13 bp, Homo sapiens
ttaatatgtactt

SEQ ID NO: 6556851 - DNA, 18 bp, Homo sapiens
ttaatatgtacttttcca

SEQ ID NO: 6556852 - DNA, 17 bp, Homo sapiens
ttaatatgtattttatg

SEQ ID NO: 6556853 - DNA, 19 bp, Homo sapiens
ttaatatgtattttatgta

SEQ ID NO: 6556854 - DNA, 22 bp, Homo sapiens
ttaatatgtgctgaacattgtt

SEQ ID NO: 6556855 - DNA, 23 bp, Homo sapiens
ttaatatgttaacctcagtgtca

SEQ ID NO: 6556856 - DNA, 14 bp, Homo sapiens
ttaatatgttgact

SEQ ID NO: 6556857 - DNA, 11 bp, Homo sapiens
ttaatattaaa

SEQ ID NO: 6556858 - DNA, 16 bp, Homo sapiens
ttaatattaaagccat

SEQ ID NO: 6556859 - DNA, 19 bp, Homo sapiens
ttaatattaacttttaatg

SEQ ID NO: 6556860 - DNA, 15 bp, Homo sapiens
ttaatattactgtct

SEQ ID NO: 6556861 - DNA, 16 bp, Homo sapiens
ttaatattactgtctt

SEQ ID NO: 6556862 - DNA, 18 bp, Homo sapiens
ttaatattactgtcttta

SEQ ID NO: 6556863 - DNA, 16 bp, Homo sapiens
ttaatattattactgt

SEQ ID NO: 6556864 - DNA, 15 bp, Homo sapiens
ttaatattcagatgt

SEQ ID NO: 6556865 - DNA, 22 bp, Homo sapiens
ttaatattcattgtataaaaat

SEQ ID NO: 6556866 - DNA, 15 bp, Homo sapiens
ttaatattcttttgt

SEQ ID NO: 6556867 - DNA, 21 bp, Homo sapiens
ttaatattcttttgtttccat

SEQ ID NO: 6556868 - DNA, 14 bp, Homo sapiens
ttaatattgagaat

SEQ ID NO: 6556869 - DNA, 12 bp, Homo sapiens
ttaatatttaaa

SEQ ID NO: 6556870 - DNA, 15 bp, Homo sapiens
ttaatatttaaacag

SEQ ID NO: 6556871 - DNA, 17 bp, Homo sapiens
ttaatatttaacattat

SEQ ID NO: 6556872 - DNA, 19 bp, Homo sapiens
ttaatatttaacctctttt

SEQ ID NO: 6556873 - DNA, 18 bp, Homo sapiens
ttaatatttaccaaagta

SEQ ID NO: 6556874 - DNA, 17 bp, Homo sapiens
ttaatatttatagagtt

SEQ ID NO: 6556875 - DNA, 17 bp, Homo sapiens
ttaatatttctgtggaa

SEQ ID NO: 6556876 - DNA, 19 bp, Homo sapiens
ttaatatttgctgacagct

SEQ ID NO: 6556877 - DNA, 16 bp, Homo sapiens
ttaatatttgtttagt

SEQ ID NO: 6556878 - DNA, 23 bp, Homo sapiens
ttaatattttgtaatattctgtt

SEQ ID NO: 6556879 - DNA, 17 bp, Homo sapiens
ttaatattttgtatttt

SEQ ID NO: 6556880 - DNA, 19 bp, Homo sapiens
ttaatattttgtattttca

SEQ ID NO: 6556881 - DNA, 19 bp, Homo sapiens
ttaatatttttacatgcag

SEQ ID NO: 6556882 - DNA, 14 bp, Homo sapiens
ttaatatttttcaa

SEQ ID NO: 6556883 - DNA, 20 bp, Homo sapiens
ttaatatttttcaaaatcaa

SEQ ID NO: 6556884 - DNA, 10 bp, Homo sapiens
ttaatcaaag

SEQ ID NO: 6556885 - DNA, 18 bp, Homo sapiens
ttaatcaaaggcatatct

SEQ ID NO: 6556886 - DNA, 13 bp, Homo sapiens
ttaatcaactgta

SEQ ID NO: 6556887 - DNA, 19 bp, Homo sapiens
ttaatcaagaatattcaaa

SEQ ID NO: 6556888 - DNA, 12 bp, Homo sapiens
ttaatcaagaga

SEQ ID NO: 6556889 - DNA, 19 bp, Homo sapiens
ttaatcaagagaaacttca

SEQ ID NO: 6556890 - DNA, 18 bp, Homo sapiens
ttaatcaagagagacaaa

SEQ ID NO: 6556891 - DNA, 20 bp, Homo sapiens
ttaatcacaaatttcactta

SEQ ID NO: 6556892 - DNA, 17 bp, Homo sapiens
ttaatcaccatgggaaa

SEQ ID NO: 6556893 - DNA, 20 bp, Homo sapiens
ttaatcaccttctttgtaat

SEQ ID NO: 6556894 - DNA, 16 bp, Homo sapiens
ttaatcactactgtat

SEQ ID NO: 6556895 - DNA, 13 bp, Homo sapiens
ttaatcactgtgt

SEQ ID NO: 6556896 - DNA, 19 bp, Homo sapiens
ttaatcagaatatcagaat

SEQ ID NO: 6556897 - DNA, 17 bp, Homo sapiens
ttaatcagctgttgcag

SEQ ID NO: 6556898 - DNA, 18 bp, Homo sapiens
ttaatcagtggaactcaa

SEQ ID NO: 6556899 - DNA, 22 bp, Homo sapiens
ttaatcagtggaactcaatata

SEQ ID NO: 6556900 - DNA, 15 bp, Homo sapiens
ttaatcataaagaaa

SEQ ID NO: 6556901 - DNA, 14 bp, Homo sapiens
ttaatcatagatta

SEQ ID NO: 6556902 - DNA, 22 bp, Homo sapiens
ttaatcatatttgaaaaccata

SEQ ID NO: 6556903 - DNA, 15 bp, Homo sapiens
ttaatcatcaagaga

SEQ ID NO: 6556904 - DNA, 15 bp, Homo sapiens
ttaatcatcttctct

SEQ ID NO: 6556905 - DNA, 16 bp, Homo sapiens
ttaatcatcttctctt

SEQ ID NO: 6556906 - DNA, 18 bp, Homo sapiens
ttaatcatgaatatgatg

SEQ ID NO: 6556907 - DNA, 17 bp, Homo sapiens
ttaatcatgaatgtgta

SEQ ID NO: 6556908 - DNA, 20 bp, Homo sapiens
ttaatcatgagcctgtttat

SEQ ID NO: 6556909 - DNA, 16 bp, Homo sapiens
ttaatcatgggttcct

SEQ ID NO: 6556910 - DNA, 22 bp, Homo sapiens
ttaatcattatccttctaagag

SEQ ID NO: 6556911 - DNA, 13 bp, Homo sapiens
ttaatcattccat

SEQ ID NO: 6556912 - DNA, 13 bp, Homo sapiens
ttaatcattgcct

SEQ ID NO: 6556913 - DNA, 20 bp, Homo sapiens
ttaatcatttccagcaaaat

SEQ ID NO: 6556914 - DNA, 23 bp, Homo sapiens
ttaatccaatcaatttaaatgtt

SEQ ID NO: 6556915 - DNA, 12 bp, Homo sapiens
ttaatccaatgg

SEQ ID NO: 6556916 - DNA, 20 bp, Homo sapiens
ttaatccacagtatgttaca

SEQ ID NO: 6556917 - DNA, 18 bp, Homo sapiens
ttaatccagaataactag

SEQ ID NO: 6556918 - DNA, 23 bp, Homo sapiens
ttaatccagaataactagcacca

SEQ ID NO: 6556919 - DNA, 11 bp, Homo sapiens
ttaatccagag

SEQ ID NO: 6556920 - DNA, 18 bp, Homo sapiens
ttaatccagtctatcatt

SEQ ID NO: 6556921 - DNA, 21 bp, Homo sapiens
ttaatccagttataagaagaa

SEQ ID NO: 6556922 - DNA, 17 bp, Homo sapiens
ttaatccattaaaaagt

SEQ ID NO: 6556923 - DNA, 13 bp, Homo sapiens
ttaatcccagcac

SEQ ID NO: 6556924 - DNA, 16 bp, Homo sapiens
ttaatcccagcacttt

SEQ ID NO: 6556925 - DNA, 14 bp, Homo sapiens
ttaatcccagccct

SEQ ID NO: 6556926 - DNA, 18 bp, Homo sapiens
ttaatcccattgcaaaca

SEQ ID NO: 6556927 - DNA, 18 bp, Homo sapiens
ttaatcccggtttcagaa

SEQ ID NO: 6556928 - DNA, 20 bp, Homo sapiens
ttaatcccggtttcagaagc

SEQ ID NO: 6556929 - DNA, 21 bp, Homo sapiens
ttaatccctatgtttgtctca

SEQ ID NO: 6556930 - DNA, 21 bp, Homo sapiens
ttaatcctagctgtgtgcagt

SEQ ID NO: 6556931 - DNA, 18 bp, Homo sapiens
ttaatcctgtaccaaatc

SEQ ID NO: 6556932 - DNA, 21 bp, Homo sapiens
ttaatcctgtaccaaatctga

SEQ ID NO: 6556933 - DNA, 22 bp, Homo sapiens
ttaatcctgtaccaaatctgac

SEQ ID NO: 6556934 - DNA, 23 bp, Homo sapiens
ttaatcctttgttttctgactaa

SEQ ID NO: 6556935 - DNA, 16 bp, Homo sapiens
ttaatcgatgaatgta

SEQ ID NO: 6556936 - DNA, 18 bp, Homo sapiens
ttaatcgtcaaccacttt

SEQ ID NO: 6556937 - DNA, 23 bp, Homo sapiens
ttaatctacattataataaaatt

SEQ ID NO: 6556938 - DNA, 15 bp, Homo sapiens
ttaatctactttttg

SEQ ID NO: 6556939 - DNA, 13 bp, Homo sapiens
ttaatctagagct

SEQ ID NO: 6556940 - DNA, 16 bp, Homo sapiens
ttaatctagagctatg

SEQ ID NO: 6556941 - DNA, 18 bp, Homo sapiens
ttaatctcacttcatcaa

SEQ ID NO: 6556942 - DNA, 22 bp, Homo sapiens
ttaatctccaccagtcattttt

SEQ ID NO: 6556943 - DNA, 15 bp, Homo sapiens
ttaatctcccagccc

SEQ ID NO: 6556944 - DNA, 20 bp, Homo sapiens
ttaatctctaaaattctagt

SEQ ID NO: 6556945 - DNA, 17 bp, Homo sapiens
ttaatctctaacagtgg

SEQ ID NO: 6556946 - DNA, 14 bp, Homo sapiens
ttaatctctgttat

SEQ ID NO: 6556947 - DNA, 10 bp, Homo sapiens
tttaggaaat

SEQ ID NO: 6556948 - DNA, 18 bp, Homo sapiens
tttaggaaatgaatgtgt

SEQ ID NO: 6556949 - DNA, 21 bp, Homo sapiens
tttaggaaatgggcagtgaag

SEQ ID NO: 6556950 - DNA, 14 bp, Homo sapiens
tttaggaagaagtg

SEQ ID NO: 6556951 - DNA, 18 bp, Homo sapiens
tttaggaatcctttggtg

SEQ ID NO: 6556952 - DNA, 15 bp, Homo sapiens
tttaggaatgctcaa

SEQ ID NO: 6556953 - DNA, 21 bp, Homo sapiens
tttaggaatgctcaatgtgct

SEQ ID NO: 6556954 - DNA, 17 bp, Homo sapiens
tttaggacatgaaaata

SEQ ID NO: 6556955 - DNA, 21 bp, Homo sapiens
tttaggactgggttccccaca

SEQ ID NO: 6556956 - DNA, 20 bp, Homo sapiens
tttaggagaaattatagtta

SEQ ID NO: 6556957 - DNA, 13 bp, Homo sapiens
tttaggagatttt

SEQ ID NO: 6556958 - DNA, 16 bp, Homo sapiens
tttaggagtgattact

SEQ ID NO: 6556959 - DNA, 18 bp, Homo sapiens
tttaggatacttaacaaa

SEQ ID NO: 6556960 - DNA, 10 bp, Homo sapiens
tttaggcagg

SEQ ID NO: 6556961 - DNA, 22 bp, Homo sapiens
tttaggcaggaagtcaggagcc

SEQ ID NO: 6556962 - DNA, 21 bp, Homo sapiens
tttaggcatatgcttctttaa

SEQ ID NO: 6556963 - DNA, 19 bp, Homo sapiens
tttaggccaatcagaagct

SEQ ID NO: 6556964 - DNA, 13 bp, Homo sapiens
tttagggaagcag

SEQ ID NO: 6556965 - DNA, 23 bp, Homo sapiens
tttagggactcaatttctcccca

SEQ ID NO: 6556966 - DNA, 23 bp, Homo sapiens
tttagggagacccaataaagaat

SEQ ID NO: 6556967 - DNA, 15 bp, Homo sapiens
tttagggcagcttgc

SEQ ID NO: 6556968 - DNA, 16 bp, Homo sapiens
tttagggccttttctg

SEQ ID NO: 6556969 - DNA, 17 bp, Homo sapiens
tttaggggtagaaaatg

SEQ ID NO: 6556970 - DNA, 18 bp, Homo sapiens
tttaggggtgttgacaca

SEQ ID NO: 6556971 - DNA, 16 bp, Homo sapiens
tttagggtaaaaattg

SEQ ID NO: 6556972 - DNA, 20 bp, Homo sapiens
tttagggtactaaatttaaa

SEQ ID NO: 6556973 - DNA, 14 bp, Homo sapiens
tttagggtgggtaa

SEQ ID NO: 6556974 - DNA, 18 bp, Homo sapiens
tttagggtgggtaagaaa

SEQ ID NO: 6556975 - DNA, 17 bp, Homo sapiens
tttagggttctgcctct

SEQ ID NO: 6556976 - DNA, 14 bp, Homo sapiens
tttaggtaaataaa

SEQ ID NO: 6556977 - DNA, 15 bp, Homo sapiens
tttaggtaagaagtt

SEQ ID NO: 6556978 - DNA, 17 bp, Homo sapiens
tttaggtactattctga

SEQ ID NO: 6556979 - DNA, 22 bp, Homo sapiens
tttaggtcagtagactgtgatt

SEQ ID NO: 6556980 - DNA, 19 bp, Homo sapiens
tttaggtctcttcccctct

SEQ ID NO: 6556981 - DNA, 14 bp, Homo sapiens
tttaggtctttgta

SEQ ID NO: 6556982 - DNA, 14 bp, Homo sapiens
tttaggtgaaaata

SEQ ID NO: 6556983 - DNA, 21 bp, Homo sapiens
tttaggtgaattaattaaaca

SEQ ID NO: 6556984 - DNA, 17 bp, Homo sapiens
tttaggtgctgttatgt

SEQ ID NO: 6556985 - DNA, 13 bp, Homo sapiens
tttaggtgtcttt

SEQ ID NO: 6556986 - DNA, 22 bp, Homo sapiens
tttaggtgttgattttctgttg

SEQ ID NO: 6556987 - DNA, 11 bp, Homo sapiens
tttaggttcta

SEQ ID NO: 6556988 - DNA, 12 bp, Homo sapiens
tttaggttctaa

SEQ ID NO: 6556989 - DNA, 14 bp, Homo sapiens
tttaggttctaaag

SEQ ID NO: 6556990 - DNA, 18 bp, Homo sapiens
tttaggttctaaagttct

SEQ ID NO: 6556991 - DNA, 23 bp, Homo sapiens
tttaggttctaaagttctaagat

SEQ ID NO: 6556992 - DNA, 22 bp, Homo sapiens
tttaggtttttgtttgtttcct

SEQ ID NO: 6556993 - DNA, 15 bp, Homo sapiens
tttagtaaaaacatt

SEQ ID NO: 6556994 - DNA, 13 bp, Homo sapiens
tttagtaaaatta

SEQ ID NO: 6556995 - DNA, 22 bp, Homo sapiens
tttagtaaaattatctgttcta

SEQ ID NO: 6556996 - DNA, 21 bp, Homo sapiens
tttagtaaatcctattatgtg

SEQ ID NO: 6556997 - DNA, 17 bp, Homo sapiens
tttagtaaatgttatct

SEQ ID NO: 6556998 - DNA, 13 bp, Homo sapiens
tttagtaatttct

SEQ ID NO: 6556999 - DNA, 15 bp, Homo sapiens
tttagtaatttcttt

SEQ ID NO: 6557000 - DNA, 17 bp, Homo sapiens
tttagtacaatttcaac

SEQ ID NO: 6557001 - DNA, 12 bp, Homo sapiens
tttagtaccctg

SEQ ID NO: 6557002 - DNA, 14 bp, Homo sapiens
tttagtaccctgca

SEQ ID NO: 6557003 - DNA, 20 bp, Homo sapiens
tttagtaccctgcaggccag

SEQ ID NO: 6557004 - DNA, 14 bp, Homo sapiens
tttagtaccttcaa

SEQ ID NO: 6557005 - DNA, 16 bp, Homo sapiens
tttagtagagacaggg

SEQ ID NO: 6557006 - DNA, 21 bp, Homo sapiens
tttagtagcagtgattgtctt

SEQ ID NO: 6557007 - DNA, 22 bp, Homo sapiens
tttagtagcagtgattgtctta

SEQ ID NO: 6557008 - DNA, 19 bp, Homo sapiens
tttagtagctgataaagaa

SEQ ID NO: 6557009 - DNA, 23 bp, Homo sapiens
tttagtatagccacaaatgcctt

SEQ ID NO: 6557010 - DNA, 21 bp, Homo sapiens
tttagtatgacgctgatacat

SEQ ID NO: 6557011 - DNA, 17 bp, Homo sapiens
tttagtcaatcactgca

SEQ ID NO: 6557012 - DNA, 12 bp, Homo sapiens
tttagtcacttt

SEQ ID NO: 6557013 - DNA, 22 bp, Homo sapiens
tttagtcagaaatgattcaggg

SEQ ID NO: 6557014 - DNA, 23 bp, Homo sapiens
tttagtcatccaacaagaagaaa

SEQ ID NO: 6557015 - DNA, 15 bp, Homo sapiens
tttagtcctgtactg

SEQ ID NO: 6557016 - DNA, 21 bp, Homo sapiens
tttagtctaagatgattcaaa

SEQ ID NO: 6557017 - DNA, 13 bp, Homo sapiens
tttagtctcttta

SEQ ID NO: 6557018 - DNA, 16 bp, Homo sapiens
tttagtctgcaaaatg

SEQ ID NO: 6557019 - DNA, 14 bp, Homo sapiens
tttagtcttgtctc

SEQ ID NO: 6557020 - DNA, 15 bp, Homo sapiens
tttagtcttgtctca

SEQ ID NO: 6557021 - DNA, 23 bp, Homo sapiens
tttagtcttgtctcagattttat

SEQ ID NO: 6557022 - DNA, 13 bp, Homo sapiens
tttagtctttata

SEQ ID NO: 6557023 - DNA, 23 bp, Homo sapiens
tttagtctttttttccttccttt

SEQ ID NO: 6557024 - DNA, 17 bp, Homo sapiens
tttagtgaaacataata

SEQ ID NO: 6557025 - DNA, 16 bp, Homo sapiens
tttagtgaacttgaaa

SEQ ID NO: 6557026 - DNA, 17 bp, Homo sapiens
tttagtgactgtaatta

SEQ ID NO: 6557027 - DNA, 19 bp, Homo sapiens
tttagtgatcacagcagct

SEQ ID NO: 6557028 - DNA, 22 bp, Homo sapiens
tttagtgcaaagtataaaatta

SEQ ID NO: 6557029 - DNA, 24 bp, Homo sapiens
tttagtgcaagctttaacagacta

SEQ ID NO: 6557030 - DNA, 21 bp, Homo sapiens
tttagtgcaatttcttctgta

SEQ ID NO: 6557031 - DNA, 18 bp, Homo sapiens
tttagtgccaatgttgtg

SEQ ID NO: 6557032 - DNA, 21 bp, Homo sapiens
tttagtgctcttaacttgtta

SEQ ID NO: 6557033 - DNA, 15 bp, Homo sapiens
tttagtggaaaatag

SEQ ID NO: 6557034 - DNA, 22 bp, Homo sapiens
tttagtggaccctgaaatgtgt

SEQ ID NO: 6557035 - DNA, 19 bp, Homo sapiens
tttagtggtggtagaaatg

SEQ ID NO: 6557036 - DNA, 21 bp, Homo sapiens
tttagtggtggtagaaatgat

SEQ ID NO: 6557037 - DNA, 19 bp, Homo sapiens
tttagtggtggtgtctcac

SEQ ID NO: 6557038 - DNA, 15 bp, Homo sapiens
tttagtgtatatgtg

SEQ ID NO: 6557039 - DNA, 12 bp, Homo sapiens
tttagtgtctga

SEQ ID NO: 6557040 - DNA, 15 bp, Homo sapiens
tttagtgtgaatatt

SEQ ID NO: 6557041 - DNA, 14 bp, Homo sapiens
tttagtgtgctgct

SEQ ID NO: 6557042 - DNA, 16 bp, Homo sapiens
tttagtgtgctgctgt

SEQ ID NO: 6557043 - DNA, 13 bp, Homo sapiens
tttagtgtggttt

SEQ ID NO: 6557044 - DNA, 16 bp, Homo sapiens
tttagtgtgtaaaatt

SEQ ID NO: 6557045 - DNA, 12 bp, Homo sapiens
tttagtgtttct

SEQ ID NO: 6557046 - DNA, 21 bp, Homo sapiens
tttagttaaaactcatcacat

SEQ ID NO: 6557047 - DNA, 16 bp, Homo sapiens
tttagttacgtataat

SEQ ID NO: 6557048 - DNA, 14 bp, Homo sapiens
tttagttataaagg

SEQ ID NO: 6557049 - DNA, 21 bp, Homo sapiens
tttagttatagtgtttaactg

SEQ ID NO: 6557050 - DNA, 14 bp, Homo sapiens
tttagttatagttt

SEQ ID NO: 6557051 - DNA, 12 bp, Homo sapiens
tttagttcatat

SEQ ID NO: 6557052 - DNA, 16 bp, Homo sapiens
tttagttccaacaaag

SEQ ID NO: 6557053 - DNA, 19 bp, Homo sapiens
tttagttcctgtgcacagc

SEQ ID NO: 6557054 - DNA, 14 bp, Homo sapiens
tttagttctgactt

SEQ ID NO: 6557055 - DNA, 15 bp, Homo sapiens
tttagttctgacttt

SEQ ID NO: 6557056 - DNA, 23 bp, Homo sapiens
tttagttctgactttgaatttat

SEQ ID NO: 6557057 - DNA, 19 bp, Homo sapiens
tttagttctgctgtctccc

SEQ ID NO: 6557058 - DNA, 14 bp, Homo sapiens
tttagttgaatttt

SEQ ID NO: 6557059 - DNA, 13 bp, Homo sapiens
tttagttgagtct

SEQ ID NO: 6557060 - DNA, 17 bp, Homo sapiens
tttagttgcaactttgt

SEQ ID NO: 6557061 - DNA, 16 bp, Homo sapiens
tttagttgccaacagt

SEQ ID NO: 6557062 - DNA, 14 bp, Homo sapiens
tttagtttactcaa

SEQ ID NO: 6557063 - DNA, 22 bp, Homo sapiens
tttagtttctgttctgtggaaa

SEQ ID NO: 6557064 - DNA, 13 bp, Homo sapiens
tttagtttgttaa

SEQ ID NO: 6557065 - DNA, 21 bp, Homo sapiens
tttagtttgttaattgattaa

SEQ ID NO: 6557066 - DNA, 22 bp, Homo sapiens
tttagttttaaaagtctatgat

SEQ ID NO: 6557067 - DNA, 17 bp, Homo sapiens
tttagttttattttcta

SEQ ID NO: 6557068 - DNA, 19 bp, Homo sapiens
tttagttttattttctaaa

SEQ ID NO: 6557069 - DNA, 13 bp, Homo sapiens
tttagtttttcat

SEQ ID NO: 6557070 - DNA, 15 bp, Homo sapiens
tttagtttttcatta

SEQ ID NO: 6557071 - DNA, 16 bp, Homo sapiens
tttagtttttcattaa

SEQ ID NO: 6557072 - DNA, 18 bp, Homo sapiens
tttataaaaaaaatgaaa

SEQ ID NO: 6557073 - DNA, 19 bp, Homo sapiens
tttataaaaaaaatgaaat

SEQ ID NO: 6557074 - DNA, 21 bp, Homo sapiens
tttataaaaaaaatgaaatgt

SEQ ID NO: 6557075 - DNA, 20 bp, Homo sapiens
tttataaaaacattgaaata

SEQ ID NO: 6557076 - DNA, 20 bp, Homo sapiens
tttataaaaagtgaaataag

SEQ ID NO: 6557077 - DNA, 13 bp, Homo sapiens
tttataaaacttc

SEQ ID NO: 6557078 - DNA, 23 bp, Homo sapiens
tttataaaagaataaaattgcac

SEQ ID NO: 6557079 - DNA, 21 bp, Homo sapiens
tttataaaagcaaaagagaaa

SEQ ID NO: 6557080 - DNA, 22 bp, Homo sapiens
tttataaaagtgttcattgttt

SEQ ID NO: 6557081 - DNA, 14 bp, Homo sapiens
tttataaaatggga

SEQ ID NO: 6557082 - DNA, 22 bp, Homo sapiens
tttataaacagacaatatgtga

SEQ ID NO: 6557083 - DNA, 23 bp, Homo sapiens
tttataaacagacaatatgtgag

SEQ ID NO: 6557084 - DNA, 16 bp, Homo sapiens
tttataaacctctaat

SEQ ID NO: 6557085 - DNA, 17 bp, Homo sapiens
tttataaacctctaatt

SEQ ID NO: 6557086 - DNA, 21 bp, Homo sapiens
tttataaagcaaattactcca

SEQ ID NO: 6557087 - DNA, 13 bp, Homo sapiens
tttataaagccaa

SEQ ID NO: 6557088 - DNA, 14 bp, Homo sapiens
tttataaaggtctg

SEQ ID NO: 6557089 - DNA, 24 bp, Homo sapiens
tttataaagtacccatctagtact

SEQ ID NO: 6557090 - DNA, 17 bp, Homo sapiens
tttataaatacataaat

SEQ ID NO: 6557091 - DNA, 17 bp, Homo sapiens
tttataaatatcatgca

SEQ ID NO: 6557092 - DNA, 19 bp, Homo sapiens
tttataaatatgtgaaaat

SEQ ID NO: 6557093 - DNA, 13 bp, Homo sapiens
tttataaatccaa

SEQ ID NO: 6557094 - DNA, 15 bp, Homo sapiens
tttataaatcgcttt

SEQ ID NO: 6557095 - DNA, 12 bp, Homo sapiens
tttataaatgag

SEQ ID NO: 6557096 - DNA, 15 bp, Homo sapiens
tttataaatgagcaa

SEQ ID NO: 6557097 - DNA, 12 bp, Homo sapiens
tttataaatgct

SEQ ID NO: 6557098 - DNA, 14 bp, Homo sapiens
tttataaatggagg

SEQ ID NO: 6557099 - DNA, 20 bp, Homo sapiens
tttataaatggaggtacagg

SEQ ID NO: 6557100 - DNA, 14 bp, Homo sapiens
tttataaatgttct

SEQ ID NO: 6557101 - DNA, 18 bp, Homo sapiens
tttataaattaaatatat

SEQ ID NO: 6557102 - DNA, 14 bp, Homo sapiens
tttataacaattga

SEQ ID NO: 6557103 - DNA, 16 bp, Homo sapiens
tttataaccccagcct

SEQ ID NO: 6557104 - DNA, 17 bp, Homo sapiens
tttataaccccagcctg

SEQ ID NO: 6557105 - DNA, 14 bp, Homo sapiens
tttataactaacat

SEQ ID NO: 6557106 - DNA, 14 bp, Homo sapiens
tttataactatata

SEQ ID NO: 6557107 - DNA, 21 bp, Homo sapiens
tttataactattcagttgtgt

SEQ ID NO: 6557108 - DNA, 18 bp, Homo sapiens
tttataactcatcataaa

SEQ ID NO: 6557109 - DNA, 19 bp, Homo sapiens
tttataactcatcataaaa

SEQ ID NO: 6557110 - DNA, 21 bp, Homo sapiens
tttataactcatcataaaata

SEQ ID NO: 6557111 - DNA, 16 bp, Homo sapiens
tttataactctaggga

SEQ ID NO: 6557112 - DNA, 16 bp, Homo sapiens
tttataagaaagcctg

SEQ ID NO: 6557113 - DNA, 18 bp, Homo sapiens
tttataagaattttgctt

SEQ ID NO: 6557114 - DNA, 13 bp, Homo sapiens
tttataagacaaa

SEQ ID NO: 6557115 - DNA, 16 bp, Homo sapiens
tttataagcaaatttc

SEQ ID NO: 6557116 - DNA, 17 bp, Homo sapiens
tttataagcaaatttca

SEQ ID NO: 6557117 - DNA, 20 bp, Homo sapiens
tttataagcagatttaacaa

SEQ ID NO: 6557118 - DNA, 13 bp, Homo sapiens
tttataagcatca

SEQ ID NO: 6557119 - DNA, 14 bp, Homo sapiens
tttataagcatcat

SEQ ID NO: 6557120 - DNA, 20 bp, Homo sapiens
tttataagcatcattattta

SEQ ID NO: 6557121 - DNA, 17 bp, Homo sapiens
tttataagtcattgtat

SEQ ID NO: 6557122 - DNA, 11 bp, Homo sapiens
tttataataaa

SEQ ID NO: 6557123 - DNA, 14 bp, Homo sapiens
tttataataaaaat

SEQ ID NO: 6557124 - DNA, 16 bp, Homo sapiens
tttataataaaaatat

SEQ ID NO: 6557125 - DNA, 18 bp, Homo sapiens
tttataataggaatttgt

SEQ ID NO: 6557126 - DNA, 19 bp, Homo sapiens
tttataataggaatttgta

SEQ ID NO: 6557127 - DNA, 19 bp, Homo sapiens
ttaatctctgttatgtact

SEQ ID NO: 6557128 - DNA, 22 bp, Homo sapiens
ttaatctctgttatgtactgta

SEQ ID NO: 6557129 - DNA, 12 bp, Homo sapiens
ttaatctcttgt

SEQ ID NO: 6557130 - DNA, 13 bp, Homo sapiens
ttaatctcttgtc

SEQ ID NO: 6557131 - DNA, 18 bp, Homo sapiens
ttaatctgaaattctaaa

SEQ ID NO: 6557132 - DNA, 19 bp, Homo sapiens
ttaatctgaaattctaaag

SEQ ID NO: 6557133 - DNA, 18 bp, Homo sapiens
ttaatctgatgtataatg

SEQ ID NO: 6557134 - DNA, 20 bp, Homo sapiens
ttaatctgatgtataatgta

SEQ ID NO: 6557135 - DNA, 21 bp, Homo sapiens
ttaatctgatgtataatgtaa

SEQ ID NO: 6557136 - DNA, 22 bp, Homo sapiens
ttaatctgatgtataatgtaat

SEQ ID NO: 6557137 - DNA, 16 bp, Homo sapiens
ttaatctgggagcagg

SEQ ID NO: 6557138 - DNA, 21 bp, Homo sapiens
ttaatctgggccagaatttca

SEQ ID NO: 6557139 - DNA, 22 bp, Homo sapiens
ttaatctggtttatttttgttc

SEQ ID NO: 6557140 - DNA, 18 bp, Homo sapiens
ttaatctgtgtgtatatt

SEQ ID NO: 6557141 - DNA, 20 bp, Homo sapiens
ttaatctgtgtgtatattga

SEQ ID NO: 6557142 - DNA, 20 bp, Homo sapiens
ttaatctgtttatttacaag

SEQ ID NO: 6557143 - DNA, 15 bp, Homo sapiens
ttaatcttagctttt

SEQ ID NO: 6557144 - DNA, 20 bp, Homo sapiens
ttaatcttcaaagccttctc

SEQ ID NO: 6557145 - DNA, 17 bp, Homo sapiens
ttaatcttccattcctt

SEQ ID NO: 6557146 - DNA, 12 bp, Homo sapiens
ttaatcttgctt

SEQ ID NO: 6557147 - DNA, 16 bp, Homo sapiens
ttaatcttgcttcatt

SEQ ID NO: 6557148 - DNA, 14 bp, Homo sapiens
ttaatcttgctttc

SEQ ID NO: 6557149 - DNA, 12 bp, Homo sapiens
ttaatctttaaa

SEQ ID NO: 6557150 - DNA, 17 bp, Homo sapiens
ttaatctttgaaaggtt

SEQ ID NO: 6557151 - DNA, 13 bp, Homo sapiens
ttaatctttgctg

SEQ ID NO: 6557152 - DNA, 18 bp, Homo sapiens
ttaatctttgctgaagaa

SEQ ID NO: 6557153 - DNA, 18 bp, Homo sapiens
ttaatcttttcacaaata

SEQ ID NO: 6557154 - DNA, 20 bp, Homo sapiens
ttaatcttttcacaaataaa

SEQ ID NO: 6557155 - DNA, 13 bp, Homo sapiens
ttaatctttttca

SEQ ID NO: 6557156 - DNA, 18 bp, Homo sapiens
ttaatctttttgtttttc

SEQ ID NO: 6557157 - DNA, 16 bp, Homo sapiens
ttaatgaaaaatctga

SEQ ID NO: 6557158 - DNA, 15 bp, Homo sapiens
ttaatgaaaatgtca

SEQ ID NO: 6557159 - DNA, 16 bp, Homo sapiens
ttaatgaaaatgtcag

SEQ ID NO: 6557160 - DNA, 20 bp, Homo sapiens
ttaatgaaagactgtacaaa

SEQ ID NO: 6557161 - DNA, 23 bp, Homo sapiens
ttaatgaaagactgtacaaagta

SEQ ID NO: 6557162 - DNA, 17 bp, Homo sapiens
ttaatgaaatatctgta

SEQ ID NO: 6557163 - DNA, 21 bp, Homo sapiens
ttaatgaaatatctgtattta

SEQ ID NO: 6557164 - DNA, 19 bp, Homo sapiens
ttaatgaaatgataaagac

SEQ ID NO: 6557165 - DNA, 21 bp, Homo sapiens
ttaatgaaatgataaagactt

SEQ ID NO: 6557166 - DNA, 15 bp, Homo sapiens
ttaatgaaccttaga

SEQ ID NO: 6557167 - DNA, 22 bp, Homo sapiens
ttaatgaactgtgacaggaagc

SEQ ID NO: 6557168 - DNA, 14 bp, Homo sapiens
ttaatgaagaaagt

SEQ ID NO: 6557169 - DNA, 13 bp, Homo sapiens
ttaatgaagaaat

SEQ ID NO: 6557170 - DNA, 17 bp, Homo sapiens
ttaatgaagatctaaat

SEQ ID NO: 6557171 - DNA, 18 bp, Homo sapiens
ttaatgaagatctaaata

SEQ ID NO: 6557172 - DNA, 20 bp, Homo sapiens
ttaatgaaggtcataagttt

SEQ ID NO: 6557173 - DNA, 13 bp, Homo sapiens
ttaatgaagttga

SEQ ID NO: 6557174 - DNA, 18 bp, Homo sapiens
ttaatgaagtttgaatgt

SEQ ID NO: 6557175 - DNA, 22 bp, Homo sapiens
ttaatgaagtttgaatgttaaa

SEQ ID NO: 6557176 - DNA, 21 bp, Homo sapiens
ttaatgaatagaataaataca

SEQ ID NO: 6557177 - DNA, 15 bp, Homo sapiens
ttaatgaatgcttaa

SEQ ID NO: 6557178 - DNA, 19 bp, Homo sapiens
ttaatgaatttaaggcaaa

SEQ ID NO: 6557179 - DNA, 14 bp, Homo sapiens
ttaatgacaacaaa

SEQ ID NO: 6557180 - DNA, 15 bp, Homo sapiens
ttaatgacaacactt

SEQ ID NO: 6557181 - DNA, 14 bp, Homo sapiens
ttaatgacaatatt

SEQ ID NO: 6557182 - DNA, 17 bp, Homo sapiens
ttaatgacacaccttgg

SEQ ID NO: 6557183 - DNA, 23 bp, Homo sapiens
ttaatgacacttgtccccaaatc

SEQ ID NO: 6557184 - DNA, 14 bp, Homo sapiens
ttaatgaccatgtt

SEQ ID NO: 6557185 - DNA, 14 bp, Homo sapiens
ttaatgacctgaat

SEQ ID NO: 6557186 - DNA, 15 bp, Homo sapiens
ttaatgactttttat

SEQ ID NO: 6557187 - DNA, 12 bp, Homo sapiens
ttaatgagaaaa

SEQ ID NO: 6557188 - DNA, 15 bp, Homo sapiens
ttaatgagaagagtt

SEQ ID NO: 6557189 - DNA, 15 bp, Homo sapiens
ttaatgagaagatat

SEQ ID NO: 6557190 - DNA, 15 bp, Homo sapiens
ttaatgagaatagaa

SEQ ID NO: 6557191 - DNA, 16 bp, Homo sapiens
ttaatgagactttaaa

SEQ ID NO: 6557192 - DNA, 18 bp, Homo sapiens
ttaatgagactttaaaag

SEQ ID NO: 6557193 - DNA, 21 bp, Homo sapiens
ttaatgagactttaaaagcat

SEQ ID NO: 6557194 - DNA, 22 bp, Homo sapiens
ttaatgagatgttattactgtt

SEQ ID NO: 6557195 - DNA, 11 bp, Homo sapiens
ttaatgagtat

SEQ ID NO: 6557196 - DNA, 22 bp, Homo sapiens
ttaatgataaaatcccattgta

SEQ ID NO: 6557197 - DNA, 22 bp, Homo sapiens
ttaatgataaactcagatctga

SEQ ID NO: 6557198 - DNA, 16 bp, Homo sapiens
ttaatgatggcagagg

SEQ ID NO: 6557199 - DNA, 15 bp, Homo sapiens
ttaatgattgattat

SEQ ID NO: 6557200 - DNA, 18 bp, Homo sapiens
ttaatgatttttgtgtat

SEQ ID NO: 6557201 - DNA, 12 bp, Homo sapiens
ttaatgcacttt

SEQ ID NO: 6557202 - DNA, 14 bp, Homo sapiens
ttaatgcactttct

SEQ ID NO: 6557203 - DNA, 15 bp, Homo sapiens
ttaatgcactttcta

SEQ ID NO: 6557204 - DNA, 18 bp, Homo sapiens
ttaatgcattaaacctgt

SEQ ID NO: 6557205 - DNA, 23 bp, Homo sapiens
ttaatgcattaaacctgtctcca

SEQ ID NO: 6557206 - DNA, 14 bp, Homo sapiens
ttaatgcattgttg

SEQ ID NO: 6557207 - DNA, 19 bp, Homo sapiens
ttaatgcattgttgtaaag

SEQ ID NO: 6557208 - DNA, 16 bp, Homo sapiens
ttaatgcatttttgat

SEQ ID NO: 6557209 - DNA, 20 bp, Homo sapiens
ttaatgccacggcagccacc

SEQ ID NO: 6557210 - DNA, 22 bp, Homo sapiens
ttaatgccatctagctagcaat

SEQ ID NO: 6557211 - DNA, 19 bp, Homo sapiens
ttaatgccattatccctga

SEQ ID NO: 6557212 - DNA, 23 bp, Homo sapiens
ttaatgcccagccagccacccct

SEQ ID NO: 6557213 - DNA, 17 bp, Homo sapiens
ttaatgcctataacttt

SEQ ID NO: 6557214 - DNA, 23 bp, Homo sapiens
ttaatgcctataactttttttca

SEQ ID NO: 6557215 - DNA, 23 bp, Homo sapiens
ttaatgcctctcccgcaccaggc

SEQ ID NO: 6557216 - DNA, 18 bp, Homo sapiens
ttaatgcctgctttttgg

SEQ ID NO: 6557217 - DNA, 14 bp, Homo sapiens
ttaatgccttccac

SEQ ID NO: 6557218 - DNA, 18 bp, Homo sapiens
ttaatgcctttaaagtat

SEQ ID NO: 6557219 - DNA, 13 bp, Homo sapiens
ttaatgctaaggg

SEQ ID NO: 6557220 - DNA, 21 bp, Homo sapiens
ttaatgctaagggcaggccca

SEQ ID NO: 6557221 - DNA, 21 bp, Homo sapiens
ttaatgctatttgaacaagtg

SEQ ID NO: 6557222 - DNA, 19 bp, Homo sapiens
ttaatgctgcctgcctttt

SEQ ID NO: 6557223 - DNA, 15 bp, Homo sapiens
ttaatgcttaagatt

SEQ ID NO: 6557224 - DNA, 14 bp, Homo sapiens
ttaatgcttcattc

SEQ ID NO: 6557225 - DNA, 15 bp, Homo sapiens
ttaatgcttcattca

SEQ ID NO: 6557226 - DNA, 15 bp, Homo sapiens
ttaatggaaaactgt

SEQ ID NO: 6557227 - DNA, 16 bp, Homo sapiens
ttaatggaaaactgtt

SEQ ID NO: 6557228 - DNA, 18 bp, Homo sapiens
ttaatggaaaactgttaa

SEQ ID NO: 6557229 - DNA, 18 bp, Homo sapiens
ttaatggacaaataagtt

SEQ ID NO: 6557230 - DNA, 20 bp, Homo sapiens
ttaatggacacttttcacct

SEQ ID NO: 6557231 - DNA, 15 bp, Homo sapiens
ttaatggactgtgaa

SEQ ID NO: 6557232 - DNA, 20 bp, Homo sapiens
ttaatggactgtgaatttca

SEQ ID NO: 6557233 - DNA, 13 bp, Homo sapiens
ttaatggatattt

SEQ ID NO: 6557234 - DNA, 12 bp, Homo sapiens
ttaatggatgaa

SEQ ID NO: 6557235 - DNA, 21 bp, Homo sapiens
ttaatggattgttaatttcag

SEQ ID NO: 6557236 - DNA, 23 bp, Homo sapiens
ttaatggcaaggcagccctgtct

SEQ ID NO: 6557237 - DNA, 14 bp, Homo sapiens
ttaatggcactgat

SEQ ID NO: 6557238 - DNA, 20 bp, Homo sapiens
ttaatggcagcattcagaac

SEQ ID NO: 6557239 - DNA, 18 bp, Homo sapiens
ttaatggcataacaaagg

SEQ ID NO: 6557240 - DNA, 18 bp, Homo sapiens
ttaatggctgataatttt

SEQ ID NO: 6557241 - DNA, 21 bp, Homo sapiens
ttaatgggggtagcagctgga

SEQ ID NO: 6557242 - DNA, 18 bp, Homo sapiens
ttaatggggtctgtaaat

SEQ ID NO: 6557243 - DNA, 18 bp, Homo sapiens
ttaatggtatctgttact

SEQ ID NO: 6557244 - DNA, 19 bp, Homo sapiens
ttaatggtttattctttgc

SEQ ID NO: 6557245 - DNA, 21 bp, Homo sapiens
ttaatgtaataaagtgaactt

SEQ ID NO: 6557246 - DNA, 18 bp, Homo sapiens
ttaatgtaatctgatggc

SEQ ID NO: 6557247 - DNA, 18 bp, Homo sapiens
ttaatgtaattcaggact

SEQ ID NO: 6557248 - DNA, 15 bp, Homo sapiens
ttaatgtacagtaaa

SEQ ID NO: 6557249 - DNA, 22 bp, Homo sapiens
ttaatgtactttttattgcatg

SEQ ID NO: 6557250 - DNA, 21 bp, Homo sapiens
ttaatgtagacattatctttt

SEQ ID NO: 6557251 - DNA, 15 bp, Homo sapiens
ttaatgtagattttt

SEQ ID NO: 6557252 - DNA, 14 bp, Homo sapiens
ttaatgtatataaa

SEQ ID NO: 6557253 - DNA, 19 bp, Homo sapiens
ttaatgtatatttgctgca

SEQ ID NO: 6557254 - DNA, 16 bp, Homo sapiens
ttaatgtatctatttg

SEQ ID NO: 6557255 - DNA, 19 bp, Homo sapiens
ttaatgtattcccttcagg

SEQ ID NO: 6557256 - DNA, 17 bp, Homo sapiens
ttaatgtatttgttcat

SEQ ID NO: 6557257 - DNA, 18 bp, Homo sapiens
ttaatgtatttttgtaaa

SEQ ID NO: 6557258 - DNA, 17 bp, Homo sapiens
ttaatgtcattgctaaa

SEQ ID NO: 6557259 - DNA, 22 bp, Homo sapiens
ttaatgtctcactttactttca

SEQ ID NO: 6557260 - DNA, 18 bp, Homo sapiens
ttaatgtctcctttgctc

SEQ ID NO: 6557261 - DNA, 20 bp, Homo sapiens
ttaatgtctggtgtttgtca

SEQ ID NO: 6557262 - DNA, 21 bp, Homo sapiens
ttaatgtctgtcagaagacac

SEQ ID NO: 6557263 - DNA, 11 bp, Homo sapiens
ttaatgtgaag

SEQ ID NO: 6557264 - DNA, 12 bp, Homo sapiens
ttaatgtgaaga

SEQ ID NO: 6557265 - DNA, 16 bp, Homo sapiens
ttaatgtgaatttttg

SEQ ID NO: 6557266 - DNA, 23 bp, Homo sapiens
ttaatgtgacctagcaataggca

SEQ ID NO: 6557267 - DNA, 13 bp, Homo sapiens
ttaatgtgatgat

SEQ ID NO: 6557268 - DNA, 20 bp, Homo sapiens
ttaatgtgctctgtacctgt

SEQ ID NO: 6557269 - DNA, 12 bp, Homo sapiens
ttaatgtgtaaa

SEQ ID NO: 6557270 - DNA, 13 bp, Homo sapiens
ttaatgtgtatta

SEQ ID NO: 6557271 - DNA, 22 bp, Homo sapiens
ttaatgtgtatttactgtacta

SEQ ID NO: 6557272 - DNA, 16 bp, Homo sapiens
ttaatgttaactttca

SEQ ID NO: 6557273 - DNA, 13 bp, Homo sapiens
ttaatgttacaac

SEQ ID NO: 6557274 - DNA, 17 bp, Homo sapiens
ttaatgttatttggaat

SEQ ID NO: 6557275 - DNA, 23 bp, Homo sapiens
ttaatgttcattttctctgtatg

SEQ ID NO: 6557276 - DNA, 11 bp, Homo sapiens
ttaatgttcta

SEQ ID NO: 6557277 - DNA, 13 bp, Homo sapiens
ttaatgttctgtg

SEQ ID NO: 6557278 - DNA, 23 bp, Homo sapiens
ttaatgttctttataaaaagtga

SEQ ID NO: 6557279 - DNA, 17 bp, Homo sapiens
ttaatgttgaaaaagaa

SEQ ID NO: 6557280 - DNA, 23 bp, Homo sapiens
ttaatgttgaacaaaataaattg

SEQ ID NO: 6557281 - DNA, 14 bp, Homo sapiens
ttaatgttggaaga

SEQ ID NO: 6557282 - DNA, 21 bp, Homo sapiens
ttaatgtttagtcagtgtact

SEQ ID NO: 6557283 - DNA, 17 bp, Homo sapiens
ttaatgtttattcctga

SEQ ID NO: 6557284 - DNA, 18 bp, Homo sapiens
ttaatgtttctgatttct

SEQ ID NO: 6557285 - DNA, 12 bp, Homo sapiens
ttaatgttttca

SEQ ID NO: 6557286 - DNA, 15 bp, Homo sapiens
ttaatgttttcaaaa

SEQ ID NO: 6557287 - DNA, 21 bp, Homo sapiens
ttaatgttttcattatgttca

SEQ ID NO: 6557288 - DNA, 18 bp, Homo sapiens
ttaatgttttttgccaca

SEQ ID NO: 6557289 - DNA, 14 bp, Homo sapiens
ttaattaaaaacta

SEQ ID NO: 6557290 - DNA, 22 bp, Homo sapiens
ttaattaaaacacaacatcttt

SEQ ID NO: 6557291 - DNA, 18 bp, Homo sapiens
ttaattaaactgaagaag

SEQ ID NO: 6557292 - DNA, 15 bp, Homo sapiens
ttaattaaatagctt

SEQ ID NO: 6557293 - DNA, 19 bp, Homo sapiens
ttaattaaatagcttttgt

SEQ ID NO: 6557294 - DNA, 13 bp, Homo sapiens
ttaattaaatgca

SEQ ID NO: 6557295 - DNA, 17 bp, Homo sapiens
ttaattaaatgtattta

SEQ ID NO: 6557296 - DNA, 14 bp, Homo sapiens
ttaattaacatcaa

SEQ ID NO: 6557297 - DNA, 18 bp, Homo sapiens
ttaattaactatgtgatg

SEQ ID NO: 6557298 - DNA, 22 bp, Homo sapiens
ttaattaagcaaagcacccatt

SEQ ID NO: 6557299 - DNA, 22 bp, Homo sapiens
ttaattaagctctcatagctca

SEQ ID NO: 6557300 - DNA, 15 bp, Homo sapiens
ttaattaatgtacac

SEQ ID NO: 6557301 - DNA, 16 bp, Homo sapiens
ttaattaatgtacaca

SEQ ID NO: 6557302 - DNA, 16 bp, Homo sapiens
ttaattaattaacatc

SEQ ID NO: 6557303 - DNA, 16 bp, Homo sapiens
ttaattaatttgatta

SEQ ID NO: 6557304 - DNA, 21 bp, Homo sapiens
ttaattaatttgattaacaaa

SEQ ID NO: 6557305 - DNA, 20 bp, Homo sapiens
tttataataggaatttgtat

SEQ ID NO: 6557306 - DNA, 16 bp, Homo sapiens
tttataatattcatac

SEQ ID NO: 6557307 - DNA, 15 bp, Homo sapiens
tttataatctgaaga

SEQ ID NO: 6557308 - DNA, 21 bp, Homo sapiens
tttataatgaagaacactgta

SEQ ID NO: 6557309 - DNA, 14 bp, Homo sapiens
tttataatgatgaa

SEQ ID NO: 6557310 - DNA, 19 bp, Homo sapiens
tttataatgatgaacttat

SEQ ID NO: 6557311 - DNA, 21 bp, Homo sapiens
tttataatgatgaacttataa

SEQ ID NO: 6557312 - DNA, 13 bp, Homo sapiens
tttataatgcaat

SEQ ID NO: 6557313 - DNA, 12 bp, Homo sapiens
tttataatgcag

SEQ ID NO: 6557314 - DNA, 14 bp, Homo sapiens
tttataatgtattt

SEQ ID NO: 6557315 - DNA, 17 bp, Homo sapiens
tttataatgtatttgaa

SEQ ID NO: 6557316 - DNA, 14 bp, Homo sapiens
tttataatgtcaaa

SEQ ID NO: 6557317 - DNA, 21 bp, Homo sapiens
tttataatgtggatttcctat

SEQ ID NO: 6557318 - DNA, 15 bp, Homo sapiens
tttataatgttgtat

SEQ ID NO: 6557319 - DNA, 12 bp, Homo sapiens
tttataattaaa

SEQ ID NO: 6557320 - DNA, 20 bp, Homo sapiens
tttataattaaagatgccat

SEQ ID NO: 6557321 - DNA, 17 bp, Homo sapiens
tttataattctcattaa

SEQ ID NO: 6557322 - DNA, 23 bp, Homo sapiens
tttataattggtgctatttgaag

SEQ ID NO: 6557323 - DNA, 13 bp, Homo sapiens
tttataattgttt

SEQ ID NO: 6557324 - DNA, 16 bp, Homo sapiens
tttataatttaaatga

SEQ ID NO: 6557325 - DNA, 16 bp, Homo sapiens
tttataattttatctg

SEQ ID NO: 6557326 - DNA, 17 bp, Homo sapiens
tttataattttatctgt

SEQ ID NO: 6557327 - DNA, 17 bp, Homo sapiens
tttataattttctaagt

SEQ ID NO: 6557328 - DNA, 16 bp, Homo sapiens
tttataattttctgaa

SEQ ID NO: 6557329 - DNA, 15 bp, Homo sapiens
tttatacaaaataat

SEQ ID NO: 6557330 - DNA, 17 bp, Homo sapiens
tttatacaaagaaactt

SEQ ID NO: 6557331 - DNA, 19 bp, Homo sapiens
tttatacaaattagaaaat

SEQ ID NO: 6557332 - DNA, 15 bp, Homo sapiens
tttatacaacagtgc

SEQ ID NO: 6557333 - DNA, 22 bp, Homo sapiens
tttatacaagaagggagattca

SEQ ID NO: 6557334 - DNA, 18 bp, Homo sapiens
tttatacaatggaataaa

SEQ ID NO: 6557335 - DNA, 20 bp, Homo sapiens
tttatacaatggaataaatt

SEQ ID NO: 6557336 - DNA, 12 bp, Homo sapiens
tttatacacata

SEQ ID NO: 6557337 - DNA, 15 bp, Homo sapiens
tttatacacataatt

SEQ ID NO: 6557338 - DNA, 21 bp, Homo sapiens
tttatacacttggatttcatt

SEQ ID NO: 6557339 - DNA, 16 bp, Homo sapiens
tttatacagagtaatt

SEQ ID NO: 6557340 - DNA, 12 bp, Homo sapiens
tttatacagctg

SEQ ID NO: 6557341 - DNA, 17 bp, Homo sapiens
tttatacaggggaatat

SEQ ID NO: 6557342 - DNA, 15 bp, Homo sapiens
tttatacaggtcata

SEQ ID NO: 6557343 - DNA, 16 bp, Homo sapiens
tttatacagtgtacat

SEQ ID NO: 6557344 - DNA, 17 bp, Homo sapiens
tttatacagtgtacatg

SEQ ID NO: 6557345 - DNA, 12 bp, Homo sapiens
tttatacataaa

SEQ ID NO: 6557346 - DNA, 14 bp, Homo sapiens
tttatacataaaca

SEQ ID NO: 6557347 - DNA, 16 bp, Homo sapiens
tttatacataaacagt

SEQ ID NO: 6557348 - DNA, 17 bp, Homo sapiens
tttatacatatcagaaa

SEQ ID NO: 6557349 - DNA, 19 bp, Homo sapiens
tttatacatatcagaaaag

SEQ ID NO: 6557350 - DNA, 20 bp, Homo sapiens
tttatacatatcagaaaagt

SEQ ID NO: 6557351 - DNA, 16 bp, Homo sapiens
tttatacattagtaaa

SEQ ID NO: 6557352 - DNA, 21 bp, Homo sapiens
tttatacattagtaaatgtct

SEQ ID NO: 6557353 - DNA, 16 bp, Homo sapiens
tttataccccatttga

SEQ ID NO: 6557354 - DNA, 10 bp, Homo sapiens
tttatacctc

SEQ ID NO: 6557355 - DNA, 21 bp, Homo sapiens
tttatacctcaaactatctgg

SEQ ID NO: 6557356 - DNA, 18 bp, Homo sapiens
tttatacctgtacacaca

SEQ ID NO: 6557357 - DNA, 19 bp, Homo sapiens
tttatacctgtacacacac

SEQ ID NO: 6557358 - DNA, 20 bp, Homo sapiens
tttatacctgtacacacaca

SEQ ID NO: 6557359 - DNA, 15 bp, Homo sapiens
tttatacgagaacag

SEQ ID NO: 6557360 - DNA, 16 bp, Homo sapiens
tttatacgtgtagcta

SEQ ID NO: 6557361 - DNA, 17 bp, Homo sapiens
tttatacgtgtagctat

SEQ ID NO: 6557362 - DNA, 16 bp, Homo sapiens
tttatactatatttgt

SEQ ID NO: 6557363 - DNA, 19 bp, Homo sapiens
tttatactatatttgtgct

SEQ ID NO: 6557364 - DNA, 17 bp, Homo sapiens
tttatactcagaactgt

SEQ ID NO: 6557365 - DNA, 16 bp, Homo sapiens
tttatactctttctgt

SEQ ID NO: 6557366 - DNA, 20 bp, Homo sapiens
tttatactctttctgtatat

SEQ ID NO: 6557367 - DNA, 20 bp, Homo sapiens
tttatactgattatgtcttt

SEQ ID NO: 6557368 - DNA, 15 bp, Homo sapiens
tttatactgctctat

SEQ ID NO: 6557369 - DNA, 23 bp, Homo sapiens
tttatactgctctataaatagta

SEQ ID NO: 6557370 - DNA, 21 bp, Homo sapiens
tttatactgggtttcaagaaa

SEQ ID NO: 6557371 - DNA, 15 bp, Homo sapiens
tttatactgtacatg

SEQ ID NO: 6557372 - DNA, 15 bp, Homo sapiens
tttatactgtagcaa

SEQ ID NO: 6557373 - DNA, 21 bp, Homo sapiens
tttatactgtagcaatatatt

SEQ ID NO: 6557374 - DNA, 17 bp, Homo sapiens
tttatacttaaaaaatc

SEQ ID NO: 6557375 - DNA, 18 bp, Homo sapiens
tttatacttcaaatgtca

SEQ ID NO: 6557376 - DNA, 20 bp, Homo sapiens
tttatactttccctaccctc

SEQ ID NO: 6557377 - DNA, 15 bp, Homo sapiens
tttatagaaaatgca

SEQ ID NO: 6557378 - DNA, 23 bp, Homo sapiens
tttatagaaggaatttgtacttc

SEQ ID NO: 6557379 - DNA, 20 bp, Homo sapiens
tttatagacattatgtgagt

SEQ ID NO: 6557380 - DNA, 19 bp, Homo sapiens
tttatagactgatttagaa

SEQ ID NO: 6557381 - DNA, 16 bp, Homo sapiens
tttatagatcatttct

SEQ ID NO: 6557382 - DNA, 17 bp, Homo sapiens
tttatagattatatgaa

SEQ ID NO: 6557383 - DNA, 18 bp, Homo sapiens
tttatagcaacaacaatt

SEQ ID NO: 6557384 - DNA, 18 bp, Homo sapiens
tttatagccataaaagaa

SEQ ID NO: 6557385 - DNA, 20 bp, Homo sapiens
tttatagctattactgtctg

SEQ ID NO: 6557386 - DNA, 20 bp, Homo sapiens
tttataggaatagaggaaga

SEQ ID NO: 6557387 - DNA, 21 bp, Homo sapiens
tttataggaatagaggaagaa

SEQ ID NO: 6557388 - DNA, 13 bp, Homo sapiens
tttataggtttta

SEQ ID NO: 6557389 - DNA, 22 bp, Homo sapiens
tttatagtatgtgacttttctg

SEQ ID NO: 6557390 - DNA, 19 bp, Homo sapiens
tttatagtctcaaatcaaa

SEQ ID NO: 6557391 - DNA, 22 bp, Homo sapiens
tttatagtgaagtgttaataca

SEQ ID NO: 6557392 - DNA, 21 bp, Homo sapiens
tttatagtgagttgcatgttt

SEQ ID NO: 6557393 - DNA, 18 bp, Homo sapiens
tttatagtgcacaaaatg

SEQ ID NO: 6557394 - DNA, 15 bp, Homo sapiens
tttatagtttataca

SEQ ID NO: 6557395 - DNA, 17 bp, Homo sapiens
tttatagtttgtacatg

SEQ ID NO: 6557396 - DNA, 19 bp, Homo sapiens
tttatagtttgtacatgca

SEQ ID NO: 6557397 - DNA, 13 bp, Homo sapiens
tttatataaagta

SEQ ID NO: 6557398 - DNA, 16 bp, Homo sapiens
tttatataaagtattt

SEQ ID NO: 6557399 - DNA, 23 bp, Homo sapiens
tttatataaataaatgtttctag

SEQ ID NO: 6557400 - DNA, 15 bp, Homo sapiens
tttatataaatatat

SEQ ID NO: 6557401 - DNA, 14 bp, Homo sapiens
tttatataaatgct

SEQ ID NO: 6557402 - DNA, 17 bp, Homo sapiens
tttatataactacatta

SEQ ID NO: 6557403 - DNA, 12 bp, Homo sapiens
tttatataataa

SEQ ID NO: 6557404 - DNA, 17 bp, Homo sapiens
tttatataataaagtat

SEQ ID NO: 6557405 - DNA, 21 bp, Homo sapiens
tttatataataaagtattcca

SEQ ID NO: 6557406 - DNA, 22 bp, Homo sapiens
tttatataatatctaaagttat

SEQ ID NO: 6557407 - DNA, 17 bp, Homo sapiens
tttatataattatgtta

SEQ ID NO: 6557408 - DNA, 15 bp, Homo sapiens
tttatataattttgc

SEQ ID NO: 6557409 - DNA, 20 bp, Homo sapiens
tttatatacaataatggaaa

SEQ ID NO: 6557410 - DNA, 20 bp, Homo sapiens
tttatatacctggcttttac

SEQ ID NO: 6557411 - DNA, 20 bp, Homo sapiens
tttatatactgctatttaca

SEQ ID NO: 6557412 - DNA, 18 bp, Homo sapiens
tttatatagcaagacatt

SEQ ID NO: 6557413 - DNA, 16 bp, Homo sapiens
tttatatagcttgaaa

SEQ ID NO: 6557414 - DNA, 15 bp, Homo sapiens
tttatatataaaata

SEQ ID NO: 6557415 - DNA, 14 bp, Homo sapiens
tttatatataaggt

SEQ ID NO: 6557416 - DNA, 13 bp, Homo sapiens
tttatatatacag

SEQ ID NO: 6557417 - DNA, 15 bp, Homo sapiens
tttatatatatatct

SEQ ID NO: 6557418 - DNA, 19 bp, Homo sapiens
tttatatatatatgtatat

SEQ ID NO: 6557419 - DNA, 20 bp, Homo sapiens
tttatatatgaatattacat

SEQ ID NO: 6557420 - DNA, 13 bp, Homo sapiens
tttatatatggac

SEQ ID NO: 6557421 - DNA, 23 bp, Homo sapiens
tttatatattataagttgacctt

SEQ ID NO: 6557422 - DNA, 18 bp, Homo sapiens
tttatatattatatggaa

SEQ ID NO: 6557423 - DNA, 17 bp, Homo sapiens
tttatatattatgtctt

SEQ ID NO: 6557424 - DNA, 22 bp, Homo sapiens
tttatatattatgtgaagaatt

SEQ ID NO: 6557425 - DNA, 23 bp, Homo sapiens
tttatatattggtaacatccttt

SEQ ID NO: 6557426 - DNA, 17 bp, Homo sapiens
tttatatcaaatgagca

SEQ ID NO: 6557427 - DNA, 23 bp, Homo sapiens
tttatatcaggtgtataaatgta

SEQ ID NO: 6557428 - DNA, 17 bp, Homo sapiens
tttatatcatacagttt

SEQ ID NO: 6557429 - DNA, 15 bp, Homo sapiens
tttatatcatgcaaa

SEQ ID NO: 6557430 - DNA, 16 bp, Homo sapiens
tttatatcatgcaaaa

SEQ ID NO: 6557431 - DNA, 15 bp, Homo sapiens
tttatatccacatct

SEQ ID NO: 6557432 - DNA, 16 bp, Homo sapiens
tttatatccattttta

SEQ ID NO: 6557433 - DNA, 12 bp, Homo sapiens
tttatatctaat

SEQ ID NO: 6557434 - DNA, 21 bp, Homo sapiens
tttatatctcctttgtattct

SEQ ID NO: 6557435 - DNA, 23 bp, Homo sapiens
tttatatctggaatgagcctgtt

SEQ ID NO: 6557436 - DNA, 13 bp, Homo sapiens
tttatatctgtaa

SEQ ID NO: 6557437 - DNA, 18 bp, Homo sapiens
tttatatcttgtttacaa

SEQ ID NO: 6557438 - DNA, 12 bp, Homo sapiens
tttatatcttta

SEQ ID NO: 6557439 - DNA, 23 bp, Homo sapiens
tttatatctttatgcaaaaacat

SEQ ID NO: 6557440 - DNA, 14 bp, Homo sapiens
tttatatctttatt

SEQ ID NO: 6557441 - DNA, 12 bp, Homo sapiens
tttatatctttt

SEQ ID NO: 6557442 - DNA, 17 bp, Homo sapiens
tttatatcttttggtta

SEQ ID NO: 6557443 - DNA, 12 bp, Homo sapiens
tttatatgaaaa

SEQ ID NO: 6557444 - DNA, 13 bp, Homo sapiens
tttatatgaaaac

SEQ ID NO: 6557445 - DNA, 15 bp, Homo sapiens
tttatatgaaaacac

SEQ ID NO: 6557446 - DNA, 22 bp, Homo sapiens
tttatatgaaatgtttcactat

SEQ ID NO: 6557447 - DNA, 20 bp, Homo sapiens
tttatatgaagcaagctgtg

SEQ ID NO: 6557448 - DNA, 23 bp, Homo sapiens
tttatatgaagcaagctgtgtta

SEQ ID NO: 6557449 - DNA, 21 bp, Homo sapiens
tttatatgaagtattaaaatg

SEQ ID NO: 6557450 - DNA, 14 bp, Homo sapiens
tttatatgcatgca

SEQ ID NO: 6557451 - DNA, 17 bp, Homo sapiens
tttatatgcttctgttt

SEQ ID NO: 6557452 - DNA, 12 bp, Homo sapiens
tttatatgcttt

SEQ ID NO: 6557453 - DNA, 21 bp, Homo sapiens
tttatatgctttttctcagat

SEQ ID NO: 6557454 - DNA, 17 bp, Homo sapiens
tttatatggcccagcct

SEQ ID NO: 6557455 - DNA, 23 bp, Homo sapiens
tttatatggcgttttgtctgtgt

SEQ ID NO: 6557456 - DNA, 17 bp, Homo sapiens
tttatatgtacatgaga

SEQ ID NO: 6557457 - DNA, 21 bp, Homo sapiens
tttatatgtaccgtaggcttt

SEQ ID NO: 6557458 - DNA, 14 bp, Homo sapiens
tttatatgtactgt

SEQ ID NO: 6557459 - DNA, 17 bp, Homo sapiens
tttatatgtatatagat

SEQ ID NO: 6557460 - DNA, 15 bp, Homo sapiens
tttatatgtatgtgt

SEQ ID NO: 6557461 - DNA, 20 bp, Homo sapiens
tttatatgtatgtgtttaga

SEQ ID NO: 6557462 - DNA, 15 bp, Homo sapiens
tttatatgttattaa

SEQ ID NO: 6557463 - DNA, 19 bp, Homo sapiens
tttatatgttattaaacag

SEQ ID NO: 6557464 - DNA, 13 bp, Homo sapiens
tttatatgttcat

SEQ ID NO: 6557465 - DNA, 13 bp, Homo sapiens
tttatatgttgta

SEQ ID NO: 6557466 - DNA, 19 bp, Homo sapiens
tttatattaaataacatgt

SEQ ID NO: 6557467 - DNA, 14 bp, Homo sapiens
tttatattaatgta

SEQ ID NO: 6557468 - DNA, 13 bp, Homo sapiens
tttatattacttt

SEQ ID NO: 6557469 - DNA, 20 bp, Homo sapiens
tttatattagttgctttgtt

SEQ ID NO: 6557470 - DNA, 21 bp, Homo sapiens
tttatattagttgctttgtta

SEQ ID NO: 6557471 - DNA, 14 bp, Homo sapiens
tttatattatccat

SEQ ID NO: 6557472 - DNA, 18 bp, Homo sapiens
tttatattcattcagata

SEQ ID NO: 6557473 - DNA, 18 bp, Homo sapiens
tttatattccatttacat

SEQ ID NO: 6557474 - DNA, 21 bp, Homo sapiens
tttatattctaagccagtttt

SEQ ID NO: 6557475 - DNA, 16 bp, Homo sapiens
tttatattctataact

SEQ ID NO: 6557476 - DNA, 22 bp, Homo sapiens
tttatattgataagatctttta

SEQ ID NO: 6557477 - DNA, 18 bp, Homo sapiens
tttatattgcagattgaa

SEQ ID NO: 6557478 - DNA, 14 bp, Homo sapiens
tttatattgtaaat

SEQ ID NO: 6557479 - DNA, 22 bp, Homo sapiens
tttatattgtatattctggaaa

SEQ ID NO: 6557480 - DNA, 17 bp, Homo sapiens
tttatattgtttttata

SEQ ID NO: 6557481 - DNA, 24 bp, Homo sapiens
tttatatttaaattatatttacct

SEQ ID NO: 6557482 - DNA, 16 bp, Homo sapiens
tttatatttatccact

SEQ ID NO: 6557483 - DNA, 21 bp, Homo sapiens
tttatatttcaagtacactga

SEQ ID NO: 6557484 - DNA, 19 bp, Homo sapiens
ttaattacaaacaataaga

SEQ ID NO: 6557485 - DNA, 14 bp, Homo sapiens
ttaattactggaat

SEQ ID NO: 6557486 - DNA, 22 bp, Homo sapiens
ttaattactggaattcttctgc

SEQ ID NO: 6557487 - DNA, 16 bp, Homo sapiens
ttaattagaaacgtga

SEQ ID NO: 6557488 - DNA, 15 bp, Homo sapiens
ttaattagcattctg

SEQ ID NO: 6557489 - DNA, 19 bp, Homo sapiens
ttaattagccagtgaaaaa

SEQ ID NO: 6557490 - DNA, 14 bp, Homo sapiens
ttaattaggaaaaa

SEQ ID NO: 6557491 - DNA, 19 bp, Homo sapiens
ttaattaggaattacttta

SEQ ID NO: 6557492 - DNA, 20 bp, Homo sapiens
ttaattaggaattactttat

SEQ ID NO: 6557493 - DNA, 17 bp, Homo sapiens
ttaattaggttaactat

SEQ ID NO: 6557494 - DNA, 13 bp, Homo sapiens
ttaattagtgcta

SEQ ID NO: 6557495 - DNA, 14 bp, Homo sapiens
ttaattagtgctaa

SEQ ID NO: 6557496 - DNA, 16 bp, Homo sapiens
ttaattagtgctaagt

SEQ ID NO: 6557497 - DNA, 20 bp, Homo sapiens
ttaattagttccagtttctc

SEQ ID NO: 6557498 - DNA, 14 bp, Homo sapiens
ttaattataaacag

SEQ ID NO: 6557499 - DNA, 19 bp, Homo sapiens
ttaattataaacagcaggg

SEQ ID NO: 6557500 - DNA, 23 bp, Homo sapiens
ttaattataccatggtgaattaa

SEQ ID NO: 6557501 - DNA, 23 bp, Homo sapiens
ttaattataggagccttaatttt

SEQ ID NO: 6557502 - DNA, 16 bp, Homo sapiens
ttaattatatgtatat

SEQ ID NO: 6557503 - DNA, 13 bp, Homo sapiens
ttaattatctgat

SEQ ID NO: 6557504 - DNA, 16 bp, Homo sapiens
ttaattatctgatcgg

SEQ ID NO: 6557505 - DNA, 17 bp, Homo sapiens
ttaattatctgcattta

SEQ ID NO: 6557506 - DNA, 23 bp, Homo sapiens
ttaattatcttagtctatagaaa

SEQ ID NO: 6557507 - DNA, 17 bp, Homo sapiens
ttaattatgctaacaaa

SEQ ID NO: 6557508 - DNA, 21 bp, Homo sapiens
ttaattatgctaacaaactga

SEQ ID NO: 6557509 - DNA, 13 bp, Homo sapiens
ttaattatgtgca

SEQ ID NO: 6557510 - DNA, 14 bp, Homo sapiens
ttaattattaatac

SEQ ID NO: 6557511 - DNA, 19 bp, Homo sapiens
ttaattattataaaaatat

SEQ ID NO: 6557512 - DNA, 14 bp, Homo sapiens
ttaattattattta

SEQ ID NO: 6557513 - DNA, 16 bp, Homo sapiens
ttaattatttaaatgt

SEQ ID NO: 6557514 - DNA, 18 bp, Homo sapiens
ttaattattttctgagac

SEQ ID NO: 6557515 - DNA, 17 bp, Homo sapiens
ttaattcaacttaacta

SEQ ID NO: 6557516 - DNA, 11 bp, Homo sapiens
ttaattcaaga

SEQ ID NO: 6557517 - DNA, 21 bp, Homo sapiens
ttaattcacagaatagcacaa

SEQ ID NO: 6557518 - DNA, 14 bp, Homo sapiens
ttaattcacctcag

SEQ ID NO: 6557519 - DNA, 23 bp, Homo sapiens
ttaattcaggtatgtaaaagact

SEQ ID NO: 6557520 - DNA, 23 bp, Homo sapiens
ttaattcagtctcagctgctgaa

SEQ ID NO: 6557521 - DNA, 16 bp, Homo sapiens
ttaattcataattaga

SEQ ID NO: 6557522 - DNA, 13 bp, Homo sapiens
ttaattcatattt

SEQ ID NO: 6557523 - DNA, 14 bp, Homo sapiens
ttaattcatgtttc

SEQ ID NO: 6557524 - DNA, 15 bp, Homo sapiens
ttaattcatgtttct

SEQ ID NO: 6557525 - DNA, 13 bp, Homo sapiens
ttaattcattaaa

SEQ ID NO: 6557526 - DNA, 13 bp, Homo sapiens
ttaattcatttgg

SEQ ID NO: 6557527 - DNA, 11 bp, Homo sapiens
ttaattccaag

SEQ ID NO: 6557528 - DNA, 15 bp, Homo sapiens
ttaattcctatgaag

SEQ ID NO: 6557529 - DNA, 17 bp, Homo sapiens
ttaattccttcagcact

SEQ ID NO: 6557530 - DNA, 15 bp, Homo sapiens
ttaattcctttccag

SEQ ID NO: 6557531 - DNA, 16 bp, Homo sapiens
ttaattcctttctcat

SEQ ID NO: 6557532 - DNA, 23 bp, Homo sapiens
ttaattctaaaagagaagggagc

SEQ ID NO: 6557533 - DNA, 12 bp, Homo sapiens
ttaattctaaac

SEQ ID NO: 6557534 - DNA, 16 bp, Homo sapiens
ttaattctcattatga

SEQ ID NO: 6557535 - DNA, 19 bp, Homo sapiens
ttaattctcattatgaaga

SEQ ID NO: 6557536 - DNA, 15 bp, Homo sapiens
ttaattctccttccc

SEQ ID NO: 6557537 - DNA, 12 bp, Homo sapiens
ttaattctcttt

SEQ ID NO: 6557538 - DNA, 22 bp, Homo sapiens
ttaattctgatgctaggttgtt

SEQ ID NO: 6557539 - DNA, 17 bp, Homo sapiens
ttaattcttattttaga

SEQ ID NO: 6557540 - DNA, 18 bp, Homo sapiens
ttaattcttcacctgtta

SEQ ID NO: 6557541 - DNA, 19 bp, Homo sapiens
ttaattcttcacctttgta

SEQ ID NO: 6557542 - DNA, 21 bp, Homo sapiens
ttaattcttcacctttgtaag

SEQ ID NO: 6557543 - DNA, 15 bp, Homo sapiens
ttaattctttgttct

SEQ ID NO: 6557544 - DNA, 11 bp, Homo sapiens
ttaattgaaag

SEQ ID NO: 6557545 - DNA, 16 bp, Homo sapiens
ttaattgaaagaatgt

SEQ ID NO: 6557546 - DNA, 21 bp, Homo sapiens
ttaattgaaagggacaagtat

SEQ ID NO: 6557547 - DNA, 13 bp, Homo sapiens
ttaattgaaattt

SEQ ID NO: 6557548 - DNA, 16 bp, Homo sapiens
ttaattgacagtcact

SEQ ID NO: 6557549 - DNA, 22 bp, Homo sapiens
ttaattgacagtcactcagcca

SEQ ID NO: 6557550 - DNA, 17 bp, Homo sapiens
ttaattgatagaataaa

SEQ ID NO: 6557551 - DNA, 12 bp, Homo sapiens
ttaattgattaa

SEQ ID NO: 6557552 - DNA, 16 bp, Homo sapiens
ttaattgattaaactg

SEQ ID NO: 6557553 - DNA, 14 bp, Homo sapiens
ttaattgcaacaat

SEQ ID NO: 6557554 - DNA, 19 bp, Homo sapiens
ttaattgcaacatgaagtt

SEQ ID NO: 6557555 - DNA, 17 bp, Homo sapiens
ttaattgctaacaattg

SEQ ID NO: 6557556 - DNA, 12 bp, Homo sapiens
ttaattgctgag

SEQ ID NO: 6557557 - DNA, 13 bp, Homo sapiens
ttaattgctttga

SEQ ID NO: 6557558 - DNA, 18 bp, Homo sapiens
ttaattggcagcagattt

SEQ ID NO: 6557559 - DNA, 13 bp, Homo sapiens
ttaattgggcact

SEQ ID NO: 6557560 - DNA, 21 bp, Homo sapiens
ttaattgggccagcttttcaa

SEQ ID NO: 6557561 - DNA, 14 bp, Homo sapiens
ttaattgtaaactg

SEQ ID NO: 6557562 - DNA, 13 bp, Homo sapiens
ttaattgtataaa

SEQ ID NO: 6557563 - DNA, 22 bp, Homo sapiens
ttaattgtgaattgataataaa

SEQ ID NO: 6557564 - DNA, 23 bp, Homo sapiens
ttaattgtgcaaaggataaattt

SEQ ID NO: 6557565 - DNA, 15 bp, Homo sapiens
ttaattgtggcttta

SEQ ID NO: 6557566 - DNA, 14 bp, Homo sapiens
ttaattgtgtaact

SEQ ID NO: 6557567 - DNA, 21 bp, Homo sapiens
ttaattgtgtgaacttggaag

SEQ ID NO: 6557568 - DNA, 23 bp, Homo sapiens
ttaattgtgtggtgcttttatag

SEQ ID NO: 6557569 - DNA, 20 bp, Homo sapiens
ttaattgtgtgtcttctatt

SEQ ID NO: 6557570 - DNA, 13 bp, Homo sapiens
ttaattgtgttta

SEQ ID NO: 6557571 - DNA, 21 bp, Homo sapiens
ttaattgttccttgcttttat

SEQ ID NO: 6557572 - DNA, 21 bp, Homo sapiens
ttaattgttctgctttttctg

SEQ ID NO: 6557573 - DNA, 16 bp, Homo sapiens
ttaattgttgtttctt

SEQ ID NO: 6557574 - DNA, 13 bp, Homo sapiens
ttaattgtttaaa

SEQ ID NO: 6557575 - DNA, 21 bp, Homo sapiens
ttaatttaaagcttactctgt

SEQ ID NO: 6557576 - DNA, 12 bp, Homo sapiens
ttaatttaacaa

SEQ ID NO: 6557577 - DNA, 19 bp, Homo sapiens
ttaatttaacaaactaaaa

SEQ ID NO: 6557578 - DNA, 22 bp, Homo sapiens
ttaatttaagtttgtagttttt

SEQ ID NO: 6557579 - DNA, 23 bp, Homo sapiens
ttaatttaagttttgacaagctg

SEQ ID NO: 6557580 - DNA, 17 bp, Homo sapiens
ttaatttaatatttact

SEQ ID NO: 6557581 - DNA, 16 bp, Homo sapiens
ttaatttaattgcttt

SEQ ID NO: 6557582 - DNA, 22 bp, Homo sapiens
ttaatttacaaaaatataaaat

SEQ ID NO: 6557583 - DNA, 16 bp, Homo sapiens
ttaatttagaaaactt

SEQ ID NO: 6557584 - DNA, 15 bp, Homo sapiens
ttaatttagaaactg

SEQ ID NO: 6557585 - DNA, 20 bp, Homo sapiens
ttaatttagagcgtttggtt

SEQ ID NO: 6557586 - DNA, 18 bp, Homo sapiens
ttaatttagatattttcc

SEQ ID NO: 6557587 - DNA, 18 bp, Homo sapiens
ttaatttataatgtattt

SEQ ID NO: 6557588 - DNA, 20 bp, Homo sapiens
ttaatttataatgtatttga

SEQ ID NO: 6557589 - DNA, 21 bp, Homo sapiens
ttaatttataatgtatttgaa

SEQ ID NO: 6557590 - DNA, 22 bp, Homo sapiens
ttaatttataatgtatttgaaa

SEQ ID NO: 6557591 - DNA, 16 bp, Homo sapiens
ttaatttatatttgaa

SEQ ID NO: 6557592 - DNA, 18 bp, Homo sapiens
ttaatttatatttgtctc

SEQ ID NO: 6557593 - DNA, 13 bp, Homo sapiens
ttaatttatcaga

SEQ ID NO: 6557594 - DNA, 14 bp, Homo sapiens
ttaatttatcagat

SEQ ID NO: 6557595 - DNA, 16 bp, Homo sapiens
ttaatttatgtaaggt

SEQ ID NO: 6557596 - DNA, 14 bp, Homo sapiens
ttaatttatgtgaa

SEQ ID NO: 6557597 - DNA, 14 bp, Homo sapiens
ttaatttattaaat

SEQ ID NO: 6557598 - DNA, 13 bp, Homo sapiens
ttaatttatttca

SEQ ID NO: 6557599 - DNA, 21 bp, Homo sapiens
ttaatttattttgtgaacact

SEQ ID NO: 6557600 - DNA, 14 bp, Homo sapiens
ttaatttatttttg

SEQ ID NO: 6557601 - DNA, 13 bp, Homo sapiens
ttaatttcaggaa

SEQ ID NO: 6557602 - DNA, 18 bp, Homo sapiens
ttaatttcaggaaaatgt

SEQ ID NO: 6557603 - DNA, 17 bp, Homo sapiens
ttaatttcagtcctgta

SEQ ID NO: 6557604 - DNA, 16 bp, Homo sapiens
ttaatttcatgtatat

SEQ ID NO: 6557605 - DNA, 11 bp, Homo sapiens
ttaatttccag

SEQ ID NO: 6557606 - DNA, 15 bp, Homo sapiens
ttaatttccttctgt

SEQ ID NO: 6557607 - DNA, 17 bp, Homo sapiens
ttaatttccttctgtta

SEQ ID NO: 6557608 - DNA, 12 bp, Homo sapiens
ttaatttccttt

SEQ ID NO: 6557609 - DNA, 15 bp, Homo sapiens
ttaatttcctttttg

SEQ ID NO: 6557610 - DNA, 18 bp, Homo sapiens
ttaatttcctttttgaca

SEQ ID NO: 6557611 - DNA, 20 bp, Homo sapiens
ttaatttcctttttgacact

SEQ ID NO: 6557612 - DNA, 18 bp, Homo sapiens
ttaatttcggttatagct

SEQ ID NO: 6557613 - DNA, 21 bp, Homo sapiens
ttaatttctaagaagttactt

SEQ ID NO: 6557614 - DNA, 21 bp, Homo sapiens
ttaatttctacaaaataacat

SEQ ID NO: 6557615 - DNA, 15 bp, Homo sapiens
ttaatttctatgaag

SEQ ID NO: 6557616 - DNA, 14 bp, Homo sapiens
ttaatttctattgt

SEQ ID NO: 6557617 - DNA, 15 bp, Homo sapiens
ttaatttctgaagaa

SEQ ID NO: 6557618 - DNA, 18 bp, Homo sapiens
ttaatttctgcctttccc

SEQ ID NO: 6557619 - DNA, 20 bp, Homo sapiens
ttaatttcttgcaatttgaa

SEQ ID NO: 6557620 - DNA, 21 bp, Homo sapiens
ttaatttcttgcaatttgaag

SEQ ID NO: 6557621 - DNA, 18 bp, Homo sapiens
ttaatttgaccagaaaat

SEQ ID NO: 6557622 - DNA, 16 bp, Homo sapiens
ttaatttgatacaaaa

SEQ ID NO: 6557623 - DNA, 14 bp, Homo sapiens
ttaatttgcacagt

SEQ ID NO: 6557624 - DNA, 11 bp, Homo sapiens
ttaatttggaa

SEQ ID NO: 6557625 - DNA, 16 bp, Homo sapiens
ttaatttggaaactaa

SEQ ID NO: 6557626 - DNA, 12 bp, Homo sapiens
ttaatttggaca

SEQ ID NO: 6557627 - DNA, 18 bp, Homo sapiens
ttaatttggaccattttc

SEQ ID NO: 6557628 - DNA, 13 bp, Homo sapiens
ttaatttggataa

SEQ ID NO: 6557629 - DNA, 21 bp, Homo sapiens
ttaatttgggaatttgttgtg

SEQ ID NO: 6557630 - DNA, 14 bp, Homo sapiens
ttaatttgtattga

SEQ ID NO: 6557631 - DNA, 13 bp, Homo sapiens
ttaatttgtgaat

SEQ ID NO: 6557632 - DNA, 16 bp, Homo sapiens
ttaatttgtgaatttg

SEQ ID NO: 6557633 - DNA, 15 bp, Homo sapiens
ttaatttgttatgta

SEQ ID NO: 6557634 - DNA, 19 bp, Homo sapiens
ttaatttgtttttcttatc

SEQ ID NO: 6557635 - DNA, 18 bp, Homo sapiens
ttaattttaaagtgcaaa

SEQ ID NO: 6557636 - DNA, 20 bp, Homo sapiens
ttaattttaatgctgtttct

SEQ ID NO: 6557637 - DNA, 13 bp, Homo sapiens
ttaattttaccaa

SEQ ID NO: 6557638 - DNA, 22 bp, Homo sapiens
ttaattttaccaagagtaactt

SEQ ID NO: 6557639 - DNA, 18 bp, Homo sapiens
ttaattttagaaagaaaa

SEQ ID NO: 6557640 - DNA, 22 bp, Homo sapiens
ttaattttagagaaactttgag

SEQ ID NO: 6557641 - DNA, 15 bp, Homo sapiens
ttaattttagttttt

SEQ ID NO: 6557642 - DNA, 17 bp, Homo sapiens
ttaattttattgcaaag

SEQ ID NO: 6557643 - DNA, 14 bp, Homo sapiens
ttaattttcacaaa

SEQ ID NO: 6557644 - DNA, 15 bp, Homo sapiens
ttaattttcacaaaa

SEQ ID NO: 6557645 - DNA, 12 bp, Homo sapiens
ttaattttcact

SEQ ID NO: 6557646 - DNA, 19 bp, Homo sapiens
ttaattttcaggatttttg

SEQ ID NO: 6557647 - DNA, 14 bp, Homo sapiens
ttaattttcaggtc

SEQ ID NO: 6557648 - DNA, 17 bp, Homo sapiens
ttaattttcctcatttt

SEQ ID NO: 6557649 - DNA, 13 bp, Homo sapiens
ttaattttctaaa

SEQ ID NO: 6557650 - DNA, 14 bp, Homo sapiens
ttaattttctaaaa

SEQ ID NO: 6557651 - DNA, 14 bp, Homo sapiens
ttaattttctatgt

SEQ ID NO: 6557652 - DNA, 18 bp, Homo sapiens
ttaattttctctttagga

SEQ ID NO: 6557653 - DNA, 19 bp, Homo sapiens
ttaattttctctttgtatg

SEQ ID NO: 6557654 - DNA, 19 bp, Homo sapiens
ttaattttgacactgaaat

SEQ ID NO: 6557655 - DNA, 20 bp, Homo sapiens
ttaattttgacactgaaata

SEQ ID NO: 6557656 - DNA, 13 bp, Homo sapiens
ttaattttgctaa

SEQ ID NO: 6557657 - DNA, 13 bp, Homo sapiens
ttaattttgtatt

SEQ ID NO: 6557658 - DNA, 15 bp, Homo sapiens
ttaattttgtatttt

SEQ ID NO: 6557659 - DNA, 12 bp, Homo sapiens
ttaattttgtct

SEQ ID NO: 6557660 - DNA, 23 bp, Homo sapiens
ttaattttgtctgccccaagttt

SEQ ID NO: 6557661 - DNA, 14 bp, Homo sapiens
ttaattttgtcttt

SEQ ID NO: 6557662 - DNA, 15 bp, Homo sapiens
ttaattttgtgcatt

SEQ ID NO: 6557663 - DNA, 16 bp, Homo sapiens
ttaattttgtgcattc

SEQ ID NO: 6557664 - DNA, 17 bp, Homo sapiens
ttaatttttaaaagact

SEQ ID NO: 6557665 - DNA, 22 bp, Homo sapiens
ttaatttttaaaagactttgat

SEQ ID NO: 6557666 - DNA, 20 bp, Homo sapiens
tttatatttcaataaatgat

SEQ ID NO: 6557667 - DNA, 14 bp, Homo sapiens
tttatatttccttt

SEQ ID NO: 6557668 - DNA, 21 bp, Homo sapiens
tttatatttcctttatgtgaa

SEQ ID NO: 6557669 - DNA, 12 bp, Homo sapiens
tttatatttctc

SEQ ID NO: 6557670 - DNA, 16 bp, Homo sapiens
tttatatttggaaaga

SEQ ID NO: 6557671 - DNA, 18 bp, Homo sapiens
tttatatttggaaagaga

SEQ ID NO: 6557672 - DNA, 21 bp, Homo sapiens
tttatatttggaaagagacca

SEQ ID NO: 6557673 - DNA, 14 bp, Homo sapiens
tttatatttggatg

SEQ ID NO: 6557674 - DNA, 14 bp, Homo sapiens
tttatatttgtctc

SEQ ID NO: 6557675 - DNA, 13 bp, Homo sapiens
tttatattttcaa

SEQ ID NO: 6557676 - DNA, 14 bp, Homo sapiens
tttatattttcaat

SEQ ID NO: 6557677 - DNA, 22 bp, Homo sapiens
tttatattttcaattcaaaaat

SEQ ID NO: 6557678 - DNA, 23 bp, Homo sapiens
tttatattttcaattcaaaaatg

SEQ ID NO: 6557679 - DNA, 14 bp, Homo sapiens
tttatattttccct

SEQ ID NO: 6557680 - DNA, 13 bp, Homo sapiens
tttatattttcta

SEQ ID NO: 6557681 - DNA, 21 bp, Homo sapiens
tttatcaaaccctagccttgc

SEQ ID NO: 6557682 - DNA, 21 bp, Homo sapiens
tttatcaaagggtgaaaatta

SEQ ID NO: 6557683 - DNA, 20 bp, Homo sapiens
tttatcaatgtgtctttcta

SEQ ID NO: 6557684 - DNA, 16 bp, Homo sapiens
tttatcacatgtatgt

SEQ ID NO: 6557685 - DNA, 14 bp, Homo sapiens
tttatcacctaaaa

SEQ ID NO: 6557686 - DNA, 19 bp, Homo sapiens
tttatcacctcattctgaa

SEQ ID NO: 6557687 - DNA, 19 bp, Homo sapiens
tttatcactttttgaacta

SEQ ID NO: 6557688 - DNA, 20 bp, Homo sapiens
tttatcactttttgaactaa

SEQ ID NO: 6557689 - DNA, 20 bp, Homo sapiens
tttatcagaagcaaggaagt

SEQ ID NO: 6557690 - DNA, 23 bp, Homo sapiens
tttatcagactcggaatctattt

SEQ ID NO: 6557691 - DNA, 23 bp, Homo sapiens
tttatcagagtaacgagaagaca

SEQ ID NO: 6557692 - DNA, 16 bp, Homo sapiens
tttatcagatacatca

SEQ ID NO: 6557693 - DNA, 22 bp, Homo sapiens
tttatcagatacatcactgctt

SEQ ID NO: 6557694 - DNA, 14 bp, Homo sapiens
tttatcagatattt

SEQ ID NO: 6557695 - DNA, 15 bp, Homo sapiens
tttatcagcaaaaaa

SEQ ID NO: 6557696 - DNA, 12 bp, Homo sapiens
tttatcagcagt

SEQ ID NO: 6557697 - DNA, 17 bp, Homo sapiens
tttatcagccttgcttt

SEQ ID NO: 6557698 - DNA, 19 bp, Homo sapiens
tttatcagggaaactaaga

SEQ ID NO: 6557699 - DNA, 13 bp, Homo sapiens
tttatcagtgaca

SEQ ID NO: 6557700 - DNA, 13 bp, Homo sapiens
tttatcagtgtta

SEQ ID NO: 6557701 - DNA, 19 bp, Homo sapiens
tttatcatgaatgctttta

SEQ ID NO: 6557702 - DNA, 14 bp, Homo sapiens
tttatcatgacatg

SEQ ID NO: 6557703 - DNA, 16 bp, Homo sapiens
tttatcatgcatgtcc

SEQ ID NO: 6557704 - DNA, 22 bp, Homo sapiens
tttatcatgcatgtcctgtaaa

SEQ ID NO: 6557705 - DNA, 17 bp, Homo sapiens
tttatcatgtgaaatca

SEQ ID NO: 6557706 - DNA, 22 bp, Homo sapiens
tttatcattaaacatgaattta

SEQ ID NO: 6557707 - DNA, 14 bp, Homo sapiens
tttatcattcaagt

SEQ ID NO: 6557708 - DNA, 15 bp, Homo sapiens
tttatcattcaagtg

SEQ ID NO: 6557709 - DNA, 20 bp, Homo sapiens
tttatcattgaaacatttat

SEQ ID NO: 6557710 - DNA, 22 bp, Homo sapiens
tttatccaaaatgtgtatttct

SEQ ID NO: 6557711 - DNA, 15 bp, Homo sapiens
tttatccaatcctca

SEQ ID NO: 6557712 - DNA, 18 bp, Homo sapiens
tttatccagaaaactgtg

SEQ ID NO: 6557713 - DNA, 19 bp, Homo sapiens
tttatccagaaaactgtga

SEQ ID NO: 6557714 - DNA, 22 bp, Homo sapiens
tttatccagaatgcttctcttt

SEQ ID NO: 6557715 - DNA, 16 bp, Homo sapiens
tttatccaggaattga

SEQ ID NO: 6557716 - DNA, 17 bp, Homo sapiens
tttatccaggaattgat

SEQ ID NO: 6557717 - DNA, 16 bp, Homo sapiens
tttatccataatgatg

SEQ ID NO: 6557718 - DNA, 22 bp, Homo sapiens
tttatccataatgatggattta

SEQ ID NO: 6557719 - DNA, 21 bp, Homo sapiens
tttatccattcaactgaaaat

SEQ ID NO: 6557720 - DNA, 17 bp, Homo sapiens
tttatccatttctttta

SEQ ID NO: 6557721 - DNA, 16 bp, Homo sapiens
tttatcccaaagttgt

SEQ ID NO: 6557722 - DNA, 19 bp, Homo sapiens
tttatccccgtttcttgca

SEQ ID NO: 6557723 - DNA, 20 bp, Homo sapiens
tttatccccgtttcttgcaa

SEQ ID NO: 6557724 - DNA, 16 bp, Homo sapiens
tttatccctcacctgt

SEQ ID NO: 6557725 - DNA, 16 bp, Homo sapiens
tttatcccttaagaat

SEQ ID NO: 6557726 - DNA, 18 bp, Homo sapiens
tttatcccttaagaatga

SEQ ID NO: 6557727 - DNA, 19 bp, Homo sapiens
tttatcccttcctgtctga

SEQ ID NO: 6557728 - DNA, 22 bp, Homo sapiens
tttatccctttacaatgtgaat

SEQ ID NO: 6557729 - DNA, 15 bp, Homo sapiens
tttatcctagtattc

SEQ ID NO: 6557730 - DNA, 16 bp, Homo sapiens
tttatcctgacatatt

SEQ ID NO: 6557731 - DNA, 17 bp, Homo sapiens
tttatcctgacatattc

SEQ ID NO: 6557732 - DNA, 21 bp, Homo sapiens
tttatcctggccttgtacttg

SEQ ID NO: 6557733 - DNA, 17 bp, Homo sapiens
tttatccttacaatgtg

SEQ ID NO: 6557734 - DNA, 14 bp, Homo sapiens
tttatccttgaact

SEQ ID NO: 6557735 - DNA, 21 bp, Homo sapiens
tttatccttgtctgaatgtat

SEQ ID NO: 6557736 - DNA, 21 bp, Homo sapiens
tttatcgtcactgcttaactt

SEQ ID NO: 6557737 - DNA, 14 bp, Homo sapiens
tttatctaaaagaa

SEQ ID NO: 6557738 - DNA, 20 bp, Homo sapiens
tttatctaaaagaatttaaa

SEQ ID NO: 6557739 - DNA, 17 bp, Homo sapiens
tttatctaaggtcccca

SEQ ID NO: 6557740 - DNA, 20 bp, Homo sapiens
tttatctaaggtccccagca

SEQ ID NO: 6557741 - DNA, 21 bp, Homo sapiens
tttatctaaggtccccagcag

SEQ ID NO: 6557742 - DNA, 20 bp, Homo sapiens
tttatctaatacctctgtgt

SEQ ID NO: 6557743 - DNA, 21 bp, Homo sapiens
tttatctaccaactttcaaga

SEQ ID NO: 6557744 - DNA, 16 bp, Homo sapiens
tttatctagatgtaaa

SEQ ID NO: 6557745 - DNA, 20 bp, Homo sapiens
tttatctagatgtaaatttt

SEQ ID NO: 6557746 - DNA, 20 bp, Homo sapiens
tttatctataatttacctaa

SEQ ID NO: 6557747 - DNA, 16 bp, Homo sapiens
tttatctattgtaaga

SEQ ID NO: 6557748 - DNA, 21 bp, Homo sapiens
tttatctattgtaagataaaa

SEQ ID NO: 6557749 - DNA, 22 bp, Homo sapiens
tttatctcaagtatataaagtt

SEQ ID NO: 6557750 - DNA, 18 bp, Homo sapiens
tttatctcagatgttaaa

SEQ ID NO: 6557751 - DNA, 19 bp, Homo sapiens
tttatctcagatgttaaaa

SEQ ID NO: 6557752 - DNA, 21 bp, Homo sapiens
tttatctcctgtctacagttt

SEQ ID NO: 6557753 - DNA, 13 bp, Homo sapiens
tttatctccttgt

SEQ ID NO: 6557754 - DNA, 18 bp, Homo sapiens
tttatctccttgtggcct

SEQ ID NO: 6557755 - DNA, 14 bp, Homo sapiens
tttatctggccatt

SEQ ID NO: 6557756 - DNA, 22 bp, Homo sapiens
tttatctgtaattgtaattcca

SEQ ID NO: 6557757 - DNA, 13 bp, Homo sapiens
tttatctgtcttg

SEQ ID NO: 6557758 - DNA, 22 bp, Homo sapiens
tttatctgtcttgactttttaa

SEQ ID NO: 6557759 - DNA, 11 bp, Homo sapiens
tttatctgtga

SEQ ID NO: 6557760 - DNA, 15 bp, Homo sapiens
tttatctgtggagtt

SEQ ID NO: 6557761 - DNA, 13 bp, Homo sapiens
tttatctgtttaa

SEQ ID NO: 6557762 - DNA, 15 bp, Homo sapiens
tttatcttaaactgt

SEQ ID NO: 6557763 - DNA, 19 bp, Homo sapiens
tttatcttctagccacagt

SEQ ID NO: 6557764 - DNA, 14 bp, Homo sapiens
tttatcttctgttt

SEQ ID NO: 6557765 - DNA, 21 bp, Homo sapiens
tttatcttctgtttttctcaa

SEQ ID NO: 6557766 - DNA, 22 bp, Homo sapiens
tttatcttctgtttttctcaaa

SEQ ID NO: 6557767 - DNA, 23 bp, Homo sapiens
tttatcttgcttcattctgaacc

SEQ ID NO: 6557768 - DNA, 19 bp, Homo sapiens
tttatcttgggaccaaaac

SEQ ID NO: 6557769 - DNA, 13 bp, Homo sapiens
tttatctttacca

SEQ ID NO: 6557770 - DNA, 18 bp, Homo sapiens
tttatctttaccaaaaac

SEQ ID NO: 6557771 - DNA, 20 bp, Homo sapiens
tttatctttaccaaaaacca

SEQ ID NO: 6557772 - DNA, 12 bp, Homo sapiens
tttatctttgat

SEQ ID NO: 6557773 - DNA, 23 bp, Homo sapiens
tttatcttttgtatatctaagac

SEQ ID NO: 6557774 - DNA, 16 bp, Homo sapiens
tttatctttttacctt

SEQ ID NO: 6557775 - DNA, 19 bp, Homo sapiens
tttatgaaacagaaaagta

SEQ ID NO: 6557776 - DNA, 14 bp, Homo sapiens
tttatgaaagtatt

SEQ ID NO: 6557777 - DNA, 12 bp, Homo sapiens
tttatgaaatga

SEQ ID NO: 6557778 - DNA, 21 bp, Homo sapiens
tttatgaaatggttaagaatt

SEQ ID NO: 6557779 - DNA, 13 bp, Homo sapiens
tttatgaacaatt

SEQ ID NO: 6557780 - DNA, 15 bp, Homo sapiens
tttatgaacagaaat

SEQ ID NO: 6557781 - DNA, 23 bp, Homo sapiens
tttatgaacagaaatattggttg

SEQ ID NO: 6557782 - DNA, 16 bp, Homo sapiens
tttatgaacattgtac

SEQ ID NO: 6557783 - DNA, 17 bp, Homo sapiens
tttatgaacattgtact

SEQ ID NO: 6557784 - DNA, 13 bp, Homo sapiens
tttatgaagaaaa

SEQ ID NO: 6557785 - DNA, 18 bp, Homo sapiens
tttatgaagaaaaaatac

SEQ ID NO: 6557786 - DNA, 21 bp, Homo sapiens
tttatgaagaaaaagtacaat

SEQ ID NO: 6557787 - DNA, 18 bp, Homo sapiens
tttatgaagaaagatact

SEQ ID NO: 6557788 - DNA, 22 bp, Homo sapiens
tttatgaagaaagatactaata

SEQ ID NO: 6557789 - DNA, 14 bp, Homo sapiens
tttatgaagcagat

SEQ ID NO: 6557790 - DNA, 13 bp, Homo sapiens
tttatgaaggttt

SEQ ID NO: 6557791 - DNA, 15 bp, Homo sapiens
tttatgaagttaaca

SEQ ID NO: 6557792 - DNA, 13 bp, Homo sapiens
tttatgaagtttt

SEQ ID NO: 6557793 - DNA, 20 bp, Homo sapiens
tttatgaatgaaaaaacagt

SEQ ID NO: 6557794 - DNA, 22 bp, Homo sapiens
tttatgaatgtgcatttcttga

SEQ ID NO: 6557795 - DNA, 13 bp, Homo sapiens
tttatgaattatt

SEQ ID NO: 6557796 - DNA, 12 bp, Homo sapiens
tttatgacaaat

SEQ ID NO: 6557797 - DNA, 13 bp, Homo sapiens
tttatgacaaata

SEQ ID NO: 6557798 - DNA, 14 bp, Homo sapiens
tttatgacagtaat

SEQ ID NO: 6557799 - DNA, 17 bp, Homo sapiens
tttatgaccagagcaaa

SEQ ID NO: 6557800 - DNA, 19 bp, Homo sapiens
tttatgacctaagtcaggt

SEQ ID NO: 6557801 - DNA, 21 bp, Homo sapiens
tttatgacctaagtcaggtaa

SEQ ID NO: 6557802 - DNA, 22 bp, Homo sapiens
tttatgacgagacctcagatgt

SEQ ID NO: 6557803 - DNA, 17 bp, Homo sapiens
tttatgactaatcctta

SEQ ID NO: 6557804 - DNA, 14 bp, Homo sapiens
tttatgagaaactt

SEQ ID NO: 6557805 - DNA, 17 bp, Homo sapiens
tttatgagaaagccttc

SEQ ID NO: 6557806 - DNA, 14 bp, Homo sapiens
tttatgagaaatgt

SEQ ID NO: 6557807 - DNA, 22 bp, Homo sapiens
tttatgagatcactgaactttt

SEQ ID NO: 6557808 - DNA, 12 bp, Homo sapiens
tttatgagccag

SEQ ID NO: 6557809 - DNA, 18 bp, Homo sapiens
tttatgagtaactattat

SEQ ID NO: 6557810 - DNA, 20 bp, Homo sapiens
tttatgagtaactattatta

SEQ ID NO: 6557811 - DNA, 18 bp, Homo sapiens
tttatgagttcttgtttt

SEQ ID NO: 6557812 - DNA, 17 bp, Homo sapiens
tttatgataatagattc

SEQ ID NO: 6557813 - DNA, 16 bp, Homo sapiens
tttatgatatccctga

SEQ ID NO: 6557814 - DNA, 22 bp, Homo sapiens
tttatgatatttttttaagtct

SEQ ID NO: 6557815 - DNA, 21 bp, Homo sapiens
tttatgatcagtgttgttgct

SEQ ID NO: 6557816 - DNA, 19 bp, Homo sapiens
tttatgatctatttgtaga

SEQ ID NO: 6557817 - DNA, 18 bp, Homo sapiens
tttatgatgacaatcaaa

SEQ ID NO: 6557818 - DNA, 14 bp, Homo sapiens
tttatgatgctatt

SEQ ID NO: 6557819 - DNA, 18 bp, Homo sapiens
tttatgatgttaacattt

SEQ ID NO: 6557820 - DNA, 14 bp, Homo sapiens
tttatgattttcat

SEQ ID NO: 6557821 - DNA, 22 bp, Homo sapiens
tttatgattttcataacttatt

SEQ ID NO: 6557822 - DNA, 15 bp, Homo sapiens
tttatgcaaaaacat

SEQ ID NO: 6557823 - DNA, 18 bp, Homo sapiens
tttatgcaaaaggtttat

SEQ ID NO: 6557824 - DNA, 14 bp, Homo sapiens
tttatgcaaataca

SEQ ID NO: 6557825 - DNA, 16 bp, Homo sapiens
tttatgcaaatatttt

SEQ ID NO: 6557826 - DNA, 19 bp, Homo sapiens
tttatgcaaccataagaca

SEQ ID NO: 6557827 - DNA, 11 bp, Homo sapiens
tttatgcaata

SEQ ID NO: 6557828 - DNA, 14 bp, Homo sapiens
tttatgcaataaat

SEQ ID NO: 6557829 - DNA, 17 bp, Homo sapiens
tttatgcagacagtctg

SEQ ID NO: 6557830 - DNA, 18 bp, Homo sapiens
tttatgcagacagtctgt

SEQ ID NO: 6557831 - DNA, 18 bp, Homo sapiens
tttatgcagcaaatatat

SEQ ID NO: 6557832 - DNA, 17 bp, Homo sapiens
tttatgcagtgctgctt

SEQ ID NO: 6557833 - DNA, 14 bp, Homo sapiens
tttatgcatattat

SEQ ID NO: 6557834 - DNA, 20 bp, Homo sapiens
tttatgcatgtatatgccat

SEQ ID NO: 6557835 - DNA, 11 bp, Homo sapiens
tttatgcattt

SEQ ID NO: 6557836 - DNA, 15 bp, Homo sapiens
tttatgcatttcatt

SEQ ID NO: 6557837 - DNA, 21 bp, Homo sapiens
tttatgcgcaaatacaaaatg

SEQ ID NO: 6557838 - DNA, 22 bp, Homo sapiens
tttatgcgcaaatacaaaatga

SEQ ID NO: 6557839 - DNA, 14 bp, Homo sapiens
tttatgctcttttt

SEQ ID NO: 6557840 - DNA, 20 bp, Homo sapiens
tttatgctcttttttactca

SEQ ID NO: 6557841 - DNA, 18 bp, Homo sapiens
tttatgcttaaaatatgt

SEQ ID NO: 6557842 - DNA, 19 bp, Homo sapiens
tttatgcttaaaatatgta

SEQ ID NO: 6557843 - DNA, 23 bp, Homo sapiens
tttatggaaaaattgacaaaaaa

SEQ ID NO: 6557844 - DNA, 14 bp, Homo sapiens
ttaatttttaaatg

SEQ ID NO: 6557845 - DNA, 15 bp, Homo sapiens
ttaatttttaaatgc

SEQ ID NO: 6557846 - DNA, 15 bp, Homo sapiens
ttaatttttaaatgt

SEQ ID NO: 6557847 - DNA, 14 bp, Homo sapiens
ttaatttttaattg

SEQ ID NO: 6557848 - DNA, 20 bp, Homo sapiens
ttaatttttacatgaccaga

SEQ ID NO: 6557849 - DNA, 18 bp, Homo sapiens
ttaatttttatttcttcc

SEQ ID NO: 6557850 - DNA, 13 bp, Homo sapiens
ttaatttttccta

SEQ ID NO: 6557851 - DNA, 18 bp, Homo sapiens
ttaatttttcctgcatgt

SEQ ID NO: 6557852 - DNA, 14 bp, Homo sapiens
ttaatttttccttt

SEQ ID NO: 6557853 - DNA, 17 bp, Homo sapiens
ttaatttttgaaaagct

SEQ ID NO: 6557854 - DNA, 15 bp, Homo sapiens
ttaatttttgctttt

SEQ ID NO: 6557855 - DNA, 22 bp, Homo sapiens
ttaatttttgcttttagaaaag

SEQ ID NO: 6557856 - DNA, 23 bp, Homo sapiens
ttaatttttgtactttgcttctt

SEQ ID NO: 6557857 - DNA, 17 bp, Homo sapiens
ttaattttttggtacaa

SEQ ID NO: 6557858 - DNA, 18 bp, Homo sapiens
ttaattttttggtacaaa

SEQ ID NO: 6557859 - DNA, 18 bp, Homo sapiens
ttaatttttttaaccaaa

SEQ ID NO: 6557860 - DNA, 19 bp, Homo sapiens
ttaatttttttgagacaga

SEQ ID NO: 6557861 - DNA, 14 bp, Homo sapiens
ttacaaaaacactt

SEQ ID NO: 6557862 - DNA, 18 bp, Homo sapiens
ttacaaaaatataaaata

SEQ ID NO: 6557863 - DNA, 18 bp, Homo sapiens
ttacaaaacaaactcatt

SEQ ID NO: 6557864 - DNA, 13 bp, Homo sapiens
ttacaaaacctat

SEQ ID NO: 6557865 - DNA, 15 bp, Homo sapiens
ttacaaaacctattt

SEQ ID NO: 6557866 - DNA, 18 bp, Homo sapiens
ttacaaaactacatgaga

SEQ ID NO: 6557867 - DNA, 20 bp, Homo sapiens
ttacaaaactacatgagaac

SEQ ID NO: 6557868 - DNA, 15 bp, Homo sapiens
ttacaaaactgcttt

SEQ ID NO: 6557869 - DNA, 23 bp, Homo sapiens
ttacaaaactgctttgtgcatat

SEQ ID NO: 6557870 - DNA, 19 bp, Homo sapiens
ttacaaaagaaaaaagcaa

SEQ ID NO: 6557871 - DNA, 20 bp, Homo sapiens
ttacaaaagaaataccttga

SEQ ID NO: 6557872 - DNA, 17 bp, Homo sapiens
ttacaaaatcttaacct

SEQ ID NO: 6557873 - DNA, 16 bp, Homo sapiens
ttacaaaatgaatgca

SEQ ID NO: 6557874 - DNA, 18 bp, Homo sapiens
ttacaaaatgaatgcatt

SEQ ID NO: 6557875 - DNA, 15 bp, Homo sapiens
ttacaaaatgtaact

SEQ ID NO: 6557876 - DNA, 16 bp, Homo sapiens
ttacaaaatgtaactg

SEQ ID NO: 6557877 - DNA, 17 bp, Homo sapiens
ttacaaaatgtaactgt

SEQ ID NO: 6557878 - DNA, 17 bp, Homo sapiens
ttacaaacaaaggattt

SEQ ID NO: 6557879 - DNA, 22 bp, Homo sapiens
ttacaaacaaaggatttgaaaa

SEQ ID NO: 6557880 - DNA, 19 bp, Homo sapiens
ttacaaacaataagaacaa

SEQ ID NO: 6557881 - DNA, 20 bp, Homo sapiens
ttacaaacatggaaaacaga

SEQ ID NO: 6557882 - DNA, 17 bp, Homo sapiens
ttacaaacctctcagca

SEQ ID NO: 6557883 - DNA, 12 bp, Homo sapiens
ttacaaactgca

SEQ ID NO: 6557884 - DNA, 15 bp, Homo sapiens
ttacaaactgcaata

SEQ ID NO: 6557885 - DNA, 17 bp, Homo sapiens
ttacaaagaaacaaaat

SEQ ID NO: 6557886 - DNA, 23 bp, Homo sapiens
ttacaaagggaaagcctctggcc

SEQ ID NO: 6557887 - DNA, 14 bp, Homo sapiens
ttacaaagtgtgta

SEQ ID NO: 6557888 - DNA, 17 bp, Homo sapiens
ttacaaagtgtgtatta

SEQ ID NO: 6557889 - DNA, 15 bp, Homo sapiens
ttacaaataaagttt

SEQ ID NO: 6557890 - DNA, 14 bp, Homo sapiens
ttacaaataatttt

SEQ ID NO: 6557891 - DNA, 15 bp, Homo sapiens
ttacaaataattttt

SEQ ID NO: 6557892 - DNA, 16 bp, Homo sapiens
ttacaaatattgtcat

SEQ ID NO: 6557893 - DNA, 19 bp, Homo sapiens
ttacaaatattgtcatctt

SEQ ID NO: 6557894 - DNA, 16 bp, Homo sapiens
ttacaaatcagaactt

SEQ ID NO: 6557895 - DNA, 16 bp, Homo sapiens
ttacaaatcagaagtc

SEQ ID NO: 6557896 - DNA, 22 bp, Homo sapiens
ttacaaatcagaagtcatcttg

SEQ ID NO: 6557897 - DNA, 14 bp, Homo sapiens
ttacaaatgaggaa

SEQ ID NO: 6557898 - DNA, 17 bp, Homo sapiens
ttacaaatgattgcttt

SEQ ID NO: 6557899 - DNA, 20 bp, Homo sapiens
ttacaaatgatttcgtgact

SEQ ID NO: 6557900 - DNA, 16 bp, Homo sapiens
ttacaaattgttttta

SEQ ID NO: 6557901 - DNA, 15 bp, Homo sapiens
ttacaaatttttact

SEQ ID NO: 6557902 - DNA, 20 bp, Homo sapiens
ttacaaatttttactcaggc

SEQ ID NO: 6557903 - DNA, 16 bp, Homo sapiens
ttacaacaaacactgt

SEQ ID NO: 6557904 - DNA, 13 bp, Homo sapiens
ttacaacagattt

SEQ ID NO: 6557905 - DNA, 15 bp, Homo sapiens
ttacaacagatttgt

SEQ ID NO: 6557906 - DNA, 16 bp, Homo sapiens
ttacaacagatttgtg

SEQ ID NO: 6557907 - DNA, 21 bp, Homo sapiens
ttacaacagatttgtgaactc

SEQ ID NO: 6557908 - DNA, 14 bp, Homo sapiens
ttacaacagtaaca

SEQ ID NO: 6557909 - DNA, 18 bp, Homo sapiens
ttacaacatttatgtgag

SEQ ID NO: 6557910 - DNA, 16 bp, Homo sapiens
ttacaacatttttgca

SEQ ID NO: 6557911 - DNA, 16 bp, Homo sapiens
ttacaaccaagaacat

SEQ ID NO: 6557912 - DNA, 19 bp, Homo sapiens
ttacaacccggttcactct

SEQ ID NO: 6557913 - DNA, 19 bp, Homo sapiens
ttacaacctggaaaataaa

SEQ ID NO: 6557914 - DNA, 21 bp, Homo sapiens
ttacaacctggccagaggcat

SEQ ID NO: 6557915 - DNA, 12 bp, Homo sapiens
ttacaactaaat

SEQ ID NO: 6557916 - DNA, 16 bp, Homo sapiens
ttacaactatgtaatt

SEQ ID NO: 6557917 - DNA, 18 bp, Homo sapiens
ttacaactatgtaattta

SEQ ID NO: 6557918 - DNA, 13 bp, Homo sapiens
ttacaactgaaac

SEQ ID NO: 6557919 - DNA, 22 bp, Homo sapiens
ttacaactgcctcgaaacacag

SEQ ID NO: 6557920 - DNA, 19 bp, Homo sapiens
ttacaacttgattttttca

SEQ ID NO: 6557921 - DNA, 13 bp, Homo sapiens
ttacaacttgtat

SEQ ID NO: 6557922 - DNA, 18 bp, Homo sapiens
ttacaagaaataaatcta

SEQ ID NO: 6557923 - DNA, 13 bp, Homo sapiens
ttacaagaagaac

SEQ ID NO: 6557924 - DNA, 18 bp, Homo sapiens
ttacaagaagtttattct

SEQ ID NO: 6557925 - DNA, 21 bp, Homo sapiens
ttacaagaattgtccatgtgc

SEQ ID NO: 6557926 - DNA, 20 bp, Homo sapiens
ttacaagactgtaaattcca

SEQ ID NO: 6557927 - DNA, 17 bp, Homo sapiens
ttacaagcccccccttc

SEQ ID NO: 6557928 - DNA, 18 bp, Homo sapiens
ttacaagcttaaagcttg

SEQ ID NO: 6557929 - DNA, 16 bp, Homo sapiens
ttacaaggcaatggaa

SEQ ID NO: 6557930 - DNA, 19 bp, Homo sapiens
ttacaaggcacttgtcact

SEQ ID NO: 6557931 - DNA, 22 bp, Homo sapiens
ttacaaggcaggcctttcctac

SEQ ID NO: 6557932 - DNA, 18 bp, Homo sapiens
ttacaagggaagatttat

SEQ ID NO: 6557933 - DNA, 19 bp, Homo sapiens
ttacaagtaacaaaaataa

SEQ ID NO: 6557934 - DNA, 14 bp, Homo sapiens
ttacaagtgttctt

SEQ ID NO: 6557935 - DNA, 15 bp, Homo sapiens
ttacaagtgttctta

SEQ ID NO: 6557936 - DNA, 17 bp, Homo sapiens
ttacaagtgttcttagg

SEQ ID NO: 6557937 - DNA, 21 bp, Homo sapiens
ttacaagtgttcttaggttta

SEQ ID NO: 6557938 - DNA, 15 bp, Homo sapiens
ttacaagttatagta

SEQ ID NO: 6557939 - DNA, 16 bp, Homo sapiens
ttacaagtttcagtaa

SEQ ID NO: 6557940 - DNA, 22 bp, Homo sapiens
ttacaagtttgctaaaagaaga

SEQ ID NO: 6557941 - DNA, 18 bp, Homo sapiens
ttacaataaaactaaatg

SEQ ID NO: 6557942 - DNA, 17 bp, Homo sapiens
ttacaataaagtttaca

SEQ ID NO: 6557943 - DNA, 20 bp, Homo sapiens
ttacaataattaatgtgtgt

SEQ ID NO: 6557944 - DNA, 14 bp, Homo sapiens
ttacaatacaatag

SEQ ID NO: 6557945 - DNA, 14 bp, Homo sapiens
ttacaatagaattt

SEQ ID NO: 6557946 - DNA, 17 bp, Homo sapiens
ttacaatagttctgtgg

SEQ ID NO: 6557947 - DNA, 15 bp, Homo sapiens
ttacaatattatgaa

SEQ ID NO: 6557948 - DNA, 22 bp, Homo sapiens
ttacaatattatgaaatttcac

SEQ ID NO: 6557949 - DNA, 17 bp, Homo sapiens
ttacaatcagtgtgaat

SEQ ID NO: 6557950 - DNA, 18 bp, Homo sapiens
ttacaatcagtgtgaatg

SEQ ID NO: 6557951 - DNA, 21 bp, Homo sapiens
ttacaatgatgccgaacatta

SEQ ID NO: 6557952 - DNA, 16 bp, Homo sapiens
ttacaatgatttgtaa

SEQ ID NO: 6557953 - DNA, 17 bp, Homo sapiens
ttacaatgatttgtaaa

SEQ ID NO: 6557954 - DNA, 18 bp, Homo sapiens
ttacaatgatttgtaaag

SEQ ID NO: 6557955 - DNA, 11 bp, Homo sapiens
ttacaatggcc

SEQ ID NO: 6557956 - DNA, 15 bp, Homo sapiens
ttacaatggccagcc

SEQ ID NO: 6557957 - DNA, 14 bp, Homo sapiens
ttacaatgtaatta

SEQ ID NO: 6557958 - DNA, 16 bp, Homo sapiens
ttacaatgtatcttta

SEQ ID NO: 6557959 - DNA, 19 bp, Homo sapiens
ttacaatgtatctttatta

SEQ ID NO: 6557960 - DNA, 14 bp, Homo sapiens
ttacaatgtattaa

SEQ ID NO: 6557961 - DNA, 12 bp, Homo sapiens
ttacaatgtgaa

SEQ ID NO: 6557962 - DNA, 13 bp, Homo sapiens
ttacaatgtgaat

SEQ ID NO: 6557963 - DNA, 14 bp, Homo sapiens
ttacaatgtgaata

SEQ ID NO: 6557964 - DNA, 16 bp, Homo sapiens
ttacaatgtgcactga

SEQ ID NO: 6557965 - DNA, 14 bp, Homo sapiens
ttacaatgttttat

SEQ ID NO: 6557966 - DNA, 17 bp, Homo sapiens
ttacaattaaactcaaa

SEQ ID NO: 6557967 - DNA, 18 bp, Homo sapiens
ttacaattccctgctgtc

SEQ ID NO: 6557968 - DNA, 19 bp, Homo sapiens
ttacaattccctgctgtcg

SEQ ID NO: 6557969 - DNA, 13 bp, Homo sapiens
ttacaattgaaat

SEQ ID NO: 6557970 - DNA, 17 bp, Homo sapiens
ttacaattgaaatgact

SEQ ID NO: 6557971 - DNA, 18 bp, Homo sapiens
ttacaatttacaaagtgt

SEQ ID NO: 6557972 - DNA, 15 bp, Homo sapiens
ttacaatttctttaa

SEQ ID NO: 6557973 - DNA, 15 bp, Homo sapiens
ttacaatttgcacaa

SEQ ID NO: 6557974 - DNA, 14 bp, Homo sapiens
ttacaatttgtatt

SEQ ID NO: 6557975 - DNA, 13 bp, Homo sapiens
ttacaattttatc

SEQ ID NO: 6557976 - DNA, 18 bp, Homo sapiens
ttacaattttatctgttt

SEQ ID NO: 6557977 - DNA, 17 bp, Homo sapiens
ttacaattttttatcat

SEQ ID NO: 6557978 - DNA, 22 bp, Homo sapiens
ttacaatttttttaattttgta

SEQ ID NO: 6557979 - DNA, 16 bp, Homo sapiens
ttacacaaaacaaatg

SEQ ID NO: 6557980 - DNA, 20 bp, Homo sapiens
ttacacaaaggggatcataa

SEQ ID NO: 6557981 - DNA, 15 bp, Homo sapiens
ttacacaattaattc

SEQ ID NO: 6557982 - DNA, 17 bp, Homo sapiens
ttacacaattaattgtc

SEQ ID NO: 6557983 - DNA, 11 bp, Homo sapiens
ttacacactca

SEQ ID NO: 6557984 - DNA, 16 bp, Homo sapiens
ttacacagaaacactg

SEQ ID NO: 6557985 - DNA, 18 bp, Homo sapiens
ttacacagaaatgctgct

SEQ ID NO: 6557986 - DNA, 23 bp, Homo sapiens
ttacacagaaatgctgctggcca

SEQ ID NO: 6557987 - DNA, 21 bp, Homo sapiens
ttacacagagaaatacaaaat

SEQ ID NO: 6557988 - DNA, 23 bp, Homo sapiens
ttacacagagaaatacaaaataa

SEQ ID NO: 6557989 - DNA, 18 bp, Homo sapiens
ttacacagcaattttgta

SEQ ID NO: 6557990 - DNA, 17 bp, Homo sapiens
ttacacagcccaagagg

SEQ ID NO: 6557991 - DNA, 23 bp, Homo sapiens
ttacacaggtttagttgactaat

SEQ ID NO: 6557992 - DNA, 20 bp, Homo sapiens
ttacacagtcaaatttacat

SEQ ID NO: 6557993 - DNA, 18 bp, Homo sapiens
ttacacatctcagaccct

SEQ ID NO: 6557994 - DNA, 19 bp, Homo sapiens
ttacacatcttaaaagtgt

SEQ ID NO: 6557995 - DNA, 13 bp, Homo sapiens
ttacacattaaac

SEQ ID NO: 6557996 - DNA, 22 bp, Homo sapiens
ttacacattaaagtaaagtaca

SEQ ID NO: 6557997 - DNA, 14 bp, Homo sapiens
ttacacattatgtt

SEQ ID NO: 6557998 - DNA, 14 bp, Homo sapiens
ttacacatttcact

SEQ ID NO: 6557999 - DNA, 17 bp, Homo sapiens
ttacacatttgtacaga

SEQ ID NO: 6558000 - DNA, 15 bp, Homo sapiens
ttacacatttttcag

SEQ ID NO: 6558001 - DNA, 23 bp, Homo sapiens
ttacacatttttcagatataaaa

SEQ ID NO: 6558002 - DNA, 17 bp, Homo sapiens
ttacaccaactcctaat

SEQ ID NO: 6558003 - DNA, 21 bp, Homo sapiens
ttacaccaccggccccctccc

SEQ ID NO: 6558004 - DNA, 13 bp, Homo sapiens
ttacacccaaata

SEQ ID NO: 6558005 - DNA, 17 bp, Homo sapiens
ttacacccaaatattgt

SEQ ID NO: 6558006 - DNA, 18 bp, Homo sapiens
ttacaccgactagccagg

SEQ ID NO: 6558007 - DNA, 16 bp, Homo sapiens
ttacacctcagaaatt

SEQ ID NO: 6558008 - DNA, 21 bp, Homo sapiens
ttacacctccactcagcactc

SEQ ID NO: 6558009 - DNA, 16 bp, Homo sapiens
ttacacgaagaaatag

SEQ ID NO: 6558010 - DNA, 17 bp, Homo sapiens
ttacacgcttttgtgat

SEQ ID NO: 6558011 - DNA, 17 bp, Homo sapiens
ttacacgtatctcttgg

SEQ ID NO: 6558012 - DNA, 16 bp, Homo sapiens
ttacacgtgcgtgtga

SEQ ID NO: 6558013 - DNA, 23 bp, Homo sapiens
ttacactaaattattagcatttg

SEQ ID NO: 6558014 - DNA, 18 bp, Homo sapiens
ttacactaatatatggac

SEQ ID NO: 6558015 - DNA, 21 bp, Homo sapiens
ttacactaatatatggaccta

SEQ ID NO: 6558016 - DNA, 22 bp, Homo sapiens
ttacactatgataaagttgtaa

SEQ ID NO: 6558017 - DNA, 15 bp, Homo sapiens
ttacactccagcctg

SEQ ID NO: 6558018 - DNA, 16 bp, Homo sapiens
ttacactctctgtaca

SEQ ID NO: 6558019 - DNA, 19 bp, Homo sapiens
ttacactctctgtacaaaa

SEQ ID NO: 6558020 - DNA, 14 bp, Homo sapiens
ttacactctttgta

SEQ ID NO: 6558021 - DNA, 15 bp, Homo sapiens
ttacactctttgtaa

SEQ ID NO: 6558022 - DNA, 13 bp, Homo sapiens
ttacactgaaatc

SEQ ID NO: 6558023 - DNA, 18 bp, Homo sapiens
ttacactgaaatccaaaa

SEQ ID NO: 6558024 - DNA, 18 bp, Homo sapiens
tttatggaacttccctcc

SEQ ID NO: 6558025 - DNA, 23 bp, Homo sapiens
tttatggaggatggagagagggg

SEQ ID NO: 6558026 - DNA, 18 bp, Homo sapiens
tttatggattaaaaactg

SEQ ID NO: 6558027 - DNA, 23 bp, Homo sapiens
tttatggccaatctattctcaaa

SEQ ID NO: 6558028 - DNA, 22 bp, Homo sapiens
tttatggccacatttaatatct

SEQ ID NO: 6558029 - DNA, 13 bp, Homo sapiens
tttatggcctcag

SEQ ID NO: 6558030 - DNA, 17 bp, Homo sapiens
tttatggccttaatata

SEQ ID NO: 6558031 - DNA, 16 bp, Homo sapiens
tttatggcttttgtgc

SEQ ID NO: 6558032 - DNA, 24 bp, Homo sapiens
tttatggcttttgtgcattatcta

SEQ ID NO: 6558033 - DNA, 13 bp, Homo sapiens
tttatgggagaat

SEQ ID NO: 6558034 - DNA, 19 bp, Homo sapiens
tttatggtgcctagtattg

SEQ ID NO: 6558035 - DNA, 17 bp, Homo sapiens
tttatggttaatactat

SEQ ID NO: 6558036 - DNA, 21 bp, Homo sapiens
tttatggttacttcttctctt

SEQ ID NO: 6558037 - DNA, 16 bp, Homo sapiens
tttatggttatgtttt

SEQ ID NO: 6558038 - DNA, 16 bp, Homo sapiens
tttatggtttctccag

SEQ ID NO: 6558039 - DNA, 15 bp, Homo sapiens
tttatggttttcatt

SEQ ID NO: 6558040 - DNA, 22 bp, Homo sapiens
tttatgtaaactgcattagaaa

SEQ ID NO: 6558041 - DNA, 13 bp, Homo sapiens
tttatgtaaatca

SEQ ID NO: 6558042 - DNA, 15 bp, Homo sapiens
tttatgtaaatcact

SEQ ID NO: 6558043 - DNA, 12 bp, Homo sapiens
tttatgtaaatt

SEQ ID NO: 6558044 - DNA, 19 bp, Homo sapiens
tttatgtaatgaagtaaag

SEQ ID NO: 6558045 - DNA, 14 bp, Homo sapiens
tttatgtaatttct

SEQ ID NO: 6558046 - DNA, 13 bp, Homo sapiens
tttatgtaatttg

SEQ ID NO: 6558047 - DNA, 14 bp, Homo sapiens
tttatgtaatttgt

SEQ ID NO: 6558048 - DNA, 12 bp, Homo sapiens
tttatgtacaaa

SEQ ID NO: 6558049 - DNA, 15 bp, Homo sapiens
tttatgtacacaaat

SEQ ID NO: 6558050 - DNA, 16 bp, Homo sapiens
tttatgtactgtaaac

SEQ ID NO: 6558051 - DNA, 18 bp, Homo sapiens
tttatgtactgtaaacag

SEQ ID NO: 6558052 - DNA, 12 bp, Homo sapiens
tttatgtatctc

SEQ ID NO: 6558053 - DNA, 14 bp, Homo sapiens
tttatgtatcttga

SEQ ID NO: 6558054 - DNA, 11 bp, Homo sapiens
tttatgtatta

SEQ ID NO: 6558055 - DNA, 14 bp, Homo sapiens
tttatgtattttga

SEQ ID NO: 6558056 - DNA, 16 bp, Homo sapiens
tttatgtattttgaaa

SEQ ID NO: 6558057 - DNA, 17 bp, Homo sapiens
tttatgtcattttcaga

SEQ ID NO: 6558058 - DNA, 19 bp, Homo sapiens
tttatgtctaaagagcttt

SEQ ID NO: 6558059 - DNA, 15 bp, Homo sapiens
tttatgtgaaacatg

SEQ ID NO: 6558060 - DNA, 21 bp, Homo sapiens
tttatgtgaaatgctttctgt

SEQ ID NO: 6558061 - DNA, 14 bp, Homo sapiens
tttatgtgaacatt

SEQ ID NO: 6558062 - DNA, 17 bp, Homo sapiens
tttatgtgaacattcct

SEQ ID NO: 6558063 - DNA, 16 bp, Homo sapiens
tttatgtgaaggtgtt

SEQ ID NO: 6558064 - DNA, 16 bp, Homo sapiens
tttatgtgaattttta

SEQ ID NO: 6558065 - DNA, 20 bp, Homo sapiens
tttatgtgaatttttaagct

SEQ ID NO: 6558066 - DNA, 15 bp, Homo sapiens
tttatgtgactgctt

SEQ ID NO: 6558067 - DNA, 17 bp, Homo sapiens
tttatgtgatatgtttt

SEQ ID NO: 6558068 - DNA, 16 bp, Homo sapiens
tttatgtgatcaattt

SEQ ID NO: 6558069 - DNA, 22 bp, Homo sapiens
tttatgtgatgccaaagatgtt

SEQ ID NO: 6558070 - DNA, 12 bp, Homo sapiens
tttatgtgatgg

SEQ ID NO: 6558071 - DNA, 15 bp, Homo sapiens
tttatgtgatgtaac

SEQ ID NO: 6558072 - DNA, 22 bp, Homo sapiens
tttatgtgcagcgacccttggt

SEQ ID NO: 6558073 - DNA, 13 bp, Homo sapiens
tttatgtgctata

SEQ ID NO: 6558074 - DNA, 20 bp, Homo sapiens
tttatgtggtcttatgattt

SEQ ID NO: 6558075 - DNA, 20 bp, Homo sapiens
tttatgtgtagaatttgaaa

SEQ ID NO: 6558076 - DNA, 22 bp, Homo sapiens
tttatgtgtgaggagctgctgg

SEQ ID NO: 6558077 - DNA, 16 bp, Homo sapiens
tttatgtgtgattcaa

SEQ ID NO: 6558078 - DNA, 11 bp, Homo sapiens
tttatgtgtgt

SEQ ID NO: 6558079 - DNA, 18 bp, Homo sapiens
tttatgtgttatgaacat

SEQ ID NO: 6558080 - DNA, 17 bp, Homo sapiens
tttatgttaaaagattt

SEQ ID NO: 6558081 - DNA, 22 bp, Homo sapiens
tttatgttacttaaacatcatt

SEQ ID NO: 6558082 - DNA, 17 bp, Homo sapiens
tttatgttatatataaa

SEQ ID NO: 6558083 - DNA, 20 bp, Homo sapiens
tttatgttatatataaatat

SEQ ID NO: 6558084 - DNA, 21 bp, Homo sapiens
tttatgttatatataaatata

SEQ ID NO: 6558085 - DNA, 13 bp, Homo sapiens
tttatgttattta

SEQ ID NO: 6558086 - DNA, 14 bp, Homo sapiens
tttatgttatttat

SEQ ID NO: 6558087 - DNA, 12 bp, Homo sapiens
tttatgttcagc

SEQ ID NO: 6558088 - DNA, 17 bp, Homo sapiens
tttatgttcagcttata

SEQ ID NO: 6558089 - DNA, 12 bp, Homo sapiens
tttatgttcctt

SEQ ID NO: 6558090 - DNA, 12 bp, Homo sapiens
tttatgttctag

SEQ ID NO: 6558091 - DNA, 15 bp, Homo sapiens
tttatgttgacattt

SEQ ID NO: 6558092 - DNA, 17 bp, Homo sapiens
tttatgttgacatttgt

SEQ ID NO: 6558093 - DNA, 15 bp, Homo sapiens
tttatgtttaaaatg

SEQ ID NO: 6558094 - DNA, 18 bp, Homo sapiens
tttatgtttaaaatggca

SEQ ID NO: 6558095 - DNA, 19 bp, Homo sapiens
tttatgtttaaaatggcat

SEQ ID NO: 6558096 - DNA, 13 bp, Homo sapiens
tttatgtttgaat

SEQ ID NO: 6558097 - DNA, 16 bp, Homo sapiens
tttatgtttgtacaca

SEQ ID NO: 6558098 - DNA, 14 bp, Homo sapiens
tttatgtttgtctt

SEQ ID NO: 6558099 - DNA, 22 bp, Homo sapiens
tttatgtttgtcttttaatgct

SEQ ID NO: 6558100 - DNA, 14 bp, Homo sapiens
tttatgtttttggt

SEQ ID NO: 6558101 - DNA, 16 bp, Homo sapiens
tttattaaaaacatga

SEQ ID NO: 6558102 - DNA, 16 bp, Homo sapiens
tttattaaaaataaaa

SEQ ID NO: 6558103 - DNA, 21 bp, Homo sapiens
tttattaaaaatgttctcaaa

SEQ ID NO: 6558104 - DNA, 17 bp, Homo sapiens
tttattaaaaccattct

SEQ ID NO: 6558105 - DNA, 14 bp, Homo sapiens
tttattaaaatctt

SEQ ID NO: 6558106 - DNA, 22 bp, Homo sapiens
tttattaaaatgattgtaaaat

SEQ ID NO: 6558107 - DNA, 23 bp, Homo sapiens
tttattaaaatgattgtaaaata

SEQ ID NO: 6558108 - DNA, 16 bp, Homo sapiens
tttattaaacagatat

SEQ ID NO: 6558109 - DNA, 17 bp, Homo sapiens
tttattaaacattttca

SEQ ID NO: 6558110 - DNA, 18 bp, Homo sapiens
tttattaaacttcagcaa

SEQ ID NO: 6558111 - DNA, 12 bp, Homo sapiens
tttattaaagaa

SEQ ID NO: 6558112 - DNA, 14 bp, Homo sapiens
tttattaaagaaaa

SEQ ID NO: 6558113 - DNA, 18 bp, Homo sapiens
tttattaaagcatttcct

SEQ ID NO: 6558114 - DNA, 21 bp, Homo sapiens
tttattaaatacaaaacttcc

SEQ ID NO: 6558115 - DNA, 13 bp, Homo sapiens
tttattaaatgta

SEQ ID NO: 6558116 - DNA, 21 bp, Homo sapiens
tttattaaatttattaaatgt

SEQ ID NO: 6558117 - DNA, 13 bp, Homo sapiens
tttattaaatttt

SEQ ID NO: 6558118 - DNA, 23 bp, Homo sapiens
tttattaaatttttttgtatgaa

SEQ ID NO: 6558119 - DNA, 14 bp, Homo sapiens
tttattaacctcag

SEQ ID NO: 6558120 - DNA, 20 bp, Homo sapiens
tttattaacttaataatcaa

SEQ ID NO: 6558121 - DNA, 20 bp, Homo sapiens
tttattaagaatcattgtgc

SEQ ID NO: 6558122 - DNA, 20 bp, Homo sapiens
tttattaagcacgtatttat

SEQ ID NO: 6558123 - DNA, 20 bp, Homo sapiens
tttattaagtatatttgtaa

SEQ ID NO: 6558124 - DNA, 16 bp, Homo sapiens
tttattaataaacatt

SEQ ID NO: 6558125 - DNA, 21 bp, Homo sapiens
tttattaataaacattctatc

SEQ ID NO: 6558126 - DNA, 12 bp, Homo sapiens
tttattaatata

SEQ ID NO: 6558127 - DNA, 20 bp, Homo sapiens
tttattaatatggtgacttt

SEQ ID NO: 6558128 - DNA, 21 bp, Homo sapiens
tttattaatcactgtgtatat

SEQ ID NO: 6558129 - DNA, 17 bp, Homo sapiens
tttattaatctactgta

SEQ ID NO: 6558130 - DNA, 18 bp, Homo sapiens
tttattaatctactgtat

SEQ ID NO: 6558131 - DNA, 13 bp, Homo sapiens
tttattaatctta

SEQ ID NO: 6558132 - DNA, 18 bp, Homo sapiens
tttattaatgttttcaaa

SEQ ID NO: 6558133 - DNA, 15 bp, Homo sapiens
tttattaatttgaaa

SEQ ID NO: 6558134 - DNA, 14 bp, Homo sapiens
tttattacaagtgg

SEQ ID NO: 6558135 - DNA, 18 bp, Homo sapiens
tttattacagtataatta

SEQ ID NO: 6558136 - DNA, 23 bp, Homo sapiens
tttattacagtataattaacatg

SEQ ID NO: 6558137 - DNA, 21 bp, Homo sapiens
tttattacatagctctgaagt

SEQ ID NO: 6558138 - DNA, 12 bp, Homo sapiens
tttattacatta

SEQ ID NO: 6558139 - DNA, 12 bp, Homo sapiens
tttattaccagt

SEQ ID NO: 6558140 - DNA, 17 bp, Homo sapiens
tttattaccccctcctt

SEQ ID NO: 6558141 - DNA, 18 bp, Homo sapiens
tttattaccgataaatga

SEQ ID NO: 6558142 - DNA, 13 bp, Homo sapiens
tttattacctctg

SEQ ID NO: 6558143 - DNA, 14 bp, Homo sapiens
tttattacgtatgt

SEQ ID NO: 6558144 - DNA, 14 bp, Homo sapiens
tttattactagtgt

SEQ ID NO: 6558145 - DNA, 23 bp, Homo sapiens
tttattactagttagcatacaca

SEQ ID NO: 6558146 - DNA, 13 bp, Homo sapiens
tttattactgatt

SEQ ID NO: 6558147 - DNA, 16 bp, Homo sapiens
tttattactgtaagaa

SEQ ID NO: 6558148 - DNA, 15 bp, Homo sapiens
tttattactgtttat

SEQ ID NO: 6558149 - DNA, 15 bp, Homo sapiens
tttattacttgtgca

SEQ ID NO: 6558150 - DNA, 15 bp, Homo sapiens
tttattaggttaagt

SEQ ID NO: 6558151 - DNA, 14 bp, Homo sapiens
tttattagtattct

SEQ ID NO: 6558152 - DNA, 21 bp, Homo sapiens
tttattagtggtgtatatggt

SEQ ID NO: 6558153 - DNA, 16 bp, Homo sapiens
tttattagtttaaaaa

SEQ ID NO: 6558154 - DNA, 19 bp, Homo sapiens
tttattataaactgtatgc

SEQ ID NO: 6558155 - DNA, 16 bp, Homo sapiens
tttattataaagctta

SEQ ID NO: 6558156 - DNA, 22 bp, Homo sapiens
tttattataaagcttaaatttt

SEQ ID NO: 6558157 - DNA, 22 bp, Homo sapiens
tttattataaattctactaagt

SEQ ID NO: 6558158 - DNA, 21 bp, Homo sapiens
tttattatgaaacttgtgtaa

SEQ ID NO: 6558159 - DNA, 15 bp, Homo sapiens
tttattatgaagaag

SEQ ID NO: 6558160 - DNA, 20 bp, Homo sapiens
tttattatgcataactgaca

SEQ ID NO: 6558161 - DNA, 13 bp, Homo sapiens
tttattatgcatg

SEQ ID NO: 6558162 - DNA, 17 bp, Homo sapiens
tttattatgcattatat

SEQ ID NO: 6558163 - DNA, 20 bp, Homo sapiens
tttattatgcattcttataa

SEQ ID NO: 6558164 - DNA, 14 bp, Homo sapiens
tttattatggcttg

SEQ ID NO: 6558165 - DNA, 18 bp, Homo sapiens
tttattatggttagctgt

SEQ ID NO: 6558166 - DNA, 14 bp, Homo sapiens
tttattatgtaaat

SEQ ID NO: 6558167 - DNA, 17 bp, Homo sapiens
tttattattattactgt

SEQ ID NO: 6558168 - DNA, 12 bp, Homo sapiens
tttattattcag

SEQ ID NO: 6558169 - DNA, 16 bp, Homo sapiens
tttattatttatttat

SEQ ID NO: 6558170 - DNA, 13 bp, Homo sapiens
tttattatttgaa

SEQ ID NO: 6558171 - DNA, 20 bp, Homo sapiens
tttattattttaatatttat

SEQ ID NO: 6558172 - DNA, 13 bp, Homo sapiens
tttattattttca

SEQ ID NO: 6558173 - DNA, 19 bp, Homo sapiens
tttattatttttctctctc

SEQ ID NO: 6558174 - DNA, 19 bp, Homo sapiens
tttattcaaactacctata

SEQ ID NO: 6558175 - DNA, 17 bp, Homo sapiens
tttattcaattcctctg

SEQ ID NO: 6558176 - DNA, 15 bp, Homo sapiens
tttattcactgtaag

SEQ ID NO: 6558177 - DNA, 16 bp, Homo sapiens
tttattcactgtaagt

SEQ ID NO: 6558178 - DNA, 20 bp, Homo sapiens
tttattcacttgtgtttgta

SEQ ID NO: 6558179 - DNA, 23 bp, Homo sapiens
tttattcagctagaatttctggt

SEQ ID NO: 6558180 - DNA, 21 bp, Homo sapiens
tttattcagcttcatttgtgt

SEQ ID NO: 6558181 - DNA, 13 bp, Homo sapiens
tttattcagtaaa

SEQ ID NO: 6558182 - DNA, 12 bp, Homo sapiens
tttattcataat

SEQ ID NO: 6558183 - DNA, 18 bp, Homo sapiens
tttattcataatgaatta

SEQ ID NO: 6558184 - DNA, 22 bp, Homo sapiens
tttattcatccagcagtgttgc

SEQ ID NO: 6558185 - DNA, 17 bp, Homo sapiens
tttattcattcagtgag

SEQ ID NO: 6558186 - DNA, 18 bp, Homo sapiens
tttattccagaatgctgt

SEQ ID NO: 6558187 - DNA, 19 bp, Homo sapiens
tttattccagaatgctgta

SEQ ID NO: 6558188 - DNA, 22 bp, Homo sapiens
tttattccagaatgctgtacat

SEQ ID NO: 6558189 - DNA, 19 bp, Homo sapiens
tttattccatattcatgta

SEQ ID NO: 6558190 - DNA, 14 bp, Homo sapiens
tttattcccaagta

SEQ ID NO: 6558191 - DNA, 19 bp, Homo sapiens
tttattcccaagtatgcct

SEQ ID NO: 6558192 - DNA, 20 bp, Homo sapiens
tttattccccagtgactcca

SEQ ID NO: 6558193 - DNA, 22 bp, Homo sapiens
tttattccccagtgactccagg

SEQ ID NO: 6558194 - DNA, 14 bp, Homo sapiens
tttattccctgccc

SEQ ID NO: 6558195 - DNA, 16 bp, Homo sapiens
tttattccctgcccaa

SEQ ID NO: 6558196 - DNA, 17 bp, Homo sapiens
tttattcccttttaaag

SEQ ID NO: 6558197 - DNA, 22 bp, Homo sapiens
tttattcctatatagtttattg

SEQ ID NO: 6558198 - DNA, 15 bp, Homo sapiens
tttattcctcttatt

SEQ ID NO: 6558199 - DNA, 15 bp, Homo sapiens
tttattccttctgta

SEQ ID NO: 6558200 - DNA, 21 bp, Homo sapiens
tttattctagggtttcttaaa

SEQ ID NO: 6558201 - DNA, 21 bp, Homo sapiens
tttattctcaggtaatcattt

SEQ ID NO: 6558202 - DNA, 13 bp, Homo sapiens
tttattctgtttt

SEQ ID NO: 6558203 - DNA, 15 bp, Homo sapiens
tttattctgttttct

SEQ ID NO: 6558204 - DNA, 14 bp, Homo sapiens
tttattcttctaga

SEQ ID NO: 6558205 - DNA, 19 bp, Homo sapiens
ttacactgagtttctattt

SEQ ID NO: 6558206 - DNA, 17 bp, Homo sapiens
ttacactgcctgtatac

SEQ ID NO: 6558207 - DNA, 21 bp, Homo sapiens
ttacactgcctgtatacttta

SEQ ID NO: 6558208 - DNA, 18 bp, Homo sapiens
ttacactgcggaagccaa

SEQ ID NO: 6558209 - DNA, 21 bp, Homo sapiens
ttacactggcaatggtagttt

SEQ ID NO: 6558210 - DNA, 20 bp, Homo sapiens
ttacactggtctaatgtttg

SEQ ID NO: 6558211 - DNA, 20 bp, Homo sapiens
ttacactgtaccatatagca

SEQ ID NO: 6558212 - DNA, 17 bp, Homo sapiens
ttacactgtatttgtat

SEQ ID NO: 6558213 - DNA, 18 bp, Homo sapiens
ttacactgtgccttttcc

SEQ ID NO: 6558214 - DNA, 17 bp, Homo sapiens
ttacactgttagaacac

SEQ ID NO: 6558215 - DNA, 22 bp, Homo sapiens
ttacactgttattttcagcatg

SEQ ID NO: 6558216 - DNA, 23 bp, Homo sapiens
ttacactgttattttcagcatga

SEQ ID NO: 6558217 - DNA, 17 bp, Homo sapiens
ttacactgttcacaaag

SEQ ID NO: 6558218 - DNA, 16 bp, Homo sapiens
ttacactgtttcatct

SEQ ID NO: 6558219 - DNA, 14 bp, Homo sapiens
ttacacttactgtt

SEQ ID NO: 6558220 - DNA, 19 bp, Homo sapiens
ttacacttataaaataact

SEQ ID NO: 6558221 - DNA, 18 bp, Homo sapiens
ttacacttcatatagcat

SEQ ID NO: 6558222 - DNA, 21 bp, Homo sapiens
ttacacttggagcccgtgcag

SEQ ID NO: 6558223 - DNA, 14 bp, Homo sapiens
ttacacttttgaga

SEQ ID NO: 6558224 - DNA, 13 bp, Homo sapiens
ttacagaaacacg

SEQ ID NO: 6558225 - DNA, 16 bp, Homo sapiens
ttacagaaactgatgc

SEQ ID NO: 6558226 - DNA, 15 bp, Homo sapiens
ttacagaaatactat

SEQ ID NO: 6558227 - DNA, 16 bp, Homo sapiens
ttacagaaatactata

SEQ ID NO: 6558228 - DNA, 17 bp, Homo sapiens
ttacagaaatactataa

SEQ ID NO: 6558229 - DNA, 14 bp, Homo sapiens
ttacagaaatgttt

SEQ ID NO: 6558230 - DNA, 22 bp, Homo sapiens
ttacagaaatgtttttaacact

SEQ ID NO: 6558231 - DNA, 12 bp, Homo sapiens
ttacagaacagt

SEQ ID NO: 6558232 - DNA, 20 bp, Homo sapiens
ttacagaaccaattcacttt

SEQ ID NO: 6558233 - DNA, 11 bp, Homo sapiens
ttacagaagaa

SEQ ID NO: 6558234 - DNA, 19 bp, Homo sapiens
ttacagaatctaactggtg

SEQ ID NO: 6558235 - DNA, 17 bp, Homo sapiens
ttacagaatgcattaaa

SEQ ID NO: 6558236 - DNA, 20 bp, Homo sapiens
ttacagaatgcattaaaaaa

SEQ ID NO: 6558237 - DNA, 14 bp, Homo sapiens
ttacagactgaaag

SEQ ID NO: 6558238 - DNA, 22 bp, Homo sapiens
ttacagagaggatacatttaat

SEQ ID NO: 6558239 - DNA, 20 bp, Homo sapiens
ttacagagatataaatgaag

SEQ ID NO: 6558240 - DNA, 16 bp, Homo sapiens
ttacagagatgtctct

SEQ ID NO: 6558241 - DNA, 14 bp, Homo sapiens
ttacagagccttga

SEQ ID NO: 6558242 - DNA, 15 bp, Homo sapiens
ttacagaggacagta

SEQ ID NO: 6558243 - DNA, 20 bp, Homo sapiens
ttacagatcatataagcaag

SEQ ID NO: 6558244 - DNA, 20 bp, Homo sapiens
ttacagatgaatgtatttat

SEQ ID NO: 6558245 - DNA, 18 bp, Homo sapiens
ttacagatgtttttaatt

SEQ ID NO: 6558246 - DNA, 23 bp, Homo sapiens
ttacagatgtttttaattctagt

SEQ ID NO: 6558247 - DNA, 13 bp, Homo sapiens
ttacagattaaag

SEQ ID NO: 6558248 - DNA, 16 bp, Homo sapiens
ttacagatttaataca

SEQ ID NO: 6558249 - DNA, 22 bp, Homo sapiens
ttacagatttctcactatatat

SEQ ID NO: 6558250 - DNA, 21 bp, Homo sapiens
ttacagcattgtctttgctgt

SEQ ID NO: 6558251 - DNA, 22 bp, Homo sapiens
ttacagccaagtgccaaatgct

SEQ ID NO: 6558252 - DNA, 23 bp, Homo sapiens
ttacagccaagtgccaaatgctc

SEQ ID NO: 6558253 - DNA, 21 bp, Homo sapiens
ttacagccaagttgtgacagt

SEQ ID NO: 6558254 - DNA, 15 bp, Homo sapiens
ttacagccagaggaa

SEQ ID NO: 6558255 - DNA, 18 bp, Homo sapiens
ttacagcccttggcttgt

SEQ ID NO: 6558256 - DNA, 15 bp, Homo sapiens
ttacagcgagaggca

SEQ ID NO: 6558257 - DNA, 18 bp, Homo sapiens
ttacagctctcctccagc

SEQ ID NO: 6558258 - DNA, 16 bp, Homo sapiens
ttacagctctgtagtt

SEQ ID NO: 6558259 - DNA, 17 bp, Homo sapiens
ttacagctctgtagttt

SEQ ID NO: 6558260 - DNA, 14 bp, Homo sapiens
ttacagctgcctgc

SEQ ID NO: 6558261 - DNA, 20 bp, Homo sapiens
ttacagctgggtggcactgc

SEQ ID NO: 6558262 - DNA, 15 bp, Homo sapiens
ttacagctttacaca

SEQ ID NO: 6558263 - DNA, 11 bp, Homo sapiens
ttacaggaaac

SEQ ID NO: 6558264 - DNA, 15 bp, Homo sapiens
ttacaggaaatgcaa

SEQ ID NO: 6558265 - DNA, 23 bp, Homo sapiens
ttacaggaaattgcaaagaaaat

SEQ ID NO: 6558266 - DNA, 17 bp, Homo sapiens
ttacaggaatgaagaac

SEQ ID NO: 6558267 - DNA, 20 bp, Homo sapiens
ttacaggaatgaagaactgt

SEQ ID NO: 6558268 - DNA, 15 bp, Homo sapiens
ttacaggagccagcc

SEQ ID NO: 6558269 - DNA, 21 bp, Homo sapiens
ttacaggaggttgtggatgct

SEQ ID NO: 6558270 - DNA, 20 bp, Homo sapiens
ttacaggatattccaaaata

SEQ ID NO: 6558271 - DNA, 21 bp, Homo sapiens
ttacaggatattccaaaataa

SEQ ID NO: 6558272 - DNA, 17 bp, Homo sapiens
ttacaggcaccgagaat

SEQ ID NO: 6558273 - DNA, 19 bp, Homo sapiens
ttacaggcatgtgccacca

SEQ ID NO: 6558274 - DNA, 15 bp, Homo sapiens
ttacaggcgcctgcc

SEQ ID NO: 6558275 - DNA, 24 bp, Homo sapiens
ttacaggcgtgagccaccgtgcct

SEQ ID NO: 6558276 - DNA, 15 bp, Homo sapiens
ttacagggaagaaat

SEQ ID NO: 6558277 - DNA, 15 bp, Homo sapiens
ttacagggaagtggt

SEQ ID NO: 6558278 - DNA, 15 bp, Homo sapiens
ttacagggagcctcc

SEQ ID NO: 6558279 - DNA, 17 bp, Homo sapiens
ttacagggagcctcctg

SEQ ID NO: 6558280 - DNA, 20 bp, Homo sapiens
ttacagggatgagccaccgc

SEQ ID NO: 6558281 - DNA, 18 bp, Homo sapiens
ttacagggcccaggtgag

SEQ ID NO: 6558282 - DNA, 22 bp, Homo sapiens
ttacaggggagaaggaaatgca

SEQ ID NO: 6558283 - DNA, 17 bp, Homo sapiens
ttacagggtgactcaca

SEQ ID NO: 6558284 - DNA, 17 bp, Homo sapiens
ttacaggtaccagttct

SEQ ID NO: 6558285 - DNA, 13 bp, Homo sapiens
ttacaggtgatta

SEQ ID NO: 6558286 - DNA, 15 bp, Homo sapiens
ttacaggtgattaac

SEQ ID NO: 6558287 - DNA, 16 bp, Homo sapiens
ttacaggtgtactatg

SEQ ID NO: 6558288 - DNA, 17 bp, Homo sapiens
ttacaggtgtactatgg

SEQ ID NO: 6558289 - DNA, 19 bp, Homo sapiens
ttacaggtgtgcaccacca

SEQ ID NO: 6558290 - DNA, 15 bp, Homo sapiens
ttacaggtttgaatt

SEQ ID NO: 6558291 - DNA, 17 bp, Homo sapiens
ttacagtaaataaattg

SEQ ID NO: 6558292 - DNA, 13 bp, Homo sapiens
ttacagtaaatga

SEQ ID NO: 6558293 - DNA, 19 bp, Homo sapiens
ttacagtaactaattttgt

SEQ ID NO: 6558294 - DNA, 17 bp, Homo sapiens
ttacagtaatgtcataa

SEQ ID NO: 6558295 - DNA, 18 bp, Homo sapiens
ttacagtaatgtcataaa

SEQ ID NO: 6558296 - DNA, 22 bp, Homo sapiens
ttacagtaatgtcataaagtga

SEQ ID NO: 6558297 - DNA, 15 bp, Homo sapiens
ttacagtatcttcaa

SEQ ID NO: 6558298 - DNA, 15 bp, Homo sapiens
ttacagtatttctac

SEQ ID NO: 6558299 - DNA, 19 bp, Homo sapiens
ttacagtccagttttgtgt

SEQ ID NO: 6558300 - DNA, 20 bp, Homo sapiens
ttacagtgaaaatgtaagct

SEQ ID NO: 6558301 - DNA, 14 bp, Homo sapiens
ttacagtgaagaaa

SEQ ID NO: 6558302 - DNA, 18 bp, Homo sapiens
ttacagtgcagacaggcc

SEQ ID NO: 6558303 - DNA, 17 bp, Homo sapiens
ttacagtggggaatgaa

SEQ ID NO: 6558304 - DNA, 22 bp, Homo sapiens
ttacagtgtatctcgaagtctt

SEQ ID NO: 6558305 - DNA, 15 bp, Homo sapiens
ttacagtgtatttaa

SEQ ID NO: 6558306 - DNA, 13 bp, Homo sapiens
ttacagtgttccg

SEQ ID NO: 6558307 - DNA, 12 bp, Homo sapiens
ttacagtgttta

SEQ ID NO: 6558308 - DNA, 15 bp, Homo sapiens
ttacagttacttcct

SEQ ID NO: 6558309 - DNA, 17 bp, Homo sapiens
ttacagttacttccttc

SEQ ID NO: 6558310 - DNA, 20 bp, Homo sapiens
ttacagttacttccttcctg

SEQ ID NO: 6558311 - DNA, 13 bp, Homo sapiens
ttacagttacttt

SEQ ID NO: 6558312 - DNA, 14 bp, Homo sapiens
ttacagttactttt

SEQ ID NO: 6558313 - DNA, 16 bp, Homo sapiens
ttacagttatcctgca

SEQ ID NO: 6558314 - DNA, 14 bp, Homo sapiens
ttacagttctgtgg

SEQ ID NO: 6558315 - DNA, 22 bp, Homo sapiens
ttacagttctttcctctttctg

SEQ ID NO: 6558316 - DNA, 20 bp, Homo sapiens
ttacagtttatattgtggaa

SEQ ID NO: 6558317 - DNA, 14 bp, Homo sapiens
ttacagtttgtgtt

SEQ ID NO: 6558318 - DNA, 18 bp, Homo sapiens
ttacataaacatcaggtt

SEQ ID NO: 6558319 - DNA, 15 bp, Homo sapiens
ttacataaagactgt

SEQ ID NO: 6558320 - DNA, 11 bp, Homo sapiens
ttacataacag

SEQ ID NO: 6558321 - DNA, 17 bp, Homo sapiens
ttacataacaggcattg

SEQ ID NO: 6558322 - DNA, 17 bp, Homo sapiens
ttacataacggaaagtt

SEQ ID NO: 6558323 - DNA, 18 bp, Homo sapiens
ttacataactgatctatt

SEQ ID NO: 6558324 - DNA, 21 bp, Homo sapiens
ttacataactgatctatttat

SEQ ID NO: 6558325 - DNA, 17 bp, Homo sapiens
ttacataactgccttga

SEQ ID NO: 6558326 - DNA, 22 bp, Homo sapiens
ttacataaggatgactttttta

SEQ ID NO: 6558327 - DNA, 17 bp, Homo sapiens
ttacataatcaaagcta

SEQ ID NO: 6558328 - DNA, 22 bp, Homo sapiens
ttacataatcaaagctacctgt

SEQ ID NO: 6558329 - DNA, 15 bp, Homo sapiens
ttacataattgccaa

SEQ ID NO: 6558330 - DNA, 22 bp, Homo sapiens
ttacataatttagttgtttcta

SEQ ID NO: 6558331 - DNA, 15 bp, Homo sapiens
ttacatacagtgata

SEQ ID NO: 6558332 - DNA, 21 bp, Homo sapiens
ttacatagatcagccattaaa

SEQ ID NO: 6558333 - DNA, 20 bp, Homo sapiens
ttacatagtgcaaaactgtg

SEQ ID NO: 6558334 - DNA, 22 bp, Homo sapiens
ttacatatcacctcatggccta

SEQ ID NO: 6558335 - DNA, 14 bp, Homo sapiens
ttacatatctgact

SEQ ID NO: 6558336 - DNA, 23 bp, Homo sapiens
ttacatatctgacttctaggatt

SEQ ID NO: 6558337 - DNA, 15 bp, Homo sapiens
ttacatatctgtccc

SEQ ID NO: 6558338 - DNA, 22 bp, Homo sapiens
ttacatatttgcatatgtatga

SEQ ID NO: 6558339 - DNA, 23 bp, Homo sapiens
ttacatcagtagcatttttctaa

SEQ ID NO: 6558340 - DNA, 16 bp, Homo sapiens
ttacatcatcctcctt

SEQ ID NO: 6558341 - DNA, 13 bp, Homo sapiens
ttacatcatttct

SEQ ID NO: 6558342 - DNA, 13 bp, Homo sapiens
ttacatcattttt

SEQ ID NO: 6558343 - DNA, 16 bp, Homo sapiens
ttacatctctaatttt

SEQ ID NO: 6558344 - DNA, 22 bp, Homo sapiens
ttacatctgaacaaaatgcctt

SEQ ID NO: 6558345 - DNA, 14 bp, Homo sapiens
ttacatctgtttta

SEQ ID NO: 6558346 - DNA, 21 bp, Homo sapiens
ttacatctgttttaaatttat

SEQ ID NO: 6558347 - DNA, 15 bp, Homo sapiens
ttacatctttcacat

SEQ ID NO: 6558348 - DNA, 14 bp, Homo sapiens
ttacatcttttcta

SEQ ID NO: 6558349 - DNA, 18 bp, Homo sapiens
ttacatcttttgggaagc

SEQ ID NO: 6558350 - DNA, 12 bp, Homo sapiens
ttacatgaacac

SEQ ID NO: 6558351 - DNA, 14 bp, Homo sapiens
ttacatgaacacag

SEQ ID NO: 6558352 - DNA, 14 bp, Homo sapiens
ttacatgaagattt

SEQ ID NO: 6558353 - DNA, 15 bp, Homo sapiens
ttacatgaagtattt

SEQ ID NO: 6558354 - DNA, 20 bp, Homo sapiens
ttacatgaagtattttttca

SEQ ID NO: 6558355 - DNA, 16 bp, Homo sapiens
ttacatgaccagaaaa

SEQ ID NO: 6558356 - DNA, 23 bp, Homo sapiens
ttacatgactgtttcttttgtaa

SEQ ID NO: 6558357 - DNA, 22 bp, Homo sapiens
ttacatgatcttggtttatcat

SEQ ID NO: 6558358 - DNA, 16 bp, Homo sapiens
ttacatgattcatttt

SEQ ID NO: 6558359 - DNA, 17 bp, Homo sapiens
ttacatgattcatttta

SEQ ID NO: 6558360 - DNA, 22 bp, Homo sapiens
ttacatgcagccacttaggaca

SEQ ID NO: 6558361 - DNA, 14 bp, Homo sapiens
ttacatgcataaaa

SEQ ID NO: 6558362 - DNA, 16 bp, Homo sapiens
ttacatgcataaaagg

SEQ ID NO: 6558363 - DNA, 12 bp, Homo sapiens
ttacatgcatac

SEQ ID NO: 6558364 - DNA, 15 bp, Homo sapiens
ttacatgcatacttc

SEQ ID NO: 6558365 - DNA, 18 bp, Homo sapiens
ttacatgcatacttcaaa

SEQ ID NO: 6558366 - DNA, 19 bp, Homo sapiens
ttacatgcatacttcaaaa

SEQ ID NO: 6558367 - DNA, 22 bp, Homo sapiens
ttacatgcatacttcaaaagta

SEQ ID NO: 6558368 - DNA, 23 bp, Homo sapiens
ttacatgcccatcccagtgtcct

SEQ ID NO: 6558369 - DNA, 17 bp, Homo sapiens
ttacatgccccgttttt

SEQ ID NO: 6558370 - DNA, 12 bp, Homo sapiens
ttacatgcttat

SEQ ID NO: 6558371 - DNA, 23 bp, Homo sapiens
ttacatggagaaaaccaaaatga

SEQ ID NO: 6558372 - DNA, 15 bp, Homo sapiens
ttacatggctgtggt

SEQ ID NO: 6558373 - DNA, 18 bp, Homo sapiens
ttacatgggccagtttat

SEQ ID NO: 6558374 - DNA, 15 bp, Homo sapiens
ttacatgtaaagctg

SEQ ID NO: 6558375 - DNA, 18 bp, Homo sapiens
ttacatgtaaagctgtta

SEQ ID NO: 6558376 - DNA, 20 bp, Homo sapiens
ttacatgtaaagctgttaaa

SEQ ID NO: 6558377 - DNA, 17 bp, Homo sapiens
ttacatgtgttagtgta

SEQ ID NO: 6558378 - DNA, 15 bp, Homo sapiens
ttacatgttcttcca

SEQ ID NO: 6558379 - DNA, 17 bp, Homo sapiens
ttacatgtttaaattgt

SEQ ID NO: 6558380 - DNA, 18 bp, Homo sapiens
ttacatgttttctttgct

SEQ ID NO: 6558381 - DNA, 16 bp, Homo sapiens
ttacattaaaaagcct

SEQ ID NO: 6558382 - DNA, 24 bp, Homo sapiens
ttacattaaaatagcacatgattt

SEQ ID NO: 6558383 - DNA, 16 bp, Homo sapiens
tttattcttctagagt

SEQ ID NO: 6558384 - DNA, 13 bp, Homo sapiens
tttattcttgctg

SEQ ID NO: 6558385 - DNA, 16 bp, Homo sapiens
tttattctttttaaag

SEQ ID NO: 6558386 - DNA, 19 bp, Homo sapiens
tttattgaaaatgtggtaa

SEQ ID NO: 6558387 - DNA, 13 bp, Homo sapiens
tttattgaaagct

SEQ ID NO: 6558388 - DNA, 15 bp, Homo sapiens
tttattgaaagctca

SEQ ID NO: 6558389 - DNA, 16 bp, Homo sapiens
tttattgaagatgtcc

SEQ ID NO: 6558390 - DNA, 20 bp, Homo sapiens
tttattgaattcatttcact

SEQ ID NO: 6558391 - DNA, 22 bp, Homo sapiens
tttattgactttgacaattact

SEQ ID NO: 6558392 - DNA, 20 bp, Homo sapiens
tttattgagctgtacatgca

SEQ ID NO: 6558393 - DNA, 18 bp, Homo sapiens
tttattgaggaaaaatat

SEQ ID NO: 6558394 - DNA, 20 bp, Homo sapiens
tttattgagtaatattacat

SEQ ID NO: 6558395 - DNA, 21 bp, Homo sapiens
tttattgatgcagtgtgtctt

SEQ ID NO: 6558396 - DNA, 19 bp, Homo sapiens
tttattgatgtgcaaaaat

SEQ ID NO: 6558397 - DNA, 14 bp, Homo sapiens
tttattgatgtttt

SEQ ID NO: 6558398 - DNA, 16 bp, Homo sapiens
tttattgcaatgcaga

SEQ ID NO: 6558399 - DNA, 16 bp, Homo sapiens
tttattgcagaatgtg

SEQ ID NO: 6558400 - DNA, 13 bp, Homo sapiens
tttattgcagttt

SEQ ID NO: 6558401 - DNA, 12 bp, Homo sapiens
tttattgcattg

SEQ ID NO: 6558402 - DNA, 22 bp, Homo sapiens
tttattgccaaaacccagctgc

SEQ ID NO: 6558403 - DNA, 14 bp, Homo sapiens
tttattgccattat

SEQ ID NO: 6558404 - DNA, 22 bp, Homo sapiens
tttattgccattatagcgcctg

SEQ ID NO: 6558405 - DNA, 23 bp, Homo sapiens
tttattgccattatagcgcctgt

SEQ ID NO: 6558406 - DNA, 13 bp, Homo sapiens
tttattgcctctg

SEQ ID NO: 6558407 - DNA, 22 bp, Homo sapiens
tttattgccttctcaccagctg

SEQ ID NO: 6558408 - DNA, 14 bp, Homo sapiens
tttattgctgcatt

SEQ ID NO: 6558409 - DNA, 17 bp, Homo sapiens
tttattgctgcatttta

SEQ ID NO: 6558410 - DNA, 24 bp, Homo sapiens
tttattgcttagtgaaaatactag

SEQ ID NO: 6558411 - DNA, 20 bp, Homo sapiens
tttattggcagccaaggaat

SEQ ID NO: 6558412 - DNA, 23 bp, Homo sapiens
tttattggcagccaaggaatgtg

SEQ ID NO: 6558413 - DNA, 20 bp, Homo sapiens
tttattgggatgtgagcccc

SEQ ID NO: 6558414 - DNA, 19 bp, Homo sapiens
tttattgggcaataaaaga

SEQ ID NO: 6558415 - DNA, 19 bp, Homo sapiens
tttattggggaattaaata

SEQ ID NO: 6558416 - DNA, 23 bp, Homo sapiens
tttattggggaattaaatagtgt

SEQ ID NO: 6558417 - DNA, 23 bp, Homo sapiens
tttattggttttgcagaagaagg

SEQ ID NO: 6558418 - DNA, 16 bp, Homo sapiens
tttattgtaaatgagt

SEQ ID NO: 6558419 - DNA, 20 bp, Homo sapiens
tttattgtaccaaagctgtt

SEQ ID NO: 6558420 - DNA, 13 bp, Homo sapiens
tttattgtattct

SEQ ID NO: 6558421 - DNA, 18 bp, Homo sapiens
tttattgtattttgatga

SEQ ID NO: 6558422 - DNA, 19 bp, Homo sapiens
tttattgtattttgatgag

SEQ ID NO: 6558423 - DNA, 13 bp, Homo sapiens
tttattgtgatct

SEQ ID NO: 6558424 - DNA, 22 bp, Homo sapiens
tttattgtgtaattgatttata

SEQ ID NO: 6558425 - DNA, 17 bp, Homo sapiens
tttattgtgtttgtcat

SEQ ID NO: 6558426 - DNA, 21 bp, Homo sapiens
tttattgtgtttgtcattagc

SEQ ID NO: 6558427 - DNA, 17 bp, Homo sapiens
tttattgttaaattaca

SEQ ID NO: 6558428 - DNA, 20 bp, Homo sapiens
tttattgttaactcttgtct

SEQ ID NO: 6558429 - DNA, 15 bp, Homo sapiens
tttattgttaataca

SEQ ID NO: 6558430 - DNA, 14 bp, Homo sapiens
tttattgttagaaa

SEQ ID NO: 6558431 - DNA, 22 bp, Homo sapiens
tttattgtttaaaatcatttct

SEQ ID NO: 6558432 - DNA, 23 bp, Homo sapiens
tttattgtttaaagcaactgtct

SEQ ID NO: 6558433 - DNA, 19 bp, Homo sapiens
tttatttaaaactctggtg

SEQ ID NO: 6558434 - DNA, 15 bp, Homo sapiens
tttatttaaagcatt

SEQ ID NO: 6558435 - DNA, 14 bp, Homo sapiens
tttatttaaatgca

SEQ ID NO: 6558436 - DNA, 21 bp, Homo sapiens
tttatttaaatgtctaatgta

SEQ ID NO: 6558437 - DNA, 12 bp, Homo sapiens
tttatttaactt

SEQ ID NO: 6558438 - DNA, 22 bp, Homo sapiens
tttatttaacttttagtaaagt

SEQ ID NO: 6558439 - DNA, 19 bp, Homo sapiens
tttatttaatgctgtggca

SEQ ID NO: 6558440 - DNA, 14 bp, Homo sapiens
tttatttacaaatg

SEQ ID NO: 6558441 - DNA, 20 bp, Homo sapiens
tttatttacagatgaatgta

SEQ ID NO: 6558442 - DNA, 16 bp, Homo sapiens
tttatttactgctagt

SEQ ID NO: 6558443 - DNA, 14 bp, Homo sapiens
tttatttaggaaac

SEQ ID NO: 6558444 - DNA, 19 bp, Homo sapiens
tttatttagttccttgagt

SEQ ID NO: 6558445 - DNA, 13 bp, Homo sapiens
tttatttataaca

SEQ ID NO: 6558446 - DNA, 17 bp, Homo sapiens
tttatttatacactgtc

SEQ ID NO: 6558447 - DNA, 15 bp, Homo sapiens
tttatttatactatt

SEQ ID NO: 6558448 - DNA, 12 bp, Homo sapiens
tttatttatctt

SEQ ID NO: 6558449 - DNA, 14 bp, Homo sapiens
tttatttatgaagt

SEQ ID NO: 6558450 - DNA, 22 bp, Homo sapiens
tttatttatggaattaaccatt

SEQ ID NO: 6558451 - DNA, 14 bp, Homo sapiens
tttatttatgtact

SEQ ID NO: 6558452 - DNA, 17 bp, Homo sapiens
tttatttatgttctcaa

SEQ ID NO: 6558453 - DNA, 15 bp, Homo sapiens
tttatttattactgt

SEQ ID NO: 6558454 - DNA, 14 bp, Homo sapiens
tttatttattcact

SEQ ID NO: 6558455 - DNA, 13 bp, Homo sapiens
tttatttatttat

SEQ ID NO: 6558456 - DNA, 15 bp, Homo sapiens
tttatttcaattgtt

SEQ ID NO: 6558457 - DNA, 12 bp, Homo sapiens
tttatttcacat

SEQ ID NO: 6558458 - DNA, 11 bp, Homo sapiens
tttatttcatg

SEQ ID NO: 6558459 - DNA, 16 bp, Homo sapiens
tttatttcatgattca

SEQ ID NO: 6558460 - DNA, 12 bp, Homo sapiens
tttatttcatgg

SEQ ID NO: 6558461 - DNA, 17 bp, Homo sapiens
tttatttcattggttaa

SEQ ID NO: 6558462 - DNA, 20 bp, Homo sapiens
tttatttcatttttcaatag

SEQ ID NO: 6558463 - DNA, 22 bp, Homo sapiens
tttatttccaaaataaaatgaa

SEQ ID NO: 6558464 - DNA, 20 bp, Homo sapiens
tttatttccaatgtttcaag

SEQ ID NO: 6558465 - DNA, 12 bp, Homo sapiens
tttatttccact

SEQ ID NO: 6558466 - DNA, 20 bp, Homo sapiens
tttatttccactattttcaa

SEQ ID NO: 6558467 - DNA, 14 bp, Homo sapiens
tttatttccagagt

SEQ ID NO: 6558468 - DNA, 21 bp, Homo sapiens
tttatttcctcagctgtacaa

SEQ ID NO: 6558469 - DNA, 15 bp, Homo sapiens
tttatttctaaatga

SEQ ID NO: 6558470 - DNA, 20 bp, Homo sapiens
tttatttctaagtatttaaa

SEQ ID NO: 6558471 - DNA, 21 bp, Homo sapiens
tttatttctactgtcaaatga

SEQ ID NO: 6558472 - DNA, 20 bp, Homo sapiens
tttatttctagcaaacagat

SEQ ID NO: 6558473 - DNA, 17 bp, Homo sapiens
tttatttctccttttgt

SEQ ID NO: 6558474 - DNA, 13 bp, Homo sapiens
tttatttctttta

SEQ ID NO: 6558475 - DNA, 20 bp, Homo sapiens
tttatttcttttagaaaagg

SEQ ID NO: 6558476 - DNA, 20 bp, Homo sapiens
tttatttgaacaatgaagtt

SEQ ID NO: 6558477 - DNA, 17 bp, Homo sapiens
tttatttgagaaaatat

SEQ ID NO: 6558478 - DNA, 15 bp, Homo sapiens
tttatttgagaattt

SEQ ID NO: 6558479 - DNA, 13 bp, Homo sapiens
tttatttgaggtc

SEQ ID NO: 6558480 - DNA, 15 bp, Homo sapiens
tttatttggaataat

SEQ ID NO: 6558481 - DNA, 17 bp, Homo sapiens
tttatttggtgtgttcg

SEQ ID NO: 6558482 - DNA, 13 bp, Homo sapiens
tttatttggttcc

SEQ ID NO: 6558483 - DNA, 17 bp, Homo sapiens
tttatttgtaaaccatt

SEQ ID NO: 6558484 - DNA, 16 bp, Homo sapiens
tttatttgtaaattta

SEQ ID NO: 6558485 - DNA, 12 bp, Homo sapiens
tttatttgttga

SEQ ID NO: 6558486 - DNA, 14 bp, Homo sapiens
tttatttgtttact

SEQ ID NO: 6558487 - DNA, 20 bp, Homo sapiens
tttatttgtttgtgcatttg

SEQ ID NO: 6558488 - DNA, 13 bp, Homo sapiens
tttattttacaca

SEQ ID NO: 6558489 - DNA, 18 bp, Homo sapiens
tttattttacacagaaac

SEQ ID NO: 6558490 - DNA, 14 bp, Homo sapiens
tttattttacattt

SEQ ID NO: 6558491 - DNA, 17 bp, Homo sapiens
tttattttactagaaat

SEQ ID NO: 6558492 - DNA, 18 bp, Homo sapiens
tttattttactttgcatt

SEQ ID NO: 6558493 - DNA, 19 bp, Homo sapiens
tttattttagcagttctgc

SEQ ID NO: 6558494 - DNA, 10 bp, Homo sapiens
tttattttat

SEQ ID NO: 6558495 - DNA, 11 bp, Homo sapiens
tttattttata

SEQ ID NO: 6558496 - DNA, 16 bp, Homo sapiens
tttattttattattca

SEQ ID NO: 6558497 - DNA, 18 bp, Homo sapiens
tttattttattctatgta

SEQ ID NO: 6558498 - DNA, 12 bp, Homo sapiens
tttattttattg

SEQ ID NO: 6558499 - DNA, 21 bp, Homo sapiens
tttattttcagtatactgtgt

SEQ ID NO: 6558500 - DNA, 18 bp, Homo sapiens
tttattttgaaatggaaa

SEQ ID NO: 6558501 - DNA, 17 bp, Homo sapiens
tttattttgaactaatt

SEQ ID NO: 6558502 - DNA, 18 bp, Homo sapiens
tttattttgaatgtacct

SEQ ID NO: 6558503 - DNA, 19 bp, Homo sapiens
tttattttgaatgtacctc

SEQ ID NO: 6558504 - DNA, 13 bp, Homo sapiens
tttattttggaac

SEQ ID NO: 6558505 - DNA, 23 bp, Homo sapiens
tttattttggaattggtgtatat

SEQ ID NO: 6558506 - DNA, 22 bp, Homo sapiens
tttattttgtgctcatttaagt

SEQ ID NO: 6558507 - DNA, 13 bp, Homo sapiens
tttattttgtgta

SEQ ID NO: 6558508 - DNA, 16 bp, Homo sapiens
tttattttgtgtttag

SEQ ID NO: 6558509 - DNA, 18 bp, Homo sapiens
tttatttttaaattatgt

SEQ ID NO: 6558510 - DNA, 16 bp, Homo sapiens
tttatttttaagaaag

SEQ ID NO: 6558511 - DNA, 13 bp, Homo sapiens
tttatttttacct

SEQ ID NO: 6558512 - DNA, 16 bp, Homo sapiens
tttatttttagttaaa

SEQ ID NO: 6558513 - DNA, 15 bp, Homo sapiens
tttatttttataaaa

SEQ ID NO: 6558514 - DNA, 16 bp, Homo sapiens
tttatttttcatattg

SEQ ID NO: 6558515 - DNA, 22 bp, Homo sapiens
tttatttttccatttacaacaa

SEQ ID NO: 6558516 - DNA, 14 bp, Homo sapiens
tttatttttctatg

SEQ ID NO: 6558517 - DNA, 14 bp, Homo sapiens
tttatttttgacag

SEQ ID NO: 6558518 - DNA, 22 bp, Homo sapiens
tttatttttgcaaaataagttt

SEQ ID NO: 6558519 - DNA, 13 bp, Homo sapiens
tttatttttgcac

SEQ ID NO: 6558520 - DNA, 18 bp, Homo sapiens
tttatttttgcacaactt

SEQ ID NO: 6558521 - DNA, 15 bp, Homo sapiens
tttatttttgcatgg

SEQ ID NO: 6558522 - DNA, 23 bp, Homo sapiens
tttatttttgggtttggccaggg

SEQ ID NO: 6558523 - DNA, 16 bp, Homo sapiens
tttatttttgtacatt

SEQ ID NO: 6558524 - DNA, 17 bp, Homo sapiens
tttatttttgtactgtg

SEQ ID NO: 6558525 - DNA, 15 bp, Homo sapiens
tttatttttgtgtag

SEQ ID NO: 6558526 - DNA, 18 bp, Homo sapiens
tttattttttaagttcaa

SEQ ID NO: 6558527 - DNA, 21 bp, Homo sapiens
tttattttttaccataatctt

SEQ ID NO: 6558528 - DNA, 16 bp, Homo sapiens
tttattttttattatt

SEQ ID NO: 6558529 - DNA, 17 bp, Homo sapiens
tttattttttggacttc

SEQ ID NO: 6558530 - DNA, 14 bp, Homo sapiens
tttattttttgtaa

SEQ ID NO: 6558531 - DNA, 20 bp, Homo sapiens
tttattttttgtaactcttt

SEQ ID NO: 6558532 - DNA, 15 bp, Homo sapiens
tttatttttttaagt

SEQ ID NO: 6558533 - DNA, 18 bp, Homo sapiens
tttatttttttaccaatt

SEQ ID NO: 6558534 - DNA, 20 bp, Homo sapiens
tttatttttttgatggctaa

SEQ ID NO: 6558535 - DNA, 16 bp, Homo sapiens
tttatttttttgtaca

SEQ ID NO: 6558536 - DNA, 18 bp, Homo sapiens
tttattttttttaaagaa

SEQ ID NO: 6558537 - DNA, 21 bp, Homo sapiens
tttcaaaaaaaaaaaaaaaga

SEQ ID NO: 6558538 - DNA, 15 bp, Homo sapiens
tttcaaaaacacagt

SEQ ID NO: 6558539 - DNA, 23 bp, Homo sapiens
tttcaaaaacaccccccccccac

SEQ ID NO: 6558540 - DNA, 15 bp, Homo sapiens
tttcaaaaacatgct

SEQ ID NO: 6558541 - DNA, 13 bp, Homo sapiens
tttcaaaaatctg

SEQ ID NO: 6558542 - DNA, 19 bp, Homo sapiens
tttcaaaaatctgaagatt

SEQ ID NO: 6558543 - DNA, 24 bp, Homo sapiens
tttcaaaaatctgaagattgttta

SEQ ID NO: 6558544 - DNA, 21 bp, Homo sapiens
tttcaaaaatgctgttaatgt

SEQ ID NO: 6558545 - DNA, 23 bp, Homo sapiens
tttcaaaaatgctgttaatgtat

SEQ ID NO: 6558546 - DNA, 17 bp, Homo sapiens
tttcaaaaattacacta

SEQ ID NO: 6558547 - DNA, 23 bp, Homo sapiens
tttcaaaacacatctttcctgtc

SEQ ID NO: 6558548 - DNA, 13 bp, Homo sapiens
tttcaaaaccagg

SEQ ID NO: 6558549 - DNA, 20 bp, Homo sapiens
tttcaaaacccaaatggcta

SEQ ID NO: 6558550 - DNA, 18 bp, Homo sapiens
tttcaaaaccttttgaaa

SEQ ID NO: 6558551 - DNA, 12 bp, Homo sapiens
tttcaaaactag

SEQ ID NO: 6558552 - DNA, 20 bp, Homo sapiens
tttcaaaactcatttcctat

SEQ ID NO: 6558553 - DNA, 13 bp, Homo sapiens
tttcaaaagaaag

SEQ ID NO: 6558554 - DNA, 23 bp, Homo sapiens
tttcaaaagaaatttaagttcta

SEQ ID NO: 6558555 - DNA, 12 bp, Homo sapiens
tttcaaaagaca

SEQ ID NO: 6558556 - DNA, 23 bp, Homo sapiens
tttcaaaaggaagggtggctttg

SEQ ID NO: 6558557 - DNA, 21 bp, Homo sapiens
tttcaaaaggtattatacatg

SEQ ID NO: 6558558 - DNA, 20 bp, Homo sapiens
tttcaaaataaaaaccaaga

SEQ ID NO: 6558559 - DNA, 21 bp, Homo sapiens
tttcaaaataagtatttctga

SEQ ID NO: 6558560 - DNA, 13 bp, Homo sapiens
tttcaaaataatt

SEQ ID NO: 6558561 - DNA, 15 bp, Homo sapiens
tttcaaaatacattt

SEQ ID NO: 6558562 - DNA, 15 bp, Homo sapiens
tttcaaaatagacaa

SEQ ID NO: 6558563 - DNA, 17 bp, Homo sapiens
tttcaaaatccaaaaag

SEQ ID NO: 6558564 - DNA, 18 bp, Homo sapiens
tttcaaaatccaaaaaga

SEQ ID NO: 6558565 - DNA, 10 bp, Homo sapiens
tttcaaaatg

SEQ ID NO: 6558566 - DNA, 14 bp, Homo sapiens
tttcaaaatgaaga

SEQ ID NO: 6558567 - DNA, 15 bp, Homo sapiens
tttcaaaatgataga

SEQ ID NO: 6558568 - DNA, 14 bp, Homo sapiens
tttcaaaatgcatg

SEQ ID NO: 6558569 - DNA, 18 bp, Homo sapiens
tttcaaaatgcatgtgat

SEQ ID NO: 6558570 - DNA, 13 bp, Homo sapiens
tttcaaaatgtct

SEQ ID NO: 6558571 - DNA, 20 bp, Homo sapiens
tttcaaaatgttaacaactt

SEQ ID NO: 6558572 - DNA, 16 bp, Homo sapiens
tttcaaaattgttgca

SEQ ID NO: 6558573 - DNA, 13 bp, Homo sapiens
tttcaaacaaaat

SEQ ID NO: 6558574 - DNA, 16 bp, Homo sapiens
tttcaaacacaaatgc

SEQ ID NO: 6558575 - DNA, 15 bp, Homo sapiens
tttcaaacacacaca

SEQ ID NO: 6558576 - DNA, 19 bp, Homo sapiens
tttcaaacagcatcaaaat

SEQ ID NO: 6558577 - DNA, 13 bp, Homo sapiens
tttcaaacatttg

SEQ ID NO: 6558578 - DNA, 14 bp, Homo sapiens
tttcaaacatttgt

SEQ ID NO: 6558579 - DNA, 20 bp, Homo sapiens
tttcaaaccagtatacaaga

SEQ ID NO: 6558580 - DNA, 22 bp, Homo sapiens
tttcaaactgaatttgttctta

SEQ ID NO: 6558581 - DNA, 19 bp, Homo sapiens
tttcaaacttactattttg

SEQ ID NO: 6558582 - DNA, 16 bp, Homo sapiens
tttcaaactttactat

SEQ ID NO: 6558583 - DNA, 14 bp, Homo sapiens
tttcaaactttgga

SEQ ID NO: 6558584 - DNA, 16 bp, Homo sapiens
tttcaaacttttgaaa

SEQ ID NO: 6558585 - DNA, 20 bp, Homo sapiens
tttcaaagaaaacagaccag

SEQ ID NO: 6558586 - DNA, 14 bp, Homo sapiens
tttcaaagaaggaa

SEQ ID NO: 6558587 - DNA, 14 bp, Homo sapiens
tttcaaagacaatc

SEQ ID NO: 6558588 - DNA, 13 bp, Homo sapiens
tttcaaagatgct

SEQ ID NO: 6558589 - DNA, 12 bp, Homo sapiens
tttcaaagcaat

SEQ ID NO: 6558590 - DNA, 18 bp, Homo sapiens
tttcaaagccctgcctct

SEQ ID NO: 6558591 - DNA, 19 bp, Homo sapiens
tttcaaagccctgcctctg

SEQ ID NO: 6558592 - DNA, 22 bp, Homo sapiens
tttcaaagctaaaatatataat

SEQ ID NO: 6558593 - DNA, 13 bp, Homo sapiens
tttcaaaggaaaa

SEQ ID NO: 6558594 - DNA, 18 bp, Homo sapiens
tttcaaagtgcacacaca

SEQ ID NO: 6558595 - DNA, 12 bp, Homo sapiens
tttcaaagtttt

SEQ ID NO: 6558596 - DNA, 21 bp, Homo sapiens
tttcaaataatgcttttctaa

SEQ ID NO: 6558597 - DNA, 22 bp, Homo sapiens
tttcaaataatgcttttctaat

SEQ ID NO: 6558598 - DNA, 20 bp, Homo sapiens
tttcaaatagggtctaactc

SEQ ID NO: 6558599 - DNA, 13 bp, Homo sapiens
tttcaaatatcac

SEQ ID NO: 6558600 - DNA, 18 bp, Homo sapiens
tttcaaatatgtaaactt

SEQ ID NO: 6558601 - DNA, 21 bp, Homo sapiens
tttcaaatattgaatgcctta

SEQ ID NO: 6558602 - DNA, 22 bp, Homo sapiens
tttcaaatattgaatgccttat

SEQ ID NO: 6558603 - DNA, 11 bp, Homo sapiens
tttcaaatgag

SEQ ID NO: 6558604 - DNA, 20 bp, Homo sapiens
tttcaaatgagtttaaaaaa

SEQ ID NO: 6558605 - DNA, 18 bp, Homo sapiens
tttcaaatgagtttaatg

SEQ ID NO: 6558606 - DNA, 12 bp, Homo sapiens
tttcaaatgatt

SEQ ID NO: 6558607 - DNA, 21 bp, Homo sapiens
tttcaaatgcagaatacttga

SEQ ID NO: 6558608 - DNA, 15 bp, Homo sapiens
tttcaaatggactgt

SEQ ID NO: 6558609 - DNA, 14 bp, Homo sapiens
tttcaaatgtgctg

SEQ ID NO: 6558610 - DNA, 24 bp, Homo sapiens
tttcaaattaatctttctatattt

SEQ ID NO: 6558611 - DNA, 16 bp, Homo sapiens
tttcaaattaatgttc

SEQ ID NO: 6558612 - DNA, 21 bp, Homo sapiens
tttcaaattaatgttccagtt

SEQ ID NO: 6558613 - DNA, 19 bp, Homo sapiens
tttcaaattggactttcaa

SEQ ID NO: 6558614 - DNA, 18 bp, Homo sapiens
tttcaaatttagaaacta

SEQ ID NO: 6558615 - DNA, 20 bp, Homo sapiens
tttcaaatttagaaactaat

SEQ ID NO: 6558616 - DNA, 23 bp, Homo sapiens
tttcaacaaagatcatttaatac

SEQ ID NO: 6558617 - DNA, 14 bp, Homo sapiens
tttcaacaaatttc

SEQ ID NO: 6558618 - DNA, 15 bp, Homo sapiens
tttcaacaaatttca

SEQ ID NO: 6558619 - DNA, 16 bp, Homo sapiens
tttcaacaaatttcat

SEQ ID NO: 6558620 - DNA, 17 bp, Homo sapiens
tttcaacaaatttcatt

SEQ ID NO: 6558621 - DNA, 19 bp, Homo sapiens
tttcaacaaatttcattgc

SEQ ID NO: 6558622 - DNA, 22 bp, Homo sapiens
tttcaacaaatttcattgcact

SEQ ID NO: 6558623 - DNA, 23 bp, Homo sapiens
tttcaacaagaatattgtatgtt

SEQ ID NO: 6558624 - DNA, 20 bp, Homo sapiens
tttcaacagtgaagacagaa

SEQ ID NO: 6558625 - DNA, 21 bp, Homo sapiens
tttcaacatatgaattggggg

SEQ ID NO: 6558626 - DNA, 14 bp, Homo sapiens
tttcaaccacacct

SEQ ID NO: 6558627 - DNA, 20 bp, Homo sapiens
tttcaaccagataacatacc

SEQ ID NO: 6558628 - DNA, 12 bp, Homo sapiens
tttcaaccagca

SEQ ID NO: 6558629 - DNA, 13 bp, Homo sapiens
tttcaaccagcat

SEQ ID NO: 6558630 - DNA, 18 bp, Homo sapiens
tttcaaccagcattcatg

SEQ ID NO: 6558631 - DNA, 15 bp, Homo sapiens
tttcaaccagcattt

SEQ ID NO: 6558632 - DNA, 19 bp, Homo sapiens
tttcaaccccaccctgttt

SEQ ID NO: 6558633 - DNA, 16 bp, Homo sapiens
tttcaacgcagccctg

SEQ ID NO: 6558634 - DNA, 20 bp, Homo sapiens
tttcaacgcagccctgcttt

SEQ ID NO: 6558635 - DNA, 15 bp, Homo sapiens
tttcaactaatgtgt

SEQ ID NO: 6558636 - DNA, 15 bp, Homo sapiens
tttcaactactcttt

SEQ ID NO: 6558637 - DNA, 16 bp, Homo sapiens
tttcaactcattgcat

SEQ ID NO: 6558638 - DNA, 18 bp, Homo sapiens
tttcaactcattgcatca

SEQ ID NO: 6558639 - DNA, 16 bp, Homo sapiens
tttcaactgccaaaat

SEQ ID NO: 6558640 - DNA, 14 bp, Homo sapiens
tttcaactggctgg

SEQ ID NO: 6558641 - DNA, 19 bp, Homo sapiens
tttcaacttcttctatatc

SEQ ID NO: 6558642 - DNA, 22 bp, Homo sapiens
tttcaacttggcttcctttctt

SEQ ID NO: 6558643 - DNA, 18 bp, Homo sapiens
tttcaactttcttatctg

SEQ ID NO: 6558644 - DNA, 13 bp, Homo sapiens
tttcaactttgaa

SEQ ID NO: 6558645 - DNA, 21 bp, Homo sapiens
tttcaagaaaaaataaatgga

SEQ ID NO: 6558646 - DNA, 14 bp, Homo sapiens
tttcaagaaaactg

SEQ ID NO: 6558647 - DNA, 13 bp, Homo sapiens
tttcaagaaaatc

SEQ ID NO: 6558648 - DNA, 18 bp, Homo sapiens
tttcaagaaaattttgca

SEQ ID NO: 6558649 - DNA, 19 bp, Homo sapiens
tttcaagaaactgaggaat

SEQ ID NO: 6558650 - DNA, 21 bp, Homo sapiens
tttcaagaaaggcaagagctc

SEQ ID NO: 6558651 - DNA, 14 bp, Homo sapiens
tttcaagaacctgg

SEQ ID NO: 6558652 - DNA, 17 bp, Homo sapiens
tttcaagaacctggaaa

SEQ ID NO: 6558653 - DNA, 10 bp, Homo sapiens
tttcaagaat

SEQ ID NO: 6558654 - DNA, 23 bp, Homo sapiens
tttcaagaataatcacgctttcc

SEQ ID NO: 6558655 - DNA, 18 bp, Homo sapiens
tttcaagaatgtttcagt

SEQ ID NO: 6558656 - DNA, 23 bp, Homo sapiens
tttcaagacagatgagcaggagc

SEQ ID NO: 6558657 - DNA, 14 bp, Homo sapiens
tttcaagagaagaa

SEQ ID NO: 6558658 - DNA, 21 bp, Homo sapiens
tttcaagagtctaatagtctt

SEQ ID NO: 6558659 - DNA, 19 bp, Homo sapiens
tttcaagatgttatattaa

SEQ ID NO: 6558660 - DNA, 22 bp, Homo sapiens
tttcaagatgttatattaaaga

SEQ ID NO: 6558661 - DNA, 16 bp, Homo sapiens
tttcaagattctaaag

SEQ ID NO: 6558662 - DNA, 23 bp, Homo sapiens
tttcaagcagtcgtgcctgtgtc

SEQ ID NO: 6558663 - DNA, 20 bp, Homo sapiens
tttcaagcggtgcctaagaa

SEQ ID NO: 6558664 - DNA, 22 bp, Homo sapiens
tttcaagctttttgtgagaaag

SEQ ID NO: 6558665 - DNA, 11 bp, Homo sapiens
tttcaaggaag

SEQ ID NO: 6558666 - DNA, 15 bp, Homo sapiens
tttcaaggaatggaa

SEQ ID NO: 6558667 - DNA, 18 bp, Homo sapiens
tttcaaggatgtttttct

SEQ ID NO: 6558668 - DNA, 18 bp, Homo sapiens
tttcaaggcactctagat

SEQ ID NO: 6558669 - DNA, 19 bp, Homo sapiens
tttcaaggcactctagatt

SEQ ID NO: 6558670 - DNA, 17 bp, Homo sapiens
tttcaaggccttcagtt

SEQ ID NO: 6558671 - DNA, 20 bp, Homo sapiens
tttcaaggtaatttcttgtg

SEQ ID NO: 6558672 - DNA, 14 bp, Homo sapiens
tttcaaggttctaa

SEQ ID NO: 6558673 - DNA, 15 bp, Homo sapiens
tttcaaggtttgtgc

SEQ ID NO: 6558674 - DNA, 20 bp, Homo sapiens
tttcaagtcaaattaataat

SEQ ID NO: 6558675 - DNA, 14 bp, Homo sapiens
tttcaagttattca

SEQ ID NO: 6558676 - DNA, 21 bp, Homo sapiens
tttcaagttattcaaatttgt

SEQ ID NO: 6558677 - DNA, 18 bp, Homo sapiens
tttcaagttattcagaaa

SEQ ID NO: 6558678 - DNA, 20 bp, Homo sapiens
tttcaagtttacacttcata

SEQ ID NO: 6558679 - DNA, 14 bp, Homo sapiens
tttcaagtttttca

SEQ ID NO: 6558680 - DNA, 23 bp, Homo sapiens
tttcaagtttttcatactgtaca

SEQ ID NO: 6558681 - DNA, 15 bp, Homo sapiens
tttcaataaaacttt

SEQ ID NO: 6558682 - DNA, 23 bp, Homo sapiens
tttcaataaagaaaaaaatagtt

SEQ ID NO: 6558683 - DNA, 14 bp, Homo sapiens
tttcaataaagttg

SEQ ID NO: 6558684 - DNA, 21 bp, Homo sapiens
tttcaataaagttgttgcatt

SEQ ID NO: 6558685 - DNA, 13 bp, Homo sapiens
tttcaataaatga

SEQ ID NO: 6558686 - DNA, 22 bp, Homo sapiens
tttcaataaattgttttttaat

SEQ ID NO: 6558687 - DNA, 23 bp, Homo sapiens
tttcaataacaaagcacataact

SEQ ID NO: 6558688 - DNA, 18 bp, Homo sapiens
tttcaataacgaagttgg

SEQ ID NO: 6558689 - DNA, 16 bp, Homo sapiens
tttcaatacagatata

SEQ ID NO: 6558690 - DNA, 17 bp, Homo sapiens
tttcaataccagggaag

SEQ ID NO: 6558691 - DNA, 18 bp, Homo sapiens
tttcaataccagggaagt

SEQ ID NO: 6558692 - DNA, 17 bp, Homo sapiens
tttcaatacccttttaa

SEQ ID NO: 6558693 - DNA, 23 bp, Homo sapiens
tttcaatactcttaaattttata

SEQ ID NO: 6558694 - DNA, 20 bp, Homo sapiens
tttcaatactgctgaaacag

SEQ ID NO: 6558695 - DNA, 14 bp, Homo sapiens
tttcaatacttaca

SEQ ID NO: 6558696 - DNA, 17 bp, Homo sapiens
tttcaataggaaaaact

SEQ ID NO: 6558697 - DNA, 22 bp, Homo sapiens
tttcaataggaaaaactgattt

SEQ ID NO: 6558698 - DNA, 13 bp, Homo sapiens
tttcaatatattg

SEQ ID NO: 6558699 - DNA, 13 bp, Homo sapiens
tttcaatatcaag

SEQ ID NO: 6558700 - DNA, 15 bp, Homo sapiens
tttcaatatcattac

SEQ ID NO: 6558701 - DNA, 12 bp, Homo sapiens
tttcaatatgca

SEQ ID NO: 6558702 - DNA, 16 bp, Homo sapiens
tttcaatattttaact

SEQ ID NO: 6558703 - DNA, 19 bp, Homo sapiens
tttcaatcaaccaaagtta

SEQ ID NO: 6558704 - DNA, 17 bp, Homo sapiens
tttcaatcactgaaaat

SEQ ID NO: 6558705 - DNA, 23 bp, Homo sapiens
tttcaatcactgtcctccacaca

SEQ ID NO: 6558706 - DNA, 14 bp, Homo sapiens
tttcaatcattgaa

SEQ ID NO: 6558707 - DNA, 15 bp, Homo sapiens
tttcaatcattgaag

SEQ ID NO: 6558708 - DNA, 18 bp, Homo sapiens
tttcaatccacagtattg

SEQ ID NO: 6558709 - DNA, 15 bp, Homo sapiens
tttcaatcttcaatc

SEQ ID NO: 6558710 - DNA, 15 bp, Homo sapiens
tttcaatcttctact

SEQ ID NO: 6558711 - DNA, 21 bp, Homo sapiens
tttcaatcttttaaattgcaa

SEQ ID NO: 6558712 - DNA, 17 bp, Homo sapiens
tttcaatgcaatgcatc

SEQ ID NO: 6558713 - DNA, 14 bp, Homo sapiens
tttcaatgcagttt

SEQ ID NO: 6558714 - DNA, 23 bp, Homo sapiens
tttcaatgcatacaataaaagag

SEQ ID NO: 6558715 - DNA, 23 bp, Homo sapiens
tttcaatgcgttttgttgtagat

SEQ ID NO: 6558716 - DNA, 20 bp, Homo sapiens
tttcaatgtaattaaactgt

SEQ ID NO: 6558717 - DNA, 22 bp, Homo sapiens
tttcaatgtctaaaaacatttg

SEQ ID NO: 6558718 - DNA, 23 bp, Homo sapiens
tttcaatgtgaaacacatgccag

SEQ ID NO: 6558719 - DNA, 22 bp, Homo sapiens
tttcaatgtgattctaatgtct

SEQ ID NO: 6558720 - DNA, 21 bp, Homo sapiens
tttcaatgtgttggaaactgt

SEQ ID NO: 6558721 - DNA, 19 bp, Homo sapiens
tttcaatgtgtttaatttt

SEQ ID NO: 6558722 - DNA, 17 bp, Homo sapiens
tttcaattaaacggatt

SEQ ID NO: 6558723 - DNA, 21 bp, Homo sapiens
tttcaattagatttaaaataa

SEQ ID NO: 6558724 - DNA, 12 bp, Homo sapiens
tttcaattatat

SEQ ID NO: 6558725 - DNA, 20 bp, Homo sapiens
tttcaattatattgttagtg

SEQ ID NO: 6558726 - DNA, 18 bp, Homo sapiens
tttcaattatgtttgaaa

SEQ ID NO: 6558727 - DNA, 21 bp, Homo sapiens
tttcaattatgtttgaaaata

SEQ ID NO: 6558728 - DNA, 14 bp, Homo sapiens
tttcaattatttca

SEQ ID NO: 6558729 - DNA, 15 bp, Homo sapiens
tttcaattatttcaa

SEQ ID NO: 6558730 - DNA, 17 bp, Homo sapiens
tttcaattcaaaaatgt

SEQ ID NO: 6558731 - DNA, 22 bp, Homo sapiens
tttcaattcagattgtcttgca

SEQ ID NO: 6558732 - DNA, 22 bp, Homo sapiens
tttcaattccacctgcaatcaa

SEQ ID NO: 6558733 - DNA, 15 bp, Homo sapiens
tttcaattctcaaaa

SEQ ID NO: 6558734 - DNA, 14 bp, Homo sapiens
tttcaattctgtaa

SEQ ID NO: 6558735 - DNA, 20 bp, Homo sapiens
tttcaattctgtaattacat

SEQ ID NO: 6558736 - DNA, 14 bp, Homo sapiens
tttcaattgacaaa

SEQ ID NO: 6558737 - DNA, 15 bp, Homo sapiens
tttcaattgacaaat

SEQ ID NO: 6558738 - DNA, 19 bp, Homo sapiens
tttcaattgagtaattcta

SEQ ID NO: 6558739 - DNA, 24 bp, Homo sapiens
tttcaattgagtaattctagacat

SEQ ID NO: 6558740 - DNA, 13 bp, Homo sapiens
ttacattaaactc

SEQ ID NO: 6558741 - DNA, 20 bp, Homo sapiens
ttacattaaagccctgtgtt

SEQ ID NO: 6558742 - DNA, 20 bp, Homo sapiens
ttacattaatgcccagccag

SEQ ID NO: 6558743 - DNA, 14 bp, Homo sapiens
ttacattaatgtta

SEQ ID NO: 6558744 - DNA, 14 bp, Homo sapiens
ttacattagttaag

SEQ ID NO: 6558745 - DNA, 14 bp, Homo sapiens
ttacattcagaaat

SEQ ID NO: 6558746 - DNA, 18 bp, Homo sapiens
ttacattcagaaatgtgg

SEQ ID NO: 6558747 - DNA, 14 bp, Homo sapiens
ttacattccagtag

SEQ ID NO: 6558748 - DNA, 20 bp, Homo sapiens
ttacattcctaactagaatt

SEQ ID NO: 6558749 - DNA, 22 bp, Homo sapiens
ttacattccttgataatgttgt

SEQ ID NO: 6558750 - DNA, 13 bp, Homo sapiens
ttacattctgaat

SEQ ID NO: 6558751 - DNA, 17 bp, Homo sapiens
ttacattgaaaacagat

SEQ ID NO: 6558752 - DNA, 19 bp, Homo sapiens
ttacattgaaaacagatat

SEQ ID NO: 6558753 - DNA, 17 bp, Homo sapiens
ttacattgcattcaaaa

SEQ ID NO: 6558754 - DNA, 23 bp, Homo sapiens
ttacattgccgtggcatcttaaa

SEQ ID NO: 6558755 - DNA, 20 bp, Homo sapiens
ttacattgcctgactaaaat

SEQ ID NO: 6558756 - DNA, 20 bp, Homo sapiens
ttacattgctggtcttgtaa

SEQ ID NO: 6558757 - DNA, 14 bp, Homo sapiens
ttacattggcacaa

SEQ ID NO: 6558758 - DNA, 13 bp, Homo sapiens
ttacattgtaaat

SEQ ID NO: 6558759 - DNA, 22 bp, Homo sapiens
ttacattgtgaatgctgtggga

SEQ ID NO: 6558760 - DNA, 16 bp, Homo sapiens
ttacatttaaaagaca

SEQ ID NO: 6558761 - DNA, 17 bp, Homo sapiens
ttacatttaaaagacag

SEQ ID NO: 6558762 - DNA, 17 bp, Homo sapiens
ttacatttaaacctttt

SEQ ID NO: 6558763 - DNA, 21 bp, Homo sapiens
ttacatttaaagcattgctgt

SEQ ID NO: 6558764 - DNA, 22 bp, Homo sapiens
ttacatttaaagcattgctgtt

SEQ ID NO: 6558765 - DNA, 13 bp, Homo sapiens
ttacatttaaatc

SEQ ID NO: 6558766 - DNA, 17 bp, Homo sapiens
ttacatttacaaactga

SEQ ID NO: 6558767 - DNA, 19 bp, Homo sapiens
ttacatttacaaactgaag

SEQ ID NO: 6558768 - DNA, 12 bp, Homo sapiens
ttacatttatgt

SEQ ID NO: 6558769 - DNA, 20 bp, Homo sapiens
ttacatttcagacatatcca

SEQ ID NO: 6558770 - DNA, 16 bp, Homo sapiens
ttacatttccaaatga

SEQ ID NO: 6558771 - DNA, 15 bp, Homo sapiens
ttacatttcgatgtt

SEQ ID NO: 6558772 - DNA, 15 bp, Homo sapiens
ttacatttcttttaa

SEQ ID NO: 6558773 - DNA, 14 bp, Homo sapiens
ttacatttgtaatt

SEQ ID NO: 6558774 - DNA, 14 bp, Homo sapiens
ttacatttgtataa

SEQ ID NO: 6558775 - DNA, 18 bp, Homo sapiens
ttacattttaaacacatt

SEQ ID NO: 6558776 - DNA, 21 bp, Homo sapiens
ttacattttcagtaccaaaga

SEQ ID NO: 6558777 - DNA, 16 bp, Homo sapiens
ttacattttcctgtgt

SEQ ID NO: 6558778 - DNA, 18 bp, Homo sapiens
ttacattttcgtcctgta

SEQ ID NO: 6558779 - DNA, 18 bp, Homo sapiens
ttacattttcttgtccaa

SEQ ID NO: 6558780 - DNA, 15 bp, Homo sapiens
ttacattttctttca

SEQ ID NO: 6558781 - DNA, 14 bp, Homo sapiens
ttacattttgtata

SEQ ID NO: 6558782 - DNA, 12 bp, Homo sapiens
ttacatttttaa

SEQ ID NO: 6558783 - DNA, 15 bp, Homo sapiens
ttacatttttaagct

SEQ ID NO: 6558784 - DNA, 23 bp, Homo sapiens
ttacatttttaagtgctgcattt

SEQ ID NO: 6558785 - DNA, 13 bp, Homo sapiens
ttacatttttaca

SEQ ID NO: 6558786 - DNA, 16 bp, Homo sapiens
ttacatttttacaata

SEQ ID NO: 6558787 - DNA, 17 bp, Homo sapiens
ttacatttttatttatg

SEQ ID NO: 6558788 - DNA, 21 bp, Homo sapiens
ttacatttttcacttttgcta

SEQ ID NO: 6558789 - DNA, 16 bp, Homo sapiens
ttacatttttctgatg

SEQ ID NO: 6558790 - DNA, 12 bp, Homo sapiens
ttaccaaaaatt

SEQ ID NO: 6558791 - DNA, 16 bp, Homo sapiens
ttaccaaaaattttgt

SEQ ID NO: 6558792 - DNA, 15 bp, Homo sapiens
ttaccaaaagctcag

SEQ ID NO: 6558793 - DNA, 15 bp, Homo sapiens
ttaccaaaagtcaac

SEQ ID NO: 6558794 - DNA, 23 bp, Homo sapiens
ttaccaaaattcactaatcttga

SEQ ID NO: 6558795 - DNA, 22 bp, Homo sapiens
ttaccaaagaagagtttacaga

SEQ ID NO: 6558796 - DNA, 23 bp, Homo sapiens
ttaccaaagatgaatgaagcaaa

SEQ ID NO: 6558797 - DNA, 19 bp, Homo sapiens
ttaccaaatacacatttca

SEQ ID NO: 6558798 - DNA, 15 bp, Homo sapiens
ttaccaaatgaaatg

SEQ ID NO: 6558799 - DNA, 12 bp, Homo sapiens
ttaccaacctgt

SEQ ID NO: 6558800 - DNA, 13 bp, Homo sapiens
ttaccaacttcct

SEQ ID NO: 6558801 - DNA, 14 bp, Homo sapiens
ttaccaagaagcct

SEQ ID NO: 6558802 - DNA, 17 bp, Homo sapiens
ttaccaagagtaacttt

SEQ ID NO: 6558803 - DNA, 22 bp, Homo sapiens
ttaccaagtatgaagtataaat

SEQ ID NO: 6558804 - DNA, 14 bp, Homo sapiens
ttaccaagttatat

SEQ ID NO: 6558805 - DNA, 16 bp, Homo sapiens
ttaccaagttatataa

SEQ ID NO: 6558806 - DNA, 17 bp, Homo sapiens
ttaccaagttatataaa

SEQ ID NO: 6558807 - DNA, 14 bp, Homo sapiens
ttaccaataaactg

SEQ ID NO: 6558808 - DNA, 20 bp, Homo sapiens
ttaccaataaactgagcgac

SEQ ID NO: 6558809 - DNA, 17 bp, Homo sapiens
ttaccaatagcctgaat

SEQ ID NO: 6558810 - DNA, 14 bp, Homo sapiens
ttaccaatcatatt

SEQ ID NO: 6558811 - DNA, 13 bp, Homo sapiens
ttaccaattccaa

SEQ ID NO: 6558812 - DNA, 14 bp, Homo sapiens
ttaccaattccaat

SEQ ID NO: 6558813 - DNA, 15 bp, Homo sapiens
ttaccacacatctat

SEQ ID NO: 6558814 - DNA, 18 bp, Homo sapiens
ttaccacacatctatgat

SEQ ID NO: 6558815 - DNA, 17 bp, Homo sapiens
ttaccacagacatacta

SEQ ID NO: 6558816 - DNA, 12 bp, Homo sapiens
ttaccacagagt

SEQ ID NO: 6558817 - DNA, 18 bp, Homo sapiens
ttaccacagcaactgacc

SEQ ID NO: 6558818 - DNA, 12 bp, Homo sapiens
ttaccaccccca

SEQ ID NO: 6558819 - DNA, 23 bp, Homo sapiens
ttaccactaattttgttttaaac

SEQ ID NO: 6558820 - DNA, 13 bp, Homo sapiens
ttaccactgaaga

SEQ ID NO: 6558821 - DNA, 21 bp, Homo sapiens
ttaccactgaagatagaagaa

SEQ ID NO: 6558822 - DNA, 13 bp, Homo sapiens
ttaccactggtaa

SEQ ID NO: 6558823 - DNA, 18 bp, Homo sapiens
ttaccactggtaacatgt

SEQ ID NO: 6558824 - DNA, 20 bp, Homo sapiens
ttaccacttgcactattctt

SEQ ID NO: 6558825 - DNA, 13 bp, Homo sapiens
ttaccagaaaatg

SEQ ID NO: 6558826 - DNA, 12 bp, Homo sapiens
ttaccagaaata

SEQ ID NO: 6558827 - DNA, 20 bp, Homo sapiens
ttaccagaagtttaaatctt

SEQ ID NO: 6558828 - DNA, 17 bp, Homo sapiens
ttaccagacaaaaaaat

SEQ ID NO: 6558829 - DNA, 22 bp, Homo sapiens
ttaccagacggttcaccagcct

SEQ ID NO: 6558830 - DNA, 12 bp, Homo sapiens
ttaccagacttc

SEQ ID NO: 6558831 - DNA, 14 bp, Homo sapiens
ttaccagacttcaa

SEQ ID NO: 6558832 - DNA, 18 bp, Homo sapiens
ttaccagacttcaagatc

SEQ ID NO: 6558833 - DNA, 21 bp, Homo sapiens
ttaccagagacgcccagcccc

SEQ ID NO: 6558834 - DNA, 22 bp, Homo sapiens
ttaccagaggttgtgcactgtt

SEQ ID NO: 6558835 - DNA, 21 bp, Homo sapiens
ttaccagatagttatattaaa

SEQ ID NO: 6558836 - DNA, 21 bp, Homo sapiens
ttaccagatttttacacatgt

SEQ ID NO: 6558837 - DNA, 19 bp, Homo sapiens
ttaccagcagagcacctta

SEQ ID NO: 6558838 - DNA, 16 bp, Homo sapiens
ttaccagcatttgtcc

SEQ ID NO: 6558839 - DNA, 22 bp, Homo sapiens
ttaccagcctccgtatttcaga

SEQ ID NO: 6558840 - DNA, 23 bp, Homo sapiens
ttaccagcctccgtatttcagac

SEQ ID NO: 6558841 - DNA, 19 bp, Homo sapiens
ttaccagcttttaaccatc

SEQ ID NO: 6558842 - DNA, 17 bp, Homo sapiens
ttaccagggatgtagat

SEQ ID NO: 6558843 - DNA, 21 bp, Homo sapiens
ttaccagggtctttgcagatg

SEQ ID NO: 6558844 - DNA, 17 bp, Homo sapiens
ttaccaggtgagaagtg

SEQ ID NO: 6558845 - DNA, 16 bp, Homo sapiens
ttaccagtaaagtgta

SEQ ID NO: 6558846 - DNA, 20 bp, Homo sapiens
ttaccagtaaagtgtaacat

SEQ ID NO: 6558847 - DNA, 18 bp, Homo sapiens
ttaccagttaattactca

SEQ ID NO: 6558848 - DNA, 14 bp, Homo sapiens
ttaccagttgcctt

SEQ ID NO: 6558849 - DNA, 16 bp, Homo sapiens
ttaccagtttctttgt

SEQ ID NO: 6558850 - DNA, 17 bp, Homo sapiens
ttaccataaagccttta

SEQ ID NO: 6558851 - DNA, 13 bp, Homo sapiens
ttaccatcttaat

SEQ ID NO: 6558852 - DNA, 17 bp, Homo sapiens
ttaccatcttaatcttt

SEQ ID NO: 6558853 - DNA, 17 bp, Homo sapiens
ttaccatgaattcttga

SEQ ID NO: 6558854 - DNA, 11 bp, Homo sapiens
ttaccatgaga

SEQ ID NO: 6558855 - DNA, 14 bp, Homo sapiens
ttaccatgtaatgg

SEQ ID NO: 6558856 - DNA, 22 bp, Homo sapiens
ttaccattaaaccatctccctg

SEQ ID NO: 6558857 - DNA, 21 bp, Homo sapiens
ttaccattaattacatacaga

SEQ ID NO: 6558858 - DNA, 23 bp, Homo sapiens
ttaccattaattacatacagatt

SEQ ID NO: 6558859 - DNA, 14 bp, Homo sapiens
ttaccattagcata

SEQ ID NO: 6558860 - DNA, 19 bp, Homo sapiens
ttaccattagcataatttt

SEQ ID NO: 6558861 - DNA, 20 bp, Homo sapiens
ttaccattattttacagtct

SEQ ID NO: 6558862 - DNA, 14 bp, Homo sapiens
ttaccatttgtaat

SEQ ID NO: 6558863 - DNA, 15 bp, Homo sapiens
ttaccatttgtaata

SEQ ID NO: 6558864 - DNA, 20 bp, Homo sapiens
ttaccatttgtaataaagta

SEQ ID NO: 6558865 - DNA, 22 bp, Homo sapiens
ttaccattttgcgatgtgtttt

SEQ ID NO: 6558866 - DNA, 24 bp, Homo sapiens
ttacccaaaaactaaatctctaat

SEQ ID NO: 6558867 - DNA, 15 bp, Homo sapiens
ttacccaaagcacat

SEQ ID NO: 6558868 - DNA, 16 bp, Homo sapiens
ttacccacacacagat

SEQ ID NO: 6558869 - DNA, 16 bp, Homo sapiens
ttacccacctagaaca

SEQ ID NO: 6558870 - DNA, 22 bp, Homo sapiens
ttacccacctagaacactaact

SEQ ID NO: 6558871 - DNA, 18 bp, Homo sapiens
ttacccactgccatgcac

SEQ ID NO: 6558872 - DNA, 18 bp, Homo sapiens
ttacccactgtcaggcct

SEQ ID NO: 6558873 - DNA, 20 bp, Homo sapiens
ttacccagacaactctagaa

SEQ ID NO: 6558874 - DNA, 21 bp, Homo sapiens
ttacccagagatatctatgaa

SEQ ID NO: 6558875 - DNA, 20 bp, Homo sapiens
ttacccagattgtgtacata

SEQ ID NO: 6558876 - DNA, 20 bp, Homo sapiens
ttacccagggtggagtgcag

SEQ ID NO: 6558877 - DNA, 21 bp, Homo sapiens
ttacccagtgggacagaggag

SEQ ID NO: 6558878 - DNA, 13 bp, Homo sapiens
ttacccatatccc

SEQ ID NO: 6558879 - DNA, 20 bp, Homo sapiens
ttacccatcttgcttccaag

SEQ ID NO: 6558880 - DNA, 13 bp, Homo sapiens
ttacccatgaaaa

SEQ ID NO: 6558881 - DNA, 19 bp, Homo sapiens
ttacccatttgttcatatt

SEQ ID NO: 6558882 - DNA, 19 bp, Homo sapiens
ttaccccaaagagaaagag

SEQ ID NO: 6558883 - DNA, 11 bp, Homo sapiens
ttaccccatac

SEQ ID NO: 6558884 - DNA, 21 bp, Homo sapiens
ttaccccatggctgcacagtt

SEQ ID NO: 6558885 - DNA, 13 bp, Homo sapiens
ttaccccgggaga

SEQ ID NO: 6558886 - DNA, 13 bp, Homo sapiens
ttacccctcattt

SEQ ID NO: 6558887 - DNA, 18 bp, Homo sapiens
ttacccgaaagcatcact

SEQ ID NO: 6558888 - DNA, 17 bp, Homo sapiens
ttacccggtttcttttt

SEQ ID NO: 6558889 - DNA, 12 bp, Homo sapiens
ttaccctaatgt

SEQ ID NO: 6558890 - DNA, 17 bp, Homo sapiens
ttaccctatatctataa

SEQ ID NO: 6558891 - DNA, 22 bp, Homo sapiens
ttaccctcaggcataggcctgg

SEQ ID NO: 6558892 - DNA, 13 bp, Homo sapiens
ttaccctccctgt

SEQ ID NO: 6558893 - DNA, 13 bp, Homo sapiens
ttaccctctcttt

SEQ ID NO: 6558894 - DNA, 22 bp, Homo sapiens
ttaccctctgcagaacagtgaa

SEQ ID NO: 6558895 - DNA, 15 bp, Homo sapiens
ttaccctctttgctg

SEQ ID NO: 6558896 - DNA, 17 bp, Homo sapiens
ttaccctgatctggacc

SEQ ID NO: 6558897 - DNA, 22 bp, Homo sapiens
ttaccctgcgattttgcctgtg

SEQ ID NO: 6558898 - DNA, 17 bp, Homo sapiens
ttaccctggcccctctc

SEQ ID NO: 6558899 - DNA, 23 bp, Homo sapiens
ttaccctgtacatatgtaaacat

SEQ ID NO: 6558900 - DNA, 13 bp, Homo sapiens
ttaccctgtgtca

SEQ ID NO: 6558901 - DNA, 19 bp, Homo sapiens
ttaccctgtgtcagagcct

SEQ ID NO: 6558902 - DNA, 12 bp, Homo sapiens
ttacccttagaa

SEQ ID NO: 6558903 - DNA, 13 bp, Homo sapiens
ttacccttagaat

SEQ ID NO: 6558904 - DNA, 21 bp, Homo sapiens
ttacccttcctcatctgtgcc

SEQ ID NO: 6558905 - DNA, 19 bp, Homo sapiens
ttacccttctgtgcccagc

SEQ ID NO: 6558906 - DNA, 20 bp, Homo sapiens
ttacccttgagccctcccca

SEQ ID NO: 6558907 - DNA, 13 bp, Homo sapiens
ttaccctttagac

SEQ ID NO: 6558908 - DNA, 14 bp, Homo sapiens
ttaccctttctttt

SEQ ID NO: 6558909 - DNA, 16 bp, Homo sapiens
ttaccgagagccaaac

SEQ ID NO: 6558910 - DNA, 23 bp, Homo sapiens
ttaccgaggacagcctgcctctg

SEQ ID NO: 6558911 - DNA, 17 bp, Homo sapiens
ttaccgagtatctgtaa

SEQ ID NO: 6558912 - DNA, 20 bp, Homo sapiens
ttaccgagtatctgtaaccc

SEQ ID NO: 6558913 - DNA, 21 bp, Homo sapiens
ttaccgtgagtgacatagcct

SEQ ID NO: 6558914 - DNA, 14 bp, Homo sapiens
ttaccgtttcttcc

SEQ ID NO: 6558915 - DNA, 11 bp, Homo sapiens
ttacctaaaga

SEQ ID NO: 6558916 - DNA, 16 bp, Homo sapiens
ttacctaacaatgttt

SEQ ID NO: 6558917 - DNA, 18 bp, Homo sapiens
ttacctaagattacaaat

SEQ ID NO: 6558918 - DNA, 17 bp, Homo sapiens
ttacctaatttcatttt

SEQ ID NO: 6558919 - DNA, 17 bp, Homo sapiens
ttacctaccacagtgtc

SEQ ID NO: 6558920 - DNA, 21 bp, Homo sapiens
tttcaattgcagatgccaaaa

SEQ ID NO: 6558921 - DNA, 18 bp, Homo sapiens
tttcaattgcatctccca

SEQ ID NO: 6558922 - DNA, 12 bp, Homo sapiens
tttcaattgctt

SEQ ID NO: 6558923 - DNA, 14 bp, Homo sapiens
tttcaattgctttg

SEQ ID NO: 6558924 - DNA, 22 bp, Homo sapiens
tttcaattgctttgtgacttct

SEQ ID NO: 6558925 - DNA, 14 bp, Homo sapiens
tttcaattgtattt

SEQ ID NO: 6558926 - DNA, 16 bp, Homo sapiens
tttcaattttaaacat

SEQ ID NO: 6558927 - DNA, 22 bp, Homo sapiens
tttcacaaacagaaaacatgta

SEQ ID NO: 6558928 - DNA, 12 bp, Homo sapiens
tttcacaaataa

SEQ ID NO: 6558929 - DNA, 20 bp, Homo sapiens
tttcacaaatagttgtaaat

SEQ ID NO: 6558930 - DNA, 16 bp, Homo sapiens
tttcacaaatattaaa

SEQ ID NO: 6558931 - DNA, 22 bp, Homo sapiens
tttcacaaatattaaaaagtct

SEQ ID NO: 6558932 - DNA, 20 bp, Homo sapiens
tttcacaaatccttcaaaat

SEQ ID NO: 6558933 - DNA, 15 bp, Homo sapiens
tttcacaacatatca

SEQ ID NO: 6558934 - DNA, 12 bp, Homo sapiens
tttcacaagcaa

SEQ ID NO: 6558935 - DNA, 18 bp, Homo sapiens
tttcacaatgtgaaactg

SEQ ID NO: 6558936 - DNA, 19 bp, Homo sapiens
tttcacaatgtgaaactga

SEQ ID NO: 6558937 - DNA, 16 bp, Homo sapiens
tttcacacaaacaagg

SEQ ID NO: 6558938 - DNA, 13 bp, Homo sapiens
tttcacactgata

SEQ ID NO: 6558939 - DNA, 16 bp, Homo sapiens
tttcacactgatacat

SEQ ID NO: 6558940 - DNA, 14 bp, Homo sapiens
tttcacactgtctt

SEQ ID NO: 6558941 - DNA, 13 bp, Homo sapiens
tttcacagaaaac

SEQ ID NO: 6558942 - DNA, 14 bp, Homo sapiens
tttcacagaaaata

SEQ ID NO: 6558943 - DNA, 21 bp, Homo sapiens
tttcacagagtgtgctgctat

SEQ ID NO: 6558944 - DNA, 16 bp, Homo sapiens
tttcacagatgctgtg

SEQ ID NO: 6558945 - DNA, 23 bp, Homo sapiens
tttcacagcaacactctacttga

SEQ ID NO: 6558946 - DNA, 20 bp, Homo sapiens
tttcacagctttgaggaaca

SEQ ID NO: 6558947 - DNA, 18 bp, Homo sapiens
tttcacaggcatcaggaa

SEQ ID NO: 6558948 - DNA, 17 bp, Homo sapiens
tttcacaggtcaataaa

SEQ ID NO: 6558949 - DNA, 20 bp, Homo sapiens
tttcacagtgtctgtaaatc

SEQ ID NO: 6558950 - DNA, 20 bp, Homo sapiens
tttcacagtgtgattttgat

SEQ ID NO: 6558951 - DNA, 13 bp, Homo sapiens
tttcacagttttt

SEQ ID NO: 6558952 - DNA, 15 bp, Homo sapiens
tttcacagtttttcc

SEQ ID NO: 6558953 - DNA, 21 bp, Homo sapiens
tttcacataaatgcagcccat

SEQ ID NO: 6558954 - DNA, 14 bp, Homo sapiens
tttcacataagcca

SEQ ID NO: 6558955 - DNA, 22 bp, Homo sapiens
tttcacataagcccaaactgat

SEQ ID NO: 6558956 - DNA, 19 bp, Homo sapiens
tttcacataagttatttgt

SEQ ID NO: 6558957 - DNA, 14 bp, Homo sapiens
tttcacatagatgt

SEQ ID NO: 6558958 - DNA, 14 bp, Homo sapiens
tttcacatatttgt

SEQ ID NO: 6558959 - DNA, 18 bp, Homo sapiens
tttcacatatttgtagct

SEQ ID NO: 6558960 - DNA, 15 bp, Homo sapiens
tttcacatctgtata

SEQ ID NO: 6558961 - DNA, 19 bp, Homo sapiens
tttcacatggactttggaa

SEQ ID NO: 6558962 - DNA, 23 bp, Homo sapiens
tttcacatggactttggaaaata

SEQ ID NO: 6558963 - DNA, 17 bp, Homo sapiens
tttcacattaggctgtt

SEQ ID NO: 6558964 - DNA, 13 bp, Homo sapiens
tttcacattggaa

SEQ ID NO: 6558965 - DNA, 20 bp, Homo sapiens
tttcaccagaatttctaaga

SEQ ID NO: 6558966 - DNA, 15 bp, Homo sapiens
tttcaccaggttaaa

SEQ ID NO: 6558967 - DNA, 11 bp, Homo sapiens
tttcaccattt

SEQ ID NO: 6558968 - DNA, 17 bp, Homo sapiens
tttcacccacagaaaga

SEQ ID NO: 6558969 - DNA, 18 bp, Homo sapiens
tttcacccacagaaagag

SEQ ID NO: 6558970 - DNA, 20 bp, Homo sapiens
tttcacccacagaaagagag

SEQ ID NO: 6558971 - DNA, 12 bp, Homo sapiens
tttcacccatcc

SEQ ID NO: 6558972 - DNA, 13 bp, Homo sapiens
tttcacccctccc

SEQ ID NO: 6558973 - DNA, 15 bp, Homo sapiens
tttcacccctccctt

SEQ ID NO: 6558974 - DNA, 18 bp, Homo sapiens
tttcacccctccctttct

SEQ ID NO: 6558975 - DNA, 20 bp, Homo sapiens
tttcacccctccctttctcc

SEQ ID NO: 6558976 - DNA, 16 bp, Homo sapiens
tttcacccctcttccc

SEQ ID NO: 6558977 - DNA, 17 bp, Homo sapiens
tttcacccctcttccca

SEQ ID NO: 6558978 - DNA, 21 bp, Homo sapiens
tttcaccctgccaccctctgc

SEQ ID NO: 6558979 - DNA, 21 bp, Homo sapiens
tttcacccttaacccaaggag

SEQ ID NO: 6558980 - DNA, 16 bp, Homo sapiens
tttcacctactttgta

SEQ ID NO: 6558981 - DNA, 11 bp, Homo sapiens
tttcacctccg

SEQ ID NO: 6558982 - DNA, 21 bp, Homo sapiens
tttcacctccttcaattccat

SEQ ID NO: 6558983 - DNA, 15 bp, Homo sapiens
tttcacctgaaatgc

SEQ ID NO: 6558984 - DNA, 15 bp, Homo sapiens
tttcacctgctgctt

SEQ ID NO: 6558985 - DNA, 23 bp, Homo sapiens
tttcacctgtttttaagctgttt

SEQ ID NO: 6558986 - DNA, 13 bp, Homo sapiens
tttcaccttccct

SEQ ID NO: 6558987 - DNA, 14 bp, Homo sapiens
tttcacggaagttt

SEQ ID NO: 6558988 - DNA, 19 bp, Homo sapiens
tttcacgtaaatattcata

SEQ ID NO: 6558989 - DNA, 22 bp, Homo sapiens
tttcacgtaaatattcatatta

SEQ ID NO: 6558990 - DNA, 13 bp, Homo sapiens
tttcactaagctc

SEQ ID NO: 6558991 - DNA, 16 bp, Homo sapiens
tttcactactcagcat

SEQ ID NO: 6558992 - DNA, 21 bp, Homo sapiens
tttcactagagacaaatcttt

SEQ ID NO: 6558993 - DNA, 21 bp, Homo sapiens
tttcactatcttcttcaaata

SEQ ID NO: 6558994 - DNA, 16 bp, Homo sapiens
tttcactattcctatg

SEQ ID NO: 6558995 - DNA, 16 bp, Homo sapiens
tttcactatttccttt

SEQ ID NO: 6558996 - DNA, 12 bp, Homo sapiens
tttcactcacat

SEQ ID NO: 6558997 - DNA, 23 bp, Homo sapiens
tttcactcagggtgataaatcag

SEQ ID NO: 6558998 - DNA, 17 bp, Homo sapiens
tttcactccctccatca

SEQ ID NO: 6558999 - DNA, 14 bp, Homo sapiens
tttcactccctctt

SEQ ID NO: 6559000 - DNA, 23 bp, Homo sapiens
tttcactccggagtgagaagctt

SEQ ID NO: 6559001 - DNA, 19 bp, Homo sapiens
tttcactctaagtcatgta

SEQ ID NO: 6559002 - DNA, 20 bp, Homo sapiens
tttcactctaagtcatgtat

SEQ ID NO: 6559003 - DNA, 23 bp, Homo sapiens
tttcactctaagtcatgtatgtt

SEQ ID NO: 6559004 - DNA, 21 bp, Homo sapiens
tttcactgaagtgaatacatg

SEQ ID NO: 6559005 - DNA, 13 bp, Homo sapiens
tttcactgccata

SEQ ID NO: 6559006 - DNA, 10 bp, Homo sapiens
tttcactgct

SEQ ID NO: 6559007 - DNA, 20 bp, Homo sapiens
tttcactgctggctgcctta

SEQ ID NO: 6559008 - DNA, 22 bp, Homo sapiens
tttcactgctggctgccttaga

SEQ ID NO: 6559009 - DNA, 12 bp, Homo sapiens
tttcactgggga

SEQ ID NO: 6559010 - DNA, 12 bp, Homo sapiens
tttcactgtact

SEQ ID NO: 6559011 - DNA, 13 bp, Homo sapiens
tttcactgtactg

SEQ ID NO: 6559012 - DNA, 17 bp, Homo sapiens
tttcactgtagctctaa

SEQ ID NO: 6559013 - DNA, 22 bp, Homo sapiens
tttcactgtgttggccaggctg

SEQ ID NO: 6559014 - DNA, 16 bp, Homo sapiens
tttcacttaatgtttc

SEQ ID NO: 6559015 - DNA, 22 bp, Homo sapiens
tttcacttcaagggagaatata

SEQ ID NO: 6559016 - DNA, 21 bp, Homo sapiens
tttcacttctccaacaagtac

SEQ ID NO: 6559017 - DNA, 16 bp, Homo sapiens
tttcacttctttccct

SEQ ID NO: 6559018 - DNA, 23 bp, Homo sapiens
tttcacttgaaagattttattgt

SEQ ID NO: 6559019 - DNA, 19 bp, Homo sapiens
tttcacttgatgtttgtta

SEQ ID NO: 6559020 - DNA, 11 bp, Homo sapiens
tttcacttgta

SEQ ID NO: 6559021 - DNA, 14 bp, Homo sapiens
tttcacttgtattg

SEQ ID NO: 6559022 - DNA, 19 bp, Homo sapiens
tttcacttgtcttgctctt

SEQ ID NO: 6559023 - DNA, 17 bp, Homo sapiens
tttcactttagatgctg

SEQ ID NO: 6559024 - DNA, 13 bp, Homo sapiens
tttcactttagct

SEQ ID NO: 6559025 - DNA, 16 bp, Homo sapiens
tttcactttagctatg

SEQ ID NO: 6559026 - DNA, 20 bp, Homo sapiens
tttcactttagctatgtgga

SEQ ID NO: 6559027 - DNA, 21 bp, Homo sapiens
tttcactttcacatagatgtc

SEQ ID NO: 6559028 - DNA, 18 bp, Homo sapiens
tttcactttctgtctagg

SEQ ID NO: 6559029 - DNA, 13 bp, Homo sapiens
tttcactttgaaa

SEQ ID NO: 6559030 - DNA, 17 bp, Homo sapiens
tttcacttttagttggc

SEQ ID NO: 6559031 - DNA, 23 bp, Homo sapiens
tttcacttttagttggcatttgt

SEQ ID NO: 6559032 - DNA, 22 bp, Homo sapiens
tttcacttttgttgcccaggct

SEQ ID NO: 6559033 - DNA, 13 bp, Homo sapiens
tttcagaaaacag

SEQ ID NO: 6559034 - DNA, 23 bp, Homo sapiens
tttcagaaaacataatatagctt

SEQ ID NO: 6559035 - DNA, 16 bp, Homo sapiens
tttcagaaacagggca

SEQ ID NO: 6559036 - DNA, 15 bp, Homo sapiens
tttcagaaagccttt

SEQ ID NO: 6559037 - DNA, 22 bp, Homo sapiens
tttcagaaagggcagcccctcc

SEQ ID NO: 6559038 - DNA, 17 bp, Homo sapiens
tttcagaaataaaagta

SEQ ID NO: 6559039 - DNA, 19 bp, Homo sapiens
tttcagaaataaaagtatg

SEQ ID NO: 6559040 - DNA, 23 bp, Homo sapiens
tttcagaaataaaatgaaatgtc

SEQ ID NO: 6559041 - DNA, 23 bp, Homo sapiens
tttcagaaattccaactcctgat

SEQ ID NO: 6559042 - DNA, 14 bp, Homo sapiens
tttcagaactcaca

SEQ ID NO: 6559043 - DNA, 21 bp, Homo sapiens
tttcagaagaaaggcattgca

SEQ ID NO: 6559044 - DNA, 16 bp, Homo sapiens
tttcagaagaaataaa

SEQ ID NO: 6559045 - DNA, 21 bp, Homo sapiens
tttcagaagaaataaatatac

SEQ ID NO: 6559046 - DNA, 17 bp, Homo sapiens
tttcagaagcaggcagg

SEQ ID NO: 6559047 - DNA, 16 bp, Homo sapiens
tttcagaagttagttt

SEQ ID NO: 6559048 - DNA, 22 bp, Homo sapiens
tttcagaagttagtttgtatat

SEQ ID NO: 6559049 - DNA, 23 bp, Homo sapiens
tttcagaagttagtttgtatata

SEQ ID NO: 6559050 - DNA, 13 bp, Homo sapiens
tttcagaataaaa

SEQ ID NO: 6559051 - DNA, 14 bp, Homo sapiens
tttcagaataaaat

SEQ ID NO: 6559052 - DNA, 19 bp, Homo sapiens
tttcagaatacaattcagt

SEQ ID NO: 6559053 - DNA, 14 bp, Homo sapiens
tttcagaatatttt

SEQ ID NO: 6559054 - DNA, 14 bp, Homo sapiens
tttcagaatctgaa

SEQ ID NO: 6559055 - DNA, 17 bp, Homo sapiens
tttcagaatctgaatgt

SEQ ID NO: 6559056 - DNA, 16 bp, Homo sapiens
tttcagaatgttgaag

SEQ ID NO: 6559057 - DNA, 20 bp, Homo sapiens
tttcagacagggtctgaagg

SEQ ID NO: 6559058 - DNA, 22 bp, Homo sapiens
tttcagacatatccaaagggaa

SEQ ID NO: 6559059 - DNA, 12 bp, Homo sapiens
tttcagacattt

SEQ ID NO: 6559060 - DNA, 10 bp, Homo sapiens
tttcagaccc

SEQ ID NO: 6559061 - DNA, 21 bp, Homo sapiens
tttcagacctttgtctgaagg

SEQ ID NO: 6559062 - DNA, 11 bp, Homo sapiens
tttcagactcc

SEQ ID NO: 6559063 - DNA, 20 bp, Homo sapiens
tttcagactgcctgtctgct

SEQ ID NO: 6559064 - DNA, 13 bp, Homo sapiens
tttcagactgctt

SEQ ID NO: 6559065 - DNA, 15 bp, Homo sapiens
tttcagacttgtcaa

SEQ ID NO: 6559066 - DNA, 16 bp, Homo sapiens
tttcagagaaaggact

SEQ ID NO: 6559067 - DNA, 19 bp, Homo sapiens
tttcagagacaacttccca

SEQ ID NO: 6559068 - DNA, 16 bp, Homo sapiens
tttcagagaccattgc

SEQ ID NO: 6559069 - DNA, 14 bp, Homo sapiens
tttcagagagtcaa

SEQ ID NO: 6559070 - DNA, 15 bp, Homo sapiens
tttcagagcaggagg

SEQ ID NO: 6559071 - DNA, 16 bp, Homo sapiens
tttcagagcaggaggc

SEQ ID NO: 6559072 - DNA, 19 bp, Homo sapiens
tttcagagcccccagccct

SEQ ID NO: 6559073 - DNA, 20 bp, Homo sapiens
tttcagagccctcggagcca

SEQ ID NO: 6559074 - DNA, 14 bp, Homo sapiens
tttcagagctgagg

SEQ ID NO: 6559075 - DNA, 20 bp, Homo sapiens
tttcagagggtaagtaaaca

SEQ ID NO: 6559076 - DNA, 18 bp, Homo sapiens
tttcagaggtgaattaat

SEQ ID NO: 6559077 - DNA, 23 bp, Homo sapiens
tttcagagtgacacccaagaggg

SEQ ID NO: 6559078 - DNA, 22 bp, Homo sapiens
tttcagagtgactacacacagt

SEQ ID NO: 6559079 - DNA, 22 bp, Homo sapiens
tttcagagttctttttgaagta

SEQ ID NO: 6559080 - DNA, 14 bp, Homo sapiens
tttcagagttttac

SEQ ID NO: 6559081 - DNA, 16 bp, Homo sapiens
tttcagataaatcatg

SEQ ID NO: 6559082 - DNA, 16 bp, Homo sapiens
tttcagataaatttca

SEQ ID NO: 6559083 - DNA, 21 bp, Homo sapiens
tttcagatactggattgtact

SEQ ID NO: 6559084 - DNA, 18 bp, Homo sapiens
tttcagatataaaagact

SEQ ID NO: 6559085 - DNA, 15 bp, Homo sapiens
tttcagatatcaaaa

SEQ ID NO: 6559086 - DNA, 17 bp, Homo sapiens
tttcagatatcaaaatt

SEQ ID NO: 6559087 - DNA, 18 bp, Homo sapiens
tttcagatatcaaaattc

SEQ ID NO: 6559088 - DNA, 15 bp, Homo sapiens
tttcagatcatttag

SEQ ID NO: 6559089 - DNA, 22 bp, Homo sapiens
tttcagatgaaaagaaaactta

SEQ ID NO: 6559090 - DNA, 23 bp, Homo sapiens
tttcagatgaaaagaaaacttaa

SEQ ID NO: 6559091 - DNA, 14 bp, Homo sapiens
tttcagatgcttct

SEQ ID NO: 6559092 - DNA, 16 bp, Homo sapiens
tttcagatgtaatgtt

SEQ ID NO: 6559093 - DNA, 17 bp, Homo sapiens
tttcagatgtaatgttt

SEQ ID NO: 6559094 - DNA, 11 bp, Homo sapiens
tttcagatgtg

SEQ ID NO: 6559095 - DNA, 17 bp, Homo sapiens
tttcagatgtgcaataa

SEQ ID NO: 6559096 - DNA, 21 bp, Homo sapiens
tttcagattggggtgttagaa

SEQ ID NO: 6559097 - DNA, 21 bp, Homo sapiens
tttcagattgtggaatgttgg

SEQ ID NO: 6559098 - DNA, 16 bp, Homo sapiens
tttcagatttgcacaa

SEQ ID NO: 6559099 - DNA, 18 bp, Homo sapiens
ttacctaccacagtgtct

SEQ ID NO: 6559100 - DNA, 23 bp, Homo sapiens
ttacctactttgactttttgcat

SEQ ID NO: 6559101 - DNA, 15 bp, Homo sapiens
ttacctagtgaaact

SEQ ID NO: 6559102 - DNA, 21 bp, Homo sapiens
ttacctagtgaaacttttcta

SEQ ID NO: 6559103 - DNA, 13 bp, Homo sapiens
ttacctagtgttt

SEQ ID NO: 6559104 - DNA, 18 bp, Homo sapiens
ttacctatacctatgtga

SEQ ID NO: 6559105 - DNA, 19 bp, Homo sapiens
ttacctattaggtggaaat

SEQ ID NO: 6559106 - DNA, 14 bp, Homo sapiens
ttacctattctgaa

SEQ ID NO: 6559107 - DNA, 17 bp, Homo sapiens
ttacctattgctgtaaa

SEQ ID NO: 6559108 - DNA, 12 bp, Homo sapiens
ttacctcagcct

SEQ ID NO: 6559109 - DNA, 13 bp, Homo sapiens
ttacctcagcctg

SEQ ID NO: 6559110 - DNA, 14 bp, Homo sapiens
ttacctcagcctgg

SEQ ID NO: 6559111 - DNA, 15 bp, Homo sapiens
ttacctcagcctggg

SEQ ID NO: 6559112 - DNA, 18 bp, Homo sapiens
ttacctcagcctgggcgc

SEQ ID NO: 6559113 - DNA, 14 bp, Homo sapiens
ttacctcaggtgtg

SEQ ID NO: 6559114 - DNA, 19 bp, Homo sapiens
ttacctcaggtgtgcctgt

SEQ ID NO: 6559115 - DNA, 15 bp, Homo sapiens
ttacctcatccatgc

SEQ ID NO: 6559116 - DNA, 18 bp, Homo sapiens
ttacctccaacagaacta

SEQ ID NO: 6559117 - DNA, 13 bp, Homo sapiens
ttacctccatcca

SEQ ID NO: 6559118 - DNA, 14 bp, Homo sapiens
ttacctccatccat

SEQ ID NO: 6559119 - DNA, 15 bp, Homo sapiens
ttacctcccctgcca

SEQ ID NO: 6559120 - DNA, 17 bp, Homo sapiens
ttacctcccctgccagg

SEQ ID NO: 6559121 - DNA, 22 bp, Homo sapiens
ttacctcccctgccagggctcg

SEQ ID NO: 6559122 - DNA, 23 bp, Homo sapiens
ttacctcggggagagggggaggt

SEQ ID NO: 6559123 - DNA, 14 bp, Homo sapiens
ttacctctaaattt

SEQ ID NO: 6559124 - DNA, 14 bp, Homo sapiens
ttacctctctctgg

SEQ ID NO: 6559125 - DNA, 21 bp, Homo sapiens
ttacctctgatacctcaaccc

SEQ ID NO: 6559126 - DNA, 23 bp, Homo sapiens
ttacctctggaaccccccaggcc

SEQ ID NO: 6559127 - DNA, 13 bp, Homo sapiens
ttacctctttgga

SEQ ID NO: 6559128 - DNA, 20 bp, Homo sapiens
ttacctgaaaacactgtgca

SEQ ID NO: 6559129 - DNA, 22 bp, Homo sapiens
ttacctgaaggggttttcttga

SEQ ID NO: 6559130 - DNA, 17 bp, Homo sapiens
ttacctgacctcttgct

SEQ ID NO: 6559131 - DNA, 19 bp, Homo sapiens
ttacctgatcaatgacaga

SEQ ID NO: 6559132 - DNA, 12 bp, Homo sapiens
ttacctgccaat

SEQ ID NO: 6559133 - DNA, 15 bp, Homo sapiens
ttacctgccacttcc

SEQ ID NO: 6559134 - DNA, 13 bp, Homo sapiens
ttacctgccgccc

SEQ ID NO: 6559135 - DNA, 15 bp, Homo sapiens
ttacctgctgcttct

SEQ ID NO: 6559136 - DNA, 16 bp, Homo sapiens
ttacctgcttctggtt

SEQ ID NO: 6559137 - DNA, 11 bp, Homo sapiens
ttacctggaaa

SEQ ID NO: 6559138 - DNA, 12 bp, Homo sapiens
ttacctggaaaa

SEQ ID NO: 6559139 - DNA, 21 bp, Homo sapiens
ttacctggaatgtattttaac

SEQ ID NO: 6559140 - DNA, 11 bp, Homo sapiens
ttacctggaga

SEQ ID NO: 6559141 - DNA, 16 bp, Homo sapiens
ttacctggatgccatt

SEQ ID NO: 6559142 - DNA, 12 bp, Homo sapiens
ttacctggccta

SEQ ID NO: 6559143 - DNA, 17 bp, Homo sapiens
ttacctggcctagaaag

SEQ ID NO: 6559144 - DNA, 21 bp, Homo sapiens
ttacctggcttatttaatatg

SEQ ID NO: 6559145 - DNA, 18 bp, Homo sapiens
ttacctgggcattcttgt

SEQ ID NO: 6559146 - DNA, 22 bp, Homo sapiens
ttacctggtgagtaacttagaa

SEQ ID NO: 6559147 - DNA, 20 bp, Homo sapiens
ttacctgtaacctaccttat

SEQ ID NO: 6559148 - DNA, 19 bp, Homo sapiens
ttacctgtaatagcctcac

SEQ ID NO: 6559149 - DNA, 20 bp, Homo sapiens
ttacctgtaatagcctcacc

SEQ ID NO: 6559150 - DNA, 21 bp, Homo sapiens
ttacctgtaatagcctcacct

SEQ ID NO: 6559151 - DNA, 18 bp, Homo sapiens
ttacctgtatacagtgca

SEQ ID NO: 6559152 - DNA, 20 bp, Homo sapiens
ttacctgtcattttgcactg

SEQ ID NO: 6559153 - DNA, 15 bp, Homo sapiens
ttacctgtctctctc

SEQ ID NO: 6559154 - DNA, 19 bp, Homo sapiens
ttacctgtgaagtgttact

SEQ ID NO: 6559155 - DNA, 12 bp, Homo sapiens
ttacctgtgaca

SEQ ID NO: 6559156 - DNA, 13 bp, Homo sapiens
ttacctgtggata

SEQ ID NO: 6559157 - DNA, 20 bp, Homo sapiens
ttacctgtggatatttgtat

SEQ ID NO: 6559158 - DNA, 18 bp, Homo sapiens
ttacctgttccattgttg

SEQ ID NO: 6559159 - DNA, 22 bp, Homo sapiens
ttacctgttttcgcacctacca

SEQ ID NO: 6559160 - DNA, 23 bp, Homo sapiens
ttacctgttttcgcacctaccat

SEQ ID NO: 6559161 - DNA, 15 bp, Homo sapiens
ttaccttaaaaagta

SEQ ID NO: 6559162 - DNA, 14 bp, Homo sapiens
ttaccttacagaag

SEQ ID NO: 6559163 - DNA, 21 bp, Homo sapiens
ttaccttagattagctctgga

SEQ ID NO: 6559164 - DNA, 15 bp, Homo sapiens
ttaccttattgcact

SEQ ID NO: 6559165 - DNA, 20 bp, Homo sapiens
ttaccttattggatatttga

SEQ ID NO: 6559166 - DNA, 16 bp, Homo sapiens
ttaccttcaataaagt

SEQ ID NO: 6559167 - DNA, 17 bp, Homo sapiens
ttaccttcaataaagta

SEQ ID NO: 6559168 - DNA, 23 bp, Homo sapiens
ttaccttcacatgtcctattact

SEQ ID NO: 6559169 - DNA, 20 bp, Homo sapiens
ttaccttcatttcatcctgt

SEQ ID NO: 6559170 - DNA, 12 bp, Homo sapiens
ttaccttcctga

SEQ ID NO: 6559171 - DNA, 18 bp, Homo sapiens
ttaccttctttctaatac

SEQ ID NO: 6559172 - DNA, 12 bp, Homo sapiens
ttaccttgaaaa

SEQ ID NO: 6559173 - DNA, 15 bp, Homo sapiens
ttaccttgaaatgct

SEQ ID NO: 6559174 - DNA, 16 bp, Homo sapiens
ttaccttgtatactgt

SEQ ID NO: 6559175 - DNA, 16 bp, Homo sapiens
ttaccttgtcattttg

SEQ ID NO: 6559176 - DNA, 16 bp, Homo sapiens
ttaccttgttttctct

SEQ ID NO: 6559177 - DNA, 15 bp, Homo sapiens
ttacctttaaaatca

SEQ ID NO: 6559178 - DNA, 13 bp, Homo sapiens
ttacctttaatgc

SEQ ID NO: 6559179 - DNA, 19 bp, Homo sapiens
ttacctttatctttcacct

SEQ ID NO: 6559180 - DNA, 18 bp, Homo sapiens
ttacctttattaatgaac

SEQ ID NO: 6559181 - DNA, 12 bp, Homo sapiens
ttacctttcctg

SEQ ID NO: 6559182 - DNA, 14 bp, Homo sapiens
ttacctttctctct

SEQ ID NO: 6559183 - DNA, 15 bp, Homo sapiens
ttacctttgctgtca

SEQ ID NO: 6559184 - DNA, 17 bp, Homo sapiens
ttacctttgctgtcact

SEQ ID NO: 6559185 - DNA, 22 bp, Homo sapiens
ttaccttttaaaatagtaattt

SEQ ID NO: 6559186 - DNA, 19 bp, Homo sapiens
ttaccttttcctattctgt

SEQ ID NO: 6559187 - DNA, 20 bp, Homo sapiens
ttacctttttgtatgtgaac

SEQ ID NO: 6559188 - DNA, 15 bp, Homo sapiens
ttaccttttttgata

SEQ ID NO: 6559189 - DNA, 16 bp, Homo sapiens
ttacgacccaggacaa

SEQ ID NO: 6559190 - DNA, 13 bp, Homo sapiens
ttacgactgaaga

SEQ ID NO: 6559191 - DNA, 16 bp, Homo sapiens
ttacgatgtaaatttt

SEQ ID NO: 6559192 - DNA, 15 bp, Homo sapiens
ttacgcaaggaagga

SEQ ID NO: 6559193 - DNA, 16 bp, Homo sapiens
ttacgcaaggaaggac

SEQ ID NO: 6559194 - DNA, 20 bp, Homo sapiens
ttacgcacacgtacttaaat

SEQ ID NO: 6559195 - DNA, 20 bp, Homo sapiens
ttacgccctgttcccttcct

SEQ ID NO: 6559196 - DNA, 22 bp, Homo sapiens
ttacgcctataatcccagcatt

SEQ ID NO: 6559197 - DNA, 13 bp, Homo sapiens
ttacgctctctgt

SEQ ID NO: 6559198 - DNA, 14 bp, Homo sapiens
ttacgctctctgtc

SEQ ID NO: 6559199 - DNA, 16 bp, Homo sapiens
ttacgctgctctcctg

SEQ ID NO: 6559200 - DNA, 20 bp, Homo sapiens
ttacggagggaggacatcat

SEQ ID NO: 6559201 - DNA, 21 bp, Homo sapiens
ttacggagggaggacatcata

SEQ ID NO: 6559202 - DNA, 17 bp, Homo sapiens
ttacggcatcacactta

SEQ ID NO: 6559203 - DNA, 18 bp, Homo sapiens
ttacggccctggccttgg

SEQ ID NO: 6559204 - DNA, 14 bp, Homo sapiens
ttacggctcctctc

SEQ ID NO: 6559205 - DNA, 16 bp, Homo sapiens
ttacggtagttaggat

SEQ ID NO: 6559206 - DNA, 14 bp, Homo sapiens
ttacggtgtacagt

SEQ ID NO: 6559207 - DNA, 14 bp, Homo sapiens
ttacgtactgtaac

SEQ ID NO: 6559208 - DNA, 21 bp, Homo sapiens
ttacgtactgtaactgctcag

SEQ ID NO: 6559209 - DNA, 19 bp, Homo sapiens
ttacgtatgcaagtctgtg

SEQ ID NO: 6559210 - DNA, 17 bp, Homo sapiens
ttacgtcttgagaaata

SEQ ID NO: 6559211 - DNA, 13 bp, Homo sapiens
ttacgtgcaaaca

SEQ ID NO: 6559212 - DNA, 19 bp, Homo sapiens
ttacgtgcaaacaacctga

SEQ ID NO: 6559213 - DNA, 15 bp, Homo sapiens
ttacgtgctctgtgg

SEQ ID NO: 6559214 - DNA, 20 bp, Homo sapiens
ttacgtgtaaaggaaaataa

SEQ ID NO: 6559215 - DNA, 15 bp, Homo sapiens
ttacgtgtgcaacag

SEQ ID NO: 6559216 - DNA, 17 bp, Homo sapiens
ttacgtgtttaaaaaaa

SEQ ID NO: 6559217 - DNA, 23 bp, Homo sapiens
ttacgttgcatccacaggattcc

SEQ ID NO: 6559218 - DNA, 19 bp, Homo sapiens
ttacgtttgttattcctag

SEQ ID NO: 6559219 - DNA, 13 bp, Homo sapiens
ttactaaaagatc

SEQ ID NO: 6559220 - DNA, 15 bp, Homo sapiens
ttactaaaatggact

SEQ ID NO: 6559221 - DNA, 16 bp, Homo sapiens
ttactaaaatggactg

SEQ ID NO: 6559222 - DNA, 18 bp, Homo sapiens
ttactaaacatatgattt

SEQ ID NO: 6559223 - DNA, 13 bp, Homo sapiens
ttactaaacattt

SEQ ID NO: 6559224 - DNA, 23 bp, Homo sapiens
ttactaaagaaaatatctgaaat

SEQ ID NO: 6559225 - DNA, 22 bp, Homo sapiens
ttactaaagaaagattacttag

SEQ ID NO: 6559226 - DNA, 22 bp, Homo sapiens
ttactaaagatatcagagctct

SEQ ID NO: 6559227 - DNA, 18 bp, Homo sapiens
ttactaaagcagtgtttt

SEQ ID NO: 6559228 - DNA, 19 bp, Homo sapiens
ttactaaagcagtgttttc

SEQ ID NO: 6559229 - DNA, 18 bp, Homo sapiens
ttactaaatatgggaatg

SEQ ID NO: 6559230 - DNA, 15 bp, Homo sapiens
ttactaaattgtata

SEQ ID NO: 6559231 - DNA, 14 bp, Homo sapiens
ttactaacactggc

SEQ ID NO: 6559232 - DNA, 17 bp, Homo sapiens
ttactaacagtaactgc

SEQ ID NO: 6559233 - DNA, 20 bp, Homo sapiens
ttactaactaaactctcttt

SEQ ID NO: 6559234 - DNA, 21 bp, Homo sapiens
ttactaactctggtttaattt

SEQ ID NO: 6559235 - DNA, 17 bp, Homo sapiens
ttactaacttctaaaac

SEQ ID NO: 6559236 - DNA, 22 bp, Homo sapiens
ttactaagatgaaattgccaaa

SEQ ID NO: 6559237 - DNA, 21 bp, Homo sapiens
ttactaagatgacattgctaa

SEQ ID NO: 6559238 - DNA, 21 bp, Homo sapiens
ttactaagcatagcaaacaga

SEQ ID NO: 6559239 - DNA, 20 bp, Homo sapiens
ttactaagccacaagaaatt

SEQ ID NO: 6559240 - DNA, 20 bp, Homo sapiens
ttactaaggaagattactca

SEQ ID NO: 6559241 - DNA, 18 bp, Homo sapiens
ttactaaggaaggacaca

SEQ ID NO: 6559242 - DNA, 21 bp, Homo sapiens
ttactaaggcaggtgggcaga

SEQ ID NO: 6559243 - DNA, 23 bp, Homo sapiens
ttactaagtcaggagtgtagttg

SEQ ID NO: 6559244 - DNA, 13 bp, Homo sapiens
ttactaagttttt

SEQ ID NO: 6559245 - DNA, 12 bp, Homo sapiens
ttactaataaaa

SEQ ID NO: 6559246 - DNA, 16 bp, Homo sapiens
ttactaataaaatgtg

SEQ ID NO: 6559247 - DNA, 19 bp, Homo sapiens
ttactaatatatctgtaac

SEQ ID NO: 6559248 - DNA, 21 bp, Homo sapiens
ttactaatgatttagtgttgt

SEQ ID NO: 6559249 - DNA, 15 bp, Homo sapiens
ttactaattattcct

SEQ ID NO: 6559250 - DNA, 18 bp, Homo sapiens
ttactaattctatttctc

SEQ ID NO: 6559251 - DNA, 19 bp, Homo sapiens
ttactacaatatgtacatt

SEQ ID NO: 6559252 - DNA, 15 bp, Homo sapiens
ttactacagttgttt

SEQ ID NO: 6559253 - DNA, 22 bp, Homo sapiens
ttactacagtttttaactctac

SEQ ID NO: 6559254 - DNA, 22 bp, Homo sapiens
ttactacataattaaattttaa

SEQ ID NO: 6559255 - DNA, 22 bp, Homo sapiens
ttactactattctgttaaaatc

SEQ ID NO: 6559256 - DNA, 21 bp, Homo sapiens
ttactactgattttaaaatga

SEQ ID NO: 6559257 - DNA, 19 bp, Homo sapiens
ttactactgcaagttcaag

SEQ ID NO: 6559258 - DNA, 21 bp, Homo sapiens
ttactacttgttacctttccc

SEQ ID NO: 6559259 - DNA, 14 bp, Homo sapiens
ttactactttaaat

SEQ ID NO: 6559260 - DNA, 21 bp, Homo sapiens
ttactactttgcctcttcagc

SEQ ID NO: 6559261 - DNA, 18 bp, Homo sapiens
ttactagaaatgggaatc

SEQ ID NO: 6559262 - DNA, 13 bp, Homo sapiens
ttactagaacaca

SEQ ID NO: 6559263 - DNA, 20 bp, Homo sapiens
ttactagcacctgccaggga

SEQ ID NO: 6559264 - DNA, 23 bp, Homo sapiens
ttactagggatccctcatctgtc

SEQ ID NO: 6559265 - DNA, 14 bp, Homo sapiens
ttactaggtaactt

SEQ ID NO: 6559266 - DNA, 17 bp, Homo sapiens
ttactaggtaacttcat

SEQ ID NO: 6559267 - DNA, 19 bp, Homo sapiens
ttactaggtaacttcatat

SEQ ID NO: 6559268 - DNA, 18 bp, Homo sapiens
ttactagtatcactgctt

SEQ ID NO: 6559269 - DNA, 18 bp, Homo sapiens
ttactataaaaatcatgt

SEQ ID NO: 6559270 - DNA, 14 bp, Homo sapiens
ttactataaatgaa

SEQ ID NO: 6559271 - DNA, 17 bp, Homo sapiens
ttactatagcaaagtag

SEQ ID NO: 6559272 - DNA, 19 bp, Homo sapiens
ttactatagtggtgagatg

SEQ ID NO: 6559273 - DNA, 19 bp, Homo sapiens
ttactatatagaatttcct

SEQ ID NO: 6559274 - DNA, 14 bp, Homo sapiens
ttactatatatata

SEQ ID NO: 6559275 - DNA, 18 bp, Homo sapiens
ttactatctgttgaaaag

SEQ ID NO: 6559276 - DNA, 21 bp, Homo sapiens
ttactatgcctgttgatctat

SEQ ID NO: 6559277 - DNA, 16 bp, Homo sapiens
ttactatgtaaatgct

SEQ ID NO: 6559278 - DNA, 22 bp, Homo sapiens
tttcagatttgcacaaaaagat

SEQ ID NO: 6559279 - DNA, 14 bp, Homo sapiens
tttcagattttaaa

SEQ ID NO: 6559280 - DNA, 16 bp, Homo sapiens
tttcagattttaaaaa

SEQ ID NO: 6559281 - DNA, 20 bp, Homo sapiens
tttcagattttttatttgaa

SEQ ID NO: 6559282 - DNA, 20 bp, Homo sapiens
tttcagcaacaaccatctca

SEQ ID NO: 6559283 - DNA, 21 bp, Homo sapiens
tttcagcacccccacccacct

SEQ ID NO: 6559284 - DNA, 22 bp, Homo sapiens
tttcagcactagccaaacctca

SEQ ID NO: 6559285 - DNA, 15 bp, Homo sapiens
tttcagcactgatgg

SEQ ID NO: 6559286 - DNA, 22 bp, Homo sapiens
tttcagcacttaactactttgt

SEQ ID NO: 6559287 - DNA, 14 bp, Homo sapiens
tttcagcaggcagc

SEQ ID NO: 6559288 - DNA, 20 bp, Homo sapiens
tttcagcagtctaaattttc

SEQ ID NO: 6559289 - DNA, 20 bp, Homo sapiens
tttcagcataaatgggaact

SEQ ID NO: 6559290 - DNA, 20 bp, Homo sapiens
tttcagcatcaaacatgaaa

SEQ ID NO: 6559291 - DNA, 22 bp, Homo sapiens
tttcagcatcaaacatgaaaac

SEQ ID NO: 6559292 - DNA, 18 bp, Homo sapiens
tttcagcatgaaaatgtg

SEQ ID NO: 6559293 - DNA, 23 bp, Homo sapiens
tttcagcatggactgttcatttg

SEQ ID NO: 6559294 - DNA, 15 bp, Homo sapiens
tttcagcattcagtc

SEQ ID NO: 6559295 - DNA, 22 bp, Homo sapiens
tttcagcattcccaattatcaa

SEQ ID NO: 6559296 - DNA, 15 bp, Homo sapiens
tttcagccaagaatt

SEQ ID NO: 6559297 - DNA, 16 bp, Homo sapiens
tttcagccaagaattc

SEQ ID NO: 6559298 - DNA, 17 bp, Homo sapiens
tttcagccaagaattct

SEQ ID NO: 6559299 - DNA, 18 bp, Homo sapiens
tttcagccaaggggctgc

SEQ ID NO: 6559300 - DNA, 15 bp, Homo sapiens
tttcagccaatttgt

SEQ ID NO: 6559301 - DNA, 20 bp, Homo sapiens
tttcagccaatttgtctcct

SEQ ID NO: 6559302 - DNA, 23 bp, Homo sapiens
tttcagccaatttgtctcctact

SEQ ID NO: 6559303 - DNA, 12 bp, Homo sapiens
tttcagccacat

SEQ ID NO: 6559304 - DNA, 14 bp, Homo sapiens
tttcagcctaagag

SEQ ID NO: 6559305 - DNA, 11 bp, Homo sapiens
tttcagcctcc

SEQ ID NO: 6559306 - DNA, 21 bp, Homo sapiens
tttcagcctgcttcttcccca

SEQ ID NO: 6559307 - DNA, 17 bp, Homo sapiens
tttcagcgatgtatgca

SEQ ID NO: 6559308 - DNA, 21 bp, Homo sapiens
tttcagcgatgtatgcagcta

SEQ ID NO: 6559309 - DNA, 20 bp, Homo sapiens
tttcagctaagggaagacat

SEQ ID NO: 6559310 - DNA, 19 bp, Homo sapiens
tttcagctaggaacaaatc

SEQ ID NO: 6559311 - DNA, 19 bp, Homo sapiens
tttcagctagttaataatt

SEQ ID NO: 6559312 - DNA, 13 bp, Homo sapiens
tttcagctagttt

SEQ ID NO: 6559313 - DNA, 16 bp, Homo sapiens
tttcagctatcagtag

SEQ ID NO: 6559314 - DNA, 17 bp, Homo sapiens
tttcagctatgcagaaa

SEQ ID NO: 6559315 - DNA, 21 bp, Homo sapiens
tttcagctattagcaactgtg

SEQ ID NO: 6559316 - DNA, 23 bp, Homo sapiens
tttcagctattagcaactgtgct

SEQ ID NO: 6559317 - DNA, 17 bp, Homo sapiens
tttcagctcccttccct

SEQ ID NO: 6559318 - DNA, 21 bp, Homo sapiens
tttcagctcctgaccagttgc

SEQ ID NO: 6559319 - DNA, 11 bp, Homo sapiens
tttcagctctc

SEQ ID NO: 6559320 - DNA, 16 bp, Homo sapiens
tttcagctctctgtat

SEQ ID NO: 6559321 - DNA, 17 bp, Homo sapiens
tttcagctcttaaaaag

SEQ ID NO: 6559322 - DNA, 14 bp, Homo sapiens
tttcagctggaaac

SEQ ID NO: 6559323 - DNA, 13 bp, Homo sapiens
tttcagctggaga

SEQ ID NO: 6559324 - DNA, 14 bp, Homo sapiens
tttcagcttctctg

SEQ ID NO: 6559325 - DNA, 15 bp, Homo sapiens
tttcagctttcttca

SEQ ID NO: 6559326 - DNA, 21 bp, Homo sapiens
tttcaggaaaatgtattgatt

SEQ ID NO: 6559327 - DNA, 13 bp, Homo sapiens
tttcaggaaattt

SEQ ID NO: 6559328 - DNA, 17 bp, Homo sapiens
tttcaggaatttaaaat

SEQ ID NO: 6559329 - DNA, 11 bp, Homo sapiens
tttcaggacag

SEQ ID NO: 6559330 - DNA, 18 bp, Homo sapiens
tttcaggactctctccag

SEQ ID NO: 6559331 - DNA, 22 bp, Homo sapiens
tttcaggagagagttgaaccta

SEQ ID NO: 6559332 - DNA, 17 bp, Homo sapiens
tttcaggagcagcctca

SEQ ID NO: 6559333 - DNA, 19 bp, Homo sapiens
tttcaggaggaatactgaa

SEQ ID NO: 6559334 - DNA, 21 bp, Homo sapiens
tttcaggaggaatactgaaca

SEQ ID NO: 6559335 - DNA, 20 bp, Homo sapiens
tttcaggatactctgtcaga

SEQ ID NO: 6559336 - DNA, 21 bp, Homo sapiens
tttcaggatactctgtcagat

SEQ ID NO: 6559337 - DNA, 17 bp, Homo sapiens
tttcaggcattttgttc

SEQ ID NO: 6559338 - DNA, 19 bp, Homo sapiens
tttcaggccaaatctagaa

SEQ ID NO: 6559339 - DNA, 19 bp, Homo sapiens
tttcaggctacctttttct

SEQ ID NO: 6559340 - DNA, 21 bp, Homo sapiens
tttcaggctacctttttctgg

SEQ ID NO: 6559341 - DNA, 15 bp, Homo sapiens
tttcaggcttttatg

SEQ ID NO: 6559342 - DNA, 22 bp, Homo sapiens
tttcagggaaaaatattttact

SEQ ID NO: 6559343 - DNA, 21 bp, Homo sapiens
tttcagggaaatggagggtgg

SEQ ID NO: 6559344 - DNA, 19 bp, Homo sapiens
tttcagggaaattaatcaa

SEQ ID NO: 6559345 - DNA, 11 bp, Homo sapiens
tttcagggacc

SEQ ID NO: 6559346 - DNA, 16 bp, Homo sapiens
tttcagggacctcagg

SEQ ID NO: 6559347 - DNA, 21 bp, Homo sapiens
tttcagggcagcccctgcaga

SEQ ID NO: 6559348 - DNA, 23 bp, Homo sapiens
tttcagggcgataaaactaaata

SEQ ID NO: 6559349 - DNA, 22 bp, Homo sapiens
tttcagggctaacgaccacagg

SEQ ID NO: 6559350 - DNA, 13 bp, Homo sapiens
tttcagggctggc

SEQ ID NO: 6559351 - DNA, 20 bp, Homo sapiens
tttcaggggctttggaagct

SEQ ID NO: 6559352 - DNA, 21 bp, Homo sapiens
tttcaggggtcgtcaccacct

SEQ ID NO: 6559353 - DNA, 16 bp, Homo sapiens
tttcaggtgacatgtg

SEQ ID NO: 6559354 - DNA, 22 bp, Homo sapiens
tttcaggtgacatgtgaaacct

SEQ ID NO: 6559355 - DNA, 16 bp, Homo sapiens
tttcaggtgctcaaaa

SEQ ID NO: 6559356 - DNA, 20 bp, Homo sapiens
tttcaggtgctcaaaatgca

SEQ ID NO: 6559357 - DNA, 17 bp, Homo sapiens
tttcaggtgtcatggac

SEQ ID NO: 6559358 - DNA, 18 bp, Homo sapiens
tttcaggtgtttagttgc

SEQ ID NO: 6559359 - DNA, 17 bp, Homo sapiens
tttcaggttaaattaaa

SEQ ID NO: 6559360 - DNA, 21 bp, Homo sapiens
tttcaggttcagtattatgta

SEQ ID NO: 6559361 - DNA, 16 bp, Homo sapiens
tttcaggtttcttaaa

SEQ ID NO: 6559362 - DNA, 14 bp, Homo sapiens
tttcaggtttgtca

SEQ ID NO: 6559363 - DNA, 13 bp, Homo sapiens
tttcagtaaagtg

SEQ ID NO: 6559364 - DNA, 16 bp, Homo sapiens
tttcagtaagatcaag

SEQ ID NO: 6559365 - DNA, 11 bp, Homo sapiens
tttcagtaata

SEQ ID NO: 6559366 - DNA, 20 bp, Homo sapiens
tttcagtaataaaacatctt

SEQ ID NO: 6559367 - DNA, 17 bp, Homo sapiens
tttcagtaatagctgaa

SEQ ID NO: 6559368 - DNA, 15 bp, Homo sapiens
tttcagtaatgtctt

SEQ ID NO: 6559369 - DNA, 21 bp, Homo sapiens
tttcagtacttcagcaagaga

SEQ ID NO: 6559370 - DNA, 24 bp, Homo sapiens
tttcagtagtgagcagcatctagt

SEQ ID NO: 6559371 - DNA, 15 bp, Homo sapiens
tttcagtatactgtg

SEQ ID NO: 6559372 - DNA, 18 bp, Homo sapiens
tttcagtattgacactga

SEQ ID NO: 6559373 - DNA, 21 bp, Homo sapiens
tttcagtcatataaaagctat

SEQ ID NO: 6559374 - DNA, 20 bp, Homo sapiens
tttcagtcccctctctctgg

SEQ ID NO: 6559375 - DNA, 21 bp, Homo sapiens
tttcagtcccctctctctggg

SEQ ID NO: 6559376 - DNA, 22 bp, Homo sapiens
tttcagtgaagatgctgtaaat

SEQ ID NO: 6559377 - DNA, 21 bp, Homo sapiens
tttcagtgataatgttcattt

SEQ ID NO: 6559378 - DNA, 15 bp, Homo sapiens
tttcagtgatatctt

SEQ ID NO: 6559379 - DNA, 16 bp, Homo sapiens
tttcagtgatcttcac

SEQ ID NO: 6559380 - DNA, 20 bp, Homo sapiens
tttcagtgatcttcactgta

SEQ ID NO: 6559381 - DNA, 18 bp, Homo sapiens
tttcagtgatttttagta

SEQ ID NO: 6559382 - DNA, 13 bp, Homo sapiens
tttcagtgcctgc

SEQ ID NO: 6559383 - DNA, 17 bp, Homo sapiens
tttcagtgcctgctgtt

SEQ ID NO: 6559384 - DNA, 19 bp, Homo sapiens
tttcagtgctttctcaaaa

SEQ ID NO: 6559385 - DNA, 14 bp, Homo sapiens
tttcagtggcttcc

SEQ ID NO: 6559386 - DNA, 20 bp, Homo sapiens
tttcagtgggaaatatgcca

SEQ ID NO: 6559387 - DNA, 14 bp, Homo sapiens
tttcagtgtacatg

SEQ ID NO: 6559388 - DNA, 14 bp, Homo sapiens
tttcagtgttttca

SEQ ID NO: 6559389 - DNA, 19 bp, Homo sapiens
tttcagtgttttgcttttt

SEQ ID NO: 6559390 - DNA, 15 bp, Homo sapiens
tttcagttacttacc

SEQ ID NO: 6559391 - DNA, 12 bp, Homo sapiens
tttcagttccaa

SEQ ID NO: 6559392 - DNA, 18 bp, Homo sapiens
tttcagttcccgctctgc

SEQ ID NO: 6559393 - DNA, 15 bp, Homo sapiens
tttcagttccctcct

SEQ ID NO: 6559394 - DNA, 20 bp, Homo sapiens
tttcagttcgtttgtattct

SEQ ID NO: 6559395 - DNA, 17 bp, Homo sapiens
tttcagttctgtgtaca

SEQ ID NO: 6559396 - DNA, 22 bp, Homo sapiens
tttcagttctgtgtacatttta

SEQ ID NO: 6559397 - DNA, 14 bp, Homo sapiens
tttcagtttgttta

SEQ ID NO: 6559398 - DNA, 22 bp, Homo sapiens
tttcagttttaaaaatgaagat

SEQ ID NO: 6559399 - DNA, 24 bp, Homo sapiens
tttcagtttttattaatctactgt

SEQ ID NO: 6559400 - DNA, 18 bp, Homo sapiens
tttcagtttttcatttgt

SEQ ID NO: 6559401 - DNA, 20 bp, Homo sapiens
tttcagtttttcatttgttt

SEQ ID NO: 6559402 - DNA, 16 bp, Homo sapiens
tttcagtttttttaaa

SEQ ID NO: 6559403 - DNA, 12 bp, Homo sapiens
tttcataaaaat

SEQ ID NO: 6559404 - DNA, 11 bp, Homo sapiens
tttcataaatt

SEQ ID NO: 6559405 - DNA, 17 bp, Homo sapiens
tttcataaattggctcc

SEQ ID NO: 6559406 - DNA, 18 bp, Homo sapiens
tttcataaattggctcct

SEQ ID NO: 6559407 - DNA, 18 bp, Homo sapiens
tttcataacaaaccatct

SEQ ID NO: 6559408 - DNA, 12 bp, Homo sapiens
tttcataactta

SEQ ID NO: 6559409 - DNA, 20 bp, Homo sapiens
tttcataacttattgctgat

SEQ ID NO: 6559410 - DNA, 15 bp, Homo sapiens
tttcataataaaagg

SEQ ID NO: 6559411 - DNA, 14 bp, Homo sapiens
tttcataatcagta

SEQ ID NO: 6559412 - DNA, 17 bp, Homo sapiens
tttcataatgaaaaact

SEQ ID NO: 6559413 - DNA, 23 bp, Homo sapiens
tttcataatgaaaaactatgtca

SEQ ID NO: 6559414 - DNA, 15 bp, Homo sapiens
tttcataattcattt

SEQ ID NO: 6559415 - DNA, 19 bp, Homo sapiens
tttcataattcatttaaga

SEQ ID NO: 6559416 - DNA, 22 bp, Homo sapiens
tttcataattgcctacatttat

SEQ ID NO: 6559417 - DNA, 13 bp, Homo sapiens
tttcatacaaatt

SEQ ID NO: 6559418 - DNA, 21 bp, Homo sapiens
tttcatacagcattacaaatt

SEQ ID NO: 6559419 - DNA, 15 bp, Homo sapiens
tttcatacatatata

SEQ ID NO: 6559420 - DNA, 16 bp, Homo sapiens
tttcatacatatatat

SEQ ID NO: 6559421 - DNA, 22 bp, Homo sapiens
tttcatacatatatatatttgt

SEQ ID NO: 6559422 - DNA, 17 bp, Homo sapiens
tttcatactacatttga

SEQ ID NO: 6559423 - DNA, 19 bp, Homo sapiens
tttcatactaccctttgct

SEQ ID NO: 6559424 - DNA, 14 bp, Homo sapiens
tttcatactgtaca

SEQ ID NO: 6559425 - DNA, 22 bp, Homo sapiens
tttcatacttacggcctttaca

SEQ ID NO: 6559426 - DNA, 21 bp, Homo sapiens
tttcatagataccattttgaa

SEQ ID NO: 6559427 - DNA, 17 bp, Homo sapiens
tttcatagatgaacttt

SEQ ID NO: 6559428 - DNA, 12 bp, Homo sapiens
tttcatagatgt

SEQ ID NO: 6559429 - DNA, 20 bp, Homo sapiens
tttcatagatttgaaaaact

SEQ ID NO: 6559430 - DNA, 14 bp, Homo sapiens
tttcatagctaaaa

SEQ ID NO: 6559431 - DNA, 14 bp, Homo sapiens
tttcataggaagac

SEQ ID NO: 6559432 - DNA, 19 bp, Homo sapiens
tttcataggaagacacatt

SEQ ID NO: 6559433 - DNA, 21 bp, Homo sapiens
tttcatagtataactttaaat

SEQ ID NO: 6559434 - DNA, 20 bp, Homo sapiens
tttcatagtgacctgtgttt

SEQ ID NO: 6559435 - DNA, 21 bp, Homo sapiens
tttcatagtgtcaagaaggaa

SEQ ID NO: 6559436 - DNA, 14 bp, Homo sapiens
tttcatagttctgt

SEQ ID NO: 6559437 - DNA, 17 bp, Homo sapiens
tttcatagttctgttaa

SEQ ID NO: 6559438 - DNA, 19 bp, Homo sapiens
tttcatagttctgttaaat

SEQ ID NO: 6559439 - DNA, 20 bp, Homo sapiens
tttcatagttggggtcatag

SEQ ID NO: 6559440 - DNA, 16 bp, Homo sapiens
tttcatagttttctaa

SEQ ID NO: 6559441 - DNA, 13 bp, Homo sapiens
tttcatataaagt

SEQ ID NO: 6559442 - DNA, 12 bp, Homo sapiens
tttcatatcatt

SEQ ID NO: 6559443 - DNA, 18 bp, Homo sapiens
tttcatatgcttcaaact

SEQ ID NO: 6559444 - DNA, 14 bp, Homo sapiens
tttcatatgtggaa

SEQ ID NO: 6559445 - DNA, 17 bp, Homo sapiens
tttcatatgtggaaata

SEQ ID NO: 6559446 - DNA, 15 bp, Homo sapiens
tttcatatgttgctc

SEQ ID NO: 6559447 - DNA, 17 bp, Homo sapiens
tttcatattattttagt

SEQ ID NO: 6559448 - DNA, 18 bp, Homo sapiens
tttcatattattttagtg

SEQ ID NO: 6559449 - DNA, 15 bp, Homo sapiens
tttcatattgcttct

SEQ ID NO: 6559450 - DNA, 15 bp, Homo sapiens
tttcatattgtaatc

SEQ ID NO: 6559451 - DNA, 13 bp, Homo sapiens
tttcatatttctt

SEQ ID NO: 6559452 - DNA, 17 bp, Homo sapiens
tttcatattttaaacag

SEQ ID NO: 6559453 - DNA, 13 bp, Homo sapiens
tttcatattttag

SEQ ID NO: 6559454 - DNA, 21 bp, Homo sapiens
tttcatattttagctactata

SEQ ID NO: 6559455 - DNA, 15 bp, Homo sapiens
tttcatcaagagttt

SEQ ID NO: 6559456 - DNA, 17 bp, Homo sapiens
ttactatgtatgttttt

SEQ ID NO: 6559457 - DNA, 19 bp, Homo sapiens
ttactatgtgccagttcct

SEQ ID NO: 6559458 - DNA, 21 bp, Homo sapiens
ttactatgtgccagttcctgt

SEQ ID NO: 6559459 - DNA, 13 bp, Homo sapiens
ttactattaacat

SEQ ID NO: 6559460 - DNA, 12 bp, Homo sapiens
ttactattaact

SEQ ID NO: 6559461 - DNA, 14 bp, Homo sapiens
ttactattaagcag

SEQ ID NO: 6559462 - DNA, 19 bp, Homo sapiens
ttactattaagcagtaaaa

SEQ ID NO: 6559463 - DNA, 16 bp, Homo sapiens
ttactattgctatctt

SEQ ID NO: 6559464 - DNA, 15 bp, Homo sapiens
ttactattgtattat

SEQ ID NO: 6559465 - DNA, 19 bp, Homo sapiens
ttactattttacttctaga

SEQ ID NO: 6559466 - DNA, 21 bp, Homo sapiens
ttactattttgacagttattt

SEQ ID NO: 6559467 - DNA, 15 bp, Homo sapiens
ttactcaccaaaaag

SEQ ID NO: 6559468 - DNA, 18 bp, Homo sapiens
ttactcaccatatttgaa

SEQ ID NO: 6559469 - DNA, 15 bp, Homo sapiens
ttactcagagctgcg

SEQ ID NO: 6559470 - DNA, 21 bp, Homo sapiens
ttactcagcagcagagagccc

SEQ ID NO: 6559471 - DNA, 15 bp, Homo sapiens
ttactcagcccagct

SEQ ID NO: 6559472 - DNA, 20 bp, Homo sapiens
ttactcagggctcctcccag

SEQ ID NO: 6559473 - DNA, 19 bp, Homo sapiens
ttactcaggggatgtttac

SEQ ID NO: 6559474 - DNA, 21 bp, Homo sapiens
ttactcagggttcatctgtcc

SEQ ID NO: 6559475 - DNA, 22 bp, Homo sapiens
ttactcagggttcatctgtcca

SEQ ID NO: 6559476 - DNA, 12 bp, Homo sapiens
ttactcagtgtt

SEQ ID NO: 6559477 - DNA, 19 bp, Homo sapiens
ttactcagtgttagagaaa

SEQ ID NO: 6559478 - DNA, 20 bp, Homo sapiens
ttactcagtgttagagaaat

SEQ ID NO: 6559479 - DNA, 17 bp, Homo sapiens
ttactcatgatcttgtg

SEQ ID NO: 6559480 - DNA, 18 bp, Homo sapiens
ttactcatgtacattggt

SEQ ID NO: 6559481 - DNA, 20 bp, Homo sapiens
ttactcattaaaaataatag

SEQ ID NO: 6559482 - DNA, 15 bp, Homo sapiens
ttactcattactgca

SEQ ID NO: 6559483 - DNA, 14 bp, Homo sapiens
ttactcattgaaat

SEQ ID NO: 6559484 - DNA, 11 bp, Homo sapiens
ttactccaaaa

SEQ ID NO: 6559485 - DNA, 12 bp, Homo sapiens
ttactccaaaaa

SEQ ID NO: 6559486 - DNA, 23 bp, Homo sapiens
ttactccaaaaagacaagtgctc

SEQ ID NO: 6559487 - DNA, 22 bp, Homo sapiens
ttactccattactgtgatttct

SEQ ID NO: 6559488 - DNA, 20 bp, Homo sapiens
ttactcccaagacttcattg

SEQ ID NO: 6559489 - DNA, 22 bp, Homo sapiens
ttactcccctaagtctttactc

SEQ ID NO: 6559490 - DNA, 11 bp, Homo sapiens
ttactcccctt

SEQ ID NO: 6559491 - DNA, 20 bp, Homo sapiens
ttactccccttgagctgaga

SEQ ID NO: 6559492 - DNA, 15 bp, Homo sapiens
ttactccctgttatt

SEQ ID NO: 6559493 - DNA, 15 bp, Homo sapiens
ttactccctgtttta

SEQ ID NO: 6559494 - DNA, 18 bp, Homo sapiens
ttactccctgttttagtt

SEQ ID NO: 6559495 - DNA, 20 bp, Homo sapiens
ttactcctcctgctcctcac

SEQ ID NO: 6559496 - DNA, 11 bp, Homo sapiens
ttactcctggc

SEQ ID NO: 6559497 - DNA, 13 bp, Homo sapiens
ttactccttctgt

SEQ ID NO: 6559498 - DNA, 14 bp, Homo sapiens
ttactcctttttat

SEQ ID NO: 6559499 - DNA, 18 bp, Homo sapiens
ttactcctttttattcat

SEQ ID NO: 6559500 - DNA, 17 bp, Homo sapiens
ttactcggcgtgctcct

SEQ ID NO: 6559501 - DNA, 17 bp, Homo sapiens
ttactcgttcttcagca

SEQ ID NO: 6559502 - DNA, 14 bp, Homo sapiens
ttactctaagatct

SEQ ID NO: 6559503 - DNA, 20 bp, Homo sapiens
ttactctaaggtaaaaccat

SEQ ID NO: 6559504 - DNA, 16 bp, Homo sapiens
ttactctacactgaaa

SEQ ID NO: 6559505 - DNA, 18 bp, Homo sapiens
ttactctacactgaaacg

SEQ ID NO: 6559506 - DNA, 18 bp, Homo sapiens
ttactctagatacctaaa

SEQ ID NO: 6559507 - DNA, 22 bp, Homo sapiens
ttactctgaagggcatcatgca

SEQ ID NO: 6559508 - DNA, 13 bp, Homo sapiens
ttactctgagccc

SEQ ID NO: 6559509 - DNA, 15 bp, Homo sapiens
ttactctgagcccag

SEQ ID NO: 6559510 - DNA, 16 bp, Homo sapiens
ttactctgagcccagg

SEQ ID NO: 6559511 - DNA, 17 bp, Homo sapiens
ttactctgagcccaggc

SEQ ID NO: 6559512 - DNA, 22 bp, Homo sapiens
ttactctgcactatagccattt

SEQ ID NO: 6559513 - DNA, 22 bp, Homo sapiens
ttactctgcggtggtgccagag

SEQ ID NO: 6559514 - DNA, 20 bp, Homo sapiens
ttactctggtggattgttct

SEQ ID NO: 6559515 - DNA, 22 bp, Homo sapiens
ttactctggtggattgttctag

SEQ ID NO: 6559516 - DNA, 13 bp, Homo sapiens
ttactctgtgtaa

SEQ ID NO: 6559517 - DNA, 16 bp, Homo sapiens
ttactcttaattttaa

SEQ ID NO: 6559518 - DNA, 14 bp, Homo sapiens
ttactcttcagttt

SEQ ID NO: 6559519 - DNA, 18 bp, Homo sapiens
ttactcttcctctaacat

SEQ ID NO: 6559520 - DNA, 17 bp, Homo sapiens
ttactcttgtaagattt

SEQ ID NO: 6559521 - DNA, 18 bp, Homo sapiens
ttactcttgtaagatttt

SEQ ID NO: 6559522 - DNA, 21 bp, Homo sapiens
ttactcttgtaagattttgaa

SEQ ID NO: 6559523 - DNA, 22 bp, Homo sapiens
ttactcttgttgcccaggctgg

SEQ ID NO: 6559524 - DNA, 13 bp, Homo sapiens
ttactctttccta

SEQ ID NO: 6559525 - DNA, 14 bp, Homo sapiens
ttactctttgcaaa

SEQ ID NO: 6559526 - DNA, 20 bp, Homo sapiens
ttactctttttcaataaatt

SEQ ID NO: 6559527 - DNA, 23 bp, Homo sapiens
ttactgaagaaatctttccagtt

SEQ ID NO: 6559528 - DNA, 17 bp, Homo sapiens
ttactgaagccttacaa

SEQ ID NO: 6559529 - DNA, 16 bp, Homo sapiens
ttactgaagcctttct

SEQ ID NO: 6559530 - DNA, 22 bp, Homo sapiens
ttactgaataatatcaaataaa

SEQ ID NO: 6559531 - DNA, 18 bp, Homo sapiens
ttactgaatgatctattc

SEQ ID NO: 6559532 - DNA, 22 bp, Homo sapiens
ttactgaattgtatcaatttgt

SEQ ID NO: 6559533 - DNA, 13 bp, Homo sapiens
ttactgaattttt

SEQ ID NO: 6559534 - DNA, 20 bp, Homo sapiens
ttactgacacttcctgtcct

SEQ ID NO: 6559535 - DNA, 17 bp, Homo sapiens
ttactgacagaaatgca

SEQ ID NO: 6559536 - DNA, 18 bp, Homo sapiens
ttactgacagaaatgcaa

SEQ ID NO: 6559537 - DNA, 17 bp, Homo sapiens
ttactgacatggtgctg

SEQ ID NO: 6559538 - DNA, 19 bp, Homo sapiens
ttactgacatggtgctgtg

SEQ ID NO: 6559539 - DNA, 15 bp, Homo sapiens
ttactgactcctcag

SEQ ID NO: 6559540 - DNA, 22 bp, Homo sapiens
ttactgagcgcaagccacagcc

SEQ ID NO: 6559541 - DNA, 17 bp, Homo sapiens
ttactgagcttctctgt

SEQ ID NO: 6559542 - DNA, 14 bp, Homo sapiens
ttactgataatttt

SEQ ID NO: 6559543 - DNA, 22 bp, Homo sapiens
ttactgatagggatacatgctc

SEQ ID NO: 6559544 - DNA, 16 bp, Homo sapiens
ttactgatatcagagt

SEQ ID NO: 6559545 - DNA, 22 bp, Homo sapiens
ttactgatatttatagaacagt

SEQ ID NO: 6559546 - DNA, 14 bp, Homo sapiens
ttactgatcatgca

SEQ ID NO: 6559547 - DNA, 18 bp, Homo sapiens
ttactgatcatgcattgt

SEQ ID NO: 6559548 - DNA, 21 bp, Homo sapiens
ttactgatcttacctttatga

SEQ ID NO: 6559549 - DNA, 16 bp, Homo sapiens
ttactgatgctcctga

SEQ ID NO: 6559550 - DNA, 15 bp, Homo sapiens
ttactgatgtgatat

SEQ ID NO: 6559551 - DNA, 15 bp, Homo sapiens
ttactgatgtgtgca

SEQ ID NO: 6559552 - DNA, 22 bp, Homo sapiens
ttactgatgtgtgcaacctttt

SEQ ID NO: 6559553 - DNA, 21 bp, Homo sapiens
ttactgcagtaacactggcct

SEQ ID NO: 6559554 - DNA, 12 bp, Homo sapiens
ttactgcagtga

SEQ ID NO: 6559555 - DNA, 17 bp, Homo sapiens
ttactgcattttcacaa

SEQ ID NO: 6559556 - DNA, 22 bp, Homo sapiens
ttactgcattttcacaacatat

SEQ ID NO: 6559557 - DNA, 21 bp, Homo sapiens
ttactgccaaagggaaatatc

SEQ ID NO: 6559558 - DNA, 11 bp, Homo sapiens
ttactgccact

SEQ ID NO: 6559559 - DNA, 23 bp, Homo sapiens
ttactgccgaaacccttgactgt

SEQ ID NO: 6559560 - DNA, 19 bp, Homo sapiens
ttactgccggtttgaaaat

SEQ ID NO: 6559561 - DNA, 23 bp, Homo sapiens
ttactgcctataatcttatacaa

SEQ ID NO: 6559562 - DNA, 11 bp, Homo sapiens
ttactgcctga

SEQ ID NO: 6559563 - DNA, 17 bp, Homo sapiens
ttactgcctgaccttgg

SEQ ID NO: 6559564 - DNA, 18 bp, Homo sapiens
ttactgccttcctcctta

SEQ ID NO: 6559565 - DNA, 11 bp, Homo sapiens
ttactgccttg

SEQ ID NO: 6559566 - DNA, 14 bp, Homo sapiens
ttactgccttgaaa

SEQ ID NO: 6559567 - DNA, 21 bp, Homo sapiens
ttactgcctttggaagaaaca

SEQ ID NO: 6559568 - DNA, 13 bp, Homo sapiens
ttactgcgtagaa

SEQ ID NO: 6559569 - DNA, 21 bp, Homo sapiens
ttactgctatctactaagttt

SEQ ID NO: 6559570 - DNA, 17 bp, Homo sapiens
ttactgctctagaaagt

SEQ ID NO: 6559571 - DNA, 19 bp, Homo sapiens
ttactgctgattcttgtaa

SEQ ID NO: 6559572 - DNA, 12 bp, Homo sapiens
ttactgctgtca

SEQ ID NO: 6559573 - DNA, 13 bp, Homo sapiens
ttactgcttgcag

SEQ ID NO: 6559574 - DNA, 16 bp, Homo sapiens
ttactgcttgcagtaa

SEQ ID NO: 6559575 - DNA, 21 bp, Homo sapiens
ttactgcttgcagtaattcaa

SEQ ID NO: 6559576 - DNA, 17 bp, Homo sapiens
ttactgctttctgaatg

SEQ ID NO: 6559577 - DNA, 22 bp, Homo sapiens
ttactgcttttaacttctgata

SEQ ID NO: 6559578 - DNA, 23 bp, Homo sapiens
ttactggaattacaaaacctatt

SEQ ID NO: 6559579 - DNA, 15 bp, Homo sapiens
ttactggacctgaaa

SEQ ID NO: 6559580 - DNA, 22 bp, Homo sapiens
ttactggatctcttaagacagc

SEQ ID NO: 6559581 - DNA, 16 bp, Homo sapiens
ttactggcctttttca

SEQ ID NO: 6559582 - DNA, 22 bp, Homo sapiens
ttactggcgtggattaaactta

SEQ ID NO: 6559583 - DNA, 20 bp, Homo sapiens
ttactggtaggaacttgaga

SEQ ID NO: 6559584 - DNA, 14 bp, Homo sapiens
ttactggtccaaaa

SEQ ID NO: 6559585 - DNA, 18 bp, Homo sapiens
ttactggtccaaaagatt

SEQ ID NO: 6559586 - DNA, 13 bp, Homo sapiens
ttactggttgcat

SEQ ID NO: 6559587 - DNA, 15 bp, Homo sapiens
ttactggttgcatgg

SEQ ID NO: 6559588 - DNA, 18 bp, Homo sapiens
ttactggttgcatggaaa

SEQ ID NO: 6559589 - DNA, 19 bp, Homo sapiens
ttactggttgcatggaaat

SEQ ID NO: 6559590 - DNA, 21 bp, Homo sapiens
ttactggtttcagttgacaaa

SEQ ID NO: 6559591 - DNA, 14 bp, Homo sapiens
ttactgtaaaatgc

SEQ ID NO: 6559592 - DNA, 16 bp, Homo sapiens
ttactgtaaaatgcaa

SEQ ID NO: 6559593 - DNA, 11 bp, Homo sapiens
ttactgtaaat

SEQ ID NO: 6559594 - DNA, 12 bp, Homo sapiens
ttactgtaaatg

SEQ ID NO: 6559595 - DNA, 12 bp, Homo sapiens
ttactgtaaatt

SEQ ID NO: 6559596 - DNA, 18 bp, Homo sapiens
ttactgtaacctgttgct

SEQ ID NO: 6559597 - DNA, 15 bp, Homo sapiens
ttactgtaactgatt

SEQ ID NO: 6559598 - DNA, 15 bp, Homo sapiens
ttactgtaagaaaat

SEQ ID NO: 6559599 - DNA, 20 bp, Homo sapiens
ttactgtaatataaagtatt

SEQ ID NO: 6559600 - DNA, 13 bp, Homo sapiens
ttactgtacatga

SEQ ID NO: 6559601 - DNA, 22 bp, Homo sapiens
ttactgtacatgaaaacacatt

SEQ ID NO: 6559602 - DNA, 23 bp, Homo sapiens
ttactgtacatgaaaacacattt

SEQ ID NO: 6559603 - DNA, 13 bp, Homo sapiens
ttactgtacctgt

SEQ ID NO: 6559604 - DNA, 21 bp, Homo sapiens
ttactgtagcctcagatgatt

SEQ ID NO: 6559605 - DNA, 16 bp, Homo sapiens
ttactgtatataaact

SEQ ID NO: 6559606 - DNA, 21 bp, Homo sapiens
ttactgtatatgtattccctt

SEQ ID NO: 6559607 - DNA, 12 bp, Homo sapiens
ttactgtatgtt

SEQ ID NO: 6559608 - DNA, 13 bp, Homo sapiens
ttactgtatgttt

SEQ ID NO: 6559609 - DNA, 15 bp, Homo sapiens
ttactgtatgttttt

SEQ ID NO: 6559610 - DNA, 19 bp, Homo sapiens
ttactgtatgtttttactg

SEQ ID NO: 6559611 - DNA, 22 bp, Homo sapiens
ttactgtatttttcagaaatca

SEQ ID NO: 6559612 - DNA, 17 bp, Homo sapiens
ttactgtcaataaacag

SEQ ID NO: 6559613 - DNA, 14 bp, Homo sapiens
ttactgtcagagaa

SEQ ID NO: 6559614 - DNA, 21 bp, Homo sapiens
ttactgtcagattaaattaca

SEQ ID NO: 6559615 - DNA, 14 bp, Homo sapiens
ttactgtcattccc

SEQ ID NO: 6559616 - DNA, 15 bp, Homo sapiens
ttactgtcattccca

SEQ ID NO: 6559617 - DNA, 22 bp, Homo sapiens
ttactgtccaccagtttataca

SEQ ID NO: 6559618 - DNA, 20 bp, Homo sapiens
ttactgtcctgttgattaat

SEQ ID NO: 6559619 - DNA, 23 bp, Homo sapiens
ttactgtctggttttaacaattt

SEQ ID NO: 6559620 - DNA, 15 bp, Homo sapiens
ttactgtctgtagtg

SEQ ID NO: 6559621 - DNA, 11 bp, Homo sapiens
ttactgtctta

SEQ ID NO: 6559622 - DNA, 12 bp, Homo sapiens
ttactgtcttaa

SEQ ID NO: 6559623 - DNA, 13 bp, Homo sapiens
ttactgtcttaat

SEQ ID NO: 6559624 - DNA, 14 bp, Homo sapiens
ttactgtcttgaat

SEQ ID NO: 6559625 - DNA, 19 bp, Homo sapiens
ttactgtcttttttctaaa

SEQ ID NO: 6559626 - DNA, 18 bp, Homo sapiens
ttactgtgagaactgtga

SEQ ID NO: 6559627 - DNA, 17 bp, Homo sapiens
ttactgtggaggaagga

SEQ ID NO: 6559628 - DNA, 18 bp, Homo sapiens
ttactgtggaggaaggat

SEQ ID NO: 6559629 - DNA, 16 bp, Homo sapiens
ttactgtggaggtggc

SEQ ID NO: 6559630 - DNA, 16 bp, Homo sapiens
ttactgtgtaaactca

SEQ ID NO: 6559631 - DNA, 15 bp, Homo sapiens
ttactgtgtaaataa

SEQ ID NO: 6559632 - DNA, 16 bp, Homo sapiens
ttactgtgtaattagt

SEQ ID NO: 6559633 - DNA, 13 bp, Homo sapiens
ttactgtgtcttt

SEQ ID NO: 6559634 - DNA, 14 bp, Homo sapiens
ttactgtgtgaaga

SEQ ID NO: 6559635 - DNA, 19 bp, Homo sapiens
ttactgtgtgaagaataat

SEQ ID NO: 6559636 - DNA, 13 bp, Homo sapiens
tttcatcaagtag

SEQ ID NO: 6559637 - DNA, 24 bp, Homo sapiens
tttcatcagaacagctgttgactc

SEQ ID NO: 6559638 - DNA, 14 bp, Homo sapiens
tttcatcatttcag

SEQ ID NO: 6559639 - DNA, 19 bp, Homo sapiens
tttcatcatttcagccaaa

SEQ ID NO: 6559640 - DNA, 20 bp, Homo sapiens
tttcatccactagtgcaaat

SEQ ID NO: 6559641 - DNA, 16 bp, Homo sapiens
tttcatccataactga

SEQ ID NO: 6559642 - DNA, 22 bp, Homo sapiens
tttcatcccgtatcacagtgtt

SEQ ID NO: 6559643 - DNA, 19 bp, Homo sapiens
tttcatcctaaagaacaaa

SEQ ID NO: 6559644 - DNA, 14 bp, Homo sapiens
tttcatcctggcct

SEQ ID NO: 6559645 - DNA, 13 bp, Homo sapiens
tttcatcctgtgt

SEQ ID NO: 6559646 - DNA, 19 bp, Homo sapiens
tttcatccttctttccttg

SEQ ID NO: 6559647 - DNA, 22 bp, Homo sapiens
tttcatccttctttccttgttc

SEQ ID NO: 6559648 - DNA, 20 bp, Homo sapiens
tttcatccttttttctcttc

SEQ ID NO: 6559649 - DNA, 17 bp, Homo sapiens
tttcatctaccttttct

SEQ ID NO: 6559650 - DNA, 18 bp, Homo sapiens
tttcatctaccttttctg

SEQ ID NO: 6559651 - DNA, 15 bp, Homo sapiens
tttcatctattttat

SEQ ID NO: 6559652 - DNA, 17 bp, Homo sapiens
tttcatctattttattt

SEQ ID NO: 6559653 - DNA, 15 bp, Homo sapiens
tttcatctcagcttt

SEQ ID NO: 6559654 - DNA, 18 bp, Homo sapiens
tttcatctctctacctcc

SEQ ID NO: 6559655 - DNA, 15 bp, Homo sapiens
tttcatctcttcaat

SEQ ID NO: 6559656 - DNA, 15 bp, Homo sapiens
tttcatctgctctcc

SEQ ID NO: 6559657 - DNA, 19 bp, Homo sapiens
tttcatctgctctccttcc

SEQ ID NO: 6559658 - DNA, 21 bp, Homo sapiens
tttcatctgctgctgaaactg

SEQ ID NO: 6559659 - DNA, 12 bp, Homo sapiens
tttcatctgggt

SEQ ID NO: 6559660 - DNA, 17 bp, Homo sapiens
tttcatctggttttatt

SEQ ID NO: 6559661 - DNA, 13 bp, Homo sapiens
tttcatctgttgt

SEQ ID NO: 6559662 - DNA, 18 bp, Homo sapiens
tttcatctgttgttctgt

SEQ ID NO: 6559663 - DNA, 15 bp, Homo sapiens
tttcatcttcagttg

SEQ ID NO: 6559664 - DNA, 17 bp, Homo sapiens
tttcatcttcagttgtc

SEQ ID NO: 6559665 - DNA, 16 bp, Homo sapiens
tttcatcttctggaat

SEQ ID NO: 6559666 - DNA, 21 bp, Homo sapiens
tttcatcttctggaatattgt

SEQ ID NO: 6559667 - DNA, 16 bp, Homo sapiens
tttcatcttgaagttt

SEQ ID NO: 6559668 - DNA, 19 bp, Homo sapiens
tttcatctttccaaattga

SEQ ID NO: 6559669 - DNA, 15 bp, Homo sapiens
tttcatgaaaaagct

SEQ ID NO: 6559670 - DNA, 12 bp, Homo sapiens
tttcatgaaaac

SEQ ID NO: 6559671 - DNA, 20 bp, Homo sapiens
tttcatgaacgttattatat

SEQ ID NO: 6559672 - DNA, 21 bp, Homo sapiens
tttcatgaagaaaaaatttta

SEQ ID NO: 6559673 - DNA, 21 bp, Homo sapiens
tttcatgacagaatatacaca

SEQ ID NO: 6559674 - DNA, 20 bp, Homo sapiens
tttcatgaccactgggcctg

SEQ ID NO: 6559675 - DNA, 17 bp, Homo sapiens
tttcatgaccagtaaag

SEQ ID NO: 6559676 - DNA, 20 bp, Homo sapiens
tttcatgactggtgcgttcc

SEQ ID NO: 6559677 - DNA, 19 bp, Homo sapiens
tttcatgagatgcagtatt

SEQ ID NO: 6559678 - DNA, 13 bp, Homo sapiens
tttcatgagccca

SEQ ID NO: 6559679 - DNA, 16 bp, Homo sapiens
tttcatgattagacaa

SEQ ID NO: 6559680 - DNA, 23 bp, Homo sapiens
tttcatgatttgcaactttagaa

SEQ ID NO: 6559681 - DNA, 16 bp, Homo sapiens
tttcatgattttgaaa

SEQ ID NO: 6559682 - DNA, 13 bp, Homo sapiens
tttcatgcaaact

SEQ ID NO: 6559683 - DNA, 17 bp, Homo sapiens
tttcatgcaaactcttt

SEQ ID NO: 6559684 - DNA, 21 bp, Homo sapiens
tttcatgcaaactctttggtc

SEQ ID NO: 6559685 - DNA, 19 bp, Homo sapiens
tttcatgctgttcatgaaa

SEQ ID NO: 6559686 - DNA, 14 bp, Homo sapiens
tttcatgctttatc

SEQ ID NO: 6559687 - DNA, 16 bp, Homo sapiens
tttcatgctttatcaa

SEQ ID NO: 6559688 - DNA, 14 bp, Homo sapiens
tttcatggaatgca

SEQ ID NO: 6559689 - DNA, 15 bp, Homo sapiens
tttcatggaggggaa

SEQ ID NO: 6559690 - DNA, 19 bp, Homo sapiens
tttcatgggggtattatcc

SEQ ID NO: 6559691 - DNA, 22 bp, Homo sapiens
tttcatggggtgatgctgggct

SEQ ID NO: 6559692 - DNA, 22 bp, Homo sapiens
tttcatggtgaaaatgtactga

SEQ ID NO: 6559693 - DNA, 19 bp, Homo sapiens
tttcatgtaaactgtgcac

SEQ ID NO: 6559694 - DNA, 11 bp, Homo sapiens
tttcatgtact

SEQ ID NO: 6559695 - DNA, 22 bp, Homo sapiens
tttcatgtactgcattatttga

SEQ ID NO: 6559696 - DNA, 14 bp, Homo sapiens
tttcatgtatgtat

SEQ ID NO: 6559697 - DNA, 12 bp, Homo sapiens
tttcatgtgatc

SEQ ID NO: 6559698 - DNA, 19 bp, Homo sapiens
tttcatgtgctatagacat

SEQ ID NO: 6559699 - DNA, 17 bp, Homo sapiens
tttcatgtggctgtaga

SEQ ID NO: 6559700 - DNA, 17 bp, Homo sapiens
tttcatgtgttgcaaat

SEQ ID NO: 6559701 - DNA, 23 bp, Homo sapiens
tttcatgtgttgcaaattattct

SEQ ID NO: 6559702 - DNA, 19 bp, Homo sapiens
tttcatgttagttacctta

SEQ ID NO: 6559703 - DNA, 19 bp, Homo sapiens
tttcatgttcactgtgagt

SEQ ID NO: 6559704 - DNA, 16 bp, Homo sapiens
tttcatgttctgtgtc

SEQ ID NO: 6559705 - DNA, 14 bp, Homo sapiens
tttcatgttggttt

SEQ ID NO: 6559706 - DNA, 14 bp, Homo sapiens
tttcatgtttaaga

SEQ ID NO: 6559707 - DNA, 13 bp, Homo sapiens
tttcattaaaaat

SEQ ID NO: 6559708 - DNA, 16 bp, Homo sapiens
tttcattaaacttgaa

SEQ ID NO: 6559709 - DNA, 19 bp, Homo sapiens
tttcattaaataaatttga

SEQ ID NO: 6559710 - DNA, 16 bp, Homo sapiens
tttcattacaatggaa

SEQ ID NO: 6559711 - DNA, 21 bp, Homo sapiens
tttcattacaatggaaacaat

SEQ ID NO: 6559712 - DNA, 22 bp, Homo sapiens
tttcattaccaagttacttgaa

SEQ ID NO: 6559713 - DNA, 14 bp, Homo sapiens
tttcattacttgaa

SEQ ID NO: 6559714 - DNA, 12 bp, Homo sapiens
tttcattagcaa

SEQ ID NO: 6559715 - DNA, 15 bp, Homo sapiens
tttcattagcaaaaa

SEQ ID NO: 6559716 - DNA, 19 bp, Homo sapiens
tttcattagccatgcaaca

SEQ ID NO: 6559717 - DNA, 17 bp, Homo sapiens
tttcattaggcaaagta

SEQ ID NO: 6559718 - DNA, 20 bp, Homo sapiens
tttcattaggcaaagtacaa

SEQ ID NO: 6559719 - DNA, 20 bp, Homo sapiens
tttcattatgtaaaatgttt

SEQ ID NO: 6559720 - DNA, 20 bp, Homo sapiens
tttcattatgttcatgtaag

SEQ ID NO: 6559721 - DNA, 14 bp, Homo sapiens
tttcattatttcaa

SEQ ID NO: 6559722 - DNA, 16 bp, Homo sapiens
tttcattatttggaaa

SEQ ID NO: 6559723 - DNA, 16 bp, Homo sapiens
tttcattattttccca

SEQ ID NO: 6559724 - DNA, 17 bp, Homo sapiens
tttcattatttttcaat

SEQ ID NO: 6559725 - DNA, 20 bp, Homo sapiens
tttcattatttttcaattat

SEQ ID NO: 6559726 - DNA, 22 bp, Homo sapiens
tttcattatttttcaattatgt

SEQ ID NO: 6559727 - DNA, 14 bp, Homo sapiens
tttcattcaaatca

SEQ ID NO: 6559728 - DNA, 18 bp, Homo sapiens
tttcattcaaatcagtga

SEQ ID NO: 6559729 - DNA, 21 bp, Homo sapiens
tttcattcaaatcagtgatct

SEQ ID NO: 6559730 - DNA, 16 bp, Homo sapiens
tttcattcaacacatt

SEQ ID NO: 6559731 - DNA, 12 bp, Homo sapiens
tttcattcacaa

SEQ ID NO: 6559732 - DNA, 15 bp, Homo sapiens
tttcattcatcccat

SEQ ID NO: 6559733 - DNA, 21 bp, Homo sapiens
tttcattcccccttcctagtg

SEQ ID NO: 6559734 - DNA, 14 bp, Homo sapiens
tttcattccctgta

SEQ ID NO: 6559735 - DNA, 21 bp, Homo sapiens
tttcattccttcagatttggc

SEQ ID NO: 6559736 - DNA, 13 bp, Homo sapiens
tttcattctcatt

SEQ ID NO: 6559737 - DNA, 15 bp, Homo sapiens
tttcattctcctgcc

SEQ ID NO: 6559738 - DNA, 16 bp, Homo sapiens
tttcattctgccaaag

SEQ ID NO: 6559739 - DNA, 15 bp, Homo sapiens
tttcattctggtcct

SEQ ID NO: 6559740 - DNA, 15 bp, Homo sapiens
tttcattgaatactt

SEQ ID NO: 6559741 - DNA, 18 bp, Homo sapiens
tttcattgaggataaatt

SEQ ID NO: 6559742 - DNA, 23 bp, Homo sapiens
tttcattgaggataaattgccat

SEQ ID NO: 6559743 - DNA, 17 bp, Homo sapiens
tttcattgattaatctc

SEQ ID NO: 6559744 - DNA, 17 bp, Homo sapiens
tttcattgattatatgg

SEQ ID NO: 6559745 - DNA, 14 bp, Homo sapiens
tttcattgcaaagt

SEQ ID NO: 6559746 - DNA, 15 bp, Homo sapiens
tttcattgcaaagtt

SEQ ID NO: 6559747 - DNA, 23 bp, Homo sapiens
tttcattgcctgtgtatggaaaa

SEQ ID NO: 6559748 - DNA, 15 bp, Homo sapiens
tttcattgctgtgac

SEQ ID NO: 6559749 - DNA, 18 bp, Homo sapiens
tttcattgctgtgacagt

SEQ ID NO: 6559750 - DNA, 17 bp, Homo sapiens
tttcattggatttttgt

SEQ ID NO: 6559751 - DNA, 16 bp, Homo sapiens
tttcattgtatgatgt

SEQ ID NO: 6559752 - DNA, 18 bp, Homo sapiens
tttcattgtatgatgtgt

SEQ ID NO: 6559753 - DNA, 23 bp, Homo sapiens
tttcattgtatgatgtgttgtga

SEQ ID NO: 6559754 - DNA, 14 bp, Homo sapiens
tttcattgtctgtg

SEQ ID NO: 6559755 - DNA, 17 bp, Homo sapiens
tttcattgtgatttata

SEQ ID NO: 6559756 - DNA, 20 bp, Homo sapiens
tttcattgtgatttatatat

SEQ ID NO: 6559757 - DNA, 22 bp, Homo sapiens
tttcattgtgatttatatataa

SEQ ID NO: 6559758 - DNA, 19 bp, Homo sapiens
tttcatttacaaaagattt

SEQ ID NO: 6559759 - DNA, 19 bp, Homo sapiens
tttcatttacaatttcaaa

SEQ ID NO: 6559760 - DNA, 21 bp, Homo sapiens
tttcatttactctaaaaactg

SEQ ID NO: 6559761 - DNA, 19 bp, Homo sapiens
tttcatttagtcatgtgac

SEQ ID NO: 6559762 - DNA, 14 bp, Homo sapiens
tttcatttatctat

SEQ ID NO: 6559763 - DNA, 19 bp, Homo sapiens
tttcatttatgatacaaaa

SEQ ID NO: 6559764 - DNA, 12 bp, Homo sapiens
tttcatttcaga

SEQ ID NO: 6559765 - DNA, 13 bp, Homo sapiens
tttcatttcagat

SEQ ID NO: 6559766 - DNA, 15 bp, Homo sapiens
tttcatttcagattt

SEQ ID NO: 6559767 - DNA, 22 bp, Homo sapiens
tttcatttcagattttaaaaag

SEQ ID NO: 6559768 - DNA, 15 bp, Homo sapiens
tttcatttcatatat

SEQ ID NO: 6559769 - DNA, 13 bp, Homo sapiens
tttcatttccagc

SEQ ID NO: 6559770 - DNA, 20 bp, Homo sapiens
tttcatttcttcctcagctg

SEQ ID NO: 6559771 - DNA, 16 bp, Homo sapiens
tttcatttcttctaca

SEQ ID NO: 6559772 - DNA, 20 bp, Homo sapiens
tttcatttcttgtcaattat

SEQ ID NO: 6559773 - DNA, 13 bp, Homo sapiens
tttcatttgccta

SEQ ID NO: 6559774 - DNA, 14 bp, Homo sapiens
tttcatttgcctat

SEQ ID NO: 6559775 - DNA, 21 bp, Homo sapiens
tttcatttggggcatttgtaa

SEQ ID NO: 6559776 - DNA, 14 bp, Homo sapiens
tttcatttgtaaaa

SEQ ID NO: 6559777 - DNA, 20 bp, Homo sapiens
tttcatttgtacaaggtaat

SEQ ID NO: 6559778 - DNA, 16 bp, Homo sapiens
tttcatttgttttgct

SEQ ID NO: 6559779 - DNA, 21 bp, Homo sapiens
tttcattttagtgtatcttta

SEQ ID NO: 6559780 - DNA, 15 bp, Homo sapiens
tttcattttcattat

SEQ ID NO: 6559781 - DNA, 13 bp, Homo sapiens
tttcattttctct

SEQ ID NO: 6559782 - DNA, 17 bp, Homo sapiens
tttcattttctctcagg

SEQ ID NO: 6559783 - DNA, 18 bp, Homo sapiens
tttcattttctgcaagcc

SEQ ID NO: 6559784 - DNA, 14 bp, Homo sapiens
tttcattttgcaga

SEQ ID NO: 6559785 - DNA, 16 bp, Homo sapiens
tttcattttgcagaag

SEQ ID NO: 6559786 - DNA, 20 bp, Homo sapiens
tttcattttgcagaaggaaa

SEQ ID NO: 6559787 - DNA, 15 bp, Homo sapiens
tttcattttgcttta

SEQ ID NO: 6559788 - DNA, 22 bp, Homo sapiens
tttcattttgggccttgctaaa

SEQ ID NO: 6559789 - DNA, 9 bp, Homo sapiens
tttccaaaa

SEQ ID NO: 6559790 - DNA, 15 bp, Homo sapiens
tttccaaaaatactt

SEQ ID NO: 6559791 - DNA, 15 bp, Homo sapiens
tttccaaaacaaaaa

SEQ ID NO: 6559792 - DNA, 12 bp, Homo sapiens
tttccaaaagta

SEQ ID NO: 6559793 - DNA, 22 bp, Homo sapiens
tttccaaaataatctatattaa

SEQ ID NO: 6559794 - DNA, 21 bp, Homo sapiens
tttccaaaatctaaaagctgt

SEQ ID NO: 6559795 - DNA, 15 bp, Homo sapiens
tttccaaaatttttc

SEQ ID NO: 6559796 - DNA, 16 bp, Homo sapiens
tttccaaaccttatct

SEQ ID NO: 6559797 - DNA, 14 bp, Homo sapiens
tttccaaactgttg

SEQ ID NO: 6559798 - DNA, 18 bp, Homo sapiens
tttccaaacttgaaaaca

SEQ ID NO: 6559799 - DNA, 13 bp, Homo sapiens
tttccaaaggatt

SEQ ID NO: 6559800 - DNA, 18 bp, Homo sapiens
tttccaaaggttgtacat

SEQ ID NO: 6559801 - DNA, 15 bp, Homo sapiens
tttccaaagtacact

SEQ ID NO: 6559802 - DNA, 12 bp, Homo sapiens
tttccaaagtgc

SEQ ID NO: 6559803 - DNA, 15 bp, Homo sapiens
tttccaaataaacat

SEQ ID NO: 6559804 - DNA, 20 bp, Homo sapiens
tttccaaattaaaacaaata

SEQ ID NO: 6559805 - DNA, 18 bp, Homo sapiens
tttccaaattattaattg

SEQ ID NO: 6559806 - DNA, 14 bp, Homo sapiens
tttccaaattattt

SEQ ID NO: 6559807 - DNA, 22 bp, Homo sapiens
tttccaaattatttcttaatta

SEQ ID NO: 6559808 - DNA, 21 bp, Homo sapiens
tttccaaattgatgggtgggc

SEQ ID NO: 6559809 - DNA, 23 bp, Homo sapiens
tttccaacacacacaacgtaaaa

SEQ ID NO: 6559810 - DNA, 23 bp, Homo sapiens
tttccaacaccacagacacacac

SEQ ID NO: 6559811 - DNA, 21 bp, Homo sapiens
tttccaacaggggctggaggg

SEQ ID NO: 6559812 - DNA, 16 bp, Homo sapiens
tttccaacatacaatt

SEQ ID NO: 6559813 - DNA, 19 bp, Homo sapiens
tttccaactactaatagaa

SEQ ID NO: 6559814 - DNA, 20 bp, Homo sapiens
tttccaagaaattttagata

SEQ ID NO: 6559815 - DNA, 13 bp, Homo sapiens
ttactgtgtgtga

SEQ ID NO: 6559816 - DNA, 18 bp, Homo sapiens
ttactgtgtttcagcatg

SEQ ID NO: 6559817 - DNA, 16 bp, Homo sapiens
ttactgttaaaactgt

SEQ ID NO: 6559818 - DNA, 16 bp, Homo sapiens
ttactgttatttaatt

SEQ ID NO: 6559819 - DNA, 16 bp, Homo sapiens
ttactgttctgaaatt

SEQ ID NO: 6559820 - DNA, 16 bp, Homo sapiens
ttactgttcttattgt

SEQ ID NO: 6559821 - DNA, 12 bp, Homo sapiens
ttactgttcttg

SEQ ID NO: 6559822 - DNA, 15 bp, Homo sapiens
ttactgttcttgctg

SEQ ID NO: 6559823 - DNA, 17 bp, Homo sapiens
ttactgttcttgctgct

SEQ ID NO: 6559824 - DNA, 21 bp, Homo sapiens
ttactgttcttgctgctagaa

SEQ ID NO: 6559825 - DNA, 22 bp, Homo sapiens
ttactgttcttgctgctagaac

SEQ ID NO: 6559826 - DNA, 12 bp, Homo sapiens
ttactgttgaac

SEQ ID NO: 6559827 - DNA, 22 bp, Homo sapiens
ttactgttgaacttagaactat

SEQ ID NO: 6559828 - DNA, 14 bp, Homo sapiens
ttactgttgataat

SEQ ID NO: 6559829 - DNA, 15 bp, Homo sapiens
ttactgttgcactga

SEQ ID NO: 6559830 - DNA, 16 bp, Homo sapiens
ttactgttgcatttac

SEQ ID NO: 6559831 - DNA, 19 bp, Homo sapiens
ttactgttgcatttacttt

SEQ ID NO: 6559832 - DNA, 13 bp, Homo sapiens
ttactgttgtaca

SEQ ID NO: 6559833 - DNA, 23 bp, Homo sapiens
ttactgtttattacttccatgaa

SEQ ID NO: 6559834 - DNA, 18 bp, Homo sapiens
ttactgtttatttctgtt

SEQ ID NO: 6559835 - DNA, 18 bp, Homo sapiens
ttactgtttctcaagtgt

SEQ ID NO: 6559836 - DNA, 22 bp, Homo sapiens
ttactgtttgaaacttttcaag

SEQ ID NO: 6559837 - DNA, 21 bp, Homo sapiens
ttactgtttgtcttctcccca

SEQ ID NO: 6559838 - DNA, 19 bp, Homo sapiens
ttactgttttgggcctcca

SEQ ID NO: 6559839 - DNA, 17 bp, Homo sapiens
ttactgtttttgctatt

SEQ ID NO: 6559840 - DNA, 21 bp, Homo sapiens
ttacttaaaccgccaaggctg

SEQ ID NO: 6559841 - DNA, 19 bp, Homo sapiens
ttacttaaagatttatcaa

SEQ ID NO: 6559842 - DNA, 20 bp, Homo sapiens
ttacttaaagatttatcaaa

SEQ ID NO: 6559843 - DNA, 18 bp, Homo sapiens
ttacttaaagcttgtttg

SEQ ID NO: 6559844 - DNA, 22 bp, Homo sapiens
ttacttaaatagcatctgctct

SEQ ID NO: 6559845 - DNA, 16 bp, Homo sapiens
ttacttaaccaggttt

SEQ ID NO: 6559846 - DNA, 18 bp, Homo sapiens
ttacttaagattcagttt

SEQ ID NO: 6559847 - DNA, 15 bp, Homo sapiens
ttacttaagtgttca

SEQ ID NO: 6559848 - DNA, 20 bp, Homo sapiens
ttacttaatgaccatgttat

SEQ ID NO: 6559849 - DNA, 22 bp, Homo sapiens
ttacttaattcagtctcagctg

SEQ ID NO: 6559850 - DNA, 19 bp, Homo sapiens
ttacttaattgccagcaaa

SEQ ID NO: 6559851 - DNA, 17 bp, Homo sapiens
ttacttacaaaaatggg

SEQ ID NO: 6559852 - DNA, 11 bp, Homo sapiens
ttacttacctg

SEQ ID NO: 6559853 - DNA, 15 bp, Homo sapiens
ttacttacctgcatg

SEQ ID NO: 6559854 - DNA, 12 bp, Homo sapiens
ttacttagagat

SEQ ID NO: 6559855 - DNA, 22 bp, Homo sapiens
ttacttagagatgctactgtca

SEQ ID NO: 6559856 - DNA, 18 bp, Homo sapiens
ttacttagcaagacctga

SEQ ID NO: 6559857 - DNA, 15 bp, Homo sapiens
ttacttagtattgca

SEQ ID NO: 6559858 - DNA, 14 bp, Homo sapiens
ttacttataaagag

SEQ ID NO: 6559859 - DNA, 18 bp, Homo sapiens
ttacttatacctctctca

SEQ ID NO: 6559860 - DNA, 17 bp, Homo sapiens
ttacttatccctgccca

SEQ ID NO: 6559861 - DNA, 16 bp, Homo sapiens
ttacttatcttatgcc

SEQ ID NO: 6559862 - DNA, 20 bp, Homo sapiens
ttacttcaaagtgcctgggc

SEQ ID NO: 6559863 - DNA, 13 bp, Homo sapiens
ttacttccagcaa

SEQ ID NO: 6559864 - DNA, 14 bp, Homo sapiens
ttacttccagcaaa

SEQ ID NO: 6559865 - DNA, 14 bp, Homo sapiens
ttacttccatgaat

SEQ ID NO: 6559866 - DNA, 12 bp, Homo sapiens
ttacttccttcc

SEQ ID NO: 6559867 - DNA, 15 bp, Homo sapiens
ttacttccttcctgc

SEQ ID NO: 6559868 - DNA, 18 bp, Homo sapiens
ttacttcctttcttacca

SEQ ID NO: 6559869 - DNA, 16 bp, Homo sapiens
ttacttctaatcttaa

SEQ ID NO: 6559870 - DNA, 20 bp, Homo sapiens
ttacttctaatcttaaatca

SEQ ID NO: 6559871 - DNA, 13 bp, Homo sapiens
ttacttcttctca

SEQ ID NO: 6559872 - DNA, 14 bp, Homo sapiens
ttacttcttgccct

SEQ ID NO: 6559873 - DNA, 19 bp, Homo sapiens
ttacttgaaaaaatgttct

SEQ ID NO: 6559874 - DNA, 15 bp, Homo sapiens
ttacttgaactttcc

SEQ ID NO: 6559875 - DNA, 19 bp, Homo sapiens
ttacttgaggatcatatga

SEQ ID NO: 6559876 - DNA, 18 bp, Homo sapiens
ttacttgagtatcataat

SEQ ID NO: 6559877 - DNA, 19 bp, Homo sapiens
ttacttgagtatcataata

SEQ ID NO: 6559878 - DNA, 13 bp, Homo sapiens
ttacttgcacaag

SEQ ID NO: 6559879 - DNA, 19 bp, Homo sapiens
ttacttgcacaagcttgta

SEQ ID NO: 6559880 - DNA, 21 bp, Homo sapiens
ttacttgcactgttactctta

SEQ ID NO: 6559881 - DNA, 19 bp, Homo sapiens
ttacttgcattgaatatat

SEQ ID NO: 6559882 - DNA, 16 bp, Homo sapiens
ttacttgcctatctga

SEQ ID NO: 6559883 - DNA, 17 bp, Homo sapiens
ttacttgcctatctgac

SEQ ID NO: 6559884 - DNA, 20 bp, Homo sapiens
ttacttgctataaatagatt

SEQ ID NO: 6559885 - DNA, 16 bp, Homo sapiens
ttacttgctgctcaca

SEQ ID NO: 6559886 - DNA, 14 bp, Homo sapiens
ttacttgcttctct

SEQ ID NO: 6559887 - DNA, 15 bp, Homo sapiens
ttacttgcttctcta

SEQ ID NO: 6559888 - DNA, 15 bp, Homo sapiens
ttacttgcttctgct

SEQ ID NO: 6559889 - DNA, 18 bp, Homo sapiens
ttacttgctttacctttt

SEQ ID NO: 6559890 - DNA, 17 bp, Homo sapiens
ttacttggaaatattaa

SEQ ID NO: 6559891 - DNA, 18 bp, Homo sapiens
ttacttggcaaattctga

SEQ ID NO: 6559892 - DNA, 19 bp, Homo sapiens
ttacttggtgtaattaata

SEQ ID NO: 6559893 - DNA, 22 bp, Homo sapiens
ttacttgtaaatataaagacgt

SEQ ID NO: 6559894 - DNA, 14 bp, Homo sapiens
ttacttgtaaattg

SEQ ID NO: 6559895 - DNA, 13 bp, Homo sapiens
ttacttgtggtgt

SEQ ID NO: 6559896 - DNA, 20 bp, Homo sapiens
ttacttgtggtgtgaccatg

SEQ ID NO: 6559897 - DNA, 15 bp, Homo sapiens
ttacttgtgttcatt

SEQ ID NO: 6559898 - DNA, 17 bp, Homo sapiens
ttacttgttgcctataa

SEQ ID NO: 6559899 - DNA, 23 bp, Homo sapiens
ttacttgttgcctataagccaaa

SEQ ID NO: 6559900 - DNA, 20 bp, Homo sapiens
ttacttgtttgtaagattta

SEQ ID NO: 6559901 - DNA, 15 bp, Homo sapiens
ttactttaacatgcc

SEQ ID NO: 6559902 - DNA, 18 bp, Homo sapiens
ttactttaatttccttga

SEQ ID NO: 6559903 - DNA, 20 bp, Homo sapiens
ttactttactgcctgaataa

SEQ ID NO: 6559904 - DNA, 23 bp, Homo sapiens
ttactttaggtagtagaatctca

SEQ ID NO: 6559905 - DNA, 15 bp, Homo sapiens
ttactttatgtttgt

SEQ ID NO: 6559906 - DNA, 14 bp, Homo sapiens
ttactttcaaaatg

SEQ ID NO: 6559907 - DNA, 12 bp, Homo sapiens
ttactttcagaa

SEQ ID NO: 6559908 - DNA, 13 bp, Homo sapiens
ttactttcagaat

SEQ ID NO: 6559909 - DNA, 15 bp, Homo sapiens
ttactttcagaatgt

SEQ ID NO: 6559910 - DNA, 12 bp, Homo sapiens
ttactttcctcc

SEQ ID NO: 6559911 - DNA, 13 bp, Homo sapiens
ttactttctctgt

SEQ ID NO: 6559912 - DNA, 16 bp, Homo sapiens
ttactttctctgtagt

SEQ ID NO: 6559913 - DNA, 13 bp, Homo sapiens
ttactttctgccg

SEQ ID NO: 6559914 - DNA, 14 bp, Homo sapiens
ttactttctgccgc

SEQ ID NO: 6559915 - DNA, 11 bp, Homo sapiens
ttactttctgt

SEQ ID NO: 6559916 - DNA, 15 bp, Homo sapiens
ttactttcttaatgt

SEQ ID NO: 6559917 - DNA, 15 bp, Homo sapiens
ttactttgaatagtc

SEQ ID NO: 6559918 - DNA, 16 bp, Homo sapiens
ttactttgaatagtcc

SEQ ID NO: 6559919 - DNA, 14 bp, Homo sapiens
ttactttgccaact

SEQ ID NO: 6559920 - DNA, 21 bp, Homo sapiens
ttactttggaatgactataaa

SEQ ID NO: 6559921 - DNA, 18 bp, Homo sapiens
ttactttggtttagtctt

SEQ ID NO: 6559922 - DNA, 11 bp, Homo sapiens
ttactttgtaa

SEQ ID NO: 6559923 - DNA, 14 bp, Homo sapiens
ttactttgtaaatt

SEQ ID NO: 6559924 - DNA, 20 bp, Homo sapiens
ttactttgtaaattctgatt

SEQ ID NO: 6559925 - DNA, 23 bp, Homo sapiens
ttactttgtaaattctgatttct

SEQ ID NO: 6559926 - DNA, 15 bp, Homo sapiens
ttactttgtatgata

SEQ ID NO: 6559927 - DNA, 13 bp, Homo sapiens
ttactttgtgcaa

SEQ ID NO: 6559928 - DNA, 17 bp, Homo sapiens
ttacttttaaacagtga

SEQ ID NO: 6559929 - DNA, 15 bp, Homo sapiens
ttacttttaaactgt

SEQ ID NO: 6559930 - DNA, 16 bp, Homo sapiens
ttacttttaaactgtg

SEQ ID NO: 6559931 - DNA, 19 bp, Homo sapiens
ttacttttaaactgtgtac

SEQ ID NO: 6559932 - DNA, 15 bp, Homo sapiens
ttacttttaaatgtc

SEQ ID NO: 6559933 - DNA, 22 bp, Homo sapiens
ttacttttaataaagtatgaat

SEQ ID NO: 6559934 - DNA, 23 bp, Homo sapiens
ttacttttataataaaaggaaaa

SEQ ID NO: 6559935 - DNA, 14 bp, Homo sapiens
ttacttttattatt

SEQ ID NO: 6559936 - DNA, 23 bp, Homo sapiens
ttacttttatttgcaacatttac

SEQ ID NO: 6559937 - DNA, 16 bp, Homo sapiens
ttacttttcatatttg

SEQ ID NO: 6559938 - DNA, 21 bp, Homo sapiens
ttacttttcatatttgcacta

SEQ ID NO: 6559939 - DNA, 18 bp, Homo sapiens
ttacttttcctcttagaa

SEQ ID NO: 6559940 - DNA, 19 bp, Homo sapiens
ttacttttccttgcataca

SEQ ID NO: 6559941 - DNA, 17 bp, Homo sapiens
ttacttttctgcaatgt

SEQ ID NO: 6559942 - DNA, 15 bp, Homo sapiens
ttacttttctgccaa

SEQ ID NO: 6559943 - DNA, 19 bp, Homo sapiens
ttacttttctgccaaaata

SEQ ID NO: 6559944 - DNA, 21 bp, Homo sapiens
ttacttttctgccaaaataaa

SEQ ID NO: 6559945 - DNA, 15 bp, Homo sapiens
ttacttttgaaaaag

SEQ ID NO: 6559946 - DNA, 14 bp, Homo sapiens
ttacttttgtaaat

SEQ ID NO: 6559947 - DNA, 19 bp, Homo sapiens
ttacttttgttctgtattt

SEQ ID NO: 6559948 - DNA, 14 bp, Homo sapiens
ttactttttaaaat

SEQ ID NO: 6559949 - DNA, 17 bp, Homo sapiens
ttactttttaaacagtg

SEQ ID NO: 6559950 - DNA, 14 bp, Homo sapiens
ttactttttaactg

SEQ ID NO: 6559951 - DNA, 13 bp, Homo sapiens
ttactttttatga

SEQ ID NO: 6559952 - DNA, 17 bp, Homo sapiens
ttactttttcccatctg

SEQ ID NO: 6559953 - DNA, 18 bp, Homo sapiens
ttactttttcttgtattc

SEQ ID NO: 6559954 - DNA, 16 bp, Homo sapiens
ttactttttggctgga

SEQ ID NO: 6559955 - DNA, 14 bp, Homo sapiens
ttactttttgtaaa

SEQ ID NO: 6559956 - DNA, 17 bp, Homo sapiens
ttacttttttaacatgt

SEQ ID NO: 6559957 - DNA, 17 bp, Homo sapiens
ttactttttttctgtga

SEQ ID NO: 6559958 - DNA, 19 bp, Homo sapiens
ttactttttttctgtgaca

SEQ ID NO: 6559959 - DNA, 22 bp, Homo sapiens
ttagaaaaaaaaagaaaaatca

SEQ ID NO: 6559960 - DNA, 13 bp, Homo sapiens
ttagaaaaaaaca

SEQ ID NO: 6559961 - DNA, 13 bp, Homo sapiens
ttagaaaaaaact

SEQ ID NO: 6559962 - DNA, 15 bp, Homo sapiens
ttagaaaaaaatgaa

SEQ ID NO: 6559963 - DNA, 16 bp, Homo sapiens
ttagaaaaaaatgaaa

SEQ ID NO: 6559964 - DNA, 16 bp, Homo sapiens
ttagaaaaaaattact

SEQ ID NO: 6559965 - DNA, 22 bp, Homo sapiens
ttagaaaaaactggaaacatct

SEQ ID NO: 6559966 - DNA, 17 bp, Homo sapiens
ttagaaaaattcctaag

SEQ ID NO: 6559967 - DNA, 13 bp, Homo sapiens
ttagaaaactttg

SEQ ID NO: 6559968 - DNA, 14 bp, Homo sapiens
ttagaaaactttgt

SEQ ID NO: 6559969 - DNA, 20 bp, Homo sapiens
ttagaaaaggtgataaaatc

SEQ ID NO: 6559970 - DNA, 18 bp, Homo sapiens
ttagaaaataaatacaag

SEQ ID NO: 6559971 - DNA, 20 bp, Homo sapiens
ttagaaaatgacttatttct

SEQ ID NO: 6559972 - DNA, 23 bp, Homo sapiens
ttagaaaatgtttggaatttaag

SEQ ID NO: 6559973 - DNA, 20 bp, Homo sapiens
ttagaaacaaacaaaactct

SEQ ID NO: 6559974 - DNA, 21 bp, Homo sapiens
ttagaaacaaacaaaactctt

SEQ ID NO: 6559975 - DNA, 14 bp, Homo sapiens
ttagaaacaatgtt

SEQ ID NO: 6559976 - DNA, 22 bp, Homo sapiens
ttagaaacacataattaacact

SEQ ID NO: 6559977 - DNA, 11 bp, Homo sapiens
ttagaaacatg

SEQ ID NO: 6559978 - DNA, 12 bp, Homo sapiens
ttagaaaccaaa

SEQ ID NO: 6559979 - DNA, 13 bp, Homo sapiens
ttagaaactgaaa

SEQ ID NO: 6559980 - DNA, 16 bp, Homo sapiens
ttagaaactgaaaaat

SEQ ID NO: 6559981 - DNA, 12 bp, Homo sapiens
ttagaaactgga

SEQ ID NO: 6559982 - DNA, 13 bp, Homo sapiens
ttagaaactggaa

SEQ ID NO: 6559983 - DNA, 19 bp, Homo sapiens
ttagaaactggaaatacta

SEQ ID NO: 6559984 - DNA, 13 bp, Homo sapiens
ttagaaagaatta

SEQ ID NO: 6559985 - DNA, 14 bp, Homo sapiens
ttagaaagaattag

SEQ ID NO: 6559986 - DNA, 15 bp, Homo sapiens
ttagaaagaattagc

SEQ ID NO: 6559987 - DNA, 17 bp, Homo sapiens
ttagaaagactttctaa

SEQ ID NO: 6559988 - DNA, 18 bp, Homo sapiens
ttagaaagactttctaaa

SEQ ID NO: 6559989 - DNA, 12 bp, Homo sapiens
ttagaaagcatt

SEQ ID NO: 6559990 - DNA, 14 bp, Homo sapiens
ttagaaagcatttg

SEQ ID NO: 6559991 - DNA, 21 bp, Homo sapiens
ttagaaagcatttgaatgcat

SEQ ID NO: 6559992 - DNA, 20 bp, Homo sapiens
ttagaaaggacaacagttct

SEQ ID NO: 6559993 - DNA, 21 bp, Homo sapiens
ttagaaagtaagagctctaag

SEQ ID NO: 6559994 - DNA, 17 bp, Homo sapiens
ttagaaataaagcatct

SEQ ID NO: 6559995 - DNA, 14 bp, Homo sapiens
ttagaaataataaa

SEQ ID NO: 6559996 - DNA, 13 bp, Homo sapiens
tttccaagagctg

SEQ ID NO: 6559997 - DNA, 14 bp, Homo sapiens
tttccaagagctga

SEQ ID NO: 6559998 - DNA, 22 bp, Homo sapiens
tttccaagatgtcccattgata

SEQ ID NO: 6559999 - DNA, 13 bp, Homo sapiens
tttccaagcaaat

SEQ ID NO: 6560000 - DNA, 18 bp, Homo sapiens
tttccaagccctcagctg

SEQ ID NO: 6560001 - DNA, 21 bp, Homo sapiens
tttccaagctgttagttgctg

SEQ ID NO: 6560002 - DNA, 12 bp, Homo sapiens
tttccaaggaag

SEQ ID NO: 6560003 - DNA, 13 bp, Homo sapiens
tttccaaggagct

SEQ ID NO: 6560004 - DNA, 11 bp, Homo sapiens
tttccaaggcc

SEQ ID NO: 6560005 - DNA, 21 bp, Homo sapiens
tttccaagtcctttaactcgt

SEQ ID NO: 6560006 - DNA, 20 bp, Homo sapiens
tttccaagtgtataatgttg

SEQ ID NO: 6560007 - DNA, 16 bp, Homo sapiens
tttccaagtgtgcata

SEQ ID NO: 6560008 - DNA, 14 bp, Homo sapiens
tttccaatgtgttc

SEQ ID NO: 6560009 - DNA, 14 bp, Homo sapiens
tttccaattctcct

SEQ ID NO: 6560010 - DNA, 15 bp, Homo sapiens
tttccacaaatcagt

SEQ ID NO: 6560011 - DNA, 20 bp, Homo sapiens
tttccacaagattcccagag

SEQ ID NO: 6560012 - DNA, 16 bp, Homo sapiens
tttccacacagcctgt

SEQ ID NO: 6560013 - DNA, 14 bp, Homo sapiens
tttccacaccatca

SEQ ID NO: 6560014 - DNA, 14 bp, Homo sapiens
tttccacacgcatt

SEQ ID NO: 6560015 - DNA, 22 bp, Homo sapiens
tttccacagatttttttgtaag

SEQ ID NO: 6560016 - DNA, 22 bp, Homo sapiens
tttccacataaattttaattca

SEQ ID NO: 6560017 - DNA, 20 bp, Homo sapiens
tttccacataaggaaactgg

SEQ ID NO: 6560018 - DNA, 15 bp, Homo sapiens
tttccaccaaattct

SEQ ID NO: 6560019 - DNA, 15 bp, Homo sapiens
tttccaccaactttt

SEQ ID NO: 6560020 - DNA, 22 bp, Homo sapiens
tttccaccaagggtatctgctg

SEQ ID NO: 6560021 - DNA, 20 bp, Homo sapiens
tttccaccatcaaatgctgt

SEQ ID NO: 6560022 - DNA, 13 bp, Homo sapiens
tttccacccagac

SEQ ID NO: 6560023 - DNA, 22 bp, Homo sapiens
tttccacccagaccctccttcc

SEQ ID NO: 6560024 - DNA, 19 bp, Homo sapiens
tttccacgatgaaaaactt

SEQ ID NO: 6560025 - DNA, 16 bp, Homo sapiens
tttccacgcagttctt

SEQ ID NO: 6560026 - DNA, 17 bp, Homo sapiens
tttccacgcagttcttt

SEQ ID NO: 6560027 - DNA, 23 bp, Homo sapiens
tttccacggagccactcctctga

SEQ ID NO: 6560028 - DNA, 18 bp, Homo sapiens
tttccacgtaagtcactg

SEQ ID NO: 6560029 - DNA, 16 bp, Homo sapiens
tttccactaaaaatat

SEQ ID NO: 6560030 - DNA, 13 bp, Homo sapiens
tttccactactgc

SEQ ID NO: 6560031 - DNA, 23 bp, Homo sapiens
tttccactataattttacaaagt

SEQ ID NO: 6560032 - DNA, 19 bp, Homo sapiens
tttccactattttcaaaga

SEQ ID NO: 6560033 - DNA, 20 bp, Homo sapiens
tttccactattttcaaagaa

SEQ ID NO: 6560034 - DNA, 15 bp, Homo sapiens
tttccactgaacaaa

SEQ ID NO: 6560035 - DNA, 12 bp, Homo sapiens
tttccactgaag

SEQ ID NO: 6560036 - DNA, 19 bp, Homo sapiens
tttccactgacaacgaaag

SEQ ID NO: 6560037 - DNA, 12 bp, Homo sapiens
tttccactgtaa

SEQ ID NO: 6560038 - DNA, 18 bp, Homo sapiens
tttccactgtcttgcctg

SEQ ID NO: 6560039 - DNA, 23 bp, Homo sapiens
tttccactgtcttgcctgccagg

SEQ ID NO: 6560040 - DNA, 15 bp, Homo sapiens
tttccacttcttcat

SEQ ID NO: 6560041 - DNA, 15 bp, Homo sapiens
tttccacttcttcct

SEQ ID NO: 6560042 - DNA, 13 bp, Homo sapiens
tttccagaaaata

SEQ ID NO: 6560043 - DNA, 16 bp, Homo sapiens
tttccagaaaatataa

SEQ ID NO: 6560044 - DNA, 17 bp, Homo sapiens
tttccagaaaatataaa

SEQ ID NO: 6560045 - DNA, 15 bp, Homo sapiens
tttccagaaaccaaa

SEQ ID NO: 6560046 - DNA, 21 bp, Homo sapiens
tttccagaaagaaaatgaatt

SEQ ID NO: 6560047 - DNA, 23 bp, Homo sapiens
tttccagaaagaaaatgaatttg

SEQ ID NO: 6560048 - DNA, 21 bp, Homo sapiens
tttccagaaatacctgtctag

SEQ ID NO: 6560049 - DNA, 20 bp, Homo sapiens
tttccagaactgcacaatga

SEQ ID NO: 6560050 - DNA, 19 bp, Homo sapiens
tttccagaatgaccttgag

SEQ ID NO: 6560051 - DNA, 19 bp, Homo sapiens
tttccagacttccttgaga

SEQ ID NO: 6560052 - DNA, 21 bp, Homo sapiens
tttccagagtccggaggcagc

SEQ ID NO: 6560053 - DNA, 17 bp, Homo sapiens
tttccagcactttgtat

SEQ ID NO: 6560054 - DNA, 21 bp, Homo sapiens
tttccagcagaagacaaaaag

SEQ ID NO: 6560055 - DNA, 23 bp, Homo sapiens
tttccagcagaagacaaaaagac

SEQ ID NO: 6560056 - DNA, 18 bp, Homo sapiens
tttccagcattcccaggt

SEQ ID NO: 6560057 - DNA, 20 bp, Homo sapiens
tttccagccgtgttgtagct

SEQ ID NO: 6560058 - DNA, 22 bp, Homo sapiens
tttccagcctcctgctggctct

SEQ ID NO: 6560059 - DNA, 18 bp, Homo sapiens
tttccagctccgtgtttc

SEQ ID NO: 6560060 - DNA, 12 bp, Homo sapiens
tttccaggactc

SEQ ID NO: 6560061 - DNA, 18 bp, Homo sapiens
tttccaggatcctgcagg

SEQ ID NO: 6560062 - DNA, 19 bp, Homo sapiens
tttccaggatcctgcagga

SEQ ID NO: 6560063 - DNA, 18 bp, Homo sapiens
tttccaggcaccctcagg

SEQ ID NO: 6560064 - DNA, 16 bp, Homo sapiens
tttccaggcttctgct

SEQ ID NO: 6560065 - DNA, 18 bp, Homo sapiens
tttccagggtgtagccta

SEQ ID NO: 6560066 - DNA, 16 bp, Homo sapiens
tttccagggttattta

SEQ ID NO: 6560067 - DNA, 15 bp, Homo sapiens
tttccagtacctttg

SEQ ID NO: 6560068 - DNA, 14 bp, Homo sapiens
tttccagtattgaa

SEQ ID NO: 6560069 - DNA, 23 bp, Homo sapiens
tttccagtattgaaaacttcaaa

SEQ ID NO: 6560070 - DNA, 15 bp, Homo sapiens
tttccagtattttag

SEQ ID NO: 6560071 - DNA, 12 bp, Homo sapiens
tttccagtgcaa

SEQ ID NO: 6560072 - DNA, 18 bp, Homo sapiens
tttccagtgttctatttg

SEQ ID NO: 6560073 - DNA, 18 bp, Homo sapiens
tttccagttgctgtggac

SEQ ID NO: 6560074 - DNA, 12 bp, Homo sapiens
tttccagttttt

SEQ ID NO: 6560075 - DNA, 23 bp, Homo sapiens
tttccagtttttctttactttct

SEQ ID NO: 6560076 - DNA, 24 bp, Homo sapiens
tttccataagcttggtgacaaaat

SEQ ID NO: 6560077 - DNA, 16 bp, Homo sapiens
tttccatacagggtct

SEQ ID NO: 6560078 - DNA, 21 bp, Homo sapiens
tttccatacgtgcccatttca

SEQ ID NO: 6560079 - DNA, 22 bp, Homo sapiens
tttccatagctcttcacttcct

SEQ ID NO: 6560080 - DNA, 14 bp, Homo sapiens
tttccatatagttt

SEQ ID NO: 6560081 - DNA, 22 bp, Homo sapiens
tttccatatggattttctattg

SEQ ID NO: 6560082 - DNA, 22 bp, Homo sapiens
tttccatatttttttccttaca

SEQ ID NO: 6560083 - DNA, 14 bp, Homo sapiens
tttccatcaactcc

SEQ ID NO: 6560084 - DNA, 23 bp, Homo sapiens
tttccatcaactcccaacttctt

SEQ ID NO: 6560085 - DNA, 16 bp, Homo sapiens
tttccatcataattct

SEQ ID NO: 6560086 - DNA, 17 bp, Homo sapiens
tttccatcatgtctgta

SEQ ID NO: 6560087 - DNA, 16 bp, Homo sapiens
tttccatcatttctgt

SEQ ID NO: 6560088 - DNA, 14 bp, Homo sapiens
tttccatcccactc

SEQ ID NO: 6560089 - DNA, 14 bp, Homo sapiens
tttccatcctgagg

SEQ ID NO: 6560090 - DNA, 22 bp, Homo sapiens
tttccatcctgaggtgcctccc

SEQ ID NO: 6560091 - DNA, 11 bp, Homo sapiens
tttccatctct

SEQ ID NO: 6560092 - DNA, 15 bp, Homo sapiens
tttccatctctgcct

SEQ ID NO: 6560093 - DNA, 16 bp, Homo sapiens
tttccatctctgcctg

SEQ ID NO: 6560094 - DNA, 15 bp, Homo sapiens
tttccatctctggta

SEQ ID NO: 6560095 - DNA, 19 bp, Homo sapiens
tttccatcttaatgttact

SEQ ID NO: 6560096 - DNA, 14 bp, Homo sapiens
tttccatgacagta

SEQ ID NO: 6560097 - DNA, 19 bp, Homo sapiens
tttccatgactgcatttta

SEQ ID NO: 6560098 - DNA, 17 bp, Homo sapiens
tttccatgagtcccctg

SEQ ID NO: 6560099 - DNA, 21 bp, Homo sapiens
tttccatgatttagcaagcaa

SEQ ID NO: 6560100 - DNA, 19 bp, Homo sapiens
tttccatggcaaatgggca

SEQ ID NO: 6560101 - DNA, 20 bp, Homo sapiens
tttccatggcaggaaggctt

SEQ ID NO: 6560102 - DNA, 19 bp, Homo sapiens
tttccatgggaccacaact

SEQ ID NO: 6560103 - DNA, 18 bp, Homo sapiens
tttccatgggagccagct

SEQ ID NO: 6560104 - DNA, 22 bp, Homo sapiens
tttccatgggccccaccattta

SEQ ID NO: 6560105 - DNA, 14 bp, Homo sapiens
tttccatggtgcaa

SEQ ID NO: 6560106 - DNA, 13 bp, Homo sapiens
tttccatgtatct

SEQ ID NO: 6560107 - DNA, 14 bp, Homo sapiens
tttccatgttgctg

SEQ ID NO: 6560108 - DNA, 13 bp, Homo sapiens
tttccatgttttt

SEQ ID NO: 6560109 - DNA, 21 bp, Homo sapiens
tttccattaaagtctgttgtt

SEQ ID NO: 6560110 - DNA, 17 bp, Homo sapiens
tttccattaacagcaat

SEQ ID NO: 6560111 - DNA, 15 bp, Homo sapiens
tttccattacaagta

SEQ ID NO: 6560112 - DNA, 22 bp, Homo sapiens
tttccattcatgccaaagcaaa

SEQ ID NO: 6560113 - DNA, 12 bp, Homo sapiens
tttccattcttc

SEQ ID NO: 6560114 - DNA, 14 bp, Homo sapiens
tttccattcttctt

SEQ ID NO: 6560115 - DNA, 20 bp, Homo sapiens
tttccattcttttaaatggg

SEQ ID NO: 6560116 - DNA, 14 bp, Homo sapiens
tttccattgtttga

SEQ ID NO: 6560117 - DNA, 14 bp, Homo sapiens
tttccatttctcaa

SEQ ID NO: 6560118 - DNA, 13 bp, Homo sapiens
tttccatttctga

SEQ ID NO: 6560119 - DNA, 13 bp, Homo sapiens
tttccatttggat

SEQ ID NO: 6560120 - DNA, 17 bp, Homo sapiens
tttccatttggatttta

SEQ ID NO: 6560121 - DNA, 14 bp, Homo sapiens
tttccatttggcac

SEQ ID NO: 6560122 - DNA, 18 bp, Homo sapiens
tttccatttggcactatg

SEQ ID NO: 6560123 - DNA, 15 bp, Homo sapiens
tttccatttgtatta

SEQ ID NO: 6560124 - DNA, 13 bp, Homo sapiens
tttcccaaaacaa

SEQ ID NO: 6560125 - DNA, 22 bp, Homo sapiens
tttcccaagctagactgtgtct

SEQ ID NO: 6560126 - DNA, 21 bp, Homo sapiens
tttcccaatattgagcagttc

SEQ ID NO: 6560127 - DNA, 23 bp, Homo sapiens
tttcccaatctctacccctttct

SEQ ID NO: 6560128 - DNA, 15 bp, Homo sapiens
tttcccaattaggaa

SEQ ID NO: 6560129 - DNA, 21 bp, Homo sapiens
tttcccacaattcttttgaaa

SEQ ID NO: 6560130 - DNA, 20 bp, Homo sapiens
tttcccacaccgtgtaaacc

SEQ ID NO: 6560131 - DNA, 18 bp, Homo sapiens
tttcccacactgtgaact

SEQ ID NO: 6560132 - DNA, 14 bp, Homo sapiens
tttcccacatcttt

SEQ ID NO: 6560133 - DNA, 15 bp, Homo sapiens
tttcccacatctttc

SEQ ID NO: 6560134 - DNA, 19 bp, Homo sapiens
tttcccaccaccttggact

SEQ ID NO: 6560135 - DNA, 13 bp, Homo sapiens
tttcccaccagct

SEQ ID NO: 6560136 - DNA, 21 bp, Homo sapiens
tttcccaccattcctgccttt

SEQ ID NO: 6560137 - DNA, 18 bp, Homo sapiens
tttcccactgcaccccct

SEQ ID NO: 6560138 - DNA, 22 bp, Homo sapiens
tttcccactgcaccccctcctg

SEQ ID NO: 6560139 - DNA, 19 bp, Homo sapiens
tttcccacttcccaccctg

SEQ ID NO: 6560140 - DNA, 19 bp, Homo sapiens
tttcccagcccaaattctc

SEQ ID NO: 6560141 - DNA, 14 bp, Homo sapiens
tttcccaggaatat

SEQ ID NO: 6560142 - DNA, 16 bp, Homo sapiens
tttcccaggaccctga

SEQ ID NO: 6560143 - DNA, 14 bp, Homo sapiens
tttcccaggagaaa

SEQ ID NO: 6560144 - DNA, 16 bp, Homo sapiens
tttcccaggagaaaga

SEQ ID NO: 6560145 - DNA, 17 bp, Homo sapiens
tttcccagtgagcctct

SEQ ID NO: 6560146 - DNA, 17 bp, Homo sapiens
tttcccatcaccccttc

SEQ ID NO: 6560147 - DNA, 22 bp, Homo sapiens
tttcccatctgcaccccttctc

SEQ ID NO: 6560148 - DNA, 17 bp, Homo sapiens
tttcccatgatccagaa

SEQ ID NO: 6560149 - DNA, 15 bp, Homo sapiens
tttcccatgatttca

SEQ ID NO: 6560150 - DNA, 22 bp, Homo sapiens
tttcccatttgtgccagaggaa

SEQ ID NO: 6560151 - DNA, 15 bp, Homo sapiens
tttccccaacagtgt

SEQ ID NO: 6560152 - DNA, 19 bp, Homo sapiens
tttccccaacagtgtgaag

SEQ ID NO: 6560153 - DNA, 18 bp, Homo sapiens
tttccccaattatcctcc

SEQ ID NO: 6560154 - DNA, 23 bp, Homo sapiens
tttccccacccccctctctttct

SEQ ID NO: 6560155 - DNA, 15 bp, Homo sapiens
tttccccagacttgt

SEQ ID NO: 6560156 - DNA, 15 bp, Homo sapiens
tttccccagccacag

SEQ ID NO: 6560157 - DNA, 13 bp, Homo sapiens
tttccccagccca

SEQ ID NO: 6560158 - DNA, 19 bp, Homo sapiens
tttccccagtgtggcccca

SEQ ID NO: 6560159 - DNA, 17 bp, Homo sapiens
tttccccatctctgtct

SEQ ID NO: 6560160 - DNA, 23 bp, Homo sapiens
tttccccatctctgtctggggct

SEQ ID NO: 6560161 - DNA, 17 bp, Homo sapiens
tttccccattcagtgac

SEQ ID NO: 6560162 - DNA, 23 bp, Homo sapiens
tttccccatttaggtttctgagt

SEQ ID NO: 6560163 - DNA, 15 bp, Homo sapiens
tttcccccaaagtgg

SEQ ID NO: 6560164 - DNA, 19 bp, Homo sapiens
tttcccccaaatcttcctc

SEQ ID NO: 6560165 - DNA, 22 bp, Homo sapiens
tttcccccaccctactccctcc

SEQ ID NO: 6560166 - DNA, 14 bp, Homo sapiens
tttcccccaggaaa

SEQ ID NO: 6560167 - DNA, 23 bp, Homo sapiens
tttccccccaacccggaaacaga

SEQ ID NO: 6560168 - DNA, 13 bp, Homo sapiens
tttccccccactc

SEQ ID NO: 6560169 - DNA, 15 bp, Homo sapiens
tttcccccgagctct

SEQ ID NO: 6560170 - DNA, 23 bp, Homo sapiens
tttccccctgcattctttctgta

SEQ ID NO: 6560171 - DNA, 22 bp, Homo sapiens
tttccccctgtttttagagctt

SEQ ID NO: 6560172 - DNA, 12 bp, Homo sapiens
tttcccccttcc

SEQ ID NO: 6560173 - DNA, 15 bp, Homo sapiens
tttcccccttgagga

SEQ ID NO: 6560174 - DNA, 13 bp, Homo sapiens
tttccccctttct

SEQ ID NO: 6560175 - DNA, 13 bp, Homo sapiens
ttagaaatagaca

SEQ ID NO: 6560176 - DNA, 15 bp, Homo sapiens
ttagaaatatccttt

SEQ ID NO: 6560177 - DNA, 22 bp, Homo sapiens
ttagaaatattttaaaatcagc

SEQ ID NO: 6560178 - DNA, 17 bp, Homo sapiens
ttagaaatcacaacaaa

SEQ ID NO: 6560179 - DNA, 20 bp, Homo sapiens
ttagaaatgtaaactgccat

SEQ ID NO: 6560180 - DNA, 21 bp, Homo sapiens
ttagaaatgtaaactgccata

SEQ ID NO: 6560181 - DNA, 13 bp, Homo sapiens
ttagaaatgtgaa

SEQ ID NO: 6560182 - DNA, 15 bp, Homo sapiens
ttagaaatgtgaaga

SEQ ID NO: 6560183 - DNA, 18 bp, Homo sapiens
ttagaaatgtttattgac

SEQ ID NO: 6560184 - DNA, 13 bp, Homo sapiens
ttagaaattacaa

SEQ ID NO: 6560185 - DNA, 14 bp, Homo sapiens
ttagaaattagaaa

SEQ ID NO: 6560186 - DNA, 14 bp, Homo sapiens
ttagaaatttaaca

SEQ ID NO: 6560187 - DNA, 17 bp, Homo sapiens
ttagaaatttatttcct

SEQ ID NO: 6560188 - DNA, 16 bp, Homo sapiens
ttagaacaattttctt

SEQ ID NO: 6560189 - DNA, 20 bp, Homo sapiens
ttagaacacacacacttact

SEQ ID NO: 6560190 - DNA, 12 bp, Homo sapiens
ttagaacactat

SEQ ID NO: 6560191 - DNA, 19 bp, Homo sapiens
ttagaacactattttcaga

SEQ ID NO: 6560192 - DNA, 21 bp, Homo sapiens
ttagaacactattttcagaat

SEQ ID NO: 6560193 - DNA, 20 bp, Homo sapiens
ttagaacactggtttaaagg

SEQ ID NO: 6560194 - DNA, 15 bp, Homo sapiens
ttagaacagaaaaca

SEQ ID NO: 6560195 - DNA, 17 bp, Homo sapiens
ttagaacagaaaacaac

SEQ ID NO: 6560196 - DNA, 22 bp, Homo sapiens
ttagaacagaaaacaacaaaaa

SEQ ID NO: 6560197 - DNA, 20 bp, Homo sapiens
ttagaacaggcaagtgaaga

SEQ ID NO: 6560198 - DNA, 14 bp, Homo sapiens
ttagaacaggtttt

SEQ ID NO: 6560199 - DNA, 18 bp, Homo sapiens
ttagaacattttaattca

SEQ ID NO: 6560200 - DNA, 21 bp, Homo sapiens
ttagaaccacagcagacacca

SEQ ID NO: 6560201 - DNA, 21 bp, Homo sapiens
ttagaaccaccaaaattatag

SEQ ID NO: 6560202 - DNA, 15 bp, Homo sapiens
ttagaaccccaggtg

SEQ ID NO: 6560203 - DNA, 19 bp, Homo sapiens
ttagaacccttctgctttc

SEQ ID NO: 6560204 - DNA, 20 bp, Homo sapiens
ttagaacccttctgctttct

SEQ ID NO: 6560205 - DNA, 20 bp, Homo sapiens
ttagaacgagcctggaagca

SEQ ID NO: 6560206 - DNA, 22 bp, Homo sapiens
ttagaagaaaacatatatttta

SEQ ID NO: 6560207 - DNA, 15 bp, Homo sapiens
ttagaagaagtgtgt

SEQ ID NO: 6560208 - DNA, 12 bp, Homo sapiens
ttagaagagagc

SEQ ID NO: 6560209 - DNA, 18 bp, Homo sapiens
ttagaagatagatgcact

SEQ ID NO: 6560210 - DNA, 19 bp, Homo sapiens
ttagaagatctgcttccct

SEQ ID NO: 6560211 - DNA, 16 bp, Homo sapiens
ttagaagattctatgt

SEQ ID NO: 6560212 - DNA, 17 bp, Homo sapiens
ttagaagattctatgtt

SEQ ID NO: 6560213 - DNA, 22 bp, Homo sapiens
ttagaagcaaggagaaaatata

SEQ ID NO: 6560214 - DNA, 13 bp, Homo sapiens
ttagaagcagagg

SEQ ID NO: 6560215 - DNA, 16 bp, Homo sapiens
ttagaagcctaattgt

SEQ ID NO: 6560216 - DNA, 13 bp, Homo sapiens
ttagaagcctgca

SEQ ID NO: 6560217 - DNA, 17 bp, Homo sapiens
ttagaagctcacgcctt

SEQ ID NO: 6560218 - DNA, 14 bp, Homo sapiens
ttagaagtctttca

SEQ ID NO: 6560219 - DNA, 17 bp, Homo sapiens
ttagaagtgcatttctg

SEQ ID NO: 6560220 - DNA, 12 bp, Homo sapiens
ttagaagtgtca

SEQ ID NO: 6560221 - DNA, 13 bp, Homo sapiens
ttagaagtgtcat

SEQ ID NO: 6560222 - DNA, 15 bp, Homo sapiens
ttagaataaaattgt

SEQ ID NO: 6560223 - DNA, 13 bp, Homo sapiens
ttagaataaagtt

SEQ ID NO: 6560224 - DNA, 16 bp, Homo sapiens
ttagaataaggaggag

SEQ ID NO: 6560225 - DNA, 17 bp, Homo sapiens
ttagaataaggaggagg

SEQ ID NO: 6560226 - DNA, 19 bp, Homo sapiens
ttagaataataaatattta

SEQ ID NO: 6560227 - DNA, 14 bp, Homo sapiens
ttagaataatttta

SEQ ID NO: 6560228 - DNA, 23 bp, Homo sapiens
ttagaataattttattagaataa

SEQ ID NO: 6560229 - DNA, 17 bp, Homo sapiens
ttagaatagtgtcagtt

SEQ ID NO: 6560230 - DNA, 18 bp, Homo sapiens
ttagaatataaaaaatgt

SEQ ID NO: 6560231 - DNA, 14 bp, Homo sapiens
ttagaatatattaa

SEQ ID NO: 6560232 - DNA, 19 bp, Homo sapiens
ttagaatattgtaactcac

SEQ ID NO: 6560233 - DNA, 17 bp, Homo sapiens
ttagaatcaaacatttt

SEQ ID NO: 6560234 - DNA, 18 bp, Homo sapiens
ttagaatcaaacattttg

SEQ ID NO: 6560235 - DNA, 17 bp, Homo sapiens
ttagaatcaaatactca

SEQ ID NO: 6560236 - DNA, 21 bp, Homo sapiens
ttagaatcagaataaagttgt

SEQ ID NO: 6560237 - DNA, 21 bp, Homo sapiens
ttagaatcagccttgaaacat

SEQ ID NO: 6560238 - DNA, 22 bp, Homo sapiens
ttagaatccaaacttggatttt

SEQ ID NO: 6560239 - DNA, 17 bp, Homo sapiens
ttagaatcccatggatg

SEQ ID NO: 6560240 - DNA, 23 bp, Homo sapiens
ttagaatccctgtgttaatttaa

SEQ ID NO: 6560241 - DNA, 14 bp, Homo sapiens
ttagaatctagaaa

SEQ ID NO: 6560242 - DNA, 15 bp, Homo sapiens
ttagaatctattttc

SEQ ID NO: 6560243 - DNA, 16 bp, Homo sapiens
ttagaatctattttct

SEQ ID NO: 6560244 - DNA, 17 bp, Homo sapiens
ttagaatctattttcta

SEQ ID NO: 6560245 - DNA, 23 bp, Homo sapiens
ttagaatctattttctatgtact

SEQ ID NO: 6560246 - DNA, 17 bp, Homo sapiens
ttagaatgaatttatct

SEQ ID NO: 6560247 - DNA, 22 bp, Homo sapiens
ttagaatgaatttatctttacc

SEQ ID NO: 6560248 - DNA, 17 bp, Homo sapiens
ttagaatgacaggaacc

SEQ ID NO: 6560249 - DNA, 12 bp, Homo sapiens
ttagaatgccat

SEQ ID NO: 6560250 - DNA, 23 bp, Homo sapiens
ttagaatgccggttaaattccat

SEQ ID NO: 6560251 - DNA, 21 bp, Homo sapiens
ttagaatgcttcaagtttagt

SEQ ID NO: 6560252 - DNA, 21 bp, Homo sapiens
ttagaatggaggaagaacaac

SEQ ID NO: 6560253 - DNA, 21 bp, Homo sapiens
ttagaatggcctctttgtaga

SEQ ID NO: 6560254 - DNA, 21 bp, Homo sapiens
ttagaatggtgattttaaatg

SEQ ID NO: 6560255 - DNA, 13 bp, Homo sapiens
ttagaatgtcaat

SEQ ID NO: 6560256 - DNA, 18 bp, Homo sapiens
ttagaatgtcaataaatt

SEQ ID NO: 6560257 - DNA, 13 bp, Homo sapiens
ttagaatgttgaa

SEQ ID NO: 6560258 - DNA, 16 bp, Homo sapiens
ttagaatgttttcctt

SEQ ID NO: 6560259 - DNA, 16 bp, Homo sapiens
ttagaattaaaagttg

SEQ ID NO: 6560260 - DNA, 12 bp, Homo sapiens
ttagaattattt

SEQ ID NO: 6560261 - DNA, 13 bp, Homo sapiens
ttagaattattta

SEQ ID NO: 6560262 - DNA, 18 bp, Homo sapiens
ttagaattccttcagggt

SEQ ID NO: 6560263 - DNA, 16 bp, Homo sapiens
ttagaattctaattgt

SEQ ID NO: 6560264 - DNA, 13 bp, Homo sapiens
ttagaattgaagg

SEQ ID NO: 6560265 - DNA, 13 bp, Homo sapiens
ttagaattggaaa

SEQ ID NO: 6560266 - DNA, 15 bp, Homo sapiens
ttagacaaatactca

SEQ ID NO: 6560267 - DNA, 23 bp, Homo sapiens
ttagacaaatactcatgtgtatg

SEQ ID NO: 6560268 - DNA, 14 bp, Homo sapiens
ttagacaaatctaa

SEQ ID NO: 6560269 - DNA, 22 bp, Homo sapiens
ttagacaaatctaagggaaaaa

SEQ ID NO: 6560270 - DNA, 15 bp, Homo sapiens
ttagacaactagatt

SEQ ID NO: 6560271 - DNA, 23 bp, Homo sapiens
ttagacaactagatttgtccttt

SEQ ID NO: 6560272 - DNA, 15 bp, Homo sapiens
ttagacaagcctgga

SEQ ID NO: 6560273 - DNA, 16 bp, Homo sapiens
ttagacaagcctggag

SEQ ID NO: 6560274 - DNA, 19 bp, Homo sapiens
ttagacaagcctggaggac

SEQ ID NO: 6560275 - DNA, 13 bp, Homo sapiens
ttagacaatgtgg

SEQ ID NO: 6560276 - DNA, 21 bp, Homo sapiens
ttagacaatgtggaattacat

SEQ ID NO: 6560277 - DNA, 16 bp, Homo sapiens
ttagacacacatatac

SEQ ID NO: 6560278 - DNA, 14 bp, Homo sapiens
ttagacactatgtg

SEQ ID NO: 6560279 - DNA, 23 bp, Homo sapiens
ttagacactggctgccagctatt

SEQ ID NO: 6560280 - DNA, 13 bp, Homo sapiens
ttagacactttta

SEQ ID NO: 6560281 - DNA, 23 bp, Homo sapiens
ttagacacttttatatttgaaaa

SEQ ID NO: 6560282 - DNA, 12 bp, Homo sapiens
ttagacagaggc

SEQ ID NO: 6560283 - DNA, 11 bp, Homo sapiens
ttagacagagt

SEQ ID NO: 6560284 - DNA, 13 bp, Homo sapiens
ttagacagccaaa

SEQ ID NO: 6560285 - DNA, 13 bp, Homo sapiens
ttagacagtccct

SEQ ID NO: 6560286 - DNA, 15 bp, Homo sapiens
ttagacagtccctgc

SEQ ID NO: 6560287 - DNA, 17 bp, Homo sapiens
ttagacagtccctgcca

SEQ ID NO: 6560288 - DNA, 17 bp, Homo sapiens
ttagacatgtaatttgt

SEQ ID NO: 6560289 - DNA, 12 bp, Homo sapiens
ttagaccaagga

SEQ ID NO: 6560290 - DNA, 13 bp, Homo sapiens
ttagaccaaggaa

SEQ ID NO: 6560291 - DNA, 16 bp, Homo sapiens
ttagaccaccaagcct

SEQ ID NO: 6560292 - DNA, 13 bp, Homo sapiens
ttagaccctctat

SEQ ID NO: 6560293 - DNA, 13 bp, Homo sapiens
ttagaccctgggt

SEQ ID NO: 6560294 - DNA, 15 bp, Homo sapiens
ttagaccgctctctt

SEQ ID NO: 6560295 - DNA, 18 bp, Homo sapiens
ttagaccgctctcttttc

SEQ ID NO: 6560296 - DNA, 22 bp, Homo sapiens
ttagaccgctctcttttctgta

SEQ ID NO: 6560297 - DNA, 20 bp, Homo sapiens
ttagacctatactgaaagat

SEQ ID NO: 6560298 - DNA, 14 bp, Homo sapiens
ttagacctcagcct

SEQ ID NO: 6560299 - DNA, 22 bp, Homo sapiens
ttagacctcttcctggaataaa

SEQ ID NO: 6560300 - DNA, 15 bp, Homo sapiens
ttagacctttatcca

SEQ ID NO: 6560301 - DNA, 20 bp, Homo sapiens
ttagacgccttccaggtcag

SEQ ID NO: 6560302 - DNA, 18 bp, Homo sapiens
ttagactacatttagaga

SEQ ID NO: 6560303 - DNA, 18 bp, Homo sapiens
ttagactatagcccctgg

SEQ ID NO: 6560304 - DNA, 14 bp, Homo sapiens
ttagactcaaagaa

SEQ ID NO: 6560305 - DNA, 15 bp, Homo sapiens
ttagactcaaagaat

SEQ ID NO: 6560306 - DNA, 22 bp, Homo sapiens
ttagactcaaagaatataatct

SEQ ID NO: 6560307 - DNA, 21 bp, Homo sapiens
ttagactcatggtgtgttaca

SEQ ID NO: 6560308 - DNA, 13 bp, Homo sapiens
ttagactcctcct

SEQ ID NO: 6560309 - DNA, 17 bp, Homo sapiens
ttagactcttttccttc

SEQ ID NO: 6560310 - DNA, 15 bp, Homo sapiens
ttagactggaacttg

SEQ ID NO: 6560311 - DNA, 14 bp, Homo sapiens
ttagactgtagcct

SEQ ID NO: 6560312 - DNA, 23 bp, Homo sapiens
ttagactgtaggaagagtagcat

SEQ ID NO: 6560313 - DNA, 23 bp, Homo sapiens
ttagacttcccactgttctgaaa

SEQ ID NO: 6560314 - DNA, 19 bp, Homo sapiens
ttagacttctgttttcaat

SEQ ID NO: 6560315 - DNA, 13 bp, Homo sapiens
ttagacttgaaaa

SEQ ID NO: 6560316 - DNA, 22 bp, Homo sapiens
ttagactttaacataagctatt

SEQ ID NO: 6560317 - DNA, 21 bp, Homo sapiens
ttagagaaaaccttaaaagta

SEQ ID NO: 6560318 - DNA, 16 bp, Homo sapiens
ttagagaaaataaatt

SEQ ID NO: 6560319 - DNA, 20 bp, Homo sapiens
ttagagaaaataaatttaac

SEQ ID NO: 6560320 - DNA, 19 bp, Homo sapiens
ttagagaactgaaaagaga

SEQ ID NO: 6560321 - DNA, 14 bp, Homo sapiens
ttagagaagccata

SEQ ID NO: 6560322 - DNA, 16 bp, Homo sapiens
ttagagaagtttgtgg

SEQ ID NO: 6560323 - DNA, 12 bp, Homo sapiens
ttagagaataag

SEQ ID NO: 6560324 - DNA, 16 bp, Homo sapiens
ttagagaatgagaaat

SEQ ID NO: 6560325 - DNA, 20 bp, Homo sapiens
ttagagacaaaccttaaaac

SEQ ID NO: 6560326 - DNA, 24 bp, Homo sapiens
ttagagacagagcgacagagcagt

SEQ ID NO: 6560327 - DNA, 18 bp, Homo sapiens
ttagagagatttttcatt

SEQ ID NO: 6560328 - DNA, 15 bp, Homo sapiens
ttagagagcagtggc

SEQ ID NO: 6560329 - DNA, 18 bp, Homo sapiens
ttagagagcagtggcaga

SEQ ID NO: 6560330 - DNA, 17 bp, Homo sapiens
ttagagagcctgtcacc

SEQ ID NO: 6560331 - DNA, 21 bp, Homo sapiens
ttagagagcctgtcaccagag

SEQ ID NO: 6560332 - DNA, 14 bp, Homo sapiens
ttagagagtgttga

SEQ ID NO: 6560333 - DNA, 18 bp, Homo sapiens
ttagagagtgttgaaacg

SEQ ID NO: 6560334 - DNA, 13 bp, Homo sapiens
ttagagataaata

SEQ ID NO: 6560335 - DNA, 15 bp, Homo sapiens
ttagagataaatatt

SEQ ID NO: 6560336 - DNA, 20 bp, Homo sapiens
ttagagataccctctgagac

SEQ ID NO: 6560337 - DNA, 16 bp, Homo sapiens
ttagagatgctaaaat

SEQ ID NO: 6560338 - DNA, 18 bp, Homo sapiens
ttagagattaatttgtgt

SEQ ID NO: 6560339 - DNA, 15 bp, Homo sapiens
ttagagattgcccca

SEQ ID NO: 6560340 - DNA, 18 bp, Homo sapiens
ttagagattttacaaaat

SEQ ID NO: 6560341 - DNA, 17 bp, Homo sapiens
ttagagattttcatttt

SEQ ID NO: 6560342 - DNA, 16 bp, Homo sapiens
ttagagcatctctgcc

SEQ ID NO: 6560343 - DNA, 18 bp, Homo sapiens
ttagagcatctctgcctc

SEQ ID NO: 6560344 - DNA, 15 bp, Homo sapiens
ttagagcattaaaat

SEQ ID NO: 6560345 - DNA, 16 bp, Homo sapiens
ttagagccaggcacac

SEQ ID NO: 6560346 - DNA, 18 bp, Homo sapiens
ttagagcccattaatctt

SEQ ID NO: 6560347 - DNA, 13 bp, Homo sapiens
ttagagcctccct

SEQ ID NO: 6560348 - DNA, 14 bp, Homo sapiens
ttagagcctccctc

SEQ ID NO: 6560349 - DNA, 16 bp, Homo sapiens
ttagagctcgaaataa

SEQ ID NO: 6560350 - DNA, 14 bp, Homo sapiens
ttagagctgcataa

SEQ ID NO: 6560351 - DNA, 18 bp, Homo sapiens
ttagagctgcataatgtc

SEQ ID NO: 6560352 - DNA, 15 bp, Homo sapiens
ttagagcttccaaat

SEQ ID NO: 6560353 - DNA, 20 bp, Homo sapiens
ttagagcttttcagaacatc

SEQ ID NO: 6560354 - DNA, 22 bp, Homo sapiens
ttagaggaaataagaaaaatca

SEQ ID NO: 6560355 - DNA, 12 bp, Homo sapiens
tttcccctcccg

SEQ ID NO: 6560356 - DNA, 22 bp, Homo sapiens
tttcccctccgtctttcccctc

SEQ ID NO: 6560357 - DNA, 13 bp, Homo sapiens
tttcccctctcat

SEQ ID NO: 6560358 - DNA, 14 bp, Homo sapiens
tttcccctctctgc

SEQ ID NO: 6560359 - DNA, 20 bp, Homo sapiens
tttcccctctctgcccctga

SEQ ID NO: 6560360 - DNA, 12 bp, Homo sapiens
tttcccctctgg

SEQ ID NO: 6560361 - DNA, 16 bp, Homo sapiens
tttcccctctggcttg

SEQ ID NO: 6560362 - DNA, 23 bp, Homo sapiens
tttcccctctggcttgacagcat

SEQ ID NO: 6560363 - DNA, 16 bp, Homo sapiens
tttcccctgcactccc

SEQ ID NO: 6560364 - DNA, 20 bp, Homo sapiens
tttcccctgcccccagacct

SEQ ID NO: 6560365 - DNA, 14 bp, Homo sapiens
tttcccctgtcagt

SEQ ID NO: 6560366 - DNA, 23 bp, Homo sapiens
tttcccctgtcagtttcccctct

SEQ ID NO: 6560367 - DNA, 23 bp, Homo sapiens
tttcccctgtcctgatggtcagc

SEQ ID NO: 6560368 - DNA, 16 bp, Homo sapiens
tttccccttcccctcc

SEQ ID NO: 6560369 - DNA, 20 bp, Homo sapiens
tttccccttcccctcccctc

SEQ ID NO: 6560370 - DNA, 13 bp, Homo sapiens
tttcccctttcct

SEQ ID NO: 6560371 - DNA, 15 bp, Homo sapiens
tttcccctttcctgt

SEQ ID NO: 6560372 - DNA, 13 bp, Homo sapiens
tttcccctttctc

SEQ ID NO: 6560373 - DNA, 23 bp, Homo sapiens
tttcccgccaggaggtcctcctc

SEQ ID NO: 6560374 - DNA, 21 bp, Homo sapiens
tttcccggagccatcaccctc

SEQ ID NO: 6560375 - DNA, 20 bp, Homo sapiens
tttcccgtataataaaacca

SEQ ID NO: 6560376 - DNA, 16 bp, Homo sapiens
tttcccgtggccccag

SEQ ID NO: 6560377 - DNA, 19 bp, Homo sapiens
tttcccgtggccccagcct

SEQ ID NO: 6560378 - DNA, 13 bp, Homo sapiens
tttccctaaaata

SEQ ID NO: 6560379 - DNA, 20 bp, Homo sapiens
tttccctaagccaagggcct

SEQ ID NO: 6560380 - DNA, 17 bp, Homo sapiens
tttccctactgaagccc

SEQ ID NO: 6560381 - DNA, 23 bp, Homo sapiens
tttccctagaaagccatattcca

SEQ ID NO: 6560382 - DNA, 18 bp, Homo sapiens
tttccctagactctgtaa

SEQ ID NO: 6560383 - DNA, 16 bp, Homo sapiens
tttccctattagagaa

SEQ ID NO: 6560384 - DNA, 13 bp, Homo sapiens
tttccctcaggtt

SEQ ID NO: 6560385 - DNA, 18 bp, Homo sapiens
tttccctcaggttctatt

SEQ ID NO: 6560386 - DNA, 12 bp, Homo sapiens
tttccctcccca

SEQ ID NO: 6560387 - DNA, 14 bp, Homo sapiens
tttccctcccggga

SEQ ID NO: 6560388 - DNA, 23 bp, Homo sapiens
tttccctcccttcctctttccat

SEQ ID NO: 6560389 - DNA, 15 bp, Homo sapiens
tttccctcctgggag

SEQ ID NO: 6560390 - DNA, 14 bp, Homo sapiens
tttccctctgctgc

SEQ ID NO: 6560391 - DNA, 13 bp, Homo sapiens
tttccctctgtat

SEQ ID NO: 6560392 - DNA, 20 bp, Homo sapiens
tttccctcttcggtgttctt

SEQ ID NO: 6560393 - DNA, 15 bp, Homo sapiens
tttccctcttgtgct

SEQ ID NO: 6560394 - DNA, 14 bp, Homo sapiens
tttccctgaacaga

SEQ ID NO: 6560395 - DNA, 13 bp, Homo sapiens
tttccctgagagc

SEQ ID NO: 6560396 - DNA, 22 bp, Homo sapiens
tttccctgcaccactctcttca

SEQ ID NO: 6560397 - DNA, 18 bp, Homo sapiens
tttccctgcagacctcaa

SEQ ID NO: 6560398 - DNA, 22 bp, Homo sapiens
tttccctgccacatccagcttg

SEQ ID NO: 6560399 - DNA, 11 bp, Homo sapiens
tttccctgccc

SEQ ID NO: 6560400 - DNA, 16 bp, Homo sapiens
tttccctgctggccaa

SEQ ID NO: 6560401 - DNA, 23 bp, Homo sapiens
tttccctggacaggcagcctcct

SEQ ID NO: 6560402 - DNA, 16 bp, Homo sapiens
tttccctggagctgag

SEQ ID NO: 6560403 - DNA, 13 bp, Homo sapiens
tttccctgggtgg

SEQ ID NO: 6560404 - DNA, 15 bp, Homo sapiens
tttccctgggtggag

SEQ ID NO: 6560405 - DNA, 21 bp, Homo sapiens
tttccctggtgcctctcactt

SEQ ID NO: 6560406 - DNA, 14 bp, Homo sapiens
tttccctgtgtgga

SEQ ID NO: 6560407 - DNA, 16 bp, Homo sapiens
tttcccttcagtaccc

SEQ ID NO: 6560408 - DNA, 19 bp, Homo sapiens
tttcccttcagtaccctct

SEQ ID NO: 6560409 - DNA, 14 bp, Homo sapiens
tttcccttccaaag

SEQ ID NO: 6560410 - DNA, 12 bp, Homo sapiens
tttcccttcctc

SEQ ID NO: 6560411 - DNA, 13 bp, Homo sapiens
tttcccttctctt

SEQ ID NO: 6560412 - DNA, 14 bp, Homo sapiens
tttcccttctcttc

SEQ ID NO: 6560413 - DNA, 23 bp, Homo sapiens
tttcccttgccttatgggctgaa

SEQ ID NO: 6560414 - DNA, 20 bp, Homo sapiens
tttcccttgtgtcaagacat

SEQ ID NO: 6560415 - DNA, 21 bp, Homo sapiens
tttccctttagctgtgttatt

SEQ ID NO: 6560416 - DNA, 14 bp, Homo sapiens
tttccctttccttt

SEQ ID NO: 6560417 - DNA, 23 bp, Homo sapiens
tttccctttgaggttgctttgtt

SEQ ID NO: 6560418 - DNA, 19 bp, Homo sapiens
tttccctttttaaaaaata

SEQ ID NO: 6560419 - DNA, 22 bp, Homo sapiens
tttccgctgtcgccccaggccc

SEQ ID NO: 6560420 - DNA, 23 bp, Homo sapiens
tttccggaagtaaatacagcaat

SEQ ID NO: 6560421 - DNA, 21 bp, Homo sapiens
tttccggggaggagccttgga

SEQ ID NO: 6560422 - DNA, 20 bp, Homo sapiens
tttccggggctgctggcctg

SEQ ID NO: 6560423 - DNA, 13 bp, Homo sapiens
tttccgtaaatgt

SEQ ID NO: 6560424 - DNA, 17 bp, Homo sapiens
tttccgtaaatgtctgc

SEQ ID NO: 6560425 - DNA, 21 bp, Homo sapiens
tttccgtgagctcaaactggc

SEQ ID NO: 6560426 - DNA, 16 bp, Homo sapiens
tttccgtggcactgca

SEQ ID NO: 6560427 - DNA, 17 bp, Homo sapiens
tttccgttaaaatacca

SEQ ID NO: 6560428 - DNA, 23 bp, Homo sapiens
tttccgtttgatttgtcactgct

SEQ ID NO: 6560429 - DNA, 15 bp, Homo sapiens
tttccgttttgcctg

SEQ ID NO: 6560430 - DNA, 14 bp, Homo sapiens
tttcctaaagccaa

SEQ ID NO: 6560431 - DNA, 13 bp, Homo sapiens
tttcctaacaaaa

SEQ ID NO: 6560432 - DNA, 18 bp, Homo sapiens
tttcctaacaggattaga

SEQ ID NO: 6560433 - DNA, 16 bp, Homo sapiens
tttcctaagacatttt

SEQ ID NO: 6560434 - DNA, 17 bp, Homo sapiens
tttcctaagacattttt

SEQ ID NO: 6560435 - DNA, 16 bp, Homo sapiens
tttcctaaggaaactg

SEQ ID NO: 6560436 - DNA, 14 bp, Homo sapiens
tttcctaaggcatg

SEQ ID NO: 6560437 - DNA, 19 bp, Homo sapiens
tttcctaagtgattgtatg

SEQ ID NO: 6560438 - DNA, 24 bp, Homo sapiens
tttcctaataaagttctgtactca

SEQ ID NO: 6560439 - DNA, 15 bp, Homo sapiens
tttcctacaaaatgg

SEQ ID NO: 6560440 - DNA, 17 bp, Homo sapiens
tttcctacagaaatact

SEQ ID NO: 6560441 - DNA, 21 bp, Homo sapiens
tttcctacaggcagtctctct

SEQ ID NO: 6560442 - DNA, 16 bp, Homo sapiens
tttcctactgtcctgg

SEQ ID NO: 6560443 - DNA, 17 bp, Homo sapiens
tttcctactgtcctgga

SEQ ID NO: 6560444 - DNA, 19 bp, Homo sapiens
tttcctagaagtggtttgt

SEQ ID NO: 6560445 - DNA, 21 bp, Homo sapiens
tttcctagcacacacttttgg

SEQ ID NO: 6560446 - DNA, 14 bp, Homo sapiens
tttcctataccatt

SEQ ID NO: 6560447 - DNA, 16 bp, Homo sapiens
tttcctataccatttc

SEQ ID NO: 6560448 - DNA, 21 bp, Homo sapiens
tttcctatctagcatttattt

SEQ ID NO: 6560449 - DNA, 17 bp, Homo sapiens
tttcctatcttccttcc

SEQ ID NO: 6560450 - DNA, 17 bp, Homo sapiens
tttcctatgcaactttt

SEQ ID NO: 6560451 - DNA, 17 bp, Homo sapiens
tttcctatttccccaaa

SEQ ID NO: 6560452 - DNA, 16 bp, Homo sapiens
tttcctattttaaaac

SEQ ID NO: 6560453 - DNA, 13 bp, Homo sapiens
tttcctcaagcaa

SEQ ID NO: 6560454 - DNA, 15 bp, Homo sapiens
tttcctcaagcaata

SEQ ID NO: 6560455 - DNA, 20 bp, Homo sapiens
tttcctcaatggacttcaaa

SEQ ID NO: 6560456 - DNA, 22 bp, Homo sapiens
tttcctcacacccacctgctgc

SEQ ID NO: 6560457 - DNA, 16 bp, Homo sapiens
tttcctcactgcctgg

SEQ ID NO: 6560458 - DNA, 18 bp, Homo sapiens
tttcctcagaacatgaga

SEQ ID NO: 6560459 - DNA, 13 bp, Homo sapiens
tttcctcagtctc

SEQ ID NO: 6560460 - DNA, 12 bp, Homo sapiens
tttcctcatcct

SEQ ID NO: 6560461 - DNA, 14 bp, Homo sapiens
tttcctcatctgtc

SEQ ID NO: 6560462 - DNA, 17 bp, Homo sapiens
tttcctcatgtaacatt

SEQ ID NO: 6560463 - DNA, 22 bp, Homo sapiens
tttcctcatgtaacattggtga

SEQ ID NO: 6560464 - DNA, 12 bp, Homo sapiens
tttcctcatttt

SEQ ID NO: 6560465 - DNA, 21 bp, Homo sapiens
tttcctcattttgaattatgt

SEQ ID NO: 6560466 - DNA, 18 bp, Homo sapiens
tttcctcatttttataat

SEQ ID NO: 6560467 - DNA, 12 bp, Homo sapiens
tttcctccaccc

SEQ ID NO: 6560468 - DNA, 17 bp, Homo sapiens
tttcctccccaccttcc

SEQ ID NO: 6560469 - DNA, 19 bp, Homo sapiens
tttcctccccaccttcccc

SEQ ID NO: 6560470 - DNA, 20 bp, Homo sapiens
tttcctccccatacacacac

SEQ ID NO: 6560471 - DNA, 16 bp, Homo sapiens
tttcctccccctgcaa

SEQ ID NO: 6560472 - DNA, 23 bp, Homo sapiens
tttcctccctcctcccacagcct

SEQ ID NO: 6560473 - DNA, 22 bp, Homo sapiens
tttcctccctggtttgcagctg

SEQ ID NO: 6560474 - DNA, 21 bp, Homo sapiens
tttcctcccttctttgcttct

SEQ ID NO: 6560475 - DNA, 14 bp, Homo sapiens
tttcctccgcctgt

SEQ ID NO: 6560476 - DNA, 16 bp, Homo sapiens
tttcctcctacctttt

SEQ ID NO: 6560477 - DNA, 21 bp, Homo sapiens
tttcctcctgaggctttggat

SEQ ID NO: 6560478 - DNA, 11 bp, Homo sapiens
tttcctcctgg

SEQ ID NO: 6560479 - DNA, 14 bp, Homo sapiens
tttcctccttccat

SEQ ID NO: 6560480 - DNA, 15 bp, Homo sapiens
tttcctcctttatca

SEQ ID NO: 6560481 - DNA, 16 bp, Homo sapiens
tttcctcctttctctg

SEQ ID NO: 6560482 - DNA, 19 bp, Homo sapiens
tttcctcctttctctgtat

SEQ ID NO: 6560483 - DNA, 17 bp, Homo sapiens
tttcctcggtctccctt

SEQ ID NO: 6560484 - DNA, 19 bp, Homo sapiens
tttcctctaactcattctt

SEQ ID NO: 6560485 - DNA, 18 bp, Homo sapiens
tttcctctatacatctct

SEQ ID NO: 6560486 - DNA, 14 bp, Homo sapiens
tttcctctatctaa

SEQ ID NO: 6560487 - DNA, 20 bp, Homo sapiens
tttcctctattgatgtacag

SEQ ID NO: 6560488 - DNA, 12 bp, Homo sapiens
tttcctctccac

SEQ ID NO: 6560489 - DNA, 16 bp, Homo sapiens
tttcctctccactgct

SEQ ID NO: 6560490 - DNA, 23 bp, Homo sapiens
tttcctctccctcaggggcaggt

SEQ ID NO: 6560491 - DNA, 16 bp, Homo sapiens
tttcctctcctctctg

SEQ ID NO: 6560492 - DNA, 12 bp, Homo sapiens
tttcctctctct

SEQ ID NO: 6560493 - DNA, 22 bp, Homo sapiens
tttcctctctttgttctcagct

SEQ ID NO: 6560494 - DNA, 15 bp, Homo sapiens
tttcctctgagctgt

SEQ ID NO: 6560495 - DNA, 23 bp, Homo sapiens
tttcctctgaggatgatgtactt

SEQ ID NO: 6560496 - DNA, 23 bp, Homo sapiens
tttcctctgagttctgtacttca

SEQ ID NO: 6560497 - DNA, 13 bp, Homo sapiens
tttcctctgcttt

SEQ ID NO: 6560498 - DNA, 17 bp, Homo sapiens
tttcctctgctttgaaa

SEQ ID NO: 6560499 - DNA, 16 bp, Homo sapiens
tttcctcttaacgtaa

SEQ ID NO: 6560500 - DNA, 22 bp, Homo sapiens
tttcctcttagtcgagccaagt

SEQ ID NO: 6560501 - DNA, 23 bp, Homo sapiens
tttcctcttataacttctgaagt

SEQ ID NO: 6560502 - DNA, 17 bp, Homo sapiens
tttcctcttcctgccta

SEQ ID NO: 6560503 - DNA, 18 bp, Homo sapiens
tttcctcttccttctcta

SEQ ID NO: 6560504 - DNA, 12 bp, Homo sapiens
tttcctcttctg

SEQ ID NO: 6560505 - DNA, 13 bp, Homo sapiens
tttcctcttgtga

SEQ ID NO: 6560506 - DNA, 24 bp, Homo sapiens
tttcctgaaattctgacaccatgt

SEQ ID NO: 6560507 - DNA, 17 bp, Homo sapiens
tttcctgaacctggaaa

SEQ ID NO: 6560508 - DNA, 22 bp, Homo sapiens
tttcctgagcttggccagaagg

SEQ ID NO: 6560509 - DNA, 20 bp, Homo sapiens
tttcctgagggttttctcat

SEQ ID NO: 6560510 - DNA, 19 bp, Homo sapiens
tttcctgcaggcatccgtg

SEQ ID NO: 6560511 - DNA, 15 bp, Homo sapiens
tttcctgcatctttc

SEQ ID NO: 6560512 - DNA, 12 bp, Homo sapiens
tttcctgcccag

SEQ ID NO: 6560513 - DNA, 12 bp, Homo sapiens
tttcctgccctg

SEQ ID NO: 6560514 - DNA, 13 bp, Homo sapiens
tttcctgccctgg

SEQ ID NO: 6560515 - DNA, 16 bp, Homo sapiens
tttcctgccctgtcca

SEQ ID NO: 6560516 - DNA, 17 bp, Homo sapiens
tttcctgcccttcctca

SEQ ID NO: 6560517 - DNA, 17 bp, Homo sapiens
tttcctgccttcagagt

SEQ ID NO: 6560518 - DNA, 17 bp, Homo sapiens
tttcctgcgtcccagcc

SEQ ID NO: 6560519 - DNA, 21 bp, Homo sapiens
tttcctgctagtgtagcttct

SEQ ID NO: 6560520 - DNA, 12 bp, Homo sapiens
tttcctgcttca

SEQ ID NO: 6560521 - DNA, 16 bp, Homo sapiens
tttcctggaatttttc

SEQ ID NO: 6560522 - DNA, 20 bp, Homo sapiens
tttcctggacatcctcttct

SEQ ID NO: 6560523 - DNA, 21 bp, Homo sapiens
tttcctggcactggaccccag

SEQ ID NO: 6560524 - DNA, 23 bp, Homo sapiens
tttcctggcactggaccccagca

SEQ ID NO: 6560525 - DNA, 15 bp, Homo sapiens
tttcctggcagctgc

SEQ ID NO: 6560526 - DNA, 17 bp, Homo sapiens
tttcctggcagctgctg

SEQ ID NO: 6560527 - DNA, 18 bp, Homo sapiens
tttcctggcagctgctgt

SEQ ID NO: 6560528 - DNA, 12 bp, Homo sapiens
tttcctggcagt

SEQ ID NO: 6560529 - DNA, 15 bp, Homo sapiens
tttcctggcctcaga

SEQ ID NO: 6560530 - DNA, 17 bp, Homo sapiens
tttcctggcctcagagc

SEQ ID NO: 6560531 - DNA, 21 bp, Homo sapiens
tttcctggcctcagagcttcc

SEQ ID NO: 6560532 - DNA, 23 bp, Homo sapiens
tttcctggcctcagagcttcctg

SEQ ID NO: 6560533 - DNA, 19 bp, Homo sapiens
tttcctgggaatggaataa

SEQ ID NO: 6560534 - DNA, 23 bp, Homo sapiens
ttagaggaaataagaaaaatcat

SEQ ID NO: 6560535 - DNA, 10 bp, Homo sapiens
ttagagggcc

SEQ ID NO: 6560536 - DNA, 18 bp, Homo sapiens
ttagagggccttgcttct

SEQ ID NO: 6560537 - DNA, 18 bp, Homo sapiens
ttagagggtgaaggagaa

SEQ ID NO: 6560538 - DNA, 15 bp, Homo sapiens
ttagaggttaatcag

SEQ ID NO: 6560539 - DNA, 19 bp, Homo sapiens
ttagaggtttgtcaacaca

SEQ ID NO: 6560540 - DNA, 19 bp, Homo sapiens
ttagaggttttaaagtgat

SEQ ID NO: 6560541 - DNA, 22 bp, Homo sapiens
ttagagtaaactattctataaa

SEQ ID NO: 6560542 - DNA, 18 bp, Homo sapiens
ttagagtaaataaactgt

SEQ ID NO: 6560543 - DNA, 20 bp, Homo sapiens
ttagagtatacctcctatat

SEQ ID NO: 6560544 - DNA, 17 bp, Homo sapiens
ttagagtatttcccttc

SEQ ID NO: 6560545 - DNA, 22 bp, Homo sapiens
ttagagtatttcccttccaaag

SEQ ID NO: 6560546 - DNA, 23 bp, Homo sapiens
ttagagtatttcccttccaaaga

SEQ ID NO: 6560547 - DNA, 20 bp, Homo sapiens
ttagagtcctagttttccta

SEQ ID NO: 6560548 - DNA, 20 bp, Homo sapiens
ttagagtccttaagacggaa

SEQ ID NO: 6560549 - DNA, 23 bp, Homo sapiens
ttagagtggttattcattattcc

SEQ ID NO: 6560550 - DNA, 16 bp, Homo sapiens
ttagagtgtctttcca

SEQ ID NO: 6560551 - DNA, 12 bp, Homo sapiens
ttagagttagac

SEQ ID NO: 6560552 - DNA, 14 bp, Homo sapiens
ttagagttcttctt

SEQ ID NO: 6560553 - DNA, 15 bp, Homo sapiens
ttagagttcttttgg

SEQ ID NO: 6560554 - DNA, 18 bp, Homo sapiens
ttagagttgtgatacaga

SEQ ID NO: 6560555 - DNA, 15 bp, Homo sapiens
ttagataaatattga

SEQ ID NO: 6560556 - DNA, 15 bp, Homo sapiens
ttagataacaagaat

SEQ ID NO: 6560557 - DNA, 21 bp, Homo sapiens
ttagataacttcttgaaaaag

SEQ ID NO: 6560558 - DNA, 22 bp, Homo sapiens
ttagataataactgtcttctgg

SEQ ID NO: 6560559 - DNA, 17 bp, Homo sapiens
ttagatagctgcatgtg

SEQ ID NO: 6560560 - DNA, 16 bp, Homo sapiens
ttagatagtcatgctg

SEQ ID NO: 6560561 - DNA, 17 bp, Homo sapiens
ttagatatattctctaa

SEQ ID NO: 6560562 - DNA, 12 bp, Homo sapiens
ttagatattaaa

SEQ ID NO: 6560563 - DNA, 21 bp, Homo sapiens
ttagatattatcataacatct

SEQ ID NO: 6560564 - DNA, 18 bp, Homo sapiens
ttagatattcattaatag

SEQ ID NO: 6560565 - DNA, 13 bp, Homo sapiens
ttagatatttaca

SEQ ID NO: 6560566 - DNA, 13 bp, Homo sapiens
ttagatatttgcc

SEQ ID NO: 6560567 - DNA, 13 bp, Homo sapiens
ttagatcaaatac

SEQ ID NO: 6560568 - DNA, 23 bp, Homo sapiens
ttagatcaacaataaaaaaaaac

SEQ ID NO: 6560569 - DNA, 14 bp, Homo sapiens
ttagatcaacactt

SEQ ID NO: 6560570 - DNA, 16 bp, Homo sapiens
ttagatcatagtttta

SEQ ID NO: 6560571 - DNA, 17 bp, Homo sapiens
ttagatcatagttttat

SEQ ID NO: 6560572 - DNA, 19 bp, Homo sapiens
ttagatccaaatgtaaagg

SEQ ID NO: 6560573 - DNA, 15 bp, Homo sapiens
ttagatccattaatt

SEQ ID NO: 6560574 - DNA, 16 bp, Homo sapiens
ttagatcccatgtcac

SEQ ID NO: 6560575 - DNA, 14 bp, Homo sapiens
ttagatctaccctg

SEQ ID NO: 6560576 - DNA, 13 bp, Homo sapiens
ttagatctagttc

SEQ ID NO: 6560577 - DNA, 17 bp, Homo sapiens
ttagatgagtgaaatac

SEQ ID NO: 6560578 - DNA, 20 bp, Homo sapiens
ttagatgagtgaaataccct

SEQ ID NO: 6560579 - DNA, 21 bp, Homo sapiens
ttagatgatgactcaagattt

SEQ ID NO: 6560580 - DNA, 15 bp, Homo sapiens
ttagatgattatata

SEQ ID NO: 6560581 - DNA, 16 bp, Homo sapiens
ttagatgcatattact

SEQ ID NO: 6560582 - DNA, 19 bp, Homo sapiens
ttagatgcatattactgta

SEQ ID NO: 6560583 - DNA, 23 bp, Homo sapiens
ttagatgctctgagaaattgaat

SEQ ID NO: 6560584 - DNA, 19 bp, Homo sapiens
ttagatgctgaatatctgt

SEQ ID NO: 6560585 - DNA, 12 bp, Homo sapiens
ttagatgcttag

SEQ ID NO: 6560586 - DNA, 23 bp, Homo sapiens
ttagatggaaaaatgtgaaaaaa

SEQ ID NO: 6560587 - DNA, 23 bp, Homo sapiens
ttagatggattctccactcagtt

SEQ ID NO: 6560588 - DNA, 20 bp, Homo sapiens
ttagatggtggcacattcct

SEQ ID NO: 6560589 - DNA, 15 bp, Homo sapiens
ttagatgtatttttg

SEQ ID NO: 6560590 - DNA, 14 bp, Homo sapiens
ttagatgtgacaca

SEQ ID NO: 6560591 - DNA, 15 bp, Homo sapiens
ttagatgtgagaaaa

SEQ ID NO: 6560592 - DNA, 23 bp, Homo sapiens
ttagatgtgagagaaagagaaat

SEQ ID NO: 6560593 - DNA, 13 bp, Homo sapiens
ttagatgttctaa

SEQ ID NO: 6560594 - DNA, 20 bp, Homo sapiens
ttagatgttctaagtctttc

SEQ ID NO: 6560595 - DNA, 22 bp, Homo sapiens
ttagatgttctaagtctttcca

SEQ ID NO: 6560596 - DNA, 15 bp, Homo sapiens
ttagatgttctctat

SEQ ID NO: 6560597 - DNA, 21 bp, Homo sapiens
ttagatgttctctatcattta

SEQ ID NO: 6560598 - DNA, 23 bp, Homo sapiens
ttagatgttctctatcatttaat

SEQ ID NO: 6560599 - DNA, 22 bp, Homo sapiens
ttagatgttgccatgtgtttta

SEQ ID NO: 6560600 - DNA, 16 bp, Homo sapiens
ttagatgtttaccttc

SEQ ID NO: 6560601 - DNA, 14 bp, Homo sapiens
ttagatgtttatat

SEQ ID NO: 6560602 - DNA, 14 bp, Homo sapiens
ttagattatattga

SEQ ID NO: 6560603 - DNA, 15 bp, Homo sapiens
ttagattatttctgt

SEQ ID NO: 6560604 - DNA, 19 bp, Homo sapiens
ttagattatttctgtattt

SEQ ID NO: 6560605 - DNA, 16 bp, Homo sapiens
ttagattccaggatca

SEQ ID NO: 6560606 - DNA, 17 bp, Homo sapiens
ttagattcctacttaaa

SEQ ID NO: 6560607 - DNA, 20 bp, Homo sapiens
ttagattcctacttaaacaa

SEQ ID NO: 6560608 - DNA, 19 bp, Homo sapiens
ttagattctctgtgtctaa

SEQ ID NO: 6560609 - DNA, 18 bp, Homo sapiens
ttagattgaaatttatga

SEQ ID NO: 6560610 - DNA, 15 bp, Homo sapiens
ttagattgagaaatg

SEQ ID NO: 6560611 - DNA, 19 bp, Homo sapiens
ttagattgagaaatgtgta

SEQ ID NO: 6560612 - DNA, 16 bp, Homo sapiens
ttagattggttctgtt

SEQ ID NO: 6560613 - DNA, 13 bp, Homo sapiens
ttagattgtaaac

SEQ ID NO: 6560614 - DNA, 10 bp, Homo sapiens
ttagatttca

SEQ ID NO: 6560615 - DNA, 19 bp, Homo sapiens
ttagatttcaagaaaaaat

SEQ ID NO: 6560616 - DNA, 20 bp, Homo sapiens
ttagatttcatagttcagaa

SEQ ID NO: 6560617 - DNA, 22 bp, Homo sapiens
ttagatttcatagttcagaatt

SEQ ID NO: 6560618 - DNA, 21 bp, Homo sapiens
ttagatttgccatagagtaca

SEQ ID NO: 6560619 - DNA, 12 bp, Homo sapiens
ttagatttgtgc

SEQ ID NO: 6560620 - DNA, 14 bp, Homo sapiens
ttagattttacatg

SEQ ID NO: 6560621 - DNA, 18 bp, Homo sapiens
ttagattttctggttcta

SEQ ID NO: 6560622 - DNA, 19 bp, Homo sapiens
ttagattttctggttctaa

SEQ ID NO: 6560623 - DNA, 20 bp, Homo sapiens
ttagattttctggttctaac

SEQ ID NO: 6560624 - DNA, 15 bp, Homo sapiens
ttagattttctgtaa

SEQ ID NO: 6560625 - DNA, 22 bp, Homo sapiens
ttagatttttaaattggagaaa

SEQ ID NO: 6560626 - DNA, 15 bp, Homo sapiens
ttagcaaaaaatgaa

SEQ ID NO: 6560627 - DNA, 16 bp, Homo sapiens
ttagcaaactgatgct

SEQ ID NO: 6560628 - DNA, 20 bp, Homo sapiens
ttagcaaagagttaatatat

SEQ ID NO: 6560629 - DNA, 15 bp, Homo sapiens
ttagcaaatacatat

SEQ ID NO: 6560630 - DNA, 18 bp, Homo sapiens
ttagcaaatcagtatatt

SEQ ID NO: 6560631 - DNA, 18 bp, Homo sapiens
ttagcaaattctgttttt

SEQ ID NO: 6560632 - DNA, 22 bp, Homo sapiens
ttagcaacgcctgccttctggg

SEQ ID NO: 6560633 - DNA, 15 bp, Homo sapiens
ttagcaactagggct

SEQ ID NO: 6560634 - DNA, 21 bp, Homo sapiens
ttagcaactgctggggagaca

SEQ ID NO: 6560635 - DNA, 11 bp, Homo sapiens
ttagcaagcaa

SEQ ID NO: 6560636 - DNA, 16 bp, Homo sapiens
ttagcaagcaactaat

SEQ ID NO: 6560637 - DNA, 12 bp, Homo sapiens
ttagcaaggatt

SEQ ID NO: 6560638 - DNA, 18 bp, Homo sapiens
ttagcaaggtcatttctt

SEQ ID NO: 6560639 - DNA, 21 bp, Homo sapiens
ttagcaaggtcatttcttcag

SEQ ID NO: 6560640 - DNA, 20 bp, Homo sapiens
ttagcaatagctagctatat

SEQ ID NO: 6560641 - DNA, 20 bp, Homo sapiens
ttagcaatgaattagttgca

SEQ ID NO: 6560642 - DNA, 17 bp, Homo sapiens
ttagcaatgctgtgaat

SEQ ID NO: 6560643 - DNA, 18 bp, Homo sapiens
ttagcaatgctgtgaata

SEQ ID NO: 6560644 - DNA, 15 bp, Homo sapiens
ttagcacaatttata

SEQ ID NO: 6560645 - DNA, 14 bp, Homo sapiens
ttagcacagagagg

SEQ ID NO: 6560646 - DNA, 16 bp, Homo sapiens
ttagcacagagaggga

SEQ ID NO: 6560647 - DNA, 12 bp, Homo sapiens
ttagcacagagg

SEQ ID NO: 6560648 - DNA, 13 bp, Homo sapiens
ttagcacagattt

SEQ ID NO: 6560649 - DNA, 19 bp, Homo sapiens
ttagcacagattttaattg

SEQ ID NO: 6560650 - DNA, 21 bp, Homo sapiens
ttagcacagattttaattgtc

SEQ ID NO: 6560651 - DNA, 16 bp, Homo sapiens
ttagcacatcactgag

SEQ ID NO: 6560652 - DNA, 12 bp, Homo sapiens
ttagcaccaggg

SEQ ID NO: 6560653 - DNA, 20 bp, Homo sapiens
ttagcactgaactgctttta

SEQ ID NO: 6560654 - DNA, 21 bp, Homo sapiens
ttagcacttcagggcagattt

SEQ ID NO: 6560655 - DNA, 15 bp, Homo sapiens
ttagcagaactcatt

SEQ ID NO: 6560656 - DNA, 12 bp, Homo sapiens
ttagcagaagtg

SEQ ID NO: 6560657 - DNA, 22 bp, Homo sapiens
ttagcagaatggagaaagtaag

SEQ ID NO: 6560658 - DNA, 16 bp, Homo sapiens
ttagcagagtctgtct

SEQ ID NO: 6560659 - DNA, 18 bp, Homo sapiens
ttagcagagtctgtctct

SEQ ID NO: 6560660 - DNA, 19 bp, Homo sapiens
ttagcagcaaaacaaacga

SEQ ID NO: 6560661 - DNA, 22 bp, Homo sapiens
ttagcagcacttttgatagatt

SEQ ID NO: 6560662 - DNA, 18 bp, Homo sapiens
ttagcagctcaggcgcag

SEQ ID NO: 6560663 - DNA, 23 bp, Homo sapiens
ttagcagctcaggcgcagcccta

SEQ ID NO: 6560664 - DNA, 22 bp, Homo sapiens
ttagcagctcttcccctttcct

SEQ ID NO: 6560665 - DNA, 22 bp, Homo sapiens
ttagcaggaaatagtgttcttt

SEQ ID NO: 6560666 - DNA, 19 bp, Homo sapiens
ttagcagtaaaatagctga

SEQ ID NO: 6560667 - DNA, 12 bp, Homo sapiens
ttagcagttctg

SEQ ID NO: 6560668 - DNA, 18 bp, Homo sapiens
ttagcagttctgcaaata

SEQ ID NO: 6560669 - DNA, 23 bp, Homo sapiens
ttagcagtttcctcagtgatgga

SEQ ID NO: 6560670 - DNA, 13 bp, Homo sapiens
ttagcataaattt

SEQ ID NO: 6560671 - DNA, 17 bp, Homo sapiens
ttagcataaatttaatg

SEQ ID NO: 6560672 - DNA, 15 bp, Homo sapiens
ttagcatacattcag

SEQ ID NO: 6560673 - DNA, 23 bp, Homo sapiens
ttagcatcagaaggttcacccag

SEQ ID NO: 6560674 - DNA, 19 bp, Homo sapiens
ttagcatcctaagaaatat

SEQ ID NO: 6560675 - DNA, 14 bp, Homo sapiens
ttagcatgaaaggt

SEQ ID NO: 6560676 - DNA, 24 bp, Homo sapiens
ttagcatgacaagccccaggcagg

SEQ ID NO: 6560677 - DNA, 14 bp, Homo sapiens
ttagcatgcaagct

SEQ ID NO: 6560678 - DNA, 19 bp, Homo sapiens
ttagcatgcgcgctgtggg

SEQ ID NO: 6560679 - DNA, 20 bp, Homo sapiens
ttagcatgcgcgctgtgggc

SEQ ID NO: 6560680 - DNA, 16 bp, Homo sapiens
ttagcatgtgtgactt

SEQ ID NO: 6560681 - DNA, 19 bp, Homo sapiens
ttagcatgttgttgaaagg

SEQ ID NO: 6560682 - DNA, 13 bp, Homo sapiens
ttagcattaccta

SEQ ID NO: 6560683 - DNA, 16 bp, Homo sapiens
ttagcattattgccaa

SEQ ID NO: 6560684 - DNA, 16 bp, Homo sapiens
ttagcattcataaact

SEQ ID NO: 6560685 - DNA, 16 bp, Homo sapiens
ttagcattgaaataat

SEQ ID NO: 6560686 - DNA, 22 bp, Homo sapiens
ttagcattgtagtgctttgaga

SEQ ID NO: 6560687 - DNA, 15 bp, Homo sapiens
ttagcattgtcttgt

SEQ ID NO: 6560688 - DNA, 18 bp, Homo sapiens
ttagcatttaccaacatg

SEQ ID NO: 6560689 - DNA, 13 bp, Homo sapiens
ttagcatttgtat

SEQ ID NO: 6560690 - DNA, 14 bp, Homo sapiens
ttagcatttgtata

SEQ ID NO: 6560691 - DNA, 15 bp, Homo sapiens
ttagccaaacaacaa

SEQ ID NO: 6560692 - DNA, 19 bp, Homo sapiens
ttagccaaacaacaacaaa

SEQ ID NO: 6560693 - DNA, 17 bp, Homo sapiens
ttagccacatgtacact

SEQ ID NO: 6560694 - DNA, 16 bp, Homo sapiens
ttagccacggaaacat

SEQ ID NO: 6560695 - DNA, 19 bp, Homo sapiens
ttagccacggaaacataga

SEQ ID NO: 6560696 - DNA, 14 bp, Homo sapiens
ttagccagaatgtt

SEQ ID NO: 6560697 - DNA, 19 bp, Homo sapiens
ttagccaggtaatgtgaat

SEQ ID NO: 6560698 - DNA, 15 bp, Homo sapiens
ttagccagtaatcct

SEQ ID NO: 6560699 - DNA, 21 bp, Homo sapiens
ttagccagttcaaagtgtata

SEQ ID NO: 6560700 - DNA, 22 bp, Homo sapiens
ttagccagttcaaagtgtatat

SEQ ID NO: 6560701 - DNA, 14 bp, Homo sapiens
ttagccatacacat

SEQ ID NO: 6560702 - DNA, 23 bp, Homo sapiens
ttagccatgtgaaactcatctca

SEQ ID NO: 6560703 - DNA, 15 bp, Homo sapiens
ttagccattgaaatg

SEQ ID NO: 6560704 - DNA, 19 bp, Homo sapiens
ttagccatttctccatggg

SEQ ID NO: 6560705 - DNA, 17 bp, Homo sapiens
ttagcccaatggagaaa

SEQ ID NO: 6560706 - DNA, 15 bp, Homo sapiens
ttagcccctgaaagc

SEQ ID NO: 6560707 - DNA, 21 bp, Homo sapiens
ttagccccttggattcctgca

SEQ ID NO: 6560708 - DNA, 16 bp, Homo sapiens
ttagccctcaccacag

SEQ ID NO: 6560709 - DNA, 15 bp, Homo sapiens
ttagccctgaacatt

SEQ ID NO: 6560710 - DNA, 16 bp, Homo sapiens
ttagccctgaacattt

SEQ ID NO: 6560711 - DNA, 17 bp, Homo sapiens
ttagccctggtttgaaa

SEQ ID NO: 6560712 - DNA, 19 bp, Homo sapiens
tttcctgggacatcttctg

SEQ ID NO: 6560713 - DNA, 13 bp, Homo sapiens
tttcctgggtgct

SEQ ID NO: 6560714 - DNA, 15 bp, Homo sapiens
tttcctgggtgctca

SEQ ID NO: 6560715 - DNA, 16 bp, Homo sapiens
tttcctggtgccaatt

SEQ ID NO: 6560716 - DNA, 19 bp, Homo sapiens
tttcctggtgccaatttca

SEQ ID NO: 6560717 - DNA, 23 bp, Homo sapiens
tttcctgtaaaaaaaaaaaagtt

SEQ ID NO: 6560718 - DNA, 22 bp, Homo sapiens
tttcctgtaaagaaacatttcc

SEQ ID NO: 6560719 - DNA, 16 bp, Homo sapiens
tttcctgtaagacaat

SEQ ID NO: 6560720 - DNA, 13 bp, Homo sapiens
tttcctgtaatat

SEQ ID NO: 6560721 - DNA, 21 bp, Homo sapiens
tttcctgtcagtgtttttgaa

SEQ ID NO: 6560722 - DNA, 13 bp, Homo sapiens
tttcctgtcctgc

SEQ ID NO: 6560723 - DNA, 16 bp, Homo sapiens
tttcctgtcctgcccg

SEQ ID NO: 6560724 - DNA, 21 bp, Homo sapiens
tttcctgtctgtatataactt

SEQ ID NO: 6560725 - DNA, 23 bp, Homo sapiens
tttcctgtctgtatataacttat

SEQ ID NO: 6560726 - DNA, 13 bp, Homo sapiens
tttcctgtgagga

SEQ ID NO: 6560727 - DNA, 23 bp, Homo sapiens
tttcctgtgcccatcatctctgc

SEQ ID NO: 6560728 - DNA, 12 bp, Homo sapiens
tttcctgtggaa

SEQ ID NO: 6560729 - DNA, 19 bp, Homo sapiens
tttcctgtggaataaagat

SEQ ID NO: 6560730 - DNA, 22 bp, Homo sapiens
tttcctgtggcataaattgcat

SEQ ID NO: 6560731 - DNA, 20 bp, Homo sapiens
tttcctgtgtaaacctaatt

SEQ ID NO: 6560732 - DNA, 22 bp, Homo sapiens
tttcctgtgtcagcgcctggcc

SEQ ID NO: 6560733 - DNA, 22 bp, Homo sapiens
tttcctgtgtccacatctaaca

SEQ ID NO: 6560734 - DNA, 13 bp, Homo sapiens
tttcctgtgtctc

SEQ ID NO: 6560735 - DNA, 16 bp, Homo sapiens
tttcctgtgtctccaa

SEQ ID NO: 6560736 - DNA, 19 bp, Homo sapiens
tttcctgtgtgaagaaagc

SEQ ID NO: 6560737 - DNA, 18 bp, Homo sapiens
tttcctgttcagcattct

SEQ ID NO: 6560738 - DNA, 18 bp, Homo sapiens
tttcctgttggtttcatt

SEQ ID NO: 6560739 - DNA, 14 bp, Homo sapiens
tttcctgtttccag

SEQ ID NO: 6560740 - DNA, 15 bp, Homo sapiens
tttcctgtttccagg

SEQ ID NO: 6560741 - DNA, 17 bp, Homo sapiens
tttcctgtttccagggt

SEQ ID NO: 6560742 - DNA, 16 bp, Homo sapiens
tttccttaactaaatg

SEQ ID NO: 6560743 - DNA, 13 bp, Homo sapiens
tttccttacacat

SEQ ID NO: 6560744 - DNA, 17 bp, Homo sapiens
tttccttacataaacat

SEQ ID NO: 6560745 - DNA, 14 bp, Homo sapiens
tttccttaccatac

SEQ ID NO: 6560746 - DNA, 13 bp, Homo sapiens
tttccttaccttt

SEQ ID NO: 6560747 - DNA, 14 bp, Homo sapiens
tttccttactgtgc

SEQ ID NO: 6560748 - DNA, 21 bp, Homo sapiens
tttccttagcttaatgactta

SEQ ID NO: 6560749 - DNA, 22 bp, Homo sapiens
tttccttatcacccccttgttg

SEQ ID NO: 6560750 - DNA, 18 bp, Homo sapiens
tttccttattgaaaaatc

SEQ ID NO: 6560751 - DNA, 17 bp, Homo sapiens
tttccttatttgccttc

SEQ ID NO: 6560752 - DNA, 18 bp, Homo sapiens
tttccttatttgccttct

SEQ ID NO: 6560753 - DNA, 14 bp, Homo sapiens
tttccttatttgct

SEQ ID NO: 6560754 - DNA, 20 bp, Homo sapiens
tttccttcaagaatgcagta

SEQ ID NO: 6560755 - DNA, 22 bp, Homo sapiens
tttccttcaggcagctgaaatt

SEQ ID NO: 6560756 - DNA, 12 bp, Homo sapiens
tttccttcagtg

SEQ ID NO: 6560757 - DNA, 15 bp, Homo sapiens
tttccttcagtgcct

SEQ ID NO: 6560758 - DNA, 23 bp, Homo sapiens
tttccttcattcaacccacctgc

SEQ ID NO: 6560759 - DNA, 12 bp, Homo sapiens
tttccttccact

SEQ ID NO: 6560760 - DNA, 14 bp, Homo sapiens
tttccttccactgt

SEQ ID NO: 6560761 - DNA, 11 bp, Homo sapiens
tttccttccag

SEQ ID NO: 6560762 - DNA, 15 bp, Homo sapiens
tttccttccagccca

SEQ ID NO: 6560763 - DNA, 16 bp, Homo sapiens
tttccttccagcccag

SEQ ID NO: 6560764 - DNA, 23 bp, Homo sapiens
tttccttccatgctcccaactcc

SEQ ID NO: 6560765 - DNA, 14 bp, Homo sapiens
tttccttcccaggc

SEQ ID NO: 6560766 - DNA, 15 bp, Homo sapiens
tttccttcccaggcc

SEQ ID NO: 6560767 - DNA, 20 bp, Homo sapiens
tttccttcccttttctgttc

SEQ ID NO: 6560768 - DNA, 18 bp, Homo sapiens
tttccttcctcccctttt

SEQ ID NO: 6560769 - DNA, 16 bp, Homo sapiens
tttccttcctctgtaa

SEQ ID NO: 6560770 - DNA, 14 bp, Homo sapiens
tttccttcctgccc

SEQ ID NO: 6560771 - DNA, 14 bp, Homo sapiens
tttccttccttcct

SEQ ID NO: 6560772 - DNA, 15 bp, Homo sapiens
tttccttctgccctt

SEQ ID NO: 6560773 - DNA, 18 bp, Homo sapiens
tttccttctgcccttcct

SEQ ID NO: 6560774 - DNA, 15 bp, Homo sapiens
tttccttcttcagca

SEQ ID NO: 6560775 - DNA, 13 bp, Homo sapiens
tttccttgaagcc

SEQ ID NO: 6560776 - DNA, 20 bp, Homo sapiens
tttccttgaggggagccagg

SEQ ID NO: 6560777 - DNA, 16 bp, Homo sapiens
tttccttgcatacaaa

SEQ ID NO: 6560778 - DNA, 12 bp, Homo sapiens
tttccttgctca

SEQ ID NO: 6560779 - DNA, 15 bp, Homo sapiens
tttccttgtagcatt

SEQ ID NO: 6560780 - DNA, 17 bp, Homo sapiens
tttccttgtatgtgggt

SEQ ID NO: 6560781 - DNA, 21 bp, Homo sapiens
tttccttgtccccacactcct

SEQ ID NO: 6560782 - DNA, 13 bp, Homo sapiens
tttccttgtcccg

SEQ ID NO: 6560783 - DNA, 13 bp, Homo sapiens
tttccttgtctct

SEQ ID NO: 6560784 - DNA, 13 bp, Homo sapiens
tttccttgtgcaa

SEQ ID NO: 6560785 - DNA, 19 bp, Homo sapiens
tttccttgtttatcagata

SEQ ID NO: 6560786 - DNA, 23 bp, Homo sapiens
tttcctttaaaaaaatttaagtg

SEQ ID NO: 6560787 - DNA, 17 bp, Homo sapiens
tttcctttaatatgaaa

SEQ ID NO: 6560788 - DNA, 20 bp, Homo sapiens
tttcctttatccacttttct

SEQ ID NO: 6560789 - DNA, 13 bp, Homo sapiens
tttcctttatgtg

SEQ ID NO: 6560790 - DNA, 17 bp, Homo sapiens
tttcctttatgtgaatt

SEQ ID NO: 6560791 - DNA, 23 bp, Homo sapiens
tttcctttatgtgaatttttaag

SEQ ID NO: 6560792 - DNA, 16 bp, Homo sapiens
tttcctttcaataaag

SEQ ID NO: 6560793 - DNA, 19 bp, Homo sapiens
tttcctttcatcctcagca

SEQ ID NO: 6560794 - DNA, 19 bp, Homo sapiens
tttcctttcatttactgtg

SEQ ID NO: 6560795 - DNA, 14 bp, Homo sapiens
tttcctttctcacc

SEQ ID NO: 6560796 - DNA, 13 bp, Homo sapiens
tttcctttctgta

SEQ ID NO: 6560797 - DNA, 14 bp, Homo sapiens
tttcctttctgtat

SEQ ID NO: 6560798 - DNA, 22 bp, Homo sapiens
tttcctttcttaattttgtctt

SEQ ID NO: 6560799 - DNA, 17 bp, Homo sapiens
tttcctttcttccttcc

SEQ ID NO: 6560800 - DNA, 9 bp, Homo sapiens
tttcctttg

SEQ ID NO: 6560801 - DNA, 21 bp, Homo sapiens
tttcctttgacctctcacttt

SEQ ID NO: 6560802 - DNA, 12 bp, Homo sapiens
tttcctttgcat

SEQ ID NO: 6560803 - DNA, 14 bp, Homo sapiens
tttcctttgtagct

SEQ ID NO: 6560804 - DNA, 13 bp, Homo sapiens
tttcctttgtcat

SEQ ID NO: 6560805 - DNA, 16 bp, Homo sapiens
tttcctttgtcatcat

SEQ ID NO: 6560806 - DNA, 23 bp, Homo sapiens
tttcctttgtcatcattgtatat

SEQ ID NO: 6560807 - DNA, 19 bp, Homo sapiens
tttcctttgttgtctacat

SEQ ID NO: 6560808 - DNA, 21 bp, Homo sapiens
tttccttttaaaacacttcca

SEQ ID NO: 6560809 - DNA, 12 bp, Homo sapiens
tttccttttaag

SEQ ID NO: 6560810 - DNA, 19 bp, Homo sapiens
tttccttttaagaaagctt

SEQ ID NO: 6560811 - DNA, 15 bp, Homo sapiens
tttccttttaattct

SEQ ID NO: 6560812 - DNA, 15 bp, Homo sapiens
tttccttttcatctg

SEQ ID NO: 6560813 - DNA, 16 bp, Homo sapiens
tttccttttcatctgt

SEQ ID NO: 6560814 - DNA, 14 bp, Homo sapiens
tttccttttctctg

SEQ ID NO: 6560815 - DNA, 15 bp, Homo sapiens
tttccttttcttaaa

SEQ ID NO: 6560816 - DNA, 16 bp, Homo sapiens
tttccttttcttaaaa

SEQ ID NO: 6560817 - DNA, 18 bp, Homo sapiens
tttccttttcttaaaaca

SEQ ID NO: 6560818 - DNA, 12 bp, Homo sapiens
tttccttttgga

SEQ ID NO: 6560819 - DNA, 13 bp, Homo sapiens
tttccttttgggg

SEQ ID NO: 6560820 - DNA, 20 bp, Homo sapiens
tttccttttgggggtaaagt

SEQ ID NO: 6560821 - DNA, 22 bp, Homo sapiens
tttccttttgggggtaaagttt

SEQ ID NO: 6560822 - DNA, 21 bp, Homo sapiens
tttcctttttaaggtctttca

SEQ ID NO: 6560823 - DNA, 17 bp, Homo sapiens
tttcctttttctgatta

SEQ ID NO: 6560824 - DNA, 15 bp, Homo sapiens
tttcctttttcttcg

SEQ ID NO: 6560825 - DNA, 16 bp, Homo sapiens
tttcctttttcttcgc

SEQ ID NO: 6560826 - DNA, 13 bp, Homo sapiens
tttccttttttat

SEQ ID NO: 6560827 - DNA, 22 bp, Homo sapiens
tttccttttttatacacataat

SEQ ID NO: 6560828 - DNA, 14 bp, Homo sapiens
tttcgactggtcca

SEQ ID NO: 6560829 - DNA, 20 bp, Homo sapiens
tttcgactggtccagctctg

SEQ ID NO: 6560830 - DNA, 19 bp, Homo sapiens
tttcgagaagctgctctgg

SEQ ID NO: 6560831 - DNA, 13 bp, Homo sapiens
tttcgaggcctga

SEQ ID NO: 6560832 - DNA, 13 bp, Homo sapiens
tttcgataaacaa

SEQ ID NO: 6560833 - DNA, 20 bp, Homo sapiens
tttcgataaacaacaaggtg

SEQ ID NO: 6560834 - DNA, 16 bp, Homo sapiens
tttcgcatccaccgcc

SEQ ID NO: 6560835 - DNA, 18 bp, Homo sapiens
tttcgccaaactgtctct

SEQ ID NO: 6560836 - DNA, 18 bp, Homo sapiens
tttcgccaaggctcacat

SEQ ID NO: 6560837 - DNA, 20 bp, Homo sapiens
tttcgccccctgcctgccat

SEQ ID NO: 6560838 - DNA, 19 bp, Homo sapiens
tttcgccgttgaagaggaa

SEQ ID NO: 6560839 - DNA, 16 bp, Homo sapiens
tttcgcctttcctctc

SEQ ID NO: 6560840 - DNA, 12 bp, Homo sapiens
tttcggaaaaaa

SEQ ID NO: 6560841 - DNA, 20 bp, Homo sapiens
tttcggaaaaaaaaaaagaa

SEQ ID NO: 6560842 - DNA, 22 bp, Homo sapiens
tttcggaaaaaaaaaaagaaaa

SEQ ID NO: 6560843 - DNA, 23 bp, Homo sapiens
tttcggcagaggaacccccacca

SEQ ID NO: 6560844 - DNA, 15 bp, Homo sapiens
tttcgggctgagaag

SEQ ID NO: 6560845 - DNA, 21 bp, Homo sapiens
tttcggggtgaagcaagttca

SEQ ID NO: 6560846 - DNA, 22 bp, Homo sapiens
tttcggggtgaagcaagttcac

SEQ ID NO: 6560847 - DNA, 23 bp, Homo sapiens
tttcggggtgaagcaagttcact

SEQ ID NO: 6560848 - DNA, 16 bp, Homo sapiens
tttcgtatttctcata

SEQ ID NO: 6560849 - DNA, 22 bp, Homo sapiens
tttcgtcacaggagtctttgta

SEQ ID NO: 6560850 - DNA, 18 bp, Homo sapiens
tttcgtcatcttccctgc

SEQ ID NO: 6560851 - DNA, 14 bp, Homo sapiens
tttcgtcatgttgg

SEQ ID NO: 6560852 - DNA, 20 bp, Homo sapiens
tttcgtccacagcttcctgt

SEQ ID NO: 6560853 - DNA, 15 bp, Homo sapiens
tttcgtctactgcaa

SEQ ID NO: 6560854 - DNA, 13 bp, Homo sapiens
tttcgtgatctta

SEQ ID NO: 6560855 - DNA, 20 bp, Homo sapiens
tttcgtgttgtgttctttat

SEQ ID NO: 6560856 - DNA, 13 bp, Homo sapiens
tttcgttaacatt

SEQ ID NO: 6560857 - DNA, 15 bp, Homo sapiens
tttcgttaagcagta

SEQ ID NO: 6560858 - DNA, 21 bp, Homo sapiens
tttcgttaagcagtacatctt

SEQ ID NO: 6560859 - DNA, 13 bp, Homo sapiens
tttcgttccctga

SEQ ID NO: 6560860 - DNA, 12 bp, Homo sapiens
tttcgttctgct

SEQ ID NO: 6560861 - DNA, 13 bp, Homo sapiens
tttcgttctgctg

SEQ ID NO: 6560862 - DNA, 13 bp, Homo sapiens
tttcgttgcatgg

SEQ ID NO: 6560863 - DNA, 15 bp, Homo sapiens
tttctaaaaaggctg

SEQ ID NO: 6560864 - DNA, 19 bp, Homo sapiens
tttctaaaaagtcaattca

SEQ ID NO: 6560865 - DNA, 15 bp, Homo sapiens
tttctaaaaagtcag

SEQ ID NO: 6560866 - DNA, 12 bp, Homo sapiens
tttctaaaacat

SEQ ID NO: 6560867 - DNA, 18 bp, Homo sapiens
tttctaaaacattaattg

SEQ ID NO: 6560868 - DNA, 13 bp, Homo sapiens
tttctaaaactat

SEQ ID NO: 6560869 - DNA, 16 bp, Homo sapiens
tttctaaaactgcctt

SEQ ID NO: 6560870 - DNA, 16 bp, Homo sapiens
tttctaaaagctttca

SEQ ID NO: 6560871 - DNA, 19 bp, Homo sapiens
tttctaaaagctttcatgt

SEQ ID NO: 6560872 - DNA, 21 bp, Homo sapiens
tttctaaaatcttatagttct

SEQ ID NO: 6560873 - DNA, 19 bp, Homo sapiens
tttctaaaatgttaaaaca

SEQ ID NO: 6560874 - DNA, 13 bp, Homo sapiens
tttctaaacaaga

SEQ ID NO: 6560875 - DNA, 15 bp, Homo sapiens
tttctaaacagagat

SEQ ID NO: 6560876 - DNA, 16 bp, Homo sapiens
tttctaaacagagatg

SEQ ID NO: 6560877 - DNA, 18 bp, Homo sapiens
tttctaaacctgtgcctc

SEQ ID NO: 6560878 - DNA, 20 bp, Homo sapiens
tttctaaacctgtgcctccc

SEQ ID NO: 6560879 - DNA, 21 bp, Homo sapiens
tttctaaacctgtgcctccct

SEQ ID NO: 6560880 - DNA, 22 bp, Homo sapiens
tttctaaacgtaagcactgttt

SEQ ID NO: 6560881 - DNA, 22 bp, Homo sapiens
tttctaaactcaataaggtaat

SEQ ID NO: 6560882 - DNA, 15 bp, Homo sapiens
tttctaaactggaga

SEQ ID NO: 6560883 - DNA, 17 bp, Homo sapiens
tttctaaactggagact

SEQ ID NO: 6560884 - DNA, 18 bp, Homo sapiens
tttctaaactgttttcat

SEQ ID NO: 6560885 - DNA, 21 bp, Homo sapiens
tttctaaaggagtttatgttc

SEQ ID NO: 6560886 - DNA, 21 bp, Homo sapiens
tttctaaaggctacctttgta

SEQ ID NO: 6560887 - DNA, 17 bp, Homo sapiens
tttctaaagggatctgc

SEQ ID NO: 6560888 - DNA, 14 bp, Homo sapiens
tttctaaagtaaaa

SEQ ID NO: 6560889 - DNA, 15 bp, Homo sapiens
tttctaaagtaaaat

SEQ ID NO: 6560890 - DNA, 22 bp, Homo sapiens
tttctaaagtaaaattgaagca

SEQ ID NO: 6560891 - DNA, 12 bp, Homo sapiens
tttctaaagttg

SEQ ID NO: 6560892 - DNA, 14 bp, Homo sapiens
tttctaaataaaaa

SEQ ID NO: 6560893 - DNA, 14 bp, Homo sapiens
ttagccctgtctgc

SEQ ID NO: 6560894 - DNA, 13 bp, Homo sapiens
ttagcccttcaga

SEQ ID NO: 6560895 - DNA, 19 bp, Homo sapiens
ttagcccttccttgccagt

SEQ ID NO: 6560896 - DNA, 19 bp, Homo sapiens
ttagccgggcatggtggca

SEQ ID NO: 6560897 - DNA, 13 bp, Homo sapiens
ttagccgggcgtg

SEQ ID NO: 6560898 - DNA, 15 bp, Homo sapiens
ttagcctaagatata

SEQ ID NO: 6560899 - DNA, 15 bp, Homo sapiens
ttagcctccctgaaa

SEQ ID NO: 6560900 - DNA, 12 bp, Homo sapiens
ttagcctctccc

SEQ ID NO: 6560901 - DNA, 17 bp, Homo sapiens
ttagcctctcccacccg

SEQ ID NO: 6560902 - DNA, 20 bp, Homo sapiens
ttagcctctggatctagaag

SEQ ID NO: 6560903 - DNA, 11 bp, Homo sapiens
ttagcctcttc

SEQ ID NO: 6560904 - DNA, 12 bp, Homo sapiens
ttagcctcttcc

SEQ ID NO: 6560905 - DNA, 13 bp, Homo sapiens
ttagcctggacca

SEQ ID NO: 6560906 - DNA, 17 bp, Homo sapiens
ttagcctggacctctga

SEQ ID NO: 6560907 - DNA, 18 bp, Homo sapiens
ttagcctggatagccttg

SEQ ID NO: 6560908 - DNA, 22 bp, Homo sapiens
ttagcctggatagccttgaaaa

SEQ ID NO: 6560909 - DNA, 16 bp, Homo sapiens
ttagcctgggcctcct

SEQ ID NO: 6560910 - DNA, 22 bp, Homo sapiens
ttagcctgggcctcctcctagc

SEQ ID NO: 6560911 - DNA, 14 bp, Homo sapiens
ttagcctggtgaca

SEQ ID NO: 6560912 - DNA, 14 bp, Homo sapiens
ttagcctgtgctgg

SEQ ID NO: 6560913 - DNA, 22 bp, Homo sapiens
ttagcctgtggcagtaaagaga

SEQ ID NO: 6560914 - DNA, 22 bp, Homo sapiens
ttagccttagacgaagaagctg

SEQ ID NO: 6560915 - DNA, 14 bp, Homo sapiens
ttagccttctctgt

SEQ ID NO: 6560916 - DNA, 23 bp, Homo sapiens
ttagccttgctgtagagacttcc

SEQ ID NO: 6560917 - DNA, 17 bp, Homo sapiens
ttagccttgtgccctgc

SEQ ID NO: 6560918 - DNA, 16 bp, Homo sapiens
ttagcctttgccctgt

SEQ ID NO: 6560919 - DNA, 18 bp, Homo sapiens
ttagcctttgccctgtca

SEQ ID NO: 6560920 - DNA, 19 bp, Homo sapiens
ttagcgtcaagacatttgc

SEQ ID NO: 6560921 - DNA, 21 bp, Homo sapiens
ttagcgtcaagacatttgctg

SEQ ID NO: 6560922 - DNA, 16 bp, Homo sapiens
ttagcgttgttttgtg

SEQ ID NO: 6560923 - DNA, 17 bp, Homo sapiens
ttagcgttgttttgtgg

SEQ ID NO: 6560924 - DNA, 19 bp, Homo sapiens
ttagcgttgttttgtggat

SEQ ID NO: 6560925 - DNA, 20 bp, Homo sapiens
ttagcgttgttttgtggata

SEQ ID NO: 6560926 - DNA, 20 bp, Homo sapiens
ttagctaaatgcaatttaaa

SEQ ID NO: 6560927 - DNA, 18 bp, Homo sapiens
ttagctaaattcagggag

SEQ ID NO: 6560928 - DNA, 19 bp, Homo sapiens
ttagctacaatcctacctt

SEQ ID NO: 6560929 - DNA, 20 bp, Homo sapiens
ttagctacatagcagacttt

SEQ ID NO: 6560930 - DNA, 16 bp, Homo sapiens
ttagctactatatatg

SEQ ID NO: 6560931 - DNA, 15 bp, Homo sapiens
ttagctactgtatgc

SEQ ID NO: 6560932 - DNA, 14 bp, Homo sapiens
ttagctagaatgca

SEQ ID NO: 6560933 - DNA, 17 bp, Homo sapiens
ttagctattgggagcaa

SEQ ID NO: 6560934 - DNA, 11 bp, Homo sapiens
ttagctattta

SEQ ID NO: 6560935 - DNA, 19 bp, Homo sapiens
ttagctatttaatactaat

SEQ ID NO: 6560936 - DNA, 14 bp, Homo sapiens
ttagctcaatgagc

SEQ ID NO: 6560937 - DNA, 13 bp, Homo sapiens
ttagctcagcccc

SEQ ID NO: 6560938 - DNA, 13 bp, Homo sapiens
ttagctcatttga

SEQ ID NO: 6560939 - DNA, 15 bp, Homo sapiens
ttagctcccagctag

SEQ ID NO: 6560940 - DNA, 18 bp, Homo sapiens
ttagctcccctccaacct

SEQ ID NO: 6560941 - DNA, 14 bp, Homo sapiens
ttagctcctgtggc

SEQ ID NO: 6560942 - DNA, 18 bp, Homo sapiens
ttagctctcttaaatgaa

SEQ ID NO: 6560943 - DNA, 13 bp, Homo sapiens
ttagctctgagaa

SEQ ID NO: 6560944 - DNA, 13 bp, Homo sapiens
ttagctctgagga

SEQ ID NO: 6560945 - DNA, 16 bp, Homo sapiens
ttagctgaagaattga

SEQ ID NO: 6560946 - DNA, 20 bp, Homo sapiens
ttagctgaggctgagaaagc

SEQ ID NO: 6560947 - DNA, 16 bp, Homo sapiens
ttagctgcacggcatt

SEQ ID NO: 6560948 - DNA, 17 bp, Homo sapiens
ttagctgccaagcccca

SEQ ID NO: 6560949 - DNA, 22 bp, Homo sapiens
ttagctgccaagccccatcctg

SEQ ID NO: 6560950 - DNA, 18 bp, Homo sapiens
ttagctgcctgaaaatca

SEQ ID NO: 6560951 - DNA, 13 bp, Homo sapiens
ttagctgctcact

SEQ ID NO: 6560952 - DNA, 15 bp, Homo sapiens
ttagctggacatgct

SEQ ID NO: 6560953 - DNA, 22 bp, Homo sapiens
ttagctgggaagaatgtattcg

SEQ ID NO: 6560954 - DNA, 23 bp, Homo sapiens
ttagctgtactataagtagttgg

SEQ ID NO: 6560955 - DNA, 17 bp, Homo sapiens
ttagctgtagagtcctt

SEQ ID NO: 6560956 - DNA, 19 bp, Homo sapiens
ttagctgtattcatatatt

SEQ ID NO: 6560957 - DNA, 21 bp, Homo sapiens
ttagctgtattcatatattgc

SEQ ID NO: 6560958 - DNA, 22 bp, Homo sapiens
ttagctgtgaatggctgtgccc

SEQ ID NO: 6560959 - DNA, 14 bp, Homo sapiens
ttagctgtgttatt

SEQ ID NO: 6560960 - DNA, 16 bp, Homo sapiens
ttagctgttatttcta

SEQ ID NO: 6560961 - DNA, 17 bp, Homo sapiens
ttagctgttatttctat

SEQ ID NO: 6560962 - DNA, 18 bp, Homo sapiens
ttagctgttggaatgttg

SEQ ID NO: 6560963 - DNA, 24 bp, Homo sapiens
ttagctgtttactgacatggtgct

SEQ ID NO: 6560964 - DNA, 14 bp, Homo sapiens
ttagcttacaggaa

SEQ ID NO: 6560965 - DNA, 16 bp, Homo sapiens
ttagcttacaggaagc

SEQ ID NO: 6560966 - DNA, 19 bp, Homo sapiens
ttagcttatcaatttgtca

SEQ ID NO: 6560967 - DNA, 14 bp, Homo sapiens
ttagcttcaggaac

SEQ ID NO: 6560968 - DNA, 20 bp, Homo sapiens
ttagcttcatatctaattta

SEQ ID NO: 6560969 - DNA, 15 bp, Homo sapiens
ttagcttcctccaga

SEQ ID NO: 6560970 - DNA, 20 bp, Homo sapiens
ttagcttcctccagaggagg

SEQ ID NO: 6560971 - DNA, 12 bp, Homo sapiens
ttagcttcctta

SEQ ID NO: 6560972 - DNA, 20 bp, Homo sapiens
ttagcttgcacatgaatgca

SEQ ID NO: 6560973 - DNA, 15 bp, Homo sapiens
ttagcttggggccag

SEQ ID NO: 6560974 - DNA, 12 bp, Homo sapiens
ttagctttacat

SEQ ID NO: 6560975 - DNA, 17 bp, Homo sapiens
ttagctttactgtttgt

SEQ ID NO: 6560976 - DNA, 19 bp, Homo sapiens
ttagctttccaaggaagca

SEQ ID NO: 6560977 - DNA, 21 bp, Homo sapiens
ttagctttccaaggaagcaga

SEQ ID NO: 6560978 - DNA, 17 bp, Homo sapiens
ttagctttccctgtgcc

SEQ ID NO: 6560979 - DNA, 20 bp, Homo sapiens
ttagctttctgagcaagagg

SEQ ID NO: 6560980 - DNA, 13 bp, Homo sapiens
ttagctttgaaac

SEQ ID NO: 6560981 - DNA, 14 bp, Homo sapiens
ttagctttgaaact

SEQ ID NO: 6560982 - DNA, 12 bp, Homo sapiens
ttagctttgtca

SEQ ID NO: 6560983 - DNA, 20 bp, Homo sapiens
ttagctttgtgtttactttt

SEQ ID NO: 6560984 - DNA, 22 bp, Homo sapiens
ttagctttgtgtttggtttaca

SEQ ID NO: 6560985 - DNA, 15 bp, Homo sapiens
ttagcttttacctta

SEQ ID NO: 6560986 - DNA, 22 bp, Homo sapiens
ttagcttttagttttaaaactc

SEQ ID NO: 6560987 - DNA, 18 bp, Homo sapiens
ttagctttttaaaacatt

SEQ ID NO: 6560988 - DNA, 20 bp, Homo sapiens
ttagctttttaaaacattag

SEQ ID NO: 6560989 - DNA, 17 bp, Homo sapiens
ttagctttttcatcccc

SEQ ID NO: 6560990 - DNA, 18 bp, Homo sapiens
ttagctttttcatcccct

SEQ ID NO: 6560991 - DNA, 14 bp, Homo sapiens
ttaggaaaagcatc

SEQ ID NO: 6560992 - DNA, 21 bp, Homo sapiens
ttaggaaaatcactttgtcta

SEQ ID NO: 6560993 - DNA, 18 bp, Homo sapiens
ttaggaaagttgtgattc

SEQ ID NO: 6560994 - DNA, 11 bp, Homo sapiens
ttaggaaataa

SEQ ID NO: 6560995 - DNA, 19 bp, Homo sapiens
ttaggaaataaaacctttc

SEQ ID NO: 6560996 - DNA, 20 bp, Homo sapiens
ttaggaaataaaacctttca

SEQ ID NO: 6560997 - DNA, 21 bp, Homo sapiens
ttaggaaataaaacctttcaa

SEQ ID NO: 6560998 - DNA, 19 bp, Homo sapiens
ttaggaaatgaatgtgtgt

SEQ ID NO: 6560999 - DNA, 23 bp, Homo sapiens
ttaggaaatgtttttaataaaag

SEQ ID NO: 6561000 - DNA, 16 bp, Homo sapiens
ttaggaaatttaagac

SEQ ID NO: 6561001 - DNA, 20 bp, Homo sapiens
ttaggaaatttatacaaaga

SEQ ID NO: 6561002 - DNA, 21 bp, Homo sapiens
ttaggaacagagtatatatgt

SEQ ID NO: 6561003 - DNA, 21 bp, Homo sapiens
ttaggaacagcagtgttctca

SEQ ID NO: 6561004 - DNA, 23 bp, Homo sapiens
ttaggaacagcagtgttctcaca

SEQ ID NO: 6561005 - DNA, 16 bp, Homo sapiens
ttaggaacagtaaaat

SEQ ID NO: 6561006 - DNA, 23 bp, Homo sapiens
ttaggaaccttctcccttcttgg

SEQ ID NO: 6561007 - DNA, 20 bp, Homo sapiens
ttaggaagaaatcacttaaa

SEQ ID NO: 6561008 - DNA, 20 bp, Homo sapiens
ttaggaagaagtggtactag

SEQ ID NO: 6561009 - DNA, 22 bp, Homo sapiens
ttaggaagagccttccacccag

SEQ ID NO: 6561010 - DNA, 18 bp, Homo sapiens
ttaggaagcaagcttaat

SEQ ID NO: 6561011 - DNA, 16 bp, Homo sapiens
ttaggaagtcacagat

SEQ ID NO: 6561012 - DNA, 22 bp, Homo sapiens
ttaggaagttgacttatagtac

SEQ ID NO: 6561013 - DNA, 23 bp, Homo sapiens
ttaggaagttgacttatagtaca

SEQ ID NO: 6561014 - DNA, 12 bp, Homo sapiens
ttaggaatactg

SEQ ID NO: 6561015 - DNA, 16 bp, Homo sapiens
ttaggaatactgtttt

SEQ ID NO: 6561016 - DNA, 20 bp, Homo sapiens
ttaggaatatacatagtctt

SEQ ID NO: 6561017 - DNA, 15 bp, Homo sapiens
ttaggaatctcttca

SEQ ID NO: 6561018 - DNA, 19 bp, Homo sapiens
ttaggaatctcttcactac

SEQ ID NO: 6561019 - DNA, 19 bp, Homo sapiens
ttaggaattaagttatctt

SEQ ID NO: 6561020 - DNA, 16 bp, Homo sapiens
ttaggaattggaggct

SEQ ID NO: 6561021 - DNA, 12 bp, Homo sapiens
ttaggacaaatc

SEQ ID NO: 6561022 - DNA, 22 bp, Homo sapiens
ttaggactgaaaatactcctga

SEQ ID NO: 6561023 - DNA, 14 bp, Homo sapiens
ttaggactgggttc

SEQ ID NO: 6561024 - DNA, 14 bp, Homo sapiens
ttaggactgtataa

SEQ ID NO: 6561025 - DNA, 22 bp, Homo sapiens
ttaggacttcaaaaggtgatta

SEQ ID NO: 6561026 - DNA, 15 bp, Homo sapiens
ttaggacttgccctc

SEQ ID NO: 6561027 - DNA, 16 bp, Homo sapiens
ttaggagaagccagga

SEQ ID NO: 6561028 - DNA, 17 bp, Homo sapiens
ttaggagaagccaggaa

SEQ ID NO: 6561029 - DNA, 18 bp, Homo sapiens
ttaggagaagttggtctt

SEQ ID NO: 6561030 - DNA, 17 bp, Homo sapiens
ttaggagacgctgcact

SEQ ID NO: 6561031 - DNA, 19 bp, Homo sapiens
ttaggagcaagaagaaaat

SEQ ID NO: 6561032 - DNA, 17 bp, Homo sapiens
ttaggagctaaggctct

SEQ ID NO: 6561033 - DNA, 22 bp, Homo sapiens
ttaggagctcagttgagaaaca

SEQ ID NO: 6561034 - DNA, 17 bp, Homo sapiens
ttaggaggctcaacaat

SEQ ID NO: 6561035 - DNA, 18 bp, Homo sapiens
ttaggaggctgaggtggg

SEQ ID NO: 6561036 - DNA, 23 bp, Homo sapiens
ttaggagtgctgataagaatgaa

SEQ ID NO: 6561037 - DNA, 15 bp, Homo sapiens
ttaggagttttgaga

SEQ ID NO: 6561038 - DNA, 17 bp, Homo sapiens
ttaggataactaaaatt

SEQ ID NO: 6561039 - DNA, 20 bp, Homo sapiens
ttaggatacttaacaaatac

SEQ ID NO: 6561040 - DNA, 21 bp, Homo sapiens
ttaggatccatgcagcttttt

SEQ ID NO: 6561041 - DNA, 19 bp, Homo sapiens
ttaggatgagcaaaacatt

SEQ ID NO: 6561042 - DNA, 19 bp, Homo sapiens
ttaggatgctcagttgcta

SEQ ID NO: 6561043 - DNA, 15 bp, Homo sapiens
ttaggatggcaggac

SEQ ID NO: 6561044 - DNA, 22 bp, Homo sapiens
ttaggatggggctcccagctcc

SEQ ID NO: 6561045 - DNA, 17 bp, Homo sapiens
ttaggatggtaaagtta

SEQ ID NO: 6561046 - DNA, 16 bp, Homo sapiens
ttaggatgtgtgcatg

SEQ ID NO: 6561047 - DNA, 18 bp, Homo sapiens
ttaggatgttgaaaaagt

SEQ ID NO: 6561048 - DNA, 14 bp, Homo sapiens
ttaggattgaagtg

SEQ ID NO: 6561049 - DNA, 22 bp, Homo sapiens
ttaggatttaacagtcatttaa

SEQ ID NO: 6561050 - DNA, 19 bp, Homo sapiens
ttaggcactgttcaatact

SEQ ID NO: 6561051 - DNA, 13 bp, Homo sapiens
ttaggcacttttt

SEQ ID NO: 6561052 - DNA, 18 bp, Homo sapiens
ttaggcactttttaacat

SEQ ID NO: 6561053 - DNA, 15 bp, Homo sapiens
ttaggcagattgaaa

SEQ ID NO: 6561054 - DNA, 18 bp, Homo sapiens
ttaggcagtataaagaat

SEQ ID NO: 6561055 - DNA, 20 bp, Homo sapiens
ttaggcagtataaagaatag

SEQ ID NO: 6561056 - DNA, 18 bp, Homo sapiens
ttaggcatgcacagctgt

SEQ ID NO: 6561057 - DNA, 14 bp, Homo sapiens
ttaggcatgcctaa

SEQ ID NO: 6561058 - DNA, 13 bp, Homo sapiens
ttaggcattattt

SEQ ID NO: 6561059 - DNA, 20 bp, Homo sapiens
ttaggcattatttaatgttt

SEQ ID NO: 6561060 - DNA, 15 bp, Homo sapiens
ttaggccaaagacaa

SEQ ID NO: 6561061 - DNA, 18 bp, Homo sapiens
ttaggccaaagacaaata

SEQ ID NO: 6561062 - DNA, 16 bp, Homo sapiens
ttaggccacatgggag

SEQ ID NO: 6561063 - DNA, 10 bp, Homo sapiens
ttaggccagc

SEQ ID NO: 6561064 - DNA, 19 bp, Homo sapiens
ttaggcccccatcatcctc

SEQ ID NO: 6561065 - DNA, 16 bp, Homo sapiens
ttaggccccgtggtga

SEQ ID NO: 6561066 - DNA, 21 bp, Homo sapiens
ttaggccccgtggtgacattt

SEQ ID NO: 6561067 - DNA, 22 bp, Homo sapiens
ttaggcccgccaaacttctgaa

SEQ ID NO: 6561068 - DNA, 14 bp, Homo sapiens
ttaggcccgggccc

SEQ ID NO: 6561069 - DNA, 16 bp, Homo sapiens
ttaggcctcatttctt

SEQ ID NO: 6561070 - DNA, 10 bp, Homo sapiens
ttaggcctgg

SEQ ID NO: 6561071 - DNA, 11 bp, Homo sapiens
ttaggcctgga

SEQ ID NO: 6561072 - DNA, 17 bp, Homo sapiens
tttctaaataaaaatat

SEQ ID NO: 6561073 - DNA, 20 bp, Homo sapiens
tttctaaataaaaatatgta

SEQ ID NO: 6561074 - DNA, 19 bp, Homo sapiens
tttctaaatctccaaaata

SEQ ID NO: 6561075 - DNA, 15 bp, Homo sapiens
tttctaaatctgaga

SEQ ID NO: 6561076 - DNA, 21 bp, Homo sapiens
tttctaacaaaaaaatatatt

SEQ ID NO: 6561077 - DNA, 13 bp, Homo sapiens
tttctaacatatg

SEQ ID NO: 6561078 - DNA, 15 bp, Homo sapiens
tttctaaccaagagg

SEQ ID NO: 6561079 - DNA, 20 bp, Homo sapiens
tttctaaccaagaggctggt

SEQ ID NO: 6561080 - DNA, 22 bp, Homo sapiens
tttctaaccacggttatttaag

SEQ ID NO: 6561081 - DNA, 22 bp, Homo sapiens
tttctaaccttgaatgctgcca

SEQ ID NO: 6561082 - DNA, 23 bp, Homo sapiens
tttctaaccttgaatgctgccag

SEQ ID NO: 6561083 - DNA, 22 bp, Homo sapiens
tttctaactacaaaggtttaaa

SEQ ID NO: 6561084 - DNA, 22 bp, Homo sapiens
tttctaactctgatgtaaatga

SEQ ID NO: 6561085 - DNA, 12 bp, Homo sapiens
tttctaactgta

SEQ ID NO: 6561086 - DNA, 13 bp, Homo sapiens
tttctaactgtaa

SEQ ID NO: 6561087 - DNA, 15 bp, Homo sapiens
tttctaactgtaaat

SEQ ID NO: 6561088 - DNA, 21 bp, Homo sapiens
tttctaactgtaaatcacttg

SEQ ID NO: 6561089 - DNA, 12 bp, Homo sapiens
tttctaactttt

SEQ ID NO: 6561090 - DNA, 16 bp, Homo sapiens
tttctaagaaaatgta

SEQ ID NO: 6561091 - DNA, 17 bp, Homo sapiens
tttctaagaaacattta

SEQ ID NO: 6561092 - DNA, 22 bp, Homo sapiens
tttctaagaagttactttttgt

SEQ ID NO: 6561093 - DNA, 19 bp, Homo sapiens
tttctaagaagttgtttga

SEQ ID NO: 6561094 - DNA, 14 bp, Homo sapiens
tttctaagaattta

SEQ ID NO: 6561095 - DNA, 20 bp, Homo sapiens
tttctaagacagtttttata

SEQ ID NO: 6561096 - DNA, 13 bp, Homo sapiens
tttctaagagaag

SEQ ID NO: 6561097 - DNA, 14 bp, Homo sapiens
tttctaagagagct

SEQ ID NO: 6561098 - DNA, 14 bp, Homo sapiens
tttctaagattcta

SEQ ID NO: 6561099 - DNA, 16 bp, Homo sapiens
tttctaagcatgtagc

SEQ ID NO: 6561100 - DNA, 14 bp, Homo sapiens
tttctaagccctgt

SEQ ID NO: 6561101 - DNA, 18 bp, Homo sapiens
tttctaagctttcttaca

SEQ ID NO: 6561102 - DNA, 20 bp, Homo sapiens
tttctaaggaatgcacaaat

SEQ ID NO: 6561103 - DNA, 19 bp, Homo sapiens
tttctaaggatagcctttg

SEQ ID NO: 6561104 - DNA, 19 bp, Homo sapiens
tttctaaggctcagcccca

SEQ ID NO: 6561105 - DNA, 15 bp, Homo sapiens
tttctaagtatttaa

SEQ ID NO: 6561106 - DNA, 19 bp, Homo sapiens
tttctaagtcgtgcacttt

SEQ ID NO: 6561107 - DNA, 19 bp, Homo sapiens
tttctaagtgtaacctcag

SEQ ID NO: 6561108 - DNA, 17 bp, Homo sapiens
tttctaagttaaatcat

SEQ ID NO: 6561109 - DNA, 21 bp, Homo sapiens
tttctaatacaagcatatgtt

SEQ ID NO: 6561110 - DNA, 22 bp, Homo sapiens
tttctaatgccttttgaataca

SEQ ID NO: 6561111 - DNA, 15 bp, Homo sapiens
tttctaatgtgtgaa

SEQ ID NO: 6561112 - DNA, 15 bp, Homo sapiens
tttctaatgtttact

SEQ ID NO: 6561113 - DNA, 14 bp, Homo sapiens
tttctaatgtttct

SEQ ID NO: 6561114 - DNA, 20 bp, Homo sapiens
tttctaattcctgttgctct

SEQ ID NO: 6561115 - DNA, 14 bp, Homo sapiens
tttctaattgctta

SEQ ID NO: 6561116 - DNA, 23 bp, Homo sapiens
tttctaattgcttatttattgta

SEQ ID NO: 6561117 - DNA, 22 bp, Homo sapiens
tttctaattgtaagtgaaatta

SEQ ID NO: 6561118 - DNA, 14 bp, Homo sapiens
tttctaatttgaat

SEQ ID NO: 6561119 - DNA, 15 bp, Homo sapiens
tttctaatttgcact

SEQ ID NO: 6561120 - DNA, 14 bp, Homo sapiens
tttctaatttgctg

SEQ ID NO: 6561121 - DNA, 21 bp, Homo sapiens
tttctaattttttttgtacat

SEQ ID NO: 6561122 - DNA, 23 bp, Homo sapiens
tttctacaaagcactagagaatg

SEQ ID NO: 6561123 - DNA, 21 bp, Homo sapiens
tttctacaatgtgaactttat

SEQ ID NO: 6561124 - DNA, 22 bp, Homo sapiens
tttctacaatgtgaactttatt

SEQ ID NO: 6561125 - DNA, 22 bp, Homo sapiens
tttctacacattgctacctcag

SEQ ID NO: 6561126 - DNA, 22 bp, Homo sapiens
tttctacactttatacttgcct

SEQ ID NO: 6561127 - DNA, 14 bp, Homo sapiens
tttctacagcaaat

SEQ ID NO: 6561128 - DNA, 18 bp, Homo sapiens
tttctacagtattatgta

SEQ ID NO: 6561129 - DNA, 19 bp, Homo sapiens
tttctacagtggttttata

SEQ ID NO: 6561130 - DNA, 20 bp, Homo sapiens
tttctacataattgtgacca

SEQ ID NO: 6561131 - DNA, 11 bp, Homo sapiens
tttctacatgc

SEQ ID NO: 6561132 - DNA, 13 bp, Homo sapiens
tttctacatgtga

SEQ ID NO: 6561133 - DNA, 21 bp, Homo sapiens
tttctaccacacacagcctgt

SEQ ID NO: 6561134 - DNA, 19 bp, Homo sapiens
tttctaccactggtgtaaa

SEQ ID NO: 6561135 - DNA, 23 bp, Homo sapiens
tttctaccactggtgtaaaaaac

SEQ ID NO: 6561136 - DNA, 23 bp, Homo sapiens
tttctaccagctcatacaaaata

SEQ ID NO: 6561137 - DNA, 21 bp, Homo sapiens
tttctacccaacggccctgca

SEQ ID NO: 6561138 - DNA, 15 bp, Homo sapiens
tttctacccagcgag

SEQ ID NO: 6561139 - DNA, 17 bp, Homo sapiens
tttctaccctagccatt

SEQ ID NO: 6561140 - DNA, 14 bp, Homo sapiens
tttctacctcccag

SEQ ID NO: 6561141 - DNA, 21 bp, Homo sapiens
tttctacctgtgttcattctt

SEQ ID NO: 6561142 - DNA, 16 bp, Homo sapiens
tttctacgtcatgtat

SEQ ID NO: 6561143 - DNA, 23 bp, Homo sapiens
tttctactatatacatatatatt

SEQ ID NO: 6561144 - DNA, 22 bp, Homo sapiens
tttctactatgatcagaagaac

SEQ ID NO: 6561145 - DNA, 15 bp, Homo sapiens
tttctactcattttt

SEQ ID NO: 6561146 - DNA, 18 bp, Homo sapiens
tttctactctagatggca

SEQ ID NO: 6561147 - DNA, 13 bp, Homo sapiens
tttctactgtaag

SEQ ID NO: 6561148 - DNA, 19 bp, Homo sapiens
tttctactgtaagaagagc

SEQ ID NO: 6561149 - DNA, 12 bp, Homo sapiens
tttctactgtat

SEQ ID NO: 6561150 - DNA, 18 bp, Homo sapiens
tttctactttgaagtcat

SEQ ID NO: 6561151 - DNA, 22 bp, Homo sapiens
tttctactttgaagtcatacca

SEQ ID NO: 6561152 - DNA, 16 bp, Homo sapiens
tttctacttttaaaga

SEQ ID NO: 6561153 - DNA, 16 bp, Homo sapiens
tttctactttttctgt

SEQ ID NO: 6561154 - DNA, 17 bp, Homo sapiens
tttctagaaagaataaa

SEQ ID NO: 6561155 - DNA, 18 bp, Homo sapiens
tttctagaacagtaaaag

SEQ ID NO: 6561156 - DNA, 22 bp, Homo sapiens
tttctagaacatccctgccagc

SEQ ID NO: 6561157 - DNA, 15 bp, Homo sapiens
tttctagaatactaa

SEQ ID NO: 6561158 - DNA, 16 bp, Homo sapiens
tttctagaatggtttt

SEQ ID NO: 6561159 - DNA, 19 bp, Homo sapiens
tttctagaattatttttca

SEQ ID NO: 6561160 - DNA, 13 bp, Homo sapiens
tttctagactcaa

SEQ ID NO: 6561161 - DNA, 20 bp, Homo sapiens
tttctagacttccacaaaat

SEQ ID NO: 6561162 - DNA, 16 bp, Homo sapiens
tttctagacttgtgct

SEQ ID NO: 6561163 - DNA, 16 bp, Homo sapiens
tttctagagcactgcc

SEQ ID NO: 6561164 - DNA, 21 bp, Homo sapiens
tttctagagttatcttcttta

SEQ ID NO: 6561165 - DNA, 15 bp, Homo sapiens
tttctagatacaata

SEQ ID NO: 6561166 - DNA, 17 bp, Homo sapiens
tttctagatacaataaa

SEQ ID NO: 6561167 - DNA, 17 bp, Homo sapiens
tttctagcaaatatgct

SEQ ID NO: 6561168 - DNA, 19 bp, Homo sapiens
tttctagcatatatgtgtc

SEQ ID NO: 6561169 - DNA, 15 bp, Homo sapiens
tttctagccagagga

SEQ ID NO: 6561170 - DNA, 16 bp, Homo sapiens
tttctagccataataa

SEQ ID NO: 6561171 - DNA, 21 bp, Homo sapiens
tttctagcgaacgtatttctc

SEQ ID NO: 6561172 - DNA, 19 bp, Homo sapiens
tttctagctagaaatatga

SEQ ID NO: 6561173 - DNA, 20 bp, Homo sapiens
tttctagctagaaatatgat

SEQ ID NO: 6561174 - DNA, 23 bp, Homo sapiens
tttctagctataacaactctatt

SEQ ID NO: 6561175 - DNA, 19 bp, Homo sapiens
tttctagctgttgagctgt

SEQ ID NO: 6561176 - DNA, 21 bp, Homo sapiens
tttctagctgttgagctgttt

SEQ ID NO: 6561177 - DNA, 22 bp, Homo sapiens
tttctaggaagaattttaaaaa

SEQ ID NO: 6561178 - DNA, 16 bp, Homo sapiens
tttctaggactgaatt

SEQ ID NO: 6561179 - DNA, 17 bp, Homo sapiens
tttctaggactgaatta

SEQ ID NO: 6561180 - DNA, 18 bp, Homo sapiens
tttctaggcaaaattgtg

SEQ ID NO: 6561181 - DNA, 18 bp, Homo sapiens
tttctagggaaatgaaag

SEQ ID NO: 6561182 - DNA, 20 bp, Homo sapiens
tttctagggctgggaaacac

SEQ ID NO: 6561183 - DNA, 21 bp, Homo sapiens
tttctaggtaggaaatgtggt

SEQ ID NO: 6561184 - DNA, 19 bp, Homo sapiens
tttctagtcagtaaacatt

SEQ ID NO: 6561185 - DNA, 15 bp, Homo sapiens
tttctagtccaaaat

SEQ ID NO: 6561186 - DNA, 17 bp, Homo sapiens
tttctagtggtctttgt

SEQ ID NO: 6561187 - DNA, 19 bp, Homo sapiens
tttctagtggtctttgtaa

SEQ ID NO: 6561188 - DNA, 20 bp, Homo sapiens
tttctagtgtatcaaaatgc

SEQ ID NO: 6561189 - DNA, 14 bp, Homo sapiens
tttctagttattta

SEQ ID NO: 6561190 - DNA, 15 bp, Homo sapiens
tttctagttatttat

SEQ ID NO: 6561191 - DNA, 19 bp, Homo sapiens
tttctagtttgctcatact

SEQ ID NO: 6561192 - DNA, 15 bp, Homo sapiens
tttctagtttttaat

SEQ ID NO: 6561193 - DNA, 21 bp, Homo sapiens
tttctagtttttaattttaac

SEQ ID NO: 6561194 - DNA, 16 bp, Homo sapiens
tttctataaatcagta

SEQ ID NO: 6561195 - DNA, 20 bp, Homo sapiens
tttctataaatcagtatttt

SEQ ID NO: 6561196 - DNA, 21 bp, Homo sapiens
tttctataaatgactattgta

SEQ ID NO: 6561197 - DNA, 12 bp, Homo sapiens
tttctataaatt

SEQ ID NO: 6561198 - DNA, 17 bp, Homo sapiens
tttctataatgtgcctg

SEQ ID NO: 6561199 - DNA, 21 bp, Homo sapiens
tttctataattgtagtaattg

SEQ ID NO: 6561200 - DNA, 18 bp, Homo sapiens
tttctataattttacaag

SEQ ID NO: 6561201 - DNA, 22 bp, Homo sapiens
tttctatagccaaaaatagcta

SEQ ID NO: 6561202 - DNA, 13 bp, Homo sapiens
tttctatatcaaa

SEQ ID NO: 6561203 - DNA, 18 bp, Homo sapiens
tttctatattcctccagc

SEQ ID NO: 6561204 - DNA, 20 bp, Homo sapiens
tttctatattcctccagctg

SEQ ID NO: 6561205 - DNA, 14 bp, Homo sapiens
tttctatcacatat

SEQ ID NO: 6561206 - DNA, 20 bp, Homo sapiens
tttctatcatttttgtacag

SEQ ID NO: 6561207 - DNA, 14 bp, Homo sapiens
tttctatccccctt

SEQ ID NO: 6561208 - DNA, 21 bp, Homo sapiens
tttctatcccccttaaagaaa

SEQ ID NO: 6561209 - DNA, 15 bp, Homo sapiens
tttctatcctctgta

SEQ ID NO: 6561210 - DNA, 20 bp, Homo sapiens
tttctatcgttctctctttg

SEQ ID NO: 6561211 - DNA, 17 bp, Homo sapiens
tttctatctgcaaatag

SEQ ID NO: 6561212 - DNA, 13 bp, Homo sapiens
tttctatgaaata

SEQ ID NO: 6561213 - DNA, 15 bp, Homo sapiens
tttctatgaacttgt

SEQ ID NO: 6561214 - DNA, 13 bp, Homo sapiens
tttctatgacaaa

SEQ ID NO: 6561215 - DNA, 15 bp, Homo sapiens
tttctatgacacatg

SEQ ID NO: 6561216 - DNA, 21 bp, Homo sapiens
tttctatgacacatgcaaggt

SEQ ID NO: 6561217 - DNA, 21 bp, Homo sapiens
tttctatgagtggaaaaagcc

SEQ ID NO: 6561218 - DNA, 23 bp, Homo sapiens
tttctatgcataaaaaaatgatg

SEQ ID NO: 6561219 - DNA, 20 bp, Homo sapiens
tttctatgctgcttttatat

SEQ ID NO: 6561220 - DNA, 18 bp, Homo sapiens
tttctatggattcacttc

SEQ ID NO: 6561221 - DNA, 17 bp, Homo sapiens
tttctatggctttcaaa

SEQ ID NO: 6561222 - DNA, 14 bp, Homo sapiens
tttctatgtaaatt

SEQ ID NO: 6561223 - DNA, 18 bp, Homo sapiens
tttctatgtaaattattg

SEQ ID NO: 6561224 - DNA, 22 bp, Homo sapiens
tttctatgtactagtactgtgt

SEQ ID NO: 6561225 - DNA, 23 bp, Homo sapiens
tttctatgtactagtactgtgta

SEQ ID NO: 6561226 - DNA, 18 bp, Homo sapiens
tttctatgtatgtgccaa

SEQ ID NO: 6561227 - DNA, 19 bp, Homo sapiens
tttctattaaaagactcat

SEQ ID NO: 6561228 - DNA, 16 bp, Homo sapiens
tttctattaaaggttc

SEQ ID NO: 6561229 - DNA, 22 bp, Homo sapiens
tttctattaaattaaattttgt

SEQ ID NO: 6561230 - DNA, 20 bp, Homo sapiens
tttctattaatatttatgtg

SEQ ID NO: 6561231 - DNA, 21 bp, Homo sapiens
tttctattcagcaaaagttaa

SEQ ID NO: 6561232 - DNA, 14 bp, Homo sapiens
tttctattccaaag

SEQ ID NO: 6561233 - DNA, 23 bp, Homo sapiens
tttctattgtactctgctttatc

SEQ ID NO: 6561234 - DNA, 13 bp, Homo sapiens
tttctatttagac

SEQ ID NO: 6561235 - DNA, 12 bp, Homo sapiens
tttctatttagt

SEQ ID NO: 6561236 - DNA, 17 bp, Homo sapiens
tttctatttatgccttg

SEQ ID NO: 6561237 - DNA, 14 bp, Homo sapiens
tttctatttgactt

SEQ ID NO: 6561238 - DNA, 15 bp, Homo sapiens
tttctattttaagac

SEQ ID NO: 6561239 - DNA, 16 bp, Homo sapiens
tttctattttctctga

SEQ ID NO: 6561240 - DNA, 23 bp, Homo sapiens
tttctattttgttttttaagtaa

SEQ ID NO: 6561241 - DNA, 22 bp, Homo sapiens
tttctatttttatgatgacaat

SEQ ID NO: 6561242 - DNA, 14 bp, Homo sapiens
tttctatttttgat

SEQ ID NO: 6561243 - DNA, 16 bp, Homo sapiens
tttctcaaaagcattt

SEQ ID NO: 6561244 - DNA, 15 bp, Homo sapiens
tttctcaaagaaatt

SEQ ID NO: 6561245 - DNA, 15 bp, Homo sapiens
tttctcaaagttttg

SEQ ID NO: 6561246 - DNA, 20 bp, Homo sapiens
tttctcaaagtttttacagt

SEQ ID NO: 6561247 - DNA, 22 bp, Homo sapiens
tttctcaaagtttttacagtgt

SEQ ID NO: 6561248 - DNA, 13 bp, Homo sapiens
tttctcaaataaa

SEQ ID NO: 6561249 - DNA, 12 bp, Homo sapiens
ttaggcctggag

SEQ ID NO: 6561250 - DNA, 13 bp, Homo sapiens
ttaggcctggagt

SEQ ID NO: 6561251 - DNA, 14 bp, Homo sapiens
ttaggcctggctca

SEQ ID NO: 6561252 - DNA, 16 bp, Homo sapiens
ttaggcctttttcaac

SEQ ID NO: 6561253 - DNA, 15 bp, Homo sapiens
ttaggcgtgggctga

SEQ ID NO: 6561254 - DNA, 16 bp, Homo sapiens
ttaggctattcacaac

SEQ ID NO: 6561255 - DNA, 19 bp, Homo sapiens
ttaggctatttgtaaatct

SEQ ID NO: 6561256 - DNA, 14 bp, Homo sapiens
ttaggctgatgcca

SEQ ID NO: 6561257 - DNA, 19 bp, Homo sapiens
ttaggctggtggcccagga

SEQ ID NO: 6561258 - DNA, 14 bp, Homo sapiens
ttaggctgtaacta

SEQ ID NO: 6561259 - DNA, 17 bp, Homo sapiens
ttaggctgtaactactt

SEQ ID NO: 6561260 - DNA, 20 bp, Homo sapiens
ttaggctgtcgtccccctcc

SEQ ID NO: 6561261 - DNA, 14 bp, Homo sapiens
ttaggctgttcctt

SEQ ID NO: 6561262 - DNA, 15 bp, Homo sapiens
ttaggctgttccttg

SEQ ID NO: 6561263 - DNA, 22 bp, Homo sapiens
ttagggaaaatggatatagaaa

SEQ ID NO: 6561264 - DNA, 16 bp, Homo sapiens
ttagggaaatccaact

SEQ ID NO: 6561265 - DNA, 19 bp, Homo sapiens
ttagggaactttgatacaa

SEQ ID NO: 6561266 - DNA, 12 bp, Homo sapiens
ttagggaggggt

SEQ ID NO: 6561267 - DNA, 18 bp, Homo sapiens
ttagggagtattctaata

SEQ ID NO: 6561268 - DNA, 23 bp, Homo sapiens
ttagggcaaagatctcagcagcc

SEQ ID NO: 6561269 - DNA, 15 bp, Homo sapiens
ttagggcactgggct

SEQ ID NO: 6561270 - DNA, 15 bp, Homo sapiens
ttagggccaggcagg

SEQ ID NO: 6561271 - DNA, 14 bp, Homo sapiens
ttagggccctggag

SEQ ID NO: 6561272 - DNA, 20 bp, Homo sapiens
ttagggctaaccagttctct

SEQ ID NO: 6561273 - DNA, 22 bp, Homo sapiens
ttagggcttggatcgtggaaga

SEQ ID NO: 6561274 - DNA, 24 bp, Homo sapiens
ttagggcttggatcgtggaagaag

SEQ ID NO: 6561275 - DNA, 17 bp, Homo sapiens
ttagggcttttattttt

SEQ ID NO: 6561276 - DNA, 24 bp, Homo sapiens
ttaggggaagtaaaacagtcatct

SEQ ID NO: 6561277 - DNA, 16 bp, Homo sapiens
ttaggggatggggagg

SEQ ID NO: 6561278 - DNA, 17 bp, Homo sapiens
ttaggggccaataaaat

SEQ ID NO: 6561279 - DNA, 20 bp, Homo sapiens
ttaggggccaataaaatgta

SEQ ID NO: 6561280 - DNA, 17 bp, Homo sapiens
ttaggggtatttaatgt

SEQ ID NO: 6561281 - DNA, 17 bp, Homo sapiens
ttaggggttctatttat

SEQ ID NO: 6561282 - DNA, 15 bp, Homo sapiens
ttagggtcagccatt

SEQ ID NO: 6561283 - DNA, 20 bp, Homo sapiens
ttagggtgaaacttaaaaaa

SEQ ID NO: 6561284 - DNA, 16 bp, Homo sapiens
ttagggtgtgtgttca

SEQ ID NO: 6561285 - DNA, 18 bp, Homo sapiens
ttagggttctaaatgcaa

SEQ ID NO: 6561286 - DNA, 20 bp, Homo sapiens
ttagggttggttcctttcca

SEQ ID NO: 6561287 - DNA, 13 bp, Homo sapiens
ttagggttttgca

SEQ ID NO: 6561288 - DNA, 15 bp, Homo sapiens
ttagggttttgcaat

SEQ ID NO: 6561289 - DNA, 17 bp, Homo sapiens
ttagggttttgcaataa

SEQ ID NO: 6561290 - DNA, 13 bp, Homo sapiens
ttaggtaattgta

SEQ ID NO: 6561291 - DNA, 17 bp, Homo sapiens
ttaggtagactttgctt

SEQ ID NO: 6561292 - DNA, 23 bp, Homo sapiens
ttaggtagtagaatctcagcact

SEQ ID NO: 6561293 - DNA, 14 bp, Homo sapiens
ttaggtagtcatgc

SEQ ID NO: 6561294 - DNA, 23 bp, Homo sapiens
ttaggtcaataacactgtatttt

SEQ ID NO: 6561295 - DNA, 14 bp, Homo sapiens
ttaggtccattttc

SEQ ID NO: 6561296 - DNA, 23 bp, Homo sapiens
ttaggtccctcactccacagagt

SEQ ID NO: 6561297 - DNA, 22 bp, Homo sapiens
ttaggtcccttggtctgtacaa

SEQ ID NO: 6561298 - DNA, 15 bp, Homo sapiens
ttaggtctcatgccc

SEQ ID NO: 6561299 - DNA, 15 bp, Homo sapiens
ttaggtctgttgaag

SEQ ID NO: 6561300 - DNA, 15 bp, Homo sapiens
ttaggtcttcctgtg

SEQ ID NO: 6561301 - DNA, 18 bp, Homo sapiens
ttaggtgctgttatgttt

SEQ ID NO: 6561302 - DNA, 14 bp, Homo sapiens
ttaggtgtctgtcc

SEQ ID NO: 6561303 - DNA, 15 bp, Homo sapiens
ttaggtgtcttttaa

SEQ ID NO: 6561304 - DNA, 13 bp, Homo sapiens
ttaggtgtgaaga

SEQ ID NO: 6561305 - DNA, 16 bp, Homo sapiens
ttaggtgtgactgaat

SEQ ID NO: 6561306 - DNA, 19 bp, Homo sapiens
ttaggttctaaagttctaa

SEQ ID NO: 6561307 - DNA, 14 bp, Homo sapiens
ttaggttcttaaaa

SEQ ID NO: 6561308 - DNA, 14 bp, Homo sapiens
ttaggttgttacca

SEQ ID NO: 6561309 - DNA, 16 bp, Homo sapiens
ttaggtttcaggaagt

SEQ ID NO: 6561310 - DNA, 14 bp, Homo sapiens
ttaggtttccacgt

SEQ ID NO: 6561311 - DNA, 22 bp, Homo sapiens
ttaggttttgtacaattgaact

SEQ ID NO: 6561312 - DNA, 17 bp, Homo sapiens
ttagtaaaattatctgt

SEQ ID NO: 6561313 - DNA, 14 bp, Homo sapiens
ttagtaaagaaatg

SEQ ID NO: 6561314 - DNA, 14 bp, Homo sapiens
ttagtaaagttttg

SEQ ID NO: 6561315 - DNA, 15 bp, Homo sapiens
ttagtaaatatgtga

SEQ ID NO: 6561316 - DNA, 16 bp, Homo sapiens
ttagtaaatatgtgaa

SEQ ID NO: 6561317 - DNA, 18 bp, Homo sapiens
ttagtaaatgtctttgta

SEQ ID NO: 6561318 - DNA, 21 bp, Homo sapiens
ttagtaaatgtctttgtaagt

SEQ ID NO: 6561319 - DNA, 24 bp, Homo sapiens
ttagtaacatgaggggacattttg

SEQ ID NO: 6561320 - DNA, 12 bp, Homo sapiens
ttagtaacatgt

SEQ ID NO: 6561321 - DNA, 20 bp, Homo sapiens
ttagtaacctttaaaaatgt

SEQ ID NO: 6561322 - DNA, 23 bp, Homo sapiens
ttagtaacctttaaaaatgtata

SEQ ID NO: 6561323 - DNA, 17 bp, Homo sapiens
ttagtaactttgaaagg

SEQ ID NO: 6561324 - DNA, 13 bp, Homo sapiens
ttagtaaggattt

SEQ ID NO: 6561325 - DNA, 14 bp, Homo sapiens
ttagtaatcatatt

SEQ ID NO: 6561326 - DNA, 16 bp, Homo sapiens
ttagtaatctgtacat

SEQ ID NO: 6561327 - DNA, 21 bp, Homo sapiens
ttagtaatctgtacattttgt

SEQ ID NO: 6561328 - DNA, 20 bp, Homo sapiens
ttagtaatgctacgtgtgat

SEQ ID NO: 6561329 - DNA, 19 bp, Homo sapiens
ttagtaatggcagagcagt

SEQ ID NO: 6561330 - DNA, 14 bp, Homo sapiens
ttagtaatggtgct

SEQ ID NO: 6561331 - DNA, 14 bp, Homo sapiens
ttagtacaaagttt

SEQ ID NO: 6561332 - DNA, 16 bp, Homo sapiens
ttagtacaataatctc

SEQ ID NO: 6561333 - DNA, 17 bp, Homo sapiens
ttagtacaataatctct

SEQ ID NO: 6561334 - DNA, 12 bp, Homo sapiens
ttagtacaatag

SEQ ID NO: 6561335 - DNA, 19 bp, Homo sapiens
ttagtacaatagtatacat

SEQ ID NO: 6561336 - DNA, 13 bp, Homo sapiens
ttagtacatgctc

SEQ ID NO: 6561337 - DNA, 20 bp, Homo sapiens
ttagtacatggagctcaggt

SEQ ID NO: 6561338 - DNA, 12 bp, Homo sapiens
ttagtacatttt

SEQ ID NO: 6561339 - DNA, 18 bp, Homo sapiens
ttagtacccacctgagct

SEQ ID NO: 6561340 - DNA, 14 bp, Homo sapiens
ttagtaccctgcag

SEQ ID NO: 6561341 - DNA, 15 bp, Homo sapiens
ttagtaccctgcagg

SEQ ID NO: 6561342 - DNA, 17 bp, Homo sapiens
ttagtacctttttaaca

SEQ ID NO: 6561343 - DNA, 17 bp, Homo sapiens
ttagtacggctgctgca

SEQ ID NO: 6561344 - DNA, 19 bp, Homo sapiens
ttagtactatatctgtttt

SEQ ID NO: 6561345 - DNA, 19 bp, Homo sapiens
ttagtactcccctccttga

SEQ ID NO: 6561346 - DNA, 12 bp, Homo sapiens
ttagtactttat

SEQ ID NO: 6561347 - DNA, 13 bp, Homo sapiens
ttagtactttata

SEQ ID NO: 6561348 - DNA, 19 bp, Homo sapiens
ttagtactttatagaagaa

SEQ ID NO: 6561349 - DNA, 15 bp, Homo sapiens
ttagtagaaatgcca

SEQ ID NO: 6561350 - DNA, 21 bp, Homo sapiens
ttagtagaaattttacaatag

SEQ ID NO: 6561351 - DNA, 19 bp, Homo sapiens
ttagtagacactaattctg

SEQ ID NO: 6561352 - DNA, 18 bp, Homo sapiens
ttagtagagacagtgttt

SEQ ID NO: 6561353 - DNA, 22 bp, Homo sapiens
ttagtaggatatgcctgctctt

SEQ ID NO: 6561354 - DNA, 19 bp, Homo sapiens
ttagtaggtgatattcatt

SEQ ID NO: 6561355 - DNA, 23 bp, Homo sapiens
ttagtagtcaaaaacaaagctga

SEQ ID NO: 6561356 - DNA, 17 bp, Homo sapiens
ttagtagtttttacaaa

SEQ ID NO: 6561357 - DNA, 17 bp, Homo sapiens
ttagtataaatgtacat

SEQ ID NO: 6561358 - DNA, 14 bp, Homo sapiens
ttagtataatattt

SEQ ID NO: 6561359 - DNA, 16 bp, Homo sapiens
ttagtataccagagaa

SEQ ID NO: 6561360 - DNA, 18 bp, Homo sapiens
ttagtataccagagaagg

SEQ ID NO: 6561361 - DNA, 19 bp, Homo sapiens
ttagtatagctttatactc

SEQ ID NO: 6561362 - DNA, 19 bp, Homo sapiens
ttagtatagtagaaagaca

SEQ ID NO: 6561363 - DNA, 17 bp, Homo sapiens
ttagtatctaataatga

SEQ ID NO: 6561364 - DNA, 19 bp, Homo sapiens
ttagtatgacgctgataca

SEQ ID NO: 6561365 - DNA, 21 bp, Homo sapiens
ttagtatggttctcagatctt

SEQ ID NO: 6561366 - DNA, 13 bp, Homo sapiens
ttagtatgtctgt

SEQ ID NO: 6561367 - DNA, 15 bp, Homo sapiens
ttagtatgtctgttt

SEQ ID NO: 6561368 - DNA, 19 bp, Homo sapiens
ttagtatgtctgtttttgt

SEQ ID NO: 6561369 - DNA, 21 bp, Homo sapiens
ttagtattaacagaaatgttt

SEQ ID NO: 6561370 - DNA, 14 bp, Homo sapiens
ttagtattcattct

SEQ ID NO: 6561371 - DNA, 15 bp, Homo sapiens
ttagtattcattctg

SEQ ID NO: 6561372 - DNA, 14 bp, Homo sapiens
ttagtattgattca

SEQ ID NO: 6561373 - DNA, 17 bp, Homo sapiens
ttagtattgttgtcctt

SEQ ID NO: 6561374 - DNA, 22 bp, Homo sapiens
ttagtatttcagtgttttcatt

SEQ ID NO: 6561375 - DNA, 13 bp, Homo sapiens
ttagtatttgcat

SEQ ID NO: 6561376 - DNA, 16 bp, Homo sapiens
ttagtcaataaacttg

SEQ ID NO: 6561377 - DNA, 19 bp, Homo sapiens
ttagtcaatcactgcactg

SEQ ID NO: 6561378 - DNA, 14 bp, Homo sapiens
ttagtcacttaaaa

SEQ ID NO: 6561379 - DNA, 13 bp, Homo sapiens
ttagtcacttttt

SEQ ID NO: 6561380 - DNA, 23 bp, Homo sapiens
ttagtcagtgtactctgagtcct

SEQ ID NO: 6561381 - DNA, 14 bp, Homo sapiens
ttagtcataccatc

SEQ ID NO: 6561382 - DNA, 14 bp, Homo sapiens
ttagtcatagaaga

SEQ ID NO: 6561383 - DNA, 19 bp, Homo sapiens
ttagtcatatctatctaat

SEQ ID NO: 6561384 - DNA, 15 bp, Homo sapiens
ttagtcattttgctt

SEQ ID NO: 6561385 - DNA, 17 bp, Homo sapiens
ttagtccctcatgcaaa

SEQ ID NO: 6561386 - DNA, 19 bp, Homo sapiens
ttagtcctcaccttctgtt

SEQ ID NO: 6561387 - DNA, 17 bp, Homo sapiens
ttagtcctccctgctca

SEQ ID NO: 6561388 - DNA, 22 bp, Homo sapiens
ttagtcctgttatagacgagaa

SEQ ID NO: 6561389 - DNA, 17 bp, Homo sapiens
ttagtcgggcatgagtc

SEQ ID NO: 6561390 - DNA, 19 bp, Homo sapiens
ttagtcgtgagctcttgtg

SEQ ID NO: 6561391 - DNA, 24 bp, Homo sapiens
ttagtcgtgagctcttgtgaggaa

SEQ ID NO: 6561392 - DNA, 20 bp, Homo sapiens
ttagtcgttatatttgactt

SEQ ID NO: 6561393 - DNA, 14 bp, Homo sapiens
ttagtctaacacag

SEQ ID NO: 6561394 - DNA, 15 bp, Homo sapiens
ttagtctaacacagt

SEQ ID NO: 6561395 - DNA, 20 bp, Homo sapiens
ttagtctactcttaagccat

SEQ ID NO: 6561396 - DNA, 21 bp, Homo sapiens
ttagtctactcttaagccatc

SEQ ID NO: 6561397 - DNA, 22 bp, Homo sapiens
ttagtctactcttaagccatct

SEQ ID NO: 6561398 - DNA, 21 bp, Homo sapiens
ttagtctatcaaatgaaactc

SEQ ID NO: 6561399 - DNA, 12 bp, Homo sapiens
ttagtctcagtt

SEQ ID NO: 6561400 - DNA, 20 bp, Homo sapiens
ttagtctcagttctcttaat

SEQ ID NO: 6561401 - DNA, 21 bp, Homo sapiens
ttagtctcagtttgtgtgtct

SEQ ID NO: 6561402 - DNA, 19 bp, Homo sapiens
ttagtctgaaactggcttc

SEQ ID NO: 6561403 - DNA, 17 bp, Homo sapiens
ttagtctgcaaaatgag

SEQ ID NO: 6561404 - DNA, 15 bp, Homo sapiens
ttagtcttaaaataa

SEQ ID NO: 6561405 - DNA, 13 bp, Homo sapiens
ttagtcttctcat

SEQ ID NO: 6561406 - DNA, 14 bp, Homo sapiens
ttagtctttatact

SEQ ID NO: 6561407 - DNA, 16 bp, Homo sapiens
ttagtcttttgtaata

SEQ ID NO: 6561408 - DNA, 14 bp, Homo sapiens
ttagtgaaaaactg

SEQ ID NO: 6561409 - DNA, 19 bp, Homo sapiens
ttagtgaaaaactgctgta

SEQ ID NO: 6561410 - DNA, 17 bp, Homo sapiens
ttagtgaaaattctgtt

SEQ ID NO: 6561411 - DNA, 21 bp, Homo sapiens
ttagtgaaccaaaaatagaaa

SEQ ID NO: 6561412 - DNA, 22 bp, Homo sapiens
ttagtgaaccaaaaatagaaat

SEQ ID NO: 6561413 - DNA, 22 bp, Homo sapiens
ttagtgaactaagttattgtta

SEQ ID NO: 6561414 - DNA, 23 bp, Homo sapiens
ttagtgaagtatgcactaatcaa

SEQ ID NO: 6561415 - DNA, 14 bp, Homo sapiens
ttagtgaatgggaa

SEQ ID NO: 6561416 - DNA, 15 bp, Homo sapiens
ttagtgacaaaatag

SEQ ID NO: 6561417 - DNA, 17 bp, Homo sapiens
ttagtgactaaaccatt

SEQ ID NO: 6561418 - DNA, 11 bp, Homo sapiens
ttagtgactgt

SEQ ID NO: 6561419 - DNA, 18 bp, Homo sapiens
ttagtgagattaaaaatc

SEQ ID NO: 6561420 - DNA, 14 bp, Homo sapiens
ttagtgagatttgt

SEQ ID NO: 6561421 - DNA, 20 bp, Homo sapiens
ttagtgatactggctcagaa

SEQ ID NO: 6561422 - DNA, 16 bp, Homo sapiens
ttagtgatatagtgct

SEQ ID NO: 6561423 - DNA, 17 bp, Homo sapiens
ttagtgatcttagcata

SEQ ID NO: 6561424 - DNA, 15 bp, Homo sapiens
ttagtgattctgatt

SEQ ID NO: 6561425 - DNA, 15 bp, Homo sapiens
ttagtgcaacttaga

SEQ ID NO: 6561426 - DNA, 17 bp, Homo sapiens
ttagtgcaatttcttct

SEQ ID NO: 6561427 - DNA, 16 bp, Homo sapiens
ttagtgcacttaatat

SEQ ID NO: 6561428 - DNA, 21 bp, Homo sapiens
ttagtgccaagtttttcagaa

SEQ ID NO: 6561429 - DNA, 13 bp, Homo sapiens
tttctcaagttta

SEQ ID NO: 6561430 - DNA, 17 bp, Homo sapiens
tttctcaatagttctta

SEQ ID NO: 6561431 - DNA, 19 bp, Homo sapiens
tttctcaatagttcttaaa

SEQ ID NO: 6561432 - DNA, 20 bp, Homo sapiens
tttctcaatcagtgcagtga

SEQ ID NO: 6561433 - DNA, 13 bp, Homo sapiens
tttctcacaaaaa

SEQ ID NO: 6561434 - DNA, 23 bp, Homo sapiens
tttctcacaaaaaggcaaatatt

SEQ ID NO: 6561435 - DNA, 19 bp, Homo sapiens
tttctcacactctaactgt

SEQ ID NO: 6561436 - DNA, 22 bp, Homo sapiens
tttctcacagaagatgaagcac

SEQ ID NO: 6561437 - DNA, 15 bp, Homo sapiens
tttctcacattgctg

SEQ ID NO: 6561438 - DNA, 16 bp, Homo sapiens
tttctcacattgctgt

SEQ ID NO: 6561439 - DNA, 19 bp, Homo sapiens
tttctcacattgctgtatt

SEQ ID NO: 6561440 - DNA, 15 bp, Homo sapiens
tttctcaccctctgt

SEQ ID NO: 6561441 - DNA, 21 bp, Homo sapiens
tttctcactagtgtcaggccc

SEQ ID NO: 6561442 - DNA, 18 bp, Homo sapiens
tttctcagaatccaaaga

SEQ ID NO: 6561443 - DNA, 18 bp, Homo sapiens
tttctcagagattaaaaa

SEQ ID NO: 6561444 - DNA, 21 bp, Homo sapiens
tttctcagattcctttgtatc

SEQ ID NO: 6561445 - DNA, 17 bp, Homo sapiens
tttctcagcatatatat

SEQ ID NO: 6561446 - DNA, 23 bp, Homo sapiens
tttctcagccgcttctgactgct

SEQ ID NO: 6561447 - DNA, 18 bp, Homo sapiens
tttctcaggagcttcaat

SEQ ID NO: 6561448 - DNA, 22 bp, Homo sapiens
tttctcaggagcttcaatgagt

SEQ ID NO: 6561449 - DNA, 18 bp, Homo sapiens
tttctcaggctaggccag

SEQ ID NO: 6561450 - DNA, 19 bp, Homo sapiens
tttctcaggcttctcatgt

SEQ ID NO: 6561451 - DNA, 12 bp, Homo sapiens
tttctcagtgtg

SEQ ID NO: 6561452 - DNA, 23 bp, Homo sapiens
tttctcagtgtgcccttctctta

SEQ ID NO: 6561453 - DNA, 17 bp, Homo sapiens
tttctcagtgttggtat

SEQ ID NO: 6561454 - DNA, 16 bp, Homo sapiens
tttctcagttttcata

SEQ ID NO: 6561455 - DNA, 17 bp, Homo sapiens
tttctcataattttgca

SEQ ID NO: 6561456 - DNA, 22 bp, Homo sapiens
tttctcatagcaggaaatgtag

SEQ ID NO: 6561457 - DNA, 15 bp, Homo sapiens
tttctcatcacatca

SEQ ID NO: 6561458 - DNA, 18 bp, Homo sapiens
tttctcatgaatctgcaa

SEQ ID NO: 6561459 - DNA, 20 bp, Homo sapiens
tttctcatgacggcttttgt

SEQ ID NO: 6561460 - DNA, 18 bp, Homo sapiens
tttctcatgtgctttgta

SEQ ID NO: 6561461 - DNA, 19 bp, Homo sapiens
tttctcatgtgctttgtag

SEQ ID NO: 6561462 - DNA, 14 bp, Homo sapiens
tttctcatgttgaa

SEQ ID NO: 6561463 - DNA, 15 bp, Homo sapiens
tttctcatgttgaaa

SEQ ID NO: 6561464 - DNA, 19 bp, Homo sapiens
tttctcattgctctgaata

SEQ ID NO: 6561465 - DNA, 18 bp, Homo sapiens
tttctcatttctttctaa

SEQ ID NO: 6561466 - DNA, 13 bp, Homo sapiens
tttctcatttgaa

SEQ ID NO: 6561467 - DNA, 20 bp, Homo sapiens
tttctcatttgtttttctca

SEQ ID NO: 6561468 - DNA, 17 bp, Homo sapiens
tttctcattttaaacaa

SEQ ID NO: 6561469 - DNA, 14 bp, Homo sapiens
tttctccaaagctt

SEQ ID NO: 6561470 - DNA, 20 bp, Homo sapiens
tttctccacaacagcctggg

SEQ ID NO: 6561471 - DNA, 23 bp, Homo sapiens
tttctccagaaccagtgtctgaa

SEQ ID NO: 6561472 - DNA, 11 bp, Homo sapiens
tttctccagac

SEQ ID NO: 6561473 - DNA, 12 bp, Homo sapiens
tttctccagacc

SEQ ID NO: 6561474 - DNA, 15 bp, Homo sapiens
tttctccagtccctg

SEQ ID NO: 6561475 - DNA, 14 bp, Homo sapiens
tttctccatcccct

SEQ ID NO: 6561476 - DNA, 23 bp, Homo sapiens
tttctccatcccctccctgcctg

SEQ ID NO: 6561477 - DNA, 15 bp, Homo sapiens
tttctccatctttat

SEQ ID NO: 6561478 - DNA, 22 bp, Homo sapiens
tttctcccagcctcttatcact

SEQ ID NO: 6561479 - DNA, 12 bp, Homo sapiens
tttctcccagct

SEQ ID NO: 6561480 - DNA, 22 bp, Homo sapiens
tttctcccagtatgttttaaca

SEQ ID NO: 6561481 - DNA, 12 bp, Homo sapiens
tttctccccagg

SEQ ID NO: 6561482 - DNA, 14 bp, Homo sapiens
tttctccccctggg

SEQ ID NO: 6561483 - DNA, 15 bp, Homo sapiens
tttctccccctgggc

SEQ ID NO: 6561484 - DNA, 15 bp, Homo sapiens
tttctcccctatttt

SEQ ID NO: 6561485 - DNA, 24 bp, Homo sapiens
tttctcccctgcccccaggactgg

SEQ ID NO: 6561486 - DNA, 11 bp, Homo sapiens
tttctccctct

SEQ ID NO: 6561487 - DNA, 21 bp, Homo sapiens
tttctccctctcatgtccctc

SEQ ID NO: 6561488 - DNA, 14 bp, Homo sapiens
tttctccctggatt

SEQ ID NO: 6561489 - DNA, 18 bp, Homo sapiens
tttctccctgttcctttg

SEQ ID NO: 6561490 - DNA, 20 bp, Homo sapiens
tttctccggggtctgtgctg

SEQ ID NO: 6561491 - DNA, 17 bp, Homo sapiens
tttctccgtatgcacat

SEQ ID NO: 6561492 - DNA, 15 bp, Homo sapiens
tttctcctcccagga

SEQ ID NO: 6561493 - DNA, 16 bp, Homo sapiens
tttctcctccccacct

SEQ ID NO: 6561494 - DNA, 23 bp, Homo sapiens
tttctcctccccacctgtagctg

SEQ ID NO: 6561495 - DNA, 15 bp, Homo sapiens
tttctcctccgcctg

SEQ ID NO: 6561496 - DNA, 15 bp, Homo sapiens
tttctcctctgctat

SEQ ID NO: 6561497 - DNA, 17 bp, Homo sapiens
tttctcctctttgagac

SEQ ID NO: 6561498 - DNA, 14 bp, Homo sapiens
tttctcctgcccca

SEQ ID NO: 6561499 - DNA, 23 bp, Homo sapiens
tttctcctgggaaacctgccttt

SEQ ID NO: 6561500 - DNA, 12 bp, Homo sapiens
tttctcctgtgc

SEQ ID NO: 6561501 - DNA, 10 bp, Homo sapiens
tttctccttc

SEQ ID NO: 6561502 - DNA, 23 bp, Homo sapiens
tttctccttgaatatctttcgat

SEQ ID NO: 6561503 - DNA, 11 bp, Homo sapiens
tttctccttgg

SEQ ID NO: 6561504 - DNA, 19 bp, Homo sapiens
tttctcctttaattgtaaa

SEQ ID NO: 6561505 - DNA, 14 bp, Homo sapiens
tttctcctttacca

SEQ ID NO: 6561506 - DNA, 19 bp, Homo sapiens
tttctcctttgcaatagca

SEQ ID NO: 6561507 - DNA, 16 bp, Homo sapiens
tttctcctttgtactt

SEQ ID NO: 6561508 - DNA, 19 bp, Homo sapiens
tttctccttttcctatcct

SEQ ID NO: 6561509 - DNA, 16 bp, Homo sapiens
tttctcgagtccaaaa

SEQ ID NO: 6561510 - DNA, 18 bp, Homo sapiens
tttctcgtactttcacat

SEQ ID NO: 6561511 - DNA, 23 bp, Homo sapiens
tttctcgtccccctccctgccca

SEQ ID NO: 6561512 - DNA, 14 bp, Homo sapiens
tttctcgtgctgca

SEQ ID NO: 6561513 - DNA, 21 bp, Homo sapiens
tttctcgtgctgcatccctgt

SEQ ID NO: 6561514 - DNA, 19 bp, Homo sapiens
tttctcgtggtagaagcca

SEQ ID NO: 6561515 - DNA, 15 bp, Homo sapiens
tttctctacactaag

SEQ ID NO: 6561516 - DNA, 12 bp, Homo sapiens
tttctctaggaa

SEQ ID NO: 6561517 - DNA, 18 bp, Homo sapiens
tttctctataaagggtca

SEQ ID NO: 6561518 - DNA, 17 bp, Homo sapiens
tttctctattctttcca

SEQ ID NO: 6561519 - DNA, 14 bp, Homo sapiens
tttctctcaacacc

SEQ ID NO: 6561520 - DNA, 14 bp, Homo sapiens
tttctctcagaaat

SEQ ID NO: 6561521 - DNA, 15 bp, Homo sapiens
tttctctcagaaatg

SEQ ID NO: 6561522 - DNA, 14 bp, Homo sapiens
tttctctcagtgaa

SEQ ID NO: 6561523 - DNA, 11 bp, Homo sapiens
tttctctccca

SEQ ID NO: 6561524 - DNA, 13 bp, Homo sapiens
tttctctccctcc

SEQ ID NO: 6561525 - DNA, 16 bp, Homo sapiens
tttctctcctcacaca

SEQ ID NO: 6561526 - DNA, 13 bp, Homo sapiens
tttctctcctggc

SEQ ID NO: 6561527 - DNA, 16 bp, Homo sapiens
tttctctcctgtcctc

SEQ ID NO: 6561528 - DNA, 16 bp, Homo sapiens
tttctctctacagtgc

SEQ ID NO: 6561529 - DNA, 22 bp, Homo sapiens
tttctctctcactctcttcctt

SEQ ID NO: 6561530 - DNA, 15 bp, Homo sapiens
tttctctctcatgcc

SEQ ID NO: 6561531 - DNA, 14 bp, Homo sapiens
tttctctctcctgg

SEQ ID NO: 6561532 - DNA, 12 bp, Homo sapiens
tttctctctctt

SEQ ID NO: 6561533 - DNA, 11 bp, Homo sapiens
tttctctctgc

SEQ ID NO: 6561534 - DNA, 13 bp, Homo sapiens
tttctctctggac

SEQ ID NO: 6561535 - DNA, 12 bp, Homo sapiens
tttctctctgtg

SEQ ID NO: 6561536 - DNA, 23 bp, Homo sapiens
tttctctctgtgtggcaaacatt

SEQ ID NO: 6561537 - DNA, 17 bp, Homo sapiens
tttctctcttccctcag

SEQ ID NO: 6561538 - DNA, 21 bp, Homo sapiens
tttctctctttatacagctgt

SEQ ID NO: 6561539 - DNA, 14 bp, Homo sapiens
tttctctcttttgt

SEQ ID NO: 6561540 - DNA, 12 bp, Homo sapiens
tttctctgagca

SEQ ID NO: 6561541 - DNA, 19 bp, Homo sapiens
tttctctgagctttgttac

SEQ ID NO: 6561542 - DNA, 11 bp, Homo sapiens
tttctctgcct

SEQ ID NO: 6561543 - DNA, 17 bp, Homo sapiens
tttctctgcctccaggt

SEQ ID NO: 6561544 - DNA, 16 bp, Homo sapiens
tttctctgcctggcaa

SEQ ID NO: 6561545 - DNA, 12 bp, Homo sapiens
tttctctgctgt

SEQ ID NO: 6561546 - DNA, 21 bp, Homo sapiens
tttctctgcttcagcttgctt

SEQ ID NO: 6561547 - DNA, 19 bp, Homo sapiens
tttctctgcttccagttgg

SEQ ID NO: 6561548 - DNA, 9 bp, Homo sapiens
tttctctgg

SEQ ID NO: 6561549 - DNA, 16 bp, Homo sapiens
tttctctggaaataaa

SEQ ID NO: 6561550 - DNA, 19 bp, Homo sapiens
tttctctggcagcataatt

SEQ ID NO: 6561551 - DNA, 17 bp, Homo sapiens
tttctctggctccagaa

SEQ ID NO: 6561552 - DNA, 12 bp, Homo sapiens
tttctctgtaaa

SEQ ID NO: 6561553 - DNA, 13 bp, Homo sapiens
tttctctgtaaaa

SEQ ID NO: 6561554 - DNA, 16 bp, Homo sapiens
tttctctgtaaaatga

SEQ ID NO: 6561555 - DNA, 12 bp, Homo sapiens
tttctctgtata

SEQ ID NO: 6561556 - DNA, 14 bp, Homo sapiens
tttctctgtatatt

SEQ ID NO: 6561557 - DNA, 12 bp, Homo sapiens
tttctctgtgaa

SEQ ID NO: 6561558 - DNA, 17 bp, Homo sapiens
tttctcttaagctgccc

SEQ ID NO: 6561559 - DNA, 18 bp, Homo sapiens
tttctcttacctgttatt

SEQ ID NO: 6561560 - DNA, 12 bp, Homo sapiens
tttctcttagaa

SEQ ID NO: 6561561 - DNA, 13 bp, Homo sapiens
tttctcttagaaa

SEQ ID NO: 6561562 - DNA, 21 bp, Homo sapiens
tttctcttagaacattgtatt

SEQ ID NO: 6561563 - DNA, 11 bp, Homo sapiens
tttctcttcac

SEQ ID NO: 6561564 - DNA, 16 bp, Homo sapiens
tttctcttcatacttt

SEQ ID NO: 6561565 - DNA, 11 bp, Homo sapiens
tttctcttccc

SEQ ID NO: 6561566 - DNA, 13 bp, Homo sapiens
tttctcttccctt

SEQ ID NO: 6561567 - DNA, 15 bp, Homo sapiens
tttctcttcctaaat

SEQ ID NO: 6561568 - DNA, 21 bp, Homo sapiens
tttctcttccttttatataaa

SEQ ID NO: 6561569 - DNA, 13 bp, Homo sapiens
tttctcttctacc

SEQ ID NO: 6561570 - DNA, 18 bp, Homo sapiens
tttctcttctaccctttt

SEQ ID NO: 6561571 - DNA, 14 bp, Homo sapiens
tttctcttctcagc

SEQ ID NO: 6561572 - DNA, 19 bp, Homo sapiens
tttctcttctccccttcca

SEQ ID NO: 6561573 - DNA, 16 bp, Homo sapiens
tttctcttctgtccat

SEQ ID NO: 6561574 - DNA, 17 bp, Homo sapiens
tttctcttgagctggcc

SEQ ID NO: 6561575 - DNA, 11 bp, Homo sapiens
tttctcttgct

SEQ ID NO: 6561576 - DNA, 13 bp, Homo sapiens
tttctcttgggct

SEQ ID NO: 6561577 - DNA, 18 bp, Homo sapiens
tttctcttgtcttaaaat

SEQ ID NO: 6561578 - DNA, 15 bp, Homo sapiens
tttctcttgtttaaa

SEQ ID NO: 6561579 - DNA, 12 bp, Homo sapiens
tttctctttcaa

SEQ ID NO: 6561580 - DNA, 13 bp, Homo sapiens
tttctctttcaaa

SEQ ID NO: 6561581 - DNA, 16 bp, Homo sapiens
tttctctttctctctc

SEQ ID NO: 6561582 - DNA, 15 bp, Homo sapiens
tttctctttcttcct

SEQ ID NO: 6561583 - DNA, 14 bp, Homo sapiens
tttctctttgaaac

SEQ ID NO: 6561584 - DNA, 13 bp, Homo sapiens
tttctctttgtct

SEQ ID NO: 6561585 - DNA, 23 bp, Homo sapiens
tttctctttgtggggcttggcgt

SEQ ID NO: 6561586 - DNA, 12 bp, Homo sapiens
tttctctttgtt

SEQ ID NO: 6561587 - DNA, 16 bp, Homo sapiens
tttctcttttaaaata

SEQ ID NO: 6561588 - DNA, 13 bp, Homo sapiens
tttctcttttaag

SEQ ID NO: 6561589 - DNA, 20 bp, Homo sapiens
tttctcttttcccctttcct

SEQ ID NO: 6561590 - DNA, 21 bp, Homo sapiens
tttctcttttcccctttcctg

SEQ ID NO: 6561591 - DNA, 13 bp, Homo sapiens
tttctcttttcct

SEQ ID NO: 6561592 - DNA, 17 bp, Homo sapiens
tttctcttttgctttct

SEQ ID NO: 6561593 - DNA, 17 bp, Homo sapiens
tttctctttttttaaaa

SEQ ID NO: 6561594 - DNA, 14 bp, Homo sapiens
tttctgaaaacact

SEQ ID NO: 6561595 - DNA, 17 bp, Homo sapiens
tttctgaaaatttatat

SEQ ID NO: 6561596 - DNA, 18 bp, Homo sapiens
tttctgaaaatttatata

SEQ ID NO: 6561597 - DNA, 21 bp, Homo sapiens
tttctgaaaatttatataact

SEQ ID NO: 6561598 - DNA, 19 bp, Homo sapiens
tttctgaaactaatgaaag

SEQ ID NO: 6561599 - DNA, 13 bp, Homo sapiens
tttctgaaactcc

SEQ ID NO: 6561600 - DNA, 14 bp, Homo sapiens
tttctgaaactccc

SEQ ID NO: 6561601 - DNA, 23 bp, Homo sapiens
tttctgaaagtattcacatcatt

SEQ ID NO: 6561602 - DNA, 13 bp, Homo sapiens
tttctgaaattca

SEQ ID NO: 6561603 - DNA, 21 bp, Homo sapiens
tttctgaaatttcctgggagc

SEQ ID NO: 6561604 - DNA, 13 bp, Homo sapiens
tttctgaacagct

SEQ ID NO: 6561605 - DNA, 17 bp, Homo sapiens
tttctgaactgttacaa

SEQ ID NO: 6561606 - DNA, 14 bp, Homo sapiens
tttctgaagtgctt

SEQ ID NO: 6561607 - DNA, 15 bp, Homo sapiens
tttctgaagtggact

SEQ ID NO: 6561608 - DNA, 11 bp, Homo sapiens
tttctgaataa

SEQ ID NO: 6561609 - DNA, 12 bp, Homo sapiens
tttctgaataaa

SEQ ID NO: 6561610 - DNA, 15 bp, Homo sapiens
tttctgaatagaaat

SEQ ID NO: 6561611 - DNA, 22 bp, Homo sapiens
tttctgaatctagagaacagta

SEQ ID NO: 6561612 - DNA, 22 bp, Homo sapiens
tttctgaatgtttgtgtctgtg

SEQ ID NO: 6561613 - DNA, 15 bp, Homo sapiens
ttagtgccctgcccc

SEQ ID NO: 6561614 - DNA, 22 bp, Homo sapiens
ttagtgccctgccccctggctg

SEQ ID NO: 6561615 - DNA, 23 bp, Homo sapiens
ttagtgccctgccccctggctga

SEQ ID NO: 6561616 - DNA, 20 bp, Homo sapiens
ttagtgccggctgtggagca

SEQ ID NO: 6561617 - DNA, 15 bp, Homo sapiens
ttagtgctaaacaag

SEQ ID NO: 6561618 - DNA, 12 bp, Homo sapiens
ttagtgctaagt

SEQ ID NO: 6561619 - DNA, 15 bp, Homo sapiens
ttagtgctaagtgtg

SEQ ID NO: 6561620 - DNA, 16 bp, Homo sapiens
ttagtgctaagtgtga

SEQ ID NO: 6561621 - DNA, 23 bp, Homo sapiens
ttagtgcttaacattttcccaag

SEQ ID NO: 6561622 - DNA, 17 bp, Homo sapiens
ttagtgcttatctaatt

SEQ ID NO: 6561623 - DNA, 16 bp, Homo sapiens
ttagtggaaagtgatt

SEQ ID NO: 6561624 - DNA, 23 bp, Homo sapiens
ttagtggatttttttgtcattaa

SEQ ID NO: 6561625 - DNA, 12 bp, Homo sapiens
ttagtggcaccg

SEQ ID NO: 6561626 - DNA, 13 bp, Homo sapiens
ttagtggcaccgc

SEQ ID NO: 6561627 - DNA, 16 bp, Homo sapiens
ttagtggctcaacatt

SEQ ID NO: 6561628 - DNA, 12 bp, Homo sapiens
ttagtggcttca

SEQ ID NO: 6561629 - DNA, 14 bp, Homo sapiens
ttagtgggaagagc

SEQ ID NO: 6561630 - DNA, 17 bp, Homo sapiens
ttagtgggaagagctgg

SEQ ID NO: 6561631 - DNA, 21 bp, Homo sapiens
ttagtgggaagagctgggttt

SEQ ID NO: 6561632 - DNA, 15 bp, Homo sapiens
ttagtgggcaggtgg

SEQ ID NO: 6561633 - DNA, 15 bp, Homo sapiens
ttagtgggccagggc

SEQ ID NO: 6561634 - DNA, 12 bp, Homo sapiens
ttagtgggggac

SEQ ID NO: 6561635 - DNA, 18 bp, Homo sapiens
ttagtggtatgtctcttt

SEQ ID NO: 6561636 - DNA, 20 bp, Homo sapiens
ttagtggttctgtgcctctt

SEQ ID NO: 6561637 - DNA, 14 bp, Homo sapiens
ttagtgtaaaattg

SEQ ID NO: 6561638 - DNA, 13 bp, Homo sapiens
ttagtgtatccat

SEQ ID NO: 6561639 - DNA, 15 bp, Homo sapiens
ttagtgtatctttaa

SEQ ID NO: 6561640 - DNA, 11 bp, Homo sapiens
ttagtgtatta

SEQ ID NO: 6561641 - DNA, 21 bp, Homo sapiens
ttagtgtctctatttatgaga

SEQ ID NO: 6561642 - DNA, 14 bp, Homo sapiens
ttagtgtctgacct

SEQ ID NO: 6561643 - DNA, 15 bp, Homo sapiens
ttagtgtctgaccta

SEQ ID NO: 6561644 - DNA, 20 bp, Homo sapiens
ttagtgtgacagtttccaaa

SEQ ID NO: 6561645 - DNA, 23 bp, Homo sapiens
ttagtgtgagcatcttgccagcc

SEQ ID NO: 6561646 - DNA, 12 bp, Homo sapiens
ttagtgtgattg

SEQ ID NO: 6561647 - DNA, 22 bp, Homo sapiens
ttagtgtgtaaaattaatgtaa

SEQ ID NO: 6561648 - DNA, 14 bp, Homo sapiens
ttagtgtgtgtgca

SEQ ID NO: 6561649 - DNA, 17 bp, Homo sapiens
ttagtgtgtgtgcagag

SEQ ID NO: 6561650 - DNA, 16 bp, Homo sapiens
ttagtgtgtgtgcatg

SEQ ID NO: 6561651 - DNA, 19 bp, Homo sapiens
ttagtgtgttgtctgtgca

SEQ ID NO: 6561652 - DNA, 18 bp, Homo sapiens
ttagtgttaatgactctt

SEQ ID NO: 6561653 - DNA, 13 bp, Homo sapiens
ttagtgttagtta

SEQ ID NO: 6561654 - DNA, 14 bp, Homo sapiens
ttagtgttatatga

SEQ ID NO: 6561655 - DNA, 15 bp, Homo sapiens
ttagtgttatatgaa

SEQ ID NO: 6561656 - DNA, 12 bp, Homo sapiens
ttagtgttcaaa

SEQ ID NO: 6561657 - DNA, 14 bp, Homo sapiens
ttagtgttcaaata

SEQ ID NO: 6561658 - DNA, 17 bp, Homo sapiens
ttagtgttcaaatactt

SEQ ID NO: 6561659 - DNA, 14 bp, Homo sapiens
ttagtgttcataaa

SEQ ID NO: 6561660 - DNA, 23 bp, Homo sapiens
ttagtgtttagcattaaaaataa

SEQ ID NO: 6561661 - DNA, 18 bp, Homo sapiens
ttagtgtttctgtgcatg

SEQ ID NO: 6561662 - DNA, 21 bp, Homo sapiens
ttagtgtttgggtatattcat

SEQ ID NO: 6561663 - DNA, 17 bp, Homo sapiens
ttagtgttttaagaaat

SEQ ID NO: 6561664 - DNA, 15 bp, Homo sapiens
ttagtgttttcattc

SEQ ID NO: 6561665 - DNA, 23 bp, Homo sapiens
ttagttaaaactcatcacataaa

SEQ ID NO: 6561666 - DNA, 18 bp, Homo sapiens
ttagttaatgagccatca

SEQ ID NO: 6561667 - DNA, 17 bp, Homo sapiens
ttagttaccgagacatg

SEQ ID NO: 6561668 - DNA, 13 bp, Homo sapiens
ttagttaccttat

SEQ ID NO: 6561669 - DNA, 19 bp, Homo sapiens
ttagttaccttatagttac

SEQ ID NO: 6561670 - DNA, 20 bp, Homo sapiens
ttagttaccttatagttact

SEQ ID NO: 6561671 - DNA, 16 bp, Homo sapiens
ttagttagaattggaa

SEQ ID NO: 6561672 - DNA, 20 bp, Homo sapiens
ttagttataaatagccttca

SEQ ID NO: 6561673 - DNA, 15 bp, Homo sapiens
ttagttatagtgttt

SEQ ID NO: 6561674 - DNA, 23 bp, Homo sapiens
ttagttatagtgtttaactggca

SEQ ID NO: 6561675 - DNA, 18 bp, Homo sapiens
ttagttatagtttcagat

SEQ ID NO: 6561676 - DNA, 16 bp, Homo sapiens
ttagttcctcattagc

SEQ ID NO: 6561677 - DNA, 12 bp, Homo sapiens
ttagttcctgtg

SEQ ID NO: 6561678 - DNA, 15 bp, Homo sapiens
ttagttcctgtgcac

SEQ ID NO: 6561679 - DNA, 20 bp, Homo sapiens
ttagttccttactgtttaca

SEQ ID NO: 6561680 - DNA, 22 bp, Homo sapiens
ttagttctagctctatttactt

SEQ ID NO: 6561681 - DNA, 15 bp, Homo sapiens
ttagttctgactttg

SEQ ID NO: 6561682 - DNA, 11 bp, Homo sapiens
ttagttcttga

SEQ ID NO: 6561683 - DNA, 12 bp, Homo sapiens
ttagttcttgaa

SEQ ID NO: 6561684 - DNA, 19 bp, Homo sapiens
ttagttctttttgccagtt

SEQ ID NO: 6561685 - DNA, 19 bp, Homo sapiens
ttagttgaaaaatctagtt

SEQ ID NO: 6561686 - DNA, 15 bp, Homo sapiens
ttagttgacagtatt

SEQ ID NO: 6561687 - DNA, 16 bp, Homo sapiens
ttagttgacagtatta

SEQ ID NO: 6561688 - DNA, 20 bp, Homo sapiens
ttagttgcaactttgtataa

SEQ ID NO: 6561689 - DNA, 13 bp, Homo sapiens
ttagttgcactaa

SEQ ID NO: 6561690 - DNA, 14 bp, Homo sapiens
ttagttgccaatat

SEQ ID NO: 6561691 - DNA, 18 bp, Homo sapiens
ttagttggacagtttaaa

SEQ ID NO: 6561692 - DNA, 18 bp, Homo sapiens
ttagttggagctagaaaa

SEQ ID NO: 6561693 - DNA, 16 bp, Homo sapiens
ttagttggcagagaaa

SEQ ID NO: 6561694 - DNA, 17 bp, Homo sapiens
ttagttggcagagaaaa

SEQ ID NO: 6561695 - DNA, 15 bp, Homo sapiens
ttagttggcatttgt

SEQ ID NO: 6561696 - DNA, 17 bp, Homo sapiens
ttagttggctggaaact

SEQ ID NO: 6561697 - DNA, 19 bp, Homo sapiens
ttagttggctttcataaat

SEQ ID NO: 6561698 - DNA, 15 bp, Homo sapiens
ttagttggctttgcc

SEQ ID NO: 6561699 - DNA, 19 bp, Homo sapiens
ttagttggtctttccatct

SEQ ID NO: 6561700 - DNA, 19 bp, Homo sapiens
ttagtttaaaaataaagtt

SEQ ID NO: 6561701 - DNA, 20 bp, Homo sapiens
ttagtttagaacaggttttt

SEQ ID NO: 6561702 - DNA, 13 bp, Homo sapiens
ttagtttagtgtg

SEQ ID NO: 6561703 - DNA, 17 bp, Homo sapiens
ttagtttcaaagtgtct

SEQ ID NO: 6561704 - DNA, 20 bp, Homo sapiens
ttagtttcaagagtctaaac

SEQ ID NO: 6561705 - DNA, 17 bp, Homo sapiens
ttagtttcccttagact

SEQ ID NO: 6561706 - DNA, 11 bp, Homo sapiens
ttagtttcctt

SEQ ID NO: 6561707 - DNA, 20 bp, Homo sapiens
ttagtttcctttttaatatg

SEQ ID NO: 6561708 - DNA, 17 bp, Homo sapiens
ttagtttctgaactctg

SEQ ID NO: 6561709 - DNA, 15 bp, Homo sapiens
ttagtttctgttctg

SEQ ID NO: 6561710 - DNA, 16 bp, Homo sapiens
ttagtttgatcagaca

SEQ ID NO: 6561711 - DNA, 19 bp, Homo sapiens
ttagtttgatttaatatct

SEQ ID NO: 6561712 - DNA, 12 bp, Homo sapiens
ttagtttgcact

SEQ ID NO: 6561713 - DNA, 16 bp, Homo sapiens
ttagtttgcctgcagt

SEQ ID NO: 6561714 - DNA, 18 bp, Homo sapiens
ttagtttgcctgcagttt

SEQ ID NO: 6561715 - DNA, 14 bp, Homo sapiens
ttagtttggattct

SEQ ID NO: 6561716 - DNA, 15 bp, Homo sapiens
ttagtttgtttttgt

SEQ ID NO: 6561717 - DNA, 20 bp, Homo sapiens
ttagttttacactaggaaac

SEQ ID NO: 6561718 - DNA, 23 bp, Homo sapiens
ttagttttacattttaaaatgtt

SEQ ID NO: 6561719 - DNA, 17 bp, Homo sapiens
ttagttttagttgcaga

SEQ ID NO: 6561720 - DNA, 21 bp, Homo sapiens
ttagttttatggcatgattta

SEQ ID NO: 6561721 - DNA, 22 bp, Homo sapiens
ttagttttgcttttagtttttc

SEQ ID NO: 6561722 - DNA, 22 bp, Homo sapiens
ttagttttggttatttctaaac

SEQ ID NO: 6561723 - DNA, 22 bp, Homo sapiens
ttagttttgtgcttagttaaat

SEQ ID NO: 6561724 - DNA, 17 bp, Homo sapiens
ttagtttttaacaatct

SEQ ID NO: 6561725 - DNA, 18 bp, Homo sapiens
ttagtttttaacaatcta

SEQ ID NO: 6561726 - DNA, 15 bp, Homo sapiens
ttagtttttcacttt

SEQ ID NO: 6561727 - DNA, 13 bp, Homo sapiens
ttagtttttcatt

SEQ ID NO: 6561728 - DNA, 16 bp, Homo sapiens
ttagtttttgatcaag

SEQ ID NO: 6561729 - DNA, 23 bp, Homo sapiens
ttagtttttggttgggaatgagg

SEQ ID NO: 6561730 - DNA, 19 bp, Homo sapiens
ttataaaaaaaatgaaatg

SEQ ID NO: 6561731 - DNA, 20 bp, Homo sapiens
ttataaaaaatggtgcctga

SEQ ID NO: 6561732 - DNA, 17 bp, Homo sapiens
ttataaaaacaaaaaca

SEQ ID NO: 6561733 - DNA, 17 bp, Homo sapiens
ttataaaaacacttata

SEQ ID NO: 6561734 - DNA, 23 bp, Homo sapiens
ttataaaaacccctaaaaacaaa

SEQ ID NO: 6561735 - DNA, 19 bp, Homo sapiens
ttataaaaaggtgttttga

SEQ ID NO: 6561736 - DNA, 18 bp, Homo sapiens
ttataaaaataaagggaa

SEQ ID NO: 6561737 - DNA, 20 bp, Homo sapiens
ttataaaaataaatagaaaa

SEQ ID NO: 6561738 - DNA, 12 bp, Homo sapiens
ttataaaaatac

SEQ ID NO: 6561739 - DNA, 23 bp, Homo sapiens
ttataaaacaatgacttttaaag

SEQ ID NO: 6561740 - DNA, 22 bp, Homo sapiens
ttataaaacgtgtttgtattgt

SEQ ID NO: 6561741 - DNA, 18 bp, Homo sapiens
ttataaaagcaaaagaga

SEQ ID NO: 6561742 - DNA, 20 bp, Homo sapiens
ttataaaagctcagatgaca

SEQ ID NO: 6561743 - DNA, 15 bp, Homo sapiens
ttataaaagtgaata

SEQ ID NO: 6561744 - DNA, 13 bp, Homo sapiens
ttataaaagtgat

SEQ ID NO: 6561745 - DNA, 16 bp, Homo sapiens
ttataaaagtgttcat

SEQ ID NO: 6561746 - DNA, 17 bp, Homo sapiens
ttataaaataaacacct

SEQ ID NO: 6561747 - DNA, 18 bp, Homo sapiens
ttataaaataacttgcat

SEQ ID NO: 6561748 - DNA, 17 bp, Homo sapiens
ttataaaataatgtact

SEQ ID NO: 6561749 - DNA, 20 bp, Homo sapiens
ttataaaatataaacaaaga

SEQ ID NO: 6561750 - DNA, 23 bp, Homo sapiens
ttataaaatattgttaatgccta

SEQ ID NO: 6561751 - DNA, 20 bp, Homo sapiens
ttataaaatcctgtgcaata

SEQ ID NO: 6561752 - DNA, 15 bp, Homo sapiens
ttataaaatctgtat

SEQ ID NO: 6561753 - DNA, 13 bp, Homo sapiens
ttataaaatgctc

SEQ ID NO: 6561754 - DNA, 20 bp, Homo sapiens
ttataaaatggctgtaatca

SEQ ID NO: 6561755 - DNA, 19 bp, Homo sapiens
ttataaaatgtataaatta

SEQ ID NO: 6561756 - DNA, 14 bp, Homo sapiens
ttataaaattaaag

SEQ ID NO: 6561757 - DNA, 17 bp, Homo sapiens
ttataaaattagaaagc

SEQ ID NO: 6561758 - DNA, 19 bp, Homo sapiens
ttataaaattatttttatt

SEQ ID NO: 6561759 - DNA, 15 bp, Homo sapiens
ttataaaatttactg

SEQ ID NO: 6561760 - DNA, 18 bp, Homo sapiens
ttataaaattttgctttt

SEQ ID NO: 6561761 - DNA, 20 bp, Homo sapiens
ttataaacaacagaaacttc

SEQ ID NO: 6561762 - DNA, 13 bp, Homo sapiens
ttataaacaagaa

SEQ ID NO: 6561763 - DNA, 19 bp, Homo sapiens
ttataaacagacaatatgt

SEQ ID NO: 6561764 - DNA, 21 bp, Homo sapiens
ttataaacagacaatatgtga

SEQ ID NO: 6561765 - DNA, 15 bp, Homo sapiens
ttataaacagcaggg

SEQ ID NO: 6561766 - DNA, 23 bp, Homo sapiens
ttataaacagcagggtttgagca

SEQ ID NO: 6561767 - DNA, 18 bp, Homo sapiens
ttataaacagttttactt

SEQ ID NO: 6561768 - DNA, 14 bp, Homo sapiens
ttataaaccaatct

SEQ ID NO: 6561769 - DNA, 17 bp, Homo sapiens
ttataaaccaatcttaa

SEQ ID NO: 6561770 - DNA, 16 bp, Homo sapiens
ttataaaccaatgaaa

SEQ ID NO: 6561771 - DNA, 23 bp, Homo sapiens
ttataaacctctaatttattttg

SEQ ID NO: 6561772 - DNA, 14 bp, Homo sapiens
ttataaactgagag

SEQ ID NO: 6561773 - DNA, 13 bp, Homo sapiens
ttataaactttac

SEQ ID NO: 6561774 - DNA, 19 bp, Homo sapiens
ttataaagaatgtttctta

SEQ ID NO: 6561775 - DNA, 17 bp, Homo sapiens
ttataaagccaagaatt

SEQ ID NO: 6561776 - DNA, 20 bp, Homo sapiens
ttataaagctgttcttgaaa

SEQ ID NO: 6561777 - DNA, 18 bp, Homo sapiens
ttataaagggacactttt

SEQ ID NO: 6561778 - DNA, 13 bp, Homo sapiens
ttataaagtctaa

SEQ ID NO: 6561779 - DNA, 20 bp, Homo sapiens
ttataaagtggacttctgaa

SEQ ID NO: 6561780 - DNA, 13 bp, Homo sapiens
ttataaataaatg

SEQ ID NO: 6561781 - DNA, 18 bp, Homo sapiens
ttataaatataagccttt

SEQ ID NO: 6561782 - DNA, 19 bp, Homo sapiens
ttataaatatatataaaga

SEQ ID NO: 6561783 - DNA, 21 bp, Homo sapiens
ttataaatatgaagctcacct

SEQ ID NO: 6561784 - DNA, 14 bp, Homo sapiens
ttataaatatgtga

SEQ ID NO: 6561785 - DNA, 22 bp, Homo sapiens
ttataaatatgtgattatcatt

SEQ ID NO: 6561786 - DNA, 21 bp, Homo sapiens
ttataaatcatattgatgaaa

SEQ ID NO: 6561787 - DNA, 16 bp, Homo sapiens
ttataaatgaagatgc

SEQ ID NO: 6561788 - DNA, 15 bp, Homo sapiens
ttataaatgagcaaa

SEQ ID NO: 6561789 - DNA, 14 bp, Homo sapiens
ttataaatgctatt

SEQ ID NO: 6561790 - DNA, 22 bp, Homo sapiens
ttataaatggaggtacaggata

SEQ ID NO: 6561791 - DNA, 12 bp, Homo sapiens
ttataaatgttt

SEQ ID NO: 6561792 - DNA, 15 bp, Homo sapiens
ttataaatgtttgga

SEQ ID NO: 6561793 - DNA, 21 bp, Homo sapiens
tttctgaattatgcttccaca

SEQ ID NO: 6561794 - DNA, 19 bp, Homo sapiens
tttctgaattcaaagcttg

SEQ ID NO: 6561795 - DNA, 20 bp, Homo sapiens
tttctgaattggaagggaaa

SEQ ID NO: 6561796 - DNA, 22 bp, Homo sapiens
tttctgaattggaagggaaaaa

SEQ ID NO: 6561797 - DNA, 12 bp, Homo sapiens
tttctgaattgt

SEQ ID NO: 6561798 - DNA, 14 bp, Homo sapiens
tttctgacatcagc

SEQ ID NO: 6561799 - DNA, 15 bp, Homo sapiens
tttctgacatcagca

SEQ ID NO: 6561800 - DNA, 12 bp, Homo sapiens
tttctgaccaaa

SEQ ID NO: 6561801 - DNA, 21 bp, Homo sapiens
tttctgaccaaaatgtgtttc

SEQ ID NO: 6561802 - DNA, 14 bp, Homo sapiens
tttctgaccaaaga

SEQ ID NO: 6561803 - DNA, 22 bp, Homo sapiens
tttctgaccatgtgcggagcag

SEQ ID NO: 6561804 - DNA, 22 bp, Homo sapiens
tttctgactgcaacttctgtcc

SEQ ID NO: 6561805 - DNA, 17 bp, Homo sapiens
tttctgactgtccctgc

SEQ ID NO: 6561806 - DNA, 22 bp, Homo sapiens
tttctgacttctagctgtctgt

SEQ ID NO: 6561807 - DNA, 12 bp, Homo sapiens
tttctgagaaaa

SEQ ID NO: 6561808 - DNA, 22 bp, Homo sapiens
tttctgagaaagactattcaaa

SEQ ID NO: 6561809 - DNA, 16 bp, Homo sapiens
tttctgagaaggtcct

SEQ ID NO: 6561810 - DNA, 19 bp, Homo sapiens
tttctgagaaggtccttaa

SEQ ID NO: 6561811 - DNA, 21 bp, Homo sapiens
tttctgagagttggctcaggc

SEQ ID NO: 6561812 - DNA, 20 bp, Homo sapiens
tttctgagatgctcacttta

SEQ ID NO: 6561813 - DNA, 13 bp, Homo sapiens
tttctgagatttt

SEQ ID NO: 6561814 - DNA, 16 bp, Homo sapiens
tttctgagcaaagcat

SEQ ID NO: 6561815 - DNA, 16 bp, Homo sapiens
tttctgagcacacttt

SEQ ID NO: 6561816 - DNA, 14 bp, Homo sapiens
tttctgagcgatta

SEQ ID NO: 6561817 - DNA, 16 bp, Homo sapiens
tttctgagcttttcat

SEQ ID NO: 6561818 - DNA, 16 bp, Homo sapiens
tttctgaggtccttat

SEQ ID NO: 6561819 - DNA, 21 bp, Homo sapiens
tttctgaggtgcactgggagg

SEQ ID NO: 6561820 - DNA, 20 bp, Homo sapiens
tttctgaggtttagcgtttt

SEQ ID NO: 6561821 - DNA, 22 bp, Homo sapiens
tttctgagtagcatatataatt

SEQ ID NO: 6561822 - DNA, 17 bp, Homo sapiens
tttctgagtgccttctg

SEQ ID NO: 6561823 - DNA, 15 bp, Homo sapiens
tttctgagttttacc

SEQ ID NO: 6561824 - DNA, 17 bp, Homo sapiens
tttctgagttttaccaa

SEQ ID NO: 6561825 - DNA, 15 bp, Homo sapiens
tttctgatcagaggt

SEQ ID NO: 6561826 - DNA, 15 bp, Homo sapiens
tttctgatccagttt

SEQ ID NO: 6561827 - DNA, 23 bp, Homo sapiens
tttctgatctgatgcaagcaaga

SEQ ID NO: 6561828 - DNA, 14 bp, Homo sapiens
tttctgatggccaa

SEQ ID NO: 6561829 - DNA, 14 bp, Homo sapiens
tttctgatgtctcc

SEQ ID NO: 6561830 - DNA, 14 bp, Homo sapiens
tttctgatgtttta

SEQ ID NO: 6561831 - DNA, 15 bp, Homo sapiens
tttctgatgttttat

SEQ ID NO: 6561832 - DNA, 15 bp, Homo sapiens
tttctgattactgtc

SEQ ID NO: 6561833 - DNA, 19 bp, Homo sapiens
tttctgattagctttgtgt

SEQ ID NO: 6561834 - DNA, 13 bp, Homo sapiens
tttctgattctga

SEQ ID NO: 6561835 - DNA, 14 bp, Homo sapiens
tttctgattctttt

SEQ ID NO: 6561836 - DNA, 22 bp, Homo sapiens
tttctgattgtaacgttgctgt

SEQ ID NO: 6561837 - DNA, 13 bp, Homo sapiens
tttctgatttcac

SEQ ID NO: 6561838 - DNA, 17 bp, Homo sapiens
tttctgatttgctgctc

SEQ ID NO: 6561839 - DNA, 16 bp, Homo sapiens
tttctgattttaagtt

SEQ ID NO: 6561840 - DNA, 14 bp, Homo sapiens
tttctgcaaaatag

SEQ ID NO: 6561841 - DNA, 15 bp, Homo sapiens
tttctgcaatccaat

SEQ ID NO: 6561842 - DNA, 16 bp, Homo sapiens
tttctgcaatgactgt

SEQ ID NO: 6561843 - DNA, 17 bp, Homo sapiens
tttctgcacagcttttc

SEQ ID NO: 6561844 - DNA, 22 bp, Homo sapiens
tttctgcacaggtctctgttta

SEQ ID NO: 6561845 - DNA, 18 bp, Homo sapiens
tttctgcactgagcagag

SEQ ID NO: 6561846 - DNA, 19 bp, Homo sapiens
tttctgcagaaatttgcaa

SEQ ID NO: 6561847 - DNA, 13 bp, Homo sapiens
tttctgcagaggc

SEQ ID NO: 6561848 - DNA, 19 bp, Homo sapiens
tttctgcagccactattgt

SEQ ID NO: 6561849 - DNA, 21 bp, Homo sapiens
tttctgcagccactattgtta

SEQ ID NO: 6561850 - DNA, 21 bp, Homo sapiens
tttctgcagcccttgggcagt

SEQ ID NO: 6561851 - DNA, 21 bp, Homo sapiens
tttctgcagctgtttcaaagt

SEQ ID NO: 6561852 - DNA, 17 bp, Homo sapiens
tttctgcagtattctgt

SEQ ID NO: 6561853 - DNA, 19 bp, Homo sapiens
tttctgcagtattctgtag

SEQ ID NO: 6561854 - DNA, 21 bp, Homo sapiens
tttctgccaataaattctaaa

SEQ ID NO: 6561855 - DNA, 13 bp, Homo sapiens
tttctgccaggga

SEQ ID NO: 6561856 - DNA, 16 bp, Homo sapiens
tttctgccagggagct

SEQ ID NO: 6561857 - DNA, 21 bp, Homo sapiens
tttctgccatgatgtttacaa

SEQ ID NO: 6561858 - DNA, 21 bp, Homo sapiens
tttctgcccaaaaagggaaaa

SEQ ID NO: 6561859 - DNA, 20 bp, Homo sapiens
tttctgcccaactttcattg

SEQ ID NO: 6561860 - DNA, 11 bp, Homo sapiens
tttctgcccag

SEQ ID NO: 6561861 - DNA, 22 bp, Homo sapiens
tttctgccctcagcttcaaata

SEQ ID NO: 6561862 - DNA, 12 bp, Homo sapiens
tttctgccctgc

SEQ ID NO: 6561863 - DNA, 13 bp, Homo sapiens
tttctgccctgcc

SEQ ID NO: 6561864 - DNA, 17 bp, Homo sapiens
tttctgcctgagattct

SEQ ID NO: 6561865 - DNA, 18 bp, Homo sapiens
tttctgcctgagattctt

SEQ ID NO: 6561866 - DNA, 20 bp, Homo sapiens
tttctgcctgagattcttta

SEQ ID NO: 6561867 - DNA, 11 bp, Homo sapiens
tttctgcctgg

SEQ ID NO: 6561868 - DNA, 15 bp, Homo sapiens
tttctgccttagcct

SEQ ID NO: 6561869 - DNA, 20 bp, Homo sapiens
tttctgccttccttgctaat

SEQ ID NO: 6561870 - DNA, 22 bp, Homo sapiens
tttctgctctggaataaagttg

SEQ ID NO: 6561871 - DNA, 23 bp, Homo sapiens
tttctgctgaattttcacatgaa

SEQ ID NO: 6561872 - DNA, 13 bp, Homo sapiens
tttctgctgagga

SEQ ID NO: 6561873 - DNA, 19 bp, Homo sapiens
tttctgctggaaacagact

SEQ ID NO: 6561874 - DNA, 14 bp, Homo sapiens
tttctgctggctga

SEQ ID NO: 6561875 - DNA, 15 bp, Homo sapiens
tttctgctggctgat

SEQ ID NO: 6561876 - DNA, 16 bp, Homo sapiens
tttctgctgtttaagg

SEQ ID NO: 6561877 - DNA, 17 bp, Homo sapiens
tttctgctttaaaaatg

SEQ ID NO: 6561878 - DNA, 18 bp, Homo sapiens
tttctgctttaaaaatgt

SEQ ID NO: 6561879 - DNA, 17 bp, Homo sapiens
tttctgctttaaattaa

SEQ ID NO: 6561880 - DNA, 20 bp, Homo sapiens
tttctgctttagacttgaaa

SEQ ID NO: 6561881 - DNA, 22 bp, Homo sapiens
tttctgctttctttgattctcc

SEQ ID NO: 6561882 - DNA, 15 bp, Homo sapiens
tttctggaaattttg

SEQ ID NO: 6561883 - DNA, 13 bp, Homo sapiens
tttctggaagaaa

SEQ ID NO: 6561884 - DNA, 21 bp, Homo sapiens
tttctggaagactgctcccgg

SEQ ID NO: 6561885 - DNA, 20 bp, Homo sapiens
tttctggaatacatgaaata

SEQ ID NO: 6561886 - DNA, 17 bp, Homo sapiens
tttctggaatggaattg

SEQ ID NO: 6561887 - DNA, 14 bp, Homo sapiens
tttctggacattct

SEQ ID NO: 6561888 - DNA, 13 bp, Homo sapiens
tttctggactccc

SEQ ID NO: 6561889 - DNA, 23 bp, Homo sapiens
tttctggactcccactctttgaa

SEQ ID NO: 6561890 - DNA, 18 bp, Homo sapiens
tttctggactctggactt

SEQ ID NO: 6561891 - DNA, 23 bp, Homo sapiens
tttctggactgaagcctgcagga

SEQ ID NO: 6561892 - DNA, 16 bp, Homo sapiens
tttctggaggttgata

SEQ ID NO: 6561893 - DNA, 17 bp, Homo sapiens
tttctggaggttgataa

SEQ ID NO: 6561894 - DNA, 23 bp, Homo sapiens
tttctggattccccatctcaggc

SEQ ID NO: 6561895 - DNA, 15 bp, Homo sapiens
tttctggatttcata

SEQ ID NO: 6561896 - DNA, 14 bp, Homo sapiens
tttctggcaaatat

SEQ ID NO: 6561897 - DNA, 18 bp, Homo sapiens
tttctggcagctgtggta

SEQ ID NO: 6561898 - DNA, 21 bp, Homo sapiens
tttctggccaaaagcagtaaa

SEQ ID NO: 6561899 - DNA, 19 bp, Homo sapiens
tttctggccagtgtttaaa

SEQ ID NO: 6561900 - DNA, 16 bp, Homo sapiens
tttctggcctgccttc

SEQ ID NO: 6561901 - DNA, 16 bp, Homo sapiens
tttctggcgcccctgc

SEQ ID NO: 6561902 - DNA, 19 bp, Homo sapiens
tttctggctatgcatttga

SEQ ID NO: 6561903 - DNA, 16 bp, Homo sapiens
tttctgggagcagaaa

SEQ ID NO: 6561904 - DNA, 19 bp, Homo sapiens
tttctgggatgtcacagtc

SEQ ID NO: 6561905 - DNA, 23 bp, Homo sapiens
tttctgggcaccggggcctcgga

SEQ ID NO: 6561906 - DNA, 13 bp, Homo sapiens
tttctgggctctg

SEQ ID NO: 6561907 - DNA, 14 bp, Homo sapiens
tttctgggctttct

SEQ ID NO: 6561908 - DNA, 17 bp, Homo sapiens
tttctgggctttctcct

SEQ ID NO: 6561909 - DNA, 21 bp, Homo sapiens
tttctggggaaaaaaaagaga

SEQ ID NO: 6561910 - DNA, 15 bp, Homo sapiens
tttctggggaaagac

SEQ ID NO: 6561911 - DNA, 14 bp, Homo sapiens
tttctggggcccag

SEQ ID NO: 6561912 - DNA, 18 bp, Homo sapiens
tttctggggggatatttc

SEQ ID NO: 6561913 - DNA, 22 bp, Homo sapiens
tttctgggtaattcaccaattt

SEQ ID NO: 6561914 - DNA, 15 bp, Homo sapiens
tttctgggtagaagc

SEQ ID NO: 6561915 - DNA, 15 bp, Homo sapiens
tttctgggtcttttg

SEQ ID NO: 6561916 - DNA, 16 bp, Homo sapiens
tttctgggtgtgtcca

SEQ ID NO: 6561917 - DNA, 13 bp, Homo sapiens
tttctggtaattt

SEQ ID NO: 6561918 - DNA, 15 bp, Homo sapiens
tttctggtccctctt

SEQ ID NO: 6561919 - DNA, 18 bp, Homo sapiens
tttctggtgcctatttat

SEQ ID NO: 6561920 - DNA, 20 bp, Homo sapiens
tttctggtggggctgtcctg

SEQ ID NO: 6561921 - DNA, 15 bp, Homo sapiens
tttctggtgtatatt

SEQ ID NO: 6561922 - DNA, 11 bp, Homo sapiens
tttctgtaaag

SEQ ID NO: 6561923 - DNA, 23 bp, Homo sapiens
tttctgtaaagatacaagtaaga

SEQ ID NO: 6561924 - DNA, 13 bp, Homo sapiens
tttctgtaaataa

SEQ ID NO: 6561925 - DNA, 15 bp, Homo sapiens
tttctgtaaatacca

SEQ ID NO: 6561926 - DNA, 15 bp, Homo sapiens
tttctgtaacaaatt

SEQ ID NO: 6561927 - DNA, 19 bp, Homo sapiens
tttctgtaacaaattggga

SEQ ID NO: 6561928 - DNA, 15 bp, Homo sapiens
tttctgtaacacaga

SEQ ID NO: 6561929 - DNA, 22 bp, Homo sapiens
tttctgtaatgtaaataaacta

SEQ ID NO: 6561930 - DNA, 19 bp, Homo sapiens
tttctgtaattcaggtttt

SEQ ID NO: 6561931 - DNA, 14 bp, Homo sapiens
tttctgtaattctt

SEQ ID NO: 6561932 - DNA, 17 bp, Homo sapiens
tttctgtacacagaagt

SEQ ID NO: 6561933 - DNA, 15 bp, Homo sapiens
tttctgtaccagtta

SEQ ID NO: 6561934 - DNA, 12 bp, Homo sapiens
tttctgtagaaa

SEQ ID NO: 6561935 - DNA, 14 bp, Homo sapiens
tttctgtagaaaag

SEQ ID NO: 6561936 - DNA, 12 bp, Homo sapiens
tttctgtagaat

SEQ ID NO: 6561937 - DNA, 13 bp, Homo sapiens
tttctgtagccta

SEQ ID NO: 6561938 - DNA, 14 bp, Homo sapiens
tttctgtatactgt

SEQ ID NO: 6561939 - DNA, 19 bp, Homo sapiens
tttctgtatactgtaaaag

SEQ ID NO: 6561940 - DNA, 21 bp, Homo sapiens
tttctgtatactgtaaaagtt

SEQ ID NO: 6561941 - DNA, 21 bp, Homo sapiens
tttctgtatatagatgtctgt

SEQ ID NO: 6561942 - DNA, 22 bp, Homo sapiens
tttctgtatatagatgtctgtg

SEQ ID NO: 6561943 - DNA, 13 bp, Homo sapiens
tttctgtatttaa

SEQ ID NO: 6561944 - DNA, 14 bp, Homo sapiens
tttctgtatttaat

SEQ ID NO: 6561945 - DNA, 20 bp, Homo sapiens
tttctgtattttttgtttgt

SEQ ID NO: 6561946 - DNA, 22 bp, Homo sapiens
tttctgtattttttgtttgtat

SEQ ID NO: 6561947 - DNA, 19 bp, Homo sapiens
tttctgtcacagtaaaaat

SEQ ID NO: 6561948 - DNA, 15 bp, Homo sapiens
tttctgtcagaatgc

SEQ ID NO: 6561949 - DNA, 20 bp, Homo sapiens
tttctgtcagatgagaacaa

SEQ ID NO: 6561950 - DNA, 22 bp, Homo sapiens
tttctgtcagatgagaacaaag

SEQ ID NO: 6561951 - DNA, 15 bp, Homo sapiens
tttctgtccagaaaa

SEQ ID NO: 6561952 - DNA, 23 bp, Homo sapiens
tttctgtccttttggcactgaga

SEQ ID NO: 6561953 - DNA, 21 bp, Homo sapiens
tttctgtctaggttaaagcta

SEQ ID NO: 6561954 - DNA, 14 bp, Homo sapiens
tttctgtctctctc

SEQ ID NO: 6561955 - DNA, 19 bp, Homo sapiens
tttctgtctttatgtaaga

SEQ ID NO: 6561956 - DNA, 22 bp, Homo sapiens
tttctgtctttatgtaagaaga

SEQ ID NO: 6561957 - DNA, 16 bp, Homo sapiens
tttctgtgaaagcctt

SEQ ID NO: 6561958 - DNA, 15 bp, Homo sapiens
tttctgtgaaattct

SEQ ID NO: 6561959 - DNA, 20 bp, Homo sapiens
tttctgtgaaattctcagag

SEQ ID NO: 6561960 - DNA, 14 bp, Homo sapiens
tttctgtgaagcta

SEQ ID NO: 6561961 - DNA, 12 bp, Homo sapiens
tttctgtgaata

SEQ ID NO: 6561962 - DNA, 20 bp, Homo sapiens
tttctgtgacatttatgtct

SEQ ID NO: 6561963 - DNA, 20 bp, Homo sapiens
tttctgtgccattttctgta

SEQ ID NO: 6561964 - DNA, 16 bp, Homo sapiens
tttctgtgcttggatt

SEQ ID NO: 6561965 - DNA, 17 bp, Homo sapiens
tttctgtggaaaacaat

SEQ ID NO: 6561966 - DNA, 19 bp, Homo sapiens
tttctgtggacaccactga

SEQ ID NO: 6561967 - DNA, 14 bp, Homo sapiens
tttctgtgtagaaa

SEQ ID NO: 6561968 - DNA, 18 bp, Homo sapiens
tttctgtgtagaaactgg

SEQ ID NO: 6561969 - DNA, 10 bp, Homo sapiens
tttctgtgtg

SEQ ID NO: 6561970 - DNA, 22 bp, Homo sapiens
tttctgtgtgtcagttttcata

SEQ ID NO: 6561971 - DNA, 13 bp, Homo sapiens
tttctgtgtgttc

SEQ ID NO: 6561972 - DNA, 18 bp, Homo sapiens
ttataaatgttttaaaga

SEQ ID NO: 6561973 - DNA, 12 bp, Homo sapiens
ttataaattaaa

SEQ ID NO: 6561974 - DNA, 18 bp, Homo sapiens
ttataaattaaaaggtca

SEQ ID NO: 6561975 - DNA, 11 bp, Homo sapiens
ttataaattat

SEQ ID NO: 6561976 - DNA, 13 bp, Homo sapiens
ttataaattatgt

SEQ ID NO: 6561977 - DNA, 14 bp, Homo sapiens
ttataaattatgtt

SEQ ID NO: 6561978 - DNA, 20 bp, Homo sapiens
ttataaattttgtacatttt

SEQ ID NO: 6561979 - DNA, 16 bp, Homo sapiens
ttataacaattgattt

SEQ ID NO: 6561980 - DNA, 15 bp, Homo sapiens
ttataacagatgtga

SEQ ID NO: 6561981 - DNA, 17 bp, Homo sapiens
ttataacagatgtgaaa

SEQ ID NO: 6561982 - DNA, 17 bp, Homo sapiens
ttataacagcaaatgaa

SEQ ID NO: 6561983 - DNA, 13 bp, Homo sapiens
ttataacagttat

SEQ ID NO: 6561984 - DNA, 20 bp, Homo sapiens
ttataacagttataaagaaa

SEQ ID NO: 6561985 - DNA, 21 bp, Homo sapiens
ttataacagttataaagaaag

SEQ ID NO: 6561986 - DNA, 22 bp, Homo sapiens
ttataacagttataaagaaaga

SEQ ID NO: 6561987 - DNA, 15 bp, Homo sapiens
ttataaccaaagcaa

SEQ ID NO: 6561988 - DNA, 21 bp, Homo sapiens
ttataacctggcaaaatcttg

SEQ ID NO: 6561989 - DNA, 15 bp, Homo sapiens
ttataactaacatgt

SEQ ID NO: 6561990 - DNA, 19 bp, Homo sapiens
ttataactaacatgtcctg

SEQ ID NO: 6561991 - DNA, 22 bp, Homo sapiens
ttataactactccggagacagg

SEQ ID NO: 6561992 - DNA, 20 bp, Homo sapiens
ttataactagacatctgctg

SEQ ID NO: 6561993 - DNA, 18 bp, Homo sapiens
ttataactatataaatga

SEQ ID NO: 6561994 - DNA, 16 bp, Homo sapiens
ttataactattacagt

SEQ ID NO: 6561995 - DNA, 18 bp, Homo sapiens
ttataactcatcataaaa

SEQ ID NO: 6561996 - DNA, 14 bp, Homo sapiens
ttataactctaggg

SEQ ID NO: 6561997 - DNA, 17 bp, Homo sapiens
ttataactggaaagaag

SEQ ID NO: 6561998 - DNA, 14 bp, Homo sapiens
ttataactgtttta

SEQ ID NO: 6561999 - DNA, 15 bp, Homo sapiens
ttataacttaaaaaa

SEQ ID NO: 6562000 - DNA, 17 bp, Homo sapiens
ttataacttaaaatatt

SEQ ID NO: 6562001 - DNA, 17 bp, Homo sapiens
ttataacttattagcag

SEQ ID NO: 6562002 - DNA, 16 bp, Homo sapiens
ttataactttttatat

SEQ ID NO: 6562003 - DNA, 16 bp, Homo sapiens
ttataagaaaaacttt

SEQ ID NO: 6562004 - DNA, 17 bp, Homo sapiens
ttataagaaaaactttt

SEQ ID NO: 6562005 - DNA, 16 bp, Homo sapiens
ttataagaaagcctga

SEQ ID NO: 6562006 - DNA, 12 bp, Homo sapiens
ttataagactct

SEQ ID NO: 6562007 - DNA, 15 bp, Homo sapiens
ttataagagagctta

SEQ ID NO: 6562008 - DNA, 21 bp, Homo sapiens
ttataagaggatagctatatt

SEQ ID NO: 6562009 - DNA, 23 bp, Homo sapiens
ttataagagggaacaaattttca

SEQ ID NO: 6562010 - DNA, 20 bp, Homo sapiens
ttataagcaacatgaattaa

SEQ ID NO: 6562011 - DNA, 17 bp, Homo sapiens
ttataagcatcattatt

SEQ ID NO: 6562012 - DNA, 13 bp, Homo sapiens
ttataagcattga

SEQ ID NO: 6562013 - DNA, 21 bp, Homo sapiens
ttataagccaaaggttcagaa

SEQ ID NO: 6562014 - DNA, 13 bp, Homo sapiens
ttataaggaaact

SEQ ID NO: 6562015 - DNA, 15 bp, Homo sapiens
ttataaggactgcat

SEQ ID NO: 6562016 - DNA, 16 bp, Homo sapiens
ttataaggactgcatg

SEQ ID NO: 6562017 - DNA, 17 bp, Homo sapiens
ttataaggactgcatgg

SEQ ID NO: 6562018 - DNA, 17 bp, Homo sapiens
ttataaggctgactctt

SEQ ID NO: 6562019 - DNA, 21 bp, Homo sapiens
ttataaggctgactcttacta

SEQ ID NO: 6562020 - DNA, 14 bp, Homo sapiens
ttataagggagagc

SEQ ID NO: 6562021 - DNA, 22 bp, Homo sapiens
ttataagggccctgccctgtac

SEQ ID NO: 6562022 - DNA, 22 bp, Homo sapiens
ttataaggtgttttctgtgtaa

SEQ ID NO: 6562023 - DNA, 23 bp, Homo sapiens
ttataaggttcgtattgctatgt

SEQ ID NO: 6562024 - DNA, 15 bp, Homo sapiens
ttataaggttgtctg

SEQ ID NO: 6562025 - DNA, 18 bp, Homo sapiens
ttataagtaacttgtcaa

SEQ ID NO: 6562026 - DNA, 18 bp, Homo sapiens
ttataagtatcttcatgt

SEQ ID NO: 6562027 - DNA, 18 bp, Homo sapiens
ttataagtcattgtatgt

SEQ ID NO: 6562028 - DNA, 18 bp, Homo sapiens
ttataagtgactttaaac

SEQ ID NO: 6562029 - DNA, 23 bp, Homo sapiens
ttataagttaaaacaaaggaact

SEQ ID NO: 6562030 - DNA, 15 bp, Homo sapiens
ttataagttctattt

SEQ ID NO: 6562031 - DNA, 14 bp, Homo sapiens
ttataagttgacct

SEQ ID NO: 6562032 - DNA, 17 bp, Homo sapiens
ttataataaaaggaaaa

SEQ ID NO: 6562033 - DNA, 22 bp, Homo sapiens
ttataataaaaggaaaagcaaa

SEQ ID NO: 6562034 - DNA, 20 bp, Homo sapiens
ttataataaatatatacatt

SEQ ID NO: 6562035 - DNA, 14 bp, Homo sapiens
ttataataaatgta

SEQ ID NO: 6562036 - DNA, 12 bp, Homo sapiens
ttataataaatt

SEQ ID NO: 6562037 - DNA, 14 bp, Homo sapiens
ttataataactgaa

SEQ ID NO: 6562038 - DNA, 18 bp, Homo sapiens
ttataataactgaactgt

SEQ ID NO: 6562039 - DNA, 19 bp, Homo sapiens
ttataataactgaactgtt

SEQ ID NO: 6562040 - DNA, 19 bp, Homo sapiens
ttataatactaaaactcag

SEQ ID NO: 6562041 - DNA, 14 bp, Homo sapiens
ttataatactgttt

SEQ ID NO: 6562042 - DNA, 14 bp, Homo sapiens
ttataataggaatt

SEQ ID NO: 6562043 - DNA, 22 bp, Homo sapiens
ttataataggtatatagaacac

SEQ ID NO: 6562044 - DNA, 21 bp, Homo sapiens
ttataatataatatggaacct

SEQ ID NO: 6562045 - DNA, 13 bp, Homo sapiens
ttataatatacta

SEQ ID NO: 6562046 - DNA, 17 bp, Homo sapiens
ttataatatgtgcctta

SEQ ID NO: 6562047 - DNA, 20 bp, Homo sapiens
ttataatatgtgccttaagt

SEQ ID NO: 6562048 - DNA, 17 bp, Homo sapiens
ttataatcaatgaattt

SEQ ID NO: 6562049 - DNA, 13 bp, Homo sapiens
ttataatcacttt

SEQ ID NO: 6562050 - DNA, 16 bp, Homo sapiens
ttataatcagaatgga

SEQ ID NO: 6562051 - DNA, 21 bp, Homo sapiens
ttataatcagggaaactaatt

SEQ ID NO: 6562052 - DNA, 17 bp, Homo sapiens
ttataatccacagtaaa

SEQ ID NO: 6562053 - DNA, 15 bp, Homo sapiens
ttataatctcaaagg

SEQ ID NO: 6562054 - DNA, 11 bp, Homo sapiens
ttataatcttt

SEQ ID NO: 6562055 - DNA, 17 bp, Homo sapiens
ttataatgaaatctgtt

SEQ ID NO: 6562056 - DNA, 18 bp, Homo sapiens
ttataatgaaatctgttt

SEQ ID NO: 6562057 - DNA, 19 bp, Homo sapiens
ttataatgaagaacactgt

SEQ ID NO: 6562058 - DNA, 15 bp, Homo sapiens
ttataatgaatgaaa

SEQ ID NO: 6562059 - DNA, 14 bp, Homo sapiens
ttataatgaatgac

SEQ ID NO: 6562060 - DNA, 20 bp, Homo sapiens
ttataatgcaatgataaata

SEQ ID NO: 6562061 - DNA, 24 bp, Homo sapiens
ttataatgcaatgataaataaagt

SEQ ID NO: 6562062 - DNA, 17 bp, Homo sapiens
ttataatgcatctaaac

SEQ ID NO: 6562063 - DNA, 17 bp, Homo sapiens
ttataatgccagaatat

SEQ ID NO: 6562064 - DNA, 23 bp, Homo sapiens
ttataatgccagaatataatgtg

SEQ ID NO: 6562065 - DNA, 20 bp, Homo sapiens
ttataatgggcattactgaa

SEQ ID NO: 6562066 - DNA, 12 bp, Homo sapiens
ttataatgtatt

SEQ ID NO: 6562067 - DNA, 19 bp, Homo sapiens
ttataatgtattcatattt

SEQ ID NO: 6562068 - DNA, 13 bp, Homo sapiens
ttataatgtcaaa

SEQ ID NO: 6562069 - DNA, 18 bp, Homo sapiens
ttataatgtggatttcct

SEQ ID NO: 6562070 - DNA, 20 bp, Homo sapiens
ttataatgtggatttcctat

SEQ ID NO: 6562071 - DNA, 23 bp, Homo sapiens
ttataatgtggatttcctatttt

SEQ ID NO: 6562072 - DNA, 11 bp, Homo sapiens
ttataatgtgt

SEQ ID NO: 6562073 - DNA, 19 bp, Homo sapiens
ttataattaaagaaaattg

SEQ ID NO: 6562074 - DNA, 22 bp, Homo sapiens
ttataattcagtatgttttaca

SEQ ID NO: 6562075 - DNA, 14 bp, Homo sapiens
ttataattctcatt

SEQ ID NO: 6562076 - DNA, 14 bp, Homo sapiens
ttataattctttca

SEQ ID NO: 6562077 - DNA, 21 bp, Homo sapiens
ttataattctttcaatacaga

SEQ ID NO: 6562078 - DNA, 23 bp, Homo sapiens
ttataattctttcaatacagata

SEQ ID NO: 6562079 - DNA, 23 bp, Homo sapiens
ttataattctttctttttccttc

SEQ ID NO: 6562080 - DNA, 22 bp, Homo sapiens
ttataattggtgctatttgaag

SEQ ID NO: 6562081 - DNA, 23 bp, Homo sapiens
ttataattggtgctatttgaaga

SEQ ID NO: 6562082 - DNA, 14 bp, Homo sapiens
ttataattgtaatg

SEQ ID NO: 6562083 - DNA, 22 bp, Homo sapiens
ttataattgtatcagaggccta

SEQ ID NO: 6562084 - DNA, 19 bp, Homo sapiens
ttataattgtcatgacttt

SEQ ID NO: 6562085 - DNA, 14 bp, Homo sapiens
ttataatttaaatg

SEQ ID NO: 6562086 - DNA, 15 bp, Homo sapiens
ttataatttaaatga

SEQ ID NO: 6562087 - DNA, 14 bp, Homo sapiens
ttataatttcaatt

SEQ ID NO: 6562088 - DNA, 15 bp, Homo sapiens
ttataatttcaattt

SEQ ID NO: 6562089 - DNA, 16 bp, Homo sapiens
ttataatttcaatttt

SEQ ID NO: 6562090 - DNA, 16 bp, Homo sapiens
ttataatttccaaact

SEQ ID NO: 6562091 - DNA, 19 bp, Homo sapiens
ttataatttccaaactgtt

SEQ ID NO: 6562092 - DNA, 19 bp, Homo sapiens
ttataatttctacccatgt

SEQ ID NO: 6562093 - DNA, 17 bp, Homo sapiens
ttataattttaaatgtt

SEQ ID NO: 6562094 - DNA, 21 bp, Homo sapiens
ttataattttaagattccttt

SEQ ID NO: 6562095 - DNA, 17 bp, Homo sapiens
ttataattttatctgta

SEQ ID NO: 6562096 - DNA, 15 bp, Homo sapiens
ttataattttctgaa

SEQ ID NO: 6562097 - DNA, 19 bp, Homo sapiens
ttataattttgaccataaa

SEQ ID NO: 6562098 - DNA, 14 bp, Homo sapiens
ttataattttgtga

SEQ ID NO: 6562099 - DNA, 18 bp, Homo sapiens
ttataattttgtgaagca

SEQ ID NO: 6562100 - DNA, 16 bp, Homo sapiens
ttataatttttttcaa

SEQ ID NO: 6562101 - DNA, 19 bp, Homo sapiens
ttatacaaaataagaacga

SEQ ID NO: 6562102 - DNA, 15 bp, Homo sapiens
ttatacaaaataatt

SEQ ID NO: 6562103 - DNA, 17 bp, Homo sapiens
ttatacaaaataattta

SEQ ID NO: 6562104 - DNA, 21 bp, Homo sapiens
ttatacaaaataatttaacta

SEQ ID NO: 6562105 - DNA, 21 bp, Homo sapiens
ttatacaaacctaccaaaatg

SEQ ID NO: 6562106 - DNA, 19 bp, Homo sapiens
ttatacaaattagaaaatg

SEQ ID NO: 6562107 - DNA, 21 bp, Homo sapiens
ttatacaacagcaaaccctga

SEQ ID NO: 6562108 - DNA, 19 bp, Homo sapiens
ttatacaaccttcatttaa

SEQ ID NO: 6562109 - DNA, 19 bp, Homo sapiens
ttatacaagtaatttcctg

SEQ ID NO: 6562110 - DNA, 22 bp, Homo sapiens
ttatacaataacccagttactt

SEQ ID NO: 6562111 - DNA, 12 bp, Homo sapiens
ttatacacacag

SEQ ID NO: 6562112 - DNA, 13 bp, Homo sapiens
ttatacacataat

SEQ ID NO: 6562113 - DNA, 18 bp, Homo sapiens
ttatacacataattaaag

SEQ ID NO: 6562114 - DNA, 21 bp, Homo sapiens
ttatacacataattaaagtgt

SEQ ID NO: 6562115 - DNA, 16 bp, Homo sapiens
ttatacagaactcaca

SEQ ID NO: 6562116 - DNA, 22 bp, Homo sapiens
ttatacagaattgtgtctgcag

SEQ ID NO: 6562117 - DNA, 13 bp, Homo sapiens
ttatacagaccta

SEQ ID NO: 6562118 - DNA, 15 bp, Homo sapiens
ttatacagacctaat

SEQ ID NO: 6562119 - DNA, 21 bp, Homo sapiens
ttatacagacctaatatcatt

SEQ ID NO: 6562120 - DNA, 20 bp, Homo sapiens
ttatacagatagagttccat

SEQ ID NO: 6562121 - DNA, 17 bp, Homo sapiens
ttatacagtagtgagaa

SEQ ID NO: 6562122 - DNA, 21 bp, Homo sapiens
ttatacagtagtgagaagaat

SEQ ID NO: 6562123 - DNA, 15 bp, Homo sapiens
ttatacagtgccttg

SEQ ID NO: 6562124 - DNA, 19 bp, Homo sapiens
ttatacagtgtacatgtac

SEQ ID NO: 6562125 - DNA, 17 bp, Homo sapiens
ttatacagttataaaat

SEQ ID NO: 6562126 - DNA, 20 bp, Homo sapiens
ttatacagttgaaaacttgt

SEQ ID NO: 6562127 - DNA, 21 bp, Homo sapiens
ttatacagttttaaagaatca

SEQ ID NO: 6562128 - DNA, 12 bp, Homo sapiens
ttatacatagtc

SEQ ID NO: 6562129 - DNA, 17 bp, Homo sapiens
ttatacatagtcacaaa

SEQ ID NO: 6562130 - DNA, 21 bp, Homo sapiens
ttatacatatcagaaaagtag

SEQ ID NO: 6562131 - DNA, 22 bp, Homo sapiens
ttatacatatcagaaaagtaga

SEQ ID NO: 6562132 - DNA, 12 bp, Homo sapiens
ttatacatcact

SEQ ID NO: 6562133 - DNA, 13 bp, Homo sapiens
ttatacatcactt

SEQ ID NO: 6562134 - DNA, 17 bp, Homo sapiens
ttatacatcacttcctg

SEQ ID NO: 6562135 - DNA, 18 bp, Homo sapiens
ttatacatcttcattaat

SEQ ID NO: 6562136 - DNA, 16 bp, Homo sapiens
ttatacattagtaaat

SEQ ID NO: 6562137 - DNA, 15 bp, Homo sapiens
ttataccagcaaaag

SEQ ID NO: 6562138 - DNA, 19 bp, Homo sapiens
ttatacccagaaagttatt

SEQ ID NO: 6562139 - DNA, 18 bp, Homo sapiens
ttataccccctgcaaagc

SEQ ID NO: 6562140 - DNA, 17 bp, Homo sapiens
ttataccctttttcatt

SEQ ID NO: 6562141 - DNA, 22 bp, Homo sapiens
ttatacctcaattttcactgtg

SEQ ID NO: 6562142 - DNA, 16 bp, Homo sapiens
ttatacctgctatcag

SEQ ID NO: 6562143 - DNA, 21 bp, Homo sapiens
ttatacctgtgtattttttaa

SEQ ID NO: 6562144 - DNA, 20 bp, Homo sapiens
ttatacgagtaatatgcctg

SEQ ID NO: 6562145 - DNA, 21 bp, Homo sapiens
ttatacgctggcaacacagag

SEQ ID NO: 6562146 - DNA, 16 bp, Homo sapiens
ttatacgtacatacac

SEQ ID NO: 6562147 - DNA, 17 bp, Homo sapiens
ttatacgtgtagctata

SEQ ID NO: 6562148 - DNA, 18 bp, Homo sapiens
ttatacgtgtagctatat

SEQ ID NO: 6562149 - DNA, 14 bp, Homo sapiens
ttatactaattcag

SEQ ID NO: 6562150 - DNA, 17 bp, Homo sapiens
tttctgttaaaatgcat

SEQ ID NO: 6562151 - DNA, 15 bp, Homo sapiens
tttctgttccaaatt

SEQ ID NO: 6562152 - DNA, 12 bp, Homo sapiens
tttctgttccag

SEQ ID NO: 6562153 - DNA, 14 bp, Homo sapiens
tttctgttctagtt

SEQ ID NO: 6562154 - DNA, 15 bp, Homo sapiens
tttctgttctgtgga

SEQ ID NO: 6562155 - DNA, 23 bp, Homo sapiens
tttctgttcttacaaatgtgaaa

SEQ ID NO: 6562156 - DNA, 20 bp, Homo sapiens
tttctgttctttctggctat

SEQ ID NO: 6562157 - DNA, 15 bp, Homo sapiens
tttctgttgaagttt

SEQ ID NO: 6562158 - DNA, 22 bp, Homo sapiens
tttctgttgaattatgttttga

SEQ ID NO: 6562159 - DNA, 14 bp, Homo sapiens
tttctgttgccaca

SEQ ID NO: 6562160 - DNA, 21 bp, Homo sapiens
tttctgttggttagtagacac

SEQ ID NO: 6562161 - DNA, 23 bp, Homo sapiens
tttctgttgtaacttatgtagat

SEQ ID NO: 6562162 - DNA, 19 bp, Homo sapiens
tttctgtttataattgttt

SEQ ID NO: 6562163 - DNA, 22 bp, Homo sapiens
tttctgtttctaatttgctgct

SEQ ID NO: 6562164 - DNA, 13 bp, Homo sapiens
tttctgtttctca

SEQ ID NO: 6562165 - DNA, 19 bp, Homo sapiens
tttctgtttgaattttcaa

SEQ ID NO: 6562166 - DNA, 16 bp, Homo sapiens
tttctgtttgtaaatt

SEQ ID NO: 6562167 - DNA, 17 bp, Homo sapiens
tttctgtttgtaaatta

SEQ ID NO: 6562168 - DNA, 16 bp, Homo sapiens
tttcttaaaacacatg

SEQ ID NO: 6562169 - DNA, 13 bp, Homo sapiens
tttcttaaaattc

SEQ ID NO: 6562170 - DNA, 22 bp, Homo sapiens
tttcttaaaccaacctttaaaa

SEQ ID NO: 6562171 - DNA, 13 bp, Homo sapiens
tttcttaaagctt

SEQ ID NO: 6562172 - DNA, 21 bp, Homo sapiens
tttcttaaagtgccagtattt

SEQ ID NO: 6562173 - DNA, 19 bp, Homo sapiens
tttcttaaataagaaactt

SEQ ID NO: 6562174 - DNA, 20 bp, Homo sapiens
tttcttaaataagaaacttt

SEQ ID NO: 6562175 - DNA, 13 bp, Homo sapiens
tttcttaaataat

SEQ ID NO: 6562176 - DNA, 13 bp, Homo sapiens
tttcttaaatata

SEQ ID NO: 6562177 - DNA, 20 bp, Homo sapiens
tttcttaaatatgtatatga

SEQ ID NO: 6562178 - DNA, 18 bp, Homo sapiens
tttcttaaatttttcaac

SEQ ID NO: 6562179 - DNA, 18 bp, Homo sapiens
tttcttaaccagatcatt

SEQ ID NO: 6562180 - DNA, 17 bp, Homo sapiens
tttcttaaccagttgtg

SEQ ID NO: 6562181 - DNA, 21 bp, Homo sapiens
tttcttaaccagttgtggtgt

SEQ ID NO: 6562182 - DNA, 14 bp, Homo sapiens
tttcttaaccatct

SEQ ID NO: 6562183 - DNA, 17 bp, Homo sapiens
tttcttaaggaattttg

SEQ ID NO: 6562184 - DNA, 20 bp, Homo sapiens
tttcttaaggaattttgtct

SEQ ID NO: 6562185 - DNA, 23 bp, Homo sapiens
tttcttaaggtgaggcctgtctg

SEQ ID NO: 6562186 - DNA, 21 bp, Homo sapiens
tttcttaatagaaagtcagat

SEQ ID NO: 6562187 - DNA, 22 bp, Homo sapiens
tttcttaatatatagcatttat

SEQ ID NO: 6562188 - DNA, 15 bp, Homo sapiens
tttcttaatcatttt

SEQ ID NO: 6562189 - DNA, 14 bp, Homo sapiens
tttcttaatgagat

SEQ ID NO: 6562190 - DNA, 13 bp, Homo sapiens
tttcttaatgtct

SEQ ID NO: 6562191 - DNA, 22 bp, Homo sapiens
tttcttaatgtctgtcagaaga

SEQ ID NO: 6562192 - DNA, 21 bp, Homo sapiens
tttcttaattttcaccgagca

SEQ ID NO: 6562193 - DNA, 14 bp, Homo sapiens
tttcttaattttgt

SEQ ID NO: 6562194 - DNA, 17 bp, Homo sapiens
tttcttacataattttt

SEQ ID NO: 6562195 - DNA, 14 bp, Homo sapiens
tttcttaccagtct

SEQ ID NO: 6562196 - DNA, 18 bp, Homo sapiens
tttcttaccagtctcctc

SEQ ID NO: 6562197 - DNA, 21 bp, Homo sapiens
tttcttacccagattgtgtac

SEQ ID NO: 6562198 - DNA, 22 bp, Homo sapiens
tttcttaccctagttctcttat

SEQ ID NO: 6562199 - DNA, 20 bp, Homo sapiens
tttcttactgatttttaagt

SEQ ID NO: 6562200 - DNA, 22 bp, Homo sapiens
tttcttactgtcttttttctaa

SEQ ID NO: 6562201 - DNA, 14 bp, Homo sapiens
tttcttagaaattt

SEQ ID NO: 6562202 - DNA, 16 bp, Homo sapiens
tttcttagagattaaa

SEQ ID NO: 6562203 - DNA, 13 bp, Homo sapiens
tttcttagctttt

SEQ ID NO: 6562204 - DNA, 19 bp, Homo sapiens
tttcttagctttttaattg

SEQ ID NO: 6562205 - DNA, 20 bp, Homo sapiens
tttcttagctttttaattgt

SEQ ID NO: 6562206 - DNA, 20 bp, Homo sapiens
tttcttaggagcaagaagaa

SEQ ID NO: 6562207 - DNA, 21 bp, Homo sapiens
tttcttaggagcaagaagaaa

SEQ ID NO: 6562208 - DNA, 15 bp, Homo sapiens
tttcttagtcattac

SEQ ID NO: 6562209 - DNA, 18 bp, Homo sapiens
tttcttagtcgaatgtta

SEQ ID NO: 6562210 - DNA, 16 bp, Homo sapiens
tttcttagtgcctgtg

SEQ ID NO: 6562211 - DNA, 17 bp, Homo sapiens
tttcttatccaactttt

SEQ ID NO: 6562212 - DNA, 17 bp, Homo sapiens
tttcttatcttgaccat

SEQ ID NO: 6562213 - DNA, 13 bp, Homo sapiens
tttcttatgattt

SEQ ID NO: 6562214 - DNA, 17 bp, Homo sapiens
tttcttatgtgacatta

SEQ ID NO: 6562215 - DNA, 20 bp, Homo sapiens
tttcttattaggcctcagaa

SEQ ID NO: 6562216 - DNA, 16 bp, Homo sapiens
tttcttattcagtgaa

SEQ ID NO: 6562217 - DNA, 15 bp, Homo sapiens
tttcttattctgtat

SEQ ID NO: 6562218 - DNA, 17 bp, Homo sapiens
tttcttattgcgctgct

SEQ ID NO: 6562219 - DNA, 18 bp, Homo sapiens
tttcttatttaacttaac

SEQ ID NO: 6562220 - DNA, 14 bp, Homo sapiens
tttcttatttatgt

SEQ ID NO: 6562221 - DNA, 15 bp, Homo sapiens
tttcttatttatgta

SEQ ID NO: 6562222 - DNA, 17 bp, Homo sapiens
tttcttattttgtaata

SEQ ID NO: 6562223 - DNA, 21 bp, Homo sapiens
tttcttattttgtaataaact

SEQ ID NO: 6562224 - DNA, 15 bp, Homo sapiens
tttcttcaaaatgta

SEQ ID NO: 6562225 - DNA, 15 bp, Homo sapiens
tttcttcaatacaaa

SEQ ID NO: 6562226 - DNA, 15 bp, Homo sapiens
tttcttcactctggc

SEQ ID NO: 6562227 - DNA, 17 bp, Homo sapiens
tttcttcactgcaacat

SEQ ID NO: 6562228 - DNA, 15 bp, Homo sapiens
tttcttcactgcaga

SEQ ID NO: 6562229 - DNA, 18 bp, Homo sapiens
tttcttcagaattatcca

SEQ ID NO: 6562230 - DNA, 15 bp, Homo sapiens
tttcttcagggctgc

SEQ ID NO: 6562231 - DNA, 17 bp, Homo sapiens
tttcttcaggtaacact

SEQ ID NO: 6562232 - DNA, 15 bp, Homo sapiens
tttcttcatccaact

SEQ ID NO: 6562233 - DNA, 22 bp, Homo sapiens
tttcttcatctttgccatatgg

SEQ ID NO: 6562234 - DNA, 22 bp, Homo sapiens
tttcttcatgcaatgacatctt

SEQ ID NO: 6562235 - DNA, 14 bp, Homo sapiens
tttcttcattgtaa

SEQ ID NO: 6562236 - DNA, 17 bp, Homo sapiens
tttcttcatttctctgc

SEQ ID NO: 6562237 - DNA, 16 bp, Homo sapiens
tttcttccagtgatgt

SEQ ID NO: 6562238 - DNA, 21 bp, Homo sapiens
tttcttccagtgatgttgaaa

SEQ ID NO: 6562239 - DNA, 16 bp, Homo sapiens
tttcttcccatttgta

SEQ ID NO: 6562240 - DNA, 14 bp, Homo sapiens
tttcttccccaccc

SEQ ID NO: 6562241 - DNA, 18 bp, Homo sapiens
tttcttccccttcctctc

SEQ ID NO: 6562242 - DNA, 17 bp, Homo sapiens
tttcttcccgcacaaat

SEQ ID NO: 6562243 - DNA, 12 bp, Homo sapiens
tttcttccctgc

SEQ ID NO: 6562244 - DNA, 21 bp, Homo sapiens
tttcttccctgctttgcatct

SEQ ID NO: 6562245 - DNA, 18 bp, Homo sapiens
tttcttccctgtattttc

SEQ ID NO: 6562246 - DNA, 13 bp, Homo sapiens
tttcttcctcagc

SEQ ID NO: 6562247 - DNA, 13 bp, Homo sapiens
tttcttcctccag

SEQ ID NO: 6562248 - DNA, 13 bp, Homo sapiens
tttcttcctctgc

SEQ ID NO: 6562249 - DNA, 14 bp, Homo sapiens
tttcttcctctgct

SEQ ID NO: 6562250 - DNA, 16 bp, Homo sapiens
tttcttcctctgctga

SEQ ID NO: 6562251 - DNA, 14 bp, Homo sapiens
tttcttcctgcaga

SEQ ID NO: 6562252 - DNA, 12 bp, Homo sapiens
tttcttcctggc

SEQ ID NO: 6562253 - DNA, 18 bp, Homo sapiens
tttcttcctgttaatgta

SEQ ID NO: 6562254 - DNA, 11 bp, Homo sapiens
tttcttccttc

SEQ ID NO: 6562255 - DNA, 15 bp, Homo sapiens
tttcttcctttactt

SEQ ID NO: 6562256 - DNA, 13 bp, Homo sapiens
tttcttctacttt

SEQ ID NO: 6562257 - DNA, 13 bp, Homo sapiens
tttcttctattaa

SEQ ID NO: 6562258 - DNA, 17 bp, Homo sapiens
tttcttctattgcctct

SEQ ID NO: 6562259 - DNA, 12 bp, Homo sapiens
tttcttctattt

SEQ ID NO: 6562260 - DNA, 17 bp, Homo sapiens
tttcttctctctgtgct

SEQ ID NO: 6562261 - DNA, 18 bp, Homo sapiens
tttcttctctctgttccc

SEQ ID NO: 6562262 - DNA, 19 bp, Homo sapiens
tttcttctctctgttccct

SEQ ID NO: 6562263 - DNA, 20 bp, Homo sapiens
tttcttctctctgttccctt

SEQ ID NO: 6562264 - DNA, 14 bp, Homo sapiens
tttcttctctgcct

SEQ ID NO: 6562265 - DNA, 12 bp, Homo sapiens
tttcttctctgg

SEQ ID NO: 6562266 - DNA, 15 bp, Homo sapiens
tttcttctctgtgag

SEQ ID NO: 6562267 - DNA, 13 bp, Homo sapiens
tttcttctgccct

SEQ ID NO: 6562268 - DNA, 12 bp, Homo sapiens
tttcttctgggc

SEQ ID NO: 6562269 - DNA, 14 bp, Homo sapiens
tttcttcttcacat

SEQ ID NO: 6562270 - DNA, 13 bp, Homo sapiens
tttcttcttcatg

SEQ ID NO: 6562271 - DNA, 21 bp, Homo sapiens
tttcttcttccacacatgcaa

SEQ ID NO: 6562272 - DNA, 15 bp, Homo sapiens
tttcttctttccctg

SEQ ID NO: 6562273 - DNA, 14 bp, Homo sapiens
tttcttcttttcct

SEQ ID NO: 6562274 - DNA, 16 bp, Homo sapiens
tttcttcttttccttt

SEQ ID NO: 6562275 - DNA, 17 bp, Homo sapiens
tttcttcttttttaagt

SEQ ID NO: 6562276 - DNA, 21 bp, Homo sapiens
tttcttgaaaagccttggaga

SEQ ID NO: 6562277 - DNA, 22 bp, Homo sapiens
tttcttgaatttttttctgcac

SEQ ID NO: 6562278 - DNA, 21 bp, Homo sapiens
tttcttgacaaaacctaactt

SEQ ID NO: 6562279 - DNA, 22 bp, Homo sapiens
tttcttgactcttgttttcagt

SEQ ID NO: 6562280 - DNA, 18 bp, Homo sapiens
tttcttgatatctttcct

SEQ ID NO: 6562281 - DNA, 21 bp, Homo sapiens
tttcttgatcaacatcttttc

SEQ ID NO: 6562282 - DNA, 17 bp, Homo sapiens
tttcttgatcttaaaga

SEQ ID NO: 6562283 - DNA, 10 bp, Homo sapiens
tttcttgcaa

SEQ ID NO: 6562284 - DNA, 16 bp, Homo sapiens
tttcttgcaaaacaaa

SEQ ID NO: 6562285 - DNA, 14 bp, Homo sapiens
tttcttgcaagctc

SEQ ID NO: 6562286 - DNA, 17 bp, Homo sapiens
tttcttgcactattcca

SEQ ID NO: 6562287 - DNA, 19 bp, Homo sapiens
tttcttgcactattccaca

SEQ ID NO: 6562288 - DNA, 15 bp, Homo sapiens
tttcttgcactgaat

SEQ ID NO: 6562289 - DNA, 16 bp, Homo sapiens
tttcttgcagatcaaa

SEQ ID NO: 6562290 - DNA, 23 bp, Homo sapiens
tttcttgccaatgaggtctgaaa

SEQ ID NO: 6562291 - DNA, 18 bp, Homo sapiens
tttcttgccccagtgtgg

SEQ ID NO: 6562292 - DNA, 19 bp, Homo sapiens
tttcttgctaagctccagc

SEQ ID NO: 6562293 - DNA, 19 bp, Homo sapiens
tttcttgctcccttcagcc

SEQ ID NO: 6562294 - DNA, 19 bp, Homo sapiens
tttcttgctctctctccct

SEQ ID NO: 6562295 - DNA, 21 bp, Homo sapiens
tttcttgctggttgtcatttt

SEQ ID NO: 6562296 - DNA, 17 bp, Homo sapiens
tttcttgcttcaaaaat

SEQ ID NO: 6562297 - DNA, 15 bp, Homo sapiens
tttcttgcttgtacc

SEQ ID NO: 6562298 - DNA, 13 bp, Homo sapiens
tttcttggcaaat

SEQ ID NO: 6562299 - DNA, 20 bp, Homo sapiens
tttcttggcctcaagttcaa

SEQ ID NO: 6562300 - DNA, 11 bp, Homo sapiens
tttcttgggaa

SEQ ID NO: 6562301 - DNA, 20 bp, Homo sapiens
tttcttgggcagtctttctt

SEQ ID NO: 6562302 - DNA, 22 bp, Homo sapiens
tttcttgggcagtctttcttga

SEQ ID NO: 6562303 - DNA, 9 bp, Homo sapiens
tttcttggt

SEQ ID NO: 6562304 - DNA, 20 bp, Homo sapiens
tttcttggtggcagaatgaa

SEQ ID NO: 6562305 - DNA, 12 bp, Homo sapiens
tttcttgtagta

SEQ ID NO: 6562306 - DNA, 20 bp, Homo sapiens
tttcttgtctataaagcatt

SEQ ID NO: 6562307 - DNA, 17 bp, Homo sapiens
tttcttgtctctgaggc

SEQ ID NO: 6562308 - DNA, 14 bp, Homo sapiens
tttcttgtctgtta

SEQ ID NO: 6562309 - DNA, 15 bp, Homo sapiens
tttcttgtctttcct

SEQ ID NO: 6562310 - DNA, 17 bp, Homo sapiens
tttcttgtgccctgggc

SEQ ID NO: 6562311 - DNA, 22 bp, Homo sapiens
tttcttgtgctgactaactata

SEQ ID NO: 6562312 - DNA, 20 bp, Homo sapiens
tttcttgtggtgtaaagctg

SEQ ID NO: 6562313 - DNA, 23 bp, Homo sapiens
tttcttgtggtgtaaagctggcc

SEQ ID NO: 6562314 - DNA, 19 bp, Homo sapiens
tttcttgtgtgtttattgt

SEQ ID NO: 6562315 - DNA, 14 bp, Homo sapiens
tttcttgtgttctg

SEQ ID NO: 6562316 - DNA, 13 bp, Homo sapiens
tttcttgtgttgt

SEQ ID NO: 6562317 - DNA, 22 bp, Homo sapiens
tttcttgtttaacatatatatt

SEQ ID NO: 6562318 - DNA, 12 bp, Homo sapiens
tttcttgtttac

SEQ ID NO: 6562319 - DNA, 16 bp, Homo sapiens
tttcttgtttctgcat

SEQ ID NO: 6562320 - DNA, 15 bp, Homo sapiens
tttctttaaaaaaga

SEQ ID NO: 6562321 - DNA, 20 bp, Homo sapiens
tttctttaaaaaagaaatta

SEQ ID NO: 6562322 - DNA, 14 bp, Homo sapiens
tttctttaaaagaa

SEQ ID NO: 6562323 - DNA, 15 bp, Homo sapiens
tttctttaaagccag

SEQ ID NO: 6562324 - DNA, 17 bp, Homo sapiens
tttctttaaataaaaat

SEQ ID NO: 6562325 - DNA, 19 bp, Homo sapiens
tttctttaaataaaaataa

SEQ ID NO: 6562326 - DNA, 15 bp, Homo sapiens
tttctttaaatcatt

SEQ ID NO: 6562327 - DNA, 15 bp, Homo sapiens
tttctttaaattttg

SEQ ID NO: 6562328 - DNA, 12 bp, Homo sapiens
tttctttaactg

SEQ ID NO: 6562329 - DNA, 16 bp, Homo sapiens
tttctttaagaaagta

SEQ ID NO: 6562330 - DNA, 15 bp, Homo sapiens
tttctttaatatgat

SEQ ID NO: 6562331 - DNA, 23 bp, Homo sapiens
ttatactactttgttaggatttt

SEQ ID NO: 6562332 - DNA, 11 bp, Homo sapiens
ttatactatat

SEQ ID NO: 6562333 - DNA, 22 bp, Homo sapiens
ttatactctagaacatgcacat

SEQ ID NO: 6562334 - DNA, 15 bp, Homo sapiens
ttatactctcttccc

SEQ ID NO: 6562335 - DNA, 16 bp, Homo sapiens
ttatactctcttccct

SEQ ID NO: 6562336 - DNA, 17 bp, Homo sapiens
ttatactctcttccctt

SEQ ID NO: 6562337 - DNA, 16 bp, Homo sapiens
ttatactctttctgta

SEQ ID NO: 6562338 - DNA, 21 bp, Homo sapiens
ttatactgacaataaaaatgt

SEQ ID NO: 6562339 - DNA, 19 bp, Homo sapiens
ttatactgcacagtggcac

SEQ ID NO: 6562340 - DNA, 22 bp, Homo sapiens
ttatactgcacttatttgtcaa

SEQ ID NO: 6562341 - DNA, 16 bp, Homo sapiens
ttatactgcactttag

SEQ ID NO: 6562342 - DNA, 18 bp, Homo sapiens
ttatactgggtttcaaga

SEQ ID NO: 6562343 - DNA, 15 bp, Homo sapiens
ttatactgtacaata

SEQ ID NO: 6562344 - DNA, 17 bp, Homo sapiens
ttatactgtatttctaa

SEQ ID NO: 6562345 - DNA, 18 bp, Homo sapiens
ttatactgtatttctaag

SEQ ID NO: 6562346 - DNA, 20 bp, Homo sapiens
ttatactgtatttctaagaa

SEQ ID NO: 6562347 - DNA, 15 bp, Homo sapiens
ttatactgttatcca

SEQ ID NO: 6562348 - DNA, 20 bp, Homo sapiens
ttatacttaaacagcttttt

SEQ ID NO: 6562349 - DNA, 23 bp, Homo sapiens
ttatacttgagaccaacttttca

SEQ ID NO: 6562350 - DNA, 15 bp, Homo sapiens
ttatacttgtaatta

SEQ ID NO: 6562351 - DNA, 19 bp, Homo sapiens
ttatacttgtaattatgga

SEQ ID NO: 6562352 - DNA, 16 bp, Homo sapiens
ttatactttatatctg

SEQ ID NO: 6562353 - DNA, 15 bp, Homo sapiens
ttatagaaaacctga

SEQ ID NO: 6562354 - DNA, 18 bp, Homo sapiens
ttatagaaacaatactgt

SEQ ID NO: 6562355 - DNA, 14 bp, Homo sapiens
ttatagaaagttca

SEQ ID NO: 6562356 - DNA, 16 bp, Homo sapiens
ttatagaaattctgaa

SEQ ID NO: 6562357 - DNA, 12 bp, Homo sapiens
ttatagaagaat

SEQ ID NO: 6562358 - DNA, 17 bp, Homo sapiens
ttatagaagaatgcatg

SEQ ID NO: 6562359 - DNA, 22 bp, Homo sapiens
ttatagaaggaatttgtacttc

SEQ ID NO: 6562360 - DNA, 16 bp, Homo sapiens
ttatagaataaaagct

SEQ ID NO: 6562361 - DNA, 23 bp, Homo sapiens
ttatagaataaaagctataaagt

SEQ ID NO: 6562362 - DNA, 23 bp, Homo sapiens
ttatagaataaaagctgtggaat

SEQ ID NO: 6562363 - DNA, 14 bp, Homo sapiens
ttatagaatacttt

SEQ ID NO: 6562364 - DNA, 12 bp, Homo sapiens
ttatagaatgct

SEQ ID NO: 6562365 - DNA, 15 bp, Homo sapiens
ttatagacaaataat

SEQ ID NO: 6562366 - DNA, 21 bp, Homo sapiens
ttatagagaatgatgataaca

SEQ ID NO: 6562367 - DNA, 11 bp, Homo sapiens
ttatagagcac

SEQ ID NO: 6562368 - DNA, 23 bp, Homo sapiens
ttatagagcagaaattctgtttt

SEQ ID NO: 6562369 - DNA, 19 bp, Homo sapiens
ttatagagggccaagactt

SEQ ID NO: 6562370 - DNA, 14 bp, Homo sapiens
ttatagagttcata

SEQ ID NO: 6562371 - DNA, 22 bp, Homo sapiens
ttatagagttcatagaaataca

SEQ ID NO: 6562372 - DNA, 23 bp, Homo sapiens
ttatagagttcatagaaatacat

SEQ ID NO: 6562373 - DNA, 17 bp, Homo sapiens
ttatagatatataaata

SEQ ID NO: 6562374 - DNA, 21 bp, Homo sapiens
ttatagatcatttctaggcaa

SEQ ID NO: 6562375 - DNA, 22 bp, Homo sapiens
ttatagatcatttctaggcaaa

SEQ ID NO: 6562376 - DNA, 21 bp, Homo sapiens
ttatagatgggaatgaagctt

SEQ ID NO: 6562377 - DNA, 20 bp, Homo sapiens
ttatagattctaaagattct

SEQ ID NO: 6562378 - DNA, 21 bp, Homo sapiens
ttatagattctaaagattcta

SEQ ID NO: 6562379 - DNA, 14 bp, Homo sapiens
ttatagattgtctt

SEQ ID NO: 6562380 - DNA, 15 bp, Homo sapiens
ttatagattgtctta

SEQ ID NO: 6562381 - DNA, 15 bp, Homo sapiens
ttatagatttagcta

SEQ ID NO: 6562382 - DNA, 18 bp, Homo sapiens
ttatagcaaaaatgtttt

SEQ ID NO: 6562383 - DNA, 18 bp, Homo sapiens
ttatagcaactaatgttt

SEQ ID NO: 6562384 - DNA, 19 bp, Homo sapiens
ttatagcaactaatgtttg

SEQ ID NO: 6562385 - DNA, 19 bp, Homo sapiens
ttatagcatgtaatattaa

SEQ ID NO: 6562386 - DNA, 20 bp, Homo sapiens
ttatagcctggactgctacc

SEQ ID NO: 6562387 - DNA, 17 bp, Homo sapiens
ttatagcgcctgtataa

SEQ ID NO: 6562388 - DNA, 20 bp, Homo sapiens
ttatagctcatcactgtgcc

SEQ ID NO: 6562389 - DNA, 16 bp, Homo sapiens
ttatagcttaactaat

SEQ ID NO: 6562390 - DNA, 20 bp, Homo sapiens
ttataggaaataaatctaaa

SEQ ID NO: 6562391 - DNA, 23 bp, Homo sapiens
ttataggaatttgcgtaactaac

SEQ ID NO: 6562392 - DNA, 20 bp, Homo sapiens
ttataggactttcttctaaa

SEQ ID NO: 6562393 - DNA, 16 bp, Homo sapiens
ttataggagaaagcaa

SEQ ID NO: 6562394 - DNA, 14 bp, Homo sapiens
ttataggagagatt

SEQ ID NO: 6562395 - DNA, 16 bp, Homo sapiens
ttataggatcatttgt

SEQ ID NO: 6562396 - DNA, 18 bp, Homo sapiens
ttataggggatacttgaa

SEQ ID NO: 6562397 - DNA, 20 bp, Homo sapiens
ttataggtaaaatctctgaa

SEQ ID NO: 6562398 - DNA, 13 bp, Homo sapiens
ttataggttttat

SEQ ID NO: 6562399 - DNA, 15 bp, Homo sapiens
ttatagtaaccattt

SEQ ID NO: 6562400 - DNA, 22 bp, Homo sapiens
ttatagtaaccattttcctttg

SEQ ID NO: 6562401 - DNA, 16 bp, Homo sapiens
ttatagtacatgataa

SEQ ID NO: 6562402 - DNA, 15 bp, Homo sapiens
ttatagtatatctgg

SEQ ID NO: 6562403 - DNA, 18 bp, Homo sapiens
ttatagtatatctggaca

SEQ ID NO: 6562404 - DNA, 18 bp, Homo sapiens
ttatagtattaagtgaaa

SEQ ID NO: 6562405 - DNA, 18 bp, Homo sapiens
ttatagtctgtacttcag

SEQ ID NO: 6562406 - DNA, 15 bp, Homo sapiens
ttatagtgaagtgtt

SEQ ID NO: 6562407 - DNA, 18 bp, Homo sapiens
ttatagtgagttgcatgt

SEQ ID NO: 6562408 - DNA, 19 bp, Homo sapiens
ttatagtgcaatatatttt

SEQ ID NO: 6562409 - DNA, 17 bp, Homo sapiens
ttatagtgtttaactgg

SEQ ID NO: 6562410 - DNA, 22 bp, Homo sapiens
ttatagtgtttaactggcatgg

SEQ ID NO: 6562411 - DNA, 17 bp, Homo sapiens
ttatagtgtttggacag

SEQ ID NO: 6562412 - DNA, 14 bp, Homo sapiens
ttatagttaatcta

SEQ ID NO: 6562413 - DNA, 14 bp, Homo sapiens
ttatagttactgtg

SEQ ID NO: 6562414 - DNA, 15 bp, Homo sapiens
ttatagttactgtgt

SEQ ID NO: 6562415 - DNA, 13 bp, Homo sapiens
ttatagttattaa

SEQ ID NO: 6562416 - DNA, 15 bp, Homo sapiens
ttatagttattaaat

SEQ ID NO: 6562417 - DNA, 22 bp, Homo sapiens
ttatagttattaaatgtttcaa

SEQ ID NO: 6562418 - DNA, 15 bp, Homo sapiens
ttatagttgaagatt

SEQ ID NO: 6562419 - DNA, 17 bp, Homo sapiens
ttatagttgatatgtaa

SEQ ID NO: 6562420 - DNA, 15 bp, Homo sapiens
ttatagtttatacag

SEQ ID NO: 6562421 - DNA, 14 bp, Homo sapiens
ttatagtttcaagc

SEQ ID NO: 6562422 - DNA, 15 bp, Homo sapiens
ttatagtttctgagg

SEQ ID NO: 6562423 - DNA, 20 bp, Homo sapiens
ttatagtttgctttgctttt

SEQ ID NO: 6562424 - DNA, 15 bp, Homo sapiens
ttatagtttgtacat

SEQ ID NO: 6562425 - DNA, 14 bp, Homo sapiens
ttatataaaggttt

SEQ ID NO: 6562426 - DNA, 13 bp, Homo sapiens
ttatataaagtat

SEQ ID NO: 6562427 - DNA, 14 bp, Homo sapiens
ttatataaagtatt

SEQ ID NO: 6562428 - DNA, 21 bp, Homo sapiens
ttatataacccactgctgaaa

SEQ ID NO: 6562429 - DNA, 22 bp, Homo sapiens
ttatataacccactgctgaaaa

SEQ ID NO: 6562430 - DNA, 13 bp, Homo sapiens
ttatataactctt

SEQ ID NO: 6562431 - DNA, 18 bp, Homo sapiens
ttatataactgtatttga

SEQ ID NO: 6562432 - DNA, 14 bp, Homo sapiens
ttatataactgttg

SEQ ID NO: 6562433 - DNA, 13 bp, Homo sapiens
ttatataagcaaa

SEQ ID NO: 6562434 - DNA, 13 bp, Homo sapiens
ttatataagtatt

SEQ ID NO: 6562435 - DNA, 23 bp, Homo sapiens
ttatataagtctgttatttatta

SEQ ID NO: 6562436 - DNA, 19 bp, Homo sapiens
ttatataataaaagtgcct

SEQ ID NO: 6562437 - DNA, 20 bp, Homo sapiens
ttatataatatctaaagtta

SEQ ID NO: 6562438 - DNA, 22 bp, Homo sapiens
ttatataattgccaaaaagtga

SEQ ID NO: 6562439 - DNA, 23 bp, Homo sapiens
ttatatacagtacacagatacct

SEQ ID NO: 6562440 - DNA, 19 bp, Homo sapiens
ttatatacctggcttttac

SEQ ID NO: 6562441 - DNA, 17 bp, Homo sapiens
ttatatactgctattta

SEQ ID NO: 6562442 - DNA, 23 bp, Homo sapiens
ttatatactgctatttacactat

SEQ ID NO: 6562443 - DNA, 19 bp, Homo sapiens
ttatatactttttcatgaa

SEQ ID NO: 6562444 - DNA, 22 bp, Homo sapiens
ttatatactttttcatgaaaat

SEQ ID NO: 6562445 - DNA, 19 bp, Homo sapiens
ttatatagatgtcagcaat

SEQ ID NO: 6562446 - DNA, 19 bp, Homo sapiens
ttatatagattataacttg

SEQ ID NO: 6562447 - DNA, 19 bp, Homo sapiens
ttatatagcaaaatgattc

SEQ ID NO: 6562448 - DNA, 19 bp, Homo sapiens
ttatatagcaaagatatat

SEQ ID NO: 6562449 - DNA, 21 bp, Homo sapiens
ttatatagcacctttcaacca

SEQ ID NO: 6562450 - DNA, 18 bp, Homo sapiens
ttatatagcttgaaacat

SEQ ID NO: 6562451 - DNA, 21 bp, Homo sapiens
ttatatagggatcaaccagct

SEQ ID NO: 6562452 - DNA, 16 bp, Homo sapiens
ttatatagtctacagt

SEQ ID NO: 6562453 - DNA, 12 bp, Homo sapiens
ttatatataaaa

SEQ ID NO: 6562454 - DNA, 15 bp, Homo sapiens
ttatatataaaaaga

SEQ ID NO: 6562455 - DNA, 14 bp, Homo sapiens
ttatatataaaata

SEQ ID NO: 6562456 - DNA, 17 bp, Homo sapiens
ttatatataaaataaat

SEQ ID NO: 6562457 - DNA, 21 bp, Homo sapiens
ttatatataaaataaatatac

SEQ ID NO: 6562458 - DNA, 15 bp, Homo sapiens
ttatatataataaat

SEQ ID NO: 6562459 - DNA, 18 bp, Homo sapiens
ttatatataataaatact

SEQ ID NO: 6562460 - DNA, 15 bp, Homo sapiens
ttatatatacagtaa

SEQ ID NO: 6562461 - DNA, 15 bp, Homo sapiens
ttatatatagaaaag

SEQ ID NO: 6562462 - DNA, 21 bp, Homo sapiens
ttatatatataaagtcagtga

SEQ ID NO: 6562463 - DNA, 19 bp, Homo sapiens
ttatatatatagtttattt

SEQ ID NO: 6562464 - DNA, 15 bp, Homo sapiens
ttatatatatatgta

SEQ ID NO: 6562465 - DNA, 16 bp, Homo sapiens
ttatatatatgctact

SEQ ID NO: 6562466 - DNA, 13 bp, Homo sapiens
ttatatatatgtg

SEQ ID NO: 6562467 - DNA, 17 bp, Homo sapiens
ttatatatcataaagta

SEQ ID NO: 6562468 - DNA, 22 bp, Homo sapiens
ttatatatcatagtataaatct

SEQ ID NO: 6562469 - DNA, 13 bp, Homo sapiens
ttatatatccctg

SEQ ID NO: 6562470 - DNA, 17 bp, Homo sapiens
ttatatatctaagttca

SEQ ID NO: 6562471 - DNA, 14 bp, Homo sapiens
ttatatatgaagta

SEQ ID NO: 6562472 - DNA, 19 bp, Homo sapiens
ttatatatggacagcttta

SEQ ID NO: 6562473 - DNA, 21 bp, Homo sapiens
ttatatatggggatggtagtt

SEQ ID NO: 6562474 - DNA, 14 bp, Homo sapiens
ttatatatgtattt

SEQ ID NO: 6562475 - DNA, 20 bp, Homo sapiens
ttatatatgtcctattcatt

SEQ ID NO: 6562476 - DNA, 23 bp, Homo sapiens
ttatatatgtgaacatttatcaa

SEQ ID NO: 6562477 - DNA, 16 bp, Homo sapiens
ttatatattataagtt

SEQ ID NO: 6562478 - DNA, 19 bp, Homo sapiens
ttatatattatatggaaat

SEQ ID NO: 6562479 - DNA, 18 bp, Homo sapiens
ttatatattatgtgaaga

SEQ ID NO: 6562480 - DNA, 21 bp, Homo sapiens
ttatatattgaaagttgcttt

SEQ ID NO: 6562481 - DNA, 16 bp, Homo sapiens
ttatatattgtctgta

SEQ ID NO: 6562482 - DNA, 17 bp, Homo sapiens
ttatatattgttgacaa

SEQ ID NO: 6562483 - DNA, 15 bp, Homo sapiens
ttatatattgttgtt

SEQ ID NO: 6562484 - DNA, 14 bp, Homo sapiens
ttatatatttataa

SEQ ID NO: 6562485 - DNA, 20 bp, Homo sapiens
ttatatatttataactcatc

SEQ ID NO: 6562486 - DNA, 20 bp, Homo sapiens
ttatatattttcatcctata

SEQ ID NO: 6562487 - DNA, 17 bp, Homo sapiens
ttatatattttgttgtt

SEQ ID NO: 6562488 - DNA, 12 bp, Homo sapiens
ttatatcaaagt

SEQ ID NO: 6562489 - DNA, 15 bp, Homo sapiens
ttatatcaaatgcct

SEQ ID NO: 6562490 - DNA, 21 bp, Homo sapiens
ttatatcaaatgccttcatga

SEQ ID NO: 6562491 - DNA, 15 bp, Homo sapiens
ttatatcagcttttc

SEQ ID NO: 6562492 - DNA, 19 bp, Homo sapiens
ttatatcagtcctctttca

SEQ ID NO: 6562493 - DNA, 14 bp, Homo sapiens
ttatatcatacagt

SEQ ID NO: 6562494 - DNA, 17 bp, Homo sapiens
ttatatcatacagtttt

SEQ ID NO: 6562495 - DNA, 15 bp, Homo sapiens
ttatatcatatgtat

SEQ ID NO: 6562496 - DNA, 16 bp, Homo sapiens
ttatatcatatgtata

SEQ ID NO: 6562497 - DNA, 17 bp, Homo sapiens
ttatatccatttttatc

SEQ ID NO: 6562498 - DNA, 14 bp, Homo sapiens
ttatatcccctgct

SEQ ID NO: 6562499 - DNA, 18 bp, Homo sapiens
ttatatcgaaatacagtt

SEQ ID NO: 6562500 - DNA, 19 bp, Homo sapiens
ttatatctaattatttcca

SEQ ID NO: 6562501 - DNA, 13 bp, Homo sapiens
ttatatctaattt

SEQ ID NO: 6562502 - DNA, 19 bp, Homo sapiens
ttatatctaatttatacaa

SEQ ID NO: 6562503 - DNA, 21 bp, Homo sapiens
ttatatctaatttatacaaaa

SEQ ID NO: 6562504 - DNA, 22 bp, Homo sapiens
ttatatctaatttatacaaaat

SEQ ID NO: 6562505 - DNA, 15 bp, Homo sapiens
ttatatctatagtag

SEQ ID NO: 6562506 - DNA, 14 bp, Homo sapiens
ttatatctccccca

SEQ ID NO: 6562507 - DNA, 13 bp, Homo sapiens
ttatatctctgta

SEQ ID NO: 6562508 - DNA, 15 bp, Homo sapiens
ttatatctgaagatt

SEQ ID NO: 6562509 - DNA, 15 bp, Homo sapiens
tttctttacaaaaca

SEQ ID NO: 6562510 - DNA, 15 bp, Homo sapiens
tttctttagagaact

SEQ ID NO: 6562511 - DNA, 20 bp, Homo sapiens
tttctttagagcattgccat

SEQ ID NO: 6562512 - DNA, 19 bp, Homo sapiens
tttctttagcttttaccaa

SEQ ID NO: 6562513 - DNA, 17 bp, Homo sapiens
tttctttagtcatttaa

SEQ ID NO: 6562514 - DNA, 18 bp, Homo sapiens
tttctttatataaggtca

SEQ ID NO: 6562515 - DNA, 18 bp, Homo sapiens
tttctttatatttatcca

SEQ ID NO: 6562516 - DNA, 18 bp, Homo sapiens
tttctttatcattgctaa

SEQ ID NO: 6562517 - DNA, 14 bp, Homo sapiens
tttctttattagct

SEQ ID NO: 6562518 - DNA, 13 bp, Homo sapiens
tttctttatttct

SEQ ID NO: 6562519 - DNA, 14 bp, Homo sapiens
tttctttcaaaatt

SEQ ID NO: 6562520 - DNA, 16 bp, Homo sapiens
tttctttcagatgttt

SEQ ID NO: 6562521 - DNA, 17 bp, Homo sapiens
tttctttcatacattat

SEQ ID NO: 6562522 - DNA, 16 bp, Homo sapiens
tttctttccgacacat

SEQ ID NO: 6562523 - DNA, 15 bp, Homo sapiens
tttctttccttaaaa

SEQ ID NO: 6562524 - DNA, 13 bp, Homo sapiens
tttctttcctttc

SEQ ID NO: 6562525 - DNA, 12 bp, Homo sapiens
tttctttctagt

SEQ ID NO: 6562526 - DNA, 13 bp, Homo sapiens
tttctttctagtg

SEQ ID NO: 6562527 - DNA, 12 bp, Homo sapiens
tttctttctcga

SEQ ID NO: 6562528 - DNA, 12 bp, Homo sapiens
tttctttctgtt

SEQ ID NO: 6562529 - DNA, 16 bp, Homo sapiens
tttctttcttagtcca

SEQ ID NO: 6562530 - DNA, 16 bp, Homo sapiens
tttctttgaaatgcta

SEQ ID NO: 6562531 - DNA, 16 bp, Homo sapiens
tttctttgaatgtatt

SEQ ID NO: 6562532 - DNA, 16 bp, Homo sapiens
tttctttgaattttca

SEQ ID NO: 6562533 - DNA, 20 bp, Homo sapiens
tttctttgaattttcatttt

SEQ ID NO: 6562534 - DNA, 12 bp, Homo sapiens
tttctttgatca

SEQ ID NO: 6562535 - DNA, 15 bp, Homo sapiens
tttctttgccatctc

SEQ ID NO: 6562536 - DNA, 19 bp, Homo sapiens
tttctttgccatctctgct

SEQ ID NO: 6562537 - DNA, 11 bp, Homo sapiens
tttctttgcct

SEQ ID NO: 6562538 - DNA, 13 bp, Homo sapiens
tttctttgctgct

SEQ ID NO: 6562539 - DNA, 15 bp, Homo sapiens
tttctttgctgtgcc

SEQ ID NO: 6562540 - DNA, 17 bp, Homo sapiens
tttctttgggaatattt

SEQ ID NO: 6562541 - DNA, 19 bp, Homo sapiens
tttctttgggaatatttga

SEQ ID NO: 6562542 - DNA, 17 bp, Homo sapiens
tttctttggggaaaaat

SEQ ID NO: 6562543 - DNA, 16 bp, Homo sapiens
tttctttggtgccttt

SEQ ID NO: 6562544 - DNA, 21 bp, Homo sapiens
tttctttggtgcctttcctgt

SEQ ID NO: 6562545 - DNA, 17 bp, Homo sapiens
tttctttgtatcattca

SEQ ID NO: 6562546 - DNA, 21 bp, Homo sapiens
tttctttgtcattcagttcta

SEQ ID NO: 6562547 - DNA, 15 bp, Homo sapiens
tttctttgtgtagct

SEQ ID NO: 6562548 - DNA, 14 bp, Homo sapiens
tttctttgtttctt

SEQ ID NO: 6562549 - DNA, 20 bp, Homo sapiens
tttcttttaagccctgctct

SEQ ID NO: 6562550 - DNA, 16 bp, Homo sapiens
tttcttttagacacat

SEQ ID NO: 6562551 - DNA, 16 bp, Homo sapiens
tttcttttatatataa

SEQ ID NO: 6562552 - DNA, 17 bp, Homo sapiens
tttcttttatatataaa

SEQ ID NO: 6562553 - DNA, 20 bp, Homo sapiens
tttcttttatatataaaata

SEQ ID NO: 6562554 - DNA, 23 bp, Homo sapiens
tttcttttatatataaaataaat

SEQ ID NO: 6562555 - DNA, 15 bp, Homo sapiens
tttcttttattatca

SEQ ID NO: 6562556 - DNA, 16 bp, Homo sapiens
tttcttttctaacttt

SEQ ID NO: 6562557 - DNA, 13 bp, Homo sapiens
tttcttttctatg

SEQ ID NO: 6562558 - DNA, 16 bp, Homo sapiens
tttcttttctctttaa

SEQ ID NO: 6562559 - DNA, 13 bp, Homo sapiens
tttcttttctttg

SEQ ID NO: 6562560 - DNA, 18 bp, Homo sapiens
tttcttttgaatcaatct

SEQ ID NO: 6562561 - DNA, 16 bp, Homo sapiens
tttcttttgaattgtt

SEQ ID NO: 6562562 - DNA, 22 bp, Homo sapiens
tttcttttgcccttcacagtgt

SEQ ID NO: 6562563 - DNA, 14 bp, Homo sapiens
tttcttttgtaata

SEQ ID NO: 6562564 - DNA, 14 bp, Homo sapiens
tttcttttgtaatt

SEQ ID NO: 6562565 - DNA, 15 bp, Homo sapiens
tttcttttgtgcata

SEQ ID NO: 6562566 - DNA, 14 bp, Homo sapiens
tttcttttgttgta

SEQ ID NO: 6562567 - DNA, 15 bp, Homo sapiens
tttctttttaaagct

SEQ ID NO: 6562568 - DNA, 15 bp, Homo sapiens
tttctttttaaatgt

SEQ ID NO: 6562569 - DNA, 18 bp, Homo sapiens
tttctttttaaatgtgct

SEQ ID NO: 6562570 - DNA, 22 bp, Homo sapiens
tttctttttaaccctaatcttt

SEQ ID NO: 6562571 - DNA, 17 bp, Homo sapiens
tttctttttacagcatt

SEQ ID NO: 6562572 - DNA, 13 bp, Homo sapiens
tttctttttacat

SEQ ID NO: 6562573 - DNA, 14 bp, Homo sapiens
tttctttttacata

SEQ ID NO: 6562574 - DNA, 23 bp, Homo sapiens
tttctttttattaggttaagtct

SEQ ID NO: 6562575 - DNA, 17 bp, Homo sapiens
tttctttttctgtctct

SEQ ID NO: 6562576 - DNA, 19 bp, Homo sapiens
tttctttttgaatctttaa

SEQ ID NO: 6562577 - DNA, 15 bp, Homo sapiens
tttctttttgtaatt

SEQ ID NO: 6562578 - DNA, 17 bp, Homo sapiens
tttcttttttaaaatca

SEQ ID NO: 6562579 - DNA, 17 bp, Homo sapiens
tttcttttttattacca

SEQ ID NO: 6562580 - DNA, 22 bp, Homo sapiens
tttcttttttcggctaaaaaga

SEQ ID NO: 6562581 - DNA, 17 bp, Homo sapiens
tttctttttttaaattg

SEQ ID NO: 6562582 - DNA, 22 bp, Homo sapiens
tttctttttttattaaacagat

SEQ ID NO: 6562583 - DNA, 16 bp, Homo sapiens
tttctttttttgcata

SEQ ID NO: 6562584 - DNA, 21 bp, Homo sapiens
tttcttttttttaatgtttct

SEQ ID NO: 6562585 - DNA, 21 bp, Homo sapiens
tttcttttttttttctgttga

SEQ ID NO: 6562586 - DNA, 16 bp, Homo sapiens
tttgaaaaaagaagag

SEQ ID NO: 6562587 - DNA, 22 bp, Homo sapiens
tttgaaaaaagttactgcaact

SEQ ID NO: 6562588 - DNA, 12 bp, Homo sapiens
tttgaaaaaatt

SEQ ID NO: 6562589 - DNA, 21 bp, Homo sapiens
tttgaaaaaattaaaatcttt

SEQ ID NO: 6562590 - DNA, 15 bp, Homo sapiens
tttgaaaaagagaac

SEQ ID NO: 6562591 - DNA, 13 bp, Homo sapiens
tttgaaaaagctg

SEQ ID NO: 6562592 - DNA, 14 bp, Homo sapiens
tttgaaaaatattg

SEQ ID NO: 6562593 - DNA, 19 bp, Homo sapiens
tttgaaaaatattgctaaa

SEQ ID NO: 6562594 - DNA, 14 bp, Homo sapiens
tttgaaaaatctca

SEQ ID NO: 6562595 - DNA, 22 bp, Homo sapiens
tttgaaaaattcctattgtgat

SEQ ID NO: 6562596 - DNA, 17 bp, Homo sapiens
tttgaaaacaaacttct

SEQ ID NO: 6562597 - DNA, 19 bp, Homo sapiens
tttgaaaacaaacttctcg

SEQ ID NO: 6562598 - DNA, 14 bp, Homo sapiens
tttgaaaacaattc

SEQ ID NO: 6562599 - DNA, 16 bp, Homo sapiens
tttgaaaacagaaatt

SEQ ID NO: 6562600 - DNA, 20 bp, Homo sapiens
tttgaaaaccaacaccatca

SEQ ID NO: 6562601 - DNA, 22 bp, Homo sapiens
tttgaaaaccaacaccatcaca

SEQ ID NO: 6562602 - DNA, 20 bp, Homo sapiens
tttgaaaacgtttcaaagca

SEQ ID NO: 6562603 - DNA, 22 bp, Homo sapiens
tttgaaaactctgtgtttggaa

SEQ ID NO: 6562604 - DNA, 18 bp, Homo sapiens
tttgaaaactgaatgtca

SEQ ID NO: 6562605 - DNA, 13 bp, Homo sapiens
tttgaaaacttca

SEQ ID NO: 6562606 - DNA, 19 bp, Homo sapiens
tttgaaaacttcagaagca

SEQ ID NO: 6562607 - DNA, 16 bp, Homo sapiens
tttgaaaagaacagaa

SEQ ID NO: 6562608 - DNA, 18 bp, Homo sapiens
tttgaaaagaccaagact

SEQ ID NO: 6562609 - DNA, 16 bp, Homo sapiens
tttgaaaagcagacat

SEQ ID NO: 6562610 - DNA, 18 bp, Homo sapiens
tttgaaaagcagacattt

SEQ ID NO: 6562611 - DNA, 16 bp, Homo sapiens
tttgaaaagcccacat

SEQ ID NO: 6562612 - DNA, 19 bp, Homo sapiens
tttgaaaagcccacataag

SEQ ID NO: 6562613 - DNA, 22 bp, Homo sapiens
tttgaaaaggtctaagcaagtg

SEQ ID NO: 6562614 - DNA, 12 bp, Homo sapiens
tttgaaaagtaa

SEQ ID NO: 6562615 - DNA, 16 bp, Homo sapiens
tttgaaaataggattt

SEQ ID NO: 6562616 - DNA, 20 bp, Homo sapiens
tttgaaaatagttattcagt

SEQ ID NO: 6562617 - DNA, 18 bp, Homo sapiens
tttgaaaatagtttattt

SEQ ID NO: 6562618 - DNA, 15 bp, Homo sapiens
tttgaaaatgctctt

SEQ ID NO: 6562619 - DNA, 22 bp, Homo sapiens
tttgaaaatgctcttaaaatat

SEQ ID NO: 6562620 - DNA, 11 bp, Homo sapiens
tttgaaaatgg

SEQ ID NO: 6562621 - DNA, 15 bp, Homo sapiens
tttgaaaatgttttt

SEQ ID NO: 6562622 - DNA, 17 bp, Homo sapiens
tttgaaaattaccttta

SEQ ID NO: 6562623 - DNA, 24 bp, Homo sapiens
tttgaaacaactttctcttgtaaa

SEQ ID NO: 6562624 - DNA, 13 bp, Homo sapiens
tttgaaacacaag

SEQ ID NO: 6562625 - DNA, 19 bp, Homo sapiens
tttgaaacactttgcataa

SEQ ID NO: 6562626 - DNA, 12 bp, Homo sapiens
tttgaaacattg

SEQ ID NO: 6562627 - DNA, 13 bp, Homo sapiens
tttgaaacattgc

SEQ ID NO: 6562628 - DNA, 23 bp, Homo sapiens
tttgaaacattgcttttaaaact

SEQ ID NO: 6562629 - DNA, 16 bp, Homo sapiens
tttgaaacctttttct

SEQ ID NO: 6562630 - DNA, 22 bp, Homo sapiens
tttgaaactaaaataaattaag

SEQ ID NO: 6562631 - DNA, 16 bp, Homo sapiens
tttgaaactaactcat

SEQ ID NO: 6562632 - DNA, 13 bp, Homo sapiens
tttgaaactagaa

SEQ ID NO: 6562633 - DNA, 23 bp, Homo sapiens
tttgaaactagaaatctgtcctg

SEQ ID NO: 6562634 - DNA, 20 bp, Homo sapiens
tttgaaactgctaattacac

SEQ ID NO: 6562635 - DNA, 19 bp, Homo sapiens
tttgaaagaaaagtatttc

SEQ ID NO: 6562636 - DNA, 14 bp, Homo sapiens
tttgaaagaaatgt

SEQ ID NO: 6562637 - DNA, 16 bp, Homo sapiens
tttgaaagaagtcaaa

SEQ ID NO: 6562638 - DNA, 19 bp, Homo sapiens
tttgaaagaagtcaaatga

SEQ ID NO: 6562639 - DNA, 20 bp, Homo sapiens
tttgaaagaagtcaaatgaa

SEQ ID NO: 6562640 - DNA, 13 bp, Homo sapiens
tttgaaagaattc

SEQ ID NO: 6562641 - DNA, 18 bp, Homo sapiens
tttgaaagaattctattt

SEQ ID NO: 6562642 - DNA, 21 bp, Homo sapiens
tttgaaagatgtatggatttc

SEQ ID NO: 6562643 - DNA, 17 bp, Homo sapiens
tttgaaagattatgatg

SEQ ID NO: 6562644 - DNA, 20 bp, Homo sapiens
tttgaaagccccagaaatca

SEQ ID NO: 6562645 - DNA, 13 bp, Homo sapiens
tttgaaaggaaaa

SEQ ID NO: 6562646 - DNA, 22 bp, Homo sapiens
tttgaaaggcaatttttgagta

SEQ ID NO: 6562647 - DNA, 16 bp, Homo sapiens
tttgaaaggtcagaat

SEQ ID NO: 6562648 - DNA, 20 bp, Homo sapiens
tttgaaagtcagctgaagga

SEQ ID NO: 6562649 - DNA, 19 bp, Homo sapiens
tttgaaagtctgtccttga

SEQ ID NO: 6562650 - DNA, 23 bp, Homo sapiens
tttgaaagtgcctttgcagctca

SEQ ID NO: 6562651 - DNA, 17 bp, Homo sapiens
tttgaaagttgtacatg

SEQ ID NO: 6562652 - DNA, 16 bp, Homo sapiens
tttgaaagtttcctta

SEQ ID NO: 6562653 - DNA, 13 bp, Homo sapiens
tttgaaataaaaa

SEQ ID NO: 6562654 - DNA, 23 bp, Homo sapiens
tttgaaataattatgcagacaca

SEQ ID NO: 6562655 - DNA, 13 bp, Homo sapiens
tttgaaatacctc

SEQ ID NO: 6562656 - DNA, 18 bp, Homo sapiens
tttgaaatacctcatgtt

SEQ ID NO: 6562657 - DNA, 20 bp, Homo sapiens
tttgaaatacctcatgttta

SEQ ID NO: 6562658 - DNA, 13 bp, Homo sapiens
tttgaaatatatg

SEQ ID NO: 6562659 - DNA, 16 bp, Homo sapiens
tttgaaatatcatgtt

SEQ ID NO: 6562660 - DNA, 21 bp, Homo sapiens
tttgaaatcaccttttctaaa

SEQ ID NO: 6562661 - DNA, 15 bp, Homo sapiens
tttgaaatcagcata

SEQ ID NO: 6562662 - DNA, 20 bp, Homo sapiens
tttgaaatccagaagtttta

SEQ ID NO: 6562663 - DNA, 14 bp, Homo sapiens
tttgaaatcgttgg

SEQ ID NO: 6562664 - DNA, 14 bp, Homo sapiens
tttgaaatgaaaat

SEQ ID NO: 6562665 - DNA, 13 bp, Homo sapiens
tttgaaatgaaat

SEQ ID NO: 6562666 - DNA, 15 bp, Homo sapiens
tttgaaatgaaattt

SEQ ID NO: 6562667 - DNA, 16 bp, Homo sapiens
tttgaaatgaactttg

SEQ ID NO: 6562668 - DNA, 20 bp, Homo sapiens
tttgaaatgacatgttcctt

SEQ ID NO: 6562669 - DNA, 12 bp, Homo sapiens
tttgaaatgctg

SEQ ID NO: 6562670 - DNA, 20 bp, Homo sapiens
tttgaaatgctgaaaattgc

SEQ ID NO: 6562671 - DNA, 18 bp, Homo sapiens
tttgaaatgggcatttat

SEQ ID NO: 6562672 - DNA, 16 bp, Homo sapiens
tttgaaatgtgtttct

SEQ ID NO: 6562673 - DNA, 21 bp, Homo sapiens
tttgaaatgtttaataaagct

SEQ ID NO: 6562674 - DNA, 16 bp, Homo sapiens
tttgaaatgtttttga

SEQ ID NO: 6562675 - DNA, 17 bp, Homo sapiens
tttgaaattatgtaaat

SEQ ID NO: 6562676 - DNA, 22 bp, Homo sapiens
tttgaaattatgtgacatttta

SEQ ID NO: 6562677 - DNA, 22 bp, Homo sapiens
tttgaaattctgaatttgcaaa

SEQ ID NO: 6562678 - DNA, 21 bp, Homo sapiens
tttgaaattgtattacaaatc

SEQ ID NO: 6562679 - DNA, 22 bp, Homo sapiens
tttgaaatttaaaaatctttca

SEQ ID NO: 6562680 - DNA, 20 bp, Homo sapiens
tttgaacaaattttctggtg

SEQ ID NO: 6562681 - DNA, 15 bp, Homo sapiens
tttgaacaactcgaa

SEQ ID NO: 6562682 - DNA, 19 bp, Homo sapiens
tttgaacacgaaagaaatg

SEQ ID NO: 6562683 - DNA, 14 bp, Homo sapiens
tttgaacactggct

SEQ ID NO: 6562684 - DNA, 14 bp, Homo sapiens
tttgaacagggcaa

SEQ ID NO: 6562685 - DNA, 17 bp, Homo sapiens
tttgaaccaacatcttt

SEQ ID NO: 6562686 - DNA, 13 bp, Homo sapiens
tttgaaccaataa

SEQ ID NO: 6562687 - DNA, 23 bp, Homo sapiens
tttgaaccattccctagtcattt

SEQ ID NO: 6562688 - DNA, 13 bp, Homo sapiens
tttgaacgtgcca

SEQ ID NO: 6562689 - DNA, 22 bp, Homo sapiens
ttatatctgaggaattctgtat

SEQ ID NO: 6562690 - DNA, 16 bp, Homo sapiens
ttatatctggcctctg

SEQ ID NO: 6562691 - DNA, 14 bp, Homo sapiens
ttatatctgtaaat

SEQ ID NO: 6562692 - DNA, 15 bp, Homo sapiens
ttatatctgtaatga

SEQ ID NO: 6562693 - DNA, 22 bp, Homo sapiens
ttatatcttgtagctttatcaa

SEQ ID NO: 6562694 - DNA, 12 bp, Homo sapiens
ttatatctttat

SEQ ID NO: 6562695 - DNA, 22 bp, Homo sapiens
ttatatctttatgcaaaaacat

SEQ ID NO: 6562696 - DNA, 13 bp, Homo sapiens
ttatatgaaataa

SEQ ID NO: 6562697 - DNA, 13 bp, Homo sapiens
ttatatgaacata

SEQ ID NO: 6562698 - DNA, 17 bp, Homo sapiens
ttatatgaacatacaaa

SEQ ID NO: 6562699 - DNA, 21 bp, Homo sapiens
ttatatgaacatacaaatgca

SEQ ID NO: 6562700 - DNA, 15 bp, Homo sapiens
ttatatgaagaaaat

SEQ ID NO: 6562701 - DNA, 14 bp, Homo sapiens
ttatatgaagcaag

SEQ ID NO: 6562702 - DNA, 19 bp, Homo sapiens
ttatatgaagcaagctgtg

SEQ ID NO: 6562703 - DNA, 16 bp, Homo sapiens
ttatatgaagtttaaa

SEQ ID NO: 6562704 - DNA, 22 bp, Homo sapiens
ttatatgacaatcctgaagaaa

SEQ ID NO: 6562705 - DNA, 20 bp, Homo sapiens
ttatatgactaatataactt

SEQ ID NO: 6562706 - DNA, 18 bp, Homo sapiens
ttatatgagagaatcaca

SEQ ID NO: 6562707 - DNA, 16 bp, Homo sapiens
ttatatgatattcttt

SEQ ID NO: 6562708 - DNA, 21 bp, Homo sapiens
ttatatgattaaattatcatt

SEQ ID NO: 6562709 - DNA, 12 bp, Homo sapiens
ttatatgcatgc

SEQ ID NO: 6562710 - DNA, 20 bp, Homo sapiens
ttatatgccaagctaattta

SEQ ID NO: 6562711 - DNA, 13 bp, Homo sapiens
ttatatgcccatt

SEQ ID NO: 6562712 - DNA, 21 bp, Homo sapiens
ttatatgcccattcttttcac

SEQ ID NO: 6562713 - DNA, 16 bp, Homo sapiens
ttatatgctatttcta

SEQ ID NO: 6562714 - DNA, 22 bp, Homo sapiens
ttatatgcttcacatagcatgt

SEQ ID NO: 6562715 - DNA, 12 bp, Homo sapiens
ttatatgctttt

SEQ ID NO: 6562716 - DNA, 19 bp, Homo sapiens
ttatatgctttttctcaga

SEQ ID NO: 6562717 - DNA, 15 bp, Homo sapiens
ttatatggaaatata

SEQ ID NO: 6562718 - DNA, 20 bp, Homo sapiens
ttatatggaaatatatatta

SEQ ID NO: 6562719 - DNA, 18 bp, Homo sapiens
ttatatggcgttttgtct

SEQ ID NO: 6562720 - DNA, 19 bp, Homo sapiens
ttatatgtacatgagaagg

SEQ ID NO: 6562721 - DNA, 19 bp, Homo sapiens
ttatatgtaccctctgaaa

SEQ ID NO: 6562722 - DNA, 24 bp, Homo sapiens
ttatatgtaccctctgaaatacat

SEQ ID NO: 6562723 - DNA, 14 bp, Homo sapiens
ttatatgtaccgta

SEQ ID NO: 6562724 - DNA, 13 bp, Homo sapiens
ttatatgtatatt

SEQ ID NO: 6562725 - DNA, 23 bp, Homo sapiens
ttatatgtatccagtacatttaa

SEQ ID NO: 6562726 - DNA, 14 bp, Homo sapiens
ttatatgtatgtgt

SEQ ID NO: 6562727 - DNA, 15 bp, Homo sapiens
ttatatgtatgtgtt

SEQ ID NO: 6562728 - DNA, 16 bp, Homo sapiens
ttatatgtatgtgttt

SEQ ID NO: 6562729 - DNA, 21 bp, Homo sapiens
ttatatgtatgtgtttagaat

SEQ ID NO: 6562730 - DNA, 15 bp, Homo sapiens
ttatatgttgttctt

SEQ ID NO: 6562731 - DNA, 12 bp, Homo sapiens
ttatattaaaat

SEQ ID NO: 6562732 - DNA, 18 bp, Homo sapiens
ttatattaaaatatgaag

SEQ ID NO: 6562733 - DNA, 15 bp, Homo sapiens
ttatattactctcat

SEQ ID NO: 6562734 - DNA, 15 bp, Homo sapiens
ttatattacttttgt

SEQ ID NO: 6562735 - DNA, 22 bp, Homo sapiens
ttatattacttttgtaaatatt

SEQ ID NO: 6562736 - DNA, 18 bp, Homo sapiens
ttatattagagtgccctt

SEQ ID NO: 6562737 - DNA, 22 bp, Homo sapiens
ttatattagataaccatattca

SEQ ID NO: 6562738 - DNA, 16 bp, Homo sapiens
ttatattatgaataaa

SEQ ID NO: 6562739 - DNA, 16 bp, Homo sapiens
ttatattattccaaag

SEQ ID NO: 6562740 - DNA, 11 bp, Homo sapiens
ttatattcaac

SEQ ID NO: 6562741 - DNA, 16 bp, Homo sapiens
ttatattcaaccatgg

SEQ ID NO: 6562742 - DNA, 12 bp, Homo sapiens
ttatattcatca

SEQ ID NO: 6562743 - DNA, 13 bp, Homo sapiens
ttatattccaagg

SEQ ID NO: 6562744 - DNA, 16 bp, Homo sapiens
ttatattccaaggaaa

SEQ ID NO: 6562745 - DNA, 21 bp, Homo sapiens
ttatattccaaggaaaattga

SEQ ID NO: 6562746 - DNA, 13 bp, Homo sapiens
ttatattctaata

SEQ ID NO: 6562747 - DNA, 14 bp, Homo sapiens
ttatattctaatta

SEQ ID NO: 6562748 - DNA, 21 bp, Homo sapiens
ttatattctaattaaaattgt

SEQ ID NO: 6562749 - DNA, 18 bp, Homo sapiens
ttatattctcagcagagt

SEQ ID NO: 6562750 - DNA, 19 bp, Homo sapiens
ttatattctcagcagagtg

SEQ ID NO: 6562751 - DNA, 16 bp, Homo sapiens
ttatattctgcagaaa

SEQ ID NO: 6562752 - DNA, 12 bp, Homo sapiens
ttatattctgtt

SEQ ID NO: 6562753 - DNA, 15 bp, Homo sapiens
ttatattctgtttat

SEQ ID NO: 6562754 - DNA, 19 bp, Homo sapiens
ttatattctgtttattatg

SEQ ID NO: 6562755 - DNA, 10 bp, Homo sapiens
ttatattctt

SEQ ID NO: 6562756 - DNA, 15 bp, Homo sapiens
ttatattcttatgtt

SEQ ID NO: 6562757 - DNA, 14 bp, Homo sapiens
ttatattgaaaaaa

SEQ ID NO: 6562758 - DNA, 17 bp, Homo sapiens
ttatattgaatatatca

SEQ ID NO: 6562759 - DNA, 19 bp, Homo sapiens
ttatattgacaacaaatca

SEQ ID NO: 6562760 - DNA, 15 bp, Homo sapiens
ttatattgagacaaa

SEQ ID NO: 6562761 - DNA, 18 bp, Homo sapiens
ttatattgcagattgaat

SEQ ID NO: 6562762 - DNA, 20 bp, Homo sapiens
ttatattgcagattgaatat

SEQ ID NO: 6562763 - DNA, 21 bp, Homo sapiens
ttatattggtttgcacaagtt

SEQ ID NO: 6562764 - DNA, 16 bp, Homo sapiens
ttatattgtatattct

SEQ ID NO: 6562765 - DNA, 18 bp, Homo sapiens
ttatatttaaaaaattat

SEQ ID NO: 6562766 - DNA, 14 bp, Homo sapiens
ttatatttacaata

SEQ ID NO: 6562767 - DNA, 22 bp, Homo sapiens
ttatatttacctttttgcttat

SEQ ID NO: 6562768 - DNA, 15 bp, Homo sapiens
ttatatttagtaact

SEQ ID NO: 6562769 - DNA, 18 bp, Homo sapiens
ttatatttagttatagtt

SEQ ID NO: 6562770 - DNA, 20 bp, Homo sapiens
ttatatttattactgtaaga

SEQ ID NO: 6562771 - DNA, 20 bp, Homo sapiens
ttatatttattgactcttga

SEQ ID NO: 6562772 - DNA, 19 bp, Homo sapiens
ttatatttcaagtacactg

SEQ ID NO: 6562773 - DNA, 18 bp, Homo sapiens
ttatatttcacaggctgt

SEQ ID NO: 6562774 - DNA, 20 bp, Homo sapiens
ttatatttcacaggctgtaa

SEQ ID NO: 6562775 - DNA, 15 bp, Homo sapiens
ttatatttcagatgt

SEQ ID NO: 6562776 - DNA, 21 bp, Homo sapiens
ttatatttcagatgtaatgtt

SEQ ID NO: 6562777 - DNA, 16 bp, Homo sapiens
ttatatttcctgtatt

SEQ ID NO: 6562778 - DNA, 12 bp, Homo sapiens
ttatatttcctt

SEQ ID NO: 6562779 - DNA, 20 bp, Homo sapiens
ttatatttcctttatgtgaa

SEQ ID NO: 6562780 - DNA, 17 bp, Homo sapiens
ttatatttctacagaga

SEQ ID NO: 6562781 - DNA, 16 bp, Homo sapiens
ttatatttgaaaaaat

SEQ ID NO: 6562782 - DNA, 15 bp, Homo sapiens
ttatatttgaaatat

SEQ ID NO: 6562783 - DNA, 21 bp, Homo sapiens
ttatatttgacttgaaaagaa

SEQ ID NO: 6562784 - DNA, 17 bp, Homo sapiens
ttatatttgagtttctt

SEQ ID NO: 6562785 - DNA, 14 bp, Homo sapiens
ttatatttgcatta

SEQ ID NO: 6562786 - DNA, 22 bp, Homo sapiens
ttatatttgcattatgtattta

SEQ ID NO: 6562787 - DNA, 14 bp, Homo sapiens
ttatatttggaaag

SEQ ID NO: 6562788 - DNA, 18 bp, Homo sapiens
ttatatttgtgctatagt

SEQ ID NO: 6562789 - DNA, 14 bp, Homo sapiens
ttatatttgtgtat

SEQ ID NO: 6562790 - DNA, 18 bp, Homo sapiens
ttatattttagaaataat

SEQ ID NO: 6562791 - DNA, 14 bp, Homo sapiens
ttatattttatact

SEQ ID NO: 6562792 - DNA, 14 bp, Homo sapiens
ttatattttatcaa

SEQ ID NO: 6562793 - DNA, 16 bp, Homo sapiens
ttatattttatgaaca

SEQ ID NO: 6562794 - DNA, 21 bp, Homo sapiens
ttatattttatgaacattgta

SEQ ID NO: 6562795 - DNA, 11 bp, Homo sapiens
ttatattttca

SEQ ID NO: 6562796 - DNA, 14 bp, Homo sapiens
ttatattttctatt

SEQ ID NO: 6562797 - DNA, 17 bp, Homo sapiens
ttatattttgaaagaag

SEQ ID NO: 6562798 - DNA, 18 bp, Homo sapiens
ttatattttgaaagaagc

SEQ ID NO: 6562799 - DNA, 15 bp, Homo sapiens
ttatattttgaacaa

SEQ ID NO: 6562800 - DNA, 15 bp, Homo sapiens
ttatattttgcagtt

SEQ ID NO: 6562801 - DNA, 16 bp, Homo sapiens
ttatattttgctgttt

SEQ ID NO: 6562802 - DNA, 17 bp, Homo sapiens
ttatattttgctgttta

SEQ ID NO: 6562803 - DNA, 13 bp, Homo sapiens
ttatatttttaaa

SEQ ID NO: 6562804 - DNA, 15 bp, Homo sapiens
ttatatttttataga

SEQ ID NO: 6562805 - DNA, 21 bp, Homo sapiens
ttatatttttcttaaaaagta

SEQ ID NO: 6562806 - DNA, 23 bp, Homo sapiens
ttatatttttgtgttttcttgta

SEQ ID NO: 6562807 - DNA, 18 bp, Homo sapiens
ttatattttttctataaa

SEQ ID NO: 6562808 - DNA, 20 bp, Homo sapiens
ttatatttttttaactgtga

SEQ ID NO: 6562809 - DNA, 12 bp, Homo sapiens
ttatcaaaaaac

SEQ ID NO: 6562810 - DNA, 13 bp, Homo sapiens
ttatcaaaaaaca

SEQ ID NO: 6562811 - DNA, 16 bp, Homo sapiens
ttatcaaaaaacagaa

SEQ ID NO: 6562812 - DNA, 16 bp, Homo sapiens
ttatcaaaactttctt

SEQ ID NO: 6562813 - DNA, 23 bp, Homo sapiens
ttatcaaaatagtctaaggccat

SEQ ID NO: 6562814 - DNA, 22 bp, Homo sapiens
ttatcaagcagagacctttgtt

SEQ ID NO: 6562815 - DNA, 13 bp, Homo sapiens
ttatcaagctaat

SEQ ID NO: 6562816 - DNA, 14 bp, Homo sapiens
ttatcaagtgtctt

SEQ ID NO: 6562817 - DNA, 23 bp, Homo sapiens
ttatcaatgtgtctttctaagaa

SEQ ID NO: 6562818 - DNA, 14 bp, Homo sapiens
ttatcaattatatt

SEQ ID NO: 6562819 - DNA, 20 bp, Homo sapiens
ttatcaattatattatgttt

SEQ ID NO: 6562820 - DNA, 15 bp, Homo sapiens
ttatcaatttgtcat

SEQ ID NO: 6562821 - DNA, 20 bp, Homo sapiens
ttatcaatttgtcattttga

SEQ ID NO: 6562822 - DNA, 23 bp, Homo sapiens
ttatcaatttgtcattttgaagc

SEQ ID NO: 6562823 - DNA, 21 bp, Homo sapiens
ttatcaatttttcccagtatt

SEQ ID NO: 6562824 - DNA, 19 bp, Homo sapiens
ttatcacacaaagcagaat

SEQ ID NO: 6562825 - DNA, 16 bp, Homo sapiens
ttatcacacttgcaaa

SEQ ID NO: 6562826 - DNA, 16 bp, Homo sapiens
ttatcacagaaataaa

SEQ ID NO: 6562827 - DNA, 12 bp, Homo sapiens
ttatcacatcaa

SEQ ID NO: 6562828 - DNA, 17 bp, Homo sapiens
ttatcacatgtatgttt

SEQ ID NO: 6562829 - DNA, 19 bp, Homo sapiens
ttatcacatgtatgttttg

SEQ ID NO: 6562830 - DNA, 17 bp, Homo sapiens
ttatcaccagctgcctc

SEQ ID NO: 6562831 - DNA, 21 bp, Homo sapiens
ttatcaccagctgcctcttct

SEQ ID NO: 6562832 - DNA, 22 bp, Homo sapiens
ttatcaccctaattaatagaat

SEQ ID NO: 6562833 - DNA, 22 bp, Homo sapiens
ttatcacctaagcacttctaga

SEQ ID NO: 6562834 - DNA, 23 bp, Homo sapiens
ttatcacctaagcacttctagaa

SEQ ID NO: 6562835 - DNA, 19 bp, Homo sapiens
ttatcacctagctgaatgt

SEQ ID NO: 6562836 - DNA, 12 bp, Homo sapiens
ttatcacctcat

SEQ ID NO: 6562837 - DNA, 15 bp, Homo sapiens
ttatcaccttccaaa

SEQ ID NO: 6562838 - DNA, 16 bp, Homo sapiens
ttatcactaagaaaga

SEQ ID NO: 6562839 - DNA, 17 bp, Homo sapiens
ttatcactaagaaagaa

SEQ ID NO: 6562840 - DNA, 14 bp, Homo sapiens
ttatcactgaaaaa

SEQ ID NO: 6562841 - DNA, 16 bp, Homo sapiens
ttatcactgaaaaaat

SEQ ID NO: 6562842 - DNA, 16 bp, Homo sapiens
ttatcactttttgaac

SEQ ID NO: 6562843 - DNA, 22 bp, Homo sapiens
ttatcactttttgaactaagaa

SEQ ID NO: 6562844 - DNA, 20 bp, Homo sapiens
ttatcagaactcctttctaa

SEQ ID NO: 6562845 - DNA, 19 bp, Homo sapiens
ttatcagaagcaaggaagt

SEQ ID NO: 6562846 - DNA, 22 bp, Homo sapiens
ttatcagaatcaaatctgagcc

SEQ ID NO: 6562847 - DNA, 16 bp, Homo sapiens
ttatcagacaagatga

SEQ ID NO: 6562848 - DNA, 22 bp, Homo sapiens
ttatcagagtaacgagaagaca

SEQ ID NO: 6562849 - DNA, 20 bp, Homo sapiens
ttatcagatacatcactgct

SEQ ID NO: 6562850 - DNA, 15 bp, Homo sapiens
ttatcagcagcaaca

SEQ ID NO: 6562851 - DNA, 14 bp, Homo sapiens
ttatcagccatgtt

SEQ ID NO: 6562852 - DNA, 17 bp, Homo sapiens
ttatcagctctatgtca

SEQ ID NO: 6562853 - DNA, 19 bp, Homo sapiens
ttatcaggctttccttgtt

SEQ ID NO: 6562854 - DNA, 19 bp, Homo sapiens
ttatcagggaacttagtaa

SEQ ID NO: 6562855 - DNA, 17 bp, Homo sapiens
ttatcaggggaatttca

SEQ ID NO: 6562856 - DNA, 15 bp, Homo sapiens
ttatcagtagaaaga

SEQ ID NO: 6562857 - DNA, 15 bp, Homo sapiens
ttatcagtcaatatt

SEQ ID NO: 6562858 - DNA, 23 bp, Homo sapiens
ttatcagtcataactaaataaag

SEQ ID NO: 6562859 - DNA, 16 bp, Homo sapiens
ttatcagtgacagagt

SEQ ID NO: 6562860 - DNA, 15 bp, Homo sapiens
ttatcagtgtgcaat

SEQ ID NO: 6562861 - DNA, 13 bp, Homo sapiens
ttatcagttatat

SEQ ID NO: 6562862 - DNA, 16 bp, Homo sapiens
ttatcatactgagact

SEQ ID NO: 6562863 - DNA, 13 bp, Homo sapiens
ttatcatatatgc

SEQ ID NO: 6562864 - DNA, 16 bp, Homo sapiens
ttatcatccacattgt

SEQ ID NO: 6562865 - DNA, 18 bp, Homo sapiens
ttatcatccacattgttt

SEQ ID NO: 6562866 - DNA, 16 bp, Homo sapiens
ttatcatcctataaag

SEQ ID NO: 6562867 - DNA, 18 bp, Homo sapiens
ttatcatcctttcagttt

SEQ ID NO: 6562868 - DNA, 18 bp, Homo sapiens
ttatcatcggagttgaca

SEQ ID NO: 6562869 - DNA, 16 bp, Homo sapiens
tttgaacgtgcttctt

SEQ ID NO: 6562870 - DNA, 20 bp, Homo sapiens
tttgaacgtgcttctttgta

SEQ ID NO: 6562871 - DNA, 15 bp, Homo sapiens
tttgaactaagaaac

SEQ ID NO: 6562872 - DNA, 19 bp, Homo sapiens
tttgaactaagaaactttt

SEQ ID NO: 6562873 - DNA, 21 bp, Homo sapiens
tttgaactcagatctgtctga

SEQ ID NO: 6562874 - DNA, 14 bp, Homo sapiens
tttgaactcttcaa

SEQ ID NO: 6562875 - DNA, 17 bp, Homo sapiens
tttgaactgaaactttt

SEQ ID NO: 6562876 - DNA, 14 bp, Homo sapiens
tttgaactgagccg

SEQ ID NO: 6562877 - DNA, 17 bp, Homo sapiens
tttgaactggcaattgt

SEQ ID NO: 6562878 - DNA, 20 bp, Homo sapiens
tttgaactgttagatgctga

SEQ ID NO: 6562879 - DNA, 21 bp, Homo sapiens
tttgaacttggtagttcataa

SEQ ID NO: 6562880 - DNA, 16 bp, Homo sapiens
tttgaactttagtttg

SEQ ID NO: 6562881 - DNA, 13 bp, Homo sapiens
tttgaagaaaaca

SEQ ID NO: 6562882 - DNA, 20 bp, Homo sapiens
tttgaagaaaagaaaaaaca

SEQ ID NO: 6562883 - DNA, 21 bp, Homo sapiens
tttgaagaagggaaattcaca

SEQ ID NO: 6562884 - DNA, 19 bp, Homo sapiens
tttgaagaatgaacaaatt

SEQ ID NO: 6562885 - DNA, 19 bp, Homo sapiens
tttgaagaccaatcaaata

SEQ ID NO: 6562886 - DNA, 18 bp, Homo sapiens
tttgaagagtgaaatacc

SEQ ID NO: 6562887 - DNA, 18 bp, Homo sapiens
tttgaagatttaattact

SEQ ID NO: 6562888 - DNA, 16 bp, Homo sapiens
tttgaagcagctctgc

SEQ ID NO: 6562889 - DNA, 16 bp, Homo sapiens
tttgaagcagttgtgt

SEQ ID NO: 6562890 - DNA, 21 bp, Homo sapiens
tttgaaggaatacaatatata

SEQ ID NO: 6562891 - DNA, 13 bp, Homo sapiens
tttgaaggctgga

SEQ ID NO: 6562892 - DNA, 23 bp, Homo sapiens
tttgaagggagaagacactgcag

SEQ ID NO: 6562893 - DNA, 19 bp, Homo sapiens
tttgaagtaaattaaacat

SEQ ID NO: 6562894 - DNA, 17 bp, Homo sapiens
tttgaagtaacttattt

SEQ ID NO: 6562895 - DNA, 22 bp, Homo sapiens
tttgaagtaggtggcttgagct

SEQ ID NO: 6562896 - DNA, 13 bp, Homo sapiens
tttgaagtattta

SEQ ID NO: 6562897 - DNA, 15 bp, Homo sapiens
tttgaagtcttgtat

SEQ ID NO: 6562898 - DNA, 16 bp, Homo sapiens
tttgaagtcttgtata

SEQ ID NO: 6562899 - DNA, 16 bp, Homo sapiens
tttgaagtgctgttta

SEQ ID NO: 6562900 - DNA, 13 bp, Homo sapiens
tttgaagtgtaat

SEQ ID NO: 6562901 - DNA, 22 bp, Homo sapiens
tttgaagttatttagaaatatc

SEQ ID NO: 6562902 - DNA, 13 bp, Homo sapiens
tttgaagttctgg

SEQ ID NO: 6562903 - DNA, 13 bp, Homo sapiens
tttgaagtttaca

SEQ ID NO: 6562904 - DNA, 16 bp, Homo sapiens
tttgaagtttacattt

SEQ ID NO: 6562905 - DNA, 17 bp, Homo sapiens
tttgaagtttacatttt

SEQ ID NO: 6562906 - DNA, 10 bp, Homo sapiens
tttgaataaa

SEQ ID NO: 6562907 - DNA, 20 bp, Homo sapiens
tttgaataaaaaacatttgt

SEQ ID NO: 6562908 - DNA, 17 bp, Homo sapiens
tttgaataaaaagtgaa

SEQ ID NO: 6562909 - DNA, 23 bp, Homo sapiens
tttgaataaaaagtgaacttttg

SEQ ID NO: 6562910 - DNA, 16 bp, Homo sapiens
tttgaataaagtctga

SEQ ID NO: 6562911 - DNA, 20 bp, Homo sapiens
tttgaataaatgtcactttt

SEQ ID NO: 6562912 - DNA, 14 bp, Homo sapiens
tttgaataatgtct

SEQ ID NO: 6562913 - DNA, 20 bp, Homo sapiens
tttgaataatgtctagattt

SEQ ID NO: 6562914 - DNA, 21 bp, Homo sapiens
tttgaataatgtctagatttt

SEQ ID NO: 6562915 - DNA, 23 bp, Homo sapiens
tttgaataccattaaaactgctt

SEQ ID NO: 6562916 - DNA, 17 bp, Homo sapiens
tttgaatataaacacta

SEQ ID NO: 6562917 - DNA, 13 bp, Homo sapiens
tttgaatatgaaa

SEQ ID NO: 6562918 - DNA, 14 bp, Homo sapiens
tttgaatattaacg

SEQ ID NO: 6562919 - DNA, 21 bp, Homo sapiens
tttgaatatttgttttaatac

SEQ ID NO: 6562920 - DNA, 19 bp, Homo sapiens
tttgaatctcataatttat

SEQ ID NO: 6562921 - DNA, 12 bp, Homo sapiens
tttgaatcttgt

SEQ ID NO: 6562922 - DNA, 18 bp, Homo sapiens
tttgaatcttgtctcaat

SEQ ID NO: 6562923 - DNA, 21 bp, Homo sapiens
tttgaatcttgtctcaatgct

SEQ ID NO: 6562924 - DNA, 12 bp, Homo sapiens
tttgaatgaaaa

SEQ ID NO: 6562925 - DNA, 13 bp, Homo sapiens
tttgaatgaaaaa

SEQ ID NO: 6562926 - DNA, 14 bp, Homo sapiens
tttgaatgaaaaat

SEQ ID NO: 6562927 - DNA, 13 bp, Homo sapiens
tttgaatgcagaa

SEQ ID NO: 6562928 - DNA, 16 bp, Homo sapiens
tttgaatgcattttgt

SEQ ID NO: 6562929 - DNA, 22 bp, Homo sapiens
tttgaatgctaagaatgcatta

SEQ ID NO: 6562930 - DNA, 17 bp, Homo sapiens
tttgaatggtgcagaaa

SEQ ID NO: 6562931 - DNA, 17 bp, Homo sapiens
tttgaatgtatgcttca

SEQ ID NO: 6562932 - DNA, 14 bp, Homo sapiens
tttgaatgtggata

SEQ ID NO: 6562933 - DNA, 16 bp, Homo sapiens
tttgaatgttaatttt

SEQ ID NO: 6562934 - DNA, 17 bp, Homo sapiens
tttgaatgtttatgttc

SEQ ID NO: 6562935 - DNA, 19 bp, Homo sapiens
tttgaattaaaacttctta

SEQ ID NO: 6562936 - DNA, 21 bp, Homo sapiens
tttgaattaatctagaaaatg

SEQ ID NO: 6562937 - DNA, 22 bp, Homo sapiens
tttgaattacagggaagaaatc

SEQ ID NO: 6562938 - DNA, 20 bp, Homo sapiens
tttgaattagattatttctg

SEQ ID NO: 6562939 - DNA, 16 bp, Homo sapiens
tttgaattatgtgcac

SEQ ID NO: 6562940 - DNA, 14 bp, Homo sapiens
tttgaattcagtaa

SEQ ID NO: 6562941 - DNA, 15 bp, Homo sapiens
tttgaattggcctga

SEQ ID NO: 6562942 - DNA, 22 bp, Homo sapiens
tttgaattgtgtggagaagtgt

SEQ ID NO: 6562943 - DNA, 18 bp, Homo sapiens
tttgaattgttttcttta

SEQ ID NO: 6562944 - DNA, 15 bp, Homo sapiens
tttgaatttatataa

SEQ ID NO: 6562945 - DNA, 11 bp, Homo sapiens
tttgaatttct

SEQ ID NO: 6562946 - DNA, 16 bp, Homo sapiens
tttgaattttctgtgt

SEQ ID NO: 6562947 - DNA, 14 bp, Homo sapiens
tttgaattttgttt

SEQ ID NO: 6562948 - DNA, 15 bp, Homo sapiens
tttgaattttgtttt

SEQ ID NO: 6562949 - DNA, 14 bp, Homo sapiens
tttgacaaaaatgt

SEQ ID NO: 6562950 - DNA, 23 bp, Homo sapiens
tttgacaaaaatgtttgtacttt

SEQ ID NO: 6562951 - DNA, 17 bp, Homo sapiens
tttgacaaaagtaaatg

SEQ ID NO: 6562952 - DNA, 20 bp, Homo sapiens
tttgacaaaatgactggctc

SEQ ID NO: 6562953 - DNA, 22 bp, Homo sapiens
tttgacaaaatgactggctcct

SEQ ID NO: 6562954 - DNA, 14 bp, Homo sapiens
tttgacaaagtgcc

SEQ ID NO: 6562955 - DNA, 17 bp, Homo sapiens
tttgacaaagtgcctca

SEQ ID NO: 6562956 - DNA, 17 bp, Homo sapiens
tttgacaactaaaatta

SEQ ID NO: 6562957 - DNA, 13 bp, Homo sapiens
tttgacaattact

SEQ ID NO: 6562958 - DNA, 14 bp, Homo sapiens
tttgacaattttgt

SEQ ID NO: 6562959 - DNA, 17 bp, Homo sapiens
tttgacaattttgtctt

SEQ ID NO: 6562960 - DNA, 23 bp, Homo sapiens
tttgacacaatgttgcactgaaa

SEQ ID NO: 6562961 - DNA, 20 bp, Homo sapiens
tttgacacctcttttttcgt

SEQ ID NO: 6562962 - DNA, 17 bp, Homo sapiens
tttgacactatatctgt

SEQ ID NO: 6562963 - DNA, 18 bp, Homo sapiens
tttgacactctgcagact

SEQ ID NO: 6562964 - DNA, 17 bp, Homo sapiens
tttgacactgaaagttt

SEQ ID NO: 6562965 - DNA, 18 bp, Homo sapiens
tttgacactgaaagtttt

SEQ ID NO: 6562966 - DNA, 15 bp, Homo sapiens
tttgacactgctcta

SEQ ID NO: 6562967 - DNA, 22 bp, Homo sapiens
tttgacacttccattgtttaaa

SEQ ID NO: 6562968 - DNA, 14 bp, Homo sapiens
tttgacacttccca

SEQ ID NO: 6562969 - DNA, 18 bp, Homo sapiens
tttgacagaatatgtttc

SEQ ID NO: 6562970 - DNA, 19 bp, Homo sapiens
tttgacagaatatgtttca

SEQ ID NO: 6562971 - DNA, 20 bp, Homo sapiens
tttgacagaatatgtttcaa

SEQ ID NO: 6562972 - DNA, 13 bp, Homo sapiens
tttgacagccttc

SEQ ID NO: 6562973 - DNA, 19 bp, Homo sapiens
tttgacagcgcacagctgc

SEQ ID NO: 6562974 - DNA, 18 bp, Homo sapiens
tttgacagtgttgaaaat

SEQ ID NO: 6562975 - DNA, 16 bp, Homo sapiens
tttgacataagatggt

SEQ ID NO: 6562976 - DNA, 19 bp, Homo sapiens
tttgacatcagccagctgc

SEQ ID NO: 6562977 - DNA, 17 bp, Homo sapiens
tttgacatgggtatttt

SEQ ID NO: 6562978 - DNA, 17 bp, Homo sapiens
tttgacatgtggaaagt

SEQ ID NO: 6562979 - DNA, 18 bp, Homo sapiens
tttgacattcttcactgt

SEQ ID NO: 6562980 - DNA, 13 bp, Homo sapiens
tttgacattgtca

SEQ ID NO: 6562981 - DNA, 20 bp, Homo sapiens
tttgacattgtcagaatgtt

SEQ ID NO: 6562982 - DNA, 19 bp, Homo sapiens
tttgacatttaataacttt

SEQ ID NO: 6562983 - DNA, 14 bp, Homo sapiens
tttgacatttcctt

SEQ ID NO: 6562984 - DNA, 20 bp, Homo sapiens
tttgacatttccttctttgt

SEQ ID NO: 6562985 - DNA, 15 bp, Homo sapiens
tttgaccaatttgca

SEQ ID NO: 6562986 - DNA, 14 bp, Homo sapiens
tttgaccagaaaat

SEQ ID NO: 6562987 - DNA, 20 bp, Homo sapiens
tttgaccagaactttttcct

SEQ ID NO: 6562988 - DNA, 21 bp, Homo sapiens
tttgaccagaactttttcctc

SEQ ID NO: 6562989 - DNA, 22 bp, Homo sapiens
tttgaccagaactttttcctct

SEQ ID NO: 6562990 - DNA, 23 bp, Homo sapiens
tttgaccagaactttttcctctc

SEQ ID NO: 6562991 - DNA, 20 bp, Homo sapiens
tttgaccagtttaagccgca

SEQ ID NO: 6562992 - DNA, 21 bp, Homo sapiens
tttgaccagtttaagccgcag

SEQ ID NO: 6562993 - DNA, 22 bp, Homo sapiens
tttgacccactcacacttggag

SEQ ID NO: 6562994 - DNA, 16 bp, Homo sapiens
tttgaccccgatatat

SEQ ID NO: 6562995 - DNA, 10 bp, Homo sapiens
tttgacctcc

SEQ ID NO: 6562996 - DNA, 12 bp, Homo sapiens
tttgacctctgc

SEQ ID NO: 6562997 - DNA, 18 bp, Homo sapiens
tttgacctctgcagcaat

SEQ ID NO: 6562998 - DNA, 19 bp, Homo sapiens
tttgacctctgcagcaata

SEQ ID NO: 6562999 - DNA, 13 bp, Homo sapiens
tttgaccttgtat

SEQ ID NO: 6563000 - DNA, 14 bp, Homo sapiens
tttgaccttgtatt

SEQ ID NO: 6563001 - DNA, 21 bp, Homo sapiens
tttgacctttgtcttctataa

SEQ ID NO: 6563002 - DNA, 19 bp, Homo sapiens
tttgaccttttatgtagta

SEQ ID NO: 6563003 - DNA, 14 bp, Homo sapiens
tttgacgaagaaac

SEQ ID NO: 6563004 - DNA, 18 bp, Homo sapiens
tttgacgggaggcctcag

SEQ ID NO: 6563005 - DNA, 18 bp, Homo sapiens
tttgacgggccaggccct

SEQ ID NO: 6563006 - DNA, 14 bp, Homo sapiens
tttgactaatttta

SEQ ID NO: 6563007 - DNA, 17 bp, Homo sapiens
tttgactaattttacat

SEQ ID NO: 6563008 - DNA, 21 bp, Homo sapiens
tttgactaattttacatgttt

SEQ ID NO: 6563009 - DNA, 15 bp, Homo sapiens
tttgactatgaatgt

SEQ ID NO: 6563010 - DNA, 22 bp, Homo sapiens
tttgactcagaggctgggagca

SEQ ID NO: 6563011 - DNA, 17 bp, Homo sapiens
tttgactcttccgtgca

SEQ ID NO: 6563012 - DNA, 13 bp, Homo sapiens
tttgactctttca

SEQ ID NO: 6563013 - DNA, 20 bp, Homo sapiens
tttgactctttcaaagaaat

SEQ ID NO: 6563014 - DNA, 15 bp, Homo sapiens
tttgactggatattc

SEQ ID NO: 6563015 - DNA, 14 bp, Homo sapiens
tttgacttaatgtg

SEQ ID NO: 6563016 - DNA, 19 bp, Homo sapiens
tttgacttattgtccccac

SEQ ID NO: 6563017 - DNA, 13 bp, Homo sapiens
tttgactttaatt

SEQ ID NO: 6563018 - DNA, 14 bp, Homo sapiens
tttgactttcattg

SEQ ID NO: 6563019 - DNA, 21 bp, Homo sapiens
tttgactttttggaattcagc

SEQ ID NO: 6563020 - DNA, 22 bp, Homo sapiens
tttgactttttttgtatgtgtg

SEQ ID NO: 6563021 - DNA, 10 bp, Homo sapiens
tttgagaaaa

SEQ ID NO: 6563022 - DNA, 20 bp, Homo sapiens
tttgagaaaaaggaaaaaaa

SEQ ID NO: 6563023 - DNA, 14 bp, Homo sapiens
tttgagaaaatata

SEQ ID NO: 6563024 - DNA, 16 bp, Homo sapiens
tttgagaaattaagta

SEQ ID NO: 6563025 - DNA, 22 bp, Homo sapiens
tttgagaaccccctaacctcta

SEQ ID NO: 6563026 - DNA, 18 bp, Homo sapiens
tttgagaacgtaaagaac

SEQ ID NO: 6563027 - DNA, 14 bp, Homo sapiens
tttgagaactgtca

SEQ ID NO: 6563028 - DNA, 18 bp, Homo sapiens
tttgagaagataatcatt

SEQ ID NO: 6563029 - DNA, 12 bp, Homo sapiens
tttgagaagttc

SEQ ID NO: 6563030 - DNA, 23 bp, Homo sapiens
tttgagaatatgatcatgtaaat

SEQ ID NO: 6563031 - DNA, 14 bp, Homo sapiens
tttgagaattattc

SEQ ID NO: 6563032 - DNA, 15 bp, Homo sapiens
tttgagacaagccct

SEQ ID NO: 6563033 - DNA, 19 bp, Homo sapiens
tttgagacaagccctggca

SEQ ID NO: 6563034 - DNA, 13 bp, Homo sapiens
tttgagacagagt

SEQ ID NO: 6563035 - DNA, 15 bp, Homo sapiens
tttgagacagggtct

SEQ ID NO: 6563036 - DNA, 20 bp, Homo sapiens
tttgagacagtttcttagct

SEQ ID NO: 6563037 - DNA, 19 bp, Homo sapiens
tttgagaccaacctgggta

SEQ ID NO: 6563038 - DNA, 23 bp, Homo sapiens
tttgagacgcaccatgtgggcac

SEQ ID NO: 6563039 - DNA, 14 bp, Homo sapiens
tttgagactgaaat

SEQ ID NO: 6563040 - DNA, 21 bp, Homo sapiens
tttgagagaaatatgaagaac

SEQ ID NO: 6563041 - DNA, 22 bp, Homo sapiens
tttgagagacgccactccctgg

SEQ ID NO: 6563042 - DNA, 23 bp, Homo sapiens
tttgagagagagaacctttccac

SEQ ID NO: 6563043 - DNA, 23 bp, Homo sapiens
tttgagagagggggcactgtggt

SEQ ID NO: 6563044 - DNA, 10 bp, Homo sapiens
tttgagagca

SEQ ID NO: 6563045 - DNA, 16 bp, Homo sapiens
tttgagagttctaaat

SEQ ID NO: 6563046 - DNA, 14 bp, Homo sapiens
tttgagatctaaaa

SEQ ID NO: 6563047 - DNA, 16 bp, Homo sapiens
tttgagatctaaaaat

SEQ ID NO: 6563048 - DNA, 13 bp, Homo sapiens
ttatcatgaagcc

SEQ ID NO: 6563049 - DNA, 19 bp, Homo sapiens
ttatcatgacatgttatat

SEQ ID NO: 6563050 - DNA, 11 bp, Homo sapiens
ttatcatgcaa

SEQ ID NO: 6563051 - DNA, 16 bp, Homo sapiens
ttatcatgcaaatgct

SEQ ID NO: 6563052 - DNA, 16 bp, Homo sapiens
ttatcatggaagaaaa

SEQ ID NO: 6563053 - DNA, 22 bp, Homo sapiens
ttatcatggaatttaatgctga

SEQ ID NO: 6563054 - DNA, 19 bp, Homo sapiens
ttatcatggtctcagtcat

SEQ ID NO: 6563055 - DNA, 16 bp, Homo sapiens
ttatcatgtctatttt

SEQ ID NO: 6563056 - DNA, 22 bp, Homo sapiens
ttatcatgtggcttttaattga

SEQ ID NO: 6563057 - DNA, 13 bp, Homo sapiens
ttatcatgtgtaa

SEQ ID NO: 6563058 - DNA, 18 bp, Homo sapiens
ttatcatgttagtaatac

SEQ ID NO: 6563059 - DNA, 22 bp, Homo sapiens
ttatcatgttagtaatacctct

SEQ ID NO: 6563060 - DNA, 20 bp, Homo sapiens
ttatcattaatttttaattg

SEQ ID NO: 6563061 - DNA, 19 bp, Homo sapiens
ttatcattcattcttagct

SEQ ID NO: 6563062 - DNA, 20 bp, Homo sapiens
ttatcattgaaacatttata

SEQ ID NO: 6563063 - DNA, 19 bp, Homo sapiens
ttatcattgctcccctgat

SEQ ID NO: 6563064 - DNA, 12 bp, Homo sapiens
ttatcattgttt

SEQ ID NO: 6563065 - DNA, 15 bp, Homo sapiens
ttatcatttaagatt

SEQ ID NO: 6563066 - DNA, 11 bp, Homo sapiens
ttatcatttct

SEQ ID NO: 6563067 - DNA, 20 bp, Homo sapiens
ttatcatttctactgaagtt

SEQ ID NO: 6563068 - DNA, 22 bp, Homo sapiens
ttatccaaaagtggaagtgaca

SEQ ID NO: 6563069 - DNA, 15 bp, Homo sapiens
ttatccaaaatgtgt

SEQ ID NO: 6563070 - DNA, 16 bp, Homo sapiens
ttatccaaaatgtgta

SEQ ID NO: 6563071 - DNA, 17 bp, Homo sapiens
ttatccaaaatgtgtat

SEQ ID NO: 6563072 - DNA, 14 bp, Homo sapiens
ttatccaaatcttg

SEQ ID NO: 6563073 - DNA, 14 bp, Homo sapiens
ttatccaatcctca

SEQ ID NO: 6563074 - DNA, 17 bp, Homo sapiens
ttatccaatcttgtttc

SEQ ID NO: 6563075 - DNA, 16 bp, Homo sapiens
ttatccacaaagtact

SEQ ID NO: 6563076 - DNA, 22 bp, Homo sapiens
ttatccactacaggttttatga

SEQ ID NO: 6563077 - DNA, 18 bp, Homo sapiens
ttatccagaaaactgtga

SEQ ID NO: 6563078 - DNA, 14 bp, Homo sapiens
ttatccagaagtat

SEQ ID NO: 6563079 - DNA, 15 bp, Homo sapiens
ttatccagaagtatt

SEQ ID NO: 6563080 - DNA, 18 bp, Homo sapiens
ttatccaggggcttcacc

SEQ ID NO: 6563081 - DNA, 12 bp, Homo sapiens
ttatccataatg

SEQ ID NO: 6563082 - DNA, 17 bp, Homo sapiens
ttatccataatgatgga

SEQ ID NO: 6563083 - DNA, 22 bp, Homo sapiens
ttatccattacgtgcatttaaa

SEQ ID NO: 6563084 - DNA, 14 bp, Homo sapiens
ttatccattcccaa

SEQ ID NO: 6563085 - DNA, 14 bp, Homo sapiens
ttatccatttgtaa

SEQ ID NO: 6563086 - DNA, 23 bp, Homo sapiens
ttatcccatctcactttaataat

SEQ ID NO: 6563087 - DNA, 14 bp, Homo sapiens
ttatcccattttat

SEQ ID NO: 6563088 - DNA, 18 bp, Homo sapiens
ttatccccgtttcttgca

SEQ ID NO: 6563089 - DNA, 14 bp, Homo sapiens
ttatccctctcttc

SEQ ID NO: 6563090 - DNA, 19 bp, Homo sapiens
ttatccctctcttcccctt

SEQ ID NO: 6563091 - DNA, 23 bp, Homo sapiens
ttatccctctcttccccttccct

SEQ ID NO: 6563092 - DNA, 15 bp, Homo sapiens
ttatcccttaagaat

SEQ ID NO: 6563093 - DNA, 23 bp, Homo sapiens
ttatcccttccttttagcctagt

SEQ ID NO: 6563094 - DNA, 15 bp, Homo sapiens
ttatccgaaagtttc

SEQ ID NO: 6563095 - DNA, 19 bp, Homo sapiens
ttatcctaaaacaaatagt

SEQ ID NO: 6563096 - DNA, 16 bp, Homo sapiens
ttatcctaagggaaga

SEQ ID NO: 6563097 - DNA, 22 bp, Homo sapiens
ttatcctagattatatcaaagt

SEQ ID NO: 6563098 - DNA, 21 bp, Homo sapiens
ttatcctagcacatgcttcaa

SEQ ID NO: 6563099 - DNA, 12 bp, Homo sapiens
ttatcctagcct

SEQ ID NO: 6563100 - DNA, 23 bp, Homo sapiens
ttatcctatttttaaacaaaatg

SEQ ID NO: 6563101 - DNA, 13 bp, Homo sapiens
ttatcctccctgt

SEQ ID NO: 6563102 - DNA, 14 bp, Homo sapiens
ttatcctccctgta

SEQ ID NO: 6563103 - DNA, 18 bp, Homo sapiens
ttatcctccctgtaactt

SEQ ID NO: 6563104 - DNA, 13 bp, Homo sapiens
ttatcctctctct

SEQ ID NO: 6563105 - DNA, 18 bp, Homo sapiens
ttatcctctctctcttct

SEQ ID NO: 6563106 - DNA, 15 bp, Homo sapiens
ttatcctctgatctc

SEQ ID NO: 6563107 - DNA, 18 bp, Homo sapiens
ttatcctctttagagtta

SEQ ID NO: 6563108 - DNA, 16 bp, Homo sapiens
ttatcctctttgtaat

SEQ ID NO: 6563109 - DNA, 17 bp, Homo sapiens
ttatcctgaaatttcag

SEQ ID NO: 6563110 - DNA, 21 bp, Homo sapiens
ttatcctgacatattcaagtg

SEQ ID NO: 6563111 - DNA, 20 bp, Homo sapiens
ttatcctgagtcccttaatc

SEQ ID NO: 6563112 - DNA, 20 bp, Homo sapiens
ttatcctgcaagggacagga

SEQ ID NO: 6563113 - DNA, 16 bp, Homo sapiens
ttatcctgcattgtta

SEQ ID NO: 6563114 - DNA, 21 bp, Homo sapiens
ttatcctgctagctgtagaaa

SEQ ID NO: 6563115 - DNA, 15 bp, Homo sapiens
ttatcctgtgctaca

SEQ ID NO: 6563116 - DNA, 15 bp, Homo sapiens
ttatcctgttactga

SEQ ID NO: 6563117 - DNA, 14 bp, Homo sapiens
ttatcctgttttca

SEQ ID NO: 6563118 - DNA, 23 bp, Homo sapiens
ttatccttaggaaaatgcttctg

SEQ ID NO: 6563119 - DNA, 24 bp, Homo sapiens
ttatccttttttaaaagtaaatgt

SEQ ID NO: 6563120 - DNA, 19 bp, Homo sapiens
ttatcgaaataacaatgtt

SEQ ID NO: 6563121 - DNA, 18 bp, Homo sapiens
ttatcgcaacatgaattt

SEQ ID NO: 6563122 - DNA, 17 bp, Homo sapiens
ttatcgccctgagaaga

SEQ ID NO: 6563123 - DNA, 19 bp, Homo sapiens
ttatcgccctggcaggcag

SEQ ID NO: 6563124 - DNA, 21 bp, Homo sapiens
ttatcgccttttgacagctgt

SEQ ID NO: 6563125 - DNA, 21 bp, Homo sapiens
ttatcggacattctaatgcat

SEQ ID NO: 6563126 - DNA, 21 bp, Homo sapiens
ttatcgggagcagtgtcttcc

SEQ ID NO: 6563127 - DNA, 17 bp, Homo sapiens
ttatcgtcttctaagag

SEQ ID NO: 6563128 - DNA, 22 bp, Homo sapiens
ttatcgtttttgtattttcatg

SEQ ID NO: 6563129 - DNA, 21 bp, Homo sapiens
ttatctaaaagaaatgtctat

SEQ ID NO: 6563130 - DNA, 14 bp, Homo sapiens
ttatctaaatgaat

SEQ ID NO: 6563131 - DNA, 14 bp, Homo sapiens
ttatctaaattaaa

SEQ ID NO: 6563132 - DNA, 15 bp, Homo sapiens
ttatctaaattaaag

SEQ ID NO: 6563133 - DNA, 17 bp, Homo sapiens
ttatctaagaatacagc

SEQ ID NO: 6563134 - DNA, 20 bp, Homo sapiens
ttatctaaggtccccagcag

SEQ ID NO: 6563135 - DNA, 19 bp, Homo sapiens
ttatctaatacctctgtgt

SEQ ID NO: 6563136 - DNA, 13 bp, Homo sapiens
ttatctaatgagt

SEQ ID NO: 6563137 - DNA, 17 bp, Homo sapiens
ttatctaatttgtgcct

SEQ ID NO: 6563138 - DNA, 14 bp, Homo sapiens
ttatctaccaactt

SEQ ID NO: 6563139 - DNA, 17 bp, Homo sapiens
ttatctaccaactttca

SEQ ID NO: 6563140 - DNA, 20 bp, Homo sapiens
ttatctaccaactttcaaga

SEQ ID NO: 6563141 - DNA, 14 bp, Homo sapiens
ttatctacccagtc

SEQ ID NO: 6563142 - DNA, 15 bp, Homo sapiens
ttatctacctgttct

SEQ ID NO: 6563143 - DNA, 15 bp, Homo sapiens
ttatctactaattga

SEQ ID NO: 6563144 - DNA, 22 bp, Homo sapiens
ttatctactgactgaaatcagt

SEQ ID NO: 6563145 - DNA, 21 bp, Homo sapiens
ttatctagaaattaagattga

SEQ ID NO: 6563146 - DNA, 17 bp, Homo sapiens
ttatctagatactgtat

SEQ ID NO: 6563147 - DNA, 18 bp, Homo sapiens
ttatctagatgtaaattt

SEQ ID NO: 6563148 - DNA, 21 bp, Homo sapiens
ttatctagcaagaagattcta

SEQ ID NO: 6563149 - DNA, 21 bp, Homo sapiens
ttatctagcatagcacaaacg

SEQ ID NO: 6563150 - DNA, 19 bp, Homo sapiens
ttatctagccaaagagctc

SEQ ID NO: 6563151 - DNA, 14 bp, Homo sapiens
ttatctagctgcat

SEQ ID NO: 6563152 - DNA, 13 bp, Homo sapiens
ttatctataaaag

SEQ ID NO: 6563153 - DNA, 15 bp, Homo sapiens
ttatctataatttac

SEQ ID NO: 6563154 - DNA, 22 bp, Homo sapiens
ttatctataatttacctaagat

SEQ ID NO: 6563155 - DNA, 19 bp, Homo sapiens
ttatctatacatatcttta

SEQ ID NO: 6563156 - DNA, 14 bp, Homo sapiens
ttatctatagcaac

SEQ ID NO: 6563157 - DNA, 13 bp, Homo sapiens
ttatctatataaa

SEQ ID NO: 6563158 - DNA, 17 bp, Homo sapiens
ttatctatggaaatgtg

SEQ ID NO: 6563159 - DNA, 15 bp, Homo sapiens
ttatctatgtggaaa

SEQ ID NO: 6563160 - DNA, 12 bp, Homo sapiens
ttatctattaaa

SEQ ID NO: 6563161 - DNA, 20 bp, Homo sapiens
ttatctattctgagaaaaca

SEQ ID NO: 6563162 - DNA, 13 bp, Homo sapiens
ttatctatttgta

SEQ ID NO: 6563163 - DNA, 21 bp, Homo sapiens
ttatctcaaattttaagttaa

SEQ ID NO: 6563164 - DNA, 13 bp, Homo sapiens
ttatctcacaaat

SEQ ID NO: 6563165 - DNA, 16 bp, Homo sapiens
ttatctcacttgtgcc

SEQ ID NO: 6563166 - DNA, 16 bp, Homo sapiens
ttatctcactttgtaa

SEQ ID NO: 6563167 - DNA, 19 bp, Homo sapiens
ttatctcactttgtaaata

SEQ ID NO: 6563168 - DNA, 18 bp, Homo sapiens
ttatctcagatatttgca

SEQ ID NO: 6563169 - DNA, 17 bp, Homo sapiens
ttatctcagatgttaaa

SEQ ID NO: 6563170 - DNA, 15 bp, Homo sapiens
ttatctcagttatga

SEQ ID NO: 6563171 - DNA, 16 bp, Homo sapiens
ttatctccaagtggca

SEQ ID NO: 6563172 - DNA, 21 bp, Homo sapiens
ttatctccacaacctcttccc

SEQ ID NO: 6563173 - DNA, 16 bp, Homo sapiens
ttatctccctgcttca

SEQ ID NO: 6563174 - DNA, 20 bp, Homo sapiens
ttatctccctgcttcatatc

SEQ ID NO: 6563175 - DNA, 15 bp, Homo sapiens
ttatctcctaattgt

SEQ ID NO: 6563176 - DNA, 17 bp, Homo sapiens
ttatctcctttgaagaa

SEQ ID NO: 6563177 - DNA, 19 bp, Homo sapiens
ttatctcgaatttgaagag

SEQ ID NO: 6563178 - DNA, 15 bp, Homo sapiens
ttatctctatttaat

SEQ ID NO: 6563179 - DNA, 13 bp, Homo sapiens
ttatctctttcca

SEQ ID NO: 6563180 - DNA, 18 bp, Homo sapiens
ttatctctttctctcttt

SEQ ID NO: 6563181 - DNA, 13 bp, Homo sapiens
ttatctgaaactt

SEQ ID NO: 6563182 - DNA, 18 bp, Homo sapiens
ttatctgaaacttcccaa

SEQ ID NO: 6563183 - DNA, 13 bp, Homo sapiens
ttatctgaatatt

SEQ ID NO: 6563184 - DNA, 17 bp, Homo sapiens
ttatctgaatttttaaa

SEQ ID NO: 6563185 - DNA, 16 bp, Homo sapiens
ttatctgagcaataac

SEQ ID NO: 6563186 - DNA, 18 bp, Homo sapiens
ttatctgagctgagccag

SEQ ID NO: 6563187 - DNA, 14 bp, Homo sapiens
ttatctgatactta

SEQ ID NO: 6563188 - DNA, 19 bp, Homo sapiens
ttatctgatatgctgagaa

SEQ ID NO: 6563189 - DNA, 23 bp, Homo sapiens
ttatctgatatgctgagaaatta

SEQ ID NO: 6563190 - DNA, 14 bp, Homo sapiens
ttatctgatcagaa

SEQ ID NO: 6563191 - DNA, 18 bp, Homo sapiens
ttatctgatctgtgatta

SEQ ID NO: 6563192 - DNA, 15 bp, Homo sapiens
ttatctgatcttcct

SEQ ID NO: 6563193 - DNA, 18 bp, Homo sapiens
ttatctgcaagtgaggtg

SEQ ID NO: 6563194 - DNA, 20 bp, Homo sapiens
ttatctgcctggcctggctc

SEQ ID NO: 6563195 - DNA, 15 bp, Homo sapiens
ttatctgcggcttta

SEQ ID NO: 6563196 - DNA, 19 bp, Homo sapiens
ttatctggaaataatatca

SEQ ID NO: 6563197 - DNA, 19 bp, Homo sapiens
ttatctggaatattgtgat

SEQ ID NO: 6563198 - DNA, 23 bp, Homo sapiens
ttatctgggattatggttttgtg

SEQ ID NO: 6563199 - DNA, 12 bp, Homo sapiens
ttatctgggttc

SEQ ID NO: 6563200 - DNA, 16 bp, Homo sapiens
ttatctgtcagctgca

SEQ ID NO: 6563201 - DNA, 16 bp, Homo sapiens
ttatctgtctttatga

SEQ ID NO: 6563202 - DNA, 17 bp, Homo sapiens
ttatctgtgaattcaga

SEQ ID NO: 6563203 - DNA, 11 bp, Homo sapiens
ttatctgtgtt

SEQ ID NO: 6563204 - DNA, 18 bp, Homo sapiens
ttatctgtgttatttgga

SEQ ID NO: 6563205 - DNA, 15 bp, Homo sapiens
ttatctgtgttgtct

SEQ ID NO: 6563206 - DNA, 12 bp, Homo sapiens
ttatctgttcta

SEQ ID NO: 6563207 - DNA, 16 bp, Homo sapiens
ttatcttaacactgaa

SEQ ID NO: 6563208 - DNA, 18 bp, Homo sapiens
ttatcttacaactccccc

SEQ ID NO: 6563209 - DNA, 12 bp, Homo sapiens
ttatcttacatt

SEQ ID NO: 6563210 - DNA, 13 bp, Homo sapiens
ttatcttacgaaa

SEQ ID NO: 6563211 - DNA, 20 bp, Homo sapiens
ttatcttacgctatttctgt

SEQ ID NO: 6563212 - DNA, 16 bp, Homo sapiens
ttatcttagctggata

SEQ ID NO: 6563213 - DNA, 17 bp, Homo sapiens
ttatcttatactgaaaa

SEQ ID NO: 6563214 - DNA, 17 bp, Homo sapiens
ttatcttatgccacggg

SEQ ID NO: 6563215 - DNA, 19 bp, Homo sapiens
ttatcttcaccctcatcct

SEQ ID NO: 6563216 - DNA, 17 bp, Homo sapiens
ttatcttctagccacag

SEQ ID NO: 6563217 - DNA, 12 bp, Homo sapiens
ttatcttctgtt

SEQ ID NO: 6563218 - DNA, 15 bp, Homo sapiens
ttatcttctgttttt

SEQ ID NO: 6563219 - DNA, 16 bp, Homo sapiens
ttatcttctgtttttc

SEQ ID NO: 6563220 - DNA, 20 bp, Homo sapiens
ttatcttctgtttttctcaa

SEQ ID NO: 6563221 - DNA, 15 bp, Homo sapiens
ttatcttctttatta

SEQ ID NO: 6563222 - DNA, 17 bp, Homo sapiens
ttatcttgaaggaaaaa

SEQ ID NO: 6563223 - DNA, 18 bp, Homo sapiens
ttatcttgaaggaaaaat

SEQ ID NO: 6563224 - DNA, 16 bp, Homo sapiens
ttatcttgaataatgt

SEQ ID NO: 6563225 - DNA, 20 bp, Homo sapiens
ttatcttgaataatgtaaga

SEQ ID NO: 6563226 - DNA, 17 bp, Homo sapiens
ttatcttgacaggcgcc

SEQ ID NO: 6563227 - DNA, 22 bp, Homo sapiens
ttatcttgagtgttatgtgaat

SEQ ID NO: 6563228 - DNA, 18 bp, Homo sapiens
tttgagatctaaaaataa

SEQ ID NO: 6563229 - DNA, 15 bp, Homo sapiens
tttgagatgtaaaaa

SEQ ID NO: 6563230 - DNA, 18 bp, Homo sapiens
tttgagatttttttttct

SEQ ID NO: 6563231 - DNA, 22 bp, Homo sapiens
tttgagcaaagaaacttgtgct

SEQ ID NO: 6563232 - DNA, 15 bp, Homo sapiens
tttgagcaattcatt

SEQ ID NO: 6563233 - DNA, 18 bp, Homo sapiens
tttgagcaattcatttca

SEQ ID NO: 6563234 - DNA, 15 bp, Homo sapiens
tttgagcaattttcg

SEQ ID NO: 6563235 - DNA, 14 bp, Homo sapiens
tttgagcacaatct

SEQ ID NO: 6563236 - DNA, 18 bp, Homo sapiens
tttgagcaggagcagaaa

SEQ ID NO: 6563237 - DNA, 23 bp, Homo sapiens
tttgagcatgcacagctgcttgt

SEQ ID NO: 6563238 - DNA, 12 bp, Homo sapiens
tttgagcatttt

SEQ ID NO: 6563239 - DNA, 23 bp, Homo sapiens
tttgagcccacaggagctccctt

SEQ ID NO: 6563240 - DNA, 14 bp, Homo sapiens
tttgagccctggac

SEQ ID NO: 6563241 - DNA, 19 bp, Homo sapiens
tttgagcctgatgtttaca

SEQ ID NO: 6563242 - DNA, 18 bp, Homo sapiens
tttgagcctttattggta

SEQ ID NO: 6563243 - DNA, 22 bp, Homo sapiens
tttgagctcagccccaactctt

SEQ ID NO: 6563244 - DNA, 12 bp, Homo sapiens
tttgagctgcct

SEQ ID NO: 6563245 - DNA, 14 bp, Homo sapiens
tttgagctgccttc

SEQ ID NO: 6563246 - DNA, 19 bp, Homo sapiens
tttgagcttagtgaaatta

SEQ ID NO: 6563247 - DNA, 18 bp, Homo sapiens
tttgagcttctcctctgc

SEQ ID NO: 6563248 - DNA, 14 bp, Homo sapiens
tttgaggaaactca

SEQ ID NO: 6563249 - DNA, 21 bp, Homo sapiens
tttgaggaagtggctgtccct

SEQ ID NO: 6563250 - DNA, 20 bp, Homo sapiens
tttgaggaattatcatggga

SEQ ID NO: 6563251 - DNA, 14 bp, Homo sapiens
tttgaggacaagtt

SEQ ID NO: 6563252 - DNA, 22 bp, Homo sapiens
tttgaggacaagttacacctcc

SEQ ID NO: 6563253 - DNA, 15 bp, Homo sapiens
tttgaggactgaagc

SEQ ID NO: 6563254 - DNA, 21 bp, Homo sapiens
tttgaggagcagcttcagttg

SEQ ID NO: 6563255 - DNA, 16 bp, Homo sapiens
tttgaggagcatgttt

SEQ ID NO: 6563256 - DNA, 15 bp, Homo sapiens
tttgaggagccagcc

SEQ ID NO: 6563257 - DNA, 15 bp, Homo sapiens
tttgaggagtggttt

SEQ ID NO: 6563258 - DNA, 19 bp, Homo sapiens
tttgaggagtggtttttct

SEQ ID NO: 6563259 - DNA, 18 bp, Homo sapiens
tttgaggattagtttaga

SEQ ID NO: 6563260 - DNA, 12 bp, Homo sapiens
tttgaggcaaat

SEQ ID NO: 6563261 - DNA, 20 bp, Homo sapiens
tttgaggcaaattaactgta

SEQ ID NO: 6563262 - DNA, 18 bp, Homo sapiens
tttgaggccaaaacagat

SEQ ID NO: 6563263 - DNA, 23 bp, Homo sapiens
tttgaggggaggagttccacaga

SEQ ID NO: 6563264 - DNA, 18 bp, Homo sapiens
tttgaggggccaggggca

SEQ ID NO: 6563265 - DNA, 11 bp, Homo sapiens
tttgaggggct

SEQ ID NO: 6563266 - DNA, 15 bp, Homo sapiens
tttgagggttccatg

SEQ ID NO: 6563267 - DNA, 19 bp, Homo sapiens
tttgaggtctagagagaac

SEQ ID NO: 6563268 - DNA, 17 bp, Homo sapiens
tttgaggtgaaattcag

SEQ ID NO: 6563269 - DNA, 20 bp, Homo sapiens
tttgaggttttgtaaaactg

SEQ ID NO: 6563270 - DNA, 21 bp, Homo sapiens
tttgaggttttgtaaaactgt

SEQ ID NO: 6563271 - DNA, 22 bp, Homo sapiens
tttgaggttttgtaaaactgtt

SEQ ID NO: 6563272 - DNA, 16 bp, Homo sapiens
tttgagtaattttctg

SEQ ID NO: 6563273 - DNA, 17 bp, Homo sapiens
tttgagtacagaattca

SEQ ID NO: 6563274 - DNA, 13 bp, Homo sapiens
tttgagtacagat

SEQ ID NO: 6563275 - DNA, 21 bp, Homo sapiens
tttgagtagatattactttat

SEQ ID NO: 6563276 - DNA, 19 bp, Homo sapiens
tttgagtcaaaagcctggg

SEQ ID NO: 6563277 - DNA, 19 bp, Homo sapiens
tttgagtcattgacttcat

SEQ ID NO: 6563278 - DNA, 23 bp, Homo sapiens
tttgagtcattgacttcatttta

SEQ ID NO: 6563279 - DNA, 20 bp, Homo sapiens
tttgagtctatcctagtctt

SEQ ID NO: 6563280 - DNA, 12 bp, Homo sapiens
tttgagtctttt

SEQ ID NO: 6563281 - DNA, 21 bp, Homo sapiens
tttgagtgccaatttcttact

SEQ ID NO: 6563282 - DNA, 13 bp, Homo sapiens
tttgagtgcctta

SEQ ID NO: 6563283 - DNA, 20 bp, Homo sapiens
tttgagtgtactgtgcctgg

SEQ ID NO: 6563284 - DNA, 18 bp, Homo sapiens
tttgagtgtcaggctctg

SEQ ID NO: 6563285 - DNA, 19 bp, Homo sapiens
tttgagttattttaattat

SEQ ID NO: 6563286 - DNA, 15 bp, Homo sapiens
tttgagtttgacatt

SEQ ID NO: 6563287 - DNA, 17 bp, Homo sapiens
tttgagtttgacattta

SEQ ID NO: 6563288 - DNA, 16 bp, Homo sapiens
tttgagtttgcctcag

SEQ ID NO: 6563289 - DNA, 21 bp, Homo sapiens
tttgagtttgctgttttaaat

SEQ ID NO: 6563290 - DNA, 21 bp, Homo sapiens
tttgagttttaaattatgtat

SEQ ID NO: 6563291 - DNA, 21 bp, Homo sapiens
tttgagtttttcctcccagtg

SEQ ID NO: 6563292 - DNA, 20 bp, Homo sapiens
tttgataaaaatttagaaca

SEQ ID NO: 6563293 - DNA, 16 bp, Homo sapiens
tttgataaaataaatg

SEQ ID NO: 6563294 - DNA, 14 bp, Homo sapiens
tttgataaacattc

SEQ ID NO: 6563295 - DNA, 19 bp, Homo sapiens
tttgataaagtagtaaaaa

SEQ ID NO: 6563296 - DNA, 20 bp, Homo sapiens
tttgataaagtagtaaaaat

SEQ ID NO: 6563297 - DNA, 13 bp, Homo sapiens
tttgataaagttt

SEQ ID NO: 6563298 - DNA, 15 bp, Homo sapiens
tttgataaagtttct

SEQ ID NO: 6563299 - DNA, 13 bp, Homo sapiens
tttgataaatagt

SEQ ID NO: 6563300 - DNA, 14 bp, Homo sapiens
tttgataaatagtg

SEQ ID NO: 6563301 - DNA, 14 bp, Homo sapiens
tttgataaattact

SEQ ID NO: 6563302 - DNA, 15 bp, Homo sapiens
tttgataactgttta

SEQ ID NO: 6563303 - DNA, 23 bp, Homo sapiens
tttgataagatgaggaaataatg

SEQ ID NO: 6563304 - DNA, 12 bp, Homo sapiens
tttgataatgtt

SEQ ID NO: 6563305 - DNA, 14 bp, Homo sapiens
tttgataatgttaa

SEQ ID NO: 6563306 - DNA, 17 bp, Homo sapiens
tttgataatgttaaatt

SEQ ID NO: 6563307 - DNA, 21 bp, Homo sapiens
tttgataattttgaaatgatt

SEQ ID NO: 6563308 - DNA, 22 bp, Homo sapiens
tttgatacagtcaacaagcctg

SEQ ID NO: 6563309 - DNA, 14 bp, Homo sapiens
tttgatacataata

SEQ ID NO: 6563310 - DNA, 16 bp, Homo sapiens
tttgatacatatgtga

SEQ ID NO: 6563311 - DNA, 19 bp, Homo sapiens
tttgatacatatgtgaata

SEQ ID NO: 6563312 - DNA, 21 bp, Homo sapiens
tttgatacatttatcttctgt

SEQ ID NO: 6563313 - DNA, 21 bp, Homo sapiens
tttgatactaagcattgaatg

SEQ ID NO: 6563314 - DNA, 18 bp, Homo sapiens
tttgatacttatattttc

SEQ ID NO: 6563315 - DNA, 17 bp, Homo sapiens
tttgatacttgtaactt

SEQ ID NO: 6563316 - DNA, 15 bp, Homo sapiens
tttgatacttgttca

SEQ ID NO: 6563317 - DNA, 22 bp, Homo sapiens
tttgatagaaaggaacacgttt

SEQ ID NO: 6563318 - DNA, 16 bp, Homo sapiens
tttgatagaggtaact

SEQ ID NO: 6563319 - DNA, 13 bp, Homo sapiens
tttgatagcaatg

SEQ ID NO: 6563320 - DNA, 21 bp, Homo sapiens
tttgatagcagaagaaaaagt

SEQ ID NO: 6563321 - DNA, 18 bp, Homo sapiens
tttgatataattgtactg

SEQ ID NO: 6563322 - DNA, 19 bp, Homo sapiens
tttgatatcacagtctaat

SEQ ID NO: 6563323 - DNA, 13 bp, Homo sapiens
tttgatatgtagt

SEQ ID NO: 6563324 - DNA, 14 bp, Homo sapiens
tttgatatgtgaac

SEQ ID NO: 6563325 - DNA, 21 bp, Homo sapiens
tttgatcacattgtttcttga

SEQ ID NO: 6563326 - DNA, 17 bp, Homo sapiens
tttgatcagacagcttg

SEQ ID NO: 6563327 - DNA, 13 bp, Homo sapiens
tttgatcagtgtt

SEQ ID NO: 6563328 - DNA, 17 bp, Homo sapiens
tttgatcatagaattgt

SEQ ID NO: 6563329 - DNA, 12 bp, Homo sapiens
tttgatcatgaa

SEQ ID NO: 6563330 - DNA, 14 bp, Homo sapiens
tttgatccttggaa

SEQ ID NO: 6563331 - DNA, 21 bp, Homo sapiens
tttgatctggtgcgtgtggcc

SEQ ID NO: 6563332 - DNA, 12 bp, Homo sapiens
tttgatcttcaa

SEQ ID NO: 6563333 - DNA, 15 bp, Homo sapiens
tttgatcttcaggat

SEQ ID NO: 6563334 - DNA, 18 bp, Homo sapiens
tttgatcttcctctgcta

SEQ ID NO: 6563335 - DNA, 13 bp, Homo sapiens
tttgatctttgtt

SEQ ID NO: 6563336 - DNA, 21 bp, Homo sapiens
tttgatctttgtttaaatgcc

SEQ ID NO: 6563337 - DNA, 14 bp, Homo sapiens
tttgatctttttat

SEQ ID NO: 6563338 - DNA, 16 bp, Homo sapiens
tttgatgaaagctgat

SEQ ID NO: 6563339 - DNA, 17 bp, Homo sapiens
tttgatgaataaaatgt

SEQ ID NO: 6563340 - DNA, 21 bp, Homo sapiens
tttgatgaattcttcctctcc

SEQ ID NO: 6563341 - DNA, 23 bp, Homo sapiens
tttgatgactacctcagaacata

SEQ ID NO: 6563342 - DNA, 19 bp, Homo sapiens
tttgatgactggcatttta

SEQ ID NO: 6563343 - DNA, 14 bp, Homo sapiens
tttgatgagaaaaa

SEQ ID NO: 6563344 - DNA, 21 bp, Homo sapiens
tttgatgatgtctacagaaaa

SEQ ID NO: 6563345 - DNA, 22 bp, Homo sapiens
tttgatgatgtctacagaaaat

SEQ ID NO: 6563346 - DNA, 20 bp, Homo sapiens
tttgatgcagcacttcagat

SEQ ID NO: 6563347 - DNA, 15 bp, Homo sapiens
tttgatgccaaagca

SEQ ID NO: 6563348 - DNA, 22 bp, Homo sapiens
tttgatgcccagacagcaagta

SEQ ID NO: 6563349 - DNA, 19 bp, Homo sapiens
tttgatgcctgtgaagaac

SEQ ID NO: 6563350 - DNA, 19 bp, Homo sapiens
tttgatgctggagaggtta

SEQ ID NO: 6563351 - DNA, 15 bp, Homo sapiens
tttgatgcttttctc

SEQ ID NO: 6563352 - DNA, 18 bp, Homo sapiens
tttgatgcttttctctca

SEQ ID NO: 6563353 - DNA, 19 bp, Homo sapiens
tttgatggaaaaagaatat

SEQ ID NO: 6563354 - DNA, 13 bp, Homo sapiens
tttgatggaggag

SEQ ID NO: 6563355 - DNA, 15 bp, Homo sapiens
tttgatgggaagaaa

SEQ ID NO: 6563356 - DNA, 19 bp, Homo sapiens
tttgatggtactgatgagt

SEQ ID NO: 6563357 - DNA, 15 bp, Homo sapiens
tttgatggtatttct

SEQ ID NO: 6563358 - DNA, 16 bp, Homo sapiens
tttgatggtgaatatt

SEQ ID NO: 6563359 - DNA, 19 bp, Homo sapiens
tttgatggtgaatattaca

SEQ ID NO: 6563360 - DNA, 22 bp, Homo sapiens
tttgatggtggtattgtgacca

SEQ ID NO: 6563361 - DNA, 13 bp, Homo sapiens
tttgatgtacatt

SEQ ID NO: 6563362 - DNA, 12 bp, Homo sapiens
tttgatgtatgt

SEQ ID NO: 6563363 - DNA, 14 bp, Homo sapiens
tttgatgtcagcag

SEQ ID NO: 6563364 - DNA, 16 bp, Homo sapiens
tttgatgtcatgtgtt

SEQ ID NO: 6563365 - DNA, 18 bp, Homo sapiens
tttgatgtcatgtgttcc

SEQ ID NO: 6563366 - DNA, 19 bp, Homo sapiens
tttgatgtccccaaagtac

SEQ ID NO: 6563367 - DNA, 14 bp, Homo sapiens
tttgatgtgacttt

SEQ ID NO: 6563368 - DNA, 23 bp, Homo sapiens
tttgatgtgtgggcttctgagtt

SEQ ID NO: 6563369 - DNA, 15 bp, Homo sapiens
tttgatgtgtttttg

SEQ ID NO: 6563370 - DNA, 20 bp, Homo sapiens
tttgatgtgtttttgtatga

SEQ ID NO: 6563371 - DNA, 16 bp, Homo sapiens
tttgatgttaacacat

SEQ ID NO: 6563372 - DNA, 17 bp, Homo sapiens
tttgatgttaacacatt

SEQ ID NO: 6563373 - DNA, 21 bp, Homo sapiens
tttgattaaattcttgcaaag

SEQ ID NO: 6563374 - DNA, 20 bp, Homo sapiens
tttgattaacaatgtatttt

SEQ ID NO: 6563375 - DNA, 20 bp, Homo sapiens
tttgattaatgtttcttaaa

SEQ ID NO: 6563376 - DNA, 15 bp, Homo sapiens
tttgattaggtatgt

SEQ ID NO: 6563377 - DNA, 22 bp, Homo sapiens
tttgattaggtatgtttgtaac

SEQ ID NO: 6563378 - DNA, 15 bp, Homo sapiens
tttgattattatgtt

SEQ ID NO: 6563379 - DNA, 14 bp, Homo sapiens
tttgattattgtat

SEQ ID NO: 6563380 - DNA, 22 bp, Homo sapiens
tttgattcaaaatatttaaaaa

SEQ ID NO: 6563381 - DNA, 12 bp, Homo sapiens
tttgattcacat

SEQ ID NO: 6563382 - DNA, 16 bp, Homo sapiens
tttgattcacatgttt

SEQ ID NO: 6563383 - DNA, 19 bp, Homo sapiens
tttgattcacatgttttca

SEQ ID NO: 6563384 - DNA, 21 bp, Homo sapiens
tttgattcacatgttttcaaa

SEQ ID NO: 6563385 - DNA, 18 bp, Homo sapiens
tttgattcagacagctgc

SEQ ID NO: 6563386 - DNA, 21 bp, Homo sapiens
tttgattcagctcattatgaa

SEQ ID NO: 6563387 - DNA, 22 bp, Homo sapiens
tttgattcagctcattatgaaa

SEQ ID NO: 6563388 - DNA, 15 bp, Homo sapiens
tttgattcatagtaa

SEQ ID NO: 6563389 - DNA, 19 bp, Homo sapiens
tttgattcattttcctgtt

SEQ ID NO: 6563390 - DNA, 18 bp, Homo sapiens
tttgattcgccctcctcc

SEQ ID NO: 6563391 - DNA, 21 bp, Homo sapiens
tttgattctccttcagccctc

SEQ ID NO: 6563392 - DNA, 21 bp, Homo sapiens
tttgattgagagtaacttaag

SEQ ID NO: 6563393 - DNA, 15 bp, Homo sapiens
tttgattgatttgaa

SEQ ID NO: 6563394 - DNA, 19 bp, Homo sapiens
tttgattgctttgctgcac

SEQ ID NO: 6563395 - DNA, 13 bp, Homo sapiens
tttgattggcttt

SEQ ID NO: 6563396 - DNA, 17 bp, Homo sapiens
tttgattgggatgaatg

SEQ ID NO: 6563397 - DNA, 14 bp, Homo sapiens
tttgattgtgaaac

SEQ ID NO: 6563398 - DNA, 16 bp, Homo sapiens
tttgattgtttacagg

SEQ ID NO: 6563399 - DNA, 18 bp, Homo sapiens
tttgatttacagcaagta

SEQ ID NO: 6563400 - DNA, 22 bp, Homo sapiens
tttgatttagtgaatggcattt

SEQ ID NO: 6563401 - DNA, 14 bp, Homo sapiens
tttgatttcattaa

SEQ ID NO: 6563402 - DNA, 12 bp, Homo sapiens
tttgatttctaa

SEQ ID NO: 6563403 - DNA, 16 bp, Homo sapiens
tttgatttctaattgt

SEQ ID NO: 6563404 - DNA, 18 bp, Homo sapiens
tttgatttctaattgtaa

SEQ ID NO: 6563405 - DNA, 15 bp, Homo sapiens
tttgatttctagtat

SEQ ID NO: 6563406 - DNA, 13 bp, Homo sapiens
tttgatttctatt

SEQ ID NO: 6563407 - DNA, 16 bp, Homo sapiens
ttatcttgatacattc

SEQ ID NO: 6563408 - DNA, 17 bp, Homo sapiens
ttatcttggactgacat

SEQ ID NO: 6563409 - DNA, 18 bp, Homo sapiens
ttatcttgggaccaaaac

SEQ ID NO: 6563410 - DNA, 14 bp, Homo sapiens
ttatcttgggactg

SEQ ID NO: 6563411 - DNA, 17 bp, Homo sapiens
ttatcttgtctctgggc

SEQ ID NO: 6563412 - DNA, 16 bp, Homo sapiens
ttatcttgttcaatga

SEQ ID NO: 6563413 - DNA, 12 bp, Homo sapiens
ttatctttacca

SEQ ID NO: 6563414 - DNA, 16 bp, Homo sapiens
ttatctttagttgaat

SEQ ID NO: 6563415 - DNA, 23 bp, Homo sapiens
ttatctttagttgaattccaagt

SEQ ID NO: 6563416 - DNA, 17 bp, Homo sapiens
ttatctttatacagatt

SEQ ID NO: 6563417 - DNA, 12 bp, Homo sapiens
ttatctttatat

SEQ ID NO: 6563418 - DNA, 17 bp, Homo sapiens
ttatctttcgtgataaa

SEQ ID NO: 6563419 - DNA, 24 bp, Homo sapiens
ttatctttcgtgataaactttgct

SEQ ID NO: 6563420 - DNA, 15 bp, Homo sapiens
ttatctttctaaaac

SEQ ID NO: 6563421 - DNA, 14 bp, Homo sapiens
ttatcttttcataa

SEQ ID NO: 6563422 - DNA, 16 bp, Homo sapiens
ttatcttttgtatatc

SEQ ID NO: 6563423 - DNA, 20 bp, Homo sapiens
ttatctttttgtgtctcctt

SEQ ID NO: 6563424 - DNA, 19 bp, Homo sapiens
ttatgaaaaaatatgaacc

SEQ ID NO: 6563425 - DNA, 22 bp, Homo sapiens
ttatgaaaaacatcccaaactt

SEQ ID NO: 6563426 - DNA, 23 bp, Homo sapiens
ttatgaaaaacatcccaaacttt

SEQ ID NO: 6563427 - DNA, 12 bp, Homo sapiens
ttatgaaaactc

SEQ ID NO: 6563428 - DNA, 14 bp, Homo sapiens
ttatgaaaagtact

SEQ ID NO: 6563429 - DNA, 18 bp, Homo sapiens
ttatgaaaataaatagct

SEQ ID NO: 6563430 - DNA, 13 bp, Homo sapiens
ttatgaaaataat

SEQ ID NO: 6563431 - DNA, 15 bp, Homo sapiens
ttatgaaaatcttat

SEQ ID NO: 6563432 - DNA, 22 bp, Homo sapiens
ttatgaaaatgttgaaggaact

SEQ ID NO: 6563433 - DNA, 11 bp, Homo sapiens
ttatgaaacat

SEQ ID NO: 6563434 - DNA, 23 bp, Homo sapiens
ttatgaaaccaactgttgacata

SEQ ID NO: 6563435 - DNA, 16 bp, Homo sapiens
ttatgaaacttgtgta

SEQ ID NO: 6563436 - DNA, 14 bp, Homo sapiens
ttatgaaacttttg

SEQ ID NO: 6563437 - DNA, 19 bp, Homo sapiens
ttatgaaacttttggaagg

SEQ ID NO: 6563438 - DNA, 21 bp, Homo sapiens
ttatgaaagcaacaaagaaat

SEQ ID NO: 6563439 - DNA, 18 bp, Homo sapiens
ttatgaaaggtttacatt

SEQ ID NO: 6563440 - DNA, 13 bp, Homo sapiens
ttatgaaatctca

SEQ ID NO: 6563441 - DNA, 19 bp, Homo sapiens
ttatgaaatgccactggga

SEQ ID NO: 6563442 - DNA, 18 bp, Homo sapiens
ttatgaaattaacaagaa

SEQ ID NO: 6563443 - DNA, 19 bp, Homo sapiens
ttatgaacacttaaattat

SEQ ID NO: 6563444 - DNA, 14 bp, Homo sapiens
ttatgaacagctgt

SEQ ID NO: 6563445 - DNA, 18 bp, Homo sapiens
ttatgaacagctgtgtct

SEQ ID NO: 6563446 - DNA, 16 bp, Homo sapiens
ttatgaacattgtact

SEQ ID NO: 6563447 - DNA, 18 bp, Homo sapiens
ttatgaacattgtactgt

SEQ ID NO: 6563448 - DNA, 19 bp, Homo sapiens
ttatgaacattgtactgtt

SEQ ID NO: 6563449 - DNA, 20 bp, Homo sapiens
ttatgaactgcatcaagact

SEQ ID NO: 6563450 - DNA, 23 bp, Homo sapiens
ttatgaactgcatcaagacttca

SEQ ID NO: 6563451 - DNA, 12 bp, Homo sapiens
ttatgaagaaaa

SEQ ID NO: 6563452 - DNA, 13 bp, Homo sapiens
ttatgaagaaaat

SEQ ID NO: 6563453 - DNA, 22 bp, Homo sapiens
ttatgaagaaaatacttaaatg

SEQ ID NO: 6563454 - DNA, 20 bp, Homo sapiens
ttatgaagaatacccaggaa

SEQ ID NO: 6563455 - DNA, 23 bp, Homo sapiens
ttatgaagaattgccaatcttgt

SEQ ID NO: 6563456 - DNA, 13 bp, Homo sapiens
ttatgaagatagt

SEQ ID NO: 6563457 - DNA, 23 bp, Homo sapiens
ttatgaagatgggggcctctttc

SEQ ID NO: 6563458 - DNA, 14 bp, Homo sapiens
ttatgaagatgttt

SEQ ID NO: 6563459 - DNA, 20 bp, Homo sapiens
ttatgaagcttttatgtgaa

SEQ ID NO: 6563460 - DNA, 12 bp, Homo sapiens
ttatgaaggaat

SEQ ID NO: 6563461 - DNA, 15 bp, Homo sapiens
ttatgaaggaatttg

SEQ ID NO: 6563462 - DNA, 20 bp, Homo sapiens
ttatgaagtgcgtgaatgta

SEQ ID NO: 6563463 - DNA, 16 bp, Homo sapiens
ttatgaagtttaaaac

SEQ ID NO: 6563464 - DNA, 20 bp, Homo sapiens
ttatgaagtttaaaacagta

SEQ ID NO: 6563465 - DNA, 22 bp, Homo sapiens
ttatgaagtttaaaacagtatt

SEQ ID NO: 6563466 - DNA, 20 bp, Homo sapiens
ttatgaagtttttaaaaata

SEQ ID NO: 6563467 - DNA, 17 bp, Homo sapiens
ttatgaatagacataaa

SEQ ID NO: 6563468 - DNA, 18 bp, Homo sapiens
ttatgaatagacataaat

SEQ ID NO: 6563469 - DNA, 19 bp, Homo sapiens
ttatgaatagacataaatt

SEQ ID NO: 6563470 - DNA, 21 bp, Homo sapiens
ttatgaatagacataaattgt

SEQ ID NO: 6563471 - DNA, 17 bp, Homo sapiens
ttatgaatatttataac

SEQ ID NO: 6563472 - DNA, 16 bp, Homo sapiens
ttatgaatccaacgtg

SEQ ID NO: 6563473 - DNA, 15 bp, Homo sapiens
ttatgaatcgcagac

SEQ ID NO: 6563474 - DNA, 20 bp, Homo sapiens
ttatgaatgtgaagccttcc

SEQ ID NO: 6563475 - DNA, 16 bp, Homo sapiens
ttatgaatgtgcattt

SEQ ID NO: 6563476 - DNA, 20 bp, Homo sapiens
ttatgaatgtgcatttcttg

SEQ ID NO: 6563477 - DNA, 13 bp, Homo sapiens
ttatgaatgtttc

SEQ ID NO: 6563478 - DNA, 21 bp, Homo sapiens
ttatgaattacatttgtataa

SEQ ID NO: 6563479 - DNA, 15 bp, Homo sapiens
ttatgaattattttg

SEQ ID NO: 6563480 - DNA, 20 bp, Homo sapiens
ttatgacaaatgaaagagaa

SEQ ID NO: 6563481 - DNA, 19 bp, Homo sapiens
ttatgacacaatgacacat

SEQ ID NO: 6563482 - DNA, 22 bp, Homo sapiens
ttatgacagccatttgtaatga

SEQ ID NO: 6563483 - DNA, 15 bp, Homo sapiens
ttatgacagtaattg

SEQ ID NO: 6563484 - DNA, 16 bp, Homo sapiens
ttatgacatcacttgt

SEQ ID NO: 6563485 - DNA, 18 bp, Homo sapiens
ttatgacatttcttaaaa

SEQ ID NO: 6563486 - DNA, 20 bp, Homo sapiens
ttatgacatttcttaaaact

SEQ ID NO: 6563487 - DNA, 20 bp, Homo sapiens
ttatgaccagagcaaaaatg

SEQ ID NO: 6563488 - DNA, 22 bp, Homo sapiens
ttatgaccagagcaaaaatgta

SEQ ID NO: 6563489 - DNA, 15 bp, Homo sapiens
ttatgacctcaacaa

SEQ ID NO: 6563490 - DNA, 22 bp, Homo sapiens
ttatgacctgaaataatatatt

SEQ ID NO: 6563491 - DNA, 15 bp, Homo sapiens
ttatgactaatcctt

SEQ ID NO: 6563492 - DNA, 16 bp, Homo sapiens
ttatgactatgtaaac

SEQ ID NO: 6563493 - DNA, 20 bp, Homo sapiens
ttatgactccactgtggaaa

SEQ ID NO: 6563494 - DNA, 21 bp, Homo sapiens
ttatgactccccccttccaaa

SEQ ID NO: 6563495 - DNA, 13 bp, Homo sapiens
ttatgactgtgaa

SEQ ID NO: 6563496 - DNA, 16 bp, Homo sapiens
ttatgactgtgaaatg

SEQ ID NO: 6563497 - DNA, 14 bp, Homo sapiens
ttatgactttcaca

SEQ ID NO: 6563498 - DNA, 16 bp, Homo sapiens
ttatgagactcttaaa

SEQ ID NO: 6563499 - DNA, 16 bp, Homo sapiens
ttatgagaggctgtca

SEQ ID NO: 6563500 - DNA, 17 bp, Homo sapiens
ttatgagaggctgtcat

SEQ ID NO: 6563501 - DNA, 16 bp, Homo sapiens
ttatgagatctaatgt

SEQ ID NO: 6563502 - DNA, 20 bp, Homo sapiens
ttatgagattggttttcctg

SEQ ID NO: 6563503 - DNA, 16 bp, Homo sapiens
ttatgagcagaaggaa

SEQ ID NO: 6563504 - DNA, 18 bp, Homo sapiens
ttatgagctacaacaaaa

SEQ ID NO: 6563505 - DNA, 14 bp, Homo sapiens
ttatgagcttccaa

SEQ ID NO: 6563506 - DNA, 22 bp, Homo sapiens
ttatgaggaaacttggacattt

SEQ ID NO: 6563507 - DNA, 17 bp, Homo sapiens
ttatgaggagctgcaga

SEQ ID NO: 6563508 - DNA, 18 bp, Homo sapiens
ttatgagggccacgggtc

SEQ ID NO: 6563509 - DNA, 20 bp, Homo sapiens
ttatgaggtgaaacaattat

SEQ ID NO: 6563510 - DNA, 16 bp, Homo sapiens
ttatgagtaaaagcag

SEQ ID NO: 6563511 - DNA, 20 bp, Homo sapiens
ttatgagtaactattattat

SEQ ID NO: 6563512 - DNA, 21 bp, Homo sapiens
ttatgagtttttgatagcttt

SEQ ID NO: 6563513 - DNA, 19 bp, Homo sapiens
ttatgataaaaaattttgt

SEQ ID NO: 6563514 - DNA, 16 bp, Homo sapiens
ttatgatagtgcaagg

SEQ ID NO: 6563515 - DNA, 13 bp, Homo sapiens
ttatgatatcatt

SEQ ID NO: 6563516 - DNA, 15 bp, Homo sapiens
ttatgatatcattgt

SEQ ID NO: 6563517 - DNA, 14 bp, Homo sapiens
ttatgatatttctt

SEQ ID NO: 6563518 - DNA, 18 bp, Homo sapiens
ttatgatcaaaagtgatt

SEQ ID NO: 6563519 - DNA, 15 bp, Homo sapiens
ttatgatcagtgttg

SEQ ID NO: 6563520 - DNA, 18 bp, Homo sapiens
ttatgatccagcagatta

SEQ ID NO: 6563521 - DNA, 14 bp, Homo sapiens
ttatgatctaataa

SEQ ID NO: 6563522 - DNA, 13 bp, Homo sapiens
ttatgatctatgt

SEQ ID NO: 6563523 - DNA, 15 bp, Homo sapiens
ttatgatctatttgt

SEQ ID NO: 6563524 - DNA, 19 bp, Homo sapiens
ttatgatctatttgtagat

SEQ ID NO: 6563525 - DNA, 22 bp, Homo sapiens
ttatgatgacgtacaagtagtt

SEQ ID NO: 6563526 - DNA, 23 bp, Homo sapiens
ttatgatgatgaaaattttacca

SEQ ID NO: 6563527 - DNA, 17 bp, Homo sapiens
ttatgatgcaaatctgc

SEQ ID NO: 6563528 - DNA, 20 bp, Homo sapiens
ttatgatgcatacagttttc

SEQ ID NO: 6563529 - DNA, 17 bp, Homo sapiens
ttatgatgctaagctga

SEQ ID NO: 6563530 - DNA, 21 bp, Homo sapiens
ttatgatggaagacaggaaag

SEQ ID NO: 6563531 - DNA, 23 bp, Homo sapiens
ttatgatggaagacaggaaagtt

SEQ ID NO: 6563532 - DNA, 16 bp, Homo sapiens
ttatgatgtatattta

SEQ ID NO: 6563533 - DNA, 11 bp, Homo sapiens
ttatgatgtgc

SEQ ID NO: 6563534 - DNA, 13 bp, Homo sapiens
ttatgatgtgctt

SEQ ID NO: 6563535 - DNA, 17 bp, Homo sapiens
ttatgatgtgcttaaca

SEQ ID NO: 6563536 - DNA, 19 bp, Homo sapiens
ttatgatgttagaagaaga

SEQ ID NO: 6563537 - DNA, 22 bp, Homo sapiens
ttatgattaagtaatgataact

SEQ ID NO: 6563538 - DNA, 12 bp, Homo sapiens
ttatgattcagt

SEQ ID NO: 6563539 - DNA, 18 bp, Homo sapiens
ttatgattgaatctactt

SEQ ID NO: 6563540 - DNA, 23 bp, Homo sapiens
ttatgattgaatctacttgcaca

SEQ ID NO: 6563541 - DNA, 21 bp, Homo sapiens
ttatgattgcctttttataac

SEQ ID NO: 6563542 - DNA, 15 bp, Homo sapiens
ttatgattgttatgt

SEQ ID NO: 6563543 - DNA, 13 bp, Homo sapiens
ttatgatttaata

SEQ ID NO: 6563544 - DNA, 20 bp, Homo sapiens
ttatgatttaataaaataat

SEQ ID NO: 6563545 - DNA, 16 bp, Homo sapiens
ttatgatttgtaacat

SEQ ID NO: 6563546 - DNA, 19 bp, Homo sapiens
ttatgatttttaaagaaaa

SEQ ID NO: 6563547 - DNA, 15 bp, Homo sapiens
ttatgcaaaagcaag

SEQ ID NO: 6563548 - DNA, 23 bp, Homo sapiens
ttatgcaaaagcagctaaatgta

SEQ ID NO: 6563549 - DNA, 15 bp, Homo sapiens
ttatgcaaatgagat

SEQ ID NO: 6563550 - DNA, 20 bp, Homo sapiens
ttatgcaaatgagatttctt

SEQ ID NO: 6563551 - DNA, 22 bp, Homo sapiens
ttatgcaaggaaggaaagaaag

SEQ ID NO: 6563552 - DNA, 23 bp, Homo sapiens
ttatgcaattaggtttttcctta

SEQ ID NO: 6563553 - DNA, 14 bp, Homo sapiens
ttatgcacatttgt

SEQ ID NO: 6563554 - DNA, 21 bp, Homo sapiens
ttatgcacatttgtgcataaa

SEQ ID NO: 6563555 - DNA, 22 bp, Homo sapiens
ttatgcactaaatatgaaccct

SEQ ID NO: 6563556 - DNA, 14 bp, Homo sapiens
ttatgcactggcca

SEQ ID NO: 6563557 - DNA, 22 bp, Homo sapiens
ttatgcactgtggtttcagatg

SEQ ID NO: 6563558 - DNA, 16 bp, Homo sapiens
ttatgcacttataagg

SEQ ID NO: 6563559 - DNA, 19 bp, Homo sapiens
ttatgcacttttagaaatg

SEQ ID NO: 6563560 - DNA, 17 bp, Homo sapiens
ttatgcagacagtctgt

SEQ ID NO: 6563561 - DNA, 22 bp, Homo sapiens
ttatgcagagacagctgtttga

SEQ ID NO: 6563562 - DNA, 18 bp, Homo sapiens
ttatgcagatagaatcaa

SEQ ID NO: 6563563 - DNA, 17 bp, Homo sapiens
ttatgcagctgttctgg

SEQ ID NO: 6563564 - DNA, 20 bp, Homo sapiens
ttatgcagcttccttttgag

SEQ ID NO: 6563565 - DNA, 17 bp, Homo sapiens
ttatgcaggcagattaa

SEQ ID NO: 6563566 - DNA, 23 bp, Homo sapiens
ttatgcaggggcaaacacctgct

SEQ ID NO: 6563567 - DNA, 17 bp, Homo sapiens
ttatgcataactgacaa

SEQ ID NO: 6563568 - DNA, 14 bp, Homo sapiens
ttatgcatagataa

SEQ ID NO: 6563569 - DNA, 16 bp, Homo sapiens
ttatgcatgaagtaat

SEQ ID NO: 6563570 - DNA, 22 bp, Homo sapiens
ttatgcatgaagtaatatgcac

SEQ ID NO: 6563571 - DNA, 11 bp, Homo sapiens
ttatgcatgag

SEQ ID NO: 6563572 - DNA, 18 bp, Homo sapiens
ttatgcatttcaatttca

SEQ ID NO: 6563573 - DNA, 13 bp, Homo sapiens
ttatgcatttcat

SEQ ID NO: 6563574 - DNA, 23 bp, Homo sapiens
ttatgccacccccgctggaggat

SEQ ID NO: 6563575 - DNA, 16 bp, Homo sapiens
ttatgccacctgaata

SEQ ID NO: 6563576 - DNA, 14 bp, Homo sapiens
ttatgccagctcca

SEQ ID NO: 6563577 - DNA, 22 bp, Homo sapiens
ttatgccagggcgcactttcca

SEQ ID NO: 6563578 - DNA, 17 bp, Homo sapiens
ttatgccagttgttaaa

SEQ ID NO: 6563579 - DNA, 18 bp, Homo sapiens
ttatgccatttgtttatt

SEQ ID NO: 6563580 - DNA, 21 bp, Homo sapiens
ttatgcccagtttctgcctct

SEQ ID NO: 6563581 - DNA, 17 bp, Homo sapiens
ttatgccggatgtgctt

SEQ ID NO: 6563582 - DNA, 19 bp, Homo sapiens
ttatgccgtctcatatttt

SEQ ID NO: 6563583 - DNA, 20 bp, Homo sapiens
ttatgccgtctcatattttt

SEQ ID NO: 6563584 - DNA, 18 bp, Homo sapiens
tttgatttgtctcatata

SEQ ID NO: 6563585 - DNA, 23 bp, Homo sapiens
tttgattttgctgactttaaaag

SEQ ID NO: 6563586 - DNA, 11 bp, Homo sapiens
tttgatttttg

SEQ ID NO: 6563587 - DNA, 20 bp, Homo sapiens
tttgattttttgctgcagac

SEQ ID NO: 6563588 - DNA, 20 bp, Homo sapiens
tttgcaaaatcacttagcag

SEQ ID NO: 6563589 - DNA, 13 bp, Homo sapiens
tttgcaaagtact

SEQ ID NO: 6563590 - DNA, 15 bp, Homo sapiens
tttgcaaagtactgt

SEQ ID NO: 6563591 - DNA, 16 bp, Homo sapiens
tttgcaaagtactgta

SEQ ID NO: 6563592 - DNA, 17 bp, Homo sapiens
tttgcaaagtactgtaa

SEQ ID NO: 6563593 - DNA, 22 bp, Homo sapiens
tttgcaaagtattgtaaattat

SEQ ID NO: 6563594 - DNA, 13 bp, Homo sapiens
tttgcaaataagt

SEQ ID NO: 6563595 - DNA, 17 bp, Homo sapiens
tttgcaaatataaacat

SEQ ID NO: 6563596 - DNA, 23 bp, Homo sapiens
tttgcaacagcaaattaatgtgt

SEQ ID NO: 6563597 - DNA, 21 bp, Homo sapiens
tttgcaacagcagtgttctgg

SEQ ID NO: 6563598 - DNA, 23 bp, Homo sapiens
tttgcaacaggggaggaaaaaag

SEQ ID NO: 6563599 - DNA, 18 bp, Homo sapiens
tttgcaacatataaagta

SEQ ID NO: 6563600 - DNA, 14 bp, Homo sapiens
tttgcaacatatga

SEQ ID NO: 6563601 - DNA, 13 bp, Homo sapiens
tttgcaacattta

SEQ ID NO: 6563602 - DNA, 14 bp, Homo sapiens
tttgcaaccaggaa

SEQ ID NO: 6563603 - DNA, 19 bp, Homo sapiens
tttgcaaccttgtacttta

SEQ ID NO: 6563604 - DNA, 14 bp, Homo sapiens
tttgcaacgctcac

SEQ ID NO: 6563605 - DNA, 23 bp, Homo sapiens
tttgcaacttcaagggacaagta

SEQ ID NO: 6563606 - DNA, 13 bp, Homo sapiens
tttgcaagaacca

SEQ ID NO: 6563607 - DNA, 22 bp, Homo sapiens
tttgcaagaatgaaatgaatga

SEQ ID NO: 6563608 - DNA, 14 bp, Homo sapiens
tttgcaagccagat

SEQ ID NO: 6563609 - DNA, 22 bp, Homo sapiens
tttgcaagctctggaattgttg

SEQ ID NO: 6563610 - DNA, 12 bp, Homo sapiens
tttgcaaggaag

SEQ ID NO: 6563611 - DNA, 21 bp, Homo sapiens
tttgcaagggaaaagtctctt

SEQ ID NO: 6563612 - DNA, 21 bp, Homo sapiens
tttgcaagggaatgaatccat

SEQ ID NO: 6563613 - DNA, 21 bp, Homo sapiens
tttgcaaggtgcatttttact

SEQ ID NO: 6563614 - DNA, 17 bp, Homo sapiens
tttgcaagtcatggctg

SEQ ID NO: 6563615 - DNA, 14 bp, Homo sapiens
tttgcaagtgctgg

SEQ ID NO: 6563616 - DNA, 19 bp, Homo sapiens
tttgcaataacagctgcaa

SEQ ID NO: 6563617 - DNA, 13 bp, Homo sapiens
tttgcaataatgc

SEQ ID NO: 6563618 - DNA, 14 bp, Homo sapiens
tttgcaataatgca

SEQ ID NO: 6563619 - DNA, 15 bp, Homo sapiens
tttgcaatactgctt

SEQ ID NO: 6563620 - DNA, 14 bp, Homo sapiens
tttgcaatatttat

SEQ ID NO: 6563621 - DNA, 11 bp, Homo sapiens
tttgcaatgta

SEQ ID NO: 6563622 - DNA, 18 bp, Homo sapiens
tttgcaattattctaatt

SEQ ID NO: 6563623 - DNA, 15 bp, Homo sapiens
tttgcaattcatgta

SEQ ID NO: 6563624 - DNA, 17 bp, Homo sapiens
tttgcaattctttttgg

SEQ ID NO: 6563625 - DNA, 14 bp, Homo sapiens
tttgcacaatattt

SEQ ID NO: 6563626 - DNA, 12 bp, Homo sapiens
tttgcacacaaa

SEQ ID NO: 6563627 - DNA, 19 bp, Homo sapiens
tttgcacacattggccgct

SEQ ID NO: 6563628 - DNA, 19 bp, Homo sapiens
tttgcacaccattttgtaa

SEQ ID NO: 6563629 - DNA, 21 bp, Homo sapiens
tttgcacacctgttattgcca

SEQ ID NO: 6563630 - DNA, 14 bp, Homo sapiens
tttgcacagagggc

SEQ ID NO: 6563631 - DNA, 16 bp, Homo sapiens
tttgcacagctctccg

SEQ ID NO: 6563632 - DNA, 13 bp, Homo sapiens
tttgcacataaaa

SEQ ID NO: 6563633 - DNA, 17 bp, Homo sapiens
tttgcacatatattttt

SEQ ID NO: 6563634 - DNA, 18 bp, Homo sapiens
tttgcacatgggattgct

SEQ ID NO: 6563635 - DNA, 23 bp, Homo sapiens
tttgcacatgtaacatagattta

SEQ ID NO: 6563636 - DNA, 15 bp, Homo sapiens
tttgcacattccaaa

SEQ ID NO: 6563637 - DNA, 23 bp, Homo sapiens
tttgcacattttgtggctgttga

SEQ ID NO: 6563638 - DNA, 17 bp, Homo sapiens
tttgcaccaaagacatc

SEQ ID NO: 6563639 - DNA, 18 bp, Homo sapiens
tttgcacccatgccatag

SEQ ID NO: 6563640 - DNA, 17 bp, Homo sapiens
tttgcaccccatgctgt

SEQ ID NO: 6563641 - DNA, 15 bp, Homo sapiens
tttgcacccctccca

SEQ ID NO: 6563642 - DNA, 22 bp, Homo sapiens
tttgcaccctgtagatgttcta

SEQ ID NO: 6563643 - DNA, 13 bp, Homo sapiens
tttgcacctgtcc

SEQ ID NO: 6563644 - DNA, 16 bp, Homo sapiens
tttgcacctttctagt

SEQ ID NO: 6563645 - DNA, 21 bp, Homo sapiens
tttgcacctttctagttgaaa

SEQ ID NO: 6563646 - DNA, 21 bp, Homo sapiens
tttgcacgaattttaaaacat

SEQ ID NO: 6563647 - DNA, 20 bp, Homo sapiens
tttgcacgacgccctctccc

SEQ ID NO: 6563648 - DNA, 19 bp, Homo sapiens
tttgcactaaatcagagac

SEQ ID NO: 6563649 - DNA, 19 bp, Homo sapiens
tttgcactcaaatcttaag

SEQ ID NO: 6563650 - DNA, 14 bp, Homo sapiens
tttgcactctgtaa

SEQ ID NO: 6563651 - DNA, 23 bp, Homo sapiens
tttgcactcttgtttctcccgtg

SEQ ID NO: 6563652 - DNA, 10 bp, Homo sapiens
tttgcactga

SEQ ID NO: 6563653 - DNA, 22 bp, Homo sapiens
tttgcactgtaaattgctggca

SEQ ID NO: 6563654 - DNA, 13 bp, Homo sapiens
tttgcactgtaat

SEQ ID NO: 6563655 - DNA, 17 bp, Homo sapiens
tttgcactgtgtgctga

SEQ ID NO: 6563656 - DNA, 15 bp, Homo sapiens
tttgcacttaaaaat

SEQ ID NO: 6563657 - DNA, 17 bp, Homo sapiens
tttgcacttatgtactt

SEQ ID NO: 6563658 - DNA, 20 bp, Homo sapiens
tttgcagaaaagcacctgcc

SEQ ID NO: 6563659 - DNA, 22 bp, Homo sapiens
tttgcagaaaagcacctgccga

SEQ ID NO: 6563660 - DNA, 17 bp, Homo sapiens
tttgcagaagagggtgt

SEQ ID NO: 6563661 - DNA, 15 bp, Homo sapiens
tttgcagaaggaaat

SEQ ID NO: 6563662 - DNA, 12 bp, Homo sapiens
tttgcagaggct

SEQ ID NO: 6563663 - DNA, 23 bp, Homo sapiens
tttgcagagtggaaactcagccg

SEQ ID NO: 6563664 - DNA, 18 bp, Homo sapiens
tttgcagatgttcaaata

SEQ ID NO: 6563665 - DNA, 22 bp, Homo sapiens
tttgcagatgttcaaatattgt

SEQ ID NO: 6563666 - DNA, 21 bp, Homo sapiens
tttgcagcagtgagtctcttc

SEQ ID NO: 6563667 - DNA, 14 bp, Homo sapiens
tttgcagccaaggt

SEQ ID NO: 6563668 - DNA, 16 bp, Homo sapiens
tttgcagcgactggca

SEQ ID NO: 6563669 - DNA, 20 bp, Homo sapiens
tttgcagctatggacaattt

SEQ ID NO: 6563670 - DNA, 22 bp, Homo sapiens
tttgcagctgttttcaaagccc

SEQ ID NO: 6563671 - DNA, 15 bp, Homo sapiens
tttgcaggaaatcct

SEQ ID NO: 6563672 - DNA, 19 bp, Homo sapiens
tttgcaggacttgcacaca

SEQ ID NO: 6563673 - DNA, 23 bp, Homo sapiens
tttgcaggatttttagagcatta

SEQ ID NO: 6563674 - DNA, 21 bp, Homo sapiens
tttgcaggctctgggctcagg

SEQ ID NO: 6563675 - DNA, 15 bp, Homo sapiens
tttgcagggagacca

SEQ ID NO: 6563676 - DNA, 16 bp, Homo sapiens
tttgcagggcagcccc

SEQ ID NO: 6563677 - DNA, 22 bp, Homo sapiens
tttgcaggtctggtttatataa

SEQ ID NO: 6563678 - DNA, 22 bp, Homo sapiens
tttgcaggtctttaaatcattt

SEQ ID NO: 6563679 - DNA, 22 bp, Homo sapiens
tttgcaggtggccaagttcctc

SEQ ID NO: 6563680 - DNA, 12 bp, Homo sapiens
tttgcagtaact

SEQ ID NO: 6563681 - DNA, 17 bp, Homo sapiens
tttgcagtaactgtttt

SEQ ID NO: 6563682 - DNA, 14 bp, Homo sapiens
tttgcagtgaagat

SEQ ID NO: 6563683 - DNA, 17 bp, Homo sapiens
tttgcagtgaagatgtg

SEQ ID NO: 6563684 - DNA, 15 bp, Homo sapiens
tttgcagtgtgcata

SEQ ID NO: 6563685 - DNA, 17 bp, Homo sapiens
tttgcagttctttggct

SEQ ID NO: 6563686 - DNA, 17 bp, Homo sapiens
tttgcagttgagagggg

SEQ ID NO: 6563687 - DNA, 12 bp, Homo sapiens
tttgcataaagg

SEQ ID NO: 6563688 - DNA, 15 bp, Homo sapiens
tttgcataaattaat

SEQ ID NO: 6563689 - DNA, 17 bp, Homo sapiens
tttgcataacaattcct

SEQ ID NO: 6563690 - DNA, 20 bp, Homo sapiens
tttgcataacaattcctcta

SEQ ID NO: 6563691 - DNA, 14 bp, Homo sapiens
tttgcataatgcaa

SEQ ID NO: 6563692 - DNA, 22 bp, Homo sapiens
tttgcatacatgaataaaaata

SEQ ID NO: 6563693 - DNA, 17 bp, Homo sapiens
tttgcatacattcttca

SEQ ID NO: 6563694 - DNA, 15 bp, Homo sapiens
tttgcatagaataat

SEQ ID NO: 6563695 - DNA, 17 bp, Homo sapiens
tttgcatagaataatga

SEQ ID NO: 6563696 - DNA, 21 bp, Homo sapiens
tttgcatagattccctgagca

SEQ ID NO: 6563697 - DNA, 14 bp, Homo sapiens
tttgcatatatgtt

SEQ ID NO: 6563698 - DNA, 20 bp, Homo sapiens
tttgcatatcacccttccct

SEQ ID NO: 6563699 - DNA, 20 bp, Homo sapiens
tttgcatatcagtcatgact

SEQ ID NO: 6563700 - DNA, 15 bp, Homo sapiens
tttgcatattgcata

SEQ ID NO: 6563701 - DNA, 22 bp, Homo sapiens
tttgcatattttgagaaactgc

SEQ ID NO: 6563702 - DNA, 15 bp, Homo sapiens
tttgcatccagcagc

SEQ ID NO: 6563703 - DNA, 21 bp, Homo sapiens
tttgcatcccccaaacttctt

SEQ ID NO: 6563704 - DNA, 19 bp, Homo sapiens
tttgcatgatatcttcaag

SEQ ID NO: 6563705 - DNA, 17 bp, Homo sapiens
tttgcatgtcgcacaat

SEQ ID NO: 6563706 - DNA, 16 bp, Homo sapiens
tttgcatgtctaattc

SEQ ID NO: 6563707 - DNA, 14 bp, Homo sapiens
tttgcatgttccac

SEQ ID NO: 6563708 - DNA, 23 bp, Homo sapiens
tttgcatgtttaataatatgtac

SEQ ID NO: 6563709 - DNA, 14 bp, Homo sapiens
tttgcattaaatta

SEQ ID NO: 6563710 - DNA, 22 bp, Homo sapiens
tttgcattaaattcacaaactt

SEQ ID NO: 6563711 - DNA, 16 bp, Homo sapiens
tttgcattagacagat

SEQ ID NO: 6563712 - DNA, 16 bp, Homo sapiens
tttgcattatgtattt

SEQ ID NO: 6563713 - DNA, 10 bp, Homo sapiens
tttgcattca

SEQ ID NO: 6563714 - DNA, 13 bp, Homo sapiens
tttgcattcaaat

SEQ ID NO: 6563715 - DNA, 11 bp, Homo sapiens
tttgcattcat

SEQ ID NO: 6563716 - DNA, 18 bp, Homo sapiens
tttgcattccagcgtctg

SEQ ID NO: 6563717 - DNA, 22 bp, Homo sapiens
tttgcattccagcgtctgctgt

SEQ ID NO: 6563718 - DNA, 13 bp, Homo sapiens
tttgcattccatg

SEQ ID NO: 6563719 - DNA, 19 bp, Homo sapiens
tttgcattccttacttgca

SEQ ID NO: 6563720 - DNA, 15 bp, Homo sapiens
tttgcattccttaga

SEQ ID NO: 6563721 - DNA, 13 bp, Homo sapiens
tttgcattctccc

SEQ ID NO: 6563722 - DNA, 16 bp, Homo sapiens
tttgcattcttattca

SEQ ID NO: 6563723 - DNA, 19 bp, Homo sapiens
tttgcattgaacacaaact

SEQ ID NO: 6563724 - DNA, 13 bp, Homo sapiens
tttgcattgtctg

SEQ ID NO: 6563725 - DNA, 16 bp, Homo sapiens
tttgcatttaaaacag

SEQ ID NO: 6563726 - DNA, 19 bp, Homo sapiens
tttgcatttaaaacagaca

SEQ ID NO: 6563727 - DNA, 21 bp, Homo sapiens
tttgcatttaaaacagacact

SEQ ID NO: 6563728 - DNA, 15 bp, Homo sapiens
tttgcatttatttat

SEQ ID NO: 6563729 - DNA, 13 bp, Homo sapiens
tttgcatttcaga

SEQ ID NO: 6563730 - DNA, 15 bp, Homo sapiens
tttgcatttcagaaa

SEQ ID NO: 6563731 - DNA, 21 bp, Homo sapiens
tttgcatttctcttcctaaat

SEQ ID NO: 6563732 - DNA, 13 bp, Homo sapiens
tttgcattttctg

SEQ ID NO: 6563733 - DNA, 22 bp, Homo sapiens
tttgcattttgccgctgagata

SEQ ID NO: 6563734 - DNA, 23 bp, Homo sapiens
tttgcatttttgtattttgtaca

SEQ ID NO: 6563735 - DNA, 24 bp, Homo sapiens
tttgcatttttgttttgaaagttt

SEQ ID NO: 6563736 - DNA, 19 bp, Homo sapiens
tttgccaaaaaaaaaagaa

SEQ ID NO: 6563737 - DNA, 19 bp, Homo sapiens
tttgccaaaataatgtctt

SEQ ID NO: 6563738 - DNA, 14 bp, Homo sapiens
tttgccaacattgc

SEQ ID NO: 6563739 - DNA, 19 bp, Homo sapiens
tttgccaagccctttgctg

SEQ ID NO: 6563740 - DNA, 18 bp, Homo sapiens
tttgccaagctgaagcta

SEQ ID NO: 6563741 - DNA, 23 bp, Homo sapiens
tttgccaagttgctgtcactgtt

SEQ ID NO: 6563742 - DNA, 12 bp, Homo sapiens
tttgccaataaa

SEQ ID NO: 6563743 - DNA, 15 bp, Homo sapiens
tttgccaatttgcac

SEQ ID NO: 6563744 - DNA, 15 bp, Homo sapiens
tttgccacagctttt

SEQ ID NO: 6563745 - DNA, 18 bp, Homo sapiens
tttgccacagcttttgca

SEQ ID NO: 6563746 - DNA, 13 bp, Homo sapiens
tttgccacataca

SEQ ID NO: 6563747 - DNA, 23 bp, Homo sapiens
tttgccacatacatagatcttca

SEQ ID NO: 6563748 - DNA, 19 bp, Homo sapiens
tttgccaccactagagctg

SEQ ID NO: 6563749 - DNA, 16 bp, Homo sapiens
tttgccacctttcctg

SEQ ID NO: 6563750 - DNA, 20 bp, Homo sapiens
tttgccactaattttagtat

SEQ ID NO: 6563751 - DNA, 21 bp, Homo sapiens
tttgccactaattttagtatt

SEQ ID NO: 6563752 - DNA, 18 bp, Homo sapiens
tttgccactttggcttct

SEQ ID NO: 6563753 - DNA, 21 bp, Homo sapiens
tttgccagagccaaattttat

SEQ ID NO: 6563754 - DNA, 10 bp, Homo sapiens
tttgccagca

SEQ ID NO: 6563755 - DNA, 20 bp, Homo sapiens
tttgccagctgctgctggat

SEQ ID NO: 6563756 - DNA, 14 bp, Homo sapiens
tttgccagtcttta

SEQ ID NO: 6563757 - DNA, 15 bp, Homo sapiens
tttgccagtgggaac

SEQ ID NO: 6563758 - DNA, 19 bp, Homo sapiens
tttgccagttttccctgga

SEQ ID NO: 6563759 - DNA, 22 bp, Homo sapiens
tttgccatagagtacactgcct

SEQ ID NO: 6563760 - DNA, 19 bp, Homo sapiens
tttgccatagcagtgctag

SEQ ID NO: 6563761 - DNA, 15 bp, Homo sapiens
tttgccatgctgcta

SEQ ID NO: 6563762 - DNA, 19 bp, Homo sapiens
tttgccatgggcctgctgc

SEQ ID NO: 6563763 - DNA, 20 bp, Homo sapiens
ttatgcctgagttataaata

SEQ ID NO: 6563764 - DNA, 17 bp, Homo sapiens
ttatgccttttttgatc

SEQ ID NO: 6563765 - DNA, 20 bp, Homo sapiens
ttatgcgcaaatacaaaatg

SEQ ID NO: 6563766 - DNA, 22 bp, Homo sapiens
ttatgcgcaaatacaaaatgat

SEQ ID NO: 6563767 - DNA, 16 bp, Homo sapiens
ttatgctaactgtaga

SEQ ID NO: 6563768 - DNA, 20 bp, Homo sapiens
ttatgctaagaattttttat

SEQ ID NO: 6563769 - DNA, 19 bp, Homo sapiens
ttatgctactgaactgaaa

SEQ ID NO: 6563770 - DNA, 17 bp, Homo sapiens
ttatgctctcactgttt

SEQ ID NO: 6563771 - DNA, 21 bp, Homo sapiens
ttatgctcttttttactcatt

SEQ ID NO: 6563772 - DNA, 15 bp, Homo sapiens
ttatgctgatttatt

SEQ ID NO: 6563773 - DNA, 13 bp, Homo sapiens
ttatgctgcttta

SEQ ID NO: 6563774 - DNA, 18 bp, Homo sapiens
ttatgctgtaaaagcaag

SEQ ID NO: 6563775 - DNA, 18 bp, Homo sapiens
ttatgctgtagtcttacc

SEQ ID NO: 6563776 - DNA, 20 bp, Homo sapiens
ttatgctgtattttaacact

SEQ ID NO: 6563777 - DNA, 22 bp, Homo sapiens
ttatgctgtattttaacacttt

SEQ ID NO: 6563778 - DNA, 22 bp, Homo sapiens
ttatgcttaaaatatgtatgtc

SEQ ID NO: 6563779 - DNA, 21 bp, Homo sapiens
ttatgcttccacaggcaaaac

SEQ ID NO: 6563780 - DNA, 22 bp, Homo sapiens
ttatgctttaacttcagagtga

SEQ ID NO: 6563781 - DNA, 13 bp, Homo sapiens
ttatgctttgaac

SEQ ID NO: 6563782 - DNA, 16 bp, Homo sapiens
ttatgctttgaacttt

SEQ ID NO: 6563783 - DNA, 17 bp, Homo sapiens
ttatgctttgaacttta

SEQ ID NO: 6563784 - DNA, 12 bp, Homo sapiens
ttatgcttttgg

SEQ ID NO: 6563785 - DNA, 22 bp, Homo sapiens
ttatggaaaaattgacaaaaaa

SEQ ID NO: 6563786 - DNA, 14 bp, Homo sapiens
ttatggaacaggga

SEQ ID NO: 6563787 - DNA, 23 bp, Homo sapiens
ttatggaagatagttttctcctt

SEQ ID NO: 6563788 - DNA, 19 bp, Homo sapiens
ttatggaattaaccattta

SEQ ID NO: 6563789 - DNA, 19 bp, Homo sapiens
ttatggaattgatttgcat

SEQ ID NO: 6563790 - DNA, 20 bp, Homo sapiens
ttatggaattgatttgcatt

SEQ ID NO: 6563791 - DNA, 11 bp, Homo sapiens
ttatggacatc

SEQ ID NO: 6563792 - DNA, 16 bp, Homo sapiens
ttatggactgttttga

SEQ ID NO: 6563793 - DNA, 14 bp, Homo sapiens
ttatggagacctct

SEQ ID NO: 6563794 - DNA, 19 bp, Homo sapiens
ttatggagacctctccttc

SEQ ID NO: 6563795 - DNA, 16 bp, Homo sapiens
ttatggagtcttgtgc

SEQ ID NO: 6563796 - DNA, 20 bp, Homo sapiens
ttatggatgattaaatttta

SEQ ID NO: 6563797 - DNA, 15 bp, Homo sapiens
ttatggattaaaaac

SEQ ID NO: 6563798 - DNA, 20 bp, Homo sapiens
ttatggatttggactcgaaa

SEQ ID NO: 6563799 - DNA, 14 bp, Homo sapiens
ttatggcaaaagta

SEQ ID NO: 6563800 - DNA, 14 bp, Homo sapiens
ttatggcacatcag

SEQ ID NO: 6563801 - DNA, 13 bp, Homo sapiens
ttatggcatgatt

SEQ ID NO: 6563802 - DNA, 15 bp, Homo sapiens
ttatggcatttagta

SEQ ID NO: 6563803 - DNA, 23 bp, Homo sapiens
ttatggcatttagtaccttcaaa

SEQ ID NO: 6563804 - DNA, 13 bp, Homo sapiens
ttatggcctcagc

SEQ ID NO: 6563805 - DNA, 14 bp, Homo sapiens
ttatggccttgaag

SEQ ID NO: 6563806 - DNA, 16 bp, Homo sapiens
ttatggccttgaagtg

SEQ ID NO: 6563807 - DNA, 17 bp, Homo sapiens
ttatggctataggtgct

SEQ ID NO: 6563808 - DNA, 21 bp, Homo sapiens
ttatggctcactatgaatcta

SEQ ID NO: 6563809 - DNA, 16 bp, Homo sapiens
ttatggcttataaatg

SEQ ID NO: 6563810 - DNA, 16 bp, Homo sapiens
ttatggcttgtgaact

SEQ ID NO: 6563811 - DNA, 16 bp, Homo sapiens
ttatggcttttgtgca

SEQ ID NO: 6563812 - DNA, 14 bp, Homo sapiens
ttatgggaacaagt

SEQ ID NO: 6563813 - DNA, 18 bp, Homo sapiens
ttatgggaacaagtgtac

SEQ ID NO: 6563814 - DNA, 22 bp, Homo sapiens
ttatgggaacaagtgtacagaa

SEQ ID NO: 6563815 - DNA, 23 bp, Homo sapiens
ttatgggaaccccttcatcctct

SEQ ID NO: 6563816 - DNA, 19 bp, Homo sapiens
ttatgggaataattgcttt

SEQ ID NO: 6563817 - DNA, 12 bp, Homo sapiens
ttatgggagaat

SEQ ID NO: 6563818 - DNA, 19 bp, Homo sapiens
ttatgggatcatttttcca

SEQ ID NO: 6563819 - DNA, 16 bp, Homo sapiens
ttatgggatctcaaca

SEQ ID NO: 6563820 - DNA, 18 bp, Homo sapiens
ttatgggatgtaaacaat

SEQ ID NO: 6563821 - DNA, 22 bp, Homo sapiens
ttatgggcattgacaaatctgt

SEQ ID NO: 6563822 - DNA, 15 bp, Homo sapiens
ttatgggggggaggg

SEQ ID NO: 6563823 - DNA, 22 bp, Homo sapiens
ttatggggtattttaagcattc

SEQ ID NO: 6563824 - DNA, 13 bp, Homo sapiens
ttatgggtcacag

SEQ ID NO: 6563825 - DNA, 15 bp, Homo sapiens
ttatgggtcctgcaa

SEQ ID NO: 6563826 - DNA, 14 bp, Homo sapiens
ttatgggtggcttt

SEQ ID NO: 6563827 - DNA, 16 bp, Homo sapiens
ttatgggtttcttcca

SEQ ID NO: 6563828 - DNA, 13 bp, Homo sapiens
ttatgggttttta

SEQ ID NO: 6563829 - DNA, 21 bp, Homo sapiens
ttatggtaactgctttctgtt

SEQ ID NO: 6563830 - DNA, 23 bp, Homo sapiens
ttatggtaactgctttctgttcc

SEQ ID NO: 6563831 - DNA, 21 bp, Homo sapiens
ttatggtaatcagttttgtat

SEQ ID NO: 6563832 - DNA, 16 bp, Homo sapiens
ttatggtaatcatatt

SEQ ID NO: 6563833 - DNA, 16 bp, Homo sapiens
ttatggtacactccag

SEQ ID NO: 6563834 - DNA, 21 bp, Homo sapiens
ttatggtactaatgaaattta

SEQ ID NO: 6563835 - DNA, 13 bp, Homo sapiens
ttatggtagaaaa

SEQ ID NO: 6563836 - DNA, 14 bp, Homo sapiens
ttatggtattttcg

SEQ ID NO: 6563837 - DNA, 22 bp, Homo sapiens
ttatggtcaatcccaaaagtca

SEQ ID NO: 6563838 - DNA, 17 bp, Homo sapiens
ttatggtccagaaactc

SEQ ID NO: 6563839 - DNA, 21 bp, Homo sapiens
ttatggtcctaaaagcaaaat

SEQ ID NO: 6563840 - DNA, 11 bp, Homo sapiens
ttatggtgaaa

SEQ ID NO: 6563841 - DNA, 16 bp, Homo sapiens
ttatggtgatgactta

SEQ ID NO: 6563842 - DNA, 23 bp, Homo sapiens
ttatggtggaagaggttctcagc

SEQ ID NO: 6563843 - DNA, 17 bp, Homo sapiens
ttatggtgtgttcctaa

SEQ ID NO: 6563844 - DNA, 13 bp, Homo sapiens
ttatggtgtttct

SEQ ID NO: 6563845 - DNA, 20 bp, Homo sapiens
ttatggtgtttctccctctc

SEQ ID NO: 6563846 - DNA, 22 bp, Homo sapiens
ttatggttatgttcatctaaac

SEQ ID NO: 6563847 - DNA, 15 bp, Homo sapiens
ttatggtttaatgtt

SEQ ID NO: 6563848 - DNA, 22 bp, Homo sapiens
ttatggtttaatgttacaacaa

SEQ ID NO: 6563849 - DNA, 13 bp, Homo sapiens
ttatgtaaaagaa

SEQ ID NO: 6563850 - DNA, 20 bp, Homo sapiens
ttatgtaaaaggccaaacct

SEQ ID NO: 6563851 - DNA, 22 bp, Homo sapiens
ttatgtaaaaggccaaacctct

SEQ ID NO: 6563852 - DNA, 15 bp, Homo sapiens
ttatgtaaacaaatc

SEQ ID NO: 6563853 - DNA, 23 bp, Homo sapiens
ttatgtaaacaaatctttccata

SEQ ID NO: 6563854 - DNA, 12 bp, Homo sapiens
ttatgtaaataa

SEQ ID NO: 6563855 - DNA, 16 bp, Homo sapiens
ttatgtaaataactct

SEQ ID NO: 6563856 - DNA, 15 bp, Homo sapiens
ttatgtaaataattc

SEQ ID NO: 6563857 - DNA, 16 bp, Homo sapiens
ttatgtaaataattct

SEQ ID NO: 6563858 - DNA, 21 bp, Homo sapiens
ttatgtaaatcacttcattgt

SEQ ID NO: 6563859 - DNA, 22 bp, Homo sapiens
ttatgtaaatcacttcattgtt

SEQ ID NO: 6563860 - DNA, 12 bp, Homo sapiens
ttatgtaaatcc

SEQ ID NO: 6563861 - DNA, 22 bp, Homo sapiens
ttatgtaaatcccattattcaa

SEQ ID NO: 6563862 - DNA, 21 bp, Homo sapiens
ttatgtaacaaagtttgctga

SEQ ID NO: 6563863 - DNA, 23 bp, Homo sapiens
ttatgtaacatagtccagagaac

SEQ ID NO: 6563864 - DNA, 18 bp, Homo sapiens
ttatgtaacatccagaag

SEQ ID NO: 6563865 - DNA, 18 bp, Homo sapiens
ttatgtaagaagaaactg

SEQ ID NO: 6563866 - DNA, 20 bp, Homo sapiens
ttatgtaagcatttgtacat

SEQ ID NO: 6563867 - DNA, 19 bp, Homo sapiens
ttatgtaagtttctaagaa

SEQ ID NO: 6563868 - DNA, 16 bp, Homo sapiens
ttatgtaagtttgcat

SEQ ID NO: 6563869 - DNA, 16 bp, Homo sapiens
ttatgtaataatgtga

SEQ ID NO: 6563870 - DNA, 20 bp, Homo sapiens
ttatgtaatatattgtacaa

SEQ ID NO: 6563871 - DNA, 13 bp, Homo sapiens
ttatgtaatttca

SEQ ID NO: 6563872 - DNA, 17 bp, Homo sapiens
ttatgtaatttctttaa

SEQ ID NO: 6563873 - DNA, 11 bp, Homo sapiens
ttatgtacaaa

SEQ ID NO: 6563874 - DNA, 17 bp, Homo sapiens
ttatgtacaaaatgaat

SEQ ID NO: 6563875 - DNA, 23 bp, Homo sapiens
ttatgtacaaaatgaattgcctt

SEQ ID NO: 6563876 - DNA, 12 bp, Homo sapiens
ttatgtacaaac

SEQ ID NO: 6563877 - DNA, 14 bp, Homo sapiens
ttatgtacaaacta

SEQ ID NO: 6563878 - DNA, 13 bp, Homo sapiens
ttatgtacaacat

SEQ ID NO: 6563879 - DNA, 15 bp, Homo sapiens
ttatgtacaaccctg

SEQ ID NO: 6563880 - DNA, 17 bp, Homo sapiens
ttatgtacaaccctgac

SEQ ID NO: 6563881 - DNA, 14 bp, Homo sapiens
ttatgtacacaaat

SEQ ID NO: 6563882 - DNA, 18 bp, Homo sapiens
ttatgtactgtactaatt

SEQ ID NO: 6563883 - DNA, 11 bp, Homo sapiens
ttatgtacttt

SEQ ID NO: 6563884 - DNA, 20 bp, Homo sapiens
ttatgtagacaaaacttata

SEQ ID NO: 6563885 - DNA, 14 bp, Homo sapiens
ttatgtagacattg

SEQ ID NO: 6563886 - DNA, 15 bp, Homo sapiens
ttatgtagacattgt

SEQ ID NO: 6563887 - DNA, 13 bp, Homo sapiens
ttatgtagagttt

SEQ ID NO: 6563888 - DNA, 16 bp, Homo sapiens
ttatgtagcacataaa

SEQ ID NO: 6563889 - DNA, 13 bp, Homo sapiens
ttatgtagctctt

SEQ ID NO: 6563890 - DNA, 16 bp, Homo sapiens
ttatgtagctctttgt

SEQ ID NO: 6563891 - DNA, 19 bp, Homo sapiens
ttatgtagctgtcgtacat

SEQ ID NO: 6563892 - DNA, 19 bp, Homo sapiens
ttatgtagtaattgacatg

SEQ ID NO: 6563893 - DNA, 16 bp, Homo sapiens
ttatgtataaacataa

SEQ ID NO: 6563894 - DNA, 16 bp, Homo sapiens
ttatgtatatagatgt

SEQ ID NO: 6563895 - DNA, 17 bp, Homo sapiens
ttatgtatatagatgtg

SEQ ID NO: 6563896 - DNA, 21 bp, Homo sapiens
ttatgtatatttaaaagaaag

SEQ ID NO: 6563897 - DNA, 19 bp, Homo sapiens
ttatgtatcagtgtccttt

SEQ ID NO: 6563898 - DNA, 14 bp, Homo sapiens
ttatgtatctctat

SEQ ID NO: 6563899 - DNA, 19 bp, Homo sapiens
ttatgtatcttagttacat

SEQ ID NO: 6563900 - DNA, 20 bp, Homo sapiens
ttatgtatgtaaatagattt

SEQ ID NO: 6563901 - DNA, 19 bp, Homo sapiens
ttatgtatgtttacactgt

SEQ ID NO: 6563902 - DNA, 19 bp, Homo sapiens
ttatgtattattttctata

SEQ ID NO: 6563903 - DNA, 20 bp, Homo sapiens
ttatgtattgtgcaatgtgt

SEQ ID NO: 6563904 - DNA, 15 bp, Homo sapiens
ttatgtattgtttta

SEQ ID NO: 6563905 - DNA, 23 bp, Homo sapiens
ttatgtatttgttaaagaaacat

SEQ ID NO: 6563906 - DNA, 22 bp, Homo sapiens
ttatgtcaaactgtcttggctg

SEQ ID NO: 6563907 - DNA, 16 bp, Homo sapiens
ttatgtcatcagtaaa

SEQ ID NO: 6563908 - DNA, 18 bp, Homo sapiens
ttatgtcattttcagatc

SEQ ID NO: 6563909 - DNA, 15 bp, Homo sapiens
ttatgtccactgtgt

SEQ ID NO: 6563910 - DNA, 22 bp, Homo sapiens
ttatgtcccttcacatagtttt

SEQ ID NO: 6563911 - DNA, 17 bp, Homo sapiens
ttatgtcctgtgagatg

SEQ ID NO: 6563912 - DNA, 18 bp, Homo sapiens
ttatgtctaaaatcctgc

SEQ ID NO: 6563913 - DNA, 13 bp, Homo sapiens
ttatgtctaaaga

SEQ ID NO: 6563914 - DNA, 14 bp, Homo sapiens
ttatgtctcatgta

SEQ ID NO: 6563915 - DNA, 20 bp, Homo sapiens
ttatgtctcatgtaatttgc

SEQ ID NO: 6563916 - DNA, 13 bp, Homo sapiens
ttatgtctctgcc

SEQ ID NO: 6563917 - DNA, 15 bp, Homo sapiens
ttatgtctcttctga

SEQ ID NO: 6563918 - DNA, 13 bp, Homo sapiens
ttatgtctcttga

SEQ ID NO: 6563919 - DNA, 17 bp, Homo sapiens
ttatgtctgtttaagaa

SEQ ID NO: 6563920 - DNA, 16 bp, Homo sapiens
ttatgtcttcttttgt

SEQ ID NO: 6563921 - DNA, 13 bp, Homo sapiens
ttatgtcttggac

SEQ ID NO: 6563922 - DNA, 17 bp, Homo sapiens
ttatgtcttgtatttaa

SEQ ID NO: 6563923 - DNA, 17 bp, Homo sapiens
ttatgtcttttaataaa

SEQ ID NO: 6563924 - DNA, 21 bp, Homo sapiens
ttatgtcttttaataaaaagg

SEQ ID NO: 6563925 - DNA, 21 bp, Homo sapiens
ttatgtgaaatgctttctgta

SEQ ID NO: 6563926 - DNA, 21 bp, Homo sapiens
ttatgtgaacaactgtttgtc

SEQ ID NO: 6563927 - DNA, 12 bp, Homo sapiens
ttatgtgaagaa

SEQ ID NO: 6563928 - DNA, 13 bp, Homo sapiens
ttatgtgaagaat

SEQ ID NO: 6563929 - DNA, 22 bp, Homo sapiens
ttatgtgaagaatttagatctt

SEQ ID NO: 6563930 - DNA, 17 bp, Homo sapiens
ttatgtgaatttttaag

SEQ ID NO: 6563931 - DNA, 19 bp, Homo sapiens
ttatgtgaatttttaagct

SEQ ID NO: 6563932 - DNA, 20 bp, Homo sapiens
ttatgtgaatttttaagctg

SEQ ID NO: 6563933 - DNA, 19 bp, Homo sapiens
ttatgtgacaacctttgtg

SEQ ID NO: 6563934 - DNA, 20 bp, Homo sapiens
ttatgtgacattttacatta

SEQ ID NO: 6563935 - DNA, 14 bp, Homo sapiens
ttatgtgagatttc

SEQ ID NO: 6563936 - DNA, 14 bp, Homo sapiens
ttatgtgatcaatt

SEQ ID NO: 6563937 - DNA, 22 bp, Homo sapiens
ttatgtgccagatttatgcata

SEQ ID NO: 6563938 - DNA, 12 bp, Homo sapiens
ttatgtgctatg

SEQ ID NO: 6563939 - DNA, 24 bp, Homo sapiens
ttatgtgctatgcaaaatagacat

SEQ ID NO: 6563940 - DNA, 12 bp, Homo sapiens
ttatgtggaata

SEQ ID NO: 6563941 - DNA, 13 bp, Homo sapiens
ttatgtggtctta

SEQ ID NO: 6563942 - DNA, 22 bp, Homo sapiens
tttgccatgttggccaggctgg

SEQ ID NO: 6563943 - DNA, 15 bp, Homo sapiens
tttgccattatctgt

SEQ ID NO: 6563944 - DNA, 17 bp, Homo sapiens
tttgccattgtgaacca

SEQ ID NO: 6563945 - DNA, 14 bp, Homo sapiens
tttgccatttgata

SEQ ID NO: 6563946 - DNA, 23 bp, Homo sapiens
tttgcccaaaatacttgcatcca

SEQ ID NO: 6563947 - DNA, 16 bp, Homo sapiens
tttgcccaacaccagc

SEQ ID NO: 6563948 - DNA, 18 bp, Homo sapiens
tttgcccaacaccagccc

SEQ ID NO: 6563949 - DNA, 21 bp, Homo sapiens
tttgcccaacaccagcccctg

SEQ ID NO: 6563950 - DNA, 23 bp, Homo sapiens
tttgcccaacaccagcccctgcc

SEQ ID NO: 6563951 - DNA, 17 bp, Homo sapiens
tttgcccaacctcagca

SEQ ID NO: 6563952 - DNA, 13 bp, Homo sapiens
tttgcccagtcct

SEQ ID NO: 6563953 - DNA, 17 bp, Homo sapiens
tttgcccagtcctgggt

SEQ ID NO: 6563954 - DNA, 15 bp, Homo sapiens
tttgcccatcctccc

SEQ ID NO: 6563955 - DNA, 18 bp, Homo sapiens
tttgcccatttacacttt

SEQ ID NO: 6563956 - DNA, 23 bp, Homo sapiens
tttgccccaacttaagtttagaa

SEQ ID NO: 6563957 - DNA, 23 bp, Homo sapiens
tttgccccaaggctgctcagagg

SEQ ID NO: 6563958 - DNA, 13 bp, Homo sapiens
tttgccccactgg

SEQ ID NO: 6563959 - DNA, 19 bp, Homo sapiens
tttgccccatgataaaata

SEQ ID NO: 6563960 - DNA, 22 bp, Homo sapiens
tttgcccccaaacccccattct

SEQ ID NO: 6563961 - DNA, 17 bp, Homo sapiens
tttgccccgggatatta

SEQ ID NO: 6563962 - DNA, 15 bp, Homo sapiens
tttgcccctggcaaa

SEQ ID NO: 6563963 - DNA, 14 bp, Homo sapiens
tttgcccctttata

SEQ ID NO: 6563964 - DNA, 16 bp, Homo sapiens
tttgcccctttcagta

SEQ ID NO: 6563965 - DNA, 17 bp, Homo sapiens
tttgccctccctctctg

SEQ ID NO: 6563966 - DNA, 19 bp, Homo sapiens
tttgccctggtagggcagt

SEQ ID NO: 6563967 - DNA, 13 bp, Homo sapiens
tttgccctgtgga

SEQ ID NO: 6563968 - DNA, 12 bp, Homo sapiens
tttgcccttcct

SEQ ID NO: 6563969 - DNA, 15 bp, Homo sapiens
tttgcccttcctcct

SEQ ID NO: 6563970 - DNA, 22 bp, Homo sapiens
tttgccctttagggctgttgct

SEQ ID NO: 6563971 - DNA, 12 bp, Homo sapiens
tttgccctttga

SEQ ID NO: 6563972 - DNA, 18 bp, Homo sapiens
tttgccggatacaaactg

SEQ ID NO: 6563973 - DNA, 15 bp, Homo sapiens
tttgccgttattaaa

SEQ ID NO: 6563974 - DNA, 10 bp, Homo sapiens
tttgcctaaa

SEQ ID NO: 6563975 - DNA, 15 bp, Homo sapiens
tttgcctaaaatata

SEQ ID NO: 6563976 - DNA, 19 bp, Homo sapiens
tttgcctaggaggccttct

SEQ ID NO: 6563977 - DNA, 14 bp, Homo sapiens
tttgcctcatgaac

SEQ ID NO: 6563978 - DNA, 12 bp, Homo sapiens
tttgcctccaga

SEQ ID NO: 6563979 - DNA, 21 bp, Homo sapiens
tttgcctcctgtgtactgtgt

SEQ ID NO: 6563980 - DNA, 14 bp, Homo sapiens
tttgcctctaccag

SEQ ID NO: 6563981 - DNA, 13 bp, Homo sapiens
tttgcctctgaaa

SEQ ID NO: 6563982 - DNA, 12 bp, Homo sapiens
tttgcctctgca

SEQ ID NO: 6563983 - DNA, 19 bp, Homo sapiens
tttgcctctgcacgtgcac

SEQ ID NO: 6563984 - DNA, 12 bp, Homo sapiens
tttgcctctgct

SEQ ID NO: 6563985 - DNA, 20 bp, Homo sapiens
tttgcctcttctttgtgcct

SEQ ID NO: 6563986 - DNA, 21 bp, Homo sapiens
tttgcctcttctttgtgcctt

SEQ ID NO: 6563987 - DNA, 22 bp, Homo sapiens
tttgcctcttctttgtgccttt

SEQ ID NO: 6563988 - DNA, 23 bp, Homo sapiens
tttgcctgaatccacctgcagtt

SEQ ID NO: 6563989 - DNA, 14 bp, Homo sapiens
tttgcctgcagttt

SEQ ID NO: 6563990 - DNA, 15 bp, Homo sapiens
tttgcctgcagtttc

SEQ ID NO: 6563991 - DNA, 14 bp, Homo sapiens
tttgcctgctgtat

SEQ ID NO: 6563992 - DNA, 21 bp, Homo sapiens
tttgcctggatacctctggct

SEQ ID NO: 6563993 - DNA, 11 bp, Homo sapiens
tttgcctggct

SEQ ID NO: 6563994 - DNA, 13 bp, Homo sapiens
tttgcctggctgt

SEQ ID NO: 6563995 - DNA, 23 bp, Homo sapiens
tttgcctggctgtggaggcctga

SEQ ID NO: 6563996 - DNA, 21 bp, Homo sapiens
tttgcctgtaacaagccagat

SEQ ID NO: 6563997 - DNA, 14 bp, Homo sapiens
tttgcctgtaagaa

SEQ ID NO: 6563998 - DNA, 15 bp, Homo sapiens
tttgcctgtaagaaa

SEQ ID NO: 6563999 - DNA, 11 bp, Homo sapiens
tttgcctgtgc

SEQ ID NO: 6564000 - DNA, 16 bp, Homo sapiens
tttgcctgttcagtta

SEQ ID NO: 6564001 - DNA, 19 bp, Homo sapiens
tttgccttaaacctgaaga

SEQ ID NO: 6564002 - DNA, 15 bp, Homo sapiens
tttgccttaggaagt

SEQ ID NO: 6564003 - DNA, 12 bp, Homo sapiens
tttgccttctct

SEQ ID NO: 6564004 - DNA, 21 bp, Homo sapiens
tttgccttgggctgctcctca

SEQ ID NO: 6564005 - DNA, 22 bp, Homo sapiens
tttgccttggttcttcctagtg

SEQ ID NO: 6564006 - DNA, 11 bp, Homo sapiens
tttgcctttta

SEQ ID NO: 6564007 - DNA, 18 bp, Homo sapiens
tttgccttttatgtaaat

SEQ ID NO: 6564008 - DNA, 12 bp, Homo sapiens
tttgccttttgc

SEQ ID NO: 6564009 - DNA, 19 bp, Homo sapiens
tttgccttttgcaaacttt

SEQ ID NO: 6564010 - DNA, 21 bp, Homo sapiens
tttgcgcctcggtatctggct

SEQ ID NO: 6564011 - DNA, 15 bp, Homo sapiens
tttgcgctcctggcc

SEQ ID NO: 6564012 - DNA, 14 bp, Homo sapiens
tttgcggacgggct

SEQ ID NO: 6564013 - DNA, 13 bp, Homo sapiens
tttgcgtaaatgg

SEQ ID NO: 6564014 - DNA, 19 bp, Homo sapiens
tttgcgtacacagagaagg

SEQ ID NO: 6564015 - DNA, 15 bp, Homo sapiens
tttgctaactgggtt

SEQ ID NO: 6564016 - DNA, 13 bp, Homo sapiens
tttgctaactggt

SEQ ID NO: 6564017 - DNA, 15 bp, Homo sapiens
tttgctaactggtta

SEQ ID NO: 6564018 - DNA, 17 bp, Homo sapiens
tttgctaaggagaagct

SEQ ID NO: 6564019 - DNA, 24 bp, Homo sapiens
tttgctaatgaattttaaaagcat

SEQ ID NO: 6564020 - DNA, 21 bp, Homo sapiens
tttgctaatttttattaattt

SEQ ID NO: 6564021 - DNA, 18 bp, Homo sapiens
tttgctacaaatttatgc

SEQ ID NO: 6564022 - DNA, 19 bp, Homo sapiens
tttgctacaaatttatgca

SEQ ID NO: 6564023 - DNA, 20 bp, Homo sapiens
tttgctacaaatttatgcat

SEQ ID NO: 6564024 - DNA, 23 bp, Homo sapiens
tttgctaccaaagaatgcatgtt

SEQ ID NO: 6564025 - DNA, 15 bp, Homo sapiens
tttgctagcagtaaa

SEQ ID NO: 6564026 - DNA, 18 bp, Homo sapiens
tttgctaggagccccagc

SEQ ID NO: 6564027 - DNA, 20 bp, Homo sapiens
tttgctaggtataaaaaata

SEQ ID NO: 6564028 - DNA, 23 bp, Homo sapiens
tttgctaggtataaaaaataagt

SEQ ID NO: 6564029 - DNA, 22 bp, Homo sapiens
tttgctagttctgctgccctct

SEQ ID NO: 6564030 - DNA, 21 bp, Homo sapiens
tttgctagttggagtgcttgt

SEQ ID NO: 6564031 - DNA, 14 bp, Homo sapiens
tttgctataatcat

SEQ ID NO: 6564032 - DNA, 15 bp, Homo sapiens
tttgctataatcatt

SEQ ID NO: 6564033 - DNA, 17 bp, Homo sapiens
tttgctataatcattag

SEQ ID NO: 6564034 - DNA, 21 bp, Homo sapiens
tttgctatagttatacatcaa

SEQ ID NO: 6564035 - DNA, 12 bp, Homo sapiens
tttgctatgact

SEQ ID NO: 6564036 - DNA, 19 bp, Homo sapiens
tttgctatgactacatttt

SEQ ID NO: 6564037 - DNA, 12 bp, Homo sapiens
tttgctatgtaa

SEQ ID NO: 6564038 - DNA, 13 bp, Homo sapiens
tttgctattcaaa

SEQ ID NO: 6564039 - DNA, 13 bp, Homo sapiens
tttgctattgaca

SEQ ID NO: 6564040 - DNA, 15 bp, Homo sapiens
tttgctatttacaaa

SEQ ID NO: 6564041 - DNA, 17 bp, Homo sapiens
tttgctcaaaattgctt

SEQ ID NO: 6564042 - DNA, 19 bp, Homo sapiens
tttgctcaaaattgcttct

SEQ ID NO: 6564043 - DNA, 21 bp, Homo sapiens
tttgctcaatacctggcctca

SEQ ID NO: 6564044 - DNA, 16 bp, Homo sapiens
tttgctcatatttccc

SEQ ID NO: 6564045 - DNA, 11 bp, Homo sapiens
tttgctcatgg

SEQ ID NO: 6564046 - DNA, 23 bp, Homo sapiens
tttgctccagataactctctttc

SEQ ID NO: 6564047 - DNA, 15 bp, Homo sapiens
tttgctccctccccg

SEQ ID NO: 6564048 - DNA, 20 bp, Homo sapiens
tttgctccgctcccaccgcc

SEQ ID NO: 6564049 - DNA, 19 bp, Homo sapiens
tttgctctaaaatatttat

SEQ ID NO: 6564050 - DNA, 19 bp, Homo sapiens
tttgctctaaattaagaca

SEQ ID NO: 6564051 - DNA, 21 bp, Homo sapiens
tttgctctaccaaatagtgat

SEQ ID NO: 6564052 - DNA, 20 bp, Homo sapiens
tttgctctcccggttcttcc

SEQ ID NO: 6564053 - DNA, 18 bp, Homo sapiens
tttgctcttcaagaaatc

SEQ ID NO: 6564054 - DNA, 20 bp, Homo sapiens
tttgctcttcaagaaatctg

SEQ ID NO: 6564055 - DNA, 18 bp, Homo sapiens
tttgctcttcagatgcca

SEQ ID NO: 6564056 - DNA, 20 bp, Homo sapiens
tttgctcttcagatgccact

SEQ ID NO: 6564057 - DNA, 17 bp, Homo sapiens
tttgctcttgtttttat

SEQ ID NO: 6564058 - DNA, 23 bp, Homo sapiens
tttgctcttgtttttattaattt

SEQ ID NO: 6564059 - DNA, 22 bp, Homo sapiens
tttgctctttgacaactaaaat

SEQ ID NO: 6564060 - DNA, 19 bp, Homo sapiens
tttgctgaaagatatgtat

SEQ ID NO: 6564061 - DNA, 13 bp, Homo sapiens
tttgctgaagaat

SEQ ID NO: 6564062 - DNA, 19 bp, Homo sapiens
tttgctgaaggattatatg

SEQ ID NO: 6564063 - DNA, 22 bp, Homo sapiens
tttgctgaaggattatatgtat

SEQ ID NO: 6564064 - DNA, 21 bp, Homo sapiens
tttgctgaatgtcattatttg

SEQ ID NO: 6564065 - DNA, 16 bp, Homo sapiens
tttgctgaattcatct

SEQ ID NO: 6564066 - DNA, 20 bp, Homo sapiens
tttgctgaattcatctattt

SEQ ID NO: 6564067 - DNA, 22 bp, Homo sapiens
tttgctgaattcatctatttcg

SEQ ID NO: 6564068 - DNA, 18 bp, Homo sapiens
tttgctgaattcctttac

SEQ ID NO: 6564069 - DNA, 17 bp, Homo sapiens
tttgctgaccctcccca

SEQ ID NO: 6564070 - DNA, 19 bp, Homo sapiens
tttgctgaccctccccaaa

SEQ ID NO: 6564071 - DNA, 21 bp, Homo sapiens
tttgctgaccctccccaaagg

SEQ ID NO: 6564072 - DNA, 18 bp, Homo sapiens
tttgctgacttcccaagc

SEQ ID NO: 6564073 - DNA, 12 bp, Homo sapiens
tttgctgagact

SEQ ID NO: 6564074 - DNA, 19 bp, Homo sapiens
tttgctgagcatgtactga

SEQ ID NO: 6564075 - DNA, 14 bp, Homo sapiens
tttgctgagttgtt

SEQ ID NO: 6564076 - DNA, 15 bp, Homo sapiens
tttgctgatccccaa

SEQ ID NO: 6564077 - DNA, 13 bp, Homo sapiens
tttgctgatcttt

SEQ ID NO: 6564078 - DNA, 17 bp, Homo sapiens
tttgctgatctttgtct

SEQ ID NO: 6564079 - DNA, 18 bp, Homo sapiens
tttgctgattgctaaggg

SEQ ID NO: 6564080 - DNA, 19 bp, Homo sapiens
tttgctgattgtctgaaat

SEQ ID NO: 6564081 - DNA, 17 bp, Homo sapiens
tttgctgatttctagtg

SEQ ID NO: 6564082 - DNA, 22 bp, Homo sapiens
tttgctgcacaaacatgaaaat

SEQ ID NO: 6564083 - DNA, 19 bp, Homo sapiens
tttgctgcactttttactt

SEQ ID NO: 6564084 - DNA, 13 bp, Homo sapiens
tttgctgcatttt

SEQ ID NO: 6564085 - DNA, 15 bp, Homo sapiens
tttgctgccaaatgc

SEQ ID NO: 6564086 - DNA, 15 bp, Homo sapiens
tttgctgccctgggg

SEQ ID NO: 6564087 - DNA, 12 bp, Homo sapiens
tttgctgcctta

SEQ ID NO: 6564088 - DNA, 23 bp, Homo sapiens
tttgctgccttctgtctcttgca

SEQ ID NO: 6564089 - DNA, 20 bp, Homo sapiens
tttgctgctctatattacaa

SEQ ID NO: 6564090 - DNA, 12 bp, Homo sapiens
tttgctgctgct

SEQ ID NO: 6564091 - DNA, 17 bp, Homo sapiens
tttgctgcttttgatgg

SEQ ID NO: 6564092 - DNA, 16 bp, Homo sapiens
tttgctggaagaaact

SEQ ID NO: 6564093 - DNA, 19 bp, Homo sapiens
tttgctggagaaatcattt

SEQ ID NO: 6564094 - DNA, 22 bp, Homo sapiens
tttgctggagggaagatcttga

SEQ ID NO: 6564095 - DNA, 15 bp, Homo sapiens
tttgctggcctggca

SEQ ID NO: 6564096 - DNA, 22 bp, Homo sapiens
tttgctggggccgaaagaacag

SEQ ID NO: 6564097 - DNA, 18 bp, Homo sapiens
tttgctggtttgaaagat

SEQ ID NO: 6564098 - DNA, 19 bp, Homo sapiens
tttgctgtaagatgtctgt

SEQ ID NO: 6564099 - DNA, 19 bp, Homo sapiens
tttgctgtactagagatct

SEQ ID NO: 6564100 - DNA, 13 bp, Homo sapiens
tttgctgtagaag

SEQ ID NO: 6564101 - DNA, 21 bp, Homo sapiens
tttgctgtatacaaacaggtg

SEQ ID NO: 6564102 - DNA, 15 bp, Homo sapiens
tttgctgtgaggaat

SEQ ID NO: 6564103 - DNA, 13 bp, Homo sapiens
tttgctgtgccaa

SEQ ID NO: 6564104 - DNA, 17 bp, Homo sapiens
tttgctgtgctgtacat

SEQ ID NO: 6564105 - DNA, 13 bp, Homo sapiens
tttgctgtgcttt

SEQ ID NO: 6564106 - DNA, 18 bp, Homo sapiens
tttgctgtgtagttccct

SEQ ID NO: 6564107 - DNA, 12 bp, Homo sapiens
tttgctgtgtga

SEQ ID NO: 6564108 - DNA, 17 bp, Homo sapiens
tttgctgttactgcttc

SEQ ID NO: 6564109 - DNA, 13 bp, Homo sapiens
tttgctgttccac

SEQ ID NO: 6564110 - DNA, 19 bp, Homo sapiens
tttgctgttccacaaagca

SEQ ID NO: 6564111 - DNA, 20 bp, Homo sapiens
tttgctgttccacaaagcag

SEQ ID NO: 6564112 - DNA, 18 bp, Homo sapiens
tttgctgttcgcagcctc

SEQ ID NO: 6564113 - DNA, 22 bp, Homo sapiens
tttgctgttgggtttttgctgt

SEQ ID NO: 6564114 - DNA, 19 bp, Homo sapiens
tttgctgtttatacttgag

SEQ ID NO: 6564115 - DNA, 23 bp, Homo sapiens
tttgctgtttattaaaaatatat

SEQ ID NO: 6564116 - DNA, 22 bp, Homo sapiens
tttgctgttttaaattgcattt

SEQ ID NO: 6564117 - DNA, 13 bp, Homo sapiens
tttgcttaaaata

SEQ ID NO: 6564118 - DNA, 14 bp, Homo sapiens
tttgcttaaacaaa

SEQ ID NO: 6564119 - DNA, 21 bp, Homo sapiens
tttgcttaatttccttctgtt

SEQ ID NO: 6564120 - DNA, 22 bp, Homo sapiens
tttgcttaatttccttctgtta

SEQ ID NO: 6564121 - DNA, 19 bp, Homo sapiens
ttatgtggttttagatttt

SEQ ID NO: 6564122 - DNA, 20 bp, Homo sapiens
ttatgtggttttagattttc

SEQ ID NO: 6564123 - DNA, 20 bp, Homo sapiens
ttatgtgtagaatttgaaat

SEQ ID NO: 6564124 - DNA, 20 bp, Homo sapiens
ttatgtgtatgtgagtattc

SEQ ID NO: 6564125 - DNA, 18 bp, Homo sapiens
ttatgtgtgcatgtgtgt

SEQ ID NO: 6564126 - DNA, 20 bp, Homo sapiens
ttatgtgtgcatgtgtgtat

SEQ ID NO: 6564127 - DNA, 21 bp, Homo sapiens
ttatgtgtgcatgtgtgtata

SEQ ID NO: 6564128 - DNA, 10 bp, Homo sapiens
ttatgtgtgt

SEQ ID NO: 6564129 - DNA, 13 bp, Homo sapiens
ttatgtgttacat

SEQ ID NO: 6564130 - DNA, 15 bp, Homo sapiens
ttatgtgttatgaac

SEQ ID NO: 6564131 - DNA, 17 bp, Homo sapiens
ttatgtgttatgaacat

SEQ ID NO: 6564132 - DNA, 12 bp, Homo sapiens
ttatgttaaaat

SEQ ID NO: 6564133 - DNA, 12 bp, Homo sapiens
ttatgttaaact

SEQ ID NO: 6564134 - DNA, 13 bp, Homo sapiens
ttatgttaaacta

SEQ ID NO: 6564135 - DNA, 13 bp, Homo sapiens
ttatgttatatat

SEQ ID NO: 6564136 - DNA, 19 bp, Homo sapiens
ttatgttatcaccttccaa

SEQ ID NO: 6564137 - DNA, 20 bp, Homo sapiens
ttatgttatcaccttccaaa

SEQ ID NO: 6564138 - DNA, 20 bp, Homo sapiens
ttatgttcagcttataatga

SEQ ID NO: 6564139 - DNA, 14 bp, Homo sapiens
ttatgttcctgctg

SEQ ID NO: 6564140 - DNA, 20 bp, Homo sapiens
ttatgttccttttaaagaaa

SEQ ID NO: 6564141 - DNA, 18 bp, Homo sapiens
ttatgttgaaaaaattta

SEQ ID NO: 6564142 - DNA, 15 bp, Homo sapiens
ttatgttgacatttg

SEQ ID NO: 6564143 - DNA, 23 bp, Homo sapiens
ttatgttgataaaccaaaaacat

SEQ ID NO: 6564144 - DNA, 13 bp, Homo sapiens
ttatgttgtaata

SEQ ID NO: 6564145 - DNA, 18 bp, Homo sapiens
ttatgttgtaatattttg

SEQ ID NO: 6564146 - DNA, 16 bp, Homo sapiens
ttatgttgtatgattc

SEQ ID NO: 6564147 - DNA, 16 bp, Homo sapiens
ttatgttgttagagaa

SEQ ID NO: 6564148 - DNA, 19 bp, Homo sapiens
ttatgttgttgaactaata

SEQ ID NO: 6564149 - DNA, 23 bp, Homo sapiens
ttatgttgttgttgtttttggat

SEQ ID NO: 6564150 - DNA, 18 bp, Homo sapiens
ttatgttgttttgtacag

SEQ ID NO: 6564151 - DNA, 14 bp, Homo sapiens
ttatgtttaaaatg

SEQ ID NO: 6564152 - DNA, 18 bp, Homo sapiens
ttatgtttaaaatggcat

SEQ ID NO: 6564153 - DNA, 22 bp, Homo sapiens
ttatgtttacctcactggtgca

SEQ ID NO: 6564154 - DNA, 14 bp, Homo sapiens
ttatgtttgaaaat

SEQ ID NO: 6564155 - DNA, 15 bp, Homo sapiens
ttatgtttgaatatg

SEQ ID NO: 6564156 - DNA, 18 bp, Homo sapiens
ttatgtttgtaatctgta

SEQ ID NO: 6564157 - DNA, 16 bp, Homo sapiens
ttatgttttcaactca

SEQ ID NO: 6564158 - DNA, 20 bp, Homo sapiens
ttatgttttggtccactttt

SEQ ID NO: 6564159 - DNA, 16 bp, Homo sapiens
ttatgttttgtttctg

SEQ ID NO: 6564160 - DNA, 17 bp, Homo sapiens
ttattaaaaaaacacaa

SEQ ID NO: 6564161 - DNA, 15 bp, Homo sapiens
ttattaaaaaatttg

SEQ ID NO: 6564162 - DNA, 16 bp, Homo sapiens
ttattaaaaaatttgt

SEQ ID NO: 6564163 - DNA, 16 bp, Homo sapiens
ttattaaaaacatgac

SEQ ID NO: 6564164 - DNA, 16 bp, Homo sapiens
ttattaaaaatgttct

SEQ ID NO: 6564165 - DNA, 11 bp, Homo sapiens
ttattaaaaga

SEQ ID NO: 6564166 - DNA, 13 bp, Homo sapiens
ttattaaaagaat

SEQ ID NO: 6564167 - DNA, 17 bp, Homo sapiens
ttattaaaatactgttt

SEQ ID NO: 6564168 - DNA, 19 bp, Homo sapiens
ttattaaaatgattgtaaa

SEQ ID NO: 6564169 - DNA, 12 bp, Homo sapiens
ttattaaaattg

SEQ ID NO: 6564170 - DNA, 14 bp, Homo sapiens
ttattaaactgaat

SEQ ID NO: 6564171 - DNA, 17 bp, Homo sapiens
ttattaaacttcagcaa

SEQ ID NO: 6564172 - DNA, 13 bp, Homo sapiens
ttattaaagaaaa

SEQ ID NO: 6564173 - DNA, 22 bp, Homo sapiens
ttattaaagaaaaaaatgtatt

SEQ ID NO: 6564174 - DNA, 21 bp, Homo sapiens
ttattaaagtctaaacaaaat

SEQ ID NO: 6564175 - DNA, 22 bp, Homo sapiens
ttattaaagtctaaacaaaatt

SEQ ID NO: 6564176 - DNA, 14 bp, Homo sapiens
ttattaaagtttca

SEQ ID NO: 6564177 - DNA, 15 bp, Homo sapiens
ttattaaagtttcaa

SEQ ID NO: 6564178 - DNA, 13 bp, Homo sapiens
ttattaaagtttt

SEQ ID NO: 6564179 - DNA, 14 bp, Homo sapiens
ttattaaagttttc

SEQ ID NO: 6564180 - DNA, 20 bp, Homo sapiens
ttattaaataaaatcaattt

SEQ ID NO: 6564181 - DNA, 20 bp, Homo sapiens
ttattaaataaatattttac

SEQ ID NO: 6564182 - DNA, 20 bp, Homo sapiens
ttattaaatacaaaacttcc

SEQ ID NO: 6564183 - DNA, 11 bp, Homo sapiens
ttattaaatag

SEQ ID NO: 6564184 - DNA, 13 bp, Homo sapiens
ttattaaatcaga

SEQ ID NO: 6564185 - DNA, 22 bp, Homo sapiens
ttattaaatcagaatctttaaa

SEQ ID NO: 6564186 - DNA, 15 bp, Homo sapiens
ttattaaatcggcaa

SEQ ID NO: 6564187 - DNA, 16 bp, Homo sapiens
ttattaaatcgtttaa

SEQ ID NO: 6564188 - DNA, 18 bp, Homo sapiens
ttattaaatcgtttaatg

SEQ ID NO: 6564189 - DNA, 21 bp, Homo sapiens
ttattaaatcgtttaatgttt

SEQ ID NO: 6564190 - DNA, 13 bp, Homo sapiens
ttattaaatctga

SEQ ID NO: 6564191 - DNA, 21 bp, Homo sapiens
ttattaaatctttttttaatg

SEQ ID NO: 6564192 - DNA, 21 bp, Homo sapiens
ttattaaatgcccagcccctt

SEQ ID NO: 6564193 - DNA, 13 bp, Homo sapiens
ttattaaattgca

SEQ ID NO: 6564194 - DNA, 21 bp, Homo sapiens
ttattaaatttttttgtatga

SEQ ID NO: 6564195 - DNA, 16 bp, Homo sapiens
ttattaacaaaacagt

SEQ ID NO: 6564196 - DNA, 21 bp, Homo sapiens
ttattaacgatgtccaacccg

SEQ ID NO: 6564197 - DNA, 21 bp, Homo sapiens
ttattaacgggcatgtattat

SEQ ID NO: 6564198 - DNA, 21 bp, Homo sapiens
ttattaactaatatgggcatt

SEQ ID NO: 6564199 - DNA, 15 bp, Homo sapiens
ttattaactacattt

SEQ ID NO: 6564200 - DNA, 16 bp, Homo sapiens
ttattaactacattta

SEQ ID NO: 6564201 - DNA, 18 bp, Homo sapiens
ttattaactacatttatg

SEQ ID NO: 6564202 - DNA, 14 bp, Homo sapiens
ttattaacttaata

SEQ ID NO: 6564203 - DNA, 19 bp, Homo sapiens
ttattaacttaataatcaa

SEQ ID NO: 6564204 - DNA, 19 bp, Homo sapiens
ttattaagaatcattgtgc

SEQ ID NO: 6564205 - DNA, 18 bp, Homo sapiens
ttattaagcaaccttaaa

SEQ ID NO: 6564206 - DNA, 22 bp, Homo sapiens
ttattaagccaggaaacatgaa

SEQ ID NO: 6564207 - DNA, 23 bp, Homo sapiens
ttattaagccaggaaacatgaag

SEQ ID NO: 6564208 - DNA, 18 bp, Homo sapiens
ttattaaggttacagatt

SEQ ID NO: 6564209 - DNA, 14 bp, Homo sapiens
ttattaagtaaaat

SEQ ID NO: 6564210 - DNA, 17 bp, Homo sapiens
ttattaagtatatttgt

SEQ ID NO: 6564211 - DNA, 22 bp, Homo sapiens
ttattaagtctgggatgtagaa

SEQ ID NO: 6564212 - DNA, 22 bp, Homo sapiens
ttattaagttcgaacatgtttc

SEQ ID NO: 6564213 - DNA, 22 bp, Homo sapiens
ttattaagttctcaatgtgaaa

SEQ ID NO: 6564214 - DNA, 14 bp, Homo sapiens
ttattaataaacat

SEQ ID NO: 6564215 - DNA, 13 bp, Homo sapiens
ttattaatagaat

SEQ ID NO: 6564216 - DNA, 19 bp, Homo sapiens
ttattaatatatattatct

SEQ ID NO: 6564217 - DNA, 19 bp, Homo sapiens
ttattaatatgagttactg

SEQ ID NO: 6564218 - DNA, 14 bp, Homo sapiens
ttattaatcactgt

SEQ ID NO: 6564219 - DNA, 21 bp, Homo sapiens
ttattaatcattccatttatc

SEQ ID NO: 6564220 - DNA, 17 bp, Homo sapiens
ttattaatctactgtat

SEQ ID NO: 6564221 - DNA, 15 bp, Homo sapiens
ttattaatgaatgcc

SEQ ID NO: 6564222 - DNA, 18 bp, Homo sapiens
ttattaatgcactttcta

SEQ ID NO: 6564223 - DNA, 13 bp, Homo sapiens
ttattaatgctaa

SEQ ID NO: 6564224 - DNA, 15 bp, Homo sapiens
ttattaatgctaagg

SEQ ID NO: 6564225 - DNA, 14 bp, Homo sapiens
ttattaatgtttct

SEQ ID NO: 6564226 - DNA, 16 bp, Homo sapiens
ttattaatgttttcaa

SEQ ID NO: 6564227 - DNA, 17 bp, Homo sapiens
ttattaatgttttcaaa

SEQ ID NO: 6564228 - DNA, 14 bp, Homo sapiens
ttattaattaaaga

SEQ ID NO: 6564229 - DNA, 14 bp, Homo sapiens
ttattaattcatta

SEQ ID NO: 6564230 - DNA, 14 bp, Homo sapiens
ttattaattgcttt

SEQ ID NO: 6564231 - DNA, 22 bp, Homo sapiens
ttattaattgttttgcactttt

SEQ ID NO: 6564232 - DNA, 22 bp, Homo sapiens
ttattacaacaagcaaactgaa

SEQ ID NO: 6564233 - DNA, 16 bp, Homo sapiens
ttattacaagtggctc

SEQ ID NO: 6564234 - DNA, 12 bp, Homo sapiens
ttattacaatgt

SEQ ID NO: 6564235 - DNA, 12 bp, Homo sapiens
ttattacaattt

SEQ ID NO: 6564236 - DNA, 13 bp, Homo sapiens
ttattacaatttt

SEQ ID NO: 6564237 - DNA, 14 bp, Homo sapiens
ttattacacaaaga

SEQ ID NO: 6564238 - DNA, 19 bp, Homo sapiens
ttattacacctcagaaatt

SEQ ID NO: 6564239 - DNA, 17 bp, Homo sapiens
ttattacagaaatgttt

SEQ ID NO: 6564240 - DNA, 22 bp, Homo sapiens
ttattacataactgatctattt

SEQ ID NO: 6564241 - DNA, 23 bp, Homo sapiens
ttattacataactgatctattta

SEQ ID NO: 6564242 - DNA, 21 bp, Homo sapiens
ttattacatagctctgaagtt

SEQ ID NO: 6564243 - DNA, 15 bp, Homo sapiens
ttattacatccttgt

SEQ ID NO: 6564244 - DNA, 19 bp, Homo sapiens
ttattacatccttgtggca

SEQ ID NO: 6564245 - DNA, 12 bp, Homo sapiens
ttattacatctt

SEQ ID NO: 6564246 - DNA, 14 bp, Homo sapiens
ttattacatcttta

SEQ ID NO: 6564247 - DNA, 18 bp, Homo sapiens
ttattacatctttcacat

SEQ ID NO: 6564248 - DNA, 18 bp, Homo sapiens
ttattacatgtaatttga

SEQ ID NO: 6564249 - DNA, 18 bp, Homo sapiens
ttattacattagttaaga

SEQ ID NO: 6564250 - DNA, 18 bp, Homo sapiens
ttattacatttatacatc

SEQ ID NO: 6564251 - DNA, 18 bp, Homo sapiens
ttattacccagagttttt

SEQ ID NO: 6564252 - DNA, 15 bp, Homo sapiens
ttattactagtgttt

SEQ ID NO: 6564253 - DNA, 19 bp, Homo sapiens
ttattactagtgtttaagt

SEQ ID NO: 6564254 - DNA, 14 bp, Homo sapiens
ttattactattatt

SEQ ID NO: 6564255 - DNA, 16 bp, Homo sapiens
ttattactgaactatt

SEQ ID NO: 6564256 - DNA, 16 bp, Homo sapiens
ttattactgtaagaaa

SEQ ID NO: 6564257 - DNA, 16 bp, Homo sapiens
ttattactgtttctaa

SEQ ID NO: 6564258 - DNA, 14 bp, Homo sapiens
ttattacttatttg

SEQ ID NO: 6564259 - DNA, 16 bp, Homo sapiens
ttattacttccatgaa

SEQ ID NO: 6564260 - DNA, 17 bp, Homo sapiens
ttattacttccatgaat

SEQ ID NO: 6564261 - DNA, 18 bp, Homo sapiens
ttattacttccatgaatt

SEQ ID NO: 6564262 - DNA, 14 bp, Homo sapiens
ttattacttctgtt

SEQ ID NO: 6564263 - DNA, 15 bp, Homo sapiens
ttattacttctgttt

SEQ ID NO: 6564264 - DNA, 17 bp, Homo sapiens
ttattacttctgtttct

SEQ ID NO: 6564265 - DNA, 18 bp, Homo sapiens
ttattacttgtgcactta

SEQ ID NO: 6564266 - DNA, 16 bp, Homo sapiens
ttattactttaaatta

SEQ ID NO: 6564267 - DNA, 14 bp, Homo sapiens
ttattactttttaa

SEQ ID NO: 6564268 - DNA, 19 bp, Homo sapiens
ttattagaaaaatattata

SEQ ID NO: 6564269 - DNA, 19 bp, Homo sapiens
ttattagaacttagttttg

SEQ ID NO: 6564270 - DNA, 13 bp, Homo sapiens
ttattagaatata

SEQ ID NO: 6564271 - DNA, 12 bp, Homo sapiens
ttattagataat

SEQ ID NO: 6564272 - DNA, 12 bp, Homo sapiens
ttattagatgtt

SEQ ID NO: 6564273 - DNA, 21 bp, Homo sapiens
ttattagattctccaaatgat

SEQ ID NO: 6564274 - DNA, 20 bp, Homo sapiens
ttattagcaaggctgggtaa

SEQ ID NO: 6564275 - DNA, 15 bp, Homo sapiens
ttattagcatttgtt

SEQ ID NO: 6564276 - DNA, 19 bp, Homo sapiens
ttattagcattttcaagaa

SEQ ID NO: 6564277 - DNA, 22 bp, Homo sapiens
ttattagccaggtaatgtgaat

SEQ ID NO: 6564278 - DNA, 23 bp, Homo sapiens
ttattagccctgcattttcatag

SEQ ID NO: 6564279 - DNA, 23 bp, Homo sapiens
ttattaggaaaagatatttttat

SEQ ID NO: 6564280 - DNA, 17 bp, Homo sapiens
ttattagggagaaaatt

SEQ ID NO: 6564281 - DNA, 20 bp, Homo sapiens
ttattagggagaaaattcaa

SEQ ID NO: 6564282 - DNA, 18 bp, Homo sapiens
ttattaggttaagtctca

SEQ ID NO: 6564283 - DNA, 12 bp, Homo sapiens
ttattataaaat

SEQ ID NO: 6564284 - DNA, 12 bp, Homo sapiens
ttattataaact

SEQ ID NO: 6564285 - DNA, 21 bp, Homo sapiens
ttattataaactataaactta

SEQ ID NO: 6564286 - DNA, 12 bp, Homo sapiens
ttattataaatg

SEQ ID NO: 6564287 - DNA, 13 bp, Homo sapiens
ttattataaatgt

SEQ ID NO: 6564288 - DNA, 20 bp, Homo sapiens
ttattataatcctcaagaga

SEQ ID NO: 6564289 - DNA, 21 bp, Homo sapiens
ttattataatcttataattgt

SEQ ID NO: 6564290 - DNA, 22 bp, Homo sapiens
ttattataatcttataattgtt

SEQ ID NO: 6564291 - DNA, 15 bp, Homo sapiens
ttattataattgtat

SEQ ID NO: 6564292 - DNA, 18 bp, Homo sapiens
ttattatagtctgtactt

SEQ ID NO: 6564293 - DNA, 22 bp, Homo sapiens
ttattatagtctgtacttcagt

SEQ ID NO: 6564294 - DNA, 22 bp, Homo sapiens
ttattatatatacatgggtgaa

SEQ ID NO: 6564295 - DNA, 23 bp, Homo sapiens
ttattatatatttaacatgtgga

SEQ ID NO: 6564296 - DNA, 22 bp, Homo sapiens
ttattatatatttacagaagaa

SEQ ID NO: 6564297 - DNA, 22 bp, Homo sapiens
ttattatatttgacatgggtat

SEQ ID NO: 6564298 - DNA, 18 bp, Homo sapiens
ttattatcactttggggt

SEQ ID NO: 6564299 - DNA, 22 bp, Homo sapiens
ttattatcattgttcttttcaa

SEQ ID NO: 6564300 - DNA, 22 bp, Homo sapiens
ttattatccttcacaatttcaa

SEQ ID NO: 6564301 - DNA, 14 bp, Homo sapiens
tttgcttaccttgt

SEQ ID NO: 6564302 - DNA, 16 bp, Homo sapiens
tttgcttagaaaagaa

SEQ ID NO: 6564303 - DNA, 14 bp, Homo sapiens
tttgcttattgtgt

SEQ ID NO: 6564304 - DNA, 20 bp, Homo sapiens
tttgcttattttacaaatat

SEQ ID NO: 6564305 - DNA, 15 bp, Homo sapiens
tttgcttcaaaaaca

SEQ ID NO: 6564306 - DNA, 20 bp, Homo sapiens
tttgcttcataaatgaagca

SEQ ID NO: 6564307 - DNA, 19 bp, Homo sapiens
tttgcttcatgtgtcccag

SEQ ID NO: 6564308 - DNA, 20 bp, Homo sapiens
tttgcttcatgtgtcccaga

SEQ ID NO: 6564309 - DNA, 13 bp, Homo sapiens
tttgcttccatta

SEQ ID NO: 6564310 - DNA, 11 bp, Homo sapiens
tttgcttccca

SEQ ID NO: 6564311 - DNA, 16 bp, Homo sapiens
tttgcttcccatctga

SEQ ID NO: 6564312 - DNA, 14 bp, Homo sapiens
tttgcttctctcca

SEQ ID NO: 6564313 - DNA, 19 bp, Homo sapiens
tttgcttgaacacagtatt

SEQ ID NO: 6564314 - DNA, 16 bp, Homo sapiens
tttgcttgatccagaa

SEQ ID NO: 6564315 - DNA, 21 bp, Homo sapiens
tttgcttgcagtagattttct

SEQ ID NO: 6564316 - DNA, 19 bp, Homo sapiens
tttgcttgctcatatgcat

SEQ ID NO: 6564317 - DNA, 23 bp, Homo sapiens
tttgcttgctttgaagtagctct

SEQ ID NO: 6564318 - DNA, 13 bp, Homo sapiens
tttgcttggttca

SEQ ID NO: 6564319 - DNA, 17 bp, Homo sapiens
tttgcttgttatattaa

SEQ ID NO: 6564320 - DNA, 18 bp, Homo sapiens
tttgctttaatataaatg

SEQ ID NO: 6564321 - DNA, 23 bp, Homo sapiens
tttgctttaatataaatgcaaat

SEQ ID NO: 6564322 - DNA, 15 bp, Homo sapiens
tttgctttaatgaga

SEQ ID NO: 6564323 - DNA, 13 bp, Homo sapiens
tttgctttcctct

SEQ ID NO: 6564324 - DNA, 15 bp, Homo sapiens
tttgctttcctctga

SEQ ID NO: 6564325 - DNA, 16 bp, Homo sapiens
tttgctttcctttcct

SEQ ID NO: 6564326 - DNA, 17 bp, Homo sapiens
tttgctttcctttcctt

SEQ ID NO: 6564327 - DNA, 17 bp, Homo sapiens
tttgctttctgaaattc

SEQ ID NO: 6564328 - DNA, 15 bp, Homo sapiens
tttgctttctgctca

SEQ ID NO: 6564329 - DNA, 12 bp, Homo sapiens
tttgctttctgt

SEQ ID NO: 6564330 - DNA, 14 bp, Homo sapiens
tttgctttggaaac

SEQ ID NO: 6564331 - DNA, 22 bp, Homo sapiens
tttgcttttcctttgtttttat

SEQ ID NO: 6564332 - DNA, 19 bp, Homo sapiens
tttgctttttagttttgct

SEQ ID NO: 6564333 - DNA, 19 bp, Homo sapiens
tttggaaaaaactctgaag

SEQ ID NO: 6564334 - DNA, 20 bp, Homo sapiens
tttggaaaaagaaaaaaggg

SEQ ID NO: 6564335 - DNA, 12 bp, Homo sapiens
tttggaaaaatc

SEQ ID NO: 6564336 - DNA, 18 bp, Homo sapiens
tttggaaaaatcttgggc

SEQ ID NO: 6564337 - DNA, 20 bp, Homo sapiens
tttggaaaaatgtcactgaa

SEQ ID NO: 6564338 - DNA, 21 bp, Homo sapiens
tttggaaaaatgtcactgaag

SEQ ID NO: 6564339 - DNA, 22 bp, Homo sapiens
tttggaaaacataaaaatcact

SEQ ID NO: 6564340 - DNA, 14 bp, Homo sapiens
tttggaaaagaata

SEQ ID NO: 6564341 - DNA, 19 bp, Homo sapiens
tttggaaaagacagaaaac

SEQ ID NO: 6564342 - DNA, 21 bp, Homo sapiens
tttggaaaatatttttttcct

SEQ ID NO: 6564343 - DNA, 15 bp, Homo sapiens
tttggaaacaacatt

SEQ ID NO: 6564344 - DNA, 15 bp, Homo sapiens
tttggaaactaataa

SEQ ID NO: 6564345 - DNA, 20 bp, Homo sapiens
tttggaaactaataaaatat

SEQ ID NO: 6564346 - DNA, 15 bp, Homo sapiens
tttggaaactgcaaa

SEQ ID NO: 6564347 - DNA, 15 bp, Homo sapiens
tttggaaagagacca

SEQ ID NO: 6564348 - DNA, 21 bp, Homo sapiens
tttggaaagctgaaagggaag

SEQ ID NO: 6564349 - DNA, 17 bp, Homo sapiens
tttggaaaggaatgcaa

SEQ ID NO: 6564350 - DNA, 13 bp, Homo sapiens
tttggaaagtaca

SEQ ID NO: 6564351 - DNA, 15 bp, Homo sapiens
tttggaaagtacact

SEQ ID NO: 6564352 - DNA, 14 bp, Homo sapiens
tttggaaataaaaa

SEQ ID NO: 6564353 - DNA, 18 bp, Homo sapiens
tttggaaatggggagctg

SEQ ID NO: 6564354 - DNA, 21 bp, Homo sapiens
tttggaaatggggagctggcc

SEQ ID NO: 6564355 - DNA, 12 bp, Homo sapiens
tttggaaattca

SEQ ID NO: 6564356 - DNA, 17 bp, Homo sapiens
tttggaacaaatgcttt

SEQ ID NO: 6564357 - DNA, 18 bp, Homo sapiens
tttggaacaattatttta

SEQ ID NO: 6564358 - DNA, 20 bp, Homo sapiens
tttggaacactgtttaggta

SEQ ID NO: 6564359 - DNA, 23 bp, Homo sapiens
tttggaacatttctttcttgctg

SEQ ID NO: 6564360 - DNA, 14 bp, Homo sapiens
tttggaaccaaagt

SEQ ID NO: 6564361 - DNA, 14 bp, Homo sapiens
tttggaaccttgtt

SEQ ID NO: 6564362 - DNA, 20 bp, Homo sapiens
tttggaagaaaaaaatcttc

SEQ ID NO: 6564363 - DNA, 13 bp, Homo sapiens
tttggaagaaaat

SEQ ID NO: 6564364 - DNA, 13 bp, Homo sapiens
tttggaagaaagg

SEQ ID NO: 6564365 - DNA, 20 bp, Homo sapiens
tttggaagatcctgtgagga

SEQ ID NO: 6564366 - DNA, 16 bp, Homo sapiens
tttggaagcagcaagg

SEQ ID NO: 6564367 - DNA, 13 bp, Homo sapiens
tttggaagcaggg

SEQ ID NO: 6564368 - DNA, 15 bp, Homo sapiens
tttggaaggtgacac

SEQ ID NO: 6564369 - DNA, 16 bp, Homo sapiens
tttggaagttttactt

SEQ ID NO: 6564370 - DNA, 20 bp, Homo sapiens
tttggaataatttctattaa

SEQ ID NO: 6564371 - DNA, 16 bp, Homo sapiens
tttggaatacatttct

SEQ ID NO: 6564372 - DNA, 13 bp, Homo sapiens
tttggaatacttt

SEQ ID NO: 6564373 - DNA, 15 bp, Homo sapiens
tttggaatattaaaa

SEQ ID NO: 6564374 - DNA, 15 bp, Homo sapiens
tttggaatatttgaa

SEQ ID NO: 6564375 - DNA, 21 bp, Homo sapiens
tttggaatcatactgcctact

SEQ ID NO: 6564376 - DNA, 15 bp, Homo sapiens
tttggaatgaagaaa

SEQ ID NO: 6564377 - DNA, 12 bp, Homo sapiens
tttggaatgctt

SEQ ID NO: 6564378 - DNA, 14 bp, Homo sapiens
tttggaattcaatg

SEQ ID NO: 6564379 - DNA, 20 bp, Homo sapiens
tttggaattgacattctcta

SEQ ID NO: 6564380 - DNA, 15 bp, Homo sapiens
tttggaattttaagt

SEQ ID NO: 6564381 - DNA, 16 bp, Homo sapiens
tttggaattttaagtt

SEQ ID NO: 6564382 - DNA, 21 bp, Homo sapiens
tttggaattttgtgcccccat

SEQ ID NO: 6564383 - DNA, 17 bp, Homo sapiens
tttggacaaatgcattt

SEQ ID NO: 6564384 - DNA, 16 bp, Homo sapiens
tttggacacacacagc

SEQ ID NO: 6564385 - DNA, 20 bp, Homo sapiens
tttggacacatttaaggtgt

SEQ ID NO: 6564386 - DNA, 23 bp, Homo sapiens
tttggacagctgataaatttaat

SEQ ID NO: 6564387 - DNA, 12 bp, Homo sapiens
tttggacagtgg

SEQ ID NO: 6564388 - DNA, 16 bp, Homo sapiens
tttggacagtttacca

SEQ ID NO: 6564389 - DNA, 18 bp, Homo sapiens
tttggacatggaaagaaa

SEQ ID NO: 6564390 - DNA, 24 bp, Homo sapiens
tttggaccaaaaaccagtattgta

SEQ ID NO: 6564391 - DNA, 17 bp, Homo sapiens
tttggaccattttcctg

SEQ ID NO: 6564392 - DNA, 16 bp, Homo sapiens
tttggacccagggcct

SEQ ID NO: 6564393 - DNA, 22 bp, Homo sapiens
tttggacccagggcctgacttg

SEQ ID NO: 6564394 - DNA, 20 bp, Homo sapiens
tttggacctgcatatttagc

SEQ ID NO: 6564395 - DNA, 15 bp, Homo sapiens
tttggactttgtata

SEQ ID NO: 6564396 - DNA, 15 bp, Homo sapiens
tttggactttgttac

SEQ ID NO: 6564397 - DNA, 17 bp, Homo sapiens
tttggagaaaaaaatca

SEQ ID NO: 6564398 - DNA, 22 bp, Homo sapiens
tttggagaccaggcctcagctc

SEQ ID NO: 6564399 - DNA, 18 bp, Homo sapiens
tttggagactggggtggc

SEQ ID NO: 6564400 - DNA, 15 bp, Homo sapiens
tttggagagaaatat

SEQ ID NO: 6564401 - DNA, 20 bp, Homo sapiens
tttggagagggaaaatcttc

SEQ ID NO: 6564402 - DNA, 17 bp, Homo sapiens
tttggagccgggaaagc

SEQ ID NO: 6564403 - DNA, 17 bp, Homo sapiens
tttggagcctgccaaga

SEQ ID NO: 6564404 - DNA, 22 bp, Homo sapiens
tttggaggctggagtaatcaga

SEQ ID NO: 6564405 - DNA, 14 bp, Homo sapiens
tttggaggtgctta

SEQ ID NO: 6564406 - DNA, 17 bp, Homo sapiens
tttggagtcccctcacc

SEQ ID NO: 6564407 - DNA, 14 bp, Homo sapiens
tttggagtgcttaa

SEQ ID NO: 6564408 - DNA, 21 bp, Homo sapiens
tttggagtggaggcattgttt

SEQ ID NO: 6564409 - DNA, 15 bp, Homo sapiens
tttggagttaaaatg

SEQ ID NO: 6564410 - DNA, 16 bp, Homo sapiens
tttggataataaaaat

SEQ ID NO: 6564411 - DNA, 20 bp, Homo sapiens
tttggatagtctcctacgca

SEQ ID NO: 6564412 - DNA, 15 bp, Homo sapiens
tttggatatgtaaaa

SEQ ID NO: 6564413 - DNA, 19 bp, Homo sapiens
tttggatatttttgtactt

SEQ ID NO: 6564414 - DNA, 19 bp, Homo sapiens
tttggatctatcacctgtc

SEQ ID NO: 6564415 - DNA, 20 bp, Homo sapiens
tttggatctccaattgcctc

SEQ ID NO: 6564416 - DNA, 19 bp, Homo sapiens
tttggatctggatctgtta

SEQ ID NO: 6564417 - DNA, 15 bp, Homo sapiens
tttggatctgtgaca

SEQ ID NO: 6564418 - DNA, 22 bp, Homo sapiens
tttggatctgtgacacatcgtt

SEQ ID NO: 6564419 - DNA, 17 bp, Homo sapiens
tttggatcttgaatgtg

SEQ ID NO: 6564420 - DNA, 17 bp, Homo sapiens
tttggatgacttgttca

SEQ ID NO: 6564421 - DNA, 23 bp, Homo sapiens
tttggattctcttagctactgta

SEQ ID NO: 6564422 - DNA, 18 bp, Homo sapiens
tttggattcttatgtagc

SEQ ID NO: 6564423 - DNA, 13 bp, Homo sapiens
tttggattcttta

SEQ ID NO: 6564424 - DNA, 20 bp, Homo sapiens
tttggattggggtccctcta

SEQ ID NO: 6564425 - DNA, 20 bp, Homo sapiens
tttggatttacgactgaaga

SEQ ID NO: 6564426 - DNA, 13 bp, Homo sapiens
tttggatttctgt

SEQ ID NO: 6564427 - DNA, 18 bp, Homo sapiens
tttggatttctgtgaagt

SEQ ID NO: 6564428 - DNA, 14 bp, Homo sapiens
tttggatttttaat

SEQ ID NO: 6564429 - DNA, 19 bp, Homo sapiens
tttggcaaacgctaaagag

SEQ ID NO: 6564430 - DNA, 15 bp, Homo sapiens
tttggcaacatcttg

SEQ ID NO: 6564431 - DNA, 14 bp, Homo sapiens
tttggcaagaaatc

SEQ ID NO: 6564432 - DNA, 19 bp, Homo sapiens
tttggcaagaacttgttta

SEQ ID NO: 6564433 - DNA, 22 bp, Homo sapiens
tttggcaagagcgttactgtag

SEQ ID NO: 6564434 - DNA, 14 bp, Homo sapiens
tttggcaaggaaag

SEQ ID NO: 6564435 - DNA, 23 bp, Homo sapiens
tttggcaaggaaaggggagaagg

SEQ ID NO: 6564436 - DNA, 21 bp, Homo sapiens
tttggcaatatcatattctaa

SEQ ID NO: 6564437 - DNA, 19 bp, Homo sapiens
tttggcaatttcctggccc

SEQ ID NO: 6564438 - DNA, 17 bp, Homo sapiens
tttggcactatggtttg

SEQ ID NO: 6564439 - DNA, 14 bp, Homo sapiens
tttggcactctctg

SEQ ID NO: 6564440 - DNA, 13 bp, Homo sapiens
tttggcacttgta

SEQ ID NO: 6564441 - DNA, 14 bp, Homo sapiens
tttggcacttgtat

SEQ ID NO: 6564442 - DNA, 16 bp, Homo sapiens
tttggcacttgtattt

SEQ ID NO: 6564443 - DNA, 19 bp, Homo sapiens
tttggcacttgtatttaat

SEQ ID NO: 6564444 - DNA, 18 bp, Homo sapiens
tttggcagaactgctggg

SEQ ID NO: 6564445 - DNA, 23 bp, Homo sapiens
tttggcagcaaagtgtcagtgtt

SEQ ID NO: 6564446 - DNA, 18 bp, Homo sapiens
tttggcagccatgataat

SEQ ID NO: 6564447 - DNA, 19 bp, Homo sapiens
tttggcagccatgataata

SEQ ID NO: 6564448 - DNA, 16 bp, Homo sapiens
tttggcagcccctgtt

SEQ ID NO: 6564449 - DNA, 21 bp, Homo sapiens
tttggcataacataaatctgt

SEQ ID NO: 6564450 - DNA, 18 bp, Homo sapiens
tttggcatctcctgtcct

SEQ ID NO: 6564451 - DNA, 14 bp, Homo sapiens
tttggcatgaaagt

SEQ ID NO: 6564452 - DNA, 13 bp, Homo sapiens
tttggcatgttta

SEQ ID NO: 6564453 - DNA, 13 bp, Homo sapiens
tttggcattatct

SEQ ID NO: 6564454 - DNA, 21 bp, Homo sapiens
tttggcattatctctttctct

SEQ ID NO: 6564455 - DNA, 14 bp, Homo sapiens
tttggcattcctct

SEQ ID NO: 6564456 - DNA, 17 bp, Homo sapiens
tttggcattcctctaat

SEQ ID NO: 6564457 - DNA, 19 bp, Homo sapiens
tttggcattcctctaatgt

SEQ ID NO: 6564458 - DNA, 13 bp, Homo sapiens
tttggcatttgca

SEQ ID NO: 6564459 - DNA, 23 bp, Homo sapiens
tttggccaatgcacctaaagaaa

SEQ ID NO: 6564460 - DNA, 14 bp, Homo sapiens
tttggccacaaaac

SEQ ID NO: 6564461 - DNA, 11 bp, Homo sapiens
tttggccaggg

SEQ ID NO: 6564462 - DNA, 12 bp, Homo sapiens
tttggccaggga

SEQ ID NO: 6564463 - DNA, 19 bp, Homo sapiens
tttggcccaatctctgcca

SEQ ID NO: 6564464 - DNA, 17 bp, Homo sapiens
tttggcccctggaacct

SEQ ID NO: 6564465 - DNA, 15 bp, Homo sapiens
tttggccctacctgt

SEQ ID NO: 6564466 - DNA, 12 bp, Homo sapiens
tttggccctgga

SEQ ID NO: 6564467 - DNA, 15 bp, Homo sapiens
tttggccctggagcc

SEQ ID NO: 6564468 - DNA, 18 bp, Homo sapiens
tttggccctggagccagg

SEQ ID NO: 6564469 - DNA, 19 bp, Homo sapiens
tttggccgttttgtgaaga

SEQ ID NO: 6564470 - DNA, 21 bp, Homo sapiens
tttggccgttttgtgaagaaa

SEQ ID NO: 6564471 - DNA, 12 bp, Homo sapiens
tttggcctgcct

SEQ ID NO: 6564472 - DNA, 14 bp, Homo sapiens
tttggcctggggga

SEQ ID NO: 6564473 - DNA, 12 bp, Homo sapiens
tttggcctgtga

SEQ ID NO: 6564474 - DNA, 13 bp, Homo sapiens
tttggcctgtgat

SEQ ID NO: 6564475 - DNA, 10 bp, Homo sapiens
tttggccttg

SEQ ID NO: 6564476 - DNA, 19 bp, Homo sapiens
tttggcgctattacaaata

SEQ ID NO: 6564477 - DNA, 17 bp, Homo sapiens
tttggcgggccaaggac

SEQ ID NO: 6564478 - DNA, 19 bp, Homo sapiens
tttggctacttttgaaaat

SEQ ID NO: 6564479 - DNA, 15 bp, Homo sapiens
tttggctcagagtcc

SEQ ID NO: 6564480 - DNA, 18 bp, Homo sapiens
tttggctcctctagtaag

SEQ ID NO: 6564481 - DNA, 13 bp, Homo sapiens
tttggctcctgcc

SEQ ID NO: 6564482 - DNA, 18 bp, Homo sapiens
ttattatctagctaagcg

SEQ ID NO: 6564483 - DNA, 13 bp, Homo sapiens
ttattatctttaa

SEQ ID NO: 6564484 - DNA, 22 bp, Homo sapiens
ttattatgaaacttgtgtaaat

SEQ ID NO: 6564485 - DNA, 14 bp, Homo sapiens
ttattatgaagaat

SEQ ID NO: 6564486 - DNA, 15 bp, Homo sapiens
ttattatgaagaatt

SEQ ID NO: 6564487 - DNA, 22 bp, Homo sapiens
ttattatgcaaaatttagaaga

SEQ ID NO: 6564488 - DNA, 19 bp, Homo sapiens
ttattatgcataactgaca

SEQ ID NO: 6564489 - DNA, 12 bp, Homo sapiens
ttattatgcatg

SEQ ID NO: 6564490 - DNA, 13 bp, Homo sapiens
ttattatgcatga

SEQ ID NO: 6564491 - DNA, 17 bp, Homo sapiens
ttattatggcttgtgaa

SEQ ID NO: 6564492 - DNA, 14 bp, Homo sapiens
ttattatgtaaatc

SEQ ID NO: 6564493 - DNA, 14 bp, Homo sapiens
ttattatgttctta

SEQ ID NO: 6564494 - DNA, 13 bp, Homo sapiens
ttattattaacaa

SEQ ID NO: 6564495 - DNA, 14 bp, Homo sapiens
ttattattaaggta

SEQ ID NO: 6564496 - DNA, 13 bp, Homo sapiens
ttattattactgt

SEQ ID NO: 6564497 - DNA, 14 bp, Homo sapiens
ttattattattaaa

SEQ ID NO: 6564498 - DNA, 13 bp, Homo sapiens
ttattattattat

SEQ ID NO: 6564499 - DNA, 11 bp, Homo sapiens
ttattattcag

SEQ ID NO: 6564500 - DNA, 15 bp, Homo sapiens
ttattattgaaattg

SEQ ID NO: 6564501 - DNA, 11 bp, Homo sapiens
ttattattgtg

SEQ ID NO: 6564502 - DNA, 14 bp, Homo sapiens
ttattattgttaat

SEQ ID NO: 6564503 - DNA, 14 bp, Homo sapiens
ttattatttaactc

SEQ ID NO: 6564504 - DNA, 12 bp, Homo sapiens
ttattatttaat

SEQ ID NO: 6564505 - DNA, 22 bp, Homo sapiens
ttattatttgtgttttaattta

SEQ ID NO: 6564506 - DNA, 18 bp, Homo sapiens
ttattattttaaaatata

SEQ ID NO: 6564507 - DNA, 14 bp, Homo sapiens
ttattattttagag

SEQ ID NO: 6564508 - DNA, 19 bp, Homo sapiens
ttattattttcatataatt

SEQ ID NO: 6564509 - DNA, 14 bp, Homo sapiens
ttattattttccca

SEQ ID NO: 6564510 - DNA, 13 bp, Homo sapiens
ttattatttttca

SEQ ID NO: 6564511 - DNA, 18 bp, Homo sapiens
ttattatttttctctctc

SEQ ID NO: 6564512 - DNA, 20 bp, Homo sapiens
ttattcaaaaaatcatgttt

SEQ ID NO: 6564513 - DNA, 21 bp, Homo sapiens
ttattcaaaccaatttcttcc

SEQ ID NO: 6564514 - DNA, 12 bp, Homo sapiens
ttattcaaacta

SEQ ID NO: 6564515 - DNA, 16 bp, Homo sapiens
ttattcaaacttttat

SEQ ID NO: 6564516 - DNA, 13 bp, Homo sapiens
ttattcaaagaga

SEQ ID NO: 6564517 - DNA, 15 bp, Homo sapiens
ttattcaaagagaaa

SEQ ID NO: 6564518 - DNA, 23 bp, Homo sapiens
ttattcaaagagaaaacatctca

SEQ ID NO: 6564519 - DNA, 18 bp, Homo sapiens
ttattcaaagcagctgta

SEQ ID NO: 6564520 - DNA, 14 bp, Homo sapiens
ttattcaaatgaag

SEQ ID NO: 6564521 - DNA, 14 bp, Homo sapiens
ttattcaacagcaa

SEQ ID NO: 6564522 - DNA, 19 bp, Homo sapiens
ttattcaagaaagatatct

SEQ ID NO: 6564523 - DNA, 17 bp, Homo sapiens
ttattcaagacaccaaa

SEQ ID NO: 6564524 - DNA, 16 bp, Homo sapiens
ttattcaagttattgt

SEQ ID NO: 6564525 - DNA, 23 bp, Homo sapiens
ttattcaataaaaaaaagaaatg

SEQ ID NO: 6564526 - DNA, 20 bp, Homo sapiens
ttattcaataaagtatttaa

SEQ ID NO: 6564527 - DNA, 17 bp, Homo sapiens
ttattcaattctgtata

SEQ ID NO: 6564528 - DNA, 20 bp, Homo sapiens
ttattcaatttatttgaatg

SEQ ID NO: 6564529 - DNA, 21 bp, Homo sapiens
ttattcaatttatttgaatga

SEQ ID NO: 6564530 - DNA, 23 bp, Homo sapiens
ttattcacaacctcaccaaacta

SEQ ID NO: 6564531 - DNA, 16 bp, Homo sapiens
ttattcacatatatca

SEQ ID NO: 6564532 - DNA, 20 bp, Homo sapiens
ttattcacctttttaataaa

SEQ ID NO: 6564533 - DNA, 22 bp, Homo sapiens
ttattcacctttttaataaaaa

SEQ ID NO: 6564534 - DNA, 15 bp, Homo sapiens
ttattcactgtaagt

SEQ ID NO: 6564535 - DNA, 14 bp, Homo sapiens
ttattcacttttgt

SEQ ID NO: 6564536 - DNA, 13 bp, Homo sapiens
ttattcagaaata

SEQ ID NO: 6564537 - DNA, 18 bp, Homo sapiens
ttattcagaactatttaa

SEQ ID NO: 6564538 - DNA, 11 bp, Homo sapiens
ttattcagcag

SEQ ID NO: 6564539 - DNA, 16 bp, Homo sapiens
ttattcagctagaatt

SEQ ID NO: 6564540 - DNA, 21 bp, Homo sapiens
ttattcagctagaatttctgg

SEQ ID NO: 6564541 - DNA, 15 bp, Homo sapiens
ttattcagggaagga

SEQ ID NO: 6564542 - DNA, 17 bp, Homo sapiens
ttattcagtaaacaaat

SEQ ID NO: 6564543 - DNA, 22 bp, Homo sapiens
ttattcagtgccacaaattgaa

SEQ ID NO: 6564544 - DNA, 13 bp, Homo sapiens
ttattcagtgtca

SEQ ID NO: 6564545 - DNA, 18 bp, Homo sapiens
ttattcagttcttacaca

SEQ ID NO: 6564546 - DNA, 21 bp, Homo sapiens
ttattcataaaaaataatggt

SEQ ID NO: 6564547 - DNA, 13 bp, Homo sapiens
ttattcataatga

SEQ ID NO: 6564548 - DNA, 14 bp, Homo sapiens
ttattcataatgaa

SEQ ID NO: 6564549 - DNA, 21 bp, Homo sapiens
ttattcatagctgtatatttg

SEQ ID NO: 6564550 - DNA, 13 bp, Homo sapiens
ttattcatccagc

SEQ ID NO: 6564551 - DNA, 21 bp, Homo sapiens
ttattcatgctttctcctttt

SEQ ID NO: 6564552 - DNA, 12 bp, Homo sapiens
ttattcattatt

SEQ ID NO: 6564553 - DNA, 12 bp, Homo sapiens
ttattcatttaa

SEQ ID NO: 6564554 - DNA, 17 bp, Homo sapiens
ttattcatttaaaatga

SEQ ID NO: 6564555 - DNA, 20 bp, Homo sapiens
ttattccaaaccaaatttta

SEQ ID NO: 6564556 - DNA, 14 bp, Homo sapiens
ttattccacaaaca

SEQ ID NO: 6564557 - DNA, 15 bp, Homo sapiens
ttattccacagatat

SEQ ID NO: 6564558 - DNA, 12 bp, Homo sapiens
ttattccacatc

SEQ ID NO: 6564559 - DNA, 19 bp, Homo sapiens
ttattccacatctacgttt

SEQ ID NO: 6564560 - DNA, 17 bp, Homo sapiens
ttattccagaatgctgt

SEQ ID NO: 6564561 - DNA, 12 bp, Homo sapiens
ttattccatatt

SEQ ID NO: 6564562 - DNA, 16 bp, Homo sapiens
ttattccatcttctcc

SEQ ID NO: 6564563 - DNA, 16 bp, Homo sapiens
ttattccatgactgct

SEQ ID NO: 6564564 - DNA, 21 bp, Homo sapiens
ttattccatgaggaaaataat

SEQ ID NO: 6564565 - DNA, 18 bp, Homo sapiens
ttattccccagtgactcc

SEQ ID NO: 6564566 - DNA, 15 bp, Homo sapiens
ttattccctcatcct

SEQ ID NO: 6564567 - DNA, 23 bp, Homo sapiens
ttattcccttcctgccagcccct

SEQ ID NO: 6564568 - DNA, 16 bp, Homo sapiens
ttattcctaattcctg

SEQ ID NO: 6564569 - DNA, 21 bp, Homo sapiens
ttattcctaattcctgtatgt

SEQ ID NO: 6564570 - DNA, 14 bp, Homo sapiens
ttattcctagtctt

SEQ ID NO: 6564571 - DNA, 20 bp, Homo sapiens
ttattcctatatagtttatt

SEQ ID NO: 6564572 - DNA, 17 bp, Homo sapiens
ttattcctcagattgct

SEQ ID NO: 6564573 - DNA, 20 bp, Homo sapiens
ttattcctcctgctcatatt

SEQ ID NO: 6564574 - DNA, 15 bp, Homo sapiens
ttattcctgcactca

SEQ ID NO: 6564575 - DNA, 20 bp, Homo sapiens
ttattcctgccctgctgttt

SEQ ID NO: 6564576 - DNA, 13 bp, Homo sapiens
ttattcctgtatg

SEQ ID NO: 6564577 - DNA, 15 bp, Homo sapiens
ttattcctgtatgtt

SEQ ID NO: 6564578 - DNA, 12 bp, Homo sapiens
ttattccttcca

SEQ ID NO: 6564579 - DNA, 14 bp, Homo sapiens
ttattccttctgta

SEQ ID NO: 6564580 - DNA, 16 bp, Homo sapiens
ttattcctttgaatat

SEQ ID NO: 6564581 - DNA, 17 bp, Homo sapiens
ttattcctttgaatatt

SEQ ID NO: 6564582 - DNA, 15 bp, Homo sapiens
ttattcgccatctga

SEQ ID NO: 6564583 - DNA, 21 bp, Homo sapiens
ttattcggtgatgactcttgt

SEQ ID NO: 6564584 - DNA, 19 bp, Homo sapiens
ttattcgtagatattggac

SEQ ID NO: 6564585 - DNA, 21 bp, Homo sapiens
ttattctaagccctttgccat

SEQ ID NO: 6564586 - DNA, 12 bp, Homo sapiens
ttattctaatta

SEQ ID NO: 6564587 - DNA, 14 bp, Homo sapiens
ttattctactatac

SEQ ID NO: 6564588 - DNA, 16 bp, Homo sapiens
ttattctacttttaaa

SEQ ID NO: 6564589 - DNA, 11 bp, Homo sapiens
ttattctagtc

SEQ ID NO: 6564590 - DNA, 16 bp, Homo sapiens
ttattctagtcaactg

SEQ ID NO: 6564591 - DNA, 20 bp, Homo sapiens
ttattctagtcaactgctgt

SEQ ID NO: 6564592 - DNA, 22 bp, Homo sapiens
ttattctatcactggcaatatt

SEQ ID NO: 6564593 - DNA, 15 bp, Homo sapiens
ttattctatctgttt

SEQ ID NO: 6564594 - DNA, 13 bp, Homo sapiens
ttattctatgtag

SEQ ID NO: 6564595 - DNA, 14 bp, Homo sapiens
ttattctatgtagt

SEQ ID NO: 6564596 - DNA, 16 bp, Homo sapiens
ttattctcaaagcagg

SEQ ID NO: 6564597 - DNA, 14 bp, Homo sapiens
ttattctcagaaca

SEQ ID NO: 6564598 - DNA, 13 bp, Homo sapiens
ttattctcataat

SEQ ID NO: 6564599 - DNA, 13 bp, Homo sapiens
ttattctcctccc

SEQ ID NO: 6564600 - DNA, 17 bp, Homo sapiens
ttattctctcacagtgt

SEQ ID NO: 6564601 - DNA, 15 bp, Homo sapiens
ttattctctgtttgc

SEQ ID NO: 6564602 - DNA, 19 bp, Homo sapiens
ttattctcttttatctgtt

SEQ ID NO: 6564603 - DNA, 18 bp, Homo sapiens
ttattctgacataaaatt

SEQ ID NO: 6564604 - DNA, 11 bp, Homo sapiens
ttattctgctc

SEQ ID NO: 6564605 - DNA, 13 bp, Homo sapiens
ttattctggagtt

SEQ ID NO: 6564606 - DNA, 23 bp, Homo sapiens
ttattctgggaaatgttttaatg

SEQ ID NO: 6564607 - DNA, 20 bp, Homo sapiens
ttattctgggaatgtatagt

SEQ ID NO: 6564608 - DNA, 23 bp, Homo sapiens
ttattctgggcaccacaaaatat

SEQ ID NO: 6564609 - DNA, 11 bp, Homo sapiens
ttattctgtgg

SEQ ID NO: 6564610 - DNA, 13 bp, Homo sapiens
ttattcttctaga

SEQ ID NO: 6564611 - DNA, 12 bp, Homo sapiens
ttattcttctca

SEQ ID NO: 6564612 - DNA, 17 bp, Homo sapiens
ttattcttctcataaat

SEQ ID NO: 6564613 - DNA, 18 bp, Homo sapiens
ttattcttgaaagaagaa

SEQ ID NO: 6564614 - DNA, 11 bp, Homo sapiens
ttattcttgat

SEQ ID NO: 6564615 - DNA, 16 bp, Homo sapiens
ttattcttgctgggca

SEQ ID NO: 6564616 - DNA, 15 bp, Homo sapiens
ttattctttgaaaac

SEQ ID NO: 6564617 - DNA, 12 bp, Homo sapiens
ttattcttttcc

SEQ ID NO: 6564618 - DNA, 16 bp, Homo sapiens
ttattcttttccagaa

SEQ ID NO: 6564619 - DNA, 22 bp, Homo sapiens
ttattctttttttctctagagt

SEQ ID NO: 6564620 - DNA, 22 bp, Homo sapiens
ttattgaaaggggacacctgta

SEQ ID NO: 6564621 - DNA, 23 bp, Homo sapiens
ttattgaaaggggacacctgtac

SEQ ID NO: 6564622 - DNA, 18 bp, Homo sapiens
ttattgaacttgaaatct

SEQ ID NO: 6564623 - DNA, 13 bp, Homo sapiens
ttattgaagaaac

SEQ ID NO: 6564624 - DNA, 19 bp, Homo sapiens
ttattgaagatttaccata

SEQ ID NO: 6564625 - DNA, 22 bp, Homo sapiens
ttattgaaggaagccaaattta

SEQ ID NO: 6564626 - DNA, 13 bp, Homo sapiens
ttattgaagtgtt

SEQ ID NO: 6564627 - DNA, 21 bp, Homo sapiens
ttattgaatactgtctgtatc

SEQ ID NO: 6564628 - DNA, 16 bp, Homo sapiens
ttattgaatatatgat

SEQ ID NO: 6564629 - DNA, 17 bp, Homo sapiens
ttattgaattagaaaat

SEQ ID NO: 6564630 - DNA, 20 bp, Homo sapiens
ttattgaattagaaaattag

SEQ ID NO: 6564631 - DNA, 18 bp, Homo sapiens
ttattgacaataatttca

SEQ ID NO: 6564632 - DNA, 19 bp, Homo sapiens
ttattgacacagaaaatgt

SEQ ID NO: 6564633 - DNA, 23 bp, Homo sapiens
ttattgacacagaaaatgttgag

SEQ ID NO: 6564634 - DNA, 14 bp, Homo sapiens
ttattgacactgaa

SEQ ID NO: 6564635 - DNA, 17 bp, Homo sapiens
ttattgacactgaactt

SEQ ID NO: 6564636 - DNA, 13 bp, Homo sapiens
ttattgagaattt

SEQ ID NO: 6564637 - DNA, 21 bp, Homo sapiens
ttattgaggaaaaatatgtga

SEQ ID NO: 6564638 - DNA, 22 bp, Homo sapiens
ttattgaggaaaaatatgtgaa

SEQ ID NO: 6564639 - DNA, 15 bp, Homo sapiens
ttattgagtaatatt

SEQ ID NO: 6564640 - DNA, 17 bp, Homo sapiens
ttattgagtaatattac

SEQ ID NO: 6564641 - DNA, 18 bp, Homo sapiens
ttattgagtaatattaca

SEQ ID NO: 6564642 - DNA, 20 bp, Homo sapiens
ttattgagtctgtccagata

SEQ ID NO: 6564643 - DNA, 17 bp, Homo sapiens
ttattgatattctaaga

SEQ ID NO: 6564644 - DNA, 19 bp, Homo sapiens
ttattgatattctaagaaa

SEQ ID NO: 6564645 - DNA, 21 bp, Homo sapiens
ttattgatattctaagaaata

SEQ ID NO: 6564646 - DNA, 18 bp, Homo sapiens
ttattgatcaaaatcaaa

SEQ ID NO: 6564647 - DNA, 15 bp, Homo sapiens
ttattgatcccacat

SEQ ID NO: 6564648 - DNA, 18 bp, Homo sapiens
ttattgatctttgcccat

SEQ ID NO: 6564649 - DNA, 15 bp, Homo sapiens
ttattgatgtgaaat

SEQ ID NO: 6564650 - DNA, 21 bp, Homo sapiens
ttattgattttctttctaatt

SEQ ID NO: 6564651 - DNA, 14 bp, Homo sapiens
ttattgcagtttat

SEQ ID NO: 6564652 - DNA, 16 bp, Homo sapiens
ttattgcatatagatt

SEQ ID NO: 6564653 - DNA, 21 bp, Homo sapiens
ttattgcatatagatttagtt

SEQ ID NO: 6564654 - DNA, 12 bp, Homo sapiens
ttattgcatttg

SEQ ID NO: 6564655 - DNA, 21 bp, Homo sapiens
ttattgccaaaacccagctgc

SEQ ID NO: 6564656 - DNA, 22 bp, Homo sapiens
ttattgccattatagcgcctgt

SEQ ID NO: 6564657 - DNA, 18 bp, Homo sapiens
ttattgcctcccaggcaa

SEQ ID NO: 6564658 - DNA, 20 bp, Homo sapiens
ttattgcctgggcagtgccc

SEQ ID NO: 6564659 - DNA, 12 bp, Homo sapiens
ttattgccttct

SEQ ID NO: 6564660 - DNA, 14 bp, Homo sapiens
ttattgccttctca

SEQ ID NO: 6564661 - DNA, 17 bp, Homo sapiens
ttattgccttctcacca

SEQ ID NO: 6564662 - DNA, 22 bp, Homo sapiens
ttattgccttctcaccagctgc

SEQ ID NO: 6564663 - DNA, 15 bp, Homo sapiens
ttattgcgctgctac

SEQ ID NO: 6564664 - DNA, 18 bp, Homo sapiens
tttggctccttaccaata

SEQ ID NO: 6564665 - DNA, 14 bp, Homo sapiens
tttggctgaaatta

SEQ ID NO: 6564666 - DNA, 19 bp, Homo sapiens
tttggctgaaattatgtca

SEQ ID NO: 6564667 - DNA, 20 bp, Homo sapiens
tttggctgaaattctcctgg

SEQ ID NO: 6564668 - DNA, 21 bp, Homo sapiens
tttggctgacttcatctgggg

SEQ ID NO: 6564669 - DNA, 17 bp, Homo sapiens
tttggctgctctccatc

SEQ ID NO: 6564670 - DNA, 13 bp, Homo sapiens
tttggctgcttct

SEQ ID NO: 6564671 - DNA, 14 bp, Homo sapiens
tttggctggagccc

SEQ ID NO: 6564672 - DNA, 14 bp, Homo sapiens
tttggctgtgtcta

SEQ ID NO: 6564673 - DNA, 14 bp, Homo sapiens
tttggcttcatttc

SEQ ID NO: 6564674 - DNA, 17 bp, Homo sapiens
tttggcttgcttatgtg

SEQ ID NO: 6564675 - DNA, 13 bp, Homo sapiens
tttggcttggcct

SEQ ID NO: 6564676 - DNA, 20 bp, Homo sapiens
tttggctttacgggtgtaaa

SEQ ID NO: 6564677 - DNA, 22 bp, Homo sapiens
tttggctttatgtgcaaaatct

SEQ ID NO: 6564678 - DNA, 19 bp, Homo sapiens
tttgggaaaggcagggccc

SEQ ID NO: 6564679 - DNA, 16 bp, Homo sapiens
tttgggaacactggcc

SEQ ID NO: 6564680 - DNA, 13 bp, Homo sapiens
tttgggaacataa

SEQ ID NO: 6564681 - DNA, 18 bp, Homo sapiens
tttgggaacataaaaact

SEQ ID NO: 6564682 - DNA, 16 bp, Homo sapiens
tttgggaactgtgttt

SEQ ID NO: 6564683 - DNA, 21 bp, Homo sapiens
tttgggaagacgttttcttta

SEQ ID NO: 6564684 - DNA, 12 bp, Homo sapiens
tttgggaagggg

SEQ ID NO: 6564685 - DNA, 17 bp, Homo sapiens
tttgggaagttaaaggg

SEQ ID NO: 6564686 - DNA, 18 bp, Homo sapiens
tttgggaagtttgctgtg

SEQ ID NO: 6564687 - DNA, 17 bp, Homo sapiens
tttgggaatgtttgtct

SEQ ID NO: 6564688 - DNA, 15 bp, Homo sapiens
tttgggagccaggac

SEQ ID NO: 6564689 - DNA, 16 bp, Homo sapiens
tttgggagccaggact

SEQ ID NO: 6564690 - DNA, 17 bp, Homo sapiens
tttgggaggccaaggca

SEQ ID NO: 6564691 - DNA, 17 bp, Homo sapiens
tttgggaggctgaggtg

SEQ ID NO: 6564692 - DNA, 15 bp, Homo sapiens
tttgggagtttttat

SEQ ID NO: 6564693 - DNA, 22 bp, Homo sapiens
tttgggataggaaaaatgagta

SEQ ID NO: 6564694 - DNA, 17 bp, Homo sapiens
tttgggatccctgtctt

SEQ ID NO: 6564695 - DNA, 22 bp, Homo sapiens
tttgggatgtcttatttttaga

SEQ ID NO: 6564696 - DNA, 11 bp, Homo sapiens
tttgggcatgt

SEQ ID NO: 6564697 - DNA, 14 bp, Homo sapiens
tttgggcccaggga

SEQ ID NO: 6564698 - DNA, 15 bp, Homo sapiens
tttgggcccctctcc

SEQ ID NO: 6564699 - DNA, 13 bp, Homo sapiens
tttgggccctgca

SEQ ID NO: 6564700 - DNA, 15 bp, Homo sapiens
tttgggcttcagcct

SEQ ID NO: 6564701 - DNA, 14 bp, Homo sapiens
tttgggcttgacac

SEQ ID NO: 6564702 - DNA, 17 bp, Homo sapiens
tttggggaaaaaagcac

SEQ ID NO: 6564703 - DNA, 14 bp, Homo sapiens
tttggggaactcaa

SEQ ID NO: 6564704 - DNA, 13 bp, Homo sapiens
tttggggaagaac

SEQ ID NO: 6564705 - DNA, 17 bp, Homo sapiens
tttggggaagttcaagt

SEQ ID NO: 6564706 - DNA, 19 bp, Homo sapiens
tttggggacagggggtggg

SEQ ID NO: 6564707 - DNA, 20 bp, Homo sapiens
tttggggacagggggtggga

SEQ ID NO: 6564708 - DNA, 13 bp, Homo sapiens
tttggggactcag

SEQ ID NO: 6564709 - DNA, 13 bp, Homo sapiens
tttggggagagat

SEQ ID NO: 6564710 - DNA, 19 bp, Homo sapiens
tttggggagggggaagaga

SEQ ID NO: 6564711 - DNA, 20 bp, Homo sapiens
tttggggagggggaagagaa

SEQ ID NO: 6564712 - DNA, 16 bp, Homo sapiens
tttggggagtacctgt

SEQ ID NO: 6564713 - DNA, 20 bp, Homo sapiens
tttggggattttcaaaagat

SEQ ID NO: 6564714 - DNA, 16 bp, Homo sapiens
tttggggcatttgtaa

SEQ ID NO: 6564715 - DNA, 18 bp, Homo sapiens
tttggggccatggtggag

SEQ ID NO: 6564716 - DNA, 13 bp, Homo sapiens
tttggggccggga

SEQ ID NO: 6564717 - DNA, 19 bp, Homo sapiens
tttggggcgaggcagagga

SEQ ID NO: 6564718 - DNA, 23 bp, Homo sapiens
tttggggctttcccaggagaaag

SEQ ID NO: 6564719 - DNA, 18 bp, Homo sapiens
tttgggggaaaaaaaaga

SEQ ID NO: 6564720 - DNA, 23 bp, Homo sapiens
tttgggggaaacgggctccttcc

SEQ ID NO: 6564721 - DNA, 14 bp, Homo sapiens
tttgggggaaactt

SEQ ID NO: 6564722 - DNA, 17 bp, Homo sapiens
tttgggggaaacttcct

SEQ ID NO: 6564723 - DNA, 21 bp, Homo sapiens
tttgggggcgccctctctgct

SEQ ID NO: 6564724 - DNA, 22 bp, Homo sapiens
tttgggggcgccctctctgctc

SEQ ID NO: 6564725 - DNA, 21 bp, Homo sapiens
tttgggggctcatttttgctg

SEQ ID NO: 6564726 - DNA, 15 bp, Homo sapiens
tttggggggagaaac

SEQ ID NO: 6564727 - DNA, 20 bp, Homo sapiens
tttgggggtcagcatccagt

SEQ ID NO: 6564728 - DNA, 22 bp, Homo sapiens
tttggggtacccactgctctgg

SEQ ID NO: 6564729 - DNA, 16 bp, Homo sapiens
tttggggtctttgtgg

SEQ ID NO: 6564730 - DNA, 17 bp, Homo sapiens
tttggggtgcctaggtt

SEQ ID NO: 6564731 - DNA, 19 bp, Homo sapiens
tttggggttgcccagcctg

SEQ ID NO: 6564732 - DNA, 21 bp, Homo sapiens
tttgggtaacctgaagtttta

SEQ ID NO: 6564733 - DNA, 16 bp, Homo sapiens
tttgggtactggagct

SEQ ID NO: 6564734 - DNA, 19 bp, Homo sapiens
tttgggtattttgtcagtt

SEQ ID NO: 6564735 - DNA, 14 bp, Homo sapiens
tttgggtccaggag

SEQ ID NO: 6564736 - DNA, 22 bp, Homo sapiens
tttgggtctacaagtatatgtg

SEQ ID NO: 6564737 - DNA, 14 bp, Homo sapiens
tttgggtgaatctt

SEQ ID NO: 6564738 - DNA, 23 bp, Homo sapiens
tttgggtggggggcattgagtat

SEQ ID NO: 6564739 - DNA, 22 bp, Homo sapiens
tttgggttaatatggctcttca

SEQ ID NO: 6564740 - DNA, 16 bp, Homo sapiens
tttgggtttctgccct

SEQ ID NO: 6564741 - DNA, 19 bp, Homo sapiens
tttgggttttttaattgag

SEQ ID NO: 6564742 - DNA, 16 bp, Homo sapiens
tttggtaaatttttga

SEQ ID NO: 6564743 - DNA, 18 bp, Homo sapiens
tttggtaaggggaattga

SEQ ID NO: 6564744 - DNA, 15 bp, Homo sapiens
tttggtaataacaaa

SEQ ID NO: 6564745 - DNA, 16 bp, Homo sapiens
tttggtacaaaaataa

SEQ ID NO: 6564746 - DNA, 14 bp, Homo sapiens
tttggtacacatgt

SEQ ID NO: 6564747 - DNA, 18 bp, Homo sapiens
tttggtacacatgtgtta

SEQ ID NO: 6564748 - DNA, 16 bp, Homo sapiens
tttggtaccagataac

SEQ ID NO: 6564749 - DNA, 13 bp, Homo sapiens
tttggtagatgtt

SEQ ID NO: 6564750 - DNA, 20 bp, Homo sapiens
tttggtaggtaaatctagag

SEQ ID NO: 6564751 - DNA, 23 bp, Homo sapiens
tttggtagtggaaaaaaaaaaga

SEQ ID NO: 6564752 - DNA, 14 bp, Homo sapiens
tttggtagtttctg

SEQ ID NO: 6564753 - DNA, 18 bp, Homo sapiens
tttggtataatgtttaaa

SEQ ID NO: 6564754 - DNA, 16 bp, Homo sapiens
tttggtatggtaaaga

SEQ ID NO: 6564755 - DNA, 21 bp, Homo sapiens
tttggtatgttgggataagga

SEQ ID NO: 6564756 - DNA, 22 bp, Homo sapiens
tttggtattacactgtatttgt

SEQ ID NO: 6564757 - DNA, 16 bp, Homo sapiens
tttggtattcaatttg

SEQ ID NO: 6564758 - DNA, 14 bp, Homo sapiens
tttggtattgtatt

SEQ ID NO: 6564759 - DNA, 17 bp, Homo sapiens
tttggtatttatgtaaa

SEQ ID NO: 6564760 - DNA, 15 bp, Homo sapiens
tttggtcaggggggc

SEQ ID NO: 6564761 - DNA, 20 bp, Homo sapiens
tttggtcagttgggttttta

SEQ ID NO: 6564762 - DNA, 19 bp, Homo sapiens
tttggtccacttttccagt

SEQ ID NO: 6564763 - DNA, 21 bp, Homo sapiens
tttggtcccctccctcgtggg

SEQ ID NO: 6564764 - DNA, 22 bp, Homo sapiens
tttggtcctaagtccctgcccc

SEQ ID NO: 6564765 - DNA, 13 bp, Homo sapiens
tttggtcctgcct

SEQ ID NO: 6564766 - DNA, 22 bp, Homo sapiens
tttggtcgaggagtaacaatac

SEQ ID NO: 6564767 - DNA, 15 bp, Homo sapiens
tttggtctcttgctt

SEQ ID NO: 6564768 - DNA, 16 bp, Homo sapiens
tttggtctggactgac

SEQ ID NO: 6564769 - DNA, 19 bp, Homo sapiens
tttggtctggactgacagc

SEQ ID NO: 6564770 - DNA, 14 bp, Homo sapiens
tttggtctgggact

SEQ ID NO: 6564771 - DNA, 17 bp, Homo sapiens
tttggtctgtgttcaat

SEQ ID NO: 6564772 - DNA, 22 bp, Homo sapiens
tttggtctgtgttcaatccaga

SEQ ID NO: 6564773 - DNA, 21 bp, Homo sapiens
tttggtctttttttgtattat

SEQ ID NO: 6564774 - DNA, 16 bp, Homo sapiens
tttggtgaacagtttt

SEQ ID NO: 6564775 - DNA, 13 bp, Homo sapiens
tttggtgaattcc

SEQ ID NO: 6564776 - DNA, 13 bp, Homo sapiens
tttggtgaggacc

SEQ ID NO: 6564777 - DNA, 21 bp, Homo sapiens
tttggtgaggacctgcggcct

SEQ ID NO: 6564778 - DNA, 18 bp, Homo sapiens
tttggtgatactgtcaag

SEQ ID NO: 6564779 - DNA, 18 bp, Homo sapiens
tttggtgcatagaactgg

SEQ ID NO: 6564780 - DNA, 22 bp, Homo sapiens
tttggtgcatagaactgggtaa

SEQ ID NO: 6564781 - DNA, 18 bp, Homo sapiens
tttggtgccaatgtgaaa

SEQ ID NO: 6564782 - DNA, 15 bp, Homo sapiens
tttggtgcctttcct

SEQ ID NO: 6564783 - DNA, 13 bp, Homo sapiens
tttggtgctataa

SEQ ID NO: 6564784 - DNA, 21 bp, Homo sapiens
tttggtgctcacgtgtcctta

SEQ ID NO: 6564785 - DNA, 18 bp, Homo sapiens
tttggtgctggtctattt

SEQ ID NO: 6564786 - DNA, 21 bp, Homo sapiens
tttggtgcttctcagatttct

SEQ ID NO: 6564787 - DNA, 12 bp, Homo sapiens
tttggtgctttt

SEQ ID NO: 6564788 - DNA, 18 bp, Homo sapiens
tttggtggcccctcccca

SEQ ID NO: 6564789 - DNA, 15 bp, Homo sapiens
tttggtggctttgca

SEQ ID NO: 6564790 - DNA, 12 bp, Homo sapiens
tttggtggtccc

SEQ ID NO: 6564791 - DNA, 19 bp, Homo sapiens
tttggtgtaggtaaatcta

SEQ ID NO: 6564792 - DNA, 21 bp, Homo sapiens
tttggtgtcattattccatct

SEQ ID NO: 6564793 - DNA, 16 bp, Homo sapiens
tttggtgtctttctct

SEQ ID NO: 6564794 - DNA, 18 bp, Homo sapiens
tttggtgtgccctgtgtg

SEQ ID NO: 6564795 - DNA, 22 bp, Homo sapiens
tttggtgtggctgtattcagat

SEQ ID NO: 6564796 - DNA, 19 bp, Homo sapiens
tttggtgtgtggagatgca

SEQ ID NO: 6564797 - DNA, 12 bp, Homo sapiens
tttggtgtgttc

SEQ ID NO: 6564798 - DNA, 13 bp, Homo sapiens
tttggtgtgttcg

SEQ ID NO: 6564799 - DNA, 13 bp, Homo sapiens
tttggtgttcctg

SEQ ID NO: 6564800 - DNA, 18 bp, Homo sapiens
tttggtgttcctggaagc

SEQ ID NO: 6564801 - DNA, 16 bp, Homo sapiens
tttggtgttctggcct

SEQ ID NO: 6564802 - DNA, 16 bp, Homo sapiens
tttggtgtttgtctgt

SEQ ID NO: 6564803 - DNA, 22 bp, Homo sapiens
tttggtgttttttttaagggca

SEQ ID NO: 6564804 - DNA, 18 bp, Homo sapiens
tttggttaaaaaaaagaa

SEQ ID NO: 6564805 - DNA, 16 bp, Homo sapiens
tttggttaagctttga

SEQ ID NO: 6564806 - DNA, 18 bp, Homo sapiens
tttggttaagtctgtttt

SEQ ID NO: 6564807 - DNA, 19 bp, Homo sapiens
tttggttaagtctgtttta

SEQ ID NO: 6564808 - DNA, 22 bp, Homo sapiens
tttggttaagtctgttttatga

SEQ ID NO: 6564809 - DNA, 15 bp, Homo sapiens
tttggttaagttggc

SEQ ID NO: 6564810 - DNA, 18 bp, Homo sapiens
tttggttagctcacagga

SEQ ID NO: 6564811 - DNA, 21 bp, Homo sapiens
tttggttatagtgcaatatat

SEQ ID NO: 6564812 - DNA, 13 bp, Homo sapiens
tttggttatgaaa

SEQ ID NO: 6564813 - DNA, 21 bp, Homo sapiens
tttggttatttcagcccccat

SEQ ID NO: 6564814 - DNA, 13 bp, Homo sapiens
tttggttcccttc

SEQ ID NO: 6564815 - DNA, 21 bp, Homo sapiens
tttggttcctcatggctgtta

SEQ ID NO: 6564816 - DNA, 15 bp, Homo sapiens
tttggttcctctctg

SEQ ID NO: 6564817 - DNA, 17 bp, Homo sapiens
tttggttctctccagga

SEQ ID NO: 6564818 - DNA, 13 bp, Homo sapiens
tttggttctgggg

SEQ ID NO: 6564819 - DNA, 15 bp, Homo sapiens
tttggttgcaattgt

SEQ ID NO: 6564820 - DNA, 13 bp, Homo sapiens
tttggttgcactt

SEQ ID NO: 6564821 - DNA, 19 bp, Homo sapiens
tttggttgcactttagaca

SEQ ID NO: 6564822 - DNA, 21 bp, Homo sapiens
tttggttgcactttagacatt

SEQ ID NO: 6564823 - DNA, 17 bp, Homo sapiens
tttggttgctttaatat

SEQ ID NO: 6564824 - DNA, 13 bp, Homo sapiens
tttggttggtttt

SEQ ID NO: 6564825 - DNA, 22 bp, Homo sapiens
tttggttgtaaatgctcgtgtg

SEQ ID NO: 6564826 - DNA, 21 bp, Homo sapiens
tttggtttatattttttcagt

SEQ ID NO: 6564827 - DNA, 15 bp, Homo sapiens
tttggtttcttcatt

SEQ ID NO: 6564828 - DNA, 22 bp, Homo sapiens
tttggtttgacaattttgtctt

SEQ ID NO: 6564829 - DNA, 14 bp, Homo sapiens
tttggtttgacttg

SEQ ID NO: 6564830 - DNA, 19 bp, Homo sapiens
tttggtttgccttttatgt

SEQ ID NO: 6564831 - DNA, 20 bp, Homo sapiens
tttggtttgctttggtttat

SEQ ID NO: 6564832 - DNA, 16 bp, Homo sapiens
tttggtttggttttta

SEQ ID NO: 6564833 - DNA, 18 bp, Homo sapiens
tttggttttacacaggaa

SEQ ID NO: 6564834 - DNA, 14 bp, Homo sapiens
tttggttttggaaa

SEQ ID NO: 6564835 - DNA, 14 bp, Homo sapiens
tttggttttgttcc

SEQ ID NO: 6564836 - DNA, 16 bp, Homo sapiens
tttggtttttttgtac

SEQ ID NO: 6564837 - DNA, 22 bp, Homo sapiens
tttgtaaaaacagcattgcttt

SEQ ID NO: 6564838 - DNA, 16 bp, Homo sapiens
tttgtaaaaacttttt

SEQ ID NO: 6564839 - DNA, 22 bp, Homo sapiens
tttgtaaaaagaaattgtgaaa

SEQ ID NO: 6564840 - DNA, 13 bp, Homo sapiens
tttgtaaaaaggg

SEQ ID NO: 6564841 - DNA, 14 bp, Homo sapiens
tttgtaaaaatctt

SEQ ID NO: 6564842 - DNA, 14 bp, Homo sapiens
tttgtaaaaatgag

SEQ ID NO: 6564843 - DNA, 14 bp, Homo sapiens
ttattgctagtatt

SEQ ID NO: 6564844 - DNA, 16 bp, Homo sapiens
ttattgctagtatttg

SEQ ID NO: 6564845 - DNA, 14 bp, Homo sapiens
ttattgctcctgta

SEQ ID NO: 6564846 - DNA, 13 bp, Homo sapiens
ttattgctgattt

SEQ ID NO: 6564847 - DNA, 18 bp, Homo sapiens
ttattgctgattttaatg

SEQ ID NO: 6564848 - DNA, 15 bp, Homo sapiens
ttattgctgcataaa

SEQ ID NO: 6564849 - DNA, 22 bp, Homo sapiens
ttattgctgcataaatttgtaa

SEQ ID NO: 6564850 - DNA, 15 bp, Homo sapiens
ttattgctgcatttt

SEQ ID NO: 6564851 - DNA, 16 bp, Homo sapiens
ttattgctgcatttta

SEQ ID NO: 6564852 - DNA, 12 bp, Homo sapiens
ttattgctgcca

SEQ ID NO: 6564853 - DNA, 16 bp, Homo sapiens
ttattgctgccaaaac

SEQ ID NO: 6564854 - DNA, 19 bp, Homo sapiens
ttattgctgccaaaaccac

SEQ ID NO: 6564855 - DNA, 20 bp, Homo sapiens
ttattgctgccaaaaccaca

SEQ ID NO: 6564856 - DNA, 12 bp, Homo sapiens
ttattgctgttg

SEQ ID NO: 6564857 - DNA, 15 bp, Homo sapiens
ttattggaaatgtac

SEQ ID NO: 6564858 - DNA, 22 bp, Homo sapiens
ttattggaagtgttcaagaaat

SEQ ID NO: 6564859 - DNA, 23 bp, Homo sapiens
ttattggactccaggcctgacca

SEQ ID NO: 6564860 - DNA, 21 bp, Homo sapiens
ttattggcaaagtttaaatgt

SEQ ID NO: 6564861 - DNA, 18 bp, Homo sapiens
ttattggcaacttatgga

SEQ ID NO: 6564862 - DNA, 22 bp, Homo sapiens
ttattggcagccaaggaatgtg

SEQ ID NO: 6564863 - DNA, 23 bp, Homo sapiens
ttattggcagccaaggaatgtgt

SEQ ID NO: 6564864 - DNA, 19 bp, Homo sapiens
ttattggcctgaaatgatc

SEQ ID NO: 6564865 - DNA, 16 bp, Homo sapiens
ttattggctgagatat

SEQ ID NO: 6564866 - DNA, 22 bp, Homo sapiens
ttattggctgagatatgaacat

SEQ ID NO: 6564867 - DNA, 22 bp, Homo sapiens
ttattggcttttctgatccagt

SEQ ID NO: 6564868 - DNA, 19 bp, Homo sapiens
ttattgggatatcatttta

SEQ ID NO: 6564869 - DNA, 23 bp, Homo sapiens
ttattgggatgtgagccccaggg

SEQ ID NO: 6564870 - DNA, 19 bp, Homo sapiens
ttattgggcaagtgattga

SEQ ID NO: 6564871 - DNA, 15 bp, Homo sapiens
ttattgggcaataaa

SEQ ID NO: 6564872 - DNA, 14 bp, Homo sapiens
ttattgggttttta

SEQ ID NO: 6564873 - DNA, 21 bp, Homo sapiens
ttattggtaaattctggtata

SEQ ID NO: 6564874 - DNA, 16 bp, Homo sapiens
ttattggtatatttgt

SEQ ID NO: 6564875 - DNA, 22 bp, Homo sapiens
ttattggttggtgtgaagaaag

SEQ ID NO: 6564876 - DNA, 22 bp, Homo sapiens
ttattggtttttttgtatagac

SEQ ID NO: 6564877 - DNA, 13 bp, Homo sapiens
ttattgtaaactt

SEQ ID NO: 6564878 - DNA, 14 bp, Homo sapiens
ttattgtaaacttt

SEQ ID NO: 6564879 - DNA, 19 bp, Homo sapiens
ttattgtaaactttttcaa

SEQ ID NO: 6564880 - DNA, 16 bp, Homo sapiens
ttattgtaatgtaata

SEQ ID NO: 6564881 - DNA, 12 bp, Homo sapiens
ttattgtacttg

SEQ ID NO: 6564882 - DNA, 14 bp, Homo sapiens
ttattgtagacatg

SEQ ID NO: 6564883 - DNA, 22 bp, Homo sapiens
ttattgtataaactatcagttt

SEQ ID NO: 6564884 - DNA, 23 bp, Homo sapiens
ttattgtattcctcatgtcatca

SEQ ID NO: 6564885 - DNA, 13 bp, Homo sapiens
ttattgtattctg

SEQ ID NO: 6564886 - DNA, 16 bp, Homo sapiens
ttattgtattttgatg

SEQ ID NO: 6564887 - DNA, 17 bp, Homo sapiens
ttattgtcaaagtggtg

SEQ ID NO: 6564888 - DNA, 18 bp, Homo sapiens
ttattgtcaaagtggtga

SEQ ID NO: 6564889 - DNA, 19 bp, Homo sapiens
ttattgtcattactgcctt

SEQ ID NO: 6564890 - DNA, 22 bp, Homo sapiens
ttattgtccccactaaaacaaa

SEQ ID NO: 6564891 - DNA, 18 bp, Homo sapiens
ttattgtccttcagagct

SEQ ID NO: 6564892 - DNA, 14 bp, Homo sapiens
ttattgtctgtcta

SEQ ID NO: 6564893 - DNA, 20 bp, Homo sapiens
ttattgtcttcctgtaagac

SEQ ID NO: 6564894 - DNA, 20 bp, Homo sapiens
ttattgtcttggttgccagt

SEQ ID NO: 6564895 - DNA, 22 bp, Homo sapiens
ttattgtgaatgattcatgtta

SEQ ID NO: 6564896 - DNA, 18 bp, Homo sapiens
ttattgtgacttcactgt

SEQ ID NO: 6564897 - DNA, 19 bp, Homo sapiens
ttattgtgacttcactgta

SEQ ID NO: 6564898 - DNA, 14 bp, Homo sapiens
ttattgtggataac

SEQ ID NO: 6564899 - DNA, 20 bp, Homo sapiens
ttattgtggataacaaagat

SEQ ID NO: 6564900 - DNA, 21 bp, Homo sapiens
ttattgtggataacaaagata

SEQ ID NO: 6564901 - DNA, 20 bp, Homo sapiens
ttattgtgtgcgctgcctgg

SEQ ID NO: 6564902 - DNA, 16 bp, Homo sapiens
ttattgtgtttgtcat

SEQ ID NO: 6564903 - DNA, 19 bp, Homo sapiens
ttattgtgtttgtcattag

SEQ ID NO: 6564904 - DNA, 20 bp, Homo sapiens
ttattgtgtttgtcattagc

SEQ ID NO: 6564905 - DNA, 21 bp, Homo sapiens
ttattgttcccctaagtggat

SEQ ID NO: 6564906 - DNA, 12 bp, Homo sapiens
ttattgttgaac

SEQ ID NO: 6564907 - DNA, 18 bp, Homo sapiens
ttattgttgccttttcac

SEQ ID NO: 6564908 - DNA, 21 bp, Homo sapiens
ttattgttgctgaaaactcta

SEQ ID NO: 6564909 - DNA, 18 bp, Homo sapiens
ttattgtttgaaagactt

SEQ ID NO: 6564910 - DNA, 18 bp, Homo sapiens
ttattgttttaaaaagtt

SEQ ID NO: 6564911 - DNA, 16 bp, Homo sapiens
ttattgttttattgta

SEQ ID NO: 6564912 - DNA, 18 bp, Homo sapiens
ttatttaaaaaaaaacat

SEQ ID NO: 6564913 - DNA, 13 bp, Homo sapiens
ttatttaaaactc

SEQ ID NO: 6564914 - DNA, 19 bp, Homo sapiens
ttatttaaaagattttatg

SEQ ID NO: 6564915 - DNA, 22 bp, Homo sapiens
ttatttaaaatagcaaaagaag

SEQ ID NO: 6564916 - DNA, 16 bp, Homo sapiens
ttatttaaaatgattt

SEQ ID NO: 6564917 - DNA, 22 bp, Homo sapiens
ttatttaaacaaatgtgtaatt

SEQ ID NO: 6564918 - DNA, 17 bp, Homo sapiens
ttatttaaactattcag

SEQ ID NO: 6564919 - DNA, 20 bp, Homo sapiens
ttatttaaactctgttgcaa

SEQ ID NO: 6564920 - DNA, 19 bp, Homo sapiens
ttatttaaagcacatgcca

SEQ ID NO: 6564921 - DNA, 14 bp, Homo sapiens
ttatttaaagcatt

SEQ ID NO: 6564922 - DNA, 15 bp, Homo sapiens
ttatttaaataaaat

SEQ ID NO: 6564923 - DNA, 12 bp, Homo sapiens
ttatttaaatgc

SEQ ID NO: 6564924 - DNA, 15 bp, Homo sapiens
ttatttaaatgcatg

SEQ ID NO: 6564925 - DNA, 13 bp, Homo sapiens
ttatttaaatgct

SEQ ID NO: 6564926 - DNA, 16 bp, Homo sapiens
ttatttaaatgctttt

SEQ ID NO: 6564927 - DNA, 13 bp, Homo sapiens
ttatttaaatgta

SEQ ID NO: 6564928 - DNA, 20 bp, Homo sapiens
ttatttaaatgtctaatgta

SEQ ID NO: 6564929 - DNA, 22 bp, Homo sapiens
ttatttaaatgttgaaatctta

SEQ ID NO: 6564930 - DNA, 16 bp, Homo sapiens
ttatttaaatgtttaa

SEQ ID NO: 6564931 - DNA, 14 bp, Homo sapiens
ttatttaaatttta

SEQ ID NO: 6564932 - DNA, 16 bp, Homo sapiens
ttatttaactcttaac

SEQ ID NO: 6564933 - DNA, 14 bp, Homo sapiens
ttatttaactggta

SEQ ID NO: 6564934 - DNA, 12 bp, Homo sapiens
ttatttaacttt

SEQ ID NO: 6564935 - DNA, 15 bp, Homo sapiens
ttatttaacttttct

SEQ ID NO: 6564936 - DNA, 15 bp, Homo sapiens
ttatttaagaataaa

SEQ ID NO: 6564937 - DNA, 14 bp, Homo sapiens
ttatttaagactaa

SEQ ID NO: 6564938 - DNA, 15 bp, Homo sapiens
ttatttaagactaaa

SEQ ID NO: 6564939 - DNA, 13 bp, Homo sapiens
ttatttaagcaat

SEQ ID NO: 6564940 - DNA, 12 bp, Homo sapiens
ttatttaagcat

SEQ ID NO: 6564941 - DNA, 14 bp, Homo sapiens
ttatttaaggatgg

SEQ ID NO: 6564942 - DNA, 21 bp, Homo sapiens
ttatttaaggatggatggcac

SEQ ID NO: 6564943 - DNA, 23 bp, Homo sapiens
ttatttaagtatggaatattcat

SEQ ID NO: 6564944 - DNA, 10 bp, Homo sapiens
ttatttaata

SEQ ID NO: 6564945 - DNA, 14 bp, Homo sapiens
ttatttaataagag

SEQ ID NO: 6564946 - DNA, 22 bp, Homo sapiens
ttatttaatcacagtcatcttt

SEQ ID NO: 6564947 - DNA, 18 bp, Homo sapiens
ttatttaattaaatgtat

SEQ ID NO: 6564948 - DNA, 15 bp, Homo sapiens
ttatttaattagaat

SEQ ID NO: 6564949 - DNA, 21 bp, Homo sapiens
ttatttaatttcataaattgg

SEQ ID NO: 6564950 - DNA, 11 bp, Homo sapiens
ttatttacaag

SEQ ID NO: 6564951 - DNA, 21 bp, Homo sapiens
ttatttacactggtctaatgt

SEQ ID NO: 6564952 - DNA, 16 bp, Homo sapiens
ttatttacatttaata

SEQ ID NO: 6564953 - DNA, 13 bp, Homo sapiens
ttatttacatttt

SEQ ID NO: 6564954 - DNA, 22 bp, Homo sapiens
ttatttaccgttgcttgaaatt

SEQ ID NO: 6564955 - DNA, 16 bp, Homo sapiens
ttatttaccttttaag

SEQ ID NO: 6564956 - DNA, 21 bp, Homo sapiens
ttatttactcctcctgctcct

SEQ ID NO: 6564957 - DNA, 17 bp, Homo sapiens
ttatttactgagcttct

SEQ ID NO: 6564958 - DNA, 22 bp, Homo sapiens
ttatttactgagcttctctgtg

SEQ ID NO: 6564959 - DNA, 15 bp, Homo sapiens
ttatttactgctagt

SEQ ID NO: 6564960 - DNA, 22 bp, Homo sapiens
ttatttacttgtagaaatctgt

SEQ ID NO: 6564961 - DNA, 13 bp, Homo sapiens
ttatttagaaaaa

SEQ ID NO: 6564962 - DNA, 15 bp, Homo sapiens
ttatttagaatatgt

SEQ ID NO: 6564963 - DNA, 16 bp, Homo sapiens
ttatttagacaagaga

SEQ ID NO: 6564964 - DNA, 18 bp, Homo sapiens
ttatttagactcatctta

SEQ ID NO: 6564965 - DNA, 23 bp, Homo sapiens
ttatttagactcatcttactgta

SEQ ID NO: 6564966 - DNA, 12 bp, Homo sapiens
ttatttagagat

SEQ ID NO: 6564967 - DNA, 17 bp, Homo sapiens
ttatttagcaccaggga

SEQ ID NO: 6564968 - DNA, 15 bp, Homo sapiens
ttatttaggcttttc

SEQ ID NO: 6564969 - DNA, 17 bp, Homo sapiens
ttatttagggaactgct

SEQ ID NO: 6564970 - DNA, 21 bp, Homo sapiens
ttatttagggaactgcttgac

SEQ ID NO: 6564971 - DNA, 20 bp, Homo sapiens
ttatttagggccttttctgt

SEQ ID NO: 6564972 - DNA, 14 bp, Homo sapiens
ttatttagtaaaat

SEQ ID NO: 6564973 - DNA, 15 bp, Homo sapiens
ttatttagtaaaatt

SEQ ID NO: 6564974 - DNA, 16 bp, Homo sapiens
ttatttagtaaagttt

SEQ ID NO: 6564975 - DNA, 19 bp, Homo sapiens
ttatttagtaaagtttgtt

SEQ ID NO: 6564976 - DNA, 18 bp, Homo sapiens
ttatttagtattctgcct

SEQ ID NO: 6564977 - DNA, 15 bp, Homo sapiens
ttatttagtatttat

SEQ ID NO: 6564978 - DNA, 15 bp, Homo sapiens
ttatttagtcaacat

SEQ ID NO: 6564979 - DNA, 16 bp, Homo sapiens
ttatttagtcaattgt

SEQ ID NO: 6564980 - DNA, 16 bp, Homo sapiens
ttatttagttccttga

SEQ ID NO: 6564981 - DNA, 16 bp, Homo sapiens
ttatttataaaaagat

SEQ ID NO: 6564982 - DNA, 12 bp, Homo sapiens
ttatttataatg

SEQ ID NO: 6564983 - DNA, 16 bp, Homo sapiens
ttatttatatatgaag

SEQ ID NO: 6564984 - DNA, 13 bp, Homo sapiens
ttatttatatgaa

SEQ ID NO: 6564985 - DNA, 16 bp, Homo sapiens
ttatttatatgaagca

SEQ ID NO: 6564986 - DNA, 22 bp, Homo sapiens
ttatttatatgaagcaagctgt

SEQ ID NO: 6564987 - DNA, 14 bp, Homo sapiens
ttatttatatgtat

SEQ ID NO: 6564988 - DNA, 15 bp, Homo sapiens
ttatttatatgtatg

SEQ ID NO: 6564989 - DNA, 16 bp, Homo sapiens
ttatttatatgtatgt

SEQ ID NO: 6564990 - DNA, 18 bp, Homo sapiens
ttatttatattcagagat

SEQ ID NO: 6564991 - DNA, 18 bp, Homo sapiens
ttatttatcaaaatgtag

SEQ ID NO: 6564992 - DNA, 23 bp, Homo sapiens
ttatttatccagaaaactgtgat

SEQ ID NO: 6564993 - DNA, 12 bp, Homo sapiens
ttatttatgaag

SEQ ID NO: 6564994 - DNA, 12 bp, Homo sapiens
ttatttatgaat

SEQ ID NO: 6564995 - DNA, 21 bp, Homo sapiens
ttatttatgcgtaatttaatg

SEQ ID NO: 6564996 - DNA, 15 bp, Homo sapiens
ttatttatggaatta

SEQ ID NO: 6564997 - DNA, 21 bp, Homo sapiens
ttatttatggaccacttttat

SEQ ID NO: 6564998 - DNA, 15 bp, Homo sapiens
ttatttatgtaacaa

SEQ ID NO: 6564999 - DNA, 16 bp, Homo sapiens
ttatttatgtactttt

SEQ ID NO: 6565000 - DNA, 12 bp, Homo sapiens
ttatttatgtat

SEQ ID NO: 6565001 - DNA, 21 bp, Homo sapiens
ttatttatgtatggtgcaatg

SEQ ID NO: 6565002 - DNA, 15 bp, Homo sapiens
ttatttattaaactt

SEQ ID NO: 6565003 - DNA, 17 bp, Homo sapiens
ttatttattaaacttca

SEQ ID NO: 6565004 - DNA, 14 bp, Homo sapiens
ttatttattaagat

SEQ ID NO: 6565005 - DNA, 15 bp, Homo sapiens
ttatttattactgtc

SEQ ID NO: 6565006 - DNA, 13 bp, Homo sapiens
ttatttattattg

SEQ ID NO: 6565007 - DNA, 22 bp, Homo sapiens
ttatttattcagcttcatttgt

SEQ ID NO: 6565008 - DNA, 22 bp, Homo sapiens
ttatttattctgggaatgtata

SEQ ID NO: 6565009 - DNA, 14 bp, Homo sapiens
ttatttattgaaat

SEQ ID NO: 6565010 - DNA, 12 bp, Homo sapiens
ttatttattgac

SEQ ID NO: 6565011 - DNA, 21 bp, Homo sapiens
ttatttattgttaaattacat

SEQ ID NO: 6565012 - DNA, 14 bp, Homo sapiens
ttatttatttaata

SEQ ID NO: 6565013 - DNA, 13 bp, Homo sapiens
ttatttatttcca

SEQ ID NO: 6565014 - DNA, 14 bp, Homo sapiens
ttatttatttccaa

SEQ ID NO: 6565015 - DNA, 13 bp, Homo sapiens
ttatttatttctg

SEQ ID NO: 6565016 - DNA, 18 bp, Homo sapiens
ttatttcaataaatcttt

SEQ ID NO: 6565017 - DNA, 12 bp, Homo sapiens
ttatttcaatat

SEQ ID NO: 6565018 - DNA, 18 bp, Homo sapiens
ttatttcactaaatgtaa

SEQ ID NO: 6565019 - DNA, 15 bp, Homo sapiens
ttatttcagaaatgt

SEQ ID NO: 6565020 - DNA, 15 bp, Homo sapiens
ttatttcagatgttt

SEQ ID NO: 6565021 - DNA, 17 bp, Homo sapiens
ttatttcagtgtgcata

SEQ ID NO: 6565022 - DNA, 18 bp, Homo sapiens
ttatttcatatactataa

SEQ ID NO: 6565023 - DNA, 18 bp, Homo sapiens
tttgtaaaaatgagactt

SEQ ID NO: 6565024 - DNA, 17 bp, Homo sapiens
tttgtaaaacaatgcca

SEQ ID NO: 6565025 - DNA, 15 bp, Homo sapiens
tttgtaaaacagcct

SEQ ID NO: 6565026 - DNA, 16 bp, Homo sapiens
tttgtaaaacagccta

SEQ ID NO: 6565027 - DNA, 16 bp, Homo sapiens
tttgtaaaacagtggt

SEQ ID NO: 6565028 - DNA, 18 bp, Homo sapiens
tttgtaaaacttctgctc

SEQ ID NO: 6565029 - DNA, 21 bp, Homo sapiens
tttgtaaaagaacagtaaaca

SEQ ID NO: 6565030 - DNA, 21 bp, Homo sapiens
tttgtaaaagatgaaggctgt

SEQ ID NO: 6565031 - DNA, 18 bp, Homo sapiens
tttgtaaaatattatgtt

SEQ ID NO: 6565032 - DNA, 14 bp, Homo sapiens
tttgtaaaatcaaa

SEQ ID NO: 6565033 - DNA, 12 bp, Homo sapiens
tttgtaaaatct

SEQ ID NO: 6565034 - DNA, 17 bp, Homo sapiens
tttgtaaaatcttgcag

SEQ ID NO: 6565035 - DNA, 16 bp, Homo sapiens
tttgtaaaatgtatta

SEQ ID NO: 6565036 - DNA, 16 bp, Homo sapiens
tttgtaaaattccatg

SEQ ID NO: 6565037 - DNA, 21 bp, Homo sapiens
tttgtaaacaatctaattaaa

SEQ ID NO: 6565038 - DNA, 13 bp, Homo sapiens
tttgtaaacattt

SEQ ID NO: 6565039 - DNA, 14 bp, Homo sapiens
tttgtaaacattta

SEQ ID NO: 6565040 - DNA, 17 bp, Homo sapiens
tttgtaaactcaaaata

SEQ ID NO: 6565041 - DNA, 22 bp, Homo sapiens
tttgtaaactcaaaatatttgt

SEQ ID NO: 6565042 - DNA, 13 bp, Homo sapiens
tttgtaaacttct

SEQ ID NO: 6565043 - DNA, 14 bp, Homo sapiens
tttgtaaacttctg

SEQ ID NO: 6565044 - DNA, 12 bp, Homo sapiens
tttgtaaacttt

SEQ ID NO: 6565045 - DNA, 21 bp, Homo sapiens
tttgtaaactttgaaatatat

SEQ ID NO: 6565046 - DNA, 20 bp, Homo sapiens
tttgtaaactttgcttctcc

SEQ ID NO: 6565047 - DNA, 18 bp, Homo sapiens
tttgtaaagaaatttact

SEQ ID NO: 6565048 - DNA, 19 bp, Homo sapiens
tttgtaaagagaccatctt

SEQ ID NO: 6565049 - DNA, 18 bp, Homo sapiens
tttgtaaagatttctgtt

SEQ ID NO: 6565050 - DNA, 14 bp, Homo sapiens
tttgtaaagctatt

SEQ ID NO: 6565051 - DNA, 22 bp, Homo sapiens
tttgtaaagttgcctttatttg

SEQ ID NO: 6565052 - DNA, 21 bp, Homo sapiens
tttgtaaagttggttggataa

SEQ ID NO: 6565053 - DNA, 15 bp, Homo sapiens
tttgtaaagtttccg

SEQ ID NO: 6565054 - DNA, 15 bp, Homo sapiens
tttgtaaataagaga

SEQ ID NO: 6565055 - DNA, 18 bp, Homo sapiens
tttgtaaatactgcttga

SEQ ID NO: 6565056 - DNA, 13 bp, Homo sapiens
tttgtaaatcttt

SEQ ID NO: 6565057 - DNA, 18 bp, Homo sapiens
tttgtaaatctttgtgaa

SEQ ID NO: 6565058 - DNA, 11 bp, Homo sapiens
tttgtaaatga

SEQ ID NO: 6565059 - DNA, 24 bp, Homo sapiens
tttgtaaatgaaacttaagaattg

SEQ ID NO: 6565060 - DNA, 21 bp, Homo sapiens
tttgtaaatgattttaatttt

SEQ ID NO: 6565061 - DNA, 23 bp, Homo sapiens
tttgtaaatgcatattaaataat

SEQ ID NO: 6565062 - DNA, 16 bp, Homo sapiens
tttgtaaatgctgtaa

SEQ ID NO: 6565063 - DNA, 17 bp, Homo sapiens
tttgtaaatgctgtaaa

SEQ ID NO: 6565064 - DNA, 19 bp, Homo sapiens
tttgtaaatgctgtaaata

SEQ ID NO: 6565065 - DNA, 12 bp, Homo sapiens
tttgtaaatgta

SEQ ID NO: 6565066 - DNA, 14 bp, Homo sapiens
tttgtaaatgtact

SEQ ID NO: 6565067 - DNA, 14 bp, Homo sapiens
tttgtaaatgttat

SEQ ID NO: 6565068 - DNA, 18 bp, Homo sapiens
tttgtaaatgttatttct

SEQ ID NO: 6565069 - DNA, 19 bp, Homo sapiens
tttgtaaatgttatttctg

SEQ ID NO: 6565070 - DNA, 16 bp, Homo sapiens
tttgtaaattctggaa

SEQ ID NO: 6565071 - DNA, 22 bp, Homo sapiens
tttgtaaattctggaaatgtct

SEQ ID NO: 6565072 - DNA, 15 bp, Homo sapiens
tttgtaaattgtgtt

SEQ ID NO: 6565073 - DNA, 17 bp, Homo sapiens
tttgtaaatttatgtga

SEQ ID NO: 6565074 - DNA, 23 bp, Homo sapiens
tttgtaaattttggaaagattat

SEQ ID NO: 6565075 - DNA, 13 bp, Homo sapiens
tttgtaacattag

SEQ ID NO: 6565076 - DNA, 15 bp, Homo sapiens
tttgtaacattgtaa

SEQ ID NO: 6565077 - DNA, 15 bp, Homo sapiens
tttgtaacctcagct

SEQ ID NO: 6565078 - DNA, 19 bp, Homo sapiens
tttgtaacctcagctctgg

SEQ ID NO: 6565079 - DNA, 21 bp, Homo sapiens
tttgtaactacaaagctttgc

SEQ ID NO: 6565080 - DNA, 22 bp, Homo sapiens
tttgtaactacaaagctttgct

SEQ ID NO: 6565081 - DNA, 17 bp, Homo sapiens
tttgtaactattcttca

SEQ ID NO: 6565082 - DNA, 16 bp, Homo sapiens
tttgtaactctttggc

SEQ ID NO: 6565083 - DNA, 22 bp, Homo sapiens
tttgtaactgtttagatgaatg

SEQ ID NO: 6565084 - DNA, 14 bp, Homo sapiens
tttgtaacttcaaa

SEQ ID NO: 6565085 - DNA, 15 bp, Homo sapiens
tttgtaacttcaaat

SEQ ID NO: 6565086 - DNA, 13 bp, Homo sapiens
tttgtaagacaca

SEQ ID NO: 6565087 - DNA, 14 bp, Homo sapiens
tttgtaagacacac

SEQ ID NO: 6565088 - DNA, 17 bp, Homo sapiens
tttgtaagacatttgta

SEQ ID NO: 6565089 - DNA, 18 bp, Homo sapiens
tttgtaagacatttgtat

SEQ ID NO: 6565090 - DNA, 23 bp, Homo sapiens
tttgtaagagtgtagaagcattc

SEQ ID NO: 6565091 - DNA, 17 bp, Homo sapiens
tttgtaagcaacttgct

SEQ ID NO: 6565092 - DNA, 20 bp, Homo sapiens
tttgtaagcaacttgcttct

SEQ ID NO: 6565093 - DNA, 14 bp, Homo sapiens
tttgtaagtaacac

SEQ ID NO: 6565094 - DNA, 19 bp, Homo sapiens
tttgtaagtaagtaagaaa

SEQ ID NO: 6565095 - DNA, 20 bp, Homo sapiens
tttgtaagtgtaaaaaatgt

SEQ ID NO: 6565096 - DNA, 16 bp, Homo sapiens
tttgtaagttgaagca

SEQ ID NO: 6565097 - DNA, 20 bp, Homo sapiens
tttgtaagttgaagcaaatc

SEQ ID NO: 6565098 - DNA, 14 bp, Homo sapiens
tttgtaagtttcag

SEQ ID NO: 6565099 - DNA, 12 bp, Homo sapiens
tttgtaataaac

SEQ ID NO: 6565100 - DNA, 17 bp, Homo sapiens
tttgtaataaactctct

SEQ ID NO: 6565101 - DNA, 18 bp, Homo sapiens
tttgtaatatacagtttt

SEQ ID NO: 6565102 - DNA, 17 bp, Homo sapiens
tttgtaatatatcctgt

SEQ ID NO: 6565103 - DNA, 22 bp, Homo sapiens
tttgtaatatgagaatgtatta

SEQ ID NO: 6565104 - DNA, 13 bp, Homo sapiens
tttgtaatgaaaa

SEQ ID NO: 6565105 - DNA, 15 bp, Homo sapiens
tttgtaatgtgaaaa

SEQ ID NO: 6565106 - DNA, 21 bp, Homo sapiens
tttgtaatgtgaaaagtatca

SEQ ID NO: 6565107 - DNA, 21 bp, Homo sapiens
tttgtaatgtttgtcagtaaa

SEQ ID NO: 6565108 - DNA, 14 bp, Homo sapiens
tttgtaattaaaag

SEQ ID NO: 6565109 - DNA, 13 bp, Homo sapiens
tttgtaattatga

SEQ ID NO: 6565110 - DNA, 12 bp, Homo sapiens
tttgtaattatt

SEQ ID NO: 6565111 - DNA, 15 bp, Homo sapiens
tttgtaattcttatg

SEQ ID NO: 6565112 - DNA, 13 bp, Homo sapiens
tttgtaattgtgt

SEQ ID NO: 6565113 - DNA, 16 bp, Homo sapiens
tttgtaattgtgtaaa

SEQ ID NO: 6565114 - DNA, 13 bp, Homo sapiens
tttgtaatttgaa

SEQ ID NO: 6565115 - DNA, 16 bp, Homo sapiens
tttgtaatttgaattg

SEQ ID NO: 6565116 - DNA, 14 bp, Homo sapiens
tttgtaattttagt

SEQ ID NO: 6565117 - DNA, 15 bp, Homo sapiens
tttgtaattttcttg

SEQ ID NO: 6565118 - DNA, 16 bp, Homo sapiens
tttgtaattttcttga

SEQ ID NO: 6565119 - DNA, 13 bp, Homo sapiens
tttgtaatttttg

SEQ ID NO: 6565120 - DNA, 15 bp, Homo sapiens
tttgtaatttttgct

SEQ ID NO: 6565121 - DNA, 18 bp, Homo sapiens
tttgtaatttttttctag

SEQ ID NO: 6565122 - DNA, 16 bp, Homo sapiens
tttgtacaaactattt

SEQ ID NO: 6565123 - DNA, 20 bp, Homo sapiens
tttgtacaaataaacctgag

SEQ ID NO: 6565124 - DNA, 23 bp, Homo sapiens
tttgtacaaataaacctgaggca

SEQ ID NO: 6565125 - DNA, 17 bp, Homo sapiens
tttgtacaagattgtca

SEQ ID NO: 6565126 - DNA, 19 bp, Homo sapiens
tttgtacaaggtaattgtt

SEQ ID NO: 6565127 - DNA, 21 bp, Homo sapiens
tttgtacaatggggacttccc

SEQ ID NO: 6565128 - DNA, 12 bp, Homo sapiens
tttgtacactgc

SEQ ID NO: 6565129 - DNA, 12 bp, Homo sapiens
tttgtacagaat

SEQ ID NO: 6565130 - DNA, 14 bp, Homo sapiens
tttgtacagaattt

SEQ ID NO: 6565131 - DNA, 19 bp, Homo sapiens
tttgtacagaatttttaat

SEQ ID NO: 6565132 - DNA, 22 bp, Homo sapiens
tttgtacagacgtatgcttatt

SEQ ID NO: 6565133 - DNA, 14 bp, Homo sapiens
tttgtacagagtgc

SEQ ID NO: 6565134 - DNA, 13 bp, Homo sapiens
tttgtacaggggc

SEQ ID NO: 6565135 - DNA, 20 bp, Homo sapiens
tttgtacaggggccatgccc

SEQ ID NO: 6565136 - DNA, 21 bp, Homo sapiens
tttgtacaggggccatgcccc

SEQ ID NO: 6565137 - DNA, 18 bp, Homo sapiens
tttgtacagtttgctgta

SEQ ID NO: 6565138 - DNA, 15 bp, Homo sapiens
tttgtacataaataa

SEQ ID NO: 6565139 - DNA, 19 bp, Homo sapiens
tttgtacatagttatttat

SEQ ID NO: 6565140 - DNA, 16 bp, Homo sapiens
tttgtacattatgtta

SEQ ID NO: 6565141 - DNA, 16 bp, Homo sapiens
tttgtacattcctgat

SEQ ID NO: 6565142 - DNA, 23 bp, Homo sapiens
tttgtacattcctgatactgggt

SEQ ID NO: 6565143 - DNA, 16 bp, Homo sapiens
tttgtacatttggaac

SEQ ID NO: 6565144 - DNA, 18 bp, Homo sapiens
tttgtacatttgggagtt

SEQ ID NO: 6565145 - DNA, 12 bp, Homo sapiens
tttgtacatttt

SEQ ID NO: 6565146 - DNA, 16 bp, Homo sapiens
tttgtaccaagtaaat

SEQ ID NO: 6565147 - DNA, 22 bp, Homo sapiens
tttgtaccagtgaatttttgca

SEQ ID NO: 6565148 - DNA, 17 bp, Homo sapiens
tttgtaccatattgctc

SEQ ID NO: 6565149 - DNA, 14 bp, Homo sapiens
tttgtaccatggtg

SEQ ID NO: 6565150 - DNA, 21 bp, Homo sapiens
tttgtaccattccttcaaata

SEQ ID NO: 6565151 - DNA, 22 bp, Homo sapiens
tttgtaccattccttcaaataa

SEQ ID NO: 6565152 - DNA, 14 bp, Homo sapiens
tttgtaccatttca

SEQ ID NO: 6565153 - DNA, 20 bp, Homo sapiens
tttgtaccccccaacccctg

SEQ ID NO: 6565154 - DNA, 20 bp, Homo sapiens
tttgtaccttttgtagtttt

SEQ ID NO: 6565155 - DNA, 17 bp, Homo sapiens
tttgtacgtgttattat

SEQ ID NO: 6565156 - DNA, 21 bp, Homo sapiens
tttgtacgttaattaaacaaa

SEQ ID NO: 6565157 - DNA, 19 bp, Homo sapiens
tttgtacgttatatattgt

SEQ ID NO: 6565158 - DNA, 23 bp, Homo sapiens
tttgtactcagtggacagtgctg

SEQ ID NO: 6565159 - DNA, 22 bp, Homo sapiens
tttgtactgaatttttttgtaa

SEQ ID NO: 6565160 - DNA, 16 bp, Homo sapiens
tttgtactgtaaagag

SEQ ID NO: 6565161 - DNA, 20 bp, Homo sapiens
tttgtactgtaaagagacct

SEQ ID NO: 6565162 - DNA, 14 bp, Homo sapiens
tttgtactgtttaa

SEQ ID NO: 6565163 - DNA, 20 bp, Homo sapiens
tttgtacttgatttgatgtg

SEQ ID NO: 6565164 - DNA, 21 bp, Homo sapiens
tttgtacttgctccttttgct

SEQ ID NO: 6565165 - DNA, 16 bp, Homo sapiens
tttgtactttctgtta

SEQ ID NO: 6565166 - DNA, 17 bp, Homo sapiens
tttgtactttctgttaa

SEQ ID NO: 6565167 - DNA, 22 bp, Homo sapiens
tttgtactttgtttttccatgt

SEQ ID NO: 6565168 - DNA, 16 bp, Homo sapiens
tttgtactttttaatg

SEQ ID NO: 6565169 - DNA, 18 bp, Homo sapiens
tttgtacttttttcttaa

SEQ ID NO: 6565170 - DNA, 15 bp, Homo sapiens
tttgtagaaattaaa

SEQ ID NO: 6565171 - DNA, 17 bp, Homo sapiens
tttgtagaagtcacatt

SEQ ID NO: 6565172 - DNA, 16 bp, Homo sapiens
tttgtagaatctcttc

SEQ ID NO: 6565173 - DNA, 14 bp, Homo sapiens
tttgtagactgttt

SEQ ID NO: 6565174 - DNA, 14 bp, Homo sapiens
tttgtagacttcct

SEQ ID NO: 6565175 - DNA, 22 bp, Homo sapiens
tttgtagagagagctgtattaa

SEQ ID NO: 6565176 - DNA, 16 bp, Homo sapiens
tttgtagatatatatt

SEQ ID NO: 6565177 - DNA, 18 bp, Homo sapiens
tttgtagatatatatttc

SEQ ID NO: 6565178 - DNA, 12 bp, Homo sapiens
tttgtagatggc

SEQ ID NO: 6565179 - DNA, 19 bp, Homo sapiens
tttgtagcctatgtcttgt

SEQ ID NO: 6565180 - DNA, 20 bp, Homo sapiens
tttgtagcctatgtcttgta

SEQ ID NO: 6565181 - DNA, 18 bp, Homo sapiens
tttgtagcgtacatcaat

SEQ ID NO: 6565182 - DNA, 13 bp, Homo sapiens
tttgtagctactt

SEQ ID NO: 6565183 - DNA, 20 bp, Homo sapiens
tttgtagctttcctggaagt

SEQ ID NO: 6565184 - DNA, 21 bp, Homo sapiens
tttgtaggagaaactcccatg

SEQ ID NO: 6565185 - DNA, 17 bp, Homo sapiens
tttgtaggctgttccct

SEQ ID NO: 6565186 - DNA, 18 bp, Homo sapiens
tttgtaggggaactcatt

SEQ ID NO: 6565187 - DNA, 17 bp, Homo sapiens
tttgtaggtaaaatgta

SEQ ID NO: 6565188 - DNA, 16 bp, Homo sapiens
tttgtaggtacttttg

SEQ ID NO: 6565189 - DNA, 20 bp, Homo sapiens
tttgtaggtatactatgtaa

SEQ ID NO: 6565190 - DNA, 14 bp, Homo sapiens
tttgtagtaaaagt

SEQ ID NO: 6565191 - DNA, 12 bp, Homo sapiens
tttgtagtgagc

SEQ ID NO: 6565192 - DNA, 23 bp, Homo sapiens
tttgtagtggaaacatttatatt

SEQ ID NO: 6565193 - DNA, 21 bp, Homo sapiens
tttgtagtgtgttttcataac

SEQ ID NO: 6565194 - DNA, 17 bp, Homo sapiens
tttgtagttaatataaa

SEQ ID NO: 6565195 - DNA, 18 bp, Homo sapiens
tttgtagttactcaagca

SEQ ID NO: 6565196 - DNA, 14 bp, Homo sapiens
tttgtagttgaata

SEQ ID NO: 6565197 - DNA, 15 bp, Homo sapiens
tttgtagttgaatat

SEQ ID NO: 6565198 - DNA, 14 bp, Homo sapiens
tttgtagtttgtat

SEQ ID NO: 6565199 - DNA, 16 bp, Homo sapiens
tttgtataaaaaggaa

SEQ ID NO: 6565200 - DNA, 20 bp, Homo sapiens
tttgtataaaaattaagctt

SEQ ID NO: 6565201 - DNA, 13 bp, Homo sapiens
tttgtataaaata

SEQ ID NO: 6565202 - DNA, 16 bp, Homo sapiens
tttgtataaaataatt

SEQ ID NO: 6565203 - DNA, 21 bp, Homo sapiens
ttatttcatatactataattg

SEQ ID NO: 6565204 - DNA, 20 bp, Homo sapiens
ttatttcatcatattataca

SEQ ID NO: 6565205 - DNA, 13 bp, Homo sapiens
ttatttcatcatg

SEQ ID NO: 6565206 - DNA, 11 bp, Homo sapiens
ttatttcatga

SEQ ID NO: 6565207 - DNA, 15 bp, Homo sapiens
ttatttcatgaaaat

SEQ ID NO: 6565208 - DNA, 24 bp, Homo sapiens
ttatttcatgtggtgaatatgcaa

SEQ ID NO: 6565209 - DNA, 18 bp, Homo sapiens
ttatttccaaaataaaat

SEQ ID NO: 6565210 - DNA, 20 bp, Homo sapiens
ttatttccaaaataaaatga

SEQ ID NO: 6565211 - DNA, 18 bp, Homo sapiens
ttatttccagtgttctat

SEQ ID NO: 6565212 - DNA, 20 bp, Homo sapiens
ttatttccagtgttctatga

SEQ ID NO: 6565213 - DNA, 19 bp, Homo sapiens
ttatttccctacattaaac

SEQ ID NO: 6565214 - DNA, 20 bp, Homo sapiens
ttatttccctatggctgagc

SEQ ID NO: 6565215 - DNA, 14 bp, Homo sapiens
ttatttccctcatc

SEQ ID NO: 6565216 - DNA, 14 bp, Homo sapiens
ttatttcctgcttt

SEQ ID NO: 6565217 - DNA, 12 bp, Homo sapiens
ttatttcctgtt

SEQ ID NO: 6565218 - DNA, 20 bp, Homo sapiens
ttatttcgtgttgtgttctt

SEQ ID NO: 6565219 - DNA, 22 bp, Homo sapiens
ttatttcgtgttgtgttcttta

SEQ ID NO: 6565220 - DNA, 23 bp, Homo sapiens
ttatttctaaaccacaaaagttg

SEQ ID NO: 6565221 - DNA, 23 bp, Homo sapiens
ttatttctaaataaaaaaattaa

SEQ ID NO: 6565222 - DNA, 15 bp, Homo sapiens
ttatttctaaatcct

SEQ ID NO: 6565223 - DNA, 16 bp, Homo sapiens
ttatttctaaatgaga

SEQ ID NO: 6565224 - DNA, 22 bp, Homo sapiens
ttatttctagaagcacatgtgt

SEQ ID NO: 6565225 - DNA, 12 bp, Homo sapiens
ttatttctagca

SEQ ID NO: 6565226 - DNA, 21 bp, Homo sapiens
ttatttctagcagagtgagga

SEQ ID NO: 6565227 - DNA, 19 bp, Homo sapiens
ttatttctaggaagaattt

SEQ ID NO: 6565228 - DNA, 13 bp, Homo sapiens
ttatttctatgaa

SEQ ID NO: 6565229 - DNA, 11 bp, Homo sapiens
ttatttctcat

SEQ ID NO: 6565230 - DNA, 19 bp, Homo sapiens
ttatttctccatcccctcc

SEQ ID NO: 6565231 - DNA, 14 bp, Homo sapiens
ttatttctcctttt

SEQ ID NO: 6565232 - DNA, 21 bp, Homo sapiens
ttatttctctggcaaactttt

SEQ ID NO: 6565233 - DNA, 20 bp, Homo sapiens
ttatttctgagcaaagcatc

SEQ ID NO: 6565234 - DNA, 19 bp, Homo sapiens
ttatttctgatttcataat

SEQ ID NO: 6565235 - DNA, 17 bp, Homo sapiens
ttatttctgcaaacaaa

SEQ ID NO: 6565236 - DNA, 12 bp, Homo sapiens
ttatttctgcat

SEQ ID NO: 6565237 - DNA, 20 bp, Homo sapiens
ttatttctgcatatgttgaa

SEQ ID NO: 6565238 - DNA, 22 bp, Homo sapiens
ttatttctgcatatgttgaata

SEQ ID NO: 6565239 - DNA, 21 bp, Homo sapiens
ttatttctgcctataaattta

SEQ ID NO: 6565240 - DNA, 17 bp, Homo sapiens
ttatttctgctctggaa

SEQ ID NO: 6565241 - DNA, 19 bp, Homo sapiens
ttatttctggctttttgaa

SEQ ID NO: 6565242 - DNA, 13 bp, Homo sapiens
ttatttctgtata

SEQ ID NO: 6565243 - DNA, 14 bp, Homo sapiens
ttatttctgtatat

SEQ ID NO: 6565244 - DNA, 14 bp, Homo sapiens
ttatttctgtattt

SEQ ID NO: 6565245 - DNA, 12 bp, Homo sapiens
ttatttctgtca

SEQ ID NO: 6565246 - DNA, 21 bp, Homo sapiens
ttatttctgtctcataattgt

SEQ ID NO: 6565247 - DNA, 13 bp, Homo sapiens
ttatttctgtgaa

SEQ ID NO: 6565248 - DNA, 18 bp, Homo sapiens
ttatttctgtttgtttaa

SEQ ID NO: 6565249 - DNA, 19 bp, Homo sapiens
ttatttcttaaacaaatgt

SEQ ID NO: 6565250 - DNA, 12 bp, Homo sapiens
ttatttcttcaa

SEQ ID NO: 6565251 - DNA, 15 bp, Homo sapiens
ttatttcttttactt

SEQ ID NO: 6565252 - DNA, 13 bp, Homo sapiens
ttatttcttttgt

SEQ ID NO: 6565253 - DNA, 11 bp, Homo sapiens
ttatttgaaaa

SEQ ID NO: 6565254 - DNA, 12 bp, Homo sapiens
ttatttgaaaat

SEQ ID NO: 6565255 - DNA, 20 bp, Homo sapiens
ttatttgaacaatgaagttg

SEQ ID NO: 6565256 - DNA, 17 bp, Homo sapiens
ttatttgaataacaagg

SEQ ID NO: 6565257 - DNA, 13 bp, Homo sapiens
ttatttgaatgaa

SEQ ID NO: 6565258 - DNA, 19 bp, Homo sapiens
ttatttgaatgaacactat

SEQ ID NO: 6565259 - DNA, 14 bp, Homo sapiens
ttatttgacaaaat

SEQ ID NO: 6565260 - DNA, 17 bp, Homo sapiens
ttatttgactttttcac

SEQ ID NO: 6565261 - DNA, 18 bp, Homo sapiens
ttatttgagaagctgctc

SEQ ID NO: 6565262 - DNA, 23 bp, Homo sapiens
ttatttgagacagggaaagggtc

SEQ ID NO: 6565263 - DNA, 22 bp, Homo sapiens
ttatttgagtggagttactgaa

SEQ ID NO: 6565264 - DNA, 12 bp, Homo sapiens
ttatttgagttt

SEQ ID NO: 6565265 - DNA, 13 bp, Homo sapiens
ttatttgatctgg

SEQ ID NO: 6565266 - DNA, 12 bp, Homo sapiens
ttatttgattgc

SEQ ID NO: 6565267 - DNA, 15 bp, Homo sapiens
ttatttgattgcaga

SEQ ID NO: 6565268 - DNA, 14 bp, Homo sapiens
ttatttgcaataaa

SEQ ID NO: 6565269 - DNA, 15 bp, Homo sapiens
ttatttgcatgttat

SEQ ID NO: 6565270 - DNA, 16 bp, Homo sapiens
ttatttgcatgttatg

SEQ ID NO: 6565271 - DNA, 19 bp, Homo sapiens
ttatttgcatgttatgttt

SEQ ID NO: 6565272 - DNA, 15 bp, Homo sapiens
ttatttgccttttaa

SEQ ID NO: 6565273 - DNA, 20 bp, Homo sapiens
ttatttggaaaggaatgcaa

SEQ ID NO: 6565274 - DNA, 15 bp, Homo sapiens
ttatttggaaattta

SEQ ID NO: 6565275 - DNA, 16 bp, Homo sapiens
ttatttggaaatttag

SEQ ID NO: 6565276 - DNA, 20 bp, Homo sapiens
ttatttggaaattttagtta

SEQ ID NO: 6565277 - DNA, 21 bp, Homo sapiens
ttatttggagcctgccaagag

SEQ ID NO: 6565278 - DNA, 21 bp, Homo sapiens
ttatttgggggggcgtgagac

SEQ ID NO: 6565279 - DNA, 15 bp, Homo sapiens
ttatttggtgtgttc

SEQ ID NO: 6565280 - DNA, 16 bp, Homo sapiens
ttatttggtgtgttcg

SEQ ID NO: 6565281 - DNA, 21 bp, Homo sapiens
ttatttgtaaaccattgtaac

SEQ ID NO: 6565282 - DNA, 15 bp, Homo sapiens
ttatttgtaaagtga

SEQ ID NO: 6565283 - DNA, 13 bp, Homo sapiens
ttatttgtaaatt

SEQ ID NO: 6565284 - DNA, 17 bp, Homo sapiens
ttatttgtaatagatgt

SEQ ID NO: 6565285 - DNA, 11 bp, Homo sapiens
ttatttgtatt

SEQ ID NO: 6565286 - DNA, 13 bp, Homo sapiens
ttatttgtattca

SEQ ID NO: 6565287 - DNA, 20 bp, Homo sapiens
ttatttgtccttttccccca

SEQ ID NO: 6565288 - DNA, 22 bp, Homo sapiens
ttatttgtcttaaaaaatgtga

SEQ ID NO: 6565289 - DNA, 19 bp, Homo sapiens
ttatttgtgatgtactgta

SEQ ID NO: 6565290 - DNA, 12 bp, Homo sapiens
ttatttgtttga

SEQ ID NO: 6565291 - DNA, 21 bp, Homo sapiens
ttatttgtttgagacagggtc

SEQ ID NO: 6565292 - DNA, 16 bp, Homo sapiens
ttatttgtttgatttt

SEQ ID NO: 6565293 - DNA, 18 bp, Homo sapiens
ttatttgtttgattttca

SEQ ID NO: 6565294 - DNA, 13 bp, Homo sapiens
ttatttgtttgca

SEQ ID NO: 6565295 - DNA, 19 bp, Homo sapiens
ttatttgtttttcattcat

SEQ ID NO: 6565296 - DNA, 17 bp, Homo sapiens
ttattttaaaaaatgaa

SEQ ID NO: 6565297 - DNA, 14 bp, Homo sapiens
ttattttaaaatat

SEQ ID NO: 6565298 - DNA, 18 bp, Homo sapiens
ttattttaaaatatatga

SEQ ID NO: 6565299 - DNA, 20 bp, Homo sapiens
ttattttaaaatatatgaag

SEQ ID NO: 6565300 - DNA, 16 bp, Homo sapiens
ttattttaaaatcaaa

SEQ ID NO: 6565301 - DNA, 16 bp, Homo sapiens
ttattttaaaatttca

SEQ ID NO: 6565302 - DNA, 14 bp, Homo sapiens
ttattttaaacaaa

SEQ ID NO: 6565303 - DNA, 16 bp, Homo sapiens
ttattttaaacaaaat

SEQ ID NO: 6565304 - DNA, 17 bp, Homo sapiens
ttattttaaacaaaata

SEQ ID NO: 6565305 - DNA, 15 bp, Homo sapiens
ttattttaaacattt

SEQ ID NO: 6565306 - DNA, 15 bp, Homo sapiens
ttattttaaatgtgg

SEQ ID NO: 6565307 - DNA, 21 bp, Homo sapiens
ttattttaaattataaggact

SEQ ID NO: 6565308 - DNA, 22 bp, Homo sapiens
ttattttaaattataaggactg

SEQ ID NO: 6565309 - DNA, 20 bp, Homo sapiens
ttattttaataatgtttcaa

SEQ ID NO: 6565310 - DNA, 13 bp, Homo sapiens
ttattttaatgtg

SEQ ID NO: 6565311 - DNA, 23 bp, Homo sapiens
ttattttaatgtgatgatgtaat

SEQ ID NO: 6565312 - DNA, 17 bp, Homo sapiens
ttattttaattcagttg

SEQ ID NO: 6565313 - DNA, 17 bp, Homo sapiens
ttattttacacagaaac

SEQ ID NO: 6565314 - DNA, 19 bp, Homo sapiens
ttattttacacagaaacac

SEQ ID NO: 6565315 - DNA, 13 bp, Homo sapiens
ttattttacattt

SEQ ID NO: 6565316 - DNA, 15 bp, Homo sapiens
ttattttacatttag

SEQ ID NO: 6565317 - DNA, 23 bp, Homo sapiens
ttattttagacaaccatagaact

SEQ ID NO: 6565318 - DNA, 12 bp, Homo sapiens
ttattttagcag

SEQ ID NO: 6565319 - DNA, 16 bp, Homo sapiens
ttattttagcagttct

SEQ ID NO: 6565320 - DNA, 17 bp, Homo sapiens
ttattttagcttcagtt

SEQ ID NO: 6565321 - DNA, 18 bp, Homo sapiens
ttattttagtgtgtaaaa

SEQ ID NO: 6565322 - DNA, 20 bp, Homo sapiens
ttattttagtgtgtaaaatt

SEQ ID NO: 6565323 - DNA, 10 bp, Homo sapiens
ttattttata

SEQ ID NO: 6565324 - DNA, 22 bp, Homo sapiens
ttattttataagaaaaactttt

SEQ ID NO: 6565325 - DNA, 16 bp, Homo sapiens
ttattttataatcaat

SEQ ID NO: 6565326 - DNA, 18 bp, Homo sapiens
ttattttataatcaatga

SEQ ID NO: 6565327 - DNA, 22 bp, Homo sapiens
ttattttatatcatacagtttt

SEQ ID NO: 6565328 - DNA, 14 bp, Homo sapiens
ttattttatgagaa

SEQ ID NO: 6565329 - DNA, 23 bp, Homo sapiens
ttattttatgagaaatgtaatgc

SEQ ID NO: 6565330 - DNA, 14 bp, Homo sapiens
ttattttatgttta

SEQ ID NO: 6565331 - DNA, 16 bp, Homo sapiens
ttattttattgaaatg

SEQ ID NO: 6565332 - DNA, 13 bp, Homo sapiens
ttattttatttgt

SEQ ID NO: 6565333 - DNA, 17 bp, Homo sapiens
ttattttcaaaaccagg

SEQ ID NO: 6565334 - DNA, 13 bp, Homo sapiens
ttattttcaagaa

SEQ ID NO: 6565335 - DNA, 16 bp, Homo sapiens
ttattttcaagcaaat

SEQ ID NO: 6565336 - DNA, 16 bp, Homo sapiens
ttattttcaagtagct

SEQ ID NO: 6565337 - DNA, 18 bp, Homo sapiens
ttattttcacagcccata

SEQ ID NO: 6565338 - DNA, 14 bp, Homo sapiens
ttattttcagcatg

SEQ ID NO: 6565339 - DNA, 12 bp, Homo sapiens
ttattttcagta

SEQ ID NO: 6565340 - DNA, 14 bp, Homo sapiens
ttattttcagtatt

SEQ ID NO: 6565341 - DNA, 22 bp, Homo sapiens
ttattttcagtgcatcattact

SEQ ID NO: 6565342 - DNA, 22 bp, Homo sapiens
ttattttcagtgctttgccctt

SEQ ID NO: 6565343 - DNA, 13 bp, Homo sapiens
ttattttcataat

SEQ ID NO: 6565344 - DNA, 18 bp, Homo sapiens
ttattttcccctatcatt

SEQ ID NO: 6565345 - DNA, 18 bp, Homo sapiens
ttattttcccttcatgtt

SEQ ID NO: 6565346 - DNA, 19 bp, Homo sapiens
ttattttcccttcatgttt

SEQ ID NO: 6565347 - DNA, 15 bp, Homo sapiens
ttattttcctcccca

SEQ ID NO: 6565348 - DNA, 14 bp, Homo sapiens
ttattttctaaagt

SEQ ID NO: 6565349 - DNA, 16 bp, Homo sapiens
ttattttctatagctc

SEQ ID NO: 6565350 - DNA, 12 bp, Homo sapiens
ttattttctggt

SEQ ID NO: 6565351 - DNA, 13 bp, Homo sapiens
ttattttctgtca

SEQ ID NO: 6565352 - DNA, 14 bp, Homo sapiens
ttattttctgtcag

SEQ ID NO: 6565353 - DNA, 23 bp, Homo sapiens
ttattttctgtgtaaaatgagta

SEQ ID NO: 6565354 - DNA, 19 bp, Homo sapiens
ttattttctgttcagatta

SEQ ID NO: 6565355 - DNA, 20 bp, Homo sapiens
ttattttcttttgaattgtt

SEQ ID NO: 6565356 - DNA, 14 bp, Homo sapiens
ttattttgaatgta

SEQ ID NO: 6565357 - DNA, 20 bp, Homo sapiens
ttattttgactgtgatttat

SEQ ID NO: 6565358 - DNA, 23 bp, Homo sapiens
ttattttgaggtagaggaaaatc

SEQ ID NO: 6565359 - DNA, 11 bp, Homo sapiens
ttattttgatg

SEQ ID NO: 6565360 - DNA, 14 bp, Homo sapiens
ttattttgcactgt

SEQ ID NO: 6565361 - DNA, 21 bp, Homo sapiens
ttattttgcatatatgttctt

SEQ ID NO: 6565362 - DNA, 17 bp, Homo sapiens
ttattttgctccctctg

SEQ ID NO: 6565363 - DNA, 20 bp, Homo sapiens
ttattttgctccctctgtta

SEQ ID NO: 6565364 - DNA, 14 bp, Homo sapiens
ttattttgctgagt

SEQ ID NO: 6565365 - DNA, 20 bp, Homo sapiens
ttattttgctgagttgttct

SEQ ID NO: 6565366 - DNA, 18 bp, Homo sapiens
ttattttgctttggttaa

SEQ ID NO: 6565367 - DNA, 19 bp, Homo sapiens
ttattttggaaagaagaaa

SEQ ID NO: 6565368 - DNA, 14 bp, Homo sapiens
ttattttgtaatta

SEQ ID NO: 6565369 - DNA, 21 bp, Homo sapiens
ttattttgtacgtgttattat

SEQ ID NO: 6565370 - DNA, 22 bp, Homo sapiens
ttattttgtattacatctaatg

SEQ ID NO: 6565371 - DNA, 13 bp, Homo sapiens
ttattttgtattc

SEQ ID NO: 6565372 - DNA, 17 bp, Homo sapiens
ttattttgtcataaaat

SEQ ID NO: 6565373 - DNA, 20 bp, Homo sapiens
ttattttgtcataaaatgct

SEQ ID NO: 6565374 - DNA, 19 bp, Homo sapiens
ttattttgtgctcatttaa

SEQ ID NO: 6565375 - DNA, 14 bp, Homo sapiens
ttattttgttcata

SEQ ID NO: 6565376 - DNA, 15 bp, Homo sapiens
ttatttttaaaataa

SEQ ID NO: 6565377 - DNA, 18 bp, Homo sapiens
ttatttttaaaataattt

SEQ ID NO: 6565378 - DNA, 13 bp, Homo sapiens
ttatttttaagaa

SEQ ID NO: 6565379 - DNA, 15 bp, Homo sapiens
ttatttttaatatgt

SEQ ID NO: 6565380 - DNA, 18 bp, Homo sapiens
ttatttttaatatgttga

SEQ ID NO: 6565381 - DNA, 20 bp, Homo sapiens
ttatttttaatatgttgact

SEQ ID NO: 6565382 - DNA, 17 bp, Homo sapiens
ttatttttaatttaaaa

SEQ ID NO: 6565383 - DNA, 14 bp, Homo sapiens
ttatttttacctaa

SEQ ID NO: 6565384 - DNA, 19 bp, Homo sapiens
tttgtataaaatccataga

SEQ ID NO: 6565385 - DNA, 14 bp, Homo sapiens
tttgtataaaatct

SEQ ID NO: 6565386 - DNA, 16 bp, Homo sapiens
tttgtataaactgtca

SEQ ID NO: 6565387 - DNA, 13 bp, Homo sapiens
tttgtataaattt

SEQ ID NO: 6565388 - DNA, 20 bp, Homo sapiens
tttgtataaatttttaagtg

SEQ ID NO: 6565389 - DNA, 21 bp, Homo sapiens
tttgtataaatttttaagtgt

SEQ ID NO: 6565390 - DNA, 16 bp, Homo sapiens
tttgtataacttttga

SEQ ID NO: 6565391 - DNA, 18 bp, Homo sapiens
tttgtataattgtatcgt

SEQ ID NO: 6565392 - DNA, 17 bp, Homo sapiens
tttgtataccatgatgc

SEQ ID NO: 6565393 - DNA, 22 bp, Homo sapiens
tttgtataccctgaagaactct

SEQ ID NO: 6565394 - DNA, 22 bp, Homo sapiens
tttgtatactttaaataattta

SEQ ID NO: 6565395 - DNA, 11 bp, Homo sapiens
tttgtatagaa

SEQ ID NO: 6565396 - DNA, 18 bp, Homo sapiens
tttgtatagaccaaagca

SEQ ID NO: 6565397 - DNA, 16 bp, Homo sapiens
tttgtatagtaaagtg

SEQ ID NO: 6565398 - DNA, 21 bp, Homo sapiens
tttgtatagtattggaaaata

SEQ ID NO: 6565399 - DNA, 14 bp, Homo sapiens
tttgtatagttatg

SEQ ID NO: 6565400 - DNA, 16 bp, Homo sapiens
tttgtatatacagtta

SEQ ID NO: 6565401 - DNA, 23 bp, Homo sapiens
tttgtatatcatgaaacacttct

SEQ ID NO: 6565402 - DNA, 18 bp, Homo sapiens
tttgtatatgactgcatt

SEQ ID NO: 6565403 - DNA, 12 bp, Homo sapiens
tttgtatattgt

SEQ ID NO: 6565404 - DNA, 20 bp, Homo sapiens
tttgtatcagtcagtgctgg

SEQ ID NO: 6565405 - DNA, 13 bp, Homo sapiens
tttgtatcatgtt

SEQ ID NO: 6565406 - DNA, 21 bp, Homo sapiens
tttgtatcatgttttactaca

SEQ ID NO: 6565407 - DNA, 20 bp, Homo sapiens
tttgtatctctgaagcatgt

SEQ ID NO: 6565408 - DNA, 21 bp, Homo sapiens
tttgtatctgcaggcagacac

SEQ ID NO: 6565409 - DNA, 14 bp, Homo sapiens
tttgtatcttaaat

SEQ ID NO: 6565410 - DNA, 16 bp, Homo sapiens
tttgtatcttaaatct

SEQ ID NO: 6565411 - DNA, 17 bp, Homo sapiens
tttgtatcttaaatttg

SEQ ID NO: 6565412 - DNA, 22 bp, Homo sapiens
tttgtatcttccatatttggaa

SEQ ID NO: 6565413 - DNA, 14 bp, Homo sapiens
tttgtatcttgatg

SEQ ID NO: 6565414 - DNA, 18 bp, Homo sapiens
tttgtatctttatgctgt

SEQ ID NO: 6565415 - DNA, 14 bp, Homo sapiens
tttgtatcttttat

SEQ ID NO: 6565416 - DNA, 21 bp, Homo sapiens
tttgtatcttttatcctggga

SEQ ID NO: 6565417 - DNA, 19 bp, Homo sapiens
tttgtatctttttgaaaat

SEQ ID NO: 6565418 - DNA, 15 bp, Homo sapiens
tttgtatgaaaacat

SEQ ID NO: 6565419 - DNA, 23 bp, Homo sapiens
tttgtatgaaaacatggaacagt

SEQ ID NO: 6565420 - DNA, 20 bp, Homo sapiens
tttgtatgaaatatatgtga

SEQ ID NO: 6565421 - DNA, 15 bp, Homo sapiens
tttgtatgaactctt

SEQ ID NO: 6565422 - DNA, 17 bp, Homo sapiens
tttgtatgaagtacttt

SEQ ID NO: 6565423 - DNA, 16 bp, Homo sapiens
tttgtatgagatggtt

SEQ ID NO: 6565424 - DNA, 21 bp, Homo sapiens
tttgtatgccaatcttaaaga

SEQ ID NO: 6565425 - DNA, 14 bp, Homo sapiens
tttgtatgtaaatg

SEQ ID NO: 6565426 - DNA, 14 bp, Homo sapiens
tttgtatgtactgt

SEQ ID NO: 6565427 - DNA, 15 bp, Homo sapiens
tttgtatgtctgtgt

SEQ ID NO: 6565428 - DNA, 22 bp, Homo sapiens
tttgtatgtctgtgtatgtata

SEQ ID NO: 6565429 - DNA, 13 bp, Homo sapiens
tttgtatgtgaac

SEQ ID NO: 6565430 - DNA, 15 bp, Homo sapiens
tttgtatgtggaagt

SEQ ID NO: 6565431 - DNA, 13 bp, Homo sapiens
tttgtatgtggca

SEQ ID NO: 6565432 - DNA, 13 bp, Homo sapiens
tttgtatgtgtgt

SEQ ID NO: 6565433 - DNA, 22 bp, Homo sapiens
tttgtatgttgtgaagatgttt

SEQ ID NO: 6565434 - DNA, 18 bp, Homo sapiens
tttgtatgttttttttct

SEQ ID NO: 6565435 - DNA, 13 bp, Homo sapiens
tttgtattaataa

SEQ ID NO: 6565436 - DNA, 19 bp, Homo sapiens
tttgtattaataaagcatt

SEQ ID NO: 6565437 - DNA, 17 bp, Homo sapiens
tttgtattacatctaat

SEQ ID NO: 6565438 - DNA, 22 bp, Homo sapiens
tttgtattagtaataaaacatt

SEQ ID NO: 6565439 - DNA, 17 bp, Homo sapiens
tttgtattataattgtt

SEQ ID NO: 6565440 - DNA, 20 bp, Homo sapiens
tttgtattattgctgttgct

SEQ ID NO: 6565441 - DNA, 13 bp, Homo sapiens
tttgtattcaaaa

SEQ ID NO: 6565442 - DNA, 13 bp, Homo sapiens
tttgtattcatga

SEQ ID NO: 6565443 - DNA, 21 bp, Homo sapiens
tttgtattcatgaacttggct

SEQ ID NO: 6565444 - DNA, 20 bp, Homo sapiens
tttgtattcatgttcatgtg

SEQ ID NO: 6565445 - DNA, 21 bp, Homo sapiens
tttgtattctacctttgtaaa

SEQ ID NO: 6565446 - DNA, 12 bp, Homo sapiens
tttgtattctct

SEQ ID NO: 6565447 - DNA, 14 bp, Homo sapiens
tttgtattctctga

SEQ ID NO: 6565448 - DNA, 15 bp, Homo sapiens
tttgtattctctgca

SEQ ID NO: 6565449 - DNA, 20 bp, Homo sapiens
tttgtattcttcatgaaatg

SEQ ID NO: 6565450 - DNA, 18 bp, Homo sapiens
tttgtattgagggccagt

SEQ ID NO: 6565451 - DNA, 20 bp, Homo sapiens
tttgtattgtaaaaaattca

SEQ ID NO: 6565452 - DNA, 19 bp, Homo sapiens
tttgtattgttaatatctt

SEQ ID NO: 6565453 - DNA, 22 bp, Homo sapiens
tttgtattgttctaatgcaaca

SEQ ID NO: 6565454 - DNA, 19 bp, Homo sapiens
tttgtatttaaggattctg

SEQ ID NO: 6565455 - DNA, 22 bp, Homo sapiens
tttgtatttagtagttatttgt

SEQ ID NO: 6565456 - DNA, 13 bp, Homo sapiens
tttgtatttatat

SEQ ID NO: 6565457 - DNA, 18 bp, Homo sapiens
tttgtatttatattagag

SEQ ID NO: 6565458 - DNA, 17 bp, Homo sapiens
tttgtatttctctattt

SEQ ID NO: 6565459 - DNA, 20 bp, Homo sapiens
tttgtatttctcttgtcctt

SEQ ID NO: 6565460 - DNA, 12 bp, Homo sapiens
tttgtatttctt

SEQ ID NO: 6565461 - DNA, 13 bp, Homo sapiens
tttgtatttcttt

SEQ ID NO: 6565462 - DNA, 17 bp, Homo sapiens
tttgtatttcttttata

SEQ ID NO: 6565463 - DNA, 13 bp, Homo sapiens
tttgtatttggaa

SEQ ID NO: 6565464 - DNA, 21 bp, Homo sapiens
tttgtatttggaatatttgaa

SEQ ID NO: 6565465 - DNA, 13 bp, Homo sapiens
tttgtattttaca

SEQ ID NO: 6565466 - DNA, 21 bp, Homo sapiens
tttgtattttcatgaaaatac

SEQ ID NO: 6565467 - DNA, 15 bp, Homo sapiens
tttgtattttccaag

SEQ ID NO: 6565468 - DNA, 15 bp, Homo sapiens
tttgtattttgcata

SEQ ID NO: 6565469 - DNA, 20 bp, Homo sapiens
tttgtattttggaggtgctt

SEQ ID NO: 6565470 - DNA, 22 bp, Homo sapiens
tttgtattttggaggtgcttga

SEQ ID NO: 6565471 - DNA, 15 bp, Homo sapiens
tttgtattttgtgat

SEQ ID NO: 6565472 - DNA, 23 bp, Homo sapiens
tttgtatttttcatctttaagaa

SEQ ID NO: 6565473 - DNA, 17 bp, Homo sapiens
tttgtatttttgaataa

SEQ ID NO: 6565474 - DNA, 22 bp, Homo sapiens
tttgtatttttgattgttatgt

SEQ ID NO: 6565475 - DNA, 13 bp, Homo sapiens
tttgtatttttgt

SEQ ID NO: 6565476 - DNA, 20 bp, Homo sapiens
tttgtattttttatttacat

SEQ ID NO: 6565477 - DNA, 16 bp, Homo sapiens
tttgtattttttcctt

SEQ ID NO: 6565478 - DNA, 20 bp, Homo sapiens
tttgtcaaaaagtaatgatt

SEQ ID NO: 6565479 - DNA, 16 bp, Homo sapiens
tttgtcaaatggtatt

SEQ ID NO: 6565480 - DNA, 20 bp, Homo sapiens
tttgtcaacaaaaagacatg

SEQ ID NO: 6565481 - DNA, 21 bp, Homo sapiens
tttgtcaacacaaagacacag

SEQ ID NO: 6565482 - DNA, 11 bp, Homo sapiens
tttgtcaatga

SEQ ID NO: 6565483 - DNA, 15 bp, Homo sapiens
tttgtcaattgctaa

SEQ ID NO: 6565484 - DNA, 19 bp, Homo sapiens
tttgtcaatttatgaatat

SEQ ID NO: 6565485 - DNA, 17 bp, Homo sapiens
tttgtcacattatttat

SEQ ID NO: 6565486 - DNA, 14 bp, Homo sapiens
tttgtcactcggct

SEQ ID NO: 6565487 - DNA, 14 bp, Homo sapiens
tttgtcactgctgt

SEQ ID NO: 6565488 - DNA, 15 bp, Homo sapiens
tttgtcactgcttca

SEQ ID NO: 6565489 - DNA, 12 bp, Homo sapiens
tttgtcacttct

SEQ ID NO: 6565490 - DNA, 13 bp, Homo sapiens
tttgtcagaaaag

SEQ ID NO: 6565491 - DNA, 15 bp, Homo sapiens
tttgtcagaaaagag

SEQ ID NO: 6565492 - DNA, 20 bp, Homo sapiens
tttgtcagaactagaatttg

SEQ ID NO: 6565493 - DNA, 15 bp, Homo sapiens
tttgtcagtatggct

SEQ ID NO: 6565494 - DNA, 19 bp, Homo sapiens
tttgtcagtatttttgccg

SEQ ID NO: 6565495 - DNA, 16 bp, Homo sapiens
tttgtcataaaatgct

SEQ ID NO: 6565496 - DNA, 17 bp, Homo sapiens
tttgtcataaaatgcta

SEQ ID NO: 6565497 - DNA, 14 bp, Homo sapiens
tttgtcatatattc

SEQ ID NO: 6565498 - DNA, 13 bp, Homo sapiens
tttgtcatatcaa

SEQ ID NO: 6565499 - DNA, 19 bp, Homo sapiens
tttgtcatcagatggaaat

SEQ ID NO: 6565500 - DNA, 14 bp, Homo sapiens
tttgtcatgacagt

SEQ ID NO: 6565501 - DNA, 23 bp, Homo sapiens
tttgtcattagcctgagtagaaa

SEQ ID NO: 6565502 - DNA, 15 bp, Homo sapiens
tttgtcattatgatt

SEQ ID NO: 6565503 - DNA, 13 bp, Homo sapiens
tttgtcattcaga

SEQ ID NO: 6565504 - DNA, 15 bp, Homo sapiens
tttgtcattcagttc

SEQ ID NO: 6565505 - DNA, 16 bp, Homo sapiens
tttgtcattcagttct

SEQ ID NO: 6565506 - DNA, 21 bp, Homo sapiens
tttgtcattcagttctaggcc

SEQ ID NO: 6565507 - DNA, 13 bp, Homo sapiens
tttgtcattgttt

SEQ ID NO: 6565508 - DNA, 17 bp, Homo sapiens
tttgtcattgttttcag

SEQ ID NO: 6565509 - DNA, 20 bp, Homo sapiens
tttgtcattttaaaatctga

SEQ ID NO: 6565510 - DNA, 21 bp, Homo sapiens
tttgtcattttaaaatctgat

SEQ ID NO: 6565511 - DNA, 16 bp, Homo sapiens
tttgtcattttcatta

SEQ ID NO: 6565512 - DNA, 18 bp, Homo sapiens
tttgtcattttcattagc

SEQ ID NO: 6565513 - DNA, 23 bp, Homo sapiens
tttgtccaaacaggtgctggccc

SEQ ID NO: 6565514 - DNA, 14 bp, Homo sapiens
tttgtccaggcctg

SEQ ID NO: 6565515 - DNA, 15 bp, Homo sapiens
tttgtccatcagatt

SEQ ID NO: 6565516 - DNA, 13 bp, Homo sapiens
tttgtccatcttg

SEQ ID NO: 6565517 - DNA, 14 bp, Homo sapiens
tttgtccattattc

SEQ ID NO: 6565518 - DNA, 15 bp, Homo sapiens
tttgtccatttgtaa

SEQ ID NO: 6565519 - DNA, 16 bp, Homo sapiens
tttgtcccaagtgcca

SEQ ID NO: 6565520 - DNA, 12 bp, Homo sapiens
tttgtcccaggt

SEQ ID NO: 6565521 - DNA, 24 bp, Homo sapiens
tttgtcccatttccttggaggcca

SEQ ID NO: 6565522 - DNA, 13 bp, Homo sapiens
tttgtccccaccg

SEQ ID NO: 6565523 - DNA, 21 bp, Homo sapiens
tttgtccccaccgcagacagg

SEQ ID NO: 6565524 - DNA, 20 bp, Homo sapiens
tttgtccccagggcccctcc

SEQ ID NO: 6565525 - DNA, 17 bp, Homo sapiens
tttgtcccccaacttga

SEQ ID NO: 6565526 - DNA, 18 bp, Homo sapiens
tttgtcccctcacctcca

SEQ ID NO: 6565527 - DNA, 18 bp, Homo sapiens
tttgtcctaagagattta

SEQ ID NO: 6565528 - DNA, 23 bp, Homo sapiens
tttgtcctaagagatttatcttt

SEQ ID NO: 6565529 - DNA, 12 bp, Homo sapiens
tttgtcctcaaa

SEQ ID NO: 6565530 - DNA, 17 bp, Homo sapiens
tttgtcctgaatggctt

SEQ ID NO: 6565531 - DNA, 22 bp, Homo sapiens
tttgtcctgaatggctttgtct

SEQ ID NO: 6565532 - DNA, 23 bp, Homo sapiens
tttgtcctgaatggctttgtctt

SEQ ID NO: 6565533 - DNA, 20 bp, Homo sapiens
tttgtcctgcctcttgtttc

SEQ ID NO: 6565534 - DNA, 21 bp, Homo sapiens
tttgtccttgcacctgagcct

SEQ ID NO: 6565535 - DNA, 17 bp, Homo sapiens
tttgtcctttttcactt

SEQ ID NO: 6565536 - DNA, 21 bp, Homo sapiens
tttgtcgggcaccagccagcg

SEQ ID NO: 6565537 - DNA, 19 bp, Homo sapiens
tttgtcgggttctcccatg

SEQ ID NO: 6565538 - DNA, 17 bp, Homo sapiens
tttgtcgtggttcttaa

SEQ ID NO: 6565539 - DNA, 21 bp, Homo sapiens
tttgtcgtggttcttaaatgt

SEQ ID NO: 6565540 - DNA, 18 bp, Homo sapiens
tttgtctaaacaaggtaa

SEQ ID NO: 6565541 - DNA, 13 bp, Homo sapiens
tttgtctaagaaa

SEQ ID NO: 6565542 - DNA, 15 bp, Homo sapiens
tttgtctacaccatt

SEQ ID NO: 6565543 - DNA, 18 bp, Homo sapiens
tttgtctatgaagttgct

SEQ ID NO: 6565544 - DNA, 21 bp, Homo sapiens
tttgtctatgaagttgctgtt

SEQ ID NO: 6565545 - DNA, 18 bp, Homo sapiens
tttgtctattttaaaata

SEQ ID NO: 6565546 - DNA, 13 bp, Homo sapiens
tttgtctcacttt

SEQ ID NO: 6565547 - DNA, 16 bp, Homo sapiens
tttgtctccaaagaag

SEQ ID NO: 6565548 - DNA, 12 bp, Homo sapiens
tttgtctcctct

SEQ ID NO: 6565549 - DNA, 13 bp, Homo sapiens
tttgtctctcctt

SEQ ID NO: 6565550 - DNA, 18 bp, Homo sapiens
tttgtctctgagaacaga

SEQ ID NO: 6565551 - DNA, 13 bp, Homo sapiens
tttgtctctgagc

SEQ ID NO: 6565552 - DNA, 23 bp, Homo sapiens
tttgtctctgcaaactgccttct

SEQ ID NO: 6565553 - DNA, 16 bp, Homo sapiens
tttgtctctgtcacat

SEQ ID NO: 6565554 - DNA, 14 bp, Homo sapiens
tttgtctcttctgg

SEQ ID NO: 6565555 - DNA, 16 bp, Homo sapiens
tttgtctgacaaactc

SEQ ID NO: 6565556 - DNA, 22 bp, Homo sapiens
tttgtctgatagagtttaacag

SEQ ID NO: 6565557 - DNA, 13 bp, Homo sapiens
tttgtctgcagct

SEQ ID NO: 6565558 - DNA, 21 bp, Homo sapiens
tttgtctgccccaagttttgt

SEQ ID NO: 6565559 - DNA, 16 bp, Homo sapiens
tttgtctggctgtggc

SEQ ID NO: 6565560 - DNA, 12 bp, Homo sapiens
tttgtctgtaca

SEQ ID NO: 6565561 - DNA, 19 bp, Homo sapiens
tttgtctgtgtgctgtaac

SEQ ID NO: 6565562 - DNA, 12 bp, Homo sapiens
tttgtctgtgtt

SEQ ID NO: 6565563 - DNA, 16 bp, Homo sapiens
tttgtctgtgttgctg

SEQ ID NO: 6565564 - DNA, 18 bp, Homo sapiens
ttatttttacgatctgtt

SEQ ID NO: 6565565 - DNA, 13 bp, Homo sapiens
ttatttttacttg

SEQ ID NO: 6565566 - DNA, 14 bp, Homo sapiens
ttatttttagaatt

SEQ ID NO: 6565567 - DNA, 20 bp, Homo sapiens
ttatttttagaattttgtga

SEQ ID NO: 6565568 - DNA, 14 bp, Homo sapiens
ttatttttagccat

SEQ ID NO: 6565569 - DNA, 13 bp, Homo sapiens
ttatttttataat

SEQ ID NO: 6565570 - DNA, 16 bp, Homo sapiens
ttatttttataattgt

SEQ ID NO: 6565571 - DNA, 21 bp, Homo sapiens
ttatttttataattgtacaaa

SEQ ID NO: 6565572 - DNA, 16 bp, Homo sapiens
ttatttttatacagta

SEQ ID NO: 6565573 - DNA, 18 bp, Homo sapiens
ttatttttatatacgttt

SEQ ID NO: 6565574 - DNA, 20 bp, Homo sapiens
ttatttttatatcagcctga

SEQ ID NO: 6565575 - DNA, 16 bp, Homo sapiens
ttatttttattaaata

SEQ ID NO: 6565576 - DNA, 19 bp, Homo sapiens
ttatttttattaaataaat

SEQ ID NO: 6565577 - DNA, 17 bp, Homo sapiens
ttatttttattaaatgt

SEQ ID NO: 6565578 - DNA, 14 bp, Homo sapiens
ttatttttcactct

SEQ ID NO: 6565579 - DNA, 16 bp, Homo sapiens
ttatttttcatattgt

SEQ ID NO: 6565580 - DNA, 23 bp, Homo sapiens
ttatttttcctcagaatgatttg

SEQ ID NO: 6565581 - DNA, 14 bp, Homo sapiens
ttatttttcctgtc

SEQ ID NO: 6565582 - DNA, 14 bp, Homo sapiens
ttatttttctaaac

SEQ ID NO: 6565583 - DNA, 19 bp, Homo sapiens
ttatttttctcttgtacca

SEQ ID NO: 6565584 - DNA, 21 bp, Homo sapiens
ttatttttctctttctccctt

SEQ ID NO: 6565585 - DNA, 12 bp, Homo sapiens
ttatttttctga

SEQ ID NO: 6565586 - DNA, 12 bp, Homo sapiens
ttatttttctgt

SEQ ID NO: 6565587 - DNA, 14 bp, Homo sapiens
ttatttttctgtta

SEQ ID NO: 6565588 - DNA, 14 bp, Homo sapiens
ttatttttctttaa

SEQ ID NO: 6565589 - DNA, 21 bp, Homo sapiens
ttatttttctttaaagccagt

SEQ ID NO: 6565590 - DNA, 20 bp, Homo sapiens
ttatttttgcacaacttttg

SEQ ID NO: 6565591 - DNA, 22 bp, Homo sapiens
ttatttttgcacaacttttgag

SEQ ID NO: 6565592 - DNA, 12 bp, Homo sapiens
ttatttttgctt

SEQ ID NO: 6565593 - DNA, 18 bp, Homo sapiens
ttatttttggcaaagcca

SEQ ID NO: 6565594 - DNA, 21 bp, Homo sapiens
ttatttttgggtttggccagg

SEQ ID NO: 6565595 - DNA, 13 bp, Homo sapiens
ttatttttgtaat

SEQ ID NO: 6565596 - DNA, 14 bp, Homo sapiens
ttatttttgtaatg

SEQ ID NO: 6565597 - DNA, 16 bp, Homo sapiens
ttatttttgtacatgt

SEQ ID NO: 6565598 - DNA, 17 bp, Homo sapiens
ttatttttgtacatgtt

SEQ ID NO: 6565599 - DNA, 16 bp, Homo sapiens
ttatttttgtaccata

SEQ ID NO: 6565600 - DNA, 13 bp, Homo sapiens
ttatttttgtact

SEQ ID NO: 6565601 - DNA, 16 bp, Homo sapiens
ttatttttgtactgtg

SEQ ID NO: 6565602 - DNA, 15 bp, Homo sapiens
ttatttttgtatgcc

SEQ ID NO: 6565603 - DNA, 18 bp, Homo sapiens
ttatttttgtatgccttt

SEQ ID NO: 6565604 - DNA, 16 bp, Homo sapiens
ttatttttgtccctgc

SEQ ID NO: 6565605 - DNA, 19 bp, Homo sapiens
ttatttttgtccctgctcc

SEQ ID NO: 6565606 - DNA, 21 bp, Homo sapiens
ttatttttgttagcaaagatt

SEQ ID NO: 6565607 - DNA, 15 bp, Homo sapiens
ttattttttaaaaag

SEQ ID NO: 6565608 - DNA, 18 bp, Homo sapiens
ttattttttaaaaaggta

SEQ ID NO: 6565609 - DNA, 23 bp, Homo sapiens
ttattttttaaagaaatctattt

SEQ ID NO: 6565610 - DNA, 16 bp, Homo sapiens
ttattttttaaatgta

SEQ ID NO: 6565611 - DNA, 18 bp, Homo sapiens
ttattttttacattatta

SEQ ID NO: 6565612 - DNA, 14 bp, Homo sapiens
ttattttttcaaaa

SEQ ID NO: 6565613 - DNA, 15 bp, Homo sapiens
ttattttttcagacc

SEQ ID NO: 6565614 - DNA, 14 bp, Homo sapiens
ttattttttctaca

SEQ ID NO: 6565615 - DNA, 13 bp, Homo sapiens
ttattttttgggc

SEQ ID NO: 6565616 - DNA, 21 bp, Homo sapiens
ttattttttgggccattaccc

SEQ ID NO: 6565617 - DNA, 20 bp, Homo sapiens
ttatttttttaagctgtaaa

SEQ ID NO: 6565618 - DNA, 16 bp, Homo sapiens
ttatttttttaccaat

SEQ ID NO: 6565619 - DNA, 17 bp, Homo sapiens
ttatttttttattcttc

SEQ ID NO: 6565620 - DNA, 13 bp, Homo sapiens
ttatttttttccc

SEQ ID NO: 6565621 - DNA, 15 bp, Homo sapiens
ttatttttttctgat

SEQ ID NO: 6565622 - DNA, 16 bp, Homo sapiens
ttatttttttctgatt

SEQ ID NO: 6565623 - DNA, 17 bp, Homo sapiens
ttatttttttgagactg

SEQ ID NO: 6565624 - DNA, 18 bp, Homo sapiens
ttattttttttttttgaa

SEQ ID NO: 6565625 - DNA, 21 bp, Homo sapiens
ttcaaaaaaaaaaaaaaagac

SEQ ID NO: 6565626 - DNA, 17 bp, Homo sapiens
ttcaaaaaaacactagt

SEQ ID NO: 6565627 - DNA, 13 bp, Homo sapiens
ttcaaaaaaacat

SEQ ID NO: 6565628 - DNA, 22 bp, Homo sapiens
ttcaaaaaatcatgtttatttt

SEQ ID NO: 6565629 - DNA, 17 bp, Homo sapiens
ttcaaaaacacagtgtt

SEQ ID NO: 6565630 - DNA, 15 bp, Homo sapiens
ttcaaaaactgtatt

SEQ ID NO: 6565631 - DNA, 13 bp, Homo sapiens
ttcaaaaagatat

SEQ ID NO: 6565632 - DNA, 14 bp, Homo sapiens
ttcaaaaagatatt

SEQ ID NO: 6565633 - DNA, 22 bp, Homo sapiens
ttcaaaaagcaatctggaagaa

SEQ ID NO: 6565634 - DNA, 23 bp, Homo sapiens
ttcaaaaagcagagtggactgca

SEQ ID NO: 6565635 - DNA, 15 bp, Homo sapiens
ttcaaaaagccacag

SEQ ID NO: 6565636 - DNA, 14 bp, Homo sapiens
ttcaaaaagtgttt

SEQ ID NO: 6565637 - DNA, 23 bp, Homo sapiens
ttcaaaaataaaaaatctgaaga

SEQ ID NO: 6565638 - DNA, 14 bp, Homo sapiens
ttcaaaaataaaag

SEQ ID NO: 6565639 - DNA, 12 bp, Homo sapiens
ttcaaaaatctg

SEQ ID NO: 6565640 - DNA, 14 bp, Homo sapiens
ttcaaaaatctgaa

SEQ ID NO: 6565641 - DNA, 16 bp, Homo sapiens
ttcaaaaatgtacaaa

SEQ ID NO: 6565642 - DNA, 15 bp, Homo sapiens
ttcaaaaatttctgc

SEQ ID NO: 6565643 - DNA, 23 bp, Homo sapiens
ttcaaaacaaacagatgctctga

SEQ ID NO: 6565644 - DNA, 22 bp, Homo sapiens
ttcaaaacagttacttaagatt

SEQ ID NO: 6565645 - DNA, 13 bp, Homo sapiens
ttcaaaacattcc

SEQ ID NO: 6565646 - DNA, 15 bp, Homo sapiens
ttcaaaacattccaa

SEQ ID NO: 6565647 - DNA, 21 bp, Homo sapiens
ttcaaaacctgcagttaacag

SEQ ID NO: 6565648 - DNA, 12 bp, Homo sapiens
ttcaaaactttc

SEQ ID NO: 6565649 - DNA, 12 bp, Homo sapiens
ttcaaaagaaag

SEQ ID NO: 6565650 - DNA, 13 bp, Homo sapiens
ttcaaaagaaagt

SEQ ID NO: 6565651 - DNA, 18 bp, Homo sapiens
ttcaaaagaacattctta

SEQ ID NO: 6565652 - DNA, 21 bp, Homo sapiens
ttcaaaagaatcagaaacagg

SEQ ID NO: 6565653 - DNA, 13 bp, Homo sapiens
ttcaaaagcaatc

SEQ ID NO: 6565654 - DNA, 19 bp, Homo sapiens
ttcaaaagccataacttga

SEQ ID NO: 6565655 - DNA, 21 bp, Homo sapiens
ttcaaaagccataacttgaaa

SEQ ID NO: 6565656 - DNA, 15 bp, Homo sapiens
ttcaaaaggtgatta

SEQ ID NO: 6565657 - DNA, 14 bp, Homo sapiens
ttcaaaagtgatta

SEQ ID NO: 6565658 - DNA, 11 bp, Homo sapiens
ttcaaaagtgg

SEQ ID NO: 6565659 - DNA, 14 bp, Homo sapiens
ttcaaaagttccaa

SEQ ID NO: 6565660 - DNA, 15 bp, Homo sapiens
ttcaaaagttccaag

SEQ ID NO: 6565661 - DNA, 16 bp, Homo sapiens
ttcaaaagttccaaga

SEQ ID NO: 6565662 - DNA, 16 bp, Homo sapiens
ttcaaaagttgaaatt

SEQ ID NO: 6565663 - DNA, 14 bp, Homo sapiens
ttcaaaataaaaac

SEQ ID NO: 6565664 - DNA, 15 bp, Homo sapiens
ttcaaaataaaaagt

SEQ ID NO: 6565665 - DNA, 19 bp, Homo sapiens
ttcaaaatactttttaagg

SEQ ID NO: 6565666 - DNA, 15 bp, Homo sapiens
ttcaaaatagttcta

SEQ ID NO: 6565667 - DNA, 15 bp, Homo sapiens
ttcaaaatatgtgta

SEQ ID NO: 6565668 - DNA, 20 bp, Homo sapiens
ttcaaaatatttaaaaatgt

SEQ ID NO: 6565669 - DNA, 22 bp, Homo sapiens
ttcaaaatatttaaaaatgtct

SEQ ID NO: 6565670 - DNA, 22 bp, Homo sapiens
ttcaaaatcagtgatgggagta

SEQ ID NO: 6565671 - DNA, 13 bp, Homo sapiens
ttcaaaatccttc

SEQ ID NO: 6565672 - DNA, 19 bp, Homo sapiens
ttcaaaatcttcactgaat

SEQ ID NO: 6565673 - DNA, 13 bp, Homo sapiens
ttcaaaatgattt

SEQ ID NO: 6565674 - DNA, 23 bp, Homo sapiens
ttcaaaatgatttcctctgtaat

SEQ ID NO: 6565675 - DNA, 13 bp, Homo sapiens
ttcaaaatgcatg

SEQ ID NO: 6565676 - DNA, 21 bp, Homo sapiens
ttcaaaatgcatgtgattggc

SEQ ID NO: 6565677 - DNA, 17 bp, Homo sapiens
ttcaaaatgctttttat

SEQ ID NO: 6565678 - DNA, 20 bp, Homo sapiens
ttcaaaatggaaaattaatt

SEQ ID NO: 6565679 - DNA, 15 bp, Homo sapiens
ttcaaaatgtccagc

SEQ ID NO: 6565680 - DNA, 15 bp, Homo sapiens
ttcaaacaagaatgt

SEQ ID NO: 6565681 - DNA, 16 bp, Homo sapiens
ttcaaacaattcaatc

SEQ ID NO: 6565682 - DNA, 17 bp, Homo sapiens
ttcaaacacaaatgcag

SEQ ID NO: 6565683 - DNA, 18 bp, Homo sapiens
ttcaaacagcatcaaaat

SEQ ID NO: 6565684 - DNA, 21 bp, Homo sapiens
ttcaaacagttccataccaag

SEQ ID NO: 6565685 - DNA, 20 bp, Homo sapiens
ttcaaaccaatttcttcctt

SEQ ID NO: 6565686 - DNA, 15 bp, Homo sapiens
ttcaaaccagagaaa

SEQ ID NO: 6565687 - DNA, 21 bp, Homo sapiens
ttcaaaccagagaaaggaaag

SEQ ID NO: 6565688 - DNA, 22 bp, Homo sapiens
ttcaaaccagtatacaagataa

SEQ ID NO: 6565689 - DNA, 15 bp, Homo sapiens
ttcaaaccctgtatc

SEQ ID NO: 6565690 - DNA, 18 bp, Homo sapiens
ttcaaacctcaaatatag

SEQ ID NO: 6565691 - DNA, 17 bp, Homo sapiens
ttcaaacctgcaaggca

SEQ ID NO: 6565692 - DNA, 16 bp, Homo sapiens
ttcaaacctgcatatt

SEQ ID NO: 6565693 - DNA, 18 bp, Homo sapiens
ttcaaacgggtgcctggt

SEQ ID NO: 6565694 - DNA, 18 bp, Homo sapiens
ttcaaactactgtacatt

SEQ ID NO: 6565695 - DNA, 15 bp, Homo sapiens
ttcaaactgaatttg

SEQ ID NO: 6565696 - DNA, 21 bp, Homo sapiens
ttcaaactgaatttgttctta

SEQ ID NO: 6565697 - DNA, 15 bp, Homo sapiens
ttcaaactgagacag

SEQ ID NO: 6565698 - DNA, 17 bp, Homo sapiens
ttcaaactgctgcatac

SEQ ID NO: 6565699 - DNA, 15 bp, Homo sapiens
ttcaaactggggcct

SEQ ID NO: 6565700 - DNA, 12 bp, Homo sapiens
ttcaaactgtga

SEQ ID NO: 6565701 - DNA, 18 bp, Homo sapiens
ttcaaacttaaacaaaaa

SEQ ID NO: 6565702 - DNA, 21 bp, Homo sapiens
ttcaaacttaaacaaaaaact

SEQ ID NO: 6565703 - DNA, 17 bp, Homo sapiens
ttcaaactttcactttg

SEQ ID NO: 6565704 - DNA, 16 bp, Homo sapiens
ttcaaacttttgaaag

SEQ ID NO: 6565705 - DNA, 18 bp, Homo sapiens
ttcaaagaaaacagacca

SEQ ID NO: 6565706 - DNA, 13 bp, Homo sapiens
ttcaaagaagtca

SEQ ID NO: 6565707 - DNA, 13 bp, Homo sapiens
ttcaaagaatcac

SEQ ID NO: 6565708 - DNA, 22 bp, Homo sapiens
ttcaaagacaatcactgaaaca

SEQ ID NO: 6565709 - DNA, 19 bp, Homo sapiens
ttcaaagactgccacgtgc

SEQ ID NO: 6565710 - DNA, 22 bp, Homo sapiens
ttcaaagagactaatagagaca

SEQ ID NO: 6565711 - DNA, 19 bp, Homo sapiens
ttcaaagagtctgtcttga

SEQ ID NO: 6565712 - DNA, 15 bp, Homo sapiens
ttcaaagatacaaga

SEQ ID NO: 6565713 - DNA, 17 bp, Homo sapiens
ttcaaagatacaagaaa

SEQ ID NO: 6565714 - DNA, 21 bp, Homo sapiens
ttcaaagatacaagaaaaagt

SEQ ID NO: 6565715 - DNA, 13 bp, Homo sapiens
ttcaaagatattt

SEQ ID NO: 6565716 - DNA, 21 bp, Homo sapiens
ttcaaagatgataatttagtg

SEQ ID NO: 6565717 - DNA, 23 bp, Homo sapiens
ttcaaagatgcattttgagtgtt

SEQ ID NO: 6565718 - DNA, 13 bp, Homo sapiens
ttcaaagatgctg

SEQ ID NO: 6565719 - DNA, 23 bp, Homo sapiens
ttcaaagattatctgattccttt

SEQ ID NO: 6565720 - DNA, 16 bp, Homo sapiens
ttcaaagcaaccacct

SEQ ID NO: 6565721 - DNA, 19 bp, Homo sapiens
ttcaaagcaattgaaatgc

SEQ ID NO: 6565722 - DNA, 22 bp, Homo sapiens
ttcaaagcaattgaaatgcatt

SEQ ID NO: 6565723 - DNA, 21 bp, Homo sapiens
ttcaaagcaccaaaataagaa

SEQ ID NO: 6565724 - DNA, 23 bp, Homo sapiens
ttcaaagcaccaaaataagaaaa

SEQ ID NO: 6565725 - DNA, 16 bp, Homo sapiens
ttcaaagccaagacct

SEQ ID NO: 6565726 - DNA, 13 bp, Homo sapiens
ttcaaagccattt

SEQ ID NO: 6565727 - DNA, 16 bp, Homo sapiens
ttcaaagccctgcctc

SEQ ID NO: 6565728 - DNA, 22 bp, Homo sapiens
ttcaaagctaaaaaattgttaa

SEQ ID NO: 6565729 - DNA, 12 bp, Homo sapiens
ttcaaagctgag

SEQ ID NO: 6565730 - DNA, 16 bp, Homo sapiens
ttcaaagcttgaagat

SEQ ID NO: 6565731 - DNA, 13 bp, Homo sapiens
ttcaaagcttgtg

SEQ ID NO: 6565732 - DNA, 16 bp, Homo sapiens
ttcaaaggaacattgt

SEQ ID NO: 6565733 - DNA, 19 bp, Homo sapiens
ttcaaaggccacatacctc

SEQ ID NO: 6565734 - DNA, 11 bp, Homo sapiens
ttcaaaggctt

SEQ ID NO: 6565735 - DNA, 20 bp, Homo sapiens
ttcaaagtaccacactgaaa

SEQ ID NO: 6565736 - DNA, 14 bp, Homo sapiens
ttcaaagtatatac

SEQ ID NO: 6565737 - DNA, 17 bp, Homo sapiens
ttcaaagtcatgatgtt

SEQ ID NO: 6565738 - DNA, 19 bp, Homo sapiens
ttcaaagtcatgatgtttt

SEQ ID NO: 6565739 - DNA, 11 bp, Homo sapiens
ttcaaagtctc

SEQ ID NO: 6565740 - DNA, 19 bp, Homo sapiens
ttcaaagtctcaatgaaat

SEQ ID NO: 6565741 - DNA, 16 bp, Homo sapiens
ttcaaagtgcctgggc

SEQ ID NO: 6565742 - DNA, 14 bp, Homo sapiens
ttcaaagtgtatat

SEQ ID NO: 6565743 - DNA, 23 bp, Homo sapiens
ttcaaagtgtatatttattcata

SEQ ID NO: 6565744 - DNA, 16 bp, Homo sapiens
ttcaaagtgtctcatt

SEQ ID NO: 6565745 - DNA, 20 bp, Homo sapiens
tttgtctgtgttgctgttta

SEQ ID NO: 6565746 - DNA, 18 bp, Homo sapiens
tttgtctgtttgtttcaa

SEQ ID NO: 6565747 - DNA, 18 bp, Homo sapiens
tttgtcttaaaaaatgtg

SEQ ID NO: 6565748 - DNA, 12 bp, Homo sapiens
tttgtcttaagt

SEQ ID NO: 6565749 - DNA, 20 bp, Homo sapiens
tttgtcttatcccccccagc

SEQ ID NO: 6565750 - DNA, 14 bp, Homo sapiens
tttgtcttattctt

SEQ ID NO: 6565751 - DNA, 17 bp, Homo sapiens
tttgtcttattcttaag

SEQ ID NO: 6565752 - DNA, 14 bp, Homo sapiens
tttgtcttattgaa

SEQ ID NO: 6565753 - DNA, 19 bp, Homo sapiens
tttgtcttcagattattaa

SEQ ID NO: 6565754 - DNA, 14 bp, Homo sapiens
tttgtcttctataa

SEQ ID NO: 6565755 - DNA, 16 bp, Homo sapiens
tttgtcttctccccag

SEQ ID NO: 6565756 - DNA, 21 bp, Homo sapiens
tttgtcttgcatttttttcct

SEQ ID NO: 6565757 - DNA, 17 bp, Homo sapiens
tttgtctttaactgtca

SEQ ID NO: 6565758 - DNA, 15 bp, Homo sapiens
tttgtctttctattc

SEQ ID NO: 6565759 - DNA, 13 bp, Homo sapiens
tttgtctttgaat

SEQ ID NO: 6565760 - DNA, 16 bp, Homo sapiens
tttgtctttttccttt

SEQ ID NO: 6565761 - DNA, 12 bp, Homo sapiens
tttgtgaaattt

SEQ ID NO: 6565762 - DNA, 16 bp, Homo sapiens
tttgtgaaatttcatg

SEQ ID NO: 6565763 - DNA, 19 bp, Homo sapiens
tttgtgaaatttcatgaaa

SEQ ID NO: 6565764 - DNA, 21 bp, Homo sapiens
tttgtgaaatttcatgaaaac

SEQ ID NO: 6565765 - DNA, 17 bp, Homo sapiens
tttgtgaaatttttcat

SEQ ID NO: 6565766 - DNA, 18 bp, Homo sapiens
tttgtgaaatttttcata

SEQ ID NO: 6565767 - DNA, 18 bp, Homo sapiens
tttgtgaacgctgtgatg

SEQ ID NO: 6565768 - DNA, 18 bp, Homo sapiens
tttgtgaactggaagaaa

SEQ ID NO: 6565769 - DNA, 13 bp, Homo sapiens
tttgtgaactgtc

SEQ ID NO: 6565770 - DNA, 19 bp, Homo sapiens
tttgtgaactgtcatgata

SEQ ID NO: 6565771 - DNA, 15 bp, Homo sapiens
tttgtgaagaaacat

SEQ ID NO: 6565772 - DNA, 14 bp, Homo sapiens
tttgtgaagccctg

SEQ ID NO: 6565773 - DNA, 15 bp, Homo sapiens
tttgtgaagccctgt

SEQ ID NO: 6565774 - DNA, 14 bp, Homo sapiens
tttgtgaagtgatt

SEQ ID NO: 6565775 - DNA, 21 bp, Homo sapiens
tttgtgaagtgattgacattt

SEQ ID NO: 6565776 - DNA, 13 bp, Homo sapiens
tttgtgaattaac

SEQ ID NO: 6565777 - DNA, 18 bp, Homo sapiens
tttgtgaattaacacagt

SEQ ID NO: 6565778 - DNA, 15 bp, Homo sapiens
tttgtgactgtcact

SEQ ID NO: 6565779 - DNA, 22 bp, Homo sapiens
tttgtgagaaagagattcttgc

SEQ ID NO: 6565780 - DNA, 16 bp, Homo sapiens
tttgtgagcctatgat

SEQ ID NO: 6565781 - DNA, 16 bp, Homo sapiens
tttgtgagccttgctg

SEQ ID NO: 6565782 - DNA, 22 bp, Homo sapiens
tttgtgagccttgctgccaagt

SEQ ID NO: 6565783 - DNA, 18 bp, Homo sapiens
tttgtgagctttttgttc

SEQ ID NO: 6565784 - DNA, 15 bp, Homo sapiens
tttgtgagtatgtgt

SEQ ID NO: 6565785 - DNA, 23 bp, Homo sapiens
tttgtgagtgactcggtgtaaaa

SEQ ID NO: 6565786 - DNA, 15 bp, Homo sapiens
tttgtgagtttgttt

SEQ ID NO: 6565787 - DNA, 16 bp, Homo sapiens
tttgtgagtttgtttc

SEQ ID NO: 6565788 - DNA, 16 bp, Homo sapiens
tttgtgatacaatgct

SEQ ID NO: 6565789 - DNA, 20 bp, Homo sapiens
tttgtgatatggagccctgt

SEQ ID NO: 6565790 - DNA, 18 bp, Homo sapiens
tttgtgatcagcattgtg

SEQ ID NO: 6565791 - DNA, 22 bp, Homo sapiens
tttgtgatgaataaaataatta

SEQ ID NO: 6565792 - DNA, 19 bp, Homo sapiens
tttgtgatgaatctacatt

SEQ ID NO: 6565793 - DNA, 20 bp, Homo sapiens
tttgtgatgaatctacattt

SEQ ID NO: 6565794 - DNA, 15 bp, Homo sapiens
tttgtgatggtctct

SEQ ID NO: 6565795 - DNA, 16 bp, Homo sapiens
tttgtgatgtactgta

SEQ ID NO: 6565796 - DNA, 14 bp, Homo sapiens
tttgtgattcttcc

SEQ ID NO: 6565797 - DNA, 17 bp, Homo sapiens
tttgtgatttagaactg

SEQ ID NO: 6565798 - DNA, 14 bp, Homo sapiens
tttgtgcaagacac

SEQ ID NO: 6565799 - DNA, 20 bp, Homo sapiens
tttgtgcatcagaaaatgca

SEQ ID NO: 6565800 - DNA, 11 bp, Homo sapiens
tttgtgcattc

SEQ ID NO: 6565801 - DNA, 13 bp, Homo sapiens
tttgtgcattctg

SEQ ID NO: 6565802 - DNA, 15 bp, Homo sapiens
tttgtgcattctttg

SEQ ID NO: 6565803 - DNA, 23 bp, Homo sapiens
tttgtgcattctttggtaatttt

SEQ ID NO: 6565804 - DNA, 21 bp, Homo sapiens
tttgtgccacacgcatgggca

SEQ ID NO: 6565805 - DNA, 22 bp, Homo sapiens
tttgtgccacacgcatgggcat

SEQ ID NO: 6565806 - DNA, 13 bp, Homo sapiens
tttgtgccagccg

SEQ ID NO: 6565807 - DNA, 21 bp, Homo sapiens
tttgtgccattatatttgcat

SEQ ID NO: 6565808 - DNA, 12 bp, Homo sapiens
tttgtgcctttg

SEQ ID NO: 6565809 - DNA, 14 bp, Homo sapiens
tttgtgctagaaat

SEQ ID NO: 6565810 - DNA, 23 bp, Homo sapiens
tttgtgctatcagactgtaggat

SEQ ID NO: 6565811 - DNA, 14 bp, Homo sapiens
tttgtgctcattta

SEQ ID NO: 6565812 - DNA, 21 bp, Homo sapiens
tttgtgctcatttaagtttca

SEQ ID NO: 6565813 - DNA, 16 bp, Homo sapiens
tttgtgctctttcctg

SEQ ID NO: 6565814 - DNA, 22 bp, Homo sapiens
tttgtgctgaatgttgggactg

SEQ ID NO: 6565815 - DNA, 21 bp, Homo sapiens
tttgtgctgcagacaaaaaga

SEQ ID NO: 6565816 - DNA, 16 bp, Homo sapiens
tttgtgctgctgagtc

SEQ ID NO: 6565817 - DNA, 13 bp, Homo sapiens
tttgtgctgtggg

SEQ ID NO: 6565818 - DNA, 22 bp, Homo sapiens
tttgtgctgtgggcagcaccct

SEQ ID NO: 6565819 - DNA, 16 bp, Homo sapiens
tttgtgcttgttcttc

SEQ ID NO: 6565820 - DNA, 18 bp, Homo sapiens
tttgtgctttgaaaaaaa

SEQ ID NO: 6565821 - DNA, 16 bp, Homo sapiens
tttgtgctttttgtca

SEQ ID NO: 6565822 - DNA, 11 bp, Homo sapiens
tttgtggaaaa

SEQ ID NO: 6565823 - DNA, 17 bp, Homo sapiens
tttgtggaaaataactc

SEQ ID NO: 6565824 - DNA, 14 bp, Homo sapiens
tttgtggaaactgt

SEQ ID NO: 6565825 - DNA, 20 bp, Homo sapiens
tttgtggaaagtcacaggtc

SEQ ID NO: 6565826 - DNA, 19 bp, Homo sapiens
tttgtggcaaaatattctt

SEQ ID NO: 6565827 - DNA, 14 bp, Homo sapiens
tttgtggcaattaa

SEQ ID NO: 6565828 - DNA, 17 bp, Homo sapiens
tttgtggcaccttttct

SEQ ID NO: 6565829 - DNA, 20 bp, Homo sapiens
tttgtggcagaagtgtttca

SEQ ID NO: 6565830 - DNA, 19 bp, Homo sapiens
tttgtggcagattcaatat

SEQ ID NO: 6565831 - DNA, 21 bp, Homo sapiens
tttgtggccaaggagctgcta

SEQ ID NO: 6565832 - DNA, 22 bp, Homo sapiens
tttgtggccaaggagctgctat

SEQ ID NO: 6565833 - DNA, 23 bp, Homo sapiens
tttgtgggaggagtgacatgaag

SEQ ID NO: 6565834 - DNA, 20 bp, Homo sapiens
tttgtgggctggttgctgta

SEQ ID NO: 6565835 - DNA, 19 bp, Homo sapiens
tttgtgggcttaattgaaa

SEQ ID NO: 6565836 - DNA, 16 bp, Homo sapiens
tttgtggggctgggtg

SEQ ID NO: 6565837 - DNA, 19 bp, Homo sapiens
tttgtgggttggccaggag

SEQ ID NO: 6565838 - DNA, 21 bp, Homo sapiens
tttgtggtaacttgagattca

SEQ ID NO: 6565839 - DNA, 19 bp, Homo sapiens
tttgtggttatcactttaa

SEQ ID NO: 6565840 - DNA, 15 bp, Homo sapiens
tttgtggttctattt

SEQ ID NO: 6565841 - DNA, 21 bp, Homo sapiens
tttgtgtaaattattgatgaa

SEQ ID NO: 6565842 - DNA, 14 bp, Homo sapiens
tttgtgtactttta

SEQ ID NO: 6565843 - DNA, 12 bp, Homo sapiens
tttgtgtatgta

SEQ ID NO: 6565844 - DNA, 13 bp, Homo sapiens
tttgtgtatttaa

SEQ ID NO: 6565845 - DNA, 19 bp, Homo sapiens
tttgtgtcaataaagtcat

SEQ ID NO: 6565846 - DNA, 22 bp, Homo sapiens
tttgtgtcaatgggcaatgaca

SEQ ID NO: 6565847 - DNA, 21 bp, Homo sapiens
tttgtgtcatgtttaagaaat

SEQ ID NO: 6565848 - DNA, 22 bp, Homo sapiens
tttgtgtcccattcacatgccc

SEQ ID NO: 6565849 - DNA, 19 bp, Homo sapiens
tttgtgtcctccaggagct

SEQ ID NO: 6565850 - DNA, 15 bp, Homo sapiens
tttgtgtctatgatg

SEQ ID NO: 6565851 - DNA, 18 bp, Homo sapiens
tttgtgtctgtcatttct

SEQ ID NO: 6565852 - DNA, 17 bp, Homo sapiens
tttgtgtctttgtctgg

SEQ ID NO: 6565853 - DNA, 12 bp, Homo sapiens
tttgtgtgagag

SEQ ID NO: 6565854 - DNA, 15 bp, Homo sapiens
tttgtgtgatttcct

SEQ ID NO: 6565855 - DNA, 23 bp, Homo sapiens
tttgtgtgcaggctgtctcattt

SEQ ID NO: 6565856 - DNA, 16 bp, Homo sapiens
tttgtgtgctctccat

SEQ ID NO: 6565857 - DNA, 13 bp, Homo sapiens
tttgtgtgcttca

SEQ ID NO: 6565858 - DNA, 12 bp, Homo sapiens
tttgtgtggctc

SEQ ID NO: 6565859 - DNA, 14 bp, Homo sapiens
tttgtgtgtagtct

SEQ ID NO: 6565860 - DNA, 13 bp, Homo sapiens
tttgtgtgtatat

SEQ ID NO: 6565861 - DNA, 15 bp, Homo sapiens
tttgtgtgtatatat

SEQ ID NO: 6565862 - DNA, 14 bp, Homo sapiens
tttgtgtgtatttg

SEQ ID NO: 6565863 - DNA, 16 bp, Homo sapiens
tttgtgtgtatttgct

SEQ ID NO: 6565864 - DNA, 23 bp, Homo sapiens
tttgtgtgtcttttataaaaagt

SEQ ID NO: 6565865 - DNA, 18 bp, Homo sapiens
tttgtgtgttacaatgta

SEQ ID NO: 6565866 - DNA, 23 bp, Homo sapiens
tttgtgtgttcactaaactctga

SEQ ID NO: 6565867 - DNA, 14 bp, Homo sapiens
tttgtgtgttggca

SEQ ID NO: 6565868 - DNA, 16 bp, Homo sapiens
tttgtgttattcgtga

SEQ ID NO: 6565869 - DNA, 13 bp, Homo sapiens
tttgtgttccaaa

SEQ ID NO: 6565870 - DNA, 12 bp, Homo sapiens
tttgtgttctgt

SEQ ID NO: 6565871 - DNA, 13 bp, Homo sapiens
tttgtgttctgtt

SEQ ID NO: 6565872 - DNA, 14 bp, Homo sapiens
tttgtgttcttctt

SEQ ID NO: 6565873 - DNA, 21 bp, Homo sapiens
tttgtgttgggggaaatgttg

SEQ ID NO: 6565874 - DNA, 17 bp, Homo sapiens
tttgtgttgtaattctt

SEQ ID NO: 6565875 - DNA, 23 bp, Homo sapiens
tttgtgttgtaattcttcagttg

SEQ ID NO: 6565876 - DNA, 14 bp, Homo sapiens
tttgtgttgtttga

SEQ ID NO: 6565877 - DNA, 16 bp, Homo sapiens
tttgtgtttacttttt

SEQ ID NO: 6565878 - DNA, 12 bp, Homo sapiens
tttgtgtttatg

SEQ ID NO: 6565879 - DNA, 15 bp, Homo sapiens
tttgtgtttattctt

SEQ ID NO: 6565880 - DNA, 22 bp, Homo sapiens
tttgtgtttattcttgatgaaa

SEQ ID NO: 6565881 - DNA, 13 bp, Homo sapiens
tttgtgtttcaga

SEQ ID NO: 6565882 - DNA, 15 bp, Homo sapiens
tttgtgtttccattt

SEQ ID NO: 6565883 - DNA, 12 bp, Homo sapiens
tttgtgtttcta

SEQ ID NO: 6565884 - DNA, 18 bp, Homo sapiens
tttgtgtttgattggctt

SEQ ID NO: 6565885 - DNA, 21 bp, Homo sapiens
tttgtgtttggtttacattta

SEQ ID NO: 6565886 - DNA, 15 bp, Homo sapiens
tttgtgttttaaaaa

SEQ ID NO: 6565887 - DNA, 16 bp, Homo sapiens
tttgtgtttttctata

SEQ ID NO: 6565888 - DNA, 21 bp, Homo sapiens
tttgttaaaactggcatctga

SEQ ID NO: 6565889 - DNA, 24 bp, Homo sapiens
tttgttaaaatacagttctgtcat

SEQ ID NO: 6565890 - DNA, 18 bp, Homo sapiens
tttgttaaaatatagtgt

SEQ ID NO: 6565891 - DNA, 12 bp, Homo sapiens
tttgttaaagct

SEQ ID NO: 6565892 - DNA, 19 bp, Homo sapiens
tttgttaaccttaaataca

SEQ ID NO: 6565893 - DNA, 18 bp, Homo sapiens
tttgttaaggtcctgaaa

SEQ ID NO: 6565894 - DNA, 18 bp, Homo sapiens
tttgttaataataagata

SEQ ID NO: 6565895 - DNA, 15 bp, Homo sapiens
tttgttaatatttct

SEQ ID NO: 6565896 - DNA, 13 bp, Homo sapiens
tttgttaatcatc

SEQ ID NO: 6565897 - DNA, 21 bp, Homo sapiens
tttgttaatgcattgttgtaa

SEQ ID NO: 6565898 - DNA, 20 bp, Homo sapiens
tttgttaattaaatatttct

SEQ ID NO: 6565899 - DNA, 21 bp, Homo sapiens
tttgttaatttagaaaacttt

SEQ ID NO: 6565900 - DNA, 16 bp, Homo sapiens
tttgttacaataaaac

SEQ ID NO: 6565901 - DNA, 22 bp, Homo sapiens
tttgttaccatactgtctctgg

SEQ ID NO: 6565902 - DNA, 18 bp, Homo sapiens
tttgttaccttaaaacta

SEQ ID NO: 6565903 - DNA, 9 bp, Homo sapiens
tttgttact

SEQ ID NO: 6565904 - DNA, 23 bp, Homo sapiens
tttgttactgattcaattataat

SEQ ID NO: 6565905 - DNA, 15 bp, Homo sapiens
tttgttactgtcatt

SEQ ID NO: 6565906 - DNA, 22 bp, Homo sapiens
tttgttactgtctgtagtgttt

SEQ ID NO: 6565907 - DNA, 17 bp, Homo sapiens
tttgttactgttcttgc

SEQ ID NO: 6565908 - DNA, 20 bp, Homo sapiens
tttgttactgttcttgctgc

SEQ ID NO: 6565909 - DNA, 15 bp, Homo sapiens
tttgttactgtttta

SEQ ID NO: 6565910 - DNA, 16 bp, Homo sapiens
tttgttactgttttaa

SEQ ID NO: 6565911 - DNA, 15 bp, Homo sapiens
tttgttacttcctta

SEQ ID NO: 6565912 - DNA, 16 bp, Homo sapiens
tttgttacttccttat

SEQ ID NO: 6565913 - DNA, 12 bp, Homo sapiens
tttgttactttg

SEQ ID NO: 6565914 - DNA, 15 bp, Homo sapiens
tttgttactttgaat

SEQ ID NO: 6565915 - DNA, 20 bp, Homo sapiens
tttgttaggatagatcttaa

SEQ ID NO: 6565916 - DNA, 14 bp, Homo sapiens
tttgttaggttttc

SEQ ID NO: 6565917 - DNA, 17 bp, Homo sapiens
tttgttataattttcct

SEQ ID NO: 6565918 - DNA, 19 bp, Homo sapiens
tttgttatacatttaaaga

SEQ ID NO: 6565919 - DNA, 13 bp, Homo sapiens
tttgttatagatt

SEQ ID NO: 6565920 - DNA, 19 bp, Homo sapiens
tttgttatagttcatagtt

SEQ ID NO: 6565921 - DNA, 18 bp, Homo sapiens
tttgttatcagtacaatt

SEQ ID NO: 6565922 - DNA, 12 bp, Homo sapiens
tttgttatgaca

SEQ ID NO: 6565923 - DNA, 20 bp, Homo sapiens
tttgttattccatcaataaa

SEQ ID NO: 6565924 - DNA, 23 bp, Homo sapiens
tttgttattccatcaataaatgc

SEQ ID NO: 6565925 - DNA, 13 bp, Homo sapiens
ttcaaagtgttat

SEQ ID NO: 6565926 - DNA, 22 bp, Homo sapiens
ttcaaagtgttgtgttcctggc

SEQ ID NO: 6565927 - DNA, 16 bp, Homo sapiens
ttcaaagttgcctaaa

SEQ ID NO: 6565928 - DNA, 16 bp, Homo sapiens
ttcaaagttttgttgt

SEQ ID NO: 6565929 - DNA, 23 bp, Homo sapiens
ttcaaataaagaaatttggtacc

SEQ ID NO: 6565930 - DNA, 11 bp, Homo sapiens
ttcaaataatc

SEQ ID NO: 6565931 - DNA, 14 bp, Homo sapiens
ttcaaataatgctt

SEQ ID NO: 6565932 - DNA, 12 bp, Homo sapiens
ttcaaatacaaa

SEQ ID NO: 6565933 - DNA, 18 bp, Homo sapiens
ttcaaatacaaagtaaat

SEQ ID NO: 6565934 - DNA, 18 bp, Homo sapiens
ttcaaatagatttttgat

SEQ ID NO: 6565935 - DNA, 18 bp, Homo sapiens
ttcaaatagggtctaact

SEQ ID NO: 6565936 - DNA, 19 bp, Homo sapiens
ttcaaatagggtctaactc

SEQ ID NO: 6565937 - DNA, 14 bp, Homo sapiens
ttcaaatagtatag

SEQ ID NO: 6565938 - DNA, 16 bp, Homo sapiens
ttcaaatagtatagaa

SEQ ID NO: 6565939 - DNA, 13 bp, Homo sapiens
ttcaaatatcaaa

SEQ ID NO: 6565940 - DNA, 18 bp, Homo sapiens
ttcaaatatcaaaaggaa

SEQ ID NO: 6565941 - DNA, 14 bp, Homo sapiens
ttcaaatatgtaaa

SEQ ID NO: 6565942 - DNA, 18 bp, Homo sapiens
ttcaaatatgtaaacttt

SEQ ID NO: 6565943 - DNA, 19 bp, Homo sapiens
ttcaaatatgtaaacttta

SEQ ID NO: 6565944 - DNA, 12 bp, Homo sapiens
ttcaaatattga

SEQ ID NO: 6565945 - DNA, 22 bp, Homo sapiens
ttcaaatcaatctgtaaaacta

SEQ ID NO: 6565946 - DNA, 23 bp, Homo sapiens
ttcaaatcagcaagcttgtagct

SEQ ID NO: 6565947 - DNA, 21 bp, Homo sapiens
ttcaaatcatgttttttctgc

SEQ ID NO: 6565948 - DNA, 12 bp, Homo sapiens
ttcaaatcctca

SEQ ID NO: 6565949 - DNA, 19 bp, Homo sapiens
ttcaaatcgtttatttcac

SEQ ID NO: 6565950 - DNA, 20 bp, Homo sapiens
ttcaaatctcagcaaagcta

SEQ ID NO: 6565951 - DNA, 19 bp, Homo sapiens
ttcaaatctcctctttgtg

SEQ ID NO: 6565952 - DNA, 13 bp, Homo sapiens
ttcaaatctggtc

SEQ ID NO: 6565953 - DNA, 16 bp, Homo sapiens
ttcaaatgaacacgtg

SEQ ID NO: 6565954 - DNA, 13 bp, Homo sapiens
ttcaaatgcaaaa

SEQ ID NO: 6565955 - DNA, 11 bp, Homo sapiens
ttcaaatgcat

SEQ ID NO: 6565956 - DNA, 13 bp, Homo sapiens
ttcaaatgcatga

SEQ ID NO: 6565957 - DNA, 14 bp, Homo sapiens
ttcaaatgcatgat

SEQ ID NO: 6565958 - DNA, 16 bp, Homo sapiens
ttcaaatgcatgatat

SEQ ID NO: 6565959 - DNA, 18 bp, Homo sapiens
ttcaaatgctttttgttt

SEQ ID NO: 6565960 - DNA, 23 bp, Homo sapiens
ttcaaatggcagcagttccatga

SEQ ID NO: 6565961 - DNA, 19 bp, Homo sapiens
ttcaaatggtttaacaaaa

SEQ ID NO: 6565962 - DNA, 12 bp, Homo sapiens
ttcaaatgtacc

SEQ ID NO: 6565963 - DNA, 11 bp, Homo sapiens
ttcaaatgtca

SEQ ID NO: 6565964 - DNA, 14 bp, Homo sapiens
ttcaaatgtcattt

SEQ ID NO: 6565965 - DNA, 11 bp, Homo sapiens
ttcaaatgtgc

SEQ ID NO: 6565966 - DNA, 18 bp, Homo sapiens
ttcaaatgtgcaatttgt

SEQ ID NO: 6565967 - DNA, 19 bp, Homo sapiens
ttcaaatgtgtaactttat

SEQ ID NO: 6565968 - DNA, 22 bp, Homo sapiens
ttcaaatgttagatattgctac

SEQ ID NO: 6565969 - DNA, 22 bp, Homo sapiens
ttcaaatgtttgaaaacaaaaa

SEQ ID NO: 6565970 - DNA, 13 bp, Homo sapiens
ttcaaattaaagt

SEQ ID NO: 6565971 - DNA, 21 bp, Homo sapiens
ttcaaattaaagtgctgttta

SEQ ID NO: 6565972 - DNA, 11 bp, Homo sapiens
ttcaaattatt

SEQ ID NO: 6565973 - DNA, 13 bp, Homo sapiens
ttcaaattatttt

SEQ ID NO: 6565974 - DNA, 20 bp, Homo sapiens
ttcaaattctgattattaca

SEQ ID NO: 6565975 - DNA, 15 bp, Homo sapiens
ttcaaattgaatttg

SEQ ID NO: 6565976 - DNA, 22 bp, Homo sapiens
ttcaaattggaatggaactact

SEQ ID NO: 6565977 - DNA, 21 bp, Homo sapiens
ttcaaattggtctgaaaggct

SEQ ID NO: 6565978 - DNA, 13 bp, Homo sapiens
ttcaaatttgatt

SEQ ID NO: 6565979 - DNA, 13 bp, Homo sapiens
ttcaaatttgtac

SEQ ID NO: 6565980 - DNA, 16 bp, Homo sapiens
ttcaaatttgtacagg

SEQ ID NO: 6565981 - DNA, 11 bp, Homo sapiens
ttcaacaaatg

SEQ ID NO: 6565982 - DNA, 16 bp, Homo sapiens
ttcaacaaatttcatt

SEQ ID NO: 6565983 - DNA, 18 bp, Homo sapiens
ttcaacaaatttcattgc

SEQ ID NO: 6565984 - DNA, 23 bp, Homo sapiens
ttcaacaaatttcattgcacttt

SEQ ID NO: 6565985 - DNA, 18 bp, Homo sapiens
ttcaacaacaaaacattt

SEQ ID NO: 6565986 - DNA, 21 bp, Homo sapiens
ttcaacaacgtgagagaaaga

SEQ ID NO: 6565987 - DNA, 20 bp, Homo sapiens
ttcaacaacgttcttagttt

SEQ ID NO: 6565988 - DNA, 18 bp, Homo sapiens
ttcaacaactttgtgctt

SEQ ID NO: 6565989 - DNA, 19 bp, Homo sapiens
ttcaacaattctaaaatga

SEQ ID NO: 6565990 - DNA, 13 bp, Homo sapiens
ttcaacaattggt

SEQ ID NO: 6565991 - DNA, 23 bp, Homo sapiens
ttcaacaattggtgtcattttct

SEQ ID NO: 6565992 - DNA, 17 bp, Homo sapiens
ttcaacacagcttgtct

SEQ ID NO: 6565993 - DNA, 21 bp, Homo sapiens
ttcaacacattacttgcacaa

SEQ ID NO: 6565994 - DNA, 22 bp, Homo sapiens
ttcaacacattacttgcacaag

SEQ ID NO: 6565995 - DNA, 16 bp, Homo sapiens
ttcaacactagcattt

SEQ ID NO: 6565996 - DNA, 19 bp, Homo sapiens
ttcaacactgaaaaaatac

SEQ ID NO: 6565997 - DNA, 15 bp, Homo sapiens
ttcaacacttatttt

SEQ ID NO: 6565998 - DNA, 23 bp, Homo sapiens
ttcaacagaccccctctagaaat

SEQ ID NO: 6565999 - DNA, 20 bp, Homo sapiens
ttcaacagcaagtgtgaata

SEQ ID NO: 6566000 - DNA, 15 bp, Homo sapiens
ttcaacagggaagaa

SEQ ID NO: 6566001 - DNA, 19 bp, Homo sapiens
ttcaacagtgaagacagaa

SEQ ID NO: 6566002 - DNA, 15 bp, Homo sapiens
ttcaacataaagagc

SEQ ID NO: 6566003 - DNA, 14 bp, Homo sapiens
ttcaacatatgaat

SEQ ID NO: 6566004 - DNA, 17 bp, Homo sapiens
ttcaacatcctgccagc

SEQ ID NO: 6566005 - DNA, 21 bp, Homo sapiens
ttcaacatcctgccagcccca

SEQ ID NO: 6566006 - DNA, 21 bp, Homo sapiens
ttcaacatgttatttgtaata

SEQ ID NO: 6566007 - DNA, 15 bp, Homo sapiens
ttcaacattaaggca

SEQ ID NO: 6566008 - DNA, 15 bp, Homo sapiens
ttcaacatttcttga

SEQ ID NO: 6566009 - DNA, 20 bp, Homo sapiens
ttcaacatttttttttctcc

SEQ ID NO: 6566010 - DNA, 21 bp, Homo sapiens
ttcaaccaactgtaatgcagg

SEQ ID NO: 6566011 - DNA, 17 bp, Homo sapiens
ttcaaccacgcaggaag

SEQ ID NO: 6566012 - DNA, 18 bp, Homo sapiens
ttcaaccagcattttact

SEQ ID NO: 6566013 - DNA, 23 bp, Homo sapiens
ttcaaccagcattttactacttg

SEQ ID NO: 6566014 - DNA, 22 bp, Homo sapiens
ttcaaccagcctacaagctggc

SEQ ID NO: 6566015 - DNA, 16 bp, Homo sapiens
ttcaaccataaaagaa

SEQ ID NO: 6566016 - DNA, 16 bp, Homo sapiens
ttcaaccatgaagtct

SEQ ID NO: 6566017 - DNA, 15 bp, Homo sapiens
ttcaaccatggactt

SEQ ID NO: 6566018 - DNA, 17 bp, Homo sapiens
ttcaacccacagctact

SEQ ID NO: 6566019 - DNA, 20 bp, Homo sapiens
ttcaaccccaccctgtttgg

SEQ ID NO: 6566020 - DNA, 16 bp, Homo sapiens
ttcaaccctcagcctt

SEQ ID NO: 6566021 - DNA, 13 bp, Homo sapiens
ttcaaccctggag

SEQ ID NO: 6566022 - DNA, 15 bp, Homo sapiens
ttcaaccctggagag

SEQ ID NO: 6566023 - DNA, 17 bp, Homo sapiens
ttcaacctagaaacctt

SEQ ID NO: 6566024 - DNA, 20 bp, Homo sapiens
ttcaacctcagccctgaaaa

SEQ ID NO: 6566025 - DNA, 16 bp, Homo sapiens
ttcaaccttaccaaaa

SEQ ID NO: 6566026 - DNA, 18 bp, Homo sapiens
ttcaacgtttcttcactt

SEQ ID NO: 6566027 - DNA, 12 bp, Homo sapiens
ttcaactaatgt

SEQ ID NO: 6566028 - DNA, 17 bp, Homo sapiens
ttcaactacagtgattc

SEQ ID NO: 6566029 - DNA, 15 bp, Homo sapiens
ttcaactatgtaggt

SEQ ID NO: 6566030 - DNA, 16 bp, Homo sapiens
ttcaactatgtaggta

SEQ ID NO: 6566031 - DNA, 16 bp, Homo sapiens
ttcaactcagactagt

SEQ ID NO: 6566032 - DNA, 17 bp, Homo sapiens
ttcaactgaccagcctc

SEQ ID NO: 6566033 - DNA, 13 bp, Homo sapiens
ttcaactggaaat

SEQ ID NO: 6566034 - DNA, 13 bp, Homo sapiens
ttcaactggaaca

SEQ ID NO: 6566035 - DNA, 19 bp, Homo sapiens
ttcaactggttagtgtgaa

SEQ ID NO: 6566036 - DNA, 14 bp, Homo sapiens
ttcaactgtatacc

SEQ ID NO: 6566037 - DNA, 23 bp, Homo sapiens
ttcaactgtgctcttgttttgtc

SEQ ID NO: 6566038 - DNA, 14 bp, Homo sapiens
ttcaacttaaatca

SEQ ID NO: 6566039 - DNA, 14 bp, Homo sapiens
ttcaacttaactat

SEQ ID NO: 6566040 - DNA, 12 bp, Homo sapiens
ttcaacttattt

SEQ ID NO: 6566041 - DNA, 17 bp, Homo sapiens
ttcaacttatttaaatg

SEQ ID NO: 6566042 - DNA, 20 bp, Homo sapiens
ttcaacttatttaaatgaca

SEQ ID NO: 6566043 - DNA, 17 bp, Homo sapiens
ttcaacttatttcataa

SEQ ID NO: 6566044 - DNA, 14 bp, Homo sapiens
ttcaacttatttct

SEQ ID NO: 6566045 - DNA, 16 bp, Homo sapiens
ttcaacttatttctga

SEQ ID NO: 6566046 - DNA, 18 bp, Homo sapiens
ttcaacttggaaaaagaa

SEQ ID NO: 6566047 - DNA, 18 bp, Homo sapiens
ttcaacttgtgcctggga

SEQ ID NO: 6566048 - DNA, 22 bp, Homo sapiens
ttcaactttgaataaagaatac

SEQ ID NO: 6566049 - DNA, 12 bp, Homo sapiens
ttcaacttttcc

SEQ ID NO: 6566050 - DNA, 12 bp, Homo sapiens
ttcaacttttct

SEQ ID NO: 6566051 - DNA, 13 bp, Homo sapiens
ttcaacttttcta

SEQ ID NO: 6566052 - DNA, 16 bp, Homo sapiens
ttcaacttttctaaga

SEQ ID NO: 6566053 - DNA, 21 bp, Homo sapiens
ttcaagaaaaaataaatggaa

SEQ ID NO: 6566054 - DNA, 19 bp, Homo sapiens
ttcaagaaaagtaagccct

SEQ ID NO: 6566055 - DNA, 14 bp, Homo sapiens
ttcaagaaaatctt

SEQ ID NO: 6566056 - DNA, 20 bp, Homo sapiens
ttcaagaaaatctttgttga

SEQ ID NO: 6566057 - DNA, 17 bp, Homo sapiens
ttcaagaaaattttgca

SEQ ID NO: 6566058 - DNA, 18 bp, Homo sapiens
ttcaagaaaattttgcag

SEQ ID NO: 6566059 - DNA, 13 bp, Homo sapiens
ttcaagaaactga

SEQ ID NO: 6566060 - DNA, 20 bp, Homo sapiens
ttcaagaaagatatctatga

SEQ ID NO: 6566061 - DNA, 24 bp, Homo sapiens
ttcaagaaagatatctatgactgt

SEQ ID NO: 6566062 - DNA, 13 bp, Homo sapiens
ttcaagaaaggaa

SEQ ID NO: 6566063 - DNA, 20 bp, Homo sapiens
ttcaagaaaggcaagagctc

SEQ ID NO: 6566064 - DNA, 15 bp, Homo sapiens
ttcaagaacttctcg

SEQ ID NO: 6566065 - DNA, 14 bp, Homo sapiens
ttcaagaacttgtt

SEQ ID NO: 6566066 - DNA, 18 bp, Homo sapiens
ttcaagaagtaatcagta

SEQ ID NO: 6566067 - DNA, 19 bp, Homo sapiens
ttcaagaagtaatcagtat

SEQ ID NO: 6566068 - DNA, 22 bp, Homo sapiens
ttcaagaagtaatcagtatgca

SEQ ID NO: 6566069 - DNA, 21 bp, Homo sapiens
ttcaagaatgaaaaatataat

SEQ ID NO: 6566070 - DNA, 13 bp, Homo sapiens
ttcaagaatgttt

SEQ ID NO: 6566071 - DNA, 13 bp, Homo sapiens
ttcaagaccagcc

SEQ ID NO: 6566072 - DNA, 15 bp, Homo sapiens
ttcaagaccagcctg

SEQ ID NO: 6566073 - DNA, 16 bp, Homo sapiens
ttcaagaccagcctgg

SEQ ID NO: 6566074 - DNA, 21 bp, Homo sapiens
ttcaagacttgagcggagccc

SEQ ID NO: 6566075 - DNA, 16 bp, Homo sapiens
ttcaagagacactgct

SEQ ID NO: 6566076 - DNA, 23 bp, Homo sapiens
ttcaagagactctcctgcctcag

SEQ ID NO: 6566077 - DNA, 23 bp, Homo sapiens
ttcaagaggaaaggcgcccccgc

SEQ ID NO: 6566078 - DNA, 21 bp, Homo sapiens
ttcaagagtggggggaggaag

SEQ ID NO: 6566079 - DNA, 15 bp, Homo sapiens
ttcaagataaggaga

SEQ ID NO: 6566080 - DNA, 21 bp, Homo sapiens
ttcaagatacatgttgtattt

SEQ ID NO: 6566081 - DNA, 14 bp, Homo sapiens
ttcaagatccaaat

SEQ ID NO: 6566082 - DNA, 18 bp, Homo sapiens
ttcaagatcttcaaccat

SEQ ID NO: 6566083 - DNA, 14 bp, Homo sapiens
ttcaagatgagcct

SEQ ID NO: 6566084 - DNA, 23 bp, Homo sapiens
ttcaagatgagcctgggctcata

SEQ ID NO: 6566085 - DNA, 18 bp, Homo sapiens
ttcaagatgttatattaa

SEQ ID NO: 6566086 - DNA, 20 bp, Homo sapiens
ttcaagatgttatattaaag

SEQ ID NO: 6566087 - DNA, 21 bp, Homo sapiens
ttcaagattggacatggtctc

SEQ ID NO: 6566088 - DNA, 16 bp, Homo sapiens
ttcaagattgttgata

SEQ ID NO: 6566089 - DNA, 15 bp, Homo sapiens
ttcaagcaaaacagt

SEQ ID NO: 6566090 - DNA, 16 bp, Homo sapiens
ttcaagcaatcctccc

SEQ ID NO: 6566091 - DNA, 16 bp, Homo sapiens
ttcaagcaatcctcct

SEQ ID NO: 6566092 - DNA, 19 bp, Homo sapiens
ttcaagcacaacccaccac

SEQ ID NO: 6566093 - DNA, 16 bp, Homo sapiens
ttcaagcacctgcaga

SEQ ID NO: 6566094 - DNA, 17 bp, Homo sapiens
ttcaagcacttacagct

SEQ ID NO: 6566095 - DNA, 18 bp, Homo sapiens
ttcaagcatcctcagaag

SEQ ID NO: 6566096 - DNA, 12 bp, Homo sapiens
ttcaagcccagg

SEQ ID NO: 6566097 - DNA, 12 bp, Homo sapiens
ttcaagcctggc

SEQ ID NO: 6566098 - DNA, 23 bp, Homo sapiens
ttcaagcgattctcttgcctcag

SEQ ID NO: 6566099 - DNA, 14 bp, Homo sapiens
ttcaagctcaccct

SEQ ID NO: 6566100 - DNA, 14 bp, Homo sapiens
ttcaagctgagaaa

SEQ ID NO: 6566101 - DNA, 14 bp, Homo sapiens
ttcaagctgctttt

SEQ ID NO: 6566102 - DNA, 23 bp, Homo sapiens
ttcaagctgttatttcttccctg

SEQ ID NO: 6566103 - DNA, 14 bp, Homo sapiens
ttcaagcttatttt

SEQ ID NO: 6566104 - DNA, 19 bp, Homo sapiens
ttcaagcttattttggaga

SEQ ID NO: 6566105 - DNA, 13 bp, Homo sapiens
tttgttattctta

SEQ ID NO: 6566106 - DNA, 16 bp, Homo sapiens
tttgttattgttttgt

SEQ ID NO: 6566107 - DNA, 19 bp, Homo sapiens
tttgttatttgtacagttc

SEQ ID NO: 6566108 - DNA, 12 bp, Homo sapiens
tttgttattttg

SEQ ID NO: 6566109 - DNA, 14 bp, Homo sapiens
tttgttcaaagttg

SEQ ID NO: 6566110 - DNA, 23 bp, Homo sapiens
tttgttcaagttttgggtatgtt

SEQ ID NO: 6566111 - DNA, 21 bp, Homo sapiens
tttgttcaccttctgtgcatc

SEQ ID NO: 6566112 - DNA, 19 bp, Homo sapiens
tttgttcactgaaggtgat

SEQ ID NO: 6566113 - DNA, 18 bp, Homo sapiens
tttgttcataataaaagt

SEQ ID NO: 6566114 - DNA, 20 bp, Homo sapiens
tttgttcatgagtggatgga

SEQ ID NO: 6566115 - DNA, 14 bp, Homo sapiens
tttgttcattaaac

SEQ ID NO: 6566116 - DNA, 18 bp, Homo sapiens
tttgttccagaatctgta

SEQ ID NO: 6566117 - DNA, 18 bp, Homo sapiens
tttgttcccaaggacttc

SEQ ID NO: 6566118 - DNA, 13 bp, Homo sapiens
tttgttcccctcc

SEQ ID NO: 6566119 - DNA, 15 bp, Homo sapiens
tttgttcccctcctc

SEQ ID NO: 6566120 - DNA, 18 bp, Homo sapiens
tttgttcccctcctccac

SEQ ID NO: 6566121 - DNA, 14 bp, Homo sapiens
tttgttccttttgt

SEQ ID NO: 6566122 - DNA, 15 bp, Homo sapiens
tttgttccttttgta

SEQ ID NO: 6566123 - DNA, 15 bp, Homo sapiens
tttgttctactcctt

SEQ ID NO: 6566124 - DNA, 12 bp, Homo sapiens
tttgttctagac

SEQ ID NO: 6566125 - DNA, 13 bp, Homo sapiens
tttgttctagact

SEQ ID NO: 6566126 - DNA, 15 bp, Homo sapiens
tttgttctctcttgg

SEQ ID NO: 6566127 - DNA, 13 bp, Homo sapiens
tttgttctctggg

SEQ ID NO: 6566128 - DNA, 21 bp, Homo sapiens
tttgttctctgggagaaaatc

SEQ ID NO: 6566129 - DNA, 13 bp, Homo sapiens
tttgttctctgtc

SEQ ID NO: 6566130 - DNA, 23 bp, Homo sapiens
tttgttctgggttaacagtaaat

SEQ ID NO: 6566131 - DNA, 10 bp, Homo sapiens
tttgttctgt

SEQ ID NO: 6566132 - DNA, 13 bp, Homo sapiens
tttgttctgtata

SEQ ID NO: 6566133 - DNA, 15 bp, Homo sapiens
tttgttctgttctgg

SEQ ID NO: 6566134 - DNA, 13 bp, Homo sapiens
tttgttctgttgt

SEQ ID NO: 6566135 - DNA, 12 bp, Homo sapiens
tttgttctgttt

SEQ ID NO: 6566136 - DNA, 14 bp, Homo sapiens
tttgttcttaaaaa

SEQ ID NO: 6566137 - DNA, 15 bp, Homo sapiens
tttgttcttaaaaat

SEQ ID NO: 6566138 - DNA, 15 bp, Homo sapiens
tttgttcttcaagaa

SEQ ID NO: 6566139 - DNA, 14 bp, Homo sapiens
tttgttcttcagat

SEQ ID NO: 6566140 - DNA, 18 bp, Homo sapiens
tttgttcttgatggagat

SEQ ID NO: 6566141 - DNA, 13 bp, Homo sapiens
tttgttctttgcc

SEQ ID NO: 6566142 - DNA, 13 bp, Homo sapiens
tttgttctttgtt

SEQ ID NO: 6566143 - DNA, 14 bp, Homo sapiens
tttgttctttttat

SEQ ID NO: 6566144 - DNA, 22 bp, Homo sapiens
tttgttgaaaatggtttcaagt

SEQ ID NO: 6566145 - DNA, 19 bp, Homo sapiens
tttgttgacaaaattttct

SEQ ID NO: 6566146 - DNA, 23 bp, Homo sapiens
tttgttgagctggtaacatcgtt

SEQ ID NO: 6566147 - DNA, 16 bp, Homo sapiens
tttgttgagtctctga

SEQ ID NO: 6566148 - DNA, 16 bp, Homo sapiens
tttgttgattctctcc

SEQ ID NO: 6566149 - DNA, 17 bp, Homo sapiens
tttgttgcactgaagtt

SEQ ID NO: 6566150 - DNA, 18 bp, Homo sapiens
tttgttgcactgaagttt

SEQ ID NO: 6566151 - DNA, 19 bp, Homo sapiens
tttgttgccagatttcaga

SEQ ID NO: 6566152 - DNA, 14 bp, Homo sapiens
tttgttgccccaga

SEQ ID NO: 6566153 - DNA, 20 bp, Homo sapiens
tttgttgccttatcttgaaa

SEQ ID NO: 6566154 - DNA, 15 bp, Homo sapiens
tttgttggagatgca

SEQ ID NO: 6566155 - DNA, 22 bp, Homo sapiens
tttgttggcccttccagtggga

SEQ ID NO: 6566156 - DNA, 12 bp, Homo sapiens
tttgttggcttt

SEQ ID NO: 6566157 - DNA, 15 bp, Homo sapiens
tttgttgtaaagagt

SEQ ID NO: 6566158 - DNA, 16 bp, Homo sapiens
tttgttgtaaagagtt

SEQ ID NO: 6566159 - DNA, 13 bp, Homo sapiens
tttgttgtacttt

SEQ ID NO: 6566160 - DNA, 16 bp, Homo sapiens
tttgttgtactttata

SEQ ID NO: 6566161 - DNA, 13 bp, Homo sapiens
tttgttgtatttt

SEQ ID NO: 6566162 - DNA, 16 bp, Homo sapiens
tttgttgtcagctgaa

SEQ ID NO: 6566163 - DNA, 17 bp, Homo sapiens
tttgttgtcctcccagg

SEQ ID NO: 6566164 - DNA, 13 bp, Homo sapiens
tttgttgtgttct

SEQ ID NO: 6566165 - DNA, 16 bp, Homo sapiens
tttgttgtgttctgtt

SEQ ID NO: 6566166 - DNA, 19 bp, Homo sapiens
tttgttgttctttcagaaa

SEQ ID NO: 6566167 - DNA, 19 bp, Homo sapiens
tttgttgtttaacttgtct

SEQ ID NO: 6566168 - DNA, 12 bp, Homo sapiens
tttgttgtttat

SEQ ID NO: 6566169 - DNA, 14 bp, Homo sapiens
tttgtttaaaaagt

SEQ ID NO: 6566170 - DNA, 20 bp, Homo sapiens
tttgtttaaaaagtaataaa

SEQ ID NO: 6566171 - DNA, 16 bp, Homo sapiens
tttgtttaaagaataa

SEQ ID NO: 6566172 - DNA, 18 bp, Homo sapiens
tttgtttaaagaataaag

SEQ ID NO: 6566173 - DNA, 22 bp, Homo sapiens
tttgtttaatttttatttcttc

SEQ ID NO: 6566174 - DNA, 15 bp, Homo sapiens
tttgtttacaaacat

SEQ ID NO: 6566175 - DNA, 17 bp, Homo sapiens
tttgtttacaacacagt

SEQ ID NO: 6566176 - DNA, 18 bp, Homo sapiens
tttgtttacaacacagta

SEQ ID NO: 6566177 - DNA, 13 bp, Homo sapiens
tttgtttagaaaa

SEQ ID NO: 6566178 - DNA, 18 bp, Homo sapiens
tttgtttagaagtacgtt

SEQ ID NO: 6566179 - DNA, 21 bp, Homo sapiens
tttgtttagcctgaaaacctt

SEQ ID NO: 6566180 - DNA, 15 bp, Homo sapiens
tttgtttatgtaatt

SEQ ID NO: 6566181 - DNA, 18 bp, Homo sapiens
tttgtttcaaagggattg

SEQ ID NO: 6566182 - DNA, 22 bp, Homo sapiens
tttgtttcaatctctgactaaa

SEQ ID NO: 6566183 - DNA, 12 bp, Homo sapiens
tttgtttcatta

SEQ ID NO: 6566184 - DNA, 19 bp, Homo sapiens
tttgtttcccccacagttt

SEQ ID NO: 6566185 - DNA, 16 bp, Homo sapiens
tttgtttcctgtctga

SEQ ID NO: 6566186 - DNA, 14 bp, Homo sapiens
tttgtttctgaaag

SEQ ID NO: 6566187 - DNA, 12 bp, Homo sapiens
tttgtttctgta

SEQ ID NO: 6566188 - DNA, 13 bp, Homo sapiens
tttgtttctgtat

SEQ ID NO: 6566189 - DNA, 16 bp, Homo sapiens
tttgtttcttccaaag

SEQ ID NO: 6566190 - DNA, 17 bp, Homo sapiens
tttgtttctttctctga

SEQ ID NO: 6566191 - DNA, 14 bp, Homo sapiens
tttgtttgaactga

SEQ ID NO: 6566192 - DNA, 14 bp, Homo sapiens
tttgtttgaagttg

SEQ ID NO: 6566193 - DNA, 15 bp, Homo sapiens
tttgtttgaatgtta

SEQ ID NO: 6566194 - DNA, 13 bp, Homo sapiens
tttgtttgatgca

SEQ ID NO: 6566195 - DNA, 13 bp, Homo sapiens
tttgtttgcatca

SEQ ID NO: 6566196 - DNA, 11 bp, Homo sapiens
tttgtttgctt

SEQ ID NO: 6566197 - DNA, 14 bp, Homo sapiens
tttgtttgcttaat

SEQ ID NO: 6566198 - DNA, 15 bp, Homo sapiens
tttgtttggtattgt

SEQ ID NO: 6566199 - DNA, 16 bp, Homo sapiens
tttgtttggtattgta

SEQ ID NO: 6566200 - DNA, 22 bp, Homo sapiens
tttgtttggttatagtgcaata

SEQ ID NO: 6566201 - DNA, 18 bp, Homo sapiens
tttgtttgtaagtttgaa

SEQ ID NO: 6566202 - DNA, 18 bp, Homo sapiens
tttgtttgtattcatgtt

SEQ ID NO: 6566203 - DNA, 12 bp, Homo sapiens
tttgtttgtctc

SEQ ID NO: 6566204 - DNA, 12 bp, Homo sapiens
tttgtttgtgct

SEQ ID NO: 6566205 - DNA, 15 bp, Homo sapiens
tttgtttgtgcttct

SEQ ID NO: 6566206 - DNA, 13 bp, Homo sapiens
tttgtttgttctt

SEQ ID NO: 6566207 - DNA, 15 bp, Homo sapiens
tttgtttgtttaatt

SEQ ID NO: 6566208 - DNA, 14 bp, Homo sapiens
tttgtttgtttgca

SEQ ID NO: 6566209 - DNA, 15 bp, Homo sapiens
tttgtttgtttgggt

SEQ ID NO: 6566210 - DNA, 14 bp, Homo sapiens
tttgtttgttttgt

SEQ ID NO: 6566211 - DNA, 21 bp, Homo sapiens
tttgttttaaaataagttaaa

SEQ ID NO: 6566212 - DNA, 15 bp, Homo sapiens
tttgttttaaaatta

SEQ ID NO: 6566213 - DNA, 15 bp, Homo sapiens
tttgttttaaccaat

SEQ ID NO: 6566214 - DNA, 16 bp, Homo sapiens
tttgttttaataaaca

SEQ ID NO: 6566215 - DNA, 18 bp, Homo sapiens
tttgttttacaatgtcat

SEQ ID NO: 6566216 - DNA, 17 bp, Homo sapiens
tttgttttatttaggca

SEQ ID NO: 6566217 - DNA, 13 bp, Homo sapiens
tttgttttcattt

SEQ ID NO: 6566218 - DNA, 12 bp, Homo sapiens
tttgttttcctt

SEQ ID NO: 6566219 - DNA, 18 bp, Homo sapiens
tttgttttcggcagcctt

SEQ ID NO: 6566220 - DNA, 19 bp, Homo sapiens
tttgttttctgatgacata

SEQ ID NO: 6566221 - DNA, 16 bp, Homo sapiens
tttgttttcttcattt

SEQ ID NO: 6566222 - DNA, 18 bp, Homo sapiens
tttgttttcttcatttct

SEQ ID NO: 6566223 - DNA, 12 bp, Homo sapiens
tttgttttgcac

SEQ ID NO: 6566224 - DNA, 14 bp, Homo sapiens
tttgttttgcactg

SEQ ID NO: 6566225 - DNA, 15 bp, Homo sapiens
tttgttttgctgaga

SEQ ID NO: 6566226 - DNA, 10 bp, Homo sapiens
tttgttttgg

SEQ ID NO: 6566227 - DNA, 21 bp, Homo sapiens
tttgttttggattctttaaat

SEQ ID NO: 6566228 - DNA, 16 bp, Homo sapiens
tttgttttggctgctc

SEQ ID NO: 6566229 - DNA, 23 bp, Homo sapiens
tttgttttggggttttgttttgt

SEQ ID NO: 6566230 - DNA, 14 bp, Homo sapiens
tttgttttgtgtct

SEQ ID NO: 6566231 - DNA, 11 bp, Homo sapiens
tttgttttgtt

SEQ ID NO: 6566232 - DNA, 15 bp, Homo sapiens
tttgttttgttttgt

SEQ ID NO: 6566233 - DNA, 18 bp, Homo sapiens
tttgtttttaaaatagaa

SEQ ID NO: 6566234 - DNA, 23 bp, Homo sapiens
tttgtttttaaactgtacagtgt

SEQ ID NO: 6566235 - DNA, 17 bp, Homo sapiens
tttgtttttattaaaag

SEQ ID NO: 6566236 - DNA, 16 bp, Homo sapiens
tttgtttttatttctt

SEQ ID NO: 6566237 - DNA, 12 bp, Homo sapiens
tttgtttttcat

SEQ ID NO: 6566238 - DNA, 17 bp, Homo sapiens
tttgtttttccttccaa

SEQ ID NO: 6566239 - DNA, 15 bp, Homo sapiens
tttgtttttctgctt

SEQ ID NO: 6566240 - DNA, 13 bp, Homo sapiens
tttgtttttgcat

SEQ ID NO: 6566241 - DNA, 18 bp, Homo sapiens
tttgtttttgcatgaaat

SEQ ID NO: 6566242 - DNA, 16 bp, Homo sapiens
tttgtttttgcttgtt

SEQ ID NO: 6566243 - DNA, 17 bp, Homo sapiens
tttgtttttgctttctg

SEQ ID NO: 6566244 - DNA, 18 bp, Homo sapiens
tttgtttttgctttctga

SEQ ID NO: 6566245 - DNA, 19 bp, Homo sapiens
tttgtttttgtataggagc

SEQ ID NO: 6566246 - DNA, 16 bp, Homo sapiens
tttgttttttagcata

SEQ ID NO: 6566247 - DNA, 14 bp, Homo sapiens
tttgttttttcctt

SEQ ID NO: 6566248 - DNA, 19 bp, Homo sapiens
tttgttttttgaagtgttg

SEQ ID NO: 6566249 - DNA, 17 bp, Homo sapiens
tttgttttttgtaacta

SEQ ID NO: 6566250 - DNA, 16 bp, Homo sapiens
tttgtttttttccaac

SEQ ID NO: 6566251 - DNA, 17 bp, Homo sapiens
tttgtttttttgagatg

SEQ ID NO: 6566252 - DNA, 21 bp, Homo sapiens
tttgtttttttgcagaattaa

SEQ ID NO: 6566253 - DNA, 23 bp, Homo sapiens
tttgttttttttttaaaaaagac

SEQ ID NO: 6566254 - DNA, 21 bp, Homo sapiens
tttgtttttttttttttggta

SEQ ID NO: 6566255 - DNA, 21 bp, Homo sapiens
ttttaaaaaaaaaaacaaagc

SEQ ID NO: 6566256 - DNA, 14 bp, Homo sapiens
ttttaaaaaaaatg

SEQ ID NO: 6566257 - DNA, 17 bp, Homo sapiens
ttttaaaaaaactgaag

SEQ ID NO: 6566258 - DNA, 20 bp, Homo sapiens
ttttaaaaaaactgaaggtt

SEQ ID NO: 6566259 - DNA, 23 bp, Homo sapiens
ttttaaaaaaagctaaattacat

SEQ ID NO: 6566260 - DNA, 22 bp, Homo sapiens
ttttaaaaaaataaaacagtat

SEQ ID NO: 6566261 - DNA, 18 bp, Homo sapiens
ttttaaaaaaataatata

SEQ ID NO: 6566262 - DNA, 16 bp, Homo sapiens
ttttaaaaaaattcat

SEQ ID NO: 6566263 - DNA, 21 bp, Homo sapiens
ttttaaaaaaatttttataaa

SEQ ID NO: 6566264 - DNA, 22 bp, Homo sapiens
ttttaaaaaaatttttataaat

SEQ ID NO: 6566265 - DNA, 21 bp, Homo sapiens
ttttaaaaaataacatattct

SEQ ID NO: 6566266 - DNA, 17 bp, Homo sapiens
ttttaaaaaatacagta

SEQ ID NO: 6566267 - DNA, 19 bp, Homo sapiens
ttttaaaaaataccattga

SEQ ID NO: 6566268 - DNA, 23 bp, Homo sapiens
ttttaaaaaataccattgaaatc

SEQ ID NO: 6566269 - DNA, 24 bp, Homo sapiens
ttttaaaaaataccattgaaatca

SEQ ID NO: 6566270 - DNA, 15 bp, Homo sapiens
ttttaaaaaatatat

SEQ ID NO: 6566271 - DNA, 14 bp, Homo sapiens
ttttaaaaaatcaa

SEQ ID NO: 6566272 - DNA, 18 bp, Homo sapiens
ttttaaaaaatcaatcaa

SEQ ID NO: 6566273 - DNA, 22 bp, Homo sapiens
ttttaaaaaatgaaaataagtg

SEQ ID NO: 6566274 - DNA, 16 bp, Homo sapiens
ttttaaaaaatgcaga

SEQ ID NO: 6566275 - DNA, 21 bp, Homo sapiens
ttttaaaaaatgttttctggg

SEQ ID NO: 6566276 - DNA, 23 bp, Homo sapiens
ttttaaaaacactacttttgctt

SEQ ID NO: 6566277 - DNA, 19 bp, Homo sapiens
ttttaaaaacatagaaaaa

SEQ ID NO: 6566278 - DNA, 14 bp, Homo sapiens
ttttaaaaactctt

SEQ ID NO: 6566279 - DNA, 18 bp, Homo sapiens
ttttaaaaactcttcagt

SEQ ID NO: 6566280 - DNA, 21 bp, Homo sapiens
ttttaaaaagaaaatcagttg

SEQ ID NO: 6566281 - DNA, 16 bp, Homo sapiens
ttttaaaaaggccttt

SEQ ID NO: 6566282 - DNA, 17 bp, Homo sapiens
ttttaaaaaggtaaatg

SEQ ID NO: 6566283 - DNA, 21 bp, Homo sapiens
ttttaaaaaggtaaatggtta

SEQ ID NO: 6566284 - DNA, 21 bp, Homo sapiens
ttttaaaaagtattgccaaac

SEQ ID NO: 6566285 - DNA, 15 bp, Homo sapiens
ttttaaaaatacatt

SEQ ID NO: 6566286 - DNA, 15 bp, Homo sapiens
ttttaaaaatcataa

SEQ ID NO: 6566287 - DNA, 14 bp, Homo sapiens
ttttaaaaatgaag

SEQ ID NO: 6566288 - DNA, 16 bp, Homo sapiens
ttttaaaaatgaagat

SEQ ID NO: 6566289 - DNA, 14 bp, Homo sapiens
ttttaaaaatgcaa

SEQ ID NO: 6566290 - DNA, 23 bp, Homo sapiens
ttttaaaaatgtcctgcctttta

SEQ ID NO: 6566291 - DNA, 14 bp, Homo sapiens
ttttaaaaatgttt

SEQ ID NO: 6566292 - DNA, 15 bp, Homo sapiens
ttttaaaaatgtttg

SEQ ID NO: 6566293 - DNA, 22 bp, Homo sapiens
ttttaaaaattaaatcaacctt

SEQ ID NO: 6566294 - DNA, 20 bp, Homo sapiens
ttttaaaaattggaaactga

SEQ ID NO: 6566295 - DNA, 19 bp, Homo sapiens
ttttaaaaattgttattta

SEQ ID NO: 6566296 - DNA, 14 bp, Homo sapiens
ttttaaaacaaaag

SEQ ID NO: 6566297 - DNA, 12 bp, Homo sapiens
ttttaaaaccac

SEQ ID NO: 6566298 - DNA, 14 bp, Homo sapiens
ttttaaaacgtgta

SEQ ID NO: 6566299 - DNA, 20 bp, Homo sapiens
ttttaaaactacttagcact

SEQ ID NO: 6566300 - DNA, 13 bp, Homo sapiens
ttttaaaactgaa

SEQ ID NO: 6566301 - DNA, 13 bp, Homo sapiens
ttttaaaagaaaa

SEQ ID NO: 6566302 - DNA, 15 bp, Homo sapiens
ttttaaaagaatgat

SEQ ID NO: 6566303 - DNA, 11 bp, Homo sapiens
ttttaaaagac

SEQ ID NO: 6566304 - DNA, 15 bp, Homo sapiens
ttttaaaagacaaga

SEQ ID NO: 6566305 - DNA, 14 bp, Homo sapiens
ttttaaaagagaca

SEQ ID NO: 6566306 - DNA, 19 bp, Homo sapiens
ttttaaaagccacaggtgt

SEQ ID NO: 6566307 - DNA, 13 bp, Homo sapiens
ttttaaaagcctt

SEQ ID NO: 6566308 - DNA, 18 bp, Homo sapiens
ttttaaaagccttggcct

SEQ ID NO: 6566309 - DNA, 15 bp, Homo sapiens
ttttaaaaggtagag

SEQ ID NO: 6566310 - DNA, 22 bp, Homo sapiens
ttttaaaaggtagagtcttaca

SEQ ID NO: 6566311 - DNA, 15 bp, Homo sapiens
ttttaaaagtataca

SEQ ID NO: 6566312 - DNA, 18 bp, Homo sapiens
ttttaaaagtttcaatgt

SEQ ID NO: 6566313 - DNA, 21 bp, Homo sapiens
ttttaaaagtttcaatgtgat

SEQ ID NO: 6566314 - DNA, 19 bp, Homo sapiens
ttttaaaagttttgttctt

SEQ ID NO: 6566315 - DNA, 17 bp, Homo sapiens
ttttaaaataaactgta

SEQ ID NO: 6566316 - DNA, 22 bp, Homo sapiens
ttttaaaataaactgtaaacta

SEQ ID NO: 6566317 - DNA, 23 bp, Homo sapiens
ttttaaaataaactgtaaactaa

SEQ ID NO: 6566318 - DNA, 17 bp, Homo sapiens
ttttaaaataaggattt

SEQ ID NO: 6566319 - DNA, 12 bp, Homo sapiens
ttttaaaatact

SEQ ID NO: 6566320 - DNA, 19 bp, Homo sapiens
ttttaaaatactgtagata

SEQ ID NO: 6566321 - DNA, 16 bp, Homo sapiens
ttttaaaatagaatga

SEQ ID NO: 6566322 - DNA, 23 bp, Homo sapiens
ttttaaaatagaggctttgagca

SEQ ID NO: 6566323 - DNA, 21 bp, Homo sapiens
ttttaaaatatttgaatgaaa

SEQ ID NO: 6566324 - DNA, 16 bp, Homo sapiens
ttttaaaatcaactta

SEQ ID NO: 6566325 - DNA, 19 bp, Homo sapiens
ttttaaaatccagactttc

SEQ ID NO: 6566326 - DNA, 13 bp, Homo sapiens
ttttaaaatctga

SEQ ID NO: 6566327 - DNA, 20 bp, Homo sapiens
ttttaaaatctgagggaaat

SEQ ID NO: 6566328 - DNA, 16 bp, Homo sapiens
ttttaaaatctgattt

SEQ ID NO: 6566329 - DNA, 20 bp, Homo sapiens
ttttaaaatctgatttaatg

SEQ ID NO: 6566330 - DNA, 15 bp, Homo sapiens
ttttaaaatcttatt

SEQ ID NO: 6566331 - DNA, 17 bp, Homo sapiens
ttttaaaatcttttcta

SEQ ID NO: 6566332 - DNA, 18 bp, Homo sapiens
ttttaaaatgaataattt

SEQ ID NO: 6566333 - DNA, 23 bp, Homo sapiens
ttttaaaatgaatcttatgcaaa

SEQ ID NO: 6566334 - DNA, 12 bp, Homo sapiens
ttttaaaatgag

SEQ ID NO: 6566335 - DNA, 16 bp, Homo sapiens
ttttaaaatgcaatgt

SEQ ID NO: 6566336 - DNA, 21 bp, Homo sapiens
ttttaaaatgccgattacacc

SEQ ID NO: 6566337 - DNA, 21 bp, Homo sapiens
ttttaaaatggtgcttaagtt

SEQ ID NO: 6566338 - DNA, 15 bp, Homo sapiens
ttttaaaatgtacat

SEQ ID NO: 6566339 - DNA, 19 bp, Homo sapiens
ttttaaaatgttggtgcaa

SEQ ID NO: 6566340 - DNA, 21 bp, Homo sapiens
ttttaaaattatatagcaaag

SEQ ID NO: 6566341 - DNA, 14 bp, Homo sapiens
ttttaaaattcatg

SEQ ID NO: 6566342 - DNA, 15 bp, Homo sapiens
ttttaaaattgaata

SEQ ID NO: 6566343 - DNA, 18 bp, Homo sapiens
ttttaaaattggcctttt

SEQ ID NO: 6566344 - DNA, 23 bp, Homo sapiens
ttttaaaattgtgttcttaaaat

SEQ ID NO: 6566345 - DNA, 18 bp, Homo sapiens
ttttaaaatttatttgca

SEQ ID NO: 6566346 - DNA, 13 bp, Homo sapiens
ttttaaaatttta

SEQ ID NO: 6566347 - DNA, 14 bp, Homo sapiens
ttttaaacaaaata

SEQ ID NO: 6566348 - DNA, 23 bp, Homo sapiens
ttttaaacaaaatagaagctgta

SEQ ID NO: 6566349 - DNA, 15 bp, Homo sapiens
ttttaaacaaatgag

SEQ ID NO: 6566350 - DNA, 12 bp, Homo sapiens
ttttaaacagtg

SEQ ID NO: 6566351 - DNA, 19 bp, Homo sapiens
ttttaaacagtgagcctga

SEQ ID NO: 6566352 - DNA, 11 bp, Homo sapiens
ttttaaacata

SEQ ID NO: 6566353 - DNA, 20 bp, Homo sapiens
ttttaaacataacaatgtta

SEQ ID NO: 6566354 - DNA, 19 bp, Homo sapiens
ttttaaacataagctaaat

SEQ ID NO: 6566355 - DNA, 14 bp, Homo sapiens
ttttaaaccaaaac

SEQ ID NO: 6566356 - DNA, 22 bp, Homo sapiens
ttttaaactaagatctgttaaa

SEQ ID NO: 6566357 - DNA, 19 bp, Homo sapiens
ttttaaactacaggtagtt

SEQ ID NO: 6566358 - DNA, 12 bp, Homo sapiens
ttttaaactaga

SEQ ID NO: 6566359 - DNA, 15 bp, Homo sapiens
ttttaaactagatga

SEQ ID NO: 6566360 - DNA, 20 bp, Homo sapiens
ttttaaactgtacagtgtct

SEQ ID NO: 6566361 - DNA, 13 bp, Homo sapiens
ttttaaactgtgt

SEQ ID NO: 6566362 - DNA, 14 bp, Homo sapiens
ttttaaacttcagt

SEQ ID NO: 6566363 - DNA, 15 bp, Homo sapiens
ttttaaacttcagtt

SEQ ID NO: 6566364 - DNA, 13 bp, Homo sapiens
ttttaaacttgaa

SEQ ID NO: 6566365 - DNA, 15 bp, Homo sapiens
ttttaaagaaaagtt

SEQ ID NO: 6566366 - DNA, 19 bp, Homo sapiens
ttttaaagaaattttagta

SEQ ID NO: 6566367 - DNA, 11 bp, Homo sapiens
ttttaaagaag

SEQ ID NO: 6566368 - DNA, 16 bp, Homo sapiens
ttttaaagaagcttta

SEQ ID NO: 6566369 - DNA, 17 bp, Homo sapiens
ttttaaagaagtaaatt

SEQ ID NO: 6566370 - DNA, 11 bp, Homo sapiens
ttttaaagaat

SEQ ID NO: 6566371 - DNA, 23 bp, Homo sapiens
ttttaaagaatatgactttttat

SEQ ID NO: 6566372 - DNA, 14 bp, Homo sapiens
ttttaaagaatcca

SEQ ID NO: 6566373 - DNA, 21 bp, Homo sapiens
ttttaaagaatccaagacaaa

SEQ ID NO: 6566374 - DNA, 15 bp, Homo sapiens
ttttaaagaatgtta

SEQ ID NO: 6566375 - DNA, 13 bp, Homo sapiens
ttttaaagaattg

SEQ ID NO: 6566376 - DNA, 15 bp, Homo sapiens
ttttaaagatctgta

SEQ ID NO: 6566377 - DNA, 15 bp, Homo sapiens
ttttaaagcctggct

SEQ ID NO: 6566378 - DNA, 12 bp, Homo sapiens
ttttaaagcctt

SEQ ID NO: 6566379 - DNA, 14 bp, Homo sapiens
ttttaaagccttct

SEQ ID NO: 6566380 - DNA, 22 bp, Homo sapiens
ttttaaagctcgtagaaacaag

SEQ ID NO: 6566381 - DNA, 20 bp, Homo sapiens
ttttaaaggaaaaatcataa

SEQ ID NO: 6566382 - DNA, 16 bp, Homo sapiens
ttttaaaggacaaaca

SEQ ID NO: 6566383 - DNA, 17 bp, Homo sapiens
ttttaaaggacaaacag

SEQ ID NO: 6566384 - DNA, 13 bp, Homo sapiens
ttttaaaggcatt

SEQ ID NO: 6566385 - DNA, 16 bp, Homo sapiens
ttttaaaggctttttg

SEQ ID NO: 6566386 - DNA, 17 bp, Homo sapiens
ttttaaaggtagagatg

SEQ ID NO: 6566387 - DNA, 14 bp, Homo sapiens
ttttaaagtaaact

SEQ ID NO: 6566388 - DNA, 17 bp, Homo sapiens
ttttaaagtaaacttgt

SEQ ID NO: 6566389 - DNA, 19 bp, Homo sapiens
ttttaaagtaaacttgtgt

SEQ ID NO: 6566390 - DNA, 20 bp, Homo sapiens
ttttaaagtatttataaaaa

SEQ ID NO: 6566391 - DNA, 14 bp, Homo sapiens
ttttaaagtgcaaa

SEQ ID NO: 6566392 - DNA, 18 bp, Homo sapiens
ttttaaagttcattgcaa

SEQ ID NO: 6566393 - DNA, 19 bp, Homo sapiens
ttttaaagtttaaatacca

SEQ ID NO: 6566394 - DNA, 21 bp, Homo sapiens
ttttaaagttttgtcagaaaa

SEQ ID NO: 6566395 - DNA, 11 bp, Homo sapiens
ttttaaataaa

SEQ ID NO: 6566396 - DNA, 21 bp, Homo sapiens
ttttaaataaaagcacaagta

SEQ ID NO: 6566397 - DNA, 13 bp, Homo sapiens
ttttaaataaact

SEQ ID NO: 6566398 - DNA, 14 bp, Homo sapiens
ttttaaataaagca

SEQ ID NO: 6566399 - DNA, 21 bp, Homo sapiens
ttttaaataacctctggccct

SEQ ID NO: 6566400 - DNA, 13 bp, Homo sapiens
ttttaaataagat

SEQ ID NO: 6566401 - DNA, 22 bp, Homo sapiens
ttttaaataattgcatcagttc

SEQ ID NO: 6566402 - DNA, 14 bp, Homo sapiens
ttttaaatatgaac

SEQ ID NO: 6566403 - DNA, 17 bp, Homo sapiens
ttttaaatatgaacaaa

SEQ ID NO: 6566404 - DNA, 16 bp, Homo sapiens
ttttaaatattaactc

SEQ ID NO: 6566405 - DNA, 21 bp, Homo sapiens
ttttaaatcaaaaacttttca

SEQ ID NO: 6566406 - DNA, 19 bp, Homo sapiens
ttttaaatcctgttgaaaa

SEQ ID NO: 6566407 - DNA, 21 bp, Homo sapiens
ttttaaatctaaatctattta

SEQ ID NO: 6566408 - DNA, 23 bp, Homo sapiens
ttttaaatctgaaggttctggta

SEQ ID NO: 6566409 - DNA, 20 bp, Homo sapiens
ttttaaatctgcagcacatt

SEQ ID NO: 6566410 - DNA, 16 bp, Homo sapiens
ttttaaatctgcttta

SEQ ID NO: 6566411 - DNA, 14 bp, Homo sapiens
ttttaaatcttgac

SEQ ID NO: 6566412 - DNA, 17 bp, Homo sapiens
ttttaaatgaagtgatt

SEQ ID NO: 6566413 - DNA, 15 bp, Homo sapiens
ttttaaatgacattt

SEQ ID NO: 6566414 - DNA, 11 bp, Homo sapiens
ttttaaatgca

SEQ ID NO: 6566415 - DNA, 14 bp, Homo sapiens
ttttaaatgcacag

SEQ ID NO: 6566416 - DNA, 21 bp, Homo sapiens
ttttaaatgcacctggaatat

SEQ ID NO: 6566417 - DNA, 21 bp, Homo sapiens
ttttaaatgccacaagacata

SEQ ID NO: 6566418 - DNA, 20 bp, Homo sapiens
ttttaaatgctgtatgtcat

SEQ ID NO: 6566419 - DNA, 12 bp, Homo sapiens
ttttaaatggca

SEQ ID NO: 6566420 - DNA, 22 bp, Homo sapiens
ttttaaatgtgtgagtgcatgt

SEQ ID NO: 6566421 - DNA, 19 bp, Homo sapiens
ttttaaattataaggactg

SEQ ID NO: 6566422 - DNA, 12 bp, Homo sapiens
ttttaaattcca

SEQ ID NO: 6566423 - DNA, 13 bp, Homo sapiens
ttttaaattccac

SEQ ID NO: 6566424 - DNA, 19 bp, Homo sapiens
ttttaaattccactgaaaa

SEQ ID NO: 6566425 - DNA, 21 bp, Homo sapiens
ttttaaattccactgaaaatt

SEQ ID NO: 6566426 - DNA, 13 bp, Homo sapiens
ttttaaattcttt

SEQ ID NO: 6566427 - DNA, 13 bp, Homo sapiens
ttttaaattgcat

SEQ ID NO: 6566428 - DNA, 20 bp, Homo sapiens
ttttaaattggagaaaagca

SEQ ID NO: 6566429 - DNA, 24 bp, Homo sapiens
ttttaaattggagaaaagcactta

SEQ ID NO: 6566430 - DNA, 15 bp, Homo sapiens
ttttaaattgtttca

SEQ ID NO: 6566431 - DNA, 21 bp, Homo sapiens
ttttaaatttgccagttttat

SEQ ID NO: 6566432 - DNA, 13 bp, Homo sapiens
ttttaaattttat

SEQ ID NO: 6566433 - DNA, 14 bp, Homo sapiens
ttttaaattttctt

SEQ ID NO: 6566434 - DNA, 20 bp, Homo sapiens
ttttaaattttgtatgccaa

SEQ ID NO: 6566435 - DNA, 15 bp, Homo sapiens
ttttaacaaaaaagg

SEQ ID NO: 6566436 - DNA, 20 bp, Homo sapiens
ttttaacaaaaaaggaaaat

SEQ ID NO: 6566437 - DNA, 16 bp, Homo sapiens
ttttaacaagaagatg

SEQ ID NO: 6566438 - DNA, 16 bp, Homo sapiens
ttttaacaagaagcaa

SEQ ID NO: 6566439 - DNA, 21 bp, Homo sapiens
ttttaacaataactactgtgt

SEQ ID NO: 6566440 - DNA, 18 bp, Homo sapiens
ttttaacacacataaagg

SEQ ID NO: 6566441 - DNA, 20 bp, Homo sapiens
ttttaacacataactagaaa

SEQ ID NO: 6566442 - DNA, 23 bp, Homo sapiens
ttttaacacataactagaaacct

SEQ ID NO: 6566443 - DNA, 19 bp, Homo sapiens
ttttaacacctgatgtgta

SEQ ID NO: 6566444 - DNA, 20 bp, Homo sapiens
ttttaacacctgatgtgtac

SEQ ID NO: 6566445 - DNA, 19 bp, Homo sapiens
ttttaacacttaaatttct

SEQ ID NO: 6566446 - DNA, 15 bp, Homo sapiens
ttttaacactttgta

SEQ ID NO: 6566447 - DNA, 15 bp, Homo sapiens
ttttaacagcatgtg

SEQ ID NO: 6566448 - DNA, 14 bp, Homo sapiens
ttttaacagtttta

SEQ ID NO: 6566449 - DNA, 13 bp, Homo sapiens
ttttaacatagca

SEQ ID NO: 6566450 - DNA, 14 bp, Homo sapiens
ttttaacattcctc

SEQ ID NO: 6566451 - DNA, 23 bp, Homo sapiens
ttttaacatttatctaaaagaat

SEQ ID NO: 6566452 - DNA, 19 bp, Homo sapiens
ttttaacattttgttctta

SEQ ID NO: 6566453 - DNA, 21 bp, Homo sapiens
ttttaaccaaaggtgaaggaa

SEQ ID NO: 6566454 - DNA, 22 bp, Homo sapiens
ttttaaccagtacttctaagag

SEQ ID NO: 6566455 - DNA, 18 bp, Homo sapiens
ttttaaccatggcagggt

SEQ ID NO: 6566456 - DNA, 21 bp, Homo sapiens
ttttaaccattgtcttgttct

SEQ ID NO: 6566457 - DNA, 21 bp, Homo sapiens
ttttaaccccgtcaacaaatc

SEQ ID NO: 6566458 - DNA, 17 bp, Homo sapiens
ttttaaccctaatcttt

SEQ ID NO: 6566459 - DNA, 20 bp, Homo sapiens
ttttaacctaatatcactta

SEQ ID NO: 6566460 - DNA, 21 bp, Homo sapiens
ttttaacctcaggttccaaat

SEQ ID NO: 6566461 - DNA, 22 bp, Homo sapiens
ttttaacctgtatactcttgaa

SEQ ID NO: 6566462 - DNA, 24 bp, Homo sapiens
ttttaactaaattttaaagccatt

SEQ ID NO: 6566463 - DNA, 12 bp, Homo sapiens
ttttaactagaa

SEQ ID NO: 6566464 - DNA, 12 bp, Homo sapiens
ttttaactcacc

SEQ ID NO: 6566465 - DNA, 16 bp, Homo sapiens
ttttaactctggattt

SEQ ID NO: 6566466 - DNA, 19 bp, Homo sapiens
ttttaactctggattttga

SEQ ID NO: 6566467 - DNA, 18 bp, Homo sapiens
ttttaactcttttggaca

SEQ ID NO: 6566468 - DNA, 20 bp, Homo sapiens
ttcaagcttattttggagag

SEQ ID NO: 6566469 - DNA, 19 bp, Homo sapiens
ttcaagcttttcctttctt

SEQ ID NO: 6566470 - DNA, 12 bp, Homo sapiens
ttcaaggaaagt

SEQ ID NO: 6566471 - DNA, 14 bp, Homo sapiens
ttcaaggaacagcc

SEQ ID NO: 6566472 - DNA, 21 bp, Homo sapiens
ttcaaggaagtgataacactg

SEQ ID NO: 6566473 - DNA, 19 bp, Homo sapiens
ttcaaggaatttcttaact

SEQ ID NO: 6566474 - DNA, 17 bp, Homo sapiens
ttcaaggactgtttcag

SEQ ID NO: 6566475 - DNA, 17 bp, Homo sapiens
ttcaaggaggcccactg

SEQ ID NO: 6566476 - DNA, 14 bp, Homo sapiens
ttcaaggagggcac

SEQ ID NO: 6566477 - DNA, 21 bp, Homo sapiens
ttcaaggatatactgcagctt

SEQ ID NO: 6566478 - DNA, 18 bp, Homo sapiens
ttcaaggatcctgagcca

SEQ ID NO: 6566479 - DNA, 18 bp, Homo sapiens
ttcaaggatctcctgttt

SEQ ID NO: 6566480 - DNA, 22 bp, Homo sapiens
ttcaaggattgttaacatgcct

SEQ ID NO: 6566481 - DNA, 14 bp, Homo sapiens
ttcaaggcacattg

SEQ ID NO: 6566482 - DNA, 14 bp, Homo sapiens
ttcaaggcactcta

SEQ ID NO: 6566483 - DNA, 16 bp, Homo sapiens
ttcaaggcactctaga

SEQ ID NO: 6566484 - DNA, 19 bp, Homo sapiens
ttcaaggcactctagattc

SEQ ID NO: 6566485 - DNA, 11 bp, Homo sapiens
ttcaaggcaga

SEQ ID NO: 6566486 - DNA, 14 bp, Homo sapiens
ttcaaggcatttat

SEQ ID NO: 6566487 - DNA, 16 bp, Homo sapiens
ttcaaggcatttgtct

SEQ ID NO: 6566488 - DNA, 21 bp, Homo sapiens
ttcaaggccatattttaaaaa

SEQ ID NO: 6566489 - DNA, 12 bp, Homo sapiens
ttcaaggcctcc

SEQ ID NO: 6566490 - DNA, 12 bp, Homo sapiens
ttcaaggccttc

SEQ ID NO: 6566491 - DNA, 15 bp, Homo sapiens
ttcaaggccttcagt

SEQ ID NO: 6566492 - DNA, 19 bp, Homo sapiens
ttcaaggccttcagtttat

SEQ ID NO: 6566493 - DNA, 14 bp, Homo sapiens
ttcaaggccttcca

SEQ ID NO: 6566494 - DNA, 12 bp, Homo sapiens
ttcaaggcttca

SEQ ID NO: 6566495 - DNA, 16 bp, Homo sapiens
ttcaaggcttccactg

SEQ ID NO: 6566496 - DNA, 19 bp, Homo sapiens
ttcaaggctttaaaagtca

SEQ ID NO: 6566497 - DNA, 16 bp, Homo sapiens
ttcaagggaagaaaca

SEQ ID NO: 6566498 - DNA, 21 bp, Homo sapiens
ttcaagggaagaaacactctt

SEQ ID NO: 6566499 - DNA, 15 bp, Homo sapiens
ttcaagggaattaaa

SEQ ID NO: 6566500 - DNA, 24 bp, Homo sapiens
ttcaagggcctagatttggagact

SEQ ID NO: 6566501 - DNA, 22 bp, Homo sapiens
ttcaagggctttcctgtgccag

SEQ ID NO: 6566502 - DNA, 24 bp, Homo sapiens
ttcaaggggagccaaaatctcaag

SEQ ID NO: 6566503 - DNA, 14 bp, Homo sapiens
ttcaagggtaatct

SEQ ID NO: 6566504 - DNA, 16 bp, Homo sapiens
ttcaaggtaaaattct

SEQ ID NO: 6566505 - DNA, 19 bp, Homo sapiens
ttcaaggtaatttcttgtg

SEQ ID NO: 6566506 - DNA, 17 bp, Homo sapiens
ttcaaggtggccaaatt

SEQ ID NO: 6566507 - DNA, 15 bp, Homo sapiens
ttcaagtacactgaa

SEQ ID NO: 6566508 - DNA, 18 bp, Homo sapiens
ttcaagtattaagcagtt

SEQ ID NO: 6566509 - DNA, 16 bp, Homo sapiens
ttcaagtatttaagcc

SEQ ID NO: 6566510 - DNA, 22 bp, Homo sapiens
ttcaagtcatggggagattcct

SEQ ID NO: 6566511 - DNA, 23 bp, Homo sapiens
ttcaagtcattccacacatttcc

SEQ ID NO: 6566512 - DNA, 20 bp, Homo sapiens
ttcaagtctaccaattataa

SEQ ID NO: 6566513 - DNA, 21 bp, Homo sapiens
ttcaagtctgtgcctggagct

SEQ ID NO: 6566514 - DNA, 17 bp, Homo sapiens
ttcaagtgaatctaaaa

SEQ ID NO: 6566515 - DNA, 19 bp, Homo sapiens
ttcaagtgactctcctgcc

SEQ ID NO: 6566516 - DNA, 14 bp, Homo sapiens
ttcaagtgccaaac

SEQ ID NO: 6566517 - DNA, 12 bp, Homo sapiens
ttcaagtgccta

SEQ ID NO: 6566518 - DNA, 23 bp, Homo sapiens
ttcaagtgcctagactgttactt

SEQ ID NO: 6566519 - DNA, 23 bp, Homo sapiens
ttcaagtgcctttctgcagtttt

SEQ ID NO: 6566520 - DNA, 20 bp, Homo sapiens
ttcaagtgccttttgctgcg

SEQ ID NO: 6566521 - DNA, 23 bp, Homo sapiens
ttcaagtgccttttgctgcgcac

SEQ ID NO: 6566522 - DNA, 24 bp, Homo sapiens
ttcaagtgccttttgctgcgcacc

SEQ ID NO: 6566523 - DNA, 20 bp, Homo sapiens
ttcaagtgcttaaaaatact

SEQ ID NO: 6566524 - DNA, 18 bp, Homo sapiens
ttcaagtgtccccagacc

SEQ ID NO: 6566525 - DNA, 17 bp, Homo sapiens
ttcaagtgttttggtgt

SEQ ID NO: 6566526 - DNA, 13 bp, Homo sapiens
ttcaagttaaagt

SEQ ID NO: 6566527 - DNA, 23 bp, Homo sapiens
ttcaagttaccaatgtaacactg

SEQ ID NO: 6566528 - DNA, 13 bp, Homo sapiens
ttcaagttattca

SEQ ID NO: 6566529 - DNA, 19 bp, Homo sapiens
ttcaagttattcagaaata

SEQ ID NO: 6566530 - DNA, 14 bp, Homo sapiens
ttcaagttattgta

SEQ ID NO: 6566531 - DNA, 14 bp, Homo sapiens
ttcaagttcaatcc

SEQ ID NO: 6566532 - DNA, 19 bp, Homo sapiens
ttcaagttgcagtcagaag

SEQ ID NO: 6566533 - DNA, 12 bp, Homo sapiens
ttcaagttgtaa

SEQ ID NO: 6566534 - DNA, 22 bp, Homo sapiens
ttcaagttgtaaataatttatt

SEQ ID NO: 6566535 - DNA, 15 bp, Homo sapiens
ttcaagttttaaagt

SEQ ID NO: 6566536 - DNA, 20 bp, Homo sapiens
ttcaagtttttcatactgta

SEQ ID NO: 6566537 - DNA, 21 bp, Homo sapiens
ttcaataaaaaaaagaaatga

SEQ ID NO: 6566538 - DNA, 20 bp, Homo sapiens
ttcaataaaatgcactgacc

SEQ ID NO: 6566539 - DNA, 18 bp, Homo sapiens
ttcaataaagcatttata

SEQ ID NO: 6566540 - DNA, 13 bp, Homo sapiens
ttcaataaagctg

SEQ ID NO: 6566541 - DNA, 19 bp, Homo sapiens
ttcaataaagtactgcaaa

SEQ ID NO: 6566542 - DNA, 14 bp, Homo sapiens
ttcaataaagtatt

SEQ ID NO: 6566543 - DNA, 18 bp, Homo sapiens
ttcaataaagtatttaat

SEQ ID NO: 6566544 - DNA, 19 bp, Homo sapiens
ttcaataaagtatttaatt

SEQ ID NO: 6566545 - DNA, 15 bp, Homo sapiens
ttcaataaagttgtt

SEQ ID NO: 6566546 - DNA, 13 bp, Homo sapiens
ttcaataaatctt

SEQ ID NO: 6566547 - DNA, 18 bp, Homo sapiens
ttcaataaatctttcaaa

SEQ ID NO: 6566548 - DNA, 17 bp, Homo sapiens
ttcaataaatgatatat

SEQ ID NO: 6566549 - DNA, 17 bp, Homo sapiens
ttcaataaatgtatcat

SEQ ID NO: 6566550 - DNA, 17 bp, Homo sapiens
ttcaataacaaagcaca

SEQ ID NO: 6566551 - DNA, 16 bp, Homo sapiens
ttcaatacacagtact

SEQ ID NO: 6566552 - DNA, 12 bp, Homo sapiens
ttcaatacagat

SEQ ID NO: 6566553 - DNA, 18 bp, Homo sapiens
ttcaataccgctcagtat

SEQ ID NO: 6566554 - DNA, 14 bp, Homo sapiens
ttcaatagaacatg

SEQ ID NO: 6566555 - DNA, 14 bp, Homo sapiens
ttcaatagccacta

SEQ ID NO: 6566556 - DNA, 19 bp, Homo sapiens
ttcaatagccccatctctc

SEQ ID NO: 6566557 - DNA, 23 bp, Homo sapiens
ttcaatagccccatctctcctgc

SEQ ID NO: 6566558 - DNA, 12 bp, Homo sapiens
ttcaatagcttt

SEQ ID NO: 6566559 - DNA, 21 bp, Homo sapiens
ttcaatagtggcataccaaat

SEQ ID NO: 6566560 - DNA, 18 bp, Homo sapiens
ttcaatataagcttttct

SEQ ID NO: 6566561 - DNA, 17 bp, Homo sapiens
ttcaatatattgaactt

SEQ ID NO: 6566562 - DNA, 15 bp, Homo sapiens
ttcaatatcattact

SEQ ID NO: 6566563 - DNA, 17 bp, Homo sapiens
ttcaatatcattactaa

SEQ ID NO: 6566564 - DNA, 13 bp, Homo sapiens
ttcaatatgaagg

SEQ ID NO: 6566565 - DNA, 20 bp, Homo sapiens
ttcaatatgcaagcagcttt

SEQ ID NO: 6566566 - DNA, 19 bp, Homo sapiens
ttcaatattgaatttttcc

SEQ ID NO: 6566567 - DNA, 18 bp, Homo sapiens
ttcaatattgacatttgt

SEQ ID NO: 6566568 - DNA, 22 bp, Homo sapiens
ttcaatattgacatttgtagtt

SEQ ID NO: 6566569 - DNA, 20 bp, Homo sapiens
ttcaatatttagaaaatttt

SEQ ID NO: 6566570 - DNA, 16 bp, Homo sapiens
ttcaatattttctttt

SEQ ID NO: 6566571 - DNA, 16 bp, Homo sapiens
ttcaatcaaagctacc

SEQ ID NO: 6566572 - DNA, 18 bp, Homo sapiens
ttcaatcaaagctacctt

SEQ ID NO: 6566573 - DNA, 21 bp, Homo sapiens
ttcaatcaactttactgtaat

SEQ ID NO: 6566574 - DNA, 12 bp, Homo sapiens
ttcaatcactgt

SEQ ID NO: 6566575 - DNA, 17 bp, Homo sapiens
ttcaatcattgaagtat

SEQ ID NO: 6566576 - DNA, 16 bp, Homo sapiens
ttcaatccacagtatt

SEQ ID NO: 6566577 - DNA, 22 bp, Homo sapiens
ttcaatccacagtattgttctt

SEQ ID NO: 6566578 - DNA, 23 bp, Homo sapiens
ttcaatctcgtatagaagtcttc

SEQ ID NO: 6566579 - DNA, 12 bp, Homo sapiens
ttcaatctctgg

SEQ ID NO: 6566580 - DNA, 15 bp, Homo sapiens
ttcaatctctggaaa

SEQ ID NO: 6566581 - DNA, 23 bp, Homo sapiens
ttcaatctgaagatacatgtctt

SEQ ID NO: 6566582 - DNA, 15 bp, Homo sapiens
ttcaatctgtgaagc

SEQ ID NO: 6566583 - DNA, 14 bp, Homo sapiens
ttcaatctgtgtaa

SEQ ID NO: 6566584 - DNA, 22 bp, Homo sapiens
ttcaatctgtgtaagaaaacaa

SEQ ID NO: 6566585 - DNA, 20 bp, Homo sapiens
ttcaatcttcaatccttgaa

SEQ ID NO: 6566586 - DNA, 18 bp, Homo sapiens
ttcaatcttctactttta

SEQ ID NO: 6566587 - DNA, 20 bp, Homo sapiens
ttcaatgaaacaaagaaaga

SEQ ID NO: 6566588 - DNA, 21 bp, Homo sapiens
ttcaatgaacttccatttgta

SEQ ID NO: 6566589 - DNA, 18 bp, Homo sapiens
ttcaatgaatccccgacc

SEQ ID NO: 6566590 - DNA, 19 bp, Homo sapiens
ttcaatgaattaagaaaga

SEQ ID NO: 6566591 - DNA, 17 bp, Homo sapiens
ttcaatgacctgtattt

SEQ ID NO: 6566592 - DNA, 19 bp, Homo sapiens
ttcaatgattatttgtatt

SEQ ID NO: 6566593 - DNA, 14 bp, Homo sapiens
ttcaatgcaatgaa

SEQ ID NO: 6566594 - DNA, 22 bp, Homo sapiens
ttcaatgcaatgaaaacaaaat

SEQ ID NO: 6566595 - DNA, 14 bp, Homo sapiens
ttcaatgcaatgca

SEQ ID NO: 6566596 - DNA, 16 bp, Homo sapiens
ttcaatgcaatgcatc

SEQ ID NO: 6566597 - DNA, 19 bp, Homo sapiens
ttcaatgcatacaataaaa

SEQ ID NO: 6566598 - DNA, 23 bp, Homo sapiens
ttcaatgcatacaataaaagagc

SEQ ID NO: 6566599 - DNA, 19 bp, Homo sapiens
ttcaatgcccctgaattta

SEQ ID NO: 6566600 - DNA, 18 bp, Homo sapiens
ttcaatgcgttttgttgt

SEQ ID NO: 6566601 - DNA, 13 bp, Homo sapiens
ttcaatgctgcag

SEQ ID NO: 6566602 - DNA, 18 bp, Homo sapiens
ttcaatgggaagactcag

SEQ ID NO: 6566603 - DNA, 18 bp, Homo sapiens
ttcaatgggtaaataaat

SEQ ID NO: 6566604 - DNA, 19 bp, Homo sapiens
ttcaatgggtaaataaatg

SEQ ID NO: 6566605 - DNA, 21 bp, Homo sapiens
ttcaatgggtaaataaatgct

SEQ ID NO: 6566606 - DNA, 16 bp, Homo sapiens
ttcaatggttctgaaa

SEQ ID NO: 6566607 - DNA, 17 bp, Homo sapiens
ttcaatggttgggacaa

SEQ ID NO: 6566608 - DNA, 23 bp, Homo sapiens
ttcaatggttgggacaatggcaa

SEQ ID NO: 6566609 - DNA, 20 bp, Homo sapiens
ttcaatggtttgcaaggaag

SEQ ID NO: 6566610 - DNA, 18 bp, Homo sapiens
ttcaatgtccacctgtga

SEQ ID NO: 6566611 - DNA, 14 bp, Homo sapiens
ttcaatgtgtataa

SEQ ID NO: 6566612 - DNA, 21 bp, Homo sapiens
ttcaatgtgtataaattgtct

SEQ ID NO: 6566613 - DNA, 20 bp, Homo sapiens
ttcaatgtttttaaaaatct

SEQ ID NO: 6566614 - DNA, 16 bp, Homo sapiens
ttcaattaaaaccatt

SEQ ID NO: 6566615 - DNA, 12 bp, Homo sapiens
ttcaattaaaat

SEQ ID NO: 6566616 - DNA, 14 bp, Homo sapiens
ttcaattaaacgga

SEQ ID NO: 6566617 - DNA, 14 bp, Homo sapiens
ttcaattaaagaaa

SEQ ID NO: 6566618 - DNA, 14 bp, Homo sapiens
ttcaattaatggaa

SEQ ID NO: 6566619 - DNA, 16 bp, Homo sapiens
ttcaattacggactct

SEQ ID NO: 6566620 - DNA, 14 bp, Homo sapiens
ttcaattatgtttg

SEQ ID NO: 6566621 - DNA, 17 bp, Homo sapiens
ttcaattatgtttgaaa

SEQ ID NO: 6566622 - DNA, 16 bp, Homo sapiens
ttcaattatttcaatg

SEQ ID NO: 6566623 - DNA, 16 bp, Homo sapiens
ttcaattcatagaata

SEQ ID NO: 6566624 - DNA, 19 bp, Homo sapiens
ttcaattccaccagggcca

SEQ ID NO: 6566625 - DNA, 16 bp, Homo sapiens
ttcaattcctctggga

SEQ ID NO: 6566626 - DNA, 13 bp, Homo sapiens
ttcaattctgtaa

SEQ ID NO: 6566627 - DNA, 22 bp, Homo sapiens
ttcaattctgtaattacatatt

SEQ ID NO: 6566628 - DNA, 18 bp, Homo sapiens
ttcaattgagtaattcta

SEQ ID NO: 6566629 - DNA, 19 bp, Homo sapiens
ttcaattgagtaattctag

SEQ ID NO: 6566630 - DNA, 19 bp, Homo sapiens
ttcaattggtggaattcct

SEQ ID NO: 6566631 - DNA, 15 bp, Homo sapiens
ttcaattgtatttta

SEQ ID NO: 6566632 - DNA, 17 bp, Homo sapiens
ttcaattgtgaaaatga

SEQ ID NO: 6566633 - DNA, 18 bp, Homo sapiens
ttcaattgtgtctgtggt

SEQ ID NO: 6566634 - DNA, 15 bp, Homo sapiens
ttcaatttaaaggtt

SEQ ID NO: 6566635 - DNA, 17 bp, Homo sapiens
ttcaatttaattcttat

SEQ ID NO: 6566636 - DNA, 20 bp, Homo sapiens
ttcaatttatacctagcact

SEQ ID NO: 6566637 - DNA, 16 bp, Homo sapiens
ttcaatttatacctca

SEQ ID NO: 6566638 - DNA, 18 bp, Homo sapiens
ttcaatttattgcacaaa

SEQ ID NO: 6566639 - DNA, 18 bp, Homo sapiens
ttcaatttcatgtttctt

SEQ ID NO: 6566640 - DNA, 18 bp, Homo sapiens
ttcaatttctaaatttgc

SEQ ID NO: 6566641 - DNA, 12 bp, Homo sapiens
ttcaatttgaaa

SEQ ID NO: 6566642 - DNA, 20 bp, Homo sapiens
ttcaatttgtcatgttacta

SEQ ID NO: 6566643 - DNA, 23 bp, Homo sapiens
ttcaatttgtcatgttactaaat

SEQ ID NO: 6566644 - DNA, 19 bp, Homo sapiens
ttcaatttgttcagtcttt

SEQ ID NO: 6566645 - DNA, 20 bp, Homo sapiens
ttcaattttaaggcatattt

SEQ ID NO: 6566646 - DNA, 19 bp, Homo sapiens
ttttaactgcctttttgtc

SEQ ID NO: 6566647 - DNA, 21 bp, Homo sapiens
ttttaactgcttcaagtgtta

SEQ ID NO: 6566648 - DNA, 16 bp, Homo sapiens
ttttaactggcatgtc

SEQ ID NO: 6566649 - DNA, 12 bp, Homo sapiens
ttttaactgtga

SEQ ID NO: 6566650 - DNA, 16 bp, Homo sapiens
ttttaacttaaatttt

SEQ ID NO: 6566651 - DNA, 15 bp, Homo sapiens
ttttaacttcacctt

SEQ ID NO: 6566652 - DNA, 15 bp, Homo sapiens
ttttaacttctttct

SEQ ID NO: 6566653 - DNA, 16 bp, Homo sapiens
ttttaactttaataca

SEQ ID NO: 6566654 - DNA, 18 bp, Homo sapiens
ttttaactttaatacagc

SEQ ID NO: 6566655 - DNA, 23 bp, Homo sapiens
ttttaactttaccaaatgaaatg

SEQ ID NO: 6566656 - DNA, 23 bp, Homo sapiens
ttttaactttagaattcccaaga

SEQ ID NO: 6566657 - DNA, 12 bp, Homo sapiens
ttttaactttct

SEQ ID NO: 6566658 - DNA, 11 bp, Homo sapiens
ttttaactttg

SEQ ID NO: 6566659 - DNA, 15 bp, Homo sapiens
ttttaactttgtttt

SEQ ID NO: 6566660 - DNA, 12 bp, Homo sapiens
ttttaacttttt

SEQ ID NO: 6566661 - DNA, 13 bp, Homo sapiens
ttttaacttttta

SEQ ID NO: 6566662 - DNA, 19 bp, Homo sapiens
ttttaactttttgttttta

SEQ ID NO: 6566663 - DNA, 17 bp, Homo sapiens
ttttaagaaaaaaagca

SEQ ID NO: 6566664 - DNA, 20 bp, Homo sapiens
ttttaagaaaaaaagcaaaa

SEQ ID NO: 6566665 - DNA, 15 bp, Homo sapiens
ttttaagaaaaacaa

SEQ ID NO: 6566666 - DNA, 22 bp, Homo sapiens
ttttaagaaaaacatgtcatgt

SEQ ID NO: 6566667 - DNA, 20 bp, Homo sapiens
ttttaagaaaaattcacaag

SEQ ID NO: 6566668 - DNA, 14 bp, Homo sapiens
ttttaagaaagaaa

SEQ ID NO: 6566669 - DNA, 18 bp, Homo sapiens
ttttaagaaagaaatact

SEQ ID NO: 6566670 - DNA, 21 bp, Homo sapiens
ttttaagaaagagaatgaact

SEQ ID NO: 6566671 - DNA, 19 bp, Homo sapiens
ttttaagaaatctggccca

SEQ ID NO: 6566672 - DNA, 20 bp, Homo sapiens
ttttaagaaattttgccttt

SEQ ID NO: 6566673 - DNA, 12 bp, Homo sapiens
ttttaagaagac

SEQ ID NO: 6566674 - DNA, 22 bp, Homo sapiens
ttttaagaagttgctgcagatt

SEQ ID NO: 6566675 - DNA, 16 bp, Homo sapiens
ttttaagaatatctgt

SEQ ID NO: 6566676 - DNA, 20 bp, Homo sapiens
ttttaagaatggtctcagtg

SEQ ID NO: 6566677 - DNA, 22 bp, Homo sapiens
ttttaagaattctgtacttcca

SEQ ID NO: 6566678 - DNA, 17 bp, Homo sapiens
ttttaagactgaatgtt

SEQ ID NO: 6566679 - DNA, 19 bp, Homo sapiens
ttttaagagaaaactgcag

SEQ ID NO: 6566680 - DNA, 13 bp, Homo sapiens
ttttaagagacag

SEQ ID NO: 6566681 - DNA, 16 bp, Homo sapiens
ttttaagaggcagggt

SEQ ID NO: 6566682 - DNA, 16 bp, Homo sapiens
ttttaagatagtgtaa

SEQ ID NO: 6566683 - DNA, 23 bp, Homo sapiens
ttttaagatagtgtaacttgctt

SEQ ID NO: 6566684 - DNA, 12 bp, Homo sapiens
ttttaagatctt

SEQ ID NO: 6566685 - DNA, 22 bp, Homo sapiens
ttttaagatgcatgtctgccaa

SEQ ID NO: 6566686 - DNA, 18 bp, Homo sapiens
ttttaagattccttttct

SEQ ID NO: 6566687 - DNA, 19 bp, Homo sapiens
ttttaagatttttctcaaa

SEQ ID NO: 6566688 - DNA, 13 bp, Homo sapiens
ttttaagcataat

SEQ ID NO: 6566689 - DNA, 18 bp, Homo sapiens
ttttaagcatttgtatat

SEQ ID NO: 6566690 - DNA, 19 bp, Homo sapiens
ttttaagcctttgttgaac

SEQ ID NO: 6566691 - DNA, 13 bp, Homo sapiens
ttttaagcctttt

SEQ ID NO: 6566692 - DNA, 22 bp, Homo sapiens
ttttaagctccatgtgcatata

SEQ ID NO: 6566693 - DNA, 12 bp, Homo sapiens
ttttaagctgtt

SEQ ID NO: 6566694 - DNA, 18 bp, Homo sapiens
ttttaaggaaacttttta

SEQ ID NO: 6566695 - DNA, 17 bp, Homo sapiens
ttttaaggaagaaaaat

SEQ ID NO: 6566696 - DNA, 23 bp, Homo sapiens
ttttaaggataaatcataaagtc

SEQ ID NO: 6566697 - DNA, 14 bp, Homo sapiens
ttttaaggcttcaa

SEQ ID NO: 6566698 - DNA, 19 bp, Homo sapiens
ttttaagggatgttgcaaa

SEQ ID NO: 6566699 - DNA, 20 bp, Homo sapiens
ttttaagggatgttgcaaag

SEQ ID NO: 6566700 - DNA, 13 bp, Homo sapiens
ttttaaggtagcc

SEQ ID NO: 6566701 - DNA, 13 bp, Homo sapiens
ttttaaggtcttt

SEQ ID NO: 6566702 - DNA, 23 bp, Homo sapiens
ttttaaggtctttcagtactttt

SEQ ID NO: 6566703 - DNA, 14 bp, Homo sapiens
ttttaaggtttcaa

SEQ ID NO: 6566704 - DNA, 16 bp, Homo sapiens
ttttaagtaagacttt

SEQ ID NO: 6566705 - DNA, 17 bp, Homo sapiens
ttttaagtaatgtggaa

SEQ ID NO: 6566706 - DNA, 20 bp, Homo sapiens
ttttaagtattgtttcctga

SEQ ID NO: 6566707 - DNA, 15 bp, Homo sapiens
ttttaagtgagtcct

SEQ ID NO: 6566708 - DNA, 17 bp, Homo sapiens
ttttaagtgctgcattt

SEQ ID NO: 6566709 - DNA, 21 bp, Homo sapiens
ttttaagtgctgcatttaaaa

SEQ ID NO: 6566710 - DNA, 17 bp, Homo sapiens
ttttaagtgcttacatt

SEQ ID NO: 6566711 - DNA, 18 bp, Homo sapiens
ttttaagtgcttcacatt

SEQ ID NO: 6566712 - DNA, 19 bp, Homo sapiens
ttttaagtgcttcacattt

SEQ ID NO: 6566713 - DNA, 22 bp, Homo sapiens
ttttaagtggactctctgacaa

SEQ ID NO: 6566714 - DNA, 17 bp, Homo sapiens
ttttaagtgtatcttaa

SEQ ID NO: 6566715 - DNA, 19 bp, Homo sapiens
ttttaagttaatgaaataa

SEQ ID NO: 6566716 - DNA, 15 bp, Homo sapiens
ttttaagttcacttt

SEQ ID NO: 6566717 - DNA, 14 bp, Homo sapiens
ttttaagttgctga

SEQ ID NO: 6566718 - DNA, 16 bp, Homo sapiens
ttttaagttgtttgca

SEQ ID NO: 6566719 - DNA, 14 bp, Homo sapiens
ttttaagtttttca

SEQ ID NO: 6566720 - DNA, 18 bp, Homo sapiens
ttttaataaaaaggaaat

SEQ ID NO: 6566721 - DNA, 19 bp, Homo sapiens
ttttaataaaaataatttt

SEQ ID NO: 6566722 - DNA, 15 bp, Homo sapiens
ttttaataaaagaaa

SEQ ID NO: 6566723 - DNA, 13 bp, Homo sapiens
ttttaataaaagt

SEQ ID NO: 6566724 - DNA, 14 bp, Homo sapiens
ttttaataaacact

SEQ ID NO: 6566725 - DNA, 19 bp, Homo sapiens
ttttaataaactgcagggt

SEQ ID NO: 6566726 - DNA, 14 bp, Homo sapiens
ttttaataaacttt

SEQ ID NO: 6566727 - DNA, 19 bp, Homo sapiens
ttttaataaactttgaata

SEQ ID NO: 6566728 - DNA, 20 bp, Homo sapiens
ttttaataaagtatattgaa

SEQ ID NO: 6566729 - DNA, 21 bp, Homo sapiens
ttttaataacatatctaaagt

SEQ ID NO: 6566730 - DNA, 20 bp, Homo sapiens
ttttaataagtaattccttc

SEQ ID NO: 6566731 - DNA, 13 bp, Homo sapiens
ttttaataatgtt

SEQ ID NO: 6566732 - DNA, 20 bp, Homo sapiens
ttttaataatgtttcaaaca

SEQ ID NO: 6566733 - DNA, 15 bp, Homo sapiens
ttttaataatttcat

SEQ ID NO: 6566734 - DNA, 16 bp, Homo sapiens
ttttaataatttcatc

SEQ ID NO: 6566735 - DNA, 15 bp, Homo sapiens
ttttaatacattgat

SEQ ID NO: 6566736 - DNA, 22 bp, Homo sapiens
ttttaatacattgatcaggcca

SEQ ID NO: 6566737 - DNA, 15 bp, Homo sapiens
ttttaatagaatttt

SEQ ID NO: 6566738 - DNA, 15 bp, Homo sapiens
ttttaatagcactaa

SEQ ID NO: 6566739 - DNA, 16 bp, Homo sapiens
ttttaatagcctgtca

SEQ ID NO: 6566740 - DNA, 19 bp, Homo sapiens
ttttaataggatttttaga

SEQ ID NO: 6566741 - DNA, 14 bp, Homo sapiens
ttttaatataaatt

SEQ ID NO: 6566742 - DNA, 23 bp, Homo sapiens
ttttaatatataatttaatgtaa

SEQ ID NO: 6566743 - DNA, 21 bp, Homo sapiens
ttttaatattaacttttaatg

SEQ ID NO: 6566744 - DNA, 23 bp, Homo sapiens
ttttaatattaacttttaatggt

SEQ ID NO: 6566745 - DNA, 19 bp, Homo sapiens
ttttaatattactgtcttt

SEQ ID NO: 6566746 - DNA, 19 bp, Homo sapiens
ttttaatattccagaagaa

SEQ ID NO: 6566747 - DNA, 20 bp, Homo sapiens
ttttaatattcttttgtttc

SEQ ID NO: 6566748 - DNA, 22 bp, Homo sapiens
ttttaatattcttttgtttcca

SEQ ID NO: 6566749 - DNA, 16 bp, Homo sapiens
ttttaatattgatgtc

SEQ ID NO: 6566750 - DNA, 15 bp, Homo sapiens
ttttaatattttgta

SEQ ID NO: 6566751 - DNA, 16 bp, Homo sapiens
ttttaatcatgaaatt

SEQ ID NO: 6566752 - DNA, 23 bp, Homo sapiens
ttttaatccacagtatgttacat

SEQ ID NO: 6566753 - DNA, 23 bp, Homo sapiens
ttttaatccctatgtttgtctca

SEQ ID NO: 6566754 - DNA, 21 bp, Homo sapiens
ttttaatcctgtaccaaatct

SEQ ID NO: 6566755 - DNA, 21 bp, Homo sapiens
ttttaatctctaacagtggac

SEQ ID NO: 6566756 - DNA, 12 bp, Homo sapiens
ttttaatctctt

SEQ ID NO: 6566757 - DNA, 12 bp, Homo sapiens
ttttaatcttaa

SEQ ID NO: 6566758 - DNA, 16 bp, Homo sapiens
ttttaatcttagcttt

SEQ ID NO: 6566759 - DNA, 16 bp, Homo sapiens
ttttaatctttgtgac

SEQ ID NO: 6566760 - DNA, 19 bp, Homo sapiens
ttttaatgaaaaggaatca

SEQ ID NO: 6566761 - DNA, 19 bp, Homo sapiens
ttttaatgaaatcaaatgt

SEQ ID NO: 6566762 - DNA, 22 bp, Homo sapiens
ttttaatgatctcggatgacca

SEQ ID NO: 6566763 - DNA, 23 bp, Homo sapiens
ttttaatgatctcggatgaccaa

SEQ ID NO: 6566764 - DNA, 17 bp, Homo sapiens
ttttaatgatgacaaaa

SEQ ID NO: 6566765 - DNA, 17 bp, Homo sapiens
ttttaatgattgtttaa

SEQ ID NO: 6566766 - DNA, 14 bp, Homo sapiens
ttttaatgccttcc

SEQ ID NO: 6566767 - DNA, 13 bp, Homo sapiens
ttttaatggaaag

SEQ ID NO: 6566768 - DNA, 21 bp, Homo sapiens
ttttaatgtatatttgctgca

SEQ ID NO: 6566769 - DNA, 14 bp, Homo sapiens
ttttaatgtatctt

SEQ ID NO: 6566770 - DNA, 14 bp, Homo sapiens
ttttaatgtgctct

SEQ ID NO: 6566771 - DNA, 16 bp, Homo sapiens
ttttaatgtgctctgt

SEQ ID NO: 6566772 - DNA, 13 bp, Homo sapiens
ttttaatgtgctg

SEQ ID NO: 6566773 - DNA, 15 bp, Homo sapiens
ttttaatgtgctgtg

SEQ ID NO: 6566774 - DNA, 19 bp, Homo sapiens
ttttaatgttaactttcaa

SEQ ID NO: 6566775 - DNA, 14 bp, Homo sapiens
ttttaattaaaaaa

SEQ ID NO: 6566776 - DNA, 16 bp, Homo sapiens
ttttaattattattct

SEQ ID NO: 6566777 - DNA, 23 bp, Homo sapiens
ttttaattattatttatatatgt

SEQ ID NO: 6566778 - DNA, 14 bp, Homo sapiens
ttttaattcaagaa

SEQ ID NO: 6566779 - DNA, 15 bp, Homo sapiens
ttttaattcaagaaa

SEQ ID NO: 6566780 - DNA, 15 bp, Homo sapiens
ttttaattcaggtga

SEQ ID NO: 6566781 - DNA, 12 bp, Homo sapiens
ttttaattcata

SEQ ID NO: 6566782 - DNA, 14 bp, Homo sapiens
ttttaattcattct

SEQ ID NO: 6566783 - DNA, 11 bp, Homo sapiens
ttttaattcca

SEQ ID NO: 6566784 - DNA, 21 bp, Homo sapiens
ttttaattccatgtcagataa

SEQ ID NO: 6566785 - DNA, 14 bp, Homo sapiens
ttttaattgaaaag

SEQ ID NO: 6566786 - DNA, 19 bp, Homo sapiens
ttttaattgaaaagaagta

SEQ ID NO: 6566787 - DNA, 19 bp, Homo sapiens
ttttaattgaaattaactt

SEQ ID NO: 6566788 - DNA, 24 bp, Homo sapiens
ttttaattgatcagttttcatgtg

SEQ ID NO: 6566789 - DNA, 15 bp, Homo sapiens
ttttaattgcaacaa

SEQ ID NO: 6566790 - DNA, 12 bp, Homo sapiens
ttttaattgtag

SEQ ID NO: 6566791 - DNA, 12 bp, Homo sapiens
ttttaattgtat

SEQ ID NO: 6566792 - DNA, 14 bp, Homo sapiens
ttttaattgtattt

SEQ ID NO: 6566793 - DNA, 22 bp, Homo sapiens
ttttaattgtatttttgttgtt

SEQ ID NO: 6566794 - DNA, 14 bp, Homo sapiens
ttttaattgtcatg

SEQ ID NO: 6566795 - DNA, 16 bp, Homo sapiens
ttttaatttaaagctt

SEQ ID NO: 6566796 - DNA, 17 bp, Homo sapiens
ttttaatttaaagctta

SEQ ID NO: 6566797 - DNA, 12 bp, Homo sapiens
ttttaatttagt

SEQ ID NO: 6566798 - DNA, 19 bp, Homo sapiens
ttttaatttatttgtttcc

SEQ ID NO: 6566799 - DNA, 17 bp, Homo sapiens
ttttaatttcctgtgag

SEQ ID NO: 6566800 - DNA, 13 bp, Homo sapiens
ttttaatttctga

SEQ ID NO: 6566801 - DNA, 13 bp, Homo sapiens
ttttaatttgtat

SEQ ID NO: 6566802 - DNA, 19 bp, Homo sapiens
ttttaattttaaagagtgt

SEQ ID NO: 6566803 - DNA, 14 bp, Homo sapiens
ttttaattttaacc

SEQ ID NO: 6566804 - DNA, 18 bp, Homo sapiens
ttttaattttcagttcta

SEQ ID NO: 6566805 - DNA, 12 bp, Homo sapiens
ttttaattttgt

SEQ ID NO: 6566806 - DNA, 16 bp, Homo sapiens
ttttaattttgtctgc

SEQ ID NO: 6566807 - DNA, 20 bp, Homo sapiens
ttttaattttgtgttgctaa

SEQ ID NO: 6566808 - DNA, 17 bp, Homo sapiens
ttttaattttttctctt

SEQ ID NO: 6566809 - DNA, 10 bp, Homo sapiens
ttttacaaaa

SEQ ID NO: 6566810 - DNA, 19 bp, Homo sapiens
ttttacaaaaaagaaaaga

SEQ ID NO: 6566811 - DNA, 12 bp, Homo sapiens
ttttacaaaaca

SEQ ID NO: 6566812 - DNA, 19 bp, Homo sapiens
ttttacaaaactgctttgt

SEQ ID NO: 6566813 - DNA, 21 bp, Homo sapiens
ttttacaaataaagatggcta

SEQ ID NO: 6566814 - DNA, 22 bp, Homo sapiens
ttttacaaatattaagaaaata

SEQ ID NO: 6566815 - DNA, 21 bp, Homo sapiens
ttttacaaattaatatttgtg

SEQ ID NO: 6566816 - DNA, 15 bp, Homo sapiens
ttttacaaattcctt

SEQ ID NO: 6566817 - DNA, 15 bp, Homo sapiens
ttttacaagatgtat

SEQ ID NO: 6566818 - DNA, 17 bp, Homo sapiens
ttttacaagtaacaaaa

SEQ ID NO: 6566819 - DNA, 18 bp, Homo sapiens
ttttacaagtaacaaaaa

SEQ ID NO: 6566820 - DNA, 18 bp, Homo sapiens
ttttacaataaataatct

SEQ ID NO: 6566821 - DNA, 18 bp, Homo sapiens
ttttacaatgatttgtaa

SEQ ID NO: 6566822 - DNA, 21 bp, Homo sapiens
ttttacacagaaacactgcct

SEQ ID NO: 6566823 - DNA, 20 bp, Homo sapiens
ttttacacatgtgctgatgt

SEQ ID NO: 6566824 - DNA, 19 bp, Homo sapiens
ttttacacattagatttta

SEQ ID NO: 6566825 - DNA, 17 bp, Homo sapiens
ttttacacgagatttct

SEQ ID NO: 6566826 - DNA, 16 bp, Homo sapiens
ttcaattttttaatgt

SEQ ID NO: 6566827 - DNA, 19 bp, Homo sapiens
ttcacaaaaaaatgttcat

SEQ ID NO: 6566828 - DNA, 20 bp, Homo sapiens
ttcacaaaaggcatctgaac

SEQ ID NO: 6566829 - DNA, 21 bp, Homo sapiens
ttcacaaaaggcatctgaact

SEQ ID NO: 6566830 - DNA, 15 bp, Homo sapiens
ttcacaaacagtaaa

SEQ ID NO: 6566831 - DNA, 17 bp, Homo sapiens
ttcacaaacagtaaagg

SEQ ID NO: 6566832 - DNA, 16 bp, Homo sapiens
ttcacaaactgtgaaa

SEQ ID NO: 6566833 - DNA, 21 bp, Homo sapiens
ttcacaaactgtgaaaatagt

SEQ ID NO: 6566834 - DNA, 15 bp, Homo sapiens
ttcacaaacttttat

SEQ ID NO: 6566835 - DNA, 16 bp, Homo sapiens
ttcacaaacttttata

SEQ ID NO: 6566836 - DNA, 17 bp, Homo sapiens
ttcacaaacttttatac

SEQ ID NO: 6566837 - DNA, 16 bp, Homo sapiens
ttcacaaagtaatttg

SEQ ID NO: 6566838 - DNA, 11 bp, Homo sapiens
ttcacaaataa

SEQ ID NO: 6566839 - DNA, 20 bp, Homo sapiens
ttcacaaatagttgtaaata

SEQ ID NO: 6566840 - DNA, 15 bp, Homo sapiens
ttcacaaatattaaa

SEQ ID NO: 6566841 - DNA, 22 bp, Homo sapiens
ttcacaaatattaaaaagtctt

SEQ ID NO: 6566842 - DNA, 19 bp, Homo sapiens
ttcacaaatgtcattgtct

SEQ ID NO: 6566843 - DNA, 19 bp, Homo sapiens
ttcacaacagatttctaag

SEQ ID NO: 6566844 - DNA, 22 bp, Homo sapiens
ttcacaaccagccacacagagc

SEQ ID NO: 6566845 - DNA, 14 bp, Homo sapiens
ttcacaacccatct

SEQ ID NO: 6566846 - DNA, 18 bp, Homo sapiens
ttcacaacctcaccaaac

SEQ ID NO: 6566847 - DNA, 22 bp, Homo sapiens
ttcacaagacccaaaaggcaga

SEQ ID NO: 6566848 - DNA, 15 bp, Homo sapiens
ttcacaagcctcctg

SEQ ID NO: 6566849 - DNA, 20 bp, Homo sapiens
ttcacaagcctcctgtacct

SEQ ID NO: 6566850 - DNA, 13 bp, Homo sapiens
ttcacaataaaag

SEQ ID NO: 6566851 - DNA, 19 bp, Homo sapiens
ttcacaatggaaactttag

SEQ ID NO: 6566852 - DNA, 13 bp, Homo sapiens
ttcacaatgtgaa

SEQ ID NO: 6566853 - DNA, 17 bp, Homo sapiens
ttcacaatgtgaaactg

SEQ ID NO: 6566854 - DNA, 13 bp, Homo sapiens
ttcacaatgtggc

SEQ ID NO: 6566855 - DNA, 21 bp, Homo sapiens
ttcacaatttcaatgcttctt

SEQ ID NO: 6566856 - DNA, 14 bp, Homo sapiens
ttcacacaaagcct

SEQ ID NO: 6566857 - DNA, 21 bp, Homo sapiens
ttcacacaactgtggataaat

SEQ ID NO: 6566858 - DNA, 12 bp, Homo sapiens
ttcacacacagc

SEQ ID NO: 6566859 - DNA, 13 bp, Homo sapiens
ttcacacacagcc

SEQ ID NO: 6566860 - DNA, 14 bp, Homo sapiens
ttcacacagacaag

SEQ ID NO: 6566861 - DNA, 22 bp, Homo sapiens
ttcacacagcacctcctctctg

SEQ ID NO: 6566862 - DNA, 14 bp, Homo sapiens
ttcacacagcccag

SEQ ID NO: 6566863 - DNA, 15 bp, Homo sapiens
ttcacacaggtcctg

SEQ ID NO: 6566864 - DNA, 22 bp, Homo sapiens
ttcacacatgcctatattatca

SEQ ID NO: 6566865 - DNA, 18 bp, Homo sapiens
ttcacaccattctcctgc

SEQ ID NO: 6566866 - DNA, 17 bp, Homo sapiens
ttcacaccccacctgcg

SEQ ID NO: 6566867 - DNA, 17 bp, Homo sapiens
ttcacaccccaggccct

SEQ ID NO: 6566868 - DNA, 20 bp, Homo sapiens
ttcacacctcacgctctgga

SEQ ID NO: 6566869 - DNA, 23 bp, Homo sapiens
ttcacacctcacgctctggacat

SEQ ID NO: 6566870 - DNA, 14 bp, Homo sapiens
ttcacacctgactc

SEQ ID NO: 6566871 - DNA, 21 bp, Homo sapiens
ttcacacctgactctgaaatc

SEQ ID NO: 6566872 - DNA, 14 bp, Homo sapiens
ttcacacctgcaga

SEQ ID NO: 6566873 - DNA, 11 bp, Homo sapiens
ttcacacctta

SEQ ID NO: 6566874 - DNA, 22 bp, Homo sapiens
ttcacaccttacaaagccagct

SEQ ID NO: 6566875 - DNA, 17 bp, Homo sapiens
ttcacactcagaaagag

SEQ ID NO: 6566876 - DNA, 22 bp, Homo sapiens
ttcacactgtgcgttttagagt

SEQ ID NO: 6566877 - DNA, 15 bp, Homo sapiens
ttcacacttccacca

SEQ ID NO: 6566878 - DNA, 12 bp, Homo sapiens
ttcacacttgaa

SEQ ID NO: 6566879 - DNA, 16 bp, Homo sapiens
ttcacacttttcagca

SEQ ID NO: 6566880 - DNA, 15 bp, Homo sapiens
ttcacagaaaaagca

SEQ ID NO: 6566881 - DNA, 17 bp, Homo sapiens
ttcacagaagcctagga

SEQ ID NO: 6566882 - DNA, 12 bp, Homo sapiens
ttcacagaagga

SEQ ID NO: 6566883 - DNA, 18 bp, Homo sapiens
ttcacagagcacgcctgc

SEQ ID NO: 6566884 - DNA, 21 bp, Homo sapiens
ttcacagatgcctacttttgg

SEQ ID NO: 6566885 - DNA, 19 bp, Homo sapiens
ttcacagatgctgtgtaac

SEQ ID NO: 6566886 - DNA, 20 bp, Homo sapiens
ttcacagatgctgtgtaaca

SEQ ID NO: 6566887 - DNA, 21 bp, Homo sapiens
ttcacagcacagtacacacaa

SEQ ID NO: 6566888 - DNA, 22 bp, Homo sapiens
ttcacagcccagaaccacagat

SEQ ID NO: 6566889 - DNA, 10 bp, Homo sapiens
ttcacagcct

SEQ ID NO: 6566890 - DNA, 14 bp, Homo sapiens
ttcacagcgcctcc

SEQ ID NO: 6566891 - DNA, 17 bp, Homo sapiens
ttcacagctaagatgcc

SEQ ID NO: 6566892 - DNA, 20 bp, Homo sapiens
ttcacagctttgaggaacat

SEQ ID NO: 6566893 - DNA, 14 bp, Homo sapiens
ttcacagcttttct

SEQ ID NO: 6566894 - DNA, 18 bp, Homo sapiens
ttcacagcttttcttgat

SEQ ID NO: 6566895 - DNA, 19 bp, Homo sapiens
ttcacagcttttcttgata

SEQ ID NO: 6566896 - DNA, 13 bp, Homo sapiens
ttcacaggaggcc

SEQ ID NO: 6566897 - DNA, 15 bp, Homo sapiens
ttcacaggaggccag

SEQ ID NO: 6566898 - DNA, 17 bp, Homo sapiens
ttcacaggcagtgcatg

SEQ ID NO: 6566899 - DNA, 19 bp, Homo sapiens
ttcacaggcgaggcctgga

SEQ ID NO: 6566900 - DNA, 15 bp, Homo sapiens
ttcacaggctgtaaa

SEQ ID NO: 6566901 - DNA, 20 bp, Homo sapiens
ttcacaggctgtaaattgaa

SEQ ID NO: 6566902 - DNA, 17 bp, Homo sapiens
ttcacaggtagcctatt

SEQ ID NO: 6566903 - DNA, 17 bp, Homo sapiens
ttcacaggtggacaaat

SEQ ID NO: 6566904 - DNA, 20 bp, Homo sapiens
ttcacaggtgtggtgtaatt

SEQ ID NO: 6566905 - DNA, 17 bp, Homo sapiens
ttcacaggttttatgtg

SEQ ID NO: 6566906 - DNA, 22 bp, Homo sapiens
ttcacaggttttatgtgttctt

SEQ ID NO: 6566907 - DNA, 15 bp, Homo sapiens
ttcacagtagagcca

SEQ ID NO: 6566908 - DNA, 17 bp, Homo sapiens
ttcacagtagagccagc

SEQ ID NO: 6566909 - DNA, 20 bp, Homo sapiens
ttcacagtagagccagcttg

SEQ ID NO: 6566910 - DNA, 17 bp, Homo sapiens
ttcacagtcccaggttt

SEQ ID NO: 6566911 - DNA, 17 bp, Homo sapiens
ttcacagtctctggaaa

SEQ ID NO: 6566912 - DNA, 21 bp, Homo sapiens
ttcacagtgatcgatgattca

SEQ ID NO: 6566913 - DNA, 22 bp, Homo sapiens
ttcacagtgatcgatgattcag

SEQ ID NO: 6566914 - DNA, 12 bp, Homo sapiens
ttcacagtgttt

SEQ ID NO: 6566915 - DNA, 23 bp, Homo sapiens
ttcacagtttgaaataagctatt

SEQ ID NO: 6566916 - DNA, 13 bp, Homo sapiens
ttcacagtttttc

SEQ ID NO: 6566917 - DNA, 19 bp, Homo sapiens
ttcacataaaatagatttt

SEQ ID NO: 6566918 - DNA, 20 bp, Homo sapiens
ttcacataaccccttgaaac

SEQ ID NO: 6566919 - DNA, 18 bp, Homo sapiens
ttcacataagctcagaat

SEQ ID NO: 6566920 - DNA, 17 bp, Homo sapiens
ttcacatagagatcatc

SEQ ID NO: 6566921 - DNA, 20 bp, Homo sapiens
ttcacatatctagtatgaaa

SEQ ID NO: 6566922 - DNA, 17 bp, Homo sapiens
ttcacatcccattggga

SEQ ID NO: 6566923 - DNA, 21 bp, Homo sapiens
ttcacatcctgtgtttctagg

SEQ ID NO: 6566924 - DNA, 13 bp, Homo sapiens
ttcacatctccca

SEQ ID NO: 6566925 - DNA, 14 bp, Homo sapiens
ttcacatctctgta

SEQ ID NO: 6566926 - DNA, 13 bp, Homo sapiens
ttcacatctgtat

SEQ ID NO: 6566927 - DNA, 13 bp, Homo sapiens
ttcacatgtgccc

SEQ ID NO: 6566928 - DNA, 22 bp, Homo sapiens
ttcacatgtttatatttggctc

SEQ ID NO: 6566929 - DNA, 18 bp, Homo sapiens
ttcacatgttttcaaatg

SEQ ID NO: 6566930 - DNA, 19 bp, Homo sapiens
ttcacatgttttcaaatgg

SEQ ID NO: 6566931 - DNA, 23 bp, Homo sapiens
ttcacattaaaaaatgaaatatt

SEQ ID NO: 6566932 - DNA, 21 bp, Homo sapiens
ttcacattaactcaggcattt

SEQ ID NO: 6566933 - DNA, 18 bp, Homo sapiens
ttcacattagataaatta

SEQ ID NO: 6566934 - DNA, 12 bp, Homo sapiens
ttcacattcctg

SEQ ID NO: 6566935 - DNA, 16 bp, Homo sapiens
ttcacattcttataaa

SEQ ID NO: 6566936 - DNA, 15 bp, Homo sapiens
ttcacattcttggct

SEQ ID NO: 6566937 - DNA, 14 bp, Homo sapiens
ttcacattggaaac

SEQ ID NO: 6566938 - DNA, 19 bp, Homo sapiens
ttcacattgtattcagagt

SEQ ID NO: 6566939 - DNA, 17 bp, Homo sapiens
ttcacattgttaagaaa

SEQ ID NO: 6566940 - DNA, 14 bp, Homo sapiens
ttcacatttagaaa

SEQ ID NO: 6566941 - DNA, 15 bp, Homo sapiens
ttcacatttgatgta

SEQ ID NO: 6566942 - DNA, 18 bp, Homo sapiens
ttcacatttgatgtacat

SEQ ID NO: 6566943 - DNA, 15 bp, Homo sapiens
ttcacatttggaatt

SEQ ID NO: 6566944 - DNA, 15 bp, Homo sapiens
ttcaccaaaaccaaa

SEQ ID NO: 6566945 - DNA, 16 bp, Homo sapiens
ttcaccaaaattatcc

SEQ ID NO: 6566946 - DNA, 13 bp, Homo sapiens
ttcaccaacaaca

SEQ ID NO: 6566947 - DNA, 18 bp, Homo sapiens
ttcaccaacaacagtcag

SEQ ID NO: 6566948 - DNA, 19 bp, Homo sapiens
ttcaccaacaacagtcagc

SEQ ID NO: 6566949 - DNA, 24 bp, Homo sapiens
ttcaccaacaacagtcagccagct

SEQ ID NO: 6566950 - DNA, 14 bp, Homo sapiens
ttcaccaagaagca

SEQ ID NO: 6566951 - DNA, 16 bp, Homo sapiens
ttcaccaagtaaattt

SEQ ID NO: 6566952 - DNA, 22 bp, Homo sapiens
ttcaccaatttcctttaaaaca

SEQ ID NO: 6566953 - DNA, 22 bp, Homo sapiens
ttcaccaccaaatgccaagaaa

SEQ ID NO: 6566954 - DNA, 19 bp, Homo sapiens
ttcaccagaatggaaagac

SEQ ID NO: 6566955 - DNA, 18 bp, Homo sapiens
ttcaccagacttttctct

SEQ ID NO: 6566956 - DNA, 15 bp, Homo sapiens
ttcaccagagcccat

SEQ ID NO: 6566957 - DNA, 20 bp, Homo sapiens
ttcaccagcaactctgactc

SEQ ID NO: 6566958 - DNA, 12 bp, Homo sapiens
ttcaccaggaag

SEQ ID NO: 6566959 - DNA, 20 bp, Homo sapiens
ttcaccaggaagaaggcccg

SEQ ID NO: 6566960 - DNA, 18 bp, Homo sapiens
ttcaccagggttctgacc

SEQ ID NO: 6566961 - DNA, 12 bp, Homo sapiens
ttcaccaggtgc

SEQ ID NO: 6566962 - DNA, 22 bp, Homo sapiens
ttcaccagtacattctcagttt

SEQ ID NO: 6566963 - DNA, 23 bp, Homo sapiens
ttcaccagtacattctcagtttt

SEQ ID NO: 6566964 - DNA, 22 bp, Homo sapiens
ttcaccagtgcttgcttgtgaa

SEQ ID NO: 6566965 - DNA, 18 bp, Homo sapiens
ttcaccagtgttcctgaa

SEQ ID NO: 6566966 - DNA, 20 bp, Homo sapiens
ttcaccagtgttcctgaagc

SEQ ID NO: 6566967 - DNA, 19 bp, Homo sapiens
ttcaccatcaatcctgatt

SEQ ID NO: 6566968 - DNA, 16 bp, Homo sapiens
ttcaccatgcaggcaa

SEQ ID NO: 6566969 - DNA, 17 bp, Homo sapiens
ttcaccatggccccctc

SEQ ID NO: 6566970 - DNA, 16 bp, Homo sapiens
ttcaccatgtaaaaca

SEQ ID NO: 6566971 - DNA, 20 bp, Homo sapiens
ttcaccatgtaaaacaaaaa

SEQ ID NO: 6566972 - DNA, 22 bp, Homo sapiens
ttcaccatgttggccaggctgc

SEQ ID NO: 6566973 - DNA, 21 bp, Homo sapiens
ttcaccatgttggtcaggctg

SEQ ID NO: 6566974 - DNA, 14 bp, Homo sapiens
ttcacccacagaaa

SEQ ID NO: 6566975 - DNA, 13 bp, Homo sapiens
ttcacccaccacc

SEQ ID NO: 6566976 - DNA, 21 bp, Homo sapiens
ttcacccaccaggccagctca

SEQ ID NO: 6566977 - DNA, 20 bp, Homo sapiens
ttcacccaccccatggagac

SEQ ID NO: 6566978 - DNA, 18 bp, Homo sapiens
ttcacccagctaatctgt

SEQ ID NO: 6566979 - DNA, 15 bp, Homo sapiens
ttcaccccagaggac

SEQ ID NO: 6566980 - DNA, 22 bp, Homo sapiens
ttcaccccagggcctgagcctg

SEQ ID NO: 6566981 - DNA, 22 bp, Homo sapiens
ttcaccccagtggccactcagc

SEQ ID NO: 6566982 - DNA, 17 bp, Homo sapiens
ttcaccccccactcacc

SEQ ID NO: 6566983 - DNA, 18 bp, Homo sapiens
ttcacccccctctgctgc

SEQ ID NO: 6566984 - DNA, 20 bp, Homo sapiens
ttcaccccggcaggccctgc

SEQ ID NO: 6566985 - DNA, 17 bp, Homo sapiens
ttcacccctccctttct

SEQ ID NO: 6566986 - DNA, 14 bp, Homo sapiens
ttcacccctcttcc

SEQ ID NO: 6566987 - DNA, 16 bp, Homo sapiens
ttcacccctcttccca

SEQ ID NO: 6566988 - DNA, 18 bp, Homo sapiens
ttcacccctcttcccacc

SEQ ID NO: 6566989 - DNA, 13 bp, Homo sapiens
ttcacccctgcac

SEQ ID NO: 6566990 - DNA, 14 bp, Homo sapiens
ttcacccctgcact

SEQ ID NO: 6566991 - DNA, 18 bp, Homo sapiens
ttcacccgagttcctctg

SEQ ID NO: 6566992 - DNA, 15 bp, Homo sapiens
ttcacccgctgcagc

SEQ ID NO: 6566993 - DNA, 13 bp, Homo sapiens
ttcaccctccact

SEQ ID NO: 6566994 - DNA, 17 bp, Homo sapiens
ttcaccctccacttccc

SEQ ID NO: 6566995 - DNA, 19 bp, Homo sapiens
ttcaccctgtaatggttgg

SEQ ID NO: 6566996 - DNA, 22 bp, Homo sapiens
ttcaccctgtcaagttaacaag

SEQ ID NO: 6566997 - DNA, 19 bp, Homo sapiens
ttcaccctgtccctctaat

SEQ ID NO: 6566998 - DNA, 22 bp, Homo sapiens
ttcacccttatagtctaagact

SEQ ID NO: 6566999 - DNA, 14 bp, Homo sapiens
ttcaccgaggacat

SEQ ID NO: 6567000 - DNA, 15 bp, Homo sapiens
ttcaccgcattccag

SEQ ID NO: 6567001 - DNA, 16 bp, Homo sapiens
ttcaccgtgttagcca

SEQ ID NO: 6567002 - DNA, 19 bp, Homo sapiens
ttcacctaagtctctgtga

SEQ ID NO: 6567003 - DNA, 18 bp, Homo sapiens
ttcacctaccgagttcaa

SEQ ID NO: 6567004 - DNA, 19 bp, Homo sapiens
ttcacctcactgaaaacat

SEQ ID NO: 6567005 - DNA, 19 bp, Homo sapiens
ttttacagataaggaaact

SEQ ID NO: 6567006 - DNA, 16 bp, Homo sapiens
ttttacagatccagaa

SEQ ID NO: 6567007 - DNA, 15 bp, Homo sapiens
ttttacagccaactt

SEQ ID NO: 6567008 - DNA, 16 bp, Homo sapiens
ttttacagctgcctgc

SEQ ID NO: 6567009 - DNA, 18 bp, Homo sapiens
ttttacagtatccaaaaa

SEQ ID NO: 6567010 - DNA, 12 bp, Homo sapiens
ttttacagtgta

SEQ ID NO: 6567011 - DNA, 13 bp, Homo sapiens
ttttacagtgtat

SEQ ID NO: 6567012 - DNA, 23 bp, Homo sapiens
ttttacagttagggttttgcaat

SEQ ID NO: 6567013 - DNA, 22 bp, Homo sapiens
ttttacataaatttagtatttt

SEQ ID NO: 6567014 - DNA, 17 bp, Homo sapiens
ttttacatacttttgca

SEQ ID NO: 6567015 - DNA, 16 bp, Homo sapiens
ttttacatagttgaga

SEQ ID NO: 6567016 - DNA, 15 bp, Homo sapiens
ttttacatctaaact

SEQ ID NO: 6567017 - DNA, 13 bp, Homo sapiens
ttttacatgacca

SEQ ID NO: 6567018 - DNA, 15 bp, Homo sapiens
ttttacatgtttcca

SEQ ID NO: 6567019 - DNA, 18 bp, Homo sapiens
ttttacattacagaatat

SEQ ID NO: 6567020 - DNA, 16 bp, Homo sapiens
ttttacattatgcaaa

SEQ ID NO: 6567021 - DNA, 15 bp, Homo sapiens
ttttacattctgaat

SEQ ID NO: 6567022 - DNA, 16 bp, Homo sapiens
ttttacattctgtctg

SEQ ID NO: 6567023 - DNA, 13 bp, Homo sapiens
ttttacattgtga

SEQ ID NO: 6567024 - DNA, 14 bp, Homo sapiens
ttttacattgtgaa

SEQ ID NO: 6567025 - DNA, 16 bp, Homo sapiens
ttttacatttcataca

SEQ ID NO: 6567026 - DNA, 17 bp, Homo sapiens
ttttacatttttctgat

SEQ ID NO: 6567027 - DNA, 13 bp, Homo sapiens
ttttaccaaagca

SEQ ID NO: 6567028 - DNA, 18 bp, Homo sapiens
ttttaccaataaactgag

SEQ ID NO: 6567029 - DNA, 16 bp, Homo sapiens
ttttaccaattccaat

SEQ ID NO: 6567030 - DNA, 22 bp, Homo sapiens
ttttaccactatttaagttatc

SEQ ID NO: 6567031 - DNA, 14 bp, Homo sapiens
ttttaccagctccc

SEQ ID NO: 6567032 - DNA, 19 bp, Homo sapiens
ttttaccagctcccagggt

SEQ ID NO: 6567033 - DNA, 13 bp, Homo sapiens
ttttaccagcttt

SEQ ID NO: 6567034 - DNA, 17 bp, Homo sapiens
ttttaccatatgtttat

SEQ ID NO: 6567035 - DNA, 21 bp, Homo sapiens
ttttaccctgaggtcactgct

SEQ ID NO: 6567036 - DNA, 22 bp, Homo sapiens
ttttaccctggcccctctccct

SEQ ID NO: 6567037 - DNA, 15 bp, Homo sapiens
ttttaccctgtgtca

SEQ ID NO: 6567038 - DNA, 22 bp, Homo sapiens
ttttaccgttggggcccttaac

SEQ ID NO: 6567039 - DNA, 13 bp, Homo sapiens
ttttacctaatct

SEQ ID NO: 6567040 - DNA, 19 bp, Homo sapiens
ttttacctaccacagtgtc

SEQ ID NO: 6567041 - DNA, 23 bp, Homo sapiens
ttttacctagctggtagcataaa

SEQ ID NO: 6567042 - DNA, 15 bp, Homo sapiens
ttttacctataccta

SEQ ID NO: 6567043 - DNA, 15 bp, Homo sapiens
ttttacctattctga

SEQ ID NO: 6567044 - DNA, 16 bp, Homo sapiens
ttttacctattctgaa

SEQ ID NO: 6567045 - DNA, 22 bp, Homo sapiens
ttttacctattctgaaaaagac

SEQ ID NO: 6567046 - DNA, 14 bp, Homo sapiens
ttttacctctctct

SEQ ID NO: 6567047 - DNA, 15 bp, Homo sapiens
ttttacctgctgctt

SEQ ID NO: 6567048 - DNA, 13 bp, Homo sapiens
ttttacctgcttt

SEQ ID NO: 6567049 - DNA, 19 bp, Homo sapiens
ttttacctgggatatgaca

SEQ ID NO: 6567050 - DNA, 19 bp, Homo sapiens
ttttacctgtcacattgca

SEQ ID NO: 6567051 - DNA, 20 bp, Homo sapiens
ttttacctgtcacattgcat

SEQ ID NO: 6567052 - DNA, 13 bp, Homo sapiens
ttttaccttgttt

SEQ ID NO: 6567053 - DNA, 14 bp, Homo sapiens
ttttacctttcata

SEQ ID NO: 6567054 - DNA, 15 bp, Homo sapiens
ttttacggaattcca

SEQ ID NO: 6567055 - DNA, 17 bp, Homo sapiens
ttttacgtagtaaaagt

SEQ ID NO: 6567056 - DNA, 15 bp, Homo sapiens
ttttacgtgcaaaca

SEQ ID NO: 6567057 - DNA, 16 bp, Homo sapiens
ttttacgtgcaaacaa

SEQ ID NO: 6567058 - DNA, 13 bp, Homo sapiens
ttttactaaagaa

SEQ ID NO: 6567059 - DNA, 22 bp, Homo sapiens
ttttactaaagaaagattactt

SEQ ID NO: 6567060 - DNA, 15 bp, Homo sapiens
ttttactaatagaca

SEQ ID NO: 6567061 - DNA, 23 bp, Homo sapiens
ttttactaccatttttttttaac

SEQ ID NO: 6567062 - DNA, 15 bp, Homo sapiens
ttttactacttgtta

SEQ ID NO: 6567063 - DNA, 19 bp, Homo sapiens
ttttactagaaatgggaat

SEQ ID NO: 6567064 - DNA, 12 bp, Homo sapiens
ttttactattaa

SEQ ID NO: 6567065 - DNA, 15 bp, Homo sapiens
ttttactattgaact

SEQ ID NO: 6567066 - DNA, 17 bp, Homo sapiens
ttttactattgttacat

SEQ ID NO: 6567067 - DNA, 23 bp, Homo sapiens
ttttactcacaaataaaattctt

SEQ ID NO: 6567068 - DNA, 19 bp, Homo sapiens
ttttactcaggctttctat

SEQ ID NO: 6567069 - DNA, 21 bp, Homo sapiens
ttttactcaggctttctattg

SEQ ID NO: 6567070 - DNA, 22 bp, Homo sapiens
ttttactccaggttattgcaat

SEQ ID NO: 6567071 - DNA, 15 bp, Homo sapiens
ttttactccagtggt

SEQ ID NO: 6567072 - DNA, 22 bp, Homo sapiens
ttttactctgcctacagaactt

SEQ ID NO: 6567073 - DNA, 12 bp, Homo sapiens
ttttactctttt

SEQ ID NO: 6567074 - DNA, 11 bp, Homo sapiens
ttttactgaac

SEQ ID NO: 6567075 - DNA, 19 bp, Homo sapiens
ttttactgaagcctttctt

SEQ ID NO: 6567076 - DNA, 19 bp, Homo sapiens
ttttactgaatgatctatt

SEQ ID NO: 6567077 - DNA, 15 bp, Homo sapiens
ttttactgacagaaa

SEQ ID NO: 6567078 - DNA, 23 bp, Homo sapiens
ttttactgcattttcacaacata

SEQ ID NO: 6567079 - DNA, 12 bp, Homo sapiens
ttttactgcctg

SEQ ID NO: 6567080 - DNA, 16 bp, Homo sapiens
ttttactgctctgaga

SEQ ID NO: 6567081 - DNA, 19 bp, Homo sapiens
ttttactgctttctgaatg

SEQ ID NO: 6567082 - DNA, 13 bp, Homo sapiens
ttttactgtatgt

SEQ ID NO: 6567083 - DNA, 20 bp, Homo sapiens
ttttactgtcagattaaatt

SEQ ID NO: 6567084 - DNA, 13 bp, Homo sapiens
ttttactgtctgt

SEQ ID NO: 6567085 - DNA, 18 bp, Homo sapiens
ttttactgtcttaattaa

SEQ ID NO: 6567086 - DNA, 22 bp, Homo sapiens
ttttactgtcttaattaagtaa

SEQ ID NO: 6567087 - DNA, 13 bp, Homo sapiens
ttttactgtgaaa

SEQ ID NO: 6567088 - DNA, 15 bp, Homo sapiens
ttttactgtgtttta

SEQ ID NO: 6567089 - DNA, 22 bp, Homo sapiens
ttttactgttgtacaatcatgt

SEQ ID NO: 6567090 - DNA, 20 bp, Homo sapiens
ttttacttccatgatacttt

SEQ ID NO: 6567091 - DNA, 17 bp, Homo sapiens
ttttacttgaatcagat

SEQ ID NO: 6567092 - DNA, 14 bp, Homo sapiens
ttttacttgagcaa

SEQ ID NO: 6567093 - DNA, 22 bp, Homo sapiens
ttttacttgcattgaatatatt

SEQ ID NO: 6567094 - DNA, 21 bp, Homo sapiens
ttttacttggtgtaattaata

SEQ ID NO: 6567095 - DNA, 13 bp, Homo sapiens
ttttactttaaca

SEQ ID NO: 6567096 - DNA, 11 bp, Homo sapiens
ttttactttgg

SEQ ID NO: 6567097 - DNA, 15 bp, Homo sapiens
ttttactttggttta

SEQ ID NO: 6567098 - DNA, 22 bp, Homo sapiens
ttttactttggtttagtctttt

SEQ ID NO: 6567099 - DNA, 18 bp, Homo sapiens
ttttactttgtgcaatat

SEQ ID NO: 6567100 - DNA, 22 bp, Homo sapiens
ttttactttgtttttattctgt

SEQ ID NO: 6567101 - DNA, 20 bp, Homo sapiens
ttttacttttaaactgtgta

SEQ ID NO: 6567102 - DNA, 15 bp, Homo sapiens
ttttacttttacagt

SEQ ID NO: 6567103 - DNA, 12 bp, Homo sapiens
ttttacttttat

SEQ ID NO: 6567104 - DNA, 19 bp, Homo sapiens
ttttacttttctgccaaaa

SEQ ID NO: 6567105 - DNA, 22 bp, Homo sapiens
ttttacttttgtcttcctcact

SEQ ID NO: 6567106 - DNA, 12 bp, Homo sapiens
ttttactttttt

SEQ ID NO: 6567107 - DNA, 17 bp, Homo sapiens
ttttacttttttacact

SEQ ID NO: 6567108 - DNA, 22 bp, Homo sapiens
ttttactttttttttattttat

SEQ ID NO: 6567109 - DNA, 22 bp, Homo sapiens
ttttagaaaaacatttaaactt

SEQ ID NO: 6567110 - DNA, 14 bp, Homo sapiens
ttttagaaaatcag

SEQ ID NO: 6567111 - DNA, 18 bp, Homo sapiens
ttttagaaacaatatgga

SEQ ID NO: 6567112 - DNA, 21 bp, Homo sapiens
ttttagaaagcatttgaatgc

SEQ ID NO: 6567113 - DNA, 22 bp, Homo sapiens
ttttagaaagcatttgaatgca

SEQ ID NO: 6567114 - DNA, 23 bp, Homo sapiens
ttttagaaagcatttgaatgcat

SEQ ID NO: 6567115 - DNA, 17 bp, Homo sapiens
ttttagaaatattcaca

SEQ ID NO: 6567116 - DNA, 16 bp, Homo sapiens
ttttagaaatgcatat

SEQ ID NO: 6567117 - DNA, 14 bp, Homo sapiens
ttttagaacagaaa

SEQ ID NO: 6567118 - DNA, 18 bp, Homo sapiens
ttttagaagagttacctt

SEQ ID NO: 6567119 - DNA, 21 bp, Homo sapiens
ttttagaataagaatttgcat

SEQ ID NO: 6567120 - DNA, 12 bp, Homo sapiens
ttttagaataca

SEQ ID NO: 6567121 - DNA, 22 bp, Homo sapiens
ttttagaatcttttaaatacat

SEQ ID NO: 6567122 - DNA, 22 bp, Homo sapiens
ttttagaattacaccacaagta

SEQ ID NO: 6567123 - DNA, 20 bp, Homo sapiens
ttttagaattttagaagaga

SEQ ID NO: 6567124 - DNA, 18 bp, Homo sapiens
ttttagaattttgtgaaa

SEQ ID NO: 6567125 - DNA, 18 bp, Homo sapiens
ttttagacaaatactcat

SEQ ID NO: 6567126 - DNA, 22 bp, Homo sapiens
ttttagacaaatactcatgtgt

SEQ ID NO: 6567127 - DNA, 21 bp, Homo sapiens
ttttagacagtctcactttgt

SEQ ID NO: 6567128 - DNA, 18 bp, Homo sapiens
ttttagacagtggtaaat

SEQ ID NO: 6567129 - DNA, 18 bp, Homo sapiens
ttttagactcaaagaata

SEQ ID NO: 6567130 - DNA, 19 bp, Homo sapiens
ttttagacttaccttgaac

SEQ ID NO: 6567131 - DNA, 12 bp, Homo sapiens
ttttagagaaaa

SEQ ID NO: 6567132 - DNA, 23 bp, Homo sapiens
ttttagagaatgtgtttcaaaac

SEQ ID NO: 6567133 - DNA, 17 bp, Homo sapiens
ttttagagactatggag

SEQ ID NO: 6567134 - DNA, 18 bp, Homo sapiens
ttttagagattaatttgt

SEQ ID NO: 6567135 - DNA, 21 bp, Homo sapiens
ttttagagattaatttgtgta

SEQ ID NO: 6567136 - DNA, 13 bp, Homo sapiens
ttttagagcatta

SEQ ID NO: 6567137 - DNA, 16 bp, Homo sapiens
ttttagagcattaaaa

SEQ ID NO: 6567138 - DNA, 21 bp, Homo sapiens
ttttagagcattaaaataact

SEQ ID NO: 6567139 - DNA, 23 bp, Homo sapiens
ttttagagcattaaaataactat

SEQ ID NO: 6567140 - DNA, 21 bp, Homo sapiens
ttttagaggcagggctgcatt

SEQ ID NO: 6567141 - DNA, 20 bp, Homo sapiens
ttttagaggggcaaaaatat

SEQ ID NO: 6567142 - DNA, 16 bp, Homo sapiens
ttttagaggtgagttt

SEQ ID NO: 6567143 - DNA, 17 bp, Homo sapiens
ttttagagttgatacta

SEQ ID NO: 6567144 - DNA, 13 bp, Homo sapiens
ttttagatatatt

SEQ ID NO: 6567145 - DNA, 14 bp, Homo sapiens
ttttagatatattc

SEQ ID NO: 6567146 - DNA, 19 bp, Homo sapiens
ttttagatgagattgtttt

SEQ ID NO: 6567147 - DNA, 20 bp, Homo sapiens
ttttagatgagattgtttta

SEQ ID NO: 6567148 - DNA, 17 bp, Homo sapiens
ttttagatggtttcttg

SEQ ID NO: 6567149 - DNA, 13 bp, Homo sapiens
ttttagatgtatt

SEQ ID NO: 6567150 - DNA, 19 bp, Homo sapiens
ttttagattaaaaaaattt

SEQ ID NO: 6567151 - DNA, 19 bp, Homo sapiens
ttttagattggttctgttt

SEQ ID NO: 6567152 - DNA, 20 bp, Homo sapiens
ttttagattggttctgtttt

SEQ ID NO: 6567153 - DNA, 16 bp, Homo sapiens
ttttagatttctttga

SEQ ID NO: 6567154 - DNA, 21 bp, Homo sapiens
ttttagcaaatcagtatattt

SEQ ID NO: 6567155 - DNA, 23 bp, Homo sapiens
ttttagcacagcgttatgtgtct

SEQ ID NO: 6567156 - DNA, 22 bp, Homo sapiens
ttttagcataagccagaatatt

SEQ ID NO: 6567157 - DNA, 22 bp, Homo sapiens
ttttagcatgtgtttggttctg

SEQ ID NO: 6567158 - DNA, 16 bp, Homo sapiens
ttttagcattacctaa

SEQ ID NO: 6567159 - DNA, 11 bp, Homo sapiens
ttttagcattt

SEQ ID NO: 6567160 - DNA, 15 bp, Homo sapiens
ttttagcatttgtat

SEQ ID NO: 6567161 - DNA, 16 bp, Homo sapiens
ttttagcatttgtata

SEQ ID NO: 6567162 - DNA, 21 bp, Homo sapiens
ttttagccattgtcgtttcat

SEQ ID NO: 6567163 - DNA, 21 bp, Homo sapiens
ttttagctgatgaacttattc

SEQ ID NO: 6567164 - DNA, 22 bp, Homo sapiens
ttttagctggtggcaataaata

SEQ ID NO: 6567165 - DNA, 14 bp, Homo sapiens
ttttaggaaacctg

SEQ ID NO: 6567166 - DNA, 16 bp, Homo sapiens
ttttaggaaacttgta

SEQ ID NO: 6567167 - DNA, 22 bp, Homo sapiens
ttttaggaaacttgtagaaacg

SEQ ID NO: 6567168 - DNA, 23 bp, Homo sapiens
ttttaggaaacttgtagaaacga

SEQ ID NO: 6567169 - DNA, 18 bp, Homo sapiens
ttttaggaaggattttct

SEQ ID NO: 6567170 - DNA, 14 bp, Homo sapiens
ttttaggacatctt

SEQ ID NO: 6567171 - DNA, 16 bp, Homo sapiens
ttttaggacatcttaa

SEQ ID NO: 6567172 - DNA, 15 bp, Homo sapiens
ttttaggcactctta

SEQ ID NO: 6567173 - DNA, 18 bp, Homo sapiens
ttttaggcagggatttga

SEQ ID NO: 6567174 - DNA, 17 bp, Homo sapiens
ttttaggcataagatga

SEQ ID NO: 6567175 - DNA, 16 bp, Homo sapiens
ttttaggctgttcctt

SEQ ID NO: 6567176 - DNA, 15 bp, Homo sapiens
ttttaggcttgaaat

SEQ ID NO: 6567177 - DNA, 16 bp, Homo sapiens
ttttagggttctaaat

SEQ ID NO: 6567178 - DNA, 20 bp, Homo sapiens
ttttagggttctaaatgcaa

SEQ ID NO: 6567179 - DNA, 15 bp, Homo sapiens
ttttaggtagaaaaa

SEQ ID NO: 6567180 - DNA, 23 bp, Homo sapiens
ttttaggtcaaacccaagttagt

SEQ ID NO: 6567181 - DNA, 16 bp, Homo sapiens
ttttaggttctaaagt

SEQ ID NO: 6567182 - DNA, 15 bp, Homo sapiens
ttttaggttgttacc

SEQ ID NO: 6567183 - DNA, 13 bp, Homo sapiens
ttcacctcagcct

SEQ ID NO: 6567184 - DNA, 19 bp, Homo sapiens
ttcacctccaggttcaagt

SEQ ID NO: 6567185 - DNA, 16 bp, Homo sapiens
ttcacctccatgtcat

SEQ ID NO: 6567186 - DNA, 17 bp, Homo sapiens
ttcacctccatgtcatc

SEQ ID NO: 6567187 - DNA, 10 bp, Homo sapiens
ttcacctccg

SEQ ID NO: 6567188 - DNA, 14 bp, Homo sapiens
ttcacctctatcca

SEQ ID NO: 6567189 - DNA, 18 bp, Homo sapiens
ttcacctctatccaaaga

SEQ ID NO: 6567190 - DNA, 14 bp, Homo sapiens
ttcacctctattct

SEQ ID NO: 6567191 - DNA, 12 bp, Homo sapiens
ttcacctgagca

SEQ ID NO: 6567192 - DNA, 21 bp, Homo sapiens
ttcacctggaagcatttgttt

SEQ ID NO: 6567193 - DNA, 14 bp, Homo sapiens
ttcacctgtaaaac

SEQ ID NO: 6567194 - DNA, 13 bp, Homo sapiens
ttcacctgtaaac

SEQ ID NO: 6567195 - DNA, 16 bp, Homo sapiens
ttcacctgtaaacctg

SEQ ID NO: 6567196 - DNA, 19 bp, Homo sapiens
ttcacctgtatatttcttt

SEQ ID NO: 6567197 - DNA, 20 bp, Homo sapiens
ttcacctgtatatttctttt

SEQ ID NO: 6567198 - DNA, 16 bp, Homo sapiens
ttcacctgtgacaaag

SEQ ID NO: 6567199 - DNA, 16 bp, Homo sapiens
ttcacctgtgactcct

SEQ ID NO: 6567200 - DNA, 23 bp, Homo sapiens
ttcacctgttatgtatgaaggaa

SEQ ID NO: 6567201 - DNA, 19 bp, Homo sapiens
ttcacctgtttttaagctg

SEQ ID NO: 6567202 - DNA, 22 bp, Homo sapiens
ttcacctgtttttaagctgttt

SEQ ID NO: 6567203 - DNA, 15 bp, Homo sapiens
ttcaccttagtgcaa

SEQ ID NO: 6567204 - DNA, 14 bp, Homo sapiens
ttcaccttatgtat

SEQ ID NO: 6567205 - DNA, 20 bp, Homo sapiens
ttcaccttatgtattatttt

SEQ ID NO: 6567206 - DNA, 13 bp, Homo sapiens
ttcaccttccctc

SEQ ID NO: 6567207 - DNA, 14 bp, Homo sapiens
ttcaccttccctcg

SEQ ID NO: 6567208 - DNA, 15 bp, Homo sapiens
ttcaccttctgtgca

SEQ ID NO: 6567209 - DNA, 16 bp, Homo sapiens
ttcaccttctgtgcat

SEQ ID NO: 6567210 - DNA, 22 bp, Homo sapiens
ttcaccttgggatgatgcctca

SEQ ID NO: 6567211 - DNA, 20 bp, Homo sapiens
ttcacctttcccactttctt

SEQ ID NO: 6567212 - DNA, 21 bp, Homo sapiens
ttcacctttcctctccctcag

SEQ ID NO: 6567213 - DNA, 22 bp, Homo sapiens
ttcacctttcctctccctcagg

SEQ ID NO: 6567214 - DNA, 14 bp, Homo sapiens
ttcacctttgtccc

SEQ ID NO: 6567215 - DNA, 14 bp, Homo sapiens
ttcacgaactgttc

SEQ ID NO: 6567216 - DNA, 22 bp, Homo sapiens
ttcacgacaatgttgagaagtt

SEQ ID NO: 6567217 - DNA, 15 bp, Homo sapiens
ttcacgagagcccgg

SEQ ID NO: 6567218 - DNA, 23 bp, Homo sapiens
ttcacgattaactgtgaaatgta

SEQ ID NO: 6567219 - DNA, 15 bp, Homo sapiens
ttcacgattcatttt

SEQ ID NO: 6567220 - DNA, 16 bp, Homo sapiens
ttcacgcaacttgaaa

SEQ ID NO: 6567221 - DNA, 22 bp, Homo sapiens
ttcacgcaacttgaaattatat

SEQ ID NO: 6567222 - DNA, 12 bp, Homo sapiens
ttcacgccattc

SEQ ID NO: 6567223 - DNA, 20 bp, Homo sapiens
ttcacgccattctcctgcct

SEQ ID NO: 6567224 - DNA, 22 bp, Homo sapiens
ttcacgccgtaattctttctgt

SEQ ID NO: 6567225 - DNA, 23 bp, Homo sapiens
ttcacgccgtaattctttctgtc

SEQ ID NO: 6567226 - DNA, 15 bp, Homo sapiens
ttcacgctcacccag

SEQ ID NO: 6567227 - DNA, 23 bp, Homo sapiens
ttcacgctcacccagtcacctcc

SEQ ID NO: 6567228 - DNA, 13 bp, Homo sapiens
ttcacggcctggc

SEQ ID NO: 6567229 - DNA, 19 bp, Homo sapiens
ttcacggtttcacttttaa

SEQ ID NO: 6567230 - DNA, 19 bp, Homo sapiens
ttcacgtaaatattcatat

SEQ ID NO: 6567231 - DNA, 20 bp, Homo sapiens
ttcacgtaagatacaagttt

SEQ ID NO: 6567232 - DNA, 18 bp, Homo sapiens
ttcacgtaatcctcctga

SEQ ID NO: 6567233 - DNA, 14 bp, Homo sapiens
ttcacgtagaacat

SEQ ID NO: 6567234 - DNA, 18 bp, Homo sapiens
ttcacgtcactgccagag

SEQ ID NO: 6567235 - DNA, 18 bp, Homo sapiens
ttcacgtcttggtgcctt

SEQ ID NO: 6567236 - DNA, 23 bp, Homo sapiens
ttcacgttgggtggagagagtat

SEQ ID NO: 6567237 - DNA, 20 bp, Homo sapiens
ttcactaaaagtctccaaaa

SEQ ID NO: 6567238 - DNA, 16 bp, Homo sapiens
ttcactaaaataaaat

SEQ ID NO: 6567239 - DNA, 21 bp, Homo sapiens
ttcactacaacattagaatat

SEQ ID NO: 6567240 - DNA, 21 bp, Homo sapiens
ttcactaccctgattcttgat

SEQ ID NO: 6567241 - DNA, 14 bp, Homo sapiens
ttcactactcagca

SEQ ID NO: 6567242 - DNA, 15 bp, Homo sapiens
ttcactactcagcat

SEQ ID NO: 6567243 - DNA, 23 bp, Homo sapiens
ttcactagaagccgtgggaagaa

SEQ ID NO: 6567244 - DNA, 20 bp, Homo sapiens
ttcactaggctcgtgtttgc

SEQ ID NO: 6567245 - DNA, 13 bp, Homo sapiens
ttcactagggaat

SEQ ID NO: 6567246 - DNA, 21 bp, Homo sapiens
ttcactataatgatctaagaa

SEQ ID NO: 6567247 - DNA, 16 bp, Homo sapiens
ttcactataatgtgaa

SEQ ID NO: 6567248 - DNA, 21 bp, Homo sapiens
ttcactatacaggctgggaag

SEQ ID NO: 6567249 - DNA, 15 bp, Homo sapiens
ttcactattagagaa

SEQ ID NO: 6567250 - DNA, 14 bp, Homo sapiens
ttcactattcctat

SEQ ID NO: 6567251 - DNA, 12 bp, Homo sapiens
ttcactatttaa

SEQ ID NO: 6567252 - DNA, 13 bp, Homo sapiens
ttcactatttcct

SEQ ID NO: 6567253 - DNA, 19 bp, Homo sapiens
ttcactatttcctttataa

SEQ ID NO: 6567254 - DNA, 16 bp, Homo sapiens
ttcactcactctaaag

SEQ ID NO: 6567255 - DNA, 14 bp, Homo sapiens
ttcactcactgtca

SEQ ID NO: 6567256 - DNA, 19 bp, Homo sapiens
ttcactcactgtcaatgat

SEQ ID NO: 6567257 - DNA, 13 bp, Homo sapiens
ttcactcagcact

SEQ ID NO: 6567258 - DNA, 12 bp, Homo sapiens
ttcactcagcca

SEQ ID NO: 6567259 - DNA, 14 bp, Homo sapiens
ttcactcagccaca

SEQ ID NO: 6567260 - DNA, 15 bp, Homo sapiens
ttcactcagccacac

SEQ ID NO: 6567261 - DNA, 21 bp, Homo sapiens
ttcactcatgcaaactgcttt

SEQ ID NO: 6567262 - DNA, 13 bp, Homo sapiens
ttcactccagcct

SEQ ID NO: 6567263 - DNA, 21 bp, Homo sapiens
ttcactccggtgtgcctgcag

SEQ ID NO: 6567264 - DNA, 14 bp, Homo sapiens
ttcactcctgctgt

SEQ ID NO: 6567265 - DNA, 17 bp, Homo sapiens
ttcactctaagatgtta

SEQ ID NO: 6567266 - DNA, 22 bp, Homo sapiens
ttcactctaagatgttatattt

SEQ ID NO: 6567267 - DNA, 13 bp, Homo sapiens
ttcactctaattg

SEQ ID NO: 6567268 - DNA, 10 bp, Homo sapiens
ttcactctcc

SEQ ID NO: 6567269 - DNA, 14 bp, Homo sapiens
ttcactctccatta

SEQ ID NO: 6567270 - DNA, 13 bp, Homo sapiens
ttcactctccttg

SEQ ID NO: 6567271 - DNA, 21 bp, Homo sapiens
ttcactctgtgtctaataatg

SEQ ID NO: 6567272 - DNA, 18 bp, Homo sapiens
ttcactgaagtgaataca

SEQ ID NO: 6567273 - DNA, 22 bp, Homo sapiens
ttcactgaataaataagtaaat

SEQ ID NO: 6567274 - DNA, 15 bp, Homo sapiens
ttcactgacacagta

SEQ ID NO: 6567275 - DNA, 21 bp, Homo sapiens
ttcactgaccagcggctgctc

SEQ ID NO: 6567276 - DNA, 23 bp, Homo sapiens
ttcactgaccagcggctgctcaa

SEQ ID NO: 6567277 - DNA, 18 bp, Homo sapiens
ttcactgagctccccaga

SEQ ID NO: 6567278 - DNA, 22 bp, Homo sapiens
ttcactgagttttgtttcactt

SEQ ID NO: 6567279 - DNA, 11 bp, Homo sapiens
ttcactgattt

SEQ ID NO: 6567280 - DNA, 24 bp, Homo sapiens
ttcactgcagcatgcccagtgcca

SEQ ID NO: 6567281 - DNA, 14 bp, Homo sapiens
ttcactgccatgcc

SEQ ID NO: 6567282 - DNA, 23 bp, Homo sapiens
ttcactgctgcaaggcctttctg

SEQ ID NO: 6567283 - DNA, 18 bp, Homo sapiens
ttcactgctgctcctctt

SEQ ID NO: 6567284 - DNA, 21 bp, Homo sapiens
ttcactgctgctcctctttcc

SEQ ID NO: 6567285 - DNA, 22 bp, Homo sapiens
ttcactgctgctcctctttccc

SEQ ID NO: 6567286 - DNA, 15 bp, Homo sapiens
ttcactgctggctgc

SEQ ID NO: 6567287 - DNA, 19 bp, Homo sapiens
ttcactgctggctgcctta

SEQ ID NO: 6567288 - DNA, 15 bp, Homo sapiens
ttcactggaaaggaa

SEQ ID NO: 6567289 - DNA, 21 bp, Homo sapiens
ttcactggaatgaagaccatg

SEQ ID NO: 6567290 - DNA, 17 bp, Homo sapiens
ttcactggagttacatt

SEQ ID NO: 6567291 - DNA, 20 bp, Homo sapiens
ttcactggccacagttgttt

SEQ ID NO: 6567292 - DNA, 22 bp, Homo sapiens
ttcactggcccctactttgtgg

SEQ ID NO: 6567293 - DNA, 12 bp, Homo sapiens
ttcactggcctg

SEQ ID NO: 6567294 - DNA, 21 bp, Homo sapiens
ttcactggcgaggtgcggcca

SEQ ID NO: 6567295 - DNA, 13 bp, Homo sapiens
ttcactggcgcct

SEQ ID NO: 6567296 - DNA, 18 bp, Homo sapiens
ttcactggcgccttctcg

SEQ ID NO: 6567297 - DNA, 13 bp, Homo sapiens
ttcactgggccaa

SEQ ID NO: 6567298 - DNA, 18 bp, Homo sapiens
ttcactggtactctgcca

SEQ ID NO: 6567299 - DNA, 17 bp, Homo sapiens
ttcactggttttacaca

SEQ ID NO: 6567300 - DNA, 12 bp, Homo sapiens
ttcactgtacgt

SEQ ID NO: 6567301 - DNA, 13 bp, Homo sapiens
ttcactgtactgc

SEQ ID NO: 6567302 - DNA, 15 bp, Homo sapiens
ttcactgtataaata

SEQ ID NO: 6567303 - DNA, 18 bp, Homo sapiens
ttcactgtataaatagga

SEQ ID NO: 6567304 - DNA, 14 bp, Homo sapiens
ttcactgtatataa

SEQ ID NO: 6567305 - DNA, 22 bp, Homo sapiens
ttcactgtcctccaagccagcg

SEQ ID NO: 6567306 - DNA, 15 bp, Homo sapiens
ttcactgtcttttaa

SEQ ID NO: 6567307 - DNA, 16 bp, Homo sapiens
ttcactgtcttttaaa

SEQ ID NO: 6567308 - DNA, 22 bp, Homo sapiens
ttcactgtgaccttgagaagat

SEQ ID NO: 6567309 - DNA, 18 bp, Homo sapiens
ttcactgtgctgttgtta

SEQ ID NO: 6567310 - DNA, 22 bp, Homo sapiens
ttcactgtggccacagccccct

SEQ ID NO: 6567311 - DNA, 21 bp, Homo sapiens
ttcactgtgttggccaggctg

SEQ ID NO: 6567312 - DNA, 22 bp, Homo sapiens
ttcacttaaaagctggctttca

SEQ ID NO: 6567313 - DNA, 15 bp, Homo sapiens
ttcacttaaaatcaa

SEQ ID NO: 6567314 - DNA, 16 bp, Homo sapiens
ttcacttaaaatcaaa

SEQ ID NO: 6567315 - DNA, 22 bp, Homo sapiens
ttcacttaaagactgtctcaaa

SEQ ID NO: 6567316 - DNA, 14 bp, Homo sapiens
ttcacttaatccat

SEQ ID NO: 6567317 - DNA, 15 bp, Homo sapiens
ttcacttatatgttc

SEQ ID NO: 6567318 - DNA, 13 bp, Homo sapiens
ttcacttcacgct

SEQ ID NO: 6567319 - DNA, 16 bp, Homo sapiens
ttcacttcactgtgct

SEQ ID NO: 6567320 - DNA, 20 bp, Homo sapiens
ttcacttcagtttaatgtct

SEQ ID NO: 6567321 - DNA, 18 bp, Homo sapiens
ttcacttcatcttctcag

SEQ ID NO: 6567322 - DNA, 16 bp, Homo sapiens
ttcacttccccaactc

SEQ ID NO: 6567323 - DNA, 14 bp, Homo sapiens
ttcacttcctagag

SEQ ID NO: 6567324 - DNA, 13 bp, Homo sapiens
ttcacttcctcca

SEQ ID NO: 6567325 - DNA, 14 bp, Homo sapiens
ttcacttctcccaa

SEQ ID NO: 6567326 - DNA, 18 bp, Homo sapiens
ttcacttctcccaagact

SEQ ID NO: 6567327 - DNA, 15 bp, Homo sapiens
ttcacttcttaagga

SEQ ID NO: 6567328 - DNA, 21 bp, Homo sapiens
ttcacttcttaaggacagtgt

SEQ ID NO: 6567329 - DNA, 22 bp, Homo sapiens
ttcacttcttaaggacagtgtt

SEQ ID NO: 6567330 - DNA, 12 bp, Homo sapiens
ttcacttcttcc

SEQ ID NO: 6567331 - DNA, 14 bp, Homo sapiens
ttcacttcttccta

SEQ ID NO: 6567332 - DNA, 16 bp, Homo sapiens
ttcacttctttccctt

SEQ ID NO: 6567333 - DNA, 22 bp, Homo sapiens
ttcacttctttcccttcctcca

SEQ ID NO: 6567334 - DNA, 17 bp, Homo sapiens
ttcacttctttgcagag

SEQ ID NO: 6567335 - DNA, 20 bp, Homo sapiens
ttcacttctttgcagagcct

SEQ ID NO: 6567336 - DNA, 17 bp, Homo sapiens
ttcacttcttttctgat

SEQ ID NO: 6567337 - DNA, 14 bp, Homo sapiens
ttcacttgcttaaa

SEQ ID NO: 6567338 - DNA, 18 bp, Homo sapiens
ttcacttgggctctctct

SEQ ID NO: 6567339 - DNA, 19 bp, Homo sapiens
ttcacttgtattgacttta

SEQ ID NO: 6567340 - DNA, 14 bp, Homo sapiens
ttcacttgtctcct

SEQ ID NO: 6567341 - DNA, 24 bp, Homo sapiens
ttcactttaaagcaattgcataat

SEQ ID NO: 6567342 - DNA, 16 bp, Homo sapiens
ttcactttattgctat

SEQ ID NO: 6567343 - DNA, 17 bp, Homo sapiens
ttcactttcaaaaacat

SEQ ID NO: 6567344 - DNA, 10 bp, Homo sapiens
ttcactttga

SEQ ID NO: 6567345 - DNA, 22 bp, Homo sapiens
ttcactttgaaaagttggaagg

SEQ ID NO: 6567346 - DNA, 21 bp, Homo sapiens
ttcactttggggccaattact

SEQ ID NO: 6567347 - DNA, 15 bp, Homo sapiens
ttcacttttaaacta

SEQ ID NO: 6567348 - DNA, 18 bp, Homo sapiens
ttcacttttcaatcccaa

SEQ ID NO: 6567349 - DNA, 13 bp, Homo sapiens
ttcacttttctgt

SEQ ID NO: 6567350 - DNA, 13 bp, Homo sapiens
ttcacttttgttc

SEQ ID NO: 6567351 - DNA, 15 bp, Homo sapiens
ttcacttttttacaa

SEQ ID NO: 6567352 - DNA, 15 bp, Homo sapiens
ttcagaaaaagaaat

SEQ ID NO: 6567353 - DNA, 17 bp, Homo sapiens
ttcagaaacagggcagc

SEQ ID NO: 6567354 - DNA, 16 bp, Homo sapiens
ttcagaaactacagac

SEQ ID NO: 6567355 - DNA, 15 bp, Homo sapiens
ttcagaaagaagtgg

SEQ ID NO: 6567356 - DNA, 18 bp, Homo sapiens
ttcagaaagacagtgact

SEQ ID NO: 6567357 - DNA, 11 bp, Homo sapiens
ttcagaaagag

SEQ ID NO: 6567358 - DNA, 18 bp, Homo sapiens
ttcagaaagatgaagaag

SEQ ID NO: 6567359 - DNA, 13 bp, Homo sapiens
ttcagaaagcatt

SEQ ID NO: 6567360 - DNA, 19 bp, Homo sapiens
ttcagaaagcattacattt

SEQ ID NO: 6567361 - DNA, 20 bp, Homo sapiens
ttcagaaagcattacatttc

SEQ ID NO: 6567362 - DNA, 20 bp, Homo sapiens
ttcagaaagcctttcatttt

SEQ ID NO: 6567363 - DNA, 15 bp, Homo sapiens
ttttagtaaatcctt

SEQ ID NO: 6567364 - DNA, 18 bp, Homo sapiens
ttttagtaatctgtacat

SEQ ID NO: 6567365 - DNA, 14 bp, Homo sapiens
ttttagtaatttct

SEQ ID NO: 6567366 - DNA, 22 bp, Homo sapiens
ttttagtagagacggggtttca

SEQ ID NO: 6567367 - DNA, 19 bp, Homo sapiens
ttttagtataaatgtacat

SEQ ID NO: 6567368 - DNA, 19 bp, Homo sapiens
ttttagtatttatttatgt

SEQ ID NO: 6567369 - DNA, 19 bp, Homo sapiens
ttttagtcactaagacttt

SEQ ID NO: 6567370 - DNA, 13 bp, Homo sapiens
ttttagtccaaat

SEQ ID NO: 6567371 - DNA, 22 bp, Homo sapiens
ttttagtgcaatttcttctgta

SEQ ID NO: 6567372 - DNA, 14 bp, Homo sapiens
ttttagtgcttttg

SEQ ID NO: 6567373 - DNA, 13 bp, Homo sapiens
ttttagtgtatta

SEQ ID NO: 6567374 - DNA, 12 bp, Homo sapiens
ttttagtgtctg

SEQ ID NO: 6567375 - DNA, 13 bp, Homo sapiens
ttttagtgtctga

SEQ ID NO: 6567376 - DNA, 14 bp, Homo sapiens
ttttagtgtctgac

SEQ ID NO: 6567377 - DNA, 15 bp, Homo sapiens
ttttagtgtgtaaaa

SEQ ID NO: 6567378 - DNA, 17 bp, Homo sapiens
ttttagtgtgtaaaatt

SEQ ID NO: 6567379 - DNA, 23 bp, Homo sapiens
ttttagtgtgtaaaattaatgta

SEQ ID NO: 6567380 - DNA, 18 bp, Homo sapiens
ttttagtgtgtgcataat

SEQ ID NO: 6567381 - DNA, 16 bp, Homo sapiens
ttttagtgttaaagag

SEQ ID NO: 6567382 - DNA, 22 bp, Homo sapiens
ttttagtgttaaagagataaag

SEQ ID NO: 6567383 - DNA, 19 bp, Homo sapiens
ttttagtgttttgcaaggg

SEQ ID NO: 6567384 - DNA, 18 bp, Homo sapiens
ttttagttaaatttctgg

SEQ ID NO: 6567385 - DNA, 18 bp, Homo sapiens
ttttagttaatattttta

SEQ ID NO: 6567386 - DNA, 21 bp, Homo sapiens
ttttagttccaacaaagaaag

SEQ ID NO: 6567387 - DNA, 14 bp, Homo sapiens
ttttagttcttcaa

SEQ ID NO: 6567388 - DNA, 23 bp, Homo sapiens
ttttagttggaaaaacaattcct

SEQ ID NO: 6567389 - DNA, 14 bp, Homo sapiens
ttttagttggaatg

SEQ ID NO: 6567390 - DNA, 20 bp, Homo sapiens
ttttagtttaaaaaccttgt

SEQ ID NO: 6567391 - DNA, 17 bp, Homo sapiens
ttttagtttcaaaatgt

SEQ ID NO: 6567392 - DNA, 17 bp, Homo sapiens
ttttagtttctgaactc

SEQ ID NO: 6567393 - DNA, 21 bp, Homo sapiens
ttttagtttctgaactctgac

SEQ ID NO: 6567394 - DNA, 20 bp, Homo sapiens
ttttagtttctgttctgtgg

SEQ ID NO: 6567395 - DNA, 21 bp, Homo sapiens
ttttagtttctgttctgtgga

SEQ ID NO: 6567396 - DNA, 18 bp, Homo sapiens
ttttagtttttcattaaa

SEQ ID NO: 6567397 - DNA, 22 bp, Homo sapiens
ttttagtttttcattaaataaa

SEQ ID NO: 6567398 - DNA, 17 bp, Homo sapiens
ttttataaaattttgct

SEQ ID NO: 6567399 - DNA, 22 bp, Homo sapiens
ttttataaaccacttgagccta

SEQ ID NO: 6567400 - DNA, 12 bp, Homo sapiens
ttttataaactt

SEQ ID NO: 6567401 - DNA, 13 bp, Homo sapiens
ttttataaacttt

SEQ ID NO: 6567402 - DNA, 17 bp, Homo sapiens
ttttataaactttacct

SEQ ID NO: 6567403 - DNA, 19 bp, Homo sapiens
ttttataaactttaccttt

SEQ ID NO: 6567404 - DNA, 12 bp, Homo sapiens
ttttataaagca

SEQ ID NO: 6567405 - DNA, 12 bp, Homo sapiens
ttttataaagtg

SEQ ID NO: 6567406 - DNA, 19 bp, Homo sapiens
ttttataaagtgcttgtgt

SEQ ID NO: 6567407 - DNA, 18 bp, Homo sapiens
ttttataaagtttatcag

SEQ ID NO: 6567408 - DNA, 13 bp, Homo sapiens
ttttataaatact

SEQ ID NO: 6567409 - DNA, 22 bp, Homo sapiens
ttttataaatactgcaaatcag

SEQ ID NO: 6567410 - DNA, 20 bp, Homo sapiens
ttttataaatcgcttttgat

SEQ ID NO: 6567411 - DNA, 16 bp, Homo sapiens
ttttataaatggaggt

SEQ ID NO: 6567412 - DNA, 21 bp, Homo sapiens
ttttataaatggaggtacagg

SEQ ID NO: 6567413 - DNA, 13 bp, Homo sapiens
ttttataaatgtt

SEQ ID NO: 6567414 - DNA, 17 bp, Homo sapiens
ttttataaatgttttaa

SEQ ID NO: 6567415 - DNA, 13 bp, Homo sapiens
ttttataaattaa

SEQ ID NO: 6567416 - DNA, 15 bp, Homo sapiens
ttttataaattaaat

SEQ ID NO: 6567417 - DNA, 16 bp, Homo sapiens
ttttataacaatataa

SEQ ID NO: 6567418 - DNA, 21 bp, Homo sapiens
ttttataacatctttattgaa

SEQ ID NO: 6567419 - DNA, 15 bp, Homo sapiens
ttttataactatata

SEQ ID NO: 6567420 - DNA, 14 bp, Homo sapiens
ttttataactcatg

SEQ ID NO: 6567421 - DNA, 14 bp, Homo sapiens
ttttataagacaaa

SEQ ID NO: 6567422 - DNA, 18 bp, Homo sapiens
ttttataagcaaaaacgt

SEQ ID NO: 6567423 - DNA, 14 bp, Homo sapiens
ttttataagcaaat

SEQ ID NO: 6567424 - DNA, 15 bp, Homo sapiens
ttttataaggaaact

SEQ ID NO: 6567425 - DNA, 13 bp, Homo sapiens
ttttataatgact

SEQ ID NO: 6567426 - DNA, 15 bp, Homo sapiens
ttttataatgattca

SEQ ID NO: 6567427 - DNA, 16 bp, Homo sapiens
ttttataatgattcat

SEQ ID NO: 6567428 - DNA, 22 bp, Homo sapiens
ttttataatgtggatttcctat

SEQ ID NO: 6567429 - DNA, 13 bp, Homo sapiens
ttttataatgtta

SEQ ID NO: 6567430 - DNA, 12 bp, Homo sapiens
ttttataattgg

SEQ ID NO: 6567431 - DNA, 16 bp, Homo sapiens
ttttataattgtacaa

SEQ ID NO: 6567432 - DNA, 19 bp, Homo sapiens
ttttataattttatctgta

SEQ ID NO: 6567433 - DNA, 15 bp, Homo sapiens
ttttataattttcta

SEQ ID NO: 6567434 - DNA, 21 bp, Homo sapiens
ttttataattttgtgaagcaa

SEQ ID NO: 6567435 - DNA, 16 bp, Homo sapiens
ttttatacaagtaatt

SEQ ID NO: 6567436 - DNA, 18 bp, Homo sapiens
ttttatacacaacattta

SEQ ID NO: 6567437 - DNA, 16 bp, Homo sapiens
ttttatacataaacag

SEQ ID NO: 6567438 - DNA, 17 bp, Homo sapiens
ttttatacatagtcaca

SEQ ID NO: 6567439 - DNA, 19 bp, Homo sapiens
ttttatacatatcagaaaa

SEQ ID NO: 6567440 - DNA, 21 bp, Homo sapiens
ttttatacatatcagaaaagt

SEQ ID NO: 6567441 - DNA, 17 bp, Homo sapiens
ttttatacctgtacaca

SEQ ID NO: 6567442 - DNA, 15 bp, Homo sapiens
ttttatacctgttta

SEQ ID NO: 6567443 - DNA, 13 bp, Homo sapiens
ttttatactcttt

SEQ ID NO: 6567444 - DNA, 18 bp, Homo sapiens
ttttatactctttctgta

SEQ ID NO: 6567445 - DNA, 19 bp, Homo sapiens
ttttatactctttctgtat

SEQ ID NO: 6567446 - DNA, 15 bp, Homo sapiens
ttttatactgcacag

SEQ ID NO: 6567447 - DNA, 15 bp, Homo sapiens
ttttatactgtacat

SEQ ID NO: 6567448 - DNA, 17 bp, Homo sapiens
ttttatacttcaaatgt

SEQ ID NO: 6567449 - DNA, 15 bp, Homo sapiens
ttttatagaaaagat

SEQ ID NO: 6567450 - DNA, 14 bp, Homo sapiens
ttttatagaggttc

SEQ ID NO: 6567451 - DNA, 16 bp, Homo sapiens
ttttatagatttgacc

SEQ ID NO: 6567452 - DNA, 20 bp, Homo sapiens
ttttatagcctggactgcta

SEQ ID NO: 6567453 - DNA, 22 bp, Homo sapiens
ttttatagcttaactaatttga

SEQ ID NO: 6567454 - DNA, 18 bp, Homo sapiens
ttttataggaaaaaaact

SEQ ID NO: 6567455 - DNA, 20 bp, Homo sapiens
ttttataggggatacttgaa

SEQ ID NO: 6567456 - DNA, 22 bp, Homo sapiens
ttttataggtcacatatgtctg

SEQ ID NO: 6567457 - DNA, 22 bp, Homo sapiens
ttttatagtattaagtgaaatt

SEQ ID NO: 6567458 - DNA, 19 bp, Homo sapiens
ttttatagtctcaaatcaa

SEQ ID NO: 6567459 - DNA, 16 bp, Homo sapiens
ttttatataaagaaaa

SEQ ID NO: 6567460 - DNA, 17 bp, Homo sapiens
ttttatataataaagta

SEQ ID NO: 6567461 - DNA, 22 bp, Homo sapiens
ttttatataataaagtattcca

SEQ ID NO: 6567462 - DNA, 19 bp, Homo sapiens
ttttatatataaaataaat

SEQ ID NO: 6567463 - DNA, 20 bp, Homo sapiens
ttttatatatataaagtcag

SEQ ID NO: 6567464 - DNA, 14 bp, Homo sapiens
ttttatatatgaat

SEQ ID NO: 6567465 - DNA, 15 bp, Homo sapiens
ttttatatattatat

SEQ ID NO: 6567466 - DNA, 15 bp, Homo sapiens
ttttatatattatgt

SEQ ID NO: 6567467 - DNA, 20 bp, Homo sapiens
ttttatatcaatttaaaaaa

SEQ ID NO: 6567468 - DNA, 14 bp, Homo sapiens
ttttatatcataca

SEQ ID NO: 6567469 - DNA, 16 bp, Homo sapiens
ttttatatctgtaaat

SEQ ID NO: 6567470 - DNA, 15 bp, Homo sapiens
ttttatatctgtatg

SEQ ID NO: 6567471 - DNA, 17 bp, Homo sapiens
ttttatatctgtatgta

SEQ ID NO: 6567472 - DNA, 15 bp, Homo sapiens
ttttatatcttccta

SEQ ID NO: 6567473 - DNA, 15 bp, Homo sapiens
ttttatatgcttctg

SEQ ID NO: 6567474 - DNA, 12 bp, Homo sapiens
ttttatatgtat

SEQ ID NO: 6567475 - DNA, 16 bp, Homo sapiens
ttttatatgtatggat

SEQ ID NO: 6567476 - DNA, 13 bp, Homo sapiens
ttttatatgtgga

SEQ ID NO: 6567477 - DNA, 17 bp, Homo sapiens
ttttatattaaaataag

SEQ ID NO: 6567478 - DNA, 17 bp, Homo sapiens
ttttatattaatgtact

SEQ ID NO: 6567479 - DNA, 21 bp, Homo sapiens
ttttatattacttttgtaaat

SEQ ID NO: 6567480 - DNA, 19 bp, Homo sapiens
ttttatattcagtgaaaag

SEQ ID NO: 6567481 - DNA, 15 bp, Homo sapiens
ttttatattctcagc

SEQ ID NO: 6567482 - DNA, 22 bp, Homo sapiens
ttttatattgataacagcactg

SEQ ID NO: 6567483 - DNA, 21 bp, Homo sapiens
ttttatattgccttatttccc

SEQ ID NO: 6567484 - DNA, 21 bp, Homo sapiens
ttttatattgtttttgtattt

SEQ ID NO: 6567485 - DNA, 11 bp, Homo sapiens
ttttatattta

SEQ ID NO: 6567486 - DNA, 13 bp, Homo sapiens
ttttatatttact

SEQ ID NO: 6567487 - DNA, 13 bp, Homo sapiens
ttttatatttagt

SEQ ID NO: 6567488 - DNA, 15 bp, Homo sapiens
ttttatatttcaagt

SEQ ID NO: 6567489 - DNA, 12 bp, Homo sapiens
ttttatatttgt

SEQ ID NO: 6567490 - DNA, 14 bp, Homo sapiens
ttttatatttgtag

SEQ ID NO: 6567491 - DNA, 16 bp, Homo sapiens
ttttatatttgtatcg

SEQ ID NO: 6567492 - DNA, 16 bp, Homo sapiens
ttttatattttctatt

SEQ ID NO: 6567493 - DNA, 16 bp, Homo sapiens
ttttatcaaggaagtc

SEQ ID NO: 6567494 - DNA, 20 bp, Homo sapiens
ttttatcaattatattatgt

SEQ ID NO: 6567495 - DNA, 14 bp, Homo sapiens
ttttatcaggattt

SEQ ID NO: 6567496 - DNA, 17 bp, Homo sapiens
ttttatcatgacatgtt

SEQ ID NO: 6567497 - DNA, 17 bp, Homo sapiens
ttttatcatttctactg

SEQ ID NO: 6567498 - DNA, 20 bp, Homo sapiens
ttttatcatttctactgaag

SEQ ID NO: 6567499 - DNA, 16 bp, Homo sapiens
ttttatccaatcttgt

SEQ ID NO: 6567500 - DNA, 14 bp, Homo sapiens
ttttatccataatg

SEQ ID NO: 6567501 - DNA, 15 bp, Homo sapiens
ttttatccataatga

SEQ ID NO: 6567502 - DNA, 18 bp, Homo sapiens
ttttatccataatgatgg

SEQ ID NO: 6567503 - DNA, 22 bp, Homo sapiens
ttttatccataatgatggattt

SEQ ID NO: 6567504 - DNA, 17 bp, Homo sapiens
ttttatccctcacctgt

SEQ ID NO: 6567505 - DNA, 21 bp, Homo sapiens
ttttatcccttcctgtctgaa

SEQ ID NO: 6567506 - DNA, 19 bp, Homo sapiens
ttttatcgtcactgcttaa

SEQ ID NO: 6567507 - DNA, 18 bp, Homo sapiens
ttttatcgtttttgttta

SEQ ID NO: 6567508 - DNA, 13 bp, Homo sapiens
ttttatctccaag

SEQ ID NO: 6567509 - DNA, 21 bp, Homo sapiens
ttttatctccatactttggat

SEQ ID NO: 6567510 - DNA, 20 bp, Homo sapiens
ttttatctgaaatcaattaa

SEQ ID NO: 6567511 - DNA, 23 bp, Homo sapiens
ttttatctgaatttttaaacaag

SEQ ID NO: 6567512 - DNA, 13 bp, Homo sapiens
ttttatctgtata

SEQ ID NO: 6567513 - DNA, 13 bp, Homo sapiens
ttttatctgtgga

SEQ ID NO: 6567514 - DNA, 12 bp, Homo sapiens
ttttatcttaaa

SEQ ID NO: 6567515 - DNA, 21 bp, Homo sapiens
ttttatcttaatccattaaaa

SEQ ID NO: 6567516 - DNA, 19 bp, Homo sapiens
ttttatctttcgtgataaa

SEQ ID NO: 6567517 - DNA, 11 bp, Homo sapiens
ttttatctttt

SEQ ID NO: 6567518 - DNA, 13 bp, Homo sapiens
ttttatcttttct

SEQ ID NO: 6567519 - DNA, 17 bp, Homo sapiens
ttttatcttttctacag

SEQ ID NO: 6567520 - DNA, 16 bp, Homo sapiens
ttttatgaacattgta

SEQ ID NO: 6567521 - DNA, 17 bp, Homo sapiens
ttttatgaactgcatca

SEQ ID NO: 6567522 - DNA, 13 bp, Homo sapiens
ttttatgaagaaa

SEQ ID NO: 6567523 - DNA, 16 bp, Homo sapiens
ttttatgactaatcct

SEQ ID NO: 6567524 - DNA, 21 bp, Homo sapiens
ttttatgacttcattaataat

SEQ ID NO: 6567525 - DNA, 19 bp, Homo sapiens
ttttatgagaaagccttct

SEQ ID NO: 6567526 - DNA, 13 bp, Homo sapiens
ttttatgagaaat

SEQ ID NO: 6567527 - DNA, 20 bp, Homo sapiens
ttttatgagacttcctatta

SEQ ID NO: 6567528 - DNA, 21 bp, Homo sapiens
ttttatgagatggatcacata

SEQ ID NO: 6567529 - DNA, 22 bp, Homo sapiens
ttttatgagctcatgtagcaat

SEQ ID NO: 6567530 - DNA, 21 bp, Homo sapiens
ttttatgaggagtgaacattt

SEQ ID NO: 6567531 - DNA, 20 bp, Homo sapiens
ttttatgatgacgtacaagt

SEQ ID NO: 6567532 - DNA, 22 bp, Homo sapiens
ttttatgatggagcaactgaaa

SEQ ID NO: 6567533 - DNA, 16 bp, Homo sapiens
ttttatgcacagccta

SEQ ID NO: 6567534 - DNA, 12 bp, Homo sapiens
ttttatgcagac

SEQ ID NO: 6567535 - DNA, 18 bp, Homo sapiens
ttttatgcagacagtctg

SEQ ID NO: 6567536 - DNA, 22 bp, Homo sapiens
ttttatgcagacagtctgttat

SEQ ID NO: 6567537 - DNA, 13 bp, Homo sapiens
ttttatgcagata

SEQ ID NO: 6567538 - DNA, 18 bp, Homo sapiens
ttttatgccagttgttaa

SEQ ID NO: 6567539 - DNA, 20 bp, Homo sapiens
ttttatgcctttatatactt

SEQ ID NO: 6567540 - DNA, 19 bp, Homo sapiens
ttttatgccttttatttct

SEQ ID NO: 6567541 - DNA, 22 bp, Homo sapiens
ttttatgcgcaaatacaaaatg

SEQ ID NO: 6567542 - DNA, 13 bp, Homo sapiens
ttttatgctcttt

SEQ ID NO: 6567543 - DNA, 22 bp, Homo sapiens
ttcagaaaggggcattttgtac

SEQ ID NO: 6567544 - DNA, 13 bp, Homo sapiens
ttcagaaatatgt

SEQ ID NO: 6567545 - DNA, 19 bp, Homo sapiens
ttcagaaatctggagctgg

SEQ ID NO: 6567546 - DNA, 22 bp, Homo sapiens
ttcagaaatgaggccatggact

SEQ ID NO: 6567547 - DNA, 15 bp, Homo sapiens
ttcagaaatgctgcc

SEQ ID NO: 6567548 - DNA, 20 bp, Homo sapiens
ttcagaaatgctgcctgcct

SEQ ID NO: 6567549 - DNA, 11 bp, Homo sapiens
ttcagaaatgt

SEQ ID NO: 6567550 - DNA, 16 bp, Homo sapiens
ttcagaaatgtgttat

SEQ ID NO: 6567551 - DNA, 12 bp, Homo sapiens
ttcagaaatgtt

SEQ ID NO: 6567552 - DNA, 14 bp, Homo sapiens
ttcagaaattaaaa

SEQ ID NO: 6567553 - DNA, 21 bp, Homo sapiens
ttcagaaattaaaatattatt

SEQ ID NO: 6567554 - DNA, 14 bp, Homo sapiens
ttcagaaattccaa

SEQ ID NO: 6567555 - DNA, 15 bp, Homo sapiens
ttcagaaattctcaa

SEQ ID NO: 6567556 - DNA, 13 bp, Homo sapiens
ttcagaaattgga

SEQ ID NO: 6567557 - DNA, 13 bp, Homo sapiens
ttcagaacagagg

SEQ ID NO: 6567558 - DNA, 17 bp, Homo sapiens
ttcagaacatgctggat

SEQ ID NO: 6567559 - DNA, 12 bp, Homo sapiens
ttcagaacctct

SEQ ID NO: 6567560 - DNA, 18 bp, Homo sapiens
ttcagaactaaatttttc

SEQ ID NO: 6567561 - DNA, 13 bp, Homo sapiens
ttcagaactattt

SEQ ID NO: 6567562 - DNA, 17 bp, Homo sapiens
ttcagaactatttaaaa

SEQ ID NO: 6567563 - DNA, 22 bp, Homo sapiens
ttcagaactctcagactctaaa

SEQ ID NO: 6567564 - DNA, 11 bp, Homo sapiens
ttcagaactgc

SEQ ID NO: 6567565 - DNA, 15 bp, Homo sapiens
ttcagaactgttaaa

SEQ ID NO: 6567566 - DNA, 16 bp, Homo sapiens
ttcagaacttgtaact

SEQ ID NO: 6567567 - DNA, 14 bp, Homo sapiens
ttcagaagaaaaag

SEQ ID NO: 6567568 - DNA, 16 bp, Homo sapiens
ttcagaagaaataaat

SEQ ID NO: 6567569 - DNA, 12 bp, Homo sapiens
ttcagaagagat

SEQ ID NO: 6567570 - DNA, 15 bp, Homo sapiens
ttcagaagcaggcag

SEQ ID NO: 6567571 - DNA, 16 bp, Homo sapiens
ttcagaagcaggcagg

SEQ ID NO: 6567572 - DNA, 17 bp, Homo sapiens
ttcagaagcttctgaaa

SEQ ID NO: 6567573 - DNA, 13 bp, Homo sapiens
ttcagaaggaaac

SEQ ID NO: 6567574 - DNA, 14 bp, Homo sapiens
ttcagaaggagaag

SEQ ID NO: 6567575 - DNA, 20 bp, Homo sapiens
ttcagaaggcctcactcaag

SEQ ID NO: 6567576 - DNA, 20 bp, Homo sapiens
ttcagaaggtatcagttata

SEQ ID NO: 6567577 - DNA, 23 bp, Homo sapiens
ttcagaaggttattttctttatc

SEQ ID NO: 6567578 - DNA, 22 bp, Homo sapiens
ttcagaagtcacacattacaaa

SEQ ID NO: 6567579 - DNA, 23 bp, Homo sapiens
ttcagaagtgagctttgctgcta

SEQ ID NO: 6567580 - DNA, 15 bp, Homo sapiens
ttcagaagttagttt

SEQ ID NO: 6567581 - DNA, 23 bp, Homo sapiens
ttcagaagtttggcaatagtttg

SEQ ID NO: 6567582 - DNA, 21 bp, Homo sapiens
ttcagaatatgtcagtgctga

SEQ ID NO: 6567583 - DNA, 13 bp, Homo sapiens
ttcagaatattca

SEQ ID NO: 6567584 - DNA, 17 bp, Homo sapiens
ttcagaatcctatggaa

SEQ ID NO: 6567585 - DNA, 18 bp, Homo sapiens
ttcagaatctgaatgtaa

SEQ ID NO: 6567586 - DNA, 21 bp, Homo sapiens
ttcagaatcttttcaatgggt

SEQ ID NO: 6567587 - DNA, 20 bp, Homo sapiens
ttcagaatggcagtcctgga

SEQ ID NO: 6567588 - DNA, 13 bp, Homo sapiens
ttcagaatgttgt

SEQ ID NO: 6567589 - DNA, 16 bp, Homo sapiens
ttcagaattaaacttt

SEQ ID NO: 6567590 - DNA, 21 bp, Homo sapiens
ttcagaattttggaaaaatgt

SEQ ID NO: 6567591 - DNA, 16 bp, Homo sapiens
ttcagaattttgtata

SEQ ID NO: 6567592 - DNA, 19 bp, Homo sapiens
ttcagacaaaatggataca

SEQ ID NO: 6567593 - DNA, 16 bp, Homo sapiens
ttcagacaacattatg

SEQ ID NO: 6567594 - DNA, 22 bp, Homo sapiens
ttcagacaacattatgatctaa

SEQ ID NO: 6567595 - DNA, 16 bp, Homo sapiens
ttcagacaagacagag

SEQ ID NO: 6567596 - DNA, 20 bp, Homo sapiens
ttcagacaagcaacaggttt

SEQ ID NO: 6567597 - DNA, 22 bp, Homo sapiens
ttcagacaatatatcataactt

SEQ ID NO: 6567598 - DNA, 19 bp, Homo sapiens
ttcagacacaggaaaaata

SEQ ID NO: 6567599 - DNA, 15 bp, Homo sapiens
ttcagacagctgcct

SEQ ID NO: 6567600 - DNA, 17 bp, Homo sapiens
ttcagacagggtctgaa

SEQ ID NO: 6567601 - DNA, 20 bp, Homo sapiens
ttcagacatagaattaacac

SEQ ID NO: 6567602 - DNA, 11 bp, Homo sapiens
ttcagacattt

SEQ ID NO: 6567603 - DNA, 13 bp, Homo sapiens
ttcagacccagag

SEQ ID NO: 6567604 - DNA, 16 bp, Homo sapiens
ttcagacccctgcctg

SEQ ID NO: 6567605 - DNA, 20 bp, Homo sapiens
ttcagacctggaatgtaagt

SEQ ID NO: 6567606 - DNA, 21 bp, Homo sapiens
ttcagactcccattcctgaag

SEQ ID NO: 6567607 - DNA, 13 bp, Homo sapiens
ttcagactctctc

SEQ ID NO: 6567608 - DNA, 24 bp, Homo sapiens
ttcagactctctcctctctctccc

SEQ ID NO: 6567609 - DNA, 19 bp, Homo sapiens
ttcagactgcctgtctgct

SEQ ID NO: 6567610 - DNA, 14 bp, Homo sapiens
ttcagactggccct

SEQ ID NO: 6567611 - DNA, 16 bp, Homo sapiens
ttcagactgtgcaata

SEQ ID NO: 6567612 - DNA, 14 bp, Homo sapiens
ttcagacttgtcaa

SEQ ID NO: 6567613 - DNA, 15 bp, Homo sapiens
ttcagacttgtcaag

SEQ ID NO: 6567614 - DNA, 18 bp, Homo sapiens
ttcagacttttatcaaaa

SEQ ID NO: 6567615 - DNA, 20 bp, Homo sapiens
ttcagagaaaggactgtgga

SEQ ID NO: 6567616 - DNA, 14 bp, Homo sapiens
ttcagagaaaggca

SEQ ID NO: 6567617 - DNA, 11 bp, Homo sapiens
ttcagagaaat

SEQ ID NO: 6567618 - DNA, 19 bp, Homo sapiens
ttcagagaaatttagagct

SEQ ID NO: 6567619 - DNA, 20 bp, Homo sapiens
ttcagagaaggccttacaga

SEQ ID NO: 6567620 - DNA, 11 bp, Homo sapiens
ttcagagaagt

SEQ ID NO: 6567621 - DNA, 23 bp, Homo sapiens
ttcagagaagtcagttggagaaa

SEQ ID NO: 6567622 - DNA, 21 bp, Homo sapiens
ttcagagaattatctcaagta

SEQ ID NO: 6567623 - DNA, 22 bp, Homo sapiens
ttcagagaattatctcaagtaa

SEQ ID NO: 6567624 - DNA, 18 bp, Homo sapiens
ttcagagagcagtgcttt

SEQ ID NO: 6567625 - DNA, 22 bp, Homo sapiens
ttcagagagcagtgcttttggc

SEQ ID NO: 6567626 - DNA, 15 bp, Homo sapiens
ttcagagaggccttt

SEQ ID NO: 6567627 - DNA, 12 bp, Homo sapiens
ttcagagatgga

SEQ ID NO: 6567628 - DNA, 16 bp, Homo sapiens
ttcagagatggacaga

SEQ ID NO: 6567629 - DNA, 16 bp, Homo sapiens
ttcagagcaggaggcc

SEQ ID NO: 6567630 - DNA, 20 bp, Homo sapiens
ttcagagcataaaacctaaa

SEQ ID NO: 6567631 - DNA, 21 bp, Homo sapiens
ttcagagccaagccttaaact

SEQ ID NO: 6567632 - DNA, 22 bp, Homo sapiens
ttcagagccagtgaaggagcca

SEQ ID NO: 6567633 - DNA, 18 bp, Homo sapiens
ttcagagcccccagccct

SEQ ID NO: 6567634 - DNA, 20 bp, Homo sapiens
ttcagagcccccagccctgg

SEQ ID NO: 6567635 - DNA, 19 bp, Homo sapiens
ttcagagccctcggagcca

SEQ ID NO: 6567636 - DNA, 20 bp, Homo sapiens
ttcagagcctagccacctcc

SEQ ID NO: 6567637 - DNA, 22 bp, Homo sapiens
ttcagagcctagccacctccca

SEQ ID NO: 6567638 - DNA, 17 bp, Homo sapiens
ttcagagctgccctctc

SEQ ID NO: 6567639 - DNA, 14 bp, Homo sapiens
ttcagaggaagcac

SEQ ID NO: 6567640 - DNA, 22 bp, Homo sapiens
ttcagaggcagcaccaccacac

SEQ ID NO: 6567641 - DNA, 22 bp, Homo sapiens
ttcagaggccctcgctgccagc

SEQ ID NO: 6567642 - DNA, 12 bp, Homo sapiens
ttcagaggctca

SEQ ID NO: 6567643 - DNA, 15 bp, Homo sapiens
ttcagagggtaagta

SEQ ID NO: 6567644 - DNA, 21 bp, Homo sapiens
ttcagagggtgtcgtcctgca

SEQ ID NO: 6567645 - DNA, 15 bp, Homo sapiens
ttcagagtatctaat

SEQ ID NO: 6567646 - DNA, 19 bp, Homo sapiens
ttcagagtgaagaatctta

SEQ ID NO: 6567647 - DNA, 14 bp, Homo sapiens
ttcagagtggctca

SEQ ID NO: 6567648 - DNA, 19 bp, Homo sapiens
ttcagagtggctcactggc

SEQ ID NO: 6567649 - DNA, 15 bp, Homo sapiens
ttcagagttctctgt

SEQ ID NO: 6567650 - DNA, 22 bp, Homo sapiens
ttcagagttgatggttgtacat

SEQ ID NO: 6567651 - DNA, 21 bp, Homo sapiens
ttcagagtttgtcatatactg

SEQ ID NO: 6567652 - DNA, 15 bp, Homo sapiens
ttcagagtttgtgtg

SEQ ID NO: 6567653 - DNA, 22 bp, Homo sapiens
ttcagagtttgtgtgtatttgt

SEQ ID NO: 6567654 - DNA, 14 bp, Homo sapiens
ttcagagttttact

SEQ ID NO: 6567655 - DNA, 14 bp, Homo sapiens
ttcagataaatcat

SEQ ID NO: 6567656 - DNA, 18 bp, Homo sapiens
ttcagataactgttattt

SEQ ID NO: 6567657 - DNA, 23 bp, Homo sapiens
ttcagataatggtaatttagtgt

SEQ ID NO: 6567658 - DNA, 18 bp, Homo sapiens
ttcagatacagggtgctc

SEQ ID NO: 6567659 - DNA, 23 bp, Homo sapiens
ttcagatacttgtgaacatgcct

SEQ ID NO: 6567660 - DNA, 16 bp, Homo sapiens
ttcagatagagatatt

SEQ ID NO: 6567661 - DNA, 12 bp, Homo sapiens
ttcagatataaa

SEQ ID NO: 6567662 - DNA, 15 bp, Homo sapiens
ttcagatataaaaga

SEQ ID NO: 6567663 - DNA, 22 bp, Homo sapiens
ttcagatatcaaaattctagct

SEQ ID NO: 6567664 - DNA, 16 bp, Homo sapiens
ttcagatcatggcatc

SEQ ID NO: 6567665 - DNA, 14 bp, Homo sapiens
ttcagatcctgctg

SEQ ID NO: 6567666 - DNA, 16 bp, Homo sapiens
ttcagatcctgctgcc

SEQ ID NO: 6567667 - DNA, 17 bp, Homo sapiens
ttcagatcgtattaatt

SEQ ID NO: 6567668 - DNA, 22 bp, Homo sapiens
ttcagatctgaggttggatttg

SEQ ID NO: 6567669 - DNA, 13 bp, Homo sapiens
ttcagatcttaat

SEQ ID NO: 6567670 - DNA, 22 bp, Homo sapiens
ttcagatgaaaagaaaacttaa

SEQ ID NO: 6567671 - DNA, 18 bp, Homo sapiens
ttcagatgccacttctaa

SEQ ID NO: 6567672 - DNA, 19 bp, Homo sapiens
ttcagatgcttctgggaga

SEQ ID NO: 6567673 - DNA, 13 bp, Homo sapiens
ttcagatgtaatg

SEQ ID NO: 6567674 - DNA, 17 bp, Homo sapiens
ttcagatgtacacccac

SEQ ID NO: 6567675 - DNA, 14 bp, Homo sapiens
ttcagatgtcttct

SEQ ID NO: 6567676 - DNA, 14 bp, Homo sapiens
ttcagatgtgcatt

SEQ ID NO: 6567677 - DNA, 17 bp, Homo sapiens
ttcagatgtggagccag

SEQ ID NO: 6567678 - DNA, 19 bp, Homo sapiens
ttcagatgtggagccaggc

SEQ ID NO: 6567679 - DNA, 12 bp, Homo sapiens
ttcagatgtttc

SEQ ID NO: 6567680 - DNA, 18 bp, Homo sapiens
ttcagatgtttcatcaat

SEQ ID NO: 6567681 - DNA, 14 bp, Homo sapiens
ttcagatgtttcga

SEQ ID NO: 6567682 - DNA, 22 bp, Homo sapiens
ttcagattaggacacagtgtgt

SEQ ID NO: 6567683 - DNA, 21 bp, Homo sapiens
ttcagattatttccagttttt

SEQ ID NO: 6567684 - DNA, 23 bp, Homo sapiens
ttcagattatttccagttttttg

SEQ ID NO: 6567685 - DNA, 21 bp, Homo sapiens
ttcagattcaggcattttccc

SEQ ID NO: 6567686 - DNA, 14 bp, Homo sapiens
ttcagattgctttg

SEQ ID NO: 6567687 - DNA, 14 bp, Homo sapiens
ttcagattgtcttg

SEQ ID NO: 6567688 - DNA, 14 bp, Homo sapiens
ttcagatttcaaat

SEQ ID NO: 6567689 - DNA, 15 bp, Homo sapiens
ttcagatttgcacaa

SEQ ID NO: 6567690 - DNA, 19 bp, Homo sapiens
ttcagatttgcacaaaaag

SEQ ID NO: 6567691 - DNA, 12 bp, Homo sapiens
ttcagatttggc

SEQ ID NO: 6567692 - DNA, 16 bp, Homo sapiens
ttcagattttcagagg

SEQ ID NO: 6567693 - DNA, 23 bp, Homo sapiens
ttcagattttgataactgtttat

SEQ ID NO: 6567694 - DNA, 20 bp, Homo sapiens
ttcagcaaactcttttccca

SEQ ID NO: 6567695 - DNA, 16 bp, Homo sapiens
ttcagcaaatgccttt

SEQ ID NO: 6567696 - DNA, 19 bp, Homo sapiens
ttcagcaaatgccttttca

SEQ ID NO: 6567697 - DNA, 23 bp, Homo sapiens
ttcagcaacaagactgccaggtg

SEQ ID NO: 6567698 - DNA, 13 bp, Homo sapiens
ttcagcaactcag

SEQ ID NO: 6567699 - DNA, 18 bp, Homo sapiens
ttcagcaagataaacatt

SEQ ID NO: 6567700 - DNA, 19 bp, Homo sapiens
ttcagcaagataaacatta

SEQ ID NO: 6567701 - DNA, 21 bp, Homo sapiens
ttcagcaatatttaaggagat

SEQ ID NO: 6567702 - DNA, 22 bp, Homo sapiens
ttcagcaatgataatgagcaga

SEQ ID NO: 6567703 - DNA, 14 bp, Homo sapiens
ttcagcacacccca

SEQ ID NO: 6567704 - DNA, 19 bp, Homo sapiens
ttcagcacactgtgaaaat

SEQ ID NO: 6567705 - DNA, 17 bp, Homo sapiens
ttcagcacccccaccca

SEQ ID NO: 6567706 - DNA, 20 bp, Homo sapiens
ttcagcacccccacccacct

SEQ ID NO: 6567707 - DNA, 21 bp, Homo sapiens
ttcagcacccccacccacctc

SEQ ID NO: 6567708 - DNA, 13 bp, Homo sapiens
ttcagcaccctgg

SEQ ID NO: 6567709 - DNA, 17 bp, Homo sapiens
ttcagcaccctgggtgc

SEQ ID NO: 6567710 - DNA, 16 bp, Homo sapiens
ttcagcactagccaaa

SEQ ID NO: 6567711 - DNA, 16 bp, Homo sapiens
ttcagcagaacctgca

SEQ ID NO: 6567712 - DNA, 23 bp, Homo sapiens
ttcagcagaacctgcacacagga

SEQ ID NO: 6567713 - DNA, 13 bp, Homo sapiens
ttcagcaggcagc

SEQ ID NO: 6567714 - DNA, 11 bp, Homo sapiens
ttcagcagtgc

SEQ ID NO: 6567715 - DNA, 17 bp, Homo sapiens
ttcagcagtttctgaca

SEQ ID NO: 6567716 - DNA, 18 bp, Homo sapiens
ttcagcatcaaacatgaa

SEQ ID NO: 6567717 - DNA, 19 bp, Homo sapiens
ttcagcatccgcaggtgct

SEQ ID NO: 6567718 - DNA, 20 bp, Homo sapiens
ttcagcatctaaagcagcag

SEQ ID NO: 6567719 - DNA, 22 bp, Homo sapiens
ttcagcatctaaagcagcaggt

SEQ ID NO: 6567720 - DNA, 20 bp, Homo sapiens
ttcagcatgactatgtattt

SEQ ID NO: 6567721 - DNA, 13 bp, Homo sapiens
ttcagcatggttt

SEQ ID NO: 6567722 - DNA, 19 bp, Homo sapiens
ttttatggcttttgtgcat

SEQ ID NO: 6567723 - DNA, 16 bp, Homo sapiens
ttttatgggtgaaaat

SEQ ID NO: 6567724 - DNA, 16 bp, Homo sapiens
ttttatggtagctttt

SEQ ID NO: 6567725 - DNA, 18 bp, Homo sapiens
ttttatggtgcctagtat

SEQ ID NO: 6567726 - DNA, 15 bp, Homo sapiens
ttttatggttatgtt

SEQ ID NO: 6567727 - DNA, 21 bp, Homo sapiens
ttttatggttccaatgaaata

SEQ ID NO: 6567728 - DNA, 15 bp, Homo sapiens
ttttatgtaaatttt

SEQ ID NO: 6567729 - DNA, 22 bp, Homo sapiens
ttttatgtaatttctttaaatg

SEQ ID NO: 6567730 - DNA, 14 bp, Homo sapiens
ttttatgtactttg

SEQ ID NO: 6567731 - DNA, 20 bp, Homo sapiens
ttttatgtattgtgctttta

SEQ ID NO: 6567732 - DNA, 16 bp, Homo sapiens
ttttatgtattttcca

SEQ ID NO: 6567733 - DNA, 18 bp, Homo sapiens
ttttatgtcatagaaata

SEQ ID NO: 6567734 - DNA, 16 bp, Homo sapiens
ttttatgtctcttaga

SEQ ID NO: 6567735 - DNA, 19 bp, Homo sapiens
ttttatgtgaaacatgttt

SEQ ID NO: 6567736 - DNA, 19 bp, Homo sapiens
ttttatgtgaatgtggcaa

SEQ ID NO: 6567737 - DNA, 14 bp, Homo sapiens
ttttatgtgatatg

SEQ ID NO: 6567738 - DNA, 20 bp, Homo sapiens
ttttatgtgctatgcaaaat

SEQ ID NO: 6567739 - DNA, 21 bp, Homo sapiens
ttttatgtgctctcatcagaa

SEQ ID NO: 6567740 - DNA, 14 bp, Homo sapiens
ttttatgtggtctt

SEQ ID NO: 6567741 - DNA, 15 bp, Homo sapiens
ttttatgtggtctta

SEQ ID NO: 6567742 - DNA, 13 bp, Homo sapiens
ttttatgtgtaaa

SEQ ID NO: 6567743 - DNA, 14 bp, Homo sapiens
ttttatgtgttctt

SEQ ID NO: 6567744 - DNA, 23 bp, Homo sapiens
ttttatgtgtttggatacatctg

SEQ ID NO: 6567745 - DNA, 18 bp, Homo sapiens
ttttatgttgacatttgt

SEQ ID NO: 6567746 - DNA, 23 bp, Homo sapiens
ttttatgttgacatttgtttggt

SEQ ID NO: 6567747 - DNA, 20 bp, Homo sapiens
ttttatgttggttgatataa

SEQ ID NO: 6567748 - DNA, 15 bp, Homo sapiens
ttttatgtttagata

SEQ ID NO: 6567749 - DNA, 14 bp, Homo sapiens
ttttatgtttgaat

SEQ ID NO: 6567750 - DNA, 15 bp, Homo sapiens
ttttatgtttgaata

SEQ ID NO: 6567751 - DNA, 13 bp, Homo sapiens
ttttatgtttgta

SEQ ID NO: 6567752 - DNA, 15 bp, Homo sapiens
ttttatgtttgtaca

SEQ ID NO: 6567753 - DNA, 14 bp, Homo sapiens
ttttatgttttatt

SEQ ID NO: 6567754 - DNA, 18 bp, Homo sapiens
ttttatgttttattagca

SEQ ID NO: 6567755 - DNA, 16 bp, Homo sapiens
ttttatgttttgtttt

SEQ ID NO: 6567756 - DNA, 14 bp, Homo sapiens
ttttattaaaaata

SEQ ID NO: 6567757 - DNA, 22 bp, Homo sapiens
ttttattaaaatatttcaggtt

SEQ ID NO: 6567758 - DNA, 15 bp, Homo sapiens
ttttattaaacacag

SEQ ID NO: 6567759 - DNA, 12 bp, Homo sapiens
ttttattaaagc

SEQ ID NO: 6567760 - DNA, 14 bp, Homo sapiens
ttttattaaatgta

SEQ ID NO: 6567761 - DNA, 12 bp, Homo sapiens
ttttattaagaa

SEQ ID NO: 6567762 - DNA, 21 bp, Homo sapiens
ttttattaatcactgtgtata

SEQ ID NO: 6567763 - DNA, 13 bp, Homo sapiens
ttttattaatcta

SEQ ID NO: 6567764 - DNA, 19 bp, Homo sapiens
ttttattaatctactgtat

SEQ ID NO: 6567765 - DNA, 14 bp, Homo sapiens
ttttattacagaaa

SEQ ID NO: 6567766 - DNA, 18 bp, Homo sapiens
ttttattacagaaatgtt

SEQ ID NO: 6567767 - DNA, 18 bp, Homo sapiens
ttttattacattagttaa

SEQ ID NO: 6567768 - DNA, 18 bp, Homo sapiens
ttttattacggtgatcct

SEQ ID NO: 6567769 - DNA, 12 bp, Homo sapiens
ttttattactct

SEQ ID NO: 6567770 - DNA, 14 bp, Homo sapiens
ttttattagacatt

SEQ ID NO: 6567771 - DNA, 17 bp, Homo sapiens
ttttattagacattctc

SEQ ID NO: 6567772 - DNA, 12 bp, Homo sapiens
ttttattagcat

SEQ ID NO: 6567773 - DNA, 15 bp, Homo sapiens
ttttattagtattgt

SEQ ID NO: 6567774 - DNA, 23 bp, Homo sapiens
ttttattagtattgttgtccttt

SEQ ID NO: 6567775 - DNA, 13 bp, Homo sapiens
ttttattatcagt

SEQ ID NO: 6567776 - DNA, 12 bp, Homo sapiens
ttttattatgaa

SEQ ID NO: 6567777 - DNA, 12 bp, Homo sapiens
ttttattatgca

SEQ ID NO: 6567778 - DNA, 19 bp, Homo sapiens
ttttattatgcataactga

SEQ ID NO: 6567779 - DNA, 22 bp, Homo sapiens
ttttattattcagaattataca

SEQ ID NO: 6567780 - DNA, 13 bp, Homo sapiens
ttttattatttct

SEQ ID NO: 6567781 - DNA, 19 bp, Homo sapiens
ttttattatttttacctaa

SEQ ID NO: 6567782 - DNA, 18 bp, Homo sapiens
ttttattatttttatact

SEQ ID NO: 6567783 - DNA, 13 bp, Homo sapiens
ttttattcaaact

SEQ ID NO: 6567784 - DNA, 23 bp, Homo sapiens
ttttattcaaggtaaaattctaa

SEQ ID NO: 6567785 - DNA, 12 bp, Homo sapiens
ttttattcacat

SEQ ID NO: 6567786 - DNA, 20 bp, Homo sapiens
ttttattcacttgtgtttgt

SEQ ID NO: 6567787 - DNA, 12 bp, Homo sapiens
ttttattcagca

SEQ ID NO: 6567788 - DNA, 19 bp, Homo sapiens
ttttattcagcagactttc

SEQ ID NO: 6567789 - DNA, 20 bp, Homo sapiens
ttttattcagctagaatttc

SEQ ID NO: 6567790 - DNA, 18 bp, Homo sapiens
ttttattcataagccaat

SEQ ID NO: 6567791 - DNA, 15 bp, Homo sapiens
ttttattccacatct

SEQ ID NO: 6567792 - DNA, 22 bp, Homo sapiens
ttttattcctcttattgggata

SEQ ID NO: 6567793 - DNA, 17 bp, Homo sapiens
ttttattcctttgaata

SEQ ID NO: 6567794 - DNA, 23 bp, Homo sapiens
ttttattcggcatttaacttaca

SEQ ID NO: 6567795 - DNA, 16 bp, Homo sapiens
ttttattgaaagctca

SEQ ID NO: 6567796 - DNA, 22 bp, Homo sapiens
ttttattgaaatgtataattaa

SEQ ID NO: 6567797 - DNA, 20 bp, Homo sapiens
ttttattgaatactgtctgt

SEQ ID NO: 6567798 - DNA, 18 bp, Homo sapiens
ttttattgacacagaaaa

SEQ ID NO: 6567799 - DNA, 19 bp, Homo sapiens
ttttattgagaattttaaa

SEQ ID NO: 6567800 - DNA, 15 bp, Homo sapiens
ttttattgagatttt

SEQ ID NO: 6567801 - DNA, 21 bp, Homo sapiens
ttttattgagcaagtatcctt

SEQ ID NO: 6567802 - DNA, 15 bp, Homo sapiens
ttttattgatgtgaa

SEQ ID NO: 6567803 - DNA, 21 bp, Homo sapiens
ttttattgcatttgctgttgt

SEQ ID NO: 6567804 - DNA, 13 bp, Homo sapiens
ttttattgccttc

SEQ ID NO: 6567805 - DNA, 15 bp, Homo sapiens
ttttattgccttctc

SEQ ID NO: 6567806 - DNA, 19 bp, Homo sapiens
ttttattgctagtatttga

SEQ ID NO: 6567807 - DNA, 21 bp, Homo sapiens
ttttattgctagtatttgaat

SEQ ID NO: 6567808 - DNA, 22 bp, Homo sapiens
ttttattgctcgcccagacacc

SEQ ID NO: 6567809 - DNA, 13 bp, Homo sapiens
ttttattgctgga

SEQ ID NO: 6567810 - DNA, 23 bp, Homo sapiens
ttttattggggaattaaatagtg

SEQ ID NO: 6567811 - DNA, 13 bp, Homo sapiens
ttttattgttgaa

SEQ ID NO: 6567812 - DNA, 13 bp, Homo sapiens
ttttattgttgta

SEQ ID NO: 6567813 - DNA, 14 bp, Homo sapiens
ttttattgttttca

SEQ ID NO: 6567814 - DNA, 16 bp, Homo sapiens
ttttatttaaactatt

SEQ ID NO: 6567815 - DNA, 16 bp, Homo sapiens
ttttatttaaatgctt

SEQ ID NO: 6567816 - DNA, 19 bp, Homo sapiens
ttttatttaacagtgcaaa

SEQ ID NO: 6567817 - DNA, 22 bp, Homo sapiens
ttttatttaggcttttccaaat

SEQ ID NO: 6567818 - DNA, 17 bp, Homo sapiens
ttttatttagggaacat

SEQ ID NO: 6567819 - DNA, 19 bp, Homo sapiens
ttttatttagttgaaaaat

SEQ ID NO: 6567820 - DNA, 17 bp, Homo sapiens
ttttatttataaatgag

SEQ ID NO: 6567821 - DNA, 14 bp, Homo sapiens
ttttatttatatct

SEQ ID NO: 6567822 - DNA, 15 bp, Homo sapiens
ttttatttatatctt

SEQ ID NO: 6567823 - DNA, 16 bp, Homo sapiens
ttttatttatatgtat

SEQ ID NO: 6567824 - DNA, 12 bp, Homo sapiens
ttttatttatga

SEQ ID NO: 6567825 - DNA, 15 bp, Homo sapiens
ttttatttattttat

SEQ ID NO: 6567826 - DNA, 12 bp, Homo sapiens
ttttatttcagt

SEQ ID NO: 6567827 - DNA, 13 bp, Homo sapiens
ttttatttcagtg

SEQ ID NO: 6567828 - DNA, 15 bp, Homo sapiens
ttttatttcctgtat

SEQ ID NO: 6567829 - DNA, 14 bp, Homo sapiens
ttttatttctaagt

SEQ ID NO: 6567830 - DNA, 16 bp, Homo sapiens
ttttatttctcctttt

SEQ ID NO: 6567831 - DNA, 16 bp, Homo sapiens
ttttatttctgatgtt

SEQ ID NO: 6567832 - DNA, 12 bp, Homo sapiens
ttttatttgcat

SEQ ID NO: 6567833 - DNA, 15 bp, Homo sapiens
ttttatttgcatgtg

SEQ ID NO: 6567834 - DNA, 18 bp, Homo sapiens
ttttatttggtgtgttcg

SEQ ID NO: 6567835 - DNA, 15 bp, Homo sapiens
ttttatttgtaaagt

SEQ ID NO: 6567836 - DNA, 14 bp, Homo sapiens
ttttatttgtaatt

SEQ ID NO: 6567837 - DNA, 11 bp, Homo sapiens
ttttattttaa

SEQ ID NO: 6567838 - DNA, 15 bp, Homo sapiens
ttttattttactatt

SEQ ID NO: 6567839 - DNA, 12 bp, Homo sapiens
ttttattttcaa

SEQ ID NO: 6567840 - DNA, 14 bp, Homo sapiens
ttttattttcaaat

SEQ ID NO: 6567841 - DNA, 18 bp, Homo sapiens
ttttattttcaagcaaat

SEQ ID NO: 6567842 - DNA, 20 bp, Homo sapiens
ttttattttcaccctctgta

SEQ ID NO: 6567843 - DNA, 16 bp, Homo sapiens
ttttattttcatactt

SEQ ID NO: 6567844 - DNA, 12 bp, Homo sapiens
ttttattttcca

SEQ ID NO: 6567845 - DNA, 13 bp, Homo sapiens
ttttattttctaa

SEQ ID NO: 6567846 - DNA, 14 bp, Homo sapiens
ttttattttgccaa

SEQ ID NO: 6567847 - DNA, 12 bp, Homo sapiens
ttttattttgct

SEQ ID NO: 6567848 - DNA, 13 bp, Homo sapiens
ttttattttgctg

SEQ ID NO: 6567849 - DNA, 13 bp, Homo sapiens
ttttattttggaa

SEQ ID NO: 6567850 - DNA, 15 bp, Homo sapiens
ttttattttggaact

SEQ ID NO: 6567851 - DNA, 15 bp, Homo sapiens
ttttattttggaatt

SEQ ID NO: 6567852 - DNA, 15 bp, Homo sapiens
ttttattttgtaata

SEQ ID NO: 6567853 - DNA, 15 bp, Homo sapiens
ttttattttgtaatt

SEQ ID NO: 6567854 - DNA, 16 bp, Homo sapiens
ttttattttgtaatta

SEQ ID NO: 6567855 - DNA, 14 bp, Homo sapiens
ttttattttgtttt

SEQ ID NO: 6567856 - DNA, 15 bp, Homo sapiens
ttttatttttaagaa

SEQ ID NO: 6567857 - DNA, 17 bp, Homo sapiens
ttttatttttagaattt

SEQ ID NO: 6567858 - DNA, 16 bp, Homo sapiens
ttttatttttatccca

SEQ ID NO: 6567859 - DNA, 12 bp, Homo sapiens
ttttatttttga

SEQ ID NO: 6567860 - DNA, 12 bp, Homo sapiens
ttttatttttgc

SEQ ID NO: 6567861 - DNA, 15 bp, Homo sapiens
ttttattttttaagt

SEQ ID NO: 6567862 - DNA, 18 bp, Homo sapiens
ttttatttttttaccaat

SEQ ID NO: 6567863 - DNA, 17 bp, Homo sapiens
ttttatttttttctacc

SEQ ID NO: 6567864 - DNA, 18 bp, Homo sapiens
ttttattttttttctgta

SEQ ID NO: 6567865 - DNA, 16 bp, Homo sapiens
ttttcaaaaaaatgtt

SEQ ID NO: 6567866 - DNA, 22 bp, Homo sapiens
ttttcaaaacatacaagcaaca

SEQ ID NO: 6567867 - DNA, 14 bp, Homo sapiens
ttttcaaaagaaaa

SEQ ID NO: 6567868 - DNA, 20 bp, Homo sapiens
ttttcaaaatccaaaaagaa

SEQ ID NO: 6567869 - DNA, 14 bp, Homo sapiens
ttttcaaaatgaag

SEQ ID NO: 6567870 - DNA, 12 bp, Homo sapiens
ttttcaaacaaa

SEQ ID NO: 6567871 - DNA, 20 bp, Homo sapiens
ttttcaaacaaagatgccac

SEQ ID NO: 6567872 - DNA, 21 bp, Homo sapiens
ttttcaaacctcaaatatagt

SEQ ID NO: 6567873 - DNA, 22 bp, Homo sapiens
ttttcaaacctcaaatatagta

SEQ ID NO: 6567874 - DNA, 14 bp, Homo sapiens
ttttcaaactgctg

SEQ ID NO: 6567875 - DNA, 12 bp, Homo sapiens
ttttcaaacttt

SEQ ID NO: 6567876 - DNA, 11 bp, Homo sapiens
ttttcaaagat

SEQ ID NO: 6567877 - DNA, 14 bp, Homo sapiens
ttttcaaagattgt

SEQ ID NO: 6567878 - DNA, 21 bp, Homo sapiens
ttttcaaatatgtaaacttta

SEQ ID NO: 6567879 - DNA, 20 bp, Homo sapiens
ttttcaaatattgaatgcct

SEQ ID NO: 6567880 - DNA, 13 bp, Homo sapiens
ttttcaaatcctt

SEQ ID NO: 6567881 - DNA, 17 bp, Homo sapiens
ttttcaaatgagtttaa

SEQ ID NO: 6567882 - DNA, 15 bp, Homo sapiens
ttttcaaatgttctc

SEQ ID NO: 6567883 - DNA, 12 bp, Homo sapiens
ttttcaacaagc

SEQ ID NO: 6567884 - DNA, 17 bp, Homo sapiens
ttttcaacgcagccctg

SEQ ID NO: 6567885 - DNA, 21 bp, Homo sapiens
ttttcaacgcagccctgcttt

SEQ ID NO: 6567886 - DNA, 23 bp, Homo sapiens
ttttcaactgccaaaatgctcta

SEQ ID NO: 6567887 - DNA, 13 bp, Homo sapiens
ttttcaactttga

SEQ ID NO: 6567888 - DNA, 15 bp, Homo sapiens
ttttcaactttgaat

SEQ ID NO: 6567889 - DNA, 16 bp, Homo sapiens
ttttcaactttgaata

SEQ ID NO: 6567890 - DNA, 18 bp, Homo sapiens
ttttcaactttgaataaa

SEQ ID NO: 6567891 - DNA, 21 bp, Homo sapiens
ttttcaactttgaataaagaa

SEQ ID NO: 6567892 - DNA, 24 bp, Homo sapiens
ttttcaactttgaataaagaatac

SEQ ID NO: 6567893 - DNA, 18 bp, Homo sapiens
ttttcaagaaaattttgc

SEQ ID NO: 6567894 - DNA, 14 bp, Homo sapiens
ttttcaagaaactg

SEQ ID NO: 6567895 - DNA, 16 bp, Homo sapiens
ttttcaagaagttctt

SEQ ID NO: 6567896 - DNA, 19 bp, Homo sapiens
ttttcaagcaaaacagttc

SEQ ID NO: 6567897 - DNA, 21 bp, Homo sapiens
ttttcaagcatctcctgagga

SEQ ID NO: 6567898 - DNA, 21 bp, Homo sapiens
ttttcaaggaaaaatgctgct

SEQ ID NO: 6567899 - DNA, 17 bp, Homo sapiens
ttttcaaggaagaaaac

SEQ ID NO: 6567900 - DNA, 13 bp, Homo sapiens
ttttcaaggaagg

SEQ ID NO: 6567901 - DNA, 20 bp, Homo sapiens
ttttcaaggcatttgtcttt

SEQ ID NO: 6567902 - DNA, 12 bp, Homo sapiens
ttttcaaggcct

SEQ ID NO: 6567903 - DNA, 17 bp, Homo sapiens
ttttcaaggccttcagt

SEQ ID NO: 6567904 - DNA, 21 bp, Homo sapiens
ttttcaaggccttcagtttat

SEQ ID NO: 6567905 - DNA, 22 bp, Homo sapiens
ttcagcattaagctgttcctgt

SEQ ID NO: 6567906 - DNA, 19 bp, Homo sapiens
ttcagcattattcctccag

SEQ ID NO: 6567907 - DNA, 19 bp, Homo sapiens
ttcagcattcttagcctgt

SEQ ID NO: 6567908 - DNA, 11 bp, Homo sapiens
ttcagcatttg

SEQ ID NO: 6567909 - DNA, 21 bp, Homo sapiens
ttcagcatttgttctttgcca

SEQ ID NO: 6567910 - DNA, 14 bp, Homo sapiens
ttcagccaaacagt

SEQ ID NO: 6567911 - DNA, 23 bp, Homo sapiens
ttcagccaaacagtatgatggaa

SEQ ID NO: 6567912 - DNA, 16 bp, Homo sapiens
ttcagccaaagtccta

SEQ ID NO: 6567913 - DNA, 22 bp, Homo sapiens
ttcagccaatctggacacttct

SEQ ID NO: 6567914 - DNA, 19 bp, Homo sapiens
ttcagccaatttgtctcct

SEQ ID NO: 6567915 - DNA, 11 bp, Homo sapiens
ttcagccacat

SEQ ID NO: 6567916 - DNA, 21 bp, Homo sapiens
ttcagccagaatcttcgtcct

SEQ ID NO: 6567917 - DNA, 17 bp, Homo sapiens
ttcagccagcttaaacc

SEQ ID NO: 6567918 - DNA, 12 bp, Homo sapiens
ttcagccaggca

SEQ ID NO: 6567919 - DNA, 17 bp, Homo sapiens
ttcagccaggcaagaaa

SEQ ID NO: 6567920 - DNA, 21 bp, Homo sapiens
ttcagccaggtctgactccaa

SEQ ID NO: 6567921 - DNA, 21 bp, Homo sapiens
ttcagccatcaacaagagttg

SEQ ID NO: 6567922 - DNA, 14 bp, Homo sapiens
ttcagccattcaca

SEQ ID NO: 6567923 - DNA, 21 bp, Homo sapiens
ttcagcccaccagccacctca

SEQ ID NO: 6567924 - DNA, 14 bp, Homo sapiens
ttcagcccctcctc

SEQ ID NO: 6567925 - DNA, 18 bp, Homo sapiens
ttcagcccctcctctgcc

SEQ ID NO: 6567926 - DNA, 19 bp, Homo sapiens
ttcagcccctcctctgcca

SEQ ID NO: 6567927 - DNA, 14 bp, Homo sapiens
ttcagccccttctc

SEQ ID NO: 6567928 - DNA, 18 bp, Homo sapiens
ttcagccctggccaagct

SEQ ID NO: 6567929 - DNA, 18 bp, Homo sapiens
ttcagccgaattgtggtg

SEQ ID NO: 6567930 - DNA, 21 bp, Homo sapiens
ttcagcctagccgacctcagc

SEQ ID NO: 6567931 - DNA, 23 bp, Homo sapiens
ttcagcctagtggcttgtcctca

SEQ ID NO: 6567932 - DNA, 10 bp, Homo sapiens
ttcagcctcg

SEQ ID NO: 6567933 - DNA, 16 bp, Homo sapiens
ttcagcctcgtctctt

SEQ ID NO: 6567934 - DNA, 15 bp, Homo sapiens
ttcagcctctttctg

SEQ ID NO: 6567935 - DNA, 20 bp, Homo sapiens
ttcagcctgccttcttttct

SEQ ID NO: 6567936 - DNA, 10 bp, Homo sapiens
ttcagcctgg

SEQ ID NO: 6567937 - DNA, 11 bp, Homo sapiens
ttcagcctggc

SEQ ID NO: 6567938 - DNA, 12 bp, Homo sapiens
ttcagcctgtct

SEQ ID NO: 6567939 - DNA, 17 bp, Homo sapiens
ttcagccttcgtgtggc

SEQ ID NO: 6567940 - DNA, 13 bp, Homo sapiens
ttcagccttcttt

SEQ ID NO: 6567941 - DNA, 21 bp, Homo sapiens
ttcagccttctttttctggac

SEQ ID NO: 6567942 - DNA, 19 bp, Homo sapiens
ttcagcgcccccaggcctg

SEQ ID NO: 6567943 - DNA, 20 bp, Homo sapiens
ttcagcgcccccaggcctgc

SEQ ID NO: 6567944 - DNA, 22 bp, Homo sapiens
ttcagcggcagtgtgtccatca

SEQ ID NO: 6567945 - DNA, 17 bp, Homo sapiens
ttcagcggtttatataa

SEQ ID NO: 6567946 - DNA, 16 bp, Homo sapiens
ttcagcgttttgcaag

SEQ ID NO: 6567947 - DNA, 20 bp, Homo sapiens
ttcagctaagctaggaatga

SEQ ID NO: 6567948 - DNA, 18 bp, Homo sapiens
ttcagctagaatttctgg

SEQ ID NO: 6567949 - DNA, 16 bp, Homo sapiens
ttcagctagacaatga

SEQ ID NO: 6567950 - DNA, 19 bp, Homo sapiens
ttcagctagcttttaggaa

SEQ ID NO: 6567951 - DNA, 19 bp, Homo sapiens
ttcagctcacgcttcacag

SEQ ID NO: 6567952 - DNA, 20 bp, Homo sapiens
ttcagctcacgcttcacagt

SEQ ID NO: 6567953 - DNA, 13 bp, Homo sapiens
ttcagctcactgt

SEQ ID NO: 6567954 - DNA, 17 bp, Homo sapiens
ttcagctcattatgaaa

SEQ ID NO: 6567955 - DNA, 12 bp, Homo sapiens
ttcagctccagc

SEQ ID NO: 6567956 - DNA, 14 bp, Homo sapiens
ttcagctccagccc

SEQ ID NO: 6567957 - DNA, 21 bp, Homo sapiens
ttcagctccagcccctttcca

SEQ ID NO: 6567958 - DNA, 13 bp, Homo sapiens
ttcagctcccata

SEQ ID NO: 6567959 - DNA, 13 bp, Homo sapiens
ttcagctcctgag

SEQ ID NO: 6567960 - DNA, 11 bp, Homo sapiens
ttcagctcctt

SEQ ID NO: 6567961 - DNA, 21 bp, Homo sapiens
ttcagctctctgtataaacat

SEQ ID NO: 6567962 - DNA, 17 bp, Homo sapiens
ttcagctctgcaagaat

SEQ ID NO: 6567963 - DNA, 16 bp, Homo sapiens
ttcagctctttccaaa

SEQ ID NO: 6567964 - DNA, 13 bp, Homo sapiens
ttcagctcttttt

SEQ ID NO: 6567965 - DNA, 18 bp, Homo sapiens
ttcagctgaacacaagca

SEQ ID NO: 6567966 - DNA, 13 bp, Homo sapiens
ttcagctgagccc

SEQ ID NO: 6567967 - DNA, 13 bp, Homo sapiens
ttcagctgcagtt

SEQ ID NO: 6567968 - DNA, 23 bp, Homo sapiens
ttcagctgcccccgctcatgggc

SEQ ID NO: 6567969 - DNA, 19 bp, Homo sapiens
ttcagctgcctgaaacagc

SEQ ID NO: 6567970 - DNA, 15 bp, Homo sapiens
ttcagctgctgacaa

SEQ ID NO: 6567971 - DNA, 22 bp, Homo sapiens
ttcagctggaaacttctgtaag

SEQ ID NO: 6567972 - DNA, 23 bp, Homo sapiens
ttcagctgggtcacatccatccc

SEQ ID NO: 6567973 - DNA, 11 bp, Homo sapiens
ttcagctggtg

SEQ ID NO: 6567974 - DNA, 15 bp, Homo sapiens
ttcagctgtcctccc

SEQ ID NO: 6567975 - DNA, 19 bp, Homo sapiens
ttcagctgtcctccctcca

SEQ ID NO: 6567976 - DNA, 21 bp, Homo sapiens
ttcagctgtcctccctccacc

SEQ ID NO: 6567977 - DNA, 16 bp, Homo sapiens
ttcagctgtcttttgg

SEQ ID NO: 6567978 - DNA, 20 bp, Homo sapiens
ttcagctgtcttttggagga

SEQ ID NO: 6567979 - DNA, 20 bp, Homo sapiens
ttcagctgtgaacatggact

SEQ ID NO: 6567980 - DNA, 23 bp, Homo sapiens
ttcagctgtgaacatggactctt

SEQ ID NO: 6567981 - DNA, 22 bp, Homo sapiens
ttcagcttcgtttattttcaag

SEQ ID NO: 6567982 - DNA, 19 bp, Homo sapiens
ttcagcttctataagtgtg

SEQ ID NO: 6567983 - DNA, 19 bp, Homo sapiens
ttcagcttgaacctgcttc

SEQ ID NO: 6567984 - DNA, 21 bp, Homo sapiens
ttcagcttgtttctatactgt

SEQ ID NO: 6567985 - DNA, 20 bp, Homo sapiens
ttcagctttaaaggccagga

SEQ ID NO: 6567986 - DNA, 13 bp, Homo sapiens
ttcagctttggat

SEQ ID NO: 6567987 - DNA, 20 bp, Homo sapiens
ttcagctttggctctggctg

SEQ ID NO: 6567988 - DNA, 23 bp, Homo sapiens
ttcagctttggtgaaagggaggg

SEQ ID NO: 6567989 - DNA, 23 bp, Homo sapiens
ttcagcttttttttcagccattc

SEQ ID NO: 6567990 - DNA, 20 bp, Homo sapiens
ttcaggaaaagcctctgtgt

SEQ ID NO: 6567991 - DNA, 17 bp, Homo sapiens
ttcaggaaaaggcctgg

SEQ ID NO: 6567992 - DNA, 13 bp, Homo sapiens
ttcaggaaaattg

SEQ ID NO: 6567993 - DNA, 19 bp, Homo sapiens
ttcaggaaagcagcagttt

SEQ ID NO: 6567994 - DNA, 22 bp, Homo sapiens
ttcaggaacaagtaatgtatta

SEQ ID NO: 6567995 - DNA, 16 bp, Homo sapiens
ttcaggaacaccccca

SEQ ID NO: 6567996 - DNA, 21 bp, Homo sapiens
ttcaggaacctcgagtactgt

SEQ ID NO: 6567997 - DNA, 16 bp, Homo sapiens
ttcaggaacctggacc

SEQ ID NO: 6567998 - DNA, 20 bp, Homo sapiens
ttcaggaagataaaaatcag

SEQ ID NO: 6567999 - DNA, 23 bp, Homo sapiens
ttcaggaagcaggtgtcctttcc

SEQ ID NO: 6568000 - DNA, 11 bp, Homo sapiens
ttcaggaagct

SEQ ID NO: 6568001 - DNA, 15 bp, Homo sapiens
ttcaggaagctcagg

SEQ ID NO: 6568002 - DNA, 19 bp, Homo sapiens
ttcaggaagctcagggcct

SEQ ID NO: 6568003 - DNA, 14 bp, Homo sapiens
ttcaggaagggaga

SEQ ID NO: 6568004 - DNA, 18 bp, Homo sapiens
ttcaggaagggagaggag

SEQ ID NO: 6568005 - DNA, 22 bp, Homo sapiens
ttcaggaagggagaggagggaa

SEQ ID NO: 6568006 - DNA, 17 bp, Homo sapiens
ttcaggaagggatgcag

SEQ ID NO: 6568007 - DNA, 14 bp, Homo sapiens
ttcaggaatttaat

SEQ ID NO: 6568008 - DNA, 17 bp, Homo sapiens
ttcaggacaacacttca

SEQ ID NO: 6568009 - DNA, 16 bp, Homo sapiens
ttcaggacatggggca

SEQ ID NO: 6568010 - DNA, 17 bp, Homo sapiens
ttcaggaccccatctgc

SEQ ID NO: 6568011 - DNA, 18 bp, Homo sapiens
ttcaggactctctccagg

SEQ ID NO: 6568012 - DNA, 14 bp, Homo sapiens
ttcaggactggctc

SEQ ID NO: 6568013 - DNA, 18 bp, Homo sapiens
ttcaggactggctcaccc

SEQ ID NO: 6568014 - DNA, 21 bp, Homo sapiens
ttcaggagaacctaacatgct

SEQ ID NO: 6568015 - DNA, 14 bp, Homo sapiens
ttcaggagaatgtg

SEQ ID NO: 6568016 - DNA, 23 bp, Homo sapiens
ttcaggagaatgtgcagtgtctt

SEQ ID NO: 6568017 - DNA, 20 bp, Homo sapiens
ttcaggagagagttgaacct

SEQ ID NO: 6568018 - DNA, 21 bp, Homo sapiens
ttcaggagagagttgaaccta

SEQ ID NO: 6568019 - DNA, 16 bp, Homo sapiens
ttcaggagcagcctca

SEQ ID NO: 6568020 - DNA, 20 bp, Homo sapiens
ttcaggagcagcctcagaac

SEQ ID NO: 6568021 - DNA, 21 bp, Homo sapiens
ttcaggagcctggccaggcag

SEQ ID NO: 6568022 - DNA, 15 bp, Homo sapiens
ttcaggagctcagtt

SEQ ID NO: 6568023 - DNA, 15 bp, Homo sapiens
ttcaggaggaatact

SEQ ID NO: 6568024 - DNA, 20 bp, Homo sapiens
ttcaggaggaatactgaaca

SEQ ID NO: 6568025 - DNA, 19 bp, Homo sapiens
ttcaggaggccctggtgtc

SEQ ID NO: 6568026 - DNA, 13 bp, Homo sapiens
ttcaggaggctga

SEQ ID NO: 6568027 - DNA, 16 bp, Homo sapiens
ttcaggaggctgaggc

SEQ ID NO: 6568028 - DNA, 15 bp, Homo sapiens
ttcaggatactgtag

SEQ ID NO: 6568029 - DNA, 22 bp, Homo sapiens
ttcaggatcagatcaatacaat

SEQ ID NO: 6568030 - DNA, 22 bp, Homo sapiens
ttcaggatctatttttggaggt

SEQ ID NO: 6568031 - DNA, 20 bp, Homo sapiens
ttcaggatgcacggtttctg

SEQ ID NO: 6568032 - DNA, 21 bp, Homo sapiens
ttcaggatgcacggtttctgt

SEQ ID NO: 6568033 - DNA, 22 bp, Homo sapiens
ttcaggatgcacggtttctgtt

SEQ ID NO: 6568034 - DNA, 17 bp, Homo sapiens
ttcaggatgctgtgata

SEQ ID NO: 6568035 - DNA, 17 bp, Homo sapiens
ttcaggcacatgtgttc

SEQ ID NO: 6568036 - DNA, 12 bp, Homo sapiens
ttcaggcactga

SEQ ID NO: 6568037 - DNA, 14 bp, Homo sapiens
ttcaggcactgaga

SEQ ID NO: 6568038 - DNA, 15 bp, Homo sapiens
ttcaggcactttaga

SEQ ID NO: 6568039 - DNA, 15 bp, Homo sapiens
ttcaggcagcactga

SEQ ID NO: 6568040 - DNA, 13 bp, Homo sapiens
ttcaggcagctga

SEQ ID NO: 6568041 - DNA, 19 bp, Homo sapiens
ttcaggcatttttgtaatg

SEQ ID NO: 6568042 - DNA, 13 bp, Homo sapiens
ttcaggccagccc

SEQ ID NO: 6568043 - DNA, 14 bp, Homo sapiens
ttcaggccagccca

SEQ ID NO: 6568044 - DNA, 18 bp, Homo sapiens
ttcaggccagcccagcca

SEQ ID NO: 6568045 - DNA, 20 bp, Homo sapiens
ttcaggccagcccagccagg

SEQ ID NO: 6568046 - DNA, 14 bp, Homo sapiens
ttcaggccagctgg

SEQ ID NO: 6568047 - DNA, 16 bp, Homo sapiens
ttcaggccaggtagca

SEQ ID NO: 6568048 - DNA, 23 bp, Homo sapiens
ttcaggccaggtagcagcaaata

SEQ ID NO: 6568049 - DNA, 14 bp, Homo sapiens
ttcaggccccagga

SEQ ID NO: 6568050 - DNA, 18 bp, Homo sapiens
ttcaggcctctgaggagc

SEQ ID NO: 6568051 - DNA, 13 bp, Homo sapiens
ttcaggcctgcta

SEQ ID NO: 6568052 - DNA, 18 bp, Homo sapiens
ttcaggctcgccaaggcc

SEQ ID NO: 6568053 - DNA, 20 bp, Homo sapiens
ttcaggctcgccaaggccta

SEQ ID NO: 6568054 - DNA, 21 bp, Homo sapiens
ttcaggctcgccaaggcctag

SEQ ID NO: 6568055 - DNA, 13 bp, Homo sapiens
ttcaggctgcttg

SEQ ID NO: 6568056 - DNA, 21 bp, Homo sapiens
ttcaggcttcctgcaattttc

SEQ ID NO: 6568057 - DNA, 22 bp, Homo sapiens
ttcaggcttcctgcaattttct

SEQ ID NO: 6568058 - DNA, 21 bp, Homo sapiens
ttcaggcttctttcaaagtgt

SEQ ID NO: 6568059 - DNA, 13 bp, Homo sapiens
ttcagggaactgc

SEQ ID NO: 6568060 - DNA, 20 bp, Homo sapiens
ttcagggaagataagttgga

SEQ ID NO: 6568061 - DNA, 21 bp, Homo sapiens
ttcagggaagataagttggaa

SEQ ID NO: 6568062 - DNA, 22 bp, Homo sapiens
ttcagggaaggaggagcctgtc

SEQ ID NO: 6568063 - DNA, 19 bp, Homo sapiens
ttcagggaaggtgaaacag

SEQ ID NO: 6568064 - DNA, 18 bp, Homo sapiens
ttcagggaatttcaggaa

SEQ ID NO: 6568065 - DNA, 13 bp, Homo sapiens
ttcagggagaaac

SEQ ID NO: 6568066 - DNA, 21 bp, Homo sapiens
ttcagggagaaactccaaagt

SEQ ID NO: 6568067 - DNA, 22 bp, Homo sapiens
ttcagggagggctgttcaagtt

SEQ ID NO: 6568068 - DNA, 18 bp, Homo sapiens
ttcagggcagcccctgca

SEQ ID NO: 6568069 - DNA, 13 bp, Homo sapiens
ttcagggcctcca

SEQ ID NO: 6568070 - DNA, 13 bp, Homo sapiens
ttcagggcctggt

SEQ ID NO: 6568071 - DNA, 11 bp, Homo sapiens
ttcagggctgg

SEQ ID NO: 6568072 - DNA, 16 bp, Homo sapiens
ttcaggggactcagcc

SEQ ID NO: 6568073 - DNA, 17 bp, Homo sapiens
ttcaggggactcagccc

SEQ ID NO: 6568074 - DNA, 18 bp, Homo sapiens
ttcaggggctccctgcct

SEQ ID NO: 6568075 - DNA, 14 bp, Homo sapiens
ttcagggtaaatag

SEQ ID NO: 6568076 - DNA, 16 bp, Homo sapiens
ttcagggtatcccaga

SEQ ID NO: 6568077 - DNA, 13 bp, Homo sapiens
ttcagggtcatag

SEQ ID NO: 6568078 - DNA, 16 bp, Homo sapiens
ttcagggtgatgccag

SEQ ID NO: 6568079 - DNA, 19 bp, Homo sapiens
ttcagggtggtaaagtatg

SEQ ID NO: 6568080 - DNA, 15 bp, Homo sapiens
ttcagggttatttga

SEQ ID NO: 6568081 - DNA, 16 bp, Homo sapiens
ttcaggtaacactaca

SEQ ID NO: 6568082 - DNA, 15 bp, Homo sapiens
ttcaggtaacaggca

SEQ ID NO: 6568083 - DNA, 9 bp, Homo sapiens
ttcaggtac

SEQ ID NO: 6568084 - DNA, 21 bp, Homo sapiens
ttttcaagtttacacttcata

SEQ ID NO: 6568085 - DNA, 14 bp, Homo sapiens
ttttcaagtttttc

SEQ ID NO: 6568086 - DNA, 19 bp, Homo sapiens
ttttcaagtttttcatact

SEQ ID NO: 6568087 - DNA, 21 bp, Homo sapiens
ttttcaagtttttcatactgt

SEQ ID NO: 6568088 - DNA, 18 bp, Homo sapiens
ttttcaataaaacttttc

SEQ ID NO: 6568089 - DNA, 14 bp, Homo sapiens
ttttcaataaagaa

SEQ ID NO: 6568090 - DNA, 23 bp, Homo sapiens
ttttcaataaagaaaaaaatagt

SEQ ID NO: 6568091 - DNA, 16 bp, Homo sapiens
ttttcaataaatcagc

SEQ ID NO: 6568092 - DNA, 14 bp, Homo sapiens
ttttcaataacaaa

SEQ ID NO: 6568093 - DNA, 20 bp, Homo sapiens
ttttcaataccaattacatg

SEQ ID NO: 6568094 - DNA, 16 bp, Homo sapiens
ttttcaataccaggga

SEQ ID NO: 6568095 - DNA, 14 bp, Homo sapiens
ttttcaatagccac

SEQ ID NO: 6568096 - DNA, 19 bp, Homo sapiens
ttttcaatatatatttctt

SEQ ID NO: 6568097 - DNA, 20 bp, Homo sapiens
ttttcaatatattgaacttt

SEQ ID NO: 6568098 - DNA, 19 bp, Homo sapiens
ttttcaatatgcaagcagc

SEQ ID NO: 6568099 - DNA, 16 bp, Homo sapiens
ttttcaatatttatta

SEQ ID NO: 6568100 - DNA, 20 bp, Homo sapiens
ttttcaatcaactttactgt

SEQ ID NO: 6568101 - DNA, 23 bp, Homo sapiens
ttttcaatcaactttactgtaat

SEQ ID NO: 6568102 - DNA, 20 bp, Homo sapiens
ttttcaatcttctactttta

SEQ ID NO: 6568103 - DNA, 11 bp, Homo sapiens
ttttcaatgtg

SEQ ID NO: 6568104 - DNA, 13 bp, Homo sapiens
ttttcaatgtgat

SEQ ID NO: 6568105 - DNA, 12 bp, Homo sapiens
ttttcaattaaa

SEQ ID NO: 6568106 - DNA, 16 bp, Homo sapiens
ttttcaattatttcaa

SEQ ID NO: 6568107 - DNA, 17 bp, Homo sapiens
ttttcaattcaaaaatg

SEQ ID NO: 6568108 - DNA, 18 bp, Homo sapiens
ttttcaatttgtcatgtt

SEQ ID NO: 6568109 - DNA, 17 bp, Homo sapiens
ttttcaattttaaacat

SEQ ID NO: 6568110 - DNA, 13 bp, Homo sapiens
ttttcacaaacat

SEQ ID NO: 6568111 - DNA, 21 bp, Homo sapiens
ttttcacaatcttggggctga

SEQ ID NO: 6568112 - DNA, 17 bp, Homo sapiens
ttttcacaatgtcagta

SEQ ID NO: 6568113 - DNA, 20 bp, Homo sapiens
ttttcacaatgtcagtattt

SEQ ID NO: 6568114 - DNA, 20 bp, Homo sapiens
ttttcacaatgtgaaactga

SEQ ID NO: 6568115 - DNA, 23 bp, Homo sapiens
ttttcacacaatacaataagtta

SEQ ID NO: 6568116 - DNA, 15 bp, Homo sapiens
ttttcacactgtctt

SEQ ID NO: 6568117 - DNA, 13 bp, Homo sapiens
ttttcacagcttt

SEQ ID NO: 6568118 - DNA, 22 bp, Homo sapiens
ttttcacattcttataaatatg

SEQ ID NO: 6568119 - DNA, 16 bp, Homo sapiens
ttttcacattggaaac

SEQ ID NO: 6568120 - DNA, 12 bp, Homo sapiens
ttttcacatttt

SEQ ID NO: 6568121 - DNA, 23 bp, Homo sapiens
ttttcaccattcgtacataatac

SEQ ID NO: 6568122 - DNA, 20 bp, Homo sapiens
ttttcaccttttcaggaaaa

SEQ ID NO: 6568123 - DNA, 16 bp, Homo sapiens
ttttcactagggctga

SEQ ID NO: 6568124 - DNA, 21 bp, Homo sapiens
ttttcactggagttacattaa

SEQ ID NO: 6568125 - DNA, 23 bp, Homo sapiens
ttttcacttagaacctttctgtg

SEQ ID NO: 6568126 - DNA, 13 bp, Homo sapiens
ttttcacttgtct

SEQ ID NO: 6568127 - DNA, 17 bp, Homo sapiens
ttttcactttagctatg

SEQ ID NO: 6568128 - DNA, 22 bp, Homo sapiens
ttttcactttgggagtttttgt

SEQ ID NO: 6568129 - DNA, 18 bp, Homo sapiens
ttttcagaaaaagaaatg

SEQ ID NO: 6568130 - DNA, 14 bp, Homo sapiens
ttttcagaaagcat

SEQ ID NO: 6568131 - DNA, 19 bp, Homo sapiens
ttttcagaaagtttgaagc

SEQ ID NO: 6568132 - DNA, 13 bp, Homo sapiens
ttttcagaacatc

SEQ ID NO: 6568133 - DNA, 22 bp, Homo sapiens
ttttcagaacctcttccccaga

SEQ ID NO: 6568134 - DNA, 22 bp, Homo sapiens
ttttcagaagaaaggcattgca

SEQ ID NO: 6568135 - DNA, 20 bp, Homo sapiens
ttttcagaagaaataaatat

SEQ ID NO: 6568136 - DNA, 20 bp, Homo sapiens
ttttcagaagcaagccagac

SEQ ID NO: 6568137 - DNA, 22 bp, Homo sapiens
ttttcagaagcaagccagacct

SEQ ID NO: 6568138 - DNA, 11 bp, Homo sapiens
ttttcagaatc

SEQ ID NO: 6568139 - DNA, 11 bp, Homo sapiens
ttttcagaccc

SEQ ID NO: 6568140 - DNA, 21 bp, Homo sapiens
ttttcagactgcctgtctgct

SEQ ID NO: 6568141 - DNA, 14 bp, Homo sapiens
ttttcagactgctt

SEQ ID NO: 6568142 - DNA, 18 bp, Homo sapiens
ttttcagactgtgcaata

SEQ ID NO: 6568143 - DNA, 17 bp, Homo sapiens
ttttcagatataaaaga

SEQ ID NO: 6568144 - DNA, 21 bp, Homo sapiens
ttttcagcacccccacccacc

SEQ ID NO: 6568145 - DNA, 14 bp, Homo sapiens
ttttcagcagcaaa

SEQ ID NO: 6568146 - DNA, 22 bp, Homo sapiens
ttttcagcatcaaacatgaaaa

SEQ ID NO: 6568147 - DNA, 18 bp, Homo sapiens
ttttcagccaatttgtct

SEQ ID NO: 6568148 - DNA, 18 bp, Homo sapiens
ttttcagccattcacaac

SEQ ID NO: 6568149 - DNA, 19 bp, Homo sapiens
ttttcagcccatatttcat

SEQ ID NO: 6568150 - DNA, 23 bp, Homo sapiens
ttttcagctcaattgttaatgtg

SEQ ID NO: 6568151 - DNA, 17 bp, Homo sapiens
ttttcagcttctgctgg

SEQ ID NO: 6568152 - DNA, 21 bp, Homo sapiens
ttttcagcttgtttctatact

SEQ ID NO: 6568153 - DNA, 13 bp, Homo sapiens
ttttcaggaagct

SEQ ID NO: 6568154 - DNA, 23 bp, Homo sapiens
ttttcaggaaggtatcacacact

SEQ ID NO: 6568155 - DNA, 17 bp, Homo sapiens
ttttcaggagcgcaaga

SEQ ID NO: 6568156 - DNA, 20 bp, Homo sapiens
ttttcaggctagatgtatgt

SEQ ID NO: 6568157 - DNA, 19 bp, Homo sapiens
ttttcaggctcgccaaggc

SEQ ID NO: 6568158 - DNA, 22 bp, Homo sapiens
ttttcaggtaggcccttgtcct

SEQ ID NO: 6568159 - DNA, 16 bp, Homo sapiens
ttttcaggtttcttaa

SEQ ID NO: 6568160 - DNA, 23 bp, Homo sapiens
ttttcagtcaagttccgtctcct

SEQ ID NO: 6568161 - DNA, 23 bp, Homo sapiens
ttttcagtcatataaaagctatg

SEQ ID NO: 6568162 - DNA, 20 bp, Homo sapiens
ttttcagtcccctctctctg

SEQ ID NO: 6568163 - DNA, 14 bp, Homo sapiens
ttttcagtgtacat

SEQ ID NO: 6568164 - DNA, 17 bp, Homo sapiens
ttttcagtgtcaaatat

SEQ ID NO: 6568165 - DNA, 19 bp, Homo sapiens
ttttcagttacaagattgt

SEQ ID NO: 6568166 - DNA, 15 bp, Homo sapiens
ttttcagttcaaagt

SEQ ID NO: 6568167 - DNA, 20 bp, Homo sapiens
ttttcagttcatatgcagaa

SEQ ID NO: 6568168 - DNA, 12 bp, Homo sapiens
ttttcagttttc

SEQ ID NO: 6568169 - DNA, 23 bp, Homo sapiens
ttttcataaattatttgattatt

SEQ ID NO: 6568170 - DNA, 15 bp, Homo sapiens
ttttcataacttatt

SEQ ID NO: 6568171 - DNA, 23 bp, Homo sapiens
ttttcataacttgctgaatttca

SEQ ID NO: 6568172 - DNA, 16 bp, Homo sapiens
ttttcataagatattt

SEQ ID NO: 6568173 - DNA, 19 bp, Homo sapiens
ttttcataagatattttat

SEQ ID NO: 6568174 - DNA, 12 bp, Homo sapiens
ttttcataataa

SEQ ID NO: 6568175 - DNA, 19 bp, Homo sapiens
ttttcataataaaaggcat

SEQ ID NO: 6568176 - DNA, 16 bp, Homo sapiens
ttttcataggtctgaa

SEQ ID NO: 6568177 - DNA, 10 bp, Homo sapiens
ttttcatagt

SEQ ID NO: 6568178 - DNA, 19 bp, Homo sapiens
ttttcatagtatccatatt

SEQ ID NO: 6568179 - DNA, 20 bp, Homo sapiens
ttttcatagtatccatattt

SEQ ID NO: 6568180 - DNA, 23 bp, Homo sapiens
ttttcatagtgacctgtgtttca

SEQ ID NO: 6568181 - DNA, 15 bp, Homo sapiens
ttttcatagtgcctt

SEQ ID NO: 6568182 - DNA, 15 bp, Homo sapiens
ttttcatatctcttg

SEQ ID NO: 6568183 - DNA, 16 bp, Homo sapiens
ttttcatattgtgcca

SEQ ID NO: 6568184 - DNA, 18 bp, Homo sapiens
ttttcatatttaaagcca

SEQ ID NO: 6568185 - DNA, 15 bp, Homo sapiens
ttttcatattttaat

SEQ ID NO: 6568186 - DNA, 19 bp, Homo sapiens
ttttcatattttaatttca

SEQ ID NO: 6568187 - DNA, 18 bp, Homo sapiens
ttttcatcacagttgcct

SEQ ID NO: 6568188 - DNA, 13 bp, Homo sapiens
ttttcatcactgg

SEQ ID NO: 6568189 - DNA, 13 bp, Homo sapiens
ttttcatcatttc

SEQ ID NO: 6568190 - DNA, 19 bp, Homo sapiens
ttttcatcatttcagccaa

SEQ ID NO: 6568191 - DNA, 13 bp, Homo sapiens
ttttcatcccctt

SEQ ID NO: 6568192 - DNA, 21 bp, Homo sapiens
ttttcatcccgtatcacagtg

SEQ ID NO: 6568193 - DNA, 23 bp, Homo sapiens
ttttcatccctgccaagaactct

SEQ ID NO: 6568194 - DNA, 16 bp, Homo sapiens
ttttcatccttcccca

SEQ ID NO: 6568195 - DNA, 19 bp, Homo sapiens
ttttcatctgaaaagcagt

SEQ ID NO: 6568196 - DNA, 15 bp, Homo sapiens
ttttcatctgggaaa

SEQ ID NO: 6568197 - DNA, 16 bp, Homo sapiens
ttttcatctgggaaag

SEQ ID NO: 6568198 - DNA, 14 bp, Homo sapiens
ttttcatcttcagt

SEQ ID NO: 6568199 - DNA, 21 bp, Homo sapiens
ttttcatcttcagttgtctct

SEQ ID NO: 6568200 - DNA, 13 bp, Homo sapiens
ttttcatgaaaat

SEQ ID NO: 6568201 - DNA, 21 bp, Homo sapiens
ttttcatgattttgaaaccat

SEQ ID NO: 6568202 - DNA, 14 bp, Homo sapiens
ttttcatgcacagt

SEQ ID NO: 6568203 - DNA, 16 bp, Homo sapiens
ttttcatgcgatgaca

SEQ ID NO: 6568204 - DNA, 16 bp, Homo sapiens
ttttcatgctttatca

SEQ ID NO: 6568205 - DNA, 17 bp, Homo sapiens
ttttcatgctttatcaa

SEQ ID NO: 6568206 - DNA, 21 bp, Homo sapiens
ttttcatggaaaagccttctt

SEQ ID NO: 6568207 - DNA, 13 bp, Homo sapiens
ttttcatggaagt

SEQ ID NO: 6568208 - DNA, 18 bp, Homo sapiens
ttttcatggtgaaaatgt

SEQ ID NO: 6568209 - DNA, 14 bp, Homo sapiens
ttttcatgttatga

SEQ ID NO: 6568210 - DNA, 16 bp, Homo sapiens
ttttcatgttttaaca

SEQ ID NO: 6568211 - DNA, 19 bp, Homo sapiens
ttttcatgttttaacaaaa

SEQ ID NO: 6568212 - DNA, 23 bp, Homo sapiens
ttttcatgttttagcatttgtat

SEQ ID NO: 6568213 - DNA, 17 bp, Homo sapiens
ttttcattaaacttgaa

SEQ ID NO: 6568214 - DNA, 14 bp, Homo sapiens
ttttcattaaataa

SEQ ID NO: 6568215 - DNA, 20 bp, Homo sapiens
ttttcattaaattagctatt

SEQ ID NO: 6568216 - DNA, 15 bp, Homo sapiens
ttttcattattttat

SEQ ID NO: 6568217 - DNA, 14 bp, Homo sapiens
ttttcattcatgaa

SEQ ID NO: 6568218 - DNA, 12 bp, Homo sapiens
ttttcattctga

SEQ ID NO: 6568219 - DNA, 17 bp, Homo sapiens
ttttcattctgccaaag

SEQ ID NO: 6568220 - DNA, 22 bp, Homo sapiens
ttttcattctggtccttagtaa

SEQ ID NO: 6568221 - DNA, 20 bp, Homo sapiens
ttttcatttaggtgaggaag

SEQ ID NO: 6568222 - DNA, 13 bp, Homo sapiens
ttttcatttcaga

SEQ ID NO: 6568223 - DNA, 12 bp, Homo sapiens
ttttcatttcat

SEQ ID NO: 6568224 - DNA, 15 bp, Homo sapiens
ttttcatttcatata

SEQ ID NO: 6568225 - DNA, 20 bp, Homo sapiens
ttttcatttctaacataagt

SEQ ID NO: 6568226 - DNA, 15 bp, Homo sapiens
ttttcatttcttcct

SEQ ID NO: 6568227 - DNA, 19 bp, Homo sapiens
ttttcatttcttcctcagc

SEQ ID NO: 6568228 - DNA, 14 bp, Homo sapiens
ttttcatttgtaaa

SEQ ID NO: 6568229 - DNA, 15 bp, Homo sapiens
ttttcatttgtacaa

SEQ ID NO: 6568230 - DNA, 19 bp, Homo sapiens
ttttcatttgtacaaggta

SEQ ID NO: 6568231 - DNA, 14 bp, Homo sapiens
ttttcatttgtttt

SEQ ID NO: 6568232 - DNA, 17 bp, Homo sapiens
ttttcatttgttttgct

SEQ ID NO: 6568233 - DNA, 23 bp, Homo sapiens
ttttcatttgttttgcttttgtt

SEQ ID NO: 6568234 - DNA, 22 bp, Homo sapiens
ttttcattttaatatataattt

SEQ ID NO: 6568235 - DNA, 22 bp, Homo sapiens
ttttcattttaatttatatttg

SEQ ID NO: 6568236 - DNA, 15 bp, Homo sapiens
ttttcattttccaat

SEQ ID NO: 6568237 - DNA, 16 bp, Homo sapiens
ttttcattttctgcaa

SEQ ID NO: 6568238 - DNA, 10 bp, Homo sapiens
ttttccaaaa

SEQ ID NO: 6568239 - DNA, 15 bp, Homo sapiens
ttttccaaaaaaata

SEQ ID NO: 6568240 - DNA, 20 bp, Homo sapiens
ttttccaaaaacaaagtgca

SEQ ID NO: 6568241 - DNA, 13 bp, Homo sapiens
ttttccaaaacaa

SEQ ID NO: 6568242 - DNA, 19 bp, Homo sapiens
ttttccaaaacttgaactt

SEQ ID NO: 6568243 - DNA, 16 bp, Homo sapiens
ttttccaaaagtaaag

SEQ ID NO: 6568244 - DNA, 17 bp, Homo sapiens
ttttccaaaagtaaaga

SEQ ID NO: 6568245 - DNA, 19 bp, Homo sapiens
ttttccaaagagtgatagt

SEQ ID NO: 6568246 - DNA, 14 bp, Homo sapiens
ttttccaaagataa

SEQ ID NO: 6568247 - DNA, 22 bp, Homo sapiens
ttttccaaaggaagtgctaatg

SEQ ID NO: 6568248 - DNA, 13 bp, Homo sapiens
ttttccaaatgct

SEQ ID NO: 6568249 - DNA, 18 bp, Homo sapiens
ttttccaacatacaattt

SEQ ID NO: 6568250 - DNA, 21 bp, Homo sapiens
ttttccaacccatgagtgcta

SEQ ID NO: 6568251 - DNA, 18 bp, Homo sapiens
ttttccaactactaatag

SEQ ID NO: 6568252 - DNA, 18 bp, Homo sapiens
ttttccaagtgtgcatat

SEQ ID NO: 6568253 - DNA, 17 bp, Homo sapiens
ttttccaataaaatttt

SEQ ID NO: 6568254 - DNA, 14 bp, Homo sapiens
ttttccaatgtttt

SEQ ID NO: 6568255 - DNA, 15 bp, Homo sapiens
ttttccacaaatatg

SEQ ID NO: 6568256 - DNA, 22 bp, Homo sapiens
ttttccacaagattcccagaga

SEQ ID NO: 6568257 - DNA, 22 bp, Homo sapiens
ttttccacactatgtgtgttgt

SEQ ID NO: 6568258 - DNA, 13 bp, Homo sapiens
ttttccacataaa

SEQ ID NO: 6568259 - DNA, 14 bp, Homo sapiens
ttttccacataaat

SEQ ID NO: 6568260 - DNA, 16 bp, Homo sapiens
ttttccacataaattt

SEQ ID NO: 6568261 - DNA, 20 bp, Homo sapiens
ttttccacataaattttaat

SEQ ID NO: 6568262 - DNA, 22 bp, Homo sapiens
ttcaggtagattaaggtatctt

SEQ ID NO: 6568263 - DNA, 19 bp, Homo sapiens
ttcaggtagctgcccctgg

SEQ ID NO: 6568264 - DNA, 13 bp, Homo sapiens
ttcaggtaggccc

SEQ ID NO: 6568265 - DNA, 14 bp, Homo sapiens
ttcaggtaggccct

SEQ ID NO: 6568266 - DNA, 15 bp, Homo sapiens
ttcaggtaggccctt

SEQ ID NO: 6568267 - DNA, 20 bp, Homo sapiens
ttcaggtaggcccttgtcct

SEQ ID NO: 6568268 - DNA, 21 bp, Homo sapiens
ttcaggtatgtaaaagacttt

SEQ ID NO: 6568269 - DNA, 23 bp, Homo sapiens
ttcaggtatttttattcatgtga

SEQ ID NO: 6568270 - DNA, 14 bp, Homo sapiens
ttcaggtcagggct

SEQ ID NO: 6568271 - DNA, 15 bp, Homo sapiens
ttcaggtcagggcta

SEQ ID NO: 6568272 - DNA, 18 bp, Homo sapiens
ttcaggtcaggtggctgt

SEQ ID NO: 6568273 - DNA, 17 bp, Homo sapiens
ttcaggtcccctggccc

SEQ ID NO: 6568274 - DNA, 16 bp, Homo sapiens
ttcaggtctgtatgtc

SEQ ID NO: 6568275 - DNA, 14 bp, Homo sapiens
ttcaggtgaaaatg

SEQ ID NO: 6568276 - DNA, 17 bp, Homo sapiens
ttcaggtgacatgtgaa

SEQ ID NO: 6568277 - DNA, 19 bp, Homo sapiens
ttcaggtgacatgtgaaac

SEQ ID NO: 6568278 - DNA, 21 bp, Homo sapiens
ttcaggtgacatgtgaaacct

SEQ ID NO: 6568279 - DNA, 22 bp, Homo sapiens
ttcaggtggaacaggaggaact

SEQ ID NO: 6568280 - DNA, 20 bp, Homo sapiens
ttcaggtggatgaggagaca

SEQ ID NO: 6568281 - DNA, 23 bp, Homo sapiens
ttcaggtgtatagggaattttca

SEQ ID NO: 6568282 - DNA, 16 bp, Homo sapiens
ttcaggttagtgacat

SEQ ID NO: 6568283 - DNA, 21 bp, Homo sapiens
ttcaggttatcgaaataacaa

SEQ ID NO: 6568284 - DNA, 15 bp, Homo sapiens
ttcaggttcctccta

SEQ ID NO: 6568285 - DNA, 15 bp, Homo sapiens
ttcaggttctcatga

SEQ ID NO: 6568286 - DNA, 14 bp, Homo sapiens
ttcaggttgttctg

SEQ ID NO: 6568287 - DNA, 16 bp, Homo sapiens
ttcaggttgttctgta

SEQ ID NO: 6568288 - DNA, 15 bp, Homo sapiens
ttcaggttgttggtg

SEQ ID NO: 6568289 - DNA, 15 bp, Homo sapiens
ttcaggttttgtaaa

SEQ ID NO: 6568290 - DNA, 22 bp, Homo sapiens
ttcagtaaacaacttgtacttg

SEQ ID NO: 6568291 - DNA, 15 bp, Homo sapiens
ttcagtaaacaccat

SEQ ID NO: 6568292 - DNA, 23 bp, Homo sapiens
ttcagtaaagtggttctctgcct

SEQ ID NO: 6568293 - DNA, 17 bp, Homo sapiens
ttcagtaaataatgaaa

SEQ ID NO: 6568294 - DNA, 15 bp, Homo sapiens
ttcagtaacaagtgt

SEQ ID NO: 6568295 - DNA, 23 bp, Homo sapiens
ttcagtaagtctcataggttaaa

SEQ ID NO: 6568296 - DNA, 18 bp, Homo sapiens
ttcagtaataaaacatct

SEQ ID NO: 6568297 - DNA, 16 bp, Homo sapiens
ttcagtaatagctgaa

SEQ ID NO: 6568298 - DNA, 17 bp, Homo sapiens
ttcagtaatagctgaac

SEQ ID NO: 6568299 - DNA, 16 bp, Homo sapiens
ttcagtaatgttattt

SEQ ID NO: 6568300 - DNA, 22 bp, Homo sapiens
ttcagtacacttggtgtactgg

SEQ ID NO: 6568301 - DNA, 14 bp, Homo sapiens
ttcagtaccaaaga

SEQ ID NO: 6568302 - DNA, 21 bp, Homo sapiens
ttcagtaccctctcagctcca

SEQ ID NO: 6568303 - DNA, 22 bp, Homo sapiens
ttcagtaccctctcagctccag

SEQ ID NO: 6568304 - DNA, 23 bp, Homo sapiens
ttcagtacctggaggaggagcag

SEQ ID NO: 6568305 - DNA, 22 bp, Homo sapiens
ttcagtactcaaattcaatgat

SEQ ID NO: 6568306 - DNA, 22 bp, Homo sapiens
ttcagtacttcagcaagagaga

SEQ ID NO: 6568307 - DNA, 17 bp, Homo sapiens
ttcagtagctccttggt

SEQ ID NO: 6568308 - DNA, 16 bp, Homo sapiens
ttcagtaggaacaagc

SEQ ID NO: 6568309 - DNA, 21 bp, Homo sapiens
ttcagtaggctttatgctgtg

SEQ ID NO: 6568310 - DNA, 15 bp, Homo sapiens
ttcagtagtgagcag

SEQ ID NO: 6568311 - DNA, 15 bp, Homo sapiens
ttcagtagtttctaa

SEQ ID NO: 6568312 - DNA, 14 bp, Homo sapiens
ttcagtatactgtg

SEQ ID NO: 6568313 - DNA, 15 bp, Homo sapiens
ttcagtatactgtgt

SEQ ID NO: 6568314 - DNA, 23 bp, Homo sapiens
ttcagtatcttagagtttacagt

SEQ ID NO: 6568315 - DNA, 19 bp, Homo sapiens
ttcagtatgtgtcaactga

SEQ ID NO: 6568316 - DNA, 22 bp, Homo sapiens
ttcagtatgtgtcaactgagag

SEQ ID NO: 6568317 - DNA, 17 bp, Homo sapiens
ttcagtatgttttacac

SEQ ID NO: 6568318 - DNA, 22 bp, Homo sapiens
ttcagtatgttttacactgtac

SEQ ID NO: 6568319 - DNA, 16 bp, Homo sapiens
ttcagtattaaactct

SEQ ID NO: 6568320 - DNA, 14 bp, Homo sapiens
ttcagtattatttg

SEQ ID NO: 6568321 - DNA, 13 bp, Homo sapiens
ttcagtatttaat

SEQ ID NO: 6568322 - DNA, 18 bp, Homo sapiens
ttcagtatttaatgaaac

SEQ ID NO: 6568323 - DNA, 16 bp, Homo sapiens
ttcagtattttccagc

SEQ ID NO: 6568324 - DNA, 21 bp, Homo sapiens
ttcagtattttctccacttca

SEQ ID NO: 6568325 - DNA, 17 bp, Homo sapiens
ttcagtattttggagaa

SEQ ID NO: 6568326 - DNA, 19 bp, Homo sapiens
ttcagtattttggagaaat

SEQ ID NO: 6568327 - DNA, 17 bp, Homo sapiens
ttcagtattttttactt

SEQ ID NO: 6568328 - DNA, 13 bp, Homo sapiens
ttcagtcaattct

SEQ ID NO: 6568329 - DNA, 14 bp, Homo sapiens
ttcagtcaattctg

SEQ ID NO: 6568330 - DNA, 20 bp, Homo sapiens
ttcagtcacttgtttgtgtt

SEQ ID NO: 6568331 - DNA, 20 bp, Homo sapiens
ttcagtcagaaaactttaaa

SEQ ID NO: 6568332 - DNA, 17 bp, Homo sapiens
ttcagtccagaagaatt

SEQ ID NO: 6568333 - DNA, 22 bp, Homo sapiens
ttcagtccgcctggccggctcc

SEQ ID NO: 6568334 - DNA, 12 bp, Homo sapiens
ttcagtcctgct

SEQ ID NO: 6568335 - DNA, 13 bp, Homo sapiens
ttcagtctagaag

SEQ ID NO: 6568336 - DNA, 16 bp, Homo sapiens
ttcagtctagaagaat

SEQ ID NO: 6568337 - DNA, 21 bp, Homo sapiens
ttcagtctatgctgtgtgcag

SEQ ID NO: 6568338 - DNA, 21 bp, Homo sapiens
ttcagtctctataccaataaa

SEQ ID NO: 6568339 - DNA, 17 bp, Homo sapiens
ttcagtctctgaataca

SEQ ID NO: 6568340 - DNA, 14 bp, Homo sapiens
ttcagtctgctcca

SEQ ID NO: 6568341 - DNA, 14 bp, Homo sapiens
ttcagtcttctgga

SEQ ID NO: 6568342 - DNA, 13 bp, Homo sapiens
ttcagtcttggag

SEQ ID NO: 6568343 - DNA, 19 bp, Homo sapiens
ttcagtcttttctctgaaa

SEQ ID NO: 6568344 - DNA, 15 bp, Homo sapiens
ttcagtgaaaaagat

SEQ ID NO: 6568345 - DNA, 22 bp, Homo sapiens
ttcagtgaaaaagatattttat

SEQ ID NO: 6568346 - DNA, 16 bp, Homo sapiens
ttcagtgaactaattt

SEQ ID NO: 6568347 - DNA, 22 bp, Homo sapiens
ttcagtgaagatgctgtaaata

SEQ ID NO: 6568348 - DNA, 17 bp, Homo sapiens
ttcagtgactcctgctg

SEQ ID NO: 6568349 - DNA, 19 bp, Homo sapiens
ttcagtgactcctgctggt

SEQ ID NO: 6568350 - DNA, 13 bp, Homo sapiens
ttcagtgacttct

SEQ ID NO: 6568351 - DNA, 23 bp, Homo sapiens
ttcagtgagacacagagtggagc

SEQ ID NO: 6568352 - DNA, 19 bp, Homo sapiens
ttcagtgagcccctcccca

SEQ ID NO: 6568353 - DNA, 20 bp, Homo sapiens
ttcagtgagcccctccccag

SEQ ID NO: 6568354 - DNA, 23 bp, Homo sapiens
ttcagtgagcccctccccagcca

SEQ ID NO: 6568355 - DNA, 19 bp, Homo sapiens
ttcagtgataatgttcatt

SEQ ID NO: 6568356 - DNA, 15 bp, Homo sapiens
ttcagtgatactcac

SEQ ID NO: 6568357 - DNA, 22 bp, Homo sapiens
ttcagtgatcttcactgtatat

SEQ ID NO: 6568358 - DNA, 19 bp, Homo sapiens
ttcagtgcaagagactttg

SEQ ID NO: 6568359 - DNA, 20 bp, Homo sapiens
ttcagtgcaagagactttgt

SEQ ID NO: 6568360 - DNA, 13 bp, Homo sapiens
ttcagtgcaatca

SEQ ID NO: 6568361 - DNA, 20 bp, Homo sapiens
ttcagtgcagtaatttctga

SEQ ID NO: 6568362 - DNA, 21 bp, Homo sapiens
ttcagtgcagtttcttttcac

SEQ ID NO: 6568363 - DNA, 15 bp, Homo sapiens
ttcagtgcattttca

SEQ ID NO: 6568364 - DNA, 21 bp, Homo sapiens
ttcagtgccacaaattgaaag

SEQ ID NO: 6568365 - DNA, 12 bp, Homo sapiens
ttcagtgcctgc

SEQ ID NO: 6568366 - DNA, 16 bp, Homo sapiens
ttcagtgcctgctgtt

SEQ ID NO: 6568367 - DNA, 18 bp, Homo sapiens
ttcagtgcctgctgttcg

SEQ ID NO: 6568368 - DNA, 21 bp, Homo sapiens
ttcagtgcggcccctcggctg

SEQ ID NO: 6568369 - DNA, 15 bp, Homo sapiens
ttcagtggaattgta

SEQ ID NO: 6568370 - DNA, 20 bp, Homo sapiens
ttcagtggaccctgtggcca

SEQ ID NO: 6568371 - DNA, 21 bp, Homo sapiens
ttcagtggaccgaaatctgta

SEQ ID NO: 6568372 - DNA, 12 bp, Homo sapiens
ttcagtggagaa

SEQ ID NO: 6568373 - DNA, 24 bp, Homo sapiens
ttcagtggcacgtcatctagtttt

SEQ ID NO: 6568374 - DNA, 16 bp, Homo sapiens
ttcagtggcagctgct

SEQ ID NO: 6568375 - DNA, 17 bp, Homo sapiens
ttcagtggcagctgctt

SEQ ID NO: 6568376 - DNA, 17 bp, Homo sapiens
ttcagtggcagggctca

SEQ ID NO: 6568377 - DNA, 19 bp, Homo sapiens
ttcagtggcttcccagctc

SEQ ID NO: 6568378 - DNA, 14 bp, Homo sapiens
ttcagtgggagaaa

SEQ ID NO: 6568379 - DNA, 14 bp, Homo sapiens
ttcagtggggcagt

SEQ ID NO: 6568380 - DNA, 12 bp, Homo sapiens
ttcagtgggtta

SEQ ID NO: 6568381 - DNA, 16 bp, Homo sapiens
ttcagtgggttcagaa

SEQ ID NO: 6568382 - DNA, 18 bp, Homo sapiens
ttcagtggtgaaatcttg

SEQ ID NO: 6568383 - DNA, 15 bp, Homo sapiens
ttcagtggtttgttc

SEQ ID NO: 6568384 - DNA, 16 bp, Homo sapiens
ttcagtgtaaagtgtg

SEQ ID NO: 6568385 - DNA, 12 bp, Homo sapiens
ttcagtgtaatt

SEQ ID NO: 6568386 - DNA, 19 bp, Homo sapiens
ttcagtgtaatttctttgc

SEQ ID NO: 6568387 - DNA, 20 bp, Homo sapiens
ttcagtgtagcgggaggaag

SEQ ID NO: 6568388 - DNA, 14 bp, Homo sapiens
ttcagtgtagttaa

SEQ ID NO: 6568389 - DNA, 18 bp, Homo sapiens
ttcagtgtcccaggcagc

SEQ ID NO: 6568390 - DNA, 19 bp, Homo sapiens
ttcagtgtgagtcagaatg

SEQ ID NO: 6568391 - DNA, 22 bp, Homo sapiens
ttcagtgttaaatgtgatgaat

SEQ ID NO: 6568392 - DNA, 22 bp, Homo sapiens
ttcagtgttacctgtgtgcttg

SEQ ID NO: 6568393 - DNA, 12 bp, Homo sapiens
ttcagtgttccc

SEQ ID NO: 6568394 - DNA, 17 bp, Homo sapiens
ttcagtgtttatttcct

SEQ ID NO: 6568395 - DNA, 11 bp, Homo sapiens
ttcagttacag

SEQ ID NO: 6568396 - DNA, 14 bp, Homo sapiens
ttcagttacagaaa

SEQ ID NO: 6568397 - DNA, 15 bp, Homo sapiens
ttcagttacagaaag

SEQ ID NO: 6568398 - DNA, 16 bp, Homo sapiens
ttcagttacagaaagt

SEQ ID NO: 6568399 - DNA, 17 bp, Homo sapiens
ttcagttacagaaagtg

SEQ ID NO: 6568400 - DNA, 18 bp, Homo sapiens
ttcagttatagaggtaaa

SEQ ID NO: 6568401 - DNA, 23 bp, Homo sapiens
ttcagttattatatttacaaatg

SEQ ID NO: 6568402 - DNA, 13 bp, Homo sapiens
ttcagttcaaagt

SEQ ID NO: 6568403 - DNA, 22 bp, Homo sapiens
ttcagttcaaagtcatgatgtt

SEQ ID NO: 6568404 - DNA, 15 bp, Homo sapiens
ttcagttcaatcaaa

SEQ ID NO: 6568405 - DNA, 18 bp, Homo sapiens
ttcagttcatatgcagaa

SEQ ID NO: 6568406 - DNA, 14 bp, Homo sapiens
ttcagttccaagaa

SEQ ID NO: 6568407 - DNA, 16 bp, Homo sapiens
ttcagttccaatactt

SEQ ID NO: 6568408 - DNA, 19 bp, Homo sapiens
ttcagttccaatacttcat

SEQ ID NO: 6568409 - DNA, 13 bp, Homo sapiens
ttcagttccagct

SEQ ID NO: 6568410 - DNA, 22 bp, Homo sapiens
ttcagttcccgctctgcattgc

SEQ ID NO: 6568411 - DNA, 22 bp, Homo sapiens
ttcagttctaggcctttcctct

SEQ ID NO: 6568412 - DNA, 16 bp, Homo sapiens
ttcagttctgtgtaca

SEQ ID NO: 6568413 - DNA, 14 bp, Homo sapiens
ttcagttctttgga

SEQ ID NO: 6568414 - DNA, 16 bp, Homo sapiens
ttcagttgattttaca

SEQ ID NO: 6568415 - DNA, 19 bp, Homo sapiens
ttcagttgcttgtcttctg

SEQ ID NO: 6568416 - DNA, 17 bp, Homo sapiens
ttcagttggtaagcttc

SEQ ID NO: 6568417 - DNA, 18 bp, Homo sapiens
ttcagttggtgtgttttt

SEQ ID NO: 6568418 - DNA, 19 bp, Homo sapiens
ttcagttggttgtgtcttt

SEQ ID NO: 6568419 - DNA, 13 bp, Homo sapiens
ttcagttgttctt

SEQ ID NO: 6568420 - DNA, 14 bp, Homo sapiens
ttcagttgttcttt

SEQ ID NO: 6568421 - DNA, 18 bp, Homo sapiens
ttcagtttaatgtctcct

SEQ ID NO: 6568422 - DNA, 13 bp, Homo sapiens
ttcagtttcagga

SEQ ID NO: 6568423 - DNA, 13 bp, Homo sapiens
ttcagtttcataa

SEQ ID NO: 6568424 - DNA, 18 bp, Homo sapiens
ttcagtttctaaaattga

SEQ ID NO: 6568425 - DNA, 17 bp, Homo sapiens
ttcagtttctgaagact

SEQ ID NO: 6568426 - DNA, 15 bp, Homo sapiens
ttcagtttgtaaagt

SEQ ID NO: 6568427 - DNA, 16 bp, Homo sapiens
ttcagtttgtttactt

SEQ ID NO: 6568428 - DNA, 19 bp, Homo sapiens
ttcagttttactgcatttt

SEQ ID NO: 6568429 - DNA, 21 bp, Homo sapiens
ttcagttttactgcattttca

SEQ ID NO: 6568430 - DNA, 22 bp, Homo sapiens
ttcagttttactgcattttcac

SEQ ID NO: 6568431 - DNA, 15 bp, Homo sapiens
ttcagttttcccact

SEQ ID NO: 6568432 - DNA, 18 bp, Homo sapiens
ttcagttttcccactttt

SEQ ID NO: 6568433 - DNA, 20 bp, Homo sapiens
ttcagttttccttagttttt

SEQ ID NO: 6568434 - DNA, 12 bp, Homo sapiens
ttcagtttttca

SEQ ID NO: 6568435 - DNA, 18 bp, Homo sapiens
ttcagtttttcacttcta

SEQ ID NO: 6568436 - DNA, 17 bp, Homo sapiens
ttcagtttttgtatctt

SEQ ID NO: 6568437 - DNA, 12 bp, Homo sapiens
ttcataaaaaat

SEQ ID NO: 6568438 - DNA, 13 bp, Homo sapiens
ttcataaaaataa

SEQ ID NO: 6568439 - DNA, 18 bp, Homo sapiens
ttcataaaagtttgcatg

SEQ ID NO: 6568440 - DNA, 11 bp, Homo sapiens
ttcataaacaa

SEQ ID NO: 6568441 - DNA, 18 bp, Homo sapiens
ttttccactcctatggaa

SEQ ID NO: 6568442 - DNA, 15 bp, Homo sapiens
ttttccactgagcat

SEQ ID NO: 6568443 - DNA, 18 bp, Homo sapiens
ttttccactgtgctatta

SEQ ID NO: 6568444 - DNA, 17 bp, Homo sapiens
ttttccagaatttgaat

SEQ ID NO: 6568445 - DNA, 19 bp, Homo sapiens
ttttccagagcattccagt

SEQ ID NO: 6568446 - DNA, 13 bp, Homo sapiens
ttttccagcaaaa

SEQ ID NO: 6568447 - DNA, 21 bp, Homo sapiens
ttttccagccttatgtgttac

SEQ ID NO: 6568448 - DNA, 13 bp, Homo sapiens
ttttccagctcct

SEQ ID NO: 6568449 - DNA, 16 bp, Homo sapiens
ttttccagctgagcat

SEQ ID NO: 6568450 - DNA, 19 bp, Homo sapiens
ttttccaggcttctgctgg

SEQ ID NO: 6568451 - DNA, 21 bp, Homo sapiens
ttttccagggtgtagcctaca

SEQ ID NO: 6568452 - DNA, 9 bp, Homo sapiens
ttttccagt

SEQ ID NO: 6568453 - DNA, 23 bp, Homo sapiens
ttttccagtaatgagcttaagaa

SEQ ID NO: 6568454 - DNA, 23 bp, Homo sapiens
ttttccataaccaacattttaaa

SEQ ID NO: 6568455 - DNA, 17 bp, Homo sapiens
ttttccatatagtttgt

SEQ ID NO: 6568456 - DNA, 13 bp, Homo sapiens
ttttccatatatt

SEQ ID NO: 6568457 - DNA, 16 bp, Homo sapiens
ttttccatcataattc

SEQ ID NO: 6568458 - DNA, 17 bp, Homo sapiens
ttttccatcattttaca

SEQ ID NO: 6568459 - DNA, 15 bp, Homo sapiens
ttttccatctaaaaa

SEQ ID NO: 6568460 - DNA, 16 bp, Homo sapiens
ttttccatctaaaaat

SEQ ID NO: 6568461 - DNA, 18 bp, Homo sapiens
ttttccatctaaaatact

SEQ ID NO: 6568462 - DNA, 19 bp, Homo sapiens
ttttccatctcaaaagtat

SEQ ID NO: 6568463 - DNA, 22 bp, Homo sapiens
ttttccatcttctccccacagc

SEQ ID NO: 6568464 - DNA, 14 bp, Homo sapiens
ttttccatgaaaac

SEQ ID NO: 6568465 - DNA, 18 bp, Homo sapiens
ttttccatgaaaatgcaa

SEQ ID NO: 6568466 - DNA, 17 bp, Homo sapiens
ttttccatgatttagca

SEQ ID NO: 6568467 - DNA, 18 bp, Homo sapiens
ttttccatgatttagcaa

SEQ ID NO: 6568468 - DNA, 20 bp, Homo sapiens
ttttccatgcgtgtttctga

SEQ ID NO: 6568469 - DNA, 21 bp, Homo sapiens
ttttccatggcaggaaggctt

SEQ ID NO: 6568470 - DNA, 12 bp, Homo sapiens
ttttccatgtgt

SEQ ID NO: 6568471 - DNA, 13 bp, Homo sapiens
ttttccattgtca

SEQ ID NO: 6568472 - DNA, 14 bp, Homo sapiens
ttttccatttggca

SEQ ID NO: 6568473 - DNA, 13 bp, Homo sapiens
ttttcccaaagcc

SEQ ID NO: 6568474 - DNA, 16 bp, Homo sapiens
ttttcccacaattctt

SEQ ID NO: 6568475 - DNA, 18 bp, Homo sapiens
ttttcccaccttgtcgct

SEQ ID NO: 6568476 - DNA, 22 bp, Homo sapiens
ttttcccactgcaccccctcct

SEQ ID NO: 6568477 - DNA, 12 bp, Homo sapiens
ttttcccacttt

SEQ ID NO: 6568478 - DNA, 17 bp, Homo sapiens
ttttcccatcatccttt

SEQ ID NO: 6568479 - DNA, 23 bp, Homo sapiens
ttttcccatcatcctttgttctg

SEQ ID NO: 6568480 - DNA, 19 bp, Homo sapiens
ttttcccatgactcttgga

SEQ ID NO: 6568481 - DNA, 16 bp, Homo sapiens
ttttcccatgtattga

SEQ ID NO: 6568482 - DNA, 16 bp, Homo sapiens
ttttcccatttaaaaa

SEQ ID NO: 6568483 - DNA, 16 bp, Homo sapiens
ttttcccatttgctgt

SEQ ID NO: 6568484 - DNA, 16 bp, Homo sapiens
ttttccccctttgtgc

SEQ ID NO: 6568485 - DNA, 18 bp, Homo sapiens
ttttccccgattttccag

SEQ ID NO: 6568486 - DNA, 22 bp, Homo sapiens
ttttccccgtgacattcactgg

SEQ ID NO: 6568487 - DNA, 17 bp, Homo sapiens
ttttcccctacagaatt

SEQ ID NO: 6568488 - DNA, 19 bp, Homo sapiens
ttttcccctacagaatttt

SEQ ID NO: 6568489 - DNA, 14 bp, Homo sapiens
ttttcccctatcct

SEQ ID NO: 6568490 - DNA, 14 bp, Homo sapiens
ttttcccctggcct

SEQ ID NO: 6568491 - DNA, 13 bp, Homo sapiens
ttttccccttcct

SEQ ID NO: 6568492 - DNA, 17 bp, Homo sapiens
ttttcccctttcctgtc

SEQ ID NO: 6568493 - DNA, 20 bp, Homo sapiens
ttttccctacctaagaattt

SEQ ID NO: 6568494 - DNA, 22 bp, Homo sapiens
ttttccctacttcctctgcaaa

SEQ ID NO: 6568495 - DNA, 16 bp, Homo sapiens
ttttccctatccacag

SEQ ID NO: 6568496 - DNA, 18 bp, Homo sapiens
ttttccctattagagaag

SEQ ID NO: 6568497 - DNA, 17 bp, Homo sapiens
ttttccctcttcccaga

SEQ ID NO: 6568498 - DNA, 13 bp, Homo sapiens
ttttccctcttgt

SEQ ID NO: 6568499 - DNA, 20 bp, Homo sapiens
ttttccctcttgtgctcagt

SEQ ID NO: 6568500 - DNA, 22 bp, Homo sapiens
ttttccctctttggctcccctg

SEQ ID NO: 6568501 - DNA, 21 bp, Homo sapiens
ttttccctgaagttatgtgta

SEQ ID NO: 6568502 - DNA, 22 bp, Homo sapiens
ttttccctggaactcctggcct

SEQ ID NO: 6568503 - DNA, 13 bp, Homo sapiens
ttttccctgggtg

SEQ ID NO: 6568504 - DNA, 16 bp, Homo sapiens
ttttccctgtttgcct

SEQ ID NO: 6568505 - DNA, 14 bp, Homo sapiens
ttttcccttgcctt

SEQ ID NO: 6568506 - DNA, 13 bp, Homo sapiens
ttttcccttttta

SEQ ID NO: 6568507 - DNA, 19 bp, Homo sapiens
ttttccggagaagatttca

SEQ ID NO: 6568508 - DNA, 17 bp, Homo sapiens
ttttccggggcacaagt

SEQ ID NO: 6568509 - DNA, 15 bp, Homo sapiens
ttttcctaaatgtat

SEQ ID NO: 6568510 - DNA, 16 bp, Homo sapiens
ttttcctaagacattt

SEQ ID NO: 6568511 - DNA, 17 bp, Homo sapiens
ttttcctaaggaaactg

SEQ ID NO: 6568512 - DNA, 13 bp, Homo sapiens
ttttcctaagtga

SEQ ID NO: 6568513 - DNA, 20 bp, Homo sapiens
ttttcctaataaagttctgt

SEQ ID NO: 6568514 - DNA, 22 bp, Homo sapiens
ttttcctatgactcaaagatga

SEQ ID NO: 6568515 - DNA, 16 bp, Homo sapiens
ttttcctcaagcaata

SEQ ID NO: 6568516 - DNA, 13 bp, Homo sapiens
ttttcctcagctc

SEQ ID NO: 6568517 - DNA, 14 bp, Homo sapiens
ttttcctcagctct

SEQ ID NO: 6568518 - DNA, 20 bp, Homo sapiens
ttttcctcatcctttccctc

SEQ ID NO: 6568519 - DNA, 23 bp, Homo sapiens
ttttcctcatcctttccctctcc

SEQ ID NO: 6568520 - DNA, 20 bp, Homo sapiens
ttttcctcattttgaattat

SEQ ID NO: 6568521 - DNA, 17 bp, Homo sapiens
ttttcctcccttctgct

SEQ ID NO: 6568522 - DNA, 20 bp, Homo sapiens
ttttcctcccttctgctact

SEQ ID NO: 6568523 - DNA, 13 bp, Homo sapiens
ttttcctcctctg

SEQ ID NO: 6568524 - DNA, 14 bp, Homo sapiens
ttttcctcctctgc

SEQ ID NO: 6568525 - DNA, 15 bp, Homo sapiens
ttttcctcctctgcc

SEQ ID NO: 6568526 - DNA, 16 bp, Homo sapiens
ttttcctcctctgcct

SEQ ID NO: 6568527 - DNA, 17 bp, Homo sapiens
ttttcctcctctgccta

SEQ ID NO: 6568528 - DNA, 16 bp, Homo sapiens
ttttcctcctgagtgc

SEQ ID NO: 6568529 - DNA, 20 bp, Homo sapiens
ttttcctcctttctctgtat

SEQ ID NO: 6568530 - DNA, 22 bp, Homo sapiens
ttttcctcctttctctgtatat

SEQ ID NO: 6568531 - DNA, 16 bp, Homo sapiens
ttttcctctccacaca

SEQ ID NO: 6568532 - DNA, 21 bp, Homo sapiens
ttttcctctcgagatagtttt

SEQ ID NO: 6568533 - DNA, 21 bp, Homo sapiens
ttttcctctctgtctgtctct

SEQ ID NO: 6568534 - DNA, 20 bp, Homo sapiens
ttttcctctgttcacaaact

SEQ ID NO: 6568535 - DNA, 12 bp, Homo sapiens
ttttcctcttgt

SEQ ID NO: 6568536 - DNA, 14 bp, Homo sapiens
ttttcctgaaagtt

SEQ ID NO: 6568537 - DNA, 18 bp, Homo sapiens
ttttcctggaatttttcc

SEQ ID NO: 6568538 - DNA, 18 bp, Homo sapiens
ttttcctggacttaaaga

SEQ ID NO: 6568539 - DNA, 19 bp, Homo sapiens
ttttcctgggaatggaata

SEQ ID NO: 6568540 - DNA, 23 bp, Homo sapiens
ttttcctgggaatggaataacta

SEQ ID NO: 6568541 - DNA, 20 bp, Homo sapiens
ttttcctgggccttctcagc

SEQ ID NO: 6568542 - DNA, 22 bp, Homo sapiens
ttttcctgggccttctcagctc

SEQ ID NO: 6568543 - DNA, 17 bp, Homo sapiens
ttttcctgggtgctcag

SEQ ID NO: 6568544 - DNA, 15 bp, Homo sapiens
ttttcctgtgactgt

SEQ ID NO: 6568545 - DNA, 11 bp, Homo sapiens
ttttcctgtgg

SEQ ID NO: 6568546 - DNA, 12 bp, Homo sapiens
ttttcctgtgga

SEQ ID NO: 6568547 - DNA, 14 bp, Homo sapiens
ttttcctgttcata

SEQ ID NO: 6568548 - DNA, 16 bp, Homo sapiens
ttttcctgtttctgaa

SEQ ID NO: 6568549 - DNA, 17 bp, Homo sapiens
ttttccttaactaaatg

SEQ ID NO: 6568550 - DNA, 18 bp, Homo sapiens
ttttccttaagagctatt

SEQ ID NO: 6568551 - DNA, 19 bp, Homo sapiens
ttttccttacataaacatc

SEQ ID NO: 6568552 - DNA, 22 bp, Homo sapiens
ttttccttattgtttgtaaaca

SEQ ID NO: 6568553 - DNA, 20 bp, Homo sapiens
ttttccttcataattttcaa

SEQ ID NO: 6568554 - DNA, 16 bp, Homo sapiens
ttttccttcattcata

SEQ ID NO: 6568555 - DNA, 11 bp, Homo sapiens
ttttccttcca

SEQ ID NO: 6568556 - DNA, 12 bp, Homo sapiens
ttttccttccat

SEQ ID NO: 6568557 - DNA, 24 bp, Homo sapiens
ttttccttcctctgtaagatatcc

SEQ ID NO: 6568558 - DNA, 13 bp, Homo sapiens
ttttccttcctga

SEQ ID NO: 6568559 - DNA, 20 bp, Homo sapiens
ttttccttcctttttattca

SEQ ID NO: 6568560 - DNA, 22 bp, Homo sapiens
ttttccttgggagaactaagta

SEQ ID NO: 6568561 - DNA, 12 bp, Homo sapiens
ttttcctttaaa

SEQ ID NO: 6568562 - DNA, 19 bp, Homo sapiens
ttttcctttaaatttcagc

SEQ ID NO: 6568563 - DNA, 12 bp, Homo sapiens
ttttcctttaga

SEQ ID NO: 6568564 - DNA, 19 bp, Homo sapiens
ttttcctttatccactttt

SEQ ID NO: 6568565 - DNA, 21 bp, Homo sapiens
ttttcctttgaacgtgcttct

SEQ ID NO: 6568566 - DNA, 22 bp, Homo sapiens
ttttcctttgaacgtgcttctt

SEQ ID NO: 6568567 - DNA, 17 bp, Homo sapiens
ttttcctttgcattcat

SEQ ID NO: 6568568 - DNA, 22 bp, Homo sapiens
ttttcctttgctagttgtttgg

SEQ ID NO: 6568569 - DNA, 13 bp, Homo sapiens
ttttcctttgtgg

SEQ ID NO: 6568570 - DNA, 10 bp, Homo sapiens
ttttcctttt

SEQ ID NO: 6568571 - DNA, 13 bp, Homo sapiens
ttttccttttcac

SEQ ID NO: 6568572 - DNA, 15 bp, Homo sapiens
ttttccttttcttaa

SEQ ID NO: 6568573 - DNA, 18 bp, Homo sapiens
ttttccttttcttaaaac

SEQ ID NO: 6568574 - DNA, 14 bp, Homo sapiens
ttttccttttgctg

SEQ ID NO: 6568575 - DNA, 19 bp, Homo sapiens
ttttccttttttatacaca

SEQ ID NO: 6568576 - DNA, 13 bp, Homo sapiens
ttttcgccccctg

SEQ ID NO: 6568577 - DNA, 20 bp, Homo sapiens
ttttcgcttgcttctgcagc

SEQ ID NO: 6568578 - DNA, 16 bp, Homo sapiens
ttttcggaaacactga

SEQ ID NO: 6568579 - DNA, 16 bp, Homo sapiens
ttttcggctaaaaaga

SEQ ID NO: 6568580 - DNA, 13 bp, Homo sapiens
ttttcgtcctgta

SEQ ID NO: 6568581 - DNA, 14 bp, Homo sapiens
ttttcgtgcatttg

SEQ ID NO: 6568582 - DNA, 15 bp, Homo sapiens
ttttcgtgcatttgt

SEQ ID NO: 6568583 - DNA, 16 bp, Homo sapiens
ttttcgttaacattga

SEQ ID NO: 6568584 - DNA, 21 bp, Homo sapiens
ttttcgtttagaatcagaata

SEQ ID NO: 6568585 - DNA, 12 bp, Homo sapiens
ttttcgtttgtt

SEQ ID NO: 6568586 - DNA, 24 bp, Homo sapiens
ttttctaaaaagctatgtatcgct

SEQ ID NO: 6568587 - DNA, 17 bp, Homo sapiens
ttttctaaaaagtcaat

SEQ ID NO: 6568588 - DNA, 17 bp, Homo sapiens
ttttctaaaacaagttg

SEQ ID NO: 6568589 - DNA, 22 bp, Homo sapiens
ttttctaaaacattcccctccc

SEQ ID NO: 6568590 - DNA, 11 bp, Homo sapiens
ttttctaaaag

SEQ ID NO: 6568591 - DNA, 11 bp, Homo sapiens
ttttctaaaat

SEQ ID NO: 6568592 - DNA, 13 bp, Homo sapiens
ttttctaaaatct

SEQ ID NO: 6568593 - DNA, 19 bp, Homo sapiens
ttttctaaacctgtgcctc

SEQ ID NO: 6568594 - DNA, 12 bp, Homo sapiens
ttttctaaactg

SEQ ID NO: 6568595 - DNA, 13 bp, Homo sapiens
ttttctaaactgt

SEQ ID NO: 6568596 - DNA, 15 bp, Homo sapiens
ttttctaaactgttt

SEQ ID NO: 6568597 - DNA, 23 bp, Homo sapiens
ttttctaaactgttttcatgtgt

SEQ ID NO: 6568598 - DNA, 14 bp, Homo sapiens
ttttctaaagaaat

SEQ ID NO: 6568599 - DNA, 20 bp, Homo sapiens
ttttctaaaggagtttatgt

SEQ ID NO: 6568600 - DNA, 12 bp, Homo sapiens
ttttctaaagta

SEQ ID NO: 6568601 - DNA, 22 bp, Homo sapiens
ttttctaaataaaaatatgtaa

SEQ ID NO: 6568602 - DNA, 20 bp, Homo sapiens
ttttctaaatgttattactt

SEQ ID NO: 6568603 - DNA, 14 bp, Homo sapiens
ttttctaaccttga

SEQ ID NO: 6568604 - DNA, 12 bp, Homo sapiens
ttttctaactgg

SEQ ID NO: 6568605 - DNA, 14 bp, Homo sapiens
ttttctaactgtaa

SEQ ID NO: 6568606 - DNA, 16 bp, Homo sapiens
ttttctaactgtaaat

SEQ ID NO: 6568607 - DNA, 19 bp, Homo sapiens
ttttctaactgtaaatcac

SEQ ID NO: 6568608 - DNA, 17 bp, Homo sapiens
ttttctaagaaaagcat

SEQ ID NO: 6568609 - DNA, 20 bp, Homo sapiens
ttttctaagtcgtgcacttt

SEQ ID NO: 6568610 - DNA, 22 bp, Homo sapiens
ttttctaagtcgtgcactttct

SEQ ID NO: 6568611 - DNA, 13 bp, Homo sapiens
ttttctaataaag

SEQ ID NO: 6568612 - DNA, 18 bp, Homo sapiens
ttttctaatcacagtgtt

SEQ ID NO: 6568613 - DNA, 15 bp, Homo sapiens
ttttctaattgtacc

SEQ ID NO: 6568614 - DNA, 22 bp, Homo sapiens
ttttctaatttattttctcaat

SEQ ID NO: 6568615 - DNA, 22 bp, Homo sapiens
ttttctaattttttttgtacat

SEQ ID NO: 6568616 - DNA, 15 bp, Homo sapiens
ttttctacagcaaat

SEQ ID NO: 6568617 - DNA, 17 bp, Homo sapiens
ttttctacagcaaattt

SEQ ID NO: 6568618 - DNA, 23 bp, Homo sapiens
ttttctacagccagtaaggcagc

SEQ ID NO: 6568619 - DNA, 13 bp, Homo sapiens
ttttctacagctt

SEQ ID NO: 6568620 - DNA, 13 bp, Homo sapiens
ttttctacagtgg

SEQ ID NO: 6568621 - DNA, 18 bp, Homo sapiens
ttttctacagtggtttta

SEQ ID NO: 6568622 - DNA, 13 bp, Homo sapiens
ttcataaactgag

SEQ ID NO: 6568623 - DNA, 15 bp, Homo sapiens
ttcataaagaattgt

SEQ ID NO: 6568624 - DNA, 14 bp, Homo sapiens
ttcataaagattca

SEQ ID NO: 6568625 - DNA, 21 bp, Homo sapiens
ttcataaaggtttacagtgaa

SEQ ID NO: 6568626 - DNA, 13 bp, Homo sapiens
ttcataaatcatg

SEQ ID NO: 6568627 - DNA, 14 bp, Homo sapiens
ttcataaattaaca

SEQ ID NO: 6568628 - DNA, 11 bp, Homo sapiens
ttcataaattg

SEQ ID NO: 6568629 - DNA, 12 bp, Homo sapiens
ttcataaattgg

SEQ ID NO: 6568630 - DNA, 15 bp, Homo sapiens
ttcataacagtgcca

SEQ ID NO: 6568631 - DNA, 22 bp, Homo sapiens
ttcataacagtgccattgtctt

SEQ ID NO: 6568632 - DNA, 21 bp, Homo sapiens
ttcataactaatgaattgaaa

SEQ ID NO: 6568633 - DNA, 19 bp, Homo sapiens
ttcataacttattgctgat

SEQ ID NO: 6568634 - DNA, 21 bp, Homo sapiens
ttcataacttattgctgattt

SEQ ID NO: 6568635 - DNA, 22 bp, Homo sapiens
ttcataagccaatttttctgca

SEQ ID NO: 6568636 - DNA, 23 bp, Homo sapiens
ttcataagccaatttttctgcac

SEQ ID NO: 6568637 - DNA, 16 bp, Homo sapiens
ttcataaggcctgccc

SEQ ID NO: 6568638 - DNA, 20 bp, Homo sapiens
ttcataagtattatgtctct

SEQ ID NO: 6568639 - DNA, 19 bp, Homo sapiens
ttcataataaatagacact

SEQ ID NO: 6568640 - DNA, 17 bp, Homo sapiens
ttcataataaattttct

SEQ ID NO: 6568641 - DNA, 22 bp, Homo sapiens
ttcataataaattttctaaaag

SEQ ID NO: 6568642 - DNA, 18 bp, Homo sapiens
ttcataatacataaagtt

SEQ ID NO: 6568643 - DNA, 21 bp, Homo sapiens
ttcataataggtagtttggat

SEQ ID NO: 6568644 - DNA, 18 bp, Homo sapiens
ttcataatcagtaaatag

SEQ ID NO: 6568645 - DNA, 13 bp, Homo sapiens
ttcataatgaaaa

SEQ ID NO: 6568646 - DNA, 23 bp, Homo sapiens
ttcataatgaaaaactatgtcag

SEQ ID NO: 6568647 - DNA, 22 bp, Homo sapiens
ttcataatgaattataacagtt

SEQ ID NO: 6568648 - DNA, 23 bp, Homo sapiens
ttcataatgacttaagcacactt

SEQ ID NO: 6568649 - DNA, 22 bp, Homo sapiens
ttcataatgcagaagtattctt

SEQ ID NO: 6568650 - DNA, 20 bp, Homo sapiens
ttcataatggcctgagactt

SEQ ID NO: 6568651 - DNA, 13 bp, Homo sapiens
ttcataattaaaa

SEQ ID NO: 6568652 - DNA, 13 bp, Homo sapiens
ttcataattagaa

SEQ ID NO: 6568653 - DNA, 16 bp, Homo sapiens
ttcataattagaacaa

SEQ ID NO: 6568654 - DNA, 20 bp, Homo sapiens
ttcataattagaacaatagc

SEQ ID NO: 6568655 - DNA, 21 bp, Homo sapiens
ttcataattagaacaatagct

SEQ ID NO: 6568656 - DNA, 17 bp, Homo sapiens
ttcataattctgaaaca

SEQ ID NO: 6568657 - DNA, 19 bp, Homo sapiens
ttcataattttcaaaagaa

SEQ ID NO: 6568658 - DNA, 14 bp, Homo sapiens
ttcatacaaataat

SEQ ID NO: 6568659 - DNA, 18 bp, Homo sapiens
ttcatacacagcctgggc

SEQ ID NO: 6568660 - DNA, 20 bp, Homo sapiens
ttcatacactaaccaaatct

SEQ ID NO: 6568661 - DNA, 13 bp, Homo sapiens
ttcatacagcact

SEQ ID NO: 6568662 - DNA, 20 bp, Homo sapiens
ttcatacagcactacttact

SEQ ID NO: 6568663 - DNA, 12 bp, Homo sapiens
ttcatacagttt

SEQ ID NO: 6568664 - DNA, 13 bp, Homo sapiens
ttcatacagtttt

SEQ ID NO: 6568665 - DNA, 12 bp, Homo sapiens
ttcatacatatt

SEQ ID NO: 6568666 - DNA, 12 bp, Homo sapiens
ttcatacattat

SEQ ID NO: 6568667 - DNA, 13 bp, Homo sapiens
ttcatacattata

SEQ ID NO: 6568668 - DNA, 16 bp, Homo sapiens
ttcatacattatattc

SEQ ID NO: 6568669 - DNA, 13 bp, Homo sapiens
ttcatacattgta

SEQ ID NO: 6568670 - DNA, 19 bp, Homo sapiens
ttcatacattgtacgaaga

SEQ ID NO: 6568671 - DNA, 18 bp, Homo sapiens
ttcataccattattatgt

SEQ ID NO: 6568672 - DNA, 18 bp, Homo sapiens
ttcataccccagaaatta

SEQ ID NO: 6568673 - DNA, 12 bp, Homo sapiens
ttcataccgcct

SEQ ID NO: 6568674 - DNA, 14 bp, Homo sapiens
ttcatacctaagta

SEQ ID NO: 6568675 - DNA, 22 bp, Homo sapiens
ttcatacctaagtactgtaata

SEQ ID NO: 6568676 - DNA, 16 bp, Homo sapiens
ttcatacctacatgta

SEQ ID NO: 6568677 - DNA, 14 bp, Homo sapiens
ttcatacctccctc

SEQ ID NO: 6568678 - DNA, 12 bp, Homo sapiens
ttcatacctgtt

SEQ ID NO: 6568679 - DNA, 18 bp, Homo sapiens
ttcatacgcatcccatct

SEQ ID NO: 6568680 - DNA, 21 bp, Homo sapiens
ttcatacgcatcccatctctc

SEQ ID NO: 6568681 - DNA, 23 bp, Homo sapiens
ttcatacgcatcccatctctccc

SEQ ID NO: 6568682 - DNA, 15 bp, Homo sapiens
ttcatactaaataaa

SEQ ID NO: 6568683 - DNA, 23 bp, Homo sapiens
ttcatactccttttaagcagtga

SEQ ID NO: 6568684 - DNA, 15 bp, Homo sapiens
ttcatactccttttg

SEQ ID NO: 6568685 - DNA, 17 bp, Homo sapiens
ttcatactctgttgcct

SEQ ID NO: 6568686 - DNA, 21 bp, Homo sapiens
ttcatactctgttgcctcctc

SEQ ID NO: 6568687 - DNA, 22 bp, Homo sapiens
ttcatactctgttgcctcctct

SEQ ID NO: 6568688 - DNA, 12 bp, Homo sapiens
ttcatactgtac

SEQ ID NO: 6568689 - DNA, 17 bp, Homo sapiens
ttcatactgtacacatt

SEQ ID NO: 6568690 - DNA, 18 bp, Homo sapiens
ttcatactgtacacattt

SEQ ID NO: 6568691 - DNA, 20 bp, Homo sapiens
ttcatactgtacacatttct

SEQ ID NO: 6568692 - DNA, 21 bp, Homo sapiens
ttcatactgtacacatttctt

SEQ ID NO: 6568693 - DNA, 18 bp, Homo sapiens
ttcatacttaaaaattta

SEQ ID NO: 6568694 - DNA, 15 bp, Homo sapiens
ttcatacttctaaat

SEQ ID NO: 6568695 - DNA, 13 bp, Homo sapiens
ttcatacttttct

SEQ ID NO: 6568696 - DNA, 15 bp, Homo sapiens
ttcatagaaatacat

SEQ ID NO: 6568697 - DNA, 21 bp, Homo sapiens
ttcatagaataacaactgctg

SEQ ID NO: 6568698 - DNA, 15 bp, Homo sapiens
ttcatagaatactca

SEQ ID NO: 6568699 - DNA, 16 bp, Homo sapiens
ttcatagaccctctca

SEQ ID NO: 6568700 - DNA, 13 bp, Homo sapiens
ttcatagagaggc

SEQ ID NO: 6568701 - DNA, 17 bp, Homo sapiens
ttcatagatattggaag

SEQ ID NO: 6568702 - DNA, 23 bp, Homo sapiens
ttcatagatattggaagagagaa

SEQ ID NO: 6568703 - DNA, 17 bp, Homo sapiens
ttcatagcatcctgatt

SEQ ID NO: 6568704 - DNA, 14 bp, Homo sapiens
ttcatagctattta

SEQ ID NO: 6568705 - DNA, 13 bp, Homo sapiens
ttcataggagaca

SEQ ID NO: 6568706 - DNA, 13 bp, Homo sapiens
ttcataggcagag

SEQ ID NO: 6568707 - DNA, 21 bp, Homo sapiens
ttcatagggaaaggttttgta

SEQ ID NO: 6568708 - DNA, 16 bp, Homo sapiens
ttcatagggaccttta

SEQ ID NO: 6568709 - DNA, 20 bp, Homo sapiens
ttcatagggacctttaaaaa

SEQ ID NO: 6568710 - DNA, 15 bp, Homo sapiens
ttcataggggcaggt

SEQ ID NO: 6568711 - DNA, 19 bp, Homo sapiens
ttcatagggtctcttcagg

SEQ ID NO: 6568712 - DNA, 14 bp, Homo sapiens
ttcataggtcactg

SEQ ID NO: 6568713 - DNA, 15 bp, Homo sapiens
ttcataggtctgaaa

SEQ ID NO: 6568714 - DNA, 17 bp, Homo sapiens
ttcataggtctgaaatt

SEQ ID NO: 6568715 - DNA, 23 bp, Homo sapiens
ttcatagtaagtgcgaagactga

SEQ ID NO: 6568716 - DNA, 19 bp, Homo sapiens
ttcatagtatccatatttt

SEQ ID NO: 6568717 - DNA, 23 bp, Homo sapiens
ttcatagtatccatattttatta

SEQ ID NO: 6568718 - DNA, 17 bp, Homo sapiens
ttcatagtgcctttttc

SEQ ID NO: 6568719 - DNA, 20 bp, Homo sapiens
ttcatagtggattaatgcat

SEQ ID NO: 6568720 - DNA, 17 bp, Homo sapiens
ttcatagttcagaattt

SEQ ID NO: 6568721 - DNA, 20 bp, Homo sapiens
ttcatagttcagaatttagt

SEQ ID NO: 6568722 - DNA, 15 bp, Homo sapiens
ttcatagttctgtta

SEQ ID NO: 6568723 - DNA, 16 bp, Homo sapiens
ttccaacactgatttc

SEQ ID NO: 6568724 - DNA, 22 bp, Homo sapiens
ttccaacactgatttccccttt

SEQ ID NO: 6568725 - DNA, 19 bp, Homo sapiens
ttccaacagattttattga

SEQ ID NO: 6568726 - DNA, 23 bp, Homo sapiens
ttccaacagctcaagtcttccct

SEQ ID NO: 6568727 - DNA, 16 bp, Homo sapiens
ttccaacagttaaact

SEQ ID NO: 6568728 - DNA, 20 bp, Homo sapiens
ttccaacatacaatttactt

SEQ ID NO: 6568729 - DNA, 22 bp, Homo sapiens
ttccaacatacaatttactttt

SEQ ID NO: 6568730 - DNA, 13 bp, Homo sapiens
ttccaacatgcaa

SEQ ID NO: 6568731 - DNA, 15 bp, Homo sapiens
ttccaaccaggcagt

SEQ ID NO: 6568732 - DNA, 19 bp, Homo sapiens
ttccaaccatttatcttga

SEQ ID NO: 6568733 - DNA, 15 bp, Homo sapiens
ttccaaccccaactc

SEQ ID NO: 6568734 - DNA, 15 bp, Homo sapiens
ttccaaccccagctg

SEQ ID NO: 6568735 - DNA, 19 bp, Homo sapiens
ttccaacctcctgctctgg

SEQ ID NO: 6568736 - DNA, 14 bp, Homo sapiens
ttccaactcaggtt

SEQ ID NO: 6568737 - DNA, 22 bp, Homo sapiens
ttccaactcgtatagcatgcat

SEQ ID NO: 6568738 - DNA, 13 bp, Homo sapiens
ttccaactgctgc

SEQ ID NO: 6568739 - DNA, 22 bp, Homo sapiens
ttccaactgctgccccaaagga

SEQ ID NO: 6568740 - DNA, 18 bp, Homo sapiens
ttccaactggcactctgt

SEQ ID NO: 6568741 - DNA, 20 bp, Homo sapiens
ttccaactggcactctgtgg

SEQ ID NO: 6568742 - DNA, 22 bp, Homo sapiens
ttccaactgggcatttcaatcc

SEQ ID NO: 6568743 - DNA, 22 bp, Homo sapiens
ttccaactgtatatattcccaa

SEQ ID NO: 6568744 - DNA, 17 bp, Homo sapiens
ttccaacttcctgtggc

SEQ ID NO: 6568745 - DNA, 21 bp, Homo sapiens
ttccaacttgaaggattgcat

SEQ ID NO: 6568746 - DNA, 23 bp, Homo sapiens
ttccaacttgaaggattgcatcc

SEQ ID NO: 6568747 - DNA, 15 bp, Homo sapiens
ttccaacttgatgtc

SEQ ID NO: 6568748 - DNA, 17 bp, Homo sapiens
ttccaagaaaatatcac

SEQ ID NO: 6568749 - DNA, 21 bp, Homo sapiens
ttccaagaaagatgaatacat

SEQ ID NO: 6568750 - DNA, 14 bp, Homo sapiens
ttccaagaagacca

SEQ ID NO: 6568751 - DNA, 14 bp, Homo sapiens
ttccaagacagagt

SEQ ID NO: 6568752 - DNA, 12 bp, Homo sapiens
ttccaagacagt

SEQ ID NO: 6568753 - DNA, 14 bp, Homo sapiens
ttccaagacagtat

SEQ ID NO: 6568754 - DNA, 23 bp, Homo sapiens
ttccaagacagttgtatcacaaa

SEQ ID NO: 6568755 - DNA, 13 bp, Homo sapiens
ttccaagacattg

SEQ ID NO: 6568756 - DNA, 19 bp, Homo sapiens
ttccaagacattgtcaata

SEQ ID NO: 6568757 - DNA, 17 bp, Homo sapiens
ttccaagaccatttgta

SEQ ID NO: 6568758 - DNA, 15 bp, Homo sapiens
ttccaagactctaga

SEQ ID NO: 6568759 - DNA, 21 bp, Homo sapiens
ttccaagactctagagtccaa

SEQ ID NO: 6568760 - DNA, 12 bp, Homo sapiens
ttccaagactga

SEQ ID NO: 6568761 - DNA, 16 bp, Homo sapiens
ttccaagagaactaaa

SEQ ID NO: 6568762 - DNA, 21 bp, Homo sapiens
ttccaagcaaaatctaaaatg

SEQ ID NO: 6568763 - DNA, 19 bp, Homo sapiens
ttccaagcaaatgttacat

SEQ ID NO: 6568764 - DNA, 15 bp, Homo sapiens
ttccaagcatgacaa

SEQ ID NO: 6568765 - DNA, 13 bp, Homo sapiens
ttccaagcccttc

SEQ ID NO: 6568766 - DNA, 13 bp, Homo sapiens
ttccaagcccttt

SEQ ID NO: 6568767 - DNA, 20 bp, Homo sapiens
ttccaagctgtgttaactgt

SEQ ID NO: 6568768 - DNA, 15 bp, Homo sapiens
ttccaagcttcatat

SEQ ID NO: 6568769 - DNA, 16 bp, Homo sapiens
ttccaagcttcatatt

SEQ ID NO: 6568770 - DNA, 22 bp, Homo sapiens
ttccaaggaaaattgaaagtat

SEQ ID NO: 6568771 - DNA, 18 bp, Homo sapiens
ttccaaggagctgagaat

SEQ ID NO: 6568772 - DNA, 16 bp, Homo sapiens
ttccaaggagttccat

SEQ ID NO: 6568773 - DNA, 18 bp, Homo sapiens
ttccaaggccagaaggag

SEQ ID NO: 6568774 - DNA, 22 bp, Homo sapiens
ttccaaggccagaaggaggggg

SEQ ID NO: 6568775 - DNA, 18 bp, Homo sapiens
ttccaaggccctgctttt

SEQ ID NO: 6568776 - DNA, 13 bp, Homo sapiens
ttccaaggcttct

SEQ ID NO: 6568777 - DNA, 21 bp, Homo sapiens
ttccaaggctttaaagctgag

SEQ ID NO: 6568778 - DNA, 12 bp, Homo sapiens
ttccaagggccc

SEQ ID NO: 6568779 - DNA, 17 bp, Homo sapiens
ttccaagggtactaagg

SEQ ID NO: 6568780 - DNA, 23 bp, Homo sapiens
ttccaagggtatgggaagccata

SEQ ID NO: 6568781 - DNA, 22 bp, Homo sapiens
ttccaagggtcttcctcctaaa

SEQ ID NO: 6568782 - DNA, 19 bp, Homo sapiens
ttccaaggtcactcttggt

SEQ ID NO: 6568783 - DNA, 19 bp, Homo sapiens
ttccaagtaatataatgga

SEQ ID NO: 6568784 - DNA, 22 bp, Homo sapiens
ttccaagtgtatatttgtatca

SEQ ID NO: 6568785 - DNA, 22 bp, Homo sapiens
ttccaagtgtgcatattgtaca

SEQ ID NO: 6568786 - DNA, 15 bp, Homo sapiens
ttccaataaactatg

SEQ ID NO: 6568787 - DNA, 22 bp, Homo sapiens
ttccaatagttagatctaccct

SEQ ID NO: 6568788 - DNA, 23 bp, Homo sapiens
ttccaatatgaccttaaggaaaa

SEQ ID NO: 6568789 - DNA, 13 bp, Homo sapiens
ttccaatatttct

SEQ ID NO: 6568790 - DNA, 24 bp, Homo sapiens
ttccaatatttctgctttctttga

SEQ ID NO: 6568791 - DNA, 14 bp, Homo sapiens
ttccaatcactgtg

SEQ ID NO: 6568792 - DNA, 12 bp, Homo sapiens
ttccaatgaaat

SEQ ID NO: 6568793 - DNA, 16 bp, Homo sapiens
ttccaatgaaatatgt

SEQ ID NO: 6568794 - DNA, 19 bp, Homo sapiens
ttccaatgcctcttgtctt

SEQ ID NO: 6568795 - DNA, 15 bp, Homo sapiens
ttccaatgcttctta

SEQ ID NO: 6568796 - DNA, 13 bp, Homo sapiens
ttccaatgtctgc

SEQ ID NO: 6568797 - DNA, 18 bp, Homo sapiens
ttccaatgtctggagacc

SEQ ID NO: 6568798 - DNA, 12 bp, Homo sapiens
ttccaatgtgaa

SEQ ID NO: 6568799 - DNA, 12 bp, Homo sapiens
ttccaatgtgcc

SEQ ID NO: 6568800 - DNA, 18 bp, Homo sapiens
ttccaatgtgcccagtca

SEQ ID NO: 6568801 - DNA, 20 bp, Homo sapiens
ttccaatgtgcccagtcatg

SEQ ID NO: 6568802 - DNA, 14 bp, Homo sapiens
ttccaattccaaaa

SEQ ID NO: 6568803 - DNA, 14 bp, Homo sapiens
ttccaattccactg

SEQ ID NO: 6568804 - DNA, 14 bp, Homo sapiens
ttccaattctaaat

SEQ ID NO: 6568805 - DNA, 17 bp, Homo sapiens
ttccaatttcaaaatgt

SEQ ID NO: 6568806 - DNA, 13 bp, Homo sapiens
ttccaattttcct

SEQ ID NO: 6568807 - DNA, 21 bp, Homo sapiens
ttccaattttctggaatacat

SEQ ID NO: 6568808 - DNA, 12 bp, Homo sapiens
ttccacaaaatt

SEQ ID NO: 6568809 - DNA, 14 bp, Homo sapiens
ttccacaaatatga

SEQ ID NO: 6568810 - DNA, 12 bp, Homo sapiens
tttttaatttgg

SEQ ID NO: 6568811 - DNA, 12 bp, Homo sapiens
tttttaattttg

SEQ ID NO: 6568812 - DNA, 18 bp, Homo sapiens
tttttaattttgtatttt

SEQ ID NO: 6568813 - DNA, 13 bp, Homo sapiens
tttttacaaaact

SEQ ID NO: 6568814 - DNA, 19 bp, Homo sapiens
tttttacaaaactgctttg

SEQ ID NO: 6568815 - DNA, 23 bp, Homo sapiens
tttttacaaaactgctttgtgca

SEQ ID NO: 6568816 - DNA, 12 bp, Homo sapiens
tttttacaaaat

SEQ ID NO: 6568817 - DNA, 15 bp, Homo sapiens
tttttacaaagccct

SEQ ID NO: 6568818 - DNA, 15 bp, Homo sapiens
tttttacaaattatg

SEQ ID NO: 6568819 - DNA, 13 bp, Homo sapiens
tttttacaataaa

SEQ ID NO: 6568820 - DNA, 19 bp, Homo sapiens
tttttacactgagtttcta

SEQ ID NO: 6568821 - DNA, 13 bp, Homo sapiens
tttttacacttta

SEQ ID NO: 6568822 - DNA, 17 bp, Homo sapiens
tttttacactttatggt

SEQ ID NO: 6568823 - DNA, 21 bp, Homo sapiens
tttttacagcattgtctttgc

SEQ ID NO: 6568824 - DNA, 12 bp, Homo sapiens
tttttacagtgt

SEQ ID NO: 6568825 - DNA, 14 bp, Homo sapiens
tttttacagtgtat

SEQ ID NO: 6568826 - DNA, 15 bp, Homo sapiens
tttttacatattaaa

SEQ ID NO: 6568827 - DNA, 20 bp, Homo sapiens
tttttaccaaagtgtctttt

SEQ ID NO: 6568828 - DNA, 18 bp, Homo sapiens
tttttacccatatcccct

SEQ ID NO: 6568829 - DNA, 19 bp, Homo sapiens
tttttaccgtttcttccct

SEQ ID NO: 6568830 - DNA, 22 bp, Homo sapiens
tttttacctaccacagtgtctg

SEQ ID NO: 6568831 - DNA, 17 bp, Homo sapiens
tttttaccttgttttct

SEQ ID NO: 6568832 - DNA, 16 bp, Homo sapiens
tttttacggaattcca

SEQ ID NO: 6568833 - DNA, 20 bp, Homo sapiens
tttttacggaattccaatat

SEQ ID NO: 6568834 - DNA, 12 bp, Homo sapiens
tttttactaaag

SEQ ID NO: 6568835 - DNA, 17 bp, Homo sapiens
tttttactaaagcagtg

SEQ ID NO: 6568836 - DNA, 17 bp, Homo sapiens
tttttactacataatta

SEQ ID NO: 6568837 - DNA, 17 bp, Homo sapiens
tttttactcattgaaat

SEQ ID NO: 6568838 - DNA, 23 bp, Homo sapiens
tttttactcattgaaatgtcacg

SEQ ID NO: 6568839 - DNA, 12 bp, Homo sapiens
tttttactgaat

SEQ ID NO: 6568840 - DNA, 13 bp, Homo sapiens
tttttactgtgtt

SEQ ID NO: 6568841 - DNA, 17 bp, Homo sapiens
tttttacttttcacact

SEQ ID NO: 6568842 - DNA, 21 bp, Homo sapiens
tttttacttttcacactgtct

SEQ ID NO: 6568843 - DNA, 21 bp, Homo sapiens
tttttagaacatgtaaaatgt

SEQ ID NO: 6568844 - DNA, 22 bp, Homo sapiens
tttttagaataagaatttgcat

SEQ ID NO: 6568845 - DNA, 19 bp, Homo sapiens
tttttagagattaatttgt

SEQ ID NO: 6568846 - DNA, 20 bp, Homo sapiens
tttttagaggggcaaaaata

SEQ ID NO: 6568847 - DNA, 20 bp, Homo sapiens
tttttagattgagaaatgtg

SEQ ID NO: 6568848 - DNA, 22 bp, Homo sapiens
tttttagccataattttgcata

SEQ ID NO: 6568849 - DNA, 13 bp, Homo sapiens
tttttagctctct

SEQ ID NO: 6568850 - DNA, 23 bp, Homo sapiens
tttttagctttgtgtttactttt

SEQ ID NO: 6568851 - DNA, 16 bp, Homo sapiens
tttttaggcaaagata

SEQ ID NO: 6568852 - DNA, 17 bp, Homo sapiens
tttttaggtgctttaga

SEQ ID NO: 6568853 - DNA, 15 bp, Homo sapiens
tttttagtaatctgt

SEQ ID NO: 6568854 - DNA, 14 bp, Homo sapiens
tttttagtgttaaa

SEQ ID NO: 6568855 - DNA, 17 bp, Homo sapiens
tttttagtgttaaagag

SEQ ID NO: 6568856 - DNA, 12 bp, Homo sapiens
tttttagttaaa

SEQ ID NO: 6568857 - DNA, 23 bp, Homo sapiens
tttttagttgccaacagttgtat

SEQ ID NO: 6568858 - DNA, 12 bp, Homo sapiens
tttttagtttgt

SEQ ID NO: 6568859 - DNA, 19 bp, Homo sapiens
tttttataaaagcaaaaga

SEQ ID NO: 6568860 - DNA, 20 bp, Homo sapiens
tttttataaaagcaaaagag

SEQ ID NO: 6568861 - DNA, 18 bp, Homo sapiens
tttttataaaatggctgt

SEQ ID NO: 6568862 - DNA, 18 bp, Homo sapiens
tttttataaactacaaaa

SEQ ID NO: 6568863 - DNA, 13 bp, Homo sapiens
tttttataaagtc

SEQ ID NO: 6568864 - DNA, 21 bp, Homo sapiens
tttttataaattataatgcat

SEQ ID NO: 6568865 - DNA, 24 bp, Homo sapiens
tttttataacaatataactgagtt

SEQ ID NO: 6568866 - DNA, 16 bp, Homo sapiens
tttttataatagattt

SEQ ID NO: 6568867 - DNA, 14 bp, Homo sapiens
tttttataatgact

SEQ ID NO: 6568868 - DNA, 19 bp, Homo sapiens
tttttataattttatctgt

SEQ ID NO: 6568869 - DNA, 20 bp, Homo sapiens
tttttatacaaacctaccaa

SEQ ID NO: 6568870 - DNA, 15 bp, Homo sapiens
tttttatacactgta

SEQ ID NO: 6568871 - DNA, 19 bp, Homo sapiens
tttttatacactgtaagct

SEQ ID NO: 6568872 - DNA, 12 bp, Homo sapiens
tttttatacagt

SEQ ID NO: 6568873 - DNA, 22 bp, Homo sapiens
tttttatacatatcagaaaagt

SEQ ID NO: 6568874 - DNA, 17 bp, Homo sapiens
tttttatactccataca

SEQ ID NO: 6568875 - DNA, 16 bp, Homo sapiens
tttttatactgcactt

SEQ ID NO: 6568876 - DNA, 14 bp, Homo sapiens
tttttatactttat

SEQ ID NO: 6568877 - DNA, 19 bp, Homo sapiens
tttttatataatatgaata

SEQ ID NO: 6568878 - DNA, 21 bp, Homo sapiens
tttttatatcatgcaaaatat

SEQ ID NO: 6568879 - DNA, 23 bp, Homo sapiens
tttttatatctggaatgagcctg

SEQ ID NO: 6568880 - DNA, 15 bp, Homo sapiens
tttttatattaatgt

SEQ ID NO: 6568881 - DNA, 14 bp, Homo sapiens
tttttatattactt

SEQ ID NO: 6568882 - DNA, 15 bp, Homo sapiens
tttttatatttagtt

SEQ ID NO: 6568883 - DNA, 22 bp, Homo sapiens
tttttatcatgtcgtaggtaaa

SEQ ID NO: 6568884 - DNA, 19 bp, Homo sapiens
tttttatcattgaaacatt

SEQ ID NO: 6568885 - DNA, 18 bp, Homo sapiens
tttttatcatttctactg

SEQ ID NO: 6568886 - DNA, 23 bp, Homo sapiens
tttttatctccccttcacatgca

SEQ ID NO: 6568887 - DNA, 20 bp, Homo sapiens
tttttatctgatctgtgatt

SEQ ID NO: 6568888 - DNA, 22 bp, Homo sapiens
tttttatgactatcctgttctg

SEQ ID NO: 6568889 - DNA, 20 bp, Homo sapiens
tttttatgaggcaacctgat

SEQ ID NO: 6568890 - DNA, 17 bp, Homo sapiens
tttttatgcaaaagtca

SEQ ID NO: 6568891 - DNA, 13 bp, Homo sapiens
tttttatgctctt

SEQ ID NO: 6568892 - DNA, 20 bp, Homo sapiens
tttttatggcttttgtgcat

SEQ ID NO: 6568893 - DNA, 21 bp, Homo sapiens
tttttatggcttttgtgcatt

SEQ ID NO: 6568894 - DNA, 21 bp, Homo sapiens
tttttatgtgatgccaaagat

SEQ ID NO: 6568895 - DNA, 16 bp, Homo sapiens
tttttatgtgctatgc

SEQ ID NO: 6568896 - DNA, 12 bp, Homo sapiens
tttttatgtgtg

SEQ ID NO: 6568897 - DNA, 16 bp, Homo sapiens
tttttatgttttgaaa

SEQ ID NO: 6568898 - DNA, 14 bp, Homo sapiens
tttttatgttttgt

SEQ ID NO: 6568899 - DNA, 14 bp, Homo sapiens
tttttattaaaata

SEQ ID NO: 6568900 - DNA, 23 bp, Homo sapiens
tttttattaaaatatttcaggtt

SEQ ID NO: 6568901 - DNA, 21 bp, Homo sapiens
tttttattaaagcatttccta

SEQ ID NO: 6568902 - DNA, 21 bp, Homo sapiens
tttttattaatcactgtgtat

SEQ ID NO: 6568903 - DNA, 18 bp, Homo sapiens
tttttattaatctactgt

SEQ ID NO: 6568904 - DNA, 20 bp, Homo sapiens
tttttattaatctactgtat

SEQ ID NO: 6568905 - DNA, 17 bp, Homo sapiens
tttttattagtattgtt

SEQ ID NO: 6568906 - DNA, 10 bp, Homo sapiens
tttttattca

SEQ ID NO: 6568907 - DNA, 19 bp, Homo sapiens
tttttattcaattctgtat

SEQ ID NO: 6568908 - DNA, 13 bp, Homo sapiens
tttttattcataa

SEQ ID NO: 6568909 - DNA, 12 bp, Homo sapiens
tttttattgcat

SEQ ID NO: 6568910 - DNA, 21 bp, Homo sapiens
tttttattgcatggtgtgaac

SEQ ID NO: 6568911 - DNA, 17 bp, Homo sapiens
tttttattgcatttgct

SEQ ID NO: 6568912 - DNA, 13 bp, Homo sapiens
tttttattgcctt

SEQ ID NO: 6568913 - DNA, 13 bp, Homo sapiens
tttttatttaaaa

SEQ ID NO: 6568914 - DNA, 15 bp, Homo sapiens
tttttatttaaatgt

SEQ ID NO: 6568915 - DNA, 13 bp, Homo sapiens
tttttatttacat

SEQ ID NO: 6568916 - DNA, 13 bp, Homo sapiens
tttttatttatat

SEQ ID NO: 6568917 - DNA, 14 bp, Homo sapiens
tttttatttatatg

SEQ ID NO: 6568918 - DNA, 17 bp, Homo sapiens
tttttatttatatgtat

SEQ ID NO: 6568919 - DNA, 15 bp, Homo sapiens
tttttatttccacat

SEQ ID NO: 6568920 - DNA, 15 bp, Homo sapiens
tttttatttctcctt

SEQ ID NO: 6568921 - DNA, 12 bp, Homo sapiens
tttttatttctg

SEQ ID NO: 6568922 - DNA, 15 bp, Homo sapiens
tttttatttcttcct

SEQ ID NO: 6568923 - DNA, 18 bp, Homo sapiens
tttttatttgtttgcaat

SEQ ID NO: 6568924 - DNA, 18 bp, Homo sapiens
tttttattttaggcactg

SEQ ID NO: 6568925 - DNA, 20 bp, Homo sapiens
tttttcaaaaatgctgttaa

SEQ ID NO: 6568926 - DNA, 15 bp, Homo sapiens
tttttcaaagacttc

SEQ ID NO: 6568927 - DNA, 19 bp, Homo sapiens
tttttcaaagatgtgttgc

SEQ ID NO: 6568928 - DNA, 12 bp, Homo sapiens
tttttcaaatat

SEQ ID NO: 6568929 - DNA, 16 bp, Homo sapiens
tttttcaaatattgaa

SEQ ID NO: 6568930 - DNA, 22 bp, Homo sapiens
tttttcaaatattgaatgcctt

SEQ ID NO: 6568931 - DNA, 21 bp, Homo sapiens
tttttcaaccagcattttact

SEQ ID NO: 6568932 - DNA, 17 bp, Homo sapiens
tttttcaacttcttcta

SEQ ID NO: 6568933 - DNA, 15 bp, Homo sapiens
tttttcaagaaaact

SEQ ID NO: 6568934 - DNA, 22 bp, Homo sapiens
tttttcaagaaaattttgcaga

SEQ ID NO: 6568935 - DNA, 14 bp, Homo sapiens
tttttcaagagatc

SEQ ID NO: 6568936 - DNA, 20 bp, Homo sapiens
tttttcaagataaggagaaa

SEQ ID NO: 6568937 - DNA, 23 bp, Homo sapiens
tttttcaaggcatttattgccat

SEQ ID NO: 6568938 - DNA, 17 bp, Homo sapiens
tttttcaagttgtaaat

SEQ ID NO: 6568939 - DNA, 21 bp, Homo sapiens
tttttcaagttgtaaataatt

SEQ ID NO: 6568940 - DNA, 15 bp, Homo sapiens
tttttcaataccagg

SEQ ID NO: 6568941 - DNA, 11 bp, Homo sapiens
tttttcaatgt

SEQ ID NO: 6568942 - DNA, 16 bp, Homo sapiens
tttttcaatgtactgt

SEQ ID NO: 6568943 - DNA, 12 bp, Homo sapiens
tttttcaatgtg

SEQ ID NO: 6568944 - DNA, 19 bp, Homo sapiens
tttttcaattaaacggatt

SEQ ID NO: 6568945 - DNA, 15 bp, Homo sapiens
tttttcaattatgtt

SEQ ID NO: 6568946 - DNA, 13 bp, Homo sapiens
tttttcacaatca

SEQ ID NO: 6568947 - DNA, 15 bp, Homo sapiens
tttttcacacatcgt

SEQ ID NO: 6568948 - DNA, 22 bp, Homo sapiens
tttttcacataaagggaacaaa

SEQ ID NO: 6568949 - DNA, 20 bp, Homo sapiens
tttttcacctgaaacacttt

SEQ ID NO: 6568950 - DNA, 22 bp, Homo sapiens
tttttcactgcctaaaatttta

SEQ ID NO: 6568951 - DNA, 20 bp, Homo sapiens
tttttcactttgtgtattaa

SEQ ID NO: 6568952 - DNA, 14 bp, Homo sapiens
tttttcagaaaaat

SEQ ID NO: 6568953 - DNA, 12 bp, Homo sapiens
tttttcagaaag

SEQ ID NO: 6568954 - DNA, 13 bp, Homo sapiens
tttttcagaaagt

SEQ ID NO: 6568955 - DNA, 12 bp, Homo sapiens
tttttcagaccg

SEQ ID NO: 6568956 - DNA, 14 bp, Homo sapiens
tttttcagaccgaa

SEQ ID NO: 6568957 - DNA, 15 bp, Homo sapiens
tttttcagaggtgaa

SEQ ID NO: 6568958 - DNA, 18 bp, Homo sapiens
tttttcagtattatatgt

SEQ ID NO: 6568959 - DNA, 13 bp, Homo sapiens
tttttcagttcaa

SEQ ID NO: 6568960 - DNA, 14 bp, Homo sapiens
tttttcagttcaaa

SEQ ID NO: 6568961 - DNA, 13 bp, Homo sapiens
tttttcataaaca

SEQ ID NO: 6568962 - DNA, 12 bp, Homo sapiens
tttttcatactg

SEQ ID NO: 6568963 - DNA, 17 bp, Homo sapiens
tttttcatagtgccttt

SEQ ID NO: 6568964 - DNA, 12 bp, Homo sapiens
tttttcatcctt

SEQ ID NO: 6568965 - DNA, 23 bp, Homo sapiens
tttttcatcttcagttgtctctg

SEQ ID NO: 6568966 - DNA, 20 bp, Homo sapiens
tttttcatcttttattttgg

SEQ ID NO: 6568967 - DNA, 21 bp, Homo sapiens
tttttcatgacataataaagt

SEQ ID NO: 6568968 - DNA, 11 bp, Homo sapiens
tttttcatgat

SEQ ID NO: 6568969 - DNA, 11 bp, Homo sapiens
tttttcatgtt

SEQ ID NO: 6568970 - DNA, 12 bp, Homo sapiens
tttttcatgttt

SEQ ID NO: 6568971 - DNA, 20 bp, Homo sapiens
tttttcatgttttaacaaaa

SEQ ID NO: 6568972 - DNA, 17 bp, Homo sapiens
tttttcattcatgaata

SEQ ID NO: 6568973 - DNA, 13 bp, Homo sapiens
tttttcattgtgt

SEQ ID NO: 6568974 - DNA, 20 bp, Homo sapiens
tttttcatttcttcctcagc

SEQ ID NO: 6568975 - DNA, 12 bp, Homo sapiens
tttttcatttgt

SEQ ID NO: 6568976 - DNA, 13 bp, Homo sapiens
tttttcatttttc

SEQ ID NO: 6568977 - DNA, 15 bp, Homo sapiens
tttttccaaaacctc

SEQ ID NO: 6568978 - DNA, 11 bp, Homo sapiens
tttttccaaca

SEQ ID NO: 6568979 - DNA, 14 bp, Homo sapiens
tttttccaactgtg

SEQ ID NO: 6568980 - DNA, 17 bp, Homo sapiens
tttttccaagtgtataa

SEQ ID NO: 6568981 - DNA, 18 bp, Homo sapiens
tttttccaagtgtataat

SEQ ID NO: 6568982 - DNA, 20 bp, Homo sapiens
tttttccaagtgtataatgt

SEQ ID NO: 6568983 - DNA, 22 bp, Homo sapiens
tttttccaagtgtataatgttg

SEQ ID NO: 6568984 - DNA, 20 bp, Homo sapiens
tttttccaatgcttcttata

SEQ ID NO: 6568985 - DNA, 21 bp, Homo sapiens
tttttccacataaggaaactg

SEQ ID NO: 6568986 - DNA, 15 bp, Homo sapiens
tttttccagaattga

SEQ ID NO: 6568987 - DNA, 13 bp, Homo sapiens
tttttccaggact

SEQ ID NO: 6568988 - DNA, 14 bp, Homo sapiens
tttttccaggactc

SEQ ID NO: 6568989 - DNA, 12 bp, Homo sapiens
tttttccaggct

SEQ ID NO: 6568990 - DNA, 20 bp, Homo sapiens
tttttccatagttttgatga

SEQ ID NO: 6568991 - DNA, 20 bp, Homo sapiens
ttccacaaatctatattaaa

SEQ ID NO: 6568992 - DNA, 19 bp, Homo sapiens
ttccacaagattcccagag

SEQ ID NO: 6568993 - DNA, 20 bp, Homo sapiens
ttccacaagattcccagaga

SEQ ID NO: 6568994 - DNA, 22 bp, Homo sapiens
ttccacaagtgccgcaaattgt

SEQ ID NO: 6568995 - DNA, 20 bp, Homo sapiens
ttccacacaattatttattt

SEQ ID NO: 6568996 - DNA, 18 bp, Homo sapiens
ttccacacagcctgtctt

SEQ ID NO: 6568997 - DNA, 16 bp, Homo sapiens
ttccacacccccaccc

SEQ ID NO: 6568998 - DNA, 23 bp, Homo sapiens
ttccacactatgtgtgttgtttc

SEQ ID NO: 6568999 - DNA, 18 bp, Homo sapiens
ttccacactcacctctaa

SEQ ID NO: 6569000 - DNA, 14 bp, Homo sapiens
ttccacagaggaca

SEQ ID NO: 6569001 - DNA, 22 bp, Homo sapiens
ttccacagaggacacagagaag

SEQ ID NO: 6569002 - DNA, 20 bp, Homo sapiens
ttccacagatatctttttca

SEQ ID NO: 6569003 - DNA, 21 bp, Homo sapiens
ttccacagatttttttgtaag

SEQ ID NO: 6569004 - DNA, 13 bp, Homo sapiens
ttccacagccgcc

SEQ ID NO: 6569005 - DNA, 20 bp, Homo sapiens
ttccacagctgccctggctg

SEQ ID NO: 6569006 - DNA, 18 bp, Homo sapiens
ttccacagggtcccacag

SEQ ID NO: 6569007 - DNA, 22 bp, Homo sapiens
ttccacaggtcatcagatgcct

SEQ ID NO: 6569008 - DNA, 19 bp, Homo sapiens
ttccacagtgactgggccc

SEQ ID NO: 6569009 - DNA, 22 bp, Homo sapiens
ttccacagtgactgggccctgt

SEQ ID NO: 6569010 - DNA, 23 bp, Homo sapiens
ttccacagtgactgggccctgtc

SEQ ID NO: 6569011 - DNA, 21 bp, Homo sapiens
ttccacagtggcgggcccact

SEQ ID NO: 6569012 - DNA, 16 bp, Homo sapiens
ttccacagtgtgaaga

SEQ ID NO: 6569013 - DNA, 16 bp, Homo sapiens
ttccacatataaagct

SEQ ID NO: 6569014 - DNA, 16 bp, Homo sapiens
ttccacatccccacct

SEQ ID NO: 6569015 - DNA, 22 bp, Homo sapiens
ttccacatccccaccttccaag

SEQ ID NO: 6569016 - DNA, 20 bp, Homo sapiens
ttccacatccggaggagaag

SEQ ID NO: 6569017 - DNA, 22 bp, Homo sapiens
ttccacatctacgtttttggtg

SEQ ID NO: 6569018 - DNA, 15 bp, Homo sapiens
ttccacatctgtttc

SEQ ID NO: 6569019 - DNA, 22 bp, Homo sapiens
ttccacatctgtttcaaactga

SEQ ID NO: 6569020 - DNA, 15 bp, Homo sapiens
ttccacatgttactg

SEQ ID NO: 6569021 - DNA, 20 bp, Homo sapiens
ttccacattaattagatttt

SEQ ID NO: 6569022 - DNA, 17 bp, Homo sapiens
ttccaccaaatgtgctt

SEQ ID NO: 6569023 - DNA, 15 bp, Homo sapiens
ttccaccacagccag

SEQ ID NO: 6569024 - DNA, 22 bp, Homo sapiens
ttccaccacagccagcacctgg

SEQ ID NO: 6569025 - DNA, 22 bp, Homo sapiens
ttccaccaggattaatctctaa

SEQ ID NO: 6569026 - DNA, 13 bp, Homo sapiens
ttccaccagggcc

SEQ ID NO: 6569027 - DNA, 20 bp, Homo sapiens
ttccaccagggccagagcag

SEQ ID NO: 6569028 - DNA, 23 bp, Homo sapiens
ttccaccagggccagagcagctc

SEQ ID NO: 6569029 - DNA, 21 bp, Homo sapiens
ttccacccacaaactccaggc

SEQ ID NO: 6569030 - DNA, 18 bp, Homo sapiens
ttccacccagcttcaaag

SEQ ID NO: 6569031 - DNA, 21 bp, Homo sapiens
ttccacccaggggcagcccca

SEQ ID NO: 6569032 - DNA, 17 bp, Homo sapiens
ttccacccccagctcct

SEQ ID NO: 6569033 - DNA, 21 bp, Homo sapiens
ttccacccccgttagcttcct

SEQ ID NO: 6569034 - DNA, 12 bp, Homo sapiens
ttccaccccctc

SEQ ID NO: 6569035 - DNA, 13 bp, Homo sapiens
ttccaccccctcc

SEQ ID NO: 6569036 - DNA, 20 bp, Homo sapiens
ttccaccccctccctggcct

SEQ ID NO: 6569037 - DNA, 13 bp, Homo sapiens
ttccacccctcct

SEQ ID NO: 6569038 - DNA, 12 bp, Homo sapiens
ttccaccctgcc

SEQ ID NO: 6569039 - DNA, 13 bp, Homo sapiens
ttccaccctgccc

SEQ ID NO: 6569040 - DNA, 14 bp, Homo sapiens
ttccaccctgccct

SEQ ID NO: 6569041 - DNA, 16 bp, Homo sapiens
ttccaccctgccctgg

SEQ ID NO: 6569042 - DNA, 18 bp, Homo sapiens
ttccaccctgccctggcc

SEQ ID NO: 6569043 - DNA, 13 bp, Homo sapiens
ttccaccctggaa

SEQ ID NO: 6569044 - DNA, 16 bp, Homo sapiens
ttccaccggcactcat

SEQ ID NO: 6569045 - DNA, 17 bp, Homo sapiens
ttccaccggcactcatg

SEQ ID NO: 6569046 - DNA, 15 bp, Homo sapiens
ttccacctcacaact

SEQ ID NO: 6569047 - DNA, 23 bp, Homo sapiens
ttccacctccaccacatctgcca

SEQ ID NO: 6569048 - DNA, 15 bp, Homo sapiens
ttccacctccagcct

SEQ ID NO: 6569049 - DNA, 17 bp, Homo sapiens
ttccacctgctctgctg

SEQ ID NO: 6569050 - DNA, 21 bp, Homo sapiens
ttccacctggaaactgctcag

SEQ ID NO: 6569051 - DNA, 18 bp, Homo sapiens
ttccacctgtgccctcac

SEQ ID NO: 6569052 - DNA, 13 bp, Homo sapiens
ttccaccttaaat

SEQ ID NO: 6569053 - DNA, 16 bp, Homo sapiens
ttccaccttaaattaa

SEQ ID NO: 6569054 - DNA, 23 bp, Homo sapiens
ttccaccttggcgcgcagcccgg

SEQ ID NO: 6569055 - DNA, 16 bp, Homo sapiens
ttccaccttttgtttt

SEQ ID NO: 6569056 - DNA, 22 bp, Homo sapiens
ttccaccttttgtttttccagt

SEQ ID NO: 6569057 - DNA, 14 bp, Homo sapiens
ttccacgatgaaaa

SEQ ID NO: 6569058 - DNA, 15 bp, Homo sapiens
ttccacgcagcaccc

SEQ ID NO: 6569059 - DNA, 24 bp, Homo sapiens
ttccacgcccgggagtggggtaga

SEQ ID NO: 6569060 - DNA, 18 bp, Homo sapiens
ttccacgctgatgtttat

SEQ ID NO: 6569061 - DNA, 15 bp, Homo sapiens
ttccacgctgtctcc

SEQ ID NO: 6569062 - DNA, 18 bp, Homo sapiens
ttccacggaaacagaact

SEQ ID NO: 6569063 - DNA, 21 bp, Homo sapiens
ttccacggcatcgcatccgtc

SEQ ID NO: 6569064 - DNA, 22 bp, Homo sapiens
ttccacgggggctgtggctctg

SEQ ID NO: 6569065 - DNA, 23 bp, Homo sapiens
ttccacgtaattcaatttctcac

SEQ ID NO: 6569066 - DNA, 19 bp, Homo sapiens
ttccacgtgttttattcct

SEQ ID NO: 6569067 - DNA, 14 bp, Homo sapiens
ttccactaaaaata

SEQ ID NO: 6569068 - DNA, 23 bp, Homo sapiens
ttccactaagaacacctgcattc

SEQ ID NO: 6569069 - DNA, 15 bp, Homo sapiens
ttccactacacctgg

SEQ ID NO: 6569070 - DNA, 16 bp, Homo sapiens
ttccactacacctggc

SEQ ID NO: 6569071 - DNA, 19 bp, Homo sapiens
ttccactaccaaaagacat

SEQ ID NO: 6569072 - DNA, 15 bp, Homo sapiens
ttccactactgctac

SEQ ID NO: 6569073 - DNA, 18 bp, Homo sapiens
ttccactattttcaaaga

SEQ ID NO: 6569074 - DNA, 13 bp, Homo sapiens
ttccactcagctt

SEQ ID NO: 6569075 - DNA, 23 bp, Homo sapiens
ttccactcagcttggttcctgcc

SEQ ID NO: 6569076 - DNA, 16 bp, Homo sapiens
ttccactcctatggaa

SEQ ID NO: 6569077 - DNA, 16 bp, Homo sapiens
ttccactcctcctagc

SEQ ID NO: 6569078 - DNA, 19 bp, Homo sapiens
ttccactcgtgtgtttcta

SEQ ID NO: 6569079 - DNA, 16 bp, Homo sapiens
ttccactctgatagaa

SEQ ID NO: 6569080 - DNA, 23 bp, Homo sapiens
ttccactctggattcagccttct

SEQ ID NO: 6569081 - DNA, 16 bp, Homo sapiens
ttccactgaaactctt

SEQ ID NO: 6569082 - DNA, 21 bp, Homo sapiens
ttccactgaaatagagtgaat

SEQ ID NO: 6569083 - DNA, 16 bp, Homo sapiens
ttccactgaacaaaac

SEQ ID NO: 6569084 - DNA, 15 bp, Homo sapiens
ttccactgagctcca

SEQ ID NO: 6569085 - DNA, 15 bp, Homo sapiens
ttccactgagggcag

SEQ ID NO: 6569086 - DNA, 19 bp, Homo sapiens
ttccactgcaaataaagcc

SEQ ID NO: 6569087 - DNA, 21 bp, Homo sapiens
ttccactgcaaataaagcctt

SEQ ID NO: 6569088 - DNA, 23 bp, Homo sapiens
ttccactgcaaataaagcctttt

SEQ ID NO: 6569089 - DNA, 13 bp, Homo sapiens
ttccactgcctct

SEQ ID NO: 6569090 - DNA, 15 bp, Homo sapiens
ttccactgcctctgc

SEQ ID NO: 6569091 - DNA, 20 bp, Homo sapiens
ttccactgctactgacccag

SEQ ID NO: 6569092 - DNA, 22 bp, Homo sapiens
ttccactgctactgacccagag

SEQ ID NO: 6569093 - DNA, 22 bp, Homo sapiens
ttccactggaaacttagagtca

SEQ ID NO: 6569094 - DNA, 13 bp, Homo sapiens
ttccactggagaa

SEQ ID NO: 6569095 - DNA, 20 bp, Homo sapiens
ttccactgtcaagaaagagc

SEQ ID NO: 6569096 - DNA, 13 bp, Homo sapiens
ttccactgtgcta

SEQ ID NO: 6569097 - DNA, 18 bp, Homo sapiens
ttccacttatagcctctg

SEQ ID NO: 6569098 - DNA, 14 bp, Homo sapiens
ttccacttctctag

SEQ ID NO: 6569099 - DNA, 19 bp, Homo sapiens
ttccacttcttcctttctc

SEQ ID NO: 6569100 - DNA, 21 bp, Homo sapiens
ttccacttgagtgtcaagctg

SEQ ID NO: 6569101 - DNA, 18 bp, Homo sapiens
ttccacttgattttgcaa

SEQ ID NO: 6569102 - DNA, 15 bp, Homo sapiens
ttccacttgccctgt

SEQ ID NO: 6569103 - DNA, 20 bp, Homo sapiens
ttccacttgccctgtgttct

SEQ ID NO: 6569104 - DNA, 19 bp, Homo sapiens
ttccacttggctacacagg

SEQ ID NO: 6569105 - DNA, 15 bp, Homo sapiens
ttccacttgtgggct

SEQ ID NO: 6569106 - DNA, 19 bp, Homo sapiens
ttccactttgtataaattt

SEQ ID NO: 6569107 - DNA, 19 bp, Homo sapiens
ttccactttttgttacata

SEQ ID NO: 6569108 - DNA, 17 bp, Homo sapiens
ttccagaaaaccccagc

SEQ ID NO: 6569109 - DNA, 12 bp, Homo sapiens
ttccagaaaata

SEQ ID NO: 6569110 - DNA, 17 bp, Homo sapiens
ttccagaaaatataaat

SEQ ID NO: 6569111 - DNA, 20 bp, Homo sapiens
ttccagaaaatataaatgca

SEQ ID NO: 6569112 - DNA, 22 bp, Homo sapiens
ttccagaaagaaaatgaatttg

SEQ ID NO: 6569113 - DNA, 19 bp, Homo sapiens
ttccagaaagcaggagcag

SEQ ID NO: 6569114 - DNA, 14 bp, Homo sapiens
ttccagaaaggata

SEQ ID NO: 6569115 - DNA, 19 bp, Homo sapiens
ttccagaaatacctgtcta

SEQ ID NO: 6569116 - DNA, 15 bp, Homo sapiens
ttccagaacactctt

SEQ ID NO: 6569117 - DNA, 20 bp, Homo sapiens
ttccagaacagccctcggcc

SEQ ID NO: 6569118 - DNA, 22 bp, Homo sapiens
ttccagaacagccctcggcctc

SEQ ID NO: 6569119 - DNA, 18 bp, Homo sapiens
ttccagaagaacaacttt

SEQ ID NO: 6569120 - DNA, 18 bp, Homo sapiens
ttccagaagaagagaagc

SEQ ID NO: 6569121 - DNA, 22 bp, Homo sapiens
ttccagaagaagagaagctgct

SEQ ID NO: 6569122 - DNA, 18 bp, Homo sapiens
ttccagaagatgccctcc

SEQ ID NO: 6569123 - DNA, 18 bp, Homo sapiens
ttccagaaggatttcttg

SEQ ID NO: 6569124 - DNA, 22 bp, Homo sapiens
ttccagaaggccacaggccact

SEQ ID NO: 6569125 - DNA, 16 bp, Homo sapiens
ttccagaatcccaaga

SEQ ID NO: 6569126 - DNA, 12 bp, Homo sapiens
ttccagaatctt

SEQ ID NO: 6569127 - DNA, 20 bp, Homo sapiens
ttccagaatgctgaactcct

SEQ ID NO: 6569128 - DNA, 14 bp, Homo sapiens
ttccagaatgctgt

SEQ ID NO: 6569129 - DNA, 22 bp, Homo sapiens
ttccagaccaataaatttgtaa

SEQ ID NO: 6569130 - DNA, 11 bp, Homo sapiens
ttccagaccac

SEQ ID NO: 6569131 - DNA, 12 bp, Homo sapiens
ttccagaccacc

SEQ ID NO: 6569132 - DNA, 13 bp, Homo sapiens
ttccagaccacct

SEQ ID NO: 6569133 - DNA, 15 bp, Homo sapiens
ttccagaccacctgc

SEQ ID NO: 6569134 - DNA, 16 bp, Homo sapiens
ttccagaccacctgcc

SEQ ID NO: 6569135 - DNA, 17 bp, Homo sapiens
ttccagaccacctgcca

SEQ ID NO: 6569136 - DNA, 21 bp, Homo sapiens
ttccagaccacctgccagcca

SEQ ID NO: 6569137 - DNA, 14 bp, Homo sapiens
ttccagacctgaag

SEQ ID NO: 6569138 - DNA, 13 bp, Homo sapiens
ttccagacttcaa

SEQ ID NO: 6569139 - DNA, 20 bp, Homo sapiens
ttccagacttcaaaaataaa

SEQ ID NO: 6569140 - DNA, 20 bp, Homo sapiens
ttccagagagtcctctggat

SEQ ID NO: 6569141 - DNA, 13 bp, Homo sapiens
ttccagagagtgg

SEQ ID NO: 6569142 - DNA, 17 bp, Homo sapiens
ttccagagagtggagag

SEQ ID NO: 6569143 - DNA, 21 bp, Homo sapiens
ttccagagagtggagagagca

SEQ ID NO: 6569144 - DNA, 13 bp, Homo sapiens
ttccagagcattc

SEQ ID NO: 6569145 - DNA, 15 bp, Homo sapiens
ttccagagctgccag

SEQ ID NO: 6569146 - DNA, 20 bp, Homo sapiens
ttccagagctgcttctgtct

SEQ ID NO: 6569147 - DNA, 15 bp, Homo sapiens
ttccagaggacagct

SEQ ID NO: 6569148 - DNA, 20 bp, Homo sapiens
ttccagaggacagctctggg

SEQ ID NO: 6569149 - DNA, 16 bp, Homo sapiens
ttccagaggactctgc

SEQ ID NO: 6569150 - DNA, 19 bp, Homo sapiens
ttccagaggctattatttt

SEQ ID NO: 6569151 - DNA, 16 bp, Homo sapiens
ttccagaggggttgag

SEQ ID NO: 6569152 - DNA, 16 bp, Homo sapiens
ttccagaggtattcct

SEQ ID NO: 6569153 - DNA, 19 bp, Homo sapiens
ttccagagtccggaggcag

SEQ ID NO: 6569154 - DNA, 22 bp, Homo sapiens
ttccagagttaaaatgtttact

SEQ ID NO: 6569155 - DNA, 18 bp, Homo sapiens
ttccagataaccagctgt

SEQ ID NO: 6569156 - DNA, 21 bp, Homo sapiens
ttccagatatccacataaatg

SEQ ID NO: 6569157 - DNA, 18 bp, Homo sapiens
ttccagatcactgccaca

SEQ ID NO: 6569158 - DNA, 15 bp, Homo sapiens
ttccagatcctctct

SEQ ID NO: 6569159 - DNA, 20 bp, Homo sapiens
ttccagatgccttctccaga

SEQ ID NO: 6569160 - DNA, 21 bp, Homo sapiens
ttccagatgctggtttttccc

SEQ ID NO: 6569161 - DNA, 17 bp, Homo sapiens
ttccagatgtaggcatt

SEQ ID NO: 6569162 - DNA, 14 bp, Homo sapiens
ttccagatgtggat

SEQ ID NO: 6569163 - DNA, 18 bp, Homo sapiens
ttccagattcttccactg

SEQ ID NO: 6569164 - DNA, 12 bp, Homo sapiens
ttccagcaaaat

SEQ ID NO: 6569165 - DNA, 22 bp, Homo sapiens
ttccagcaaaatccaaactgct

SEQ ID NO: 6569166 - DNA, 23 bp, Homo sapiens
ttccagcaaaatccaaactgctg

SEQ ID NO: 6569167 - DNA, 22 bp, Homo sapiens
ttccagcaaacgtacgggaatg

SEQ ID NO: 6569168 - DNA, 15 bp, Homo sapiens
tttttccccaaagtc

SEQ ID NO: 6569169 - DNA, 17 bp, Homo sapiens
tttttccccagacttgt

SEQ ID NO: 6569170 - DNA, 13 bp, Homo sapiens
tttttccccccaa

SEQ ID NO: 6569171 - DNA, 20 bp, Homo sapiens
tttttccccccaccccccag

SEQ ID NO: 6569172 - DNA, 13 bp, Homo sapiens
tttttcccctgca

SEQ ID NO: 6569173 - DNA, 14 bp, Homo sapiens
tttttcccctgcaa

SEQ ID NO: 6569174 - DNA, 15 bp, Homo sapiens
tttttcccctgcaat

SEQ ID NO: 6569175 - DNA, 10 bp, Homo sapiens
tttttccctt

SEQ ID NO: 6569176 - DNA, 14 bp, Homo sapiens
tttttccgtaaaaa

SEQ ID NO: 6569177 - DNA, 15 bp, Homo sapiens
tttttccgtaaaaat

SEQ ID NO: 6569178 - DNA, 15 bp, Homo sapiens
tttttccgtaaatgt

SEQ ID NO: 6569179 - DNA, 19 bp, Homo sapiens
tttttccgtaaatgtctgc

SEQ ID NO: 6569180 - DNA, 23 bp, Homo sapiens
tttttcctaacaaaagatgaaag

SEQ ID NO: 6569181 - DNA, 12 bp, Homo sapiens
tttttcctacca

SEQ ID NO: 6569182 - DNA, 20 bp, Homo sapiens
tttttcctactccgttcctg

SEQ ID NO: 6569183 - DNA, 22 bp, Homo sapiens
tttttcctactccgttcctggc

SEQ ID NO: 6569184 - DNA, 21 bp, Homo sapiens
tttttcctagcctgtttcttc

SEQ ID NO: 6569185 - DNA, 15 bp, Homo sapiens
tttttcctcatgtaa

SEQ ID NO: 6569186 - DNA, 17 bp, Homo sapiens
tttttcctcatgtaaca

SEQ ID NO: 6569187 - DNA, 19 bp, Homo sapiens
tttttcctccctgcttaaa

SEQ ID NO: 6569188 - DNA, 18 bp, Homo sapiens
tttttcctcctttctctg

SEQ ID NO: 6569189 - DNA, 23 bp, Homo sapiens
tttttcctcttcagaacttgtca

SEQ ID NO: 6569190 - DNA, 11 bp, Homo sapiens
tttttcctgca

SEQ ID NO: 6569191 - DNA, 11 bp, Homo sapiens
tttttcctgtc

SEQ ID NO: 6569192 - DNA, 14 bp, Homo sapiens
tttttcctgtcctg

SEQ ID NO: 6569193 - DNA, 20 bp, Homo sapiens
tttttccttaatccagctga

SEQ ID NO: 6569194 - DNA, 22 bp, Homo sapiens
tttttccttatagggaaaaatg

SEQ ID NO: 6569195 - DNA, 11 bp, Homo sapiens
tttttccttca

SEQ ID NO: 6569196 - DNA, 18 bp, Homo sapiens
tttttccttcaaagttta

SEQ ID NO: 6569197 - DNA, 15 bp, Homo sapiens
tttttccttcataat

SEQ ID NO: 6569198 - DNA, 16 bp, Homo sapiens
tttttccttcccttct

SEQ ID NO: 6569199 - DNA, 11 bp, Homo sapiens
tttttccttta

SEQ ID NO: 6569200 - DNA, 15 bp, Homo sapiens
tttttcctttcctga

SEQ ID NO: 6569201 - DNA, 22 bp, Homo sapiens
tttttcctttgaacgtgcttct

SEQ ID NO: 6569202 - DNA, 19 bp, Homo sapiens
tttttccttttcatctgtt

SEQ ID NO: 6569203 - DNA, 12 bp, Homo sapiens
tttttccttttg

SEQ ID NO: 6569204 - DNA, 16 bp, Homo sapiens
tttttcgtttgtttgt

SEQ ID NO: 6569205 - DNA, 12 bp, Homo sapiens
tttttctaaaac

SEQ ID NO: 6569206 - DNA, 20 bp, Homo sapiens
tttttctaaacctgtgcctc

SEQ ID NO: 6569207 - DNA, 14 bp, Homo sapiens
tttttctaaaggag

SEQ ID NO: 6569208 - DNA, 23 bp, Homo sapiens
tttttctatgcataaaaaaatga

SEQ ID NO: 6569209 - DNA, 19 bp, Homo sapiens
tttttctattaaaagactc

SEQ ID NO: 6569210 - DNA, 11 bp, Homo sapiens
tttttctcaaa

SEQ ID NO: 6569211 - DNA, 16 bp, Homo sapiens
tttttctcaaagtttt

SEQ ID NO: 6569212 - DNA, 18 bp, Homo sapiens
tttttctcaatacgcctt

SEQ ID NO: 6569213 - DNA, 15 bp, Homo sapiens
tttttctcagtccta

SEQ ID NO: 6569214 - DNA, 19 bp, Homo sapiens
tttttctcatgaatctgca

SEQ ID NO: 6569215 - DNA, 17 bp, Homo sapiens
tttttctcatgtatctt

SEQ ID NO: 6569216 - DNA, 21 bp, Homo sapiens
tttttctcgctgtcctttcta

SEQ ID NO: 6569217 - DNA, 22 bp, Homo sapiens
tttttctctataaagggtcagg

SEQ ID NO: 6569218 - DNA, 13 bp, Homo sapiens
tttttctctctgg

SEQ ID NO: 6569219 - DNA, 12 bp, Homo sapiens
tttttctcttca

SEQ ID NO: 6569220 - DNA, 13 bp, Homo sapiens
tttttctctttgt

SEQ ID NO: 6569221 - DNA, 16 bp, Homo sapiens
tttttctcttttcaca

SEQ ID NO: 6569222 - DNA, 20 bp, Homo sapiens
tttttctctttttcttgtaa

SEQ ID NO: 6569223 - DNA, 15 bp, Homo sapiens
tttttctgaataaaa

SEQ ID NO: 6569224 - DNA, 20 bp, Homo sapiens
tttttctgaataaaaaagat

SEQ ID NO: 6569225 - DNA, 24 bp, Homo sapiens
tttttctgagatttttgatatctc

SEQ ID NO: 6569226 - DNA, 13 bp, Homo sapiens
tttttctgataaa

SEQ ID NO: 6569227 - DNA, 11 bp, Homo sapiens
tttttctgatg

SEQ ID NO: 6569228 - DNA, 16 bp, Homo sapiens
tttttctgattagctt

SEQ ID NO: 6569229 - DNA, 13 bp, Homo sapiens
tttttctgcacta

SEQ ID NO: 6569230 - DNA, 18 bp, Homo sapiens
tttttctgcactatatgc

SEQ ID NO: 6569231 - DNA, 17 bp, Homo sapiens
tttttctgcactgagca

SEQ ID NO: 6569232 - DNA, 14 bp, Homo sapiens
tttttctgcctcct

SEQ ID NO: 6569233 - DNA, 16 bp, Homo sapiens
tttttctgcctgagat

SEQ ID NO: 6569234 - DNA, 13 bp, Homo sapiens
tttttctgcttta

SEQ ID NO: 6569235 - DNA, 11 bp, Homo sapiens
tttttctggac

SEQ ID NO: 6569236 - DNA, 17 bp, Homo sapiens
tttttctggaggctggc

SEQ ID NO: 6569237 - DNA, 18 bp, Homo sapiens
tttttctgtaatgtaaat

SEQ ID NO: 6569238 - DNA, 20 bp, Homo sapiens
tttttctgtaatgtaaataa

SEQ ID NO: 6569239 - DNA, 22 bp, Homo sapiens
tttttctgtaatgtaaataaac

SEQ ID NO: 6569240 - DNA, 13 bp, Homo sapiens
tttttctgtctct

SEQ ID NO: 6569241 - DNA, 11 bp, Homo sapiens
tttttctgtgg

SEQ ID NO: 6569242 - DNA, 18 bp, Homo sapiens
tttttctgtgtgtcagtt

SEQ ID NO: 6569243 - DNA, 17 bp, Homo sapiens
tttttctgttgtaactt

SEQ ID NO: 6569244 - DNA, 13 bp, Homo sapiens
tttttcttaatca

SEQ ID NO: 6569245 - DNA, 13 bp, Homo sapiens
tttttcttaccaa

SEQ ID NO: 6569246 - DNA, 14 bp, Homo sapiens
tttttcttaccaaa

SEQ ID NO: 6569247 - DNA, 14 bp, Homo sapiens
tttttcttaggttt

SEQ ID NO: 6569248 - DNA, 18 bp, Homo sapiens
tttttcttatttatgtaa

SEQ ID NO: 6569249 - DNA, 10 bp, Homo sapiens
tttttcttct

SEQ ID NO: 6569250 - DNA, 22 bp, Homo sapiens
tttttcttctaaaatgctttta

SEQ ID NO: 6569251 - DNA, 16 bp, Homo sapiens
tttttcttctgtattt

SEQ ID NO: 6569252 - DNA, 11 bp, Homo sapiens
tttttcttggg

SEQ ID NO: 6569253 - DNA, 13 bp, Homo sapiens
tttttcttggggt

SEQ ID NO: 6569254 - DNA, 23 bp, Homo sapiens
tttttcttgtaaatgtgttggac

SEQ ID NO: 6569255 - DNA, 13 bp, Homo sapiens
tttttcttgtaat

SEQ ID NO: 6569256 - DNA, 19 bp, Homo sapiens
tttttcttgtattcatgaa

SEQ ID NO: 6569257 - DNA, 15 bp, Homo sapiens
tttttctttatgcat

SEQ ID NO: 6569258 - DNA, 12 bp, Homo sapiens
tttttctttcac

SEQ ID NO: 6569259 - DNA, 18 bp, Homo sapiens
tttttctttttaaagttt

SEQ ID NO: 6569260 - DNA, 21 bp, Homo sapiens
tttttgaaaaagaaaacactt

SEQ ID NO: 6569261 - DNA, 23 bp, Homo sapiens
tttttgaaaaagcgaaaaaatca

SEQ ID NO: 6569262 - DNA, 20 bp, Homo sapiens
tttttgaaaagcagacattt

SEQ ID NO: 6569263 - DNA, 17 bp, Homo sapiens
tttttgaaacccacagt

SEQ ID NO: 6569264 - DNA, 12 bp, Homo sapiens
tttttgaaagca

SEQ ID NO: 6569265 - DNA, 14 bp, Homo sapiens
tttttgaaatacct

SEQ ID NO: 6569266 - DNA, 12 bp, Homo sapiens
tttttgaaatga

SEQ ID NO: 6569267 - DNA, 17 bp, Homo sapiens
tttttgaaatgaaattt

SEQ ID NO: 6569268 - DNA, 18 bp, Homo sapiens
tttttgaaccaacatctt

SEQ ID NO: 6569269 - DNA, 20 bp, Homo sapiens
tttttgaacctccaaatgga

SEQ ID NO: 6569270 - DNA, 20 bp, Homo sapiens
tttttgaactcttctcatta

SEQ ID NO: 6569271 - DNA, 18 bp, Homo sapiens
tttttgaactttgtagga

SEQ ID NO: 6569272 - DNA, 21 bp, Homo sapiens
tttttgaagaagggaaattca

SEQ ID NO: 6569273 - DNA, 11 bp, Homo sapiens
tttttgaagtg

SEQ ID NO: 6569274 - DNA, 16 bp, Homo sapiens
tttttgaatgtcataa

SEQ ID NO: 6569275 - DNA, 15 bp, Homo sapiens
tttttgaatttaaat

SEQ ID NO: 6569276 - DNA, 19 bp, Homo sapiens
tttttgaatttaaataaag

SEQ ID NO: 6569277 - DNA, 15 bp, Homo sapiens
tttttgacactgaaa

SEQ ID NO: 6569278 - DNA, 19 bp, Homo sapiens
tttttgacactgaaagttt

SEQ ID NO: 6569279 - DNA, 22 bp, Homo sapiens
tttttgacactgaaagttttgt

SEQ ID NO: 6569280 - DNA, 16 bp, Homo sapiens
tttttgactcccagat

SEQ ID NO: 6569281 - DNA, 13 bp, Homo sapiens
tttttgactgatt

SEQ ID NO: 6569282 - DNA, 22 bp, Homo sapiens
tttttgagacggtgtctcgctg

SEQ ID NO: 6569283 - DNA, 13 bp, Homo sapiens
tttttgaggcaaa

SEQ ID NO: 6569284 - DNA, 22 bp, Homo sapiens
tttttgagtgtgcaatatgtaa

SEQ ID NO: 6569285 - DNA, 17 bp, Homo sapiens
tttttgagtttattctg

SEQ ID NO: 6569286 - DNA, 15 bp, Homo sapiens
tttttgataaagcct

SEQ ID NO: 6569287 - DNA, 21 bp, Homo sapiens
tttttgataaagtaataatgt

SEQ ID NO: 6569288 - DNA, 21 bp, Homo sapiens
tttttgataaagtttctcaga

SEQ ID NO: 6569289 - DNA, 15 bp, Homo sapiens
tttttgataccttca

SEQ ID NO: 6569290 - DNA, 22 bp, Homo sapiens
tttttgatacgcactttgcagg

SEQ ID NO: 6569291 - DNA, 19 bp, Homo sapiens
tttttgatagcattgtaag

SEQ ID NO: 6569292 - DNA, 14 bp, Homo sapiens
tttttgatggctaa

SEQ ID NO: 6569293 - DNA, 19 bp, Homo sapiens
tttttgatttatcaatatt

SEQ ID NO: 6569294 - DNA, 11 bp, Homo sapiens
tttttgcaaat

SEQ ID NO: 6569295 - DNA, 19 bp, Homo sapiens
tttttgcaactaggtattt

SEQ ID NO: 6569296 - DNA, 12 bp, Homo sapiens
tttttgcaataa

SEQ ID NO: 6569297 - DNA, 21 bp, Homo sapiens
tttttgcacaattgtaattga

SEQ ID NO: 6569298 - DNA, 9 bp, Homo sapiens
tttttgcag

SEQ ID NO: 6569299 - DNA, 22 bp, Homo sapiens
tttttgcagctaaattaccata

SEQ ID NO: 6569300 - DNA, 16 bp, Homo sapiens
tttttgcattattcat

SEQ ID NO: 6569301 - DNA, 17 bp, Homo sapiens
tttttgcatttaaaaca

SEQ ID NO: 6569302 - DNA, 16 bp, Homo sapiens
tttttgccacagcttt

SEQ ID NO: 6569303 - DNA, 17 bp, Homo sapiens
tttttgccagactctag

SEQ ID NO: 6569304 - DNA, 22 bp, Homo sapiens
tttttgcccgttgaccagataa

SEQ ID NO: 6569305 - DNA, 16 bp, Homo sapiens
tttttgcctaccattt

SEQ ID NO: 6569306 - DNA, 14 bp, Homo sapiens
tttttgcgctgcta

SEQ ID NO: 6569307 - DNA, 15 bp, Homo sapiens
tttttgctgcagaga

SEQ ID NO: 6569308 - DNA, 15 bp, Homo sapiens
tttttgcttctactt

SEQ ID NO: 6569309 - DNA, 22 bp, Homo sapiens
tttttggaagaggactccttaa

SEQ ID NO: 6569310 - DNA, 24 bp, Homo sapiens
tttttggaccaccgttcagtcatt

SEQ ID NO: 6569311 - DNA, 22 bp, Homo sapiens
tttttggactagccagaattct

SEQ ID NO: 6569312 - DNA, 22 bp, Homo sapiens
tttttggactcagcccacctgc

SEQ ID NO: 6569313 - DNA, 12 bp, Homo sapiens
tttttggacttc

SEQ ID NO: 6569314 - DNA, 13 bp, Homo sapiens
tttttggagaaat

SEQ ID NO: 6569315 - DNA, 22 bp, Homo sapiens
tttttggaggggtttatgctca

SEQ ID NO: 6569316 - DNA, 15 bp, Homo sapiens
tttttggaggtgctt

SEQ ID NO: 6569317 - DNA, 19 bp, Homo sapiens
tttttggagtgttatgtat

SEQ ID NO: 6569318 - DNA, 23 bp, Homo sapiens
tttttggcataacataaatctgt

SEQ ID NO: 6569319 - DNA, 21 bp, Homo sapiens
tttttggcattcctctaatgt

SEQ ID NO: 6569320 - DNA, 19 bp, Homo sapiens
tttttggcctgtttgatgt

SEQ ID NO: 6569321 - DNA, 23 bp, Homo sapiens
tttttggcctgtttgatgtatgt

SEQ ID NO: 6569322 - DNA, 19 bp, Homo sapiens
tttttggctgttttccctc

SEQ ID NO: 6569323 - DNA, 23 bp, Homo sapiens
tttttgggcagcaatttaaatgt

SEQ ID NO: 6569324 - DNA, 16 bp, Homo sapiens
tttttggggatatgct

SEQ ID NO: 6569325 - DNA, 19 bp, Homo sapiens
tttttggggcatcctggat

SEQ ID NO: 6569326 - DNA, 21 bp, Homo sapiens
tttttggggggttttcttgcc

SEQ ID NO: 6569327 - DNA, 22 bp, Homo sapiens
tttttggggggttttcttgcct

SEQ ID NO: 6569328 - DNA, 22 bp, Homo sapiens
tttttgggtttggccagggagg

SEQ ID NO: 6569329 - DNA, 16 bp, Homo sapiens
tttttggtaaatatga

SEQ ID NO: 6569330 - DNA, 20 bp, Homo sapiens
tttttggtaaatttttgaaa

SEQ ID NO: 6569331 - DNA, 24 bp, Homo sapiens
tttttggtaataacaaacgtgttt

SEQ ID NO: 6569332 - DNA, 13 bp, Homo sapiens
tttttggtattta

SEQ ID NO: 6569333 - DNA, 15 bp, Homo sapiens
tttttggtggatgta

SEQ ID NO: 6569334 - DNA, 17 bp, Homo sapiens
tttttggtggatgtaaa

SEQ ID NO: 6569335 - DNA, 16 bp, Homo sapiens
tttttggtgtatttga

SEQ ID NO: 6569336 - DNA, 17 bp, Homo sapiens
tttttggtgtgccctgt

SEQ ID NO: 6569337 - DNA, 16 bp, Homo sapiens
tttttggttgcaattg

SEQ ID NO: 6569338 - DNA, 18 bp, Homo sapiens
tttttggttgcaattgtt

SEQ ID NO: 6569339 - DNA, 14 bp, Homo sapiens
tttttggttgggaa

SEQ ID NO: 6569340 - DNA, 15 bp, Homo sapiens
tttttggtttccaaa

SEQ ID NO: 6569341 - DNA, 14 bp, Homo sapiens
tttttggtttttta

SEQ ID NO: 6569342 - DNA, 17 bp, Homo sapiens
tttttgtaaaaactttt

SEQ ID NO: 6569343 - DNA, 22 bp, Homo sapiens
tttttgtaaaaagggaaaaaga

SEQ ID NO: 6569344 - DNA, 12 bp, Homo sapiens
tttttgtaaata

SEQ ID NO: 6569345 - DNA, 13 bp, Homo sapiens
tttttgtaactct

SEQ ID NO: 6569346 - DNA, 16 bp, Homo sapiens
tttttgtaacttcaaa

SEQ ID NO: 6569347 - DNA, 16 bp, Homo sapiens
tttttgtaagaaaatt

SEQ ID NO: 6569348 - DNA, 11 bp, Homo sapiens
tttttgtaatt

SEQ ID NO: 6569349 - DNA, 18 bp, Homo sapiens
ttccagcaagtacagaga

SEQ ID NO: 6569350 - DNA, 23 bp, Homo sapiens
ttccagcaataagaaatgaacaa

SEQ ID NO: 6569351 - DNA, 21 bp, Homo sapiens
ttccagcaattctcctgcctc

SEQ ID NO: 6569352 - DNA, 23 bp, Homo sapiens
ttccagcaattctcctgcctcag

SEQ ID NO: 6569353 - DNA, 22 bp, Homo sapiens
ttccagcagaagacaaaaagac

SEQ ID NO: 6569354 - DNA, 16 bp, Homo sapiens
ttccagcagtgaaact

SEQ ID NO: 6569355 - DNA, 19 bp, Homo sapiens
ttccagcagtgaaacttgt

SEQ ID NO: 6569356 - DNA, 16 bp, Homo sapiens
ttccagcagtttcatg

SEQ ID NO: 6569357 - DNA, 24 bp, Homo sapiens
ttccagcatgaggtatctaaggat

SEQ ID NO: 6569358 - DNA, 18 bp, Homo sapiens
ttccagccaaagcatgcc

SEQ ID NO: 6569359 - DNA, 21 bp, Homo sapiens
ttccagccaggcccaggccag

SEQ ID NO: 6569360 - DNA, 11 bp, Homo sapiens
ttccagcccat

SEQ ID NO: 6569361 - DNA, 20 bp, Homo sapiens
ttccagcccatccaaacact

SEQ ID NO: 6569362 - DNA, 17 bp, Homo sapiens
ttccagcccctctggtc

SEQ ID NO: 6569363 - DNA, 14 bp, Homo sapiens
ttccagcctgggac

SEQ ID NO: 6569364 - DNA, 16 bp, Homo sapiens
ttccagcctgggacac

SEQ ID NO: 6569365 - DNA, 22 bp, Homo sapiens
ttccagcgggccctctgccgac

SEQ ID NO: 6569366 - DNA, 15 bp, Homo sapiens
ttccagcgtctgctg

SEQ ID NO: 6569367 - DNA, 16 bp, Homo sapiens
ttccagcgtctgctgt

SEQ ID NO: 6569368 - DNA, 23 bp, Homo sapiens
ttccagctagtgacccacatgcc

SEQ ID NO: 6569369 - DNA, 20 bp, Homo sapiens
ttccagctcaccccccacac

SEQ ID NO: 6569370 - DNA, 23 bp, Homo sapiens
ttccagctcaccccccacactca

SEQ ID NO: 6569371 - DNA, 16 bp, Homo sapiens
ttccagctccctcccc

SEQ ID NO: 6569372 - DNA, 17 bp, Homo sapiens
ttccagctccgtgtttc

SEQ ID NO: 6569373 - DNA, 19 bp, Homo sapiens
ttccagctctaataaaaca

SEQ ID NO: 6569374 - DNA, 11 bp, Homo sapiens
ttccagctgcc

SEQ ID NO: 6569375 - DNA, 12 bp, Homo sapiens
ttccagctgcca

SEQ ID NO: 6569376 - DNA, 20 bp, Homo sapiens
ttccagctgctgtcttctgg

SEQ ID NO: 6569377 - DNA, 18 bp, Homo sapiens
ttccagctggatgagaat

SEQ ID NO: 6569378 - DNA, 17 bp, Homo sapiens
ttccagctgtgcagcac

SEQ ID NO: 6569379 - DNA, 14 bp, Homo sapiens
ttccagcttcaggc

SEQ ID NO: 6569380 - DNA, 19 bp, Homo sapiens
ttccagcttgcattgattg

SEQ ID NO: 6569381 - DNA, 15 bp, Homo sapiens
ttccagcttgcctgt

SEQ ID NO: 6569382 - DNA, 13 bp, Homo sapiens
ttccagctttctc

SEQ ID NO: 6569383 - DNA, 18 bp, Homo sapiens
ttccagctttctctttgt

SEQ ID NO: 6569384 - DNA, 21 bp, Homo sapiens
ttccaggaaaaaataaaaaga

SEQ ID NO: 6569385 - DNA, 22 bp, Homo sapiens
ttccaggaaaaaataaaaagag

SEQ ID NO: 6569386 - DNA, 24 bp, Homo sapiens
ttccaggaaactccacatctgcct

SEQ ID NO: 6569387 - DNA, 15 bp, Homo sapiens
ttccaggaaccaaaa

SEQ ID NO: 6569388 - DNA, 19 bp, Homo sapiens
ttccaggaaccaaaaagag

SEQ ID NO: 6569389 - DNA, 16 bp, Homo sapiens
ttccaggaagcacagg

SEQ ID NO: 6569390 - DNA, 18 bp, Homo sapiens
ttccaggaagcacaggcc

SEQ ID NO: 6569391 - DNA, 13 bp, Homo sapiens
ttccaggacccct

SEQ ID NO: 6569392 - DNA, 20 bp, Homo sapiens
ttccaggactgtttcaaaca

SEQ ID NO: 6569393 - DNA, 15 bp, Homo sapiens
ttccaggagacatat

SEQ ID NO: 6569394 - DNA, 16 bp, Homo sapiens
ttccaggagacatata

SEQ ID NO: 6569395 - DNA, 22 bp, Homo sapiens
ttccaggagcacacggccctgc

SEQ ID NO: 6569396 - DNA, 21 bp, Homo sapiens
ttccaggaggagttagccaaa

SEQ ID NO: 6569397 - DNA, 22 bp, Homo sapiens
ttccaggaggagttagccaaac

SEQ ID NO: 6569398 - DNA, 18 bp, Homo sapiens
ttccaggatcctgcagga

SEQ ID NO: 6569399 - DNA, 13 bp, Homo sapiens
ttccaggcagcct

SEQ ID NO: 6569400 - DNA, 18 bp, Homo sapiens
ttccaggcatgaccctgg

SEQ ID NO: 6569401 - DNA, 21 bp, Homo sapiens
ttccaggcatgaccctggagc

SEQ ID NO: 6569402 - DNA, 15 bp, Homo sapiens
ttccaggccccaggc

SEQ ID NO: 6569403 - DNA, 16 bp, Homo sapiens
ttccaggcccctgagg

SEQ ID NO: 6569404 - DNA, 17 bp, Homo sapiens
ttccaggcccctgagga

SEQ ID NO: 6569405 - DNA, 21 bp, Homo sapiens
ttccaggcccctgaggactgg

SEQ ID NO: 6569406 - DNA, 17 bp, Homo sapiens
ttccaggcccgaagcat

SEQ ID NO: 6569407 - DNA, 21 bp, Homo sapiens
ttccaggcgtagggccagggc

SEQ ID NO: 6569408 - DNA, 21 bp, Homo sapiens
ttccaggctaaacatccaata

SEQ ID NO: 6569409 - DNA, 11 bp, Homo sapiens
ttccaggctcc

SEQ ID NO: 6569410 - DNA, 12 bp, Homo sapiens
ttccaggctgag

SEQ ID NO: 6569411 - DNA, 15 bp, Homo sapiens
ttccaggctgagagc

SEQ ID NO: 6569412 - DNA, 18 bp, Homo sapiens
ttccaggctgagccatga

SEQ ID NO: 6569413 - DNA, 16 bp, Homo sapiens
ttccaggctgcataga

SEQ ID NO: 6569414 - DNA, 23 bp, Homo sapiens
ttccaggcttccctgacttgctt

SEQ ID NO: 6569415 - DNA, 14 bp, Homo sapiens
ttccaggcttctgc

SEQ ID NO: 6569416 - DNA, 15 bp, Homo sapiens
ttccaggcttctgct

SEQ ID NO: 6569417 - DNA, 18 bp, Homo sapiens
ttccaggcttctgctggg

SEQ ID NO: 6569418 - DNA, 15 bp, Homo sapiens
ttccagggaaccaga

SEQ ID NO: 6569419 - DNA, 16 bp, Homo sapiens
ttccagggaaccagag

SEQ ID NO: 6569420 - DNA, 23 bp, Homo sapiens
ttccagggactgtacctgtagga

SEQ ID NO: 6569421 - DNA, 15 bp, Homo sapiens
ttccagggaggggcc

SEQ ID NO: 6569422 - DNA, 14 bp, Homo sapiens
ttccagggatccag

SEQ ID NO: 6569423 - DNA, 20 bp, Homo sapiens
ttccagggatttgcctcacc

SEQ ID NO: 6569424 - DNA, 23 bp, Homo sapiens
ttccagggatttgcctcaccttg

SEQ ID NO: 6569425 - DNA, 14 bp, Homo sapiens
ttccagggcaatca

SEQ ID NO: 6569426 - DNA, 18 bp, Homo sapiens
ttccagggcataaaactc

SEQ ID NO: 6569427 - DNA, 12 bp, Homo sapiens
ttccagggccct

SEQ ID NO: 6569428 - DNA, 13 bp, Homo sapiens
ttccagggctggg

SEQ ID NO: 6569429 - DNA, 19 bp, Homo sapiens
ttccagggctggggtgagc

SEQ ID NO: 6569430 - DNA, 22 bp, Homo sapiens
ttccaggggtcaccttgagagg

SEQ ID NO: 6569431 - DNA, 17 bp, Homo sapiens
ttccaggggtgggacac

SEQ ID NO: 6569432 - DNA, 16 bp, Homo sapiens
ttccagggtccctctg

SEQ ID NO: 6569433 - DNA, 18 bp, Homo sapiens
ttccagggtccctctgtg

SEQ ID NO: 6569434 - DNA, 19 bp, Homo sapiens
ttccagggtccctctgtgt

SEQ ID NO: 6569435 - DNA, 21 bp, Homo sapiens
ttccaggtaacaggtgtgtat

SEQ ID NO: 6569436 - DNA, 20 bp, Homo sapiens
ttccaggtaatatgtcttgg

SEQ ID NO: 6569437 - DNA, 15 bp, Homo sapiens
ttccaggtatgggac

SEQ ID NO: 6569438 - DNA, 17 bp, Homo sapiens
ttccaggtccaaaccct

SEQ ID NO: 6569439 - DNA, 18 bp, Homo sapiens
ttccaggtctgcctggtt

SEQ ID NO: 6569440 - DNA, 15 bp, Homo sapiens
ttccaggtggcagga

SEQ ID NO: 6569441 - DNA, 15 bp, Homo sapiens
ttccaggtggggtga

SEQ ID NO: 6569442 - DNA, 16 bp, Homo sapiens
ttccagtaactttttt

SEQ ID NO: 6569443 - DNA, 20 bp, Homo sapiens
ttccagtaacttttttgtgt

SEQ ID NO: 6569444 - DNA, 19 bp, Homo sapiens
ttccagtacacctttcagc

SEQ ID NO: 6569445 - DNA, 16 bp, Homo sapiens
ttccagtacagtattc

SEQ ID NO: 6569446 - DNA, 17 bp, Homo sapiens
ttccagtacagtattct

SEQ ID NO: 6569447 - DNA, 21 bp, Homo sapiens
ttccagtacagtattctttta

SEQ ID NO: 6569448 - DNA, 12 bp, Homo sapiens
ttccagtataaa

SEQ ID NO: 6569449 - DNA, 15 bp, Homo sapiens
ttccagtatcctgaa

SEQ ID NO: 6569450 - DNA, 19 bp, Homo sapiens
ttccagtattgaaaacttc

SEQ ID NO: 6569451 - DNA, 21 bp, Homo sapiens
ttccagtattgaaaacttcaa

SEQ ID NO: 6569452 - DNA, 12 bp, Homo sapiens
ttccagtatttt

SEQ ID NO: 6569453 - DNA, 15 bp, Homo sapiens
ttccagtcaggatga

SEQ ID NO: 6569454 - DNA, 19 bp, Homo sapiens
ttccagtctcaaaaataca

SEQ ID NO: 6569455 - DNA, 13 bp, Homo sapiens
ttccagtgaggaa

SEQ ID NO: 6569456 - DNA, 22 bp, Homo sapiens
ttccagtgaggcatctctctgg

SEQ ID NO: 6569457 - DNA, 15 bp, Homo sapiens
ttccagtgaggctct

SEQ ID NO: 6569458 - DNA, 17 bp, Homo sapiens
ttccagtgaggctctgc

SEQ ID NO: 6569459 - DNA, 19 bp, Homo sapiens
ttccagtgaggctctgccc

SEQ ID NO: 6569460 - DNA, 17 bp, Homo sapiens
ttccagtgatgttgaaa

SEQ ID NO: 6569461 - DNA, 19 bp, Homo sapiens
ttccagtgatgttgaaatt

SEQ ID NO: 6569462 - DNA, 11 bp, Homo sapiens
ttccagtgcta

SEQ ID NO: 6569463 - DNA, 14 bp, Homo sapiens
ttccagtgctgctc

SEQ ID NO: 6569464 - DNA, 18 bp, Homo sapiens
ttccagtggatcataaga

SEQ ID NO: 6569465 - DNA, 20 bp, Homo sapiens
ttccagtggatgagggccac

SEQ ID NO: 6569466 - DNA, 17 bp, Homo sapiens
ttccagtggcttctccc

SEQ ID NO: 6569467 - DNA, 20 bp, Homo sapiens
ttccagtggcttctcccaac

SEQ ID NO: 6569468 - DNA, 23 bp, Homo sapiens
ttccagtggtccatggaatgctt

SEQ ID NO: 6569469 - DNA, 16 bp, Homo sapiens
ttccagtgtccatgtt

SEQ ID NO: 6569470 - DNA, 13 bp, Homo sapiens
ttccagtgtctgt

SEQ ID NO: 6569471 - DNA, 14 bp, Homo sapiens
ttccagtgtctgtc

SEQ ID NO: 6569472 - DNA, 17 bp, Homo sapiens
ttccagttactttccaa

SEQ ID NO: 6569473 - DNA, 20 bp, Homo sapiens
ttccagttatttatttccaa

SEQ ID NO: 6569474 - DNA, 23 bp, Homo sapiens
ttccagttatttatttccaaaat

SEQ ID NO: 6569475 - DNA, 15 bp, Homo sapiens
ttccagttccaggac

SEQ ID NO: 6569476 - DNA, 14 bp, Homo sapiens
ttccagttgctgtg

SEQ ID NO: 6569477 - DNA, 23 bp, Homo sapiens
ttccagttggactgtggcctcag

SEQ ID NO: 6569478 - DNA, 24 bp, Homo sapiens
ttccagttggactgtggcctcagg

SEQ ID NO: 6569479 - DNA, 17 bp, Homo sapiens
ttccagttgttactgaa

SEQ ID NO: 6569480 - DNA, 21 bp, Homo sapiens
ttccagttgttactgaagtta

SEQ ID NO: 6569481 - DNA, 22 bp, Homo sapiens
ttccagtttagcccttccctgc

SEQ ID NO: 6569482 - DNA, 22 bp, Homo sapiens
ttccagttttgtggattaaacc

SEQ ID NO: 6569483 - DNA, 17 bp, Homo sapiens
ttccagttttgttttga

SEQ ID NO: 6569484 - DNA, 21 bp, Homo sapiens
ttccagttttttgccactgca

SEQ ID NO: 6569485 - DNA, 13 bp, Homo sapiens
ttccataaatcta

SEQ ID NO: 6569486 - DNA, 14 bp, Homo sapiens
ttccataagctatt

SEQ ID NO: 6569487 - DNA, 15 bp, Homo sapiens
ttccatacttctctc

SEQ ID NO: 6569488 - DNA, 15 bp, Homo sapiens
ttccatagcaacagg

SEQ ID NO: 6569489 - DNA, 18 bp, Homo sapiens
ttccatagctcaataaaa

SEQ ID NO: 6569490 - DNA, 13 bp, Homo sapiens
ttccatagctctt

SEQ ID NO: 6569491 - DNA, 17 bp, Homo sapiens
ttccatagtatattaaa

SEQ ID NO: 6569492 - DNA, 11 bp, Homo sapiens
ttccatatatt

SEQ ID NO: 6569493 - DNA, 13 bp, Homo sapiens
ttccatatattgg

SEQ ID NO: 6569494 - DNA, 22 bp, Homo sapiens
ttccatatccctgcccagcctg

SEQ ID NO: 6569495 - DNA, 20 bp, Homo sapiens
ttccatatccgggtgctcaa

SEQ ID NO: 6569496 - DNA, 20 bp, Homo sapiens
ttccatatccttctggctgt

SEQ ID NO: 6569497 - DNA, 20 bp, Homo sapiens
ttccatatgacctcatgcat

SEQ ID NO: 6569498 - DNA, 14 bp, Homo sapiens
ttccatatgctctt

SEQ ID NO: 6569499 - DNA, 13 bp, Homo sapiens
ttccatatggagc

SEQ ID NO: 6569500 - DNA, 21 bp, Homo sapiens
ttccatatggagcatttttca

SEQ ID NO: 6569501 - DNA, 18 bp, Homo sapiens
ttccatatggatccactg

SEQ ID NO: 6569502 - DNA, 14 bp, Homo sapiens
ttccatcaaagaga

SEQ ID NO: 6569503 - DNA, 14 bp, Homo sapiens
ttccatcaataaat

SEQ ID NO: 6569504 - DNA, 15 bp, Homo sapiens
ttccatcaataaatg

SEQ ID NO: 6569505 - DNA, 14 bp, Homo sapiens
ttccatcacagcca

SEQ ID NO: 6569506 - DNA, 15 bp, Homo sapiens
ttccatcacagccag

SEQ ID NO: 6569507 - DNA, 17 bp, Homo sapiens
ttccatcacagccagcc

SEQ ID NO: 6569508 - DNA, 22 bp, Homo sapiens
ttccatcacccgtacaggcaat

SEQ ID NO: 6569509 - DNA, 13 bp, Homo sapiens
ttccatcagcttt

SEQ ID NO: 6569510 - DNA, 17 bp, Homo sapiens
ttccatcagctttataa

SEQ ID NO: 6569511 - DNA, 20 bp, Homo sapiens
ttccatcatcactgtaaaga

SEQ ID NO: 6569512 - DNA, 21 bp, Homo sapiens
ttccatcatcactgtaaagac

SEQ ID NO: 6569513 - DNA, 16 bp, Homo sapiens
ttccatcatctctttt

SEQ ID NO: 6569514 - DNA, 13 bp, Homo sapiens
ttccatcatgtct

SEQ ID NO: 6569515 - DNA, 15 bp, Homo sapiens
ttccatcatttggtt

SEQ ID NO: 6569516 - DNA, 19 bp, Homo sapiens
ttccatccaccaccttgcc

SEQ ID NO: 6569517 - DNA, 17 bp, Homo sapiens
ttccatccataaatcca

SEQ ID NO: 6569518 - DNA, 20 bp, Homo sapiens
ttccatccatggccagcagc

SEQ ID NO: 6569519 - DNA, 21 bp, Homo sapiens
ttccatccattacctccatcc

SEQ ID NO: 6569520 - DNA, 22 bp, Homo sapiens
ttccatccattacctccatcca

SEQ ID NO: 6569521 - DNA, 13 bp, Homo sapiens
ttccatcccagag

SEQ ID NO: 6569522 - DNA, 14 bp, Homo sapiens
ttccatcccagagg

SEQ ID NO: 6569523 - DNA, 22 bp, Homo sapiens
ttccatccctaagaattcccag

SEQ ID NO: 6569524 - DNA, 15 bp, Homo sapiens
ttccatccctacccc

SEQ ID NO: 6569525 - DNA, 13 bp, Homo sapiens
ttccatcctgagg

SEQ ID NO: 6569526 - DNA, 14 bp, Homo sapiens
ttccatcctgagga

SEQ ID NO: 6569527 - DNA, 15 bp, Homo sapiens
ttccatcctgtgtcc

SEQ ID NO: 6569528 - DNA, 18 bp, Homo sapiens
ttccatccttgactgaag

SEQ ID NO: 6569529 - DNA, 18 bp, Homo sapiens
ttccatcctttacgtgtt

SEQ ID NO: 6569530 - DNA, 17 bp, Homo sapiens
ttccatctaaaaatata

SEQ ID NO: 6569531 - DNA, 19 bp, Homo sapiens
ttccatctagcagctggcc

SEQ ID NO: 6569532 - DNA, 21 bp, Homo sapiens
ttccatctatataaatcgcat

SEQ ID NO: 6569533 - DNA, 16 bp, Homo sapiens
ttccatctatcactgc

SEQ ID NO: 6569534 - DNA, 18 bp, Homo sapiens
ttccatctatcactgcat

SEQ ID NO: 6569535 - DNA, 18 bp, Homo sapiens
ttccatctcaacctacct

SEQ ID NO: 6569536 - DNA, 23 bp, Homo sapiens
ttccatctcctataatctgtcaa

SEQ ID NO: 6569537 - DNA, 14 bp, Homo sapiens
ttccatctctgact

SEQ ID NO: 6569538 - DNA, 15 bp, Homo sapiens
ttccatctctgcctg

SEQ ID NO: 6569539 - DNA, 16 bp, Homo sapiens
ttccatctctgcctgt

SEQ ID NO: 6569540 - DNA, 14 bp, Homo sapiens
ttccatctctggta

SEQ ID NO: 6569541 - DNA, 15 bp, Homo sapiens
ttccatctcttcctt

SEQ ID NO: 6569542 - DNA, 15 bp, Homo sapiens
ttccatcttcagttt

SEQ ID NO: 6569543 - DNA, 12 bp, Homo sapiens
ttccatcttgta

SEQ ID NO: 6569544 - DNA, 15 bp, Homo sapiens
ttccatgaaaacgtt

SEQ ID NO: 6569545 - DNA, 24 bp, Homo sapiens
ttccatgaaaatgcaacaacatgt

SEQ ID NO: 6569546 - DNA, 22 bp, Homo sapiens
ttccatgaagacacgcttaaaa

SEQ ID NO: 6569547 - DNA, 18 bp, Homo sapiens
ttccatgaagaccacatc

SEQ ID NO: 6569548 - DNA, 20 bp, Homo sapiens
ttccatgaagtttgaacttc

SEQ ID NO: 6569549 - DNA, 13 bp, Homo sapiens
ttccatgacaata

SEQ ID NO: 6569550 - DNA, 12 bp, Homo sapiens
ttccatgacatt

SEQ ID NO: 6569551 - DNA, 13 bp, Homo sapiens
ttccatgacattt

SEQ ID NO: 6569552 - DNA, 14 bp, Homo sapiens
ttccatgacctccc

SEQ ID NO: 6569553 - DNA, 17 bp, Homo sapiens
ttccatgacctcccctc

SEQ ID NO: 6569554 - DNA, 21 bp, Homo sapiens
ttccatgacctcccctcccca

SEQ ID NO: 6569555 - DNA, 14 bp, Homo sapiens
ttccatgactctgc

SEQ ID NO: 6569556 - DNA, 16 bp, Homo sapiens
ttccatgactctgcct

SEQ ID NO: 6569557 - DNA, 21 bp, Homo sapiens
ttccatgactgcttgccctaa

SEQ ID NO: 6569558 - DNA, 21 bp, Homo sapiens
ttccatgagttatcatgaatt

SEQ ID NO: 6569559 - DNA, 16 bp, Homo sapiens
ttccatgatactttaa

SEQ ID NO: 6569560 - DNA, 19 bp, Homo sapiens
ttccatgatttagcaagca

SEQ ID NO: 6569561 - DNA, 22 bp, Homo sapiens
ttccatgatttagcaagcaact

SEQ ID NO: 6569562 - DNA, 14 bp, Homo sapiens
ttccatgattttac

SEQ ID NO: 6569563 - DNA, 17 bp, Homo sapiens
ttccatgcagccttggg

SEQ ID NO: 6569564 - DNA, 15 bp, Homo sapiens
ttccatgccctggga

SEQ ID NO: 6569565 - DNA, 14 bp, Homo sapiens
ttccatgcctgagg

SEQ ID NO: 6569566 - DNA, 22 bp, Homo sapiens
ttccatgcctgagggtggagac

SEQ ID NO: 6569567 - DNA, 15 bp, Homo sapiens
ttccatgcctgctct

SEQ ID NO: 6569568 - DNA, 16 bp, Homo sapiens
ttccatgcctgctctc

SEQ ID NO: 6569569 - DNA, 17 bp, Homo sapiens
ttccatgcctggccctt

SEQ ID NO: 6569570 - DNA, 15 bp, Homo sapiens
ttccatgctcccaac

SEQ ID NO: 6569571 - DNA, 17 bp, Homo sapiens
ttccatgctcccaactc

SEQ ID NO: 6569572 - DNA, 18 bp, Homo sapiens
ttccatgctcccaactcc

SEQ ID NO: 6569573 - DNA, 14 bp, Homo sapiens
ttccatgctgtgcg

SEQ ID NO: 6569574 - DNA, 17 bp, Homo sapiens
ttccatggaaataaaaa

SEQ ID NO: 6569575 - DNA, 14 bp, Homo sapiens
ttccatggactttg

SEQ ID NO: 6569576 - DNA, 15 bp, Homo sapiens
ttccatggactttgt

SEQ ID NO: 6569577 - DNA, 14 bp, Homo sapiens
ttccatggattttg

SEQ ID NO: 6569578 - DNA, 17 bp, Homo sapiens
ttccatggcaattttgt

SEQ ID NO: 6569579 - DNA, 19 bp, Homo sapiens
ttccatggcaggaaggctt

SEQ ID NO: 6569580 - DNA, 22 bp, Homo sapiens
ttccatggccgtgtagaagcat

SEQ ID NO: 6569581 - DNA, 14 bp, Homo sapiens
ttccatggctctgt

SEQ ID NO: 6569582 - DNA, 16 bp, Homo sapiens
ttccatggcttcctga

SEQ ID NO: 6569583 - DNA, 17 bp, Homo sapiens
ttccatggcttcctgag

SEQ ID NO: 6569584 - DNA, 21 bp, Homo sapiens
ttccatgggactttccttccc

SEQ ID NO: 6569585 - DNA, 18 bp, Homo sapiens
ttccatgggccccaccat

SEQ ID NO: 6569586 - DNA, 21 bp, Homo sapiens
ttccatgggcccgctgcctct

SEQ ID NO: 6569587 - DNA, 12 bp, Homo sapiens
ttccatggggta

SEQ ID NO: 6569588 - DNA, 15 bp, Homo sapiens
ttccatgtcaagatt

SEQ ID NO: 6569589 - DNA, 21 bp, Homo sapiens
ttccatgtcaagattcagcta

SEQ ID NO: 6569590 - DNA, 14 bp, Homo sapiens
ttccatgtccctgt

SEQ ID NO: 6569591 - DNA, 15 bp, Homo sapiens
ttccatgtcggcctc

SEQ ID NO: 6569592 - DNA, 14 bp, Homo sapiens
ttccatgtggagaa

SEQ ID NO: 6569593 - DNA, 18 bp, Homo sapiens
ttccatgtgttttgcttt

SEQ ID NO: 6569594 - DNA, 16 bp, Homo sapiens
ttccatgttctgggtg

SEQ ID NO: 6569595 - DNA, 16 bp, Homo sapiens
ttccatgtttagcaga

SEQ ID NO: 6569596 - DNA, 13 bp, Homo sapiens
ttccattaaacga

SEQ ID NO: 6569597 - DNA, 21 bp, Homo sapiens
ttccattaaattgcctttgta

SEQ ID NO: 6569598 - DNA, 22 bp, Homo sapiens
ttccattaaattgcctttgtaa

SEQ ID NO: 6569599 - DNA, 14 bp, Homo sapiens
ttccattaacaaat

SEQ ID NO: 6569600 - DNA, 15 bp, Homo sapiens
ttccattaacaaatg

SEQ ID NO: 6569601 - DNA, 15 bp, Homo sapiens
ttccattaatttcaa

SEQ ID NO: 6569602 - DNA, 23 bp, Homo sapiens
ttccattacaaaatccaactctc

SEQ ID NO: 6569603 - DNA, 23 bp, Homo sapiens
ttccattacaggggcagtgcctt

SEQ ID NO: 6569604 - DNA, 14 bp, Homo sapiens
ttccattagaatgc

SEQ ID NO: 6569605 - DNA, 15 bp, Homo sapiens
ttccattagaatgct

SEQ ID NO: 6569606 - DNA, 15 bp, Homo sapiens
ttccattagcatttg

SEQ ID NO: 6569607 - DNA, 13 bp, Homo sapiens
ttccattatctta

SEQ ID NO: 6569608 - DNA, 18 bp, Homo sapiens
ttccattatgaggaaact

SEQ ID NO: 6569609 - DNA, 16 bp, Homo sapiens
ttccattatgattctt

SEQ ID NO: 6569610 - DNA, 15 bp, Homo sapiens
ttccattccatctag

SEQ ID NO: 6569611 - DNA, 14 bp, Homo sapiens
ttccattcccttcg

SEQ ID NO: 6569612 - DNA, 13 bp, Homo sapiens
ttccattctcacc

SEQ ID NO: 6569613 - DNA, 15 bp, Homo sapiens
ttccattctgggtgt

SEQ ID NO: 6569614 - DNA, 18 bp, Homo sapiens
ttccattctttcttcctc

SEQ ID NO: 6569615 - DNA, 19 bp, Homo sapiens
ttccattgaccttaatttc

SEQ ID NO: 6569616 - DNA, 23 bp, Homo sapiens
ttccattgaccttaatttcttgg

SEQ ID NO: 6569617 - DNA, 21 bp, Homo sapiens
ttccattgcaaaatagaagaa

SEQ ID NO: 6569618 - DNA, 18 bp, Homo sapiens
ttccattgcctcttttca

SEQ ID NO: 6569619 - DNA, 22 bp, Homo sapiens
ttccattgcctcttttcacatt

SEQ ID NO: 6569620 - DNA, 16 bp, Homo sapiens
ttccattggatctcat

SEQ ID NO: 6569621 - DNA, 22 bp, Homo sapiens
ttccattgtgtggcctggtggg

SEQ ID NO: 6569622 - DNA, 15 bp, Homo sapiens
ttccattgtttgaaa

SEQ ID NO: 6569623 - DNA, 18 bp, Homo sapiens
ttccattgtttggagaca

SEQ ID NO: 6569624 - DNA, 21 bp, Homo sapiens
ttccattgtttggagacattc

SEQ ID NO: 6569625 - DNA, 20 bp, Homo sapiens
ttccatttacagtctctttc

SEQ ID NO: 6569626 - DNA, 17 bp, Homo sapiens
ttccatttactgcattc

SEQ ID NO: 6569627 - DNA, 19 bp, Homo sapiens
ttccatttacttaagactt

SEQ ID NO: 6569628 - DNA, 21 bp, Homo sapiens
ttccatttatcctagaaaatt

SEQ ID NO: 6569629 - DNA, 19 bp, Homo sapiens
ttccatttatgctggttaa

SEQ ID NO: 6569630 - DNA, 14 bp, Homo sapiens
ttccatttattgtt

SEQ ID NO: 6569631 - DNA, 22 bp, Homo sapiens
ttccatttatttatgaaaaaat

SEQ ID NO: 6569632 - DNA, 14 bp, Homo sapiens
ttccatttcatttg

SEQ ID NO: 6569633 - DNA, 16 bp, Homo sapiens
ttccatttccagttca

SEQ ID NO: 6569634 - DNA, 21 bp, Homo sapiens
ttccatttccagttcatctat

SEQ ID NO: 6569635 - DNA, 22 bp, Homo sapiens
ttccatttctactgtataaaca

SEQ ID NO: 6569636 - DNA, 21 bp, Homo sapiens
ttccatttctctctccagtct

SEQ ID NO: 6569637 - DNA, 17 bp, Homo sapiens
ttccatttcttcagagg

SEQ ID NO: 6569638 - DNA, 14 bp, Homo sapiens
ttccatttcttcca

SEQ ID NO: 6569639 - DNA, 16 bp, Homo sapiens
ttccatttcttcctca

SEQ ID NO: 6569640 - DNA, 18 bp, Homo sapiens
ttccatttcttcctcact

SEQ ID NO: 6569641 - DNA, 19 bp, Homo sapiens
ttccatttcttcctcacta

SEQ ID NO: 6569642 - DNA, 13 bp, Homo sapiens
ttccatttgcaag

SEQ ID NO: 6569643 - DNA, 17 bp, Homo sapiens
ttccatttgcatttgtt

SEQ ID NO: 6569644 - DNA, 21 bp, Homo sapiens
ttccatttggattttaaacaa

SEQ ID NO: 6569645 - DNA, 22 bp, Homo sapiens
ttccatttgggcacattttact

SEQ ID NO: 6569646 - DNA, 13 bp, Homo sapiens
ttccatttggtat

SEQ ID NO: 6569647 - DNA, 11 bp, Homo sapiens
ttccatttgtg

SEQ ID NO: 6569648 - DNA, 14 bp, Homo sapiens
ttccatttgtgtgt

SEQ ID NO: 6569649 - DNA, 21 bp, Homo sapiens
ttccattttctataagaaaaa

SEQ ID NO: 6569650 - DNA, 22 bp, Homo sapiens
ttccattttgccacctttcctg

SEQ ID NO: 6569651 - DNA, 21 bp, Homo sapiens
ttccatttttactaaagcagt

SEQ ID NO: 6569652 - DNA, 19 bp, Homo sapiens
ttccatttttcctctgttc

SEQ ID NO: 6569653 - DNA, 20 bp, Homo sapiens
ttccatttttcctctgttca

SEQ ID NO: 6569654 - DNA, 21 bp, Homo sapiens
ttccatttttcctctgttcac

SEQ ID NO: 6569655 - DNA, 23 bp, Homo sapiens
ttccatttttttctttacttatc

SEQ ID NO: 6569656 - DNA, 23 bp, Homo sapiens
ttcccaaaacaatctatttaaaa

SEQ ID NO: 6569657 - DNA, 11 bp, Homo sapiens
ttcccaaaagc

SEQ ID NO: 6569658 - DNA, 21 bp, Homo sapiens
ttcccaaaagcccattcattc

SEQ ID NO: 6569659 - DNA, 21 bp, Homo sapiens
ttcccaaacccagtctcctct

SEQ ID NO: 6569660 - DNA, 18 bp, Homo sapiens
ttcccaaactacagaata

SEQ ID NO: 6569661 - DNA, 20 bp, Homo sapiens
ttcccaaactacagaataat

SEQ ID NO: 6569662 - DNA, 14 bp, Homo sapiens
ttcccaaagcacaa

SEQ ID NO: 6569663 - DNA, 19 bp, Homo sapiens
ttcccaaaggactccaccc

SEQ ID NO: 6569664 - DNA, 16 bp, Homo sapiens
ttcccaaagtcctctg

SEQ ID NO: 6569665 - DNA, 22 bp, Homo sapiens
ttcccaaatcctagactgctcc

SEQ ID NO: 6569666 - DNA, 12 bp, Homo sapiens
ttcccaaatgta

SEQ ID NO: 6569667 - DNA, 12 bp, Homo sapiens
ttcccaaatttc

SEQ ID NO: 6569668 - DNA, 17 bp, Homo sapiens
ttcccaacagccttagc

SEQ ID NO: 6569669 - DNA, 16 bp, Homo sapiens
ttcccaacatttctta

SEQ ID NO: 6569670 - DNA, 15 bp, Homo sapiens
ttcccaacctcccct

SEQ ID NO: 6569671 - DNA, 21 bp, Homo sapiens
ttcccaacctcccctggtcct

SEQ ID NO: 6569672 - DNA, 16 bp, Homo sapiens
ttcccaacctgctcat

SEQ ID NO: 6569673 - DNA, 19 bp, Homo sapiens
ttcccaactcactgtgctc

SEQ ID NO: 6569674 - DNA, 15 bp, Homo sapiens
ttcccaactcagctg

SEQ ID NO: 6569675 - DNA, 15 bp, Homo sapiens
ttcccaactctagct

SEQ ID NO: 6569676 - DNA, 16 bp, Homo sapiens
ttcccaactgctctgc

SEQ ID NO: 6569677 - DNA, 17 bp, Homo sapiens
ttcccaactgctctgcc

SEQ ID NO: 6569678 - DNA, 23 bp, Homo sapiens
ttcccaacttcatactggcagga

SEQ ID NO: 6569679 - DNA, 15 bp, Homo sapiens
ttcccaacttgcctt

SEQ ID NO: 6569680 - DNA, 19 bp, Homo sapiens
ttcccaacttgcctttgaa

SEQ ID NO: 6569681 - DNA, 21 bp, Homo sapiens
ttcccaagagcatcatgcctc

SEQ ID NO: 6569682 - DNA, 21 bp, Homo sapiens
ttcccaagagtggtggcagct

SEQ ID NO: 6569683 - DNA, 15 bp, Homo sapiens
ttcccaagccatggc

SEQ ID NO: 6569684 - DNA, 17 bp, Homo sapiens
ttcccaagctagactgt

SEQ ID NO: 6569685 - DNA, 20 bp, Homo sapiens
ttcccaagctagactgtgtc

SEQ ID NO: 6569686 - DNA, 16 bp, Homo sapiens
ttcccaagctcccttc

SEQ ID NO: 6569687 - DNA, 13 bp, Homo sapiens
ttcccaagctctg

SEQ ID NO: 6569688 - DNA, 14 bp, Homo sapiens
ttcccaaggaagct

SEQ ID NO: 6569689 - DNA, 23 bp, Homo sapiens
ttcccaaggaagctccttcctgt

SEQ ID NO: 6569690 - DNA, 11 bp, Homo sapiens
ttcccaaggac

SEQ ID NO: 6569691 - DNA, 17 bp, Homo sapiens
ttcccaaggacatgagt

SEQ ID NO: 6569692 - DNA, 16 bp, Homo sapiens
ttcccaagggctgccg

SEQ ID NO: 6569693 - DNA, 17 bp, Homo sapiens
ttcccaagtatgcctta

SEQ ID NO: 6569694 - DNA, 18 bp, Homo sapiens
ttcccaagtatgccttaa

SEQ ID NO: 6569695 - DNA, 15 bp, Homo sapiens
ttcccaatcagcact

SEQ ID NO: 6569696 - DNA, 16 bp, Homo sapiens
ttcccaatcagcactg

SEQ ID NO: 6569697 - DNA, 20 bp, Homo sapiens
ttcccaatcagcactgaaaa

SEQ ID NO: 6569698 - DNA, 19 bp, Homo sapiens
ttcccaatggtgtttttct

SEQ ID NO: 6569699 - DNA, 14 bp, Homo sapiens
ttcccacaagcctg

SEQ ID NO: 6569700 - DNA, 17 bp, Homo sapiens
ttcccacaattcttttg

SEQ ID NO: 6569701 - DNA, 15 bp, Homo sapiens
ttcccacacatattc

SEQ ID NO: 6569702 - DNA, 18 bp, Homo sapiens
ttcccacaccccagcgcc

SEQ ID NO: 6569703 - DNA, 17 bp, Homo sapiens
ttcccacacctccacag

SEQ ID NO: 6569704 - DNA, 23 bp, Homo sapiens
ttcccacacggcagcccccccct

SEQ ID NO: 6569705 - DNA, 12 bp, Homo sapiens
ttcccacagcct

SEQ ID NO: 6569706 - DNA, 18 bp, Homo sapiens
ttcccacatctttcctca

SEQ ID NO: 6569707 - DNA, 13 bp, Homo sapiens
ttcccacatttgt

SEQ ID NO: 6569708 - DNA, 12 bp, Homo sapiens
ttcccaccaaca

SEQ ID NO: 6569709 - DNA, 21 bp, Homo sapiens
ttcccaccaactctctctgcc

SEQ ID NO: 6569710 - DNA, 14 bp, Homo sapiens
ttcccaccagcatg

SEQ ID NO: 6569711 - DNA, 23 bp, Homo sapiens
ttcccaccagcatgtcactccca

SEQ ID NO: 6569712 - DNA, 18 bp, Homo sapiens
ttcccaccaggctgctca

SEQ ID NO: 6569713 - DNA, 14 bp, Homo sapiens
ttcccacccagcct

SEQ ID NO: 6569714 - DNA, 15 bp, Homo sapiens
ttcccacccagcctg

SEQ ID NO: 6569715 - DNA, 21 bp, Homo sapiens
ttcccacccaggaaaggagga

SEQ ID NO: 6569716 - DNA, 15 bp, Homo sapiens
ttcccacccatcgct

SEQ ID NO: 6569717 - DNA, 21 bp, Homo sapiens
ttcccaccccaacctgctctc

SEQ ID NO: 6569718 - DNA, 22 bp, Homo sapiens
ttcccaccccaacctgctctcc

SEQ ID NO: 6569719 - DNA, 12 bp, Homo sapiens
ttcccaccccca

SEQ ID NO: 6569720 - DNA, 18 bp, Homo sapiens
ttcccacccctacacaca

SEQ ID NO: 6569721 - DNA, 19 bp, Homo sapiens
ttcccacccctacacacac

SEQ ID NO: 6569722 - DNA, 20 bp, Homo sapiens
ttcccacccctacacacaca

SEQ ID NO: 6569723 - DNA, 10 bp, Homo sapiens
ttcccaccct

SEQ ID NO: 6569724 - DNA, 20 bp, Homo sapiens
ttcccaccctccacctctca

SEQ ID NO: 6569725 - DNA, 22 bp, Homo sapiens
ttcccacctctctcactccttg

SEQ ID NO: 6569726 - DNA, 18 bp, Homo sapiens
ttcccacgacaaaaacaa

SEQ ID NO: 6569727 - DNA, 16 bp, Homo sapiens
ttcccacggccactgc

SEQ ID NO: 6569728 - DNA, 14 bp, Homo sapiens
ttcccactccaagc

SEQ ID NO: 6569729 - DNA, 12 bp, Homo sapiens
ttcccactcccg

SEQ ID NO: 6569730 - DNA, 11 bp, Homo sapiens
ttcccactgca

SEQ ID NO: 6569731 - DNA, 18 bp, Homo sapiens
ttcccactgcaccccctc

SEQ ID NO: 6569732 - DNA, 23 bp, Homo sapiens
ttcccactgcaccccctcctgct

SEQ ID NO: 6569733 - DNA, 14 bp, Homo sapiens
ttcccactgcactt

SEQ ID NO: 6569734 - DNA, 13 bp, Homo sapiens
ttcccactggctc

SEQ ID NO: 6569735 - DNA, 21 bp, Homo sapiens
ttcccactgtcctttctccag

SEQ ID NO: 6569736 - DNA, 16 bp, Homo sapiens
ttcccactttcattca

SEQ ID NO: 6569737 - DNA, 17 bp, Homo sapiens
ttcccactttcattcaa

SEQ ID NO: 6569738 - DNA, 23 bp, Homo sapiens
ttcccagaatcaaagcaatgcat

SEQ ID NO: 6569739 - DNA, 19 bp, Homo sapiens
ttcccagaatctctgagcc

SEQ ID NO: 6569740 - DNA, 22 bp, Homo sapiens
ttcccagaccccgcagcacgcc

SEQ ID NO: 6569741 - DNA, 22 bp, Homo sapiens
ttcccagactagatttcaagct

SEQ ID NO: 6569742 - DNA, 15 bp, Homo sapiens
ttcccagagaagctc

SEQ ID NO: 6569743 - DNA, 19 bp, Homo sapiens
ttcccagagacaggaaaat

SEQ ID NO: 6569744 - DNA, 18 bp, Homo sapiens
ttcccagagaccttctga

SEQ ID NO: 6569745 - DNA, 11 bp, Homo sapiens
ttcccagaggg

SEQ ID NO: 6569746 - DNA, 22 bp, Homo sapiens
ttcccagagtcacaagtagcct

SEQ ID NO: 6569747 - DNA, 22 bp, Homo sapiens
ttcccagagtcagaggagaaga

SEQ ID NO: 6569748 - DNA, 18 bp, Homo sapiens
ttcccagatagtcccagc

SEQ ID NO: 6569749 - DNA, 18 bp, Homo sapiens
ttcccagcaaagttttca

SEQ ID NO: 6569750 - DNA, 18 bp, Homo sapiens
ttcccagcattcagtggt

SEQ ID NO: 6569751 - DNA, 16 bp, Homo sapiens
ttcccagccatgccca

SEQ ID NO: 6569752 - DNA, 16 bp, Homo sapiens
ttcccagcccctcctc

SEQ ID NO: 6569753 - DNA, 19 bp, Homo sapiens
ttcccagcccctcctccct

SEQ ID NO: 6569754 - DNA, 22 bp, Homo sapiens
ttcccagcccctcctccctcag

SEQ ID NO: 6569755 - DNA, 23 bp, Homo sapiens
ttcccagcccctcctccctcagg

SEQ ID NO: 6569756 - DNA, 16 bp, Homo sapiens
ttcccagcccctgcag

SEQ ID NO: 6569757 - DNA, 12 bp, Homo sapiens
ttcccagccctc

SEQ ID NO: 6569758 - DNA, 17 bp, Homo sapiens
ttcccagccctcatccc

SEQ ID NO: 6569759 - DNA, 11 bp, Homo sapiens
ttcccagcctg

SEQ ID NO: 6569760 - DNA, 12 bp, Homo sapiens
ttcccagcctga

SEQ ID NO: 6569761 - DNA, 20 bp, Homo sapiens
ttcccagcgcatggcgcccc

SEQ ID NO: 6569762 - DNA, 20 bp, Homo sapiens
ttcccagctcagtgccaaag

SEQ ID NO: 6569763 - DNA, 18 bp, Homo sapiens
ttcccagctggcagcgcc

SEQ ID NO: 6569764 - DNA, 13 bp, Homo sapiens
ttcccagctgtct

SEQ ID NO: 6569765 - DNA, 18 bp, Homo sapiens
ttcccagcttctgccaca

SEQ ID NO: 6569766 - DNA, 19 bp, Homo sapiens
ttcccaggaaagaagcatt

SEQ ID NO: 6569767 - DNA, 13 bp, Homo sapiens
ttcccaggagaaa

SEQ ID NO: 6569768 - DNA, 15 bp, Homo sapiens
ttcccaggagaccat

SEQ ID NO: 6569769 - DNA, 16 bp, Homo sapiens
ttcccaggagaccatt

SEQ ID NO: 6569770 - DNA, 19 bp, Homo sapiens
ttcccaggagttctgctca

SEQ ID NO: 6569771 - DNA, 21 bp, Homo sapiens
ttcccaggatctgctccaaca

SEQ ID NO: 6569772 - DNA, 20 bp, Homo sapiens
ttcccaggatgagcatccca

SEQ ID NO: 6569773 - DNA, 19 bp, Homo sapiens
ttcccaggcaaataaaatt

SEQ ID NO: 6569774 - DNA, 13 bp, Homo sapiens
ttcccaggcaggg

SEQ ID NO: 6569775 - DNA, 15 bp, Homo sapiens
ttcccaggccagcga

SEQ ID NO: 6569776 - DNA, 15 bp, Homo sapiens
ttcccaggccagggc

SEQ ID NO: 6569777 - DNA, 16 bp, Homo sapiens
ttcccaggccagggct

SEQ ID NO: 6569778 - DNA, 18 bp, Homo sapiens
ttcccaggccagggctgg

SEQ ID NO: 6569779 - DNA, 21 bp, Homo sapiens
ttcccaggccagggctgggtc

SEQ ID NO: 6569780 - DNA, 12 bp, Homo sapiens
ttcccaggccca

SEQ ID NO: 6569781 - DNA, 19 bp, Homo sapiens
ttcccaggcccactgtgcc

SEQ ID NO: 6569782 - DNA, 16 bp, Homo sapiens
ttcccaggcctttgga

SEQ ID NO: 6569783 - DNA, 15 bp, Homo sapiens
ttcccaggctgcccc

SEQ ID NO: 6569784 - DNA, 19 bp, Homo sapiens
ttcccagggaccagcacct

SEQ ID NO: 6569785 - DNA, 13 bp, Homo sapiens
ttcccagggacct

SEQ ID NO: 6569786 - DNA, 17 bp, Homo sapiens
ttcccagggaccttgga

SEQ ID NO: 6569787 - DNA, 16 bp, Homo sapiens
ttcccagggccgcttc

SEQ ID NO: 6569788 - DNA, 16 bp, Homo sapiens
ttcccagggctggaga

SEQ ID NO: 6569789 - DNA, 18 bp, Homo sapiens
ttcccaggtaatttaaat

SEQ ID NO: 6569790 - DNA, 21 bp, Homo sapiens
ttcccaggtaggccaaggtgt

SEQ ID NO: 6569791 - DNA, 23 bp, Homo sapiens
ttcccagtaagtttcccctctgg

SEQ ID NO: 6569792 - DNA, 23 bp, Homo sapiens
ttcccagtataagatttttgaaa

SEQ ID NO: 6569793 - DNA, 17 bp, Homo sapiens
ttcccagtgaattcttg

SEQ ID NO: 6569794 - DNA, 23 bp, Homo sapiens
ttcccagtgacacttcagagagc

SEQ ID NO: 6569795 - DNA, 21 bp, Homo sapiens
ttcccagtgagtcacatcctg

SEQ ID NO: 6569796 - DNA, 16 bp, Homo sapiens
ttcccagtggctgctg

SEQ ID NO: 6569797 - DNA, 12 bp, Homo sapiens
ttcccataataa

SEQ ID NO: 6569798 - DNA, 17 bp, Homo sapiens
ttcccataataaagcaa

SEQ ID NO: 6569799 - DNA, 11 bp, Homo sapiens
ttcccataatt

SEQ ID NO: 6569800 - DNA, 22 bp, Homo sapiens
ttcccataccacccaaaatcat

SEQ ID NO: 6569801 - DNA, 22 bp, Homo sapiens
ttcccatagtggggcctgggag

SEQ ID NO: 6569802 - DNA, 18 bp, Homo sapiens
ttcccatatacaatcttc

SEQ ID NO: 6569803 - DNA, 19 bp, Homo sapiens
ttcccatcaccccttcccc

SEQ ID NO: 6569804 - DNA, 15 bp, Homo sapiens
ttcccatcactcttt

SEQ ID NO: 6569805 - DNA, 12 bp, Homo sapiens
ttcccatctgca

SEQ ID NO: 6569806 - DNA, 18 bp, Homo sapiens
ttcccatctggctttttc

SEQ ID NO: 6569807 - DNA, 22 bp, Homo sapiens
ttcccatctggctttttctgcc

SEQ ID NO: 6569808 - DNA, 20 bp, Homo sapiens
ttcccatgacccaggctggg

SEQ ID NO: 6569809 - DNA, 17 bp, Homo sapiens
ttcccatgactcttgga

SEQ ID NO: 6569810 - DNA, 13 bp, Homo sapiens
ttcccatgactgc

SEQ ID NO: 6569811 - DNA, 16 bp, Homo sapiens
ttcccatgatgccgct

SEQ ID NO: 6569812 - DNA, 18 bp, Homo sapiens
ttcccatgatttcatgta

SEQ ID NO: 6569813 - DNA, 22 bp, Homo sapiens
ttcccatgatttcatgtactgc

SEQ ID NO: 6569814 - DNA, 17 bp, Homo sapiens
ttcccatgctgaattat

SEQ ID NO: 6569815 - DNA, 20 bp, Homo sapiens
ttcccatgctgaattatttt

SEQ ID NO: 6569816 - DNA, 14 bp, Homo sapiens
ttcccatggggagg

SEQ ID NO: 6569817 - DNA, 23 bp, Homo sapiens
ttcccatggggagggattctggt

SEQ ID NO: 6569818 - DNA, 19 bp, Homo sapiens
ttcccatggtagactgtga

SEQ ID NO: 6569819 - DNA, 20 bp, Homo sapiens
ttcccatggtagactgtgac

SEQ ID NO: 6569820 - DNA, 16 bp, Homo sapiens
ttcccatggtgtatgt

SEQ ID NO: 6569821 - DNA, 14 bp, Homo sapiens
ttcccattaaaaat

SEQ ID NO: 6569822 - DNA, 17 bp, Homo sapiens
ttcccattggatgcatt

SEQ ID NO: 6569823 - DNA, 21 bp, Homo sapiens
ttcccattggatgcatttcta

SEQ ID NO: 6569824 - DNA, 18 bp, Homo sapiens
ttcccattggtctgcatg

SEQ ID NO: 6569825 - DNA, 19 bp, Homo sapiens
ttcccattggttcacctgt

SEQ ID NO: 6569826 - DNA, 15 bp, Homo sapiens
ttcccattgtgacag

SEQ ID NO: 6569827 - DNA, 17 bp, Homo sapiens
ttcccatttaaaaatat

SEQ ID NO: 6569828 - DNA, 15 bp, Homo sapiens
ttcccatttagaatg

SEQ ID NO: 6569829 - DNA, 19 bp, Homo sapiens
ttcccatttccttgtctaa

SEQ ID NO: 6569830 - DNA, 18 bp, Homo sapiens
ttcccatttctctacact

SEQ ID NO: 6569831 - DNA, 14 bp, Homo sapiens
ttcccatttcttcc

SEQ ID NO: 6569832 - DNA, 18 bp, Homo sapiens
ttcccatttgtaatgtat

SEQ ID NO: 6569833 - DNA, 17 bp, Homo sapiens
ttcccatttgtaatttg

SEQ ID NO: 6569834 - DNA, 20 bp, Homo sapiens
ttcccatttgtgccagagga

SEQ ID NO: 6569835 - DNA, 17 bp, Homo sapiens
ttcccattttgcaaaat

SEQ ID NO: 6569836 - DNA, 21 bp, Homo sapiens
ttccccaacccctcagatttt

SEQ ID NO: 6569837 - DNA, 18 bp, Homo sapiens
ttccccaacgaaaagcac

SEQ ID NO: 6569838 - DNA, 18 bp, Homo sapiens
ttccccaacggggtgggg

SEQ ID NO: 6569839 - DNA, 22 bp, Homo sapiens
ttccccaagatctgccagacct

SEQ ID NO: 6569840 - DNA, 23 bp, Homo sapiens
ttccccaagatctgccagacctg

SEQ ID NO: 6569841 - DNA, 17 bp, Homo sapiens
ttccccaagcctggcag

SEQ ID NO: 6569842 - DNA, 17 bp, Homo sapiens
ttccccaagggccctgg

SEQ ID NO: 6569843 - DNA, 21 bp, Homo sapiens
ttccccaagtaattgtaggaa

SEQ ID NO: 6569844 - DNA, 13 bp, Homo sapiens
ttccccaattaat

SEQ ID NO: 6569845 - DNA, 11 bp, Homo sapiens
ttccccacaga

SEQ ID NO: 6569846 - DNA, 15 bp, Homo sapiens
ttccccacaggtcct

SEQ ID NO: 6569847 - DNA, 16 bp, Homo sapiens
ttccccaccagcttta

SEQ ID NO: 6569848 - DNA, 23 bp, Homo sapiens
ttccccaccccataagccctgag

SEQ ID NO: 6569849 - DNA, 23 bp, Homo sapiens
ttccccacccccctctctttctc

SEQ ID NO: 6569850 - DNA, 11 bp, Homo sapiens
ttccccaccct

SEQ ID NO: 6569851 - DNA, 16 bp, Homo sapiens
ttccccacctcttcct

SEQ ID NO: 6569852 - DNA, 14 bp, Homo sapiens
ttccccactccccc

SEQ ID NO: 6569853 - DNA, 19 bp, Homo sapiens
ttccccactctgctcccag

SEQ ID NO: 6569854 - DNA, 21 bp, Homo sapiens
ttccccactgacagcctccca

SEQ ID NO: 6569855 - DNA, 23 bp, Homo sapiens
ttccccactgacagcctcccacc

SEQ ID NO: 6569856 - DNA, 13 bp, Homo sapiens
ttccccactggag

SEQ ID NO: 6569857 - DNA, 12 bp, Homo sapiens
ttccccagacac

SEQ ID NO: 6569858 - DNA, 13 bp, Homo sapiens
ttccccagacaca

SEQ ID NO: 6569859 - DNA, 12 bp, Homo sapiens
ttccccagaccc

SEQ ID NO: 6569860 - DNA, 14 bp, Homo sapiens
ttccccagacccag

SEQ ID NO: 6569861 - DNA, 13 bp, Homo sapiens
ttccccagactca

SEQ ID NO: 6569862 - DNA, 19 bp, Homo sapiens
ttccccagactcagctcca

SEQ ID NO: 6569863 - DNA, 15 bp, Homo sapiens
ttccccagacttgtt

SEQ ID NO: 6569864 - DNA, 12 bp, Homo sapiens
ttccccagagaa

SEQ ID NO: 6569865 - DNA, 16 bp, Homo sapiens
ttccccagagagcagg

SEQ ID NO: 6569866 - DNA, 12 bp, Homo sapiens
ttccccagcatc

SEQ ID NO: 6569867 - DNA, 18 bp, Homo sapiens
ttccccagcatcactccc

SEQ ID NO: 6569868 - DNA, 13 bp, Homo sapiens
ttccccagcccag

SEQ ID NO: 6569869 - DNA, 16 bp, Homo sapiens
ttccccagctccagca

SEQ ID NO: 6569870 - DNA, 22 bp, Homo sapiens
ttccccagctcccccaggcaga

SEQ ID NO: 6569871 - DNA, 15 bp, Homo sapiens
ttccccagctctcag

SEQ ID NO: 6569872 - DNA, 21 bp, Homo sapiens
ttccccagctgattagtgtct

SEQ ID NO: 6569873 - DNA, 18 bp, Homo sapiens
ttccccaggaggccagcc

SEQ ID NO: 6569874 - DNA, 16 bp, Homo sapiens
ttccccaggcccacca

SEQ ID NO: 6569875 - DNA, 12 bp, Homo sapiens
ttccccaggtgt

SEQ ID NO: 6569876 - DNA, 17 bp, Homo sapiens
ttccccaggtgtgtgct

SEQ ID NO: 6569877 - DNA, 15 bp, Homo sapiens
ttccccagtgactcc

SEQ ID NO: 6569878 - DNA, 23 bp, Homo sapiens
ttccccagtgtggccccagcccg

SEQ ID NO: 6569879 - DNA, 23 bp, Homo sapiens
ttccccataactcaatggcctaa

SEQ ID NO: 6569880 - DNA, 14 bp, Homo sapiens
ttccccatacaaat

SEQ ID NO: 6569881 - DNA, 16 bp, Homo sapiens
ttccccatatttgtgt

SEQ ID NO: 6569882 - DNA, 19 bp, Homo sapiens
ttccccatatttgtgttca

SEQ ID NO: 6569883 - DNA, 15 bp, Homo sapiens
ttccccatcagctcc

SEQ ID NO: 6569884 - DNA, 18 bp, Homo sapiens
ttccccatcagctcccaa

SEQ ID NO: 6569885 - DNA, 18 bp, Homo sapiens
ttccccatcgccttctgg

SEQ ID NO: 6569886 - DNA, 13 bp, Homo sapiens
aagcacaaactgt

SEQ ID NO: 6569887 - DNA, 14 bp, Homo sapiens
aagcacaaactgtc

SEQ ID NO: 6569888 - DNA, 17 bp, Homo sapiens
aagcacaaacttctgta

SEQ ID NO: 6569889 - DNA, 21 bp, Homo sapiens
aagcacaaagttctcagagct

SEQ ID NO: 6569890 - DNA, 18 bp, Homo sapiens
aagcacaacccaccacaa

SEQ ID NO: 6569891 - DNA, 14 bp, Homo sapiens
aagcacaactccct

SEQ ID NO: 6569892 - DNA, 15 bp, Homo sapiens
aagcacaagtacttt

SEQ ID NO: 6569893 - DNA, 16 bp, Homo sapiens
aagcacaagttcctgg

SEQ ID NO: 6569894 - DNA, 20 bp, Homo sapiens
aagcacaataaaagacatcc

SEQ ID NO: 6569895 - DNA, 20 bp, Homo sapiens
aagcacaatcactaaacttt

SEQ ID NO: 6569896 - DNA, 21 bp, Homo sapiens
aagcacaatgtctcacatggg

SEQ ID NO: 6569897 - DNA, 19 bp, Homo sapiens
aagcacacacacacagtcc

SEQ ID NO: 6569898 - DNA, 23 bp, Homo sapiens
aagcacaccaatcttactttgta

SEQ ID NO: 6569899 - DNA, 19 bp, Homo sapiens
aagcacactcatcccctca

SEQ ID NO: 6569900 - DNA, 21 bp, Homo sapiens
aagcacactgcagggctgctg

SEQ ID NO: 6569901 - DNA, 15 bp, Homo sapiens
aagcacactggaata

SEQ ID NO: 6569902 - DNA, 16 bp, Homo sapiens
aagcacactggaatat

SEQ ID NO: 6569903 - DNA, 21 bp, Homo sapiens
aagcacactggaatataaaac

SEQ ID NO: 6569904 - DNA, 16 bp, Homo sapiens
aagcacacttgacatc

SEQ ID NO: 6569905 - DNA, 16 bp, Homo sapiens
aagcacagacaattct

SEQ ID NO: 6569906 - DNA, 17 bp, Homo sapiens
aagcacagagcctggcc

SEQ ID NO: 6569907 - DNA, 19 bp, Homo sapiens
aagcacagagcctggcccc

SEQ ID NO: 6569908 - DNA, 21 bp, Homo sapiens
aagcacagagcctggccccag

SEQ ID NO: 6569909 - DNA, 16 bp, Homo sapiens
aagcacagcagcctgg

SEQ ID NO: 6569910 - DNA, 16 bp, Homo sapiens
aagcacagcctcagaa

SEQ ID NO: 6569911 - DNA, 15 bp, Homo sapiens
aagcacagctcctgc

SEQ ID NO: 6569912 - DNA, 18 bp, Homo sapiens
aagcacagctctcactgg

SEQ ID NO: 6569913 - DNA, 11 bp, Homo sapiens
aagcacagctg

SEQ ID NO: 6569914 - DNA, 18 bp, Homo sapiens
aagcacaggagacactgt

SEQ ID NO: 6569915 - DNA, 11 bp, Homo sapiens
aagcacaggcc

SEQ ID NO: 6569916 - DNA, 19 bp, Homo sapiens
aagcacaggtccaaggctg

SEQ ID NO: 6569917 - DNA, 23 bp, Homo sapiens
aagcacagtggtggcagggccta

SEQ ID NO: 6569918 - DNA, 17 bp, Homo sapiens
aagcacagtttgaacaa

SEQ ID NO: 6569919 - DNA, 18 bp, Homo sapiens
aagcacataactggattt

SEQ ID NO: 6569920 - DNA, 13 bp, Homo sapiens
aagcacatacatt

SEQ ID NO: 6569921 - DNA, 18 bp, Homo sapiens
aagcacatacattaaaac

SEQ ID NO: 6569922 - DNA, 21 bp, Homo sapiens
aagcacatattagtgcagcca

SEQ ID NO: 6569923 - DNA, 16 bp, Homo sapiens
aagcacatattgagca

SEQ ID NO: 6569924 - DNA, 16 bp, Homo sapiens
aagcacatgccaggga

SEQ ID NO: 6569925 - DNA, 15 bp, Homo sapiens
aagcacatgcctctc

SEQ ID NO: 6569926 - DNA, 20 bp, Homo sapiens
aagcacatgcctctctcagg

SEQ ID NO: 6569927 - DNA, 17 bp, Homo sapiens
aagcacatgcttagctt

SEQ ID NO: 6569928 - DNA, 21 bp, Homo sapiens
aagcacattattgtagagaaa

SEQ ID NO: 6569929 - DNA, 16 bp, Homo sapiens
aagcaccaaaataaga

SEQ ID NO: 6569930 - DNA, 19 bp, Homo sapiens
aagcaccaaaataagaaaa

SEQ ID NO: 6569931 - DNA, 17 bp, Homo sapiens
aagcaccaacctccaga

SEQ ID NO: 6569932 - DNA, 18 bp, Homo sapiens
aagcaccaacctccagac

SEQ ID NO: 6569933 - DNA, 19 bp, Homo sapiens
aagcaccaacctccagact

SEQ ID NO: 6569934 - DNA, 16 bp, Homo sapiens
aagcaccagcctcagt

SEQ ID NO: 6569935 - DNA, 14 bp, Homo sapiens
aagcaccagctgcc

SEQ ID NO: 6569936 - DNA, 15 bp, Homo sapiens
aagcaccagctgcct

SEQ ID NO: 6569937 - DNA, 22 bp, Homo sapiens
aagcaccagctgcctctttgct

SEQ ID NO: 6569938 - DNA, 21 bp, Homo sapiens
aagcaccagcttctccaggct

SEQ ID NO: 6569939 - DNA, 14 bp, Homo sapiens
aagcaccaggaagt

SEQ ID NO: 6569940 - DNA, 18 bp, Homo sapiens
aagcaccaggaagtgttt

SEQ ID NO: 6569941 - DNA, 16 bp, Homo sapiens
aagcaccatcccctcc

SEQ ID NO: 6569942 - DNA, 18 bp, Homo sapiens
aagcacctcttgaagaac

SEQ ID NO: 6569943 - DNA, 17 bp, Homo sapiens
aagcacctgaaccactg

SEQ ID NO: 6569944 - DNA, 13 bp, Homo sapiens
aagcacctgggtg

SEQ ID NO: 6569945 - DNA, 22 bp, Homo sapiens
aagcacctgggtgtgctccagg

SEQ ID NO: 6569946 - DNA, 22 bp, Homo sapiens
aagcacctgttaataaaggtct

SEQ ID NO: 6569947 - DNA, 19 bp, Homo sapiens
aagcaccttagctggcatt

SEQ ID NO: 6569948 - DNA, 21 bp, Homo sapiens
aagcacgtggtaaaacacttg

SEQ ID NO: 6569949 - DNA, 14 bp, Homo sapiens
aagcacgttgccca

SEQ ID NO: 6569950 - DNA, 14 bp, Homo sapiens
aagcactaagaggt

SEQ ID NO: 6569951 - DNA, 15 bp, Homo sapiens
aagcactacaatcat

SEQ ID NO: 6569952 - DNA, 22 bp, Homo sapiens
aagcactacaggaggaatgcac

SEQ ID NO: 6569953 - DNA, 17 bp, Homo sapiens
aagcactacataaactg

SEQ ID NO: 6569954 - DNA, 23 bp, Homo sapiens
aagcactacataaactgacttta

SEQ ID NO: 6569955 - DNA, 17 bp, Homo sapiens
aagcactaccagtatct

SEQ ID NO: 6569956 - DNA, 20 bp, Homo sapiens
aagcactagagaatgcacag

SEQ ID NO: 6569957 - DNA, 18 bp, Homo sapiens
aagcactcctttaaagcc

SEQ ID NO: 6569958 - DNA, 23 bp, Homo sapiens
aagcactctcgcacacacagtga

SEQ ID NO: 6569959 - DNA, 21 bp, Homo sapiens
aagcactctctgcagtcctcc

SEQ ID NO: 6569960 - DNA, 13 bp, Homo sapiens
aagcactctgctg

SEQ ID NO: 6569961 - DNA, 15 bp, Homo sapiens
aagcactctgctggc

SEQ ID NO: 6569962 - DNA, 13 bp, Homo sapiens
aagcactgaaaaa

SEQ ID NO: 6569963 - DNA, 19 bp, Homo sapiens
aagcactgctaggcgagtg

SEQ ID NO: 6569964 - DNA, 13 bp, Homo sapiens
aagcactgctcac

SEQ ID NO: 6569965 - DNA, 19 bp, Homo sapiens
aagcactggtttcaagaat

SEQ ID NO: 6569966 - DNA, 22 bp, Homo sapiens
aagcactggtttcaagaatatg

SEQ ID NO: 6569967 - DNA, 16 bp, Homo sapiens
aagcactgtgctcagg

SEQ ID NO: 6569968 - DNA, 18 bp, Homo sapiens
aagcactgtgtttatatg

SEQ ID NO: 6569969 - DNA, 22 bp, Homo sapiens
aagcactgtttaactgggagtg

SEQ ID NO: 6569970 - DNA, 13 bp, Homo sapiens
aagcactgttttt

SEQ ID NO: 6569971 - DNA, 14 bp, Homo sapiens
aagcacttaaagtt

SEQ ID NO: 6569972 - DNA, 21 bp, Homo sapiens
aagcacttgctcaaaatctgt

SEQ ID NO: 6569973 - DNA, 19 bp, Homo sapiens
aagcacttggactcttgct

SEQ ID NO: 6569974 - DNA, 21 bp, Homo sapiens
aagcacttgttccttctgctt

SEQ ID NO: 6569975 - DNA, 21 bp, Homo sapiens
aagcactttaacacagtgtct

SEQ ID NO: 6569976 - DNA, 18 bp, Homo sapiens
aagcactttaatggcctg

SEQ ID NO: 6569977 - DNA, 21 bp, Homo sapiens
aagcactttaatggcctggag

SEQ ID NO: 6569978 - DNA, 18 bp, Homo sapiens
aagcactttgaaaatatt

SEQ ID NO: 6569979 - DNA, 21 bp, Homo sapiens
aagcactttgaaaatatttct

SEQ ID NO: 6569980 - DNA, 20 bp, Homo sapiens
aagcacttttaaaaaaattt

SEQ ID NO: 6569981 - DNA, 15 bp, Homo sapiens
aagcacttttgttat

SEQ ID NO: 6569982 - DNA, 19 bp, Homo sapiens
aagcacttttgttattcca

SEQ ID NO: 6569983 - DNA, 21 bp, Homo sapiens
aagcacttttgttattccatc

SEQ ID NO: 6569984 - DNA, 22 bp, Homo sapiens
aagcacttttgttattccatca

SEQ ID NO: 6569985 - DNA, 13 bp, Homo sapiens
aagcactttttgg

SEQ ID NO: 6569986 - DNA, 11 bp, Homo sapiens
aagcagaaaac

SEQ ID NO: 6569987 - DNA, 13 bp, Homo sapiens
aagcagaaacaaa

SEQ ID NO: 6569988 - DNA, 14 bp, Homo sapiens
aagcagaaacaaaa

SEQ ID NO: 6569989 - DNA, 15 bp, Homo sapiens
aagcagaaacaaaat

SEQ ID NO: 6569990 - DNA, 17 bp, Homo sapiens
aagcagaaacagcatat

SEQ ID NO: 6569991 - DNA, 13 bp, Homo sapiens
aagcagaaagtgc

SEQ ID NO: 6569992 - DNA, 15 bp, Homo sapiens
aagcagaaatccaag

SEQ ID NO: 6569993 - DNA, 13 bp, Homo sapiens
aagcagaacaaat

SEQ ID NO: 6569994 - DNA, 14 bp, Homo sapiens
aagcagaacaaatg

SEQ ID NO: 6569995 - DNA, 20 bp, Homo sapiens
aagcagaacaaatgtgtttt

SEQ ID NO: 6569996 - DNA, 17 bp, Homo sapiens
aagcagaacatactgtt

SEQ ID NO: 6569997 - DNA, 16 bp, Homo sapiens
aagcagaagccccaaa

SEQ ID NO: 6569998 - DNA, 11 bp, Homo sapiens
aagcagaataa

SEQ ID NO: 6569999 - DNA, 19 bp, Homo sapiens
aagcagaatgagatgattt

SEQ ID NO: 6570000 - DNA, 23 bp, Homo sapiens
aagcagaatgagatgatttaatt

SEQ ID NO: 6570001 - DNA, 14 bp, Homo sapiens
aagcagaattggaa

SEQ ID NO: 6570002 - DNA, 15 bp, Homo sapiens
aagcagaattggaaa

SEQ ID NO: 6570003 - DNA, 20 bp, Homo sapiens
aagcagaattttaatgtgaa

SEQ ID NO: 6570004 - DNA, 17 bp, Homo sapiens
aagcagacagccctggc

SEQ ID NO: 6570005 - DNA, 14 bp, Homo sapiens
aagcagacagctcc

SEQ ID NO: 6570006 - DNA, 16 bp, Homo sapiens
aagcagacattttaaa

SEQ ID NO: 6570007 - DNA, 21 bp, Homo sapiens
aagcagaccactgataaaacc

SEQ ID NO: 6570008 - DNA, 22 bp, Homo sapiens
aagcagaccattggggctccca

SEQ ID NO: 6570009 - DNA, 15 bp, Homo sapiens
aagcagactatgcag

SEQ ID NO: 6570010 - DNA, 15 bp, Homo sapiens
aagcagactcagctg

SEQ ID NO: 6570011 - DNA, 18 bp, Homo sapiens
aagcagactccagcccct

SEQ ID NO: 6570012 - DNA, 20 bp, Homo sapiens
aagcagactccagcccctgg

SEQ ID NO: 6570013 - DNA, 21 bp, Homo sapiens
aagcagactccagcccctgga

SEQ ID NO: 6570014 - DNA, 14 bp, Homo sapiens
aagcagagaagctc

SEQ ID NO: 6570015 - DNA, 15 bp, Homo sapiens
aagcagagacctttg

SEQ ID NO: 6570016 - DNA, 22 bp, Homo sapiens
aagcagagacctttgttgggag

SEQ ID NO: 6570017 - DNA, 21 bp, Homo sapiens
aagcagagagaagtacttttg

SEQ ID NO: 6570018 - DNA, 18 bp, Homo sapiens
aagcagagaggtggagaa

SEQ ID NO: 6570019 - DNA, 19 bp, Homo sapiens
aagcagagatcgacagaca

SEQ ID NO: 6570020 - DNA, 19 bp, Homo sapiens
aagcagagattttcaacat

SEQ ID NO: 6570021 - DNA, 13 bp, Homo sapiens
aagcagagcaaaa

SEQ ID NO: 6570022 - DNA, 17 bp, Homo sapiens
aagcagagccaaggcca

SEQ ID NO: 6570023 - DNA, 22 bp, Homo sapiens
aagcagagccagtcttcctcct

SEQ ID NO: 6570024 - DNA, 15 bp, Homo sapiens
aagcagagcctcctg

SEQ ID NO: 6570025 - DNA, 14 bp, Homo sapiens
aagcagagcctggg

SEQ ID NO: 6570026 - DNA, 13 bp, Homo sapiens
aagcagaggaagg

SEQ ID NO: 6570027 - DNA, 16 bp, Homo sapiens
aagcagaggaaggaaa

SEQ ID NO: 6570028 - DNA, 17 bp, Homo sapiens
aagcagaggaaggaaac

SEQ ID NO: 6570029 - DNA, 19 bp, Homo sapiens
aagcagaggaaggaaacat

SEQ ID NO: 6570030 - DNA, 22 bp, Homo sapiens
aagcagaggaaggaaacataga

SEQ ID NO: 6570031 - DNA, 20 bp, Homo sapiens
aagcagaggaggggccgctg

SEQ ID NO: 6570032 - DNA, 13 bp, Homo sapiens
aagcagaggccct

SEQ ID NO: 6570033 - DNA, 20 bp, Homo sapiens
aagcagaggccctgccccca

SEQ ID NO: 6570034 - DNA, 13 bp, Homo sapiens
aagcagaggctgg

SEQ ID NO: 6570035 - DNA, 16 bp, Homo sapiens
aagcagaggtggaaaa

SEQ ID NO: 6570036 - DNA, 10 bp, Homo sapiens
aagcagagtg

SEQ ID NO: 6570037 - DNA, 20 bp, Homo sapiens
aagcagagtgcacagctgtc

SEQ ID NO: 6570038 - DNA, 17 bp, Homo sapiens
aagcagagtggactgca

SEQ ID NO: 6570039 - DNA, 16 bp, Homo sapiens
aagcagagttctttgc

SEQ ID NO: 6570040 - DNA, 18 bp, Homo sapiens
aagcagagttgctcttca

SEQ ID NO: 6570041 - DNA, 15 bp, Homo sapiens
aagcagagttttcat

SEQ ID NO: 6570042 - DNA, 14 bp, Homo sapiens
aagcagatgacaga

SEQ ID NO: 6570043 - DNA, 14 bp, Homo sapiens
aagcagatgcaaag

SEQ ID NO: 6570044 - DNA, 16 bp, Homo sapiens
aagcagatgcaaagag

SEQ ID NO: 6570045 - DNA, 19 bp, Homo sapiens
aagcagatgcaaagaggca

SEQ ID NO: 6570046 - DNA, 20 bp, Homo sapiens
aagcagatggaatgctgtgt

SEQ ID NO: 6570047 - DNA, 14 bp, Homo sapiens
aagcagattacctc

SEQ ID NO: 6570048 - DNA, 23 bp, Homo sapiens
aagcagattttcctaaggccact

SEQ ID NO: 6570049 - DNA, 21 bp, Homo sapiens
aagcagcaaaatccttacttc

SEQ ID NO: 6570050 - DNA, 19 bp, Homo sapiens
aagcagcaacttgtcctag

SEQ ID NO: 6570051 - DNA, 14 bp, Homo sapiens
aagcagcagcctcg

SEQ ID NO: 6570052 - DNA, 14 bp, Homo sapiens
aagcagcatggaaa

SEQ ID NO: 6570053 - DNA, 16 bp, Homo sapiens
aagcagccaagctcct

SEQ ID NO: 6570054 - DNA, 21 bp, Homo sapiens
aagcagccaagctccttggga

SEQ ID NO: 6570055 - DNA, 11 bp, Homo sapiens
aagcagccagc

SEQ ID NO: 6570056 - DNA, 12 bp, Homo sapiens
aagcagccagcc

SEQ ID NO: 6570057 - DNA, 17 bp, Homo sapiens
aagcagccagccagtct

SEQ ID NO: 6570058 - DNA, 22 bp, Homo sapiens
aagcagccagccagtcttgcct

SEQ ID NO: 6570059 - DNA, 12 bp, Homo sapiens
aagcagccagct

SEQ ID NO: 6570060 - DNA, 21 bp, Homo sapiens
aagcagccagctccccacacc

SEQ ID NO: 6570061 - DNA, 15 bp, Homo sapiens
aagcagccaggaggg

SEQ ID NO: 6570062 - DNA, 13 bp, Homo sapiens
aagcagcccttgg

SEQ ID NO: 6570063 - DNA, 12 bp, Homo sapiens
aagcagcctcct

SEQ ID NO: 6570064 - DNA, 13 bp, Homo sapiens
aagcagcctcctg

SEQ ID NO: 6570065 - DNA, 19 bp, Homo sapiens
ttccccatcgccttctggg

SEQ ID NO: 6570066 - DNA, 13 bp, Homo sapiens
ttccccatctctg

SEQ ID NO: 6570067 - DNA, 16 bp, Homo sapiens
ttccccatctctgtct

SEQ ID NO: 6570068 - DNA, 19 bp, Homo sapiens
ttccccatctctgtctggg

SEQ ID NO: 6570069 - DNA, 15 bp, Homo sapiens
ttccccatctgtgtg

SEQ ID NO: 6570070 - DNA, 17 bp, Homo sapiens
ttccccatcttctaaac

SEQ ID NO: 6570071 - DNA, 22 bp, Homo sapiens
ttccccatctttgatccttctg

SEQ ID NO: 6570072 - DNA, 19 bp, Homo sapiens
ttccccatgtctcgactca

SEQ ID NO: 6570073 - DNA, 18 bp, Homo sapiens
ttccccattcagtgacat

SEQ ID NO: 6570074 - DNA, 16 bp, Homo sapiens
ttccccattgcctcct

SEQ ID NO: 6570075 - DNA, 21 bp, Homo sapiens
ttccccatttcctcttccttc

SEQ ID NO: 6570076 - DNA, 19 bp, Homo sapiens
ttcccccaaactttttgtt

SEQ ID NO: 6570077 - DNA, 23 bp, Homo sapiens
ttcccccaaatttaaagaagtat

SEQ ID NO: 6570078 - DNA, 17 bp, Homo sapiens
ttcccccaacctcagac

SEQ ID NO: 6570079 - DNA, 18 bp, Homo sapiens
ttcccccaacctcagact

SEQ ID NO: 6570080 - DNA, 18 bp, Homo sapiens
ttcccccaccagctaagg

SEQ ID NO: 6570081 - DNA, 20 bp, Homo sapiens
ttcccccaccagctgcagcc

SEQ ID NO: 6570082 - DNA, 16 bp, Homo sapiens
ttcccccaccccagag

SEQ ID NO: 6570083 - DNA, 12 bp, Homo sapiens
ttcccccaccct

SEQ ID NO: 6570084 - DNA, 16 bp, Homo sapiens
ttcccccaccctgggt

SEQ ID NO: 6570085 - DNA, 23 bp, Homo sapiens
ttcccccaccggtccagctggcc

SEQ ID NO: 6570086 - DNA, 14 bp, Homo sapiens
ttcccccactaccg

SEQ ID NO: 6570087 - DNA, 12 bp, Homo sapiens
ttcccccacttg

SEQ ID NO: 6570088 - DNA, 14 bp, Homo sapiens
ttcccccagacaga

SEQ ID NO: 6570089 - DNA, 20 bp, Homo sapiens
ttcccccagcaacgcccctc

SEQ ID NO: 6570090 - DNA, 23 bp, Homo sapiens
ttcccccagcaacgcccctccaa

SEQ ID NO: 6570091 - DNA, 18 bp, Homo sapiens
ttcccccagcaaggcaga

SEQ ID NO: 6570092 - DNA, 21 bp, Homo sapiens
ttcccccagcacaaagcactg

SEQ ID NO: 6570093 - DNA, 15 bp, Homo sapiens
ttcccccagcaccta

SEQ ID NO: 6570094 - DNA, 13 bp, Homo sapiens
ttcccccagcttt

SEQ ID NO: 6570095 - DNA, 21 bp, Homo sapiens
ttcccccagtacctccaagca

SEQ ID NO: 6570096 - DNA, 17 bp, Homo sapiens
ttcccccatagccaccc

SEQ ID NO: 6570097 - DNA, 14 bp, Homo sapiens
ttcccccatcccta

SEQ ID NO: 6570098 - DNA, 16 bp, Homo sapiens
ttcccccatttttccc

SEQ ID NO: 6570099 - DNA, 13 bp, Homo sapiens
ttccccccaaccc

SEQ ID NO: 6570100 - DNA, 18 bp, Homo sapiens
ttccccccactctcccca

SEQ ID NO: 6570101 - DNA, 19 bp, Homo sapiens
ttccccccactctccccac

SEQ ID NO: 6570102 - DNA, 16 bp, Homo sapiens
ttccccccatctctga

SEQ ID NO: 6570103 - DNA, 21 bp, Homo sapiens
ttccccccatgttgtaatgct

SEQ ID NO: 6570104 - DNA, 23 bp, Homo sapiens
ttcccccctacttgagataatct

SEQ ID NO: 6570105 - DNA, 17 bp, Homo sapiens
ttcccccctctcctccc

SEQ ID NO: 6570106 - DNA, 20 bp, Homo sapiens
ttcccccgagctcttggcct

SEQ ID NO: 6570107 - DNA, 12 bp, Homo sapiens
ttccccctaaac

SEQ ID NO: 6570108 - DNA, 19 bp, Homo sapiens
ttccccctccaatcccacc

SEQ ID NO: 6570109 - DNA, 15 bp, Homo sapiens
ttccccctcccaggg

SEQ ID NO: 6570110 - DNA, 17 bp, Homo sapiens
ttccccctccccctcct

SEQ ID NO: 6570111 - DNA, 23 bp, Homo sapiens
ttccccctccccctcctgctgtg

SEQ ID NO: 6570112 - DNA, 19 bp, Homo sapiens
ttccccctcttcttctgaa

SEQ ID NO: 6570113 - DNA, 14 bp, Homo sapiens
ttccccctgctgat

SEQ ID NO: 6570114 - DNA, 22 bp, Homo sapiens
ttccccctggccaccacccccc

SEQ ID NO: 6570115 - DNA, 22 bp, Homo sapiens
ttccccctgtttcagaggctca

SEQ ID NO: 6570116 - DNA, 22 bp, Homo sapiens
ttcccccttactacttcttgga

SEQ ID NO: 6570117 - DNA, 12 bp, Homo sapiens
ttcccccttccc

SEQ ID NO: 6570118 - DNA, 13 bp, Homo sapiens
ttcccccttccca

SEQ ID NO: 6570119 - DNA, 16 bp, Homo sapiens
ttcccccttcccattt

SEQ ID NO: 6570120 - DNA, 16 bp, Homo sapiens
ttcccccttcctagtg

SEQ ID NO: 6570121 - DNA, 22 bp, Homo sapiens
ttcccccttgaggattgtggaa

SEQ ID NO: 6570122 - DNA, 22 bp, Homo sapiens
ttccccctttctctgcctggca

SEQ ID NO: 6570123 - DNA, 19 bp, Homo sapiens
ttccccgatgtcccctgcg

SEQ ID NO: 6570124 - DNA, 21 bp, Homo sapiens
ttccccgatgtcccctgcggg

SEQ ID NO: 6570125 - DNA, 20 bp, Homo sapiens
ttccccgcaacccacagctc

SEQ ID NO: 6570126 - DNA, 19 bp, Homo sapiens
ttccccgcattccaggctc

SEQ ID NO: 6570127 - DNA, 16 bp, Homo sapiens
ttccccggtcccttga

SEQ ID NO: 6570128 - DNA, 23 bp, Homo sapiens
ttccccgtcccctgcagcctggg

SEQ ID NO: 6570129 - DNA, 19 bp, Homo sapiens
ttcccctacacctccctcc

SEQ ID NO: 6570130 - DNA, 18 bp, Homo sapiens
ttcccctagatccagaaa

SEQ ID NO: 6570131 - DNA, 22 bp, Homo sapiens
ttcccctcaatgcagtcagtgt

SEQ ID NO: 6570132 - DNA, 19 bp, Homo sapiens
ttcccctcactggatgaaa

SEQ ID NO: 6570133 - DNA, 15 bp, Homo sapiens
ttcccctcagagctc

SEQ ID NO: 6570134 - DNA, 17 bp, Homo sapiens
ttcccctccaagaccct

SEQ ID NO: 6570135 - DNA, 23 bp, Homo sapiens
ttcccctccaagaccctgtgttc

SEQ ID NO: 6570136 - DNA, 20 bp, Homo sapiens
ttcccctcccaatcctctct

SEQ ID NO: 6570137 - DNA, 21 bp, Homo sapiens
ttcccctcccaatcctctctc

SEQ ID NO: 6570138 - DNA, 22 bp, Homo sapiens
ttcccctcccaatcctctctcc

SEQ ID NO: 6570139 - DNA, 23 bp, Homo sapiens
ttcccctcccaatcctctctccc

SEQ ID NO: 6570140 - DNA, 19 bp, Homo sapiens
ttcccctcccacctctcct

SEQ ID NO: 6570141 - DNA, 15 bp, Homo sapiens
ttcccctcccctcct

SEQ ID NO: 6570142 - DNA, 23 bp, Homo sapiens
ttcccctcccgcttcctccggct

SEQ ID NO: 6570143 - DNA, 22 bp, Homo sapiens
ttcccctcccgtcttcctcctc

SEQ ID NO: 6570144 - DNA, 15 bp, Homo sapiens
ttcccctcctccact

SEQ ID NO: 6570145 - DNA, 16 bp, Homo sapiens
ttcccctcctgtaaga

SEQ ID NO: 6570146 - DNA, 17 bp, Homo sapiens
ttcccctcgctgtcctg

SEQ ID NO: 6570147 - DNA, 21 bp, Homo sapiens
ttcccctcgctgtcctgctgt

SEQ ID NO: 6570148 - DNA, 20 bp, Homo sapiens
ttcccctctaactggacagc

SEQ ID NO: 6570149 - DNA, 11 bp, Homo sapiens
ttcccctctcc

SEQ ID NO: 6570150 - DNA, 13 bp, Homo sapiens
ttcccctctccct

SEQ ID NO: 6570151 - DNA, 12 bp, Homo sapiens
ttcccctctctg

SEQ ID NO: 6570152 - DNA, 22 bp, Homo sapiens
ttcccctctggcttgacagcat

SEQ ID NO: 6570153 - DNA, 18 bp, Homo sapiens
ttcccctctgtgtcctct

SEQ ID NO: 6570154 - DNA, 13 bp, Homo sapiens
ttcccctcttccc

SEQ ID NO: 6570155 - DNA, 19 bp, Homo sapiens
ttcccctcttgtctcccct

SEQ ID NO: 6570156 - DNA, 14 bp, Homo sapiens
ttcccctctttgaa

SEQ ID NO: 6570157 - DNA, 22 bp, Homo sapiens
ttcccctgagagtttcctcaga

SEQ ID NO: 6570158 - DNA, 19 bp, Homo sapiens
ttcccctgcactcccgacc

SEQ ID NO: 6570159 - DNA, 19 bp, Homo sapiens
ttcccctgcgccctccctc

SEQ ID NO: 6570160 - DNA, 20 bp, Homo sapiens
ttcccctgcgccctccctcc

SEQ ID NO: 6570161 - DNA, 21 bp, Homo sapiens
ttcccctgcgccctccctccc

SEQ ID NO: 6570162 - DNA, 21 bp, Homo sapiens
ttcccctggaccacacctccg

SEQ ID NO: 6570163 - DNA, 14 bp, Homo sapiens
ttcccctggcctta

SEQ ID NO: 6570164 - DNA, 22 bp, Homo sapiens
ttcccctgggatgctgacccag

SEQ ID NO: 6570165 - DNA, 23 bp, Homo sapiens
ttcccctgggatgctgacccagg

SEQ ID NO: 6570166 - DNA, 16 bp, Homo sapiens
ttcccctggggaccca

SEQ ID NO: 6570167 - DNA, 13 bp, Homo sapiens
ttcccctgtcctg

SEQ ID NO: 6570168 - DNA, 21 bp, Homo sapiens
ttcccctgtcctgtgaatgga

SEQ ID NO: 6570169 - DNA, 12 bp, Homo sapiens
ttcccctgtggt

SEQ ID NO: 6570170 - DNA, 11 bp, Homo sapiens
ttcccctgtgt

SEQ ID NO: 6570171 - DNA, 15 bp, Homo sapiens
ttcccctgtgtcatc

SEQ ID NO: 6570172 - DNA, 19 bp, Homo sapiens
ttcccctgtttattcatat

SEQ ID NO: 6570173 - DNA, 20 bp, Homo sapiens
ttccccttatcctccctgta

SEQ ID NO: 6570174 - DNA, 18 bp, Homo sapiens
ttccccttcaccgctccc

SEQ ID NO: 6570175 - DNA, 12 bp, Homo sapiens
ttccccttcaga

SEQ ID NO: 6570176 - DNA, 11 bp, Homo sapiens
ttccccttccc

SEQ ID NO: 6570177 - DNA, 13 bp, Homo sapiens
ttccccttcccct

SEQ ID NO: 6570178 - DNA, 14 bp, Homo sapiens
ttccccttccctca

SEQ ID NO: 6570179 - DNA, 13 bp, Homo sapiens
ttccccttccctt

SEQ ID NO: 6570180 - DNA, 15 bp, Homo sapiens
ttccccttccttctt

SEQ ID NO: 6570181 - DNA, 17 bp, Homo sapiens
ttccccttccttttaag

SEQ ID NO: 6570182 - DNA, 18 bp, Homo sapiens
ttccccttgaacctcatt

SEQ ID NO: 6570183 - DNA, 22 bp, Homo sapiens
ttccccttgcccttgccctgac

SEQ ID NO: 6570184 - DNA, 19 bp, Homo sapiens
ttccccttgtccctggggc

SEQ ID NO: 6570185 - DNA, 19 bp, Homo sapiens
ttcccctttactcagccca

SEQ ID NO: 6570186 - DNA, 22 bp, Homo sapiens
ttcccctttactcagcccagct

SEQ ID NO: 6570187 - DNA, 14 bp, Homo sapiens
ttcccctttcctgt

SEQ ID NO: 6570188 - DNA, 15 bp, Homo sapiens
ttcccctttcctgtc

SEQ ID NO: 6570189 - DNA, 14 bp, Homo sapiens
ttcccctttctctt

SEQ ID NO: 6570190 - DNA, 15 bp, Homo sapiens
ttcccctttgcactg

SEQ ID NO: 6570191 - DNA, 16 bp, Homo sapiens
ttccccttttgccaat

SEQ ID NO: 6570192 - DNA, 17 bp, Homo sapiens
ttccccttttgcctggc

SEQ ID NO: 6570193 - DNA, 16 bp, Homo sapiens
ttcccgacccagccag

SEQ ID NO: 6570194 - DNA, 22 bp, Homo sapiens
ttcccgagcaaagtctaaagtt

SEQ ID NO: 6570195 - DNA, 23 bp, Homo sapiens
ttcccgagcaaagtctaaagttt

SEQ ID NO: 6570196 - DNA, 14 bp, Homo sapiens
ttcccgagcgctgg

SEQ ID NO: 6570197 - DNA, 22 bp, Homo sapiens
ttcccgaggaactcgcctcagc

SEQ ID NO: 6570198 - DNA, 20 bp, Homo sapiens
ttcccgattcacgtttttct

SEQ ID NO: 6570199 - DNA, 13 bp, Homo sapiens
ttcccgcagcacc

SEQ ID NO: 6570200 - DNA, 20 bp, Homo sapiens
ttcccgcagtgggagcaaac

SEQ ID NO: 6570201 - DNA, 21 bp, Homo sapiens
ttcccgccagagggcttgtga

SEQ ID NO: 6570202 - DNA, 22 bp, Homo sapiens
ttcccgccaggaggtcctcctc

SEQ ID NO: 6570203 - DNA, 22 bp, Homo sapiens
ttcccgccctccccctgccaga

SEQ ID NO: 6570204 - DNA, 20 bp, Homo sapiens
ttcccgccggaggccagcta

SEQ ID NO: 6570205 - DNA, 14 bp, Homo sapiens
ttcccgcctcagcc

SEQ ID NO: 6570206 - DNA, 15 bp, Homo sapiens
ttcccgcctcagcct

SEQ ID NO: 6570207 - DNA, 20 bp, Homo sapiens
ttcccgcctcagcctctcaa

SEQ ID NO: 6570208 - DNA, 22 bp, Homo sapiens
ttcccgcgggttccgcaggcag

SEQ ID NO: 6570209 - DNA, 14 bp, Homo sapiens
ttcccgctcagccc

SEQ ID NO: 6570210 - DNA, 19 bp, Homo sapiens
ttcccggcccccggccaag

SEQ ID NO: 6570211 - DNA, 20 bp, Homo sapiens
ttcccggcccccggccaagg

SEQ ID NO: 6570212 - DNA, 22 bp, Homo sapiens
ttcccggcccttacctttcctg

SEQ ID NO: 6570213 - DNA, 13 bp, Homo sapiens
ttcccgggagctg

SEQ ID NO: 6570214 - DNA, 20 bp, Homo sapiens
ttcccgggagctgggccctg

SEQ ID NO: 6570215 - DNA, 20 bp, Homo sapiens
ttcccgggataaactgagcc

SEQ ID NO: 6570216 - DNA, 15 bp, Homo sapiens
ttcccgggccctcag

SEQ ID NO: 6570217 - DNA, 19 bp, Homo sapiens
ttcccgggccctcagccct

SEQ ID NO: 6570218 - DNA, 17 bp, Homo sapiens
ttcccgggcccttcagt

SEQ ID NO: 6570219 - DNA, 14 bp, Homo sapiens
ttcccggtcccgag

SEQ ID NO: 6570220 - DNA, 15 bp, Homo sapiens
ttcccggtcccgagt

SEQ ID NO: 6570221 - DNA, 19 bp, Homo sapiens
ttcccggtcccgagtacag

SEQ ID NO: 6570222 - DNA, 23 bp, Homo sapiens
ttcccggtccgcccgcttccctc

SEQ ID NO: 6570223 - DNA, 16 bp, Homo sapiens
ttcccgtaaggctgta

SEQ ID NO: 6570224 - DNA, 20 bp, Homo sapiens
ttcccgtaaggctgtacata

SEQ ID NO: 6570225 - DNA, 23 bp, Homo sapiens
ttcccgtaaggctgtacatagtc

SEQ ID NO: 6570226 - DNA, 16 bp, Homo sapiens
ttcccgtagctgccag

SEQ ID NO: 6570227 - DNA, 16 bp, Homo sapiens
ttcccgtataataaaa

SEQ ID NO: 6570228 - DNA, 21 bp, Homo sapiens
ttcccgtcccatatcctgcct

SEQ ID NO: 6570229 - DNA, 14 bp, Homo sapiens
ttcccgtctcagaa

SEQ ID NO: 6570230 - DNA, 20 bp, Homo sapiens
ttcccgtctcagaatctaaa

SEQ ID NO: 6570231 - DNA, 23 bp, Homo sapiens
ttcccgtggaacgtttttcctgt

SEQ ID NO: 6570232 - DNA, 22 bp, Homo sapiens
ttcccgtggtctccttgcactt

SEQ ID NO: 6570233 - DNA, 15 bp, Homo sapiens
ttcccgtttctccac

SEQ ID NO: 6570234 - DNA, 19 bp, Homo sapiens
ttccctaaaatacatttaa

SEQ ID NO: 6570235 - DNA, 11 bp, Homo sapiens
ttccctaaagc

SEQ ID NO: 6570236 - DNA, 15 bp, Homo sapiens
ttccctaactctcgg

SEQ ID NO: 6570237 - DNA, 19 bp, Homo sapiens
ttccctaacttgtgaagac

SEQ ID NO: 6570238 - DNA, 19 bp, Homo sapiens
ttccctaagccaagggcct

SEQ ID NO: 6570239 - DNA, 16 bp, Homo sapiens
ttccctaatctatggt

SEQ ID NO: 6570240 - DNA, 15 bp, Homo sapiens
ttccctaattctgcc

SEQ ID NO: 6570241 - DNA, 18 bp, Homo sapiens
ttccctaattctgcctta

SEQ ID NO: 6570242 - DNA, 16 bp, Homo sapiens
aagcagcctctcccca

SEQ ID NO: 6570243 - DNA, 17 bp, Homo sapiens
aagcagcctctccccag

SEQ ID NO: 6570244 - DNA, 20 bp, Homo sapiens
aagcagcctggagacttcct

SEQ ID NO: 6570245 - DNA, 17 bp, Homo sapiens
aagcagccttaagctta

SEQ ID NO: 6570246 - DNA, 15 bp, Homo sapiens
aagcagcctttctgt

SEQ ID NO: 6570247 - DNA, 21 bp, Homo sapiens
aagcagcctttctgtggagag

SEQ ID NO: 6570248 - DNA, 20 bp, Homo sapiens
aagcagcctttttcaccatg

SEQ ID NO: 6570249 - DNA, 19 bp, Homo sapiens
aagcagcgaccgccccctc

SEQ ID NO: 6570250 - DNA, 19 bp, Homo sapiens
aagcagcgctagtggaggg

SEQ ID NO: 6570251 - DNA, 22 bp, Homo sapiens
aagcagcggtcagcagacaagg

SEQ ID NO: 6570252 - DNA, 21 bp, Homo sapiens
aagcagcgtttctatgacaca

SEQ ID NO: 6570253 - DNA, 16 bp, Homo sapiens
aagcagctcaaaggca

SEQ ID NO: 6570254 - DNA, 10 bp, Homo sapiens
aagcagctct

SEQ ID NO: 6570255 - DNA, 14 bp, Homo sapiens
aagcagctctcccc

SEQ ID NO: 6570256 - DNA, 15 bp, Homo sapiens
aagcagctctgcctt

SEQ ID NO: 6570257 - DNA, 19 bp, Homo sapiens
aagcagctgaagaaaaaat

SEQ ID NO: 6570258 - DNA, 13 bp, Homo sapiens
aagcagctgaagg

SEQ ID NO: 6570259 - DNA, 20 bp, Homo sapiens
aagcagctggtcagtctttg

SEQ ID NO: 6570260 - DNA, 22 bp, Homo sapiens
aagcagctggtcagtctttgct

SEQ ID NO: 6570261 - DNA, 16 bp, Homo sapiens
aagcagcttattgttt

SEQ ID NO: 6570262 - DNA, 15 bp, Homo sapiens
aagcagcttcttttg

SEQ ID NO: 6570263 - DNA, 22 bp, Homo sapiens
aagcagcttgaatggtttttct

SEQ ID NO: 6570264 - DNA, 13 bp, Homo sapiens
aagcagctttaaa

SEQ ID NO: 6570265 - DNA, 16 bp, Homo sapiens
aagcagctttaaacaa

SEQ ID NO: 6570266 - DNA, 22 bp, Homo sapiens
aagcagctttttattccctgcc

SEQ ID NO: 6570267 - DNA, 16 bp, Homo sapiens
aagcaggaagctcaga

SEQ ID NO: 6570268 - DNA, 15 bp, Homo sapiens
aagcaggaattatgt

SEQ ID NO: 6570269 - DNA, 14 bp, Homo sapiens
aagcaggacagaca

SEQ ID NO: 6570270 - DNA, 16 bp, Homo sapiens
aagcaggacctggcat

SEQ ID NO: 6570271 - DNA, 21 bp, Homo sapiens
aagcaggaggaggtgccaaca

SEQ ID NO: 6570272 - DNA, 22 bp, Homo sapiens
aagcaggagtaagtttctcatc

SEQ ID NO: 6570273 - DNA, 16 bp, Homo sapiens
aagcaggatggagctg

SEQ ID NO: 6570274 - DNA, 19 bp, Homo sapiens
aagcaggatggagctgact

SEQ ID NO: 6570275 - DNA, 14 bp, Homo sapiens
aagcaggcactgta

SEQ ID NO: 6570276 - DNA, 14 bp, Homo sapiens
aagcaggcagggca

SEQ ID NO: 6570277 - DNA, 14 bp, Homo sapiens
aagcaggccgccct

SEQ ID NO: 6570278 - DNA, 16 bp, Homo sapiens
aagcaggcctttgcag

SEQ ID NO: 6570279 - DNA, 21 bp, Homo sapiens
aagcaggctggtttgcaagaa

SEQ ID NO: 6570280 - DNA, 16 bp, Homo sapiens
aagcaggcttgtgctt

SEQ ID NO: 6570281 - DNA, 17 bp, Homo sapiens
aagcagggaatttctat

SEQ ID NO: 6570282 - DNA, 23 bp, Homo sapiens
aagcagggagagttggggaaggc

SEQ ID NO: 6570283 - DNA, 12 bp, Homo sapiens
aagcagggagga

SEQ ID NO: 6570284 - DNA, 17 bp, Homo sapiens
aagcaggggagtatgca

SEQ ID NO: 6570285 - DNA, 20 bp, Homo sapiens
aagcaggggctacaagaggg

SEQ ID NO: 6570286 - DNA, 21 bp, Homo sapiens
aagcaggggctacaagaggga

SEQ ID NO: 6570287 - DNA, 22 bp, Homo sapiens
aagcaggggtggggggtgcagg

SEQ ID NO: 6570288 - DNA, 23 bp, Homo sapiens
aagcagggtaccctttggggagc

SEQ ID NO: 6570289 - DNA, 18 bp, Homo sapiens
aagcaggtcagaagaggg

SEQ ID NO: 6570290 - DNA, 14 bp, Homo sapiens
aagcaggtgctaca

SEQ ID NO: 6570291 - DNA, 20 bp, Homo sapiens
aagcaggtgtcctttcccct

SEQ ID NO: 6570292 - DNA, 14 bp, Homo sapiens
aagcaggttaaatg

SEQ ID NO: 6570293 - DNA, 18 bp, Homo sapiens
aagcaggttaaatgtttt

SEQ ID NO: 6570294 - DNA, 20 bp, Homo sapiens
aagcaggttaaatgttttgt

SEQ ID NO: 6570295 - DNA, 20 bp, Homo sapiens
aagcaggttcttgatgtcat

SEQ ID NO: 6570296 - DNA, 15 bp, Homo sapiens
aagcaggttcttgtt

SEQ ID NO: 6570297 - DNA, 20 bp, Homo sapiens
aagcaggtttcttgcttctg

SEQ ID NO: 6570298 - DNA, 16 bp, Homo sapiens
aagcaggtttgttttc

SEQ ID NO: 6570299 - DNA, 16 bp, Homo sapiens
aagcaggtttttctcc

SEQ ID NO: 6570300 - DNA, 13 bp, Homo sapiens
aagcagtaaaata

SEQ ID NO: 6570301 - DNA, 13 bp, Homo sapiens
aagcagtaactga

SEQ ID NO: 6570302 - DNA, 19 bp, Homo sapiens
aagcagtaatctgtcagtg

SEQ ID NO: 6570303 - DNA, 18 bp, Homo sapiens
aagcagtacatcttgtgc

SEQ ID NO: 6570304 - DNA, 19 bp, Homo sapiens
aagcagtacatcttgtgca

SEQ ID NO: 6570305 - DNA, 20 bp, Homo sapiens
aagcagtagaaataatatgc

SEQ ID NO: 6570306 - DNA, 19 bp, Homo sapiens
aagcagtatataataactt

SEQ ID NO: 6570307 - DNA, 22 bp, Homo sapiens
aagcagtccagagtctaggcaa

SEQ ID NO: 6570308 - DNA, 21 bp, Homo sapiens
aagcagtcctgttcaaatttt

SEQ ID NO: 6570309 - DNA, 18 bp, Homo sapiens
aagcagtcgtgcctgtgt

SEQ ID NO: 6570310 - DNA, 18 bp, Homo sapiens
aagcagtctacccacctc

SEQ ID NO: 6570311 - DNA, 14 bp, Homo sapiens
aagcagtcttgctc

SEQ ID NO: 6570312 - DNA, 14 bp, Homo sapiens
aagcagtgcatgct

SEQ ID NO: 6570313 - DNA, 20 bp, Homo sapiens
aagcagtgcatgctgtccct

SEQ ID NO: 6570314 - DNA, 13 bp, Homo sapiens
aagcagtgcccag

SEQ ID NO: 6570315 - DNA, 15 bp, Homo sapiens
aagcagtgcccaggt

SEQ ID NO: 6570316 - DNA, 23 bp, Homo sapiens
aagcagtgccctctggacagctt

SEQ ID NO: 6570317 - DNA, 14 bp, Homo sapiens
aagcagtgcctcga

SEQ ID NO: 6570318 - DNA, 17 bp, Homo sapiens
aagcagtgccttccata

SEQ ID NO: 6570319 - DNA, 20 bp, Homo sapiens
aagcagtgccttccataatt

SEQ ID NO: 6570320 - DNA, 19 bp, Homo sapiens
aagcagtgcgtgtgaaaca

SEQ ID NO: 6570321 - DNA, 15 bp, Homo sapiens
aagcagtgcttctca

SEQ ID NO: 6570322 - DNA, 17 bp, Homo sapiens
aagcagtggatacgtgt

SEQ ID NO: 6570323 - DNA, 11 bp, Homo sapiens
aagcagtgttt

SEQ ID NO: 6570324 - DNA, 17 bp, Homo sapiens
aagcagttaatttatat

SEQ ID NO: 6570325 - DNA, 17 bp, Homo sapiens
aagcagttcatgtctga

SEQ ID NO: 6570326 - DNA, 22 bp, Homo sapiens
aagcagttcattctaccaagct

SEQ ID NO: 6570327 - DNA, 23 bp, Homo sapiens
aagcagttcattctaccaagctg

SEQ ID NO: 6570328 - DNA, 17 bp, Homo sapiens
aagcagttcctgtccca

SEQ ID NO: 6570329 - DNA, 19 bp, Homo sapiens
aagcagttgcaatgatcag

SEQ ID NO: 6570330 - DNA, 20 bp, Homo sapiens
aagcagttgcaatgatcaga

SEQ ID NO: 6570331 - DNA, 13 bp, Homo sapiens
aagcagttgggag

SEQ ID NO: 6570332 - DNA, 21 bp, Homo sapiens
aagcagttgggagtacatatg

SEQ ID NO: 6570333 - DNA, 17 bp, Homo sapiens
aagcagttggggccctc

SEQ ID NO: 6570334 - DNA, 18 bp, Homo sapiens
aagcagttggggccctct

SEQ ID NO: 6570335 - DNA, 12 bp, Homo sapiens
aagcagtttcaa

SEQ ID NO: 6570336 - DNA, 14 bp, Homo sapiens
aagcagtttcagat

SEQ ID NO: 6570337 - DNA, 23 bp, Homo sapiens
aagcagtttcagataaatcatgg

SEQ ID NO: 6570338 - DNA, 18 bp, Homo sapiens
aagcagttttgtaaatgt

SEQ ID NO: 6570339 - DNA, 19 bp, Homo sapiens
aagcagttttgtaaatgta

SEQ ID NO: 6570340 - DNA, 23 bp, Homo sapiens
aagcagttttgtaaatgtactgg

SEQ ID NO: 6570341 - DNA, 18 bp, Homo sapiens
aagcagtttttgaaagac

SEQ ID NO: 6570342 - DNA, 15 bp, Homo sapiens
aagcataaaaacatt

SEQ ID NO: 6570343 - DNA, 16 bp, Homo sapiens
aagcataaaaattgaa

SEQ ID NO: 6570344 - DNA, 18 bp, Homo sapiens
aagcataaaaattgaatt

SEQ ID NO: 6570345 - DNA, 14 bp, Homo sapiens
aagcataaaacttt

SEQ ID NO: 6570346 - DNA, 12 bp, Homo sapiens
aagcataaaaga

SEQ ID NO: 6570347 - DNA, 22 bp, Homo sapiens
aagcataaaagatgaaagagca

SEQ ID NO: 6570348 - DNA, 14 bp, Homo sapiens
aagcataaagctca

SEQ ID NO: 6570349 - DNA, 14 bp, Homo sapiens
aagcataagaccaa

SEQ ID NO: 6570350 - DNA, 13 bp, Homo sapiens
aagcataaggccg

SEQ ID NO: 6570351 - DNA, 16 bp, Homo sapiens
aagcataatctgaaaa

SEQ ID NO: 6570352 - DNA, 15 bp, Homo sapiens
aagcataatgaaaat

SEQ ID NO: 6570353 - DNA, 21 bp, Homo sapiens
aagcataatgttgaacattca

SEQ ID NO: 6570354 - DNA, 16 bp, Homo sapiens
aagcataatttgttta

SEQ ID NO: 6570355 - DNA, 22 bp, Homo sapiens
aagcataatttgtttaaaattc

SEQ ID NO: 6570356 - DNA, 13 bp, Homo sapiens
aagcatacaagat

SEQ ID NO: 6570357 - DNA, 22 bp, Homo sapiens
aagcatacatgcaaaaagaaat

SEQ ID NO: 6570358 - DNA, 23 bp, Homo sapiens
aagcatacatgcaaaaagaaatg

SEQ ID NO: 6570359 - DNA, 18 bp, Homo sapiens
aagcatactttgtaaata

SEQ ID NO: 6570360 - DNA, 13 bp, Homo sapiens
aagcatagagaac

SEQ ID NO: 6570361 - DNA, 15 bp, Homo sapiens
aagcatagatgtttt

SEQ ID NO: 6570362 - DNA, 14 bp, Homo sapiens
aagcatagggtagt

SEQ ID NO: 6570363 - DNA, 16 bp, Homo sapiens
aagcatataaaatggc

SEQ ID NO: 6570364 - DNA, 21 bp, Homo sapiens
aagcatatataaaacaaaaca

SEQ ID NO: 6570365 - DNA, 18 bp, Homo sapiens
aagcatatcgtaaagctg

SEQ ID NO: 6570366 - DNA, 19 bp, Homo sapiens
aagcatatgcctacttgta

SEQ ID NO: 6570367 - DNA, 21 bp, Homo sapiens
aagcatatgtgttacttcaag

SEQ ID NO: 6570368 - DNA, 13 bp, Homo sapiens
aagcatattggaa

SEQ ID NO: 6570369 - DNA, 23 bp, Homo sapiens
aagcatattggaaagtgatttta

SEQ ID NO: 6570370 - DNA, 14 bp, Homo sapiens
aagcatattttgct

SEQ ID NO: 6570371 - DNA, 17 bp, Homo sapiens
aagcatattttgctggt

SEQ ID NO: 6570372 - DNA, 16 bp, Homo sapiens
aagcatcaaataatac

SEQ ID NO: 6570373 - DNA, 15 bp, Homo sapiens
aagcatcacacagtg

SEQ ID NO: 6570374 - DNA, 16 bp, Homo sapiens
aagcatcactgccttg

SEQ ID NO: 6570375 - DNA, 13 bp, Homo sapiens
aagcatcagcaag

SEQ ID NO: 6570376 - DNA, 15 bp, Homo sapiens
aagcatcagcaagac

SEQ ID NO: 6570377 - DNA, 19 bp, Homo sapiens
aagcatcagttctacggat

SEQ ID NO: 6570378 - DNA, 22 bp, Homo sapiens
aagcatcatcacgacacatttg

SEQ ID NO: 6570379 - DNA, 22 bp, Homo sapiens
aagcatcatggatcaaccaagt

SEQ ID NO: 6570380 - DNA, 23 bp, Homo sapiens
aagcatcattacaatacagtatt

SEQ ID NO: 6570381 - DNA, 15 bp, Homo sapiens
aagcatcattattta

SEQ ID NO: 6570382 - DNA, 17 bp, Homo sapiens
aagcatcattatttatg

SEQ ID NO: 6570383 - DNA, 21 bp, Homo sapiens
aagcatcattatttatgtatt

SEQ ID NO: 6570384 - DNA, 14 bp, Homo sapiens
aagcatcattgtaa

SEQ ID NO: 6570385 - DNA, 13 bp, Homo sapiens
aagcatccctcac

SEQ ID NO: 6570386 - DNA, 13 bp, Homo sapiens
aagcatcctcccc

SEQ ID NO: 6570387 - DNA, 16 bp, Homo sapiens
aagcatcctcctcctg

SEQ ID NO: 6570388 - DNA, 20 bp, Homo sapiens
aagcatctaaactttaatat

SEQ ID NO: 6570389 - DNA, 15 bp, Homo sapiens
aagcatctaaggaca

SEQ ID NO: 6570390 - DNA, 22 bp, Homo sapiens
aagcatctattcccaaagaacc

SEQ ID NO: 6570391 - DNA, 18 bp, Homo sapiens
aagcatctgatagaatga

SEQ ID NO: 6570392 - DNA, 13 bp, Homo sapiens
aagcatctgtgta

SEQ ID NO: 6570393 - DNA, 14 bp, Homo sapiens
aagcatgaaatgtg

SEQ ID NO: 6570394 - DNA, 20 bp, Homo sapiens
aagcatgaacagtgcacctg

SEQ ID NO: 6570395 - DNA, 16 bp, Homo sapiens
aagcatgaataaaatt

SEQ ID NO: 6570396 - DNA, 16 bp, Homo sapiens
aagcatgaattggaac

SEQ ID NO: 6570397 - DNA, 18 bp, Homo sapiens
aagcatgaattggaactg

SEQ ID NO: 6570398 - DNA, 22 bp, Homo sapiens
aagcatgaattggaactgcaat

SEQ ID NO: 6570399 - DNA, 19 bp, Homo sapiens
aagcatgacagaaaatatg

SEQ ID NO: 6570400 - DNA, 17 bp, Homo sapiens
aagcatgagatttttct

SEQ ID NO: 6570401 - DNA, 19 bp, Homo sapiens
aagcatgagtggccttaat

SEQ ID NO: 6570402 - DNA, 19 bp, Homo sapiens
aagcatgatcttgttactg

SEQ ID NO: 6570403 - DNA, 20 bp, Homo sapiens
aagcatgatcttgttactgt

SEQ ID NO: 6570404 - DNA, 17 bp, Homo sapiens
aagcatgatgggaaaat

SEQ ID NO: 6570405 - DNA, 23 bp, Homo sapiens
aagcatgatgggaaaatatttcc

SEQ ID NO: 6570406 - DNA, 19 bp, Homo sapiens
aagcatgcaataatgtgca

SEQ ID NO: 6570407 - DNA, 16 bp, Homo sapiens
aagcatgcataaatca

SEQ ID NO: 6570408 - DNA, 16 bp, Homo sapiens
aagcatgcattgaaaa

SEQ ID NO: 6570409 - DNA, 15 bp, Homo sapiens
aagcatgccccaccc

SEQ ID NO: 6570410 - DNA, 12 bp, Homo sapiens
aagcatgctcag

SEQ ID NO: 6570411 - DNA, 22 bp, Homo sapiens
aagcatgcttgtgaaaatgtgt

SEQ ID NO: 6570412 - DNA, 16 bp, Homo sapiens
aagcatggagaacagt

SEQ ID NO: 6570413 - DNA, 16 bp, Homo sapiens
aagcatggccctgctg

SEQ ID NO: 6570414 - DNA, 21 bp, Homo sapiens
aagcatggctcattctgcaat

SEQ ID NO: 6570415 - DNA, 20 bp, Homo sapiens
aagcatgggaaaaagagact

SEQ ID NO: 6570416 - DNA, 22 bp, Homo sapiens
aagcatggtcccacatccctgg

SEQ ID NO: 6570417 - DNA, 18 bp, Homo sapiens
aagcatgtacagtgttct

SEQ ID NO: 6570418 - DNA, 20 bp, Homo sapiens
aagcatgtagactgtgccag

SEQ ID NO: 6570419 - DNA, 16 bp, Homo sapiens
aagcatgtaggagaat

SEQ ID NO: 6570420 - DNA, 14 bp, Homo sapiens
ttccctacacaggg

SEQ ID NO: 6570421 - DNA, 21 bp, Homo sapiens
ttccctacccacagggcctga

SEQ ID NO: 6570422 - DNA, 14 bp, Homo sapiens
ttccctaccctcta

SEQ ID NO: 6570423 - DNA, 16 bp, Homo sapiens
ttccctacccttcctg

SEQ ID NO: 6570424 - DNA, 18 bp, Homo sapiens
ttccctacccttcctgcc

SEQ ID NO: 6570425 - DNA, 15 bp, Homo sapiens
ttccctacctcaggc

SEQ ID NO: 6570426 - DNA, 13 bp, Homo sapiens
ttccctacgagga

SEQ ID NO: 6570427 - DNA, 22 bp, Homo sapiens
ttccctactgaaccctgcctct

SEQ ID NO: 6570428 - DNA, 13 bp, Homo sapiens
ttccctacttcct

SEQ ID NO: 6570429 - DNA, 17 bp, Homo sapiens
ttccctacttcctgtga

SEQ ID NO: 6570430 - DNA, 15 bp, Homo sapiens
ttccctagaaagcca

SEQ ID NO: 6570431 - DNA, 18 bp, Homo sapiens
ttccctagagagaataaa

SEQ ID NO: 6570432 - DNA, 19 bp, Homo sapiens
ttccctagagagaataaat

SEQ ID NO: 6570433 - DNA, 20 bp, Homo sapiens
ttccctagaggcaaacattt

SEQ ID NO: 6570434 - DNA, 23 bp, Homo sapiens
ttccctaggctgagctggcattg

SEQ ID NO: 6570435 - DNA, 13 bp, Homo sapiens
ttccctatacttc

SEQ ID NO: 6570436 - DNA, 17 bp, Homo sapiens
ttccctataggaacagc

SEQ ID NO: 6570437 - DNA, 18 bp, Homo sapiens
ttccctatcaaaacatat

SEQ ID NO: 6570438 - DNA, 21 bp, Homo sapiens
ttccctatgaaagattccaca

SEQ ID NO: 6570439 - DNA, 20 bp, Homo sapiens
ttccctatggagaggcttcc

SEQ ID NO: 6570440 - DNA, 19 bp, Homo sapiens
ttccctattttaggctatt

SEQ ID NO: 6570441 - DNA, 16 bp, Homo sapiens
ttccctattttgaatg

SEQ ID NO: 6570442 - DNA, 18 bp, Homo sapiens
ttccctcacccccagcac

SEQ ID NO: 6570443 - DNA, 18 bp, Homo sapiens
ttccctcaccccctccca

SEQ ID NO: 6570444 - DNA, 22 bp, Homo sapiens
ttccctcaccccctcccacccc

SEQ ID NO: 6570445 - DNA, 21 bp, Homo sapiens
ttccctcactcgtctccccca

SEQ ID NO: 6570446 - DNA, 18 bp, Homo sapiens
ttccctcactcttcctca

SEQ ID NO: 6570447 - DNA, 17 bp, Homo sapiens
ttccctcagtgtgaagc

SEQ ID NO: 6570448 - DNA, 16 bp, Homo sapiens
ttccctcatcctttca

SEQ ID NO: 6570449 - DNA, 16 bp, Homo sapiens
ttccctcatgttctca

SEQ ID NO: 6570450 - DNA, 15 bp, Homo sapiens
ttccctcattctgca

SEQ ID NO: 6570451 - DNA, 18 bp, Homo sapiens
ttccctcattctgcatta

SEQ ID NO: 6570452 - DNA, 23 bp, Homo sapiens
ttccctccatccccctttaccct

SEQ ID NO: 6570453 - DNA, 19 bp, Homo sapiens
ttccctcccagaggagcca

SEQ ID NO: 6570454 - DNA, 18 bp, Homo sapiens
ttccctccccagctcctc

SEQ ID NO: 6570455 - DNA, 13 bp, Homo sapiens
ttccctccccctc

SEQ ID NO: 6570456 - DNA, 23 bp, Homo sapiens
ttccctcccgggagaggagatca

SEQ ID NO: 6570457 - DNA, 12 bp, Homo sapiens
ttccctcctccc

SEQ ID NO: 6570458 - DNA, 14 bp, Homo sapiens
ttccctcctgccca

SEQ ID NO: 6570459 - DNA, 16 bp, Homo sapiens
ttccctcctgcccagg

SEQ ID NO: 6570460 - DNA, 11 bp, Homo sapiens
ttccctcctgt

SEQ ID NO: 6570461 - DNA, 15 bp, Homo sapiens
ttccctcctgtgccc

SEQ ID NO: 6570462 - DNA, 19 bp, Homo sapiens
ttccctccttcccttctct

SEQ ID NO: 6570463 - DNA, 14 bp, Homo sapiens
ttccctcctttcct

SEQ ID NO: 6570464 - DNA, 23 bp, Homo sapiens
ttccctcgacttgaccctttcct

SEQ ID NO: 6570465 - DNA, 19 bp, Homo sapiens
ttccctcggagttcttctt

SEQ ID NO: 6570466 - DNA, 14 bp, Homo sapiens
ttccctcgtccgtc

SEQ ID NO: 6570467 - DNA, 15 bp, Homo sapiens
ttccctcgtccgtct

SEQ ID NO: 6570468 - DNA, 19 bp, Homo sapiens
ttccctctcagctgctggg

SEQ ID NO: 6570469 - DNA, 13 bp, Homo sapiens
ttccctctcatcc

SEQ ID NO: 6570470 - DNA, 14 bp, Homo sapiens
ttccctctcatcca

SEQ ID NO: 6570471 - DNA, 13 bp, Homo sapiens
ttccctctcccac

SEQ ID NO: 6570472 - DNA, 17 bp, Homo sapiens
ttccctctcccaggccc

SEQ ID NO: 6570473 - DNA, 13 bp, Homo sapiens
ttccctctccttc

SEQ ID NO: 6570474 - DNA, 14 bp, Homo sapiens
ttccctctctcact

SEQ ID NO: 6570475 - DNA, 22 bp, Homo sapiens
ttccctctctcagcacagcctg

SEQ ID NO: 6570476 - DNA, 21 bp, Homo sapiens
ttccctctctcataccctccc

SEQ ID NO: 6570477 - DNA, 17 bp, Homo sapiens
ttccctctctccctgcc

SEQ ID NO: 6570478 - DNA, 15 bp, Homo sapiens
ttccctctctctgac

SEQ ID NO: 6570479 - DNA, 12 bp, Homo sapiens
ttccctctctga

SEQ ID NO: 6570480 - DNA, 22 bp, Homo sapiens
ttccctctctgatgtcccagtg

SEQ ID NO: 6570481 - DNA, 16 bp, Homo sapiens
ttccctctctggacct

SEQ ID NO: 6570482 - DNA, 23 bp, Homo sapiens
ttccctctcttgcctttcttatt

SEQ ID NO: 6570483 - DNA, 12 bp, Homo sapiens
ttccctctgcct

SEQ ID NO: 6570484 - DNA, 13 bp, Homo sapiens
ttccctctgcctg

SEQ ID NO: 6570485 - DNA, 14 bp, Homo sapiens
ttccctctgcctgt

SEQ ID NO: 6570486 - DNA, 14 bp, Homo sapiens
ttccctctgctcag

SEQ ID NO: 6570487 - DNA, 15 bp, Homo sapiens
ttccctctgctcctg

SEQ ID NO: 6570488 - DNA, 18 bp, Homo sapiens
ttccctctgctgcttttg

SEQ ID NO: 6570489 - DNA, 14 bp, Homo sapiens
ttccctctggagtt

SEQ ID NO: 6570490 - DNA, 13 bp, Homo sapiens
ttccctctggctt

SEQ ID NO: 6570491 - DNA, 12 bp, Homo sapiens
ttccctctggga

SEQ ID NO: 6570492 - DNA, 22 bp, Homo sapiens
ttccctctgggcacgcctgctg

SEQ ID NO: 6570493 - DNA, 14 bp, Homo sapiens
ttccctctgtgtta

SEQ ID NO: 6570494 - DNA, 19 bp, Homo sapiens
ttccctcttcggtgttctt

SEQ ID NO: 6570495 - DNA, 20 bp, Homo sapiens
ttccctcttcggtgttcttc

SEQ ID NO: 6570496 - DNA, 15 bp, Homo sapiens
ttccctctttcccca

SEQ ID NO: 6570497 - DNA, 17 bp, Homo sapiens
ttccctctttccccacc

SEQ ID NO: 6570498 - DNA, 14 bp, Homo sapiens
ttccctctttcctg

SEQ ID NO: 6570499 - DNA, 20 bp, Homo sapiens
ttccctctttggctcccctg

SEQ ID NO: 6570500 - DNA, 14 bp, Homo sapiens
ttccctcttttctt

SEQ ID NO: 6570501 - DNA, 19 bp, Homo sapiens
ttccctcttttcttactcc

SEQ ID NO: 6570502 - DNA, 23 bp, Homo sapiens
ttccctgaaaacctcacatgcat

SEQ ID NO: 6570503 - DNA, 22 bp, Homo sapiens
ttccctgaaacacgaaacttgt

SEQ ID NO: 6570504 - DNA, 13 bp, Homo sapiens
ttccctgaacaga

SEQ ID NO: 6570505 - DNA, 17 bp, Homo sapiens
ttccctgaacatctgtg

SEQ ID NO: 6570506 - DNA, 21 bp, Homo sapiens
ttccctgaagagacaggcacc

SEQ ID NO: 6570507 - DNA, 13 bp, Homo sapiens
ttccctgaagcta

SEQ ID NO: 6570508 - DNA, 16 bp, Homo sapiens
ttccctgaaggaacca

SEQ ID NO: 6570509 - DNA, 15 bp, Homo sapiens
ttccctgaatgtatt

SEQ ID NO: 6570510 - DNA, 18 bp, Homo sapiens
ttccctgactcctctaag

SEQ ID NO: 6570511 - DNA, 21 bp, Homo sapiens
ttccctgagaaacccaccagc

SEQ ID NO: 6570512 - DNA, 16 bp, Homo sapiens
ttccctgagtcaccag

SEQ ID NO: 6570513 - DNA, 18 bp, Homo sapiens
ttccctgagtcaccagga

SEQ ID NO: 6570514 - DNA, 19 bp, Homo sapiens
ttccctgagtcaccaggaa

SEQ ID NO: 6570515 - DNA, 15 bp, Homo sapiens
ttccctgatggcctt

SEQ ID NO: 6570516 - DNA, 15 bp, Homo sapiens
ttccctgattattta

SEQ ID NO: 6570517 - DNA, 16 bp, Homo sapiens
ttccctgattatttat

SEQ ID NO: 6570518 - DNA, 10 bp, Homo sapiens
ttccctgcaa

SEQ ID NO: 6570519 - DNA, 13 bp, Homo sapiens
ttccctgcacaca

SEQ ID NO: 6570520 - DNA, 15 bp, Homo sapiens
ttccctgcacacaca

SEQ ID NO: 6570521 - DNA, 11 bp, Homo sapiens
ttccctgcacc

SEQ ID NO: 6570522 - DNA, 12 bp, Homo sapiens
ttccctgcagct

SEQ ID NO: 6570523 - DNA, 18 bp, Homo sapiens
ttccctgcatatgcttct

SEQ ID NO: 6570524 - DNA, 21 bp, Homo sapiens
ttccctgcatatgcttctgat

SEQ ID NO: 6570525 - DNA, 19 bp, Homo sapiens
ttccctgcatttctgagtt

SEQ ID NO: 6570526 - DNA, 12 bp, Homo sapiens
ttccctgccaca

SEQ ID NO: 6570527 - DNA, 12 bp, Homo sapiens
ttccctgccact

SEQ ID NO: 6570528 - DNA, 19 bp, Homo sapiens
ttccctgccacttcaaccc

SEQ ID NO: 6570529 - DNA, 13 bp, Homo sapiens
ttccctgccaggc

SEQ ID NO: 6570530 - DNA, 19 bp, Homo sapiens
ttccctgccaggccctttg

SEQ ID NO: 6570531 - DNA, 10 bp, Homo sapiens
ttccctgccc

SEQ ID NO: 6570532 - DNA, 17 bp, Homo sapiens
ttccctgcccaaaccct

SEQ ID NO: 6570533 - DNA, 13 bp, Homo sapiens
ttccctgccccac

SEQ ID NO: 6570534 - DNA, 14 bp, Homo sapiens
ttccctgcccctgt

SEQ ID NO: 6570535 - DNA, 22 bp, Homo sapiens
ttccctgcccctgtgcctctgt

SEQ ID NO: 6570536 - DNA, 14 bp, Homo sapiens
ttccctgccctccc

SEQ ID NO: 6570537 - DNA, 21 bp, Homo sapiens
ttccctgcctccagctgtcag

SEQ ID NO: 6570538 - DNA, 23 bp, Homo sapiens
ttccctgcctctcatcaactgaa

SEQ ID NO: 6570539 - DNA, 17 bp, Homo sapiens
ttccctgcgcttcatct

SEQ ID NO: 6570540 - DNA, 12 bp, Homo sapiens
ttccctgctgcg

SEQ ID NO: 6570541 - DNA, 14 bp, Homo sapiens
ttccctgcttccag

SEQ ID NO: 6570542 - DNA, 16 bp, Homo sapiens
ttccctgcttccagga

SEQ ID NO: 6570543 - DNA, 12 bp, Homo sapiens
ttccctgctttg

SEQ ID NO: 6570544 - DNA, 19 bp, Homo sapiens
ttccctgcttttctcccag

SEQ ID NO: 6570545 - DNA, 21 bp, Homo sapiens
ttccctgcttttctcccagaa

SEQ ID NO: 6570546 - DNA, 19 bp, Homo sapiens
ttccctggaactcctggcc

SEQ ID NO: 6570547 - DNA, 16 bp, Homo sapiens
ttccctggaattcacc

SEQ ID NO: 6570548 - DNA, 12 bp, Homo sapiens
ttccctggacag

SEQ ID NO: 6570549 - DNA, 17 bp, Homo sapiens
ttccctggacaggcagc

SEQ ID NO: 6570550 - DNA, 20 bp, Homo sapiens
ttccctggacaggcagcctc

SEQ ID NO: 6570551 - DNA, 11 bp, Homo sapiens
ttccctggaga

SEQ ID NO: 6570552 - DNA, 20 bp, Homo sapiens
ttccctggagaccccagagt

SEQ ID NO: 6570553 - DNA, 16 bp, Homo sapiens
ttccctggaggagaag

SEQ ID NO: 6570554 - DNA, 20 bp, Homo sapiens
ttccctggcaggtggccagg

SEQ ID NO: 6570555 - DNA, 22 bp, Homo sapiens
ttccctggcatgatggacaaag

SEQ ID NO: 6570556 - DNA, 21 bp, Homo sapiens
ttccctggcctggctctcctg

SEQ ID NO: 6570557 - DNA, 11 bp, Homo sapiens
ttccctggctc

SEQ ID NO: 6570558 - DNA, 12 bp, Homo sapiens
ttccctgggaac

SEQ ID NO: 6570559 - DNA, 22 bp, Homo sapiens
ttccctgggaaccgccctcctg

SEQ ID NO: 6570560 - DNA, 12 bp, Homo sapiens
ttccctgggagg

SEQ ID NO: 6570561 - DNA, 20 bp, Homo sapiens
ttccctgggctgtgctacct

SEQ ID NO: 6570562 - DNA, 13 bp, Homo sapiens
ttccctggggagc

SEQ ID NO: 6570563 - DNA, 22 bp, Homo sapiens
ttccctggggagccctcaggct

SEQ ID NO: 6570564 - DNA, 17 bp, Homo sapiens
ttccctgggggcatcct

SEQ ID NO: 6570565 - DNA, 20 bp, Homo sapiens
ttccctgggggcatcctgct

SEQ ID NO: 6570566 - DNA, 12 bp, Homo sapiens
ttccctgggtgg

SEQ ID NO: 6570567 - DNA, 16 bp, Homo sapiens
ttccctggtgggcctc

SEQ ID NO: 6570568 - DNA, 15 bp, Homo sapiens
ttccctgtcagcctg

SEQ ID NO: 6570569 - DNA, 20 bp, Homo sapiens
ttccctgtctcttgaaaaat

SEQ ID NO: 6570570 - DNA, 12 bp, Homo sapiens
ttccctgtggat

SEQ ID NO: 6570571 - DNA, 14 bp, Homo sapiens
ttccctgtgtcttt

SEQ ID NO: 6570572 - DNA, 16 bp, Homo sapiens
ttccctgttctccctt

SEQ ID NO: 6570573 - DNA, 16 bp, Homo sapiens
ttcccttaacttttcc

SEQ ID NO: 6570574 - DNA, 22 bp, Homo sapiens
ttcccttaaggggtatcatgta

SEQ ID NO: 6570575 - DNA, 14 bp, Homo sapiens
ttcccttacaaggt

SEQ ID NO: 6570576 - DNA, 22 bp, Homo sapiens
ttcccttagactttagtagttt

SEQ ID NO: 6570577 - DNA, 15 bp, Homo sapiens
ttcccttagcctctc

SEQ ID NO: 6570578 - DNA, 22 bp, Homo sapiens
ttcccttagcctctcccacccg

SEQ ID NO: 6570579 - DNA, 21 bp, Homo sapiens
ttcccttagtgactcttgaag

SEQ ID NO: 6570580 - DNA, 15 bp, Homo sapiens
ttcccttatctttta

SEQ ID NO: 6570581 - DNA, 15 bp, Homo sapiens
ttcccttattactgc

SEQ ID NO: 6570582 - DNA, 22 bp, Homo sapiens
ttcccttcagtaccctctcagc

SEQ ID NO: 6570583 - DNA, 23 bp, Homo sapiens
ttcccttcagtaccctctcagct

SEQ ID NO: 6570584 - DNA, 11 bp, Homo sapiens
ttcccttccaa

SEQ ID NO: 6570585 - DNA, 13 bp, Homo sapiens
ttcccttccaaag

SEQ ID NO: 6570586 - DNA, 14 bp, Homo sapiens
ttcccttccaaaga

SEQ ID NO: 6570587 - DNA, 13 bp, Homo sapiens
ttcccttccactg

SEQ ID NO: 6570588 - DNA, 19 bp, Homo sapiens
ttcccttccactgcctctg

SEQ ID NO: 6570589 - DNA, 17 bp, Homo sapiens
ttcccttccatctcttc

SEQ ID NO: 6570590 - DNA, 13 bp, Homo sapiens
ttcccttcccaga

SEQ ID NO: 6570591 - DNA, 18 bp, Homo sapiens
ttcccttccctaaagtga

SEQ ID NO: 6570592 - DNA, 12 bp, Homo sapiens
ttcccttccctc

SEQ ID NO: 6570593 - DNA, 17 bp, Homo sapiens
ttcccttccggtgcgtg

SEQ ID NO: 6570594 - DNA, 11 bp, Homo sapiens
ttcccttcctc

SEQ ID NO: 6570595 - DNA, 15 bp, Homo sapiens
ttcccttcctccatt

SEQ ID NO: 6570596 - DNA, 17 bp, Homo sapiens
ttcccttcctccattgc

SEQ ID NO: 6570597 - DNA, 16 bp, Homo sapiens
ttcccttcctctgatt

SEQ ID NO: 6570598 - DNA, 15 bp, Homo sapiens
ttcccttcctctgtg

SEQ ID NO: 6570599 - DNA, 19 bp, Homo sapiens
ttcccttcctctgtgccac

SEQ ID NO: 6570600 - DNA, 14 bp, Homo sapiens
ttcccttcctgcca

SEQ ID NO: 6570601 - DNA, 17 bp, Homo sapiens
ttcccttcctgccctgt

SEQ ID NO: 6570602 - DNA, 14 bp, Homo sapiens
tttttgtacagtat

SEQ ID NO: 6570603 - DNA, 15 bp, Homo sapiens
tttttgtacagtatt

SEQ ID NO: 6570604 - DNA, 12 bp, Homo sapiens
tttttgtacatg

SEQ ID NO: 6570605 - DNA, 12 bp, Homo sapiens
tttttgtaccaa

SEQ ID NO: 6570606 - DNA, 14 bp, Homo sapiens
tttttgtaccattt

SEQ ID NO: 6570607 - DNA, 23 bp, Homo sapiens
tttttgtaccattttaaagttag

SEQ ID NO: 6570608 - DNA, 13 bp, Homo sapiens
tttttgtacttga

SEQ ID NO: 6570609 - DNA, 19 bp, Homo sapiens
tttttgtagagacagggtc

SEQ ID NO: 6570610 - DNA, 21 bp, Homo sapiens
tttttgtagagagagctgtat

SEQ ID NO: 6570611 - DNA, 17 bp, Homo sapiens
tttttgtagcactgaca

SEQ ID NO: 6570612 - DNA, 20 bp, Homo sapiens
tttttgtagcactgacagat

SEQ ID NO: 6570613 - DNA, 11 bp, Homo sapiens
tttttgtagta

SEQ ID NO: 6570614 - DNA, 21 bp, Homo sapiens
tttttgtataaaaaggaaatt

SEQ ID NO: 6570615 - DNA, 14 bp, Homo sapiens
tttttgtataaatg

SEQ ID NO: 6570616 - DNA, 14 bp, Homo sapiens
tttttgtatgtgtg

SEQ ID NO: 6570617 - DNA, 20 bp, Homo sapiens
tttttgtatgttatgaacat

SEQ ID NO: 6570618 - DNA, 15 bp, Homo sapiens
tttttgtattaacaa

SEQ ID NO: 6570619 - DNA, 14 bp, Homo sapiens
tttttgtatttctt

SEQ ID NO: 6570620 - DNA, 21 bp, Homo sapiens
tttttgtatttcttttatata

SEQ ID NO: 6570621 - DNA, 19 bp, Homo sapiens
tttttgtattttttcctta

SEQ ID NO: 6570622 - DNA, 17 bp, Homo sapiens
tttttgtcaaataaaat

SEQ ID NO: 6570623 - DNA, 18 bp, Homo sapiens
tttttgtcatgaactgta

SEQ ID NO: 6570624 - DNA, 14 bp, Homo sapiens
tttttgtcatttta

SEQ ID NO: 6570625 - DNA, 22 bp, Homo sapiens
tttttgtccatcttgtttcatt

SEQ ID NO: 6570626 - DNA, 14 bp, Homo sapiens
tttttgtgaaattc

SEQ ID NO: 6570627 - DNA, 20 bp, Homo sapiens
tttttgtggttttgagaaag

SEQ ID NO: 6570628 - DNA, 18 bp, Homo sapiens
tttttgtgtgtatttgct

SEQ ID NO: 6570629 - DNA, 13 bp, Homo sapiens
tttttgtgtttct

SEQ ID NO: 6570630 - DNA, 11 bp, Homo sapiens
tttttgttact

SEQ ID NO: 6570631 - DNA, 15 bp, Homo sapiens
tttttgttactgttt

SEQ ID NO: 6570632 - DNA, 23 bp, Homo sapiens
tttttgttcaccttctgtgcatc

SEQ ID NO: 6570633 - DNA, 20 bp, Homo sapiens
tttttgttcctgtgtattct

SEQ ID NO: 6570634 - DNA, 22 bp, Homo sapiens
tttttgttcttaattgcactct

SEQ ID NO: 6570635 - DNA, 13 bp, Homo sapiens
tttttgttctttt

SEQ ID NO: 6570636 - DNA, 12 bp, Homo sapiens
tttttgttgaca

SEQ ID NO: 6570637 - DNA, 14 bp, Homo sapiens
tttttgttggagtg

SEQ ID NO: 6570638 - DNA, 14 bp, Homo sapiens
tttttgttgtttaa

SEQ ID NO: 6570639 - DNA, 19 bp, Homo sapiens
tttttgttgttttgtagca

SEQ ID NO: 6570640 - DNA, 14 bp, Homo sapiens
tttttgtttggaga

SEQ ID NO: 6570641 - DNA, 15 bp, Homo sapiens
tttttgtttgtttgt

SEQ ID NO: 6570642 - DNA, 13 bp, Homo sapiens
tttttgttttcat

SEQ ID NO: 6570643 - DNA, 17 bp, Homo sapiens
tttttgttttgaaagtt

SEQ ID NO: 6570644 - DNA, 18 bp, Homo sapiens
tttttgttttgaaagttt

SEQ ID NO: 6570645 - DNA, 14 bp, Homo sapiens
tttttgtttttctg

SEQ ID NO: 6570646 - DNA, 13 bp, Homo sapiens
ttttttaaaaact

SEQ ID NO: 6570647 - DNA, 12 bp, Homo sapiens
ttttttaaaaat

SEQ ID NO: 6570648 - DNA, 13 bp, Homo sapiens
ttttttaaaagaa

SEQ ID NO: 6570649 - DNA, 23 bp, Homo sapiens
ttttttaaaccagggatgtctgt

SEQ ID NO: 6570650 - DNA, 23 bp, Homo sapiens
ttttttaaagaaaatgtgtctgc

SEQ ID NO: 6570651 - DNA, 16 bp, Homo sapiens
ttttttaaagaatcca

SEQ ID NO: 6570652 - DNA, 13 bp, Homo sapiens
ttttttaaagcaa

SEQ ID NO: 6570653 - DNA, 15 bp, Homo sapiens
ttttttaaataaact

SEQ ID NO: 6570654 - DNA, 16 bp, Homo sapiens
ttttttaaataaactt

SEQ ID NO: 6570655 - DNA, 23 bp, Homo sapiens
ttttttaacgtggcttgtagaat

SEQ ID NO: 6570656 - DNA, 15 bp, Homo sapiens
ttttttaactggtga

SEQ ID NO: 6570657 - DNA, 15 bp, Homo sapiens
ttttttaagcttcag

SEQ ID NO: 6570658 - DNA, 13 bp, Homo sapiens
ttttttaaggttt

SEQ ID NO: 6570659 - DNA, 12 bp, Homo sapiens
ttttttaagtga

SEQ ID NO: 6570660 - DNA, 17 bp, Homo sapiens
ttttttaagtgcaacat

SEQ ID NO: 6570661 - DNA, 15 bp, Homo sapiens
ttttttaatgtattc

SEQ ID NO: 6570662 - DNA, 16 bp, Homo sapiens
ttttttaatgtgctgt

SEQ ID NO: 6570663 - DNA, 12 bp, Homo sapiens
ttttttaattga

SEQ ID NO: 6570664 - DNA, 13 bp, Homo sapiens
ttttttacagatt

SEQ ID NO: 6570665 - DNA, 12 bp, Homo sapiens
ttttttacattt

SEQ ID NO: 6570666 - DNA, 17 bp, Homo sapiens
ttttttacggaattcca

SEQ ID NO: 6570667 - DNA, 19 bp, Homo sapiens
ttttttacggaattccaat

SEQ ID NO: 6570668 - DNA, 21 bp, Homo sapiens
ttttttacggaattccaatat

SEQ ID NO: 6570669 - DNA, 22 bp, Homo sapiens
ttttttactcattgaaatgtca

SEQ ID NO: 6570670 - DNA, 13 bp, Homo sapiens
ttttttactcttt

SEQ ID NO: 6570671 - DNA, 23 bp, Homo sapiens
ttttttagaaagcatttgaatgc

SEQ ID NO: 6570672 - DNA, 13 bp, Homo sapiens
ttttttagaacag

SEQ ID NO: 6570673 - DNA, 12 bp, Homo sapiens
ttttttaggaaa

SEQ ID NO: 6570674 - DNA, 23 bp, Homo sapiens
ttttttagtaagttaatgtatat

SEQ ID NO: 6570675 - DNA, 13 bp, Homo sapiens
ttttttataacaa

SEQ ID NO: 6570676 - DNA, 13 bp, Homo sapiens
ttttttatacatt

SEQ ID NO: 6570677 - DNA, 16 bp, Homo sapiens
ttttttatgctaatca

SEQ ID NO: 6570678 - DNA, 13 bp, Homo sapiens
ttttttatgtatt

SEQ ID NO: 6570679 - DNA, 13 bp, Homo sapiens
ttttttatgtgat

SEQ ID NO: 6570680 - DNA, 13 bp, Homo sapiens
ttttttattctgt

SEQ ID NO: 6570681 - DNA, 16 bp, Homo sapiens
ttttttattgtttaaa

SEQ ID NO: 6570682 - DNA, 13 bp, Homo sapiens
ttttttatttcca

SEQ ID NO: 6570683 - DNA, 18 bp, Homo sapiens
ttttttcaatatttatta

SEQ ID NO: 6570684 - DNA, 12 bp, Homo sapiens
ttttttcagttg

SEQ ID NO: 6570685 - DNA, 12 bp, Homo sapiens
ttttttcatagt

SEQ ID NO: 6570686 - DNA, 11 bp, Homo sapiens
ttttttcatct

SEQ ID NO: 6570687 - DNA, 13 bp, Homo sapiens
ttttttcatcttc

SEQ ID NO: 6570688 - DNA, 13 bp, Homo sapiens
ttttttcatttgt

SEQ ID NO: 6570689 - DNA, 19 bp, Homo sapiens
ttttttcattttgttctgt

SEQ ID NO: 6570690 - DNA, 16 bp, Homo sapiens
ttttttccacttttgt

SEQ ID NO: 6570691 - DNA, 22 bp, Homo sapiens
ttttttccacttttgttctact

SEQ ID NO: 6570692 - DNA, 11 bp, Homo sapiens
ttttttcctct

SEQ ID NO: 6570693 - DNA, 10 bp, Homo sapiens
ttttttcctt

SEQ ID NO: 6570694 - DNA, 14 bp, Homo sapiens
ttttttccttaaaa

SEQ ID NO: 6570695 - DNA, 12 bp, Homo sapiens
ttttttctaaga

SEQ ID NO: 6570696 - DNA, 11 bp, Homo sapiens
ttttttctacc

SEQ ID NO: 6570697 - DNA, 20 bp, Homo sapiens
ttttttctctctctctttgt

SEQ ID NO: 6570698 - DNA, 11 bp, Homo sapiens
ttttttctctt

SEQ ID NO: 6570699 - DNA, 12 bp, Homo sapiens
ttttttctgaat

SEQ ID NO: 6570700 - DNA, 12 bp, Homo sapiens
ttttttctgggt

SEQ ID NO: 6570701 - DNA, 12 bp, Homo sapiens
ttttttcttaag

SEQ ID NO: 6570702 - DNA, 13 bp, Homo sapiens
ttttttctttata

SEQ ID NO: 6570703 - DNA, 21 bp, Homo sapiens
ttttttctttgaaatgctaaa

SEQ ID NO: 6570704 - DNA, 13 bp, Homo sapiens
ttttttcttttta

SEQ ID NO: 6570705 - DNA, 20 bp, Homo sapiens
ttttttgaaacacaatacct

SEQ ID NO: 6570706 - DNA, 20 bp, Homo sapiens
ttttttgaaccaacatcttt

SEQ ID NO: 6570707 - DNA, 13 bp, Homo sapiens
ttttttgaaggtt

SEQ ID NO: 6570708 - DNA, 13 bp, Homo sapiens
ttttttgaagtgt

SEQ ID NO: 6570709 - DNA, 9 bp, Homo sapiens
ttttttgag

SEQ ID NO: 6570710 - DNA, 18 bp, Homo sapiens
ttttttgagtttattctg

SEQ ID NO: 6570711 - DNA, 16 bp, Homo sapiens
ttttttgatggctaag

SEQ ID NO: 6570712 - DNA, 13 bp, Homo sapiens
ttttttgattaat

SEQ ID NO: 6570713 - DNA, 23 bp, Homo sapiens
ttttttgattaatgaagaaagta

SEQ ID NO: 6570714 - DNA, 11 bp, Homo sapiens
ttttttggaga

SEQ ID NO: 6570715 - DNA, 12 bp, Homo sapiens
ttttttggctgt

SEQ ID NO: 6570716 - DNA, 21 bp, Homo sapiens
ttttttgggccattaccccat

SEQ ID NO: 6570717 - DNA, 13 bp, Homo sapiens
ttttttgggttaa

SEQ ID NO: 6570718 - DNA, 20 bp, Homo sapiens
ttttttgggttaaaagatgg

SEQ ID NO: 6570719 - DNA, 22 bp, Homo sapiens
ttttttggtgtgccctgtgtgt

SEQ ID NO: 6570720 - DNA, 18 bp, Homo sapiens
ttttttggttgtttgctg

SEQ ID NO: 6570721 - DNA, 13 bp, Homo sapiens
ttttttgtaacta

SEQ ID NO: 6570722 - DNA, 13 bp, Homo sapiens
ttttttgtaataa

SEQ ID NO: 6570723 - DNA, 12 bp, Homo sapiens
ttttttgtatag

SEQ ID NO: 6570724 - DNA, 21 bp, Homo sapiens
ttttttgtatagaccaaagca

SEQ ID NO: 6570725 - DNA, 15 bp, Homo sapiens
ttttttgtatagtta

SEQ ID NO: 6570726 - DNA, 12 bp, Homo sapiens
ttttttgtattt

SEQ ID NO: 6570727 - DNA, 14 bp, Homo sapiens
ttttttgtatttct

SEQ ID NO: 6570728 - DNA, 14 bp, Homo sapiens
ttttttgttactgt

SEQ ID NO: 6570729 - DNA, 12 bp, Homo sapiens
ttttttgttatt

SEQ ID NO: 6570730 - DNA, 12 bp, Homo sapiens
ttttttgttcaa

SEQ ID NO: 6570731 - DNA, 13 bp, Homo sapiens
ttttttgttcaat

SEQ ID NO: 6570732 - DNA, 12 bp, Homo sapiens
ttttttgttgtt

SEQ ID NO: 6570733 - DNA, 12 bp, Homo sapiens
ttttttgtttca

SEQ ID NO: 6570734 - DNA, 12 bp, Homo sapiens
ttttttgtttct

SEQ ID NO: 6570735 - DNA, 13 bp, Homo sapiens
ttttttgtttgtt

SEQ ID NO: 6570736 - DNA, 13 bp, Homo sapiens
tttttttaaaatc

SEQ ID NO: 6570737 - DNA, 13 bp, Homo sapiens
tttttttaaactt

SEQ ID NO: 6570738 - DNA, 13 bp, Homo sapiens
tttttttaactgt

SEQ ID NO: 6570739 - DNA, 13 bp, Homo sapiens
tttttttaagggc

SEQ ID NO: 6570740 - DNA, 14 bp, Homo sapiens
tttttttaagtgct

SEQ ID NO: 6570741 - DNA, 13 bp, Homo sapiens
tttttttaatgtg

SEQ ID NO: 6570742 - DNA, 12 bp, Homo sapiens
tttttttcaatg

SEQ ID NO: 6570743 - DNA, 13 bp, Homo sapiens
tttttttcaatgt

SEQ ID NO: 6570744 - DNA, 12 bp, Homo sapiens
tttttttcagtt

SEQ ID NO: 6570745 - DNA, 10 bp, Homo sapiens
tttttttcca

SEQ ID NO: 6570746 - DNA, 12 bp, Homo sapiens
tttttttccaaa

SEQ ID NO: 6570747 - DNA, 13 bp, Homo sapiens
tttttttccaatt

SEQ ID NO: 6570748 - DNA, 13 bp, Homo sapiens
tttttttccgtgt

SEQ ID NO: 6570749 - DNA, 10 bp, Homo sapiens
tttttttcct

SEQ ID NO: 6570750 - DNA, 12 bp, Homo sapiens
tttttttcctta

SEQ ID NO: 6570751 - DNA, 12 bp, Homo sapiens
tttttttctagc

SEQ ID NO: 6570752 - DNA, 13 bp, Homo sapiens
tttttttctgaat

SEQ ID NO: 6570753 - DNA, 12 bp, Homo sapiens
tttttttctgtc

SEQ ID NO: 6570754 - DNA, 13 bp, Homo sapiens
tttttttctgtga

SEQ ID NO: 6570755 - DNA, 11 bp, Homo sapiens
tttttttgcag

SEQ ID NO: 6570756 - DNA, 12 bp, Homo sapiens
tttttttgcagg

SEQ ID NO: 6570757 - DNA, 11 bp, Homo sapiens
tttttttgcat

SEQ ID NO: 6570758 - DNA, 13 bp, Homo sapiens
tttttttgctggt

SEQ ID NO: 6570759 - DNA, 10 bp, Homo sapiens
tttttttggt

SEQ ID NO: 6570760 - DNA, 13 bp, Homo sapiens
tttttttgtaata

SEQ ID NO: 6570761 - DNA, 13 bp, Homo sapiens
tttttttgtagct

SEQ ID NO: 6570762 - DNA, 13 bp, Homo sapiens
tttttttgtttgt

SEQ ID NO: 6570763 - DNA, 12 bp, Homo sapiens
ttttttttaaga

SEQ ID NO: 6570764 - DNA, 12 bp, Homo sapiens
ttttttttaagt

SEQ ID NO: 6570765 - DNA, 13 bp, Homo sapiens
ttttttttaatgt

SEQ ID NO: 6570766 - DNA, 12 bp, Homo sapiens
ttttttttcaaa

SEQ ID NO: 6570767 - DNA, 13 bp, Homo sapiens
ttttttttcaaaa

SEQ ID NO: 6570768 - DNA, 13 bp, Homo sapiens
ttttttttcccat

SEQ ID NO: 6570769 - DNA, 13 bp, Homo sapiens
ttttttttccgtg

SEQ ID NO: 6570770 - DNA, 12 bp, Homo sapiens
ttcccttcctgt

SEQ ID NO: 6570771 - DNA, 13 bp, Homo sapiens
ttcccttcctgtt

SEQ ID NO: 6570772 - DNA, 14 bp, Homo sapiens
ttcccttctatgca

SEQ ID NO: 6570773 - DNA, 15 bp, Homo sapiens
ttcccttctatgcag

SEQ ID NO: 6570774 - DNA, 17 bp, Homo sapiens
ttcccttctccccagcc

SEQ ID NO: 6570775 - DNA, 13 bp, Homo sapiens
ttcccttctccct

SEQ ID NO: 6570776 - DNA, 22 bp, Homo sapiens
ttcccttctctccttccctctt

SEQ ID NO: 6570777 - DNA, 16 bp, Homo sapiens
ttcccttctctggtct

SEQ ID NO: 6570778 - DNA, 14 bp, Homo sapiens
ttcccttctgggct

SEQ ID NO: 6570779 - DNA, 22 bp, Homo sapiens
ttcccttgaaactttgggaaaa

SEQ ID NO: 6570780 - DNA, 21 bp, Homo sapiens
ttcccttgagatgagtttctg

SEQ ID NO: 6570781 - DNA, 17 bp, Homo sapiens
ttcccttgattcaaata

SEQ ID NO: 6570782 - DNA, 20 bp, Homo sapiens
ttcccttgcaggggtccccc

SEQ ID NO: 6570783 - DNA, 22 bp, Homo sapiens
ttcccttgcaggggtcccccct

SEQ ID NO: 6570784 - DNA, 18 bp, Homo sapiens
ttcccttgccctttccat

SEQ ID NO: 6570785 - DNA, 16 bp, Homo sapiens
ttcccttgctcatgag

SEQ ID NO: 6570786 - DNA, 21 bp, Homo sapiens
ttcccttgctcatgagctcct

SEQ ID NO: 6570787 - DNA, 17 bp, Homo sapiens
ttcccttgcttttccct

SEQ ID NO: 6570788 - DNA, 20 bp, Homo sapiens
ttcccttgcttttccctctt

SEQ ID NO: 6570789 - DNA, 20 bp, Homo sapiens
ttcccttggaatgcatatcg

SEQ ID NO: 6570790 - DNA, 14 bp, Homo sapiens
ttcccttggaggga

SEQ ID NO: 6570791 - DNA, 16 bp, Homo sapiens
ttcccttggagggaga

SEQ ID NO: 6570792 - DNA, 11 bp, Homo sapiens
ttcccttggcc

SEQ ID NO: 6570793 - DNA, 14 bp, Homo sapiens
ttcccttggctgtt

SEQ ID NO: 6570794 - DNA, 19 bp, Homo sapiens
ttcccttgtagaaagtgag

SEQ ID NO: 6570795 - DNA, 16 bp, Homo sapiens
ttcccttgtagctcct

SEQ ID NO: 6570796 - DNA, 11 bp, Homo sapiens
ttcccttgtat

SEQ ID NO: 6570797 - DNA, 13 bp, Homo sapiens
ttcccttgtattt

SEQ ID NO: 6570798 - DNA, 23 bp, Homo sapiens
ttcccttgtgtcaagacatttct

SEQ ID NO: 6570799 - DNA, 18 bp, Homo sapiens
ttccctttacagctctcc

SEQ ID NO: 6570800 - DNA, 15 bp, Homo sapiens
ttccctttagctgtg

SEQ ID NO: 6570801 - DNA, 15 bp, Homo sapiens
ttccctttccccagc

SEQ ID NO: 6570802 - DNA, 14 bp, Homo sapiens
ttccctttcctttc

SEQ ID NO: 6570803 - DNA, 19 bp, Homo sapiens
ttccctttcttttcatgcc

SEQ ID NO: 6570804 - DNA, 15 bp, Homo sapiens
ttccctttgacttca

SEQ ID NO: 6570805 - DNA, 21 bp, Homo sapiens
ttccctttgacttcagctgcc

SEQ ID NO: 6570806 - DNA, 12 bp, Homo sapiens
ttccctttgcca

SEQ ID NO: 6570807 - DNA, 18 bp, Homo sapiens
ttccctttgccacactgt

SEQ ID NO: 6570808 - DNA, 18 bp, Homo sapiens
ttccctttgctccacccc

SEQ ID NO: 6570809 - DNA, 14 bp, Homo sapiens
ttccctttgcttgt

SEQ ID NO: 6570810 - DNA, 19 bp, Homo sapiens
ttccctttgcttgtcttct

SEQ ID NO: 6570811 - DNA, 15 bp, Homo sapiens
ttccctttgtgtatc

SEQ ID NO: 6570812 - DNA, 17 bp, Homo sapiens
ttccctttgttgctgtc

SEQ ID NO: 6570813 - DNA, 18 bp, Homo sapiens
ttcccttttacatactgc

SEQ ID NO: 6570814 - DNA, 13 bp, Homo sapiens
ttcccttttaggt

SEQ ID NO: 6570815 - DNA, 18 bp, Homo sapiens
ttcccttttccatcatct

SEQ ID NO: 6570816 - DNA, 16 bp, Homo sapiens
ttccctttttcataat

SEQ ID NO: 6570817 - DNA, 14 bp, Homo sapiens
ttcccttttttctt

SEQ ID NO: 6570818 - DNA, 22 bp, Homo sapiens
ttccgaagaagatgctccagca

SEQ ID NO: 6570819 - DNA, 15 bp, Homo sapiens
ttccgaagaattcca

SEQ ID NO: 6570820 - DNA, 16 bp, Homo sapiens
ttccgaagtctctgat

SEQ ID NO: 6570821 - DNA, 14 bp, Homo sapiens
ttccgaatctcttt

SEQ ID NO: 6570822 - DNA, 19 bp, Homo sapiens
ttccgacaccactgggaac

SEQ ID NO: 6570823 - DNA, 22 bp, Homo sapiens
ttccgacatcccagaccagcca

SEQ ID NO: 6570824 - DNA, 22 bp, Homo sapiens
ttccgactctttctgagtgcct

SEQ ID NO: 6570825 - DNA, 14 bp, Homo sapiens
ttccgactgcccag

SEQ ID NO: 6570826 - DNA, 15 bp, Homo sapiens
ttccgactgcccaga

SEQ ID NO: 6570827 - DNA, 20 bp, Homo sapiens
ttccgagacaccacaaggca

SEQ ID NO: 6570828 - DNA, 21 bp, Homo sapiens
ttccgagatccccagggcagc

SEQ ID NO: 6570829 - DNA, 17 bp, Homo sapiens
ttccgagcattccagta

SEQ ID NO: 6570830 - DNA, 14 bp, Homo sapiens
ttccgatcaacatt

SEQ ID NO: 6570831 - DNA, 17 bp, Homo sapiens
ttccgatcaacatttat

SEQ ID NO: 6570832 - DNA, 16 bp, Homo sapiens
ttccgatcgactgcca

SEQ ID NO: 6570833 - DNA, 21 bp, Homo sapiens
ttccgcacttcagaattccat

SEQ ID NO: 6570834 - DNA, 13 bp, Homo sapiens
ttccgcactttcc

SEQ ID NO: 6570835 - DNA, 15 bp, Homo sapiens
ttccgccactggggc

SEQ ID NO: 6570836 - DNA, 14 bp, Homo sapiens
ttccgccccttccc

SEQ ID NO: 6570837 - DNA, 18 bp, Homo sapiens
ttccgcgtggttctgcca

SEQ ID NO: 6570838 - DNA, 12 bp, Homo sapiens
ttccgctcccac

SEQ ID NO: 6570839 - DNA, 16 bp, Homo sapiens
ttccgctcctttacct

SEQ ID NO: 6570840 - DNA, 12 bp, Homo sapiens
ttccgctctggg

SEQ ID NO: 6570841 - DNA, 16 bp, Homo sapiens
ttccgctgtccgtcag

SEQ ID NO: 6570842 - DNA, 15 bp, Homo sapiens
ttccggctgagctgt

SEQ ID NO: 6570843 - DNA, 22 bp, Homo sapiens
ttccggctgagctgtgccagct

SEQ ID NO: 6570844 - DNA, 16 bp, Homo sapiens
ttccgggaactggagt

SEQ ID NO: 6570845 - DNA, 13 bp, Homo sapiens
ttccgggagctgg

SEQ ID NO: 6570846 - DNA, 19 bp, Homo sapiens
ttccgggaggcagagagga

SEQ ID NO: 6570847 - DNA, 15 bp, Homo sapiens
ttccggggagaaacc

SEQ ID NO: 6570848 - DNA, 21 bp, Homo sapiens
ttccggggagaaacccagaga

SEQ ID NO: 6570849 - DNA, 15 bp, Homo sapiens
ttccggggccatggg

SEQ ID NO: 6570850 - DNA, 17 bp, Homo sapiens
ttccggtagggaggcag

SEQ ID NO: 6570851 - DNA, 21 bp, Homo sapiens
ttccggtagggaggcagcctc

SEQ ID NO: 6570852 - DNA, 16 bp, Homo sapiens
ttccgtagactgttta

SEQ ID NO: 6570853 - DNA, 18 bp, Homo sapiens
ttccgtagccagctgctc

SEQ ID NO: 6570854 - DNA, 18 bp, Homo sapiens
ttccgtatttaaagttgt

SEQ ID NO: 6570855 - DNA, 19 bp, Homo sapiens
ttccgtcaaaattggattt

SEQ ID NO: 6570856 - DNA, 21 bp, Homo sapiens
ttccgtcaccacgactggcca

SEQ ID NO: 6570857 - DNA, 15 bp, Homo sapiens
ttccgtcacccttgg

SEQ ID NO: 6570858 - DNA, 15 bp, Homo sapiens
ttccgtcacttaaat

SEQ ID NO: 6570859 - DNA, 17 bp, Homo sapiens
ttccgtcagaaagtgta

SEQ ID NO: 6570860 - DNA, 13 bp, Homo sapiens
ttccgtccatccc

SEQ ID NO: 6570861 - DNA, 15 bp, Homo sapiens
ttccgtcccccccca

SEQ ID NO: 6570862 - DNA, 14 bp, Homo sapiens
ttccgtctcctctc

SEQ ID NO: 6570863 - DNA, 16 bp, Homo sapiens
ttccgtctcctctcca

SEQ ID NO: 6570864 - DNA, 16 bp, Homo sapiens
ttccgtgaagggcacc

SEQ ID NO: 6570865 - DNA, 17 bp, Homo sapiens
ttccgtgagacacaaga

SEQ ID NO: 6570866 - DNA, 17 bp, Homo sapiens
ttccgtgagctcaaact

SEQ ID NO: 6570867 - DNA, 16 bp, Homo sapiens
ttccgtgcatcccaga

SEQ ID NO: 6570868 - DNA, 19 bp, Homo sapiens
ttccgtgggaccctcagca

SEQ ID NO: 6570869 - DNA, 20 bp, Homo sapiens
ttccgtgggaccctcagcag

SEQ ID NO: 6570870 - DNA, 17 bp, Homo sapiens
ttccgtgggtcatccca

SEQ ID NO: 6570871 - DNA, 21 bp, Homo sapiens
ttccgtgggtcatcccagcac

SEQ ID NO: 6570872 - DNA, 21 bp, Homo sapiens
ttccgtggtcagagtgccact

SEQ ID NO: 6570873 - DNA, 19 bp, Homo sapiens
ttccgtgtcctctccccca

SEQ ID NO: 6570874 - DNA, 18 bp, Homo sapiens
ttccgtgtggccctttgg

SEQ ID NO: 6570875 - DNA, 16 bp, Homo sapiens
ttccgttaaaatacca

SEQ ID NO: 6570876 - DNA, 23 bp, Homo sapiens
ttccgttaacctttttgtaaata

SEQ ID NO: 6570877 - DNA, 16 bp, Homo sapiens
ttccgttcatctgagg

SEQ ID NO: 6570878 - DNA, 15 bp, Homo sapiens
ttccgttcattgctc

SEQ ID NO: 6570879 - DNA, 18 bp, Homo sapiens
ttccgttcattgctctcc

SEQ ID NO: 6570880 - DNA, 16 bp, Homo sapiens
ttccgttctgttctgc

SEQ ID NO: 6570881 - DNA, 20 bp, Homo sapiens
ttccgttggaaagaacattt

SEQ ID NO: 6570882 - DNA, 15 bp, Homo sapiens
ttccgtttgcttttg

SEQ ID NO: 6570883 - DNA, 17 bp, Homo sapiens
ttcctaaaactctgcca

SEQ ID NO: 6570884 - DNA, 19 bp, Homo sapiens
ttcctaaaactctgccagc

SEQ ID NO: 6570885 - DNA, 13 bp, Homo sapiens
ttcctaaaatgct

SEQ ID NO: 6570886 - DNA, 16 bp, Homo sapiens
ttcctaaacataattg

SEQ ID NO: 6570887 - DNA, 16 bp, Homo sapiens
ttcctaaacccaatga

SEQ ID NO: 6570888 - DNA, 20 bp, Homo sapiens
ttcctaaagtctctgctgct

SEQ ID NO: 6570889 - DNA, 16 bp, Homo sapiens
ttcctaaatattatga

SEQ ID NO: 6570890 - DNA, 18 bp, Homo sapiens
ttcctaaatattatgaga

SEQ ID NO: 6570891 - DNA, 18 bp, Homo sapiens
ttcctaaattttcctgtc

SEQ ID NO: 6570892 - DNA, 21 bp, Homo sapiens
ttcctaaattttcctgtcctc

SEQ ID NO: 6570893 - DNA, 14 bp, Homo sapiens
ttcctaacacagca

SEQ ID NO: 6570894 - DNA, 22 bp, Homo sapiens
ttcctaacctgtcagaataata

SEQ ID NO: 6570895 - DNA, 17 bp, Homo sapiens
ttcctaactagaattag

SEQ ID NO: 6570896 - DNA, 15 bp, Homo sapiens
ttcctaactgttttg

SEQ ID NO: 6570897 - DNA, 21 bp, Homo sapiens
ttcctaacttacccagatgtt

SEQ ID NO: 6570898 - DNA, 14 bp, Homo sapiens
ttcctaacttttca

SEQ ID NO: 6570899 - DNA, 16 bp, Homo sapiens
ttcctaagaagcttct

SEQ ID NO: 6570900 - DNA, 13 bp, Homo sapiens
ttcctaagacatt

SEQ ID NO: 6570901 - DNA, 14 bp, Homo sapiens
ttcctaagacattt

SEQ ID NO: 6570902 - DNA, 15 bp, Homo sapiens
ttcctaagacatttt

SEQ ID NO: 6570903 - DNA, 17 bp, Homo sapiens
ttcctaagacatttttc

SEQ ID NO: 6570904 - DNA, 19 bp, Homo sapiens
ttcctaagacatttttcat

SEQ ID NO: 6570905 - DNA, 20 bp, Homo sapiens
ttcctaagacatttttcatt

SEQ ID NO: 6570906 - DNA, 18 bp, Homo sapiens
ttcctaagacctggggtt

SEQ ID NO: 6570907 - DNA, 21 bp, Homo sapiens
ttcctaagccacttgaaatgt

SEQ ID NO: 6570908 - DNA, 20 bp, Homo sapiens
ttcctaagcctgttgctgaa

SEQ ID NO: 6570909 - DNA, 13 bp, Homo sapiens
ttcctaagctgtt

SEQ ID NO: 6570910 - DNA, 19 bp, Homo sapiens
ttcctaaggcccagctgcc

SEQ ID NO: 6570911 - DNA, 17 bp, Homo sapiens
ttcctaagtataaatgg

SEQ ID NO: 6570912 - DNA, 19 bp, Homo sapiens
ttcctaagttcccttctat

SEQ ID NO: 6570913 - DNA, 14 bp, Homo sapiens
ttcctaagttctta

SEQ ID NO: 6570914 - DNA, 19 bp, Homo sapiens
ttcctaataaagttctgta

SEQ ID NO: 6570915 - DNA, 20 bp, Homo sapiens
ttcctaatcactcagagcag

SEQ ID NO: 6570916 - DNA, 15 bp, Homo sapiens
ttcctaatcctctag

SEQ ID NO: 6570917 - DNA, 17 bp, Homo sapiens
ttcctaatcctctagga

SEQ ID NO: 6570918 - DNA, 16 bp, Homo sapiens
ttcctaattccacagc

SEQ ID NO: 6570919 - DNA, 17 bp, Homo sapiens
ttcctaattccacagct

SEQ ID NO: 6570920 - DNA, 14 bp, Homo sapiens
ttcctaattttagt

SEQ ID NO: 6570921 - DNA, 15 bp, Homo sapiens
ttcctacaaaatgga

SEQ ID NO: 6570922 - DNA, 21 bp, Homo sapiens
ttcctacaactaaaaataaat

SEQ ID NO: 6570923 - DNA, 19 bp, Homo sapiens
ttcctacaacttaatggaa

SEQ ID NO: 6570924 - DNA, 17 bp, Homo sapiens
ttcctacaagttaacca

SEQ ID NO: 6570925 - DNA, 17 bp, Homo sapiens
ttcctacacaggacagg

SEQ ID NO: 6570926 - DNA, 18 bp, Homo sapiens
ttcctacacccttggact

SEQ ID NO: 6570927 - DNA, 22 bp, Homo sapiens
ttcctacagaaatactgctctg

SEQ ID NO: 6570928 - DNA, 14 bp, Homo sapiens
ttcctacagcacta

SEQ ID NO: 6570929 - DNA, 12 bp, Homo sapiens
ttcctacagccc

SEQ ID NO: 6570930 - DNA, 22 bp, Homo sapiens
ttcctacaggagatagctttct

SEQ ID NO: 6570931 - DNA, 17 bp, Homo sapiens
ttcctacaggcagtctc

SEQ ID NO: 6570932 - DNA, 18 bp, Homo sapiens
ttcctacaggcagtctct

SEQ ID NO: 6570933 - DNA, 21 bp, Homo sapiens
ttcctacaggcctatttaaca

SEQ ID NO: 6570934 - DNA, 18 bp, Homo sapiens
ttcctacatcggaatcca

SEQ ID NO: 6570935 - DNA, 20 bp, Homo sapiens
ttcctacatcttcttcccag

SEQ ID NO: 6570936 - DNA, 14 bp, Homo sapiens
ttcctacattttct

SEQ ID NO: 6570937 - DNA, 16 bp, Homo sapiens
ttcctacccaaccact

SEQ ID NO: 6570938 - DNA, 17 bp, Homo sapiens
ttcctacccaaccactc

SEQ ID NO: 6570939 - DNA, 23 bp, Homo sapiens
ttcctacccacttaggctttgta

SEQ ID NO: 6570940 - DNA, 20 bp, Homo sapiens
ttcctaccgtactccctgca

SEQ ID NO: 6570941 - DNA, 13 bp, Homo sapiens
ttcctacctccct

SEQ ID NO: 6570942 - DNA, 16 bp, Homo sapiens
ttcctacctccctgca

SEQ ID NO: 6570943 - DNA, 17 bp, Homo sapiens
ttcctacggtacaagct

SEQ ID NO: 6570944 - DNA, 21 bp, Homo sapiens
ttcctactccgttcctggcat

SEQ ID NO: 6570945 - DNA, 19 bp, Homo sapiens
ttcctactcttctctctgc

SEQ ID NO: 6570946 - DNA, 20 bp, Homo sapiens
ttcctactcttctctctgct

SEQ ID NO: 6570947 - DNA, 21 bp, Homo sapiens
ttcctactcttctctctgctc

SEQ ID NO: 6570948 - DNA, 17 bp, Homo sapiens
ttcctactgtcctcaga

SEQ ID NO: 6570949 - DNA, 15 bp, Homo sapiens
ttcctactgtcctgg

SEQ ID NO: 6570950 - DNA, 18 bp, Homo sapiens
aagcatgtattcagcttt

SEQ ID NO: 6570951 - DNA, 16 bp, Homo sapiens
aagcatgtctctgctt

SEQ ID NO: 6570952 - DNA, 19 bp, Homo sapiens
aagcatgtctctgcttcca

SEQ ID NO: 6570953 - DNA, 21 bp, Homo sapiens
aagcatgtggatgacacaatc

SEQ ID NO: 6570954 - DNA, 23 bp, Homo sapiens
aagcatgtggtcttatagtgttt

SEQ ID NO: 6570955 - DNA, 13 bp, Homo sapiens
aagcatgtgtcat

SEQ ID NO: 6570956 - DNA, 17 bp, Homo sapiens
aagcatgtgtcatgcat

SEQ ID NO: 6570957 - DNA, 15 bp, Homo sapiens
aagcatgtgtttgca

SEQ ID NO: 6570958 - DNA, 14 bp, Homo sapiens
aagcatgttttgca

SEQ ID NO: 6570959 - DNA, 17 bp, Homo sapiens
aagcatgttttgcatgt

SEQ ID NO: 6570960 - DNA, 12 bp, Homo sapiens
aagcattaaaaa

SEQ ID NO: 6570961 - DNA, 17 bp, Homo sapiens
aagcattactcttgtaa

SEQ ID NO: 6570962 - DNA, 19 bp, Homo sapiens
aagcattactcttgtaaga

SEQ ID NO: 6570963 - DNA, 20 bp, Homo sapiens
aagcattactcttgtaagat

SEQ ID NO: 6570964 - DNA, 23 bp, Homo sapiens
aagcattactcttgtaagatttt

SEQ ID NO: 6570965 - DNA, 15 bp, Homo sapiens
aagcattactttaac

SEQ ID NO: 6570966 - DNA, 23 bp, Homo sapiens
aagcattactttaacctccctca

SEQ ID NO: 6570967 - DNA, 14 bp, Homo sapiens
aagcattactttat

SEQ ID NO: 6570968 - DNA, 12 bp, Homo sapiens
aagcattagcac

SEQ ID NO: 6570969 - DNA, 21 bp, Homo sapiens
aagcattcaatttattcaaga

SEQ ID NO: 6570970 - DNA, 22 bp, Homo sapiens
aagcattcaatttattcaagaa

SEQ ID NO: 6570971 - DNA, 12 bp, Homo sapiens
aagcattcacaa

SEQ ID NO: 6570972 - DNA, 21 bp, Homo sapiens
aagcattcagaagaaaaagaa

SEQ ID NO: 6570973 - DNA, 17 bp, Homo sapiens
aagcattccacactgca

SEQ ID NO: 6570974 - DNA, 23 bp, Homo sapiens
aagcattccacactgcagggagg

SEQ ID NO: 6570975 - DNA, 18 bp, Homo sapiens
aagcattccttctttgat

SEQ ID NO: 6570976 - DNA, 17 bp, Homo sapiens
aagcattctcattggaa

SEQ ID NO: 6570977 - DNA, 18 bp, Homo sapiens
aagcattctcattggaaa

SEQ ID NO: 6570978 - DNA, 18 bp, Homo sapiens
aagcattctccccagtgt

SEQ ID NO: 6570979 - DNA, 18 bp, Homo sapiens
aagcattctgagctgggc

SEQ ID NO: 6570980 - DNA, 13 bp, Homo sapiens
aagcattctgtct

SEQ ID NO: 6570981 - DNA, 23 bp, Homo sapiens
aagcattctgtgcataaaagtta

SEQ ID NO: 6570982 - DNA, 12 bp, Homo sapiens
aagcattcttag

SEQ ID NO: 6570983 - DNA, 14 bp, Homo sapiens
aagcattgaaaaca

SEQ ID NO: 6570984 - DNA, 21 bp, Homo sapiens
aagcattgaaaacaaagacat

SEQ ID NO: 6570985 - DNA, 14 bp, Homo sapiens
aagcattgaaatta

SEQ ID NO: 6570986 - DNA, 13 bp, Homo sapiens
aagcattgaatgg

SEQ ID NO: 6570987 - DNA, 12 bp, Homo sapiens
aagcattgaatt

SEQ ID NO: 6570988 - DNA, 17 bp, Homo sapiens
aagcattgcctggactg

SEQ ID NO: 6570989 - DNA, 20 bp, Homo sapiens
aagcattgcctggactgacc

SEQ ID NO: 6570990 - DNA, 14 bp, Homo sapiens
aagcattgcctggc

SEQ ID NO: 6570991 - DNA, 17 bp, Homo sapiens
aagcattgtaaaataat

SEQ ID NO: 6570992 - DNA, 18 bp, Homo sapiens
aagcattgtaaaataatt

SEQ ID NO: 6570993 - DNA, 18 bp, Homo sapiens
aagcattgtaaatgtgct

SEQ ID NO: 6570994 - DNA, 13 bp, Homo sapiens
aagcattgtctct

SEQ ID NO: 6570995 - DNA, 15 bp, Homo sapiens
aagcattgtctctct

SEQ ID NO: 6570996 - DNA, 17 bp, Homo sapiens
aagcatttaaaagagta

SEQ ID NO: 6570997 - DNA, 13 bp, Homo sapiens
aagcatttaaagg

SEQ ID NO: 6570998 - DNA, 20 bp, Homo sapiens
aagcatttaatgtagccatg

SEQ ID NO: 6570999 - DNA, 16 bp, Homo sapiens
aagcatttactttgaa

SEQ ID NO: 6571000 - DNA, 13 bp, Homo sapiens
aagcatttcaaag

SEQ ID NO: 6571001 - DNA, 11 bp, Homo sapiens
aagcatttcat

SEQ ID NO: 6571002 - DNA, 21 bp, Homo sapiens
aagcatttcatgaaaaagctg

SEQ ID NO: 6571003 - DNA, 23 bp, Homo sapiens
aagcatttcatgaaaaagctgct

SEQ ID NO: 6571004 - DNA, 12 bp, Homo sapiens
aagcatttccag

SEQ ID NO: 6571005 - DNA, 12 bp, Homo sapiens
aagcatttgaat

SEQ ID NO: 6571006 - DNA, 18 bp, Homo sapiens
aagcatttgaatgcattt

SEQ ID NO: 6571007 - DNA, 22 bp, Homo sapiens
aagcatttgtactaagctcctc

SEQ ID NO: 6571008 - DNA, 12 bp, Homo sapiens
aagcatttgtat

SEQ ID NO: 6571009 - DNA, 21 bp, Homo sapiens
aagcattttactgtctgtaag

SEQ ID NO: 6571010 - DNA, 19 bp, Homo sapiens
aagcattttataaatcgct

SEQ ID NO: 6571011 - DNA, 15 bp, Homo sapiens
aagcattttctcaga

SEQ ID NO: 6571012 - DNA, 17 bp, Homo sapiens
aagcattttgaaacaaa

SEQ ID NO: 6571013 - DNA, 20 bp, Homo sapiens
aagcattttgaaacaaagta

SEQ ID NO: 6571014 - DNA, 13 bp, Homo sapiens
aagcattttgcaa

SEQ ID NO: 6571015 - DNA, 12 bp, Homo sapiens
aagcattttgta

SEQ ID NO: 6571016 - DNA, 19 bp, Homo sapiens
aagcattttgtaagttgaa

SEQ ID NO: 6571017 - DNA, 17 bp, Homo sapiens
aagcattttgtaataat

SEQ ID NO: 6571018 - DNA, 23 bp, Homo sapiens
aagcatttttattatatttatgt

SEQ ID NO: 6571019 - DNA, 20 bp, Homo sapiens
aagcatttttccatctgtgt

SEQ ID NO: 6571020 - DNA, 17 bp, Homo sapiens
aagccaaaaaccttagc

SEQ ID NO: 6571021 - DNA, 14 bp, Homo sapiens
aagccaaaataaga

SEQ ID NO: 6571022 - DNA, 17 bp, Homo sapiens
aagccaaaataagacta

SEQ ID NO: 6571023 - DNA, 14 bp, Homo sapiens
aagccaaaattaag

SEQ ID NO: 6571024 - DNA, 17 bp, Homo sapiens
aagccaaaattaaggtg

SEQ ID NO: 6571025 - DNA, 22 bp, Homo sapiens
aagccaaaattaaggtgtttga

SEQ ID NO: 6571026 - DNA, 17 bp, Homo sapiens
aagccaaacctctgtga

SEQ ID NO: 6571027 - DNA, 20 bp, Homo sapiens
aagccaaactgttggaagtt

SEQ ID NO: 6571028 - DNA, 11 bp, Homo sapiens
aagccaaagaa

SEQ ID NO: 6571029 - DNA, 15 bp, Homo sapiens
aagccaaagaaaaat

SEQ ID NO: 6571030 - DNA, 21 bp, Homo sapiens
aagccaaagaaaaataaccct

SEQ ID NO: 6571031 - DNA, 15 bp, Homo sapiens
aagccaaagaaatga

SEQ ID NO: 6571032 - DNA, 22 bp, Homo sapiens
aagccaaagaaatgaacattcc

SEQ ID NO: 6571033 - DNA, 16 bp, Homo sapiens
aagccaaagagactgg

SEQ ID NO: 6571034 - DNA, 13 bp, Homo sapiens
aagccaaagccaa

SEQ ID NO: 6571035 - DNA, 15 bp, Homo sapiens
aagccaaaggcagct

SEQ ID NO: 6571036 - DNA, 22 bp, Homo sapiens
aagccaaaggtcaaacaggctg

SEQ ID NO: 6571037 - DNA, 16 bp, Homo sapiens
aagccaaagtttctgt

SEQ ID NO: 6571038 - DNA, 19 bp, Homo sapiens
aagccaaagtttctgttga

SEQ ID NO: 6571039 - DNA, 23 bp, Homo sapiens
aagccaaagttttcaaactgctg

SEQ ID NO: 6571040 - DNA, 15 bp, Homo sapiens
aagccaaatttatat

SEQ ID NO: 6571041 - DNA, 17 bp, Homo sapiens
aagccaacagtcaaaac

SEQ ID NO: 6571042 - DNA, 15 bp, Homo sapiens
aagccaaccagcctt

SEQ ID NO: 6571043 - DNA, 22 bp, Homo sapiens
aagccaagaagtgaggcctggg

SEQ ID NO: 6571044 - DNA, 13 bp, Homo sapiens
aagccaagaattg

SEQ ID NO: 6571045 - DNA, 18 bp, Homo sapiens
aagccaagaggctgcagc

SEQ ID NO: 6571046 - DNA, 13 bp, Homo sapiens
aagccaagcagcc

SEQ ID NO: 6571047 - DNA, 17 bp, Homo sapiens
aagccaagcagccaagc

SEQ ID NO: 6571048 - DNA, 16 bp, Homo sapiens
aagccaagccctccgc

SEQ ID NO: 6571049 - DNA, 17 bp, Homo sapiens
aagccaagctagaagga

SEQ ID NO: 6571050 - DNA, 12 bp, Homo sapiens
aagccaagctgt

SEQ ID NO: 6571051 - DNA, 10 bp, Homo sapiens
aagccaaggg

SEQ ID NO: 6571052 - DNA, 18 bp, Homo sapiens
aagccaagggaacctgtg

SEQ ID NO: 6571053 - DNA, 20 bp, Homo sapiens
aagccaagggaacctgtgtc

SEQ ID NO: 6571054 - DNA, 13 bp, Homo sapiens
aagccaagggcct

SEQ ID NO: 6571055 - DNA, 21 bp, Homo sapiens
aagccaaggtgtcatttatgt

SEQ ID NO: 6571056 - DNA, 15 bp, Homo sapiens
aagccaagtgtcctg

SEQ ID NO: 6571057 - DNA, 19 bp, Homo sapiens
aagccaataaataatatta

SEQ ID NO: 6571058 - DNA, 17 bp, Homo sapiens
aagccaataacacacag

SEQ ID NO: 6571059 - DNA, 14 bp, Homo sapiens
aagccaatcccctc

SEQ ID NO: 6571060 - DNA, 20 bp, Homo sapiens
aagccaatcccctccttggg

SEQ ID NO: 6571061 - DNA, 18 bp, Homo sapiens
aagccaatttttctgcac

SEQ ID NO: 6571062 - DNA, 21 bp, Homo sapiens
aagccaatttttctgcactga

SEQ ID NO: 6571063 - DNA, 15 bp, Homo sapiens
aagccacaagaaatt

SEQ ID NO: 6571064 - DNA, 15 bp, Homo sapiens
aagccacaaggctgg

SEQ ID NO: 6571065 - DNA, 18 bp, Homo sapiens
aagccacaaggctggcca

SEQ ID NO: 6571066 - DNA, 14 bp, Homo sapiens
aagccacacagccc

SEQ ID NO: 6571067 - DNA, 17 bp, Homo sapiens
aagccacacagcccaga

SEQ ID NO: 6571068 - DNA, 15 bp, Homo sapiens
aagccacactttgaa

SEQ ID NO: 6571069 - DNA, 11 bp, Homo sapiens
aagccacagaa

SEQ ID NO: 6571070 - DNA, 20 bp, Homo sapiens
aagccacagcagagcattgt

SEQ ID NO: 6571071 - DNA, 13 bp, Homo sapiens
aagccacagcctg

SEQ ID NO: 6571072 - DNA, 14 bp, Homo sapiens
aagccacagctggt

SEQ ID NO: 6571073 - DNA, 21 bp, Homo sapiens
aagccacaggaaggaggggag

SEQ ID NO: 6571074 - DNA, 15 bp, Homo sapiens
aagccacaggcctga

SEQ ID NO: 6571075 - DNA, 17 bp, Homo sapiens
aagccacaggcctgaga

SEQ ID NO: 6571076 - DNA, 23 bp, Homo sapiens
aagccacaggcctgagatttcat

SEQ ID NO: 6571077 - DNA, 17 bp, Homo sapiens
aagccacaggcctggcc

SEQ ID NO: 6571078 - DNA, 19 bp, Homo sapiens
aagccacatcgttgagaca

SEQ ID NO: 6571079 - DNA, 22 bp, Homo sapiens
aagccacatcgttgagacatca

SEQ ID NO: 6571080 - DNA, 11 bp, Homo sapiens
aagccacatct

SEQ ID NO: 6571081 - DNA, 14 bp, Homo sapiens
aagccaccaacagc

SEQ ID NO: 6571082 - DNA, 19 bp, Homo sapiens
aagccaccaacatactccc

SEQ ID NO: 6571083 - DNA, 13 bp, Homo sapiens
aagccaccacaca

SEQ ID NO: 6571084 - DNA, 16 bp, Homo sapiens
aagccacccaaagcag

SEQ ID NO: 6571085 - DNA, 19 bp, Homo sapiens
aagccaccctaccatgaat

SEQ ID NO: 6571086 - DNA, 23 bp, Homo sapiens
aagccaccctgggctacagaaac

SEQ ID NO: 6571087 - DNA, 12 bp, Homo sapiens
aagccacccttc

SEQ ID NO: 6571088 - DNA, 15 bp, Homo sapiens
aagccacccttccct

SEQ ID NO: 6571089 - DNA, 16 bp, Homo sapiens
aagccacccttccctg

SEQ ID NO: 6571090 - DNA, 24 bp, Homo sapiens
aagccacccttccctgcctccagc

SEQ ID NO: 6571091 - DNA, 13 bp, Homo sapiens
aagccaccgcagc

SEQ ID NO: 6571092 - DNA, 16 bp, Homo sapiens
aagccaccgggagatt

SEQ ID NO: 6571093 - DNA, 17 bp, Homo sapiens
aagccacctctccctca

SEQ ID NO: 6571094 - DNA, 22 bp, Homo sapiens
aagccacctctctgcctgttcc

SEQ ID NO: 6571095 - DNA, 23 bp, Homo sapiens
aagccaccttccagtgagctctg

SEQ ID NO: 6571096 - DNA, 16 bp, Homo sapiens
aagccacgctgtcctc

SEQ ID NO: 6571097 - DNA, 16 bp, Homo sapiens
aagccacgctgtgtcc

SEQ ID NO: 6571098 - DNA, 20 bp, Homo sapiens
aagccacgtgctggagagta

SEQ ID NO: 6571099 - DNA, 21 bp, Homo sapiens
aagccacgtgctggagagtag

SEQ ID NO: 6571100 - DNA, 17 bp, Homo sapiens
aagccactagactcttc

SEQ ID NO: 6571101 - DNA, 23 bp, Homo sapiens
aagccactagcccactccccagt

SEQ ID NO: 6571102 - DNA, 19 bp, Homo sapiens
aagccactatgtccagcta

SEQ ID NO: 6571103 - DNA, 20 bp, Homo sapiens
aagccactatgtccagctag

SEQ ID NO: 6571104 - DNA, 19 bp, Homo sapiens
aagccactctgtcccttcc

SEQ ID NO: 6571105 - DNA, 18 bp, Homo sapiens
aagccactggaaggagca

SEQ ID NO: 6571106 - DNA, 19 bp, Homo sapiens
aagccactggaaggagcac

SEQ ID NO: 6571107 - DNA, 21 bp, Homo sapiens
aagccactggaaggagcacat

SEQ ID NO: 6571108 - DNA, 17 bp, Homo sapiens
aagccactgttacattt

SEQ ID NO: 6571109 - DNA, 18 bp, Homo sapiens
aagccacttaaaatgttc

SEQ ID NO: 6571110 - DNA, 22 bp, Homo sapiens
aagccagaacctcagaggccac

SEQ ID NO: 6571111 - DNA, 13 bp, Homo sapiens
aagccagaagctg

SEQ ID NO: 6571112 - DNA, 20 bp, Homo sapiens
aagccagaagctgagcacca

SEQ ID NO: 6571113 - DNA, 20 bp, Homo sapiens
aagccagaatattctaacct

SEQ ID NO: 6571114 - DNA, 15 bp, Homo sapiens
aagccagacaacttc

SEQ ID NO: 6571115 - DNA, 23 bp, Homo sapiens
aagccagacaacttctgtttctt

SEQ ID NO: 6571116 - DNA, 11 bp, Homo sapiens
aagccagacag

SEQ ID NO: 6571117 - DNA, 20 bp, Homo sapiens
aagccagacctagcaggctg

SEQ ID NO: 6571118 - DNA, 14 bp, Homo sapiens
aagccagaggagaa

SEQ ID NO: 6571119 - DNA, 20 bp, Homo sapiens
aagccagaggagaagacaac

SEQ ID NO: 6571120 - DNA, 14 bp, Homo sapiens
aagccagaggctgg

SEQ ID NO: 6571121 - DNA, 18 bp, Homo sapiens
aagccagagggtgggagg

SEQ ID NO: 6571122 - DNA, 17 bp, Homo sapiens
aagccagattctcttga

SEQ ID NO: 6571123 - DNA, 13 bp, Homo sapiens
aagccagattttc

SEQ ID NO: 6571124 - DNA, 20 bp, Homo sapiens
aagccagcaaagcctccagc

SEQ ID NO: 6571125 - DNA, 21 bp, Homo sapiens
aagccagcaaagcctccagca

SEQ ID NO: 6571126 - DNA, 17 bp, Homo sapiens
aagccagcaccggacca

SEQ ID NO: 6571127 - DNA, 18 bp, Homo sapiens
aagccagcaggctctcag

SEQ ID NO: 6571128 - DNA, 10 bp, Homo sapiens
aagccagcca

SEQ ID NO: 6571129 - DNA, 20 bp, Homo sapiens
aagccagccccctccagctc

SEQ ID NO: 6571130 - DNA, 14 bp, Homo sapiens
ttcctacttaaaca

SEQ ID NO: 6571131 - DNA, 15 bp, Homo sapiens
ttcctacttaaacaa

SEQ ID NO: 6571132 - DNA, 19 bp, Homo sapiens
ttcctacttgcagtacatc

SEQ ID NO: 6571133 - DNA, 14 bp, Homo sapiens
ttcctactttgctt

SEQ ID NO: 6571134 - DNA, 19 bp, Homo sapiens
ttcctacttttccttccct

SEQ ID NO: 6571135 - DNA, 19 bp, Homo sapiens
ttcctagaagcccctgtcg

SEQ ID NO: 6571136 - DNA, 20 bp, Homo sapiens
ttcctagagagcagaaataa

SEQ ID NO: 6571137 - DNA, 20 bp, Homo sapiens
ttcctagagcatctgtccca

SEQ ID NO: 6571138 - DNA, 14 bp, Homo sapiens
ttcctagaggagac

SEQ ID NO: 6571139 - DNA, 17 bp, Homo sapiens
ttcctagataaaaagat

SEQ ID NO: 6571140 - DNA, 18 bp, Homo sapiens
ttcctagatctgcaggct

SEQ ID NO: 6571141 - DNA, 22 bp, Homo sapiens
ttcctagatggcagtcactgaa

SEQ ID NO: 6571142 - DNA, 21 bp, Homo sapiens
ttcctagattacatctgcctt

SEQ ID NO: 6571143 - DNA, 22 bp, Homo sapiens
ttcctagccaccgcctcctaca

SEQ ID NO: 6571144 - DNA, 14 bp, Homo sapiens
ttcctagccctctc

SEQ ID NO: 6571145 - DNA, 18 bp, Homo sapiens
ttcctagccctctcacat

SEQ ID NO: 6571146 - DNA, 13 bp, Homo sapiens
ttcctagcctgtt

SEQ ID NO: 6571147 - DNA, 16 bp, Homo sapiens
ttcctagcctgtttct

SEQ ID NO: 6571148 - DNA, 16 bp, Homo sapiens
ttcctagctaggagca

SEQ ID NO: 6571149 - DNA, 22 bp, Homo sapiens
ttcctagctaggagcaggcttg

SEQ ID NO: 6571150 - DNA, 22 bp, Homo sapiens
ttcctagctggagaggagccct

SEQ ID NO: 6571151 - DNA, 18 bp, Homo sapiens
ttcctagcttatctccct

SEQ ID NO: 6571152 - DNA, 21 bp, Homo sapiens
ttcctagcttatctccctgct

SEQ ID NO: 6571153 - DNA, 22 bp, Homo sapiens
ttcctagcttatctccctgctt

SEQ ID NO: 6571154 - DNA, 21 bp, Homo sapiens
ttcctaggcccaggcctgggt

SEQ ID NO: 6571155 - DNA, 21 bp, Homo sapiens
ttcctagggatctgaaatcca

SEQ ID NO: 6571156 - DNA, 17 bp, Homo sapiens
ttcctaggtccaagccc

SEQ ID NO: 6571157 - DNA, 17 bp, Homo sapiens
ttcctagtctttccagt

SEQ ID NO: 6571158 - DNA, 23 bp, Homo sapiens
ttcctagtggtgtcatttttgaa

SEQ ID NO: 6571159 - DNA, 20 bp, Homo sapiens
ttcctagttctgtagaaatg

SEQ ID NO: 6571160 - DNA, 19 bp, Homo sapiens
ttcctagttttatgtttct

SEQ ID NO: 6571161 - DNA, 15 bp, Homo sapiens
ttcctataacactgt

SEQ ID NO: 6571162 - DNA, 16 bp, Homo sapiens
ttcctataacttcttc

SEQ ID NO: 6571163 - DNA, 19 bp, Homo sapiens
ttcctataacttgatgcat

SEQ ID NO: 6571164 - DNA, 22 bp, Homo sapiens
ttcctataataaaatggcacct

SEQ ID NO: 6571165 - DNA, 20 bp, Homo sapiens
ttcctataatataataaata

SEQ ID NO: 6571166 - DNA, 15 bp, Homo sapiens
ttcctatagtacttt

SEQ ID NO: 6571167 - DNA, 17 bp, Homo sapiens
ttcctatcaaaaagata

SEQ ID NO: 6571168 - DNA, 22 bp, Homo sapiens
ttcctatcaatccaaattccct

SEQ ID NO: 6571169 - DNA, 13 bp, Homo sapiens
ttcctatcacctc

SEQ ID NO: 6571170 - DNA, 22 bp, Homo sapiens
ttcctatctgtatgtctgccta

SEQ ID NO: 6571171 - DNA, 16 bp, Homo sapiens
ttcctatctttacatc

SEQ ID NO: 6571172 - DNA, 18 bp, Homo sapiens
ttcctatgatggatggca

SEQ ID NO: 6571173 - DNA, 13 bp, Homo sapiens
ttcctatgcccag

SEQ ID NO: 6571174 - DNA, 14 bp, Homo sapiens
ttcctatgctttga

SEQ ID NO: 6571175 - DNA, 16 bp, Homo sapiens
ttcctatgctttgaaa

SEQ ID NO: 6571176 - DNA, 14 bp, Homo sapiens
ttcctatggaaaca

SEQ ID NO: 6571177 - DNA, 17 bp, Homo sapiens
ttcctattaatcttcag

SEQ ID NO: 6571178 - DNA, 16 bp, Homo sapiens
ttcctattctcctgcc

SEQ ID NO: 6571179 - DNA, 13 bp, Homo sapiens
ttcctattgtcat

SEQ ID NO: 6571180 - DNA, 17 bp, Homo sapiens
ttcctattgtcattaaa

SEQ ID NO: 6571181 - DNA, 18 bp, Homo sapiens
ttcctattgtcattaaag

SEQ ID NO: 6571182 - DNA, 21 bp, Homo sapiens
ttcctattgtgatttgactgt

SEQ ID NO: 6571183 - DNA, 15 bp, Homo sapiens
ttcctatttcttata

SEQ ID NO: 6571184 - DNA, 22 bp, Homo sapiens
ttcctattttaaaaccatgcag

SEQ ID NO: 6571185 - DNA, 23 bp, Homo sapiens
ttcctattttaaaaccatgcagc

SEQ ID NO: 6571186 - DNA, 17 bp, Homo sapiens
ttcctattttcagccca

SEQ ID NO: 6571187 - DNA, 15 bp, Homo sapiens
ttcctcaaaaagcag

SEQ ID NO: 6571188 - DNA, 19 bp, Homo sapiens
ttcctcaaaataaagaagt

SEQ ID NO: 6571189 - DNA, 21 bp, Homo sapiens
ttcctcaaaataaagaagtat

SEQ ID NO: 6571190 - DNA, 18 bp, Homo sapiens
ttcctcaaagcttggatt

SEQ ID NO: 6571191 - DNA, 18 bp, Homo sapiens
ttcctcaaatcaaaaaca

SEQ ID NO: 6571192 - DNA, 17 bp, Homo sapiens
ttcctcaaatgttgaca

SEQ ID NO: 6571193 - DNA, 21 bp, Homo sapiens
ttcctcaacagtgttttcaga

SEQ ID NO: 6571194 - DNA, 20 bp, Homo sapiens
ttcctcaagcaataattgtt

SEQ ID NO: 6571195 - DNA, 22 bp, Homo sapiens
ttcctcacacccacctgctgct

SEQ ID NO: 6571196 - DNA, 23 bp, Homo sapiens
ttcctcacacccacctgctgctg

SEQ ID NO: 6571197 - DNA, 16 bp, Homo sapiens
ttcctcacactgctgt

SEQ ID NO: 6571198 - DNA, 24 bp, Homo sapiens
ttcctcacactgctgtcctctccc

SEQ ID NO: 6571199 - DNA, 15 bp, Homo sapiens
ttcctcaccaataac

SEQ ID NO: 6571200 - DNA, 13 bp, Homo sapiens
ttcctcaccttga

SEQ ID NO: 6571201 - DNA, 13 bp, Homo sapiens
ttcctcagaaccc

SEQ ID NO: 6571202 - DNA, 11 bp, Homo sapiens
ttcctcagaat

SEQ ID NO: 6571203 - DNA, 18 bp, Homo sapiens
ttcctcagactctaagaa

SEQ ID NO: 6571204 - DNA, 16 bp, Homo sapiens
ttcctcagattgctga

SEQ ID NO: 6571205 - DNA, 18 bp, Homo sapiens
ttcctcagattgctgaat

SEQ ID NO: 6571206 - DNA, 11 bp, Homo sapiens
ttcctcagcca

SEQ ID NO: 6571207 - DNA, 14 bp, Homo sapiens
ttcctcagccagcc

SEQ ID NO: 6571208 - DNA, 15 bp, Homo sapiens
ttcctcagccagcct

SEQ ID NO: 6571209 - DNA, 16 bp, Homo sapiens
ttcctcagccagcctc

SEQ ID NO: 6571210 - DNA, 21 bp, Homo sapiens
ttcctcagctgtacaaatcct

SEQ ID NO: 6571211 - DNA, 21 bp, Homo sapiens
ttcctcaggaaggacatgggt

SEQ ID NO: 6571212 - DNA, 14 bp, Homo sapiens
ttcctcagggccca

SEQ ID NO: 6571213 - DNA, 19 bp, Homo sapiens
ttcctcagggcccagcagg

SEQ ID NO: 6571214 - DNA, 17 bp, Homo sapiens
ttcctcagtcctggaag

SEQ ID NO: 6571215 - DNA, 23 bp, Homo sapiens
ttcctcagttcatccattctatt

SEQ ID NO: 6571216 - DNA, 13 bp, Homo sapiens
ttcctcatcagta

SEQ ID NO: 6571217 - DNA, 15 bp, Homo sapiens
ttcctcatcagtaga

SEQ ID NO: 6571218 - DNA, 16 bp, Homo sapiens
ttcctcatcagtagat

SEQ ID NO: 6571219 - DNA, 22 bp, Homo sapiens
ttcctcatcagtgtcattttct

SEQ ID NO: 6571220 - DNA, 20 bp, Homo sapiens
ttcctcatcccctcgtcctg

SEQ ID NO: 6571221 - DNA, 16 bp, Homo sapiens
ttcctcatcctcagat

SEQ ID NO: 6571222 - DNA, 19 bp, Homo sapiens
ttcctcatcctcagatgct

SEQ ID NO: 6571223 - DNA, 16 bp, Homo sapiens
ttcctcatcctgcttc

SEQ ID NO: 6571224 - DNA, 14 bp, Homo sapiens
ttcctcatcctttc

SEQ ID NO: 6571225 - DNA, 18 bp, Homo sapiens
ttcctcatctatggttct

SEQ ID NO: 6571226 - DNA, 15 bp, Homo sapiens
ttcctcatctccatg

SEQ ID NO: 6571227 - DNA, 19 bp, Homo sapiens
ttcctcatctccatgctct

SEQ ID NO: 6571228 - DNA, 16 bp, Homo sapiens
ttcctcatctgtgcct

SEQ ID NO: 6571229 - DNA, 16 bp, Homo sapiens
ttcctcatgaatgtaa

SEQ ID NO: 6571230 - DNA, 14 bp, Homo sapiens
ttcctcatgaatta

SEQ ID NO: 6571231 - DNA, 15 bp, Homo sapiens
ttcctcatgtaacat

SEQ ID NO: 6571232 - DNA, 21 bp, Homo sapiens
ttcctcatgtaacattggtga

SEQ ID NO: 6571233 - DNA, 17 bp, Homo sapiens
ttcctcatttgttcatt

SEQ ID NO: 6571234 - DNA, 23 bp, Homo sapiens
ttcctcatttgttcattaaacgt

SEQ ID NO: 6571235 - DNA, 23 bp, Homo sapiens
ttcctcattttgaattatgtgca

SEQ ID NO: 6571236 - DNA, 22 bp, Homo sapiens
ttcctccaaatctcttgcttgt

SEQ ID NO: 6571237 - DNA, 22 bp, Homo sapiens
ttcctccacagtcccccaccca

SEQ ID NO: 6571238 - DNA, 22 bp, Homo sapiens
ttcctccagaagcctccttaca

SEQ ID NO: 6571239 - DNA, 15 bp, Homo sapiens
ttcctccagaggagg

SEQ ID NO: 6571240 - DNA, 14 bp, Homo sapiens
ttcctccagcctcc

SEQ ID NO: 6571241 - DNA, 17 bp, Homo sapiens
ttcctccagcctcccct

SEQ ID NO: 6571242 - DNA, 18 bp, Homo sapiens
ttcctccagcctcccctc

SEQ ID NO: 6571243 - DNA, 20 bp, Homo sapiens
ttcctccaggagaaggggcc

SEQ ID NO: 6571244 - DNA, 14 bp, Homo sapiens
ttcctccatcctcc

SEQ ID NO: 6571245 - DNA, 24 bp, Homo sapiens
ttcctccatcctcctccttcctag

SEQ ID NO: 6571246 - DNA, 13 bp, Homo sapiens
ttcctccatggcc

SEQ ID NO: 6571247 - DNA, 14 bp, Homo sapiens
ttcctccattttct

SEQ ID NO: 6571248 - DNA, 19 bp, Homo sapiens
ttcctcccagtgagactgc

SEQ ID NO: 6571249 - DNA, 23 bp, Homo sapiens
ttcctcccagtgagactgcccca

SEQ ID NO: 6571250 - DNA, 20 bp, Homo sapiens
ttcctccccacccattttcc

SEQ ID NO: 6571251 - DNA, 12 bp, Homo sapiens
ttcctccccagc

SEQ ID NO: 6571252 - DNA, 21 bp, Homo sapiens
ttcctccccagccccctggca

SEQ ID NO: 6571253 - DNA, 16 bp, Homo sapiens
ttcctccccattccta

SEQ ID NO: 6571254 - DNA, 14 bp, Homo sapiens
ttcctccccctgca

SEQ ID NO: 6571255 - DNA, 14 bp, Homo sapiens
ttcctccccctgct

SEQ ID NO: 6571256 - DNA, 12 bp, Homo sapiens
ttcctcccctca

SEQ ID NO: 6571257 - DNA, 13 bp, Homo sapiens
ttcctcccctcaa

SEQ ID NO: 6571258 - DNA, 14 bp, Homo sapiens
ttcctcccctcgcc

SEQ ID NO: 6571259 - DNA, 15 bp, Homo sapiens
ttcctcccctctcat

SEQ ID NO: 6571260 - DNA, 20 bp, Homo sapiens
ttcctcccggggccttcctt

SEQ ID NO: 6571261 - DNA, 10 bp, Homo sapiens
ttcctccctc

SEQ ID NO: 6571262 - DNA, 21 bp, Homo sapiens
ttcctccctccctctttccct

SEQ ID NO: 6571263 - DNA, 18 bp, Homo sapiens
ttcctccctcctcccaca

SEQ ID NO: 6571264 - DNA, 13 bp, Homo sapiens
ttcctccctggca

SEQ ID NO: 6571265 - DNA, 12 bp, Homo sapiens
ttcctcccttct

SEQ ID NO: 6571266 - DNA, 15 bp, Homo sapiens
ttcctccgctcccct

SEQ ID NO: 6571267 - DNA, 12 bp, Homo sapiens
ttcctccggagc

SEQ ID NO: 6571268 - DNA, 16 bp, Homo sapiens
ttcctccggagcctca

SEQ ID NO: 6571269 - DNA, 14 bp, Homo sapiens
ttcctccgtccacc

SEQ ID NO: 6571270 - DNA, 13 bp, Homo sapiens
ttcctcctacctg

SEQ ID NO: 6571271 - DNA, 16 bp, Homo sapiens
ttcctcctacctgggg

SEQ ID NO: 6571272 - DNA, 19 bp, Homo sapiens
ttcctcctaggcgctcaga

SEQ ID NO: 6571273 - DNA, 21 bp, Homo sapiens
ttcctcctaggcgctcagagg

SEQ ID NO: 6571274 - DNA, 23 bp, Homo sapiens
ttcctcctaggcgctcagaggcc

SEQ ID NO: 6571275 - DNA, 12 bp, Homo sapiens
ttcctcctcagg

SEQ ID NO: 6571276 - DNA, 20 bp, Homo sapiens
ttcctcctcaggcacacagc

SEQ ID NO: 6571277 - DNA, 19 bp, Homo sapiens
ttcctcctcatgaaagcag

SEQ ID NO: 6571278 - DNA, 19 bp, Homo sapiens
ttcctcctccacagtgctg

SEQ ID NO: 6571279 - DNA, 15 bp, Homo sapiens
ttcctcctccaccac

SEQ ID NO: 6571280 - DNA, 11 bp, Homo sapiens
ttcctcctccc

SEQ ID NO: 6571281 - DNA, 14 bp, Homo sapiens
ttcctcctccccac

SEQ ID NO: 6571282 - DNA, 24 bp, Homo sapiens
ttcctcctcctcctcctgttcctg

SEQ ID NO: 6571283 - DNA, 12 bp, Homo sapiens
ttcctcctctgc

SEQ ID NO: 6571284 - DNA, 12 bp, Homo sapiens
ttcctcctgaca

SEQ ID NO: 6571285 - DNA, 20 bp, Homo sapiens
ttcctcctgacaccccactt

SEQ ID NO: 6571286 - DNA, 18 bp, Homo sapiens
ttcctcctgcctttctca

SEQ ID NO: 6571287 - DNA, 11 bp, Homo sapiens
ttcctcctgct

SEQ ID NO: 6571288 - DNA, 14 bp, Homo sapiens
ttcctcctgctgta

SEQ ID NO: 6571289 - DNA, 11 bp, Homo sapiens
ttcctcctgga

SEQ ID NO: 6571290 - DNA, 14 bp, Homo sapiens
ttcctcctggcaga

SEQ ID NO: 6571291 - DNA, 15 bp, Homo sapiens
ttcctcctgggccct

SEQ ID NO: 6571292 - DNA, 13 bp, Homo sapiens
ttcctcctgtgta

SEQ ID NO: 6571293 - DNA, 17 bp, Homo sapiens
ttcctcctgtgtacagg

SEQ ID NO: 6571294 - DNA, 18 bp, Homo sapiens
ttcctccttcatttcagc

SEQ ID NO: 6571295 - DNA, 23 bp, Homo sapiens
ttcctccttccagatgcccgagc

SEQ ID NO: 6571296 - DNA, 13 bp, Homo sapiens
ttcctccttcccc

SEQ ID NO: 6571297 - DNA, 23 bp, Homo sapiens
ttcctccttccccccatctctga

SEQ ID NO: 6571298 - DNA, 15 bp, Homo sapiens
ttcctcctttacctt

SEQ ID NO: 6571299 - DNA, 14 bp, Homo sapiens
ttcctcctttatca

SEQ ID NO: 6571300 - DNA, 20 bp, Homo sapiens
ttcctcctttcctatttccc

SEQ ID NO: 6571301 - DNA, 17 bp, Homo sapiens
ttcctcctttctctgta

SEQ ID NO: 6571302 - DNA, 15 bp, Homo sapiens
ttcctcgagaggcac

SEQ ID NO: 6571303 - DNA, 18 bp, Homo sapiens
ttcctcgcacagggcatg

SEQ ID NO: 6571304 - DNA, 15 bp, Homo sapiens
ttcctcgcttctttc

SEQ ID NO: 6571305 - DNA, 15 bp, Homo sapiens
ttcctcggtctccct

SEQ ID NO: 6571306 - DNA, 15 bp, Homo sapiens
ttcctcggtggctct

SEQ ID NO: 6571307 - DNA, 19 bp, Homo sapiens
ttcctcgtgcagagctggg

SEQ ID NO: 6571308 - DNA, 15 bp, Homo sapiens
ttcctcgttttgaaa

SEQ ID NO: 6571309 - DNA, 20 bp, Homo sapiens
ttcctctaactcactgccta

SEQ ID NO: 6571310 - DNA, 15 bp, Homo sapiens
ttcctctaattaaaa

SEQ ID NO: 6571311 - DNA, 23 bp, Homo sapiens
ttcctctaattaaaatgtgcagt

SEQ ID NO: 6571312 - DNA, 19 bp, Homo sapiens
ttcctctagcttttctatt

SEQ ID NO: 6571313 - DNA, 20 bp, Homo sapiens
ttcctctatacatctctccc

SEQ ID NO: 6571314 - DNA, 15 bp, Homo sapiens
ttcctctatactttg

SEQ ID NO: 6571315 - DNA, 22 bp, Homo sapiens
ttcctctatactttgttctgtt

SEQ ID NO: 6571316 - DNA, 19 bp, Homo sapiens
ttcctctcaaattcagctc

SEQ ID NO: 6571317 - DNA, 22 bp, Homo sapiens
ttcctctcaccccactcctgtc

SEQ ID NO: 6571318 - DNA, 17 bp, Homo sapiens
ttcctctcactaaactt

SEQ ID NO: 6571319 - DNA, 19 bp, Homo sapiens
ttcctctcactaaacttta

SEQ ID NO: 6571320 - DNA, 15 bp, Homo sapiens
ttcctctcattgtct

SEQ ID NO: 6571321 - DNA, 17 bp, Homo sapiens
ttcctctccacaggagc

SEQ ID NO: 6571322 - DNA, 13 bp, Homo sapiens
ttcctctccactg

SEQ ID NO: 6571323 - DNA, 21 bp, Homo sapiens
ttcctctccactgctggacat

SEQ ID NO: 6571324 - DNA, 13 bp, Homo sapiens
ttcctctccagcc

SEQ ID NO: 6571325 - DNA, 12 bp, Homo sapiens
ttcctctcccat

SEQ ID NO: 6571326 - DNA, 16 bp, Homo sapiens
ttcctctccctcaggg

SEQ ID NO: 6571327 - DNA, 22 bp, Homo sapiens
ttcctctccctcaggggcaggt

SEQ ID NO: 6571328 - DNA, 23 bp, Homo sapiens
ttcctctcccttcccttccctca

SEQ ID NO: 6571329 - DNA, 14 bp, Homo sapiens
ttcctctcctagcc

SEQ ID NO: 6571330 - DNA, 14 bp, Homo sapiens
ttcctctcctctct

SEQ ID NO: 6571331 - DNA, 17 bp, Homo sapiens
ttcctctcctctctgga

SEQ ID NO: 6571332 - DNA, 15 bp, Homo sapiens
ttcctctccttcctt

SEQ ID NO: 6571333 - DNA, 21 bp, Homo sapiens
ttcctctcgcggccctcagta

SEQ ID NO: 6571334 - DNA, 13 bp, Homo sapiens
ttcctctctaccc

SEQ ID NO: 6571335 - DNA, 15 bp, Homo sapiens
ttcctctctatattt

SEQ ID NO: 6571336 - DNA, 14 bp, Homo sapiens
ttcctctctatctt

SEQ ID NO: 6571337 - DNA, 15 bp, Homo sapiens
ttcctctctccagat

SEQ ID NO: 6571338 - DNA, 13 bp, Homo sapiens
ttcctctctccca

SEQ ID NO: 6571339 - DNA, 15 bp, Homo sapiens
ttcctctctccccca

SEQ ID NO: 6571340 - DNA, 12 bp, Homo sapiens
ttcctctctctc

SEQ ID NO: 6571341 - DNA, 15 bp, Homo sapiens
ttcctctctctcacc

SEQ ID NO: 6571342 - DNA, 15 bp, Homo sapiens
ttcctctcttgacat

SEQ ID NO: 6571343 - DNA, 23 bp, Homo sapiens
ttcctctcttggcaattcctctt

SEQ ID NO: 6571344 - DNA, 22 bp, Homo sapiens
ttcctctctttgttctcagctc

SEQ ID NO: 6571345 - DNA, 14 bp, Homo sapiens
ttcctctgaagact

SEQ ID NO: 6571346 - DNA, 24 bp, Homo sapiens
ttcctctgagcccagctgcctgga

SEQ ID NO: 6571347 - DNA, 13 bp, Homo sapiens
ttcctctgagccg

SEQ ID NO: 6571348 - DNA, 16 bp, Homo sapiens
ttcctctgagccgcag

SEQ ID NO: 6571349 - DNA, 13 bp, Homo sapiens
ttcctctgagcct

SEQ ID NO: 6571350 - DNA, 17 bp, Homo sapiens
ttcctctgagccttggg

SEQ ID NO: 6571351 - DNA, 15 bp, Homo sapiens
ttcctctgagctgtt

SEQ ID NO: 6571352 - DNA, 19 bp, Homo sapiens
ttcctctgagctgttatct

SEQ ID NO: 6571353 - DNA, 11 bp, Homo sapiens
ttcctctgagg

SEQ ID NO: 6571354 - DNA, 19 bp, Homo sapiens
ttcctctgcaagtgctcag

SEQ ID NO: 6571355 - DNA, 16 bp, Homo sapiens
ttcctctgcagcactt

SEQ ID NO: 6571356 - DNA, 14 bp, Homo sapiens
ttcctctgcaggac

SEQ ID NO: 6571357 - DNA, 12 bp, Homo sapiens
ttcctctgcctg

SEQ ID NO: 6571358 - DNA, 13 bp, Homo sapiens
ttcctctgcctgc

SEQ ID NO: 6571359 - DNA, 22 bp, Homo sapiens
ttcctctgctaaattgatgttg

SEQ ID NO: 6571360 - DNA, 12 bp, Homo sapiens
ttcctctgctcc

SEQ ID NO: 6571361 - DNA, 16 bp, Homo sapiens
ttcctctggttccttt

SEQ ID NO: 6571362 - DNA, 20 bp, Homo sapiens
ttcctctggtttctgtgtgt

SEQ ID NO: 6571363 - DNA, 17 bp, Homo sapiens
ttcctctgtacagcaag

SEQ ID NO: 6571364 - DNA, 16 bp, Homo sapiens
ttcctctgtagaattt

SEQ ID NO: 6571365 - DNA, 21 bp, Homo sapiens
ttcctctgtattgtgctgatt

SEQ ID NO: 6571366 - DNA, 18 bp, Homo sapiens
ttcctctgtctcctaagc

SEQ ID NO: 6571367 - DNA, 15 bp, Homo sapiens
ttcctctgtgaactg

SEQ ID NO: 6571368 - DNA, 13 bp, Homo sapiens
ttcctctgtgcca

SEQ ID NO: 6571369 - DNA, 16 bp, Homo sapiens
ttcctctgtgccacgc

SEQ ID NO: 6571370 - DNA, 16 bp, Homo sapiens
ttcctcttacctgtaa

SEQ ID NO: 6571371 - DNA, 19 bp, Homo sapiens
ttcctcttactttcagttt

SEQ ID NO: 6571372 - DNA, 22 bp, Homo sapiens
ttcctcttagaagaatattgta

SEQ ID NO: 6571373 - DNA, 17 bp, Homo sapiens
ttcctcttagcctctgg

SEQ ID NO: 6571374 - DNA, 18 bp, Homo sapiens
ttcctcttccccttgccc

SEQ ID NO: 6571375 - DNA, 19 bp, Homo sapiens
ttcctcttccgggcagaaa

SEQ ID NO: 6571376 - DNA, 13 bp, Homo sapiens
ttcctcttcctgc

SEQ ID NO: 6571377 - DNA, 20 bp, Homo sapiens
ttcctcttcctgcccttgaa

SEQ ID NO: 6571378 - DNA, 14 bp, Homo sapiens
ttcctcttccttct

SEQ ID NO: 6571379 - DNA, 15 bp, Homo sapiens
ttcctcttcttgttg

SEQ ID NO: 6571380 - DNA, 22 bp, Homo sapiens
ttcctcttggagtctagaacat

SEQ ID NO: 6571381 - DNA, 22 bp, Homo sapiens
ttcctcttggcaagatgtttct

SEQ ID NO: 6571382 - DNA, 13 bp, Homo sapiens
ttcctctttccat

SEQ ID NO: 6571383 - DNA, 19 bp, Homo sapiens
ttcctctttctctccttct

SEQ ID NO: 6571384 - DNA, 13 bp, Homo sapiens
ttcctctttcttc

SEQ ID NO: 6571385 - DNA, 18 bp, Homo sapiens
ttcctctttgcccaaaat

SEQ ID NO: 6571386 - DNA, 19 bp, Homo sapiens
ttcctctttgctccctcca

SEQ ID NO: 6571387 - DNA, 22 bp, Homo sapiens
ttcctctttgctttgctttctg

SEQ ID NO: 6571388 - DNA, 19 bp, Homo sapiens
ttcctcttttccttcccaa

SEQ ID NO: 6571389 - DNA, 16 bp, Homo sapiens
ttcctcttttctctgc

SEQ ID NO: 6571390 - DNA, 20 bp, Homo sapiens
ttcctcttttgggtaaaatc

SEQ ID NO: 6571391 - DNA, 20 bp, Homo sapiens
ttcctgaaactatattttgt

SEQ ID NO: 6571392 - DNA, 18 bp, Homo sapiens
ttcctgaaagaaacagtt

SEQ ID NO: 6571393 - DNA, 19 bp, Homo sapiens
ttcctgaaataaacactgg

SEQ ID NO: 6571394 - DNA, 18 bp, Homo sapiens
ttcctgaaatatccagga

SEQ ID NO: 6571395 - DNA, 11 bp, Homo sapiens
ttcctgaaatg

SEQ ID NO: 6571396 - DNA, 15 bp, Homo sapiens
ttcctgaaatgcagt

SEQ ID NO: 6571397 - DNA, 15 bp, Homo sapiens
ttcctgaacctgatg

SEQ ID NO: 6571398 - DNA, 15 bp, Homo sapiens
ttcctgaagaaccag

SEQ ID NO: 6571399 - DNA, 16 bp, Homo sapiens
ttcctgaagaaccagt

SEQ ID NO: 6571400 - DNA, 11 bp, Homo sapiens
ttcctgaagct

SEQ ID NO: 6571401 - DNA, 12 bp, Homo sapiens
ttcctgaagctg

SEQ ID NO: 6571402 - DNA, 18 bp, Homo sapiens
ttcctgaagctgctgtgt

SEQ ID NO: 6571403 - DNA, 14 bp, Homo sapiens
ttcctgaaggggga

SEQ ID NO: 6571404 - DNA, 13 bp, Homo sapiens
ttcctgaatccaa

SEQ ID NO: 6571405 - DNA, 22 bp, Homo sapiens
ttcctgaatctaaaataaaaat

SEQ ID NO: 6571406 - DNA, 16 bp, Homo sapiens
ttcctgaatgaaatat

SEQ ID NO: 6571407 - DNA, 14 bp, Homo sapiens
ttcctgaattggaa

SEQ ID NO: 6571408 - DNA, 13 bp, Homo sapiens
ttcctgacacttt

SEQ ID NO: 6571409 - DNA, 23 bp, Homo sapiens
ttcctgacagatgcctggtgagc

SEQ ID NO: 6571410 - DNA, 17 bp, Homo sapiens
ttcctgacatcacagca

SEQ ID NO: 6571411 - DNA, 20 bp, Homo sapiens
ttcctgacatcacagcagcc

SEQ ID NO: 6571412 - DNA, 15 bp, Homo sapiens
ttcctgacccaggcc

SEQ ID NO: 6571413 - DNA, 23 bp, Homo sapiens
ttcctgacccaggccgcagctct

SEQ ID NO: 6571414 - DNA, 21 bp, Homo sapiens
ttcctgacccggattggccct

SEQ ID NO: 6571415 - DNA, 22 bp, Homo sapiens
ttcctgacctcctcctgccctc

SEQ ID NO: 6571416 - DNA, 18 bp, Homo sapiens
ttcctgactctcacctgt

SEQ ID NO: 6571417 - DNA, 20 bp, Homo sapiens
ttcctgactgacacaggcca

SEQ ID NO: 6571418 - DNA, 13 bp, Homo sapiens
ttcctgactggca

SEQ ID NO: 6571419 - DNA, 16 bp, Homo sapiens
ttcctgactggcaaag

SEQ ID NO: 6571420 - DNA, 15 bp, Homo sapiens
ttcctgactgggaag

SEQ ID NO: 6571421 - DNA, 20 bp, Homo sapiens
ttcctgagattctgggaaag

SEQ ID NO: 6571422 - DNA, 14 bp, Homo sapiens
ttcctgagctagca

SEQ ID NO: 6571423 - DNA, 16 bp, Homo sapiens
ttcctgagctgtcgct

SEQ ID NO: 6571424 - DNA, 23 bp, Homo sapiens
ttcctgagggatctatacttgct

SEQ ID NO: 6571425 - DNA, 22 bp, Homo sapiens
ttcctgagttaggctttctctt

SEQ ID NO: 6571426 - DNA, 14 bp, Homo sapiens
ttcctgataataaa

SEQ ID NO: 6571427 - DNA, 17 bp, Homo sapiens
ttcctgataataattga

SEQ ID NO: 6571428 - DNA, 19 bp, Homo sapiens
ttcctgataataattgatc

SEQ ID NO: 6571429 - DNA, 17 bp, Homo sapiens
ttcctgatgacccaggc

SEQ ID NO: 6571430 - DNA, 18 bp, Homo sapiens
ttcctgatgacccaggct

SEQ ID NO: 6571431 - DNA, 21 bp, Homo sapiens
ttcctgatgacccaggctgcc

SEQ ID NO: 6571432 - DNA, 15 bp, Homo sapiens
ttcctgatgatgctg

SEQ ID NO: 6571433 - DNA, 23 bp, Homo sapiens
ttcctgatgctgggcaatgaggc

SEQ ID NO: 6571434 - DNA, 19 bp, Homo sapiens
ttcctgatggaattgttat

SEQ ID NO: 6571435 - DNA, 21 bp, Homo sapiens
ttcctgatggcaggatggcct

SEQ ID NO: 6571436 - DNA, 23 bp, Homo sapiens
ttcctgattaccagtctgattat

SEQ ID NO: 6571437 - DNA, 15 bp, Homo sapiens
ttcctgattccccac

SEQ ID NO: 6571438 - DNA, 17 bp, Homo sapiens
ttcctgattgtttacag

SEQ ID NO: 6571439 - DNA, 16 bp, Homo sapiens
ttcctgatttttcata

SEQ ID NO: 6571440 - DNA, 15 bp, Homo sapiens
ttcctgcaaagggaa

SEQ ID NO: 6571441 - DNA, 21 bp, Homo sapiens
ttcctgcaatgaagtctctga

SEQ ID NO: 6571442 - DNA, 14 bp, Homo sapiens
ttcctgcactccag

SEQ ID NO: 6571443 - DNA, 15 bp, Homo sapiens
ttcctgcactccaga

SEQ ID NO: 6571444 - DNA, 19 bp, Homo sapiens
ttcctgcagccccagaaga

SEQ ID NO: 6571445 - DNA, 21 bp, Homo sapiens
ttcctgcagccccagaagaaa

SEQ ID NO: 6571446 - DNA, 18 bp, Homo sapiens
ttcctgcagcctggaggc

SEQ ID NO: 6571447 - DNA, 19 bp, Homo sapiens
ttcctgcagtgaatttgaa

SEQ ID NO: 6571448 - DNA, 19 bp, Homo sapiens
ttcctgcagtgttttgcat

SEQ ID NO: 6571449 - DNA, 22 bp, Homo sapiens
ttcctgcatcccgatacctcag

SEQ ID NO: 6571450 - DNA, 12 bp, Homo sapiens
ttcctgcattca

SEQ ID NO: 6571451 - DNA, 14 bp, Homo sapiens
ttcctgccaagcca

SEQ ID NO: 6571452 - DNA, 12 bp, Homo sapiens
ttcctgccacca

SEQ ID NO: 6571453 - DNA, 18 bp, Homo sapiens
ttcctgccaccagtcact

SEQ ID NO: 6571454 - DNA, 18 bp, Homo sapiens
ttcctgccatgtttagtg

SEQ ID NO: 6571455 - DNA, 16 bp, Homo sapiens
ttcctgccccaggcct

SEQ ID NO: 6571456 - DNA, 16 bp, Homo sapiens
ttcctgcccccgccct

SEQ ID NO: 6571457 - DNA, 14 bp, Homo sapiens
ttcctgcccctctt

SEQ ID NO: 6571458 - DNA, 15 bp, Homo sapiens
ttcctgcccctcttt

SEQ ID NO: 6571459 - DNA, 20 bp, Homo sapiens
ttcctgcccctctttctctt

SEQ ID NO: 6571460 - DNA, 16 bp, Homo sapiens
ttcctgccctgggagg

SEQ ID NO: 6571461 - DNA, 22 bp, Homo sapiens
ttcctgccctgggaggcagtga

SEQ ID NO: 6571462 - DNA, 15 bp, Homo sapiens
ttcctgccctgtacc

SEQ ID NO: 6571463 - DNA, 17 bp, Homo sapiens
ttcctgcccttcctcag

SEQ ID NO: 6571464 - DNA, 12 bp, Homo sapiens
ttcctgcctggt

SEQ ID NO: 6571465 - DNA, 23 bp, Homo sapiens
ttcctgccttcttctttttgctg

SEQ ID NO: 6571466 - DNA, 15 bp, Homo sapiens
ttcctgcctttaagc

SEQ ID NO: 6571467 - DNA, 19 bp, Homo sapiens
ttcctgcggagtgaagagg

SEQ ID NO: 6571468 - DNA, 23 bp, Homo sapiens
ttcctgcggagtgaagaggggca

SEQ ID NO: 6571469 - DNA, 21 bp, Homo sapiens
ttcctgcgggcttttccccgg

SEQ ID NO: 6571470 - DNA, 20 bp, Homo sapiens
ttcctgctacaagtgtttta

SEQ ID NO: 6571471 - DNA, 16 bp, Homo sapiens
ttcctgctacaggagg

SEQ ID NO: 6571472 - DNA, 18 bp, Homo sapiens
ttcctgctacagtagctg

SEQ ID NO: 6571473 - DNA, 22 bp, Homo sapiens
ttcctgctacagtagctgtggg

SEQ ID NO: 6571474 - DNA, 17 bp, Homo sapiens
ttcctgctacttaaatt

SEQ ID NO: 6571475 - DNA, 22 bp, Homo sapiens
ttcctgctatattaacatcatc

SEQ ID NO: 6571476 - DNA, 14 bp, Homo sapiens
ttcctgctccagtg

SEQ ID NO: 6571477 - DNA, 12 bp, Homo sapiens
ttcctgctgcct

SEQ ID NO: 6571478 - DNA, 23 bp, Homo sapiens
ttcctgctgcctgggtaggcccc

SEQ ID NO: 6571479 - DNA, 13 bp, Homo sapiens
ttcctgctgctgt

SEQ ID NO: 6571480 - DNA, 15 bp, Homo sapiens
ttcctgctgctgtct

SEQ ID NO: 6571481 - DNA, 14 bp, Homo sapiens
ttcctgctgtcctg

SEQ ID NO: 6571482 - DNA, 16 bp, Homo sapiens
ttcctgctgtcctggt

SEQ ID NO: 6571483 - DNA, 17 bp, Homo sapiens
ttcctgctgtcctggtg

SEQ ID NO: 6571484 - DNA, 21 bp, Homo sapiens
ttcctgctgtcctggtggctg

SEQ ID NO: 6571485 - DNA, 19 bp, Homo sapiens
ttcctgcttaaacttgacc

SEQ ID NO: 6571486 - DNA, 13 bp, Homo sapiens
ttcctgcttccga

SEQ ID NO: 6571487 - DNA, 17 bp, Homo sapiens
ttcctgcttcctcagag

SEQ ID NO: 6571488 - DNA, 18 bp, Homo sapiens
ttcctgcttcctcagagg

SEQ ID NO: 6571489 - DNA, 14 bp, Homo sapiens
ttcctgctttctct

SEQ ID NO: 6571490 - DNA, 16 bp, Homo sapiens
aagccagcccggccgc

SEQ ID NO: 6571491 - DNA, 11 bp, Homo sapiens
aagccagcctg

SEQ ID NO: 6571492 - DNA, 12 bp, Homo sapiens
aagccagcctgg

SEQ ID NO: 6571493 - DNA, 14 bp, Homo sapiens
aagccagcgtcctc

SEQ ID NO: 6571494 - DNA, 16 bp, Homo sapiens
aagccagctctaggct

SEQ ID NO: 6571495 - DNA, 21 bp, Homo sapiens
aagccagctgcagctgggctg

SEQ ID NO: 6571496 - DNA, 22 bp, Homo sapiens
aagccagctgccctatgggcct

SEQ ID NO: 6571497 - DNA, 21 bp, Homo sapiens
aagccagctgccgaccagagc

SEQ ID NO: 6571498 - DNA, 17 bp, Homo sapiens
aagccagctggctttgc

SEQ ID NO: 6571499 - DNA, 12 bp, Homo sapiens
aagccagcttgt

SEQ ID NO: 6571500 - DNA, 12 bp, Homo sapiens
aagccagctttc

SEQ ID NO: 6571501 - DNA, 17 bp, Homo sapiens
aagccagctttccctgc

SEQ ID NO: 6571502 - DNA, 14 bp, Homo sapiens
aagccaggaacagg

SEQ ID NO: 6571503 - DNA, 18 bp, Homo sapiens
aagccaggaacagggacc

SEQ ID NO: 6571504 - DNA, 24 bp, Homo sapiens
aagccaggaatttcccaggaccct

SEQ ID NO: 6571505 - DNA, 21 bp, Homo sapiens
aagccaggagaagacccctgc

SEQ ID NO: 6571506 - DNA, 22 bp, Homo sapiens
aagccaggagaagacccctgcc

SEQ ID NO: 6571507 - DNA, 23 bp, Homo sapiens
aagccaggagaagacccctgccc

SEQ ID NO: 6571508 - DNA, 19 bp, Homo sapiens
aagccaggagaccctgtct

SEQ ID NO: 6571509 - DNA, 20 bp, Homo sapiens
aagccaggagaccctgtctt

SEQ ID NO: 6571510 - DNA, 12 bp, Homo sapiens
aagccaggagca

SEQ ID NO: 6571511 - DNA, 18 bp, Homo sapiens
aagccaggagcaaatgtt

SEQ ID NO: 6571512 - DNA, 17 bp, Homo sapiens
aagccaggagcagccct

SEQ ID NO: 6571513 - DNA, 18 bp, Homo sapiens
aagccaggaggaaactac

SEQ ID NO: 6571514 - DNA, 19 bp, Homo sapiens
aagccaggccctctctgca

SEQ ID NO: 6571515 - DNA, 15 bp, Homo sapiens
aagccaggcctggct

SEQ ID NO: 6571516 - DNA, 17 bp, Homo sapiens
aagccaggcctggctgg

SEQ ID NO: 6571517 - DNA, 22 bp, Homo sapiens
aagccaggcctggctggaggag

SEQ ID NO: 6571518 - DNA, 17 bp, Homo sapiens
aagccaggctcaggaga

SEQ ID NO: 6571519 - DNA, 23 bp, Homo sapiens
aagccaggctgagtgagccacag

SEQ ID NO: 6571520 - DNA, 23 bp, Homo sapiens
aagccagggatggggccacagcc

SEQ ID NO: 6571521 - DNA, 15 bp, Homo sapiens
aagccagggcccaga

SEQ ID NO: 6571522 - DNA, 16 bp, Homo sapiens
aagccagggcccagag

SEQ ID NO: 6571523 - DNA, 22 bp, Homo sapiens
aagccagggcccagagcccttg

SEQ ID NO: 6571524 - DNA, 17 bp, Homo sapiens
aagccagggctggagaa

SEQ ID NO: 6571525 - DNA, 23 bp, Homo sapiens
aagccagggtctctccctcaggt

SEQ ID NO: 6571526 - DNA, 16 bp, Homo sapiens
aagccaggtccctctc

SEQ ID NO: 6571527 - DNA, 18 bp, Homo sapiens
aagccaggtgagctctga

SEQ ID NO: 6571528 - DNA, 23 bp, Homo sapiens
aagccaggttccacagaggacac

SEQ ID NO: 6571529 - DNA, 15 bp, Homo sapiens
aagccaggttgtttt

SEQ ID NO: 6571530 - DNA, 20 bp, Homo sapiens
aagccagtatttctttccct

SEQ ID NO: 6571531 - DNA, 17 bp, Homo sapiens
aagccagtcagggcccc

SEQ ID NO: 6571532 - DNA, 23 bp, Homo sapiens
aagccagtcatggaatcttgctg

SEQ ID NO: 6571533 - DNA, 14 bp, Homo sapiens
aagccagtcttaac

SEQ ID NO: 6571534 - DNA, 17 bp, Homo sapiens
aagccagtgaaatgtga

SEQ ID NO: 6571535 - DNA, 20 bp, Homo sapiens
aagccagtgaaatgtgaagg

SEQ ID NO: 6571536 - DNA, 18 bp, Homo sapiens
aagccagtgactccagga

SEQ ID NO: 6571537 - DNA, 17 bp, Homo sapiens
aagccagttgcttcttc

SEQ ID NO: 6571538 - DNA, 23 bp, Homo sapiens
aagccagttggcttctgtgcctg

SEQ ID NO: 6571539 - DNA, 22 bp, Homo sapiens
aagccataacgtgcccccagag

SEQ ID NO: 6571540 - DNA, 16 bp, Homo sapiens
aagccatagtgtcact

SEQ ID NO: 6571541 - DNA, 23 bp, Homo sapiens
aagccatatatgaccagaagcct

SEQ ID NO: 6571542 - DNA, 22 bp, Homo sapiens
aagccatatgacaatttcaaaa

SEQ ID NO: 6571543 - DNA, 16 bp, Homo sapiens
aagccatatggacact

SEQ ID NO: 6571544 - DNA, 18 bp, Homo sapiens
aagccatatggacactgt

SEQ ID NO: 6571545 - DNA, 19 bp, Homo sapiens
aagccatatggacactgtg

SEQ ID NO: 6571546 - DNA, 23 bp, Homo sapiens
aagccatatggacactgtgacaa

SEQ ID NO: 6571547 - DNA, 13 bp, Homo sapiens
aagccatattcca

SEQ ID NO: 6571548 - DNA, 13 bp, Homo sapiens
aagccatattcta

SEQ ID NO: 6571549 - DNA, 22 bp, Homo sapiens
aagccatatttttttctgtaaa

SEQ ID NO: 6571550 - DNA, 13 bp, Homo sapiens
aagccatcacttc

SEQ ID NO: 6571551 - DNA, 20 bp, Homo sapiens
aagccatcacttctccccgc

SEQ ID NO: 6571552 - DNA, 21 bp, Homo sapiens
aagccatcacttctccccgca

SEQ ID NO: 6571553 - DNA, 16 bp, Homo sapiens
aagccatcatgccttg

SEQ ID NO: 6571554 - DNA, 18 bp, Homo sapiens
aagccatcatgtaaatta

SEQ ID NO: 6571555 - DNA, 15 bp, Homo sapiens
aagccatcgcgctcc

SEQ ID NO: 6571556 - DNA, 18 bp, Homo sapiens
aagccatctcaggttggc

SEQ ID NO: 6571557 - DNA, 14 bp, Homo sapiens
aagccatcttggta

SEQ ID NO: 6571558 - DNA, 16 bp, Homo sapiens
aagccatcttggtaaa

SEQ ID NO: 6571559 - DNA, 23 bp, Homo sapiens
aagccatgagttccagaaagtaa

SEQ ID NO: 6571560 - DNA, 13 bp, Homo sapiens
aagccatgctgga

SEQ ID NO: 6571561 - DNA, 21 bp, Homo sapiens
aagccatgctggaaaataata

SEQ ID NO: 6571562 - DNA, 14 bp, Homo sapiens
aagccatggagtga

SEQ ID NO: 6571563 - DNA, 21 bp, Homo sapiens
aagccatgggtagcctgggtg

SEQ ID NO: 6571564 - DNA, 21 bp, Homo sapiens
aagccatggtcccgaagtgta

SEQ ID NO: 6571565 - DNA, 12 bp, Homo sapiens
aagccatggtga

SEQ ID NO: 6571566 - DNA, 23 bp, Homo sapiens
aagccatggtgaactgataattt

SEQ ID NO: 6571567 - DNA, 18 bp, Homo sapiens
aagccatgtataaatgtg

SEQ ID NO: 6571568 - DNA, 20 bp, Homo sapiens
aagccatgtataaatgtgat

SEQ ID NO: 6571569 - DNA, 21 bp, Homo sapiens
aagccatgtggggttgctgaa

SEQ ID NO: 6571570 - DNA, 17 bp, Homo sapiens
aagccatgtttaagatt

SEQ ID NO: 6571571 - DNA, 22 bp, Homo sapiens
aagccatgtttaagatttaatt

SEQ ID NO: 6571572 - DNA, 17 bp, Homo sapiens
aagccatgtttattaca

SEQ ID NO: 6571573 - DNA, 18 bp, Homo sapiens
aagccattaaatgaatat

SEQ ID NO: 6571574 - DNA, 14 bp, Homo sapiens
aagccattctgcct

SEQ ID NO: 6571575 - DNA, 23 bp, Homo sapiens
aagccattcttactcgggcgacc

SEQ ID NO: 6571576 - DNA, 13 bp, Homo sapiens
aagccattctttt

SEQ ID NO: 6571577 - DNA, 15 bp, Homo sapiens
aagccattcttttaa

SEQ ID NO: 6571578 - DNA, 20 bp, Homo sapiens
aagccattggagagctgtct

SEQ ID NO: 6571579 - DNA, 13 bp, Homo sapiens
aagccatttaact

SEQ ID NO: 6571580 - DNA, 15 bp, Homo sapiens
aagccatttcttata

SEQ ID NO: 6571581 - DNA, 14 bp, Homo sapiens
aagccattttccag

SEQ ID NO: 6571582 - DNA, 19 bp, Homo sapiens
aagcccaaactcctttctt

SEQ ID NO: 6571583 - DNA, 14 bp, Homo sapiens
aagcccaacacaca

SEQ ID NO: 6571584 - DNA, 16 bp, Homo sapiens
aagcccaacctcctga

SEQ ID NO: 6571585 - DNA, 23 bp, Homo sapiens
aagcccacagcacagctccctgc

SEQ ID NO: 6571586 - DNA, 20 bp, Homo sapiens
aagcccacaggcctgttccc

SEQ ID NO: 6571587 - DNA, 18 bp, Homo sapiens
aagcccacccgccccaga

SEQ ID NO: 6571588 - DNA, 22 bp, Homo sapiens
aagcccacccgccccagagact

SEQ ID NO: 6571589 - DNA, 13 bp, Homo sapiens
aagcccaccctgc

SEQ ID NO: 6571590 - DNA, 21 bp, Homo sapiens
aagcccacctgaaagcctgtc

SEQ ID NO: 6571591 - DNA, 18 bp, Homo sapiens
aagcccacctgggctggg

SEQ ID NO: 6571592 - DNA, 21 bp, Homo sapiens
aagcccactgcctcctccctg

SEQ ID NO: 6571593 - DNA, 18 bp, Homo sapiens
aagcccagagggtctggg

SEQ ID NO: 6571594 - DNA, 18 bp, Homo sapiens
aagcccagcccatggaga

SEQ ID NO: 6571595 - DNA, 19 bp, Homo sapiens
aagcccagcccctactgct

SEQ ID NO: 6571596 - DNA, 12 bp, Homo sapiens
aagcccagcctg

SEQ ID NO: 6571597 - DNA, 14 bp, Homo sapiens
aagcccagctccag

SEQ ID NO: 6571598 - DNA, 19 bp, Homo sapiens
aagcccagctctttgttca

SEQ ID NO: 6571599 - DNA, 17 bp, Homo sapiens
aagcccaggaaaggctc

SEQ ID NO: 6571600 - DNA, 22 bp, Homo sapiens
aagcccaggaaaggctccagga

SEQ ID NO: 6571601 - DNA, 18 bp, Homo sapiens
aagcccaggacactgcct

SEQ ID NO: 6571602 - DNA, 14 bp, Homo sapiens
aagcccaggagaag

SEQ ID NO: 6571603 - DNA, 19 bp, Homo sapiens
aagcccaggagaagtccca

SEQ ID NO: 6571604 - DNA, 14 bp, Homo sapiens
aagcccaggatctc

SEQ ID NO: 6571605 - DNA, 16 bp, Homo sapiens
aagcccaggctggaga

SEQ ID NO: 6571606 - DNA, 19 bp, Homo sapiens
aagcccagttcagcttggg

SEQ ID NO: 6571607 - DNA, 21 bp, Homo sapiens
aagcccataaggccagaaact

SEQ ID NO: 6571608 - DNA, 22 bp, Homo sapiens
aagcccatatgctaccaccagc

SEQ ID NO: 6571609 - DNA, 22 bp, Homo sapiens
aagcccatcaattatagaaagc

SEQ ID NO: 6571610 - DNA, 15 bp, Homo sapiens
aagcccatcctgacc

SEQ ID NO: 6571611 - DNA, 16 bp, Homo sapiens
aagcccatcctgacca

SEQ ID NO: 6571612 - DNA, 14 bp, Homo sapiens
aagcccatgctttc

SEQ ID NO: 6571613 - DNA, 20 bp, Homo sapiens
aagcccatgtcttctgctgt

SEQ ID NO: 6571614 - DNA, 16 bp, Homo sapiens
aagcccattcattcca

SEQ ID NO: 6571615 - DNA, 23 bp, Homo sapiens
aagcccattcattccattctgga

SEQ ID NO: 6571616 - DNA, 14 bp, Homo sapiens
aagccccaactttc

SEQ ID NO: 6571617 - DNA, 16 bp, Homo sapiens
aagccccaagcgaatt

SEQ ID NO: 6571618 - DNA, 13 bp, Homo sapiens
aagccccagggcc

SEQ ID NO: 6571619 - DNA, 15 bp, Homo sapiens
aagccccagggcctg

SEQ ID NO: 6571620 - DNA, 18 bp, Homo sapiens
aagccccagggcctgggg

SEQ ID NO: 6571621 - DNA, 12 bp, Homo sapiens
aagccccatcct

SEQ ID NO: 6571622 - DNA, 16 bp, Homo sapiens
aagccccatgctggag

SEQ ID NO: 6571623 - DNA, 18 bp, Homo sapiens
aagccccatgctggagcc

SEQ ID NO: 6571624 - DNA, 20 bp, Homo sapiens
aagccccatgctggagcctg

SEQ ID NO: 6571625 - DNA, 18 bp, Homo sapiens
aagccccatgtgccttgt

SEQ ID NO: 6571626 - DNA, 15 bp, Homo sapiens
aagccccatttcctc

SEQ ID NO: 6571627 - DNA, 16 bp, Homo sapiens
aagccccatttcctca

SEQ ID NO: 6571628 - DNA, 14 bp, Homo sapiens
aagcccccactact

SEQ ID NO: 6571629 - DNA, 19 bp, Homo sapiens
aagcccccagagcccaggc

SEQ ID NO: 6571630 - DNA, 13 bp, Homo sapiens
aagcccccagggc

SEQ ID NO: 6571631 - DNA, 15 bp, Homo sapiens
aagcccccagggcct

SEQ ID NO: 6571632 - DNA, 19 bp, Homo sapiens
aagcccccagggcctccag

SEQ ID NO: 6571633 - DNA, 16 bp, Homo sapiens
aagccccccagctccc

SEQ ID NO: 6571634 - DNA, 17 bp, Homo sapiens
aagccccccagctccca

SEQ ID NO: 6571635 - DNA, 20 bp, Homo sapiens
aagccccccagctcccacac

SEQ ID NO: 6571636 - DNA, 21 bp, Homo sapiens
aagccccccagctcccacacc

SEQ ID NO: 6571637 - DNA, 19 bp, Homo sapiens
aagccccctggcagctgcc

SEQ ID NO: 6571638 - DNA, 22 bp, Homo sapiens
aagccccctggcagctgcccct

SEQ ID NO: 6571639 - DNA, 23 bp, Homo sapiens
aagccccctggcagctgcccctc

SEQ ID NO: 6571640 - DNA, 20 bp, Homo sapiens
aagccccgcatatgtgagtg

SEQ ID NO: 6571641 - DNA, 19 bp, Homo sapiens
aagcccctagtcttagaga

SEQ ID NO: 6571642 - DNA, 17 bp, Homo sapiens
aagcccctcacctcagg

SEQ ID NO: 6571643 - DNA, 14 bp, Homo sapiens
aagcccctctttct

SEQ ID NO: 6571644 - DNA, 17 bp, Homo sapiens
aagcccctgtgaccctc

SEQ ID NO: 6571645 - DNA, 21 bp, Homo sapiens
aagccccttctctcaatccct

SEQ ID NO: 6571646 - DNA, 21 bp, Homo sapiens
aagccccttgctctcccctgc

SEQ ID NO: 6571647 - DNA, 13 bp, Homo sapiens
aagccccttggag

SEQ ID NO: 6571648 - DNA, 14 bp, Homo sapiens
aagccccttggaga

SEQ ID NO: 6571649 - DNA, 23 bp, Homo sapiens
aagcccgaccgggccaggcctgg

SEQ ID NO: 6571650 - DNA, 19 bp, Homo sapiens
aagcccgcctgacagaaac

SEQ ID NO: 6571651 - DNA, 23 bp, Homo sapiens
aagcccgcttgctcgcttgctgg

SEQ ID NO: 6571652 - DNA, 19 bp, Homo sapiens
aagcccgtgtcctgccttg

SEQ ID NO: 6571653 - DNA, 15 bp, Homo sapiens
aagccctaagcctgt

SEQ ID NO: 6571654 - DNA, 23 bp, Homo sapiens
aagccctaagcctgtccccagac

SEQ ID NO: 6571655 - DNA, 19 bp, Homo sapiens
aagccctacagagctgtgg

SEQ ID NO: 6571656 - DNA, 17 bp, Homo sapiens
aagccctcatcttctct

SEQ ID NO: 6571657 - DNA, 13 bp, Homo sapiens
aagccctcccagg

SEQ ID NO: 6571658 - DNA, 17 bp, Homo sapiens
aagccctccctgtctgt

SEQ ID NO: 6571659 - DNA, 11 bp, Homo sapiens
aagccctcctt

SEQ ID NO: 6571660 - DNA, 13 bp, Homo sapiens
aagccctccttcc

SEQ ID NO: 6571661 - DNA, 15 bp, Homo sapiens
aagccctccttccac

SEQ ID NO: 6571662 - DNA, 16 bp, Homo sapiens
aagccctccttgccac

SEQ ID NO: 6571663 - DNA, 18 bp, Homo sapiens
aagccctccttgccaccc

SEQ ID NO: 6571664 - DNA, 14 bp, Homo sapiens
aagccctcttccat

SEQ ID NO: 6571665 - DNA, 16 bp, Homo sapiens
aagccctcttccatca

SEQ ID NO: 6571666 - DNA, 18 bp, Homo sapiens
aagccctcttccatcatg

SEQ ID NO: 6571667 - DNA, 19 bp, Homo sapiens
ttcctggaaacagcatgaa

SEQ ID NO: 6571668 - DNA, 20 bp, Homo sapiens
ttcctggaatgcattcactc

SEQ ID NO: 6571669 - DNA, 17 bp, Homo sapiens
ttcctggaattgccagc

SEQ ID NO: 6571670 - DNA, 11 bp, Homo sapiens
ttcctggacac

SEQ ID NO: 6571671 - DNA, 15 bp, Homo sapiens
ttcctggacactcag

SEQ ID NO: 6571672 - DNA, 19 bp, Homo sapiens
ttcctggacactcagacct

SEQ ID NO: 6571673 - DNA, 17 bp, Homo sapiens
ttcctggacagctgtgc

SEQ ID NO: 6571674 - DNA, 15 bp, Homo sapiens
ttcctggacatcacc

SEQ ID NO: 6571675 - DNA, 23 bp, Homo sapiens
ttcctggaccggggccttggtcc

SEQ ID NO: 6571676 - DNA, 23 bp, Homo sapiens
ttcctggactggcccttgcccaa

SEQ ID NO: 6571677 - DNA, 17 bp, Homo sapiens
ttcctggacttaaagaa

SEQ ID NO: 6571678 - DNA, 19 bp, Homo sapiens
ttcctggagccccagaacc

SEQ ID NO: 6571679 - DNA, 13 bp, Homo sapiens
ttcctggagcccg

SEQ ID NO: 6571680 - DNA, 19 bp, Homo sapiens
ttcctggaggtcagcattt

SEQ ID NO: 6571681 - DNA, 10 bp, Homo sapiens
ttcctggagt

SEQ ID NO: 6571682 - DNA, 20 bp, Homo sapiens
ttcctggagtgccctgcagg

SEQ ID NO: 6571683 - DNA, 21 bp, Homo sapiens
ttcctggatggggcagagctt

SEQ ID NO: 6571684 - DNA, 18 bp, Homo sapiens
ttcctggattttctttct

SEQ ID NO: 6571685 - DNA, 18 bp, Homo sapiens
ttcctggcaatagtgtgt

SEQ ID NO: 6571686 - DNA, 22 bp, Homo sapiens
ttcctggcaatagtgtgttctg

SEQ ID NO: 6571687 - DNA, 14 bp, Homo sapiens
ttcctggcacaatg

SEQ ID NO: 6571688 - DNA, 23 bp, Homo sapiens
ttcctggcacattgcccctctgc

SEQ ID NO: 6571689 - DNA, 20 bp, Homo sapiens
ttcctggcactgcttccagt

SEQ ID NO: 6571690 - DNA, 17 bp, Homo sapiens
ttcctggcagtctcagt

SEQ ID NO: 6571691 - DNA, 10 bp, Homo sapiens
ttcctggcat

SEQ ID NO: 6571692 - DNA, 16 bp, Homo sapiens
ttcctggcccaggcct

SEQ ID NO: 6571693 - DNA, 10 bp, Homo sapiens
ttcctggcct

SEQ ID NO: 6571694 - DNA, 18 bp, Homo sapiens
ttcctggcctcactggct

SEQ ID NO: 6571695 - DNA, 20 bp, Homo sapiens
ttcctggcctcactggctgg

SEQ ID NO: 6571696 - DNA, 21 bp, Homo sapiens
ttcctggcctcagccagctgc

SEQ ID NO: 6571697 - DNA, 12 bp, Homo sapiens
ttcctggcctcc

SEQ ID NO: 6571698 - DNA, 17 bp, Homo sapiens
ttcctggcctcccttct

SEQ ID NO: 6571699 - DNA, 20 bp, Homo sapiens
ttcctggcctcccttctcct

SEQ ID NO: 6571700 - DNA, 17 bp, Homo sapiens
ttcctggcctcttctgg

SEQ ID NO: 6571701 - DNA, 20 bp, Homo sapiens
ttcctggcctcttctgggct

SEQ ID NO: 6571702 - DNA, 14 bp, Homo sapiens
ttcctggcctgaga

SEQ ID NO: 6571703 - DNA, 22 bp, Homo sapiens
ttcctggcgggggtgggccgtg

SEQ ID NO: 6571704 - DNA, 12 bp, Homo sapiens
ttcctggctctg

SEQ ID NO: 6571705 - DNA, 21 bp, Homo sapiens
ttcctgggaaatattccctag

SEQ ID NO: 6571706 - DNA, 16 bp, Homo sapiens
ttcctgggaacatcac

SEQ ID NO: 6571707 - DNA, 17 bp, Homo sapiens
ttcctgggaatggaata

SEQ ID NO: 6571708 - DNA, 18 bp, Homo sapiens
ttcctgggaatggaataa

SEQ ID NO: 6571709 - DNA, 19 bp, Homo sapiens
ttcctgggaccccctcgcc

SEQ ID NO: 6571710 - DNA, 17 bp, Homo sapiens
ttcctgggactgtcaga

SEQ ID NO: 6571711 - DNA, 15 bp, Homo sapiens
ttcctgggagctttt

SEQ ID NO: 6571712 - DNA, 16 bp, Homo sapiens
ttcctgggagcttttg

SEQ ID NO: 6571713 - DNA, 19 bp, Homo sapiens
ttcctgggaggacaggcag

SEQ ID NO: 6571714 - DNA, 14 bp, Homo sapiens
ttcctgggcaagaa

SEQ ID NO: 6571715 - DNA, 19 bp, Homo sapiens
ttcctgggcacacgctgct

SEQ ID NO: 6571716 - DNA, 20 bp, Homo sapiens
ttcctgggcacacgctgctc

SEQ ID NO: 6571717 - DNA, 22 bp, Homo sapiens
ttcctgggcacacgctgctctg

SEQ ID NO: 6571718 - DNA, 17 bp, Homo sapiens
ttcctgggcagcccaga

SEQ ID NO: 6571719 - DNA, 19 bp, Homo sapiens
ttcctgggcagcccagaga

SEQ ID NO: 6571720 - DNA, 15 bp, Homo sapiens
ttcctgggcagttgg

SEQ ID NO: 6571721 - DNA, 11 bp, Homo sapiens
ttcctgggcct

SEQ ID NO: 6571722 - DNA, 14 bp, Homo sapiens
ttcctgggccttct

SEQ ID NO: 6571723 - DNA, 21 bp, Homo sapiens
ttcctgggccttctcagctct

SEQ ID NO: 6571724 - DNA, 18 bp, Homo sapiens
ttcctggggaccaagatt

SEQ ID NO: 6571725 - DNA, 19 bp, Homo sapiens
ttcctggggcatccatggg

SEQ ID NO: 6571726 - DNA, 18 bp, Homo sapiens
ttcctggggcccaaatgc

SEQ ID NO: 6571727 - DNA, 15 bp, Homo sapiens
ttcctggggccccgc

SEQ ID NO: 6571728 - DNA, 21 bp, Homo sapiens
ttcctggggccgcctgccctg

SEQ ID NO: 6571729 - DNA, 22 bp, Homo sapiens
ttcctggggccgcctgccctgc

SEQ ID NO: 6571730 - DNA, 14 bp, Homo sapiens
ttcctggggctggt

SEQ ID NO: 6571731 - DNA, 21 bp, Homo sapiens
ttcctggggtaaagtatcact

SEQ ID NO: 6571732 - DNA, 20 bp, Homo sapiens
ttcctggggtgccctccact

SEQ ID NO: 6571733 - DNA, 21 bp, Homo sapiens
ttcctggggtgccctccactg

SEQ ID NO: 6571734 - DNA, 15 bp, Homo sapiens
ttcctgggtcctgcc

SEQ ID NO: 6571735 - DNA, 14 bp, Homo sapiens
ttcctgggtgctca

SEQ ID NO: 6571736 - DNA, 22 bp, Homo sapiens
ttcctgggtggctactctgtgc

SEQ ID NO: 6571737 - DNA, 23 bp, Homo sapiens
ttcctgggtggctactctgtgcc

SEQ ID NO: 6571738 - DNA, 15 bp, Homo sapiens
ttcctggtacccagc

SEQ ID NO: 6571739 - DNA, 16 bp, Homo sapiens
ttcctggtacccagcc

SEQ ID NO: 6571740 - DNA, 19 bp, Homo sapiens
ttcctggtacccagccatc

SEQ ID NO: 6571741 - DNA, 21 bp, Homo sapiens
ttcctggtacccagccatctg

SEQ ID NO: 6571742 - DNA, 19 bp, Homo sapiens
ttcctggtgccaatttcaa

SEQ ID NO: 6571743 - DNA, 19 bp, Homo sapiens
ttcctggttaagcaggcat

SEQ ID NO: 6571744 - DNA, 19 bp, Homo sapiens
ttcctggttgttcctgcat

SEQ ID NO: 6571745 - DNA, 18 bp, Homo sapiens
ttcctgtaaataagagtt

SEQ ID NO: 6571746 - DNA, 19 bp, Homo sapiens
ttcctgtaacacaagccac

SEQ ID NO: 6571747 - DNA, 13 bp, Homo sapiens
ttcctgtaatata

SEQ ID NO: 6571748 - DNA, 21 bp, Homo sapiens
ttcctgtaatatatttatata

SEQ ID NO: 6571749 - DNA, 16 bp, Homo sapiens
ttcctgtactactgcc

SEQ ID NO: 6571750 - DNA, 17 bp, Homo sapiens
ttcctgtactactgcct

SEQ ID NO: 6571751 - DNA, 17 bp, Homo sapiens
ttcctgtagcatcttct

SEQ ID NO: 6571752 - DNA, 22 bp, Homo sapiens
ttcctgtagccttctgtaggaa

SEQ ID NO: 6571753 - DNA, 19 bp, Homo sapiens
ttcctgtagtgcccctccc

SEQ ID NO: 6571754 - DNA, 22 bp, Homo sapiens
ttcctgtagtggcaaaaaagaa

SEQ ID NO: 6571755 - DNA, 20 bp, Homo sapiens
ttcctgtatttgttcccaag

SEQ ID NO: 6571756 - DNA, 16 bp, Homo sapiens
ttcctgtcagtgtttt

SEQ ID NO: 6571757 - DNA, 22 bp, Homo sapiens
ttcctgtcagtgtttttgaaac

SEQ ID NO: 6571758 - DNA, 17 bp, Homo sapiens
ttcctgtcatagggaag

SEQ ID NO: 6571759 - DNA, 22 bp, Homo sapiens
ttcctgtccagctccaacctgc

SEQ ID NO: 6571760 - DNA, 11 bp, Homo sapiens
ttcctgtccca

SEQ ID NO: 6571761 - DNA, 15 bp, Homo sapiens
ttcctgtcccacatg

SEQ ID NO: 6571762 - DNA, 23 bp, Homo sapiens
ttcctgtcccaccatacgagcac

SEQ ID NO: 6571763 - DNA, 20 bp, Homo sapiens
ttcctgtccccaaaatgtga

SEQ ID NO: 6571764 - DNA, 17 bp, Homo sapiens
ttcctgtccccagggga

SEQ ID NO: 6571765 - DNA, 15 bp, Homo sapiens
ttcctgtccctgcgc

SEQ ID NO: 6571766 - DNA, 23 bp, Homo sapiens
ttcctgtccctgcgcctttcctt

SEQ ID NO: 6571767 - DNA, 13 bp, Homo sapiens
ttcctgtcctgcc

SEQ ID NO: 6571768 - DNA, 17 bp, Homo sapiens
ttcctgtcctgcctcct

SEQ ID NO: 6571769 - DNA, 16 bp, Homo sapiens
ttcctgtcctgctcac

SEQ ID NO: 6571770 - DNA, 18 bp, Homo sapiens
ttcctgtctcaatagctc

SEQ ID NO: 6571771 - DNA, 14 bp, Homo sapiens
ttcctgtctggccc

SEQ ID NO: 6571772 - DNA, 15 bp, Homo sapiens
ttcctgtctggccca

SEQ ID NO: 6571773 - DNA, 16 bp, Homo sapiens
ttcctgtctgtttata

SEQ ID NO: 6571774 - DNA, 14 bp, Homo sapiens
ttcctgtcttcctg

SEQ ID NO: 6571775 - DNA, 19 bp, Homo sapiens
ttcctgtgactgtttttgt

SEQ ID NO: 6571776 - DNA, 13 bp, Homo sapiens
ttcctgtgaggat

SEQ ID NO: 6571777 - DNA, 20 bp, Homo sapiens
ttcctgtgatacatttctga

SEQ ID NO: 6571778 - DNA, 15 bp, Homo sapiens
ttcctgtgcacagcc

SEQ ID NO: 6571779 - DNA, 21 bp, Homo sapiens
ttcctgtgccaggactctctt

SEQ ID NO: 6571780 - DNA, 23 bp, Homo sapiens
ttcctgtgccaggactctctttc

SEQ ID NO: 6571781 - DNA, 14 bp, Homo sapiens
ttcctgtgccaggt

SEQ ID NO: 6571782 - DNA, 15 bp, Homo sapiens
ttcctgtgccctaga

SEQ ID NO: 6571783 - DNA, 13 bp, Homo sapiens
ttcctgtgccctc

SEQ ID NO: 6571784 - DNA, 12 bp, Homo sapiens
ttcctgtgcctc

SEQ ID NO: 6571785 - DNA, 22 bp, Homo sapiens
ttcctgtgctaagtctttccca

SEQ ID NO: 6571786 - DNA, 18 bp, Homo sapiens
ttcctgtggaataaagat

SEQ ID NO: 6571787 - DNA, 14 bp, Homo sapiens
ttcctgtggagaca

SEQ ID NO: 6571788 - DNA, 15 bp, Homo sapiens
ttcctgtggagacac

SEQ ID NO: 6571789 - DNA, 18 bp, Homo sapiens
ttcctgtggagacactga

SEQ ID NO: 6571790 - DNA, 19 bp, Homo sapiens
ttcctgtggccaggaggtt

SEQ ID NO: 6571791 - DNA, 22 bp, Homo sapiens
ttcctgtggctccctctctcct

SEQ ID NO: 6571792 - DNA, 18 bp, Homo sapiens
ttcctgtgtaacatctgc

SEQ ID NO: 6571793 - DNA, 22 bp, Homo sapiens
ttcctgtgtacctctagaatcc

SEQ ID NO: 6571794 - DNA, 12 bp, Homo sapiens
ttcctgtgtatt

SEQ ID NO: 6571795 - DNA, 13 bp, Homo sapiens
ttcctgtgtattc

SEQ ID NO: 6571796 - DNA, 13 bp, Homo sapiens
ttcctgtgtcaat

SEQ ID NO: 6571797 - DNA, 18 bp, Homo sapiens
ttcctgtgtcaatccaga

SEQ ID NO: 6571798 - DNA, 14 bp, Homo sapiens
ttcctgtgtctcca

SEQ ID NO: 6571799 - DNA, 19 bp, Homo sapiens
ttcctgtgtttgtcctggg

SEQ ID NO: 6571800 - DNA, 23 bp, Homo sapiens
ttcctgttaggtattagaaagtg

SEQ ID NO: 6571801 - DNA, 21 bp, Homo sapiens
ttcctgttcaccttatgtatt

SEQ ID NO: 6571802 - DNA, 14 bp, Homo sapiens
ttcctgttcagcat

SEQ ID NO: 6571803 - DNA, 19 bp, Homo sapiens
ttcctgttcagtaataaaa

SEQ ID NO: 6571804 - DNA, 13 bp, Homo sapiens
ttcctgttccctc

SEQ ID NO: 6571805 - DNA, 20 bp, Homo sapiens
ttcctgttcttaagacgtga

SEQ ID NO: 6571806 - DNA, 17 bp, Homo sapiens
ttcctgttcttccttcc

SEQ ID NO: 6571807 - DNA, 18 bp, Homo sapiens
ttcctgttgatgggaaaa

SEQ ID NO: 6571808 - DNA, 14 bp, Homo sapiens
ttcctgttgtctga

SEQ ID NO: 6571809 - DNA, 17 bp, Homo sapiens
ttcctgttgtgtaataa

SEQ ID NO: 6571810 - DNA, 14 bp, Homo sapiens
ttcctgtttactga

SEQ ID NO: 6571811 - DNA, 16 bp, Homo sapiens
ttcctgtttccagggt

SEQ ID NO: 6571812 - DNA, 13 bp, Homo sapiens
ttcctgtttctaa

SEQ ID NO: 6571813 - DNA, 18 bp, Homo sapiens
ttcctgtttctgaaaaga

SEQ ID NO: 6571814 - DNA, 21 bp, Homo sapiens
ttcctgtttgaacccaggaga

SEQ ID NO: 6571815 - DNA, 14 bp, Homo sapiens
ttcctgtttgtaca

SEQ ID NO: 6571816 - DNA, 21 bp, Homo sapiens
ttcctgttttaagcagctcta

SEQ ID NO: 6571817 - DNA, 13 bp, Homo sapiens
ttccttaaaattt

SEQ ID NO: 6571818 - DNA, 14 bp, Homo sapiens
ttccttaaacatga

SEQ ID NO: 6571819 - DNA, 13 bp, Homo sapiens
ttccttaaatgaa

SEQ ID NO: 6571820 - DNA, 14 bp, Homo sapiens
ttccttaaatgaac

SEQ ID NO: 6571821 - DNA, 16 bp, Homo sapiens
ttccttaaatgaacta

SEQ ID NO: 6571822 - DNA, 24 bp, Homo sapiens
ttccttaaatgaactactgctatt

SEQ ID NO: 6571823 - DNA, 14 bp, Homo sapiens
ttccttaacagctg

SEQ ID NO: 6571824 - DNA, 18 bp, Homo sapiens
ttccttaacagctgtatt

SEQ ID NO: 6571825 - DNA, 21 bp, Homo sapiens
ttccttaacagctgtattatc

SEQ ID NO: 6571826 - DNA, 15 bp, Homo sapiens
ttccttaagccagga

SEQ ID NO: 6571827 - DNA, 14 bp, Homo sapiens
ttccttaataaatt

SEQ ID NO: 6571828 - DNA, 13 bp, Homo sapiens
ttccttaatagcc

SEQ ID NO: 6571829 - DNA, 19 bp, Homo sapiens
ttccttaattgtattgttt

SEQ ID NO: 6571830 - DNA, 13 bp, Homo sapiens
ttccttacataaa

SEQ ID NO: 6571831 - DNA, 15 bp, Homo sapiens
ttccttacccaaact

SEQ ID NO: 6571832 - DNA, 14 bp, Homo sapiens
ttccttacctttac

SEQ ID NO: 6571833 - DNA, 16 bp, Homo sapiens
ttccttacctttaccc

SEQ ID NO: 6571834 - DNA, 16 bp, Homo sapiens
ttccttactagaaata

SEQ ID NO: 6571835 - DNA, 13 bp, Homo sapiens
ttccttacttgca

SEQ ID NO: 6571836 - DNA, 15 bp, Homo sapiens
ttccttacttgcact

SEQ ID NO: 6571837 - DNA, 19 bp, Homo sapiens
ttccttagacccgccaggt

SEQ ID NO: 6571838 - DNA, 14 bp, Homo sapiens
ttccttagcattgt

SEQ ID NO: 6571839 - DNA, 17 bp, Homo sapiens
ttccttaggagatgtca

SEQ ID NO: 6571840 - DNA, 19 bp, Homo sapiens
ttccttaggcttaagagag

SEQ ID NO: 6571841 - DNA, 22 bp, Homo sapiens
ttccttaggtaatctataacta

SEQ ID NO: 6571842 - DNA, 14 bp, Homo sapiens
ttccttagttttta

SEQ ID NO: 6571843 - DNA, 14 bp, Homo sapiens
ttccttataagaat

SEQ ID NO: 6571844 - DNA, 22 bp, Homo sapiens
ttccttataagaattaatctta

SEQ ID NO: 6571845 - DNA, 14 bp, Homo sapiens
ttccttatccctct

SEQ ID NO: 6571846 - DNA, 19 bp, Homo sapiens
aagccctgaatttcttctt

SEQ ID NO: 6571847 - DNA, 19 bp, Homo sapiens
aagccctgagctttctgct

SEQ ID NO: 6571848 - DNA, 19 bp, Homo sapiens
aagccctgaggcctgaggc

SEQ ID NO: 6571849 - DNA, 11 bp, Homo sapiens
aagccctgcaa

SEQ ID NO: 6571850 - DNA, 19 bp, Homo sapiens
aagccctgcataatgttaa

SEQ ID NO: 6571851 - DNA, 14 bp, Homo sapiens
aagccctgcccaca

SEQ ID NO: 6571852 - DNA, 17 bp, Homo sapiens
aagccctgcccacagaa

SEQ ID NO: 6571853 - DNA, 17 bp, Homo sapiens
aagccctgcctctgtgt

SEQ ID NO: 6571854 - DNA, 10 bp, Homo sapiens
aagccctgct

SEQ ID NO: 6571855 - DNA, 20 bp, Homo sapiens
aagccctgctctttctctga

SEQ ID NO: 6571856 - DNA, 19 bp, Homo sapiens
aagccctgcttgctggaaa

SEQ ID NO: 6571857 - DNA, 17 bp, Homo sapiens
aagccctgcttttgcat

SEQ ID NO: 6571858 - DNA, 23 bp, Homo sapiens
aagccctggagccaactgctgct

SEQ ID NO: 6571859 - DNA, 13 bp, Homo sapiens
aagccctggcccc

SEQ ID NO: 6571860 - DNA, 16 bp, Homo sapiens
aagccctggggcaggg

SEQ ID NO: 6571861 - DNA, 22 bp, Homo sapiens
aagccctggtgaccagaccaag

SEQ ID NO: 6571862 - DNA, 20 bp, Homo sapiens
aagccctgtcgagacacttg

SEQ ID NO: 6571863 - DNA, 23 bp, Homo sapiens
aagcccttccatgtcgcctctgc

SEQ ID NO: 6571864 - DNA, 21 bp, Homo sapiens
aagcccttctcaagaccgagt

SEQ ID NO: 6571865 - DNA, 14 bp, Homo sapiens
aagccctttgccat

SEQ ID NO: 6571866 - DNA, 18 bp, Homo sapiens
aagccctttgcctgtaga

SEQ ID NO: 6571867 - DNA, 12 bp, Homo sapiens
aagccctttgct

SEQ ID NO: 6571868 - DNA, 15 bp, Homo sapiens
aagccgaccttagat

SEQ ID NO: 6571869 - DNA, 14 bp, Homo sapiens
aagccgactctggc

SEQ ID NO: 6571870 - DNA, 17 bp, Homo sapiens
aagccgactctggccct

SEQ ID NO: 6571871 - DNA, 19 bp, Homo sapiens
aagccgcaagctctcagca

SEQ ID NO: 6571872 - DNA, 13 bp, Homo sapiens
aagccgcccagtg

SEQ ID NO: 6571873 - DNA, 23 bp, Homo sapiens
aagccgcccagtgggacccacag

SEQ ID NO: 6571874 - DNA, 16 bp, Homo sapiens
aagccggcccaaccca

SEQ ID NO: 6571875 - DNA, 13 bp, Homo sapiens
aagccggcggccc

SEQ ID NO: 6571876 - DNA, 14 bp, Homo sapiens
aagccgggaacaga

SEQ ID NO: 6571877 - DNA, 20 bp, Homo sapiens
aagccgggggaggggccctc

SEQ ID NO: 6571878 - DNA, 21 bp, Homo sapiens
aagccgggggaggggccctca

SEQ ID NO: 6571879 - DNA, 22 bp, Homo sapiens
aagccgggggaggggccctcag

SEQ ID NO: 6571880 - DNA, 16 bp, Homo sapiens
aagccggtgtccctgg

SEQ ID NO: 6571881 - DNA, 19 bp, Homo sapiens
aagccggtgtccctggatg

SEQ ID NO: 6571882 - DNA, 19 bp, Homo sapiens
aagccgttgaatctgggag

SEQ ID NO: 6571883 - DNA, 17 bp, Homo sapiens
aagccgttgacaaggct

SEQ ID NO: 6571884 - DNA, 22 bp, Homo sapiens
aagccgttgtttacttaaagat

SEQ ID NO: 6571885 - DNA, 16 bp, Homo sapiens
aagcctaaatttgtgc

SEQ ID NO: 6571886 - DNA, 20 bp, Homo sapiens
aagcctaacttcatagaaac

SEQ ID NO: 6571887 - DNA, 17 bp, Homo sapiens
aagcctaagggatcctg

SEQ ID NO: 6571888 - DNA, 22 bp, Homo sapiens
aagcctaatcacagtttttcct

SEQ ID NO: 6571889 - DNA, 21 bp, Homo sapiens
aagcctagtgtgtgtgctttc

SEQ ID NO: 6571890 - DNA, 23 bp, Homo sapiens
aagcctatacgtttctgtggagt

SEQ ID NO: 6571891 - DNA, 22 bp, Homo sapiens
aagcctatttatttgaaagtcc

SEQ ID NO: 6571892 - DNA, 23 bp, Homo sapiens
aagcctcaaaacctgattggcca

SEQ ID NO: 6571893 - DNA, 22 bp, Homo sapiens
aagcctcaaagagagaaagttt

SEQ ID NO: 6571894 - DNA, 21 bp, Homo sapiens
aagcctcaaatttgaacatgt

SEQ ID NO: 6571895 - DNA, 23 bp, Homo sapiens
aagcctcaagttccagtgcagag

SEQ ID NO: 6571896 - DNA, 22 bp, Homo sapiens
aagcctcactattacttgaact

SEQ ID NO: 6571897 - DNA, 11 bp, Homo sapiens
aagcctcagag

SEQ ID NO: 6571898 - DNA, 23 bp, Homo sapiens
aagcctcagcaaacccaaagatg

SEQ ID NO: 6571899 - DNA, 11 bp, Homo sapiens
aagcctcagcc

SEQ ID NO: 6571900 - DNA, 11 bp, Homo sapiens
aagcctcagct

SEQ ID NO: 6571901 - DNA, 20 bp, Homo sapiens
aagcctcatatttaaagaca

SEQ ID NO: 6571902 - DNA, 23 bp, Homo sapiens
aagcctcatgggagtcagggagc

SEQ ID NO: 6571903 - DNA, 19 bp, Homo sapiens
aagcctccaagggtttcga

SEQ ID NO: 6571904 - DNA, 13 bp, Homo sapiens
aagcctccacagc

SEQ ID NO: 6571905 - DNA, 16 bp, Homo sapiens
aagcctccagcatctt

SEQ ID NO: 6571906 - DNA, 19 bp, Homo sapiens
aagcctccgctgggcttca

SEQ ID NO: 6571907 - DNA, 20 bp, Homo sapiens
aagcctccgtggaacattct

SEQ ID NO: 6571908 - DNA, 19 bp, Homo sapiens
aagcctcctccagccgcca

SEQ ID NO: 6571909 - DNA, 14 bp, Homo sapiens
aagcctcctgcccc

SEQ ID NO: 6571910 - DNA, 16 bp, Homo sapiens
aagcctcctgccccct

SEQ ID NO: 6571911 - DNA, 14 bp, Homo sapiens
aagcctcctgtacc

SEQ ID NO: 6571912 - DNA, 18 bp, Homo sapiens
aagcctcctgtctcccct

SEQ ID NO: 6571913 - DNA, 20 bp, Homo sapiens
aagcctccttacattaaaaa

SEQ ID NO: 6571914 - DNA, 18 bp, Homo sapiens
aagcctcgaggtgccttc

SEQ ID NO: 6571915 - DNA, 17 bp, Homo sapiens
aagcctctctccttggc

SEQ ID NO: 6571916 - DNA, 19 bp, Homo sapiens
aagcctctctctccctccc

SEQ ID NO: 6571917 - DNA, 18 bp, Homo sapiens
aagcctctgccccaaggg

SEQ ID NO: 6571918 - DNA, 18 bp, Homo sapiens
aagcctctgccctgcctc

SEQ ID NO: 6571919 - DNA, 20 bp, Homo sapiens
aagcctctgccctgcctccc

SEQ ID NO: 6571920 - DNA, 22 bp, Homo sapiens
aagcctctgccctgcctccctt

SEQ ID NO: 6571921 - DNA, 15 bp, Homo sapiens
aagcctctgcttccg

SEQ ID NO: 6571922 - DNA, 12 bp, Homo sapiens
aagcctctggga

SEQ ID NO: 6571923 - DNA, 15 bp, Homo sapiens
aagcctctgtctttt

SEQ ID NO: 6571924 - DNA, 18 bp, Homo sapiens
aagcctctgtcttttctg

SEQ ID NO: 6571925 - DNA, 13 bp, Homo sapiens
aagcctctgtgtc

SEQ ID NO: 6571926 - DNA, 17 bp, Homo sapiens
aagcctctgtgtcactg

SEQ ID NO: 6571927 - DNA, 15 bp, Homo sapiens
aagcctcttatgggg

SEQ ID NO: 6571928 - DNA, 23 bp, Homo sapiens
aagcctcttatgggggtgtttct

SEQ ID NO: 6571929 - DNA, 17 bp, Homo sapiens
aagcctgaaaattccaa

SEQ ID NO: 6571930 - DNA, 19 bp, Homo sapiens
aagcctgaaagtaatttca

SEQ ID NO: 6571931 - DNA, 20 bp, Homo sapiens
aagcctgaagggcctcccag

SEQ ID NO: 6571932 - DNA, 23 bp, Homo sapiens
aagcctgaatttctcagtgttgg

SEQ ID NO: 6571933 - DNA, 12 bp, Homo sapiens
aagcctgacaac

SEQ ID NO: 6571934 - DNA, 16 bp, Homo sapiens
aagcctgactgctcgg

SEQ ID NO: 6571935 - DNA, 12 bp, Homo sapiens
aagcctgagcct

SEQ ID NO: 6571936 - DNA, 13 bp, Homo sapiens
aagcctgagcctt

SEQ ID NO: 6571937 - DNA, 22 bp, Homo sapiens
aagcctgagccttagctcccag

SEQ ID NO: 6571938 - DNA, 22 bp, Homo sapiens
aagcctgagggaaaggccagca

SEQ ID NO: 6571939 - DNA, 24 bp, Homo sapiens
aagcctgagggaaaggccagcact

SEQ ID NO: 6571940 - DNA, 15 bp, Homo sapiens
aagcctgagggagga

SEQ ID NO: 6571941 - DNA, 19 bp, Homo sapiens
aagcctgatactttagcca

SEQ ID NO: 6571942 - DNA, 12 bp, Homo sapiens
aagcctgcaact

SEQ ID NO: 6571943 - DNA, 21 bp, Homo sapiens
aagcctgcagctttctggaaa

SEQ ID NO: 6571944 - DNA, 11 bp, Homo sapiens
aagcctgcccc

SEQ ID NO: 6571945 - DNA, 19 bp, Homo sapiens
aagcctgccccggccactc

SEQ ID NO: 6571946 - DNA, 11 bp, Homo sapiens
aagcctgccct

SEQ ID NO: 6571947 - DNA, 17 bp, Homo sapiens
aagcctgcccttgtctg

SEQ ID NO: 6571948 - DNA, 21 bp, Homo sapiens
aagcctgcctaggaattccca

SEQ ID NO: 6571949 - DNA, 15 bp, Homo sapiens
aagcctgcctcccaa

SEQ ID NO: 6571950 - DNA, 22 bp, Homo sapiens
aagcctgcctcgccttgtgtta

SEQ ID NO: 6571951 - DNA, 20 bp, Homo sapiens
aagcctgcggcgccagcctc

SEQ ID NO: 6571952 - DNA, 13 bp, Homo sapiens
aagcctgctgatt

SEQ ID NO: 6571953 - DNA, 14 bp, Homo sapiens
aagcctgctggctg

SEQ ID NO: 6571954 - DNA, 19 bp, Homo sapiens
aagcctgctggctgcggcc

SEQ ID NO: 6571955 - DNA, 21 bp, Homo sapiens
aagcctgctggctgcggcccc

SEQ ID NO: 6571956 - DNA, 14 bp, Homo sapiens
aagcctgctgtgtc

SEQ ID NO: 6571957 - DNA, 19 bp, Homo sapiens
aagcctgctttttaagtgt

SEQ ID NO: 6571958 - DNA, 12 bp, Homo sapiens
aagcctggaagc

SEQ ID NO: 6571959 - DNA, 19 bp, Homo sapiens
aagcctggacgcagccaca

SEQ ID NO: 6571960 - DNA, 16 bp, Homo sapiens
aagcctggactctgcc

SEQ ID NO: 6571961 - DNA, 17 bp, Homo sapiens
aagcctggactctgccc

SEQ ID NO: 6571962 - DNA, 11 bp, Homo sapiens
aagcctggagc

SEQ ID NO: 6571963 - DNA, 12 bp, Homo sapiens
aagcctggagcc

SEQ ID NO: 6571964 - DNA, 18 bp, Homo sapiens
aagcctggagcccctgtg

SEQ ID NO: 6571965 - DNA, 12 bp, Homo sapiens
aagcctggagga

SEQ ID NO: 6571966 - DNA, 20 bp, Homo sapiens
aagcctggattccagcagtg

SEQ ID NO: 6571967 - DNA, 14 bp, Homo sapiens
aagcctggcaccca

SEQ ID NO: 6571968 - DNA, 15 bp, Homo sapiens
aagcctggcacccac

SEQ ID NO: 6571969 - DNA, 16 bp, Homo sapiens
aagcctggcaggggat

SEQ ID NO: 6571970 - DNA, 12 bp, Homo sapiens
aagcctggcttc

SEQ ID NO: 6571971 - DNA, 16 bp, Homo sapiens
aagcctggcttcttat

SEQ ID NO: 6571972 - DNA, 17 bp, Homo sapiens
aagcctgggattgacag

SEQ ID NO: 6571973 - DNA, 16 bp, Homo sapiens
aagcctgggcttgagc

SEQ ID NO: 6571974 - DNA, 15 bp, Homo sapiens
aagcctgggggcctg

SEQ ID NO: 6571975 - DNA, 17 bp, Homo sapiens
aagcctgggggcctggc

SEQ ID NO: 6571976 - DNA, 20 bp, Homo sapiens
aagcctgggggcctggctgg

SEQ ID NO: 6571977 - DNA, 21 bp, Homo sapiens
aagcctgggggcctggctggc

SEQ ID NO: 6571978 - DNA, 23 bp, Homo sapiens
aagcctgggtgtcaagtgcctgc

SEQ ID NO: 6571979 - DNA, 17 bp, Homo sapiens
aagcctggtcagcccaa

SEQ ID NO: 6571980 - DNA, 17 bp, Homo sapiens
aagcctgtaacactcct

SEQ ID NO: 6571981 - DNA, 17 bp, Homo sapiens
aagcctgtaatcccagc

SEQ ID NO: 6571982 - DNA, 23 bp, Homo sapiens
aagcctgtccccagaccaaccct

SEQ ID NO: 6571983 - DNA, 13 bp, Homo sapiens
aagcctgtctctt

SEQ ID NO: 6571984 - DNA, 11 bp, Homo sapiens
aagcctgtgcc

SEQ ID NO: 6571985 - DNA, 15 bp, Homo sapiens
aagcctgtggctgtg

SEQ ID NO: 6571986 - DNA, 17 bp, Homo sapiens
aagcctgttcatggcag

SEQ ID NO: 6571987 - DNA, 16 bp, Homo sapiens
aagcctgttcccctca

SEQ ID NO: 6571988 - DNA, 19 bp, Homo sapiens
aagcctgttttgttggaag

SEQ ID NO: 6571989 - DNA, 19 bp, Homo sapiens
aagccttaaactgtacaga

SEQ ID NO: 6571990 - DNA, 21 bp, Homo sapiens
aagccttaagaagataaatga

SEQ ID NO: 6571991 - DNA, 15 bp, Homo sapiens
aagccttacaaaggg

SEQ ID NO: 6571992 - DNA, 11 bp, Homo sapiens
aagccttacag

SEQ ID NO: 6571993 - DNA, 22 bp, Homo sapiens
aagccttacagttatcctgcaa

SEQ ID NO: 6571994 - DNA, 24 bp, Homo sapiens
aagccttacggtcatgatgtctgc

SEQ ID NO: 6571995 - DNA, 18 bp, Homo sapiens
aagccttactcacctctc

SEQ ID NO: 6571996 - DNA, 19 bp, Homo sapiens
aagccttactcacctctct

SEQ ID NO: 6571997 - DNA, 14 bp, Homo sapiens
aagccttagggaag

SEQ ID NO: 6571998 - DNA, 19 bp, Homo sapiens
aagccttataaaccaatct

SEQ ID NO: 6571999 - DNA, 16 bp, Homo sapiens
aagccttatcaagtgt

SEQ ID NO: 6572000 - DNA, 18 bp, Homo sapiens
aagccttcaagctctgag

SEQ ID NO: 6572001 - DNA, 11 bp, Homo sapiens
aagccttccta

SEQ ID NO: 6572002 - DNA, 19 bp, Homo sapiens
aagccttcgaaaagaaatt

SEQ ID NO: 6572003 - DNA, 22 bp, Homo sapiens
aagccttcgggcgtctgtgtgc

SEQ ID NO: 6572004 - DNA, 20 bp, Homo sapiens
aagccttctggatccatggg

SEQ ID NO: 6572005 - DNA, 21 bp, Homo sapiens
aagccttcttatatctgaaga

SEQ ID NO: 6572006 - DNA, 13 bp, Homo sapiens
aagccttcttgct

SEQ ID NO: 6572007 - DNA, 14 bp, Homo sapiens
aagccttcttgctg

SEQ ID NO: 6572008 - DNA, 22 bp, Homo sapiens
aagccttcttgctgcccacaac

SEQ ID NO: 6572009 - DNA, 17 bp, Homo sapiens
aagccttcttggaaaat

SEQ ID NO: 6572010 - DNA, 13 bp, Homo sapiens
aagccttgctcat

SEQ ID NO: 6572011 - DNA, 19 bp, Homo sapiens
aagccttggaaccagcccc

SEQ ID NO: 6572012 - DNA, 21 bp, Homo sapiens
aagccttggggctgatgcagt

SEQ ID NO: 6572013 - DNA, 21 bp, Homo sapiens
aagccttgtgtatatttgtat

SEQ ID NO: 6572014 - DNA, 22 bp, Homo sapiens
aagccttgtgtatatttgtata

SEQ ID NO: 6572015 - DNA, 14 bp, Homo sapiens
aagccttgttgcct

SEQ ID NO: 6572016 - DNA, 16 bp, Homo sapiens
aagccttgttttctct

SEQ ID NO: 6572017 - DNA, 17 bp, Homo sapiens
aagcctttatggctgct

SEQ ID NO: 6572018 - DNA, 19 bp, Homo sapiens
aagcctttcataccagtca

SEQ ID NO: 6572019 - DNA, 22 bp, Homo sapiens
aagcctttcataccagtcagta

SEQ ID NO: 6572020 - DNA, 17 bp, Homo sapiens
aagcctttcattttgct

SEQ ID NO: 6572021 - DNA, 15 bp, Homo sapiens
aagcctttccataag

SEQ ID NO: 6572022 - DNA, 12 bp, Homo sapiens
aagcctttgaag

SEQ ID NO: 6572023 - DNA, 17 bp, Homo sapiens
aagcctttgagactgtt

SEQ ID NO: 6572024 - DNA, 15 bp, Homo sapiens
ttccttatcctagcc

SEQ ID NO: 6572025 - DNA, 19 bp, Homo sapiens
ttccttatgggatcatttt

SEQ ID NO: 6572026 - DNA, 23 bp, Homo sapiens
ttccttatgtatcagtgtccttt

SEQ ID NO: 6572027 - DNA, 23 bp, Homo sapiens
ttccttatttaagacatgtttaa

SEQ ID NO: 6572028 - DNA, 15 bp, Homo sapiens
ttccttatttcaagg

SEQ ID NO: 6572029 - DNA, 23 bp, Homo sapiens
ttccttatttctctctcctggtg

SEQ ID NO: 6572030 - DNA, 12 bp, Homo sapiens
ttccttattttc

SEQ ID NO: 6572031 - DNA, 18 bp, Homo sapiens
ttccttattttcataatt

SEQ ID NO: 6572032 - DNA, 20 bp, Homo sapiens
ttccttcaaagcaaatgtct

SEQ ID NO: 6572033 - DNA, 18 bp, Homo sapiens
ttccttcaaatcctgcca

SEQ ID NO: 6572034 - DNA, 19 bp, Homo sapiens
ttccttcaaccaccatttt

SEQ ID NO: 6572035 - DNA, 21 bp, Homo sapiens
ttccttcaagaatgcagtact

SEQ ID NO: 6572036 - DNA, 17 bp, Homo sapiens
ttccttcacatcctgtg

SEQ ID NO: 6572037 - DNA, 12 bp, Homo sapiens
ttccttcaccca

SEQ ID NO: 6572038 - DNA, 21 bp, Homo sapiens
ttccttcagagagcagtgctt

SEQ ID NO: 6572039 - DNA, 15 bp, Homo sapiens
ttccttcagatattt

SEQ ID NO: 6572040 - DNA, 14 bp, Homo sapiens
ttccttcagcactt

SEQ ID NO: 6572041 - DNA, 15 bp, Homo sapiens
ttccttcagcacttt

SEQ ID NO: 6572042 - DNA, 16 bp, Homo sapiens
ttccttcagcacttta

SEQ ID NO: 6572043 - DNA, 11 bp, Homo sapiens
ttccttcaggc

SEQ ID NO: 6572044 - DNA, 15 bp, Homo sapiens
ttccttcagggtgat

SEQ ID NO: 6572045 - DNA, 11 bp, Homo sapiens
ttccttcagtg

SEQ ID NO: 6572046 - DNA, 14 bp, Homo sapiens
ttccttcagtgcct

SEQ ID NO: 6572047 - DNA, 16 bp, Homo sapiens
ttccttcagtgcctta

SEQ ID NO: 6572048 - DNA, 19 bp, Homo sapiens
ttccttcagtgccttatgg

SEQ ID NO: 6572049 - DNA, 23 bp, Homo sapiens
ttccttcagtgccttatggaaca

SEQ ID NO: 6572050 - DNA, 23 bp, Homo sapiens
ttccttcagtttgtaaagtcggt

SEQ ID NO: 6572051 - DNA, 21 bp, Homo sapiens
ttccttcataattttcaaaag

SEQ ID NO: 6572052 - DNA, 16 bp, Homo sapiens
ttccttcattcatagg

SEQ ID NO: 6572053 - DNA, 14 bp, Homo sapiens
ttccttcatttcca

SEQ ID NO: 6572054 - DNA, 17 bp, Homo sapiens
ttccttcatttcctccg

SEQ ID NO: 6572055 - DNA, 13 bp, Homo sapiens
ttccttccactgt

SEQ ID NO: 6572056 - DNA, 14 bp, Homo sapiens
ttccttccactgta

SEQ ID NO: 6572057 - DNA, 15 bp, Homo sapiens
ttccttccactgtag

SEQ ID NO: 6572058 - DNA, 13 bp, Homo sapiens
ttccttccagcct

SEQ ID NO: 6572059 - DNA, 14 bp, Homo sapiens
ttccttccagcctt

SEQ ID NO: 6572060 - DNA, 20 bp, Homo sapiens
ttccttccaggtgattctgt

SEQ ID NO: 6572061 - DNA, 19 bp, Homo sapiens
ttccttccatctagcagct

SEQ ID NO: 6572062 - DNA, 23 bp, Homo sapiens
ttccttccattgctcccagtgcc

SEQ ID NO: 6572063 - DNA, 22 bp, Homo sapiens
ttccttcccaactcactgtgct

SEQ ID NO: 6572064 - DNA, 22 bp, Homo sapiens
ttccttcccagaatgttactga

SEQ ID NO: 6572065 - DNA, 23 bp, Homo sapiens
ttccttcccccatcccctttcct

SEQ ID NO: 6572066 - DNA, 11 bp, Homo sapiens
ttccttccctc

SEQ ID NO: 6572067 - DNA, 13 bp, Homo sapiens
ttccttccctcaa

SEQ ID NO: 6572068 - DNA, 14 bp, Homo sapiens
ttccttccctcctt

SEQ ID NO: 6572069 - DNA, 19 bp, Homo sapiens
ttccttccctccttttaaa

SEQ ID NO: 6572070 - DNA, 13 bp, Homo sapiens
ttccttccctggg

SEQ ID NO: 6572071 - DNA, 21 bp, Homo sapiens
ttccttcctagaagcccctgt

SEQ ID NO: 6572072 - DNA, 13 bp, Homo sapiens
ttccttcctctga

SEQ ID NO: 6572073 - DNA, 14 bp, Homo sapiens
ttccttcctgcaga

SEQ ID NO: 6572074 - DNA, 17 bp, Homo sapiens
ttccttcctgcagacct

SEQ ID NO: 6572075 - DNA, 14 bp, Homo sapiens
ttccttcctgccct

SEQ ID NO: 6572076 - DNA, 15 bp, Homo sapiens
ttccttcctgccctg

SEQ ID NO: 6572077 - DNA, 15 bp, Homo sapiens
ttccttcctgttctg

SEQ ID NO: 6572078 - DNA, 17 bp, Homo sapiens
ttccttcctttctctct

SEQ ID NO: 6572079 - DNA, 21 bp, Homo sapiens
ttccttcgaaaggccttcaga

SEQ ID NO: 6572080 - DNA, 18 bp, Homo sapiens
ttccttctaagtgtactt

SEQ ID NO: 6572081 - DNA, 13 bp, Homo sapiens
ttccttctcccat

SEQ ID NO: 6572082 - DNA, 14 bp, Homo sapiens
ttccttctcgtctt

SEQ ID NO: 6572083 - DNA, 10 bp, Homo sapiens
ttccttctct

SEQ ID NO: 6572084 - DNA, 15 bp, Homo sapiens
ttccttctctgaaca

SEQ ID NO: 6572085 - DNA, 22 bp, Homo sapiens
ttccttctctgaacacaggcag

SEQ ID NO: 6572086 - DNA, 13 bp, Homo sapiens
ttccttctctggg

SEQ ID NO: 6572087 - DNA, 15 bp, Homo sapiens
ttccttctgcaccca

SEQ ID NO: 6572088 - DNA, 19 bp, Homo sapiens
ttccttctgcacccagaaa

SEQ ID NO: 6572089 - DNA, 20 bp, Homo sapiens
ttccttctgcccttcctcca

SEQ ID NO: 6572090 - DNA, 23 bp, Homo sapiens
ttccttctgcccttcctccagga

SEQ ID NO: 6572091 - DNA, 20 bp, Homo sapiens
ttccttctgctcccacccca

SEQ ID NO: 6572092 - DNA, 13 bp, Homo sapiens
ttccttctggcct

SEQ ID NO: 6572093 - DNA, 14 bp, Homo sapiens
ttccttctggcctt

SEQ ID NO: 6572094 - DNA, 20 bp, Homo sapiens
ttccttctgggactggacag

SEQ ID NO: 6572095 - DNA, 12 bp, Homo sapiens
ttccttctgtga

SEQ ID NO: 6572096 - DNA, 13 bp, Homo sapiens
ttccttctgtgaa

SEQ ID NO: 6572097 - DNA, 17 bp, Homo sapiens
ttccttctgtgaaagta

SEQ ID NO: 6572098 - DNA, 15 bp, Homo sapiens
ttccttctgtgaaga

SEQ ID NO: 6572099 - DNA, 16 bp, Homo sapiens
ttccttctgtgaagaa

SEQ ID NO: 6572100 - DNA, 17 bp, Homo sapiens
ttccttcttgccttcag

SEQ ID NO: 6572101 - DNA, 16 bp, Homo sapiens
ttccttcttgctcagt

SEQ ID NO: 6572102 - DNA, 15 bp, Homo sapiens
ttccttctttgccct

SEQ ID NO: 6572103 - DNA, 14 bp, Homo sapiens
ttccttgaagccga

SEQ ID NO: 6572104 - DNA, 13 bp, Homo sapiens
ttccttgaatctt

SEQ ID NO: 6572105 - DNA, 21 bp, Homo sapiens
ttccttgacctgcattgtaaa

SEQ ID NO: 6572106 - DNA, 18 bp, Homo sapiens
ttccttgaccttcctctg

SEQ ID NO: 6572107 - DNA, 22 bp, Homo sapiens
ttccttgagacacggagcccag

SEQ ID NO: 6572108 - DNA, 20 bp, Homo sapiens
ttccttgagttgattcagct

SEQ ID NO: 6572109 - DNA, 17 bp, Homo sapiens
ttccttgagtttcatat

SEQ ID NO: 6572110 - DNA, 13 bp, Homo sapiens
ttccttgatcatt

SEQ ID NO: 6572111 - DNA, 13 bp, Homo sapiens
ttccttgccccac

SEQ ID NO: 6572112 - DNA, 19 bp, Homo sapiens
ttccttgccccacagttgt

SEQ ID NO: 6572113 - DNA, 15 bp, Homo sapiens
ttccttgcccctgct

SEQ ID NO: 6572114 - DNA, 18 bp, Homo sapiens
ttccttgcccctgctctg

SEQ ID NO: 6572115 - DNA, 11 bp, Homo sapiens
ttccttgcctg

SEQ ID NO: 6572116 - DNA, 13 bp, Homo sapiens
ttccttgcgacca

SEQ ID NO: 6572117 - DNA, 16 bp, Homo sapiens
ttccttgcgaccacca

SEQ ID NO: 6572118 - DNA, 18 bp, Homo sapiens
ttccttgcgcctcagccc

SEQ ID NO: 6572119 - DNA, 11 bp, Homo sapiens
ttccttgctct

SEQ ID NO: 6572120 - DNA, 14 bp, Homo sapiens
ttccttgctctccc

SEQ ID NO: 6572121 - DNA, 18 bp, Homo sapiens
ttccttgctctgcacccc

SEQ ID NO: 6572122 - DNA, 18 bp, Homo sapiens
ttccttgctgtcctaggc

SEQ ID NO: 6572123 - DNA, 20 bp, Homo sapiens
ttccttgctgtcctaggcca

SEQ ID NO: 6572124 - DNA, 15 bp, Homo sapiens
ttccttgcttttatg

SEQ ID NO: 6572125 - DNA, 20 bp, Homo sapiens
ttccttggactcattttaaa

SEQ ID NO: 6572126 - DNA, 13 bp, Homo sapiens
ttccttggcccag

SEQ ID NO: 6572127 - DNA, 15 bp, Homo sapiens
ttccttggcccagca

SEQ ID NO: 6572128 - DNA, 14 bp, Homo sapiens
ttccttggggcagg

SEQ ID NO: 6572129 - DNA, 18 bp, Homo sapiens
ttccttggggcaggcagt

SEQ ID NO: 6572130 - DNA, 16 bp, Homo sapiens
ttccttgtagcctttt

SEQ ID NO: 6572131 - DNA, 15 bp, Homo sapiens
ttccttgtatttaaa

SEQ ID NO: 6572132 - DNA, 16 bp, Homo sapiens
ttccttgtcactggta

SEQ ID NO: 6572133 - DNA, 13 bp, Homo sapiens
ttccttgtcccca

SEQ ID NO: 6572134 - DNA, 21 bp, Homo sapiens
ttccttgttagaatgcaagca

SEQ ID NO: 6572135 - DNA, 22 bp, Homo sapiens
ttccttgttggtcagaggagtg

SEQ ID NO: 6572136 - DNA, 18 bp, Homo sapiens
ttccttgttgtttgcttt

SEQ ID NO: 6572137 - DNA, 14 bp, Homo sapiens
ttccttgtttatca

SEQ ID NO: 6572138 - DNA, 13 bp, Homo sapiens
ttcctttaaaaaa

SEQ ID NO: 6572139 - DNA, 16 bp, Homo sapiens
ttcctttaaaaaaatt

SEQ ID NO: 6572140 - DNA, 23 bp, Homo sapiens
ttcctttaaaaaaatttaagtgc

SEQ ID NO: 6572141 - DNA, 22 bp, Homo sapiens
ttcctttaaaaatacatagcat

SEQ ID NO: 6572142 - DNA, 17 bp, Homo sapiens
ttcctttaacaacatgt

SEQ ID NO: 6572143 - DNA, 16 bp, Homo sapiens
ttcctttacagctgtt

SEQ ID NO: 6572144 - DNA, 19 bp, Homo sapiens
ttcctttaccttttctata

SEQ ID NO: 6572145 - DNA, 23 bp, Homo sapiens
ttcctttaccttttctataagtt

SEQ ID NO: 6572146 - DNA, 17 bp, Homo sapiens
ttcctttactttccctt

SEQ ID NO: 6572147 - DNA, 20 bp, Homo sapiens
ttcctttactttcccttgct

SEQ ID NO: 6572148 - DNA, 19 bp, Homo sapiens
ttcctttatactgtgaagt

SEQ ID NO: 6572149 - DNA, 14 bp, Homo sapiens
ttcctttatattta

SEQ ID NO: 6572150 - DNA, 14 bp, Homo sapiens
ttcctttatgtgaa

SEQ ID NO: 6572151 - DNA, 15 bp, Homo sapiens
ttcctttatgtgaat

SEQ ID NO: 6572152 - DNA, 22 bp, Homo sapiens
ttcctttcagagttttactaag

SEQ ID NO: 6572153 - DNA, 14 bp, Homo sapiens
ttcctttcagatga

SEQ ID NO: 6572154 - DNA, 22 bp, Homo sapiens
ttcctttcagccctgtctactg

SEQ ID NO: 6572155 - DNA, 16 bp, Homo sapiens
ttcctttcatcctcag

SEQ ID NO: 6572156 - DNA, 9 bp, Homo sapiens
ttcctttcc

SEQ ID NO: 6572157 - DNA, 22 bp, Homo sapiens
ttcctttccaacgtttggaaga

SEQ ID NO: 6572158 - DNA, 21 bp, Homo sapiens
ttcctttccaagtatttcaca

SEQ ID NO: 6572159 - DNA, 15 bp, Homo sapiens
ttcctttccccagcc

SEQ ID NO: 6572160 - DNA, 16 bp, Homo sapiens
ttcctttccctttagc

SEQ ID NO: 6572161 - DNA, 11 bp, Homo sapiens
ttcctttccta

SEQ ID NO: 6572162 - DNA, 12 bp, Homo sapiens
ttcctttcctac

SEQ ID NO: 6572163 - DNA, 14 bp, Homo sapiens
ttcctttcctactg

SEQ ID NO: 6572164 - DNA, 21 bp, Homo sapiens
ttcctttcctctgcagcactt

SEQ ID NO: 6572165 - DNA, 15 bp, Homo sapiens
ttcctttcctttcat

SEQ ID NO: 6572166 - DNA, 14 bp, Homo sapiens
ttcctttcctttct

SEQ ID NO: 6572167 - DNA, 22 bp, Homo sapiens
ttcctttctaatcctatctggg

SEQ ID NO: 6572168 - DNA, 15 bp, Homo sapiens
ttcctttctatatcc

SEQ ID NO: 6572169 - DNA, 22 bp, Homo sapiens
ttcctttctatatccttgacac

SEQ ID NO: 6572170 - DNA, 14 bp, Homo sapiens
ttcctttctcaccg

SEQ ID NO: 6572171 - DNA, 19 bp, Homo sapiens
ttcctttctcatttctttc

SEQ ID NO: 6572172 - DNA, 19 bp, Homo sapiens
ttcctttctccaggaccaa

SEQ ID NO: 6572173 - DNA, 22 bp, Homo sapiens
ttcctttctctttctctcttcc

SEQ ID NO: 6572174 - DNA, 15 bp, Homo sapiens
ttcctttctggaatt

SEQ ID NO: 6572175 - DNA, 13 bp, Homo sapiens
ttcctttctgtat

SEQ ID NO: 6572176 - DNA, 13 bp, Homo sapiens
ttcctttcttcct

SEQ ID NO: 6572177 - DNA, 14 bp, Homo sapiens
ttcctttcttcctt

SEQ ID NO: 6572178 - DNA, 16 bp, Homo sapiens
ttcctttcttccttcc

SEQ ID NO: 6572179 - DNA, 18 bp, Homo sapiens
ttcctttcttttccccct

SEQ ID NO: 6572180 - DNA, 15 bp, Homo sapiens
ttcctttgaagagga

SEQ ID NO: 6572181 - DNA, 13 bp, Homo sapiens
ttcctttgaagat

SEQ ID NO: 6572182 - DNA, 14 bp, Homo sapiens
ttcctttgaagata

SEQ ID NO: 6572183 - DNA, 12 bp, Homo sapiens
ttcctttgactt

SEQ ID NO: 6572184 - DNA, 15 bp, Homo sapiens
ttcctttgcattcat

SEQ ID NO: 6572185 - DNA, 22 bp, Homo sapiens
ttcctttggactgttcaagcaa

SEQ ID NO: 6572186 - DNA, 15 bp, Homo sapiens
ttcctttggagcttt

SEQ ID NO: 6572187 - DNA, 20 bp, Homo sapiens
ttcctttggggaagtttatt

SEQ ID NO: 6572188 - DNA, 15 bp, Homo sapiens
ttcctttgtaattga

SEQ ID NO: 6572189 - DNA, 17 bp, Homo sapiens
ttcctttgtaattgaca

SEQ ID NO: 6572190 - DNA, 13 bp, Homo sapiens
ttcctttgtgctt

SEQ ID NO: 6572191 - DNA, 18 bp, Homo sapiens
ttcctttgtgtttctatt

SEQ ID NO: 6572192 - DNA, 11 bp, Homo sapiens
ttcctttgttc

SEQ ID NO: 6572193 - DNA, 22 bp, Homo sapiens
ttccttttaaaacacttccata

SEQ ID NO: 6572194 - DNA, 14 bp, Homo sapiens
ttccttttaaagaa

SEQ ID NO: 6572195 - DNA, 12 bp, Homo sapiens
ttccttttcact

SEQ ID NO: 6572196 - DNA, 15 bp, Homo sapiens
ttccttttcagcatg

SEQ ID NO: 6572197 - DNA, 18 bp, Homo sapiens
ttccttttcaggagatgg

SEQ ID NO: 6572198 - DNA, 15 bp, Homo sapiens
ttccttttcatctgt

SEQ ID NO: 6572199 - DNA, 20 bp, Homo sapiens
ttccttttctattccttctg

SEQ ID NO: 6572200 - DNA, 14 bp, Homo sapiens
ttccttttctctgc

SEQ ID NO: 6572201 - DNA, 21 bp, Homo sapiens
ttccttttctgtataaagttc

SEQ ID NO: 6572202 - DNA, 22 bp, Homo sapiens
ttccttttcttgtttatcagca

SEQ ID NO: 6572203 - DNA, 13 bp, Homo sapiens
ttccttttcttta

SEQ ID NO: 6572204 - DNA, 15 bp, Homo sapiens
ttccttttgatgggg

SEQ ID NO: 6572205 - DNA, 18 bp, Homo sapiens
ttccttttgatggggaga

SEQ ID NO: 6572206 - DNA, 19 bp, Homo sapiens
aagcctttgtatctttctt

SEQ ID NO: 6572207 - DNA, 14 bp, Homo sapiens
aagcctttgttgaa

SEQ ID NO: 6572208 - DNA, 21 bp, Homo sapiens
aagccttttccataaagtgta

SEQ ID NO: 6572209 - DNA, 10 bp, Homo sapiens
aagccttttt

SEQ ID NO: 6572210 - DNA, 17 bp, Homo sapiens
aagcgaaatacttgaaa

SEQ ID NO: 6572211 - DNA, 22 bp, Homo sapiens
aagcgaacatcttcatataaac

SEQ ID NO: 6572212 - DNA, 17 bp, Homo sapiens
aagcgaaccgtgaggag

SEQ ID NO: 6572213 - DNA, 22 bp, Homo sapiens
aagcgaaccgtgaggaggggtg

SEQ ID NO: 6572214 - DNA, 21 bp, Homo sapiens
aagcgacctaaacagctgctt

SEQ ID NO: 6572215 - DNA, 22 bp, Homo sapiens
aagcgacctaaacagctgcttt

SEQ ID NO: 6572216 - DNA, 16 bp, Homo sapiens
aagcgactcccagctc

SEQ ID NO: 6572217 - DNA, 20 bp, Homo sapiens
aagcgactctcctgcctcag

SEQ ID NO: 6572218 - DNA, 22 bp, Homo sapiens
aagcgactctcctgcctcagcc

SEQ ID NO: 6572219 - DNA, 20 bp, Homo sapiens
aagcgagtcgggtccccaac

SEQ ID NO: 6572220 - DNA, 16 bp, Homo sapiens
aagcgatatacagatg

SEQ ID NO: 6572221 - DNA, 22 bp, Homo sapiens
aagcgatatacagatgaaaatt

SEQ ID NO: 6572222 - DNA, 18 bp, Homo sapiens
aagcgatcacttcctata

SEQ ID NO: 6572223 - DNA, 21 bp, Homo sapiens
aagcgatccctcccctcagcc

SEQ ID NO: 6572224 - DNA, 21 bp, Homo sapiens
aagcgatgaatttggagactc

SEQ ID NO: 6572225 - DNA, 15 bp, Homo sapiens
aagcgattcactgta

SEQ ID NO: 6572226 - DNA, 23 bp, Homo sapiens
aagcgattctcccgcctcagcct

SEQ ID NO: 6572227 - DNA, 14 bp, Homo sapiens
aagcgattctcctg

SEQ ID NO: 6572228 - DNA, 20 bp, Homo sapiens
aagcgattctcttgcctcaa

SEQ ID NO: 6572229 - DNA, 14 bp, Homo sapiens
aagcgattcttctg

SEQ ID NO: 6572230 - DNA, 16 bp, Homo sapiens
aagcgattcttctgct

SEQ ID NO: 6572231 - DNA, 17 bp, Homo sapiens
aagcgattcttctgctt

SEQ ID NO: 6572232 - DNA, 19 bp, Homo sapiens
aagcgattcttgtgcctca

SEQ ID NO: 6572233 - DNA, 14 bp, Homo sapiens
aagcgatttgaaac

SEQ ID NO: 6572234 - DNA, 19 bp, Homo sapiens
aagcgcacttgatggtcag

SEQ ID NO: 6572235 - DNA, 13 bp, Homo sapiens
aagcgcagagaaa

SEQ ID NO: 6572236 - DNA, 19 bp, Homo sapiens
aagcgcagggaggatgcca

SEQ ID NO: 6572237 - DNA, 22 bp, Homo sapiens
aagcgcctggctgctgcttctt

SEQ ID NO: 6572238 - DNA, 17 bp, Homo sapiens
aagcgcggctaacttat

SEQ ID NO: 6572239 - DNA, 22 bp, Homo sapiens
aagcgctcatctggcttttcgc

SEQ ID NO: 6572240 - DNA, 15 bp, Homo sapiens
aagcgctcccagcct

SEQ ID NO: 6572241 - DNA, 17 bp, Homo sapiens
aagcgctcccagcctgc

SEQ ID NO: 6572242 - DNA, 12 bp, Homo sapiens
aagcgctgccct

SEQ ID NO: 6572243 - DNA, 22 bp, Homo sapiens
aagcgctgccctgtgagagcca

SEQ ID NO: 6572244 - DNA, 14 bp, Homo sapiens
aagcgctgtttcct

SEQ ID NO: 6572245 - DNA, 22 bp, Homo sapiens
aagcgcttctttctgactctaa

SEQ ID NO: 6572246 - DNA, 23 bp, Homo sapiens
aagcgcttttccttggcattccg

SEQ ID NO: 6572247 - DNA, 23 bp, Homo sapiens
aagcggaaaaggttttattttgt

SEQ ID NO: 6572248 - DNA, 17 bp, Homo sapiens
aagcggaacatgtgctt

SEQ ID NO: 6572249 - DNA, 19 bp, Homo sapiens
aagcggaacatgtgcttca

SEQ ID NO: 6572250 - DNA, 20 bp, Homo sapiens
aagcggatgctccatttcaa

SEQ ID NO: 6572251 - DNA, 15 bp, Homo sapiens
aagcggccctgtgtg

SEQ ID NO: 6572252 - DNA, 16 bp, Homo sapiens
aagcggccctgtgtgt

SEQ ID NO: 6572253 - DNA, 22 bp, Homo sapiens
aagcggccgatgggagtctccc

SEQ ID NO: 6572254 - DNA, 14 bp, Homo sapiens
aagcggctgcctcc

SEQ ID NO: 6572255 - DNA, 15 bp, Homo sapiens
aagcggctgcctcca

SEQ ID NO: 6572256 - DNA, 18 bp, Homo sapiens
aagcgggatcccagcatc

SEQ ID NO: 6572257 - DNA, 23 bp, Homo sapiens
aagcgggctgggggtagcctgga

SEQ ID NO: 6572258 - DNA, 22 bp, Homo sapiens
aagcgggggcgtggctggcctt

SEQ ID NO: 6572259 - DNA, 14 bp, Homo sapiens
aagcggggggaggg

SEQ ID NO: 6572260 - DNA, 21 bp, Homo sapiens
aagcggtgtctctcctgcccc

SEQ ID NO: 6572261 - DNA, 20 bp, Homo sapiens
aagcggttgcttctggctcc

SEQ ID NO: 6572262 - DNA, 13 bp, Homo sapiens
aagcgtatggctt

SEQ ID NO: 6572263 - DNA, 13 bp, Homo sapiens
aagcgtctccctt

SEQ ID NO: 6572264 - DNA, 18 bp, Homo sapiens
aagcgtctttaagagact

SEQ ID NO: 6572265 - DNA, 23 bp, Homo sapiens
aagcgtctttaagagactcactg

SEQ ID NO: 6572266 - DNA, 23 bp, Homo sapiens
aagcgtgaaggccgagaagcaag

SEQ ID NO: 6572267 - DNA, 17 bp, Homo sapiens
aagcgtgagacgccacc

SEQ ID NO: 6572268 - DNA, 16 bp, Homo sapiens
aagcgtgagccactgc

SEQ ID NO: 6572269 - DNA, 20 bp, Homo sapiens
aagcgtgagccactgcaccg

SEQ ID NO: 6572270 - DNA, 22 bp, Homo sapiens
aagcgtgagcttaaaatacaag

SEQ ID NO: 6572271 - DNA, 20 bp, Homo sapiens
aagcgtgggtggaggaagat

SEQ ID NO: 6572272 - DNA, 12 bp, Homo sapiens
aagcgtggtgga

SEQ ID NO: 6572273 - DNA, 15 bp, Homo sapiens
aagcgttaagggcag

SEQ ID NO: 6572274 - DNA, 16 bp, Homo sapiens
aagcgttaagggcaga

SEQ ID NO: 6572275 - DNA, 16 bp, Homo sapiens
aagcgttcctggcctt

SEQ ID NO: 6572276 - DNA, 12 bp, Homo sapiens
aagcgtttttct

SEQ ID NO: 6572277 - DNA, 16 bp, Homo sapiens
aagctaaaaggaaaag

SEQ ID NO: 6572278 - DNA, 23 bp, Homo sapiens
aagctaaaaggaaagaaaataaa

SEQ ID NO: 6572279 - DNA, 16 bp, Homo sapiens
aagctaaaataaagaa

SEQ ID NO: 6572280 - DNA, 17 bp, Homo sapiens
aagctaaaatgaaaaat

SEQ ID NO: 6572281 - DNA, 14 bp, Homo sapiens
aagctaaaatggtg

SEQ ID NO: 6572282 - DNA, 15 bp, Homo sapiens
aagctaaaatgttac

SEQ ID NO: 6572283 - DNA, 14 bp, Homo sapiens
aagctaaagaaact

SEQ ID NO: 6572284 - DNA, 19 bp, Homo sapiens
aagctaaagcagtgtttgc

SEQ ID NO: 6572285 - DNA, 15 bp, Homo sapiens
aagctaaattacata

SEQ ID NO: 6572286 - DNA, 23 bp, Homo sapiens
aagctaaattttgttactgattc

SEQ ID NO: 6572287 - DNA, 21 bp, Homo sapiens
aagctaacagcagtttcaggt

SEQ ID NO: 6572288 - DNA, 22 bp, Homo sapiens
aagctaacagcagtttcaggta

SEQ ID NO: 6572289 - DNA, 22 bp, Homo sapiens
aagctaacagggaaggcaggca

SEQ ID NO: 6572290 - DNA, 16 bp, Homo sapiens
aagctaacatctttac

SEQ ID NO: 6572291 - DNA, 17 bp, Homo sapiens
aagctaagatgggtgga

SEQ ID NO: 6572292 - DNA, 16 bp, Homo sapiens
aagctaagctgcaggc

SEQ ID NO: 6572293 - DNA, 18 bp, Homo sapiens
aagctaataaaatatcat

SEQ ID NO: 6572294 - DNA, 21 bp, Homo sapiens
aagctaataaaatatcattca

SEQ ID NO: 6572295 - DNA, 14 bp, Homo sapiens
aagctaatgtgcag

SEQ ID NO: 6572296 - DNA, 20 bp, Homo sapiens
aagctaatgtggtagtgaaa

SEQ ID NO: 6572297 - DNA, 15 bp, Homo sapiens
aagctaattatttta

SEQ ID NO: 6572298 - DNA, 20 bp, Homo sapiens
aagctaattgggagtccagg

SEQ ID NO: 6572299 - DNA, 23 bp, Homo sapiens
aagctaattgtactaatctgaga

SEQ ID NO: 6572300 - DNA, 21 bp, Homo sapiens
aagctaatttctaatggcctt

SEQ ID NO: 6572301 - DNA, 15 bp, Homo sapiens
aagctaatttgcatt

SEQ ID NO: 6572302 - DNA, 13 bp, Homo sapiens
aagctacaggtta

SEQ ID NO: 6572303 - DNA, 15 bp, Homo sapiens
aagctacaggttaca

SEQ ID NO: 6572304 - DNA, 18 bp, Homo sapiens
aagctacaggttacaaca

SEQ ID NO: 6572305 - DNA, 19 bp, Homo sapiens
aagctacaggttacaacag

SEQ ID NO: 6572306 - DNA, 21 bp, Homo sapiens
aagctacaggttacaacagat

SEQ ID NO: 6572307 - DNA, 20 bp, Homo sapiens
aagctacccctcaaactgca

SEQ ID NO: 6572308 - DNA, 19 bp, Homo sapiens
aagctacctcaaacttcca

SEQ ID NO: 6572309 - DNA, 22 bp, Homo sapiens
aagctaccttttttttacggaa

SEQ ID NO: 6572310 - DNA, 19 bp, Homo sapiens
aagctactgaatttattgc

SEQ ID NO: 6572311 - DNA, 22 bp, Homo sapiens
aagctactgccatcctggccca

SEQ ID NO: 6572312 - DNA, 12 bp, Homo sapiens
aagctagaaaca

SEQ ID NO: 6572313 - DNA, 21 bp, Homo sapiens
aagctagaaacaatctatagt

SEQ ID NO: 6572314 - DNA, 16 bp, Homo sapiens
aagctagacacatgaa

SEQ ID NO: 6572315 - DNA, 17 bp, Homo sapiens
aagctagacacatgaag

SEQ ID NO: 6572316 - DNA, 21 bp, Homo sapiens
aagctagacagatccccgttc

SEQ ID NO: 6572317 - DNA, 16 bp, Homo sapiens
aagctagcaaatagta

SEQ ID NO: 6572318 - DNA, 18 bp, Homo sapiens
aagctagccagagggtgg

SEQ ID NO: 6572319 - DNA, 17 bp, Homo sapiens
aagctaggaaaggcaga

SEQ ID NO: 6572320 - DNA, 18 bp, Homo sapiens
aagctaggaaaggcagaa

SEQ ID NO: 6572321 - DNA, 19 bp, Homo sapiens
aagctaggaaaggcagaaa

SEQ ID NO: 6572322 - DNA, 15 bp, Homo sapiens
aagctaggccccaga

SEQ ID NO: 6572323 - DNA, 19 bp, Homo sapiens
aagctaggccccagaggcc

SEQ ID NO: 6572324 - DNA, 16 bp, Homo sapiens
aagctaggcctggcca

SEQ ID NO: 6572325 - DNA, 22 bp, Homo sapiens
aagctaggcctggccagatgca

SEQ ID NO: 6572326 - DNA, 15 bp, Homo sapiens
aagctagggtggccc

SEQ ID NO: 6572327 - DNA, 19 bp, Homo sapiens
aagctagggtggcccttgc

SEQ ID NO: 6572328 - DNA, 15 bp, Homo sapiens
aagctagtcaacagt

SEQ ID NO: 6572329 - DNA, 14 bp, Homo sapiens
aagctagtcttttg

SEQ ID NO: 6572330 - DNA, 15 bp, Homo sapiens
aagctagtcttttgc

SEQ ID NO: 6572331 - DNA, 17 bp, Homo sapiens
aagctagtcttttgctt

SEQ ID NO: 6572332 - DNA, 19 bp, Homo sapiens
aagctagtcttttgctttt

SEQ ID NO: 6572333 - DNA, 14 bp, Homo sapiens
aagctagtgtttct

SEQ ID NO: 6572334 - DNA, 20 bp, Homo sapiens
aagctagtgtttctagctaa

SEQ ID NO: 6572335 - DNA, 21 bp, Homo sapiens
aagctagttaatgtcagtgac

SEQ ID NO: 6572336 - DNA, 15 bp, Homo sapiens
aagctagttgaatac

SEQ ID NO: 6572337 - DNA, 19 bp, Homo sapiens
aagctagttgaatacttga

SEQ ID NO: 6572338 - DNA, 21 bp, Homo sapiens
aagctataacatatttattgt

SEQ ID NO: 6572339 - DNA, 20 bp, Homo sapiens
aagctatagacccgaggaaa

SEQ ID NO: 6572340 - DNA, 13 bp, Homo sapiens
aagctatcagcaa

SEQ ID NO: 6572341 - DNA, 14 bp, Homo sapiens
aagctatcagcaat

SEQ ID NO: 6572342 - DNA, 17 bp, Homo sapiens
aagctatccaaataact

SEQ ID NO: 6572343 - DNA, 21 bp, Homo sapiens
aagctatccttgcacctcagc

SEQ ID NO: 6572344 - DNA, 18 bp, Homo sapiens
aagctatcttaaaatata

SEQ ID NO: 6572345 - DNA, 21 bp, Homo sapiens
aagctatcttaaaatatagaa

SEQ ID NO: 6572346 - DNA, 23 bp, Homo sapiens
aagctatcttaaaatatagaaaa

SEQ ID NO: 6572347 - DNA, 22 bp, Homo sapiens
aagctatggtgagatgcagctg

SEQ ID NO: 6572348 - DNA, 14 bp, Homo sapiens
aagctatgtcacta

SEQ ID NO: 6572349 - DNA, 19 bp, Homo sapiens
aagctatgtttttaaagtg

SEQ ID NO: 6572350 - DNA, 21 bp, Homo sapiens
aagctatgtttttaaagtgta

SEQ ID NO: 6572351 - DNA, 22 bp, Homo sapiens
aagctatgtttttaaagtgtac

SEQ ID NO: 6572352 - DNA, 22 bp, Homo sapiens
aagctattcctttcccttcctc

SEQ ID NO: 6572353 - DNA, 23 bp, Homo sapiens
aagctattcctttcccttcctct

SEQ ID NO: 6572354 - DNA, 15 bp, Homo sapiens
aagctattgatgttt

SEQ ID NO: 6572355 - DNA, 15 bp, Homo sapiens
aagctattgtctgta

SEQ ID NO: 6572356 - DNA, 13 bp, Homo sapiens
aagctatttaaag

SEQ ID NO: 6572357 - DNA, 18 bp, Homo sapiens
aagctatttaaagcatct

SEQ ID NO: 6572358 - DNA, 13 bp, Homo sapiens
aagctatttaagt

SEQ ID NO: 6572359 - DNA, 14 bp, Homo sapiens
aagctatttaagtg

SEQ ID NO: 6572360 - DNA, 20 bp, Homo sapiens
aagctatttaagtggactgt

SEQ ID NO: 6572361 - DNA, 17 bp, Homo sapiens
aagctatttatctgtag

SEQ ID NO: 6572362 - DNA, 17 bp, Homo sapiens
aagctatttatgggccc

SEQ ID NO: 6572363 - DNA, 18 bp, Homo sapiens
aagctatttatgggcccc

SEQ ID NO: 6572364 - DNA, 22 bp, Homo sapiens
aagctatttatgggcccctggc

SEQ ID NO: 6572365 - DNA, 15 bp, Homo sapiens
aagctatttgatatg

SEQ ID NO: 6572366 - DNA, 17 bp, Homo sapiens
aagctatttgatatgca

SEQ ID NO: 6572367 - DNA, 14 bp, Homo sapiens
aagctatttgatgt

SEQ ID NO: 6572368 - DNA, 16 bp, Homo sapiens
aagctatttgatgtaa

SEQ ID NO: 6572369 - DNA, 22 bp, Homo sapiens
aagctcaaagtatgcaatgctt

SEQ ID NO: 6572370 - DNA, 14 bp, Homo sapiens
aagctcaaatgtat

SEQ ID NO: 6572371 - DNA, 16 bp, Homo sapiens
aagctcaattcaagtg

SEQ ID NO: 6572372 - DNA, 15 bp, Homo sapiens
aagctcacacctgtc

SEQ ID NO: 6572373 - DNA, 17 bp, Homo sapiens
aagctcaccctgctcct

SEQ ID NO: 6572374 - DNA, 22 bp, Homo sapiens
aagctcacctgttgcttacaat

SEQ ID NO: 6572375 - DNA, 22 bp, Homo sapiens
aagctcacgccttagtttgaaa

SEQ ID NO: 6572376 - DNA, 15 bp, Homo sapiens
aagctcacgtcctga

SEQ ID NO: 6572377 - DNA, 17 bp, Homo sapiens
aagctcacgtcctgaga

SEQ ID NO: 6572378 - DNA, 18 bp, Homo sapiens
aagctcacgtcctgagaa

SEQ ID NO: 6572379 - DNA, 19 bp, Homo sapiens
aagctcacgtcctgagaaa

SEQ ID NO: 6572380 - DNA, 14 bp, Homo sapiens
aagctcagaaggct

SEQ ID NO: 6572381 - DNA, 22 bp, Homo sapiens
aagctcagaggcgcactgtgac

SEQ ID NO: 6572382 - DNA, 20 bp, Homo sapiens
ttccttttgatggggagaaa

SEQ ID NO: 6572383 - DNA, 20 bp, Homo sapiens
ttccttttgcaacaagacaa

SEQ ID NO: 6572384 - DNA, 12 bp, Homo sapiens
ttccttttgcac

SEQ ID NO: 6572385 - DNA, 21 bp, Homo sapiens
ttccttttgcacattccaaaa

SEQ ID NO: 6572386 - DNA, 17 bp, Homo sapiens
ttccttttgccgacccc

SEQ ID NO: 6572387 - DNA, 17 bp, Homo sapiens
ttccttttgctgtgtga

SEQ ID NO: 6572388 - DNA, 15 bp, Homo sapiens
ttccttttggaacat

SEQ ID NO: 6572389 - DNA, 14 bp, Homo sapiens
ttccttttgtaaag

SEQ ID NO: 6572390 - DNA, 20 bp, Homo sapiens
ttccttttgtccacttgtaa

SEQ ID NO: 6572391 - DNA, 17 bp, Homo sapiens
ttccttttgtgtacagt

SEQ ID NO: 6572392 - DNA, 18 bp, Homo sapiens
ttcctttttaggtacagt

SEQ ID NO: 6572393 - DNA, 18 bp, Homo sapiens
ttcctttttatgaggcaa

SEQ ID NO: 6572394 - DNA, 21 bp, Homo sapiens
ttcctttttattccttttaaa

SEQ ID NO: 6572395 - DNA, 18 bp, Homo sapiens
ttcctttttatttatatg

SEQ ID NO: 6572396 - DNA, 14 bp, Homo sapiens
ttcctttttctaaa

SEQ ID NO: 6572397 - DNA, 15 bp, Homo sapiens
ttcctttttctattt

SEQ ID NO: 6572398 - DNA, 21 bp, Homo sapiens
ttcctttttctgattagcttt

SEQ ID NO: 6572399 - DNA, 14 bp, Homo sapiens
ttcctttttcttcg

SEQ ID NO: 6572400 - DNA, 15 bp, Homo sapiens
ttcctttttcttcgc

SEQ ID NO: 6572401 - DNA, 16 bp, Homo sapiens
ttcctttttgacactg

SEQ ID NO: 6572402 - DNA, 20 bp, Homo sapiens
ttccttttttaaaataaaat

SEQ ID NO: 6572403 - DNA, 15 bp, Homo sapiens
ttccttttttcccat

SEQ ID NO: 6572404 - DNA, 17 bp, Homo sapiens
ttccttttttgagattt

SEQ ID NO: 6572405 - DNA, 22 bp, Homo sapiens
ttccttttttggggagtacctg

SEQ ID NO: 6572406 - DNA, 24 bp, Homo sapiens
ttccttttttggggagtacctgtc

SEQ ID NO: 6572407 - DNA, 16 bp, Homo sapiens
ttccttttttgtctat

SEQ ID NO: 6572408 - DNA, 19 bp, Homo sapiens
ttccttttttgtctatgaa

SEQ ID NO: 6572409 - DNA, 23 bp, Homo sapiens
ttcctttttttaaattttctcca

SEQ ID NO: 6572410 - DNA, 20 bp, Homo sapiens
ttcctttttttcccttttct

SEQ ID NO: 6572411 - DNA, 14 bp, Homo sapiens
ttcctttttttgta

SEQ ID NO: 6572412 - DNA, 22 bp, Homo sapiens
ttcgaaacctgggattcaggaa

SEQ ID NO: 6572413 - DNA, 13 bp, Homo sapiens
ttcgaaactgcca

SEQ ID NO: 6572414 - DNA, 12 bp, Homo sapiens
ttcgaaaggcct

SEQ ID NO: 6572415 - DNA, 18 bp, Homo sapiens
ttcgaaggaacctgtgtt

SEQ ID NO: 6572416 - DNA, 17 bp, Homo sapiens
ttcgaaggatatggact

SEQ ID NO: 6572417 - DNA, 19 bp, Homo sapiens
ttcgaagggtcttaaagaa

SEQ ID NO: 6572418 - DNA, 18 bp, Homo sapiens
ttcgaagtcattaaactg

SEQ ID NO: 6572419 - DNA, 15 bp, Homo sapiens
ttcgaagttcatttt

SEQ ID NO: 6572420 - DNA, 22 bp, Homo sapiens
ttcgaatatatctgtaaagata

SEQ ID NO: 6572421 - DNA, 16 bp, Homo sapiens
ttcgaatctctgcccc

SEQ ID NO: 6572422 - DNA, 17 bp, Homo sapiens
ttcgaatctctgcccct

SEQ ID NO: 6572423 - DNA, 20 bp, Homo sapiens
ttcgaatctctgcccctcac

SEQ ID NO: 6572424 - DNA, 23 bp, Homo sapiens
ttcgaatcttaatttattatttt

SEQ ID NO: 6572425 - DNA, 15 bp, Homo sapiens
ttcgaatgacactgt

SEQ ID NO: 6572426 - DNA, 17 bp, Homo sapiens
ttcgaatggggtagaaa

SEQ ID NO: 6572427 - DNA, 16 bp, Homo sapiens
ttcgacagcattttcc

SEQ ID NO: 6572428 - DNA, 17 bp, Homo sapiens
ttcgacatgctgccagg

SEQ ID NO: 6572429 - DNA, 11 bp, Homo sapiens
ttcgaccctgg

SEQ ID NO: 6572430 - DNA, 20 bp, Homo sapiens
ttcgaccctttctctgagag

SEQ ID NO: 6572431 - DNA, 19 bp, Homo sapiens
ttcgactggtccagctctg

SEQ ID NO: 6572432 - DNA, 14 bp, Homo sapiens
ttcgagaccagcct

SEQ ID NO: 6572433 - DNA, 16 bp, Homo sapiens
ttcgagaccagcctgg

SEQ ID NO: 6572434 - DNA, 17 bp, Homo sapiens
ttcgagaccagcctggc

SEQ ID NO: 6572435 - DNA, 19 bp, Homo sapiens
ttcgagaccagcctggcca

SEQ ID NO: 6572436 - DNA, 21 bp, Homo sapiens
ttcgagcatgcggagccagca

SEQ ID NO: 6572437 - DNA, 11 bp, Homo sapiens
ttcgaggcctg

SEQ ID NO: 6572438 - DNA, 13 bp, Homo sapiens
ttcgaggcctgaa

SEQ ID NO: 6572439 - DNA, 16 bp, Homo sapiens
ttcgaggtgtcaccct

SEQ ID NO: 6572440 - DNA, 22 bp, Homo sapiens
ttcgatcgtttcacatctgtat

SEQ ID NO: 6572441 - DNA, 19 bp, Homo sapiens
ttcgatgcctgcatgctga

SEQ ID NO: 6572442 - DNA, 22 bp, Homo sapiens
ttcgatgcgtattctgtggccg

SEQ ID NO: 6572443 - DNA, 21 bp, Homo sapiens
ttcgatgggcccaattcttac

SEQ ID NO: 6572444 - DNA, 16 bp, Homo sapiens
ttcgatgtacagtctc

SEQ ID NO: 6572445 - DNA, 23 bp, Homo sapiens
ttcgatgtacagtctcaattttg

SEQ ID NO: 6572446 - DNA, 15 bp, Homo sapiens
ttcgatttctacctc

SEQ ID NO: 6572447 - DNA, 18 bp, Homo sapiens
ttcgcaccattctcctgc

SEQ ID NO: 6572448 - DNA, 18 bp, Homo sapiens
ttcgcagcagctccgcct

SEQ ID NO: 6572449 - DNA, 11 bp, Homo sapiens
ttcgcagccac

SEQ ID NO: 6572450 - DNA, 14 bp, Homo sapiens
ttcgcagccaccct

SEQ ID NO: 6572451 - DNA, 19 bp, Homo sapiens
ttcgcagccaccctgagga

SEQ ID NO: 6572452 - DNA, 24 bp, Homo sapiens
ttcgcagccaccctgaggagtctg

SEQ ID NO: 6572453 - DNA, 22 bp, Homo sapiens
ttcgcagctctggcctcctaat

SEQ ID NO: 6572454 - DNA, 17 bp, Homo sapiens
ttcgcagctgaagtgga

SEQ ID NO: 6572455 - DNA, 17 bp, Homo sapiens
ttcgcagtgcccagtga

SEQ ID NO: 6572456 - DNA, 16 bp, Homo sapiens
ttcgcatccaccgcca

SEQ ID NO: 6572457 - DNA, 23 bp, Homo sapiens
ttcgcatggtcacacactgatgc

SEQ ID NO: 6572458 - DNA, 17 bp, Homo sapiens
ttcgccaaactgtctct

SEQ ID NO: 6572459 - DNA, 18 bp, Homo sapiens
ttcgccaaactgtctctg

SEQ ID NO: 6572460 - DNA, 12 bp, Homo sapiens
ttcgccatctga

SEQ ID NO: 6572461 - DNA, 14 bp, Homo sapiens
ttcgccatgtgctg

SEQ ID NO: 6572462 - DNA, 18 bp, Homo sapiens
ttcgccatgtgctgtgca

SEQ ID NO: 6572463 - DNA, 17 bp, Homo sapiens
ttcgccccctgcctgcc

SEQ ID NO: 6572464 - DNA, 19 bp, Homo sapiens
ttcgccgtctggcgagccc

SEQ ID NO: 6572465 - DNA, 14 bp, Homo sapiens
ttcgccgtggctgc

SEQ ID NO: 6572466 - DNA, 17 bp, Homo sapiens
ttcgcctgtgggaagag

SEQ ID NO: 6572467 - DNA, 14 bp, Homo sapiens
ttcgccttaaactc

SEQ ID NO: 6572468 - DNA, 13 bp, Homo sapiens
ttcgcctttcctc

SEQ ID NO: 6572469 - DNA, 16 bp, Homo sapiens
ttcgcctttcctctct

SEQ ID NO: 6572470 - DNA, 22 bp, Homo sapiens
ttcgcgatggacagactcacaa

SEQ ID NO: 6572471 - DNA, 19 bp, Homo sapiens
ttcgcgtgccctcgctgct

SEQ ID NO: 6572472 - DNA, 16 bp, Homo sapiens
ttcgctatagatttta

SEQ ID NO: 6572473 - DNA, 20 bp, Homo sapiens
ttcgctattcccaggcaggg

SEQ ID NO: 6572474 - DNA, 19 bp, Homo sapiens
ttcgctccatcgcccaggc

SEQ ID NO: 6572475 - DNA, 14 bp, Homo sapiens
ttcgctctttgaga

SEQ ID NO: 6572476 - DNA, 10 bp, Homo sapiens
ttcgctgcca

SEQ ID NO: 6572477 - DNA, 11 bp, Homo sapiens
ttcgctgccag

SEQ ID NO: 6572478 - DNA, 12 bp, Homo sapiens
ttcgctgccagg

SEQ ID NO: 6572479 - DNA, 21 bp, Homo sapiens
ttcgctgccaggacacctgcc

SEQ ID NO: 6572480 - DNA, 14 bp, Homo sapiens
ttcgctgctctagc

SEQ ID NO: 6572481 - DNA, 15 bp, Homo sapiens
ttcgctgctctagct

SEQ ID NO: 6572482 - DNA, 16 bp, Homo sapiens
ttcgctggactattgt

SEQ ID NO: 6572483 - DNA, 12 bp, Homo sapiens
ttcgctggctga

SEQ ID NO: 6572484 - DNA, 23 bp, Homo sapiens
ttcgctgtcccccaacactgagc

SEQ ID NO: 6572485 - DNA, 17 bp, Homo sapiens
ttcgctgtcccctcagc

SEQ ID NO: 6572486 - DNA, 18 bp, Homo sapiens
ttcgctgtcccctcagcg

SEQ ID NO: 6572487 - DNA, 16 bp, Homo sapiens
ttcgcttgttttaaaa

SEQ ID NO: 6572488 - DNA, 13 bp, Homo sapiens
ttcgctttcctct

SEQ ID NO: 6572489 - DNA, 12 bp, Homo sapiens
ttcggaaaaaaa

SEQ ID NO: 6572490 - DNA, 19 bp, Homo sapiens
ttcggaaaaaaaaaaagaa

SEQ ID NO: 6572491 - DNA, 22 bp, Homo sapiens
ttcggaaaaaaaaaaagaaaaa

SEQ ID NO: 6572492 - DNA, 19 bp, Homo sapiens
ttcggaactgtcctttcct

SEQ ID NO: 6572493 - DNA, 20 bp, Homo sapiens
ttcggaaggggttcctcaaa

SEQ ID NO: 6572494 - DNA, 12 bp, Homo sapiens
ttcggaatggtt

SEQ ID NO: 6572495 - DNA, 17 bp, Homo sapiens
ttcggaatttttaaaat

SEQ ID NO: 6572496 - DNA, 17 bp, Homo sapiens
ttcggacagacatatgg

SEQ ID NO: 6572497 - DNA, 13 bp, Homo sapiens
ttcggagctcttc

SEQ ID NO: 6572498 - DNA, 12 bp, Homo sapiens
ttcggaggaggt

SEQ ID NO: 6572499 - DNA, 19 bp, Homo sapiens
ttcggaggccccactgatg

SEQ ID NO: 6572500 - DNA, 19 bp, Homo sapiens
ttcggaggtcaagaaagca

SEQ ID NO: 6572501 - DNA, 15 bp, Homo sapiens
ttcggagttgggggt

SEQ ID NO: 6572502 - DNA, 13 bp, Homo sapiens
ttcggataatttt

SEQ ID NO: 6572503 - DNA, 16 bp, Homo sapiens
ttcggataattttcat

SEQ ID NO: 6572504 - DNA, 20 bp, Homo sapiens
ttcggcagatactgtctctt

SEQ ID NO: 6572505 - DNA, 12 bp, Homo sapiens
ttcggcagcctt

SEQ ID NO: 6572506 - DNA, 17 bp, Homo sapiens
ttcggcagtggctgggg

SEQ ID NO: 6572507 - DNA, 21 bp, Homo sapiens
ttcggccaatttatgcagagt

SEQ ID NO: 6572508 - DNA, 16 bp, Homo sapiens
ttcggccagagctgaa

SEQ ID NO: 6572509 - DNA, 14 bp, Homo sapiens
ttcggcctccatcc

SEQ ID NO: 6572510 - DNA, 22 bp, Homo sapiens
ttcggcctccatcctgaggctc

SEQ ID NO: 6572511 - DNA, 16 bp, Homo sapiens
ttcggcctttgggtgt

SEQ ID NO: 6572512 - DNA, 22 bp, Homo sapiens
ttcggctgcttttatgtagttt

SEQ ID NO: 6572513 - DNA, 22 bp, Homo sapiens
ttcgggaagagaggagttcaat

SEQ ID NO: 6572514 - DNA, 17 bp, Homo sapiens
ttcgggaccaatatata

SEQ ID NO: 6572515 - DNA, 16 bp, Homo sapiens
ttcgggagccttgtca

SEQ ID NO: 6572516 - DNA, 21 bp, Homo sapiens
ttcgggagccttgtcagtgtg

SEQ ID NO: 6572517 - DNA, 15 bp, Homo sapiens
ttcgggattccctgg

SEQ ID NO: 6572518 - DNA, 18 bp, Homo sapiens
ttcgggccaaggacctga

SEQ ID NO: 6572519 - DNA, 18 bp, Homo sapiens
ttcggggaagctgcacat

SEQ ID NO: 6572520 - DNA, 13 bp, Homo sapiens
ttcggggaccagc

SEQ ID NO: 6572521 - DNA, 12 bp, Homo sapiens
ttcggggcctgc

SEQ ID NO: 6572522 - DNA, 13 bp, Homo sapiens
ttcggggcctgct

SEQ ID NO: 6572523 - DNA, 17 bp, Homo sapiens
ttcggggcctgtctgaa

SEQ ID NO: 6572524 - DNA, 18 bp, Homo sapiens
ttcgggggacaacttgta

SEQ ID NO: 6572525 - DNA, 12 bp, Homo sapiens
ttcggtcttttg

SEQ ID NO: 6572526 - DNA, 13 bp, Homo sapiens
ttcggtgcttccc

SEQ ID NO: 6572527 - DNA, 22 bp, Homo sapiens
ttcggtggctagtcaagctcct

SEQ ID NO: 6572528 - DNA, 14 bp, Homo sapiens
ttcggtgggacagc

SEQ ID NO: 6572529 - DNA, 16 bp, Homo sapiens
ttcggtgggacagccc

SEQ ID NO: 6572530 - DNA, 13 bp, Homo sapiens
ttcggtgtgaact

SEQ ID NO: 6572531 - DNA, 18 bp, Homo sapiens
ttcggttgggtaccatgc

SEQ ID NO: 6572532 - DNA, 20 bp, Homo sapiens
ttcggttgggtaccatgctt

SEQ ID NO: 6572533 - DNA, 16 bp, Homo sapiens
ttcggtttcaaagtga

SEQ ID NO: 6572534 - DNA, 14 bp, Homo sapiens
ttcggtttctaact

SEQ ID NO: 6572535 - DNA, 20 bp, Homo sapiens
ttcggtttctaacttggagc

SEQ ID NO: 6572536 - DNA, 20 bp, Homo sapiens
ttcgtaacggccttgatccc

SEQ ID NO: 6572537 - DNA, 13 bp, Homo sapiens
ttcgtaagttctg

SEQ ID NO: 6572538 - DNA, 14 bp, Homo sapiens
ttcgtacagttctt

SEQ ID NO: 6572539 - DNA, 20 bp, Homo sapiens
ttcgtacagttcttcgggaa

SEQ ID NO: 6572540 - DNA, 23 bp, Homo sapiens
ttcgtacagttcttcgggaagag

SEQ ID NO: 6572541 - DNA, 18 bp, Homo sapiens
ttcgtacataatactgaa

SEQ ID NO: 6572542 - DNA, 14 bp, Homo sapiens
ttcgtaccttccca

SEQ ID NO: 6572543 - DNA, 19 bp, Homo sapiens
ttcgtagcccctgctaagt

SEQ ID NO: 6572544 - DNA, 22 bp, Homo sapiens
ttcgtattgcaaataagactct

SEQ ID NO: 6572545 - DNA, 18 bp, Homo sapiens
ttcgtattgctatgttct

SEQ ID NO: 6572546 - DNA, 20 bp, Homo sapiens
ttcgtcacaggagtctttgt

SEQ ID NO: 6572547 - DNA, 13 bp, Homo sapiens
ttcgtcagctcca

SEQ ID NO: 6572548 - DNA, 16 bp, Homo sapiens
ttcgtcagtgttcatg

SEQ ID NO: 6572549 - DNA, 12 bp, Homo sapiens
ttcgtcatcttc

SEQ ID NO: 6572550 - DNA, 15 bp, Homo sapiens
ttcgtcatcttccct

SEQ ID NO: 6572551 - DNA, 18 bp, Homo sapiens
ttcgtcatttgcaagctg

SEQ ID NO: 6572552 - DNA, 19 bp, Homo sapiens
ttcgtccacagcttcctgt

SEQ ID NO: 6572553 - DNA, 17 bp, Homo sapiens
ttcgtccatgtttctca

SEQ ID NO: 6572554 - DNA, 23 bp, Homo sapiens
ttcgtccttagaatactgtattg

SEQ ID NO: 6572555 - DNA, 19 bp, Homo sapiens
ttcgtctgtttataaacat

SEQ ID NO: 6572556 - DNA, 19 bp, Homo sapiens
ttcgtcttcgccctctgaa

SEQ ID NO: 6572557 - DNA, 21 bp, Homo sapiens
ttcgtcttcgccctctgaaat

SEQ ID NO: 6572558 - DNA, 13 bp, Homo sapiens
ttcgtcttctaat

SEQ ID NO: 6572559 - DNA, 14 bp, Homo sapiens
ttcgtcttctaatt

SEQ ID NO: 6572560 - DNA, 12 bp, Homo sapiens
ttcgtgaacata

SEQ ID NO: 6572561 - DNA, 23 bp, Homo sapiens
ttcgtgaataagttgattctgtc

SEQ ID NO: 6572562 - DNA, 19 bp, Homo sapiens
ttcgtgacaatgtttacaa

SEQ ID NO: 6572563 - DNA, 15 bp, Homo sapiens
ttcgtgagccccatc

SEQ ID NO: 6572564 - DNA, 13 bp, Homo sapiens
ttcgtgagctggg

SEQ ID NO: 6572565 - DNA, 15 bp, Homo sapiens
ttcgtgagctgggga

SEQ ID NO: 6572566 - DNA, 18 bp, Homo sapiens
ttcgtgatcttattgctt

SEQ ID NO: 6572567 - DNA, 13 bp, Homo sapiens
ttcgtgcattttt

SEQ ID NO: 6572568 - DNA, 12 bp, Homo sapiens
ttcgtggagctc

SEQ ID NO: 6572569 - DNA, 16 bp, Homo sapiens
ttcgtggcagcacggc

SEQ ID NO: 6572570 - DNA, 20 bp, Homo sapiens
ttcgtgtagtggaagagcag

SEQ ID NO: 6572571 - DNA, 21 bp, Homo sapiens
ttcgtgtctctcccaccccgg

SEQ ID NO: 6572572 - DNA, 14 bp, Homo sapiens
ttcgtgtgctgctg

SEQ ID NO: 6572573 - DNA, 18 bp, Homo sapiens
ttcgtgtgctgctgctgc

SEQ ID NO: 6572574 - DNA, 21 bp, Homo sapiens
ttcgttaatagattatttcat

SEQ ID NO: 6572575 - DNA, 17 bp, Homo sapiens
ttcgttccctgattatt

SEQ ID NO: 6572576 - DNA, 12 bp, Homo sapiens
ttcgttcctgcg

SEQ ID NO: 6572577 - DNA, 23 bp, Homo sapiens
ttcgttgcacagctgtttgaaat

SEQ ID NO: 6572578 - DNA, 20 bp, Homo sapiens
ttcgttggtgaccagtttct

SEQ ID NO: 6572579 - DNA, 16 bp, Homo sapiens
ttcgttggttgtttct

SEQ ID NO: 6572580 - DNA, 13 bp, Homo sapiens
ttcgtttagaatc

SEQ ID NO: 6572581 - DNA, 20 bp, Homo sapiens
ttcgtttccatcatgtctgt

SEQ ID NO: 6572582 - DNA, 16 bp, Homo sapiens
ttcgtttctgtataca

SEQ ID NO: 6572583 - DNA, 11 bp, Homo sapiens
ttcgtttgttt

SEQ ID NO: 6572584 - DNA, 22 bp, Homo sapiens
ttcgttttggttaagttggctt

SEQ ID NO: 6572585 - DNA, 17 bp, Homo sapiens
ttcgttttttacctgtt

SEQ ID NO: 6572586 - DNA, 14 bp, Homo sapiens
ttctaaaaaaagaa

SEQ ID NO: 6572587 - DNA, 19 bp, Homo sapiens
ttctaaaaaaataaacaaa

SEQ ID NO: 6572588 - DNA, 13 bp, Homo sapiens
ttctaaaaaacag

SEQ ID NO: 6572589 - DNA, 18 bp, Homo sapiens
ttctaaaaaatgttttta

SEQ ID NO: 6572590 - DNA, 17 bp, Homo sapiens
ttctaaaaagattagca

SEQ ID NO: 6572591 - DNA, 14 bp, Homo sapiens
ttctaaaaagtcag

SEQ ID NO: 6572592 - DNA, 18 bp, Homo sapiens
ttctaaaacattcccctc

SEQ ID NO: 6572593 - DNA, 16 bp, Homo sapiens
ttctaaaactactgcc

SEQ ID NO: 6572594 - DNA, 17 bp, Homo sapiens
ttctaaaactgcctttc

SEQ ID NO: 6572595 - DNA, 12 bp, Homo sapiens
ttctaaaactgt

SEQ ID NO: 6572596 - DNA, 18 bp, Homo sapiens
ttctaaaactgtactttg

SEQ ID NO: 6572597 - DNA, 15 bp, Homo sapiens
ttctaaaaggtgtga

SEQ ID NO: 6572598 - DNA, 15 bp, Homo sapiens
ttctaaaagtaataa

SEQ ID NO: 6572599 - DNA, 22 bp, Homo sapiens
ttctaaaataaatgttttggaa

SEQ ID NO: 6572600 - DNA, 12 bp, Homo sapiens
ttctaaaatcaa

SEQ ID NO: 6572601 - DNA, 14 bp, Homo sapiens
ttctaaaatgcttt

SEQ ID NO: 6572602 - DNA, 20 bp, Homo sapiens
ttctaaaatgtgatgttcta

SEQ ID NO: 6572603 - DNA, 15 bp, Homo sapiens
ttctaaaatgttaaa

SEQ ID NO: 6572604 - DNA, 20 bp, Homo sapiens
ttctaaacagatgtccctga

SEQ ID NO: 6572605 - DNA, 22 bp, Homo sapiens
ttctaaacaggttaagtagcag

SEQ ID NO: 6572606 - DNA, 14 bp, Homo sapiens
ttctaaaccatgaa

SEQ ID NO: 6572607 - DNA, 15 bp, Homo sapiens
ttctaaaccatgaaa

SEQ ID NO: 6572608 - DNA, 18 bp, Homo sapiens
ttctaaacccaatccaaa

SEQ ID NO: 6572609 - DNA, 19 bp, Homo sapiens
ttctaaacccaatccaaat

SEQ ID NO: 6572610 - DNA, 16 bp, Homo sapiens
ttctaaactaggattg

SEQ ID NO: 6572611 - DNA, 19 bp, Homo sapiens
ttctaaactgaagctgctg

SEQ ID NO: 6572612 - DNA, 14 bp, Homo sapiens
ttctaaactgtttt

SEQ ID NO: 6572613 - DNA, 19 bp, Homo sapiens
ttctaaactgttttcatgt

SEQ ID NO: 6572614 - DNA, 18 bp, Homo sapiens
ttctaaacttagaaatat

SEQ ID NO: 6572615 - DNA, 20 bp, Homo sapiens
ttctaaagagcacttactgt

SEQ ID NO: 6572616 - DNA, 13 bp, Homo sapiens
ttctaaagatgga

SEQ ID NO: 6572617 - DNA, 15 bp, Homo sapiens
ttctaaagatggaaa

SEQ ID NO: 6572618 - DNA, 22 bp, Homo sapiens
ttctaaagattctatagttcta

SEQ ID NO: 6572619 - DNA, 22 bp, Homo sapiens
ttctaaagcactggtttcaaga

SEQ ID NO: 6572620 - DNA, 13 bp, Homo sapiens
ttctaaagctgcc

SEQ ID NO: 6572621 - DNA, 16 bp, Homo sapiens
ttctaaagctttctga

SEQ ID NO: 6572622 - DNA, 18 bp, Homo sapiens
ttctaaaggctacctttg

SEQ ID NO: 6572623 - DNA, 21 bp, Homo sapiens
ttctaaaggctacctttgtat

SEQ ID NO: 6572624 - DNA, 19 bp, Homo sapiens
ttctaaagggatctgctta

SEQ ID NO: 6572625 - DNA, 20 bp, Homo sapiens
ttctaaaggtgttgtccctt

SEQ ID NO: 6572626 - DNA, 13 bp, Homo sapiens
ttctaaagttcta

SEQ ID NO: 6572627 - DNA, 18 bp, Homo sapiens
ttctaaagttctaagatt

SEQ ID NO: 6572628 - DNA, 18 bp, Homo sapiens
ttctaaagttgtagtgaa

SEQ ID NO: 6572629 - DNA, 19 bp, Homo sapiens
ttctaaagttttgcaacaa

SEQ ID NO: 6572630 - DNA, 23 bp, Homo sapiens
ttctaaataaaatataattgttt

SEQ ID NO: 6572631 - DNA, 20 bp, Homo sapiens
ttctaaataaggaatttcct

SEQ ID NO: 6572632 - DNA, 23 bp, Homo sapiens
ttctaaatacatgccacatcaaa

SEQ ID NO: 6572633 - DNA, 13 bp, Homo sapiens
ttctaaatagcaa

SEQ ID NO: 6572634 - DNA, 15 bp, Homo sapiens
ttctaaatattgctt

SEQ ID NO: 6572635 - DNA, 21 bp, Homo sapiens
ttctaaatatttatttattct

SEQ ID NO: 6572636 - DNA, 18 bp, Homo sapiens
ttctaaatccgacttgaa

SEQ ID NO: 6572637 - DNA, 19 bp, Homo sapiens
ttctaaatccgacttgaat

SEQ ID NO: 6572638 - DNA, 12 bp, Homo sapiens
ttctaaatgaat

SEQ ID NO: 6572639 - DNA, 21 bp, Homo sapiens
ttctaaatgaatgtttacact

SEQ ID NO: 6572640 - DNA, 14 bp, Homo sapiens
ttctaaatgctggt

SEQ ID NO: 6572641 - DNA, 15 bp, Homo sapiens
ttctaaatgctggtc

SEQ ID NO: 6572642 - DNA, 15 bp, Homo sapiens
ttctaaatgttatta

SEQ ID NO: 6572643 - DNA, 22 bp, Homo sapiens
ttctaaatgttggaattttcaa

SEQ ID NO: 6572644 - DNA, 14 bp, Homo sapiens
ttctaaatgtttct

SEQ ID NO: 6572645 - DNA, 20 bp, Homo sapiens
ttctaaatgtttggcatgta

SEQ ID NO: 6572646 - DNA, 17 bp, Homo sapiens
ttctaaattaatggtaa

SEQ ID NO: 6572647 - DNA, 12 bp, Homo sapiens
ttctaaattcac

SEQ ID NO: 6572648 - DNA, 21 bp, Homo sapiens
ttctaaattctataaaaacca

SEQ ID NO: 6572649 - DNA, 12 bp, Homo sapiens
ttctaaattctt

SEQ ID NO: 6572650 - DNA, 14 bp, Homo sapiens
ttctaaattttata

SEQ ID NO: 6572651 - DNA, 20 bp, Homo sapiens
ttctaacaaggacttggaga

SEQ ID NO: 6572652 - DNA, 14 bp, Homo sapiens
ttctaacaagtcat

SEQ ID NO: 6572653 - DNA, 14 bp, Homo sapiens
ttctaacacatttc

SEQ ID NO: 6572654 - DNA, 12 bp, Homo sapiens
ttctaacatgaa

SEQ ID NO: 6572655 - DNA, 15 bp, Homo sapiens
ttctaacatgaaata

SEQ ID NO: 6572656 - DNA, 18 bp, Homo sapiens
ttctaacatgaaatatat

SEQ ID NO: 6572657 - DNA, 17 bp, Homo sapiens
ttctaacatttgataat

SEQ ID NO: 6572658 - DNA, 18 bp, Homo sapiens
ttctaacatttgataatt

SEQ ID NO: 6572659 - DNA, 17 bp, Homo sapiens
ttctaaccaagaggctg

SEQ ID NO: 6572660 - DNA, 18 bp, Homo sapiens
ttctaaccagagcaagct

SEQ ID NO: 6572661 - DNA, 22 bp, Homo sapiens
ttctaacccagtcttatttttc

SEQ ID NO: 6572662 - DNA, 21 bp, Homo sapiens
ttctaaccttgaatgctgcca

SEQ ID NO: 6572663 - DNA, 14 bp, Homo sapiens
ttctaacctttaca

SEQ ID NO: 6572664 - DNA, 13 bp, Homo sapiens
ttctaactaagga

SEQ ID NO: 6572665 - DNA, 23 bp, Homo sapiens
ttctaactacaaaggtttaaatg

SEQ ID NO: 6572666 - DNA, 14 bp, Homo sapiens
ttctaactgtaaat

SEQ ID NO: 6572667 - DNA, 13 bp, Homo sapiens
ttctaacttctgt

SEQ ID NO: 6572668 - DNA, 14 bp, Homo sapiens
ttctaagaaaatgt

SEQ ID NO: 6572669 - DNA, 17 bp, Homo sapiens
ttctaagaaaatgtagt

SEQ ID NO: 6572670 - DNA, 14 bp, Homo sapiens
ttctaagaaacatt

SEQ ID NO: 6572671 - DNA, 16 bp, Homo sapiens
ttctaagaaacattta

SEQ ID NO: 6572672 - DNA, 20 bp, Homo sapiens
ttctaagaaacatttatatt

SEQ ID NO: 6572673 - DNA, 19 bp, Homo sapiens
ttctaagaaatagagccaa

SEQ ID NO: 6572674 - DNA, 19 bp, Homo sapiens
ttctaagaagacattttgt

SEQ ID NO: 6572675 - DNA, 13 bp, Homo sapiens
ttctaagaagtga

SEQ ID NO: 6572676 - DNA, 19 bp, Homo sapiens
ttctaagaataatggactc

SEQ ID NO: 6572677 - DNA, 15 bp, Homo sapiens
ttctaagaatttaga

SEQ ID NO: 6572678 - DNA, 13 bp, Homo sapiens
ttctaagactcaa

SEQ ID NO: 6572679 - DNA, 12 bp, Homo sapiens
ttctaagagaag

SEQ ID NO: 6572680 - DNA, 22 bp, Homo sapiens
ttctaagagcgaacttcacata

SEQ ID NO: 6572681 - DNA, 23 bp, Homo sapiens
ttctaagatgccagcatatactg

SEQ ID NO: 6572682 - DNA, 12 bp, Homo sapiens
ttctaagatgtg

SEQ ID NO: 6572683 - DNA, 20 bp, Homo sapiens
ttctaagatgtgatattcta

SEQ ID NO: 6572684 - DNA, 15 bp, Homo sapiens
ttctaagattctaat

SEQ ID NO: 6572685 - DNA, 16 bp, Homo sapiens
ttctaagattgtacat

SEQ ID NO: 6572686 - DNA, 17 bp, Homo sapiens
ttctaagattgtacata

SEQ ID NO: 6572687 - DNA, 19 bp, Homo sapiens
ttctaagcaatgcaaatgt

SEQ ID NO: 6572688 - DNA, 21 bp, Homo sapiens
ttctaagccagttttcatttt

SEQ ID NO: 6572689 - DNA, 21 bp, Homo sapiens
ttctaagcgcctattgtttgt

SEQ ID NO: 6572690 - DNA, 13 bp, Homo sapiens
ttctaagctgttt

SEQ ID NO: 6572691 - DNA, 17 bp, Homo sapiens
ttctaaggaatgcacaa

SEQ ID NO: 6572692 - DNA, 22 bp, Homo sapiens
ttctaaggacctgaaattccaa

SEQ ID NO: 6572693 - DNA, 21 bp, Homo sapiens
ttctaaggatagcctttgtag

SEQ ID NO: 6572694 - DNA, 20 bp, Homo sapiens
ttctaaggcctaggattcta

SEQ ID NO: 6572695 - DNA, 21 bp, Homo sapiens
ttctaaggcctaggattctaa

SEQ ID NO: 6572696 - DNA, 18 bp, Homo sapiens
ttctaaggctcagcccca

SEQ ID NO: 6572697 - DNA, 13 bp, Homo sapiens
ttctaaggctctg

SEQ ID NO: 6572698 - DNA, 23 bp, Homo sapiens
ttctaagggaaaaagttgtatca

SEQ ID NO: 6572699 - DNA, 19 bp, Homo sapiens
ttctaagtaaaaccacagc

SEQ ID NO: 6572700 - DNA, 21 bp, Homo sapiens
ttctaagtaaaaccacagcag

SEQ ID NO: 6572701 - DNA, 16 bp, Homo sapiens
ttctaagtaaatacaa

SEQ ID NO: 6572702 - DNA, 17 bp, Homo sapiens
ttctaagtaaatacaat

SEQ ID NO: 6572703 - DNA, 23 bp, Homo sapiens
ttctaagtcaaacacttgtgact

SEQ ID NO: 6572704 - DNA, 15 bp, Homo sapiens
ttctaagtctttcca

SEQ ID NO: 6572705 - DNA, 23 bp, Homo sapiens
ttctaagtgtaacctcagtattt

SEQ ID NO: 6572706 - DNA, 15 bp, Homo sapiens
ttctaagtgtacttc

SEQ ID NO: 6572707 - DNA, 14 bp, Homo sapiens
ttctaagtgtttca

SEQ ID NO: 6572708 - DNA, 17 bp, Homo sapiens
ttctaagtgtttcacag

SEQ ID NO: 6572709 - DNA, 12 bp, Homo sapiens
ttctaagttaaa

SEQ ID NO: 6572710 - DNA, 12 bp, Homo sapiens
ttctaagtttct

SEQ ID NO: 6572711 - DNA, 14 bp, Homo sapiens
ttctaagtttctaa

SEQ ID NO: 6572712 - DNA, 16 bp, Homo sapiens
ttctaagtttctaaga

SEQ ID NO: 6572713 - DNA, 21 bp, Homo sapiens
ttctaagtttctaagattcta

SEQ ID NO: 6572714 - DNA, 15 bp, Homo sapiens
ttctaataaaacaaa

SEQ ID NO: 6572715 - DNA, 18 bp, Homo sapiens
ttctaataaatatactat

SEQ ID NO: 6572716 - DNA, 22 bp, Homo sapiens
ttctaataaatatactatgaaa

SEQ ID NO: 6572717 - DNA, 18 bp, Homo sapiens
ttctaataatttctaatg

SEQ ID NO: 6572718 - DNA, 14 bp, Homo sapiens
ttctaatagagaga

SEQ ID NO: 6572719 - DNA, 16 bp, Homo sapiens
ttctaatagagagatt

SEQ ID NO: 6572720 - DNA, 16 bp, Homo sapiens
ttctaatagtttttca

SEQ ID NO: 6572721 - DNA, 13 bp, Homo sapiens
ttctaatatcatt

SEQ ID NO: 6572722 - DNA, 21 bp, Homo sapiens
ttctaatatttattgctttat

SEQ ID NO: 6572723 - DNA, 21 bp, Homo sapiens
ttctaatcccagcactttggt

SEQ ID NO: 6572724 - DNA, 14 bp, Homo sapiens
ttctaatctgctat

SEQ ID NO: 6572725 - DNA, 21 bp, Homo sapiens
ttctaatcttaaatcagaata

SEQ ID NO: 6572726 - DNA, 14 bp, Homo sapiens
ttctaatgacccag

SEQ ID NO: 6572727 - DNA, 23 bp, Homo sapiens
ttctaatgacccagatatggaaa

SEQ ID NO: 6572728 - DNA, 13 bp, Homo sapiens
ttctaatgatgat

SEQ ID NO: 6572729 - DNA, 16 bp, Homo sapiens
ttctaatgcatattta

SEQ ID NO: 6572730 - DNA, 21 bp, Homo sapiens
ttctaatgcatatttataaga

SEQ ID NO: 6572731 - DNA, 22 bp, Homo sapiens
ttctaatgcatatttataagag

SEQ ID NO: 6572732 - DNA, 22 bp, Homo sapiens
ttctaatgctgcacaccagtta

SEQ ID NO: 6572733 - DNA, 14 bp, Homo sapiens
ttctaatggtaact

SEQ ID NO: 6572734 - DNA, 15 bp, Homo sapiens
ttctaatggtaactt

SEQ ID NO: 6572735 - DNA, 17 bp, Homo sapiens
ttctaatggtaactttt

SEQ ID NO: 6572736 - DNA, 20 bp, Homo sapiens
ttctaatggtaacttttgta

SEQ ID NO: 6572737 - DNA, 16 bp, Homo sapiens
ttctaatgtcttcatt

SEQ ID NO: 6572738 - DNA, 17 bp, Homo sapiens
ttctaatgtcttcattt

SEQ ID NO: 6572739 - DNA, 20 bp, Homo sapiens
ttctaatgttattttccttc

SEQ ID NO: 6572740 - DNA, 21 bp, Homo sapiens
ttctaatgttattttccttct

SEQ ID NO: 6572741 - DNA, 16 bp, Homo sapiens
ttctaatgttccccgt

SEQ ID NO: 6572742 - DNA, 15 bp, Homo sapiens
aagctcagattattt

SEQ ID NO: 6572743 - DNA, 16 bp, Homo sapiens
aagctcagattattta

SEQ ID NO: 6572744 - DNA, 13 bp, Homo sapiens
aagctcaggaggg

SEQ ID NO: 6572745 - DNA, 12 bp, Homo sapiens
aagctcagggcc

SEQ ID NO: 6572746 - DNA, 19 bp, Homo sapiens
aagctcagggcctggctca

SEQ ID NO: 6572747 - DNA, 18 bp, Homo sapiens
aagctcaggttccctgcc

SEQ ID NO: 6572748 - DNA, 18 bp, Homo sapiens
aagctcagtgctctctcc

SEQ ID NO: 6572749 - DNA, 15 bp, Homo sapiens
aagctcatagcacat

SEQ ID NO: 6572750 - DNA, 20 bp, Homo sapiens
aagctcatagcacatgtttt

SEQ ID NO: 6572751 - DNA, 20 bp, Homo sapiens
aagctcatattttgtatata

SEQ ID NO: 6572752 - DNA, 22 bp, Homo sapiens
aagctcatattttgtatatatc

SEQ ID NO: 6572753 - DNA, 23 bp, Homo sapiens
aagctcatattttgtatatatct

SEQ ID NO: 6572754 - DNA, 15 bp, Homo sapiens
aagctcatccctgga

SEQ ID NO: 6572755 - DNA, 22 bp, Homo sapiens
aagctcatgatgcgcttcaaag

SEQ ID NO: 6572756 - DNA, 22 bp, Homo sapiens
aagctcatgcatttcaagcagc

SEQ ID NO: 6572757 - DNA, 23 bp, Homo sapiens
aagctcatggctgtgtccactgc

SEQ ID NO: 6572758 - DNA, 22 bp, Homo sapiens
aagctcattcccaacgtgcaaa

SEQ ID NO: 6572759 - DNA, 20 bp, Homo sapiens
aagctcatttagttagaaaa

SEQ ID NO: 6572760 - DNA, 18 bp, Homo sapiens
aagctcatttcatgctct

SEQ ID NO: 6572761 - DNA, 13 bp, Homo sapiens
aagctccaagccc

SEQ ID NO: 6572762 - DNA, 19 bp, Homo sapiens
aagctccactgtcaccctc

SEQ ID NO: 6572763 - DNA, 23 bp, Homo sapiens
aagctccagctgaatagagggag

SEQ ID NO: 6572764 - DNA, 13 bp, Homo sapiens
aagctccagcttt

SEQ ID NO: 6572765 - DNA, 17 bp, Homo sapiens
aagctccaggtgccctg

SEQ ID NO: 6572766 - DNA, 20 bp, Homo sapiens
aagctccaggtgccctgtgg

SEQ ID NO: 6572767 - DNA, 13 bp, Homo sapiens
aagctccagtagc

SEQ ID NO: 6572768 - DNA, 15 bp, Homo sapiens
aagctccatcaatga

SEQ ID NO: 6572769 - DNA, 16 bp, Homo sapiens
aagctccatcttattt

SEQ ID NO: 6572770 - DNA, 16 bp, Homo sapiens
aagctccatgtgcata

SEQ ID NO: 6572771 - DNA, 21 bp, Homo sapiens
aagctccatgtttagaaataa

SEQ ID NO: 6572772 - DNA, 21 bp, Homo sapiens
aagctcccaagggatggtgcc

SEQ ID NO: 6572773 - DNA, 19 bp, Homo sapiens
aagctcccagatgctgggg

SEQ ID NO: 6572774 - DNA, 13 bp, Homo sapiens
aagctcccaggaa

SEQ ID NO: 6572775 - DNA, 16 bp, Homo sapiens
aagctcccaggaacaa

SEQ ID NO: 6572776 - DNA, 22 bp, Homo sapiens
aagctcccaggcattccccagg

SEQ ID NO: 6572777 - DNA, 14 bp, Homo sapiens
aagctcccctgcct

SEQ ID NO: 6572778 - DNA, 16 bp, Homo sapiens
aagctccctgccccaa

SEQ ID NO: 6572779 - DNA, 19 bp, Homo sapiens
aagctccctggagccctgt

SEQ ID NO: 6572780 - DNA, 19 bp, Homo sapiens
aagctcccttgaagcaaga

SEQ ID NO: 6572781 - DNA, 16 bp, Homo sapiens
aagctcctacttttgc

SEQ ID NO: 6572782 - DNA, 15 bp, Homo sapiens
aagctcctcctccct

SEQ ID NO: 6572783 - DNA, 18 bp, Homo sapiens
aagctcctcctccctgca

SEQ ID NO: 6572784 - DNA, 14 bp, Homo sapiens
aagctcctctgtaa

SEQ ID NO: 6572785 - DNA, 14 bp, Homo sapiens
aagctcctgctact

SEQ ID NO: 6572786 - DNA, 13 bp, Homo sapiens
aagctcctgtcct

SEQ ID NO: 6572787 - DNA, 19 bp, Homo sapiens
aagctccttcagtttgaag

SEQ ID NO: 6572788 - DNA, 18 bp, Homo sapiens
aagctccttcctgtttgt

SEQ ID NO: 6572789 - DNA, 18 bp, Homo sapiens
aagctcgaaaacaattgt

SEQ ID NO: 6572790 - DNA, 22 bp, Homo sapiens
aagctcgatgtggtcacagctg

SEQ ID NO: 6572791 - DNA, 14 bp, Homo sapiens
aagctcgccccacc

SEQ ID NO: 6572792 - DNA, 15 bp, Homo sapiens
aagctcgccccacct

SEQ ID NO: 6572793 - DNA, 17 bp, Homo sapiens
aagctcgccccacctcc

SEQ ID NO: 6572794 - DNA, 22 bp, Homo sapiens
aagctctctgcatctactccca

SEQ ID NO: 6572795 - DNA, 16 bp, Homo sapiens
aagctctctgggcctg

SEQ ID NO: 6572796 - DNA, 13 bp, Homo sapiens
aagctctgaaaac

SEQ ID NO: 6572797 - DNA, 14 bp, Homo sapiens
aagctctgaaaaca

SEQ ID NO: 6572798 - DNA, 20 bp, Homo sapiens
aagctctgaaaacaaggttt

SEQ ID NO: 6572799 - DNA, 16 bp, Homo sapiens
aagctctgagctgtca

SEQ ID NO: 6572800 - DNA, 13 bp, Homo sapiens
aagctctgaggga

SEQ ID NO: 6572801 - DNA, 14 bp, Homo sapiens
aagctctgcccctt

SEQ ID NO: 6572802 - DNA, 15 bp, Homo sapiens
aagctctgccccttc

SEQ ID NO: 6572803 - DNA, 15 bp, Homo sapiens
aagctctgcctcccg

SEQ ID NO: 6572804 - DNA, 14 bp, Homo sapiens
aagctctgctatta

SEQ ID NO: 6572805 - DNA, 17 bp, Homo sapiens
aagctctgctcctctcc

SEQ ID NO: 6572806 - DNA, 16 bp, Homo sapiens
aagctctggaattgtt

SEQ ID NO: 6572807 - DNA, 23 bp, Homo sapiens
aagctctggggatgggtggggag

SEQ ID NO: 6572808 - DNA, 20 bp, Homo sapiens
aagctctggtgacaccagcc

SEQ ID NO: 6572809 - DNA, 11 bp, Homo sapiens
aagctctgttg

SEQ ID NO: 6572810 - DNA, 22 bp, Homo sapiens
aagctctgtttataaaaacaaa

SEQ ID NO: 6572811 - DNA, 22 bp, Homo sapiens
aagctcttacactacattagaa

SEQ ID NO: 6572812 - DNA, 17 bp, Homo sapiens
aagctcttcatttctgg

SEQ ID NO: 6572813 - DNA, 19 bp, Homo sapiens
aagctcttgaagacactga

SEQ ID NO: 6572814 - DNA, 20 bp, Homo sapiens
aagctcttgaagacactgaa

SEQ ID NO: 6572815 - DNA, 21 bp, Homo sapiens
aagctcttgaagacactgaaa

SEQ ID NO: 6572816 - DNA, 15 bp, Homo sapiens
aagctcttggacaac

SEQ ID NO: 6572817 - DNA, 14 bp, Homo sapiens
aagctcttgtttct

SEQ ID NO: 6572818 - DNA, 16 bp, Homo sapiens
aagctcttgtttctgt

SEQ ID NO: 6572819 - DNA, 20 bp, Homo sapiens
aagctcttgtttctgtttag

SEQ ID NO: 6572820 - DNA, 11 bp, Homo sapiens
aagctgaaatt

SEQ ID NO: 6572821 - DNA, 16 bp, Homo sapiens
aagctgaaattgtgtt

SEQ ID NO: 6572822 - DNA, 17 bp, Homo sapiens
aagctgaaccccctcca

SEQ ID NO: 6572823 - DNA, 22 bp, Homo sapiens
aagctgaactaaaataaaaatg

SEQ ID NO: 6572824 - DNA, 18 bp, Homo sapiens
aagctgaagaccatggat

SEQ ID NO: 6572825 - DNA, 17 bp, Homo sapiens
aagctgaagatccccaa

SEQ ID NO: 6572826 - DNA, 22 bp, Homo sapiens
aagctgaagatccccattcttt

SEQ ID NO: 6572827 - DNA, 22 bp, Homo sapiens
aagctgaagattaggcacacag

SEQ ID NO: 6572828 - DNA, 12 bp, Homo sapiens
aagctgaagtga

SEQ ID NO: 6572829 - DNA, 13 bp, Homo sapiens
aagctgaatacat

SEQ ID NO: 6572830 - DNA, 16 bp, Homo sapiens
aagctgacaatttatg

SEQ ID NO: 6572831 - DNA, 22 bp, Homo sapiens
aagctgacattgccaaaaagga

SEQ ID NO: 6572832 - DNA, 17 bp, Homo sapiens
aagctgaccacaggcag

SEQ ID NO: 6572833 - DNA, 21 bp, Homo sapiens
aagctgactgttttttttgca

SEQ ID NO: 6572834 - DNA, 17 bp, Homo sapiens
aagctgacttggcactt

SEQ ID NO: 6572835 - DNA, 17 bp, Homo sapiens
aagctgacttggctggt

SEQ ID NO: 6572836 - DNA, 20 bp, Homo sapiens
aagctgacttggctggtgtg

SEQ ID NO: 6572837 - DNA, 15 bp, Homo sapiens
aagctgactttgttg

SEQ ID NO: 6572838 - DNA, 21 bp, Homo sapiens
aagctgagaaaagtattctca

SEQ ID NO: 6572839 - DNA, 19 bp, Homo sapiens
aagctgagaactcctgact

SEQ ID NO: 6572840 - DNA, 13 bp, Homo sapiens
aagctgagaagaa

SEQ ID NO: 6572841 - DNA, 15 bp, Homo sapiens
aagctgagaagaatg

SEQ ID NO: 6572842 - DNA, 19 bp, Homo sapiens
aagctgagagaccctggcc

SEQ ID NO: 6572843 - DNA, 21 bp, Homo sapiens
aagctgagcaggacagccagc

SEQ ID NO: 6572844 - DNA, 23 bp, Homo sapiens
aagctgaggaacaggttcctgtg

SEQ ID NO: 6572845 - DNA, 13 bp, Homo sapiens
aagctgaggccca

SEQ ID NO: 6572846 - DNA, 14 bp, Homo sapiens
aagctgaggcccat

SEQ ID NO: 6572847 - DNA, 21 bp, Homo sapiens
aagctgaggcccatggccaca

SEQ ID NO: 6572848 - DNA, 13 bp, Homo sapiens
aagctgaggccta

SEQ ID NO: 6572849 - DNA, 17 bp, Homo sapiens
aagctgaggcgggagaa

SEQ ID NO: 6572850 - DNA, 15 bp, Homo sapiens
aagctgaggctgctg

SEQ ID NO: 6572851 - DNA, 17 bp, Homo sapiens
aagctgaggtgcccagg

SEQ ID NO: 6572852 - DNA, 18 bp, Homo sapiens
aagctgagtattaaaatg

SEQ ID NO: 6572853 - DNA, 22 bp, Homo sapiens
aagctgagttaggtgtctgtcc

SEQ ID NO: 6572854 - DNA, 13 bp, Homo sapiens
aagctgagtttcc

SEQ ID NO: 6572855 - DNA, 22 bp, Homo sapiens
aagctgagtttcctatgggaac

SEQ ID NO: 6572856 - DNA, 13 bp, Homo sapiens
aagctgatccagt

SEQ ID NO: 6572857 - DNA, 13 bp, Homo sapiens
aagctgatcctgc

SEQ ID NO: 6572858 - DNA, 15 bp, Homo sapiens
aagctgatggttgga

SEQ ID NO: 6572859 - DNA, 14 bp, Homo sapiens
aagctgattaaaac

SEQ ID NO: 6572860 - DNA, 17 bp, Homo sapiens
aagctgattaaaacaca

SEQ ID NO: 6572861 - DNA, 16 bp, Homo sapiens
aagctgattaaatgac

SEQ ID NO: 6572862 - DNA, 16 bp, Homo sapiens
aagctgattcccagag

SEQ ID NO: 6572863 - DNA, 18 bp, Homo sapiens
aagctgattcccagagca

SEQ ID NO: 6572864 - DNA, 20 bp, Homo sapiens
aagctgatttcccttttttc

SEQ ID NO: 6572865 - DNA, 13 bp, Homo sapiens
aagctgattttat

SEQ ID NO: 6572866 - DNA, 18 bp, Homo sapiens
aagctgattttttttaat

SEQ ID NO: 6572867 - DNA, 13 bp, Homo sapiens
aagctgcactgtg

SEQ ID NO: 6572868 - DNA, 16 bp, Homo sapiens
aagctgcactgtgaac

SEQ ID NO: 6572869 - DNA, 17 bp, Homo sapiens
aagctgcagagatttct

SEQ ID NO: 6572870 - DNA, 18 bp, Homo sapiens
aagctgcagatctttgct

SEQ ID NO: 6572871 - DNA, 11 bp, Homo sapiens
aagctgcagct

SEQ ID NO: 6572872 - DNA, 14 bp, Homo sapiens
aagctgcagcttcc

SEQ ID NO: 6572873 - DNA, 16 bp, Homo sapiens
aagctgcagcttcctg

SEQ ID NO: 6572874 - DNA, 13 bp, Homo sapiens
aagctgcaggttt

SEQ ID NO: 6572875 - DNA, 17 bp, Homo sapiens
aagctgccacccctctt

SEQ ID NO: 6572876 - DNA, 11 bp, Homo sapiens
aagctgccagc

SEQ ID NO: 6572877 - DNA, 12 bp, Homo sapiens
aagctgccagcc

SEQ ID NO: 6572878 - DNA, 16 bp, Homo sapiens
aagctgccagcccaga

SEQ ID NO: 6572879 - DNA, 17 bp, Homo sapiens
aagctgccagccttccc

SEQ ID NO: 6572880 - DNA, 20 bp, Homo sapiens
aagctgcccaatttcacaga

SEQ ID NO: 6572881 - DNA, 23 bp, Homo sapiens
aagctgcccaatttcacagagta

SEQ ID NO: 6572882 - DNA, 18 bp, Homo sapiens
aagctgcccactgtttct

SEQ ID NO: 6572883 - DNA, 22 bp, Homo sapiens
aagctgcccagccctggcccag

SEQ ID NO: 6572884 - DNA, 15 bp, Homo sapiens
aagctgccctgccca

SEQ ID NO: 6572885 - DNA, 20 bp, Homo sapiens
aagctgcctaggcagccagc

SEQ ID NO: 6572886 - DNA, 23 bp, Homo sapiens
aagctgcctcccctctccttcct

SEQ ID NO: 6572887 - DNA, 17 bp, Homo sapiens
aagctgcctccctgtcc

SEQ ID NO: 6572888 - DNA, 11 bp, Homo sapiens
aagctgcctct

SEQ ID NO: 6572889 - DNA, 15 bp, Homo sapiens
aagctgcctctgggc

SEQ ID NO: 6572890 - DNA, 20 bp, Homo sapiens
aagctgcctggtatatccaa

SEQ ID NO: 6572891 - DNA, 23 bp, Homo sapiens
aagctgcctgtgccatgcccaag

SEQ ID NO: 6572892 - DNA, 20 bp, Homo sapiens
aagctgcgggggcaggccgg

SEQ ID NO: 6572893 - DNA, 12 bp, Homo sapiens
aagctgctcaac

SEQ ID NO: 6572894 - DNA, 16 bp, Homo sapiens
aagctgctccaggcct

SEQ ID NO: 6572895 - DNA, 15 bp, Homo sapiens
aagctgctctgaggt

SEQ ID NO: 6572896 - DNA, 16 bp, Homo sapiens
aagctgctctggaatt

SEQ ID NO: 6572897 - DNA, 14 bp, Homo sapiens
aagctgctgacagt

SEQ ID NO: 6572898 - DNA, 21 bp, Homo sapiens
aagctgctgaccaattgtgct

SEQ ID NO: 6572899 - DNA, 21 bp, Homo sapiens
aagctgctgagaatctagcct

SEQ ID NO: 6572900 - DNA, 15 bp, Homo sapiens
aagctgctgaggccc

SEQ ID NO: 6572901 - DNA, 20 bp, Homo sapiens
aagctgctgccgcctcacct

SEQ ID NO: 6572902 - DNA, 15 bp, Homo sapiens
aagctgctgggccag

SEQ ID NO: 6572903 - DNA, 13 bp, Homo sapiens
aagctgctgtctc

SEQ ID NO: 6572904 - DNA, 14 bp, Homo sapiens
aagctgcttctgcc

SEQ ID NO: 6572905 - DNA, 18 bp, Homo sapiens
aagctgcttctgggggat

SEQ ID NO: 6572906 - DNA, 19 bp, Homo sapiens
aagctgcttgactatcaca

SEQ ID NO: 6572907 - DNA, 21 bp, Homo sapiens
aagctgcttgcccaagtcaca

SEQ ID NO: 6572908 - DNA, 23 bp, Homo sapiens
aagctgcttggacctcgtgcttt

SEQ ID NO: 6572909 - DNA, 19 bp, Homo sapiens
aagctgctttcttctctgc

SEQ ID NO: 6572910 - DNA, 20 bp, Homo sapiens
aagctgctttcttctctgcc

SEQ ID NO: 6572911 - DNA, 14 bp, Homo sapiens
aagctggaacattt

SEQ ID NO: 6572912 - DNA, 15 bp, Homo sapiens
aagctggaacatttg

SEQ ID NO: 6572913 - DNA, 14 bp, Homo sapiens
aagctggaagcaca

SEQ ID NO: 6572914 - DNA, 18 bp, Homo sapiens
aagctggacaagaagctg

SEQ ID NO: 6572915 - DNA, 18 bp, Homo sapiens
aagctggaccttttccct

SEQ ID NO: 6572916 - DNA, 15 bp, Homo sapiens
aagctggactagtgt

SEQ ID NO: 6572917 - DNA, 13 bp, Homo sapiens
aagctggactgac

SEQ ID NO: 6572918 - DNA, 14 bp, Homo sapiens
aagctggactgacc

SEQ ID NO: 6572919 - DNA, 15 bp, Homo sapiens
aagctggactgacca

SEQ ID NO: 6572920 - DNA, 16 bp, Homo sapiens
aagctggacttctgtg

SEQ ID NO: 6572921 - DNA, 17 bp, Homo sapiens
aagctggagggaggtgg

SEQ ID NO: 6572922 - DNA, 12 bp, Homo sapiens
ttctaatgttta

SEQ ID NO: 6572923 - DNA, 19 bp, Homo sapiens
ttctaatgtttactatata

SEQ ID NO: 6572924 - DNA, 13 bp, Homo sapiens
ttctaattaagaa

SEQ ID NO: 6572925 - DNA, 14 bp, Homo sapiens
ttctaattgtaagt

SEQ ID NO: 6572926 - DNA, 13 bp, Homo sapiens
ttctaattgtcag

SEQ ID NO: 6572927 - DNA, 23 bp, Homo sapiens
ttctaattgtcagtgattttgta

SEQ ID NO: 6572928 - DNA, 16 bp, Homo sapiens
ttctaatttcaagtta

SEQ ID NO: 6572929 - DNA, 23 bp, Homo sapiens
ttctaatttgcactaatgtgtta

SEQ ID NO: 6572930 - DNA, 15 bp, Homo sapiens
ttctaatttgctgct

SEQ ID NO: 6572931 - DNA, 16 bp, Homo sapiens
ttctaatttgctgctg

SEQ ID NO: 6572932 - DNA, 14 bp, Homo sapiens
ttctaatttgtatc

SEQ ID NO: 6572933 - DNA, 17 bp, Homo sapiens
ttctaattttggatgga

SEQ ID NO: 6572934 - DNA, 13 bp, Homo sapiens
ttctaattttgtg

SEQ ID NO: 6572935 - DNA, 15 bp, Homo sapiens
ttctaattttgtgct

SEQ ID NO: 6572936 - DNA, 15 bp, Homo sapiens
ttctaatttttaaga

SEQ ID NO: 6572937 - DNA, 20 bp, Homo sapiens
ttctaattttttttgtacat

SEQ ID NO: 6572938 - DNA, 17 bp, Homo sapiens
ttctacaaccagagccc

SEQ ID NO: 6572939 - DNA, 18 bp, Homo sapiens
ttctacaaccagagcccc

SEQ ID NO: 6572940 - DNA, 21 bp, Homo sapiens
ttctacaactcatacactcgt

SEQ ID NO: 6572941 - DNA, 15 bp, Homo sapiens
ttctacaagcatatt

SEQ ID NO: 6572942 - DNA, 18 bp, Homo sapiens
ttctacaagcatatttga

SEQ ID NO: 6572943 - DNA, 14 bp, Homo sapiens
ttctacaaggactc

SEQ ID NO: 6572944 - DNA, 16 bp, Homo sapiens
ttctacaatctattta

SEQ ID NO: 6572945 - DNA, 17 bp, Homo sapiens
ttctacacactcagcca

SEQ ID NO: 6572946 - DNA, 18 bp, Homo sapiens
ttctacacactcagccac

SEQ ID NO: 6572947 - DNA, 21 bp, Homo sapiens
ttctacacatttcatctaatt

SEQ ID NO: 6572948 - DNA, 13 bp, Homo sapiens
ttctacacctgga

SEQ ID NO: 6572949 - DNA, 17 bp, Homo sapiens
ttctacagaaaaacaat

SEQ ID NO: 6572950 - DNA, 17 bp, Homo sapiens
ttctacagagaaaatga

SEQ ID NO: 6572951 - DNA, 17 bp, Homo sapiens
ttctacagcaaatttat

SEQ ID NO: 6572952 - DNA, 19 bp, Homo sapiens
ttctacagcaaatttataa

SEQ ID NO: 6572953 - DNA, 20 bp, Homo sapiens
ttctacaggaaatacagaga

SEQ ID NO: 6572954 - DNA, 19 bp, Homo sapiens
ttctacataattgtgacca

SEQ ID NO: 6572955 - DNA, 19 bp, Homo sapiens
ttctacatagtaactctta

SEQ ID NO: 6572956 - DNA, 15 bp, Homo sapiens
ttctacatgactggg

SEQ ID NO: 6572957 - DNA, 14 bp, Homo sapiens
ttctacatgcaaat

SEQ ID NO: 6572958 - DNA, 20 bp, Homo sapiens
ttctacatgcaaatctggct

SEQ ID NO: 6572959 - DNA, 22 bp, Homo sapiens
ttctacatgcaaatctggctta

SEQ ID NO: 6572960 - DNA, 12 bp, Homo sapiens
ttctacatgtga

SEQ ID NO: 6572961 - DNA, 22 bp, Homo sapiens
ttctacatgtgagatagttttc

SEQ ID NO: 6572962 - DNA, 13 bp, Homo sapiens
ttctacattctct

SEQ ID NO: 6572963 - DNA, 15 bp, Homo sapiens
ttctacattgacaca

SEQ ID NO: 6572964 - DNA, 14 bp, Homo sapiens
ttctacatttcacc

SEQ ID NO: 6572965 - DNA, 19 bp, Homo sapiens
ttctaccaaccccagataa

SEQ ID NO: 6572966 - DNA, 16 bp, Homo sapiens
ttctaccaaggcatat

SEQ ID NO: 6572967 - DNA, 19 bp, Homo sapiens
ttctaccaaggtcttctta

SEQ ID NO: 6572968 - DNA, 19 bp, Homo sapiens
ttctaccacacacagcctg

SEQ ID NO: 6572969 - DNA, 20 bp, Homo sapiens
ttctaccacacacagcctgt

SEQ ID NO: 6572970 - DNA, 14 bp, Homo sapiens
ttctaccatttcag

SEQ ID NO: 6572971 - DNA, 18 bp, Homo sapiens
ttctaccatttcagagag

SEQ ID NO: 6572972 - DNA, 19 bp, Homo sapiens
ttctaccccaaggccagta

SEQ ID NO: 6572973 - DNA, 21 bp, Homo sapiens
ttctaccccaaggccagtagt

SEQ ID NO: 6572974 - DNA, 13 bp, Homo sapiens
ttctaccccacct

SEQ ID NO: 6572975 - DNA, 22 bp, Homo sapiens
ttctacccccagagataaatgt

SEQ ID NO: 6572976 - DNA, 18 bp, Homo sapiens
ttctaccctagccattcc

SEQ ID NO: 6572977 - DNA, 21 bp, Homo sapiens
ttctaccctccatgtgagaat

SEQ ID NO: 6572978 - DNA, 13 bp, Homo sapiens
ttctacccttttc

SEQ ID NO: 6572979 - DNA, 20 bp, Homo sapiens
ttctaccggctttgccatgt

SEQ ID NO: 6572980 - DNA, 19 bp, Homo sapiens
ttctaccgtggatttgtac

SEQ ID NO: 6572981 - DNA, 22 bp, Homo sapiens
ttctacctacatatttgtatgt

SEQ ID NO: 6572982 - DNA, 14 bp, Homo sapiens
ttctacctcccaga

SEQ ID NO: 6572983 - DNA, 16 bp, Homo sapiens
ttctacctcttccagg

SEQ ID NO: 6572984 - DNA, 14 bp, Homo sapiens
ttctacctgcagga

SEQ ID NO: 6572985 - DNA, 22 bp, Homo sapiens
ttctacctgcaggcggggctcc

SEQ ID NO: 6572986 - DNA, 21 bp, Homo sapiens
ttctacctttttttctctcct

SEQ ID NO: 6572987 - DNA, 19 bp, Homo sapiens
ttctacggatcatcaacaa

SEQ ID NO: 6572988 - DNA, 15 bp, Homo sapiens
ttctacgtataaata

SEQ ID NO: 6572989 - DNA, 13 bp, Homo sapiens
ttctacgtttctt

SEQ ID NO: 6572990 - DNA, 15 bp, Homo sapiens
ttctactaagttatt

SEQ ID NO: 6572991 - DNA, 19 bp, Homo sapiens
ttctactaagttattttat

SEQ ID NO: 6572992 - DNA, 19 bp, Homo sapiens
ttctactcacttttcccac

SEQ ID NO: 6572993 - DNA, 15 bp, Homo sapiens
ttctactcatatata

SEQ ID NO: 6572994 - DNA, 12 bp, Homo sapiens
ttctactcccct

SEQ ID NO: 6572995 - DNA, 13 bp, Homo sapiens
ttctactcccctt

SEQ ID NO: 6572996 - DNA, 13 bp, Homo sapiens
ttctactcctgcc

SEQ ID NO: 6572997 - DNA, 23 bp, Homo sapiens
ttctactccttccctaatagctt

SEQ ID NO: 6572998 - DNA, 24 bp, Homo sapiens
ttctactcttaatgatgttatctt

SEQ ID NO: 6572999 - DNA, 17 bp, Homo sapiens
ttctactcttgtcattt

SEQ ID NO: 6573000 - DNA, 18 bp, Homo sapiens
ttctactgaagttgggaa

SEQ ID NO: 6573001 - DNA, 12 bp, Homo sapiens
ttctactgagca

SEQ ID NO: 6573002 - DNA, 13 bp, Homo sapiens
ttctactgcttct

SEQ ID NO: 6573003 - DNA, 10 bp, Homo sapiens
ttctactgta

SEQ ID NO: 6573004 - DNA, 12 bp, Homo sapiens
ttctactgtatg

SEQ ID NO: 6573005 - DNA, 23 bp, Homo sapiens
ttctactgtcaaatgatgtgcaa

SEQ ID NO: 6573006 - DNA, 13 bp, Homo sapiens
ttctactgtgact

SEQ ID NO: 6573007 - DNA, 16 bp, Homo sapiens
ttctactgttcaattt

SEQ ID NO: 6573008 - DNA, 16 bp, Homo sapiens
ttctacttccaagact

SEQ ID NO: 6573009 - DNA, 18 bp, Homo sapiens
ttctacttcccctgggat

SEQ ID NO: 6573010 - DNA, 20 bp, Homo sapiens
ttctacttcttgtgctttac

SEQ ID NO: 6573011 - DNA, 16 bp, Homo sapiens
ttctacttgatatttc

SEQ ID NO: 6573012 - DNA, 13 bp, Homo sapiens
ttctacttgctct

SEQ ID NO: 6573013 - DNA, 16 bp, Homo sapiens
ttctacttgctctgga

SEQ ID NO: 6573014 - DNA, 20 bp, Homo sapiens
ttctacttgctctggacctg

SEQ ID NO: 6573015 - DNA, 22 bp, Homo sapiens
ttctacttgctctggacctgcc

SEQ ID NO: 6573016 - DNA, 21 bp, Homo sapiens
ttctacttgcttattacattt

SEQ ID NO: 6573017 - DNA, 17 bp, Homo sapiens
ttctactttaaattgtg

SEQ ID NO: 6573018 - DNA, 18 bp, Homo sapiens
ttctactttaagcactac

SEQ ID NO: 6573019 - DNA, 12 bp, Homo sapiens
ttctactttgaa

SEQ ID NO: 6573020 - DNA, 22 bp, Homo sapiens
ttctactttgcccctttcagta

SEQ ID NO: 6573021 - DNA, 16 bp, Homo sapiens
ttctactttgtttatt

SEQ ID NO: 6573022 - DNA, 15 bp, Homo sapiens
ttctacttttaaaga

SEQ ID NO: 6573023 - DNA, 14 bp, Homo sapiens
ttctacttttaaat

SEQ ID NO: 6573024 - DNA, 22 bp, Homo sapiens
ttctacttttaactaataaaat

SEQ ID NO: 6573025 - DNA, 19 bp, Homo sapiens
ttctactttttccttcctg

SEQ ID NO: 6573026 - DNA, 13 bp, Homo sapiens
ttctagaaaagct

SEQ ID NO: 6573027 - DNA, 18 bp, Homo sapiens
ttctagaaaagcttccta

SEQ ID NO: 6573028 - DNA, 19 bp, Homo sapiens
ttctagaaaagcttcctag

SEQ ID NO: 6573029 - DNA, 17 bp, Homo sapiens
ttctagaaagcctgttc

SEQ ID NO: 6573030 - DNA, 22 bp, Homo sapiens
ttctagaacatccctgccagct

SEQ ID NO: 6573031 - DNA, 23 bp, Homo sapiens
ttctagaacctgggctgtgctgc

SEQ ID NO: 6573032 - DNA, 16 bp, Homo sapiens
ttctagaagcacatgt

SEQ ID NO: 6573033 - DNA, 21 bp, Homo sapiens
ttctagaaggggcgaggcttt

SEQ ID NO: 6573034 - DNA, 20 bp, Homo sapiens
ttctagaaggtctccaagac

SEQ ID NO: 6573035 - DNA, 18 bp, Homo sapiens
ttctagaatactaataaa

SEQ ID NO: 6573036 - DNA, 17 bp, Homo sapiens
ttctagaatcatgtatt

SEQ ID NO: 6573037 - DNA, 18 bp, Homo sapiens
ttctagaattatttttca

SEQ ID NO: 6573038 - DNA, 15 bp, Homo sapiens
ttctagaatttatca

SEQ ID NO: 6573039 - DNA, 15 bp, Homo sapiens
ttctagacacagtgt

SEQ ID NO: 6573040 - DNA, 20 bp, Homo sapiens
ttctagacactccttgaaat

SEQ ID NO: 6573041 - DNA, 16 bp, Homo sapiens
ttctagacactgaagg

SEQ ID NO: 6573042 - DNA, 17 bp, Homo sapiens
ttctagacagtattgcc

SEQ ID NO: 6573043 - DNA, 20 bp, Homo sapiens
ttctagacatggaggttcta

SEQ ID NO: 6573044 - DNA, 22 bp, Homo sapiens
ttctagacatggaggttctaag

SEQ ID NO: 6573045 - DNA, 23 bp, Homo sapiens
ttctagacatggaggttctaagg

SEQ ID NO: 6573046 - DNA, 12 bp, Homo sapiens
ttctagaccaat

SEQ ID NO: 6573047 - DNA, 18 bp, Homo sapiens
ttctagaccctatacatt

SEQ ID NO: 6573048 - DNA, 15 bp, Homo sapiens
ttctagacgcccctc

SEQ ID NO: 6573049 - DNA, 22 bp, Homo sapiens
ttctagactgtgaagattcagt

SEQ ID NO: 6573050 - DNA, 14 bp, Homo sapiens
ttctagacttcccc

SEQ ID NO: 6573051 - DNA, 15 bp, Homo sapiens
ttctagacttcccca

SEQ ID NO: 6573052 - DNA, 21 bp, Homo sapiens
ttctagagagggaattctctt

SEQ ID NO: 6573053 - DNA, 14 bp, Homo sapiens
ttctagagccagca

SEQ ID NO: 6573054 - DNA, 20 bp, Homo sapiens
ttctagagcctgctggatct

SEQ ID NO: 6573055 - DNA, 21 bp, Homo sapiens
ttctagaggctcatggccctg

SEQ ID NO: 6573056 - DNA, 19 bp, Homo sapiens
ttctagagggcactagaac

SEQ ID NO: 6573057 - DNA, 22 bp, Homo sapiens
ttctagagggcaggttagagac

SEQ ID NO: 6573058 - DNA, 16 bp, Homo sapiens
ttctagagtaattatc

SEQ ID NO: 6573059 - DNA, 15 bp, Homo sapiens
ttctagagttatctt

SEQ ID NO: 6573060 - DNA, 22 bp, Homo sapiens
ttctagagttatcttctttatt

SEQ ID NO: 6573061 - DNA, 21 bp, Homo sapiens
ttctagataaccttgtttatt

SEQ ID NO: 6573062 - DNA, 22 bp, Homo sapiens
ttctagatcactgtgcttattt

SEQ ID NO: 6573063 - DNA, 16 bp, Homo sapiens
ttctagatcagatgct

SEQ ID NO: 6573064 - DNA, 14 bp, Homo sapiens
ttctagatcctgca

SEQ ID NO: 6573065 - DNA, 19 bp, Homo sapiens
ttctagatcctgcacccca

SEQ ID NO: 6573066 - DNA, 19 bp, Homo sapiens
ttctagatgcaagtctctt

SEQ ID NO: 6573067 - DNA, 14 bp, Homo sapiens
ttctagattcactg

SEQ ID NO: 6573068 - DNA, 14 bp, Homo sapiens
ttctagcaattgct

SEQ ID NO: 6573069 - DNA, 16 bp, Homo sapiens
ttctagcaattttctt

SEQ ID NO: 6573070 - DNA, 18 bp, Homo sapiens
ttctagcaattttctttg

SEQ ID NO: 6573071 - DNA, 19 bp, Homo sapiens
ttctagcagtatgtgtgct

SEQ ID NO: 6573072 - DNA, 14 bp, Homo sapiens
ttctagcatataga

SEQ ID NO: 6573073 - DNA, 19 bp, Homo sapiens
ttctagcatgaagacagag

SEQ ID NO: 6573074 - DNA, 20 bp, Homo sapiens
ttctagcatggcatattttt

SEQ ID NO: 6573075 - DNA, 13 bp, Homo sapiens
ttctagccataat

SEQ ID NO: 6573076 - DNA, 16 bp, Homo sapiens
ttctagccataataaa

SEQ ID NO: 6573077 - DNA, 17 bp, Homo sapiens
ttctagccatacctcag

SEQ ID NO: 6573078 - DNA, 17 bp, Homo sapiens
ttctagcccctctggat

SEQ ID NO: 6573079 - DNA, 12 bp, Homo sapiens
ttctagcctgca

SEQ ID NO: 6573080 - DNA, 24 bp, Homo sapiens
ttctagcctgcactttgatgtcat

SEQ ID NO: 6573081 - DNA, 15 bp, Homo sapiens
ttctagccttagaca

SEQ ID NO: 6573082 - DNA, 21 bp, Homo sapiens
ttctagccttagacaaatgat

SEQ ID NO: 6573083 - DNA, 24 bp, Homo sapiens
ttctagcgaacgtatttctccaga

SEQ ID NO: 6573084 - DNA, 17 bp, Homo sapiens
ttctagcgcaaggcact

SEQ ID NO: 6573085 - DNA, 17 bp, Homo sapiens
ttctagctagaaatatg

SEQ ID NO: 6573086 - DNA, 18 bp, Homo sapiens
ttctagctataacaactc

SEQ ID NO: 6573087 - DNA, 14 bp, Homo sapiens
ttctagctctcaca

SEQ ID NO: 6573088 - DNA, 14 bp, Homo sapiens
ttctagctctgact

SEQ ID NO: 6573089 - DNA, 14 bp, Homo sapiens
ttctagctgtatga

SEQ ID NO: 6573090 - DNA, 14 bp, Homo sapiens
ttctagctgtctgt

SEQ ID NO: 6573091 - DNA, 12 bp, Homo sapiens
ttctagctgttg

SEQ ID NO: 6573092 - DNA, 21 bp, Homo sapiens
ttctagcttagtgctatgtgt

SEQ ID NO: 6573093 - DNA, 15 bp, Homo sapiens
ttctagctttgttgt

SEQ ID NO: 6573094 - DNA, 17 bp, Homo sapiens
ttctagctttgttgtcc

SEQ ID NO: 6573095 - DNA, 23 bp, Homo sapiens
ttctagctttgttgtcctcccag

SEQ ID NO: 6573096 - DNA, 16 bp, Homo sapiens
ttctagcttttctctt

SEQ ID NO: 6573097 - DNA, 16 bp, Homo sapiens
ttctaggaaaataaaa

SEQ ID NO: 6573098 - DNA, 14 bp, Homo sapiens
ttctaggaagaatt

SEQ ID NO: 6573099 - DNA, 18 bp, Homo sapiens
ttctaggaagaattttaa

SEQ ID NO: 6573100 - DNA, 16 bp, Homo sapiens
ttctaggaggatgctg

SEQ ID NO: 6573101 - DNA, 19 bp, Homo sapiens
ttctaggagtcaactggct

SEQ ID NO: 6573102 - DNA, 21 bp, Homo sapiens
ttctaggatagcgctcccctt

SEQ ID NO: 6573103 - DNA, 15 bp, Homo sapiens
ttctaggatgaacaa

SEQ ID NO: 6573104 - DNA, 19 bp, Homo sapiens
ttctaggcaaaattgtgaa

SEQ ID NO: 6573105 - DNA, 21 bp, Homo sapiens
ttctaggcactgtagttctaa

SEQ ID NO: 6573106 - DNA, 15 bp, Homo sapiens
ttctaggcatacttt

SEQ ID NO: 6573107 - DNA, 20 bp, Homo sapiens
ttctaggcatctctgtactt

SEQ ID NO: 6573108 - DNA, 21 bp, Homo sapiens
ttctaggcccattgtcctcct

SEQ ID NO: 6573109 - DNA, 23 bp, Homo sapiens
ttctaggctacaattttctccca

SEQ ID NO: 6573110 - DNA, 13 bp, Homo sapiens
ttctaggctgctg

SEQ ID NO: 6573111 - DNA, 16 bp, Homo sapiens
ttctagggctgggaaa

SEQ ID NO: 6573112 - DNA, 23 bp, Homo sapiens
ttctagggctgggaaacactcct

SEQ ID NO: 6573113 - DNA, 16 bp, Homo sapiens
ttctaggggagaagag

SEQ ID NO: 6573114 - DNA, 18 bp, Homo sapiens
ttctaggggtagctggtg

SEQ ID NO: 6573115 - DNA, 23 bp, Homo sapiens
ttctagggtccctgaacgccctg

SEQ ID NO: 6573116 - DNA, 19 bp, Homo sapiens
ttctagggtgggccccagc

SEQ ID NO: 6573117 - DNA, 19 bp, Homo sapiens
ttctaggtcagtctaacag

SEQ ID NO: 6573118 - DNA, 20 bp, Homo sapiens
ttctagtaataaagactcta

SEQ ID NO: 6573119 - DNA, 19 bp, Homo sapiens
ttctagtacacttttatga

SEQ ID NO: 6573120 - DNA, 13 bp, Homo sapiens
ttctagtacataa

SEQ ID NO: 6573121 - DNA, 22 bp, Homo sapiens
ttctagtacataattgattaaa

SEQ ID NO: 6573122 - DNA, 23 bp, Homo sapiens
ttctagtacataattgattaaaa

SEQ ID NO: 6573123 - DNA, 18 bp, Homo sapiens
ttctagtagaaagaaaat

SEQ ID NO: 6573124 - DNA, 21 bp, Homo sapiens
ttctagtcaactgctgtttta

SEQ ID NO: 6573125 - DNA, 14 bp, Homo sapiens
ttctagtcagtaaa

SEQ ID NO: 6573126 - DNA, 21 bp, Homo sapiens
ttctagtctcctttgcactga

SEQ ID NO: 6573127 - DNA, 22 bp, Homo sapiens
ttctagtctcctttgcactgag

SEQ ID NO: 6573128 - DNA, 13 bp, Homo sapiens
ttctagtctctga

SEQ ID NO: 6573129 - DNA, 16 bp, Homo sapiens
ttctagtctctgattt

SEQ ID NO: 6573130 - DNA, 23 bp, Homo sapiens
ttctagtctctgatttgcaaatg

SEQ ID NO: 6573131 - DNA, 14 bp, Homo sapiens
ttctagtctggaac

SEQ ID NO: 6573132 - DNA, 19 bp, Homo sapiens
ttctagtctggtgttctga

SEQ ID NO: 6573133 - DNA, 13 bp, Homo sapiens
ttctagtgaaact

SEQ ID NO: 6573134 - DNA, 18 bp, Homo sapiens
ttctagtgaaactgcatt

SEQ ID NO: 6573135 - DNA, 16 bp, Homo sapiens
ttctagtgagcctggg

SEQ ID NO: 6573136 - DNA, 12 bp, Homo sapiens
ttctagtgctgc

SEQ ID NO: 6573137 - DNA, 16 bp, Homo sapiens
ttctagtgctgctgaa

SEQ ID NO: 6573138 - DNA, 18 bp, Homo sapiens
ttctagtgctgctgaaga

SEQ ID NO: 6573139 - DNA, 21 bp, Homo sapiens
ttctagtggccttagaaaaca

SEQ ID NO: 6573140 - DNA, 14 bp, Homo sapiens
ttctagtggctgtt

SEQ ID NO: 6573141 - DNA, 15 bp, Homo sapiens
ttctagtgtagaatt

SEQ ID NO: 6573142 - DNA, 15 bp, Homo sapiens
ttctagttctgccag

SEQ ID NO: 6573143 - DNA, 17 bp, Homo sapiens
ttctagttctgccagga

SEQ ID NO: 6573144 - DNA, 20 bp, Homo sapiens
ttctagttgcccccattccc

SEQ ID NO: 6573145 - DNA, 22 bp, Homo sapiens
ttctagttgcccccattcccag

SEQ ID NO: 6573146 - DNA, 13 bp, Homo sapiens
ttctagtttcctg

SEQ ID NO: 6573147 - DNA, 14 bp, Homo sapiens
ttctagtttctctt

SEQ ID NO: 6573148 - DNA, 13 bp, Homo sapiens
ttctagtttgttt

SEQ ID NO: 6573149 - DNA, 17 bp, Homo sapiens
ttctagttttttttcta

SEQ ID NO: 6573150 - DNA, 11 bp, Homo sapiens
ttctataaaaa

SEQ ID NO: 6573151 - DNA, 21 bp, Homo sapiens
ttctataaaactctgcatgta

SEQ ID NO: 6573152 - DNA, 19 bp, Homo sapiens
ttctataaaatactggtat

SEQ ID NO: 6573153 - DNA, 12 bp, Homo sapiens
ttctataaatca

SEQ ID NO: 6573154 - DNA, 19 bp, Homo sapiens
ttctataaatttaagaaaa

SEQ ID NO: 6573155 - DNA, 21 bp, Homo sapiens
ttctataaatttaagaaaaca

SEQ ID NO: 6573156 - DNA, 15 bp, Homo sapiens
ttctataacagatat

SEQ ID NO: 6573157 - DNA, 15 bp, Homo sapiens
ttctataacctggat

SEQ ID NO: 6573158 - DNA, 22 bp, Homo sapiens
ttctataagttgtaccaaaaca

SEQ ID NO: 6573159 - DNA, 12 bp, Homo sapiens
ttctataataag

SEQ ID NO: 6573160 - DNA, 18 bp, Homo sapiens
ttctataataagttttga

SEQ ID NO: 6573161 - DNA, 22 bp, Homo sapiens
ttctataataagttttgatata

SEQ ID NO: 6573162 - DNA, 13 bp, Homo sapiens
ttctatacaaata

SEQ ID NO: 6573163 - DNA, 14 bp, Homo sapiens
ttctatactgttga

SEQ ID NO: 6573164 - DNA, 15 bp, Homo sapiens
ttctatactttctca

SEQ ID NO: 6573165 - DNA, 19 bp, Homo sapiens
ttctatagagatagatatt

SEQ ID NO: 6573166 - DNA, 16 bp, Homo sapiens
ttctatagagcctggc

SEQ ID NO: 6573167 - DNA, 23 bp, Homo sapiens
ttctatagcagattgtgtaacaa

SEQ ID NO: 6573168 - DNA, 16 bp, Homo sapiens
ttctatagcagtcatc

SEQ ID NO: 6573169 - DNA, 19 bp, Homo sapiens
ttctatagcatcacttaaa

SEQ ID NO: 6573170 - DNA, 22 bp, Homo sapiens
ttctatagcatcacttaaaaca

SEQ ID NO: 6573171 - DNA, 17 bp, Homo sapiens
ttctatagccaaaaata

SEQ ID NO: 6573172 - DNA, 19 bp, Homo sapiens
ttctatagccaaagctgtt

SEQ ID NO: 6573173 - DNA, 16 bp, Homo sapiens
ttctatagttattaag

SEQ ID NO: 6573174 - DNA, 17 bp, Homo sapiens
ttctatagttctagaca

SEQ ID NO: 6573175 - DNA, 18 bp, Homo sapiens
ttctatataaaatgtatt

SEQ ID NO: 6573176 - DNA, 19 bp, Homo sapiens
ttctatataaaatgtattc

SEQ ID NO: 6573177 - DNA, 18 bp, Homo sapiens
ttctatataaggaggaaa

SEQ ID NO: 6573178 - DNA, 19 bp, Homo sapiens
ttctatataatttttcctt

SEQ ID NO: 6573179 - DNA, 22 bp, Homo sapiens
ttctatatagttccttgcctta

SEQ ID NO: 6573180 - DNA, 12 bp, Homo sapiens
ttctatatcaaa

SEQ ID NO: 6573181 - DNA, 13 bp, Homo sapiens
ttctatatgaatg

SEQ ID NO: 6573182 - DNA, 23 bp, Homo sapiens
ttctatatgaatttaaatataat

SEQ ID NO: 6573183 - DNA, 18 bp, Homo sapiens
ttctatattattatatat

SEQ ID NO: 6573184 - DNA, 13 bp, Homo sapiens
ttctatattcctc

SEQ ID NO: 6573185 - DNA, 13 bp, Homo sapiens
ttctatatttact

SEQ ID NO: 6573186 - DNA, 16 bp, Homo sapiens
ttctatatttactgtt

SEQ ID NO: 6573187 - DNA, 16 bp, Homo sapiens
ttctatatttcatatt

SEQ ID NO: 6573188 - DNA, 22 bp, Homo sapiens
ttctatatttgtaactttgcat

SEQ ID NO: 6573189 - DNA, 23 bp, Homo sapiens
ttctatatttgtaactttgcatg

SEQ ID NO: 6573190 - DNA, 11 bp, Homo sapiens
ttctatatttt

SEQ ID NO: 6573191 - DNA, 18 bp, Homo sapiens
ttctatattttaatagaa

SEQ ID NO: 6573192 - DNA, 16 bp, Homo sapiens
ttctatattttcattc

SEQ ID NO: 6573193 - DNA, 23 bp, Homo sapiens
ttctatcagacgtgctccctccc

SEQ ID NO: 6573194 - DNA, 21 bp, Homo sapiens
ttctatcattccaattctaaa

SEQ ID NO: 6573195 - DNA, 18 bp, Homo sapiens
ttctatcatttttgtaca

SEQ ID NO: 6573196 - DNA, 19 bp, Homo sapiens
ttctatcatttttgtacag

SEQ ID NO: 6573197 - DNA, 23 bp, Homo sapiens
ttctatcccaaactaagctatgt

SEQ ID NO: 6573198 - DNA, 23 bp, Homo sapiens
ttctatcccacccaacagctcag

SEQ ID NO: 6573199 - DNA, 20 bp, Homo sapiens
ttctatccccaatcagctcc

SEQ ID NO: 6573200 - DNA, 19 bp, Homo sapiens
ttctatccttccagaaaaa

SEQ ID NO: 6573201 - DNA, 14 bp, Homo sapiens
ttctatccttttgc

SEQ ID NO: 6573202 - DNA, 15 bp, Homo sapiens
ttctatcgttattat

SEQ ID NO: 6573203 - DNA, 19 bp, Homo sapiens
ttctatctcatctgtctcg

SEQ ID NO: 6573204 - DNA, 17 bp, Homo sapiens
ttctatctgcaaatagt

SEQ ID NO: 6573205 - DNA, 20 bp, Homo sapiens
ttctatctgcttagcaacta

SEQ ID NO: 6573206 - DNA, 20 bp, Homo sapiens
ttctatcttgaatttcatgc

SEQ ID NO: 6573207 - DNA, 20 bp, Homo sapiens
ttctatcttgttccaaggcc

SEQ ID NO: 6573208 - DNA, 22 bp, Homo sapiens
ttctatgaaagctatgaatgtt

SEQ ID NO: 6573209 - DNA, 14 bp, Homo sapiens
ttctatgaaatatt

SEQ ID NO: 6573210 - DNA, 15 bp, Homo sapiens
ttctatgaacttgtc

SEQ ID NO: 6573211 - DNA, 22 bp, Homo sapiens
ttctatgaagtctttgttgcac

SEQ ID NO: 6573212 - DNA, 17 bp, Homo sapiens
ttctatgacaaattcaa

SEQ ID NO: 6573213 - DNA, 18 bp, Homo sapiens
ttctatgacaaattcaag

SEQ ID NO: 6573214 - DNA, 15 bp, Homo sapiens
ttctatgacaataaa

SEQ ID NO: 6573215 - DNA, 16 bp, Homo sapiens
ttctatgacacatgca

SEQ ID NO: 6573216 - DNA, 22 bp, Homo sapiens
ttctatgagacctcccccaggg

SEQ ID NO: 6573217 - DNA, 16 bp, Homo sapiens
ttctatgagcatctct

SEQ ID NO: 6573218 - DNA, 19 bp, Homo sapiens
ttctatgagtggaaaaagc

SEQ ID NO: 6573219 - DNA, 22 bp, Homo sapiens
ttctatgatccttttttgtcat

SEQ ID NO: 6573220 - DNA, 15 bp, Homo sapiens
ttctatgattaaact

SEQ ID NO: 6573221 - DNA, 13 bp, Homo sapiens
ttctatgcaaata

SEQ ID NO: 6573222 - DNA, 16 bp, Homo sapiens
ttctatgcaggcagca

SEQ ID NO: 6573223 - DNA, 15 bp, Homo sapiens
ttctatgcctgtatt

SEQ ID NO: 6573224 - DNA, 20 bp, Homo sapiens
ttctatgctaaactgtgaaa

SEQ ID NO: 6573225 - DNA, 18 bp, Homo sapiens
ttctatgctgcttttata

SEQ ID NO: 6573226 - DNA, 22 bp, Homo sapiens
ttctatggaatagttctgtata

SEQ ID NO: 6573227 - DNA, 19 bp, Homo sapiens
ttctatggaccaaatgtaa

SEQ ID NO: 6573228 - DNA, 18 bp, Homo sapiens
ttctatggattcacttct

SEQ ID NO: 6573229 - DNA, 16 bp, Homo sapiens
ttctatggctttcaaa

SEQ ID NO: 6573230 - DNA, 18 bp, Homo sapiens
ttctatggctttcaaagc

SEQ ID NO: 6573231 - DNA, 16 bp, Homo sapiens
ttctatggttatgaaa

SEQ ID NO: 6573232 - DNA, 21 bp, Homo sapiens
ttctatgtaaattattgtaaa

SEQ ID NO: 6573233 - DNA, 24 bp, Homo sapiens
ttctatgtaaattattgtaaactt

SEQ ID NO: 6573234 - DNA, 23 bp, Homo sapiens
ttctatgtaacttgttgcagact

SEQ ID NO: 6573235 - DNA, 15 bp, Homo sapiens
ttctatgtactagta

SEQ ID NO: 6573236 - DNA, 24 bp, Homo sapiens
ttctatgtactagtactgtgtact

SEQ ID NO: 6573237 - DNA, 22 bp, Homo sapiens
ttctatgtagtggttttaggat

SEQ ID NO: 6573238 - DNA, 15 bp, Homo sapiens
ttctatgtagtttat

SEQ ID NO: 6573239 - DNA, 13 bp, Homo sapiens
ttctatgtatgtg

SEQ ID NO: 6573240 - DNA, 22 bp, Homo sapiens
ttctatgtatgtgccaattttg

SEQ ID NO: 6573241 - DNA, 14 bp, Homo sapiens
ttctatgtatgtta

SEQ ID NO: 6573242 - DNA, 22 bp, Homo sapiens
ttctatgtcatttttaatgtat

SEQ ID NO: 6573243 - DNA, 18 bp, Homo sapiens
ttctatgtccaaacctgg

SEQ ID NO: 6573244 - DNA, 19 bp, Homo sapiens
ttctatgttaaatactgtg

SEQ ID NO: 6573245 - DNA, 21 bp, Homo sapiens
ttctatgttaaatactgtgca

SEQ ID NO: 6573246 - DNA, 13 bp, Homo sapiens
ttctatgttcata

SEQ ID NO: 6573247 - DNA, 20 bp, Homo sapiens
ttctatgttggcattaacaa

SEQ ID NO: 6573248 - DNA, 22 bp, Homo sapiens
ttctatgttggtttcagtggct

SEQ ID NO: 6573249 - DNA, 14 bp, Homo sapiens
ttctatgtttactt

SEQ ID NO: 6573250 - DNA, 18 bp, Homo sapiens
ttctatgtttttttaatt

SEQ ID NO: 6573251 - DNA, 13 bp, Homo sapiens
ttctattaaaaga

SEQ ID NO: 6573252 - DNA, 21 bp, Homo sapiens
ttctattaaaagactcatccg

SEQ ID NO: 6573253 - DNA, 12 bp, Homo sapiens
ttctattaaagg

SEQ ID NO: 6573254 - DNA, 17 bp, Homo sapiens
ttctattaactttaatt

SEQ ID NO: 6573255 - DNA, 22 bp, Homo sapiens
ttctattaatcaagagaaactt

SEQ ID NO: 6573256 - DNA, 20 bp, Homo sapiens
ttctattagccagtctttac

SEQ ID NO: 6573257 - DNA, 13 bp, Homo sapiens
ttctattatatat

SEQ ID NO: 6573258 - DNA, 15 bp, Homo sapiens
ttctattatggaaaa

SEQ ID NO: 6573259 - DNA, 20 bp, Homo sapiens
ttctattccctaacttgtga

SEQ ID NO: 6573260 - DNA, 23 bp, Homo sapiens
ttctattccctaacttgtgaaga

SEQ ID NO: 6573261 - DNA, 13 bp, Homo sapiens
ttctattccttat

SEQ ID NO: 6573262 - DNA, 18 bp, Homo sapiens
ttctattccttctggcct

SEQ ID NO: 6573263 - DNA, 14 bp, Homo sapiens
ttctattctccaga

SEQ ID NO: 6573264 - DNA, 17 bp, Homo sapiens
ttctattctctcctcag

SEQ ID NO: 6573265 - DNA, 14 bp, Homo sapiens
ttctattgaaaaat

SEQ ID NO: 6573266 - DNA, 18 bp, Homo sapiens
ttctattgaaaacagtgt

SEQ ID NO: 6573267 - DNA, 18 bp, Homo sapiens
ttctattgactttcttaa

SEQ ID NO: 6573268 - DNA, 18 bp, Homo sapiens
ttctattgcagttataga

SEQ ID NO: 6573269 - DNA, 19 bp, Homo sapiens
ttctattgccatgaaccat

SEQ ID NO: 6573270 - DNA, 13 bp, Homo sapiens
ttctattgcctct

SEQ ID NO: 6573271 - DNA, 17 bp, Homo sapiens
ttctattgcctctgaga

SEQ ID NO: 6573272 - DNA, 20 bp, Homo sapiens
ttctattgccttctttgaag

SEQ ID NO: 6573273 - DNA, 23 bp, Homo sapiens
ttctattgccttctttgaagaag

SEQ ID NO: 6573274 - DNA, 19 bp, Homo sapiens
ttctattggcatggatttc

SEQ ID NO: 6573275 - DNA, 21 bp, Homo sapiens
ttctattgtattatttggagt

SEQ ID NO: 6573276 - DNA, 15 bp, Homo sapiens
ttctattgttgtaca

SEQ ID NO: 6573277 - DNA, 14 bp, Homo sapiens
ttctattgtttctt

SEQ ID NO: 6573278 - DNA, 18 bp, Homo sapiens
aagctggagtgctgcttg

SEQ ID NO: 6573279 - DNA, 13 bp, Homo sapiens
aagctggcacaaa

SEQ ID NO: 6573280 - DNA, 19 bp, Homo sapiens
aagctggcagaacggagga

SEQ ID NO: 6573281 - DNA, 15 bp, Homo sapiens
aagctggccctgcct

SEQ ID NO: 6573282 - DNA, 16 bp, Homo sapiens
aagctggccctgcctc

SEQ ID NO: 6573283 - DNA, 18 bp, Homo sapiens
aagctggccctgcctcct

SEQ ID NO: 6573284 - DNA, 23 bp, Homo sapiens
aagctggccctgcctcctgggaa

SEQ ID NO: 6573285 - DNA, 21 bp, Homo sapiens
aagctggccgagggtcctggc

SEQ ID NO: 6573286 - DNA, 14 bp, Homo sapiens
aagctggcctgaga

SEQ ID NO: 6573287 - DNA, 13 bp, Homo sapiens
aagctggcctgga

SEQ ID NO: 6573288 - DNA, 15 bp, Homo sapiens
aagctggcctggacc

SEQ ID NO: 6573289 - DNA, 20 bp, Homo sapiens
aagctggctggggtggcctg

SEQ ID NO: 6573290 - DNA, 18 bp, Homo sapiens
aagctggcttacactggc

SEQ ID NO: 6573291 - DNA, 15 bp, Homo sapiens
aagctgggaacttct

SEQ ID NO: 6573292 - DNA, 22 bp, Homo sapiens
aagctgggactcattcacattt

SEQ ID NO: 6573293 - DNA, 14 bp, Homo sapiens
aagctgggagggag

SEQ ID NO: 6573294 - DNA, 16 bp, Homo sapiens
aagctgggagggaggg

SEQ ID NO: 6573295 - DNA, 20 bp, Homo sapiens
aagctgggcatgaacgcact

SEQ ID NO: 6573296 - DNA, 21 bp, Homo sapiens
aagctgggcccaaaggcccag

SEQ ID NO: 6573297 - DNA, 22 bp, Homo sapiens
aagctgggcccaaaggcccagg

SEQ ID NO: 6573298 - DNA, 15 bp, Homo sapiens
aagctgggccgaggc

SEQ ID NO: 6573299 - DNA, 12 bp, Homo sapiens
aagctgggctgt

SEQ ID NO: 6573300 - DNA, 16 bp, Homo sapiens
aagctggggacagctt

SEQ ID NO: 6573301 - DNA, 23 bp, Homo sapiens
aagctggggacagctttcctggg

SEQ ID NO: 6573302 - DNA, 15 bp, Homo sapiens
aagctgggggaaggg

SEQ ID NO: 6573303 - DNA, 19 bp, Homo sapiens
aagctgggggaagggtggt

SEQ ID NO: 6573304 - DNA, 15 bp, Homo sapiens
aagctggtaaaaatg

SEQ ID NO: 6573305 - DNA, 17 bp, Homo sapiens
aagctggtctagactgt

SEQ ID NO: 6573306 - DNA, 24 bp, Homo sapiens
aagctggtctggagttgctgaatg

SEQ ID NO: 6573307 - DNA, 16 bp, Homo sapiens
aagctggtttaatgtt

SEQ ID NO: 6573308 - DNA, 18 bp, Homo sapiens
aagctgtaaaaagagaga

SEQ ID NO: 6573309 - DNA, 16 bp, Homo sapiens
aagctgtaaattacat

SEQ ID NO: 6573310 - DNA, 16 bp, Homo sapiens
aagctgtaaattacta

SEQ ID NO: 6573311 - DNA, 15 bp, Homo sapiens
aagctgtaatatcat

SEQ ID NO: 6573312 - DNA, 11 bp, Homo sapiens
aagctgtacac

SEQ ID NO: 6573313 - DNA, 15 bp, Homo sapiens
aagctgtagaggacc

SEQ ID NO: 6573314 - DNA, 21 bp, Homo sapiens
aagctgtagaggaccaggact

SEQ ID NO: 6573315 - DNA, 22 bp, Homo sapiens
aagctgtataattaattgtcat

SEQ ID NO: 6573316 - DNA, 23 bp, Homo sapiens
aagctgtatgtacttccagtatc

SEQ ID NO: 6573317 - DNA, 11 bp, Homo sapiens
aagctgtcaca

SEQ ID NO: 6573318 - DNA, 11 bp, Homo sapiens
aagctgtcaga

SEQ ID NO: 6573319 - DNA, 14 bp, Homo sapiens
aagctgtcagaagt

SEQ ID NO: 6573320 - DNA, 18 bp, Homo sapiens
aagctgtcagaagtttct

SEQ ID NO: 6573321 - DNA, 20 bp, Homo sapiens
aagctgtcaggctgggacag

SEQ ID NO: 6573322 - DNA, 13 bp, Homo sapiens
aagctgtccctgc

SEQ ID NO: 6573323 - DNA, 14 bp, Homo sapiens
aagctgtccctgca

SEQ ID NO: 6573324 - DNA, 17 bp, Homo sapiens
aagctgtccctgcaggg

SEQ ID NO: 6573325 - DNA, 20 bp, Homo sapiens
aagctgtccctgcagggcca

SEQ ID NO: 6573326 - DNA, 13 bp, Homo sapiens
aagctgtctactg

SEQ ID NO: 6573327 - DNA, 23 bp, Homo sapiens
aagctgtctcttcggcagggagg

SEQ ID NO: 6573328 - DNA, 16 bp, Homo sapiens
aagctgtgaacaggct

SEQ ID NO: 6573329 - DNA, 23 bp, Homo sapiens
aagctgtgaactcagagcccctc

SEQ ID NO: 6573330 - DNA, 14 bp, Homo sapiens
aagctgtgaatatt

SEQ ID NO: 6573331 - DNA, 17 bp, Homo sapiens
aagctgtgaccctcaat

SEQ ID NO: 6573332 - DNA, 21 bp, Homo sapiens
aagctgtgagcaaacagagga

SEQ ID NO: 6573333 - DNA, 14 bp, Homo sapiens
aagctgtgccaccc

SEQ ID NO: 6573334 - DNA, 16 bp, Homo sapiens
aagctgtgccaccctg

SEQ ID NO: 6573335 - DNA, 13 bp, Homo sapiens
aagctgtgccttc

SEQ ID NO: 6573336 - DNA, 14 bp, Homo sapiens
aagctgtgctggga

SEQ ID NO: 6573337 - DNA, 17 bp, Homo sapiens
aagctgtgctgggaagc

SEQ ID NO: 6573338 - DNA, 22 bp, Homo sapiens
aagctgtgctgggaagcccgga

SEQ ID NO: 6573339 - DNA, 13 bp, Homo sapiens
aagctgtggccag

SEQ ID NO: 6573340 - DNA, 22 bp, Homo sapiens
aagctgtgtccttgcacctgca

SEQ ID NO: 6573341 - DNA, 20 bp, Homo sapiens
aagctgtgtctttagacaac

SEQ ID NO: 6573342 - DNA, 12 bp, Homo sapiens
aagctgtgtgca

SEQ ID NO: 6573343 - DNA, 13 bp, Homo sapiens
aagctgtgttact

SEQ ID NO: 6573344 - DNA, 20 bp, Homo sapiens
aagctgtgttacttgaagta

SEQ ID NO: 6573345 - DNA, 21 bp, Homo sapiens
aagctgtgttgaaacagaaaa

SEQ ID NO: 6573346 - DNA, 15 bp, Homo sapiens
aagctgttaaactgt

SEQ ID NO: 6573347 - DNA, 17 bp, Homo sapiens
aagctgttaaactgtta

SEQ ID NO: 6573348 - DNA, 21 bp, Homo sapiens
aagctgttaaagatattttta

SEQ ID NO: 6573349 - DNA, 23 bp, Homo sapiens
aagctgttaaagatatttttatt

SEQ ID NO: 6573350 - DNA, 18 bp, Homo sapiens
aagctgttactgtcttca

SEQ ID NO: 6573351 - DNA, 21 bp, Homo sapiens
aagctgttattcttgttatac

SEQ ID NO: 6573352 - DNA, 12 bp, Homo sapiens
aagctgttccac

SEQ ID NO: 6573353 - DNA, 13 bp, Homo sapiens
aagctgttcctgt

SEQ ID NO: 6573354 - DNA, 18 bp, Homo sapiens
aagctgttctctgctttt

SEQ ID NO: 6573355 - DNA, 14 bp, Homo sapiens
aagctgttcttcct

SEQ ID NO: 6573356 - DNA, 20 bp, Homo sapiens
aagctgttggatttcagtga

SEQ ID NO: 6573357 - DNA, 19 bp, Homo sapiens
aagctgttggggggctgag

SEQ ID NO: 6573358 - DNA, 14 bp, Homo sapiens
aagctgttggtgtt

SEQ ID NO: 6573359 - DNA, 12 bp, Homo sapiens
aagctgttgtac

SEQ ID NO: 6573360 - DNA, 17 bp, Homo sapiens
aagctgttgtacattta

SEQ ID NO: 6573361 - DNA, 18 bp, Homo sapiens
aagctgttgtacatttat

SEQ ID NO: 6573362 - DNA, 23 bp, Homo sapiens
aagctgtttagtttgttaattga

SEQ ID NO: 6573363 - DNA, 18 bp, Homo sapiens
aagctgtttgaaggaaag

SEQ ID NO: 6573364 - DNA, 19 bp, Homo sapiens
aagctgtttgccaagctga

SEQ ID NO: 6573365 - DNA, 21 bp, Homo sapiens
aagctgtttggaaaagacagt

SEQ ID NO: 6573366 - DNA, 19 bp, Homo sapiens
aagctgtttggttttaaaa

SEQ ID NO: 6573367 - DNA, 20 bp, Homo sapiens
aagctgtttggttttaaaat

SEQ ID NO: 6573368 - DNA, 22 bp, Homo sapiens
aagctgtttttgtgctctttgt

SEQ ID NO: 6573369 - DNA, 15 bp, Homo sapiens
aagcttaaaaaaaac

SEQ ID NO: 6573370 - DNA, 16 bp, Homo sapiens
aagcttaaaaaaaact

SEQ ID NO: 6573371 - DNA, 13 bp, Homo sapiens
aagcttaaaaaga

SEQ ID NO: 6573372 - DNA, 14 bp, Homo sapiens
aagcttaaaacttt

SEQ ID NO: 6573373 - DNA, 13 bp, Homo sapiens
aagcttaaaataa

SEQ ID NO: 6573374 - DNA, 14 bp, Homo sapiens
aagcttaaactgaa

SEQ ID NO: 6573375 - DNA, 22 bp, Homo sapiens
aagcttaaataggaaagtttct

SEQ ID NO: 6573376 - DNA, 15 bp, Homo sapiens
aagcttaaattttat

SEQ ID NO: 6573377 - DNA, 15 bp, Homo sapiens
aagcttaacatttca

SEQ ID NO: 6573378 - DNA, 18 bp, Homo sapiens
aagcttaacatttcatgt

SEQ ID NO: 6573379 - DNA, 17 bp, Homo sapiens
aagcttaatatgtgctg

SEQ ID NO: 6573380 - DNA, 22 bp, Homo sapiens
aagcttacccttggtttgcaca

SEQ ID NO: 6573381 - DNA, 13 bp, Homo sapiens
aagcttactacag

SEQ ID NO: 6573382 - DNA, 11 bp, Homo sapiens
aagcttagaac

SEQ ID NO: 6573383 - DNA, 13 bp, Homo sapiens
aagcttagcagga

SEQ ID NO: 6573384 - DNA, 20 bp, Homo sapiens
aagcttagcaggagaggaga

SEQ ID NO: 6573385 - DNA, 13 bp, Homo sapiens
aagcttaggcagg

SEQ ID NO: 6573386 - DNA, 22 bp, Homo sapiens
aagcttaggtcatgaacatggt

SEQ ID NO: 6573387 - DNA, 18 bp, Homo sapiens
aagcttatccataaaaaa

SEQ ID NO: 6573388 - DNA, 22 bp, Homo sapiens
aagcttatccataaaaaaaaat

SEQ ID NO: 6573389 - DNA, 18 bp, Homo sapiens
aagcttatgcttaaattc

SEQ ID NO: 6573390 - DNA, 18 bp, Homo sapiens
aagcttattaaaactcat

SEQ ID NO: 6573391 - DNA, 14 bp, Homo sapiens
aagcttattaatgc

SEQ ID NO: 6573392 - DNA, 17 bp, Homo sapiens
aagcttattaatgctaa

SEQ ID NO: 6573393 - DNA, 18 bp, Homo sapiens
aagcttattaatgctaag

SEQ ID NO: 6573394 - DNA, 13 bp, Homo sapiens
aagcttatttcta

SEQ ID NO: 6573395 - DNA, 18 bp, Homo sapiens
aagcttcaaactgcatga

SEQ ID NO: 6573396 - DNA, 18 bp, Homo sapiens
aagcttcaaattaaaaca

SEQ ID NO: 6573397 - DNA, 20 bp, Homo sapiens
aagcttcaaattatagaaac

SEQ ID NO: 6573398 - DNA, 22 bp, Homo sapiens
aagcttcaaattatagaaacaa

SEQ ID NO: 6573399 - DNA, 15 bp, Homo sapiens
aagcttcaaccctca

SEQ ID NO: 6573400 - DNA, 18 bp, Homo sapiens
aagcttcaaccctcagcc

SEQ ID NO: 6573401 - DNA, 14 bp, Homo sapiens
aagcttcaagtgat

SEQ ID NO: 6573402 - DNA, 15 bp, Homo sapiens
aagcttcaagtgata

SEQ ID NO: 6573403 - DNA, 20 bp, Homo sapiens
aagcttcaagtgatatatgt

SEQ ID NO: 6573404 - DNA, 12 bp, Homo sapiens
aagcttcagact

SEQ ID NO: 6573405 - DNA, 13 bp, Homo sapiens
aagcttcagagcc

SEQ ID NO: 6573406 - DNA, 21 bp, Homo sapiens
aagcttcagagcctagccacc

SEQ ID NO: 6573407 - DNA, 22 bp, Homo sapiens
aagcttcagagcctagccacct

SEQ ID NO: 6573408 - DNA, 19 bp, Homo sapiens
aagcttcagtgctgccgat

SEQ ID NO: 6573409 - DNA, 15 bp, Homo sapiens
aagcttcagttgctt

SEQ ID NO: 6573410 - DNA, 18 bp, Homo sapiens
aagcttcagttgcttgtc

SEQ ID NO: 6573411 - DNA, 20 bp, Homo sapiens
aagcttcatgcacttaaaga

SEQ ID NO: 6573412 - DNA, 22 bp, Homo sapiens
aagcttcatgcacttaaagaag

SEQ ID NO: 6573413 - DNA, 16 bp, Homo sapiens
aagcttccacaaaatt

SEQ ID NO: 6573414 - DNA, 15 bp, Homo sapiens
aagcttccacctgtc

SEQ ID NO: 6573415 - DNA, 16 bp, Homo sapiens
aagcttccaggaaaaa

SEQ ID NO: 6573416 - DNA, 12 bp, Homo sapiens
aagcttccagta

SEQ ID NO: 6573417 - DNA, 21 bp, Homo sapiens
aagcttccagtccaatctcat

SEQ ID NO: 6573418 - DNA, 16 bp, Homo sapiens
aagcttccataacatt

SEQ ID NO: 6573419 - DNA, 20 bp, Homo sapiens
aagcttccatagctgctgcc

SEQ ID NO: 6573420 - DNA, 13 bp, Homo sapiens
aagcttccatgat

SEQ ID NO: 6573421 - DNA, 16 bp, Homo sapiens
aagcttccatgatgca

SEQ ID NO: 6573422 - DNA, 18 bp, Homo sapiens
aagcttccatgatgcaca

SEQ ID NO: 6573423 - DNA, 20 bp, Homo sapiens
aagcttccatgatgcacagt

SEQ ID NO: 6573424 - DNA, 14 bp, Homo sapiens
aagcttccctctca

SEQ ID NO: 6573425 - DNA, 22 bp, Homo sapiens
aagcttccgggaaaacagctat

SEQ ID NO: 6573426 - DNA, 13 bp, Homo sapiens
aagcttcctgtgc

SEQ ID NO: 6573427 - DNA, 23 bp, Homo sapiens
aagcttcgtcttgtgtttgctgc

SEQ ID NO: 6573428 - DNA, 14 bp, Homo sapiens
aagcttctaataaa

SEQ ID NO: 6573429 - DNA, 22 bp, Homo sapiens
aagcttctagacactccttgaa

SEQ ID NO: 6573430 - DNA, 13 bp, Homo sapiens
aagcttctctctg

SEQ ID NO: 6573431 - DNA, 15 bp, Homo sapiens
aagcttctgtcctgc

SEQ ID NO: 6573432 - DNA, 20 bp, Homo sapiens
aagcttctgtctccagcttc

SEQ ID NO: 6573433 - DNA, 21 bp, Homo sapiens
aagcttcttaattaatttgat

SEQ ID NO: 6573434 - DNA, 19 bp, Homo sapiens
aagcttcttgctcctgttt

SEQ ID NO: 6573435 - DNA, 13 bp, Homo sapiens
aagcttgagcctc

SEQ ID NO: 6573436 - DNA, 14 bp, Homo sapiens
aagcttgaggccaa

SEQ ID NO: 6573437 - DNA, 19 bp, Homo sapiens
aagcttgaggccaagatgg

SEQ ID NO: 6573438 - DNA, 22 bp, Homo sapiens
aagcttgatttgatctttgttt

SEQ ID NO: 6573439 - DNA, 19 bp, Homo sapiens
aagcttgcaccttttcatg

SEQ ID NO: 6573440 - DNA, 18 bp, Homo sapiens
aagcttggattaaataca

SEQ ID NO: 6573441 - DNA, 14 bp, Homo sapiens
aagcttggcagccg

SEQ ID NO: 6573442 - DNA, 18 bp, Homo sapiens
aagcttggctgctcagtt

SEQ ID NO: 6573443 - DNA, 16 bp, Homo sapiens
aagcttggttctgtga

SEQ ID NO: 6573444 - DNA, 17 bp, Homo sapiens
aagcttgtatatacata

SEQ ID NO: 6573445 - DNA, 23 bp, Homo sapiens
aagcttgtattcctttttctctc

SEQ ID NO: 6573446 - DNA, 13 bp, Homo sapiens
aagcttgtgtatc

SEQ ID NO: 6573447 - DNA, 16 bp, Homo sapiens
aagcttgtgtatccat

SEQ ID NO: 6573448 - DNA, 21 bp, Homo sapiens
aagcttgtgtatccattatca

SEQ ID NO: 6573449 - DNA, 22 bp, Homo sapiens
aagcttgtgtatccattatcat

SEQ ID NO: 6573450 - DNA, 17 bp, Homo sapiens
aagcttgtttccctgct

SEQ ID NO: 6573451 - DNA, 13 bp, Homo sapiens
aagctttaaatga

SEQ ID NO: 6573452 - DNA, 18 bp, Homo sapiens
aagctttaaatgacagta

SEQ ID NO: 6573453 - DNA, 13 bp, Homo sapiens
aagctttaacaga

SEQ ID NO: 6573454 - DNA, 14 bp, Homo sapiens
aagctttactactg

SEQ ID NO: 6573455 - DNA, 17 bp, Homo sapiens
aagctttactactgtgg

SEQ ID NO: 6573456 - DNA, 16 bp, Homo sapiens
aagctttactctttca

SEQ ID NO: 6573457 - DNA, 9 bp, Homo sapiens
aagctttag

SEQ ID NO: 6573458 - DNA, 17 bp, Homo sapiens
ttctatttaacaactgg

SEQ ID NO: 6573459 - DNA, 16 bp, Homo sapiens
ttctatttaagtgtac

SEQ ID NO: 6573460 - DNA, 13 bp, Homo sapiens
ttctatttaatgg

SEQ ID NO: 6573461 - DNA, 17 bp, Homo sapiens
ttctatttaattgaaac

SEQ ID NO: 6573462 - DNA, 13 bp, Homo sapiens
ttctatttataat

SEQ ID NO: 6573463 - DNA, 19 bp, Homo sapiens
ttctatttcagtgccaata

SEQ ID NO: 6573464 - DNA, 17 bp, Homo sapiens
ttctatttctcctccat

SEQ ID NO: 6573465 - DNA, 16 bp, Homo sapiens
ttctatttctctgtgt

SEQ ID NO: 6573466 - DNA, 18 bp, Homo sapiens
ttctatttcttgaagaat

SEQ ID NO: 6573467 - DNA, 17 bp, Homo sapiens
ttctatttgcctccagt

SEQ ID NO: 6573468 - DNA, 18 bp, Homo sapiens
ttctatttgctatctgaa

SEQ ID NO: 6573469 - DNA, 18 bp, Homo sapiens
ttctatttgctgggcttt

SEQ ID NO: 6573470 - DNA, 14 bp, Homo sapiens
ttctatttgtcttc

SEQ ID NO: 6573471 - DNA, 13 bp, Homo sapiens
ttctattttacaa

SEQ ID NO: 6573472 - DNA, 23 bp, Homo sapiens
ttctattttaccactaattttgt

SEQ ID NO: 6573473 - DNA, 16 bp, Homo sapiens
ttctattttactttgt

SEQ ID NO: 6573474 - DNA, 18 bp, Homo sapiens
ttctattttagttaacta

SEQ ID NO: 6573475 - DNA, 17 bp, Homo sapiens
ttctattttcattttct

SEQ ID NO: 6573476 - DNA, 23 bp, Homo sapiens
ttctattttcattttctgcaagc

SEQ ID NO: 6573477 - DNA, 12 bp, Homo sapiens
ttctattttctt

SEQ ID NO: 6573478 - DNA, 16 bp, Homo sapiens
ttctattttgcagata

SEQ ID NO: 6573479 - DNA, 18 bp, Homo sapiens
ttctattttgcagataga

SEQ ID NO: 6573480 - DNA, 12 bp, Homo sapiens
ttctattttgct

SEQ ID NO: 6573481 - DNA, 13 bp, Homo sapiens
ttctattttgtaa

SEQ ID NO: 6573482 - DNA, 14 bp, Homo sapiens
ttctatttttatca

SEQ ID NO: 6573483 - DNA, 18 bp, Homo sapiens
ttctatttttatcatgaa

SEQ ID NO: 6573484 - DNA, 16 bp, Homo sapiens
ttctatttttcaatca

SEQ ID NO: 6573485 - DNA, 17 bp, Homo sapiens
ttctatttttcaatcat

SEQ ID NO: 6573486 - DNA, 18 bp, Homo sapiens
ttctatttttcaatcatc

SEQ ID NO: 6573487 - DNA, 16 bp, Homo sapiens
ttctatttttcttcta

SEQ ID NO: 6573488 - DNA, 18 bp, Homo sapiens
ttctattttttaaagact

SEQ ID NO: 6573489 - DNA, 15 bp, Homo sapiens
ttctattttttgttt

SEQ ID NO: 6573490 - DNA, 23 bp, Homo sapiens
ttctattttttgttttgtttcct

SEQ ID NO: 6573491 - DNA, 22 bp, Homo sapiens
ttctcaaaacccttaaaagaag

SEQ ID NO: 6573492 - DNA, 13 bp, Homo sapiens
ttctcaaaagagg

SEQ ID NO: 6573493 - DNA, 21 bp, Homo sapiens
ttctcaaaagaggttacttta

SEQ ID NO: 6573494 - DNA, 16 bp, Homo sapiens
ttctcaaaagcattta

SEQ ID NO: 6573495 - DNA, 23 bp, Homo sapiens
ttctcaaaatacgtgttcaaaaa

SEQ ID NO: 6573496 - DNA, 23 bp, Homo sapiens
ttctcaaacacagttacacttgt

SEQ ID NO: 6573497 - DNA, 15 bp, Homo sapiens
ttctcaaagaaattt

SEQ ID NO: 6573498 - DNA, 16 bp, Homo sapiens
ttctcaaagaatctca

SEQ ID NO: 6573499 - DNA, 18 bp, Homo sapiens
ttctcaaaggagcgagca

SEQ ID NO: 6573500 - DNA, 20 bp, Homo sapiens
ttctcaaagttaaaagtaaa

SEQ ID NO: 6573501 - DNA, 12 bp, Homo sapiens
ttctcaaagttt

SEQ ID NO: 6573502 - DNA, 23 bp, Homo sapiens
ttctcaaagttttattataaatt

SEQ ID NO: 6573503 - DNA, 15 bp, Homo sapiens
ttctcaaagttttga

SEQ ID NO: 6573504 - DNA, 12 bp, Homo sapiens
ttctcaaataaa

SEQ ID NO: 6573505 - DNA, 12 bp, Homo sapiens
ttctcaaatctt

SEQ ID NO: 6573506 - DNA, 19 bp, Homo sapiens
ttctcaaatgctactcagt

SEQ ID NO: 6573507 - DNA, 14 bp, Homo sapiens
ttctcaaatgtgtg

SEQ ID NO: 6573508 - DNA, 15 bp, Homo sapiens
ttctcaacacacagt

SEQ ID NO: 6573509 - DNA, 16 bp, Homo sapiens
ttctcaacagttcatt

SEQ ID NO: 6573510 - DNA, 14 bp, Homo sapiens
ttctcaacctacca

SEQ ID NO: 6573511 - DNA, 14 bp, Homo sapiens
ttctcaactccaaa

SEQ ID NO: 6573512 - DNA, 12 bp, Homo sapiens
ttctcaagaatc

SEQ ID NO: 6573513 - DNA, 13 bp, Homo sapiens
ttctcaagaatct

SEQ ID NO: 6573514 - DNA, 15 bp, Homo sapiens
ttctcaagccctgca

SEQ ID NO: 6573515 - DNA, 18 bp, Homo sapiens
ttctcaagccgcatccca

SEQ ID NO: 6573516 - DNA, 14 bp, Homo sapiens
ttctcaagtccctt
